United States Patent 10,968,269 (MHC MULTIMERS IN BORRELIA DIAGNOSTICS AND DISEASE) - sequence listing, part 5

SEQ ID NO: 126336 - protein, 9 aa, Borrelia burgdorferi B31 Seq2
FSCAISGVY

SEQ ID NO: 126337 - protein, 15 aa, Borrelia burgdorferi B31 Seq2
FSCAISGVYSSYVSD

SEQ ID NO: 126338 - protein, 9 aa, Borrelia burgdorferi B31 Seq2
FSCAISGVY

SEQ ID NO: 126339 - protein, 15 aa, Borrelia burgdorferi B31 Seq2
VGYMLTDASLLVSSE

SEQ ID NO: 126340 - protein, 9 aa, Borrelia burgdorferi B31 Seq2
YMLTDASLL

SEQ ID NO: 126341 - protein, 15 aa, Borrelia burgdorferi B31 Seq2
WLVGYMLTDASLLVS

SEQ ID NO: 126342 - protein, 9 aa, Borrelia burgdorferi B31 Seq2
YMLTDASLL

SEQ ID NO: 126343 - protein, 15 aa, Borrelia burgdorferi B31 Seq2
IWLVGYMLTDASLLV

SEQ ID NO: 126344 - protein, 9 aa, Borrelia burgdorferi B31 Seq2
YMLTDASLL

SEQ ID NO: 126345 - protein, 15 aa, Borrelia burgdorferi B31 Seq2
LVGYMLTDASLLVSS

SEQ ID NO: 126346 - protein, 9 aa, Borrelia burgdorferi B31 Seq2
YMLTDASLL

SEQ ID NO: 126347 - protein, 15 aa, Borrelia burgdorferi B31 Seq2
LDDKSFNSSANEALL

SEQ ID NO: 126348 - protein, 9 aa, Borrelia burgdorferi B31 Seq2
FNSSANEAL

SEQ ID NO: 126349 - protein, 15 aa, Borrelia burgdorferi B31 Seq2
DKSFNSSANEALLRL

SEQ ID NO: 126350 - protein, 9 aa, Borrelia burgdorferi B31 Seq2
FNSSANEAL

SEQ ID NO: 126351 - protein, 15 aa, Borrelia burgdorferi B31 Seq2
DDKSFNSSANEALLR

SEQ ID NO: 126352 - protein, 9 aa, Borrelia burgdorferi B31 Seq2
FNSSANEAL

SEQ ID NO: 126353 - protein, 15 aa, Borrelia burgdorferi B31 Seq2
VLDDKSFNSSANEAL

SEQ ID NO: 126354 - protein, 9 aa, Borrelia burgdorferi B31 Seq2
SFNSSANEA

SEQ ID NO: 126355 - protein, 15 aa, Borrelia burgdorferi B31 Seq2
KSFNSSANEALLRLK

SEQ ID NO: 126356 - protein, 9 aa, Borrelia burgdorferi B31 Seq2
FNSSANEAL

SEQ ID NO: 126357 - protein, 15 aa, Borrelia burgdorferi B31 Seq2
GIDVIHFAAGLAGIG

SEQ ID NO: 126358 - protein, 9 aa, Borrelia burgdorferi B31 Seq2
VIHFAAGLA

SEQ ID NO: 126359 - protein, 15 aa, Borrelia burgdorferi B31 Seq2
IDVIHFAAGLAGIGV

SEQ ID NO: 126360 - protein, 9 aa, Borrelia burgdorferi B31 Seq2
VIHFAAGLA

SEQ ID NO: 126361 - protein, 15 aa, Borrelia burgdorferi B31 Seq2
YLAPKNFITSVIKNI

SEQ ID NO: 126362 - protein, 9 aa, Borrelia burgdorferi B31 Seq2
YLAPKNFIT

SEQ ID NO: 126363 - protein, 15 aa, Borrelia burgdorferi B31 Seq2
VSDLDNLKRNGSDLI

SEQ ID NO: 126364 - protein, 9 aa, Borrelia burgdorferi B31 Seq2
LDNLKRNGS

SEQ ID NO: 126365 - protein, 15 aa, Borrelia burgdorferi B31 Seq2
SDLDNLKRNGSDLIW

SEQ ID NO: 126366 - protein, 9 aa, Borrelia burgdorferi B31 Seq2
LKRNGSDLI

SEQ ID NO: 126367 - protein, 15 aa, Borrelia burgdorferi B31 Seq2
RIVIFIFGILLTSCF

SEQ ID NO: 126368 - protein, 9 aa, Borrelia burgdorferi B31 Seq2
IFIFGILLT

SEQ ID NO: 126369 - protein, 15 aa, Borrelia burgdorferi B31 Seq2
NFITSVIKNIGDALY

SEQ ID NO: 126370 - protein, 9 aa, Borrelia burgdorferi B31 Seq2
ITSVIKNIG

SEQ ID NO: 126371 - protein, 15 aa, Borrelia burgdorferi B31 Seq2
IVIFIFGILLTSCFS

SEQ ID NO: 126372 - protein, 9 aa, Borrelia burgdorferi B31 Seq2
FGILLTSCF

SEQ ID NO: 126373 - protein, 15 aa, Borrelia burgdorferi B31 Seq2
LAPKNFITSVIKNIG

SEQ ID NO: 126374 - protein, 9 aa, Borrelia burgdorferi B31 Seq2
PKNFITSVI

SEQ ID NO: 126375 - protein, 15 aa, Borrelia burgdorferi B31 Seq2
LDNLKRNGSDLIWLV

SEQ ID NO: 126376 - protein, 9 aa, Borrelia burgdorferi B31 Seq2
LKRNGSDLI

SEQ ID NO: 126377 - protein, 15 aa, Borrelia burgdorferi B31 Seq2
KNFITSVIKNIGDAL

SEQ ID NO: 126378 - protein, 9 aa, Borrelia burgdorferi B31 Seq2
ITSVIKNIG

SEQ ID NO: 126379 - protein, 15 aa, Borrelia burgdorferi B31 Seq2
LITGEYIKNNNVWEG

SEQ ID NO: 126380 - protein, 9 aa, Borrelia burgdorferi B31 Seq2
YIKNNNVWE

SEQ ID NO: 126381 - protein, 15 aa, Borrelia burgdorferi B31 Seq2
DLDNLKRNGSDLIWL

SEQ ID NO: 126382 - protein, 9 aa, Borrelia burgdorferi B31 Seq2
LKRNGSDLI

SEQ ID NO: 126383 - protein, 15 aa, Borrelia burgdorferi B31 Seq2
ITGEYIKNNNVWEGG

SEQ ID NO: 126384 - protein, 9 aa, Borrelia burgdorferi B31 Seq2
IKNNNVWEG

SEQ ID NO: 126385 - protein, 15 aa, Borrelia burgdorferi B31 Seq2
GEYIKNNNVWEGGKV

SEQ ID NO: 126386 - protein, 9 aa, Borrelia burgdorferi B31 Seq2
IKNNNVWEG

SEQ ID NO: 126387 - protein, 15 aa, Borrelia burgdorferi B31 Seq2
TGEYIKNNNVWEGGK

SEQ ID NO: 126388 - protein, 9 aa, Borrelia burgdorferi B31 Seq2
IKNNNVWEG

SEQ ID NO: 126389 - protein, 15 aa, Borrelia burgdorferi B31 Seq2
VIFIFGILLTSCFSR

SEQ ID NO: 126390 - protein, 9 aa, Borrelia burgdorferi B31 Seq2
FGILLTSCF

SEQ ID NO: 126391 - protein, 15 aa, Borrelia burgdorferi B31 Seq2
IFIFGILLTSCFSRN

SEQ ID NO: 126392 - protein, 9 aa, Borrelia burgdorferi B31 Seq2
FGILLTSCF

SEQ ID NO: 126393 - protein, 15 aa, Borrelia burgdorferi B31 Seq2
EYIKNNNVWEGGKVV

SEQ ID NO: 126394 - protein, 9 aa, Borrelia burgdorferi B31 Seq2
IKNNNVWEG

SEQ ID NO: 126395 - protein, 15 aa, Borrelia burgdorferi B31 Seq2
FITSVIKNIGDALYL

SEQ ID NO: 126396 - protein, 9 aa, Borrelia burgdorferi B31 Seq2
ITSVIKNIG

SEQ ID NO: 126397 - protein, 15 aa, Borrelia burgdorferi B31 Seq2
ITSVIKNIGDALYLI

SEQ ID NO: 126398 - protein, 9 aa, Borrelia burgdorferi B31 Seq2
ITSVIKNIG

SEQ ID NO: 126399 - protein, 15 aa, Borrelia burgdorferi B31 Seq2
APKNFITSVIKNIGD

SEQ ID NO: 126400 - protein, 9 aa, Borrelia burgdorferi B31 Seq2
ITSVIKNIG

SEQ ID NO: 126401 - protein, 15 aa, Borrelia burgdorferi B31 Seq2
PKNFITSVIKNIGDA

SEQ ID NO: 126402 - protein, 9 aa, Borrelia burgdorferi B31 Seq2
ITSVIKNIG

SEQ ID NO: 126403 - protein, 15 aa, Borrelia burgdorferi B31 Seq2
SSKKIKISMLVDGVL

SEQ ID NO: 126404 - protein, 9 aa, Borrelia burgdorferi B31 Seq2
IKISMLVDG

SEQ ID NO: 126405 - protein, 15 aa, Borrelia burgdorferi B31 Seq2
FIFGILLTSCFSRNG

SEQ ID NO: 126406 - protein, 9 aa, Borrelia burgdorferi B31 Seq2
FGILLTSCF

SEQ ID NO: 126407 - protein, 15 aa, Borrelia burgdorferi B31 Seq2
MRIVIFIFGILLTSC

SEQ ID NO: 126408 - protein, 9 aa, Borrelia burgdorferi B31 Seq2
IFIFGILLT

SEQ ID NO: 126409 - protein, 15 aa, Borrelia burgdorferi B31 Seq2
DNLKRNGSDLIWLVG

SEQ ID NO: 126410 - protein, 9 aa, Borrelia burgdorferi B31 Seq2
LKRNGSDLI

SEQ ID NO: 126411 - protein, 15 aa, Borrelia burgdorferi B31 Seq2
SKKIKISMLVDGVLD

SEQ ID NO: 126412 - protein, 9 aa, Borrelia burgdorferi B31 Seq2
IKISMLVDG

SEQ ID NO: 126413 - protein, 15 aa, Borrelia burgdorferi B31 Seq2
VLERKIINKEIIVPC

SEQ ID NO: 126414 - protein, 9 aa, Borrelia burgdorferi B31 Seq2
IINKEIIVP

SEQ ID NO: 126415 - protein, 15 aa, Borrelia burgdorferi B31 Seq2
LERKIINKEIIVPCN

SEQ ID NO: 126416 - protein, 9 aa, Borrelia burgdorferi B31 Seq2
IINKEIIVP

SEQ ID NO: 126417 - protein, 15 aa, Borrelia burgdorferi B31 Seq2
KVLERKIINKEIIVP

SEQ ID NO: 126418 - protein, 9 aa, Borrelia burgdorferi B31 Seq2
LERKIINKE

SEQ ID NO: 126419 - protein, 15 aa, Borrelia burgdorferi B31 Seq2
KKIKISMLVDGVLDD

SEQ ID NO: 126420 - protein, 9 aa, Borrelia burgdorferi B31 Seq2
IKISMLVDG

SEQ ID NO: 126421 - protein, 15 aa, Borrelia burgdorferi B31 Seq2
SSSKKIKISMLVDGV

SEQ ID NO: 126422 - protein, 9 aa, Borrelia burgdorferi B31 Seq2
IKISMLVDG

SEQ ID NO: 126423 - protein, 15 aa, Borrelia burgdorferi B31 Seq2
TSVIKNIGDALYLIT

SEQ ID NO: 126424 - protein, 9 aa, Borrelia burgdorferi B31 Seq2
IKNIGDALY

SEQ ID NO: 126425 - protein, 15 aa, Borrelia burgdorferi B31 Seq2
ESSSKKIKISMLVDG

SEQ ID NO: 126426 - protein, 9 aa, Borrelia burgdorferi B31 Seq2
KKIKISMLV

SEQ ID NO: 126427 - protein, 15 aa, Borrelia burgdorferi B31 Seq2
FEYIKVLERKIINKE

SEQ ID NO: 126428 - protein, 9 aa, Borrelia burgdorferi B31 Seq2
IKVLERKII

SEQ ID NO: 126429 - protein, 15 aa, Borrelia burgdorferi B31 Seq2
EYIKVLERKIINKEI

SEQ ID NO: 126430 - protein, 9 aa, Borrelia burgdorferi B31 Seq2
IKVLERKII

SEQ ID NO: 126431 - protein, 15 aa, Borrelia burgdorferi B31 Seq2
SDLIWLVGYMLTDAS

SEQ ID NO: 126432 - protein, 9 aa, Borrelia burgdorferi B31 Seq2
LIWLVGYML

SEQ ID NO: 126433 - protein, 15 aa, Borrelia burgdorferi B31 Seq2
YIKNNNVWEGGKVVQ

SEQ ID NO: 126434 - protein, 9 aa, Borrelia burgdorferi B31 Seq2
IKNNNVWEG

SEQ ID NO: 126435 - protein, 15 aa, Borrelia burgdorferi B31 Seq2
IKNNNVWEGGKVVQM

SEQ ID NO: 126436 - protein, 9 aa, Borrelia burgdorferi B31 Seq2
IKNNNVWEG

SEQ ID NO: 126437 - protein, 15 aa, Borrelia burgdorferi B31 Seq2
ERKIINKEIIVPCNQ

SEQ ID NO: 126438 - protein, 9 aa, Borrelia burgdorferi B31 Seq2
IINKEIIVP

SEQ ID NO: 126439 - protein, 15 aa, Borrelia burgdorferi B31 Seq2
IKVLERKIINKEIIV

SEQ ID NO: 126440 - protein, 9 aa, Borrelia burgdorferi B31 Seq2
IKVLERKII

SEQ ID NO: 126441 - protein, 15 aa, Borrelia burgdorferi B31 Seq2
SSYVSDLDNLKRNGS

SEQ ID NO: 126442 - protein, 9 aa, Borrelia burgdorferi B31 Seq2
YVSDLDNLK

SEQ ID NO: 126443 - protein, 15 aa, Borrelia burgdorferi B31 Seq2
RKIINKEIIVPCNQE

SEQ ID NO: 126444 - protein, 9 aa, Borrelia burgdorferi B31 Seq2
IINKEIIVP

SEQ ID NO: 126445 - protein, 15 aa, Borrelia burgdorferi B31 Seq2
YVSDLDNLKRNGSDL

SEQ ID NO: 126446 - protein, 9 aa, Borrelia burgdorferi B31 Seq2
LDNLKRNGS

SEQ ID NO: 126447 - protein, 15 aa, Borrelia burgdorferi B31 Seq2
GKVVQMGLRDGVIGL

SEQ ID NO: 126448 - protein, 9 aa, Borrelia burgdorferi B31 Seq2
MGLRDGVIG

SEQ ID NO: 126449 - protein, 15 aa, Borrelia burgdorferi B31 Seq2
SVIKNIGDALYLITG

SEQ ID NO: 126450 - protein, 9 aa, Borrelia burgdorferi B31 Seq2
IKNIGDALY

SEQ ID NO: 126451 - protein, 15 aa, Borrelia burgdorferi B31 Seq2
YIKVLERKIINKEII

SEQ ID NO: 126452 - protein, 9 aa, Borrelia burgdorferi B31 Seq2
IKVLERKII

SEQ ID NO: 126453 - protein, 15 aa, Borrelia burgdorferi B31 Seq2
GGKVVQMGLRDGVIG

SEQ ID NO: 126454 - protein, 9 aa, Borrelia burgdorferi B31 Seq2
VQMGLRDGV

SEQ ID NO: 126455 - protein, 15 aa, Borrelia burgdorferi B31 Seq2
SYVSDLDNLKRNGSD

SEQ ID NO: 126456 - protein, 9 aa, Borrelia burgdorferi B31 Seq2
LDNLKRNGS

SEQ ID NO: 126457 - protein, 15 aa, Borrelia burgdorferi B31 Seq2
DLIWLVGYMLTDASL

SEQ ID NO: 126458 - protein, 9 aa, Borrelia burgdorferi B31 Seq2
VGYMLTDAS

SEQ ID NO: 126459 - protein, 15 aa, Borrelia burgdorferi B31 Seq2
KVVQMGLRDGVIGLP

SEQ ID NO: 126460 - protein, 9 aa, Borrelia burgdorferi B31 Seq2
MGLRDGVIG

SEQ ID NO: 126461 - protein, 15 aa, Borrelia burgdorferi B31 Seq2
IGFIGGMKGNIVDAF

SEQ ID NO: 126462 - protein, 9 aa, Borrelia burgdorferi B31 Seq2
IGGMKGNIV

SEQ ID NO: 126463 - protein, 15 aa, Borrelia burgdorferi B31 Seq2
SGKIGFIGGMKGNIV

SEQ ID NO: 126464 - protein, 9 aa, Borrelia burgdorferi B31 Seq2
IGFIGGMKG

SEQ ID NO: 126465 - protein, 15 aa, Borrelia burgdorferi B31 Seq2
VDIGRTIASKMYSKG

SEQ ID NO: 126466 - protein, 9 aa, Borrelia burgdorferi B31 Seq2
IGRTIASKM

SEQ ID NO: 126467 - protein, 15 aa, Borrelia burgdorferi B31 Seq2
GKIGFIGGMKGNIVD

SEQ ID NO: 126468 - protein, 9 aa, Borrelia burgdorferi B31 Seq2
IGGMKGNIV

SEQ ID NO: 126469 - protein, 15 aa, Borrelia burgdorferi B31 Seq2
IFGILLTSCFSRNGI

SEQ ID NO: 126470 - protein, 9 aa, Borrelia burgdorferi B31 Seq2
FGILLTSCF

SEQ ID NO: 126471 - protein, 15 aa, Borrelia burgdorferi B31 Seq2
LIWLVGYMLTDASLL

SEQ ID NO: 126472 - protein, 9 aa, Borrelia burgdorferi B31 Seq2
VGYMLTDAS

SEQ ID NO: 126473 - protein, 15 aa, Borrelia burgdorferi B31 Seq2
NGSDLIWLVGYMLTD

SEQ ID NO: 126474 - protein, 9 aa, Borrelia burgdorferi B31 Seq2
LIWLVGYML

SEQ ID NO: 126475 - protein, 15 aa, Borrelia burgdorferi B31 Seq2
RNGSDLIWLVGYMLT

SEQ ID NO: 126476 - protein, 9 aa, Borrelia burgdorferi B31 Seq2
LIWLVGYML

SEQ ID NO: 126477 - protein, 15 aa, Borrelia burgdorferi B31 Seq2
WLVGYMLTDASLLVS

SEQ ID NO: 126478 - protein, 9 aa, Borrelia burgdorferi B31 Seq2
VGYMLTDAS

SEQ ID NO: 126479 - protein, 15 aa, Borrelia burgdorferi B31 Seq2
FGILLTSCFSRNGIE

SEQ ID NO: 126480 - protein, 9 aa, Borrelia burgdorferi B31 Seq2
FGILLTSCF

SEQ ID NO: 126481 - protein, 15 aa, Borrelia burgdorferi B31 Seq2
GSDLIWLVGYMLTDA

SEQ ID NO: 126482 - protein, 9 aa, Borrelia burgdorferi B31 Seq2
LIWLVGYML

SEQ ID NO: 126483 - protein, 15 aa, Borrelia burgdorferi B31 Seq2
ANEFEYIKVLERKII

SEQ ID NO: 126484 - protein, 9 aa, Borrelia burgdorferi B31 Seq2
FEYIKVLER

SEQ ID NO: 126485 - protein, 15 aa, Borrelia burgdorferi B31 Seq2
NEFEYIKVLERKIIN

SEQ ID NO: 126486 - protein, 9 aa, Borrelia burgdorferi B31 Seq2
IKVLERKII

SEQ ID NO: 126487 - protein, 15 aa, Borrelia burgdorferi B31 Seq2
EFEYIKVLERKIINK

SEQ ID NO: 126488 - protein, 9 aa, Borrelia burgdorferi B31 Seq2
IKVLERKII

SEQ ID NO: 126489 - protein, 15 aa, Borrelia burgdorferi B31 Seq2
IWLVGYMLTDASLLV

SEQ ID NO: 126490 - protein, 9 aa, Borrelia burgdorferi B31 Seq2
VGYMLTDAS

SEQ ID NO: 126491 - protein, 15 aa, Borrelia burgdorferi B31 Seq2
VVQMGLRDGVIGLPN

SEQ ID NO: 126492 - protein, 9 aa, Borrelia burgdorferi B31 Seq2
MGLRDGVIG

SEQ ID NO: 126493 - protein, 15 aa, Borrelia burgdorferi B31 Seq2
KIKISMLVDGVLDDK

SEQ ID NO: 126494 - protein, 9 aa, Borrelia burgdorferi B31 Seq2
IKISMLVDG

SEQ ID NO: 126495 - protein, 15 aa, Borrelia burgdorferi B31 Seq2
NLKRNGSDLIWLVGY

SEQ ID NO: 126496 - protein, 9 aa, Borrelia burgdorferi B31 Seq2
LKRNGSDLI

SEQ ID NO: 126497 - protein, 15 aa, Borrelia burgdorferi B31 Seq2
IKISMLVDGVLDDKS

SEQ ID NO: 126498 - protein, 9 aa, Borrelia burgdorferi B31 Seq2
IKISMLVDG

SEQ ID NO: 126499 - protein, 15 aa, Borrelia burgdorferi B31 Seq2
LKRNGSDLIWLVGYM

SEQ ID NO: 126500 - protein, 9 aa, Borrelia burgdorferi B31 Seq2
LKRNGSDLI

SEQ ID NO: 126501 - protein, 15 aa, Borrelia burgdorferi B31 Seq2
YLAPKNFITSVIKNI

SEQ ID NO: 126502 - protein, 9 aa, Borrelia burgdorferi B31 Seq2
PKNFITSVI

SEQ ID NO: 126503 - protein, 15 aa, Borrelia burgdorferi B31 Seq2
GFIGGMKGNIVDAFR

SEQ ID NO: 126504 - protein, 9 aa, Borrelia burgdorferi B31 Seq2
IGGMKGNIV

SEQ ID NO: 126505 - protein, 15 aa, Borrelia burgdorferi B31 Seq2
ENPKISYGIIDPIYG

SEQ ID NO: 126506 - protein, 9 aa, Borrelia burgdorferi B31 Seq2
ISYGIIDPI

SEQ ID NO: 126507 - protein, 15 aa, Borrelia burgdorferi B31 Seq2
VIKNIGDALYLITGE

SEQ ID NO: 126508 - protein, 9 aa, Borrelia burgdorferi B31 Seq2
IKNIGDALY

SEQ ID NO: 126509 - protein, 15 aa, Borrelia burgdorferi B31 Seq2
SDVDIGRTIASKMYS

SEQ ID NO: 126510 - protein, 9 aa, Borrelia burgdorferi B31 Seq2
IGRTIASKM

SEQ ID NO: 126511 - protein, 15 aa, Borrelia burgdorferi B31 Seq2
VQMGLRDGVIGLPNA

SEQ ID NO: 126512 - protein, 9 aa, Borrelia burgdorferi B31 Seq2
MGLRDGVIG

SEQ ID NO: 126513 - protein, 15 aa, Borrelia burgdorferi B31 Seq2
KIGFIGGMKGNIVDA

SEQ ID NO: 126514 - protein, 9 aa, Borrelia burgdorferi B31 Seq2
IGGMKGNIV

SEQ ID NO: 126515 - protein, 15 aa, Borrelia burgdorferi B31 Seq2
NPKISYGIIDPIYGD

SEQ ID NO: 126516 - protein, 9 aa, Borrelia burgdorferi B31 Seq2
YGIIDPIYG

SEQ ID NO: 126517 - protein, 15 aa, Borrelia burgdorferi B31 Seq2
PKISYGIIDPIYGDD

SEQ ID NO: 126518 - protein, 9 aa, Borrelia burgdorferi B31 Seq2
YGIIDPIYG

SEQ ID NO: 126519 - protein, 15 aa, Borrelia burgdorferi B31 Seq2
DVDIGRTIASKMYSK

SEQ ID NO: 126520 - protein, 9 aa, Borrelia burgdorferi B31 Seq2
IGRTIASKM

SEQ ID NO: 126521 - protein, 15 aa, Borrelia burgdorferi B31 Seq2
SYLAPKNFITSVIKN

SEQ ID NO: 126522 - protein, 8 aa, Borrelia burgdorferi B31 Seq2
PKNFITSV

SEQ ID NO: 126523 - protein, 15 aa, Borrelia burgdorferi B31 Seq2
FSDVDIGRTIASKMY

SEQ ID NO: 126524 - protein, 9 aa, Borrelia burgdorferi B31 Seq2
IGRTIASKM

SEQ ID NO: 126525 - protein, 15 aa, Borrelia burgdorferi B31 Seq2
QSYLAPKNFITSVIK

SEQ ID NO: 126526 - protein, 9 aa, Borrelia burgdorferi B31 Seq2
PKNFITSVI

SEQ ID NO: 126527 - protein, 15 aa, Borrelia burgdorferi B31 Seq2
SFSDVDIGRTIASKM

SEQ ID NO: 126528 - protein, 9 aa, Borrelia burgdorferi B31 Seq2
VDIGRTIAS

SEQ ID NO: 126529 - protein, 15 aa, Borrelia burgdorferi B31 Seq2
NQEEYEIFIKQILKL

SEQ ID NO: 126530 - protein, 9 aa, Borrelia burgdorferi B31 Seq2
YEIFIKQIL

SEQ ID NO: 126531 - protein, 15 aa, Borrelia burgdorferi B31 Seq2
LVGYMLTDASLLVSS

SEQ ID NO: 126532 - protein, 9 aa, Borrelia burgdorferi B31 Seq2
VGYMLTDAS

SEQ ID NO: 126533 - protein, 15 aa, Borrelia burgdorferi B31 Seq2
IGRTIASKMYSKGID

SEQ ID NO: 126534 - protein, 9 aa, Borrelia burgdorferi B31 Seq2
IGRTIASKM

SEQ ID NO: 126535 - protein, 15 aa, Borrelia burgdorferi B31 Seq2
VGYMLTDASLLVSSE

SEQ ID NO: 126536 - protein, 9 aa, Borrelia burgdorferi B31 Seq2
VGYMLTDAS

SEQ ID NO: 126537 - protein, 15 aa, Borrelia burgdorferi B31 Seq2
DQSYLAPKNFITSVI

SEQ ID NO: 126538 - protein, 9 aa, Borrelia burgdorferi B31 Seq2
LAPKNFITS

SEQ ID NO: 126539 - protein, 15 aa, Borrelia burgdorferi B31 Seq2
KIINKEIIVPCNQEE

SEQ ID NO: 126540 - protein, 9 aa, Borrelia burgdorferi B31 Seq2
IINKEIIVP

SEQ ID NO: 126541 - protein, 15 aa, Borrelia burgdorferi B31 Seq2
FIGGMKGNIVDAFRY

SEQ ID NO: 126542 - protein, 9 aa, Borrelia burgdorferi B31 Seq2
IGGMKGNIV

SEQ ID NO: 126543 - protein, 15 aa, Borrelia burgdorferi B31 Seq2
MRIVIFIFGILLTSC

SEQ ID NO: 126544 - protein, 9 aa, Borrelia burgdorferi B31 Seq2
FIFGILLTS

SEQ ID NO: 126545 - protein, 15 aa, Borrelia burgdorferi B31 Seq2
VIFIFGILLTSCFSR

SEQ ID NO: 126546 - protein, 9 aa, Borrelia burgdorferi B31 Seq2
FIFGILLTS

SEQ ID NO: 126547 - protein, 15 aa, Borrelia burgdorferi B31 Seq2
RIVIFIFGILLTSCF

SEQ ID NO: 126548 - protein, 9 aa, Borrelia burgdorferi B31 Seq2
FIFGILLTS

SEQ ID NO: 126549 - protein, 15 aa, Borrelia burgdorferi B31 Seq2
IVIFIFGILLTSCFS

SEQ ID NO: 126550 - protein, 9 aa, Borrelia burgdorferi B31 Seq2
FIFGILLTS

SEQ ID NO: 126551 - protein, 15 aa, Borrelia burgdorferi B31 Seq2
AFLAGYIAAKKSFSG

SEQ ID NO: 126552 - protein, 9 aa, Borrelia burgdorferi B31 Seq2
FLAGYIAAK

SEQ ID NO: 126553 - protein, 15 aa, Borrelia burgdorferi B31 Seq2
IFIFGILLTSCFSRN

SEQ ID NO: 126554 - protein, 9 aa, Borrelia burgdorferi B31 Seq2
ILLTSCFSR

SEQ ID NO: 126555 - protein, 15 aa, Borrelia burgdorferi B31 Seq2
FLAGYIAAKKSFSGK

SEQ ID NO: 126556 - protein, 9 aa, Borrelia burgdorferi B31 Seq2
IAAKKSFSG

SEQ ID NO: 126557 - protein, 15 aa, Borrelia burgdorferi B31 Seq2
SDLIWLVGYMLTDAS

SEQ ID NO: 126558 - protein, 9 aa, Borrelia burgdorferi B31 Seq2
LVGYMLTDA

SEQ ID NO: 126559 - protein, 15 aa, Borrelia burgdorferi B31 Seq2
DLIWLVGYMLTDASL

SEQ ID NO: 126560 - protein, 9 aa, Borrelia burgdorferi B31 Seq2
LVGYMLTDA

SEQ ID NO: 126561 - protein, 15 aa, Borrelia burgdorferi B31 Seq2
LIWLVGYMLTDASLL

SEQ ID NO: 126562 - protein, 9 aa, Borrelia burgdorferi B31 Seq2
LVGYMLTDA

SEQ ID NO: 126563 - protein, 15 aa, Borrelia burgdorferi B31 Seq2
GKVVQMGLRDGVIGL

SEQ ID NO: 126564 - protein, 9 aa, Borrelia burgdorferi B31 Seq2
VVQMGLRDG

SEQ ID NO: 126565 - protein, 15 aa, Borrelia burgdorferi B31 Seq2
GSDLIWLVGYMLTDA

SEQ ID NO: 126566 - protein, 9 aa, Borrelia burgdorferi B31 Seq2
LIWLVGYML

SEQ ID NO: 126567 - protein, 15 aa, Borrelia burgdorferi B31 Seq2
GGKVVQMGLRDGVIG

SEQ ID NO: 126568 - protein, 9 aa, Borrelia burgdorferi B31 Seq2
VVQMGLRDG

SEQ ID NO: 126569 - protein, 15 aa, Borrelia burgdorferi B31 Seq2
IWLVGYMLTDASLLV

SEQ ID NO: 126570 - protein, 9 aa, Borrelia burgdorferi B31 Seq2
LVGYMLTDA

SEQ ID NO: 126571 - protein, 15 aa, Borrelia burgdorferi B31 Seq2
WEGGKVVQMGLRDGV

SEQ ID NO: 126572 - protein, 9 aa, Borrelia burgdorferi B31 Seq2
VVQMGLRDG

SEQ ID NO: 126573 - protein, 15 aa, Borrelia burgdorferi B31 Seq2
VWEGGKVVQMGLRDG

SEQ ID NO: 126574 - protein, 9 aa, Borrelia burgdorferi B31 Seq2
GKVVQMGLR

SEQ ID NO: 126575 - protein, 15 aa, Borrelia burgdorferi B31 Seq2
SDLIWLVGYMLTDAS

SEQ ID NO: 126576 - protein, 9 aa, Borrelia burgdorferi B31 Seq2
LIWLVGYML

SEQ ID NO: 126577 - protein, 15 aa, Borrelia burgdorferi B31 Seq2
GSDLIWLVGYMLTDA

SEQ ID NO: 126578 - protein, 9 aa, Borrelia burgdorferi B31 Seq2
LIWLVGYML

SEQ ID NO: 126579 - protein, 15 aa, Borrelia burgdorferi B31 Seq2
NGSDLIWLVGYMLTD

SEQ ID NO: 126580 - protein, 9 aa, Borrelia burgdorferi B31 Seq2
LIWLVGYML

SEQ ID NO: 126581 - protein, 15 aa, Borrelia burgdorferi B31 Seq2
RNGSDLIWLVGYMLT

SEQ ID NO: 126582 - protein, 9 aa, Borrelia burgdorferi B31 Seq2
LIWLVGYML

SEQ ID NO: 126583 - protein, 15 aa, Borrelia burgdorferi B31 Seq2
DLIWLVGYMLTDASL

SEQ ID NO: 126584 - protein, 9 aa, Borrelia burgdorferi B31 Seq2
IWLVGYMLT

SEQ ID NO: 126585 - protein, 15 aa, Borrelia burgdorferi B31 Seq3
AGIFYANPKLRLVSK

SEQ ID NO: 126586 - protein, 9 aa, Borrelia burgdorferi B31 Seq3
YANPKLRLV

SEQ ID NO: 126587 - protein, 15 aa, Borrelia burgdorferi B31 Seq3
GIFYANPKLRLVSKK

SEQ ID NO: 126588 - protein, 9 aa, Borrelia burgdorferi B31 Seq3
YANPKLRLV

SEQ ID NO: 126589 - protein, 15 aa, Borrelia burgdorferi B31 Seq3
FKAGIFYANPKLRLV

SEQ ID NO: 126590 - protein, 9 aa, Borrelia burgdorferi B31 Seq3
FYANPKLRL

SEQ ID NO: 126591 - protein, 15 aa, Borrelia burgdorferi B31 Seq3
KAGIFYANPKLRLVS

SEQ ID NO: 126592 - protein, 9 aa, Borrelia burgdorferi B31 Seq3
YANPKLRLV

SEQ ID NO: 126593 - protein, 15 aa, Borrelia burgdorferi B31 Seq3
LAIKFRNEEAAFLAG

SEQ ID NO: 126594 - protein, 9 aa, Borrelia burgdorferi B31 Seq3
FRNEEAAFL

SEQ ID NO: 126595 - protein, 15 aa, Borrelia burgdorferi B31 Seq3
AIKFRNEEAAFLAGY

SEQ ID NO: 126596 - protein, 9 aa, Borrelia burgdorferi B31 Seq3
FRNEEAAFL

SEQ ID NO: 126597 - protein, 15 aa, Borrelia burgdorferi B31 Seq3
IFYANPKLRLVSKKA

SEQ ID NO: 126598 - protein, 9 aa, Borrelia burgdorferi B31 Seq3
YANPKLRLV

SEQ ID NO: 126599 - protein, 15 aa, Borrelia burgdorferi B31 Seq3
SLAIKFRNEEAAFLA

SEQ ID NO: 126600 - protein, 9 aa, Borrelia burgdorferi B31 Seq3
FRNEEAAFL

SEQ ID NO: 126601 - protein, 15 aa, Borrelia burgdorferi B31 Seq3
IKFRNEEAAFLAGYI

SEQ ID NO: 126602 - protein, 9 aa, Borrelia burgdorferi B31 Seq3
FRNEEAAFL

SEQ ID NO: 126603 - protein, 15 aa, Borrelia burgdorferi B31 Seq3
NSLAIKFRNEEAAFL

SEQ ID NO: 126604 - protein, 9 aa, Borrelia burgdorferi B31 Seq3
NSLAIKFRN

SEQ ID NO: 126605 - protein, 15 aa, Borrelia burgdorferi B31 Seq3
FPIAGITGLGVYDAA

SEQ ID NO: 126606 - protein, 9 aa, Borrelia burgdorferi B31 Seq3
ITGLGVYDA

SEQ ID NO: 126607 - protein, 15 aa, Borrelia burgdorferi B31 Seq3
IFPIAGITGLGVYDA

SEQ ID NO: 126608 - protein, 9 aa, Borrelia burgdorferi B31 Seq3
IAGITGLGV

SEQ ID NO: 126609 - protein, 15 aa, Borrelia burgdorferi B31 Seq3
EKIGFLTGPMSEHVK

SEQ ID NO: 126610 - protein, 9 aa, Borrelia burgdorferi B31 Seq3
LTGPMSEHV

SEQ ID NO: 126611 - protein, 15 aa, Borrelia burgdorferi B31 Seq3
KEKIGFLTGPMSEHV

SEQ ID NO: 126612 - protein, 9 aa, Borrelia burgdorferi B31 Seq3
FLTGPMSEH

SEQ ID NO: 126613 - protein, 15 aa, Borrelia burgdorferi B31 Seq3
KIGFLTGPMSEHVKD

SEQ ID NO: 126614 - protein, 9 aa, Borrelia burgdorferi B31 Seq3
LTGPMSEHV

SEQ ID NO: 126615 - protein, 15 aa, Borrelia burgdorferi B31 Seq3
IGFLTGPMSEHVKDF

SEQ ID NO: 126616 - protein, 9 aa, Borrelia burgdorferi B31 Seq3
LTGPMSEHV

SEQ ID NO: 126617 - protein, 15 aa, Borrelia burgdorferi B31 Seq3
IKSDKVVVGVLAHGS

SEQ ID NO: 126618 - protein, 9 aa, Borrelia burgdorferi B31 Seq3
VVVGVLAHG

SEQ ID NO: 126619 - protein, 15 aa, Borrelia burgdorferi B31 Seq3
IAGITGLGVYDAAKE

SEQ ID NO: 126620 - protein, 9 aa, Borrelia burgdorferi B31 Seq3
ITGLGVYDA

SEQ ID NO: 126621 - protein, 15 aa, Borrelia burgdorferi B31 Seq3
KSDKVVVGVLAHGSF

SEQ ID NO: 126622 - protein, 9 aa, Borrelia burgdorferi B31 Seq3
VVGVLAHGS

SEQ ID NO: 126623 - protein, 15 aa, Borrelia burgdorferi B31 Seq3
DKVVVGVLAHGSFYD

SEQ ID NO: 126624 - protein, 9 aa, Borrelia burgdorferi B31 Seq3
VVGVLAHGS

SEQ ID NO: 126625 - protein, 15 aa, Borrelia burgdorferi B31 Seq3
PIAGITGLGVYDAAK

SEQ ID NO: 126626 - protein, 9 aa, Borrelia burgdorferi B31 Seq3
ITGLGVYDA

SEQ ID NO: 126627 - protein, 15 aa, Borrelia burgdorferi B31 Seq3
SDKVVVGVLAHGSFY

SEQ ID NO: 126628 - protein, 9 aa, Borrelia burgdorferi B31 Seq3
VVGVLAHGS

SEQ ID NO: 126629 - protein, 15 aa, Borrelia burgdorferi B31 Seq3
GFLTGPMSEHVKDFK

SEQ ID NO: 126630 - protein, 9 aa, Borrelia burgdorferi B31 Seq3
LTGPMSEHV

SEQ ID NO: 126631 - protein, 15 aa, Borrelia burgdorferi B31 Seq3
KVVVGVLAHGSFYDK

SEQ ID NO: 126632 - protein, 9 aa, Borrelia burgdorferi B31 Seq3
VVGVLAHGS

SEQ ID NO: 126633 - protein, 15 aa, Borrelia burgdorferi B31 Seq3
FKRFIFITLSLLVFA

SEQ ID NO: 126634 - protein, 9 aa, Borrelia burgdorferi B31 Seq3
IFITLSLLV

SEQ ID NO: 126635 - protein, 15 aa, Borrelia burgdorferi B31 Seq3
AGITGLGVYDAAKEL

SEQ ID NO: 126636 - protein, 9 aa, Borrelia burgdorferi B31 Seq3
ITGLGVYDA

SEQ ID NO: 126637 - protein, 15 aa, Borrelia burgdorferi B31 Seq3
KRFIFITLSLLVFAC

SEQ ID NO: 126638 - protein, 9 aa, Borrelia burgdorferi B31 Seq3
IFITLSLLV

SEQ ID NO: 126639 - protein, 15 aa, Borrelia burgdorferi B31 Seq3
RFIFITLSLLVFACF

SEQ ID NO: 126640 - protein, 9 aa, Borrelia burgdorferi B31 Seq3
IFITLSLLV

SEQ ID NO: 126641 - protein, 15 aa, Borrelia burgdorferi B31 Seq3
MFKRFIFITLSLLVF

SEQ ID NO: 126642 - protein, 9 aa, Borrelia burgdorferi B31 Seq3
IFITLSLLV

SEQ ID NO: 126643 - protein, 15 aa, Borrelia burgdorferi B31 Seq3
FYANPKLRLVSKKAP

SEQ ID NO: 126644 - protein, 9 aa, Borrelia burgdorferi B31 Seq3
YANPKLRLV

SEQ ID NO: 126645 - protein, 15 aa, Borrelia burgdorferi B31 Seq3
NPKLRLVSKKAPSLF

SEQ ID NO: 126646 - protein, 9 aa, Borrelia burgdorferi B31 Seq3
LVSKKAPSL

SEQ ID NO: 126647 - protein, 15 aa, Borrelia burgdorferi B31 Seq3
ANPKLRLVSKKAPSL

SEQ ID NO: 126648 - protein, 9 aa, Borrelia burgdorferi B31 Seq3
KLRLVSKKA

SEQ ID NO: 126649 - protein, 15 aa, Borrelia burgdorferi B31 Seq3
PKLRLVSKKAPSLFD

SEQ ID NO: 126650 - protein, 9 aa, Borrelia burgdorferi B31 Seq3
LVSKKAPSL

SEQ ID NO: 126651 - protein, 15 aa, Borrelia burgdorferi B31 Seq3
AAFLAGYIAAKMSRK

SEQ ID NO: 126652 - protein, 9 aa, Borrelia burgdorferi B31 Seq3
LAGYIAAKM

SEQ ID NO: 126653 - protein, 15 aa, Borrelia burgdorferi B31 Seq3
KLRLVSKKAPSLFDK

SEQ ID NO: 126654 - protein, 9 aa, Borrelia burgdorferi B31 Seq3
LVSKKAPSL

SEQ ID NO: 126655 - protein, 15 aa, Borrelia burgdorferi B31 Seq3
AFLAGYIAAKMSRKE

SEQ ID NO: 126656 - protein, 9 aa, Borrelia burgdorferi B31 Seq3
LAGYIAAKM

SEQ ID NO: 126657 - protein, 15 aa, Borrelia burgdorferi B31 Seq3
FIFITLSLLVFACFK

SEQ ID NO: 126658 - protein, 9 aa, Borrelia burgdorferi B31 Seq3
FITLSLLVF

SEQ ID NO: 126659 - protein, 15 aa, Borrelia burgdorferi B31 Seq3
EAAFLAGYIAAKMSR

SEQ ID NO: 126660 - protein, 9 aa, Borrelia burgdorferi B31 Seq3
LAGYIAAKM

SEQ ID NO: 126661 - protein, 15 aa, Borrelia burgdorferi B31 Seq3
EEAAFLAGYIAAKMS

SEQ ID NO: 126662 - protein, 9 aa, Borrelia burgdorferi B31 Seq3
LAGYIAAKM

SEQ ID NO: 126663 - protein, 15 aa, Borrelia burgdorferi B31 Seq3
YANPKLRLVSKKAPS

SEQ ID NO: 126664 - protein, 9 aa, Borrelia burgdorferi B31 Seq3
YANPKLRLV

SEQ ID NO: 126665 - protein, 15 aa, Borrelia burgdorferi B31 Seq3
LRLVSKKAPSLFDKE

SEQ ID NO: 126666 - protein, 9 aa, Borrelia burgdorferi B31 Seq3
LVSKKAPSL

SEQ ID NO: 126667 - protein, 15 aa, Borrelia burgdorferi B31 Seq3
KFRNEEAAFLAGYIA

SEQ ID NO: 126668 - protein, 9 aa, Borrelia burgdorferi B31 Seq3
FRNEEAAFL

SEQ ID NO: 126669 - protein, 15 aa, Borrelia burgdorferi B31 Seq3
FRNEEAAFLAGYIAA

SEQ ID NO: 126670 - protein, 9 aa, Borrelia burgdorferi B31 Seq3
FRNEEAAFL

SEQ ID NO: 126671 - protein, 15 aa, Borrelia burgdorferi B31 Seq3
VGVIFPIAGITGLGV

SEQ ID NO: 126672 - protein, 9 aa, Borrelia burgdorferi B31 Seq3
FPIAGITGL

SEQ ID NO: 126673 - protein, 15 aa, Borrelia burgdorferi B31 Seq3
GVIFPIAGITGLGVY

SEQ ID NO: 126674 - protein, 9 aa, Borrelia burgdorferi B31 Seq3
IAGITGLGV

SEQ ID NO: 126675 - protein, 15 aa, Borrelia burgdorferi B31 Seq3
KNPLNLFWLIGYRFS

SEQ ID NO: 126676 - protein, 9 aa, Borrelia burgdorferi B31 Seq3
LFWLIGYRF

SEQ ID NO: 126677 - protein, 15 aa, Borrelia burgdorferi B31 Seq3
NEEAAFLAGYIAAKM

SEQ ID NO: 126678 - protein, 9 aa, Borrelia burgdorferi B31 Seq3
FLAGYIAAK

SEQ ID NO: 126679 - protein, 15 aa, Borrelia burgdorferi B31 Seq3
PLNLFWLIGYRFSDL

SEQ ID NO: 126680 - protein, 9 aa, Borrelia burgdorferi B31 Seq3
LFWLIGYRF

SEQ ID NO: 126681 - protein, 15 aa, Borrelia burgdorferi B31 Seq3
NPLNLFWLIGYRFSD

SEQ ID NO: 126682 - protein, 9 aa, Borrelia burgdorferi B31 Seq3
LFWLIGYRF

SEQ ID NO: 126683 - protein, 15 aa, Borrelia burgdorferi B31 Seq3
LNLFWLIGYRFSDLS

SEQ ID NO: 126684 - protein, 9 aa, Borrelia burgdorferi B31 Seq3
LFWLIGYRF

SEQ ID NO: 126685 - protein, 15 aa, Borrelia burgdorferi B31 Seq3
VIFPIAGITGLGVYD

SEQ ID NO: 126686 - protein, 9 aa, Borrelia burgdorferi B31 Seq3
IAGITGLGV

SEQ ID NO: 126687 - protein, 15 aa, Borrelia burgdorferi B31 Seq3
QSYIAPQNVITSIIK

SEQ ID NO: 126688 - protein, 9 aa, Borrelia burgdorferi B31 Seq3
YIAPQNVIT

SEQ ID NO: 126689 - protein, 15 aa, Borrelia burgdorferi B31 Seq3
FLTGPMSEHVKDFKF

SEQ ID NO: 126690 - protein, 9 aa, Borrelia burgdorferi B31 Seq3
LTGPMSEHV

SEQ ID NO: 126691 - protein, 15 aa, Borrelia burgdorferi B31 Seq3
DQSYIAPQNVITSII

SEQ ID NO: 126692 - protein, 9 aa, Borrelia burgdorferi B31 Seq3
YIAPQNVIT

SEQ ID NO: 126693 - protein, 15 aa, Borrelia burgdorferi B31 Seq3
VVVGVLAHGSFYDKG

SEQ ID NO: 126694 - protein, 9 aa, Borrelia burgdorferi B31 Seq3
VVGVLAHGS

SEQ ID NO: 126695 - protein, 15 aa, Borrelia burgdorferi B31 Seq3
IFITLSLLVFACFKS

SEQ ID NO: 126696 - protein, 9 aa, Borrelia burgdorferi B31 Seq3
IFITLSLLV

SEQ ID NO: 126697 - protein, 15 aa, Borrelia burgdorferi B31 Seq3
NQDQSYIAPQNVITS

SEQ ID NO: 126698 - protein, 9 aa, Borrelia burgdorferi B31 Seq3
YIAPQNVIT

SEQ ID NO: 126699 - protein, 15 aa, Borrelia burgdorferi B31 Seq3
VVGVLAHGSFYDKGY

SEQ ID NO: 126700 - protein, 9 aa, Borrelia burgdorferi B31 Seq3
VVGVLAHGS

SEQ ID NO: 126701 - protein, 15 aa, Borrelia burgdorferi B31 Seq3
QDQSYIAPQNVITSI

SEQ ID NO: 126702 - protein, 9 aa, Borrelia burgdorferi B31 Seq3
YIAPQNVIT

SEQ ID NO: 126703 - protein, 15 aa, Borrelia burgdorferi B31 Seq3
GITGLGVYDAAKELG

SEQ ID NO: 126704 - protein, 9 aa, Borrelia burgdorferi B31 Seq3
ITGLGVYDA

SEQ ID NO: 126705 - protein, 15 aa, Borrelia burgdorferi B31 Seq3
FLAGYIAAKMSRKEK

SEQ ID NO: 126706 - protein, 9 aa, Borrelia burgdorferi B31 Seq3
LAGYIAAKM

SEQ ID NO: 126707 - protein, 15 aa, Borrelia burgdorferi B31 Seq3
ITGLGVYDAAKELGP

SEQ ID NO: 126708 - protein, 9 aa, Borrelia burgdorferi B31 Seq3
ITGLGVYDA

SEQ ID NO: 126709 - protein, 15 aa, Borrelia burgdorferi B31 Seq3
LNQDQSYIAPQNVIT

SEQ ID NO: 126710 - protein, 9 aa, Borrelia burgdorferi B31 Seq3
LNQDQSYIA

SEQ ID NO: 126711 - protein, 15 aa, Borrelia burgdorferi B31 Seq3
GYRFSDLSVKLSYER

SEQ ID NO: 126712 - protein, 9 aa, Borrelia burgdorferi B31 Seq3
FSDLSVKLS

SEQ ID NO: 126713 - protein, 15 aa, Borrelia burgdorferi B31 Seq3
GFKAGIFYANPKLRL

SEQ ID NO: 126714 - protein, 9 aa, Borrelia burgdorferi B31 Seq3
FKAGIFYAN

SEQ ID NO: 126715 - protein, 15 aa, Borrelia burgdorferi B31 Seq3
LTGPMSEHVKDFKFG

SEQ ID NO: 126716 - protein, 9 aa, Borrelia burgdorferi B31 Seq3
LTGPMSEHV

SEQ ID NO: 126717 - protein, 15 aa, Borrelia burgdorferi B31 Seq3
YRFSDLSVKLSYERP

SEQ ID NO: 126718 - protein, 9 aa, Borrelia burgdorferi B31 Seq3
FSDLSVKLS

SEQ ID NO: 126719 - protein, 15 aa, Borrelia burgdorferi B31 Seq3
WLIGYRFSDLSVKLS

SEQ ID NO: 126720 - protein, 9 aa, Borrelia burgdorferi B31 Seq3
RFSDLSVKL

SEQ ID NO: 126721 - protein, 15 aa, Borrelia burgdorferi B31 Seq3
DKVGVIFPIAGITGL

SEQ ID NO: 126722 - protein, 9 aa, Borrelia burgdorferi B31 Seq3
IFPIAGITG

SEQ ID NO: 126723 - protein, 15 aa, Borrelia burgdorferi B31 Seq3
IGYRFSDLSVKLSYE

SEQ ID NO: 126724 - protein, 9 aa, Borrelia burgdorferi B31 Seq3
FSDLSVKLS

SEQ ID NO: 126725 - protein, 15 aa, Borrelia burgdorferi B31 Seq3
LAGYIAAKMSRKEKI

SEQ ID NO: 126726 - protein, 9 aa, Borrelia burgdorferi B31 Seq3
LAGYIAAKM

SEQ ID NO: 126727 - protein, 15 aa, Borrelia burgdorferi B31 Seq3
LIGYRFSDLSVKLSY

SEQ ID NO: 126728 - protein, 9 aa, Borrelia burgdorferi B31 Seq3
FSDLSVKLS

SEQ ID NO: 126729 - protein, 15 aa, Borrelia burgdorferi B31 Seq3
GKVIYSISSEYINNR

SEQ ID NO: 126730 - protein, 9 aa, Borrelia burgdorferi B31 Seq3
IYSISSEYI

SEQ ID NO: 126731 - protein, 15 aa, Borrelia burgdorferi B31 Seq3
KVGVIFPIAGITGLG

SEQ ID NO: 126732 - protein, 9 aa, Borrelia burgdorferi B31 Seq3
FPIAGITGL

SEQ ID NO: 126733 - protein, 15 aa, Borrelia burgdorferi B31 Seq3
DIGKVIYSISSEYIN

SEQ ID NO: 126734 - protein, 9 aa, Borrelia burgdorferi B31 Seq3
IYSISSEYI

SEQ ID NO: 126735 - protein, 15 aa, Borrelia burgdorferi B31 Seq3
IGKVIYSISSEYINN

SEQ ID NO: 126736 - protein, 9 aa, Borrelia burgdorferi B31 Seq3
IYSISSEYI

SEQ ID NO: 126737 - protein, 15 aa, Borrelia burgdorferi B31 Seq3
KDIGKVIYSISSEYI

SEQ ID NO: 126738 - protein, 9 aa, Borrelia burgdorferi B31 Seq3
VIYSISSEY

SEQ ID NO: 126739 - protein, 15 aa, Borrelia burgdorferi B31 Seq3
KVIYSISSEYINNRV

SEQ ID NO: 126740 - protein, 9 aa, Borrelia burgdorferi B31 Seq3
IYSISSEYI

SEQ ID NO: 126741 - protein, 15 aa, Borrelia burgdorferi B31 Seq3
LRPYPIEGKRLLTVD

SEQ ID NO: 126742 - protein, 9 aa, Borrelia burgdorferi B31 Seq3
IEGKRLLTV

SEQ ID NO: 126743 - protein, 15 aa, Borrelia burgdorferi B31 Seq3
SLRPYPIEGKRLLTV

SEQ ID NO: 126744 - protein, 9 aa, Borrelia burgdorferi B31 Seq3
YPIEGKRLL

SEQ ID NO: 126745 - protein, 15 aa, Borrelia burgdorferi B31 Seq3
DNFGIKLITKSLRPY

SEQ ID NO: 126746 - protein, 9 aa, Borrelia burgdorferi B31 Seq3
FGIKLITKS

SEQ ID NO: 126747 - protein, 15 aa, Borrelia burgdorferi B31 Seq3
FGIKLITKSLRPYPI

SEQ ID NO: 126748 - protein, 9 aa, Borrelia burgdorferi B31 Seq3
LITKSLRPY

SEQ ID NO: 126749 - protein, 15 aa, Borrelia burgdorferi B31 Seq3
RLVSKKAPSLFDKEK

SEQ ID NO: 126750 - protein, 9 aa, Borrelia burgdorferi B31 Seq3
LVSKKAPSL

SEQ ID NO: 126751 - protein, 15 aa, Borrelia burgdorferi B31 Seq3
RPYPIEGKRLLTVDE

SEQ ID NO: 126752 - protein, 9 aa, Borrelia burgdorferi B31 Seq3
IEGKRLLTV

SEQ ID NO: 126753 - protein, 15 aa, Borrelia burgdorferi B31 Seq3
EDKVGVIFPIAGITG

SEQ ID NO: 126754 - protein, 9 aa, Borrelia burgdorferi B31 Seq3
VGVIFPIAG

SEQ ID NO: 126755 - protein, 15 aa, Borrelia burgdorferi B31 Seq3
QKNPLNLFWLIGYRF

SEQ ID NO: 126756 - protein, 9 aa, Borrelia burgdorferi B31 Seq3
PLNLFWLIG

SEQ ID NO: 126757 - protein, 15 aa, Borrelia burgdorferi B31 Seq3
SYIAPQNVITSIIKD

SEQ ID NO: 126758 - protein, 9 aa, Borrelia burgdorferi B31 Seq3
YIAPQNVIT

SEQ ID NO: 126759 - protein, 15 aa, Borrelia burgdorferi B31 Seq3
NLFWLIGYRFSDLSV

SEQ ID NO: 126760 - protein, 9 aa, Borrelia burgdorferi B31 Seq3
LFWLIGYRF

SEQ ID NO: 126761 - protein, 15 aa, Borrelia burgdorferi B31 Seq3
PYPIEGKRLLTVDEA

SEQ ID NO: 126762 - protein, 9 aa, Borrelia burgdorferi B31 Seq3
IEGKRLLTV

SEQ ID NO: 126763 - protein, 15 aa, Borrelia burgdorferi B31 Seq3
KYYVIGLNQDQSYIA

SEQ ID NO: 126764 - protein, 9 aa, Borrelia burgdorferi B31 Seq3
YVIGLNQDQ

SEQ ID NO: 126765 - protein, 15 aa, Borrelia burgdorferi B31 Seq3
FGFKAGIFYANPKLR

SEQ ID NO: 126766 - protein, 9 aa, Borrelia burgdorferi B31 Seq3
FKAGIFYAN

SEQ ID NO: 126767 - protein, 15 aa, Borrelia burgdorferi B31 Seq3
YPIEGKRLLTVDEAM

SEQ ID NO: 126768 - protein, 9 aa, Borrelia burgdorferi B31 Seq3
IEGKRLLTV

SEQ ID NO: 126769 - protein, 15 aa, Borrelia burgdorferi B31 Seq3
LVSKKAPSLFDKEKG

SEQ ID NO: 126770 - protein, 9 aa, Borrelia burgdorferi B31 Seq3
LVSKKAPSL

SEQ ID NO: 126771 - protein, 15 aa, Borrelia burgdorferi B31 Seq3
RDNFGIKLITKSLRP

SEQ ID NO: 126772 - protein, 9 aa, Borrelia burgdorferi B31 Seq3
FGIKLITKS

SEQ ID NO: 126773 - protein, 15 aa, Borrelia burgdorferi B31 Seq3
LRDNFGIKLITKSLR

SEQ ID NO: 126774 - protein, 9 aa, Borrelia burgdorferi B31 Seq3
FGIKLITKS

SEQ ID NO: 126775 - protein, 15 aa, Borrelia burgdorferi B31 Seq3
IKLITKSLRPYPIEG

SEQ ID NO: 126776 - protein, 9 aa, Borrelia burgdorferi B31 Seq3
TKSLRPYPI

SEQ ID NO: 126777 - protein, 15 aa, Borrelia burgdorferi B31 Seq3
KLITKSLRPYPIEGK

SEQ ID NO: 126778 - protein, 9 aa, Borrelia burgdorferi B31 Seq3
TKSLRPYPI

SEQ ID NO: 126779 - protein, 15 aa, Borrelia burgdorferi B31 Seq3
KDFKFGFKAGIFYAN

SEQ ID NO: 126780 - protein, 9 aa, Borrelia burgdorferi B31 Seq3
GFKAGIFYA

SEQ ID NO: 126781 - protein, 15 aa, Borrelia burgdorferi B31 Seq3
GIKLITKSLRPYPIE

SEQ ID NO: 126782 - protein, 9 aa, Borrelia burgdorferi B31 Seq3
TKSLRPYPI

SEQ ID NO: 126783 - protein, 15 aa, Borrelia burgdorferi B31 Seq3
YYVIGLNQDQSYIAP

SEQ ID NO: 126784 - protein, 9 aa, Borrelia burgdorferi B31 Seq3
LNQDQSYIA

SEQ ID NO: 126785 - protein, 15 aa, Borrelia burgdorferi B31 Seq3
AGYIAAKMSRKEKIG

SEQ ID NO: 126786 - protein, 9 aa, Borrelia burgdorferi B31 Seq3
IAAKMSRKE

SEQ ID NO: 126787 - protein, 15 aa, Borrelia burgdorferi B31 Seq3
FKFGFKAGIFYANPK

SEQ ID NO: 126788 - protein, 9 aa, Borrelia burgdorferi B31 Seq3
FKAGIFYAN

SEQ ID NO: 126789 - protein, 15 aa, Borrelia burgdorferi B31 Seq3
LITKSLRPYPIEGKR

SEQ ID NO: 126790 - protein, 9 aa, Borrelia burgdorferi B31 Seq3
TKSLRPYPI

SEQ ID NO: 126791 - protein, 15 aa, Borrelia burgdorferi B31 Seq3
DFKFGFKAGIFYANP

SEQ ID NO: 126792 - protein, 9 aa, Borrelia burgdorferi B31 Seq3
FKAGIFYAN

SEQ ID NO: 126793 - protein, 15 aa, Borrelia burgdorferi B31 Seq3
KLRDNFGIKLITKSL

SEQ ID NO: 126794 - protein, 9 aa, Borrelia burgdorferi B31 Seq3
FGIKLITKS

SEQ ID NO: 126795 - protein, 15 aa, Borrelia burgdorferi B31 Seq3
KFGFKAGIFYANPKL

SEQ ID NO: 126796 - protein, 9 aa, Borrelia burgdorferi B31 Seq3
FKAGIFYAN

SEQ ID NO: 126797 - protein, 15 aa, Borrelia burgdorferi B31 Seq3
YVIGLNQDQSYIAPQ

SEQ ID NO: 126798 - protein, 9 aa, Borrelia burgdorferi B31 Seq3
LNQDQSYIA

SEQ ID NO: 126799 - protein, 15 aa, Borrelia burgdorferi B31 Seq3
LFWLIGYRFSDLSVK

SEQ ID NO: 126800 - protein, 9 aa, Borrelia burgdorferi B31 Seq3
LFWLIGYRF

SEQ ID NO: 126801 - protein, 15 aa, Borrelia burgdorferi B31 Seq3
IGLNQDQSYIAPQNV

SEQ ID NO: 126802 - protein, 9 aa, Borrelia burgdorferi B31 Seq3
LNQDQSYIA

SEQ ID NO: 126803 - protein, 15 aa, Borrelia burgdorferi B31 Seq3
FITLSLLVFACFKSN

SEQ ID NO: 126804 - protein, 9 aa, Borrelia burgdorferi B31 Seq3
FITLSLLVF

SEQ ID NO: 126805 - protein, 15 aa, Borrelia burgdorferi B31 Seq3
YIAPQNVITSIIKDI

SEQ ID NO: 126806 - protein, 9 aa, Borrelia burgdorferi B31 Seq3
YIAPQNVIT

SEQ ID NO: 126807 - protein, 15 aa, Borrelia burgdorferi B31 Seq3
RFSDLSVKLSYERPD

SEQ ID NO: 126808 - protein, 9 aa, Borrelia burgdorferi B31 Seq3
FSDLSVKLS

SEQ ID NO: 126809 - protein, 15 aa, Borrelia burgdorferi B31 Seq3
FDYGDIQVPKNSLAI

SEQ ID NO: 126810 - protein, 9 aa, Borrelia burgdorferi B31 Seq3
IQVPKNSLA

SEQ ID NO: 126811 - protein, 15 aa, Borrelia burgdorferi B31 Seq3
VKLRDNFGIKLITKS

SEQ ID NO: 126812 - protein, 9 aa, Borrelia burgdorferi B31 Seq3
LRDNFGIKL

SEQ ID NO: 126813 - protein, 15 aa, Borrelia burgdorferi B31 Seq3
VIGLNQDQSYIAPQN

SEQ ID NO: 126814 - protein, 9 aa, Borrelia burgdorferi B31 Seq3
LNQDQSYIA

SEQ ID NO: 126815 - protein, 15 aa, Borrelia burgdorferi B31 Seq3
FSDLSVKLSYERPDI

SEQ ID NO: 126816 - protein, 9 aa, Borrelia burgdorferi B31 Seq3
FSDLSVKLS

SEQ ID NO: 126817 - protein, 15 aa, Borrelia burgdorferi B31 Seq3
NFGIKLITKSLRPYP

SEQ ID NO: 126818 - protein, 9 aa, Borrelia burgdorferi B31 Seq3
LITKSLRPY

SEQ ID NO: 126819 - protein, 15 aa, Borrelia burgdorferi B31 Seq3
RKEKIGFLTGPMSEH

SEQ ID NO: 126820 - protein, 9 aa, Borrelia burgdorferi B31 Seq3
IGFLTGPMS

SEQ ID NO: 126821 - protein, 15 aa, Borrelia burgdorferi B31 Seq3
SNKKSIKSDKVVVGV

SEQ ID NO: 126822 - protein, 9 aa, Borrelia burgdorferi B31 Seq3
IKSDKVVVG

SEQ ID NO: 126823 - protein, 15 aa, Borrelia burgdorferi B31 Seq3
KKSIKSDKVVVGVLA

SEQ ID NO: 126824 - protein, 9 aa, Borrelia burgdorferi B31 Seq3
IKSDKVVVG

SEQ ID NO: 126825 - protein, 15 aa, Borrelia burgdorferi B31 Seq3
KSNKKSIKSDKVVVG

SEQ ID NO: 126826 - protein, 9 aa, Borrelia burgdorferi B31 Seq3
KKSIKSDKV

SEQ ID NO: 126827 - protein, 15 aa, Borrelia burgdorferi B31 Seq3
YINNRVFKGGIIIDR

SEQ ID NO: 126828 - protein, 9 aa, Borrelia burgdorferi B31 Seq3
YINNRVFKG

SEQ ID NO: 126829 - protein, 15 aa, Borrelia burgdorferi B31 Seq3
KSIKSDKVVVGVLAH

SEQ ID NO: 126830 - protein, 9 aa, Borrelia burgdorferi B31 Seq3
IKSDKVVVG

SEQ ID NO: 126831 - protein, 15 aa, Borrelia burgdorferi B31 Seq3
NRVFKGGIIIDRGLK

SEQ ID NO: 126832 - protein, 9 aa, Borrelia burgdorferi B31 Seq3
FKGGIIIDR

SEQ ID NO: 126833 - protein, 15 aa, Borrelia burgdorferi B31 Seq3
SEYINNRVFKGGIII

SEQ ID NO: 126834 - protein, 9 aa, Borrelia burgdorferi B31 Seq3
YINNRVFKG

SEQ ID NO: 126835 - protein, 15 aa, Borrelia burgdorferi B31 Seq3
RVFKGGIIIDRGLKE

SEQ ID NO: 126836 - protein, 9 aa, Borrelia burgdorferi B31 Seq3
FKGGIIIDR

SEQ ID NO: 126837 - protein, 15 aa, Borrelia burgdorferi B31 Seq3
SSEYINNRVFKGGII

SEQ ID NO: 126838 - protein, 9 aa, Borrelia burgdorferi B31 Seq3
YINNRVFKG

SEQ ID NO: 126839 - protein, 15 aa, Borrelia burgdorferi B31 Seq3
ISSEYINNRVFKGGI

SEQ ID NO: 126840 - protein, 9 aa, Borrelia burgdorferi B31 Seq3
YINNRVFKG

SEQ ID NO: 126841 - protein, 15 aa, Borrelia burgdorferi B31 Seq3
NNRVFKGGIIIDRGL

SEQ ID NO: 126842 - protein, 9 aa, Borrelia burgdorferi B31 Seq3
FKGGIIIDR

SEQ ID NO: 126843 - protein, 15 aa, Borrelia burgdorferi B31 Seq3
NKKSIKSDKVVVGVL

SEQ ID NO: 126844 - protein, 9 aa, Borrelia burgdorferi B31 Seq3
IKSDKVVVG

SEQ ID NO: 126845 - protein, 15 aa, Borrelia burgdorferi B31 Seq3
SISSEYINNRVFKGG

SEQ ID NO: 126846 - protein, 9 aa, Borrelia burgdorferi B31 Seq3
YINNRVFKG

SEQ ID NO: 126847 - protein, 15 aa, Borrelia burgdorferi B31 Seq3
INNRVFKGGIIIDRG

SEQ ID NO: 126848 - protein, 9 aa, Borrelia burgdorferi B31 Seq3
FKGGIIIDR

SEQ ID NO: 126849 - protein, 15 aa, Borrelia burgdorferi B31 Seq3
YGDIQVPKNSLAIKF

SEQ ID NO: 126850 - protein, 9 aa, Borrelia burgdorferi B31 Seq3
IQVPKNSLA

SEQ ID NO: 126851 - protein, 15 aa, Borrelia burgdorferi B31 Seq3
DAYEVQKNPLNLFWL

SEQ ID NO: 126852 - protein, 9 aa, Borrelia burgdorferi B31 Seq3
VQKNPLNLF

SEQ ID NO: 126853 - protein, 15 aa, Borrelia burgdorferi B31 Seq3
SIKSDKVVVGVLAHG

SEQ ID NO: 126854 - protein, 9 aa, Borrelia burgdorferi B31 Seq3
IKSDKVVVG

SEQ ID NO: 126855 - protein, 15 aa, Borrelia burgdorferi B31 Seq3
EDAYEVQKNPLNLFW

SEQ ID NO: 126856 - protein, 9 aa, Borrelia burgdorferi B31 Seq3
VQKNPLNLF

SEQ ID NO: 126857 - protein, 15 aa, Borrelia burgdorferi B31 Seq3
DYGDIQVPKNSLAIK

SEQ ID NO: 126858 - protein, 9 aa, Borrelia burgdorferi B31 Seq3
IQVPKNSLA

SEQ ID NO: 126859 - protein, 15 aa, Borrelia burgdorferi B31 Seq3
TEDAYEVQKNPLNLF

SEQ ID NO: 126860 - protein, 9 aa, Borrelia burgdorferi B31 Seq3
YEVQKNPLN

SEQ ID NO: 126861 - protein, 15 aa, Borrelia burgdorferi B31 Seq3
GDIQVPKNSLAIKFR

SEQ ID NO: 126862 - protein, 9 aa, Borrelia burgdorferi B31 Seq3
IQVPKNSLA

SEQ ID NO: 126863 - protein, 15 aa, Borrelia burgdorferi B31 Seq3
GSFYDKGYNQSVHDG

SEQ ID NO: 126864 - protein, 9 aa, Borrelia burgdorferi B31 Seq3
YDKGYNQSV

SEQ ID NO: 126865 - protein, 15 aa, Borrelia burgdorferi B31 Seq3
GYIAAKMSRKEKIGF

SEQ ID NO: 126866 - protein, 9 aa, Borrelia burgdorferi B31 Seq3
IAAKMSRKE

SEQ ID NO: 126867 - protein, 15 aa, Borrelia burgdorferi B31 Seq3
AYEVQKNPLNLFWLI

SEQ ID NO: 126868 - protein, 9 aa, Borrelia burgdorferi B31 Seq3
VQKNPLNLF

SEQ ID NO: 126869 - protein, 15 aa, Borrelia burgdorferi B31 Seq3
IEGKRLLTVDEAMTE

SEQ ID NO: 126870 - protein, 9 aa, Borrelia burgdorferi B31 Seq3
IEGKRLLTV

SEQ ID NO: 126871 - protein, 15 aa, Borrelia burgdorferi B31 Seq3
AFDYGDIQVPKNSLA

SEQ ID NO: 126872 - protein, 9 aa, Borrelia burgdorferi B31 Seq3
YGDIQVPKN

SEQ ID NO: 126873 - protein, 15 aa, Borrelia burgdorferi B31 Seq3
KEDKVGVIFPIAGIT

SEQ ID NO: 126874 - protein, 9 aa, Borrelia burgdorferi B31 Seq3
VGVIFPIAG

SEQ ID NO: 126875 - protein, 15 aa, Borrelia burgdorferi B31 Seq3
TKSLRPYPIEGKRLL

SEQ ID NO: 126876 - protein, 9 aa, Borrelia burgdorferi B31 Seq3
TKSLRPYPI

SEQ ID NO: 126877 - protein, 15 aa, Borrelia burgdorferi B31 Seq3
YEVQKNPLNLFWLIG

SEQ ID NO: 126878 - protein, 9 aa, Borrelia burgdorferi B31 Seq3
VQKNPLNLF

SEQ ID NO: 126879 - protein, 15 aa, Borrelia burgdorferi B31 Seq3
PIEGKRLLTVDEAMT

SEQ ID NO: 126880 - protein, 9 aa, Borrelia burgdorferi B31 Seq3
IEGKRLLTV

SEQ ID NO: 126881 - protein, 15 aa, Borrelia burgdorferi B31 Seq3
VIYSISSEYINNRVF

SEQ ID NO: 126882 - protein, 9 aa, Borrelia burgdorferi B31 Seq3
IYSISSEYI

SEQ ID NO: 126883 - protein, 15 aa, Borrelia burgdorferi B31 Seq3
FKRFIFITLSLLVFA

SEQ ID NO: 126884 - protein, 9 aa, Borrelia burgdorferi B31 Seq3
IFITLSLLV

SEQ ID NO: 126885 - protein, 15 aa, Borrelia burgdorferi B31 Seq3
KRFIFITLSLLVFAC

SEQ ID NO: 126886 - protein, 9 aa, Borrelia burgdorferi B31 Seq3
IFITLSLLV

SEQ ID NO: 126887 - protein, 15 aa, Borrelia burgdorferi B31 Seq3
MFKRFIFITLSLLVF

SEQ ID NO: 126888 - protein, 9 aa, Borrelia burgdorferi B31 Seq3
IFITLSLLV

SEQ ID NO: 126889 - protein, 15 aa, Borrelia burgdorferi B31 Seq3
RFIFITLSLLVFACF

SEQ ID NO: 126890 - protein, 9 aa, Borrelia burgdorferi B31 Seq3
IFITLSLLV

SEQ ID NO: 126891 - protein, 15 aa, Borrelia burgdorferi B31 Seq3
KDIGKVIYSISSEYI

SEQ ID NO: 126892 - protein, 9 aa, Borrelia burgdorferi B31 Seq3
GKVIYSISS

SEQ ID NO: 126893 - protein, 15 aa, Borrelia burgdorferi B31 Seq3
DIGKVIYSISSEYIN

SEQ ID NO: 126894 - protein, 9 aa, Borrelia burgdorferi B31 Seq3
GKVIYSISS

SEQ ID NO: 126895 - protein, 15 aa, Borrelia burgdorferi B31 Seq3
IKDIGKVIYSISSEY

SEQ ID NO: 126896 - protein, 9 aa, Borrelia burgdorferi B31 Seq3
GKVIYSISS

SEQ ID NO: 126897 - protein, 15 aa, Borrelia burgdorferi B31 Seq3
GKVIYSISSEYINNR

SEQ ID NO: 126898 - protein, 9 aa, Borrelia burgdorferi B31 Seq3
VIYSISSEY

SEQ ID NO: 126899 - protein, 15 aa, Borrelia burgdorferi B31 Seq3
FIFITLSLLVFACFK

SEQ ID NO: 126900 - protein, 9 aa, Borrelia burgdorferi B31 Seq3
IFITLSLLV

SEQ ID NO: 126901 - protein, 15 aa, Borrelia burgdorferi B31 Seq3
IFITLSLLVFACFKS

SEQ ID NO: 126902 - protein, 9 aa, Borrelia burgdorferi B31 Seq3
IFITLSLLV

SEQ ID NO: 126903 - protein, 15 aa, Borrelia burgdorferi B31 Seq3
IGKVIYSISSEYINN

SEQ ID NO: 126904 - protein, 9 aa, Borrelia burgdorferi B31 Seq3
VIYSISSEY

SEQ ID NO: 126905 - protein, 15 aa, Borrelia burgdorferi B31 Seq3
FKRFIFITLSLLVFA

SEQ ID NO: 126906 - protein, 9 aa, Borrelia burgdorferi B31 Seq3
IFITLSLLV

SEQ ID NO: 126907 - protein, 15 aa, Borrelia burgdorferi B31 Seq3
MFKRFIFITLSLLVF

SEQ ID NO: 126908 - protein, 9 aa, Borrelia burgdorferi B31 Seq3
IFITLSLLV

SEQ ID NO: 126909 - protein, 15 aa, Borrelia burgdorferi B31 Seq3
EGVIEIVKDPDVLNN

SEQ ID NO: 126910 - protein, 9 aa, Borrelia burgdorferi B31 Seq3
IVKDPDVLN

SEQ ID NO: 126911 - protein, 15 aa, Borrelia burgdorferi B31 Seq3
KEGVIEIVKDPDVLN

SEQ ID NO: 126912 - protein, 9 aa, Borrelia burgdorferi B31 Seq3
VIEIVKDPD

SEQ ID NO: 126913 - protein, 15 aa, Borrelia burgdorferi B31 Seq3
GVIEIVKDPDVLNNR

SEQ ID NO: 126914 - protein, 9 aa, Borrelia burgdorferi B31 Seq3
IVKDPDVLN

SEQ ID NO: 126915 - protein, 15 aa, Borrelia burgdorferi B31 Seq3
IEIVKDPDVLNNRLV

SEQ ID NO: 126916 - protein, 9 aa, Borrelia burgdorferi B31 Seq3
IVKDPDVLN

SEQ ID NO: 126917 - protein, 15 aa, Borrelia burgdorferi B31 Seq3
VIEIVKDPDVLNNRL

SEQ ID NO: 126918 - protein, 9 aa, Borrelia burgdorferi B31 Seq3
IVKDPDVLN

SEQ ID NO: 126919 - protein, 15 aa, Borrelia burgdorferi B31 Seq3
TEDAYEVQKNPLNLF

SEQ ID NO: 126920 - protein, 9 aa, Borrelia burgdorferi B31 Seq3
YEVQKNPLN

SEQ ID NO: 126921 - protein, 15 aa, Borrelia burgdorferi B31 Seq3
EDAYEVQKNPLNLFW

SEQ ID NO: 126922 - protein, 9 aa, Borrelia burgdorferi B31 Seq3
YEVQKNPLN

SEQ ID NO: 126923 - protein, 15 aa, Borrelia burgdorferi B31 Seq3
DAYEVQKNPLNLFWL

SEQ ID NO: 126924 - protein, 9 aa, Borrelia burgdorferi B31 Seq3
YEVQKNPLN

SEQ ID NO: 126925 - protein, 15 aa, Borrelia burgdorferi B31 Seq3
AMTEDAYEVQKNPLN

SEQ ID NO: 126926 - protein, 9 aa, Borrelia burgdorferi B31 Seq3
EDAYEVQKN

SEQ ID NO: 126927 - protein, 15 aa, Borrelia burgdorferi B31 Seq3
MTEDAYEVQKNPLNL

SEQ ID NO: 126928 - protein, 9 aa, Borrelia burgdorferi B31 Seq3
YEVQKNPLN

SEQ ID NO: 126929 - protein, 15 aa, Borrelia burgdorferi B31 Seq3
LRLVSKKAPSLFDKE

SEQ ID NO: 126930 - protein, 9 aa, Borrelia burgdorferi B31 Seq3
SKKAPSLFD

SEQ ID NO: 126931 - protein, 15 aa, Borrelia burgdorferi B31 Seq3
RLVSKKAPSLFDKEK

SEQ ID NO: 126932 - protein, 9 aa, Borrelia burgdorferi B31 Seq3
SKKAPSLFD

SEQ ID NO: 126933 - protein, 15 aa, Borrelia burgdorferi B31 Seq3
PKLRLVSKKAPSLFD

SEQ ID NO: 126934 - protein, 9 aa, Borrelia burgdorferi B31 Seq3
LRLVSKKAP

SEQ ID NO: 126935 - protein, 15 aa, Borrelia burgdorferi B31 Seq3
KLRLVSKKAPSLFDK

SEQ ID NO: 126936 - protein, 9 aa, Borrelia burgdorferi B31 Seq3
SKKAPSLFD

SEQ ID NO: 126937 - protein, 15 aa, Borrelia burgdorferi B31 Seq3
LVSKKAPSLFDKEKG

SEQ ID NO: 126938 - protein, 9 aa, Borrelia burgdorferi B31 Seq3
SKKAPSLFD

SEQ ID NO: 126939 - protein, 15 aa, Borrelia burgdorferi B31 Seq3
EIVKDPDVLNNRLVD

SEQ ID NO: 126940 - protein, 9 aa, Borrelia burgdorferi B31 Seq3
IVKDPDVLN

SEQ ID NO: 126941 - protein, 15 aa, Borrelia burgdorferi B31 Seq3
IVKDPDVLNNRLVDE

SEQ ID NO: 126942 - protein, 9 aa, Borrelia burgdorferi B31 Seq3
IVKDPDVLN

SEQ ID NO: 126943 - protein, 15 aa, Borrelia burgdorferi B31 Seq3
AYEVQKNPLNLFWLI

SEQ ID NO: 126944 - protein, 9 aa, Borrelia burgdorferi B31 Seq3
YEVQKNPLN

SEQ ID NO: 126945 - protein, 15 aa, Borrelia burgdorferi B31 Seq3
YEVQKNPLNLFWLIG

SEQ ID NO: 126946 - protein, 9 aa, Borrelia burgdorferi B31 Seq3
YEVQKNPLN

SEQ ID NO: 126947 - protein, 15 aa, Borrelia burgdorferi B31 Seq3
MFKRFIFITLSLLVF

SEQ ID NO: 126948 - protein, 9 aa, Borrelia burgdorferi B31 Seq3
IFITLSLLV

SEQ ID NO: 126949 - protein, 15 aa, Borrelia burgdorferi B31 Seq3
FKRFIFITLSLLVFA

SEQ ID NO: 126950 - protein, 9 aa, Borrelia burgdorferi B31 Seq3
IFITLSLLV

SEQ ID NO: 126951 - protein, 15 aa, Borrelia burgdorferi B31 Seq3
KRFIFITLSLLVFAC

SEQ ID NO: 126952 - protein, 9 aa, Borrelia burgdorferi B31 Seq3
IFITLSLLV

SEQ ID NO: 126953 - protein, 15 aa, Borrelia burgdorferi B31 Seq3
RFIFITLSLLVFACF

SEQ ID NO: 126954 - protein, 9 aa, Borrelia burgdorferi B31 Seq3
IFITLSLLV

SEQ ID NO: 126955 - protein, 15 aa, Borrelia burgdorferi B31 Seq3
PKLRLVSKKAPSLFD

SEQ ID NO: 126956 - protein, 9 aa, Borrelia burgdorferi B31 Seq3
VSKKAPSLF

SEQ ID NO: 126957 - protein, 15 aa, Borrelia burgdorferi B31 Seq3
FGIKLITKSLRPYPI

SEQ ID NO: 126958 - protein, 9 aa, Borrelia burgdorferi B31 Seq3
ITKSLRPYP

SEQ ID NO: 126959 - protein, 15 aa, Borrelia burgdorferi B31 Seq3
IKLITKSLRPYPIEG

SEQ ID NO: 126960 - protein, 9 aa, Borrelia burgdorferi B31 Seq3
ITKSLRPYP

SEQ ID NO: 126961 - protein, 15 aa, Borrelia burgdorferi B31 Seq3
GIKLITKSLRPYPIE

SEQ ID NO: 126962 - protein, 9 aa, Borrelia burgdorferi B31 Seq3
ITKSLRPYP

SEQ ID NO: 126963 - protein, 15 aa, Borrelia burgdorferi B31 Seq3
KLITKSLRPYPIEGK

SEQ ID NO: 126964 - protein, 9 aa, Borrelia burgdorferi B31 Seq3
ITKSLRPYP

SEQ ID NO: 126965 - protein, 15 aa, Borrelia burgdorferi B31 Seq3
PLNLFWLIGYRFSDL

SEQ ID NO: 126966 - protein, 9 aa, Borrelia burgdorferi B31 Seq3
FWLIGYRFS

SEQ ID NO: 126967 - protein, 15 aa, Borrelia burgdorferi B31 Seq3
LNLFWLIGYRFSDLS

SEQ ID NO: 126968 - protein, 9 aa, Borrelia burgdorferi B31 Seq3
FWLIGYRFS

SEQ ID NO: 126969 - protein, 15 aa, Borrelia burgdorferi B31 Seq3
NPLNLFWLIGYRFSD

SEQ ID NO: 126970 - protein, 9 aa, Borrelia burgdorferi B31 Seq3
FWLIGYRFS

SEQ ID NO: 126971 - protein, 15 aa, Borrelia burgdorferi B31 Seq3
KNPLNLFWLIGYRFS

SEQ ID NO: 126972 - protein, 9 aa, Borrelia burgdorferi B31 Seq3
LFWLIGYRF

SEQ ID NO: 126973 - protein, 15 aa, Borrelia burgdorferi B31 Seq3
NLFWLIGYRFSDLSV

SEQ ID NO: 126974 - protein, 9 aa, Borrelia burgdorferi B31 Seq3
FWLIGYRFS

SEQ ID NO: 126975 - protein, 15 aa, Borrelia burgdorferi B31 Seq3
SSEYINNRVFKGGII

SEQ ID NO: 126976 - protein, 9 aa, Borrelia burgdorferi B31 Seq3
YINNRVFKG

SEQ ID NO: 126977 - protein, 15 aa, Borrelia burgdorferi B31 Seq3
ISSEYINNRVFKGGI

SEQ ID NO: 126978 - protein, 9 aa, Borrelia burgdorferi B31 Seq3
YINNRVFKG

SEQ ID NO: 126979 - protein, 15 aa, Borrelia burgdorferi B31 Seq3
SISSEYINNRVFKGG

SEQ ID NO: 126980 - protein, 9 aa, Borrelia burgdorferi B31 Seq3
YINNRVFKG

SEQ ID NO: 126981 - protein, 15 aa, Borrelia burgdorferi B31 Seq3
YSISSEYINNRVFKG

SEQ ID NO: 126982 - protein, 9 aa, Borrelia burgdorferi B31 Seq3
EYINNRVFK

SEQ ID NO: 126983 - protein, 15 aa, Borrelia burgdorferi B31 Seq3
DNFGIKLITKSLRPY

SEQ ID NO: 126984 - protein, 9 aa, Borrelia burgdorferi B31 Seq3
IKLITKSLR

SEQ ID NO: 126985 - protein, 15 aa, Borrelia burgdorferi B31 Seq3
LRDNFGIKLITKSLR

SEQ ID NO: 126986 - protein, 9 aa, Borrelia burgdorferi B31 Seq3
FGIKLITKS

SEQ ID NO: 126987 - protein, 15 aa, Borrelia burgdorferi B31 Seq3
RDNFGIKLITKSLRP

SEQ ID NO: 126988 - protein, 9 aa, Borrelia burgdorferi B31 Seq3
IKLITKSLR

SEQ ID NO: 126989 - protein, 15 aa, Borrelia burgdorferi B31 Seq3
NFGIKLITKSLRPYP

SEQ ID NO: 126990 - protein, 9 aa, Borrelia burgdorferi B31 Seq3
IKLITKSLR

SEQ ID NO: 126991 - protein, 15 aa, Borrelia burgdorferi B31 Seq3
FGIKLITKSLRPYPI

SEQ ID NO: 126992 - protein, 9 aa, Borrelia burgdorferi B31 Seq3
IKLITKSLR

SEQ ID NO: 126993 - protein, 15 aa, Borrelia burgdorferi B31 Seq3
GIKLITKSLRPYPIE

SEQ ID NO: 126994 - protein, 9 aa, Borrelia burgdorferi B31 Seq3
IKLITKSLR

SEQ ID NO: 126995 - protein, 15 aa, Borrelia burgdorferi B31 Seq3
IKLITKSLRPYPIEG

SEQ ID NO: 126996 - protein, 9 aa, Borrelia burgdorferi B31 Seq3
IKLITKSLR

SEQ ID NO: 126997 - protein, 15 aa, Borrelia burgdorferi B31 Seq3
TSIIKDIGKVIYSIS

SEQ ID NO: 126998 - protein, 9 aa, Borrelia burgdorferi B31 Seq3
IKDIGKVIY

SEQ ID NO: 126999 - protein, 15 aa, Borrelia burgdorferi B31 Seq3
SIIKDIGKVIYSISS

SEQ ID NO: 127000 - protein, 9 aa, Borrelia burgdorferi B31 Seq3
IKDIGKVIY

SEQ ID NO: 127001 - protein, 15 aa, Borrelia burgdorferi B31 Seq3
IKDIGKVIYSISSEY

SEQ ID NO: 127002 - protein, 9 aa, Borrelia burgdorferi B31 Seq3
IGKVIYSIS

SEQ ID NO: 127003 - protein, 15 aa, Borrelia burgdorferi B31 Seq3
NVITSIIKDIGKVIY

SEQ ID NO: 127004 - protein, 9 aa, Borrelia burgdorferi B31 Seq3
ITSIIKDIG

SEQ ID NO: 127005 - protein, 15 aa, Borrelia burgdorferi B31 Seq3
SSEYINNRVFKGGII

SEQ ID NO: 127006 - protein, 9 aa, Borrelia burgdorferi B31 Seq3
YINNRVFKG

SEQ ID NO: 127007 - protein, 15 aa, Borrelia burgdorferi B31 Seq3
IIKDIGKVIYSISSE

SEQ ID NO: 127008 - protein, 9 aa, Borrelia burgdorferi B31 Seq3
IGKVIYSIS

SEQ ID NO: 127009 - protein, 15 aa, Borrelia burgdorferi B31 Seq3
SEYINNRVFKGGIII

SEQ ID NO: 127010 - protein, 9 aa, Borrelia burgdorferi B31 Seq3
YINNRVFKG

SEQ ID NO: 127011 - protein, 15 aa, Borrelia burgdorferi B31 Seq3
ISSEYINNRVFKGGI

SEQ ID NO: 127012 - protein, 9 aa, Borrelia burgdorferi B31 Seq3
YINNRVFKG

SEQ ID NO: 127013 - protein, 15 aa, Borrelia burgdorferi B31 Seq3
VITSIIKDIGKVIYS

SEQ ID NO: 127014 - protein, 9 aa, Borrelia burgdorferi B31 Seq3
IKDIGKVIY

SEQ ID NO: 127015 - protein, 15 aa, Borrelia burgdorferi B31 Seq3
SISSEYINNRVFKGG

SEQ ID NO: 127016 - protein, 9 aa, Borrelia burgdorferi B31 Seq3
YINNRVFKG

SEQ ID NO: 127017 - protein, 15 aa, Borrelia burgdorferi B31 Seq3
ITSIIKDIGKVIYSI

SEQ ID NO: 127018 - protein, 9 aa, Borrelia burgdorferi B31 Seq3
IKDIGKVIY

SEQ ID NO: 127019 - protein, 15 aa, Borrelia burgdorferi B31 Seq3
DAYEVQKNPLNLFWL

SEQ ID NO: 127020 - protein, 9 aa, Borrelia burgdorferi B31 Seq3
VQKNPLNLF

SEQ ID NO: 127021 - protein, 15 aa, Borrelia burgdorferi B31 Seq3
AYEVQKNPLNLFWLI

SEQ ID NO: 127022 - protein, 9 aa, Borrelia burgdorferi B31 Seq3
VQKNPLNLF

SEQ ID NO: 127023 - protein, 15 aa, Borrelia burgdorferi B31 Seq3
YEVQKNPLNLFWLIG

SEQ ID NO: 127024 - protein, 9 aa, Borrelia burgdorferi B31 Seq3
VQKNPLNLF

SEQ ID NO: 127025 - protein, 15 aa, Borrelia burgdorferi B31 Seq3
TEDAYEVQKNPLNLF

SEQ ID NO: 127026 - protein, 9 aa, Borrelia burgdorferi B31 Seq3
YEVQKNPLN

SEQ ID NO: 127027 - protein, 15 aa, Borrelia burgdorferi B31 Seq3
EDAYEVQKNPLNLFW

SEQ ID NO: 127028 - protein, 9 aa, Borrelia burgdorferi B31 Seq3
VQKNPLNLF

SEQ ID NO: 127029 - protein, 15 aa, Borrelia burgdorferi B31 Seq3
FKRFIFITLSLLVFA

SEQ ID NO: 127030 - protein, 9 aa, Borrelia burgdorferi B31 Seq3
FITLSLLVF

SEQ ID NO: 127031 - protein, 15 aa, Borrelia burgdorferi B31 Seq3
IAPQNVITSIIKDIG

SEQ ID NO: 127032 - protein, 9 aa, Borrelia burgdorferi B31 Seq3
PQNVITSII

SEQ ID NO: 127033 - protein, 15 aa, Borrelia burgdorferi B31 Seq3
MFKRFIFITLSLLVF

SEQ ID NO: 127034 - protein, 9 aa, Borrelia burgdorferi B31 Seq3
FIFITLSLL

SEQ ID NO: 127035 - protein, 15 aa, Borrelia burgdorferi B31 Seq3
YSISSEYINNRVFKG

SEQ ID NO: 127036 - protein, 9 aa, Borrelia burgdorferi B31 Seq3
EYINNRVFK

SEQ ID NO: 127037 - protein, 15 aa, Borrelia burgdorferi B31 Seq3
KDIGKVIYSISSEYI

SEQ ID NO: 127038 - protein, 9 aa, Borrelia burgdorferi B31 Seq3
IGKVIYSIS

SEQ ID NO: 127039 - protein, 15 aa, Borrelia burgdorferi B31 Seq3
RFIFITLSLLVFACF

SEQ ID NO: 127040 - protein, 9 aa, Borrelia burgdorferi B31 Seq3
FITLSLLVF

SEQ ID NO: 127041 - protein, 15 aa, Borrelia burgdorferi B31 Seq3
KRFIFITLSLLVFAC

SEQ ID NO: 127042 - protein, 9 aa, Borrelia burgdorferi B31 Seq3
FITLSLLVF

SEQ ID NO: 127043 - protein, 15 aa, Borrelia burgdorferi B31 Seq3
LVFACFKSNKKSIKS

SEQ ID NO: 127044 - protein, 9 aa, Borrelia burgdorferi B31 Seq3
FKSNKKSIK

SEQ ID NO: 127045 - protein, 15 aa, Borrelia burgdorferi B31 Seq3
EVQKNPLNLFWLIGY

SEQ ID NO: 127046 - protein, 9 aa, Borrelia burgdorferi B31 Seq3
VQKNPLNLF

SEQ ID NO: 127047 - protein, 15 aa, Borrelia burgdorferi B31 Seq3
LLVFACFKSNKKSIK

SEQ ID NO: 127048 - protein, 9 aa, Borrelia burgdorferi B31 Seq3
FACFKSNKK

SEQ ID NO: 127049 - protein, 15 aa, Borrelia burgdorferi B31 Seq3
VFACFKSNKKSIKSD

SEQ ID NO: 127050 - protein, 9 aa, Borrelia burgdorferi B31 Seq3
FKSNKKSIK

SEQ ID NO: 127051 - protein, 15 aa, Borrelia burgdorferi B31 Seq3
FACFKSNKKSIKSDK

SEQ ID NO: 127052 - protein, 9 aa, Borrelia burgdorferi B31 Seq3
FKSNKKSIK

SEQ ID NO: 127053 - protein, 15 aa, Borrelia burgdorferi B31 Seq3
VQKNPLNLFWLIGYR

SEQ ID NO: 127054 - protein, 9 aa, Borrelia burgdorferi B31 Seq3
VQKNPLNLF

SEQ ID NO: 127055 - protein, 15 aa, Borrelia burgdorferi B31 Seq3
ACFKSNKKSIKSDKV

SEQ ID NO: 127056 - protein, 9 aa, Borrelia burgdorferi B31 Seq3
FKSNKKSIK

SEQ ID NO: 127057 - protein, 15 aa, Borrelia burgdorferi B31 Seq3
EYINNRVFKGGIIID

SEQ ID NO: 127058 - protein, 9 aa, Borrelia burgdorferi B31 Seq3
YINNRVFKG

SEQ ID NO: 127059 - protein, 15 aa, Borrelia burgdorferi B31 Seq3
VKLRDNFGIKLITKS

SEQ ID NO: 127060 - protein, 9 aa, Borrelia burgdorferi B31 Seq3
LRDNFGIKL

SEQ ID NO: 127061 - protein, 15 aa, Borrelia burgdorferi B31 Seq3
FIFITLSLLVFACFK

SEQ ID NO: 127062 - protein, 9 aa, Borrelia burgdorferi B31 Seq3
FITLSLLVF

SEQ ID NO: 127063 - protein, 15 aa, Borrelia burgdorferi B31 Seq3
KNPLNLFWLIGYRFS

SEQ ID NO: 127064 - protein, 9 aa, Borrelia burgdorferi B31 Seq3
LFWLIGYRF

SEQ ID NO: 127065 - protein, 15 aa, Borrelia burgdorferi B31 Seq3
YIAPQNVITSIIKDI

SEQ ID NO: 127066 - protein, 9 aa, Borrelia burgdorferi B31 Seq3
PQNVITSII

SEQ ID NO: 127067 - protein, 15 aa, Borrelia burgdorferi B31 Seq3
QSYIAPQNVITSIIK

SEQ ID NO: 127068 - protein, 9 aa, Borrelia burgdorferi B31 Seq3
PQNVITSII

SEQ ID NO: 127069 - protein, 15 aa, Borrelia burgdorferi B31 Seq3
KLRDNFGIKLITKSL

SEQ ID NO: 127070 - protein, 9 aa, Borrelia burgdorferi B31 Seq3
FGIKLITKS

SEQ ID NO: 127071 - protein, 15 aa, Borrelia burgdorferi B31 Seq3
NPLNLFWLIGYRFSD

SEQ ID NO: 127072 - protein, 9 aa, Borrelia burgdorferi B31 Seq3
LFWLIGYRF

SEQ ID NO: 127073 - protein, 15 aa, Borrelia burgdorferi B31 Seq3
FKAGIFYANPKLRLV

SEQ ID NO: 127074 - protein, 9 aa, Borrelia burgdorferi B31 Seq3
AGIFYANPK

SEQ ID NO: 127075 - protein, 15 aa, Borrelia burgdorferi B31 Seq3
SYIAPQNVITSIIKD

SEQ ID NO: 127076 - protein, 9 aa, Borrelia burgdorferi B31 Seq3
PQNVITSII

SEQ ID NO: 127077 - protein, 15 aa, Borrelia burgdorferi B31 Seq3
DQSYIAPQNVITSII

SEQ ID NO: 127078 - protein, 9 aa, Borrelia burgdorferi B31 Seq3
IAPQNVITS

SEQ ID NO: 127079 - protein, 15 aa, Borrelia burgdorferi B31 Seq3
QNVITSIIKDIGKVI

SEQ ID NO: 127080 - protein, 9 aa, Borrelia burgdorferi B31 Seq3
ITSIIKDIG

SEQ ID NO: 127081 - protein, 15 aa, Borrelia burgdorferi B31 Seq3
APQNVITSIIKDIGK

SEQ ID NO: 127082 - protein, 9 aa, Borrelia burgdorferi B31 Seq3
PQNVITSII

SEQ ID NO: 127083 - protein, 15 aa, Borrelia burgdorferi B31 Seq3
LNLFWLIGYRFSDLS

SEQ ID NO: 127084 - protein, 9 aa, Borrelia burgdorferi B31 Seq3
LFWLIGYRF

SEQ ID NO: 127085 - protein, 15 aa, Borrelia burgdorferi B31 Seq3
DIGKVIYSISSEYIN

SEQ ID NO: 127086 - protein, 9 aa, Borrelia burgdorferi B31 Seq3
IGKVIYSIS

SEQ ID NO: 127087 - protein, 15 aa, Borrelia burgdorferi B31 Seq3
NPKLRLVSKKAPSLF

SEQ ID NO: 127088 - protein, 9 aa, Borrelia burgdorferi B31 Seq3
LRLVSKKAP

SEQ ID NO: 127089 - protein, 15 aa, Borrelia burgdorferi B31 Seq3
PKLRLVSKKAPSLFD

SEQ ID NO: 127090 - protein, 9 aa, Borrelia burgdorferi B31 Seq3
LRLVSKKAP

SEQ ID NO: 127091 - protein, 15 aa, Borrelia burgdorferi B31 Seq3
PQNVITSIIKDIGKV

SEQ ID NO: 127092 - protein, 9 aa, Borrelia burgdorferi B31 Seq3
PQNVITSII

SEQ ID NO: 127093 - protein, 15 aa, Borrelia burgdorferi B31 Seq3
IGKVIYSISSEYINN

SEQ ID NO: 127094 - protein, 9 aa, Borrelia burgdorferi B31 Seq3
IGKVIYSIS

SEQ ID NO: 127095 - protein, 15 aa, Borrelia burgdorferi B31 Seq3
YINNRVFKGGIIIDR

SEQ ID NO: 127096 - protein, 9 aa, Borrelia burgdorferi B31 Seq3
YINNRVFKG

SEQ ID NO: 127097 - protein, 15 aa, Borrelia burgdorferi B31 Seq3
QKNPLNLFWLIGYRF

SEQ ID NO: 127098 - protein, 9 aa, Borrelia burgdorferi B31 Seq3
LNLFWLIGY

SEQ ID NO: 127099 - protein, 15 aa, Borrelia burgdorferi B31 Seq3
KAGIFYANPKLRLVS

SEQ ID NO: 127100 - protein, 9 aa, Borrelia burgdorferi B31 Seq3
YANPKLRLV

SEQ ID NO: 127101 - protein, 15 aa, Borrelia burgdorferi B31 Seq3
FYANPKLRLVSKKAP

SEQ ID NO: 127102 - protein, 9 aa, Borrelia burgdorferi B31 Seq3
YANPKLRLV

SEQ ID NO: 127103 - protein, 15 aa, Borrelia burgdorferi B31 Seq3
AGIFYANPKLRLVSK

SEQ ID NO: 127104 - protein, 9 aa, Borrelia burgdorferi B31 Seq3
YANPKLRLV

SEQ ID NO: 127105 - protein, 15 aa, Borrelia burgdorferi B31 Seq3
PLNLFWLIGYRFSDL

SEQ ID NO: 127106 - protein, 9 aa, Borrelia burgdorferi B31 Seq3
LFWLIGYRF

SEQ ID NO: 127107 - protein, 15 aa, Borrelia burgdorferi B31 Seq3
YANPKLRLVSKKAPS

SEQ ID NO: 127108 - protein, 9 aa, Borrelia burgdorferi B31 Seq3
LRLVSKKAP

SEQ ID NO: 127109 - protein, 15 aa, Borrelia burgdorferi B31 Seq3
IFITLSLLVFACFKS

SEQ ID NO: 127110 - protein, 9 aa, Borrelia burgdorferi B31 Seq3
FITLSLLVF

SEQ ID NO: 127111 - protein, 15 aa, Borrelia burgdorferi B31 Seq3
ANPKLRLVSKKAPSL

SEQ ID NO: 127112 - protein, 9 aa, Borrelia burgdorferi B31 Seq3
LRLVSKKAP

SEQ ID NO: 127113 - protein, 15 aa, Borrelia burgdorferi B31 Seq3
EVIDLENKIISGEII

SEQ ID NO: 127114 - protein, 9 aa, Borrelia burgdorferi B31 Seq3
LENKIISGE

SEQ ID NO: 127115 - protein, 15 aa, Borrelia burgdorferi B31 Seq3
GIFYANPKLRLVSKK

SEQ ID NO: 127116 - protein, 9 aa, Borrelia burgdorferi B31 Seq3
FYANPKLRL

SEQ ID NO: 127117 - protein, 15 aa, Borrelia burgdorferi B31 Seq3
GFKAGIFYANPKLRL

SEQ ID NO: 127118 - protein, 9 aa, Borrelia burgdorferi B31 Seq3
IFYANPKLR

SEQ ID NO: 127119 - protein, 15 aa, Borrelia burgdorferi B31 Seq3
DKVGVIFPIAGITGL

SEQ ID NO: 127120 - protein, 9 aa, Borrelia burgdorferi B31 Seq3
VGVIFPIAG

SEQ ID NO: 127121 - protein, 15 aa, Borrelia burgdorferi B31 Seq3
KLRLVSKKAPSLFDK

SEQ ID NO: 127122 - protein, 9 aa, Borrelia burgdorferi B31 Seq3
LRLVSKKAP

SEQ ID NO: 127123 - protein, 15 aa, Borrelia burgdorferi B31 Seq3
CFKSNKKSIKSDKVV

SEQ ID NO: 127124 - protein, 9 aa, Borrelia burgdorferi B31 Seq3
FKSNKKSIK

SEQ ID NO: 127125 - protein, 15 aa, Borrelia burgdorferi B31 Seq3
KNPLNLFWLIGYRFS

SEQ ID NO: 127126 - protein, 9 aa, Borrelia burgdorferi B31 Seq3
NLFWLIGYR

SEQ ID NO: 127127 - protein, 15 aa, Borrelia burgdorferi B31 Seq3
QKNPLNLFWLIGYRF

SEQ ID NO: 127128 - protein, 9 aa, Borrelia burgdorferi B31 Seq3
NLFWLIGYR

SEQ ID NO: 127129 - protein, 15 aa, Borrelia burgdorferi B31 Seq3
VQKNPLNLFWLIGYR

SEQ ID NO: 127130 - protein, 9 aa, Borrelia burgdorferi B31 Seq3
LNLFWLIGY

SEQ ID NO: 127131 - protein, 15 aa, Borrelia burgdorferi B31 Seq3
LFWLIGYRFSDLSVK

SEQ ID NO: 127132 - protein, 9 aa, Borrelia burgdorferi B31 Seq3
GYRFSDLSV

SEQ ID NO: 127133 - protein, 15 aa, Borrelia burgdorferi B31 Seq3
NPLNLFWLIGYRFSD

SEQ ID NO: 127134 - protein, 9 aa, Borrelia burgdorferi B31 Seq3
NLFWLIGYR

SEQ ID NO: 127135 - protein, 15 aa, Borrelia burgdorferi B31 Seq3
FWLIGYRFSDLSVKL

SEQ ID NO: 127136 - protein, 9 aa, Borrelia burgdorferi B31 Seq3
YRFSDLSVK

SEQ ID NO: 127137 - protein, 15 aa, Borrelia burgdorferi B31 Seq3
PLNLFWLIGYRFSDL

SEQ ID NO: 127138 - protein, 9 aa, Borrelia burgdorferi B31 Seq3
NLFWLIGYR

SEQ ID NO: 127139 - protein, 15 aa, Borrelia burgdorferi B31 Seq3
WLIGYRFSDLSVKLS

SEQ ID NO: 127140 - protein, 9 aa, Borrelia burgdorferi B31 Seq3
YRFSDLSVK

SEQ ID NO: 127141 - protein, 15 aa, Borrelia burgdorferi B31 Seq3
LIGYRFSDLSVKLSY

SEQ ID NO: 127142 - protein, 9 aa, Borrelia burgdorferi B31 Seq3
YRFSDLSVK

SEQ ID NO: 127143 - protein, 15 aa, Borrelia burgdorferi B31 Seq3
DNFGIKLITKSLRPY

SEQ ID NO: 127144 - protein, 9 aa, Borrelia burgdorferi B31 Seq3
IKLITKSLR

SEQ ID NO: 127145 - protein, 15 aa, Borrelia burgdorferi B31 Seq3
MFKRFIFITLSLLVF

SEQ ID NO: 127146 - protein, 9 aa, Borrelia burgdorferi B31 Seq3
IFITLSLLV

SEQ ID NO: 127147 - protein, 15 aa, Borrelia burgdorferi B31 Seq3
NFGIKLITKSLRPYP

SEQ ID NO: 127148 - protein, 9 aa, Borrelia burgdorferi B31 Seq3
IKLITKSLR

SEQ ID NO: 127149 - protein, 15 aa, Borrelia burgdorferi B31 Seq3
FKRFIFITLSLLVFA

SEQ ID NO: 127150 - protein, 9 aa, Borrelia burgdorferi B31 Seq3
IFITLSLLV

SEQ ID NO: 127151 - protein, 15 aa, Borrelia burgdorferi B31 Seq3
GYRFSDLSVKLSYER

SEQ ID NO: 127152 - protein, 9 aa, Borrelia burgdorferi B31 Seq3
YRFSDLSVK

SEQ ID NO: 127153 - protein, 15 aa, Borrelia burgdorferi B31 Seq3
LNLFWLIGYRFSDLS

SEQ ID NO: 127154 - protein, 9 aa, Borrelia burgdorferi B31 Seq3
NLFWLIGYR

SEQ ID NO: 127155 - protein, 15 aa, Borrelia burgdorferi B31 Seq3
FGIKLITKSLRPYPI

SEQ ID NO: 127156 - protein, 9 aa, Borrelia burgdorferi B31 Seq3
IKLITKSLR

SEQ ID NO: 127157 - protein, 15 aa, Borrelia burgdorferi B31 Seq3
KRFIFITLSLLVFAC

SEQ ID NO: 127158 - protein, 9 aa, Borrelia burgdorferi B31 Seq3
IFITLSLLV

SEQ ID NO: 127159 - protein, 15 aa, Borrelia burgdorferi B31 Seq3
IGYRFSDLSVKLSYE

SEQ ID NO: 127160 - protein, 9 aa, Borrelia burgdorferi B31 Seq3
YRFSDLSVK

SEQ ID NO: 127161 - protein, 15 aa, Borrelia burgdorferi B31 Seq3
YRFSDLSVKLSYERP

SEQ ID NO: 127162 - protein, 9 aa, Borrelia burgdorferi B31 Seq3
LSVKLSYER

SEQ ID NO: 127163 - protein, 15 aa, Borrelia burgdorferi B31 Seq3
RDNFGIKLITKSLRP

SEQ ID NO: 127164 - protein, 9 aa, Borrelia burgdorferi B31 Seq3
IKLITKSLR

SEQ ID NO: 127165 - protein, 15 aa, Borrelia burgdorferi B31 Seq3
LRDNFGIKLITKSLR

SEQ ID NO: 127166 - protein, 9 aa, Borrelia burgdorferi B31 Seq3
NFGIKLITK

SEQ ID NO: 127167 - protein, 15 aa, Borrelia burgdorferi B31 Seq3
NLFWLIGYRFSDLSV

SEQ ID NO: 127168 - protein, 9 aa, Borrelia burgdorferi B31 Seq3
NLFWLIGYR

SEQ ID NO: 127169 - protein, 15 aa, Borrelia burgdorferi B31 Seq3
SLRPYPIEGKRLLTV

SEQ ID NO: 127170 - protein, 9 aa, Borrelia burgdorferi B31 Seq3
LRPYPIEGK

SEQ ID NO: 127171 - protein, 15 aa, Borrelia burgdorferi B31 Seq3
LRPYPIEGKRLLTVD

SEQ ID NO: 127172 - protein, 9 aa, Borrelia burgdorferi B31 Seq3
IEGKRLLTV

SEQ ID NO: 127173 - protein, 15 aa, Borrelia burgdorferi B31 Seq3
YINNRVFKGGIIIDR

SEQ ID NO: 127174 - protein, 9 aa, Borrelia burgdorferi B31 Seq3
NRVFKGGII

SEQ ID NO: 127175 - protein, 15 aa, Borrelia burgdorferi B31 Seq3
RFIFITLSLLVFACF

SEQ ID NO: 127176 - protein, 9 aa, Borrelia burgdorferi B31 Seq3
IFITLSLLV

SEQ ID NO: 127177 - protein, 15 aa, Borrelia burgdorferi B31 Seq3
IFITLSLLVFACFKS

SEQ ID NO: 127178 - protein, 9 aa, Borrelia burgdorferi B31 Seq3
IFITLSLLV

SEQ ID NO: 127179 - protein, 15 aa, Borrelia burgdorferi B31 Seq3
LSLLVFACFKSNKKS

SEQ ID NO: 127180 - protein, 9 aa, Borrelia burgdorferi B31 Seq3
LLVFACFKS

SEQ ID NO: 127181 - protein, 15 aa, Borrelia burgdorferi B31 Seq3
ANPKLRLVSKKAPSL

SEQ ID NO: 127182 - protein, 9 aa, Borrelia burgdorferi B31 Seq3
LRLVSKKAP

SEQ ID NO: 127183 - protein, 15 aa, Borrelia burgdorferi B31 Seq3
NPKLRLVSKKAPSLF

SEQ ID NO: 127184 - protein, 9 aa, Borrelia burgdorferi B31 Seq3
LVSKKAPSL

SEQ ID NO: 127185 - protein, 15 aa, Borrelia burgdorferi B31 Seq3
INNRVFKGGIIIDRG

SEQ ID NO: 127186 - protein, 9 aa, Borrelia burgdorferi B31 Seq3
FKGGIIIDR

SEQ ID NO: 127187 - protein, 15 aa, Borrelia burgdorferi B31 Seq3
IKLITKSLRPYPIEG

SEQ ID NO: 127188 - protein, 9 aa, Borrelia burgdorferi B31 Seq3
LITKSLRPY

SEQ ID NO: 127189 - protein, 15 aa, Borrelia burgdorferi B31 Seq3
TLSLLVFACFKSNKK

SEQ ID NO: 127190 - protein, 9 aa, Borrelia burgdorferi B31 Seq3
LLVFACFKS

SEQ ID NO: 127191 - protein, 15 aa, Borrelia burgdorferi B31 Seq3
PYPIEGKRLLTVDEA

SEQ ID NO: 127192 - protein, 9 aa, Borrelia burgdorferi B31 Seq3
IEGKRLLTV

SEQ ID NO: 127193 - protein, 15 aa, Borrelia burgdorferi B31 Seq3
RPYPIEGKRLLTVDE

SEQ ID NO: 127194 - protein, 9 aa, Borrelia burgdorferi B31 Seq3
IEGKRLLTV

SEQ ID NO: 127195 - protein, 15 aa, Borrelia burgdorferi B31 Seq3
GIKLITKSLRPYPIE

SEQ ID NO: 127196 - protein, 9 aa, Borrelia burgdorferi B31 Seq3
LITKSLRPY

SEQ ID NO: 127197 - protein, 15 aa, Borrelia burgdorferi B31 Seq3
YPIEGKRLLTVDEAM

SEQ ID NO: 127198 - protein, 9 aa, Borrelia burgdorferi B31 Seq3
IEGKRLLTV

SEQ ID NO: 127199 - protein, 15 aa, Borrelia burgdorferi B31 Seq3
LLVFACFKSNKKSIK

SEQ ID NO: 127200 - protein, 9 aa, Borrelia burgdorferi B31 Seq3
FACFKSNKK

SEQ ID NO: 127201 - protein, 15 aa, Borrelia burgdorferi B31 Seq3
SLLVFACFKSNKKSI

SEQ ID NO: 127202 - protein, 9 aa, Borrelia burgdorferi B31 Seq3
FACFKSNKK

SEQ ID NO: 127203 - protein, 15 aa, Borrelia burgdorferi B31 Seq3
PKLRLVSKKAPSLFD

SEQ ID NO: 127204 - protein, 9 aa, Borrelia burgdorferi B31 Seq3
LVSKKAPSL

SEQ ID NO: 127205 - protein, 15 aa, Borrelia burgdorferi B31 Seq3
KAGIFYANPKLRLVS

SEQ ID NO: 127206 - protein, 9 aa, Borrelia burgdorferi B31 Seq3
IFYANPKLR

SEQ ID NO: 127207 - protein, 15 aa, Borrelia burgdorferi B31 Seq3
RFIFITLSLLVFACF

SEQ ID NO: 127208 - protein, 9 aa, Borrelia burgdorferi B31 Seq3
FITLSLLVF

SEQ ID NO: 127209 - protein, 15 aa, Borrelia burgdorferi B31 Seq3
FIFITLSLLVFACFK

SEQ ID NO: 127210 - protein, 9 aa, Borrelia burgdorferi B31 Seq3
LSLLVFACF

SEQ ID NO: 127211 - protein, 15 aa, Borrelia burgdorferi B31 Seq3
FITLSLLVFACFKSN

SEQ ID NO: 127212 - protein, 9 aa, Borrelia burgdorferi B31 Seq3
LSLLVFACF

SEQ ID NO: 127213 - protein, 15 aa, Borrelia burgdorferi B31 Seq3
IFITLSLLVFACFKS

SEQ ID NO: 127214 - protein, 9 aa, Borrelia burgdorferi B31 Seq3
LSLLVFACF

SEQ ID NO: 127215 - protein, 15 aa, Borrelia burgdorferi B31 Seq3
ITLSLLVFACFKSNK

SEQ ID NO: 127216 - protein, 9 aa, Borrelia burgdorferi B31 Seq3
LSLLVFACF

SEQ ID NO: 127217 - protein, 15 aa, Borrelia burgdorferi B31 Seq3
NPKLRLVSKKAPSLF

SEQ ID NO: 127218 - protein, 9 aa, Borrelia burgdorferi B31 Seq3
LRLVSKKAP

SEQ ID NO: 127219 - protein, 15 aa, Borrelia burgdorferi B31 Seq3
PKLRLVSKKAPSLFD

SEQ ID NO: 127220 - protein, 9 aa, Borrelia burgdorferi B31 Seq3
VSKKAPSLF

SEQ ID NO: 127221 - protein, 15 aa, Borrelia burgdorferi B31 Seq3
KLRLVSKKAPSLFDK

SEQ ID NO: 127222 - protein, 9 aa, Borrelia burgdorferi B31 Seq3
VSKKAPSLF

SEQ ID NO: 127223 - protein, 15 aa, Borrelia burgdorferi B31 Seq3
LRLVSKKAPSLFDKE

SEQ ID NO: 127224 - protein, 9 aa, Borrelia burgdorferi B31 Seq3
VSKKAPSLF

SEQ ID NO: 127225 - protein, 15 aa, Borrelia burgdorferi B31 Seq3
LSVKLSYERPDIYYG

SEQ ID NO: 127226 - protein, 9 aa, Borrelia burgdorferi B31 Seq3
LSYERPDIY

SEQ ID NO: 127227 - protein, 15 aa, Borrelia burgdorferi B31 Seq3
SDLSVKLSYERPDIY

SEQ ID NO: 127228 - protein, 9 aa, Borrelia burgdorferi B31 Seq3
LSVKLSYER

SEQ ID NO: 127229 - protein, 15 aa, Borrelia burgdorferi B31 Seq3
VKLSYERPDIYYGII

SEQ ID NO: 127230 - protein, 9 aa, Borrelia burgdorferi B31 Seq3
LSYERPDIY

SEQ ID NO: 127231 - protein, 15 aa, Borrelia burgdorferi B31 Seq3
SVKLSYERPDIYYGI

SEQ ID NO: 127232 - protein, 9 aa, Borrelia burgdorferi B31 Seq3
LSYERPDIY

SEQ ID NO: 127233 - protein, 15 aa, Borrelia burgdorferi B31 Seq3
DLSVKLSYERPDIYY

SEQ ID NO: 127234 - protein, 9 aa, Borrelia burgdorferi B31 Seq3
LSYERPDIY

SEQ ID NO: 127235 - protein, 15 aa, Borrelia burgdorferi B31 Seq3
RLVSKKAPSLFDKEK

SEQ ID NO: 127236 - protein, 9 aa, Borrelia burgdorferi B31 Seq3
VSKKAPSLF

SEQ ID NO: 127237 - protein, 15 aa, Borrelia burgdorferi B31 Seq3
TLSLLVFACFKSNKK

SEQ ID NO: 127238 - protein, 9 aa, Borrelia burgdorferi B31 Seq3
LSLLVFACF

SEQ ID NO: 127239 - protein, 15 aa, Borrelia burgdorferi B31 Seq3
LSLLVFACFKSNKKS

SEQ ID NO: 127240 - protein, 9 aa, Borrelia burgdorferi B31 Seq3
LSLLVFACF

SEQ ID NO: 127241 - protein, 15 aa, Borrelia burgdorferi B31 Seq3
TEDAYEVQKNPLNLF

SEQ ID NO: 127242 - protein, 9 aa, Borrelia burgdorferi B31 Seq3
YEVQKNPLN

SEQ ID NO: 127243 - protein, 15 aa, Borrelia burgdorferi B31 Seq3
EDAYEVQKNPLNLFW

SEQ ID NO: 127244 - protein, 9 aa, Borrelia burgdorferi B31 Seq3
VQKNPLNLF

SEQ ID NO: 127245 - protein, 15 aa, Borrelia burgdorferi B31 Seq3
DAYEVQKNPLNLFWL

SEQ ID NO: 127246 - protein, 9 aa, Borrelia burgdorferi B31 Seq3
VQKNPLNLF

SEQ ID NO: 127247 - protein, 15 aa, Borrelia burgdorferi B31 Seq3
AYEVQKNPLNLFWLI

SEQ ID NO: 127248 - protein, 9 aa, Borrelia burgdorferi B31 Seq3
VQKNPLNLF

SEQ ID NO: 127249 - protein, 15 aa, Borrelia burgdorferi B31 Seq3
FGIKLITKSLRPYPI

SEQ ID NO: 127250 - protein, 9 aa, Borrelia burgdorferi B31 Seq3
IKLITKSLR

SEQ ID NO: 127251 - protein, 15 aa, Borrelia burgdorferi B31 Seq3
AGYIAAKMSRKEKIG

SEQ ID NO: 127252 - protein, 9 aa, Borrelia burgdorferi B31 Seq3
YIAAKMSRK

SEQ ID NO: 127253 - protein, 15 aa, Borrelia burgdorferi B31 Seq3
FLAGYIAAKMSRKEK

SEQ ID NO: 127254 - protein, 9 aa, Borrelia burgdorferi B31 Seq3
YIAAKMSRK

SEQ ID NO: 127255 - protein, 15 aa, Borrelia burgdorferi B31 Seq3
LAGYIAAKMSRKEKI

SEQ ID NO: 127256 - protein, 9 aa, Borrelia burgdorferi B31 Seq3
YIAAKMSRK

SEQ ID NO: 127257 - protein, 15 aa, Borrelia burgdorferi B31 Seq3
AAFLAGYIAAKMSRK

SEQ ID NO: 127258 - protein, 9 aa, Borrelia burgdorferi B31 Seq3
GYIAAKMSR

SEQ ID NO: 127259 - protein, 15 aa, Borrelia burgdorferi B31 Seq3
AFLAGYIAAKMSRKE

SEQ ID NO: 127260 - protein, 9 aa, Borrelia burgdorferi B31 Seq3
YIAAKMSRK

SEQ ID NO: 127261 - protein, 15 aa, Borrelia burgdorferi B31 Seq3
KAGIFYANPKLRLVS

SEQ ID NO: 127262 - protein, 9 aa, Borrelia burgdorferi B31 Seq3
IFYANPKLR

SEQ ID NO: 127263 - protein, 15 aa, Borrelia burgdorferi B31 Seq3
FKAGIFYANPKLRLV

SEQ ID NO: 127264 - protein, 9 aa, Borrelia burgdorferi B31 Seq3
IFYANPKLR

SEQ ID NO: 127265 - protein, 15 aa, Borrelia burgdorferi B31 Seq3
AGIFYANPKLRLVSK

SEQ ID NO: 127266 - protein, 9 aa, Borrelia burgdorferi B31 Seq3
IFYANPKLR

SEQ ID NO: 127267 - protein, 15 aa, Borrelia burgdorferi B31 Seq3
FGFKAGIFYANPKLR

SEQ ID NO: 127268 - protein, 9 aa, Borrelia burgdorferi B31 Seq3
FKAGIFYAN

SEQ ID NO: 127269 - protein, 15 aa, Borrelia burgdorferi B31 Seq3
GFKAGIFYANPKLRL

SEQ ID NO: 127270 - protein, 9 aa, Borrelia burgdorferi B31 Seq3
IFYANPKLR

SEQ ID NO: 127271 - protein, 15 aa, Borrelia burgdorferi B31 Seq3
GYIAAKMSRKEKIGF

SEQ ID NO: 127272 - protein, 9 aa, Borrelia burgdorferi B31 Seq3
YIAAKMSRK

SEQ ID NO: 127273 - protein, 15 aa, Borrelia burgdorferi B31 Seq3
YIAAKMSRKEKIGFL

SEQ ID NO: 127274 - protein, 9 aa, Borrelia burgdorferi B31 Seq3
YIAAKMSRK

SEQ ID NO: 127275 - protein, 15 aa, Borrelia burgdorferi B31 Seq3
GIFYANPKLRLVSKK

SEQ ID NO: 127276 - protein, 9 aa, Borrelia burgdorferi B31 Seq3
IFYANPKLR

SEQ ID NO: 127277 - protein, 15 aa, Borrelia burgdorferi B31 Seq3
IFYANPKLRLVSKKA

SEQ ID NO: 127278 - protein, 9 aa, Borrelia burgdorferi B31 Seq3
IFYANPKLR

SEQ ID NO: 127279 - protein, 15 aa, Borrelia burgdorferi B31 Seq3
SLFDKEKGKAMALFM

SEQ ID NO: 127280 - protein, 9 aa, Borrelia burgdorferi B31 Seq3
FDKEKGKAM

SEQ ID NO: 127281 - protein, 15 aa, Borrelia burgdorferi B31 Seq3
KKAPSLFDKEKGKAM

SEQ ID NO: 127282 - protein, 9 aa, Borrelia burgdorferi B31 Seq3
KKAPSLFDK

SEQ ID NO: 127283 - protein, 15 aa, Borrelia burgdorferi B31 Seq3
PSLFDKEKGKAMALF

SEQ ID NO: 127284 - protein, 9 aa, Borrelia burgdorferi B31 Seq3
FDKEKGKAM

SEQ ID NO: 127285 - protein, 15 aa, Borrelia burgdorferi B31 Seq3
KAPSLFDKEKGKAMA

SEQ ID NO: 127286 - protein, 9 aa, Borrelia burgdorferi B31 Seq3
FDKEKGKAM

SEQ ID NO: 127287 - protein, 15 aa, Borrelia burgdorferi B31 Seq3
APSLFDKEKGKAMAL

SEQ ID NO: 127288 - protein, 9 aa, Borrelia burgdorferi B31 Seq3
FDKEKGKAM

SEQ ID NO: 127289 - protein, 15 aa, Borrelia burgdorferi B31
AFLAGYFASKASKTG

SEQ ID NO: 127290 - protein, 9 aa, Borrelia burgdorferi B31
YFASKASKT

SEQ ID NO: 127291 - protein, 15 aa, Borrelia burgdorferi B31
FLAGYFASKASKTGK

SEQ ID NO: 127292 - protein, 9 aa, Borrelia burgdorferi B31
FASKASKTG

SEQ ID NO: 127293 - protein, 15 aa, Borrelia burgdorferi B31
LAGYFASKASKTGKI

SEQ ID NO: 127294 - protein, 9 aa, Borrelia burgdorferi B31
FASKASKTG

SEQ ID NO: 127295 - protein, 15 aa, Borrelia burgdorferi B31
AGYFASKASKTGKIG

SEQ ID NO: 127296 - protein, 9 aa, Borrelia burgdorferi B31
FASKASKTG

SEQ ID NO: 127297 - protein, 15 aa, Borrelia burgdorferi B31
GYFASKASKTGKIGF

SEQ ID NO: 127298 - protein, 9 aa, Borrelia burgdorferi B31
FASKASKTG

SEQ ID NO: 127299 - protein, 15 aa, Borrelia burgdorferi B31
FGDFGLGRSTASNMY

SEQ ID NO: 127300 - protein, 9 aa, Borrelia burgdorferi B31
FGLGRSTAS

SEQ ID NO: 127301 - protein, 15 aa, Borrelia burgdorferi B31
TFGDFGLGRSTASNM

SEQ ID NO: 127302 - protein, 9 aa, Borrelia burgdorferi B31
FGLGRSTAS

SEQ ID NO: 127303 - protein, 15 aa, Borrelia burgdorferi B31
GTFGDFGLGRSTASN

SEQ ID NO: 127304 - protein, 9 aa, Borrelia burgdorferi B31
FGLGRSTAS

SEQ ID NO: 127305 - protein, 15 aa, Borrelia burgdorferi B31
GDFGLGRSTASNMYR

SEQ ID NO: 127306 - protein, 9 aa, Borrelia burgdorferi B31
FGLGRSTAS

SEQ ID NO: 127307 - protein, 15 aa, Borrelia burgdorferi B31
VGTFGDFGLGRSTAS

SEQ ID NO: 127308 - protein, 9 aa, Borrelia burgdorferi B31
DFGLGRSTA

SEQ ID NO: 127309 - protein, 15 aa, Borrelia burgdorferi B31
DGVDIIFAAAGLSGI

SEQ ID NO: 127310 - protein, 9 aa, Borrelia burgdorferi B31
IFAAAGLSG

SEQ ID NO: 127311 - protein, 15 aa, Borrelia burgdorferi B31
GVDIIFAAAGLSGIG

SEQ ID NO: 127312 - protein, 9 aa, Borrelia burgdorferi B31
IFAAAGLSG

SEQ ID NO: 127313 - protein, 15 aa, Borrelia burgdorferi B31
VDIIFAAAGLSGIGV

SEQ ID NO: 127314 - protein, 9 aa, Borrelia burgdorferi B31
IFAAAGLSG

SEQ ID NO: 127315 - protein, 15 aa, Borrelia burgdorferi B31
YFASKASKTGKIGFV

SEQ ID NO: 127316 - protein, 9 aa, Borrelia burgdorferi B31
FASKASKTG

SEQ ID NO: 127317 - protein, 15 aa, Borrelia burgdorferi B31
VAFLAGYFASKASKT

SEQ ID NO: 127318 - protein, 9 aa, Borrelia burgdorferi B31
LAGYFASKA

SEQ ID NO: 127319 - protein, 15 aa, Borrelia burgdorferi B31
DIIFAAAGLSGIGVI

SEQ ID NO: 127320 - protein, 9 aa, Borrelia burgdorferi B31
IFAAAGLSG

SEQ ID NO: 127321 - protein, 15 aa, Borrelia burgdorferi B31
RDGVDIIFAAAGLSG

SEQ ID NO: 127322 - protein, 9 aa, Borrelia burgdorferi B31
IIFAAAGLS

SEQ ID NO: 127323 - protein, 15 aa, Borrelia burgdorferi B31
SNLIWGIGFRLSDIL

SEQ ID NO: 127324 - protein, 9 aa, Borrelia burgdorferi B31
IWGIGFRLS

SEQ ID NO: 127325 - protein, 15 aa, Borrelia burgdorferi B31
NSNLIWGIGFRLSDI

SEQ ID NO: 127326 - protein, 9 aa, Borrelia burgdorferi B31
IWGIGFRLS

SEQ ID NO: 127327 - protein, 15 aa, Borrelia burgdorferi B31
GNSNLIWGIGFRLSD

SEQ ID NO: 127328 - protein, 9 aa, Borrelia burgdorferi B31
IWGIGFRLS

SEQ ID NO: 127329 - protein, 15 aa, Borrelia burgdorferi B31
DGNSNLIWGIGFRLS

SEQ ID NO: 127330 - protein, 9 aa, Borrelia burgdorferi B31
LIWGIGFRL

SEQ ID NO: 127331 - protein, 15 aa, Borrelia burgdorferi B31
DFGLGRSTASNMYRD

SEQ ID NO: 127332 - protein, 9 aa, Borrelia burgdorferi B31
FGLGRSTAS

SEQ ID NO: 127333 - protein, 15 aa, Borrelia burgdorferi B31
IIFAAAGLSGIGVIE

SEQ ID NO: 127334 - protein, 9 aa, Borrelia burgdorferi B31
FAAAGLSGI

SEQ ID NO: 127335 - protein, 15 aa, Borrelia burgdorferi B31
FGLGRSTASNMYRDG

SEQ ID NO: 127336 - protein, 9 aa, Borrelia burgdorferi B31
FGLGRSTAS

SEQ ID NO: 127337 - protein, 15 aa, Borrelia burgdorferi B31
IYNKSLKIGQSIMNG

SEQ ID NO: 127338 - protein, 9 aa, Borrelia burgdorferi B31
LKIGQSIMN

SEQ ID NO: 127339 - protein, 15 aa, Borrelia burgdorferi B31
EIYNKSLKIGQSIMN

SEQ ID NO: 127340 - protein, 9 aa, Borrelia burgdorferi B31
IYNKSLKIG

SEQ ID NO: 127341 - protein, 15 aa, Borrelia burgdorferi B31
FASKASKTGKIGFVG

SEQ ID NO: 127342 - protein, 9 aa, Borrelia burgdorferi B31
FASKASKTG

SEQ ID NO: 127343 - protein, 15 aa, Borrelia burgdorferi B31
NLIWGIGFRLSDILF

SEQ ID NO: 127344 - protein, 9 aa, Borrelia burgdorferi B31
IWGIGFRLS

SEQ ID NO: 127345 - protein, 15 aa, Borrelia burgdorferi B31
NKSLKIGQSIMNGII

SEQ ID NO: 127346 - protein, 9 aa, Borrelia burgdorferi B31
LKIGQSIMN

SEQ ID NO: 127347 - protein, 15 aa, Borrelia burgdorferi B31
YNKSLKIGQSIMNGI

SEQ ID NO: 127348 - protein, 9 aa, Borrelia burgdorferi B31
LKIGQSIMN

SEQ ID NO: 127349 - protein, 15 aa, Borrelia burgdorferi B31
TGVLDGGKTMFLGLK

SEQ ID NO: 127350 - protein, 9 aa, Borrelia burgdorferi B31
LDGGKTMFL

SEQ ID NO: 127351 - protein, 15 aa, Borrelia burgdorferi B31
KSLKIGQSIMNGIIK

SEQ ID NO: 127352 - protein, 9 aa, Borrelia burgdorferi B31
LKIGQSIMN

SEQ ID NO: 127353 - protein, 15 aa, Borrelia burgdorferi B31
GVLDGGKTMFLGLKE

SEQ ID NO: 127354 - protein, 9 aa, Borrelia burgdorferi B31
LDGGKTMFL

SEQ ID NO: 127355 - protein, 15 aa, Borrelia burgdorferi B31
LETGVLDGGKTMFLG

SEQ ID NO: 127356 - protein, 9 aa, Borrelia burgdorferi B31
LDGGKTMFL

SEQ ID NO: 127357 - protein, 15 aa, Borrelia burgdorferi B31
EEVAFLAGYFASKAS

SEQ ID NO: 127358 - protein, 9 aa, Borrelia burgdorferi B31
VAFLAGYFA

SEQ ID NO: 127359 - protein, 15 aa, Borrelia burgdorferi B31
YLETGVLDGGKTMFL

SEQ ID NO: 127360 - protein, 9 aa, Borrelia burgdorferi B31
TGVLDGGKT

SEQ ID NO: 127361 - protein, 15 aa, Borrelia burgdorferi B31
SEEVAFLAGYFASKA

SEQ ID NO: 127362 - protein, 9 aa, Borrelia burgdorferi B31
VAFLAGYFA

SEQ ID NO: 127363 - protein, 15 aa, Borrelia burgdorferi B31
ETGVLDGGKTMFLGL

SEQ ID NO: 127364 - protein, 8 aa, Borrelia burgdorferi B31
LDGGKTMF

SEQ ID NO: 127365 - protein, 15 aa, Borrelia burgdorferi B31
IFAAAGLSGIGVIEA

SEQ ID NO: 127366 - protein, 9 aa, Borrelia burgdorferi B31
IFAAAGLSG

SEQ ID NO: 127367 - protein, 15 aa, Borrelia burgdorferi B31
LSDILFQRASENVSV

SEQ ID NO: 127368 - protein, 9 aa, Borrelia burgdorferi B31
LFQRASENV

SEQ ID NO: 127369 - protein, 15 aa, Borrelia burgdorferi B31
EVAFLAGYFASKASK

SEQ ID NO: 127370 - protein, 9 aa, Borrelia burgdorferi B31
LAGYFASKA

SEQ ID NO: 127371 - protein, 15 aa, Borrelia burgdorferi B31
YRDGVDIIFAAAGLS

SEQ ID NO: 127372 - protein, 9 aa, Borrelia burgdorferi B31
VDIIFAAAG

SEQ ID NO: 127373 - protein, 15 aa, Borrelia burgdorferi B31
SDILFQRASENVSVN

SEQ ID NO: 127374 - protein, 9 aa, Borrelia burgdorferi B31
LFQRASENV

SEQ ID NO: 127375 - protein, 15 aa, Borrelia burgdorferi B31
DKGFNESSSKAIRKL

SEQ ID NO: 127376 - protein, 9 aa, Borrelia burgdorferi B31
FNESSSKAI

SEQ ID NO: 127377 - protein, 15 aa, Borrelia burgdorferi B31
LIWGIGFRLSDILFQ

SEQ ID NO: 127378 - protein, 9 aa, Borrelia burgdorferi B31
IWGIGFRLS

SEQ ID NO: 127379 - protein, 15 aa, Borrelia burgdorferi B31
RLSDILFQRASENVS

SEQ ID NO: 127380 - protein, 9 aa, Borrelia burgdorferi B31
LFQRASENV

SEQ ID NO: 127381 - protein, 15 aa, Borrelia burgdorferi B31
DDKGFNESSSKAIRK

SEQ ID NO: 127382 - protein, 9 aa, Borrelia burgdorferi B31
FNESSSKAI

SEQ ID NO: 127383 - protein, 15 aa, Borrelia burgdorferi B31
FDDKGFNESSSKAIR

SEQ ID NO: 127384 - protein, 9 aa, Borrelia burgdorferi B31
FNESSSKAI

SEQ ID NO: 127385 - protein, 15 aa, Borrelia burgdorferi B31
DILFQRASENVSVNY

SEQ ID NO: 127386 - protein, 9 aa, Borrelia burgdorferi B31
LFQRASENV

SEQ ID NO: 127387 - protein, 15 aa, Borrelia burgdorferi B31
AFDDKGFNESSSKAI

SEQ ID NO: 127388 - protein, 9 aa, Borrelia burgdorferi B31
GFNESSSKA

SEQ ID NO: 127389 - protein, 15 aa, Borrelia burgdorferi B31
IGFVGGVRGKVLESF

SEQ ID NO: 127390 - protein, 9 aa, Borrelia burgdorferi B31
VGGVRGKVL

SEQ ID NO: 127391 - protein, 15 aa, Borrelia burgdorferi B31
KGFNESSSKAIRKLK

SEQ ID NO: 127392 - protein, 9 aa, Borrelia burgdorferi B31
FNESSSKAI

SEQ ID NO: 127393 - protein, 15 aa, Borrelia burgdorferi B31
GFVGGVRGKVLESFM

SEQ ID NO: 127394 - protein, 9 aa, Borrelia burgdorferi B31
VGGVRGKVL

SEQ ID NO: 127395 - protein, 15 aa, Borrelia burgdorferi B31
FRLSDILFQRASENV

SEQ ID NO: 127396 - protein, 9 aa, Borrelia burgdorferi B31
LSDILFQRA

SEQ ID NO: 127397 - protein, 15 aa, Borrelia burgdorferi B31
LKIGQSIMNGIIKVP

SEQ ID NO: 127398 - protein, 9 aa, Borrelia burgdorferi B31
LKIGQSIMN

SEQ ID NO: 127399 - protein, 15 aa, Borrelia burgdorferi B31
LLNISFRSEEVAFLA

SEQ ID NO: 127400 - protein, 9 aa, Borrelia burgdorferi B31
FRSEEVAFL

SEQ ID NO: 127401 - protein, 15 aa, Borrelia burgdorferi B31
NLLNISFRSEEVAFL

SEQ ID NO: 127402 - protein, 9 aa, Borrelia burgdorferi B31
NISFRSEEV

SEQ ID NO: 127403 - protein, 15 aa, Borrelia burgdorferi B31
QDQSYLAPNNVIVSA

SEQ ID NO: 127404 - protein, 9 aa, Borrelia burgdorferi B31
LAPNNVIVS

SEQ ID NO: 127405 - protein, 15 aa, Borrelia burgdorferi B31
LNISFRSEEVAFLAG

SEQ ID NO: 127406 - protein, 9 aa, Borrelia burgdorferi B31
FRSEEVAFL

SEQ ID NO: 127407 - protein, 15 aa, Borrelia burgdorferi B31
NISFRSEEVAFLAGY

SEQ ID NO: 127408 - protein, 9 aa, Borrelia burgdorferi B31
FRSEEVAFL

SEQ ID NO: 127409 - protein, 15 aa, Borrelia burgdorferi B31
DQDQSYLAPNNVIVS

SEQ ID NO: 127410 - protein, 9 aa, Borrelia burgdorferi B31
YLAPNNVIV

SEQ ID NO: 127411 - protein, 15 aa, Borrelia burgdorferi B31
AKYANSNIKVVSQYV

SEQ ID NO: 127412 - protein, 9 aa, Borrelia burgdorferi B31
YANSNIKVV

SEQ ID NO: 127413 - protein, 15 aa, Borrelia burgdorferi B31
ISFRSEEVAFLAGYF

SEQ ID NO: 127414 - protein, 9 aa, Borrelia burgdorferi B31
FRSEEVAFL

SEQ ID NO: 127415 - protein, 15 aa, Borrelia burgdorferi B31
FRSEEVAFLAGYFAS

SEQ ID NO: 127416 - protein, 9 aa, Borrelia burgdorferi B31
VAFLAGYFA

SEQ ID NO: 127417 - protein, 15 aa, Borrelia burgdorferi B31
FAAAGLSGIGVIEAA

SEQ ID NO: 127418 - protein, 9 aa, Borrelia burgdorferi B31
FAAAGLSGI

SEQ ID NO: 127419 - protein, 15 aa, Borrelia burgdorferi B31
DQSYLAPNNVIVSAV

SEQ ID NO: 127420 - protein, 9 aa, Borrelia burgdorferi B31
LAPNNVIVS

SEQ ID NO: 127421 - protein, 15 aa, Borrelia burgdorferi B31
SFRSEEVAFLAGYFA

SEQ ID NO: 127422 - protein, 9 aa, Borrelia burgdorferi B31
FRSEEVAFL

SEQ ID NO: 127423 - protein, 15 aa, Borrelia burgdorferi B31
QSYLAPNNVIVSAVK

SEQ ID NO: 127424 - protein, 9 aa, Borrelia burgdorferi B31
LAPNNVIVS

SEQ ID NO: 127425 - protein, 15 aa, Borrelia burgdorferi B31
YSEIYNKSLKIGQSI

SEQ ID NO: 127426 - protein, 9 aa, Borrelia burgdorferi B31
IYNKSLKIG

SEQ ID NO: 127427 - protein, 15 aa, Borrelia burgdorferi B31
NYSEIYNKSLKIGQS

SEQ ID NO: 127428 - protein, 9 aa, Borrelia burgdorferi B31
IYNKSLKIG

SEQ ID NO: 127429 - protein, 15 aa, Borrelia burgdorferi B31
SNYSEIYNKSLKIGQ

SEQ ID NO: 127430 - protein, 9 aa, Borrelia burgdorferi B31
IYNKSLKIG

SEQ ID NO: 127431 - protein, 15 aa, Borrelia burgdorferi B31
YEAGAKYANSNIKVV

SEQ ID NO: 127432 - protein, 9 aa, Borrelia burgdorferi B31
AGAKYANSN

SEQ ID NO: 127433 - protein, 15 aa, Borrelia burgdorferi B31
SLKIGQSIMNGIIKV

SEQ ID NO: 127434 - protein, 9 aa, Borrelia burgdorferi B31
LKIGQSIMN

SEQ ID NO: 127435 - protein, 15 aa, Borrelia burgdorferi B31
VSAVKKVDSLMYSLT

SEQ ID NO: 127436 - protein, 9 aa, Borrelia burgdorferi B31
VKKVDSLMY

SEQ ID NO: 127437 - protein, 15 aa, Borrelia burgdorferi B31
SAVKKVDSLMYSLTK

SEQ ID NO: 127438 - protein, 9 aa, Borrelia burgdorferi B31
VKKVDSLMY

SEQ ID NO: 127439 - protein, 15 aa, Borrelia burgdorferi B31
ILFQRASENVSVNYA

SEQ ID NO: 127440 - protein, 9 aa, Borrelia burgdorferi B31
FQRASENVS

SEQ ID NO: 127441 - protein, 15 aa, Borrelia burgdorferi B31
KSNYSEIYNKSLKIG

SEQ ID NO: 127442 - protein, 9 aa, Borrelia burgdorferi B31
YSEIYNKSL

SEQ ID NO: 127443 - protein, 15 aa, Borrelia burgdorferi B31
FVGGVRGKVLESFMY

SEQ ID NO: 127444 - protein, 9 aa, Borrelia burgdorferi B31
VRGKVLESF

SEQ ID NO: 127445 - protein, 15 aa, Borrelia burgdorferi B31
RSEEVAFLAGYFASK

SEQ ID NO: 127446 - protein, 9 aa, Borrelia burgdorferi B31
VAFLAGYFA

SEQ ID NO: 127447 - protein, 15 aa, Borrelia burgdorferi B31
AGAKYANSNIKVVSQ

SEQ ID NO: 127448 - protein, 9 aa, Borrelia burgdorferi B31
YANSNIKVV

SEQ ID NO: 127449 - protein, 15 aa, Borrelia burgdorferi B31
VGGVRGKVLESFMYG

SEQ ID NO: 127450 - protein, 9 aa, Borrelia burgdorferi B31
VRGKVLESF

SEQ ID NO: 127451 - protein, 15 aa, Borrelia burgdorferi B31
YLAPNNVIVSAVKKV

SEQ ID NO: 127452 - protein, 9 aa, Borrelia burgdorferi B31
LAPNNVIVS

SEQ ID NO: 127453 - protein, 15 aa, Borrelia burgdorferi B31
EAGAKYANSNIKVVS

SEQ ID NO: 127454 - protein, 9 aa, Borrelia burgdorferi B31
YANSNIKVV

SEQ ID NO: 127455 - protein, 15 aa, Borrelia burgdorferi B31
VLDGGKTMFLGLKED

SEQ ID NO: 127456 - protein, 9 aa, Borrelia burgdorferi B31
LDGGKTMFL

SEQ ID NO: 127457 - protein, 15 aa, Borrelia burgdorferi B31
LDGGKTMFLGLKEDG

SEQ ID NO: 127458 - protein, 9 aa, Borrelia burgdorferi B31
LDGGKTMFL

SEQ ID NO: 127459 - protein, 15 aa, Borrelia burgdorferi B31
VDQDQSYLAPNNVIV

SEQ ID NO: 127460 - protein, 9 aa, Borrelia burgdorferi B31
VDQDQSYLA

SEQ ID NO: 127461 - protein, 15 aa, Borrelia burgdorferi B31
SEIYNKSLKIGQSIM

SEQ ID NO: 127462 - protein, 9 aa, Borrelia burgdorferi B31
IYNKSLKIG

SEQ ID NO: 127463 - protein, 15 aa, Borrelia burgdorferi B31
VIVSAVKKVDSLMYS

SEQ ID NO: 127464 - protein, 9 aa, Borrelia burgdorferi B31
VKKVDSLMY

SEQ ID NO: 127465 - protein, 15 aa, Borrelia burgdorferi B31
GAKYANSNIKVVSQY

SEQ ID NO: 127466 - protein, 9 aa, Borrelia burgdorferi B31
YANSNIKVV

SEQ ID NO: 127467 - protein, 15 aa, Borrelia burgdorferi B31
NVIVSAVKKVDSLMY

SEQ ID NO: 127468 - protein, 9 aa, Borrelia burgdorferi B31
VIVSAVKKV

SEQ ID NO: 127469 - protein, 15 aa, Borrelia burgdorferi B31
KIGFVGGVRGKVLES

SEQ ID NO: 127470 - protein, 9 aa, Borrelia burgdorferi B31
VGGVRGKVL

SEQ ID NO: 127471 - protein, 15 aa, Borrelia burgdorferi B31
IWGIGFRLSDILFQR

SEQ ID NO: 127472 - protein, 9 aa, Borrelia burgdorferi B31
IWGIGFRLS

SEQ ID NO: 127473 - protein, 15 aa, Borrelia burgdorferi B31
TGKIGFVGGVRGKVL

SEQ ID NO: 127474 - protein, 9 aa, Borrelia burgdorferi B31
IGFVGGVRG

SEQ ID NO: 127475 - protein, 15 aa, Borrelia burgdorferi B31
LAPNNVIVSAVKKVD

SEQ ID NO: 127476 - protein, 9 aa, Borrelia burgdorferi B31
VIVSAVKKV

SEQ ID NO: 127477 - protein, 15 aa, Borrelia burgdorferi B31
VKKVDSLMYSLTKKY

SEQ ID NO: 127478 - protein, 9 aa, Borrelia burgdorferi B31
VDSLMYSLT

SEQ ID NO: 127479 - protein, 15 aa, Borrelia burgdorferi B31
GKIGFVGGVRGKVLE

SEQ ID NO: 127480 - protein, 9 aa, Borrelia burgdorferi B31
VGGVRGKVL

SEQ ID NO: 127481 - protein, 15 aa, Borrelia burgdorferi B31
KKVDSLMYSLTKKYL

SEQ ID NO: 127482 - protein, 9 aa, Borrelia burgdorferi B31
LMYSLTKKY

SEQ ID NO: 127483 - protein, 15 aa, Borrelia burgdorferi B31
DSLMYSLTKKYLETG

SEQ ID NO: 127484 - protein, 9 aa, Borrelia burgdorferi B31
LMYSLTKKY

SEQ ID NO: 127485 - protein, 15 aa, Borrelia burgdorferi B31
SYLAPNNVIVSAVKK

SEQ ID NO: 127486 - protein, 9 aa, Borrelia burgdorferi B31
LAPNNVIVS

SEQ ID NO: 127487 - protein, 15 aa, Borrelia burgdorferi B31
LVLNENLKSNYSEIY

SEQ ID NO: 127488 - protein, 9 aa, Borrelia burgdorferi B31
NENLKSNYS

SEQ ID NO: 127489 - protein, 15 aa, Borrelia burgdorferi B31
GQSIMNGIIKVPYDK

SEQ ID NO: 127490 - protein, 9 aa, Borrelia burgdorferi B31
IMNGIIKVP

SEQ ID NO: 127491 - protein, 15 aa, Borrelia burgdorferi B31
LGLVLNENLKSNYSE

SEQ ID NO: 127492 - protein, 9 aa, Borrelia burgdorferi B31
NENLKSNYS

SEQ ID NO: 127493 - protein, 15 aa, Borrelia burgdorferi B31
KIGQSIMNGIIKVPY

SEQ ID NO: 127494 - protein, 9 aa, Borrelia burgdorferi B31
IMNGIIKVP

SEQ ID NO: 127495 - protein, 15 aa, Borrelia burgdorferi B31
IGQSIMNGIIKVPYD

SEQ ID NO: 127496 - protein, 9 aa, Borrelia burgdorferi B31
IMNGIIKVP

SEQ ID NO: 127497 - protein, 15 aa, Borrelia burgdorferi B31
GLGLVLNENLKSNYS

SEQ ID NO: 127498 - protein, 9 aa, Borrelia burgdorferi B31
LVLNENLKS

SEQ ID NO: 127499 - protein, 15 aa, Borrelia burgdorferi B31
VLNENLKSNYSEIYN

SEQ ID NO: 127500 - protein, 9 aa, Borrelia burgdorferi B31
LKSNYSEIY

SEQ ID NO: 127501 - protein, 15 aa, Borrelia burgdorferi B31
QSIMNGIIKVPYDKV

SEQ ID NO: 127502 - protein, 9 aa, Borrelia burgdorferi B31
IMNGIIKVP

SEQ ID NO: 127503 - protein, 15 aa, Borrelia burgdorferi B31
INIIEKASTGNSYLG

SEQ ID NO: 127504 - protein, 9 aa, Borrelia burgdorferi B31
IIEKASTGN

SEQ ID NO: 127505 - protein, 15 aa, Borrelia burgdorferi B31
YFLIFLFIVACSSSD

SEQ ID NO: 127506 - protein, 9 aa, Borrelia burgdorferi B31
FLFIVACSS

SEQ ID NO: 127507 - protein, 15 aa, Borrelia burgdorferi B31
FLIFLFIVACSSSDD

SEQ ID NO: 127508 - protein, 9 aa, Borrelia burgdorferi B31
FLFIVACSS

SEQ ID NO: 127509 - protein, 15 aa, Borrelia burgdorferi B31
SKAIRKLKADLNINI

SEQ ID NO: 127510 - protein, 9 aa, Borrelia burgdorferi B31
IRKLKADLN

SEQ ID NO: 127511 - protein, 15 aa, Borrelia burgdorferi B31
IVSAVKKVDSLMYSL

SEQ ID NO: 127512 - protein, 9 aa, Borrelia burgdorferi B31
VKKVDSLMY

SEQ ID NO: 127513 - protein, 15 aa, Borrelia burgdorferi B31
GFNESSSKAIRKLKA

SEQ ID NO: 127514 - protein, 9 aa, Borrelia burgdorferi B31
FNESSSKAI

SEQ ID NO: 127515 - protein, 15 aa, Borrelia burgdorferi B31
LIFLFIVACSSSDDG

SEQ ID NO: 127516 - protein, 9 aa, Borrelia burgdorferi B31
FLFIVACSS

SEQ ID NO: 127517 - protein, 15 aa, Borrelia burgdorferi B31
KAIRKLKADLNINII

SEQ ID NO: 127518 - protein, 9 aa, Borrelia burgdorferi B31
IRKLKADLN

SEQ ID NO: 127519 - protein, 15 aa, Borrelia burgdorferi B31
APNNVIVSAVKKVDS

SEQ ID NO: 127520 - protein, 9 aa, Borrelia burgdorferi B31
VIVSAVKKV

SEQ ID NO: 127521 - protein, 15 aa, Borrelia burgdorferi B31
PNNVIVSAVKKVDSL

SEQ ID NO: 127522 - protein, 9 aa, Borrelia burgdorferi B31
VIVSAVKKV

SEQ ID NO: 127523 - protein, 15 aa, Borrelia burgdorferi B31
DLNINIIEKASTGNS

SEQ ID NO: 127524 - protein, 9 aa, Borrelia burgdorferi B31
IIEKASTGN

SEQ ID NO: 127525 - protein, 15 aa, Borrelia burgdorferi B31
LNINIIEKASTGNSY

SEQ ID NO: 127526 - protein, 9 aa, Borrelia burgdorferi B31
IIEKASTGN

SEQ ID NO: 127527 - protein, 15 aa, Borrelia burgdorferi B31
IGVDQDQSYLAPNNV

SEQ ID NO: 127528 - protein, 9 aa, Borrelia burgdorferi B31
VDQDQSYLA

SEQ ID NO: 127529 - protein, 15 aa, Borrelia burgdorferi B31
NNVIVSAVKKVDSLM

SEQ ID NO: 127530 - protein, 9 aa, Borrelia burgdorferi B31
VIVSAVKKV

SEQ ID NO: 127531 - protein, 15 aa, Borrelia burgdorferi B31
EDGNSNLIWGIGFRL

SEQ ID NO: 127532 - protein, 9 aa, Borrelia burgdorferi B31
NSNLIWGIG

SEQ ID NO: 127533 - protein, 15 aa, Borrelia burgdorferi B31
LFQRASENVSVNYAI

SEQ ID NO: 127534 - protein, 9 aa, Borrelia burgdorferi B31
LFQRASENV

SEQ ID NO: 127535 - protein, 15 aa, Borrelia burgdorferi B31
KVDSLMYSLTKKYLE

SEQ ID NO: 127536 - protein, 9 aa, Borrelia burgdorferi B31
LMYSLTKKY

SEQ ID NO: 127537 - protein, 15 aa, Borrelia burgdorferi B31
NINIIEKASTGNSYL

SEQ ID NO: 127538 - protein, 9 aa, Borrelia burgdorferi B31
IIEKASTGN

SEQ ID NO: 127539 - protein, 15 aa, Borrelia burgdorferi B31
AVKKVDSLMYSLTKK

SEQ ID NO: 127540 - protein, 9 aa, Borrelia burgdorferi B31
VDSLMYSLT

SEQ ID NO: 127541 - protein, 15 aa, Borrelia burgdorferi B31
VDSLMYSLTKKYLET

SEQ ID NO: 127542 - protein, 9 aa, Borrelia burgdorferi B31
LMYSLTKKY

SEQ ID NO: 127543 - protein, 15 aa, Borrelia burgdorferi B31
AAGLSGIGVIEAAKE

SEQ ID NO: 127544 - protein, 9 aa, Borrelia burgdorferi B31
LSGIGVIEA

SEQ ID NO: 127545 - protein, 15 aa, Borrelia burgdorferi B31
DHYIIGVDQDQSYLA

SEQ ID NO: 127546 - protein, 9 aa, Borrelia burgdorferi B31
YIIGVDQDQ

SEQ ID NO: 127547 - protein, 15 aa, Borrelia burgdorferi B31
ESFMYGYEAGAKYAN

SEQ ID NO: 127548 - protein, 9 aa, Borrelia burgdorferi B31
FMYGYEAGA

SEQ ID NO: 127549 - protein, 15 aa, Borrelia burgdorferi B31
SIMNGIIKVPYDKVS

SEQ ID NO: 127550 - protein, 9 aa, Borrelia burgdorferi B31
IMNGIIKVP

SEQ ID NO: 127551 - protein, 15 aa, Borrelia burgdorferi B31
KYANSNIKVVSQYVG

SEQ ID NO: 127552 - protein, 9 aa, Borrelia burgdorferi B31
YANSNIKVV

SEQ ID NO: 127553 - protein, 15 aa, Borrelia burgdorferi B31
YANSNIKVVSQYVGT

SEQ ID NO: 127554 - protein, 9 aa, Borrelia burgdorferi B31
YANSNIKVV

SEQ ID NO: 127555 - protein, 15 aa, Borrelia burgdorferi B31
FNESSSKAIRKLKAD

SEQ ID NO: 127556 - protein, 9 aa, Borrelia burgdorferi B31
FNESSSKAI

SEQ ID NO: 127557 - protein, 15 aa, Borrelia burgdorferi B31
GDFGLGRSTASNMYR

SEQ ID NO: 127558 - protein, 9 aa, Borrelia burgdorferi B31
GRSTASNMY

SEQ ID NO: 127559 - protein, 15 aa, Borrelia burgdorferi B31
FGDFGLGRSTASNMY

SEQ ID NO: 127560 - protein, 9 aa, Borrelia burgdorferi B31
FGLGRSTAS

SEQ ID NO: 127561 - protein, 15 aa, Borrelia burgdorferi B31
LVLNENLKSNYSEIY

SEQ ID NO: 127562 - protein, 9 aa, Borrelia burgdorferi B31
NENLKSNYS

SEQ ID NO: 127563 - protein, 15 aa, Borrelia burgdorferi B31
VLNENLKSNYSEIYN

SEQ ID NO: 127564 - protein, 9 aa, Borrelia burgdorferi B31
LKSNYSEIY

SEQ ID NO: 127565 - protein, 15 aa, Borrelia burgdorferi B31
IKVVSQYVGTFGDFG

SEQ ID NO: 127566 - protein, 9 aa, Borrelia burgdorferi B31
VVSQYVGTF

SEQ ID NO: 127567 - protein, 15 aa, Borrelia burgdorferi B31
VVSQYVGTFGDFGLG

SEQ ID NO: 127568 - protein, 9 aa, Borrelia burgdorferi B31
YVGTFGDFG

SEQ ID NO: 127569 - protein, 15 aa, Borrelia burgdorferi B31
KVVSQYVGTFGDFGL

SEQ ID NO: 127570 - protein, 9 aa, Borrelia burgdorferi B31
YVGTFGDFG

SEQ ID NO: 127571 - protein, 15 aa, Borrelia burgdorferi B31
SQYVGTFGDFGLGRS

SEQ ID NO: 127572 - protein, 9 aa, Borrelia burgdorferi B31
YVGTFGDFG

SEQ ID NO: 127573 - protein, 15 aa, Borrelia burgdorferi B31
VSQYVGTFGDFGLGR

SEQ ID NO: 127574 - protein, 9 aa, Borrelia burgdorferi B31
YVGTFGDFG

SEQ ID NO: 127575 - protein, 15 aa, Borrelia burgdorferi B31
VAFLAGYFASKASKT

SEQ ID NO: 127576 - protein, 9 aa, Borrelia burgdorferi B31
LAGYFASKA

SEQ ID NO: 127577 - protein, 15 aa, Borrelia burgdorferi B31
EEVAFLAGYFASKAS

SEQ ID NO: 127578 - protein, 9 aa, Borrelia burgdorferi B31
LAGYFASKA

SEQ ID NO: 127579 - protein, 15 aa, Borrelia burgdorferi B31
SEEVAFLAGYFASKA

SEQ ID NO: 127580 - protein, 9 aa, Borrelia burgdorferi B31
FLAGYFASK

SEQ ID NO: 127581 - protein, 15 aa, Borrelia burgdorferi B31
EVAFLAGYFASKASK

SEQ ID NO: 127582 - protein, 9 aa, Borrelia burgdorferi B31
LAGYFASKA

SEQ ID NO: 127583 - protein, 15 aa, Borrelia burgdorferi B31
YVGTFGDFGLGRSTA

SEQ ID NO: 127584 - protein, 9 aa, Borrelia burgdorferi B31
YVGTFGDFG

SEQ ID NO: 127585 - protein, 15 aa, Borrelia burgdorferi B31
QYVGTFGDFGLGRST

SEQ ID NO: 127586 - protein, 9 aa, Borrelia burgdorferi B31
YVGTFGDFG

SEQ ID NO: 127587 - protein, 15 aa, Borrelia burgdorferi B31
AFLAGYFASKASKTG

SEQ ID NO: 127588 - protein, 9 aa, Borrelia burgdorferi B31
LAGYFASKA

SEQ ID NO: 127589 - protein, 15 aa, Borrelia burgdorferi B31
EGVYDEIQIPKNLLN

SEQ ID NO: 127590 - protein, 9 aa, Borrelia burgdorferi B31
YDEIQIPKN

SEQ ID NO: 127591 - protein, 15 aa, Borrelia burgdorferi B31
GVYDEIQIPKNLLNI

SEQ ID NO: 127592 - protein, 9 aa, Borrelia burgdorferi B31
IQIPKNLLN

SEQ ID NO: 127593 - protein, 15 aa, Borrelia burgdorferi B31
VYDEIQIPKNLLNIS

SEQ ID NO: 127594 - protein, 9 aa, Borrelia burgdorferi B31
IQIPKNLLN

SEQ ID NO: 127595 - protein, 15 aa, Borrelia burgdorferi B31
YDEIQIPKNLLNISF

SEQ ID NO: 127596 - protein, 9 aa, Borrelia burgdorferi B31
IQIPKNLLN

SEQ ID NO: 127597 - protein, 15 aa, Borrelia burgdorferi B31
DEIQIPKNLLNISFR

SEQ ID NO: 127598 - protein, 9 aa, Borrelia burgdorferi B31
IQIPKNLLN

SEQ ID NO: 127599 - protein, 15 aa, Borrelia burgdorferi B31
YEAGAKYANSNIKVV

SEQ ID NO: 127600 - protein, 9 aa, Borrelia burgdorferi B31
KYANSNIKV

SEQ ID NO: 127601 - protein, 15 aa, Borrelia burgdorferi B31
EAGAKYANSNIKVVS

SEQ ID NO: 127602 - protein, 9 aa, Borrelia burgdorferi B31
YANSNIKVV

SEQ ID NO: 127603 - protein, 15 aa, Borrelia burgdorferi B31
AGAKYANSNIKVVSQ

SEQ ID NO: 127604 - protein, 9 aa, Borrelia burgdorferi B31
YANSNIKVV

SEQ ID NO: 127605 - protein, 15 aa, Borrelia burgdorferi B31
GAKYANSNIKVVSQY

SEQ ID NO: 127606 - protein, 9 aa, Borrelia burgdorferi B31
YANSNIKVV

SEQ ID NO: 127607 - protein, 15 aa, Borrelia burgdorferi B31
AKYANSNIKVVSQYV

SEQ ID NO: 127608 - protein, 9 aa, Borrelia burgdorferi B31
YANSNIKVV

SEQ ID NO: 127609 - protein, 15 aa, Borrelia burgdorferi B31
AGYFASKASKTGKIG

SEQ ID NO: 127610 - protein, 9 aa, Borrelia burgdorferi B31
YFASKASKT

SEQ ID NO: 127611 - protein, 15 aa, Borrelia burgdorferi B31
LAGYFASKASKTGKI

SEQ ID NO: 127612 - protein, 9 aa, Borrelia burgdorferi B31
YFASKASKT

SEQ ID NO: 127613 - protein, 15 aa, Borrelia burgdorferi B31
AFLAGYFASKASKTG

SEQ ID NO: 127614 - protein, 9 aa, Borrelia burgdorferi B31
YFASKASKT

SEQ ID NO: 127615 - protein, 15 aa, Borrelia burgdorferi B31
FLAGYFASKASKTGK

SEQ ID NO: 127616 - protein, 9 aa, Borrelia burgdorferi B31
YFASKASKT

SEQ ID NO: 127617 - protein, 15 aa, Borrelia burgdorferi B31
AFDDKGFNESSSKAI

SEQ ID NO: 127618 - protein, 9 aa, Borrelia burgdorferi B31
GFNESSSKA

SEQ ID NO: 127619 - protein, 15 aa, Borrelia burgdorferi B31
DKGFNESSSKAIRKL

SEQ ID NO: 127620 - protein, 9 aa, Borrelia burgdorferi B31
FNESSSKAI

SEQ ID NO: 127621 - protein, 15 aa, Borrelia burgdorferi B31
FDDKGFNESSSKAIR

SEQ ID NO: 127622 - protein, 9 aa, Borrelia burgdorferi B31
FNESSSKAI

SEQ ID NO: 127623 - protein, 15 aa, Borrelia burgdorferi B31
DDKGFNESSSKAIRK

SEQ ID NO: 127624 - protein, 9 aa, Borrelia burgdorferi B31
FNESSSKAI

SEQ ID NO: 127625 - protein, 15 aa, Borrelia burgdorferi B31
VAFLAGYFASKASKT

SEQ ID NO: 127626 - protein, 9 aa, Borrelia burgdorferi B31
VAFLAGYFA

SEQ ID NO: 127627 - protein, 15 aa, Borrelia burgdorferi B31
KGFNESSSKAIRKLK

SEQ ID NO: 127628 - protein, 9 aa, Borrelia burgdorferi B31
FNESSSKAI

SEQ ID NO: 127629 - protein, 15 aa, Borrelia burgdorferi B31
GIIKVPYDKVSYFVL

SEQ ID NO: 127630 - protein, 9 aa, Borrelia burgdorferi B31
PYDKVSYFV

SEQ ID NO: 127631 - protein, 15 aa, Borrelia burgdorferi B31
KEDIFMLKKVYYFLI

SEQ ID NO: 127632 - protein, 9 aa, Borrelia burgdorferi B31
MLKKVYYFL

SEQ ID NO: 127633 - protein, 15 aa, Borrelia burgdorferi B31
EDIFMLKKVYYFLIF

SEQ ID NO: 127634 - protein, 9 aa, Borrelia burgdorferi B31
MLKKVYYFL

SEQ ID NO: 127635 - protein, 15 aa, Borrelia burgdorferi B31
IIKVPYDKVSYFVLQ

SEQ ID NO: 127636 - protein, 9 aa, Borrelia burgdorferi B31
YDKVSYFVL

SEQ ID NO: 127637 - protein, 15 aa, Borrelia burgdorferi B31
IKVPYDKVSYFVLQM

SEQ ID NO: 127638 - protein, 9 aa, Borrelia burgdorferi B31
YDKVSYFVL

SEQ ID NO: 127639 - protein, 15 aa, Borrelia burgdorferi B31
KVPYDKVSYFVLQME

SEQ ID NO: 127640 - protein, 9 aa, Borrelia burgdorferi B31
YDKVSYFVL

SEQ ID NO: 127641 - protein, 15 aa, Borrelia burgdorferi B31
DQSYLAPNNVIVSAV

SEQ ID NO: 127642 - protein, 9 aa, Borrelia burgdorferi B31
YLAPNNVIV

SEQ ID NO: 127643 - protein, 15 aa, Borrelia burgdorferi B31
FGDFGLGRSTASNMY

SEQ ID NO: 127644 - protein, 9 aa, Borrelia burgdorferi B31
LGRSTASNM

SEQ ID NO: 127645 - protein, 15 aa, Borrelia burgdorferi B31
GDFGLGRSTASNMYR

SEQ ID NO: 127646 - protein, 9 aa, Borrelia burgdorferi B31
LGRSTASNM

SEQ ID NO: 127647 - protein, 15 aa, Borrelia burgdorferi B31
KYANSNIKVVSQYVG

SEQ ID NO: 127648 - protein, 9 aa, Borrelia burgdorferi B31
YANSNIKVV

SEQ ID NO: 127649 - protein, 15 aa, Borrelia burgdorferi B31
YANSNIKVVSQYVGT

SEQ ID NO: 127650 - protein, 9 aa, Borrelia burgdorferi B31
YANSNIKVV

SEQ ID NO: 127651 - protein, 15 aa, Borrelia burgdorferi B31
DIFMLKKVYYFLIFL

SEQ ID NO: 127652 - protein, 9 aa, Borrelia burgdorferi B31
MLKKVYYFL

SEQ ID NO: 127653 - protein, 15 aa, Borrelia burgdorferi B31
GVDIIFAAAGLSGIG

SEQ ID NO: 127654 - protein, 9 aa, Borrelia burgdorferi B31
IIFAAAGLS

SEQ ID NO: 127655 - protein, 15 aa, Borrelia burgdorferi B31
DGVDIIFAAAGLSGI

SEQ ID NO: 127656 - protein, 9 aa, Borrelia burgdorferi B31
IIFAAAGLS

SEQ ID NO: 127657 - protein, 15 aa, Borrelia burgdorferi B31
VDIIFAAAGLSGIGV

SEQ ID NO: 127658 - protein, 9 aa, Borrelia burgdorferi B31
IIFAAAGLS

SEQ ID NO: 127659 - protein, 15 aa, Borrelia burgdorferi B31
DKGFNESSSKAIRKL

SEQ ID NO: 127660 - protein, 9 aa, Borrelia burgdorferi B31
FNESSSKAI

SEQ ID NO: 127661 - protein, 15 aa, Borrelia burgdorferi B31
KGFNESSSKAIRKLK

SEQ ID NO: 127662 - protein, 9 aa, Borrelia burgdorferi B31
FNESSSKAI

SEQ ID NO: 127663 - protein, 15 aa, Borrelia burgdorferi B31
AFDDKGFNESSSKAI

SEQ ID NO: 127664 - protein, 9 aa, Borrelia burgdorferi B31
GFNESSSKA

SEQ ID NO: 127665 - protein, 15 aa, Borrelia burgdorferi B31
FDDKGFNESSSKAIR

SEQ ID NO: 127666 - protein, 9 aa, Borrelia burgdorferi B31
FNESSSKAI

SEQ ID NO: 127667 - protein, 15 aa, Borrelia burgdorferi B31
DDKGFNESSSKAIRK

SEQ ID NO: 127668 - protein, 9 aa, Borrelia burgdorferi B31
FNESSSKAI

SEQ ID NO: 127669 - protein, 15 aa, Borrelia burgdorferi B31
RDGVDIIFAAAGLSG

SEQ ID NO: 127670 - protein, 9 aa, Borrelia burgdorferi B31
IIFAAAGLS

SEQ ID NO: 127671 - protein, 15 aa, Borrelia burgdorferi B31
YRDGVDIIFAAAGLS

SEQ ID NO: 127672 - protein, 9 aa, Borrelia burgdorferi B31
YRDGVDIIF

SEQ ID NO: 127673 - protein, 15 aa, Borrelia burgdorferi B31
EAGAKYANSNIKVVS

SEQ ID NO: 127674 - protein, 9 aa, Borrelia burgdorferi B31
YANSNIKVV

SEQ ID NO: 127675 - protein, 15 aa, Borrelia burgdorferi B31
YEAGAKYANSNIKVV

SEQ ID NO: 127676 - protein, 9 aa, Borrelia burgdorferi B31
AKYANSNIK

SEQ ID NO: 127677 - protein, 15 aa, Borrelia burgdorferi B31
AGAKYANSNIKVVSQ

SEQ ID NO: 127678 - protein, 9 aa, Borrelia burgdorferi B31
YANSNIKVV

SEQ ID NO: 127679 - protein, 15 aa, Borrelia burgdorferi B31
DIIFAAAGLSGIGVI

SEQ ID NO: 127680 - protein, 9 aa, Borrelia burgdorferi B31
IIFAAAGLS

SEQ ID NO: 127681 - protein, 15 aa, Borrelia burgdorferi B31
IIFAAAGLSGIGVIE

SEQ ID NO: 127682 - protein, 9 aa, Borrelia burgdorferi B31
IIFAAAGLS

SEQ ID NO: 127683 - protein, 15 aa, Borrelia burgdorferi B31
GAKYANSNIKVVSQY

SEQ ID NO: 127684 - protein, 9 aa, Borrelia burgdorferi B31
YANSNIKVV

SEQ ID NO: 127685 - protein, 15 aa, Borrelia burgdorferi B31
LAGYFASKASKTGKI

SEQ ID NO: 127686 - protein, 9 aa, Borrelia burgdorferi B31
YFASKASKT

SEQ ID NO: 127687 - protein, 15 aa, Borrelia burgdorferi B31
AKYANSNIKVVSQYV

SEQ ID NO: 127688 - protein, 9 aa, Borrelia burgdorferi B31
YANSNIKVV

SEQ ID NO: 127689 - protein, 15 aa, Borrelia burgdorferi B31
AGYFASKASKTGKIG

SEQ ID NO: 127690 - protein, 9 aa, Borrelia burgdorferi B31
YFASKASKT

SEQ ID NO: 127691 - protein, 15 aa, Borrelia burgdorferi B31
AFLAGYFASKASKTG

SEQ ID NO: 127692 - protein, 9 aa, Borrelia burgdorferi B31
YFASKASKT

SEQ ID NO: 127693 - protein, 15 aa, Borrelia burgdorferi B31
FLAGYFASKASKTGK

SEQ ID NO: 127694 - protein, 9 aa, Borrelia burgdorferi B31
YFASKASKT

SEQ ID NO: 127695 - protein, 15 aa, Borrelia burgdorferi B31
VAFLAGYFASKASKT

SEQ ID NO: 127696 - protein, 9 aa, Borrelia burgdorferi B31
LAGYFASKA

SEQ ID NO: 127697 - protein, 15 aa, Borrelia burgdorferi B31
LSDILFQRASENVSV

SEQ ID NO: 127698 - protein, 9 aa, Borrelia burgdorferi B31
FQRASENVS

SEQ ID NO: 127699 - protein, 15 aa, Borrelia burgdorferi B31
SDILFQRASENVSVN

SEQ ID NO: 127700 - protein, 9 aa, Borrelia burgdorferi B31
FQRASENVS

SEQ ID NO: 127701 - protein, 15 aa, Borrelia burgdorferi B31
DILFQRASENVSVNY

SEQ ID NO: 127702 - protein, 9 aa, Borrelia burgdorferi B31
FQRASENVS

SEQ ID NO: 127703 - protein, 15 aa, Borrelia burgdorferi B31
RLSDILFQRASENVS

SEQ ID NO: 127704 - protein, 9 aa, Borrelia burgdorferi B31
LFQRASENV

SEQ ID NO: 127705 - protein, 15 aa, Borrelia burgdorferi B31
LIWGIGFRLSDILFQ

SEQ ID NO: 127706 - protein, 9 aa, Borrelia burgdorferi B31
IGFRLSDIL

SEQ ID NO: 127707 - protein, 15 aa, Borrelia burgdorferi B31
IWGIGFRLSDILFQR

SEQ ID NO: 127708 - protein, 9 aa, Borrelia burgdorferi B31
FRLSDILFQ

SEQ ID NO: 127709 - protein, 15 aa, Borrelia burgdorferi B31
WGIGFRLSDILFQRA

SEQ ID NO: 127710 - protein, 9 aa, Borrelia burgdorferi B31
FRLSDILFQ

SEQ ID NO: 127711 - protein, 15 aa, Borrelia burgdorferi B31
ILFQRASENVSVNYA

SEQ ID NO: 127712 - protein, 9 aa, Borrelia burgdorferi B31
FQRASENVS

SEQ ID NO: 127713 - protein, 15 aa, Borrelia burgdorferi B31
GFNESSSKAIRKLKA

SEQ ID NO: 127714 - protein, 9 aa, Borrelia burgdorferi B31
FNESSSKAI

SEQ ID NO: 127715 - protein, 15 aa, Borrelia burgdorferi B31
GIGFRLSDILFQRAS

SEQ ID NO: 127716 - protein, 9 aa, Borrelia burgdorferi B31
FRLSDILFQ

SEQ ID NO: 127717 - protein, 15 aa, Borrelia burgdorferi B31
FNESSSKAIRKLKAD

SEQ ID NO: 127718 - protein, 9 aa, Borrelia burgdorferi B31
FNESSSKAI

SEQ ID NO: 127719 - protein, 15 aa, Borrelia burgdorferi B31
IGFRLSDILFQRASE

SEQ ID NO: 127720 - protein, 9 aa, Borrelia burgdorferi B31
FRLSDILFQ

SEQ ID NO: 127721 - protein, 15 aa, Borrelia burgdorferi B31
GYFASKASKTGKIGF

SEQ ID NO: 127722 - protein, 9 aa, Borrelia burgdorferi B31
YFASKASKT

SEQ ID NO: 127723 - protein, 15 aa, Borrelia burgdorferi B31
KYANSNIKVVSQYVG

SEQ ID NO: 127724 - protein, 9 aa, Borrelia burgdorferi B31
ANSNIKVVS

SEQ ID NO: 127725 - protein, 15 aa, Borrelia burgdorferi B31
KIGQSIMNGIIKVPY

SEQ ID NO: 127726 - protein, 9 aa, Borrelia burgdorferi B31
IGQSIMNGI

SEQ ID NO: 127727 - protein, 15 aa, Borrelia burgdorferi B31
IGQSIMNGIIKVPYD

SEQ ID NO: 127728 - protein, 9 aa, Borrelia burgdorferi B31
IGQSIMNGI

SEQ ID NO: 127729 - protein, 15 aa, Borrelia burgdorferi B31
LKIGQSIMNGIIKVP

SEQ ID NO: 127730 - protein, 9 aa, Borrelia burgdorferi B31
IGQSIMNGI

SEQ ID NO: 127731 - protein, 15 aa, Borrelia burgdorferi B31
YANSNIKVVSQYVGT

SEQ ID NO: 127732 - protein, 9 aa, Borrelia burgdorferi B31
IKVVSQYVG

SEQ ID NO: 127733 - protein, 15 aa, Borrelia burgdorferi B31
ANSNIKVVSQYVGTF

SEQ ID NO: 127734 - protein, 9 aa, Borrelia burgdorferi B31
IKVVSQYVG

SEQ ID NO: 127735 - protein, 15 aa, Borrelia burgdorferi B31
SLKIGQSIMNGIIKV

SEQ ID NO: 127736 - protein, 9 aa, Borrelia burgdorferi B31
IGQSIMNGI

SEQ ID NO: 127737 - protein, 15 aa, Borrelia burgdorferi B31
KSLKIGQSIMNGIIK

SEQ ID NO: 127738 - protein, 9 aa, Borrelia burgdorferi B31
IGQSIMNGI

SEQ ID NO: 127739 - protein, 15 aa, Borrelia burgdorferi B31
NSNIKVVSQYVGTFG

SEQ ID NO: 127740 - protein, 9 aa, Borrelia burgdorferi B31
IKVVSQYVG

SEQ ID NO: 127741 - protein, 15 aa, Borrelia burgdorferi B31
SNIKVVSQYVGTFGD

SEQ ID NO: 127742 - protein, 9 aa, Borrelia burgdorferi B31
IKVVSQYVG

SEQ ID NO: 127743 - protein, 15 aa, Borrelia burgdorferi B31
NKSLKIGQSIMNGII

SEQ ID NO: 127744 - protein, 9 aa, Borrelia burgdorferi B31
IGQSIMNGI

SEQ ID NO: 127745 - protein, 15 aa, Borrelia burgdorferi B31
YNKSLKIGQSIMNGI

SEQ ID NO: 127746 - protein, 9 aa, Borrelia burgdorferi B31
LKIGQSIMN

SEQ ID NO: 127747 - protein, 15 aa, Borrelia burgdorferi B31
KEDIFMLKKVYYFLI

SEQ ID NO: 127748 - protein, 9 aa, Borrelia burgdorferi B31
IFMLKKVYY

SEQ ID NO: 127749 - protein, 15 aa, Borrelia burgdorferi B31
EDIFMLKKVYYFLIF

SEQ ID NO: 127750 - protein, 9 aa, Borrelia burgdorferi B31
IFMLKKVYY

SEQ ID NO: 127751 - protein, 15 aa, Borrelia burgdorferi B31
AKYANSNIKVVSQYV

SEQ ID NO: 127752 - protein, 9 aa, Borrelia burgdorferi B31
YANSNIKVV

SEQ ID NO: 127753 - protein, 15 aa, Borrelia burgdorferi B31
GAKYANSNIKVVSQY

SEQ ID NO: 127754 - protein, 9 aa, Borrelia burgdorferi B31
YANSNIKVV

SEQ ID NO: 127755 - protein, 15 aa, Borrelia burgdorferi B31
GQSIMNGIIKVPYDK

SEQ ID NO: 127756 - protein, 9 aa, Borrelia burgdorferi B31
MNGIIKVPY

SEQ ID NO: 127757 - protein, 15 aa, Borrelia burgdorferi B31
EAGAKYANSNIKVVS

SEQ ID NO: 127758 - protein, 9 aa, Borrelia burgdorferi B31
YANSNIKVV

SEQ ID NO: 127759 - protein, 15 aa, Borrelia burgdorferi B31
AGAKYANSNIKVVSQ

SEQ ID NO: 127760 - protein, 9 aa, Borrelia burgdorferi B31
YANSNIKVV

SEQ ID NO: 127761 - protein, 15 aa, Borrelia burgdorferi B31
LKADLNINIIEKAST

SEQ ID NO: 127762 - protein, 9 aa, Borrelia burgdorferi B31
LNINIIEKA

SEQ ID NO: 127763 - protein, 15 aa, Borrelia burgdorferi B31
QSIMNGIIKVPYDKV

SEQ ID NO: 127764 - protein, 9 aa, Borrelia burgdorferi B31
MNGIIKVPY

SEQ ID NO: 127765 - protein, 15 aa, Borrelia burgdorferi B31
EIQIPKNLLNISFRS

SEQ ID NO: 127766 - protein, 9 aa, Borrelia burgdorferi B31
IPKNLLNIS

SEQ ID NO: 127767 - protein, 15 aa, Borrelia burgdorferi B31
IQIPKNLLNISFRSE

SEQ ID NO: 127768 - protein, 9 aa, Borrelia burgdorferi B31
IPKNLLNIS

SEQ ID NO: 127769 - protein, 15 aa, Borrelia burgdorferi B31
SKEDIFMLKKVYYFL

SEQ ID NO: 127770 - protein, 9 aa, Borrelia burgdorferi B31
IFMLKKVYY

SEQ ID NO: 127771 - protein, 15 aa, Borrelia burgdorferi B31
KADLNINIIEKASTG

SEQ ID NO: 127772 - protein, 9 aa, Borrelia burgdorferi B31
LNINIIEKA

SEQ ID NO: 127773 - protein, 15 aa, Borrelia burgdorferi B31
DEIQIPKNLLNISFR

SEQ ID NO: 127774 - protein, 9 aa, Borrelia burgdorferi B31
IPKNLLNIS

SEQ ID NO: 127775 - protein, 15 aa, Borrelia burgdorferi B31
KSKEDIFMLKKVYYF

SEQ ID NO: 127776 - protein, 9 aa, Borrelia burgdorferi B31
IFMLKKVYY

SEQ ID NO: 127777 - protein, 15 aa, Borrelia burgdorferi B31
ADLNINIIEKASTGN

SEQ ID NO: 127778 - protein, 9 aa, Borrelia burgdorferi B31
LNINIIEKA

SEQ ID NO: 127779 - protein, 15 aa, Borrelia burgdorferi B31
YDEIQIPKNLLNISF

SEQ ID NO: 127780 - protein, 9 aa, Borrelia burgdorferi B31
IPKNLLNIS

SEQ ID NO: 127781 - protein, 15 aa, Borrelia burgdorferi B31
VYDEIQIPKNLLNIS

SEQ ID NO: 127782 - protein, 9 aa, Borrelia burgdorferi B31
IQIPKNLLN

SEQ ID NO: 127783 - protein, 15 aa, Borrelia burgdorferi B31
RKLKADLNINIIEKA

SEQ ID NO: 127784 - protein, 9 aa, Borrelia burgdorferi B31
KADLNINII

SEQ ID NO: 127785 - protein, 15 aa, Borrelia burgdorferi B31
DIFMLKKVYYFLIFL

SEQ ID NO: 127786 - protein, 9 aa, Borrelia burgdorferi B31
IFMLKKVYY

SEQ ID NO: 127787 - protein, 15 aa, Borrelia burgdorferi B31
KLKADLNINIIEKAS

SEQ ID NO: 127788 - protein, 9 aa, Borrelia burgdorferi B31
LNINIIEKA

SEQ ID NO: 127789 - protein, 15 aa, Borrelia burgdorferi B31
QIPKNLLNISFRSEE

SEQ ID NO: 127790 - protein, 9 aa, Borrelia burgdorferi B31
IPKNLLNIS

SEQ ID NO: 127791 - protein, 15 aa, Borrelia burgdorferi B31
IPKNLLNISFRSEEV

SEQ ID NO: 127792 - protein, 9 aa, Borrelia burgdorferi B31
IPKNLLNIS

SEQ ID NO: 127793 - protein, 15 aa, Borrelia burgdorferi B31
SIMNGIIKVPYDKVS

SEQ ID NO: 127794 - protein, 9 aa, Borrelia burgdorferi B31
MNGIIKVPY

SEQ ID NO: 127795 - protein, 15 aa, Borrelia burgdorferi B31
GLGLVLNENLKSNYS

SEQ ID NO: 127796 - protein, 9 aa, Borrelia burgdorferi B31
LNENLKSNY

SEQ ID NO: 127797 - protein, 15 aa, Borrelia burgdorferi B31
GKIGFVGGVRGKVLE

SEQ ID NO: 127798 - protein, 9 aa, Borrelia burgdorferi B31
IGFVGGVRG

SEQ ID NO: 127799 - protein, 15 aa, Borrelia burgdorferi B31
NYSEIYNKSLKIGQS

SEQ ID NO: 127800 - protein, 9 aa, Borrelia burgdorferi B31
IYNKSLKIG

SEQ ID NO: 127801 - protein, 15 aa, Borrelia burgdorferi B31
IFMLKKVYYFLIFLF

SEQ ID NO: 127802 - protein, 9 aa, Borrelia burgdorferi B31
IFMLKKVYY

SEQ ID NO: 127803 - protein, 15 aa, Borrelia burgdorferi B31
YSEIYNKSLKIGQSI

SEQ ID NO: 127804 - protein, 9 aa, Borrelia burgdorferi B31
IYNKSLKIG

SEQ ID NO: 127805 - protein, 15 aa, Borrelia burgdorferi B31
LGLVLNENLKSNYSE

SEQ ID NO: 127806 - protein, 9 aa, Borrelia burgdorferi B31
LNENLKSNY

SEQ ID NO: 127807 - protein, 15 aa, Borrelia burgdorferi B31
SNYSEIYNKSLKIGQ

SEQ ID NO: 127808 - protein, 9 aa, Borrelia burgdorferi B31
IYNKSLKIG

SEQ ID NO: 127809 - protein, 15 aa, Borrelia burgdorferi B31
LAPNNVIVSAVKKVD

SEQ ID NO: 127810 - protein, 9 aa, Borrelia burgdorferi B31
PNNVIVSAV

SEQ ID NO: 127811 - protein, 15 aa, Borrelia burgdorferi B31
LNINIIEKASTGNSY

SEQ ID NO: 127812 - protein, 9 aa, Borrelia burgdorferi B31
LNINIIEKA

SEQ ID NO: 127813 - protein, 15 aa, Borrelia burgdorferi B31
SEIYNKSLKIGQSIM

SEQ ID NO: 127814 - protein, 9 aa, Borrelia burgdorferi B31
IYNKSLKIG

SEQ ID NO: 127815 - protein, 15 aa, Borrelia burgdorferi B31
NIKVVSQYVGTFGDF

SEQ ID NO: 127816 - protein, 9 aa, Borrelia burgdorferi B31
IKVVSQYVG

SEQ ID NO: 127817 - protein, 15 aa, Borrelia burgdorferi B31
YLAPNNVIVSAVKKV

SEQ ID NO: 127818 - protein, 9 aa, Borrelia burgdorferi B31
PNNVIVSAV

SEQ ID NO: 127819 - protein, 15 aa, Borrelia burgdorferi B31
DGLGLVLNENLKSNY

SEQ ID NO: 127820 - protein, 9 aa, Borrelia burgdorferi B31
LVLNENLKS

SEQ ID NO: 127821 - protein, 15 aa, Borrelia burgdorferi B31
DLNINIIEKASTGNS

SEQ ID NO: 127822 - protein, 9 aa, Borrelia burgdorferi B31
LNINIIEKA

SEQ ID NO: 127823 - protein, 15 aa, Borrelia burgdorferi B31
SYLAPNNVIVSAVKK

SEQ ID NO: 127824 - protein, 9 aa, Borrelia burgdorferi B31
LAPNNVIVS

SEQ ID NO: 127825 - protein, 15 aa, Borrelia burgdorferi B31
EIYNKSLKIGQSIMN

SEQ ID NO: 127826 - protein, 9 aa, Borrelia burgdorferi B31
IYNKSLKIG

SEQ ID NO: 127827 - protein, 15 aa, Borrelia burgdorferi B31
TGKIGFVGGVRGKVL

SEQ ID NO: 127828 - protein, 9 aa, Borrelia burgdorferi B31
IGFVGGVRG

SEQ ID NO: 127829 - protein, 15 aa, Borrelia burgdorferi B31
DQSYLAPNNVIVSAV

SEQ ID NO: 127830 - protein, 9 aa, Borrelia burgdorferi B31
LAPNNVIVS

SEQ ID NO: 127831 - protein, 15 aa, Borrelia burgdorferi B31
IKSKEDIFMLKKVYY

SEQ ID NO: 127832 - protein, 9 aa, Borrelia burgdorferi B31
IKSKEDIFM

SEQ ID NO: 127833 - protein, 15 aa, Borrelia burgdorferi B31
QSYLAPNNVIVSAVK

SEQ ID NO: 127834 - protein, 9 aa, Borrelia burgdorferi B31
LAPNNVIVS

SEQ ID NO: 127835 - protein, 15 aa, Borrelia burgdorferi B31
KSNYSEIYNKSLKIG

SEQ ID NO: 127836 - protein, 9 aa, Borrelia burgdorferi B31
SEIYNKSLK

SEQ ID NO: 127837 - protein, 15 aa, Borrelia burgdorferi B31
IKVVSQYVGTFGDFG

SEQ ID NO: 127838 - protein, 9 aa, Borrelia burgdorferi B31
IKVVSQYVG

SEQ ID NO: 127839 - protein, 15 aa, Borrelia burgdorferi B31
LVLNENLKSNYSEIY

SEQ ID NO: 127840 - protein, 9 aa, Borrelia burgdorferi B31
LNENLKSNY

SEQ ID NO: 127841 - protein, 15 aa, Borrelia burgdorferi B31
GLVLNENLKSNYSEI

SEQ ID NO: 127842 - protein, 9 aa, Borrelia burgdorferi B31
LNENLKSNY

SEQ ID NO: 127843 - protein, 15 aa, Borrelia burgdorferi B31
IYNKSLKIGQSIMNG

SEQ ID NO: 127844 - protein, 9 aa, Borrelia burgdorferi B31
IYNKSLKIG

SEQ ID NO: 127845 - protein, 15 aa, Borrelia burgdorferi B31
VSAVKKVDSLMYSLT

SEQ ID NO: 127846 - protein, 9 aa, Borrelia burgdorferi B31
VKKVDSLMY

SEQ ID NO: 127847 - protein, 15 aa, Borrelia burgdorferi B31
NVIVSAVKKVDSLMY

SEQ ID NO: 127848 - protein, 9 aa, Borrelia burgdorferi B31
IVSAVKKVD

SEQ ID NO: 127849 - protein, 15 aa, Borrelia burgdorferi B31
YEAGAKYANSNIKVV

SEQ ID NO: 127850 - protein, 9 aa, Borrelia burgdorferi B31
AKYANSNIK

SEQ ID NO: 127851 - protein, 15 aa, Borrelia burgdorferi B31
KTGKIGFVGGVRGKV

SEQ ID NO: 127852 - protein, 9 aa, Borrelia burgdorferi B31
IGFVGGVRG

SEQ ID NO: 127853 - protein, 15 aa, Borrelia burgdorferi B31
SAVKKVDSLMYSLTK

SEQ ID NO: 127854 - protein, 9 aa, Borrelia burgdorferi B31
VKKVDSLMY

SEQ ID NO: 127855 - protein, 15 aa, Borrelia burgdorferi B31
VIVSAVKKVDSLMYS

SEQ ID NO: 127856 - protein, 9 aa, Borrelia burgdorferi B31
VKKVDSLMY

SEQ ID NO: 127857 - protein, 15 aa, Borrelia burgdorferi B31
IMNGIIKVPYDKVSY

SEQ ID NO: 127858 - protein, 9 aa, Borrelia burgdorferi B31
MNGIIKVPY

SEQ ID NO: 127859 - protein, 15 aa, Borrelia burgdorferi B31
APNNVIVSAVKKVDS

SEQ ID NO: 127860 - protein, 9 aa, Borrelia burgdorferi B31
VIVSAVKKV

SEQ ID NO: 127861 - protein, 15 aa, Borrelia burgdorferi B31
ASKTGKIGFVGGVRG

SEQ ID NO: 127862 - protein, 9 aa, Borrelia burgdorferi B31
KIGFVGGVR

SEQ ID NO: 127863 - protein, 15 aa, Borrelia burgdorferi B31
QDQSYLAPNNVIVSA

SEQ ID NO: 127864 - protein, 9 aa, Borrelia burgdorferi B31
LAPNNVIVS

SEQ ID NO: 127865 - protein, 15 aa, Borrelia burgdorferi B31
SKTGKIGFVGGVRGK

SEQ ID NO: 127866 - protein, 9 aa, Borrelia burgdorferi B31
IGFVGGVRG

SEQ ID NO: 127867 - protein, 15 aa, Borrelia burgdorferi B31
PNNVIVSAVKKVDSL

SEQ ID NO: 127868 - protein, 9 aa, Borrelia burgdorferi B31
VIVSAVKKV

SEQ ID NO: 127869 - protein, 15 aa, Borrelia burgdorferi B31
KIGFVGGVRGKVLES

SEQ ID NO: 127870 - protein, 9 aa, Borrelia burgdorferi B31
IGFVGGVRG

SEQ ID NO: 127871 - protein, 15 aa, Borrelia burgdorferi B31
IGFVGGVRGKVLESF

SEQ ID NO: 127872 - protein, 9 aa, Borrelia burgdorferi B31
IGFVGGVRG

SEQ ID NO: 127873 - protein, 15 aa, Borrelia burgdorferi B31
VKKVDSLMYSLTKKY

SEQ ID NO: 127874 - protein, 9 aa, Borrelia burgdorferi B31
VDSLMYSLT

SEQ ID NO: 127875 - protein, 15 aa, Borrelia burgdorferi B31
AVKKVDSLMYSLTKK

SEQ ID NO: 127876 - protein, 9 aa, Borrelia burgdorferi B31
VDSLMYSLT

SEQ ID NO: 127877 - protein, 15 aa, Borrelia burgdorferi B31
KVYYFLIFLFIVACS

SEQ ID NO: 127878 - protein, 9 aa, Borrelia burgdorferi B31
FLIFLFIVA

SEQ ID NO: 127879 - protein, 15 aa, Borrelia burgdorferi B31
KKVYYFLIFLFIVAC

SEQ ID NO: 127880 - protein, 9 aa, Borrelia burgdorferi B31
FLIFLFIVA

SEQ ID NO: 127881 - protein, 15 aa, Borrelia burgdorferi B31
VYYFLIFLFIVACSS

SEQ ID NO: 127882 - protein, 9 aa, Borrelia burgdorferi B31
FLIFLFIVA

SEQ ID NO: 127883 - protein, 15 aa, Borrelia burgdorferi B31
LKKVYYFLIFLFIVA

SEQ ID NO: 127884 - protein, 9 aa, Borrelia burgdorferi B31
YFLIFLFIV

SEQ ID NO: 127885 - protein, 15 aa, Borrelia burgdorferi B31
YYFLIFLFIVACSSS

SEQ ID NO: 127886 - protein, 9 aa, Borrelia burgdorferi B31
FLIFLFIVA

SEQ ID NO: 127887 - protein, 15 aa, Borrelia burgdorferi B31
YEIYFLYFFIKSKED

SEQ ID NO: 127888 - protein, 9 aa, Borrelia burgdorferi B31
FLYFFIKSK

SEQ ID NO: 127889 - protein, 15 aa, Borrelia burgdorferi B31
YYEIYFLYFFIKSKE

SEQ ID NO: 127890 - protein, 9 aa, Borrelia burgdorferi B31
FLYFFIKSK

SEQ ID NO: 127891 - protein, 15 aa, Borrelia burgdorferi B31
AFLAGYFASKASKTG

SEQ ID NO: 127892 - protein, 9 aa, Borrelia burgdorferi B31
LAGYFASKA

SEQ ID NO: 127893 - protein, 15 aa, Borrelia burgdorferi B31
NYYEIYFLYFFIKSK

SEQ ID NO: 127894 - protein, 9 aa, Borrelia burgdorferi B31
IYFLYFFIK

SEQ ID NO: 127895 - protein, 15 aa, Borrelia burgdorferi B31
EIYFLYFFIKSKEDI

SEQ ID NO: 127896 - protein, 9 aa, Borrelia burgdorferi B31
FLYFFIKSK

SEQ ID NO: 127897 - protein, 15 aa, Borrelia burgdorferi B31
FLAGYFASKASKTGK

SEQ ID NO: 127898 - protein, 9 aa, Borrelia burgdorferi B31
FASKASKTG

SEQ ID NO: 127899 - protein, 15 aa, Borrelia burgdorferi B31
VAFLAGYFASKASKT

SEQ ID NO: 127900 - protein, 9 aa, Borrelia burgdorferi B31
FLAGYFASK

SEQ ID NO: 127901 - protein, 15 aa, Borrelia burgdorferi B31
YFLIFLFIVACSSSD

SEQ ID NO: 127902 - protein, 9 aa, Borrelia burgdorferi B31
FLIFLFIVA

SEQ ID NO: 127903 - protein, 15 aa, Borrelia burgdorferi B31
IQIPKNLLNISFRSE

SEQ ID NO: 127904 - protein, 9 aa, Borrelia burgdorferi B31
IPKNLLNIS

SEQ ID NO: 127905 - protein, 15 aa, Borrelia afzelii
ILTLTLLASLLAACS

SEQ ID NO: 127906 - protein, 9 aa, Borrelia afzelii
LTLLASLLA

SEQ ID NO: 127907 - protein, 15 aa, Borrelia afzelii
LTLTLLASLLAACSL

SEQ ID NO: 127908 - protein, 9 aa, Borrelia afzelii
LTLLASLLA

SEQ ID NO: 127909 - protein, 15 aa, Borrelia afzelii
LTLLASLLAACSLTG

SEQ ID NO: 127910 - protein, 9 aa, Borrelia afzelii
LASLLAACS

SEQ ID NO: 127911 - protein, 15 aa, Borrelia afzelii
TLTLLASLLAACSLT

SEQ ID NO: 127912 - protein, 9 aa, Borrelia afzelii
LASLLAACS

SEQ ID NO: 127913 - protein, 15 aa, Borrelia afzelii
TLLASLLAACSLTGK

SEQ ID NO: 127914 - protein, 9 aa, Borrelia afzelii
LASLLAACS

SEQ ID NO: 127915 - protein, 15 aa, Borrelia afzelii
NKIILTLTLLASLLA

SEQ ID NO: 127916 - protein, 9 aa, Borrelia afzelii
ILTLTLLAS

SEQ ID NO: 127917 - protein, 15 aa, Borrelia afzelii
KIILTLTLLASLLAA

SEQ ID NO: 127918 - protein, 9 aa, Borrelia afzelii
LTLLASLLA

SEQ ID NO: 127919 - protein, 15 aa, Borrelia afzelii
IILTLTLLASLLAAC

SEQ ID NO: 127920 - protein, 9 aa, Borrelia afzelii
LTLLASLLA

SEQ ID NO: 127921 - protein, 15 aa, Borrelia afzelii
LASLLAACSLTGKAR

SEQ ID NO: 127922 - protein, 9 aa, Borrelia afzelii
LLAACSLTG

SEQ ID NO: 127923 - protein, 15 aa, Borrelia afzelii
LLASLLAACSLTGKA

SEQ ID NO: 127924 - protein, 9 aa, Borrelia afzelii
LASLLAACS

SEQ ID NO: 127925 - protein, 15 aa, Borrelia afzelii
IKYNKIILTLTLLAS

SEQ ID NO: 127926 - protein, 9 aa, Borrelia afzelii
YNKIILTLT

SEQ ID NO: 127927 - protein, 15 aa, Borrelia afzelii
ASLLAACSLTGKARL

SEQ ID NO: 127928 - protein, 9 aa, Borrelia afzelii
LLAACSLTG

SEQ ID NO: 127929 - protein, 15 aa, Borrelia afzelii
YNKIILTLTLLASLL

SEQ ID NO: 127930 - protein, 9 aa, Borrelia afzelii
ILTLTLLAS

SEQ ID NO: 127931 - protein, 15 aa, Borrelia afzelii
KYNKIILTLTLLASL

SEQ ID NO: 127932 - protein, 9 aa, Borrelia afzelii
ILTLTLLAS

SEQ ID NO: 127933 - protein, 15 aa, Borrelia afzelii
MIKYNKIILTLTLLA

SEQ ID NO: 127934 - protein, 9 aa, Borrelia afzelii
YNKIILTLT

SEQ ID NO: 127935 - protein, 15 aa, Borrelia afzelii
VGGSQIRAAKIRVAD

SEQ ID NO: 127936 - protein, 9 aa, Borrelia afzelii
IRAAKIRVA

SEQ ID NO: 127937 - protein, 15 aa, Borrelia afzelii
KVGGSQIRAAKIRVA

SEQ ID NO: 127938 - protein, 9 aa, Borrelia afzelii
VGGSQIRAA

SEQ ID NO: 127939 - protein, 15 aa, Borrelia afzelii
GSQIRAAKIRVADLT

SEQ ID NO: 127940 - protein, 9 aa, Borrelia afzelii
IRAAKIRVA

SEQ ID NO: 127941 - protein, 15 aa, Borrelia afzelii
GGSQIRAAKIRVADL

SEQ ID NO: 127942 - protein, 9 aa, Borrelia afzelii
IRAAKIRVA

SEQ ID NO: 127943 - protein, 15 aa, Borrelia afzelii
SQIRAAKIRVADLTI

SEQ ID NO: 127944 - protein, 9 aa, Borrelia afzelii
IRAAKIRVA

SEQ ID NO: 127945 - protein, 15 aa, Borrelia afzelii
IYDLILNAAKAVEKI

SEQ ID NO: 127946 - protein, 9 aa, Borrelia afzelii
LILNAAKAV

SEQ ID NO: 127947 - protein, 15 aa, Borrelia afzelii
GIYDLILNAAKAVEK

SEQ ID NO: 127948 - protein, 9 aa, Borrelia afzelii
LILNAAKAV

SEQ ID NO: 127949 - protein, 15 aa, Borrelia afzelii
FSGIYDLILNAAKAV

SEQ ID NO: 127950 - protein, 9 aa, Borrelia afzelii
IYDLILNAA

SEQ ID NO: 127951 - protein, 15 aa, Borrelia afzelii
SGIYDLILNAAKAVE

SEQ ID NO: 127952 - protein, 9 aa, Borrelia afzelii
LILNAAKAV

SEQ ID NO: 127953 - protein, 15 aa, Borrelia afzelii
YDLILNAAKAVEKIG

SEQ ID NO: 127954 - protein, 9 aa, Borrelia afzelii
LILNAAKAV

SEQ ID NO: 127955 - protein, 15 aa, Borrelia afzelii
LLAACSLTGKARLES

SEQ ID NO: 127956 - protein, 9 aa, Borrelia afzelii
LLAACSLTG

SEQ ID NO: 127957 - protein, 15 aa, Borrelia afzelii
SLLAACSLTGKARLE

SEQ ID NO: 127958 - protein, 9 aa, Borrelia afzelii
LLAACSLTG

SEQ ID NO: 127959 - protein, 15 aa, Borrelia afzelii
TGGKVGGSQIRAAKI

SEQ ID NO: 127960 - protein, 9 aa, Borrelia afzelii
VGGSQIRAA

SEQ ID NO: 127961 - protein, 15 aa, Borrelia afzelii
DLILNAAKAVEKIGM

SEQ ID NO: 127962 - protein, 9 aa, Borrelia afzelii
LILNAAKAV

SEQ ID NO: 127963 - protein, 15 aa, Borrelia afzelii
GGKVGGSQIRAAKIR

SEQ ID NO: 127964 - protein, 9 aa, Borrelia afzelii
VGGSQIRAA

SEQ ID NO: 127965 - protein, 15 aa, Borrelia afzelii
QIRAAKIRVADLTIK

SEQ ID NO: 127966 - protein, 9 aa, Borrelia afzelii
IRAAKIRVA

SEQ ID NO: 127967 - protein, 15 aa, Borrelia afzelii
GKVGGSQIRAAKIRV

SEQ ID NO: 127968 - protein, 9 aa, Borrelia afzelii
VGGSQIRAA

SEQ ID NO: 127969 - protein, 15 aa, Borrelia afzelii
LILNAAKAVEKIGMQ

SEQ ID NO: 127970 - protein, 9 aa, Borrelia afzelii
LILNAAKAV

SEQ ID NO: 127971 - protein, 15 aa, Borrelia afzelii
IRAAKIRVADLTIKF

SEQ ID NO: 127972 - protein, 9 aa, Borrelia afzelii
IRAAKIRVA

SEQ ID NO: 127973 - protein, 15 aa, Borrelia afzelii
QTGGKVGGSQIRAAK

SEQ ID NO: 127974 - protein, 9 aa, Borrelia afzelii
VGGSQIRAA

SEQ ID NO: 127975 - protein, 15 aa, Borrelia afzelii
TQTGGKVGGSQIRAA

SEQ ID NO: 127976 - protein, 9 aa, Borrelia afzelii
GKVGGSQIR

SEQ ID NO: 127977 - protein, 15 aa, Borrelia afzelii
KAVEKIGMQGMKQAV

SEQ ID NO: 127978 - protein, 9 aa, Borrelia afzelii
IGMQGMKQA

SEQ ID NO: 127979 - protein, 15 aa, Borrelia afzelii
DGIIAIVKVMKAKVE

SEQ ID NO: 127980 - protein, 9 aa, Borrelia afzelii
IAIVKVMKA

SEQ ID NO: 127981 - protein, 15 aa, Borrelia afzelii
GIIAIVKVMKAKVEN

SEQ ID NO: 127982 - protein, 9 aa, Borrelia afzelii
VKVMKAKVE

SEQ ID NO: 127983 - protein, 15 aa, Borrelia afzelii
VEKIGMQGMKQAVEE

SEQ ID NO: 127984 - protein, 9 aa, Borrelia afzelii
IGMQGMKQA

SEQ ID NO: 127985 - protein, 15 aa, Borrelia afzelii
AVEKIGMQGMKQAVE

SEQ ID NO: 127986 - protein, 9 aa, Borrelia afzelii
IGMQGMKQA

SEQ ID NO: 127987 - protein, 15 aa, Borrelia afzelii
AKAVEKIGMQGMKQA

SEQ ID NO: 127988 - protein, 9 aa, Borrelia afzelii
VEKIGMQGM

SEQ ID NO: 127989 - protein, 15 aa, Borrelia afzelii
EKIGMQGMKQAVEEA

SEQ ID NO: 127990 - protein, 9 aa, Borrelia afzelii
IGMQGMKQA

SEQ ID NO: 127991 - protein, 15 aa, Borrelia afzelii
IAIVKVMKAKVENIK

SEQ ID NO: 127992 - protein, 9 aa, Borrelia afzelii
VKVMKAKVE

SEQ ID NO: 127993 - protein, 15 aa, Borrelia afzelii
IIAIVKVMKAKVENI

SEQ ID NO: 127994 - protein, 9 aa, Borrelia afzelii
VKVMKAKVE

SEQ ID NO: 127995 - protein, 15 aa, Borrelia afzelii
ADGIIAIVKVMKAKV

SEQ ID NO: 127996 - protein, 9 aa, Borrelia afzelii
IAIVKVMKA

SEQ ID NO: 127997 - protein, 15 aa, Borrelia afzelii
AIVKVMKAKVENIKE

SEQ ID NO: 127998 - protein, 9 aa, Borrelia afzelii
VKVMKAKVE

SEQ ID NO: 127999 - protein, 15 aa, Borrelia afzelii
TTADGIIAIVKVMKA

SEQ ID NO: 128000 - protein, 9 aa, Borrelia afzelii
DGIIAIVKV

SEQ ID NO: 128001 - protein, 15 aa, Borrelia afzelii
KIRVADLTIKFLEAT

SEQ ID NO: 128002 - protein, 9 aa, Borrelia afzelii
VADLTIKFL

SEQ ID NO: 128003 - protein, 15 aa, Borrelia afzelii
IRVADLTIKFLEATE

SEQ ID NO: 128004 - protein, 9 aa, Borrelia afzelii
LTIKFLEAT

SEQ ID NO: 128005 - protein, 15 aa, Borrelia afzelii
TADGIIAIVKVMKAK

SEQ ID NO: 128006 - protein, 9 aa, Borrelia afzelii
IAIVKVMKA

SEQ ID NO: 128007 - protein, 15 aa, Borrelia afzelii
KIGMQGMKQAVEEAA

SEQ ID NO: 128008 - protein, 9 aa, Borrelia afzelii
IGMQGMKQA

SEQ ID NO: 128009 - protein, 15 aa, Borrelia afzelii
IGMQGMKQAVEEAAK

SEQ ID NO: 128010 - protein, 9 aa, Borrelia afzelii
IGMQGMKQA

SEQ ID NO: 128011 - protein, 15 aa, Borrelia afzelii
VADLTIKFLEATEEE

SEQ ID NO: 128012 - protein, 9 aa, Borrelia afzelii
LTIKFLEAT

SEQ ID NO: 128013 - protein, 15 aa, Borrelia afzelii
RVADLTIKFLEATEE

SEQ ID NO: 128014 - protein, 9 aa, Borrelia afzelii
LTIKFLEAT

SEQ ID NO: 128015 - protein, 15 aa, Borrelia afzelii
ADLTIKFLEATEEET

SEQ ID NO: 128016 - protein, 9 aa, Borrelia afzelii
LTIKFLEAT

SEQ ID NO: 128017 - protein, 15 aa, Borrelia afzelii
EDFSGIYDLILNAAK

SEQ ID NO: 128018 - protein, 9 aa, Borrelia afzelii
IYDLILNAA

SEQ ID NO: 128019 - protein, 15 aa, Borrelia afzelii
DAGVKTDAFTETQTG

SEQ ID NO: 128020 - protein, 9 aa, Borrelia afzelii
VKTDAFTET

SEQ ID NO: 128021 - protein, 15 aa, Borrelia afzelii
AGVKTDAFTETQTGG

SEQ ID NO: 128022 - protein, 9 aa, Borrelia afzelii
VKTDAFTET

SEQ ID NO: 128023 - protein, 15 aa, Borrelia afzelii
EDAGVKTDAFTETQT

SEQ ID NO: 128024 - protein, 9 aa, Borrelia afzelii
VKTDAFTET

SEQ ID NO: 128025 - protein, 15 aa, Borrelia afzelii
AEDAGVKTDAFTETQ

SEQ ID NO: 128026 - protein, 9 aa, Borrelia afzelii
VKTDAFTET

SEQ ID NO: 128027 - protein, 15 aa, Borrelia afzelii
RAAKIRVADLTIKFL

SEQ ID NO: 128028 - protein, 9 aa, Borrelia afzelii
IRVADLTIK

SEQ ID NO: 128029 - protein, 15 aa, Borrelia afzelii
EEDFSGIYDLILNAA

SEQ ID NO: 128030 - protein, 9 aa, Borrelia afzelii
FSGIYDLIL

SEQ ID NO: 128031 - protein, 15 aa, Borrelia afzelii
EAEDAGVKTDAFTET

SEQ ID NO: 128032 - protein, 9 aa, Borrelia afzelii
AGVKTDAFT

SEQ ID NO: 128033 - protein, 15 aa, Borrelia afzelii
AAKIRVADLTIKFLE

SEQ ID NO: 128034 - protein, 9 aa, Borrelia afzelii
VADLTIKFL

SEQ ID NO: 128035 - protein, 15 aa, Borrelia afzelii
AKIRVADLTIKFLEA

SEQ ID NO: 128036 - protein, 9 aa, Borrelia afzelii
VADLTIKFL

SEQ ID NO: 128037 - protein, 15 aa, Borrelia afzelii
LNAAKAVEKIGMQGM

SEQ ID NO: 128038 - protein, 9 aa, Borrelia afzelii
LNAAKAVEK

SEQ ID NO: 128039 - protein, 15 aa, Borrelia afzelii
NKIILTLTLLASLLA

SEQ ID NO: 128040 - protein, 9 aa, Borrelia afzelii
IILTLTLLA

SEQ ID NO: 128041 - protein, 15 aa, Borrelia afzelii
IKYNKIILTLTLLAS

SEQ ID NO: 128042 - protein, 9 aa, Borrelia afzelii
IILTLTLLA

SEQ ID NO: 128043 - protein, 15 aa, Borrelia afzelii
MIKYNKIILTLTLLA

SEQ ID NO: 128044 - protein, 9 aa, Borrelia afzelii
YNKIILTLT

SEQ ID NO: 128045 - protein, 15 aa, Borrelia afzelii
KYNKIILTLTLLASL

SEQ ID NO: 128046 - protein, 9 aa, Borrelia afzelii
IILTLTLLA

SEQ ID NO: 128047 - protein, 15 aa, Borrelia afzelii
KIILTLTLLASLLAA

SEQ ID NO: 128048 - protein, 9 aa, Borrelia afzelii
LTLLASLLA

SEQ ID NO: 128049 - protein, 15 aa, Borrelia afzelii
IILTLTLLASLLAAC

SEQ ID NO: 128050 - protein, 9 aa, Borrelia afzelii
LTLLASLLA

SEQ ID NO: 128051 - protein, 15 aa, Borrelia afzelii
YNKIILTLTLLASLL

SEQ ID NO: 128052 - protein, 9 aa, Borrelia afzelii
IILTLTLLA

SEQ ID NO: 128053 - protein, 15 aa, Borrelia afzelii
ILTLTLLASLLAACS

SEQ ID NO: 128054 - protein, 9 aa, Borrelia afzelii
LTLLASLLA

SEQ ID NO: 128055 - protein, 15 aa, Borrelia afzelii
LTLTLLASLLAACSL

SEQ ID NO: 128056 - protein, 9 aa, Borrelia afzelii
LTLLASLLA

SEQ ID NO: 128057 - protein, 15 aa, Borrelia afzelii
LTLLASLLAACSLTG

SEQ ID NO: 128058 - protein, 9 aa, Borrelia afzelii
LTLLASLLA

SEQ ID NO: 128059 - protein, 15 aa, Borrelia afzelii
TLTLLASLLAACSLT

SEQ ID NO: 128060 - protein, 9 aa, Borrelia afzelii
LTLLASLLA

SEQ ID NO: 128061 - protein, 15 aa, Borrelia afzelii
NKIILTLTLLASLLA

SEQ ID NO: 128062 - protein, 9 aa, Borrelia afzelii
IILTLTLLA

SEQ ID NO: 128063 - protein, 15 aa, Borrelia afzelii
IKYNKIILTLTLLAS

SEQ ID NO: 128064 - protein, 9 aa, Borrelia afzelii
IILTLTLLA

SEQ ID NO: 128065 - protein, 15 aa, Borrelia afzelii
KYNKIILTLTLLASL

SEQ ID NO: 128066 - protein, 9 aa, Borrelia afzelii
IILTLTLLA

SEQ ID NO: 128067 - protein, 15 aa, Borrelia afzelii
YNKIILTLTLLASLL

SEQ ID NO: 128068 - protein, 9 aa, Borrelia afzelii
IILTLTLLA

SEQ ID NO: 128069 - protein, 15 aa, Borrelia afzelii
MIKYNKIILTLTLLA

SEQ ID NO: 128070 - protein, 9 aa, Borrelia afzelii
YNKIILTLT

SEQ ID NO: 128071 - protein, 15 aa, Borrelia afzelii
KIILTLTLLASLLAA

SEQ ID NO: 128072 - protein, 9 aa, Borrelia afzelii
IILTLTLLA

SEQ ID NO: 128073 - protein, 15 aa, Borrelia afzelii
IILTLTLLASLLAAC

SEQ ID NO: 128074 - protein, 9 aa, Borrelia afzelii
IILTLTLLA

SEQ ID NO: 128075 - protein, 15 aa, Borrelia afzelii
LTLLASLLAACSLTG

SEQ ID NO: 128076 - protein, 9 aa, Borrelia afzelii
LASLLAACS

SEQ ID NO: 128077 - protein, 15 aa, Borrelia afzelii
LLASLLAACSLTGKA

SEQ ID NO: 128078 - protein, 9 aa, Borrelia afzelii
LLAACSLTG

SEQ ID NO: 128079 - protein, 15 aa, Borrelia afzelii
TLLASLLAACSLTGK

SEQ ID NO: 128080 - protein, 9 aa, Borrelia afzelii
LLAACSLTG

SEQ ID NO: 128081 - protein, 15 aa, Borrelia afzelii
LASLLAACSLTGKAR

SEQ ID NO: 128082 - protein, 9 aa, Borrelia afzelii
LLAACSLTG

SEQ ID NO: 128083 - protein, 15 aa, Borrelia afzelii
ASLLAACSLTGKARL

SEQ ID NO: 128084 - protein, 9 aa, Borrelia afzelii
LLAACSLTG

SEQ ID NO: 128085 - protein, 15 aa, Borrelia afzelii
NKIILTLTLLASLLA

SEQ ID NO: 128086 - protein, 9 aa, Borrelia afzelii
IILTLTLLA

SEQ ID NO: 128087 - protein, 15 aa, Borrelia afzelii
IKYNKIILTLTLLAS

SEQ ID NO: 128088 - protein, 9 aa, Borrelia afzelii
IILTLTLLA

SEQ ID NO: 128089 - protein, 15 aa, Borrelia afzelii
KYNKIILTLTLLASL

SEQ ID NO: 128090 - protein, 9 aa, Borrelia afzelii
IILTLTLLA

SEQ ID NO: 128091 - protein, 15 aa, Borrelia afzelii
MIKYNKIILTLTLLA

SEQ ID NO: 128092 - protein, 9 aa, Borrelia afzelii
YNKIILTLT

SEQ ID NO: 128093 - protein, 15 aa, Borrelia afzelii
YNKIILTLTLLASLL

SEQ ID NO: 128094 - protein, 9 aa, Borrelia afzelii
IILTLTLLA

SEQ ID NO: 128095 - protein, 15 aa, Borrelia afzelii
KVGGSQIRAAKIRVA

SEQ ID NO: 128096 - protein, 9 aa, Borrelia afzelii
GSQIRAAKI

SEQ ID NO: 128097 - protein, 15 aa, Borrelia afzelii
VGGSQIRAAKIRVAD

SEQ ID NO: 128098 - protein, 9 aa, Borrelia afzelii
IRAAKIRVA

SEQ ID NO: 128099 - protein, 15 aa, Borrelia afzelii
GGSQIRAAKIRVADL

SEQ ID NO: 128100 - protein, 9 aa, Borrelia afzelii
IRAAKIRVA

SEQ ID NO: 128101 - protein, 15 aa, Borrelia afzelii
GSQIRAAKIRVADLT

SEQ ID NO: 128102 - protein, 9 aa, Borrelia afzelii
IRAAKIRVA

SEQ ID NO: 128103 - protein, 15 aa, Borrelia afzelii
SQIRAAKIRVADLTI

SEQ ID NO: 128104 - protein, 9 aa, Borrelia afzelii
IRAAKIRVA

SEQ ID NO: 128105 - protein, 15 aa, Borrelia afzelii
YDLILNAAKAVEKIG

SEQ ID NO: 128106 - protein, 9 aa, Borrelia afzelii
LILNAAKAV

SEQ ID NO: 128107 - protein, 15 aa, Borrelia afzelii
GIYDLILNAAKAVEK

SEQ ID NO: 128108 - protein, 9 aa, Borrelia afzelii
LILNAAKAV

SEQ ID NO: 128109 - protein, 15 aa, Borrelia afzelii
IYDLILNAAKAVEKI

SEQ ID NO: 128110 - protein, 9 aa, Borrelia afzelii
LILNAAKAV

SEQ ID NO: 128111 - protein, 15 aa, Borrelia afzelii
IKYNKIILTLTLLAS

SEQ ID NO: 128112 - protein, 9 aa, Borrelia afzelii
YNKIILTLT

SEQ ID NO: 128113 - protein, 15 aa, Borrelia afzelii
MIKYNKIILTLTLLA

SEQ ID NO: 128114 - protein, 9 aa, Borrelia afzelii
YNKIILTLT

SEQ ID NO: 128115 - protein, 15 aa, Borrelia afzelii
KYNKIILTLTLLASL

SEQ ID NO: 128116 - protein, 9 aa, Borrelia afzelii
YNKIILTLT

SEQ ID NO: 128117 - protein, 15 aa, Borrelia afzelii
YNKIILTLTLLASLL

SEQ ID NO: 128118 - protein, 9 aa, Borrelia afzelii
YNKIILTLT

SEQ ID NO: 128119 - protein, 15 aa, Borrelia afzelii
NKIILTLTLLASLLA

SEQ ID NO: 128120 - protein, 9 aa, Borrelia afzelii
ILTLTLLAS

SEQ ID NO: 128121 - protein, 15 aa, Borrelia afzelii
KIILTLTLLASLLAA

SEQ ID NO: 128122 - protein, 9 aa, Borrelia afzelii
LTLLASLLA

SEQ ID NO: 128123 - protein, 15 aa, Borrelia afzelii
DGIIAIVKVMKAKVE

SEQ ID NO: 128124 - protein, 9 aa, Borrelia afzelii
IAIVKVMKA

SEQ ID NO: 128125 - protein, 15 aa, Borrelia afzelii
ADGIIAIVKVMKAKV

SEQ ID NO: 128126 - protein, 9 aa, Borrelia afzelii
IAIVKVMKA

SEQ ID NO: 128127 - protein, 15 aa, Borrelia afzelii
DLILNAAKAVEKIGM

SEQ ID NO: 128128 - protein, 9 aa, Borrelia afzelii
ILNAAKAVE

SEQ ID NO: 128129 - protein, 15 aa, Borrelia afzelii
IYDLILNAAKAVEKI

SEQ ID NO: 128130 - protein, 9 aa, Borrelia afzelii
ILNAAKAVE

SEQ ID NO: 128131 - protein, 15 aa, Borrelia afzelii
GIYDLILNAAKAVEK

SEQ ID NO: 128132 - protein, 9 aa, Borrelia afzelii
ILNAAKAVE

SEQ ID NO: 128133 - protein, 15 aa, Borrelia afzelii
IILTLTLLASLLAAC

SEQ ID NO: 128134 - protein, 9 aa, Borrelia afzelii
LTLLASLLA

SEQ ID NO: 128135 - protein, 15 aa, Borrelia afzelii
GIIAIVKVMKAKVEN

SEQ ID NO: 128136 - protein, 9 aa, Borrelia afzelii
IAIVKVMKA

SEQ ID NO: 128137 - protein, 15 aa, Borrelia afzelii
YDLILNAAKAVEKIG

SEQ ID NO: 128138 - protein, 9 aa, Borrelia afzelii
ILNAAKAVE

SEQ ID NO: 128139 - protein, 15 aa, Borrelia afzelii
TTADGIIAIVKVMKA

SEQ ID NO: 128140 - protein, 9 aa, Borrelia afzelii
IIAIVKVMK

SEQ ID NO: 128141 - protein, 15 aa, Borrelia afzelii
ILTLTLLASLLAACS

SEQ ID NO: 128142 - protein, 9 aa, Borrelia afzelii
LTLLASLLA

SEQ ID NO: 128143 - protein, 15 aa, Borrelia afzelii
TADGIIAIVKVMKAK

SEQ ID NO: 128144 - protein, 9 aa, Borrelia afzelii
IAIVKVMKA

SEQ ID NO: 128145 - protein, 15 aa, Borrelia afzelii
SGIYDLILNAAKAVE

SEQ ID NO: 128146 - protein, 9 aa, Borrelia afzelii
LILNAAKAV

SEQ ID NO: 128147 - protein, 15 aa, Borrelia afzelii
AKAVEKIGMQGMKQA

SEQ ID NO: 128148 - protein, 9 aa, Borrelia afzelii
VEKIGMQGM

SEQ ID NO: 128149 - protein, 15 aa, Borrelia afzelii
LILNAAKAVEKIGMQ

SEQ ID NO: 128150 - protein, 9 aa, Borrelia afzelii
ILNAAKAVE

SEQ ID NO: 128151 - protein, 15 aa, Borrelia afzelii
KAVEKIGMQGMKQAV

SEQ ID NO: 128152 - protein, 9 aa, Borrelia afzelii
IGMQGMKQA

SEQ ID NO: 128153 - protein, 15 aa, Borrelia afzelii
IAIVKVMKAKVENIK

SEQ ID NO: 128154 - protein, 9 aa, Borrelia afzelii
VKVMKAKVE

SEQ ID NO: 128155 - protein, 15 aa, Borrelia afzelii
IIAIVKVMKAKVENI

SEQ ID NO: 128156 - protein, 9 aa, Borrelia afzelii
VKVMKAKVE

SEQ ID NO: 128157 - protein, 15 aa, Borrelia afzelii
KIILTLTLLASLLAA

SEQ ID NO: 128158 - protein, 9 aa, Borrelia afzelii
ILTLTLLAS

SEQ ID NO: 128159 - protein, 15 aa, Borrelia afzelii
NKIILTLTLLASLLA

SEQ ID NO: 128160 - protein, 9 aa, Borrelia afzelii
ILTLTLLAS

SEQ ID NO: 128161 - protein, 15 aa, Borrelia afzelii
KYNKIILTLTLLASL

SEQ ID NO: 128162 - protein, 9 aa, Borrelia afzelii
ILTLTLLAS

SEQ ID NO: 128163 - protein, 15 aa, Borrelia afzelii
IKYNKIILTLTLLAS

SEQ ID NO: 128164 - protein, 9 aa, Borrelia afzelii
KYNKIILTL

SEQ ID NO: 128165 - protein, 15 aa, Borrelia afzelii
YNKIILTLTLLASLL

SEQ ID NO: 128166 - protein, 9 aa, Borrelia afzelii
ILTLTLLAS

SEQ ID NO: 128167 - protein, 15 aa, Borrelia afzelii
QIRAAKIRVADLTIK

SEQ ID NO: 128168 - protein, 9 aa, Borrelia afzelii
IRAAKIRVA

SEQ ID NO: 128169 - protein, 15 aa, Borrelia afzelii
IRAAKIRVADLTIKF

SEQ ID NO: 128170 - protein, 9 aa, Borrelia afzelii
IRVADLTIK

SEQ ID NO: 128171 - protein, 15 aa, Borrelia afzelii
ILTLTLLASLLAACS

SEQ ID NO: 128172 - protein, 9 aa, Borrelia afzelii
ILTLTLLAS

SEQ ID NO: 128173 - protein, 15 aa, Borrelia afzelii
IILTLTLLASLLAAC

SEQ ID NO: 128174 - protein, 9 aa, Borrelia afzelii
ILTLTLLAS

SEQ ID NO: 128175 - protein, 15 aa, Borrelia afzelii
TLLASLLAACSLTGK

SEQ ID NO: 128176 - protein, 9 aa, Borrelia afzelii
LLAACSLTG

SEQ ID NO: 128177 - protein, 15 aa, Borrelia afzelii
LASLLAACSLTGKAR

SEQ ID NO: 128178 - protein, 9 aa, Borrelia afzelii
LLAACSLTG

SEQ ID NO: 128179 - protein, 15 aa, Borrelia afzelii
LLASLLAACSLTGKA

SEQ ID NO: 128180 - protein, 9 aa, Borrelia afzelii
LLAACSLTG

SEQ ID NO: 128181 - protein, 15 aa, Borrelia afzelii
GIYDLILNAAKAVEK

SEQ ID NO: 128182 - protein, 9 aa, Borrelia afzelii
YDLILNAAK

SEQ ID NO: 128183 - protein, 15 aa, Borrelia afzelii
IYDLILNAAKAVEKI

SEQ ID NO: 128184 - protein, 9 aa, Borrelia afzelii
LNAAKAVEK

SEQ ID NO: 128185 - protein, 15 aa, Borrelia afzelii
YDLILNAAKAVEKIG

SEQ ID NO: 128186 - protein, 9 aa, Borrelia afzelii
LNAAKAVEK

SEQ ID NO: 128187 - protein, 15 aa, Borrelia garinii
EIGIQKMTGTVTKEA

SEQ ID NO: 128188 - protein, 9 aa, Borrelia garinii
IQKMTGTVT

SEQ ID NO: 128189 - protein, 15 aa, Borrelia garinii
IGIQKMTGTVTKEAE

SEQ ID NO: 128190 - protein, 9 aa, Borrelia garinii
IQKMTGTVT

SEQ ID NO: 128191 - protein, 15 aa, Borrelia garinii
LEEIGIQKMTGTVTK

SEQ ID NO: 128192 - protein, 9 aa, Borrelia garinii
IQKMTGTVT

SEQ ID NO: 128193 - protein, 15 aa, Borrelia garinii
EEIGIQKMTGTVTKE

SEQ ID NO: 128194 - protein, 9 aa, Borrelia garinii
IQKMTGTVT

SEQ ID NO: 128195 - protein, 15 aa, Borrelia garinii
PLEEIGIQKMTGTVT

SEQ ID NO: 128196 - protein, 9 aa, Borrelia garinii
IGIQKMTGT

SEQ ID NO: 128197 - protein, 15 aa, Borrelia garinii
LLKLSLIVSLLVACG

SEQ ID NO: 128198 - protein, 9 aa, Borrelia garinii
LSLIVSLLV

SEQ ID NO: 128199 - protein, 15 aa, Borrelia garinii
LKLSLIVSLLVACGL

SEQ ID NO: 128200 - protein, 9 aa, Borrelia garinii
IVSLLVACG

SEQ ID NO: 128201 - protein, 15 aa, Borrelia garinii
LSLIVSLLVACGLTG

SEQ ID NO: 128202 - protein, 9 aa, Borrelia garinii
IVSLLVACG

SEQ ID NO: 128203 - protein, 15 aa, Borrelia garinii
IQKMTGTVTKEAEKT

SEQ ID NO: 128204 - protein, 9 aa, Borrelia garinii
IQKMTGTVT

SEQ ID NO: 128205 - protein, 15 aa, Borrelia garinii
SLIVSLLVACGLTGE

SEQ ID NO: 128206 - protein, 9 aa, Borrelia garinii
IVSLLVACG

SEQ ID NO: 128207 - protein, 15 aa, Borrelia garinii
KLSLIVSLLVACGLT

SEQ ID NO: 128208 - protein, 9 aa, Borrelia garinii
IVSLLVACG

SEQ ID NO: 128209 - protein, 15 aa, Borrelia garinii
GIQKMTGTVTKEAEK

SEQ ID NO: 128210 - protein, 9 aa, Borrelia garinii
IQKMTGTVT

SEQ ID NO: 128211 - protein, 15 aa, Borrelia garinii
NKILLKLSLIVSLLV

SEQ ID NO: 128212 - protein, 9 aa, Borrelia garinii
LKLSLIVSL

SEQ ID NO: 128213 - protein, 15 aa, Borrelia garinii
IKYNKILLKLSLIVS

SEQ ID NO: 128214 - protein, 9 aa, Borrelia garinii
YNKILLKLS

SEQ ID NO: 128215 - protein, 15 aa, Borrelia garinii
KILLKLSLIVSLLVA

SEQ ID NO: 128216 - protein, 9 aa, Borrelia garinii
LKLSLIVSL

SEQ ID NO: 128217 - protein, 15 aa, Borrelia garinii
YNKILLKLSLIVSLL

SEQ ID NO: 128218 - protein, 9 aa, Borrelia garinii
LKLSLIVSL

SEQ ID NO: 128219 - protein, 15 aa, Borrelia garinii
KYNKILLKLSLIVSL

SEQ ID NO: 128220 - protein, 9 aa, Borrelia garinii
ILLKLSLIV

SEQ ID NO: 128221 - protein, 15 aa, Borrelia garinii
MIKYNKILLKLSLIV

SEQ ID NO: 128222 - protein, 9 aa, Borrelia garinii
YNKILLKLS

SEQ ID NO: 128223 - protein, 15 aa, Borrelia garinii
ILLKLSLIVSLLVAC

SEQ ID NO: 128224 - protein, 9 aa, Borrelia garinii
LKLSLIVSL

SEQ ID NO: 128225 - protein, 15 aa, Borrelia garinii
LIVSLLVACGLTGET

SEQ ID NO: 128226 - protein, 9 aa, Borrelia garinii
IVSLLVACG

SEQ ID NO: 128227 - protein, 15 aa, Borrelia garinii
IVSLLVACGLTGETK

SEQ ID NO: 128228 - protein, 9 aa, Borrelia garinii
IVSLLVACG

SEQ ID NO: 128229 - protein, 15 aa, Borrelia garinii
QKMTGTVTKEAEKTP

SEQ ID NO: 128230 - protein, 9 aa, Borrelia garinii
MTGTVTKEA

SEQ ID NO: 128231 - protein, 15 aa, Borrelia garinii
AEKLKKSGSSGAFSA

SEQ ID NO: 128232 - protein, 9 aa, Borrelia garinii
LKKSGSSGA

SEQ ID NO: 128233 - protein, 15 aa, Borrelia garinii
EAEKLKKSGSSGAFS

SEQ ID NO: 128234 - protein, 9 aa, Borrelia garinii
LKKSGSSGA

SEQ ID NO: 128235 - protein, 15 aa, Borrelia garinii
EKLKKSGSSGAFSAM

SEQ ID NO: 128236 - protein, 9 aa, Borrelia garinii
LKKSGSSGA

SEQ ID NO: 128237 - protein, 15 aa, Borrelia garinii
EEAEKLKKSGSSGAF

SEQ ID NO: 128238 - protein, 9 aa, Borrelia garinii
LKKSGSSGA

SEQ ID NO: 128239 - protein, 15 aa, Borrelia garinii
KEEAEKLKKSGSSGA

SEQ ID NO: 128240 - protein, 9 aa, Borrelia garinii
AEKLKKSGS

SEQ ID NO: 128241 - protein, 15 aa, Borrelia garinii
LKNLEEKANTAATTT

SEQ ID NO: 128242 - protein, 9 aa, Borrelia garinii
LEEKANTAA

SEQ ID NO: 128243 - protein, 15 aa, Borrelia garinii
FILKAKIKAIQVAER

SEQ ID NO: 128244 - protein, 9 aa, Borrelia garinii
AKIKAIQVA

SEQ ID NO: 128245 - protein, 15 aa, Borrelia garinii
ILKAKIKAIQVAERF

SEQ ID NO: 128246 - protein, 9 aa, Borrelia garinii
IKAIQVAER

SEQ ID NO: 128247 - protein, 15 aa, Borrelia garinii
VSLLVACGLTGETKI

SEQ ID NO: 128248 - protein, 9 aa, Borrelia garinii
LLVACGLTG

SEQ ID NO: 128249 - protein, 15 aa, Borrelia garinii
SGSSGAFSAMYDLMI

SEQ ID NO: 128250 - protein, 9 aa, Borrelia garinii
SSGAFSAMY

SEQ ID NO: 128251 - protein, 15 aa, Borrelia garinii
LKAKIKAIQVAERFV

SEQ ID NO: 128252 - protein, 9 aa, Borrelia garinii
IKAIQVAER

SEQ ID NO: 128253 - protein, 15 aa, Borrelia garinii
ADGIIAIAQAMEEKL

SEQ ID NO: 128254 - protein, 9 aa, Borrelia garinii
IAIAQAMEE

SEQ ID NO: 128255 - protein, 15 aa, Borrelia garinii
FSAMYDLMIDVSKPL

SEQ ID NO: 128256 - protein, 9 aa, Borrelia garinii
FSAMYDLMI

SEQ ID NO: 128257 - protein, 15 aa, Borrelia garinii
KMTGTVTKEAEKTPP

SEQ ID NO: 128258 - protein, 9 aa, Borrelia garinii
MTGTVTKEA

SEQ ID NO: 128259 - protein, 15 aa, Borrelia garinii
MTGTVTKEAEKTPPT

SEQ ID NO: 128260 - protein, 9 aa, Borrelia garinii
MTGTVTKEA

SEQ ID NO: 128261 - protein, 15 aa, Borrelia garinii
ALKNLEEKANTAATT

SEQ ID NO: 128262 - protein, 9 aa, Borrelia garinii
LEEKANTAA

SEQ ID NO: 128263 - protein, 15 aa, Borrelia garinii
SGAFSAMYDLMIDVS

SEQ ID NO: 128264 - protein, 9 aa, Borrelia garinii
FSAMYDLMI

SEQ ID NO: 128265 - protein, 15 aa, Borrelia garinii
TTADGIIAIAQAMEE

SEQ ID NO: 128266 - protein, 9 aa, Borrelia garinii
GIIAIAQAM

SEQ ID NO: 128267 - protein, 15 aa, Borrelia garinii
GAFSAMYDLMIDVSK

SEQ ID NO: 128268 - protein, 9 aa, Borrelia garinii
FSAMYDLMI

SEQ ID NO: 128269 - protein, 15 aa, Borrelia garinii
TADGIIAIAQAMEEK

SEQ ID NO: 128270 - protein, 9 aa, Borrelia garinii
IAIAQAMEE

SEQ ID NO: 128271 - protein, 15 aa, Borrelia garinii
LLVACGLTGETKIRL

SEQ ID NO: 128272 - protein, 9 aa, Borrelia garinii
LLVACGLTG

SEQ ID NO: 128273 - protein, 15 aa, Borrelia garinii
KLKKSGSSGAFSAMY

SEQ ID NO: 128274 - protein, 9 aa, Borrelia garinii
LKKSGSSGA

SEQ ID NO: 128275 - protein, 15 aa, Borrelia garinii
GSSGAFSAMYDLMID

SEQ ID NO: 128276 - protein, 9 aa, Borrelia garinii
FSAMYDLMI

SEQ ID NO: 128277 - protein, 15 aa, Borrelia garinii
LKKSGSSGAFSAMYD

SEQ ID NO: 128278 - protein, 9 aa, Borrelia garinii
LKKSGSSGA

SEQ ID NO: 128279 - protein, 15 aa, Borrelia garinii
KAKIKAIQVAERFVK

SEQ ID NO: 128280 - protein, 9 aa, Borrelia garinii
IKAIQVAER

SEQ ID NO: 128281 - protein, 15 aa, Borrelia garinii
VKFEAFTNTQTGSKI

SEQ ID NO: 128282 - protein, 9 aa, Borrelia garinii
FEAFTNTQT

SEQ ID NO: 128283 - protein, 15 aa, Borrelia garinii
DGIIAIAQAMEEKLN

SEQ ID NO: 128284 - protein, 9 aa, Borrelia garinii
IAIAQAMEE

SEQ ID NO: 128285 - protein, 15 aa, Borrelia garinii
SSGAFSAMYDLMIDV

SEQ ID NO: 128286 - protein, 9 aa, Borrelia garinii
FSAMYDLMI

SEQ ID NO: 128287 - protein, 15 aa, Borrelia garinii
AKIKAIQVAERFVKA

SEQ ID NO: 128288 - protein, 9 aa, Borrelia garinii
IKAIQVAER

SEQ ID NO: 128289 - protein, 15 aa, Borrelia garinii
GVKFEAFTNTQTGSK

SEQ ID NO: 128290 - protein, 9 aa, Borrelia garinii
FEAFTNTQT

SEQ ID NO: 128291 - protein, 15 aa, Borrelia garinii
GIIAIAQAMEEKLNN

SEQ ID NO: 128292 - protein, 9 aa, Borrelia garinii
IAIAQAMEE

SEQ ID NO: 128293 - protein, 15 aa, Borrelia garinii
PEFILKAKIKAIQVA

SEQ ID NO: 128294 - protein, 9 aa, Borrelia garinii
ILKAKIKAI

SEQ ID NO: 128295 - protein, 15 aa, Borrelia garinii
LLKLSLIVSLLVACG

SEQ ID NO: 128296 - protein, 9 aa, Borrelia garinii
LSLIVSLLV

SEQ ID NO: 128297 - protein, 15 aa, Borrelia garinii
LKLSLIVSLLVACGL

SEQ ID NO: 128298 - protein, 9 aa, Borrelia garinii
LSLIVSLLV

SEQ ID NO: 128299 - protein, 15 aa, Borrelia garinii
NKILLKLSLIVSLLV

SEQ ID NO: 128300 - protein, 9 aa, Borrelia garinii
ILLKLSLIV

SEQ ID NO: 128301 - protein, 15 aa, Borrelia garinii
ILLKLSLIVSLLVAC

SEQ ID NO: 128302 - protein, 9 aa, Borrelia garinii
LSLIVSLLV

SEQ ID NO: 128303 - protein, 15 aa, Borrelia garinii
KILLKLSLIVSLLVA

SEQ ID NO: 128304 - protein, 9 aa, Borrelia garinii
LSLIVSLLV

SEQ ID NO: 128305 - protein, 15 aa, Borrelia garinii
GVKFEAFTNTQTGSK

SEQ ID NO: 128306 - protein, 9 aa, Borrelia garinii
KFEAFTNTQ

SEQ ID NO: 128307 - protein, 15 aa, Borrelia garinii
VKFEAFTNTQTGSKI

SEQ ID NO: 128308 - protein, 9 aa, Borrelia garinii
KFEAFTNTQ

SEQ ID NO: 128309 - protein, 15 aa, Borrelia garinii
EGVKFEAFTNTQTGS

SEQ ID NO: 128310 - protein, 9 aa, Borrelia garinii
KFEAFTNTQ

SEQ ID NO: 128311 - protein, 15 aa, Borrelia garinii
KEGVKFEAFTNTQTG

SEQ ID NO: 128312 - protein, 9 aa, Borrelia garinii
KFEAFTNTQ

SEQ ID NO: 128313 - protein, 15 aa, Borrelia garinii
KFEAFTNTQTGSKIS

SEQ ID NO: 128314 - protein, 9 aa, Borrelia garinii
KFEAFTNTQ

SEQ ID NO: 128315 - protein, 15 aa, Borrelia garinii
KKEGVKFEAFTNTQT

SEQ ID NO: 128316 - protein, 9 aa, Borrelia garinii
KFEAFTNTQ

SEQ ID NO: 128317 - protein, 15 aa, Borrelia garinii
AKKEGVKFEAFTNTQ

SEQ ID NO: 128318 - protein, 9 aa, Borrelia garinii
VKFEAFTNT

SEQ ID NO: 128319 - protein, 15 aa, Borrelia garinii
LIVSLLVACGLTGET

SEQ ID NO: 128320 - protein, 9 aa, Borrelia garinii
LLVACGLTG

SEQ ID NO: 128321 - protein, 15 aa, Borrelia garinii
IVSLLVACGLTGETK

SEQ ID NO: 128322 - protein, 9 aa, Borrelia garinii
LLVACGLTG

SEQ ID NO: 128323 - protein, 15 aa, Borrelia garinii
LSLIVSLLVACGLTG

SEQ ID NO: 128324 - protein, 9 aa, Borrelia garinii
IVSLLVACG

SEQ ID NO: 128325 - protein, 15 aa, Borrelia garinii
SLIVSLLVACGLTGE

SEQ ID NO: 128326 - protein, 9 aa, Borrelia garinii
LLVACGLTG

SEQ ID NO: 128327 - protein, 15 aa, Borrelia garinii
VSLLVACGLTGETKI

SEQ ID NO: 128328 - protein, 9 aa, Borrelia garinii
LLVACGLTH

SEQ ID NO: 128329 - protein, 15 aa, Borrelia garinii
GVKFEAFTNTQTGSK

SEQ ID NO: 128330 - protein, 9 aa, Borrelia garinii
FEAFTNTQT

SEQ ID NO: 128331 - protein, 15 aa, Borrelia garinii
KEGVKFEAFTNTQTG

SEQ ID NO: 128332 - protein, 9 aa, Borrelia garinii
FEAFTNTQT

SEQ ID NO: 128333 - protein, 15 aa, Borrelia garinii
VKFEAFTNTQTGSKI

SEQ ID NO: 128334 - protein, 9 aa, Borrelia garinii
FEAFTNTQT

SEQ ID NO: 128335 - protein, 15 aa, Borrelia garinii
KKEGVKFEAFTNTQT

SEQ ID NO: 128336 - protein, 9 aa, Borrelia garinii
GVKFEAFTN

SEQ ID NO: 128337 - protein, 15 aa, Borrelia garinii
EGVKFEAFTNTQTGS

SEQ ID NO: 128338 - protein, 9 aa, Borrelia garinii
FEAFTNTQT

SEQ ID NO: 128339 - protein, 15 aa, Borrelia garinii
NKILLKLSLIVSLLV

SEQ ID NO: 128340 - protein, 9 aa, Borrelia garinii
ILLKLSLIV

SEQ ID NO: 128341 - protein, 15 aa, Borrelia garinii
KILLKLSLIVSLLVA

SEQ ID NO: 128342 - protein, 9 aa, Borrelia garinii
LSLIVSLLV

SEQ ID NO: 128343 - protein, 15 aa, Borrelia garinii
ILLKLSLIVSLLVAC

SEQ ID NO: 128344 - protein, 9 aa, Borrelia garinii
LSLIVSLLV

SEQ ID NO: 128345 - protein, 15 aa, Borrelia garinii
LEEIGIQKMTGTVTK

SEQ ID NO: 128346 - protein, 9 aa, Borrelia garinii
IGIQKMTGT

SEQ ID NO: 128347 - protein, 15 aa, Borrelia garinii
EEIGIQKMTGTVTKE

SEQ ID NO: 128348 - protein, 9 aa, Borrelia garinii
IGIQKMTGT

SEQ ID NO: 128349 - protein, 15 aa, Borrelia garinii
PLEEIGIQKMTGTVT

SEQ ID NO: 128350 - protein, 9 aa, Borrelia garinii
IGIQKMTGT

SEQ ID NO: 128351 - protein, 15 aa, Borrelia garinii
EIGIQKMTGTVTKEA

SEQ ID NO: 128352 - protein, 9 aa, Borrelia garinii
IGIQKMTGT

SEQ ID NO: 128353 - protein, 15 aa, Borrelia garinii
IGIQKMTGTVTKEAE

SEQ ID NO: 128354 - protein, 9 aa, Borrelia garinii
IGIQKMTGT

SEQ ID NO: 128355 - protein, 15 aa, Borrelia garinii
NKILLKLSLIVSLLV

SEQ ID NO: 128356 - protein, 9 aa, Borrelia garinii
LLKLSLIVS

SEQ ID NO: 128357 - protein, 15 aa, Borrelia garinii
KILLKLSLIVSLLVA

SEQ ID NO: 128358 - protein, 9 aa, Borrelia garinii
LLKLSLIVS

SEQ ID NO: 128359 - protein, 15 aa, Borrelia garinii
IKYNKILLKLSLIVS

SEQ ID NO: 128360 - protein, 9 aa, Borrelia garinii
IKYNKILLK

SEQ ID NO: 128361 - protein, 15 aa, Borrelia garinii
KPLEEIGIQKMTGTV

SEQ ID NO: 128362 - protein, 9 aa, Borrelia garinii
IGIQKMTGT

SEQ ID NO: 128363 - protein, 15 aa, Borrelia garinii
YNKILLKLSLIVSLL

SEQ ID NO: 128364 - protein, 9 aa, Borrelia garinii
LLKLSLIVS

SEQ ID NO: 128365 - protein, 15 aa, Borrelia garinii
SKPLEEIGIQKMTGT

SEQ ID NO: 128366 - protein, 9 aa, Borrelia garinii
LEEIGIQKM

SEQ ID NO: 128367 - protein, 15 aa, Borrelia garinii
KYNKILLKLSLIVSL

SEQ ID NO: 128368 - protein, 9 aa, Borrelia garinii
LLKLSLIVS

SEQ ID NO: 128369 - protein, 15 aa, Borrelia garinii
MIKYNKILLKLSLIV

SEQ ID NO: 128370 - protein, 9 aa, Borrelia garinii
IKYNKILLK

SEQ ID NO: 128371 - protein, 15 aa, Borrelia garinii
ILLKLSLIVSLLVAC

SEQ ID NO: 128372 - protein, 9 aa, Borrelia garinii
LLKLSLIVS

SEQ ID NO: 128373 - protein, 15 aa, Borrelia garinii
LLKLSLIVSLLVACG

SEQ ID NO: 128374 - protein, 9 aa, Borrelia garinii
LLKLSLIVS

SEQ ID NO: 128375 - protein, 15 aa, Borrelia garinii
LKLSLIVSLLVACGL

SEQ ID NO: 128376 - protein, 9 aa, Borrelia garinii
LSLIVSLLV

SEQ ID NO: 128377 - protein, 15 aa, Borrelia garinii
AMEEKLNNVNKKQHD

SEQ ID NO: 128378 - protein, 9 aa, Borrelia garinii
LNNVNKKQH

SEQ ID NO: 128379 - protein, 15 aa, Borrelia garinii
MEEKLNNVNKKQHDA

SEQ ID NO: 128380 - protein, 9 aa, Borrelia garinii
LNNVNKKQH

SEQ ID NO: 128381 - protein, 15 aa, Borrelia garinii
EEKLNNVNKKQHDAL

SEQ ID NO: 128382 - protein, 9 aa, Borrelia garinii
LNNVNKKQH

SEQ ID NO: 128383 - protein, 15 aa, Borrelia garinii
EKLNNVNKKQHDALK

SEQ ID NO: 128384 - protein, 9 aa, Borrelia garinii
LNNVNKKQH

SEQ ID NO: 128385 - protein, 15 aa, Borrelia garinii
KDEINKIKANAKKEG

SEQ ID NO: 128386 - protein, 9 aa, Borrelia garinii
INKIKANAK

SEQ ID NO: 128387 - protein, 15 aa, Borrelia garinii
DEINKIKANAKKEGV

SEQ ID NO: 128388 - protein, 9 aa, Borrelia garinii
IKANAKKEG

SEQ ID NO: 128389 - protein, 15 aa, Borrelia garinii
KLSLIVSLLVACGLT

SEQ ID NO: 128390 - protein, 9 aa, Borrelia garinii
LSLIVSLLV

SEQ ID NO: 128391 - protein, 15 aa, Borrelia garinii
LSLIVSLLVACGLTG

SEQ ID NO: 128392 - protein, 9 aa, Borrelia garinii
LSLIVSLLV

SEQ ID NO: 128393 - protein, 15 aa, Borrelia garinii
EINKIKANAKKEGVK

SEQ ID NO: 128394 - protein, 9 aa, Borrelia garinii
IKANAKKEG

SEQ ID NO: 128395 - protein, 15 aa, Borrelia garinii
PEFILKAKIKAIQVA

SEQ ID NO: 128396 - protein, 9 aa, Borrelia garinii
FILKAKIKA

SEQ ID NO: 128397 - protein, 15 aa, Borrelia garinii
KPEFILKAKIKAIQV

SEQ ID NO: 128398 - protein, 9 aa, Borrelia garinii
FILKAKIKA

SEQ ID NO: 128399 - protein, 15 aa, Borrelia garinii
INKIKANAKKEGVKF

SEQ ID NO: 128400 - protein, 9 aa, Borrelia garinii
IKANAKKEG

SEQ ID NO: 128401 - protein, 15 aa, Borrelia garinii
EKPEFILKAKIKAIQ

SEQ ID NO: 128402 - protein, 9 aa, Borrelia garinii
FILKAKIKA

SEQ ID NO: 128403 - protein, 15 aa, Borrelia garinii
GIQKMTGTVTKEAEK

SEQ ID NO: 128404 - protein, 9 aa, Borrelia garinii
IQKMTGTVT

SEQ ID NO: 128405 - protein, 15 aa, Borrelia garinii
IKYNKILLKLSLIVS

SEQ ID NO: 128406 - protein, 9 aa, Borrelia garinii
ILLKLSLIV

SEQ ID NO: 128407 - protein, 15 aa, Borrelia garinii
NKILLKLSLIVSLLV

SEQ ID NO: 128408 - protein, 9 aa, Borrelia garinii
LLKLSLIVS

SEQ ID NO: 128409 - protein, 15 aa, Borrelia garinii
KYNKILLKLSLIVSL

SEQ ID NO: 128410 - protein, 9 aa, Borrelia garinii
LLKLSLIVS

SEQ ID NO: 128411 - protein, 15 aa, Borrelia garinii
YNKILLKLSLIVSLL

SEQ ID NO: 128412 - protein, 9 aa, Borrelia garinii
LLKLSLIVS

SEQ ID NO: 128413 - protein, 15 aa, Borrelia garinii
KILLKLSLIVSLLVA

SEQ ID NO: 128414 - protein, 9 aa, Borrelia garinii
LLKLSLIVS

SEQ ID NO: 128415 - protein, 15 aa, Borrelia garinii
ILLKLSLIVSLLVAC

SEQ ID NO: 128416 - protein, 9 aa, Borrelia garinii
LLKLSLIVS

SEQ ID NO: 128417 - protein, 15 aa, Borrelia garinii
LLKLSLIVSLLVACG

SEQ ID NO: 128418 - protein, 9 aa, Borrelia garinii
LLKLSLIVS

SEQ ID NO: 128419 - protein, 15 aa, Borrelia garinii
MIKYNKILLKLSLIV

SEQ ID NO: 128420 - protein, 9 aa, Borrelia garinii
IKYNKILLK

SEQ ID NO: 128421 - protein, 15 aa, Borrelia garinii
GVKFEAFTNTQTGSK

SEQ ID NO: 128422 - protein, 9 aa, Borrelia garinii
FEAFTNTQT

SEQ ID NO: 128423 - protein, 15 aa, Borrelia garinii
KAKIKAIQVAERFVK

SEQ ID NO: 128424 - protein, 9 aa, Borrelia garinii
IKAIQVAER

SEQ ID NO: 128425 - protein, 15 aa, Borrelia garinii
VKFEAFTNTQTGSKI

SEQ ID NO: 128426 - protein, 9 aa, Borrelia garinii
FTNTQTGSK

SEQ ID NO: 128427 - protein, 15 aa, Borrelia garinii
AKIKAIQVAERFVKA

SEQ ID NO: 128428 - protein, 9 aa, Borrelia garinii
IQVAERFVK

SEQ ID NO: 128429 - protein, 15 aa, Borrelia burgdorferi
LEDVGIIGLKARVLE

SEQ ID NO: 128430 - protein, 9 aa, Borrelia burgdorferi
IIGLKARVL

SEQ ID NO: 128431 - protein, 15 aa, Borrelia burgdorferi
EDVGIIGLKARVLEE

SEQ ID NO: 128432 - protein, 9 aa, Borrelia burgdorferi
IIGLKARVL

SEQ ID NO: 128433 - protein, 15 aa, Borrelia burgdorferi
DVGIIGLKARVLEES

SEQ ID NO: 128434 - protein, 9 aa, Borrelia burgdorferi
IIGLKARVL

SEQ ID NO: 128435 - protein, 15 aa, Borrelia burgdorferi
VGIIGLKARVLEESK

SEQ ID NO: 128436 - protein, 9 aa, Borrelia burgdorferi
IIGLKARVL

SEQ ID NO: 128437 - protein, 15 aa, Borrelia burgdorferi
ALFFKLLVACSIGLV

SEQ ID NO: 128438 - protein, 9 aa, Borrelia burgdorferi
FKLLVACSI

SEQ ID NO: 128439 - protein, 15 aa, Borrelia burgdorferi
IALFFKLLVACSIGL

SEQ ID NO: 128440 - protein, 9 aa, Borrelia burgdorferi
FKLLVACSI

SEQ ID NO: 128441 - protein, 15 aa, Borrelia burgdorferi
GIIGLKARVLEESKN

SEQ ID NO: 128442 - protein, 9 aa, Borrelia burgdorferi
IIGLKARVL

SEQ ID NO: 128443 - protein, 15 aa, Borrelia burgdorferi
IIGLKARVLEESKNN

SEQ ID NO: 128444 - protein, 9 aa, Borrelia burgdorferi
IIGLKARVL

SEQ ID NO: 128445 - protein, 15 aa, Borrelia burgdorferi
IVIALFFKLLVACSI

SEQ ID NO: 128446 - protein, 9 aa, Borrelia burgdorferi
FFKLLVACS

SEQ ID NO: 128447 - protein, 15 aa, Borrelia burgdorferi
VIALFFKLLVACSIG

SEQ ID NO: 128448 - protein, 9 aa, Borrelia burgdorferi
FKLLVACSI

SEQ ID NO: 128449 - protein, 15 aa, Borrelia burgdorferi
LFFKLLVACSIGLVE

SEQ ID NO: 128450 - protein, 9 aa, Borrelia burgdorferi
FKLLVACSI

SEQ ID NO: 128451 - protein, 15 aa, Borrelia burgdorferi
SGQFLAMFDLMLEVV

SEQ ID NO: 128452 - protein, 9 aa, Borrelia burgdorferi
FLAMFDLML

SEQ ID NO: 128453 - protein, 15 aa, Borrelia burgdorferi
GQFLAMFDLMLEVVE

SEQ ID NO: 128454 - protein, 9 aa, Borrelia burgdorferi
FLAMFDLML

SEQ ID NO: 128455 - protein, 15 aa, Borrelia burgdorferi
SIVIALFFKLLVACS

SEQ ID NO: 128456 - protein, 9 aa, Borrelia burgdorferi
VIALFFKLL

SEQ ID NO: 128457 - protein, 15 aa, Borrelia burgdorferi
FFKLLVACSIGLVER

SEQ ID NO: 128458 - protein, 9 aa, Borrelia burgdorferi
LLVACSIGL

SEQ ID NO: 128459 - protein, 15 aa, Borrelia burgdorferi
GSKVTSGGLALREAK

SEQ ID NO: 128460 - protein, 9 aa, Borrelia burgdorferi
VTSGGLALR

SEQ ID NO: 128461 - protein, 15 aa, Borrelia burgdorferi
TGSKVTSGGLALREA

SEQ ID NO: 128462 - protein, 9 aa, Borrelia burgdorferi
VTSGGLALR

SEQ ID NO: 128463 - protein, 15 aa, Borrelia burgdorferi
SKVTSGGLALREAKV

SEQ ID NO: 128464 - protein, 9 aa, Borrelia burgdorferi
VTSGGLALR

SEQ ID NO: 128465 - protein, 15 aa, Borrelia burgdorferi
FKLLVACSIGLVERT

SEQ ID NO: 128466 - protein, 9 aa, Borrelia burgdorferi
LLVACSIGL

SEQ ID NO: 128467 - protein, 15 aa, Borrelia burgdorferi
FLAMFDLMLEVVESL

SEQ ID NO: 128468 - protein, 9 aa, Borrelia burgdorferi
FLAMFDLML

SEQ ID NO: 128469 - protein, 15 aa, Borrelia burgdorferi
QFLAMFDLMLEVVES

SEQ ID NO: 128470 - protein, 9 aa, Borrelia burgdorferi
FLAMFDLML

SEQ ID NO: 128471 - protein, 15 aa, Borrelia burgdorferi
FEAFTGLKTGSKVTS

SEQ ID NO: 128472 - protein, 9 aa, Borrelia burgdorferi
FTGLKTGSK

SEQ ID NO: 128473 - protein, 15 aa, Borrelia burgdorferi
TSGGLALREAKVQAI

SEQ ID NO: 128474 - protein, 9 aa, Borrelia burgdorferi
LALREAKVQ

SEQ ID NO: 128475 - protein, 15 aa, Borrelia burgdorferi
SGGLALREAKVQAIV

SEQ ID NO: 128476 - protein, 9 aa, Borrelia burgdorferi
LREAKVQAI

SEQ ID NO: 128477 - protein, 15 aa, Borrelia burgdorferi
EAFTGLKTGSKVTSG

SEQ ID NO: 128478 - protein, 9 aa, Borrelia burgdorferi
LKTGSKVTS

SEQ ID NO: 128479 - protein, 15 aa, Borrelia burgdorferi
LKTGSKVTSGGLALR

SEQ ID NO: 128480 - protein, 9 aa, Borrelia burgdorferi
LKTGSKVTS

SEQ ID NO: 128481 - protein, 15 aa, Borrelia burgdorferi
GNSGQFLAMFDLMLE

SEQ ID NO: 128482 - protein, 9 aa, Borrelia burgdorferi
FLAMFDLML

SEQ ID NO: 128483 - protein, 15 aa, Borrelia burgdorferi
NSGQFLAMFDLMLEV

SEQ ID NO: 128484 - protein, 9 aa, Borrelia burgdorferi
FLAMFDLML

SEQ ID NO: 128485 - protein, 15 aa, Borrelia burgdorferi
KTGSKVTSGGLALRE

SEQ ID NO: 128486 - protein, 9 aa, Borrelia burgdorferi
VTSGGLALR

SEQ ID NO: 128487 - protein, 15 aa, Borrelia burgdorferi
AFTGLKTGSKVTSGG

SEQ ID NO: 128488 - protein, 9 aa, Borrelia burgdorferi
LKTGSKVTS

SEQ ID NO: 128489 - protein, 15 aa, Borrelia burgdorferi
FTGLKTGSKVTSGGL

SEQ ID NO: 128490 - protein, 9 aa, Borrelia burgdorferi
LKTGSKVTS

SEQ ID NO: 128491 - protein, 15 aa, Borrelia burgdorferi
KVTSGGLALREAKVQ

SEQ ID NO: 128492 - protein, 9 aa, Borrelia burgdorferi
VTSGGLALR

SEQ ID NO: 128493 - protein, 15 aa, Borrelia burgdorferi
GGLALREAKVQAIVE

SEQ ID NO: 128494 - protein, 9 aa, Borrelia burgdorferi
LREAKVQAI

SEQ ID NO: 128495 - protein, 15 aa, Borrelia burgdorferi
VTSGGLALREAKVQA

SEQ ID NO: 128496 - protein, 9 aa, Borrelia burgdorferi
VTSGGLALR

SEQ ID NO: 128497 - protein, 15 aa, Borrelia burgdorferi
GLALREAKVQAIVET

SEQ ID NO: 128498 - protein, 9 aa, Borrelia burgdorferi
LREAKVQAI

SEQ ID NO: 128499 - protein, 15 aa, Borrelia burgdorferi
LALREAKVQAIVETG

SEQ ID NO: 128500 - protein, 9 aa, Borrelia burgdorferi
LREAKVQAI

SEQ ID NO: 128501 - protein, 15 aa, Borrelia burgdorferi
VLFEAFTGLKTGSKV

SEQ ID NO: 128502 - protein, 9 aa, Borrelia burgdorferi
FTGLKTGSK

SEQ ID NO: 128503 - protein, 15 aa, Borrelia burgdorferi
GVLFEAFTGLKTGSK

SEQ ID NO: 128504 - protein, 9 aa, Borrelia burgdorferi
FEAFTGLKT

SEQ ID NO: 128505 - protein, 15 aa, Borrelia burgdorferi
TGLKTGSKVTSGGLA

SEQ ID NO: 128506 - protein, 9 aa, Borrelia burgdorferi
LKTGSKVTS

SEQ ID NO: 128507 - protein, 15 aa, Borrelia burgdorferi
TGNSGQFLAMFDLML

SEQ ID NO: 128508 - protein, 9 aa, Borrelia burgdorferi
GQFLAMFDL

SEQ ID NO: 128509 - protein, 15 aa, Borrelia burgdorferi
INTAERLLAAKAQIE

SEQ ID NO: 128510 - protein, 9 aa, Borrelia burgdorferi
AERLLAAKA

SEQ ID NO: 128511 - protein, 15 aa, Borrelia burgdorferi
LFEAFTGLKTGSKVT

SEQ ID NO: 128512 - protein, 9 aa, Borrelia burgdorferi
FTGLKTGSK

SEQ ID NO: 128513 - protein, 15 aa, Borrelia burgdorferi
NTAERLLAAKAQIEN

SEQ ID NO: 128514 - protein, 9 aa, Borrelia burgdorferi
LLAAKAQIE

SEQ ID NO: 128515 - protein, 15 aa, Borrelia burgdorferi
TAERLLAAKAQIENQ

SEQ ID NO: 128516 - protein, 9 aa, Borrelia burgdorferi
LLAAKAQIE

SEQ ID NO: 128517 - protein, 15 aa, Borrelia burgdorferi
ILKIKKEATGKGVLF

SEQ ID NO: 128518 - protein, 9 aa, Borrelia burgdorferi
IKKEATGKG

SEQ ID NO: 128519 - protein, 15 aa, Borrelia burgdorferi
LAMFDLMLEVVESLE

SEQ ID NO: 128520 - protein, 9 aa, Borrelia burgdorferi
MFDLMLEVV

SEQ ID NO: 128521 - protein, 15 aa, Borrelia burgdorferi
AERLLAAKAQIENQL

SEQ ID NO: 128522 - protein, 9 aa, Borrelia burgdorferi
LLAAKAQIE

SEQ ID NO: 128523 - protein, 15 aa, Borrelia burgdorferi
NKILKIKKEATGKGV

SEQ ID NO: 128524 - protein, 9 aa, Borrelia burgdorferi
IKKEATGKG

SEQ ID NO: 128525 - protein, 15 aa, Borrelia burgdorferi
LKIKKEATGKGVLFE

SEQ ID NO: 128526 - protein, 9 aa, Borrelia burgdorferi
IKKEATGKG

SEQ ID NO: 128527 - protein, 15 aa, Borrelia burgdorferi
KILKIKKEATGKGVL

SEQ ID NO: 128528 - protein, 9 aa, Borrelia burgdorferi
IKKEATGKG

SEQ ID NO: 128529 - protein, 15 aa, Borrelia burgdorferi
KNKILKIKKEATGKG

SEQ ID NO: 128530 - protein, 9 aa, Borrelia burgdorferi
ILKIKKEAT

SEQ ID NO: 128531 - protein, 15 aa, Borrelia burgdorferi
KLLVACSIGLVERTN

SEQ ID NO: 128532 - protein, 9 aa, Borrelia burgdorferi
LLVACSIGL

SEQ ID NO: 128533 - protein, 15 aa, Borrelia burgdorferi
NPINTAERLLAAKAQ

SEQ ID NO: 128534 - protein, 9 aa, Borrelia burgdorferi
INTAERLLA

SEQ ID NO: 128535 - protein, 15 aa, Borrelia burgdorferi
IGLVERTNAALESSS

SEQ ID NO: 128536 - protein, 9 aa, Borrelia burgdorferi
RTNAALESS

SEQ ID NO: 128537 - protein, 15 aa, Borrelia burgdorferi
SIGLVERTNAALESS

SEQ ID NO: 128538 - protein, 9 aa, Borrelia burgdorferi
ERTNAALES

SEQ ID NO: 128539 - protein, 15 aa, Borrelia burgdorferi
ERLLAAKAQIENQLK

SEQ ID NO: 128540 - protein, 9 aa, Borrelia burgdorferi
LLAAKAQIE

SEQ ID NO: 128541 - protein, 15 aa, Borrelia burgdorferi
NNPINTAERLLAAKA

SEQ ID NO: 128542 - protein, 9 aa, Borrelia burgdorferi
INTAERLLA

SEQ ID NO: 128543 - protein, 15 aa, Borrelia burgdorferi
ALREAKVQAIVETGK

SEQ ID NO: 128544 - protein, 9 aa, Borrelia burgdorferi
LREAKVQAI

SEQ ID NO: 128545 - protein, 15 aa, Borrelia burgdorferi
GLVERTNAALESSSK

SEQ ID NO: 128546 - protein, 9 aa, Borrelia burgdorferi
RTNAALESS

SEQ ID NO: 128547 - protein, 15 aa, Borrelia burgdorferi
GLKTGSKVTSGGLAL

SEQ ID NO: 128548 - protein, 9 aa, Borrelia burgdorferi
LKTGSKVTS

SEQ ID NO: 128549 - protein, 15 aa, Borrelia burgdorferi
LREAKVQAIVETGKF

SEQ ID NO: 128550 - protein, 9 aa, Borrelia burgdorferi
LREAKVQAI

SEQ ID NO: 128551 - protein, 15 aa, Borrelia burgdorferi
LLVACSIGLVERTNA

SEQ ID NO: 128552 - protein, 9 aa, Borrelia burgdorferi
LLVACSIGL

SEQ ID NO: 128553 - protein, 15 aa, Borrelia burgdorferi
IVIALFFKLLVACSI

SEQ ID NO: 128554 - protein, 9 aa, Borrelia burgdorferi
FFKLLVACS

SEQ ID NO: 128555 - protein, 15 aa, Borrelia burgdorferi
SIVIALFFKLLVACS

SEQ ID NO: 128556 - protein, 9 aa, Borrelia burgdorferi
IALFFKLLV

SEQ ID NO: 128557 - protein, 15 aa, Borrelia burgdorferi
VIALFFKLLVACSIG

SEQ ID NO: 128558 - protein, 9 aa, Borrelia burgdorferi
FFKLLVACS

SEQ ID NO: 128559 - protein, 15 aa, Borrelia burgdorferi
IALFFKLLVACSIGL

SEQ ID NO: 128560 - protein, 9 aa, Borrelia burgdorferi
FFKLLVACS

SEQ ID NO: 128561 - protein, 15 aa, Borrelia burgdorferi
ALFFKLLVACSIGLV

SEQ ID NO: 128562 - protein, 9 aa, Borrelia burgdorferi
FFKLLVACS

SEQ ID NO: 128563 - protein, 15 aa, Borrelia burgdorferi
GVLFEAFTGLKTGSK

SEQ ID NO: 128564 - protein, 9 aa, Borrelia burgdorferi
LFEAFTGLK

SEQ ID NO: 128565 - protein, 15 aa, Borrelia burgdorferi
ARVLEESKNNPINTA

SEQ ID NO: 128566 - protein, 9 aa, Borrelia burgdorferi
VLEESKNNP

SEQ ID NO: 128567 - protein, 15 aa, Borrelia burgdorferi
KGVLFEAFTGLKTGS

SEQ ID NO: 128568 - protein, 9 aa, Borrelia burgdorferi
LFEAFTGLK

SEQ ID NO: 128569 - protein, 15 aa, Borrelia burgdorferi
GKGVLFEAFTGLKTG

SEQ ID NO: 128570 - protein, 9 aa, Borrelia burgdorferi
LFEAFTGLK

SEQ ID NO: 128571 - protein, 15 aa, Borrelia burgdorferi
IGLKARVLEESKNNP

SEQ ID NO: 128572 - protein, 9 aa, Borrelia burgdorferi
ARVLEESKN

SEQ ID NO: 128573 - protein, 15 aa, Borrelia burgdorferi
LKARVLEESKNNPIN

SEQ ID NO: 128574 - protein, 9 aa, Borrelia burgdorferi
VLEESKNNP

SEQ ID NO: 128575 - protein, 15 aa, Borrelia burgdorferi
KARVLEESKNNPINT

SEQ ID NO: 128576 - protein, 9 aa, Borrelia burgdorferi
VLEESKNNP

SEQ ID NO: 128577 - protein, 15 aa, Borrelia burgdorferi
GLKARVLEESKNNPI

SEQ ID NO: 128578 - protein, 9 aa, Borrelia burgdorferi
VLEESKNNP

SEQ ID NO: 128579 - protein, 15 aa, Borrelia burgdorferi
TGKGVLFEAFTGLKT

SEQ ID NO: 128580 - protein, 9 aa, Borrelia burgdorferi
LFEAFTGLK

SEQ ID NO: 128581 - protein, 15 aa, Borrelia burgdorferi
ATGKGVLFEAFTGLK

SEQ ID NO: 128582 - protein, 9 aa, Borrelia burgdorferi
KGVLFEAFT

SEQ ID NO: 128583 - protein, 15 aa, Borrelia burgdorferi
LFEAFTGLKTGSKVT

SEQ ID NO: 128584 - protein, 9 aa, Borrelia burgdorferi
LFEAFTGLK

SEQ ID NO: 128585 - protein, 15 aa, Borrelia burgdorferi
VLFEAFTGLKTGSKV

SEQ ID NO: 128586 - protein, 9 aa, Borrelia burgdorferi
LFEAFTGLK

SEQ ID NO: 128587 - protein, 15 aa, Borrelia burgdorferi
RVLEESKNNPINTAE

SEQ ID NO: 128588 - protein, 9 aa, Borrelia burgdorferi
VLEESKNNP

SEQ ID NO: 128589 - protein, 15 aa, Borrelia burgdorferi
VLEESKNNPINTAER

SEQ ID NO: 128590 - protein, 9 aa, Borrelia burgdorferi
VLEESKNNP

SEQ ID NO: 128591 - protein, 15 aa, Borrelia burgdorferi
IVIALFFKLLVACSI

SEQ ID NO: 128592 - protein, 9 aa, Borrelia burgdorferi
IALFFKLLV

SEQ ID NO: 128593 - protein, 15 aa, Borrelia burgdorferi
SIVIALFFKLLVACS

SEQ ID NO: 128594 - protein, 9 aa, Borrelia burgdorferi
IALFFKLLV

SEQ ID NO: 128595 - protein, 15 aa, Borrelia burgdorferi
AMFDLMLEVVESLED

SEQ ID NO: 128596 - protein, 9 aa, Borrelia burgdorferi
MLEVVESLE

SEQ ID NO: 128597 - protein, 15 aa, Borrelia burgdorferi
EDVGIIGLKARVLEE

SEQ ID NO: 128598 - protein, 9 aa, Borrelia burgdorferi
IIGLKARVL

SEQ ID NO: 128599 - protein, 15 aa, Borrelia burgdorferi
DVGIIGLKARVLEES

SEQ ID NO: 128600 - protein, 9 aa, Borrelia burgdorferi
IIGLKARVL

SEQ ID NO: 128601 - protein, 15 aa, Borrelia burgdorferi
SLEDVGIIGLKARVL

SEQ ID NO: 128602 - protein, 9 aa, Borrelia burgdorferi
GIIGLKARV

SEQ ID NO: 128603 - protein, 15 aa, Borrelia burgdorferi
LEDVGIIGLKARVLE

SEQ ID NO: 128604 - protein, 9 aa, Borrelia burgdorferi
IIGLKARVL

SEQ ID NO: 128605 - protein, 15 aa, Borrelia burgdorferi
VGIIGLKARVLEESK

SEQ ID NO: 128606 - protein, 9 aa, Borrelia burgdorferi
IIGLKARVL

SEQ ID NO: 128607 - protein, 15 aa, Borrelia burgdorferi
LEDVGIIGLKARVLE

SEQ ID NO: 128608 - protein, 9 aa, Borrelia burgdorferi
VGIIGLKAR

SEQ ID NO: 128609 - protein, 15 aa, Borrelia burgdorferi
EDVGIIGLKARVLEE

SEQ ID NO: 128610 - protein, 9 aa, Borrelia burgdorferi
IGLKARVLE

SEQ ID NO: 128611 - protein, 15 aa, Borrelia burgdorferi
ESSSKDLKNKILKIK

SEQ ID NO: 128612 - protein, 9 aa, Borrelia burgdorferi
SSKDLKNKI

SEQ ID NO: 128613 - protein, 15 aa, Borrelia burgdorferi
SSSKDLKNKILKIKK

SEQ ID NO: 128614 - protein, 9 aa, Borrelia burgdorferi
LKNKILKIK

SEQ ID NO: 128615 - protein, 15 aa, Borrelia burgdorferi
SSKDLKNKILKIKKE

SEQ ID NO: 128616 - protein, 9 aa, Borrelia burgdorferi
LKNKILKIK

SEQ ID NO: 128617 - protein, 15 aa, Borrelia burgdorferi
KDLKNKILKIKKEAT

SEQ ID NO: 128618 - protein, 9 aa, Borrelia burgdorferi
LKNKILKIK

SEQ ID NO: 128619 - protein, 15 aa, Borrelia burgdorferi
SKDLKNKILKIKKEA

SEQ ID NO: 128620 - protein, 9 aa, Borrelia burgdorferi
LKNKILKIK

SEQ ID NO: 128621 - protein, 15 aa, Borrelia burgdorferi
DVGIIGLKARVLEES

SEQ ID NO: 128622 - protein, 9 aa, Borrelia burgdorferi
IGLKARVLE

SEQ ID NO: 128623 - protein, 15 aa, Borrelia burgdorferi
VGIIGLKARVLEESK

SEQ ID NO: 128624 - protein, 9 aa, Borrelia burgdorferi
IGLKARVLE

SEQ ID NO: 128625 - protein, 15 aa, Borrelia burgdorferi
DLKNKILKIKKEATG

SEQ ID NO: 128626 - protein, 9 aa, Borrelia burgdorferi
LKNKILKIK

SEQ ID NO: 128627 - protein, 15 aa, Borrelia burgdorferi
LKNKILKIKKEATGK

SEQ ID NO: 128628 - protein, 9 aa, Borrelia burgdorferi
LKNKILKIK

SEQ ID NO: 128629 - protein, 15 aa, Borrelia burgdorferi
GIIGLKARVLEESKN

SEQ ID NO: 128630 - protein, 9 aa, Borrelia burgdorferi
IGLKARVLE

SEQ ID NO: 128631 - protein, 15 aa, Borrelia burgdorferi
SLEDVGIIGLKARVL

SEQ ID NO: 128632 - protein, 9 aa, Borrelia burgdorferi
VGIIGLKAR

SEQ ID NO: 128633 - protein, 15 aa, Borrelia burgdorferi
ESLEDVGIIGLKARV

SEQ ID NO: 128634 - protein, 9 aa, Borrelia burgdorferi
VGIIGLKAR

SEQ ID NO: 128635 - protein, 15 aa, Borrelia burgdorferi
VESLEDVGIIGLKAR

SEQ ID NO: 128636 - protein, 9 aa, Borrelia burgdorferi
LEDVGIIGL

SEQ ID NO: 128637 - protein, 15 aa, Borrelia burgdorferi
AQIENQLKVVKEKQN

SEQ ID NO: 128638 - protein, 9 aa, Borrelia burgdorferi
IENQLKVVK

SEQ ID NO: 128639 - protein, 15 aa, Borrelia burgdorferi
KAQIENQLKVVKEKQ

SEQ ID NO: 128640 - protein, 9 aa, Borrelia burgdorferi
IENQLKVVK

SEQ ID NO: 128641 - protein, 15 aa, Borrelia burgdorferi
AAKAQIENQLKVVKE

SEQ ID NO: 128642 - protein, 9 aa, Borrelia burgdorferi
IENQLKVVK

SEQ ID NO: 128643 - protein, 15 aa, Borrelia burgdorferi
AKAQIENQLKVVKEK

SEQ ID NO: 128644 - protein, 9 aa, Borrelia burgdorferi
IENQLKVVK

SEQ ID NO: 128645 - protein, 15 aa, Borrelia burgdorferi
IIGLKARVLEESKNN

SEQ ID NO: 128646 - protein, 9 aa, Borrelia burgdorferi
IGLKARVLE

SEQ ID NO: 128647 - protein, 15 aa, Borrelia burgdorferi
AFTGLKTGSKVTSGG

SEQ ID NO: 128648 - protein, 9 aa, Borrelia burgdorferi
LKTGSKVTS

SEQ ID NO: 128649 - protein, 15 aa, Borrelia burgdorferi
FTGLKTGSKVTSGGL

SEQ ID NO: 128650 - protein, 9 aa, Borrelia burgdorferi
LKTGSKVTS

SEQ ID NO: 128651 - protein, 15 aa, Borrelia burgdorferi
TGLKTGSKVTSGGLA

SEQ ID NO: 128652 - protein, 9 aa, Borrelia burgdorferi
LKTGSKVTS

SEQ ID NO: 128653 - protein, 15 aa, Borrelia burgdorferi
IGLKARVLEESKNNP

SEQ ID NO: 128654 - protein, 9 aa, Borrelia burgdorferi
IGLKARVLE

SEQ ID NO: 128655 - protein, 15 aa, Borrelia burgdorferi
FEAFTGLKTGSKVTS

SEQ ID NO: 128656 - protein, 9 aa, Borrelia burgdorferi
TGLKTGSKV

SEQ ID NO: 128657 - protein, 15 aa, Borrelia burgdorferi
EAFTGLKTGSKVTSG

SEQ ID NO: 128658 - protein, 9 aa, Borrelia burgdorferi
LKTGSKVTS

SEQ ID NO: 128659 - protein, 15 aa, Borrelia burgdorferi
LAAKAQIENQLKVVK

SEQ ID NO: 128660 - protein, 9 aa, Borrelia burgdorferi
AKAQIENQL

SEQ ID NO: 128661 - protein, 15 aa, Borrelia burgdorferi
SLEDVGIIGLKARVL

SEQ ID NO: 128662 - protein, 9 aa, Borrelia burgdorferi
VGIIGLKAR

SEQ ID NO: 128663 - protein, 15 aa, Borrelia burgdorferi
LEDVGIIGLKARVLE

SEQ ID NO: 128664 - protein, 9 aa, Borrelia burgdorferi
VGIIGLKAR

SEQ ID NO: 128665 - protein, 15 aa, Borrelia burgdorferi
EDVGIIGLKARVLEE

SEQ ID NO: 128666 - protein, 9 aa, Borrelia burgdorferi
VGIIGLKAR

SEQ ID NO: 128667 - protein, 15 aa, Borrelia burgdorferi
SIVIALFFKLLVACS

SEQ ID NO: 128668 - protein, 9 aa, Borrelia burgdorferi
ALFFKLLVA

SEQ ID NO: 128669 - protein, 15 aa, Borrelia burgdorferi
IVIALFFKLLVACSI

SEQ ID NO: 128670 - protein, 9 aa, Borrelia burgdorferi
ALFFKLLVA

SEQ ID NO: 128671 - protein, 15 aa, Borrelia burgdorferi
GVLFEAFTGLKTGSK

SEQ ID NO: 128672 - protein, 9 aa, Borrelia burgdorferi
FEAFTGLKT

SEQ ID NO: 128673 - protein, 15 aa, Borrelia burgdorferi
DVGIIGLKARVLEES

SEQ ID NO: 128674 - protein, 9 aa, Borrelia burgdorferi
IIGLKARVL

SEQ ID NO: 128675 - protein, 15 aa, Borrelia burgdorferi
VGIIGLKARVLEESK

SEQ ID NO: 128676 - protein, 9 aa, Borrelia burgdorferi
IIGLKARVL

SEQ ID NO: 128677 - protein, 15 aa, Borrelia burgdorferi
VLFEAFTGLKTGSKV

SEQ ID NO: 128678 - protein, 9 aa, Borrelia burgdorferi
FTGLKTGSK

SEQ ID NO: 128679 - protein, 15 aa, Borrelia burgdorferi
VIALFFKLLVACSIG

SEQ ID NO: 128680 - protein, 9 aa, Borrelia burgdorferi
ALFFKLLVA

SEQ ID NO: 128681 - protein, 15 aa, Borrelia burgdorferi
GKGVLFEAFTGLKTG

SEQ ID NO: 128682 - protein, 9 aa, Borrelia burgdorferi
VLFEAFTGL

SEQ ID NO: 128683 - protein, 15 aa, Borrelia burgdorferi
LFEAFTGLKTGSKVT

SEQ ID NO: 128684 - protein, 9 aa, Borrelia burgdorferi
FTGLKTGSK

SEQ ID NO: 128685 - protein, 15 aa, Borrelia burgdorferi B31
NDPTYQMQKIMLSMG

SEQ ID NO: 128686 - protein, 9 aa, Borrelia burgdorferi B31
YQMQKIMLS

SEQ ID NO: 128687 - protein, 15 aa, Borrelia burgdorferi B31
DPTYQMQKIMLSMGQ

SEQ ID NO: 128688 - protein, 9 aa, Borrelia burgdorferi B31
YQMQKIMLS

SEQ ID NO: 128689 - protein, 15 aa, Borrelia burgdorferi B31
PTYQMQKIMLSMGQE

SEQ ID NO: 128690 - protein, 9 aa, Borrelia burgdorferi B31
YQMQKIMLS

SEQ ID NO: 128691 - protein, 15 aa, Borrelia burgdorferi B31
DSNDPTYQMQKIMLS

SEQ ID NO: 128692 - protein, 9 aa, Borrelia burgdorferi B31
DPTYQMQKI

SEQ ID NO: 128693 - protein, 15 aa, Borrelia burgdorferi B31
SNDPTYQMQKIMLSM

SEQ ID NO: 128694 - protein, 9 aa, Borrelia burgdorferi B31
YQMQKIMLS

SEQ ID NO: 128695 - protein, 15 aa, Borrelia burgdorferi B31
TYQMQKIMLSMGQEV

SEQ ID NO: 128696 - protein, 9 aa, Borrelia burgdorferi B31
YQMQKIMLS

SEQ ID NO: 128697 - protein, 15 aa, Borrelia burgdorferi B31
YQMQKIMLSMGQEVK

SEQ ID NO: 128698 - protein, 9 aa, Borrelia burgdorferi B31
YQMQKIMLS

SEQ ID NO: 128699 - protein, 15 aa, Borrelia burgdorferi B31
IVQNLKNLEPEKLEK

SEQ ID NO: 128700 - protein, 9 aa, Borrelia burgdorferi B31
LKNLEPEKL

SEQ ID NO: 128701 - protein, 15 aa, Borrelia burgdorferi B31
VQNLKNLEPEKLEKI

SEQ ID NO: 128702 - protein, 9 aa, Borrelia burgdorferi B31
LKNLEPEKL

SEQ ID NO: 128703 - protein, 15 aa, Borrelia burgdorferi B31
NKIVQNLKNLEPEKL

SEQ ID NO: 128704 - protein, 9 aa, Borrelia burgdorferi B31
VQNLKNLEP

SEQ ID NO: 128705 - protein, 15 aa, Borrelia burgdorferi B31
KIVQNLKNLEPEKLE

SEQ ID NO: 128706 - protein, 9 aa, Borrelia burgdorferi B31
LKNLEPEKL

SEQ ID NO: 128707 - protein, 15 aa, Borrelia burgdorferi B31
QNLKNLEPEKLEKIS

SEQ ID NO: 128708 - protein, 9 aa, Borrelia burgdorferi B31
LKNLEPEKL

SEQ ID NO: 128709 - protein, 15 aa, Borrelia burgdorferi B31
YTNLFYVPSKAPYDL

SEQ ID NO: 128710 - protein, 9 aa, Borrelia burgdorferi B31
YTNLFYVPS

SEQ ID NO: 128711 - protein, 15 aa, Borrelia burgdorferi B31
NLEYTNLFYVPSKAP

SEQ ID NO: 128712 - protein, 9 aa, Borrelia burgdorferi B31
YTNLFYVPS

SEQ ID NO: 128713 - protein, 15 aa, Borrelia burgdorferi B31
LEYTNLFYVPSKAPY

SEQ ID NO: 128714 - protein, 9 aa, Borrelia burgdorferi B31
YTNLFYVPS

SEQ ID NO: 128715 - protein, 15 aa, Borrelia burgdorferi B31
EIFLRELISNASDAI

SEQ ID NO: 128716 - protein, 9 aa, Borrelia burgdorferi B31
LRELISNAS

SEQ ID NO: 128717 - protein, 15 aa, Borrelia burgdorferi B31
IFLRELISNASDAID

SEQ ID NO: 128718 - protein, 9 aa, Borrelia burgdorferi B31
LRELISNAS

SEQ ID NO: 128719 - protein, 15 aa, Borrelia burgdorferi B31
KEIFLRELISNASDA

SEQ ID NO: 128720 - protein, 9 aa, Borrelia burgdorferi B31
LRELISNAS

SEQ ID NO: 128721 - protein, 15 aa, Borrelia burgdorferi B31
SILLFEEAMLTSGMP

SEQ ID NO: 128722 - protein, 9 aa, Borrelia burgdorferi B31
LLFEEAMLT

SEQ ID NO: 128723 - protein, 15 aa, Borrelia burgdorferi B31
HKEIFLRELISNASD

SEQ ID NO: 128724 - protein, 9 aa, Borrelia burgdorferi B31
LRELISNAS

SEQ ID NO: 128725 - protein, 15 aa, Borrelia burgdorferi B31
SHKEIFLRELISNAS

SEQ ID NO: 128726 - protein, 9 aa, Borrelia burgdorferi B31
SHKEIFLRE

SEQ ID NO: 128727 - protein, 15 aa, Borrelia burgdorferi B31
NLKNLEPEKLEKISI

SEQ ID NO: 128728 - protein, 9 aa, Borrelia burgdorferi B31
LKNLEPEKL

SEQ ID NO: 128729 - protein, 15 aa, Borrelia burgdorferi B31
LKNLEPEKLEKISIL

SEQ ID NO: 128730 - protein, 9 aa, Borrelia burgdorferi B31
LKNLEPEKL

SEQ ID NO: 128731 - protein, 15 aa, Borrelia burgdorferi B31
ISILLFEEAMLTSGM

SEQ ID NO: 128732 - protein, 9 aa, Borrelia burgdorferi B31
LLFEEAMLT

SEQ ID NO: 128733 - protein, 15 aa, Borrelia burgdorferi B31
TNLFYVPSKAPYDLY

SEQ ID NO: 128734 - protein, 9 aa, Borrelia burgdorferi B31
VPSKAPYDL

SEQ ID NO: 128735 - protein, 15 aa, Borrelia burgdorferi B31
EYTNLFYVPSKAPYD

SEQ ID NO: 128736 - protein, 9 aa, Borrelia burgdorferi B31
YTNLFYVPS

SEQ ID NO: 128737 - protein, 15 aa, Borrelia burgdorferi B31
LIFYFKQIALFIIFR

SEQ ID NO: 128738 - protein, 9 aa, Borrelia burgdorferi B31
FKQIALFII

SEQ ID NO: 128739 - protein, 15 aa, Borrelia burgdorferi B31
MILIFYFKQIALFII

SEQ ID NO: 128740 - protein, 9 aa, Borrelia burgdorferi B31
YFKQIALFI

SEQ ID NO: 128741 - protein, 15 aa, Borrelia burgdorferi B31
DLLYLIIHSLYSHKE

SEQ ID NO: 128742 - protein, 9 aa, Borrelia burgdorferi B31
YLIIHSLYS

SEQ ID NO: 128743 - protein, 15 aa, Borrelia burgdorferi B31
KDHIKEVNLSATLIK

SEQ ID NO: 128744 - protein, 9 aa, Borrelia burgdorferi B31
EVNLSATLI

SEQ ID NO: 128745 - protein, 15 aa, Borrelia burgdorferi B31
DHIKEVNLSATLIKE

SEQ ID NO: 128746 - protein, 9 aa, Borrelia burgdorferi B31
EVNLSATLI

SEQ ID NO: 128747 - protein, 15 aa, Borrelia burgdorferi B31
IFYFKQIALFIIFRL

SEQ ID NO: 128748 - protein, 9 aa, Borrelia burgdorferi B31
FKQIALFII

SEQ ID NO: 128749 - protein, 15 aa, Borrelia burgdorferi B31
LLYLIIHSLYSHKEI

SEQ ID NO: 128750 - protein, 9 aa, Borrelia burgdorferi B31
YLIIHSLYS

SEQ ID NO: 128751 - protein, 15 aa, Borrelia burgdorferi B31
ILIFYFKQIALFIIF

SEQ ID NO: 128752 - protein, 9 aa, Borrelia burgdorferi B31
FKQIALFII

SEQ ID NO: 128753 - protein, 15 aa, Borrelia burgdorferi B31
NDLLYLIIHSLYSHK

SEQ ID NO: 128754 - protein, 8 aa, Borrelia burgdorferi B31
YLIIHSLY

SEQ ID NO: 128755 - protein, 15 aa, Borrelia burgdorferi B31
NLSATLIKEPSAIII

SEQ ID NO: 128756 - protein, 9 aa, Borrelia burgdorferi B31
LIKEPSAII

SEQ ID NO: 128757 - protein, 15 aa, Borrelia burgdorferi B31
SATLIKEPSAIIIDS

SEQ ID NO: 128758 - protein, 9 aa, Borrelia burgdorferi B31
LIKEPSAII

SEQ ID NO: 128759 - protein, 15 aa, Borrelia burgdorferi B31
KISILLFEEAMLTSG

SEQ ID NO: 128760 - protein, 9 aa, Borrelia burgdorferi B31
LLFEEAMLT

SEQ ID NO: 128761 - protein, 15 aa, Borrelia burgdorferi B31
VNDLLYLIIHSLYSH

SEQ ID NO: 128762 - protein, 9 aa, Borrelia burgdorferi B31
YLIIHSLYS

SEQ ID NO: 128763 - protein, 15 aa, Borrelia burgdorferi B31
LSATLIKEPSAIIID

SEQ ID NO: 128764 - protein, 9 aa, Borrelia burgdorferi B31
LIKEPSAII

SEQ ID NO: 128765 - protein, 15 aa, Borrelia burgdorferi B31
GNLEYTNLFYVPSKA

SEQ ID NO: 128766 - protein, 9 aa, Borrelia burgdorferi B31
YTNLFYVPS

SEQ ID NO: 128767 - protein, 15 aa, Borrelia burgdorferi B31
ATLIKEPSAIIIDSN

SEQ ID NO: 128768 - protein, 9 aa, Borrelia burgdorferi B31
LIKEPSAII

SEQ ID NO: 128769 - protein, 15 aa, Borrelia burgdorferi B31
IPEYEGLKLKAINKN

SEQ ID NO: 128770 - protein, 9 aa, Borrelia burgdorferi B31
YEGLKLKAI

SEQ ID NO: 128771 - protein, 15 aa, Borrelia burgdorferi B31
QDLTNHLGVIAKSGT

SEQ ID NO: 128772 - protein, 9 aa, Borrelia burgdorferi B31
LTNHLGVIA

SEQ ID NO: 128773 - protein, 15 aa, Borrelia burgdorferi B31
EGNLEYTNLFYVPSK

SEQ ID NO: 128774 - protein, 9 aa, Borrelia burgdorferi B31
YTNLFYVPS

SEQ ID NO: 128775 - protein, 15 aa, Borrelia burgdorferi B31
HIKEVNLSATLIKEP

SEQ ID NO: 128776 - protein, 9 aa, Borrelia burgdorferi B31
EVNLSATLI

SEQ ID NO: 128777 - protein, 15 aa, Borrelia burgdorferi B31
IKEVNLSATLIKEPS

SEQ ID NO: 128778 - protein, 9 aa, Borrelia burgdorferi B31
EVNLSATLI

SEQ ID NO: 128779 - protein, 15 aa, Borrelia burgdorferi B31
PEYEGLKLKAINKNE

SEQ ID NO: 128780 - protein, 9 aa, Borrelia burgdorferi B31
YEGLKLKAI

SEQ ID NO: 128781 - protein, 15 aa, Borrelia burgdorferi B31
NLFYVPSKAPYDLYY

SEQ ID NO: 128782 - protein, 9 aa, Borrelia burgdorferi B31
VPSKAPYDL

SEQ ID NO: 128783 - protein, 15 aa, Borrelia burgdorferi B31
EVNDLLYLIIHSLYS

SEQ ID NO: 128784 - protein, 9 aa, Borrelia burgdorferi B31
LLYLIIHSL

SEQ ID NO: 128785 - protein, 15 aa, Borrelia burgdorferi B31
AEGNLEYTNLFYVPS

SEQ ID NO: 128786 - protein, 9 aa, Borrelia burgdorferi B31
EGNLEYTNL

SEQ ID NO: 128787 - protein, 15 aa, Borrelia burgdorferi B31
NKILSKIKSSSVKKI

SEQ ID NO: 128788 - protein, 9 aa, Borrelia burgdorferi B31
LSKIKSSSV

SEQ ID NO: 128789 - protein, 15 aa, Borrelia burgdorferi B31
KILSKIKSSSVKKIL

SEQ ID NO: 128790 - protein, 9 aa, Borrelia burgdorferi B31
IKSSSVKKI

SEQ ID NO: 128791 - protein, 15 aa, Borrelia burgdorferi B31
LFYVPSKAPYDLYYP

SEQ ID NO: 128792 - protein, 9 aa, Borrelia burgdorferi B31
VPSKAPYDL

SEQ ID NO: 128793 - protein, 15 aa, Borrelia burgdorferi B31
EQDLTNHLGVIAKSG

SEQ ID NO: 128794 - protein, 9 aa, Borrelia burgdorferi B31
LTNHLGVIA

SEQ ID NO: 128795 - protein, 15 aa, Borrelia burgdorferi B31
EKISILLFEEAMLTS

SEQ ID NO: 128796 - protein, 9 aa, Borrelia burgdorferi B31
LLFEEAMLT

SEQ ID NO: 128797 - protein, 15 aa, Borrelia burgdorferi B31
LLFEEAMLTSGMPSK

SEQ ID NO: 128798 - protein, 9 aa, Borrelia burgdorferi B31
LLFEEAMLT

SEQ ID NO: 128799 - protein, 15 aa, Borrelia burgdorferi B31
FEEAMLTSGMPSKNP

SEQ ID NO: 128800 - protein, 9 aa, Borrelia burgdorferi B31
LTSGMPSKN

SEQ ID NO: 128801 - protein, 15 aa, Borrelia burgdorferi B31
ILLFEEAMLTSGMPS

SEQ ID NO: 128802 - protein, 9 aa, Borrelia burgdorferi B31
LLFEEAMLT

SEQ ID NO: 128803 - protein, 15 aa, Borrelia burgdorferi B31
LEKISILLFEEAMLT

SEQ ID NO: 128804 - protein, 9 aa, Borrelia burgdorferi B31
ISILLFEEA

SEQ ID NO: 128805 - protein, 15 aa, Borrelia burgdorferi B31
EEAMLTSGMPSKNPG

SEQ ID NO: 128806 - protein, 9 aa, Borrelia burgdorferi B31
LTSGMPSKN

SEQ ID NO: 128807 - protein, 15 aa, Borrelia burgdorferi B31
FYFKQIALFIIFRLC

SEQ ID NO: 128808 - protein, 9 aa, Borrelia burgdorferi B31
FKQIALFII

SEQ ID NO: 128809 - protein, 15 aa, Borrelia burgdorferi B31
EAMLTSGMPSKNPGK

SEQ ID NO: 128810 - protein, 9 aa, Borrelia burgdorferi B31
LTSGMPSKN

SEQ ID NO: 128811 - protein, 15 aa, Borrelia burgdorferi B31
FLRELISNASDAIDK

SEQ ID NO: 128812 - protein, 9 aa, Borrelia burgdorferi B31
LRELISNAS

SEQ ID NO: 128813 - protein, 15 aa, Borrelia burgdorferi B31
LKDHIKEVNLSATLI

SEQ ID NO: 128814 - protein, 9 aa, Borrelia burgdorferi B31
IKEVNLSAT

SEQ ID NO: 128815 - protein, 15 aa, Borrelia burgdorferi B31
LRELISNASDAIDKL

SEQ ID NO: 128816 - protein, 9 aa, Borrelia burgdorferi B31
LRELISNAS

SEQ ID NO: 128817 - protein, 15 aa, Borrelia burgdorferi B31
LIPEYEGLKLKAINK

SEQ ID NO: 128818 - protein, 9 aa, Borrelia burgdorferi B31
YEGLKLKAI

SEQ ID NO: 128819 - protein, 15 aa, Borrelia burgdorferi B31
ILSKIKSSSVKKILS

SEQ ID NO: 128820 - protein, 9 aa, Borrelia burgdorferi B31
IKSSSVKKI

SEQ ID NO: 128821 - protein, 15 aa, Borrelia burgdorferi B31
LSKIKSSSVKKILSE

SEQ ID NO: 128822 - protein, 9 aa, Borrelia burgdorferi B31
IKSSSVKKI

SEQ ID NO: 128823 - protein, 15 aa, Borrelia burgdorferi B31
AMLTSGMPSKNPGKF

SEQ ID NO: 128824 - protein, 9 aa, Borrelia burgdorferi B31
LTSGMPSKN

SEQ ID NO: 128825 - protein, 15 aa, Borrelia burgdorferi B31
NLIPEYEGLKLKAIN

SEQ ID NO: 128826 - protein, 9 aa, Borrelia burgdorferi B31
YEGLKLKAI

SEQ ID NO: 128827 - protein, 15 aa, Borrelia burgdorferi B31
LNLIPEYEGLKLKAI

SEQ ID NO: 128828 - protein, 9 aa, Borrelia burgdorferi B31
LNLIPEYEG

SEQ ID NO: 128829 - protein, 15 aa, Borrelia burgdorferi B31
DEQDLTNHLGVIAKS

SEQ ID NO: 128830 - protein, 9 aa, Borrelia burgdorferi B31
LTNHLGVIA

SEQ ID NO: 128831 - protein, 15 aa, Borrelia burgdorferi B31
LFEEAMLTSGMPSKN

SEQ ID NO: 128832 - protein, 9 aa, Borrelia burgdorferi B31
EAMLTSGMP

SEQ ID NO: 128833 - protein, 15 aa, Borrelia burgdorferi B31
MDEQDLTNHLGVIAK

SEQ ID NO: 128834 - protein, 9 aa, Borrelia burgdorferi B31
LTNHLGVIA

SEQ ID NO: 128835 - protein, 15 aa, Borrelia burgdorferi B31
GMDEQDLTNHLGVIA

SEQ ID NO: 128836 - protein, 9 aa, Borrelia burgdorferi B31
DEQDLTNHL

SEQ ID NO: 128837 - protein, 15 aa, Borrelia burgdorferi B31
ENILKENPIVAAYKE

SEQ ID NO: 128838 - protein, 9 aa, Borrelia burgdorferi B31
LKENPIVAA

SEQ ID NO: 128839 - protein, 15 aa, Borrelia burgdorferi B31
QMQKIMLSMGQEVKE

SEQ ID NO: 128840 - protein, 9 aa, Borrelia burgdorferi B31
IMLSMGQEV

SEQ ID NO: 128841 - protein, 15 aa, Borrelia burgdorferi B31
KVEVTSKKALESDAY

SEQ ID NO: 128842 - protein, 9 aa, Borrelia burgdorferi B31
VTSKKALES

SEQ ID NO: 128843 - protein, 15 aa, Borrelia burgdorferi B31
KENILKENPIVAAYK

SEQ ID NO: 128844 - protein, 9 aa, Borrelia burgdorferi B31
LKENPIVAA

SEQ ID NO: 128845 - protein, 15 aa, Borrelia burgdorferi B31
SEKVEVTSKKALESD

SEQ ID NO: 128846 - protein, 9 aa, Borrelia burgdorferi B31
VTSKKALES

SEQ ID NO: 128847 - protein, 15 aa, Borrelia burgdorferi B31
VSEKVEVTSKKALES

SEQ ID NO: 128848 - protein, 9 aa, Borrelia burgdorferi B31
KVEVTSKKA

SEQ ID NO: 128849 - protein, 15 aa, Borrelia burgdorferi B31
EKVEVTSKKALESDA

SEQ ID NO: 128850 - protein, 9 aa, Borrelia burgdorferi B31
VTSKKALES

SEQ ID NO: 128851 - protein, 15 aa, Borrelia burgdorferi B31
TLIKEPSAIIIDSND

SEQ ID NO: 128852 - protein, 9 aa, Borrelia burgdorferi B31
IKEPSAIII

SEQ ID NO: 128853 - protein, 15 aa, Borrelia burgdorferi B31
VEVTSKKALESDAYI

SEQ ID NO: 128854 - protein, 9 aa, Borrelia burgdorferi B31
VTSKKALES

SEQ ID NO: 128855 - protein, 15 aa, Borrelia burgdorferi B31
VNLSATLIKEPSAII

SEQ ID NO: 128856 - protein, 9 aa, Borrelia burgdorferi B31
SATLIKEPS

SEQ ID NO: 128857 - protein, 15 aa, Borrelia burgdorferi B31
NILKENPIVAAYKEK

SEQ ID NO: 128858 - protein, 9 aa, Borrelia burgdorferi B31
LKENPIVAA

SEQ ID NO: 128859 - protein, 15 aa, Borrelia burgdorferi B31
GGKENILKENPIVAA

SEQ ID NO: 128860 - protein, 9 aa, Borrelia burgdorferi B31
ILKENPIVA

SEQ ID NO: 128861 - protein, 15 aa, Borrelia burgdorferi B31
GKENILKENPIVAAY

SEQ ID NO: 128862 - protein, 9 aa, Borrelia burgdorferi B31
LKENPIVAA

SEQ ID NO: 128863 - protein, 15 aa, Borrelia burgdorferi B31
LYLIIHSLYSHKEIF

SEQ ID NO: 128864 - protein, 9 aa, Borrelia burgdorferi B31
YLIIHSLYS

SEQ ID NO: 128865 - protein, 15 aa, Borrelia burgdorferi B31
YEGLKLKAINKNETS

SEQ ID NO: 128866 - protein, 9 aa, Borrelia burgdorferi B31
YEGLKLKAI

SEQ ID NO: 128867 - protein, 15 aa, Borrelia burgdorferi B31
EYEGLKLKAINKNET

SEQ ID NO: 128868 - protein, 9 aa, Borrelia burgdorferi B31
YEGLKLKAI

SEQ ID NO: 128869 - protein, 15 aa, Borrelia burgdorferi B31
LTNHLGVIAKSGTKE

SEQ ID NO: 128870 - protein, 9 aa, Borrelia burgdorferi B31
LTNHLGVIA

SEQ ID NO: 128871 - protein, 15 aa, Borrelia burgdorferi B31
KEVNLSATLIKEPSA

SEQ ID NO: 128872 - protein, 9 aa, Borrelia burgdorferi B31
EVNLSATLI

SEQ ID NO: 128873 - protein, 15 aa, Borrelia burgdorferi B31
SKIKSSSVKKILSEL

SEQ ID NO: 128874 - protein, 9 aa, Borrelia burgdorferi B31
IKSSSVKKI

SEQ ID NO: 128875 - protein, 15 aa, Borrelia burgdorferi B31
DLTNHLGVIAKSGTK

SEQ ID NO: 128876 - protein, 9 aa, Borrelia burgdorferi B31
LTNHLGVIA

SEQ ID NO: 128877 - protein, 15 aa, Borrelia burgdorferi B31
YLIIHSLYSHKEIFL

SEQ ID NO: 128878 - protein, 9 aa, Borrelia burgdorferi B31
YLIIHSLYS

SEQ ID NO: 128879 - protein, 15 aa, Borrelia burgdorferi B31
MQKIMLSMGQEVKEI

SEQ ID NO: 128880 - protein, 9 aa, Borrelia burgdorferi B31
IMLSMGQEV

SEQ ID NO: 128881 - protein, 15 aa, Borrelia burgdorferi B31
FYVPSKAPYDLYYPN

SEQ ID NO: 128882 - protein, 9 aa, Borrelia burgdorferi B31
VPSKAPYDL

SEQ ID NO: 128883 - protein, 15 aa, Borrelia burgdorferi B31
IKSSSVKKILSELEK

SEQ ID NO: 128884 - protein, 9 aa, Borrelia burgdorferi B31
VKKILSELE

SEQ ID NO: 128885 - protein, 15 aa, Borrelia burgdorferi B31
KIKSSSVKKILSELE

SEQ ID NO: 128886 - protein, 9 aa, Borrelia burgdorferi B31
IKSSSVKKI

SEQ ID NO: 128887 - protein, 15 aa, Borrelia burgdorferi B31
MLTSGMPSKNPGKFI

SEQ ID NO: 128888 - protein, 9 aa, Borrelia burgdorferi B31
LTSGMPSKN

SEQ ID NO: 128889 - protein, 15 aa, Borrelia burgdorferi B31
EVNLSATLIKEPSAI

SEQ ID NO: 128890 - protein, 9 aa, Borrelia burgdorferi B31
EVNLSATLI

SEQ ID NO: 128891 - protein, 15 aa, Borrelia burgdorferi B31
YFKQIALFIIFRLCY

SEQ ID NO: 128892 - protein, 9 aa, Borrelia burgdorferi B31
FKQIALFII

SEQ ID NO: 128893 - protein, 15 aa, Borrelia burgdorferi B31
LTNEKFKNIALEPKI

SEQ ID NO: 128894 - protein, 9 aa, Borrelia burgdorferi B31
FKNIALEPK

SEQ ID NO: 128895 - protein, 15 aa, Borrelia burgdorferi B31
NEKFKNIALEPKIEI

SEQ ID NO: 128896 - protein, 9 aa, Borrelia burgdorferi B31
FKNIALEPK

SEQ ID NO: 128897 - protein, 15 aa, Borrelia burgdorferi B31
LIKEPSAIIIDSNDP

SEQ ID NO: 128898 - protein, 9 aa, Borrelia burgdorferi B31
LIKEPSAII

SEQ ID NO: 128899 - protein, 15 aa, Borrelia burgdorferi B31
EKFKNIALEPKIEIS

SEQ ID NO: 128900 - protein, 9 aa, Borrelia burgdorferi B31
FKNIALEPK

SEQ ID NO: 128901 - protein, 15 aa, Borrelia burgdorferi B31
TNEKFKNIALEPKIE

SEQ ID NO: 128902 - protein, 9 aa, Borrelia burgdorferi B31
FKNIALEPK

SEQ ID NO: 128903 - protein, 15 aa, Borrelia burgdorferi B31
QKIMLSMGQEVKEIK

SEQ ID NO: 128904 - protein, 9 aa, Borrelia burgdorferi B31
IMLSMGQEV

SEQ ID NO: 128905 - protein, 15 aa, Borrelia burgdorferi B31
ILKENPIVAAYKEKG

SEQ ID NO: 128906 - protein, 9 aa, Borrelia burgdorferi B31
LKENPIVAA

SEQ ID NO: 128907 - protein, 15 aa, Borrelia burgdorferi B31
SLTNEKFKNIALEPK

SEQ ID NO: 128908 - protein, 9 aa, Borrelia burgdorferi B31
LTNEKFKNI

SEQ ID NO: 128909 - protein, 15 aa, Borrelia burgdorferi B31
LKENPIVAAYKEKGF

SEQ ID NO: 128910 - protein, 9 aa, Borrelia burgdorferi B31
LKENPIVAA

SEQ ID NO: 128911 - protein, 15 aa, Borrelia burgdorferi B31
QQNKILSKIKSSSVK

SEQ ID NO: 128912 - protein, 9 aa, Borrelia burgdorferi B31
LSKIKSSSV

SEQ ID NO: 128913 - protein, 15 aa, Borrelia burgdorferi B31
KEEKLNETTALWTKN

SEQ ID NO: 128914 - protein, 9 aa, Borrelia burgdorferi B31
LNETTALWT

SEQ ID NO: 128915 - protein, 15 aa, Borrelia burgdorferi B31
FYSAFIVSEKVEVTS

SEQ ID NO: 128916 - protein, 9 aa, Borrelia burgdorferi B31
IVSEKVEVT

SEQ ID NO: 128917 - protein, 15 aa, Borrelia burgdorferi B31
GFYSAFIVSEKVEVT

SEQ ID NO: 128918 - protein, 9 aa, Borrelia burgdorferi B31
SAFIVSEKV

SEQ ID NO: 128919 - protein, 15 aa, Borrelia burgdorferi B31
LQQNKILSKIKSSSV

SEQ ID NO: 128920 - protein, 9 aa, Borrelia burgdorferi B31
NKILSKIKS

SEQ ID NO: 128921 - protein, 15 aa, Borrelia burgdorferi B31
QNKILSKIKSSSVKK

SEQ ID NO: 128922 - protein, 9 aa, Borrelia burgdorferi B31
LSKIKSSSV

SEQ ID NO: 128923 - protein, 15 aa, Borrelia burgdorferi B31
EEKLNETTALWTKNK

SEQ ID NO: 128924 - protein, 9 aa, Borrelia burgdorferi B31
LNETTALWT

SEQ ID NO: 128925 - protein, 15 aa, Borrelia burgdorferi B31
EKEEKLNETTALWTK

SEQ ID NO: 128926 - protein, 9 aa, Borrelia burgdorferi B31
LNETTALWT

SEQ ID NO: 128927 - protein, 15 aa, Borrelia burgdorferi B31
IIDCQDLPLNVSREI

SEQ ID NO: 128928 - protein, 9 aa, Borrelia burgdorferi B31
CQDLPLNVS

SEQ ID NO: 128929 - protein, 15 aa, Borrelia burgdorferi B31
IDCQDLPLNVSREIL

SEQ ID NO: 128930 - protein, 9 aa, Borrelia burgdorferi B31
LPLNVSREI

SEQ ID NO: 128931 - protein, 15 aa, Borrelia burgdorferi B31
EEKEEKLNETTALWT

SEQ ID NO: 128932 - protein, 9 aa, Borrelia burgdorferi B31
KLNETTALW

SEQ ID NO: 128933 - protein, 15 aa, Borrelia burgdorferi B31
SAFIVSEKVEVTSKK

SEQ ID NO: 128934 - protein, 9 aa, Borrelia burgdorferi B31
IVSEKVEVT

SEQ ID NO: 128935 - protein, 15 aa, Borrelia burgdorferi B31
LTSGMPSKNPGKFIN

SEQ ID NO: 128936 - protein, 9 aa, Borrelia burgdorferi B31
LTSGMPSKN

SEQ ID NO: 128937 - protein, 15 aa, Borrelia burgdorferi B31
YSAFIVSEKVEVTSK

SEQ ID NO: 128938 - protein, 9 aa, Borrelia burgdorferi B31
IVSEKVEVT

SEQ ID NO: 128939 - protein, 15 aa, Borrelia burgdorferi B31
TNHLGVIAKSGTKEF

SEQ ID NO: 128940 - protein, 9 aa, Borrelia burgdorferi B31
HLGVIAKSG

SEQ ID NO: 128941 - protein, 15 aa, Borrelia burgdorferi B31
AFIVSEKVEVTSKKA

SEQ ID NO: 128942 - protein, 9 aa, Borrelia burgdorferi B31
IVSEKVEVT

SEQ ID NO: 128943 - protein, 15 aa, Borrelia burgdorferi B31
EKLNETTALWTKNKS

SEQ ID NO: 128944 - protein, 9 aa, Borrelia burgdorferi B31
LNETTALWT

SEQ ID NO: 128945 - protein, 15 aa, Borrelia burgdorferi B31
EVTSKKALESDAYIW

SEQ ID NO: 128946 - protein, 9 aa, Borrelia burgdorferi B31
VTSKKALES

SEQ ID NO: 128947 - protein, 15 aa, Borrelia burgdorferi B31
VTSKKALESDAYIWS

SEQ ID NO: 128948 - protein, 9 aa, Borrelia burgdorferi B31
VTSKKALES

SEQ ID NO: 128949 - protein, 15 aa, Borrelia burgdorferi B31
SHKEIFLRELISNAS

SEQ ID NO: 128950 - protein, 9 aa, Borrelia burgdorferi B31
FLRELISNA

SEQ ID NO: 128951 - protein, 15 aa, Borrelia burgdorferi B31
HKEIFLRELISNASD

SEQ ID NO: 128952 - protein, 9 aa, Borrelia burgdorferi B31
LRELISNAS

SEQ ID NO: 128953 - protein, 15 aa, Borrelia burgdorferi B31
KEIFLRELISNASDA

SEQ ID NO: 128954 - protein, 9 aa, Borrelia burgdorferi B31
LRELISNAS

SEQ ID NO: 128955 - protein, 15 aa, Borrelia burgdorferi B31
EIFLRELISNASDAI

SEQ ID NO: 128956 - protein, 9 aa, Borrelia burgdorferi B31
LRELISNAS

SEQ ID NO: 128957 - protein, 15 aa, Borrelia burgdorferi B31
IFLRELISNASDAID

SEQ ID NO: 128958 - protein, 9 aa, Borrelia burgdorferi B31
LRELISNAS

SEQ ID NO: 128959 - protein, 15 aa, Borrelia burgdorferi B31
DSNDPTYQMQKIMLS

SEQ ID NO: 128960 - protein, 9 aa, Borrelia burgdorferi B31
DSNDPTYQM

SEQ ID NO: 128961 - protein, 15 aa, Borrelia burgdorferi B31
SNDPTYQMQKIMLSM

SEQ ID NO: 128962 - protein, 9 aa, Borrelia burgdorferi B31
YQMQKIMLS

SEQ ID NO: 128963 - protein, 15 aa, Borrelia burgdorferi B31
DPTYQMQKIMLSMGQ

SEQ ID NO: 128964 - protein, 9 aa, Borrelia burgdorferi B31
YQMQKIMLS

SEQ ID NO: 128965 - protein, 15 aa, Borrelia burgdorferi B31
PTYQMQKIMLSMGQE

SEQ ID NO: 128966 - protein, 9 aa, Borrelia burgdorferi B31
YQMQKIMLS

SEQ ID NO: 128967 - protein, 15 aa, Borrelia burgdorferi B31
FLRELISNASDAIDK

SEQ ID NO: 128968 - protein, 9 aa, Borrelia burgdorferi B31
LRELISNAS

SEQ ID NO: 128969 - protein, 15 aa, Borrelia burgdorferi B31
NDPTYQMQKIMLSMG

SEQ ID NO: 128970 - protein, 9 aa, Borrelia burgdorferi B31
YQMQKIMLS

SEQ ID NO: 128971 - protein, 15 aa, Borrelia burgdorferi B31
WKIQEIIKKYSNHIN

SEQ ID NO: 128972 - protein, 9 aa, Borrelia burgdorferi B31
IIKKYSNHI

SEQ ID NO: 128973 - protein, 15 aa, Borrelia burgdorferi B31
KWKIQEIIKKYSNHI

SEQ ID NO: 128974 - protein, 9 aa, Borrelia burgdorferi B31
WKIQEIIKK

SEQ ID NO: 128975 - protein, 15 aa, Borrelia burgdorferi B31
LRELISNASDAIDKL

SEQ ID NO: 128976 - protein, 9 aa, Borrelia burgdorferi B31
LRELISNAS

SEQ ID NO: 128977 - protein, 15 aa, Borrelia burgdorferi B31
QEIIKKYSNHINYPI

SEQ ID NO: 128978 - protein, 9 aa, Borrelia burgdorferi B31
IIKKYSNHI

SEQ ID NO: 128979 - protein, 15 aa, Borrelia burgdorferi B31
IQEIIKKYSNHINYP

SEQ ID NO: 128980 - protein, 9 aa, Borrelia burgdorferi B31
IIKKYSNHI

SEQ ID NO: 128981 - protein, 15 aa, Borrelia burgdorferi B31
KIQEIIKKYSNHINY

SEQ ID NO: 128982 - protein, 9 aa, Borrelia burgdorferi B31
IIKKYSNHI

SEQ ID NO: 128983 - protein, 15 aa, Borrelia burgdorferi B31
YQMQKIMLSMGQEVK

SEQ ID NO: 128984 - protein, 9 aa, Borrelia burgdorferi B31
YQMQKIMLS

SEQ ID NO: 128985 - protein, 15 aa, Borrelia burgdorferi B31
NDLLYLIIHSLYSHK

SEQ ID NO: 128986 - protein, 9 aa, Borrelia burgdorferi B31
YLIIHSLYS

SEQ ID NO: 128987 - protein, 15 aa, Borrelia burgdorferi B31
TYQMQKIMLSMGQEV

SEQ ID NO: 128988 - protein, 9 aa, Borrelia burgdorferi B31
YQMQKIMLS

SEQ ID NO: 128989 - protein, 15 aa, Borrelia burgdorferi B31
DLLYLIIHSLYSHKE

SEQ ID NO: 128990 - protein, 9 aa, Borrelia burgdorferi B31
YLIIHSLYS

SEQ ID NO: 128991 - protein, 15 aa, Borrelia burgdorferi B31
VNDLLYLIIHSLYSH

SEQ ID NO: 128992 - protein, 9 aa, Borrelia burgdorferi B31
YLIIHSLYS

SEQ ID NO: 128993 - protein, 15 aa, Borrelia burgdorferi B31
EVNDLLYLIIHSLYS

SEQ ID NO: 128994 - protein, 9 aa, Borrelia burgdorferi B31
LYLIIHSLY

SEQ ID NO: 128995 - protein, 15 aa, Borrelia burgdorferi B31
EGLKLKAINKNETSN

SEQ ID NO: 128996 - protein, 9 aa, Borrelia burgdorferi B31
LKLKAINKN

SEQ ID NO: 128997 - protein, 15 aa, Borrelia burgdorferi B31
YEGLKLKAINKNETS

SEQ ID NO: 128998 - protein, 9 aa, Borrelia burgdorferi B31
LKLKAINKN

SEQ ID NO: 128999 - protein, 15 aa, Borrelia burgdorferi B31
EYEGLKLKAINKNET

SEQ ID NO: 129000 - protein, 9 aa, Borrelia burgdorferi B31
LKLKAINKN

SEQ ID NO: 129001 - protein, 15 aa, Borrelia burgdorferi B31
LLYLIIHSLYSHKEI

SEQ ID NO: 129002 - protein, 9 aa, Borrelia burgdorferi B31
YLIIHSLYS

SEQ ID NO: 129003 - protein, 15 aa, Borrelia burgdorferi B31
LKLKAINKNETSNEL

SEQ ID NO: 129004 - protein, 9 aa, Borrelia burgdorferi B31
LKAINKNET

SEQ ID NO: 129005 - protein, 15 aa, Borrelia burgdorferi B31
EIIKKYSNHINYPIY

SEQ ID NO: 129006 - protein, 9 aa, Borrelia burgdorferi B31
IIKKYSNHI

SEQ ID NO: 129007 - protein, 15 aa, Borrelia burgdorferi B31
IIKKYSNHINYPIYI

SEQ ID NO: 129008 - protein, 9 aa, Borrelia burgdorferi B31
IIKKYSNHI

SEQ ID NO: 129009 - protein, 15 aa, Borrelia burgdorferi B31
EEYNEFYKNTTFDYE

SEQ ID NO: 129010 - protein, 9 aa, Borrelia burgdorferi B31
FYKNTTFDY

SEQ ID NO: 129011 - protein, 15 aa, Borrelia burgdorferi B31
KEIFLRELISNASDA

SEQ ID NO: 129012 - protein, 9 aa, Borrelia burgdorferi B31
FLRELISNA

SEQ ID NO: 129013 - protein, 15 aa, Borrelia burgdorferi B31
EIFLRELISNASDAI

SEQ ID NO: 129014 - protein, 9 aa, Borrelia burgdorferi B31
FLRELISNA

SEQ ID NO: 129015 - protein, 15 aa, Borrelia burgdorferi B31
SHKEIFLRELISNAS

SEQ ID NO: 129016 - protein, 9 aa, Borrelia burgdorferi B31
FLRELISNA

SEQ ID NO: 129017 - protein, 15 aa, Borrelia burgdorferi B31
HKEIFLRELISNASD

SEQ ID NO: 129018 - protein, 9 aa, Borrelia burgdorferi B31
FLRELISNA

SEQ ID NO: 129019 - protein, 15 aa, Borrelia burgdorferi B31
YSHKEIFLRELISNA

SEQ ID NO: 129020 - protein, 9 aa, Borrelia burgdorferi B31
IFLRELISN

SEQ ID NO: 129021 - protein, 15 aa, Borrelia burgdorferi B31
KEIKPILELNPNNKI

SEQ ID NO: 129022 - protein, 9 aa, Borrelia burgdorferi B31
ILELNPNNK

SEQ ID NO: 129023 - protein, 15 aa, Borrelia burgdorferi B31
VKEIKPILELNPNNK

SEQ ID NO: 129024 - protein, 9 aa, Borrelia burgdorferi B31
IKPILELNP

SEQ ID NO: 129025 - protein, 15 aa, Borrelia burgdorferi B31
NDLLYLIIHSLYSHK

SEQ ID NO: 129026 - protein, 9 aa, Borrelia burgdorferi B31
YLIIHSLYS

SEQ ID NO: 129027 - protein, 15 aa, Borrelia burgdorferi B31
EIKPILELNPNNKIV

SEQ ID NO: 129028 - protein, 9 aa, Borrelia burgdorferi B31
ILELNPNNK

SEQ ID NO: 129029 - protein, 15 aa, Borrelia burgdorferi B31
IKPILELNPNNKIVQ

SEQ ID NO: 129030 - protein, 9 aa, Borrelia burgdorferi B31
ILELNPNNK

SEQ ID NO: 129031 - protein, 15 aa, Borrelia burgdorferi B31
DLLYLIIHSLYSHKE

SEQ ID NO: 129032 - protein, 9 aa, Borrelia burgdorferi B31
YLIIHSLYS

SEQ ID NO: 129033 - protein, 15 aa, Borrelia burgdorferi B31
LLYLIIHSLYSHKEI

SEQ ID NO: 129034 - protein, 9 aa, Borrelia burgdorferi B31
YLIIHSLYS

SEQ ID NO: 129035 - protein, 15 aa, Borrelia burgdorferi B31
IFLRELISNASDAID

SEQ ID NO: 129036 - protein, 9 aa, Borrelia burgdorferi B31
FLRELISNA

SEQ ID NO: 129037 - protein, 15 aa, Borrelia burgdorferi B31
VNDLLYLIIHSLYSH

SEQ ID NO: 129038 - protein, 9 aa, Borrelia burgdorferi B31
YLIIHSLYS

SEQ ID NO: 129039 - protein, 15 aa, Borrelia burgdorferi B31
KPILELNPNNKIVQN

SEQ ID NO: 129040 - protein, 9 aa, Borrelia burgdorferi B31
ILELNPNNK

SEQ ID NO: 129041 - protein, 15 aa, Borrelia burgdorferi B31
EVNDLLYLIIHSLYS

SEQ ID NO: 129042 - protein, 9 aa, Borrelia burgdorferi B31
LLYLIIHSL

SEQ ID NO: 129043 - protein, 15 aa, Borrelia burgdorferi B31
FLRELISNASDAIDK

SEQ ID NO: 129044 - protein, 9 aa, Borrelia burgdorferi B31
FLRELISNA

SEQ ID NO: 129045 - protein, 15 aa, Borrelia burgdorferi B31
FEEAMLTSGMPSKNP

SEQ ID NO: 129046 - protein, 9 aa, Borrelia burgdorferi B31
MLTSGMPSK

SEQ ID NO: 129047 - protein, 15 aa, Borrelia burgdorferi B31
EEAMLTSGMPSKNPG

SEQ ID NO: 129048 - protein, 9 aa, Borrelia burgdorferi B31
MLTSGMPSK

SEQ ID NO: 129049 - protein, 15 aa, Borrelia burgdorferi B31
DSNDPTYQMQKIMLS

SEQ ID NO: 129050 - protein, 9 aa, Borrelia burgdorferi B31
DSNDPTYQM

SEQ ID NO: 129051 - protein, 15 aa, Borrelia burgdorferi B31
NPNNKIVQNLKNLEP

SEQ ID NO: 129052 - protein, 9 aa, Borrelia burgdorferi B31
NKIVQNLKN

SEQ ID NO: 129053 - protein, 15 aa, Borrelia burgdorferi B31
PNNKIVQNLKNLEPE

SEQ ID NO: 129054 - protein, 9 aa, Borrelia burgdorferi B31
VQNLKNLEP

SEQ ID NO: 129055 - protein, 15 aa, Borrelia burgdorferi B31
PTYQMQKIMLSMGQE

SEQ ID NO: 129056 - protein, 9 aa, Borrelia burgdorferi B31
YQMQKIMLS

SEQ ID NO: 129057 - protein, 15 aa, Borrelia burgdorferi B31
DPTYQMQKIMLSMGQ

SEQ ID NO: 129058 - protein, 9 aa, Borrelia burgdorferi B31
YQMQKIMLS

SEQ ID NO: 129059 - protein, 15 aa, Borrelia burgdorferi B31
SNDPTYQMQKIMLSM

SEQ ID NO: 129060 - protein, 9 aa, Borrelia burgdorferi B31
YQMQKIMLS

SEQ ID NO: 129061 - protein, 15 aa, Borrelia burgdorferi B31
NDPTYQMQKIMLSMG

SEQ ID NO: 129062 - protein, 9 aa, Borrelia burgdorferi B31
YQMQKIMLS

SEQ ID NO: 129063 - protein, 15 aa, Borrelia burgdorferi B31
LLYLIIHSLYSHKEI

SEQ ID NO: 129064 - protein, 9 aa, Borrelia burgdorferi B31
YLIIHSLYS

SEQ ID NO: 129065 - protein, 15 aa, Borrelia burgdorferi B31
DLLYLIIHSLYSHKE

SEQ ID NO: 129066 - protein, 9 aa, Borrelia burgdorferi B31
YLIIHSLYS

SEQ ID NO: 129067 - protein, 15 aa, Borrelia burgdorferi B31
NNKIVQNLKNLEPEK

SEQ ID NO: 129068 - protein, 9 aa, Borrelia burgdorferi B31
VQNLKNLEP

SEQ ID NO: 129069 - protein, 15 aa, Borrelia burgdorferi B31
NKIVQNLKNLEPEKL

SEQ ID NO: 129070 - protein, 9 aa, Borrelia burgdorferi B31
VQNLKNLEP

SEQ ID NO: 129071 - protein, 15 aa, Borrelia burgdorferi B31
VNDLLYLIIHSLYSH

SEQ ID NO: 129072 - protein, 9 aa, Borrelia burgdorferi B31
YLIIHSLYS

SEQ ID NO: 129073 - protein, 15 aa, Borrelia burgdorferi B31
EVNDLLYLIIHSLYS

SEQ ID NO: 129074 - protein, 9 aa, Borrelia burgdorferi B31
LYLIIHSLY

SEQ ID NO: 129075 - protein, 15 aa, Borrelia burgdorferi B31
NDLLYLIIHSLYSHK

SEQ ID NO: 129076 - protein, 9 aa, Borrelia burgdorferi B31
YLIIHSLYS

SEQ ID NO: 129077 - protein, 15 aa, Borrelia burgdorferi B31
IFLRELISNASDAID

SEQ ID NO: 129078 - protein, 9 aa, Borrelia burgdorferi B31
LRELISNAS

SEQ ID NO: 129079 - protein, 15 aa, Borrelia burgdorferi B31
KIVQNLKNLEPEKLE

SEQ ID NO: 129080 - protein, 9 aa, Borrelia burgdorferi B31
VQNLKNLEP

SEQ ID NO: 129081 - protein, 15 aa, Borrelia burgdorferi B31
HKEIFLRELISNASD

SEQ ID NO: 129082 - protein, 9 aa, Borrelia burgdorferi B31
LRELISNAS

SEQ ID NO: 129083 - protein, 15 aa, Borrelia burgdorferi B31
KEIFLRELISNASDA

SEQ ID NO: 129084 - protein, 9 aa, Borrelia burgdorferi B31
LRELISNAS

SEQ ID NO: 129085 - protein, 15 aa, Borrelia burgdorferi B31
EIFLRELISNASDAI

SEQ ID NO: 129086 - protein, 9 aa, Borrelia burgdorferi B31
LRELISNAS

SEQ ID NO: 129087 - protein, 15 aa, Borrelia burgdorferi B31
EKLISLIRFKSSSVD

SEQ ID NO: 129088 - protein, 9 aa, Borrelia burgdorferi B31
LIRFKSSSV

SEQ ID NO: 129089 - protein, 15 aa, Borrelia burgdorferi B31
KLISLIRFKSSSVDG

SEQ ID NO: 129090 - protein, 9 aa, Borrelia burgdorferi B31
IRFKSSSVD

SEQ ID NO: 129091 - protein, 15 aa, Borrelia burgdorferi B31
LISLIRFKSSSVDGF

SEQ ID NO: 129092 - protein, 9 aa, Borrelia burgdorferi B31
IRFKSSSVD

SEQ ID NO: 129093 - protein, 15 aa, Borrelia burgdorferi B31
SHKEIFLRELISNAS

SEQ ID NO: 129094 - protein, 9 aa, Borrelia burgdorferi B31
EIFLRELIS

SEQ ID NO: 129095 - protein, 15 aa, Borrelia burgdorferi B31
NKILSKIKSSSVKKI

SEQ ID NO: 129096 - protein, 9 aa, Borrelia burgdorferi B31
LSKIKSSSV

SEQ ID NO: 129097 - protein, 15 aa, Borrelia burgdorferi B31
KILSKIKSSSVKKIL

SEQ ID NO: 129098 - protein, 9 aa, Borrelia burgdorferi B31
LSKIKSSSV

SEQ ID NO: 129099 - protein, 15 aa, Borrelia burgdorferi B31
LQQNKILSKIKSSSV

SEQ ID NO: 129100 - protein, 9 aa, Borrelia burgdorferi B31
LQQNKILSK

SEQ ID NO: 129101 - protein, 15 aa, Borrelia burgdorferi B31
QQNKILSKIKSSSVK

SEQ ID NO: 129102 - protein, 9 aa, Borrelia burgdorferi B31
LSKIKSSSV

SEQ ID NO: 129103 - protein, 15 aa, Borrelia burgdorferi B31
QNKILSKIKSSSVKK

SEQ ID NO: 129104 - protein, 9 aa, Borrelia burgdorferi B31
LSKIKSSSV

SEQ ID NO: 129105 - protein, 15 aa, Borrelia burgdorferi B31
LSKIKSSSVKKILSE

SEQ ID NO: 129106 - protein, 9 aa, Borrelia burgdorferi B31
LSKIKSSSV

SEQ ID NO: 129107 - protein, 15 aa, Borrelia burgdorferi B31
ILSKIKSSSVKKILS

SEQ ID NO: 129108 - protein, 9 aa, Borrelia burgdorferi B31
LSKIKSSSV

SEQ ID NO: 129109 - protein, 15 aa, Borrelia burgdorferi B31
DLYYPNTKPGVKLFI

SEQ ID NO: 129110 - protein, 9 aa, Borrelia burgdorferi B31
YPNTKPGVK

SEQ ID NO: 129111 - protein, 15 aa, Borrelia burgdorferi B31
YDLYYPNTKPGVKLF

SEQ ID NO: 129112 - protein, 9 aa, Borrelia burgdorferi B31
YPNTKPGVK

SEQ ID NO: 129113 - protein, 15 aa, Borrelia burgdorferi B31
ISLIRFKSSSVDGFV

SEQ ID NO: 129114 - protein, 9 aa, Borrelia burgdorferi B31
LIRFKSSSV

SEQ ID NO: 129115 - protein, 15 aa, Borrelia burgdorferi B31
PYDLYYPNTKPGVKL

SEQ ID NO: 129116 - protein, 9 aa, Borrelia burgdorferi B31
YPNTKPGVK

SEQ ID NO: 129117 - protein, 15 aa, Borrelia burgdorferi B31
APYDLYYPNTKPGVK

SEQ ID NO: 129118 - protein, 9 aa, Borrelia burgdorferi B31
YYPNTKPGV

SEQ ID NO: 129119 - protein, 15 aa, Borrelia burgdorferi B31
LISLIRFKSSSVDGF

SEQ ID NO: 129120 - protein, 9 aa, Borrelia burgdorferi B31
LIRFKSSSV

SEQ ID NO: 129121 - protein, 15 aa, Borrelia burgdorferi B31
KLISLIRFKSSSVDG

SEQ ID NO: 129122 - protein, 9 aa, Borrelia burgdorferi B31
LIRFKSSSV

SEQ ID NO: 129123 - protein, 15 aa, Borrelia burgdorferi B31
EKLISLIRFKSSSVD

SEQ ID NO: 129124 - protein, 9 aa, Borrelia burgdorferi B31
LIRFKSSSV

SEQ ID NO: 129125 - protein, 15 aa, Borrelia burgdorferi B31
EEYNEFYKNTTFDYE

SEQ ID NO: 129126 - protein, 9 aa, Borrelia burgdorferi B31
FYKNTTFDY

SEQ ID NO: 129127 - protein, 15 aa, Borrelia burgdorferi B31
EYNEFYKNTTFDYEN

SEQ ID NO: 129128 - protein, 9 aa, Borrelia burgdorferi B31
FYKNTTFDY

SEQ ID NO: 129129 - protein, 15 aa, Borrelia burgdorferi B31
QEIIKKYSNHINYPI

SEQ ID NO: 129130 - protein, 9 aa, Borrelia burgdorferi B31
IIKKYSNHI

SEQ ID NO: 129131 - protein, 15 aa, Borrelia burgdorferi B31
LYYPNTKPGVKLFIN

SEQ ID NO: 129132 - protein, 9 aa, Borrelia burgdorferi B31
YPNTKPGVK

SEQ ID NO: 129133 - protein, 15 aa, Borrelia burgdorferi B31
YNEFYKNTTFDYENP

SEQ ID NO: 129134 - protein, 9 aa, Borrelia burgdorferi B31
FYKNTTFDY

SEQ ID NO: 129135 - protein, 15 aa, Borrelia burgdorferi B31
NEFYKNTTFDYENPL

SEQ ID NO: 129136 - protein, 9 aa, Borrelia burgdorferi B31
FYKNTTFDY

SEQ ID NO: 129137 - protein, 15 aa, Borrelia burgdorferi B31
IFYFKQIALFIIFRL

SEQ ID NO: 129138 - protein, 9 aa, Borrelia burgdorferi B31
YFKQIALFI

SEQ ID NO: 129139 - protein, 15 aa, Borrelia burgdorferi B31
ILIFYFKQIALFIIF

SEQ ID NO: 129140 - protein, 9 aa, Borrelia burgdorferi B31
YFKQIALFI

SEQ ID NO: 129141 - protein, 15 aa, Borrelia burgdorferi B31
MILIFYFKQIALFII

SEQ ID NO: 129142 - protein, 9 aa, Borrelia burgdorferi B31
YFKQIALFI

SEQ ID NO: 129143 - protein, 15 aa, Borrelia burgdorferi B31
LIFYFKQIALFIIFR

SEQ ID NO: 129144 - protein, 9 aa, Borrelia burgdorferi B31
YFKQIALFI

SEQ ID NO: 129145 - protein, 15 aa, Borrelia burgdorferi B31
AEEYNEFYKNTTFDY

SEQ ID NO: 129146 - protein, 9 aa, Borrelia burgdorferi B31
EFYKNTTFD

SEQ ID NO: 129147 - protein, 15 aa, Borrelia burgdorferi B31
REKLISLIRFKSSSV

SEQ ID NO: 129148 - protein, 9 aa, Borrelia burgdorferi B31
ISLIRFKSS

SEQ ID NO: 129149 - protein, 15 aa, Borrelia burgdorferi B31
CYIIKKVKIKLKRKS

SEQ ID NO: 129150 - protein, 9 aa, Borrelia burgdorferi B31
IIKKVKIKL

SEQ ID NO: 129151 - protein, 15 aa, Borrelia burgdorferi B31
IIKKVKIKLKRKSCM

SEQ ID NO: 129152 - protein, 9 aa, Borrelia burgdorferi B31
VKIKLKRKS

SEQ ID NO: 129153 - protein, 15 aa, Borrelia burgdorferi B31
YIIKKVKIKLKRKSC

SEQ ID NO: 129154 - protein, 9 aa, Borrelia burgdorferi B31
VKIKLKRKS

SEQ ID NO: 129155 - protein, 15 aa, Borrelia burgdorferi B31
KKVKIKLKRKSCMKK

SEQ ID NO: 129156 - protein, 9 aa, Borrelia burgdorferi B31
VKIKLKRKS

SEQ ID NO: 129157 - protein, 15 aa, Borrelia burgdorferi B31
INYPIYIKYSEPIMK

SEQ ID NO: 129158 - protein, 9 aa, Borrelia burgdorferi B31
YIKYSEPIM

SEQ ID NO: 129159 - protein, 15 aa, Borrelia burgdorferi B31
YPIYIKYSEPIMKDG

SEQ ID NO: 129160 - protein, 9 aa, Borrelia burgdorferi B31
YIKYSEPIM

SEQ ID NO: 129161 - protein, 15 aa, Borrelia burgdorferi B31
NYPIYIKYSEPIMKD

SEQ ID NO: 129162 - protein, 9 aa, Borrelia burgdorferi B31
YIKYSEPIM

SEQ ID NO: 129163 - protein, 15 aa, Borrelia burgdorferi B31
PIYIKYSEPIMKDGK

SEQ ID NO: 129164 - protein, 9 aa, Borrelia burgdorferi B31
YIKYSEPIM

SEQ ID NO: 129165 - protein, 15 aa, Borrelia burgdorferi B31
HINYPIYIKYSEPIM

SEQ ID NO: 129166 - protein, 9 aa, Borrelia burgdorferi B31
IYIKYSEPI

SEQ ID NO: 129167 - protein, 15 aa, Borrelia burgdorferi B31
KILSKIKSSSVKKIL

SEQ ID NO: 129168 - protein, 9 aa, Borrelia burgdorferi B31
IKSSSVKKI

SEQ ID NO: 129169 - protein, 15 aa, Borrelia burgdorferi B31
YTNLFYVPSKAPYDL

SEQ ID NO: 129170 - protein, 9 aa, Borrelia burgdorferi B31
YVPSKAPYD

SEQ ID NO: 129171 - protein, 15 aa, Borrelia burgdorferi B31
TNLFYVPSKAPYDLY

SEQ ID NO: 129172 - protein, 9 aa, Borrelia burgdorferi B31
YVPSKAPYD

SEQ ID NO: 129173 - protein, 15 aa, Borrelia burgdorferi B31
ILSKIKSSSVKKILS

SEQ ID NO: 129174 - protein, 9 aa, Borrelia burgdorferi B31
IKSSSVKKI

SEQ ID NO: 129175 - protein, 15 aa, Borrelia burgdorferi B31
NKILSKIKSSSVKKI

SEQ ID NO: 129176 - protein, 9 aa, Borrelia burgdorferi B31
LSKIKSSSV

SEQ ID NO: 129177 - protein, 15 aa, Borrelia burgdorferi B31
LSKIKSSSVKKILSE

SEQ ID NO: 129178 - protein, 9 aa, Borrelia burgdorferi B31
IKSSSVKKI

SEQ ID NO: 129179 - protein, 15 aa, Borrelia burgdorferi B31
NLFYVPSKAPYDLYY

SEQ ID NO: 129180 - protein, 9 aa, Borrelia burgdorferi B31
YVPSKAPYD

SEQ ID NO: 129181 - protein, 15 aa, Borrelia burgdorferi B31
SKIKSSSVKKILSEL

SEQ ID NO: 129182 - protein, 9 aa, Borrelia burgdorferi B31
IKSSSVKKI

SEQ ID NO: 129183 - protein, 15 aa, Borrelia burgdorferi B31
EYTNLFYVPSKAPYD

SEQ ID NO: 129184 - protein, 9 aa, Borrelia burgdorferi B31
FYVPSKAPY

SEQ ID NO: 129185 - protein, 15 aa, Borrelia burgdorferi B31
MILIFYFKQIALFII

SEQ ID NO: 129186 - protein, 9 aa, Borrelia burgdorferi B31
YFKQIALFI

SEQ ID NO: 129187 - protein, 15 aa, Borrelia burgdorferi B31
ILIFYFKQIALFIIF

SEQ ID NO: 129188 - protein, 9 aa, Borrelia burgdorferi B31
YFKQIALFI

SEQ ID NO: 129189 - protein, 15 aa, Borrelia burgdorferi B31
LIFYFKQIALFIIFR

SEQ ID NO: 129190 - protein, 9 aa, Borrelia burgdorferi B31
YFKQIALFI

SEQ ID NO: 129191 - protein, 15 aa, Borrelia burgdorferi B31
IYIKYSEPIMKDGKQ

SEQ ID NO: 129192 - protein, 9 aa, Borrelia burgdorferi B31
YIKYSEPIM

SEQ ID NO: 129193 - protein, 15 aa, Borrelia burgdorferi B31
IFYFKQIALFIIFRL

SEQ ID NO: 129194 - protein, 9 aa, Borrelia burgdorferi B31
YFKQIALFI

SEQ ID NO: 129195 - protein, 15 aa, Borrelia burgdorferi B31
LFYVPSKAPYDLYYP

SEQ ID NO: 129196 - protein, 9 aa, Borrelia burgdorferi B31
YVPSKAPYD

SEQ ID NO: 129197 - protein, 15 aa, Borrelia burgdorferi B31
ISLIRFKSSSVDGFV

SEQ ID NO: 129198 - protein, 9 aa, Borrelia burgdorferi B31
FKSSSVDGF

SEQ ID NO: 129199 - protein, 15 aa, Borrelia burgdorferi B31
LISLIRFKSSSVDGF

SEQ ID NO: 129200 - protein, 9 aa, Borrelia burgdorferi B31
RFKSSSVDG

SEQ ID NO: 129201 - protein, 15 aa, Borrelia burgdorferi B31
EGNLEYTNLFYVPSK

SEQ ID NO: 129202 - protein, 9 aa, Borrelia burgdorferi B31
YTNLFYVPS

SEQ ID NO: 129203 - protein, 15 aa, Borrelia burgdorferi B31
AEGNLEYTNLFYVPS

SEQ ID NO: 129204 - protein, 9 aa, Borrelia burgdorferi B31
LEYTNLFYV

SEQ ID NO: 129205 - protein, 15 aa, Borrelia burgdorferi B31
GNLEYTNLFYVPSKA

SEQ ID NO: 129206 - protein, 9 aa, Borrelia burgdorferi B31
YTNLFYVPS

SEQ ID NO: 129207 - protein, 15 aa, Borrelia burgdorferi B31
LEYTNLFYVPSKAPY

SEQ ID NO: 129208 - protein, 9 aa, Borrelia burgdorferi B31
YTNLFYVPS

SEQ ID NO: 129209 - protein, 15 aa, Borrelia burgdorferi B31
NLEYTNLFYVPSKAP

SEQ ID NO: 129210 - protein, 9 aa, Borrelia burgdorferi B31
YTNLFYVPS

SEQ ID NO: 129211 - protein, 15 aa, Borrelia burgdorferi B31
EKLISLIRFKSSSVD

SEQ ID NO: 129212 - protein, 9 aa, Borrelia burgdorferi B31
LISLIRFKS

SEQ ID NO: 129213 - protein, 15 aa, Borrelia burgdorferi B31
NREKLISLIRFKSSS

SEQ ID NO: 129214 - protein, 9 aa, Borrelia burgdorferi B31
LISLIRFKS

SEQ ID NO: 129215 - protein, 15 aa, Borrelia burgdorferi B31
ENREKLISLIRFKSS

SEQ ID NO: 129216 - protein, 9 aa, Borrelia burgdorferi B31
LISLIRFKS

SEQ ID NO: 129217 - protein, 15 aa, Borrelia burgdorferi B31
REKLISLIRFKSSSV

SEQ ID NO: 129218 - protein, 9 aa, Borrelia burgdorferi B31
LISLIRFKS

SEQ ID NO: 129219 - protein, 15 aa, Borrelia burgdorferi B31
FENREKLISLIRFKS

SEQ ID NO: 129220 - protein, 9 aa, Borrelia burgdorferi B31
EKLISLIRF

SEQ ID NO: 129221 - protein, 15 aa, Borrelia burgdorferi B31
YTNLFYVPSKAPYDL

SEQ ID NO: 129222 - protein, 9 aa, Borrelia burgdorferi B31
YTNLFYVPS

SEQ ID NO: 129223 - protein, 15 aa, Borrelia burgdorferi B31
EYTNLFYVPSKAPYD

SEQ ID NO: 129224 - protein, 9 aa, Borrelia burgdorferi B31
YTNLFYVPS

SEQ ID NO: 129225 - protein, 15 aa, Borrelia burgdorferi B31
KKVKIKLKRKSCMKK

SEQ ID NO: 129226 - protein, 9 aa, Borrelia burgdorferi B31
VKIKLKRKS

SEQ ID NO: 129227 - protein, 15 aa, Borrelia burgdorferi B31
EGLKLKAINKNETSN

SEQ ID NO: 129228 - protein, 9 aa, Borrelia burgdorferi B31
LKAINKNET

SEQ ID NO: 129229 - protein, 15 aa, Borrelia burgdorferi B31
YEGLKLKAINKNETS

SEQ ID NO: 129230 - protein, 9 aa, Borrelia burgdorferi B31
LKAINKNET

SEQ ID NO: 129231 - protein, 15 aa, Borrelia burgdorferi B31
GLKLKAINKNETSNE

SEQ ID NO: 129232 - protein, 9 aa, Borrelia burgdorferi B31
LKAINKNET

SEQ ID NO: 129233 - protein, 15 aa, Borrelia burgdorferi B31
LKLKAINKNETSNEL

SEQ ID NO: 129234 - protein, 9 aa, Borrelia burgdorferi B31
LKAINKNET

SEQ ID NO: 129235 - protein, 15 aa, Borrelia burgdorferi B31
EYEGLKLKAINKNET

SEQ ID NO: 129236 - protein, 9 aa, Borrelia burgdorferi B31
LKLKAINKN

SEQ ID NO: 129237 - protein, 15 aa, Borrelia burgdorferi B31
IIKKVKIKLKRKSCM

SEQ ID NO: 129238 - protein, 9 aa, Borrelia burgdorferi B31
VKIKLKRKS

SEQ ID NO: 129239 - protein, 15 aa, Borrelia burgdorferi B31
QDLTNHLGVIAKSGT

SEQ ID NO: 129240 - protein, 9 aa, Borrelia burgdorferi B31
LTNHLGVIA

SEQ ID NO: 129241 - protein, 15 aa, Borrelia burgdorferi B31
IKPILELNPNNKIVQ

SEQ ID NO: 129242 - protein, 9 aa, Borrelia burgdorferi B31
LELNPNNKI

SEQ ID NO: 129243 - protein, 15 aa, Borrelia burgdorferi B31
KPILELNPNNKIVQN

SEQ ID NO: 129244 - protein, 9 aa, Borrelia burgdorferi B31
LNPNNKIVQ

SEQ ID NO: 129245 - protein, 15 aa, Borrelia burgdorferi B31
IKKVKIKLKRKSCMK

SEQ ID NO: 129246 - protein, 9 aa, Borrelia burgdorferi B31
IKLKRKSCM

SEQ ID NO: 129247 - protein, 15 aa, Borrelia burgdorferi B31
KDHIKEVNLSATLIK

SEQ ID NO: 129248 - protein, 9 aa, Borrelia burgdorferi B31
IKEVNLSAT

SEQ ID NO: 129249 - protein, 15 aa, Borrelia burgdorferi B31
DHIKEVNLSATLIKE

SEQ ID NO: 129250 - protein, 9 aa, Borrelia burgdorferi B31
VNLSATLIK

SEQ ID NO: 129251 - protein, 15 aa, Borrelia burgdorferi B31
PGVKLFINRIFITDS

SEQ ID NO: 129252 - protein, 9 aa, Borrelia burgdorferi B31
LFINRIFIT

SEQ ID NO: 129253 - protein, 15 aa, Borrelia burgdorferi B31
PILELNPNNKIVQNL

SEQ ID NO: 129254 - protein, 9 aa, Borrelia burgdorferi B31
LNPNNKIVQ

SEQ ID NO: 129255 - protein, 15 aa, Borrelia burgdorferi B31
LTNHLGVIAKSGTKE

SEQ ID NO: 129256 - protein, 9 aa, Borrelia burgdorferi B31
LGVIAKSGT

SEQ ID NO: 129257 - protein, 15 aa, Borrelia burgdorferi B31
NKIVQNLKNLEPEKL

SEQ ID NO: 129258 - protein, 9 aa, Borrelia burgdorferi B31
IVQNLKNLE

SEQ ID NO: 129259 - protein, 15 aa, Borrelia burgdorferi B31
TNHLGVIAKSGTKEF

SEQ ID NO: 129260 - protein, 9 aa, Borrelia burgdorferi B31
LGVIAKSGT

SEQ ID NO: 129261 - protein, 15 aa, Borrelia burgdorferi B31
LNPNNKIVQNLKNLE

SEQ ID NO: 129262 - protein, 9 aa, Borrelia burgdorferi B31
LNPNNKIVQ

SEQ ID NO: 129263 - protein, 15 aa, Borrelia burgdorferi B31
KPGVKLFINRIFITD

SEQ ID NO: 129264 - protein, 9 aa, Borrelia burgdorferi B31
LFINRIFIT

SEQ ID NO: 129265 - protein, 15 aa, Borrelia burgdorferi B31
REILQQNKILSKIKS

SEQ ID NO: 129266 - protein, 9 aa, Borrelia burgdorferi B31
ILQQNKILS

SEQ ID NO: 129267 - protein, 15 aa, Borrelia burgdorferi B31
NHLGVIAKSGTKEFI

SEQ ID NO: 129268 - protein, 9 aa, Borrelia burgdorferi B31
LGVIAKSGT

SEQ ID NO: 129269 - protein, 15 aa, Borrelia burgdorferi B31
KKVKIKLKRKSCMKK

SEQ ID NO: 129270 - protein, 9 aa, Borrelia burgdorferi B31
IKLKRKSCM

SEQ ID NO: 129271 - protein, 15 aa, Borrelia burgdorferi B31
GVKLFINRIFITDSE

SEQ ID NO: 129272 - protein, 9 aa, Borrelia burgdorferi B31
LFINRIFIT

SEQ ID NO: 129273 - protein, 15 aa, Borrelia burgdorferi B31
DLTNHLGVIAKSGTK

SEQ ID NO: 129274 - protein, 9 aa, Borrelia burgdorferi B31
LGVIAKSGT

SEQ ID NO: 129275 - protein, 15 aa, Borrelia burgdorferi B31
VKLFINRIFITDSEG

SEQ ID NO: 129276 - protein, 9 aa, Borrelia burgdorferi B31
LFINRIFIT

SEQ ID NO: 129277 - protein, 15 aa, Borrelia burgdorferi B31
IKEVNLSATLIKEPS

SEQ ID NO: 129278 - protein, 9 aa, Borrelia burgdorferi B31
VNLSATLIK

SEQ ID NO: 129279 - protein, 15 aa, Borrelia burgdorferi B31
HIKEVNLSATLIKEP

SEQ ID NO: 129280 - protein, 9 aa, Borrelia burgdorferi B31
VNLSATLIK

SEQ ID NO: 129281 - protein, 15 aa, Borrelia burgdorferi B31
ILELNPNNKIVQNLK

SEQ ID NO: 129282 - protein, 9 aa, Borrelia burgdorferi B31
LNPNNKIVQ

SEQ ID NO: 129283 - protein, 15 aa, Borrelia burgdorferi B31
CYIIKKVKIKLKRKS

SEQ ID NO: 129284 - protein, 9 aa, Borrelia burgdorferi B31
IKKVKIKLK

SEQ ID NO: 129285 - protein, 15 aa, Borrelia burgdorferi B31
NPNNKIVQNLKNLEP

SEQ ID NO: 129286 - protein, 9 aa, Borrelia burgdorferi B31
IVQNLKNLE

SEQ ID NO: 129287 - protein, 15 aa, Borrelia burgdorferi B31
PNNKIVQNLKNLEPE

SEQ ID NO: 129288 - protein, 9 aa, Borrelia burgdorferi B31
IVQNLKNLE

SEQ ID NO: 129289 - protein, 15 aa, Borrelia burgdorferi B31
KIVQNLKNLEPEKLE

SEQ ID NO: 129290 - protein, 9 aa, Borrelia burgdorferi B31
VQNLKNLEP

SEQ ID NO: 129291 - protein, 15 aa, Borrelia burgdorferi B31
EILQQNKILSKIKSS

SEQ ID NO: 129292 - protein, 9 aa, Borrelia burgdorferi B31
NKILSKIKS

SEQ ID NO: 129293 - protein, 15 aa, Borrelia burgdorferi B31
FENREKLISLIRFKS

SEQ ID NO: 129294 - protein, 9 aa, Borrelia burgdorferi B31
EKLISLIRF

SEQ ID NO: 129295 - protein, 15 aa, Borrelia burgdorferi B31
NNKIVQNLKNLEPEK

SEQ ID NO: 129296 - protein, 9 aa, Borrelia burgdorferi B31
IVQNLKNLE

SEQ ID NO: 129297 - protein, 15 aa, Borrelia burgdorferi B31
YIIKKVKIKLKRKSC

SEQ ID NO: 129298 - protein, 9 aa, Borrelia burgdorferi B31
VKIKLKRKS

SEQ ID NO: 129299 - protein, 15 aa, Borrelia burgdorferi B31
TKPGVKLFINRIFIT

SEQ ID NO: 129300 - protein, 9 aa, Borrelia burgdorferi B31
VKLFINRIF

SEQ ID NO: 129301 - protein, 15 aa, Borrelia burgdorferi B31
ILQQNKILSKIKSSS

SEQ ID NO: 129302 - protein, 9 aa, Borrelia burgdorferi B31
NKILSKIKS

SEQ ID NO: 129303 - protein, 15 aa, Borrelia burgdorferi B31
KVKIKLKRKSCMKKQ

SEQ ID NO: 129304 - protein, 9 aa, Borrelia burgdorferi B31
IKLKRKSCM

SEQ ID NO: 129305 - protein, 15 aa, Borrelia burgdorferi B31
FRLCYIIKKVKIKLK

SEQ ID NO: 129306 - protein, 9 aa, Borrelia burgdorferi B31
YIIKKVKIK

SEQ ID NO: 129307 - protein, 15 aa, Borrelia burgdorferi B31
PTYQMQKIMLSMGQE

SEQ ID NO: 129308 - protein, 9 aa, Borrelia burgdorferi B31
YQMQKIMLS

SEQ ID NO: 129309 - protein, 15 aa, Borrelia burgdorferi B31
RLCYIIKKVKIKLKR

SEQ ID NO: 129310 - protein, 9 aa, Borrelia burgdorferi B31
IKKVKIKLK

SEQ ID NO: 129311 - protein, 15 aa, Borrelia burgdorferi B31
VKIKLKRKSCMKKQF

SEQ ID NO: 129312 - protein, 9 aa, Borrelia burgdorferi B31
IKLKRKSCM

SEQ ID NO: 129313 - protein, 15 aa, Borrelia burgdorferi B31
DPTYQMQKIMLSMGQ

SEQ ID NO: 129314 - protein, 9 aa, Borrelia burgdorferi B31
YQMQKIMLS

SEQ ID NO: 129315 - protein, 15 aa, Borrelia burgdorferi B31
NDPTYQMQKIMLSMG

SEQ ID NO: 129316 - protein, 9 aa, Borrelia burgdorferi B31
YQMQKIMLS

SEQ ID NO: 129317 - protein, 15 aa, Borrelia burgdorferi B31
LELNPNNKIVQNLKN

SEQ ID NO: 129318 - protein, 9 aa, Borrelia burgdorferi B31
LNPNNKIVQ

SEQ ID NO: 129319 - protein, 15 aa, Borrelia burgdorferi B31
VSREILQQNKILSKI

SEQ ID NO: 129320 - protein, 9 aa, Borrelia burgdorferi B31
ILQQNKILS

SEQ ID NO: 129321 - protein, 15 aa, Borrelia burgdorferi B31
ENREKLISLIRFKSS

SEQ ID NO: 129322 - protein, 9 aa, Borrelia burgdorferi B31
LISLIRFKS

SEQ ID NO: 129323 - protein, 15 aa, Borrelia burgdorferi B31
LCYIIKKVKIKLKRK

SEQ ID NO: 129324 - protein, 9 aa, Borrelia burgdorferi B31
IKKVKIKLK

SEQ ID NO: 129325 - protein, 15 aa, Borrelia burgdorferi B31
NREKLISLIRFKSSS

SEQ ID NO: 129326 - protein, 9 aa, Borrelia burgdorferi B31
LISLIRFKS

SEQ ID NO: 129327 - protein, 15 aa, Borrelia burgdorferi B31
SREILQQNKILSKIK

SEQ ID NO: 129328 - protein, 9 aa, Borrelia burgdorferi B31
ILQQNKILS

SEQ ID NO: 129329 - protein, 15 aa, Borrelia burgdorferi B31
EKLISLIRFKSSSVD

SEQ ID NO: 129330 - protein, 9 aa, Borrelia burgdorferi B31
LISLIRFKS

SEQ ID NO: 129331 - protein, 15 aa, Borrelia burgdorferi B31
REKLISLIRFKSSSV

SEQ ID NO: 129332 - protein, 9 aa, Borrelia burgdorferi B31
LISLIRFKS

SEQ ID NO: 129333 - protein, 15 aa, Borrelia burgdorferi B31
IVQNLKNLEPEKLEK

SEQ ID NO: 129334 - protein, 9 aa, Borrelia burgdorferi B31
IVQNLKNLE

SEQ ID NO: 129335 - protein, 15 aa, Borrelia burgdorferi B31
KLKAINKNETSNELK

SEQ ID NO: 129336 - protein, 9 aa, Borrelia burgdorferi B31
LKAINKNET

SEQ ID NO: 129337 - protein, 15 aa, Borrelia burgdorferi B31
NKILSKIKSSSVKKI

SEQ ID NO: 129338 - protein, 9 aa, Borrelia burgdorferi B31
NKILSKIKS

SEQ ID NO: 129339 - protein, 15 aa, Borrelia burgdorferi B31
NVSREILQQNKILSK

SEQ ID NO: 129340 - protein, 9 aa, Borrelia burgdorferi B31
ILQQNKILS

SEQ ID NO: 129341 - protein, 15 aa, Borrelia burgdorferi B31
LGVIAKSGTKEFINN

SEQ ID NO: 129342 - protein, 9 aa, Borrelia burgdorferi B31
LGVIAKSGT

SEQ ID NO: 129343 - protein, 15 aa, Borrelia burgdorferi B31
HLGVIAKSGTKEFIN

SEQ ID NO: 129344 - protein, 9 aa, Borrelia burgdorferi B31
LGVIAKSGT

SEQ ID NO: 129345 - protein, 15 aa, Borrelia burgdorferi B31
LKAINKNETSNELKD

SEQ ID NO: 129346 - protein, 9 aa, Borrelia burgdorferi B31
LKAINKNET

SEQ ID NO: 129347 - protein, 15 aa, Borrelia burgdorferi B31
SLLPNYLRFIKGIID

SEQ ID NO: 129348 - protein, 9 aa, Borrelia burgdorferi B31
LPNYLRFIK

SEQ ID NO: 129349 - protein, 15 aa, Borrelia burgdorferi B31
LQQNKILSKIKSSSV

SEQ ID NO: 129350 - protein, 9 aa, Borrelia burgdorferi B31
NKILSKIKS

SEQ ID NO: 129351 - protein, 15 aa, Borrelia burgdorferi B31
VNDLLYLIIHSLYSH

SEQ ID NO: 129352 - protein, 9 aa, Borrelia burgdorferi B31
LYLIIHSLY

SEQ ID NO: 129353 - protein, 15 aa, Borrelia burgdorferi B31
YQMQKIMLSMGQEVK

SEQ ID NO: 129354 - protein, 9 aa, Borrelia burgdorferi B31
YQMQKIMLS

SEQ ID NO: 129355 - protein, 15 aa, Borrelia burgdorferi B31
KLFINRIFITDSEGS

SEQ ID NO: 129356 - protein, 9 aa, Borrelia burgdorferi B31
LFINRIFIT

SEQ ID NO: 129357 - protein, 15 aa, Borrelia burgdorferi B31
LNVSREILQQNKILS

SEQ ID NO: 129358 - protein, 9 aa, Borrelia burgdorferi B31
LNVSREILQ

SEQ ID NO: 129359 - protein, 15 aa, Borrelia burgdorferi B31
IFYFKQIALFIIFRL

SEQ ID NO: 129360 - protein, 9 aa, Borrelia burgdorferi B31
FKQIALFII

SEQ ID NO: 129361 - protein, 15 aa, Borrelia burgdorferi B31
NDLLYLIIHSLYSHK

SEQ ID NO: 129362 - protein, 9 aa, Borrelia burgdorferi B31
LYLIIHSLY

SEQ ID NO: 129363 - protein, 15 aa, Borrelia burgdorferi B31
FYFKQIALFIIFRLC

SEQ ID NO: 129364 - protein, 9 aa, Borrelia burgdorferi B31
FKQIALFII

SEQ ID NO: 129365 - protein, 15 aa, Borrelia burgdorferi B31
KEVNLSATLIKEPSA

SEQ ID NO: 129366 - protein, 9 aa, Borrelia burgdorferi B31
VNLSATLIK

SEQ ID NO: 129367 - protein, 15 aa, Borrelia burgdorferi B31
GSLLPNYLRFIKGII

SEQ ID NO: 129368 - protein, 9 aa, Borrelia burgdorferi B31
LPNYLRFIK

SEQ ID NO: 129369 - protein, 15 aa, Borrelia burgdorferi B31
EIKPILELNPNNKIV

SEQ ID NO: 129370 - protein, 9 aa, Borrelia burgdorferi B31
LELNPNNKI

SEQ ID NO: 129371 - protein, 15 aa, Borrelia burgdorferi B31
QQNKILSKIKSSSVK

SEQ ID NO: 129372 - protein, 9 aa, Borrelia burgdorferi B31
NKILSKIKS

SEQ ID NO: 129373 - protein, 15 aa, Borrelia burgdorferi B31
LKDHIKEVNLSATLI

SEQ ID NO: 129374 - protein, 9 aa, Borrelia burgdorferi B31
IKEVNLSAT

SEQ ID NO: 129375 - protein, 15 aa, Borrelia burgdorferi B31
KEIKPILELNPNNKI

SEQ ID NO: 129376 - protein, 9 aa, Borrelia burgdorferi B31
ILELNPNNK

SEQ ID NO: 129377 - protein, 15 aa, Borrelia burgdorferi B31
TYQMQKIMLSMGQEV

SEQ ID NO: 129378 - protein, 9 aa, Borrelia burgdorferi B31
YQMQKIMLS

SEQ ID NO: 129379 - protein, 15 aa, Borrelia burgdorferi B31
DLLYLIIHSLYSHKE

SEQ ID NO: 129380 - protein, 9 aa, Borrelia burgdorferi B31
LYLIIHSLY

SEQ ID NO: 129381 - protein, 15 aa, Borrelia burgdorferi B31
IKKYSNHINYPIYIK

SEQ ID NO: 129382 - protein, 9 aa, Borrelia burgdorferi B31
YSNHINYPI

SEQ ID NO: 129383 - protein, 15 aa, Borrelia burgdorferi B31
IFRLCYIIKKVKIKL

SEQ ID NO: 129384 - protein, 9 aa, Borrelia burgdorferi B31
YIIKKVKIK

SEQ ID NO: 129385 - protein, 15 aa, Borrelia burgdorferi B31
SNDPTYQMQKIMLSM

SEQ ID NO: 129386 - protein, 9 aa, Borrelia burgdorferi B31
YQMQKIMLS

SEQ ID NO: 129387 - protein, 15 aa, Borrelia burgdorferi B31
QEIIKKYSNHINYPI

SEQ ID NO: 129388 - protein, 9 aa, Borrelia burgdorferi B31
IKKYSNHIN

SEQ ID NO: 129389 - protein, 15 aa, Borrelia burgdorferi B31
IIKKYSNHINYPIYI

SEQ ID NO: 129390 - protein, 9 aa, Borrelia burgdorferi B31
YSNHINYPI

SEQ ID NO: 129391 - protein, 15 aa, Borrelia burgdorferi B31
KKYSNHINYPIYIKY

SEQ ID NO: 129392 - protein, 9 aa, Borrelia burgdorferi B31
YSNHINYPI

SEQ ID NO: 129393 - protein, 15 aa, Borrelia burgdorferi B31
LLPNYLRFIKGIIDC

SEQ ID NO: 129394 - protein, 9 aa, Borrelia burgdorferi B31
YLRFIKGII

SEQ ID NO: 129395 - protein, 15 aa, Borrelia burgdorferi B31
DSNDPTYQMQKIMLS

SEQ ID NO: 129396 - protein, 9 aa, Borrelia burgdorferi B31
TYQMQKIML

SEQ ID NO: 129397 - protein, 15 aa, Borrelia burgdorferi B31
DDKSILIKDNGIGMD

SEQ ID NO: 129398 - protein, 9 aa, Borrelia burgdorferi B31
LIKDNGIGM

SEQ ID NO: 129399 - protein, 15 aa, Borrelia burgdorferi B31
EIIKKYSNHINYPIY

SEQ ID NO: 129400 - protein, 9 aa, Borrelia burgdorferi B31
YSNHINYPI

SEQ ID NO: 129401 - protein, 15 aa, Borrelia burgdorferi B31
LPNYLRFIKGIIDCQ

SEQ ID NO: 129402 - protein, 9 aa, Borrelia burgdorferi B31
YLRFIKGII

SEQ ID NO: 129403 - protein, 15 aa, Borrelia burgdorferi B31
DEQDLTNHLGVIAKS

SEQ ID NO: 129404 - protein, 9 aa, Borrelia burgdorferi B31
LTNHLGVIA

SEQ ID NO: 129405 - protein, 15 aa, Borrelia burgdorferi B31
MDEQDLTNHLGVIAK

SEQ ID NO: 129406 - protein, 9 aa, Borrelia burgdorferi B31
LTNHLGVIA

SEQ ID NO: 129407 - protein, 15 aa, Borrelia burgdorferi B31
PEYEGLKLKAINKNE

SEQ ID NO: 129408 - protein, 9 aa, Borrelia burgdorferi B31
LKLKAINKN

SEQ ID NO: 129409 - protein, 15 aa, Borrelia burgdorferi B31
IPEYEGLKLKAINKN

SEQ ID NO: 129410 - protein, 9 aa, Borrelia burgdorferi B31
YEGLKLKAI

SEQ ID NO: 129411 - protein, 15 aa, Borrelia burgdorferi B31
FKQIALFIIFRLCYI

SEQ ID NO: 129412 - protein, 9 aa, Borrelia burgdorferi B31
IALFIIFRL

SEQ ID NO: 129413 - protein, 15 aa, Borrelia burgdorferi B31
LFINRIFITDSEGSL

SEQ ID NO: 129414 - protein, 9 aa, Borrelia burgdorferi B31
LFINRIFIT

SEQ ID NO: 129415 - protein, 15 aa, Borrelia burgdorferi B31
YFKQIALFIIFRLCY

SEQ ID NO: 129416 - protein, 9 aa, Borrelia burgdorferi B31
IALFIIFRL

SEQ ID NO: 129417 - protein, 15 aa, Borrelia burgdorferi B31
EILKDHIKEVNLSAT

SEQ ID NO: 129418 - protein, 9 aa, Borrelia burgdorferi B31
LKDHIKEVN

SEQ ID NO: 129419 - protein, 15 aa, Borrelia burgdorferi B31
DKSILIKDNGIGMDE

SEQ ID NO: 129420 - protein, 9 aa, Borrelia burgdorferi B31
IKDNGIGMD

SEQ ID NO: 129421 - protein, 15 aa, Borrelia burgdorferi B31
EQDLTNHLGVIAKSG

SEQ ID NO: 129422 - protein, 9 aa, Borrelia burgdorferi B31
LTNHLGVIA

SEQ ID NO: 129423 - protein, 15 aa, Borrelia burgdorferi B31
KSILIKDNGIGMDEQ

SEQ ID NO: 129424 - protein, 9 aa, Borrelia burgdorferi B31
LIKDNGIGM

SEQ ID NO: 129425 - protein, 15 aa, Borrelia burgdorferi B31
EVNDLLYLIIHSLYS

SEQ ID NO: 129426 - protein, 9 aa, Borrelia burgdorferi B31
LYLIIHSLY

SEQ ID NO: 129427 - protein, 15 aa, Borrelia burgdorferi B31
TEVNDLLYLIIHSLY

SEQ ID NO: 129428 - protein, 9 aa, Borrelia burgdorferi B31
LLYLIIHSL

SEQ ID NO: 129429 - protein, 15 aa, Borrelia burgdorferi B31
LLYLIIHSLYSHKEI

SEQ ID NO: 129430 - protein, 9 aa, Borrelia burgdorferi B31
LIIHSLYSH

SEQ ID NO: 129431 - protein, 15 aa, Borrelia burgdorferi B31
ILKDHIKEVNLSATL

SEQ ID NO: 129432 - protein, 9 aa, Borrelia burgdorferi B31
IKEVNLSAT

SEQ ID NO: 129433 - protein, 15 aa, Borrelia burgdorferi B31
LDEAILNLIPEYEGL

SEQ ID NO: 129434 - protein, 9 aa, Borrelia burgdorferi B31
ILNLIPEYE

SEQ ID NO: 129435 - protein, 15 aa, Borrelia burgdorferi B31
KILSKIKSSSVKKIL

SEQ ID NO: 129436 - protein, 9 aa, Borrelia burgdorferi B31
IKSSSVKKI

SEQ ID NO: 129437 - protein, 15 aa, Borrelia burgdorferi B31
ELDEAILNLIPEYEG

SEQ ID NO: 129438 - protein, 9 aa, Borrelia burgdorferi B31
ILNLIPEYE

SEQ ID NO: 129439 - protein, 15 aa, Borrelia burgdorferi B31
ILSKIKSSSVKKILS

SEQ ID NO: 129440 - protein, 9 aa, Borrelia burgdorferi B31
IKSSSVKKI

SEQ ID NO: 129441 - protein, 15 aa, Borrelia burgdorferi B31
IIFRLCYIIKKVKIK

SEQ ID NO: 129442 - protein, 9 aa, Borrelia burgdorferi B31
CYIIKKVKI

SEQ ID NO: 129443 - protein, 15 aa, Borrelia burgdorferi B31
LISLIRFKSSSVDGF

SEQ ID NO: 129444 - protein, 9 aa, Borrelia burgdorferi B31
LISLIRFKS

SEQ ID NO: 129445 - protein, 15 aa, Borrelia burgdorferi B31
YSNHINYPIYIKYSE

SEQ ID NO: 129446 - protein, 9 aa, Borrelia burgdorferi B31
YSNHINYPI

SEQ ID NO: 129447 - protein, 15 aa, Borrelia burgdorferi B31
PGKFINIINEFIEKD

SEQ ID NO: 129448 - protein, 9 aa, Borrelia burgdorferi B31
INIINEFIE

SEQ ID NO: 129449 - protein, 15 aa, Borrelia burgdorferi B31
ILIFYFKQIALFIIF

SEQ ID NO: 129450 - protein, 9 aa, Borrelia burgdorferi B31
FKQIALFII

SEQ ID NO: 129451 - protein, 15 aa, Borrelia burgdorferi B31
QNKILSKIKSSSVKK

SEQ ID NO: 129452 - protein, 9 aa, Borrelia burgdorferi B31
NKILSKIKS

SEQ ID NO: 129453 - protein, 15 aa, Borrelia burgdorferi B31
IFLRELISNASDAID

SEQ ID NO: 129454 - protein, 9 aa, Borrelia burgdorferi B31
LRELISNAS

SEQ ID NO: 129455 - protein, 15 aa, Borrelia burgdorferi B31
SEGSLLPNYLRFIKG

SEQ ID NO: 129456 - protein, 9 aa, Borrelia burgdorferi B31
LPNYLRFIK

SEQ ID NO: 129457 - protein, 15 aa, Borrelia burgdorferi B31
GMDEQDLTNHLGVIA

SEQ ID NO: 129458 - protein, 9 aa, Borrelia burgdorferi B31
DLTNHLGVI

SEQ ID NO: 129459 - protein, 15 aa, Borrelia burgdorferi B31
KNPGKFINIINEFIE

SEQ ID NO: 129460 - protein, 9 aa, Borrelia burgdorferi B31
KFINIINEF

SEQ ID NO: 129461 - protein, 15 aa, Borrelia burgdorferi B31
NPGKFINIINEFIEK

SEQ ID NO: 129462 - protein, 9 aa, Borrelia burgdorferi B31
INIINEFIE

SEQ ID NO: 129463 - protein, 15 aa, Borrelia burgdorferi B31
NEKFKNIALEPKIEI

SEQ ID NO: 129464 - protein, 9 aa, Borrelia burgdorferi B31
FKNIALEPK

SEQ ID NO: 129465 - protein, 15 aa, Borrelia burgdorferi B31
MILIFYFKQIALFII

SEQ ID NO: 129466 - protein, 9 aa, Borrelia burgdorferi B31
IFYFKQIAL

SEQ ID NO: 129467 - protein, 15 aa, Borrelia burgdorferi B31
DSEGSLLPNYLRFIK

SEQ ID NO: 129468 - protein, 9 aa, Borrelia burgdorferi B31
EGSLLPNYL

SEQ ID NO: 129469 - protein, 15 aa, Borrelia burgdorferi B31
EVNLSATLIKEPSAI

SEQ ID NO: 129470 - protein, 9 aa, Borrelia burgdorferi B31
VNLSATLIK

SEQ ID NO: 129471 - protein, 15 aa, Borrelia burgdorferi B31
EKFKNIALEPKIEIS

SEQ ID NO: 129472 - protein, 9 aa, Borrelia burgdorferi B31
FKNIALEPK

SEQ ID NO: 129473 - protein, 15 aa, Borrelia burgdorferi B31
KQIALFIIFRLCYII

SEQ ID NO: 129474 - protein, 9 aa, Borrelia burgdorferi B31
IALFIIFRL

SEQ ID NO: 129475 - protein, 15 aa, Borrelia burgdorferi B31
SGTKEFINNLKQDEK

SEQ ID NO: 129476 - protein, 9 aa, Borrelia burgdorferi B31
FINNLKQDE

SEQ ID NO: 129477 - protein, 15 aa, Borrelia burgdorferi B31
EGSLLPNYLRFIKGI

SEQ ID NO: 129478 - protein, 9 aa, Borrelia burgdorferi B31
LPNYLRFIK

SEQ ID NO: 129479 - protein, 15 aa, Borrelia burgdorferi B31
LYLIIHSLYSHKEIF

SEQ ID NO: 129480 - protein, 9 aa, Borrelia burgdorferi B31
LIIHSLYSH

SEQ ID NO: 129481 - protein, 15 aa, Borrelia burgdorferi B31
LIFYFKQIALFIIFR

SEQ ID NO: 129482 - protein, 9 aa, Borrelia burgdorferi B31
FKQIALFII

SEQ ID NO: 129483 - protein, 15 aa, Borrelia burgdorferi B31
KLISLIRFKSSSVDG

SEQ ID NO: 129484 - protein, 9 aa, Borrelia burgdorferi B31
LISLIRFKS

SEQ ID NO: 129485 - protein, 15 aa, Borrelia burgdorferi B31
VQNLKNLEPEKLEKI

SEQ ID NO: 129486 - protein, 9 aa, Borrelia burgdorferi B31
LKNLEPEKL

SEQ ID NO: 129487 - protein, 15 aa, Borrelia burgdorferi B31
EIFLRELISNASDAI

SEQ ID NO: 129488 - protein, 9 aa, Borrelia burgdorferi B31
LRELISNAS

SEQ ID NO: 129489 - protein, 15 aa, Borrelia burgdorferi B31
EEYNEFYKNTTFDYE

SEQ ID NO: 129490 - protein, 9 aa, Borrelia burgdorferi B31
YNEFYKNTT

SEQ ID NO: 129491 - protein, 15 aa, Borrelia burgdorferi B31
LSKIKSSSVKKILSE

SEQ ID NO: 129492 - protein, 9 aa, Borrelia burgdorferi B31
IKSSSVKKI

SEQ ID NO: 129493 - protein, 15 aa, Borrelia burgdorferi B31
SKIKSSSVKKILSEL

SEQ ID NO: 129494 - protein, 9 aa, Borrelia burgdorferi B31
IKSSSVKKI

SEQ ID NO: 129495 - protein, 15 aa, Borrelia burgdorferi B31
WKIQEIIKKYSNHIN

SEQ ID NO: 129496 - protein, 9 aa, Borrelia burgdorferi B31
IQEIIKKYS

SEQ ID NO: 129497 - protein, 15 aa, Borrelia burgdorferi B31
GKFINIINEFIEKDF

SEQ ID NO: 129498 - protein, 9 aa, Borrelia burgdorferi B31
INIINEFIE

SEQ ID NO: 129499 - protein, 15 aa, Borrelia burgdorferi B31
KYSNHINYPIYIKYS

SEQ ID NO: 129500 - protein, 9 aa, Borrelia burgdorferi B31
YSNHINYPI

SEQ ID NO: 129501 - protein, 15 aa, Borrelia burgdorferi B31
GTKEFINNLKQDEKK

SEQ ID NO: 129502 - protein, 9 aa, Borrelia burgdorferi B31
INNLKQDEK

SEQ ID NO: 129503 - protein, 15 aa, Borrelia burgdorferi B31
SILIKDNGIGMDEQD

SEQ ID NO: 129504 - protein, 9 aa, Borrelia burgdorferi B31
LIKDNGIGM

SEQ ID NO: 129505 - protein, 15 aa, Borrelia burgdorferi B31
DELDEAILNLIPEYE

SEQ ID NO: 129506 - protein, 9 aa, Borrelia burgdorferi B31
LDEAILNLI

SEQ ID NO: 129507 - protein, 15 aa, Borrelia burgdorferi B31
SDFENREKLISLIRF

SEQ ID NO: 129508 - protein, 9 aa, Borrelia burgdorferi B31
FENREKLIS

SEQ ID NO: 129509 - protein, 15 aa, Borrelia burgdorferi B31
TKEFINNLKQDEKKS

SEQ ID NO: 129510 - protein, 9 aa, Borrelia burgdorferi B31
INNLKQDEK

SEQ ID NO: 129511 - protein, 15 aa, Borrelia burgdorferi B31
KLISLIRFKSSSVDG

SEQ ID NO: 129512 - protein, 9 aa, Borrelia burgdorferi B31
LIRFKSSSV

SEQ ID NO: 129513 - protein, 15 aa, Borrelia burgdorferi B31
LISLIRFKSSSVDGF

SEQ ID NO: 129514 - protein, 9 aa, Borrelia burgdorferi B31
LIRFKSSSV

SEQ ID NO: 129515 - protein, 15 aa, Borrelia burgdorferi B31
ISLIRFKSSSVDGFV

SEQ ID NO: 129516 - protein, 9 aa, Borrelia burgdorferi B31
LIRFKSSSV

SEQ ID NO: 129517 - protein, 15 aa, Borrelia burgdorferi B31
REKLISLIRFKSSSV

SEQ ID NO: 129518 - protein, 9 aa, Borrelia burgdorferi B31
ISLIRFKSS

SEQ ID NO: 129519 - protein, 15 aa, Borrelia burgdorferi B31
SLIRFKSSSVDGFVS

SEQ ID NO: 129520 - protein, 9 aa, Borrelia burgdorferi B31
LIRFKSSSV

SEQ ID NO: 129521 - protein, 15 aa, Borrelia burgdorferi B31
NDLLYLIIHSLYSHK

SEQ ID NO: 129522 - protein, 9 aa, Borrelia burgdorferi B31
LIIHSLYSH

SEQ ID NO: 129523 - protein, 15 aa, Borrelia burgdorferi B31
LIRFKSSSVDGFVSF

SEQ ID NO: 129524 - protein, 9 aa, Borrelia burgdorferi B31
LIRFKSSSV

SEQ ID NO: 129525 - protein, 15 aa, Borrelia burgdorferi B31
DLLYLIIHSLYSHKE

SEQ ID NO: 129526 - protein, 9 aa, Borrelia burgdorferi B31
LIIHSLYSH

SEQ ID NO: 129527 - protein, 15 aa, Borrelia burgdorferi B31
LLYLIIHSLYSHKEI

SEQ ID NO: 129528 - protein, 9 aa, Borrelia burgdorferi B31
LIIHSLYSH

SEQ ID NO: 129529 - protein, 15 aa, Borrelia burgdorferi B31
LYLIIHSLYSHKEIF

SEQ ID NO: 129530 - protein, 9 aa, Borrelia burgdorferi B31
LIIHSLYSH

SEQ ID NO: 129531 - protein, 15 aa, Borrelia burgdorferi B31
VNDLLYLIIHSLYSH

SEQ ID NO: 129532 - protein, 9 aa, Borrelia burgdorferi B31
YLIIHSLYS

SEQ ID NO: 129533 - protein, 15 aa, Borrelia burgdorferi B31
YLIIHSLYSHKEIFL

SEQ ID NO: 129534 - protein, 9 aa, Borrelia burgdorferi B31
LIIHSLYSH

SEQ ID NO: 129535 - protein, 15 aa, Borrelia burgdorferi B31
SHKEIFLRELISNAS

SEQ ID NO: 129536 - protein, 9 aa, Borrelia burgdorferi B31
FLRELISNA

SEQ ID NO: 129537 - protein, 15 aa, Borrelia burgdorferi B31
KEIFLRELISNASDA

SEQ ID NO: 129538 - protein, 9 aa, Borrelia burgdorferi B31
LRELISNAS

SEQ ID NO: 129539 - protein, 15 aa, Borrelia burgdorferi B31
HKEIFLRELISNASD

SEQ ID NO: 129540 - protein, 9 aa, Borrelia burgdorferi B31
LRELISNAS

SEQ ID NO: 129541 - protein, 15 aa, Borrelia burgdorferi B31
EIFLRELISNASDAI

SEQ ID NO: 129542 - protein, 9 aa, Borrelia burgdorferi B31
LRELISNAS

SEQ ID NO: 129543 - protein, 15 aa, Borrelia burgdorferi B31
LIIHSLYSHKEIFLR

SEQ ID NO: 129544 - protein, 9 aa, Borrelia burgdorferi B31
LIIHSLYSH

SEQ ID NO: 129545 - protein, 15 aa, Borrelia burgdorferi B31
IALFIIFRLCYIIKK

SEQ ID NO: 129546 - protein, 9 aa, Borrelia burgdorferi B31
FIIFRLCYI

SEQ ID NO: 129547 - protein, 15 aa, Borrelia burgdorferi B31
ALFIIFRLCYIIKKV

SEQ ID NO: 129548 - protein, 9 aa, Borrelia burgdorferi B31
FIIFRLCYI

SEQ ID NO: 129549 - protein, 15 aa, Borrelia burgdorferi B31
IFLRELISNASDAID

SEQ ID NO: 129550 - protein, 9 aa, Borrelia burgdorferi B31
LRELISNAS

SEQ ID NO: 129551 - protein, 15 aa, Borrelia burgdorferi B31
QIALFIIFRLCYIIK

SEQ ID NO: 129552 - protein, 9 aa, Borrelia burgdorferi B31
FIIFRLCYI

SEQ ID NO: 129553 - protein, 15 aa, Borrelia burgdorferi B31
LFIIFRLCYIIKKVK

SEQ ID NO: 129554 - protein, 9 aa, Borrelia burgdorferi B31
IFRLCYIIK

SEQ ID NO: 129555 - protein, 15 aa, Borrelia burgdorferi B31
CYIIKKVKIKLKRKS

SEQ ID NO: 129556 - protein, 9 aa, Borrelia burgdorferi B31
IKKVKIKLK

SEQ ID NO: 129557 - protein, 15 aa, Borrelia burgdorferi B31
FIIFRLCYIIKKVKI

SEQ ID NO: 129558 - protein, 9 aa, Borrelia burgdorferi B31
IFRLCYIIK

SEQ ID NO: 129559 - protein, 15 aa, Borrelia burgdorferi B31
LCYIIKKVKIKLKRK

SEQ ID NO: 129560 - protein, 9 aa, Borrelia burgdorferi B31
IKKVKIKLK

SEQ ID NO: 129561 - protein, 15 aa, Borrelia burgdorferi B31
YIIKKVKIKLKRKSC

SEQ ID NO: 129562 - protein, 9 aa, Borrelia burgdorferi B31
IKKVKIKLK

SEQ ID NO: 129563 - protein, 15 aa, Borrelia burgdorferi B31
RLCYIIKKVKIKLKR

SEQ ID NO: 129564 - protein, 9 aa, Borrelia burgdorferi B31
IKKVKIKLK

SEQ ID NO: 129565 - protein, 15 aa, Borrelia burgdorferi B31
KKVKIKLKRKSCMKK

SEQ ID NO: 129566 - protein, 9 aa, Borrelia burgdorferi B31
IKLKRKSCM

SEQ ID NO: 129567 - protein, 15 aa, Borrelia burgdorferi B31
IKKVKIKLKRKSCMK

SEQ ID NO: 129568 - protein, 9 aa, Borrelia burgdorferi B31
VKIKLKRKS

SEQ ID NO: 129569 - protein, 15 aa, Borrelia burgdorferi B31
IIKKVKIKLKRKSCM

SEQ ID NO: 129570 - protein, 9 aa, Borrelia burgdorferi B31
KKVKIKLKR

SEQ ID NO: 129571 - protein, 15 aa, Borrelia burgdorferi B31
IIFRLCYIIKKVKIK

SEQ ID NO: 129572 - protein, 9 aa, Borrelia burgdorferi B31
FRLCYIIKK

SEQ ID NO: 129573 - protein, 15 aa, Borrelia burgdorferi B31
FRLCYIIKKVKIKLK

SEQ ID NO: 129574 - protein, 9 aa, Borrelia burgdorferi B31
YIIKKVKIK

SEQ ID NO: 129575 - protein, 15 aa, Borrelia burgdorferi B31
FKQIALFIIFRLCYI

SEQ ID NO: 129576 - protein, 9 aa, Borrelia burgdorferi B31
LFIIFRLCY

SEQ ID NO: 129577 - protein, 15 aa, Borrelia burgdorferi B31
KVKIKLKRKSCMKKQ

SEQ ID NO: 129578 - protein, 9 aa, Borrelia burgdorferi B31
IKLKRKSCM

SEQ ID NO: 129579 - protein, 15 aa, Borrelia burgdorferi B31
KQIALFIIFRLCYII

SEQ ID NO: 129580 - protein, 9 aa, Borrelia burgdorferi B31
FIIFRLCYI

SEQ ID NO: 129581 - protein, 15 aa, Borrelia burgdorferi B31
IFRLCYIIKKVKIKL

SEQ ID NO: 129582 - protein, 9 aa, Borrelia burgdorferi B31
YIIKKVKIK

SEQ ID NO: 129583 - protein, 15 aa, Borrelia burgdorferi B31
VKIKLKRKSCMKKQF

SEQ ID NO: 129584 - protein, 9 aa, Borrelia burgdorferi B31
IKLKRKSCM

SEQ ID NO: 129585 - protein, 15 aa, Borrelia burgdorferi B31
KEIKPILELNPNNKI

SEQ ID NO: 129586 - protein, 9 aa, Borrelia burgdorferi B31
ILELNPNNK

SEQ ID NO: 129587 - protein, 15 aa, Borrelia burgdorferi B31
EIKPILELNPNNKIV

SEQ ID NO: 129588 - protein, 9 aa, Borrelia burgdorferi B31
ILELNPNNK

SEQ ID NO: 129589 - protein, 15 aa, Borrelia burgdorferi B31
IKPILELNPNNKIVQ

SEQ ID NO: 129590 - protein, 9 aa, Borrelia burgdorferi B31
ILELNPNNK

SEQ ID NO: 129591 - protein, 15 aa, Borrelia burgdorferi B31
KPILELNPNNKIVQN

SEQ ID NO: 129592 - protein, 9 aa, Borrelia burgdorferi B31
ILELNPNNK

SEQ ID NO: 129593 - protein, 15 aa, Borrelia burgdorferi B31
PILELNPNNKIVQNL

SEQ ID NO: 129594 - protein, 9 aa, Borrelia burgdorferi B31
ILELNPNNK

SEQ ID NO: 129595 - protein, 15 aa, Borrelia burgdorferi B31
VKEIKPILELNPNNK

SEQ ID NO: 129596 - protein, 9 aa, Borrelia burgdorferi B31
VKEIKPILE

SEQ ID NO: 129597 - protein, 15 aa, Borrelia burgdorferi B31
ILELNPNNKIVQNLK

SEQ ID NO: 129598 - protein, 9 aa, Borrelia burgdorferi B31
ILELNPNNK

SEQ ID NO: 129599 - protein, 15 aa, Borrelia burgdorferi B31
KKVKIKLKRKSCMKK

SEQ ID NO: 129600 - protein, 9 aa, Borrelia burgdorferi B31
IKLKRKSCM

SEQ ID NO: 129601 - protein, 15 aa, Borrelia burgdorferi B31
DLLYLIIHSLYSHKE

SEQ ID NO: 129602 - protein, 9 aa, Borrelia burgdorferi B31
LIIHSLYSH

SEQ ID NO: 129603 - protein, 15 aa, Borrelia burgdorferi B31
NKIVQNLKNLEPEKL

SEQ ID NO: 129604 - protein, 9 aa, Borrelia burgdorferi B31
IVQNLKNLE

SEQ ID NO: 129605 - protein, 15 aa, Borrelia burgdorferi B31
VNDLLYLIIHSLYSH

SEQ ID NO: 129606 - protein, 9 aa, Borrelia burgdorferi B31
LYLIIHSLY

SEQ ID NO: 129607 - protein, 15 aa, Borrelia burgdorferi B31
NDLLYLIIHSLYSHK

SEQ ID NO: 129608 - protein, 9 aa, Borrelia burgdorferi B31
LIIHSLYSH

SEQ ID NO: 129609 - protein, 15 aa, Borrelia burgdorferi B31
KVKIKLKRKSCMKKQ

SEQ ID NO: 129610 - protein, 9 aa, Borrelia burgdorferi B31
IKLKRKSCM

SEQ ID NO: 129611 - protein, 15 aa, Borrelia burgdorferi B31
EYEGLKLKAINKNET

SEQ ID NO: 129612 - protein, 9 aa, Borrelia burgdorferi B31
LKLKAINKN

SEQ ID NO: 129613 - protein, 15 aa, Borrelia burgdorferi B31
YEGLKLKAINKNETS

SEQ ID NO: 129614 - protein, 9 aa, Borrelia burgdorferi B31
LKLKAINKN

SEQ ID NO: 129615 - protein, 15 aa, Borrelia burgdorferi B31
EGLKLKAINKNETSN

SEQ ID NO: 129616 - protein, 9 aa, Borrelia burgdorferi B31
LKLKAINKN

SEQ ID NO: 129617 - protein, 15 aa, Borrelia burgdorferi B31
LLYLIIHSLYSHKEI

SEQ ID NO: 129618 - protein, 9 aa, Borrelia burgdorferi B31
LIIHSLYSH

SEQ ID NO: 129619 - protein, 15 aa, Borrelia burgdorferi B31
VKIKLKRKSCMKKQF

SEQ ID NO: 129620 - protein, 9 aa, Borrelia burgdorferi B31
IKLKRKSCM

SEQ ID NO: 129621 - protein, 15 aa, Borrelia burgdorferi B31
LYLIIHSLYSHKEIF

SEQ ID NO: 129622 - protein, 9 aa, Borrelia burgdorferi B31
LIIHSLYSH

SEQ ID NO: 129623 - protein, 15 aa, Borrelia burgdorferi B31
LSELEKLSKKNPEKF

SEQ ID NO: 129624 - protein, 9 aa, Borrelia burgdorferi B31
LSELEKLSK

SEQ ID NO: 129625 - protein, 15 aa, Borrelia burgdorferi B31
IPEYEGLKLKAINKN

SEQ ID NO: 129626 - protein, 9 aa, Borrelia burgdorferi B31
YEGLKLKAI

SEQ ID NO: 129627 - protein, 15 aa, Borrelia burgdorferi B31
KIVQNLKNLEPEKLE

SEQ ID NO: 129628 - protein, 9 aa, Borrelia burgdorferi B31
LKNLEPEKL

SEQ ID NO: 129629 - protein, 15 aa, Borrelia burgdorferi B31
PEYEGLKLKAINKNE

SEQ ID NO: 129630 - protein, 9 aa, Borrelia burgdorferi B31
LKLKAINKN

SEQ ID NO: 129631 - protein, 15 aa, Borrelia burgdorferi B31
IVQNLKNLEPEKLEK

SEQ ID NO: 129632 - protein, 9 aa, Borrelia burgdorferi B31
LKNLEPEKL

SEQ ID NO: 129633 - protein, 15 aa, Borrelia burgdorferi B31
PTYQMQKIMLSMGQE

SEQ ID NO: 129634 - protein, 9 aa, Borrelia burgdorferi B31
YQMQKIMLS

SEQ ID NO: 129635 - protein, 15 aa, Borrelia burgdorferi B31
NDPTYQMQKIMLSMG

SEQ ID NO: 129636 - protein, 9 aa, Borrelia burgdorferi B31
YQMQKIMLS

SEQ ID NO: 129637 - protein, 15 aa, Borrelia burgdorferi B31
DPTYQMQKIMLSMGQ

SEQ ID NO: 129638 - protein, 9 aa, Borrelia burgdorferi B31
YQMQKIMLS

SEQ ID NO: 129639 - protein, 15 aa, Borrelia burgdorferi B31
VPSKAPYDLYYPNTK

SEQ ID NO: 129640 - protein, 9 aa, Borrelia burgdorferi B31
VPSKAPYDL

SEQ ID NO: 129641 - protein, 15 aa, Borrelia burgdorferi B31
SNDPTYQMQKIMLSM

SEQ ID NO: 129642 - protein, 9 aa, Borrelia burgdorferi B31
YQMQKIMLS

SEQ ID NO: 129643 - protein, 15 aa, Borrelia burgdorferi B31
SELEKLSKKNPEKFS

SEQ ID NO: 129644 - protein, 9 aa, Borrelia burgdorferi B31
LSKKNPEKF

SEQ ID NO: 129645 - protein, 15 aa, Borrelia burgdorferi B31
APYDLYYPNTKPGVK

SEQ ID NO: 129646 - protein, 9 aa, Borrelia burgdorferi B31
YDLYYPNTK

SEQ ID NO: 129647 - protein, 15 aa, Borrelia burgdorferi B31
PYDLYYPNTKPGVKL

SEQ ID NO: 129648 - protein, 9 aa, Borrelia burgdorferi B31
YPNTKPGVK

SEQ ID NO: 129649 - protein, 15 aa, Borrelia burgdorferi B31
YDLYYPNTKPGVKLF

SEQ ID NO: 129650 - protein, 9 aa, Borrelia burgdorferi B31
YPNTKPGVK

SEQ ID NO: 129651 - protein, 15 aa, Borrelia burgdorferi B31
DLYYPNTKPGVKLFI

SEQ ID NO: 129652 - protein, 9 aa, Borrelia burgdorferi B31
YPNTKPGVK

SEQ ID NO: 129653 - protein, 15 aa, Borrelia burgdorferi B31
LYYPNTKPGVKLFIN

SEQ ID NO: 129654 - protein, 9 aa, Borrelia burgdorferi B31
YPNTKPGVK

SEQ ID NO: 129655 - protein, 15 aa, Borrelia burgdorferi B31
LEYANKWKIQEIIKK

SEQ ID NO: 129656 - protein, 9 aa, Borrelia burgdorferi B31
YANKWKIQE

SEQ ID NO: 129657 - protein, 15 aa, Borrelia burgdorferi B31
YANKWKIQEIIKKYS

SEQ ID NO: 129658 - protein, 9 aa, Borrelia burgdorferi B31
WKIQEIIKK

SEQ ID NO: 129659 - protein, 15 aa, Borrelia burgdorferi B31
EYANKWKIQEIIKKY

SEQ ID NO: 129660 - protein, 9 aa, Borrelia burgdorferi B31
WKIQEIIKK

SEQ ID NO: 129661 - protein, 15 aa, Borrelia burgdorferi B31
ANKWKIQEIIKKYSN

SEQ ID NO: 129662 - protein, 9 aa, Borrelia burgdorferi B31
WKIQEIIKK

SEQ ID NO: 129663 - protein, 15 aa, Borrelia burgdorferi B31
NKWKIQEIIKKYSNH

SEQ ID NO: 129664 - protein, 9 aa, Borrelia burgdorferi B31
WKIQEIIKK

SEQ ID NO: 129665 - protein, 15 aa, Borrelia burgdorferi B31
YYPNTKPGVKLFINR

SEQ ID NO: 129666 - protein, 9 aa, Borrelia burgdorferi B31
YPNTKPGVK

SEQ ID NO: 129667 - protein, 15 aa, Borrelia burgdorferi B31
YPNTKPGVKLFINRI

SEQ ID NO: 129668 - protein, 9 aa, Borrelia burgdorferi B31
YPNTKPGVK

SEQ ID NO: 129669 - protein, 15 aa, Borrelia burgdorferi B31
KKIEEEFKDTLTKVK

SEQ ID NO: 129670 - protein, 9 aa, Borrelia burgdorferi B31
EEFKDTLTK

SEQ ID NO: 129671 - protein, 15 aa, Borrelia burgdorferi B31
KIEEEFKDTLTKVKE

SEQ ID NO: 129672 - protein, 9 aa, Borrelia burgdorferi B31
FKDTLTKVK

SEQ ID NO: 129673 - protein, 15 aa, Borrelia burgdorferi B31
IEEEFKDTLTKVKEI

SEQ ID NO: 129674 - protein, 9 aa, Borrelia burgdorferi B31
FKDTLTKVK

SEQ ID NO: 129675 - protein, 15 aa, Borrelia burgdorferi B31
EEEFKDTLTKVKEIL

SEQ ID NO: 129676 - protein, 9 aa, Borrelia burgdorferi B31
FKDTLTKVK

SEQ ID NO: 129677 - protein, 15 aa, Borrelia burgdorferi B31
EEFKDTLTKVKEILK

SEQ ID NO: 129678 - protein, 9 aa, Borrelia burgdorferi B31
FKDTLTKVK

SEQ ID NO: 129679 - protein, 15 aa, Borrelia burgdorferi
KKYLLGIGLILALIA

SEQ ID NO: 129680 - protein, 9 aa, Borrelia burgdorferi
LLGIGLILA

SEQ ID NO: 129681 - protein, 15 aa, Borrelia burgdorferi
KYLLGIGLILALIAC

SEQ ID NO: 129682 - protein, 9 aa, Borrelia burgdorferi
LLGIGLILA

SEQ ID NO: 129683 - protein, 15 aa, Borrelia burgdorferi
MKKYLLGIGLILALI

SEQ ID NO: 129684 - protein, 9 aa, Borrelia burgdorferi
LLGIGLILA

SEQ ID NO: 129685 - protein, 15 aa, Borrelia burgdorferi
KTGKWDSKTSTLTIS

SEQ ID NO: 129686 - protein, 9 aa, Borrelia burgdorferi
WDSKTSTLT

SEQ ID NO: 129687 - protein, 15 aa, Borrelia burgdorferi
TGKWDSKTSTLTISV

SEQ ID NO: 129688 - protein, 9 aa, Borrelia burgdorferi
WDSKTSTLT

SEQ ID NO: 129689 - protein, 15 aa, Borrelia burgdorferi
TKKTGKWDSKTSTLT

SEQ ID NO: 129690 - protein, 9 aa, Borrelia burgdorferi
TGKWDSKTS

SEQ ID NO: 129691 - protein, 15 aa, Borrelia burgdorferi
KKTGKWDSKTSTLTI

SEQ ID NO: 129692 - protein, 9 aa, Borrelia burgdorferi
WDSKTSTLT

SEQ ID NO: 129693 - protein, 15 aa, Borrelia burgdorferi
GKWDSKTSTLTISVN

SEQ ID NO: 129694 - protein, 9 aa, Borrelia burgdorferi
WDSKTSTLT

SEQ ID NO: 129695 - protein, 15 aa, Borrelia burgdorferi
LKDFTLEGTLAADGK

SEQ ID NO: 129696 - protein, 9 aa, Borrelia burgdorferi
FTLEGTLAA

SEQ ID NO: 129697 - protein, 15 aa, Borrelia burgdorferi
VLKDFTLEGTLAADG

SEQ ID NO: 129698 - protein, 9 aa, Borrelia burgdorferi
FTLEGTLAA

SEQ ID NO: 129699 - protein, 15 aa, Borrelia burgdorferi
KDFTLEGTLAADGKT

SEQ ID NO: 129700 - protein, 9 aa, Borrelia burgdorferi
FTLEGTLAA

SEQ ID NO: 129701 - protein, 15 aa, Borrelia burgdorferi
SVSVDLPGGMTELVS

SEQ ID NO: 129702 - protein, 9 aa, Borrelia burgdorferi
LPGGMTELV

SEQ ID NO: 129703 - protein, 15 aa, Borrelia burgdorferi
YLLGIGLILALIACK

SEQ ID NO: 129704 - protein, 9 aa, Borrelia burgdorferi
IGLILALIA

SEQ ID NO: 129705 - protein, 15 aa, Borrelia burgdorferi
NSVSVDLPGGMTELV

SEQ ID NO: 129706 - protein, 9 aa, Borrelia burgdorferi
SVDLPGGMT

SEQ ID NO: 129707 - protein, 15 aa, Borrelia burgdorferi
SVDLPGGMTELVSKE

SEQ ID NO: 129708 - protein, 9 aa, Borrelia burgdorferi
LPGGMTELV

SEQ ID NO: 129709 - protein, 15 aa, Borrelia burgdorferi
VSVDLPGGMTELVSK

SEQ ID NO: 129710 - protein, 9 aa, Borrelia burgdorferi
LPGGMTELV

SEQ ID NO: 129711 - protein, 15 aa, Borrelia burgdorferi
VDLPGGMTELVSKEK

SEQ ID NO: 129712 - protein, 9 aa, Borrelia burgdorferi
LPGGMTELV

SEQ ID NO: 129713 - protein, 15 aa, Borrelia burgdorferi
LLGIGLILALIACKQ

SEQ ID NO: 129714 - protein, 9 aa, Borrelia burgdorferi
IGLILALIA

SEQ ID NO: 129715 - protein, 15 aa, Borrelia burgdorferi
KEVLKDFTLEGTLAA

SEQ ID NO: 129716 - protein, 9 aa, Borrelia burgdorferi
LKDFTLEGT

SEQ ID NO: 129717 - protein, 15 aa, Borrelia burgdorferi
EVLKDFTLEGTLAAD

SEQ ID NO: 129718 - protein, 9 aa, Borrelia burgdorferi
FTLEGTLAA

SEQ ID NO: 129719 - protein, 15 aa, Borrelia burgdorferi
TSEKTIVRANGTRLE

SEQ ID NO: 129720 - protein, 9 aa, Borrelia burgdorferi
IVRANGTRL

SEQ ID NO: 129721 - protein, 15 aa, Borrelia burgdorferi
SEKTIVRANGTRLEY

SEQ ID NO: 129722 - protein, 9 aa, Borrelia burgdorferi
IVRANGTRL

SEQ ID NO: 129723 - protein, 15 aa, Borrelia burgdorferi
TTLKVTEGTVVLSKN

SEQ ID NO: 129724 - protein, 9 aa, Borrelia burgdorferi
VTEGTVVLS

SEQ ID NO: 129725 - protein, 15 aa, Borrelia burgdorferi
KTTLKVTEGTVVLSK

SEQ ID NO: 129726 - protein, 9 aa, Borrelia burgdorferi
VTEGTVVLS

SEQ ID NO: 129727 - protein, 15 aa, Borrelia burgdorferi
EKTIVRANGTRLEYT

SEQ ID NO: 129728 - protein, 9 aa, Borrelia burgdorferi
IVRANGTRL

SEQ ID NO: 129729 - protein, 15 aa, Borrelia burgdorferi
GKTTLKVTEGTVVLS

SEQ ID NO: 129730 - protein, 9 aa, Borrelia burgdorferi
LKVTEGTVV

SEQ ID NO: 129731 - protein, 15 aa, Borrelia burgdorferi
KTIVRANGTRLEYTD

SEQ ID NO: 129732 - protein, 9 aa, Borrelia burgdorferi
IVRANGTRL

SEQ ID NO: 129733 - protein, 15 aa, Borrelia burgdorferi
KNILKSGEITVALDD

SEQ ID NO: 129734 - protein, 9 aa, Borrelia burgdorferi
LKSGEITVA

SEQ ID NO: 129735 - protein, 15 aa, Borrelia burgdorferi
LSKNILKSGEITVAL

SEQ ID NO: 129736 - protein, 9 aa, Borrelia burgdorferi
LKSGEITVA

SEQ ID NO: 129737 - protein, 15 aa, Borrelia burgdorferi
SKNILKSGEITVALD

SEQ ID NO: 129738 - protein, 9 aa, Borrelia burgdorferi
LKSGEITVA

SEQ ID NO: 129739 - protein, 15 aa, Borrelia burgdorferi
NILKSGEITVALDDS

SEQ ID NO: 129740 - protein, 9 aa, Borrelia burgdorferi
LKSGEITVA

SEQ ID NO: 129741 - protein, 15 aa, Borrelia burgdorferi
DFTLEGTLAADGKTT

SEQ ID NO: 129742 - protein, 9 aa, Borrelia burgdorferi
FTLEGTLAA

SEQ ID NO: 129743 - protein, 15 aa, Borrelia burgdorferi
FTLEGTLAADGKTTL

SEQ ID NO: 129744 - protein, 9 aa, Borrelia burgdorferi
FTLEGTLAA

SEQ ID NO: 129745 - protein, 15 aa, Borrelia burgdorferi
TLKVTEGTVVLSKNI

SEQ ID NO: 129746 - protein, 9 aa, Borrelia burgdorferi
VTEGTVVLS

SEQ ID NO: 129747 - protein, 15 aa, Borrelia burgdorferi
LGIGLILALIACKQN

SEQ ID NO: 129748 - protein, 9 aa, Borrelia burgdorferi
IGLILALIA

SEQ ID NO: 129749 - protein, 15 aa, Borrelia burgdorferi
VLSKNILKSGEITVA

SEQ ID NO: 129750 - protein, 9 aa, Borrelia burgdorferi
KNILKSGEI

SEQ ID NO: 129751 - protein, 15 aa, Borrelia burgdorferi
KEDAKTLVSKKVTLK

SEQ ID NO: 129752 - protein, 9 aa, Borrelia burgdorferi
AKTLVSKKV

SEQ ID NO: 129753 - protein, 15 aa, Borrelia burgdorferi
EDAKTLVSKKVTLKD

SEQ ID NO: 129754 - protein, 9 aa, Borrelia burgdorferi
AKTLVSKKV

SEQ ID NO: 129755 - protein, 15 aa, Borrelia burgdorferi
LKVTEGTVVLSKNIL

SEQ ID NO: 129756 - protein, 9 aa, Borrelia burgdorferi
VTEGTVVLS

SEQ ID NO: 129757 - protein, 15 aa, Borrelia burgdorferi
TIVRANGTRLEYTDI

SEQ ID NO: 129758 - protein, 9 aa, Borrelia burgdorferi
VRANGTRLE

SEQ ID NO: 129759 - protein, 15 aa, Borrelia burgdorferi
EIFKEDAKTLVSKKV

SEQ ID NO: 129760 - protein, 9 aa, Borrelia burgdorferi
FKEDAKTLV

SEQ ID NO: 129761 - protein, 15 aa, Borrelia burgdorferi
SAGTNLEGKAVEITT

SEQ ID NO: 129762 - protein, 9 aa, Borrelia burgdorferi
LEGKAVEIT

SEQ ID NO: 129763 - protein, 15 aa, Borrelia burgdorferi
DSAGTNLEGKAVEIT

SEQ ID NO: 129764 - protein, 9 aa, Borrelia burgdorferi
GTNLEGKAV

SEQ ID NO: 129765 - protein, 15 aa, Borrelia burgdorferi
KWDSKTSTLTISVNS

SEQ ID NO: 129766 - protein, 9 aa, Borrelia burgdorferi
WDSKTSTLT

SEQ ID NO: 129767 - protein, 15 aa, Borrelia burgdorferi
WDSKTSTLTISVNSQ

SEQ ID NO: 129768 - protein, 9 aa, Borrelia burgdorferi
WDSKTSTLT

SEQ ID NO: 129769 - protein, 15 aa, Borrelia burgdorferi
IFKEDAKTLVSKKVT

SEQ ID NO: 129770 - protein, 9 aa, Borrelia burgdorferi
AKTLVSKKV

SEQ ID NO: 129771 - protein, 15 aa, Borrelia burgdorferi
GTNLEGKAVEITTLK

SEQ ID NO: 129772 - protein, 9 aa, Borrelia burgdorferi
LEGKAVEIT

SEQ ID NO: 129773 - protein, 15 aa, Borrelia burgdorferi
AGTNLEGKAVEITTL

SEQ ID NO: 129774 - protein, 9 aa, Borrelia burgdorferi
LEGKAVEIT

SEQ ID NO: 129775 - protein, 15 aa, Borrelia burgdorferi
DLPGGMTELVSKEKD

SEQ ID NO: 129776 - protein, 9 aa, Borrelia burgdorferi
LPGGMTELV

SEQ ID NO: 129777 - protein, 15 aa, Borrelia burgdorferi
FKEDAKTLVSKKVTL

SEQ ID NO: 129778 - protein, 9 aa, Borrelia burgdorferi
AKTLVSKKV

SEQ ID NO: 129779 - protein, 15 aa, Borrelia burgdorferi
DGKTTLKVTEGTVVL

SEQ ID NO: 129780 - protein, 9 aa, Borrelia burgdorferi
LKVTEGTVV

SEQ ID NO: 129781 - protein, 15 aa, Borrelia burgdorferi
LPGGMTELVSKEKDK

SEQ ID NO: 129782 - protein, 9 aa, Borrelia burgdorferi
LPGGMTELV

SEQ ID NO: 129783 - protein, 15 aa, Borrelia burgdorferi
ITVQKYDSAGTNLEG

SEQ ID NO: 129784 - protein, 9 aa, Borrelia burgdorferi
VQKYDSAGT

SEQ ID NO: 129785 - protein, 15 aa, Borrelia burgdorferi
TITVQKYDSAGTNLE

SEQ ID NO: 129786 - protein, 9 aa, Borrelia burgdorferi
VQKYDSAGT

SEQ ID NO: 129787 - protein, 15 aa, Borrelia burgdorferi
TNLEGKAVEITTLKE

SEQ ID NO: 129788 - protein, 9 aa, Borrelia burgdorferi
LEGKAVEIT

SEQ ID NO: 129789 - protein, 15 aa, Borrelia burgdorferi
NLVFTKEDTITVQKY

SEQ ID NO: 129790 - protein, 9 aa, Borrelia burgdorferi
FTKEDTITV

SEQ ID NO: 129791 - protein, 15 aa, Borrelia burgdorferi
AKTLVSKKVTLKDKS

SEQ ID NO: 129792 - protein, 9 aa, Borrelia burgdorferi
AKTLVSKKV

SEQ ID NO: 129793 - protein, 15 aa, Borrelia burgdorferi
DAKTLVSKKVTLKDK

SEQ ID NO: 129794 - protein, 9 aa, Borrelia burgdorferi
AKTLVSKKV

SEQ ID NO: 129795 - protein, 15 aa, Borrelia burgdorferi
KNLVFTKEDTITVQK

SEQ ID NO: 129796 - protein, 9 aa, Borrelia burgdorferi
FTKEDTITV

SEQ ID NO: 129797 - protein, 15 aa, Borrelia burgdorferi
GIGLILALIACKQNV

SEQ ID NO: 129798 - protein, 9 aa, Borrelia burgdorferi
ILALIACKQ

SEQ ID NO: 129799 - protein, 15 aa, Borrelia burgdorferi
ETSEKTIVRANGTRL

SEQ ID NO: 129800 - protein, 9 aa, Borrelia burgdorferi
KTIVRANGT

SEQ ID NO: 129801 - protein, 15 aa, Borrelia burgdorferi
TKNLVFTKEDTITVQ

SEQ ID NO: 129802 - protein, 9 aa, Borrelia burgdorferi
FTKEDTITV

SEQ ID NO: 129803 - protein, 15 aa, Borrelia burgdorferi
IGLILALIACKQNVS

SEQ ID NO: 129804 - protein, 9 aa, Borrelia burgdorferi
ILALIACKQ

SEQ ID NO: 129805 - protein, 15 aa, Borrelia burgdorferi
KTKNLVFTKEDTITV

SEQ ID NO: 129806 - protein, 9 aa, Borrelia burgdorferi
VFTKEDTIT

SEQ ID NO: 129807 - protein, 15 aa, Borrelia burgdorferi
IVRANGTRLEYTDIK

SEQ ID NO: 129808 - protein, 9 aa, Borrelia burgdorferi
IVRANGTRL

SEQ ID NO: 129809 - protein, 15 aa, Borrelia burgdorferi
ADGKTTLKVTEGTVV

SEQ ID NO: 129810 - protein, 9 aa, Borrelia burgdorferi
ADGKTTLKV

SEQ ID NO: 129811 - protein, 15 aa, Borrelia burgdorferi
LVFTKEDTITVQKYD

SEQ ID NO: 129812 - protein, 9 aa, Borrelia burgdorferi
FTKEDTITV

SEQ ID NO: 129813 - protein, 15 aa, Borrelia burgdorferi
LKSGEITVALDDSDT

SEQ ID NO: 129814 - protein, 9 aa, Borrelia burgdorferi
LKSGEITVA

SEQ ID NO: 129815 - protein, 15 aa, Borrelia burgdorferi
ILKSGEITVALDDSD

SEQ ID NO: 129816 - protein, 9 aa, Borrelia burgdorferi
LKSGEITVA

SEQ ID NO: 129817 - protein, 15 aa, Borrelia burgdorferi
DTITVQKYDSAGTNL

SEQ ID NO: 129818 - protein, 9 aa, Borrelia burgdorferi
VQKYDSAGT

SEQ ID NO: 129819 - protein, 15 aa, Borrelia burgdorferi
EDTITVQKYDSAGTN

SEQ ID NO: 129820 - protein, 9 aa, Borrelia burgdorferi
VQKYDSAGT

SEQ ID NO: 129821 - protein, 15 aa, Borrelia burgdorferi
KEDTITVQKYDSAGT

SEQ ID NO: 129822 - protein, 9 aa, Borrelia burgdorferi
ITVQKYDSA

SEQ ID NO: 129823 - protein, 15 aa, Borrelia burgdorferi
GLILALIACKQNVST

SEQ ID NO: 129824 - protein, 9 aa, Borrelia burgdorferi
ILALIACKQ

SEQ ID NO: 129825 - protein, 15 aa, Borrelia burgdorferi
LEGTLAADGKTTLKV

SEQ ID NO: 129826 - protein, 9 aa, Borrelia burgdorferi
LEGTLAADG

SEQ ID NO: 129827 - protein, 15 aa, Borrelia burgdorferi
TISVNSQKTKNLVFT

SEQ ID NO: 129828 - protein, 9 aa, Borrelia burgdorferi
VNSQKTKNL

SEQ ID NO: 129829 - protein, 15 aa, Borrelia burgdorferi
LEYTDIKSDGSGKAK

SEQ ID NO: 129830 - protein, 9 aa, Borrelia burgdorferi
IKSDGSGKA

SEQ ID NO: 129831 - protein, 15 aa, Borrelia burgdorferi
RLEYTDIKSDGSGKA

SEQ ID NO: 129832 - protein, 9 aa, Borrelia burgdorferi
YTDIKSDGS

SEQ ID NO: 129833 - protein, 15 aa, Borrelia burgdorferi
TLTISVNSQKTKNLV

SEQ ID NO: 129834 - protein, 9 aa, Borrelia burgdorferi
VNSQKTKNL

SEQ ID NO: 129835 - protein, 15 aa, Borrelia burgdorferi
STLTISVNSQKTKNL

SEQ ID NO: 129836 - protein, 9 aa, Borrelia burgdorferi
TISVNSQKT

SEQ ID NO: 129837 - protein, 15 aa, Borrelia burgdorferi
ISVNSQKTKNLVFTK

SEQ ID NO: 129838 - protein, 9 aa, Borrelia burgdorferi
VNSQKTKNL

SEQ ID NO: 129839 - protein, 15 aa, Borrelia burgdorferi
TVQKYDSAGTNLEGK

SEQ ID NO: 129840 - protein, 9 aa, Borrelia burgdorferi
VQKYDSAGT

SEQ ID NO: 129841 - protein, 15 aa, Borrelia burgdorferi
VQKYDSAGTNLEGKA

SEQ ID NO: 129842 - protein, 9 aa, Borrelia burgdorferi
VQKYDSAGT

SEQ ID NO: 129843 - protein, 15 aa, Borrelia burgdorferi
VTEGTVVLSKNILKS

SEQ ID NO: 129844 - protein, 9 aa, Borrelia burgdorferi
VTEGTVVLS

SEQ ID NO: 129845 - protein, 15 aa, Borrelia burgdorferi
VALDDSDTTQATKKT

SEQ ID NO: 129846 - protein, 9 aa, Borrelia burgdorferi
LDDSDTTQA

SEQ ID NO: 129847 - protein, 15 aa, Borrelia burgdorferi
YTDIKSDGSGKAKEV

SEQ ID NO: 129848 - protein, 9 aa, Borrelia burgdorferi
IKSDGSGKA

SEQ ID NO: 129849 - protein, 15 aa, Borrelia burgdorferi
QKYDSAGTNLEGKAV

SEQ ID NO: 129850 - protein, 9 aa, Borrelia burgdorferi
YDSAGTNLE

SEQ ID NO: 129851 - protein, 15 aa, Borrelia burgdorferi
TLEGTLAADGKTTLK

SEQ ID NO: 129852 - protein, 9 aa, Borrelia burgdorferi
LEGTLAADG

SEQ ID NO: 129853 - protein, 15 aa, Borrelia burgdorferi
LTISVNSQKTKNLVF

SEQ ID NO: 129854 - protein, 9 aa, Borrelia burgdorferi
VNSQKTKNL

SEQ ID NO: 129855 - protein, 15 aa, Borrelia burgdorferi
KVTEGTVVLSKNILK

SEQ ID NO: 129856 - protein, 9 aa, Borrelia burgdorferi
VTEGTVVLS

SEQ ID NO: 129857 - protein, 15 aa, Borrelia burgdorferi
EYTDIKSDGSGKAKE

SEQ ID NO: 129858 - protein, 9 aa, Borrelia burgdorferi
IKSDGSGKA

SEQ ID NO: 129859 - protein, 15 aa, Borrelia burgdorferi
LILALIACKQNVSTL

SEQ ID NO: 129860 - protein, 9 aa, Borrelia burgdorferi
IACKQNVST

SEQ ID NO: 129861 - protein, 15 aa, Borrelia burgdorferi
FEIFKEDAKTLVSKK

SEQ ID NO: 129862 - protein, 9 aa, Borrelia burgdorferi
IFKEDAKTL

SEQ ID NO: 129863 - protein, 15 aa, Borrelia burgdorferi
KFEIFKEDAKTLVSK

SEQ ID NO: 129864 - protein, 9 aa, Borrelia burgdorferi
IFKEDAKTL

SEQ ID NO: 129865 - protein, 15 aa, Borrelia burgdorferi
VRANGTRLEYTDIKS

SEQ ID NO: 129866 - protein, 9 aa, Borrelia burgdorferi
VRANGTRLE

SEQ ID NO: 129867 - protein, 15 aa, Borrelia burgdorferi
NLEGKAVEITTLKEL

SEQ ID NO: 129868 - protein, 9 aa, Borrelia burgdorferi
LEGKAVEIT

SEQ ID NO: 129869 - protein, 15 aa, Borrelia burgdorferi
KEVLKDFTLEGTLAA

SEQ ID NO: 129870 - protein, 9 aa, Borrelia burgdorferi
VLKDFTLEG

SEQ ID NO: 129871 - protein, 15 aa, Borrelia burgdorferi
EVLKDFTLEGTLAAD

SEQ ID NO: 129872 - protein, 9 aa, Borrelia burgdorferi
FTLEGTLAA

SEQ ID NO: 129873 - protein, 15 aa, Borrelia burgdorferi
VLKDFTLEGTLAADG

SEQ ID NO: 129874 - protein, 9 aa, Borrelia burgdorferi
FTLEGTLAA

SEQ ID NO: 129875 - protein, 15 aa, Borrelia burgdorferi
LKDFTLEGTLAADGK

SEQ ID NO: 129876 - protein, 9 aa, Borrelia burgdorferi
FTLEGTLAA

SEQ ID NO: 129877 - protein, 15 aa, Borrelia burgdorferi
KDFTLEGTLAADGKT

SEQ ID NO: 129878 - protein, 9 aa, Borrelia burgdorferi
FTLEGTLAA

SEQ ID NO: 129879 - protein, 15 aa, Borrelia burgdorferi
KNLVFTKEDTITVQK

SEQ ID NO: 129880 - protein, 9 aa, Borrelia burgdorferi
FTKEDTITV

SEQ ID NO: 129881 - protein, 15 aa, Borrelia burgdorferi
NLVFTKEDTITVQKY

SEQ ID NO: 129882 - protein, 9 aa, Borrelia burgdorferi
FTKEDTITV

SEQ ID NO: 129883 - protein, 15 aa, Borrelia burgdorferi
LVFTKEDTITVQKYD

SEQ ID NO: 129884 - protein, 9 aa, Borrelia burgdorferi
FTKEDTITV

SEQ ID NO: 129885 - protein, 15 aa, Borrelia burgdorferi
DFTLEGTLAADGKTT

SEQ ID NO: 129886 - protein, 9 aa, Borrelia burgdorferi
FTLEGTLAA

SEQ ID NO: 129887 - protein, 15 aa, Borrelia burgdorferi
LEYTDIKSDGSGKAK

SEQ ID NO: 129888 - protein, 9 aa, Borrelia burgdorferi
IKSDGSGKA

SEQ ID NO: 129889 - protein, 15 aa, Borrelia burgdorferi
TKNLVFTKEDTITVQ

SEQ ID NO: 129890 - protein, 9 aa, Borrelia burgdorferi
FTKEDTITV

SEQ ID NO: 129891 - protein, 15 aa, Borrelia burgdorferi
FTLEGTLAADGKTTL

SEQ ID NO: 129892 - protein, 9 aa, Borrelia burgdorferi
FTLEGTLAA

SEQ ID NO: 129893 - protein, 15 aa, Borrelia burgdorferi
RLEYTDIKSDGSGKA

SEQ ID NO: 129894 - protein, 9 aa, Borrelia burgdorferi
YTDIKSDGS

SEQ ID NO: 129895 - protein, 15 aa, Borrelia burgdorferi
KTKNLVFTKEDTITV

SEQ ID NO: 129896 - protein, 9 aa, Borrelia burgdorferi
KTKNLVFTK

SEQ ID NO: 129897 - protein, 15 aa, Borrelia burgdorferi
AKEVLKDFTLEGTLA

SEQ ID NO: 129898 - protein, 9 aa, Borrelia burgdorferi
VLKDFTLEG

SEQ ID NO: 129899 - protein, 15 aa, Borrelia burgdorferi
KEVLKDFTLEGTLAA

SEQ ID NO: 129900 - protein, 9 aa, Borrelia burgdorferi
VLKDFTLEG

SEQ ID NO: 129901 - protein, 15 aa, Borrelia burgdorferi
GKAKEVLKDFTLEGT

SEQ ID NO: 129902 - protein, 9 aa, Borrelia burgdorferi
VLKDFTLEG

SEQ ID NO: 129903 - protein, 15 aa, Borrelia burgdorferi
AKEVLKDFTLEGTLA

SEQ ID NO: 129904 - protein, 9 aa, Borrelia burgdorferi
VLKDFTLEG

SEQ ID NO: 129905 - protein, 15 aa, Borrelia burgdorferi
KAKEVLKDFTLEGTL

SEQ ID NO: 129906 - protein, 9 aa, Borrelia burgdorferi
VLKDFTLEG

SEQ ID NO: 129907 - protein, 15 aa, Borrelia burgdorferi
SGKAKEVLKDFTLEG

SEQ ID NO: 129908 - protein, 9 aa, Borrelia burgdorferi
AKEVLKDFT

SEQ ID NO: 129909 - protein, 15 aa, Borrelia burgdorferi
TITVQKYDSAGTNLE

SEQ ID NO: 129910 - protein, 9 aa, Borrelia burgdorferi
VQKYDSAGT

SEQ ID NO: 129911 - protein, 15 aa, Borrelia burgdorferi
ITVQKYDSAGTNLEG

SEQ ID NO: 129912 - protein, 9 aa, Borrelia burgdorferi
YDSAGTNLE

SEQ ID NO: 129913 - protein, 15 aa, Borrelia burgdorferi
TVQKYDSAGTNLEGK

SEQ ID NO: 129914 - protein, 9 aa, Borrelia burgdorferi
YDSAGTNLE

SEQ ID NO: 129915 - protein, 15 aa, Borrelia burgdorferi
VQKYDSAGTNLEGKA

SEQ ID NO: 129916 - protein, 9 aa, Borrelia burgdorferi
YDSAGTNLE

SEQ ID NO: 129917 - protein, 15 aa, Borrelia burgdorferi
QKYDSAGTNLEGKAV

SEQ ID NO: 129918 - protein, 9 aa, Borrelia burgdorferi
YDSAGTNLE

SEQ ID NO: 129919 - protein, 15 aa, Borrelia burgdorferi
DGKTTLKVTEGTVVL

SEQ ID NO: 129920 - protein, 9 aa, Borrelia burgdorferi
LKVTEGTVV

SEQ ID NO: 129921 - protein, 15 aa, Borrelia burgdorferi
GKTTLKVTEGTVVLS

SEQ ID NO: 129922 - protein, 9 aa, Borrelia burgdorferi
LKVTEGTVV

SEQ ID NO: 129923 - protein, 15 aa, Borrelia burgdorferi
KTTLKVTEGTVVLSK

SEQ ID NO: 129924 - protein, 9 aa, Borrelia burgdorferi
LKVTEGTVV

SEQ ID NO: 129925 - protein, 15 aa, Borrelia burgdorferi
ADGKTTLKVTEGTVV

SEQ ID NO: 129926 - protein, 9 aa, Borrelia burgdorferi
TLKVTEGTV

SEQ ID NO: 129927 - protein, 15 aa, Borrelia burgdorferi
TTLKVTEGTVVLSKN

SEQ ID NO: 129928 - protein, 9 aa, Borrelia burgdorferi
LKVTEGTVV

SEQ ID NO: 129929 - protein, 15 aa, Borrelia burgdorferi
TEGTVVLSKNILKSG

SEQ ID NO: 129930 - protein, 9 aa, Borrelia burgdorferi
TVVLSKNIL

SEQ ID NO: 129931 - protein, 15 aa, Borrelia burgdorferi
EGTVVLSKNILKSGE

SEQ ID NO: 129932 - protein, 9 aa, Borrelia burgdorferi
TVVLSKNIL

SEQ ID NO: 129933 - protein, 15 aa, Borrelia burgdorferi
GTVVLSKNILKSGEI

SEQ ID NO: 129934 - protein, 9 aa, Borrelia burgdorferi
VVLSKNILK

SEQ ID NO: 129935 - protein, 15 aa, Borrelia burgdorferi
VTEGTVVLSKNILKS

SEQ ID NO: 129936 - protein, 9 aa, Borrelia burgdorferi
TVVLSKNIL

SEQ ID NO: 129937 - protein, 15 aa, Borrelia burgdorferi
TVVLSKNILKSGEIT

SEQ ID NO: 129938 - protein, 9 aa, Borrelia burgdorferi
TVVLSKNIL

SEQ ID NO: 129939 - protein, 15 aa, Borrelia burgdorferi
SEKTIVRANGTRLEY

SEQ ID NO: 129940 - protein, 9 aa, Borrelia burgdorferi
IVRANGTRL

SEQ ID NO: 129941 - protein, 15 aa, Borrelia burgdorferi
TSEKTIVRANGTRLE

SEQ ID NO: 129942 - protein, 9 aa, Borrelia burgdorferi
IVRANGTRL

SEQ ID NO: 129943 - protein, 15 aa, Borrelia burgdorferi
EKTIVRANGTRLEYT

SEQ ID NO: 129944 - protein, 9 aa, Borrelia burgdorferi
IVRANGTRL

SEQ ID NO: 129945 - protein, 15 aa, Borrelia burgdorferi
KTIVRANGTRLEYTD

SEQ ID NO: 129946 - protein, 9 aa, Borrelia burgdorferi
IVRANGTRL

SEQ ID NO: 129947 - protein, 15 aa, Borrelia burgdorferi
TLTISVNSQKTKNLV

SEQ ID NO: 129948 - protein, 9 aa, Borrelia burgdorferi
VNSQKTKNL

SEQ ID NO: 129949 - protein, 15 aa, Borrelia burgdorferi
STLTISVNSQKTKNL

SEQ ID NO: 129950 - protein, 9 aa, Borrelia burgdorferi
ISVNSQKTK

SEQ ID NO: 129951 - protein, 15 aa, Borrelia burgdorferi
LTISVNSQKTKNLVF

SEQ ID NO: 129952 - protein, 9 aa, Borrelia burgdorferi
VNSQKTKNL

SEQ ID NO: 129953 - protein, 15 aa, Borrelia burgdorferi
KVTEGTVVLSKNILK

SEQ ID NO: 129954 - protein, 9 aa, Borrelia burgdorferi
TVVLSKNIL

SEQ ID NO: 129955 - protein, 15 aa, Borrelia burgdorferi
TISVNSQKTKNLVFT

SEQ ID NO: 129956 - protein, 9 aa, Borrelia burgdorferi
VNSQKTKNL

SEQ ID NO: 129957 - protein, 15 aa, Borrelia burgdorferi
LKVTEGTVVLSKNIL

SEQ ID NO: 129958 - protein, 9 aa, Borrelia burgdorferi
LKVTEGTVV

SEQ ID NO: 129959 - protein, 15 aa, Borrelia burgdorferi
TIVRANGTRLEYTDI

SEQ ID NO: 129960 - protein, 9 aa, Borrelia burgdorferi
VRANGTRLE

SEQ ID NO: 129961 - protein, 15 aa, Borrelia burgdorferi
ISVNSQKTKNLVFTK

SEQ ID NO: 129962 - protein, 9 aa, Borrelia burgdorferi
VNSQKTKNL

SEQ ID NO: 129963 - protein, 15 aa, Borrelia burgdorferi
VVLSKNILKSGEITV

SEQ ID NO: 129964 - protein, 9 aa, Borrelia burgdorferi
VVLSKNILK

SEQ ID NO: 129965 - protein, 15 aa, Borrelia burgdorferi
ETSEKTIVRANGTRL

SEQ ID NO: 129966 - protein, 9 aa, Borrelia burgdorferi
KTIVRANGT

SEQ ID NO: 129967 - protein, 15 aa, Borrelia burgdorferi
EDAKTLVSKKVTLKD

SEQ ID NO: 129968 - protein, 9 aa, Borrelia burgdorferi
LVSKKVTLK

SEQ ID NO: 129969 - protein, 15 aa, Borrelia burgdorferi
DAKTLVSKKVTLKDK

SEQ ID NO: 129970 - protein, 9 aa, Borrelia burgdorferi
LVSKKVTLK

SEQ ID NO: 129971 - protein, 15 aa, Borrelia burgdorferi
TEGTVVLSKNILKSG

SEQ ID NO: 129972 - protein, 9 aa, Borrelia burgdorferi
VLSKNILKS

SEQ ID NO: 129973 - protein, 15 aa, Borrelia burgdorferi
EGTVVLSKNILKSGE

SEQ ID NO: 129974 - protein, 9 aa, Borrelia burgdorferi
VLSKNILKS

SEQ ID NO: 129975 - protein, 15 aa, Borrelia burgdorferi
KDKDGKYSLEATVDK

SEQ ID NO: 129976 - protein, 9 aa, Borrelia burgdorferi
KDKDGKYSL

SEQ ID NO: 129977 - protein, 15 aa, Borrelia burgdorferi
DKDGKYSLEATVDKL

SEQ ID NO: 129978 - protein, 9 aa, Borrelia burgdorferi
YSLEATVDK

SEQ ID NO: 129979 - protein, 15 aa, Borrelia burgdorferi
KDGKYSLEATVDKLE

SEQ ID NO: 129980 - protein, 9 aa, Borrelia burgdorferi
YSLEATVDK

SEQ ID NO: 129981 - protein, 15 aa, Borrelia burgdorferi
DGKYSLEATVDKLEL

SEQ ID NO: 129982 - protein, 9 aa, Borrelia burgdorferi
YSLEATVDK

SEQ ID NO: 129983 - protein, 15 aa, Borrelia burgdorferi
GKYSLEATVDKLELK

SEQ ID NO: 129984 - protein, 9 aa, Borrelia burgdorferi
YSLEATVDK

SEQ ID NO: 129985 - protein, 15 aa, Borrelia garinii
KKYLLGFALVLALIA

SEQ ID NO: 129986 - protein, 9 aa, Borrelia garinii
LLGFALVLA

SEQ ID NO: 129987 - protein, 15 aa, Borrelia garinii
ITVQNYDTAGTKLAG

SEQ ID NO: 129988 - protein, 9 aa, Borrelia garinii
YDTAGTKLA

SEQ ID NO: 129989 - protein, 15 aa, Borrelia garinii
TITVQNYDTAGTKLA

SEQ ID NO: 129990 - protein, 9 aa, Borrelia garinii
VQNYDTAGT

SEQ ID NO: 129991 - protein, 15 aa, Borrelia garinii
QNYDTAGTKLAGTAT

SEQ ID NO: 129992 - protein, 9 aa, Borrelia garinii
YDTAGTKLA

SEQ ID NO: 129993 - protein, 15 aa, Borrelia garinii
KYLLGFALVLALIAC

SEQ ID NO: 129994 - protein, 9 aa, Borrelia garinii
LLGFALVLA

SEQ ID NO: 129995 - protein, 15 aa, Borrelia garinii
MKKYLLGFALVLALI

SEQ ID NO: 129996 - protein, 9 aa, Borrelia garinii
LLGFALVLA

SEQ ID NO: 129997 - protein, 15 aa, Borrelia garinii
TVQNYDTAGTKLAGT

SEQ ID NO: 129998 - protein, 9 aa, Borrelia garinii
YDTAGTKLA

SEQ ID NO: 129999 - protein, 15 aa, Borrelia garinii
VQNYDTAGTKLAGTA

SEQ ID NO: 130000 - protein, 9 aa, Borrelia garinii
YDTAGTKLA

SEQ ID NO: 130001 - protein, 15 aa, Borrelia garinii
ATEIKDLEALKAALK

SEQ ID NO: 130002 - protein, 9 aa, Borrelia garinii
IKDLEALKA

SEQ ID NO: 130003 - protein, 15 aa, Borrelia garinii
TATEIKDLEALKAAL

SEQ ID NO: 130004 - protein, 9 aa, Borrelia garinii
IKDLEALKA

SEQ ID NO: 130005 - protein, 15 aa, Borrelia garinii
YLLGFALVLALIACG

SEQ ID NO: 130006 - protein, 9 aa, Borrelia garinii
FALVLALIA

SEQ ID NO: 130007 - protein, 15 aa, Borrelia garinii
GTATEIKDLEALKAA

SEQ ID NO: 130008 - protein, 9 aa, Borrelia garinii
IKDLEALKA

SEQ ID NO: 130009 - protein, 15 aa, Borrelia garinii
AGTATEIKDLEALKA

SEQ ID NO: 130010 - protein, 9 aa, Borrelia garinii
AGTATEIKD

SEQ ID NO: 130011 - protein, 15 aa, Borrelia garinii
LLGFALVLALIACGQ

SEQ ID NO: 130012 - protein, 9 aa, Borrelia garinii
FALVLALIA

SEQ ID NO: 130013 - protein, 15 aa, Borrelia garinii
LGFALVLALIACGQK

SEQ ID NO: 130014 - protein, 9 aa, Borrelia garinii
FALVLALIA

SEQ ID NO: 130015 - protein, 15 aa, Borrelia garinii
YDTAGTKLAGTATEI

SEQ ID NO: 130016 - protein, 9 aa, Borrelia garinii
YDTAGTKLA

SEQ ID NO: 130017 - protein, 15 aa, Borrelia garinii
NYDTAGTKLAGTATE

SEQ ID NO: 130018 - protein, 9 aa, Borrelia garinii
YDTAGTKLA

SEQ ID NO: 130019 - protein, 15 aa, Borrelia garinii
EGVKSDQSKVTMSIT

SEQ ID NO: 130020 - protein, 9 aa, Borrelia garinii
VKSDQSKVT

SEQ ID NO: 130021 - protein, 15 aa, Borrelia garinii
LEGVKSDQSKVTMSI

SEQ ID NO: 130022 - protein, 9 aa, Borrelia garinii
VKSDQSKVT

SEQ ID NO: 130023 - protein, 15 aa, Borrelia garinii
GKLEGVKSDQSKVTM

SEQ ID NO: 130024 - protein, 9 aa, Borrelia garinii
VKSDQSKVT

SEQ ID NO: 130025 - protein, 15 aa, Borrelia garinii
GGKLEGVKSDQSKVT

SEQ ID NO: 130026 - protein, 9 aa, Borrelia garinii
LEGVKSDQS

SEQ ID NO: 130027 - protein, 15 aa, Borrelia garinii
KLEGVKSDQSKVTMS

SEQ ID NO: 130028 - protein, 9 aa, Borrelia garinii
VKSDQSKVT

SEQ ID NO: 130029 - protein, 15 aa, Borrelia garinii
DGTITVQNYDTAGTK

SEQ ID NO: 130030 - protein, 9 aa, Borrelia garinii
VQNYDTAGT

SEQ ID NO: 130031 - protein, 15 aa, Borrelia garinii
GTITVQNYDTAGTKL

SEQ ID NO: 130032 - protein, 9 aa, Borrelia garinii
VQNYDTAGT

SEQ ID NO: 130033 - protein, 15 aa, Borrelia garinii
SKKDLPLVTEDTVKL

SEQ ID NO: 130034 - protein, 9 aa, Borrelia garinii
DLPLVTEDT

SEQ ID NO: 130035 - protein, 15 aa, Borrelia garinii
GFALVLALIACGQKG

SEQ ID NO: 130036 - protein, 9 aa, Borrelia garinii
LVLALIACG

SEQ ID NO: 130037 - protein, 15 aa, Borrelia garinii
TDGTITVQNYDTAGT

SEQ ID NO: 130038 - protein, 9 aa, Borrelia garinii
TITVQNYDT

SEQ ID NO: 130039 - protein, 15 aa, Borrelia garinii
KKDLPLVTEDTVKLF

SEQ ID NO: 130040 - protein, 9 aa, Borrelia garinii
LVTEDTVKL

SEQ ID NO: 130041 - protein, 15 aa, Borrelia garinii
FALVLALIACGQKGA

SEQ ID NO: 130042 - protein, 9 aa, Borrelia garinii
LVLALIACG

SEQ ID NO: 130043 - protein, 15 aa, Borrelia garinii
MLEGNLVGGKTSVEI

SEQ ID NO: 130044 - protein, 9 aa, Borrelia garinii
LVGGKTSVE

SEQ ID NO: 130045 - protein, 15 aa, Borrelia garinii
KDLPLVTEDTVKLFN

SEQ ID NO: 130046 - protein, 9 aa, Borrelia garinii
LVTEDTVKL

SEQ ID NO: 130047 - protein, 15 aa, Borrelia garinii
DLPLVTEDTVKLFND

SEQ ID NO: 130048 - protein, 9 aa, Borrelia garinii
LVTEDTVKL

SEQ ID NO: 130049 - protein, 15 aa, Borrelia garinii
LEGNLVGGKTSVEIK

SEQ ID NO: 130050 - protein, 9 aa, Borrelia garinii
VGGKTSVEI

SEQ ID NO: 130051 - protein, 15 aa, Borrelia garinii
EGNLVGGKTSVEIKE

SEQ ID NO: 130052 - protein, 9 aa, Borrelia garinii
VGGKTSVEI

SEQ ID NO: 130053 - protein, 15 aa, Borrelia garinii
GNLVGGKTSVEIKEG

SEQ ID NO: 130054 - protein, 9 aa, Borrelia garinii
VGGKTSVEI

SEQ ID NO: 130055 - protein, 15 aa, Borrelia garinii
LPLVTEDTVKLFNDT

SEQ ID NO: 130056 - protein, 9 aa, Borrelia garinii
LVTEDTVKL

SEQ ID NO: 130057 - protein, 15 aa, Borrelia garinii
NLVGGKTSVEIKEGT

SEQ ID NO: 130058 - protein, 9 aa, Borrelia garinii
VGGKTSVEI

SEQ ID NO: 130059 - protein, 15 aa, Borrelia garinii
ETLKNGIMLEGNLVG

SEQ ID NO: 130060 - protein, 9 aa, Borrelia garinii
LKNGIMLEG

SEQ ID NO: 130061 - protein, 15 aa, Borrelia garinii
YKTGKLSTKKITRTN

SEQ ID NO: 130062 - protein, 9 aa, Borrelia garinii
LSTKKITRT

SEQ ID NO: 130063 - protein, 15 aa, Borrelia garinii
TYKTGKLSTKKITRT

SEQ ID NO: 130064 - protein, 9 aa, Borrelia garinii
TGKLSTKKI

SEQ ID NO: 130065 - protein, 15 aa, Borrelia garinii
TGKLSTKKITRTNGT

SEQ ID NO: 130066 - protein, 9 aa, Borrelia garinii
LSTKKITRT

SEQ ID NO: 130067 - protein, 15 aa, Borrelia garinii
VETLKNGIMLEGNLV

SEQ ID NO: 130068 - protein, 9 aa, Borrelia garinii
LKNGIMLEG

SEQ ID NO: 130069 - protein, 15 aa, Borrelia garinii
KKEIEKAGTVKLFLD

SEQ ID NO: 130070 - protein, 9 aa, Borrelia garinii
IEKAGTVKL

SEQ ID NO: 130071 - protein, 15 aa, Borrelia garinii
LKKEIEKAGTVKLFL

SEQ ID NO: 130072 - protein, 9 aa, Borrelia garinii
IEKAGTVKL

SEQ ID NO: 130073 - protein, 15 aa, Borrelia garinii
KEIEKAGTVKLFLDD

SEQ ID NO: 130074 - protein, 9 aa, Borrelia garinii
IEKAGTVKL

SEQ ID NO: 130075 - protein, 15 aa, Borrelia garinii
KDFVFLTDGTITVQN

SEQ ID NO: 130076 - protein, 9 aa, Borrelia garinii
FLTDGTITV

SEQ ID NO: 130077 - protein, 15 aa, Borrelia garinii
VTLKKEIEKAGTVKL

SEQ ID NO: 130078 - protein, 9 aa, Borrelia garinii
LKKEIEKAG

SEQ ID NO: 130079 - protein, 15 aa, Borrelia garinii
TLKKEIEKAGTVKLF

SEQ ID NO: 130080 - protein, 9 aa, Borrelia garinii
IEKAGTVKL

SEQ ID NO: 130081 - protein, 15 aa, Borrelia garinii
KTGKLSTKKITRTNG

SEQ ID NO: 130082 - protein, 9 aa, Borrelia garinii
LSTKKITRT

SEQ ID NO: 130083 - protein, 15 aa, Borrelia garinii
GKLSTKKITRTNGTT

SEQ ID NO: 130084 - protein, 9 aa, Borrelia garinii
LSTKKITRT

SEQ ID NO: 130085 - protein, 15 aa, Borrelia garinii
DTAGTKLAGTATEIK

SEQ ID NO: 130086 - protein, 9 aa, Borrelia garinii
GTKLAGTAT

SEQ ID NO: 130087 - protein, 15 aa, Borrelia garinii
GVKSDQSKVTMSITD

SEQ ID NO: 130088 - protein, 9 aa, Borrelia garinii
VKSDQSKVT

SEQ ID NO: 130089 - protein, 15 aa, Borrelia garinii
VKSDQSKVTMSITDD

SEQ ID NO: 130090 - protein, 9 aa, Borrelia garinii
VKSDQSKVT

SEQ ID NO: 130091 - protein, 15 aa, Borrelia garinii
DFVFLTDGTITVQNY

SEQ ID NO: 130092 - protein, 9 aa, Borrelia garinii
FLTDGTITV

SEQ ID NO: 130093 - protein, 15 aa, Borrelia garinii
TAGTKLAGTATEIKD

SEQ ID NO: 130094 - protein, 9 aa, Borrelia garinii
LAGTATEIK

SEQ ID NO: 130095 - protein, 15 aa, Borrelia garinii
IKDFVFLTDGTITVQ

SEQ ID NO: 130096 - protein, 9 aa, Borrelia garinii
FLTDGTITV

SEQ ID NO: 130097 - protein, 15 aa, Borrelia garinii
DGKYELRATVDTVEL

SEQ ID NO: 130098 - protein, 9 aa, Borrelia garinii
YELRATVDT

SEQ ID NO: 130099 - protein, 15 aa, Borrelia garinii
FVFLTDGTITVQNYD

SEQ ID NO: 130100 - protein, 9 aa, Borrelia garinii
FLTDGTITV

SEQ ID NO: 130101 - protein, 15 aa, Borrelia garinii
GKYELRATVDTVELK

SEQ ID NO: 130102 - protein, 9 aa, Borrelia garinii
YELRATVDT

SEQ ID NO: 130103 - protein, 15 aa, Borrelia garinii
ALVLALIACGQKGAE

SEQ ID NO: 130104 - protein, 9 aa, Borrelia garinii
LVLALIACG

SEQ ID NO: 130105 - protein, 15 aa, Borrelia garinii
NKDGKYELRATVDTV

SEQ ID NO: 130106 - protein, 9 aa, Borrelia garinii
YELRATVDT

SEQ ID NO: 130107 - protein, 15 aa, Borrelia garinii
KNKDGKYELRATVDT

SEQ ID NO: 130108 - protein, 9 aa, Borrelia garinii
DGKYELRAT

SEQ ID NO: 130109 - protein, 15 aa, Borrelia garinii
KDGKYELRATVDTVE

SEQ ID NO: 130110 - protein, 9 aa, Borrelia garinii
YELRATVDT

SEQ ID NO: 130111 - protein, 15 aa, Borrelia garinii
KAVETLKNGIMLEGN

SEQ ID NO: 130112 - protein, 9 aa, Borrelia garinii
LKNGIMLEG

SEQ ID NO: 130113 - protein, 15 aa, Borrelia garinii
AVETLKNGIMLEGNL

SEQ ID NO: 130114 - protein, 9 aa, Borrelia garinii
LKNGIMLEG

SEQ ID NO: 130115 - protein, 15 aa, Borrelia garinii
ASKVFKKQGSLTEET

SEQ ID NO: 130116 - protein, 9 aa, Borrelia garinii
FKKQGSLTE

SEQ ID NO: 130117 - protein, 15 aa, Borrelia garinii
TLKNGIMLEGNLVGG

SEQ ID NO: 130118 - protein, 9 aa, Borrelia garinii
LKNGIMLEG

SEQ ID NO: 130119 - protein, 15 aa, Borrelia garinii
SKVFKKQGSLTEETE

SEQ ID NO: 130120 - protein, 9 aa, Borrelia garinii
FKKQGSLTE

SEQ ID NO: 130121 - protein, 15 aa, Borrelia garinii
KIKDFVFLTDGTITV

SEQ ID NO: 130122 - protein, 9 aa, Borrelia garinii
FVFLTDGTI

SEQ ID NO: 130123 - protein, 15 aa, Borrelia garinii
LKNGIMLEGNLVGGK

SEQ ID NO: 130124 - protein, 9 aa, Borrelia garinii
LKNGIMLEG

SEQ ID NO: 130125 - protein, 15 aa, Borrelia garinii
AGTKLAGTATEIKDL

SEQ ID NO: 130126 - protein, 9 aa, Borrelia garinii
LAGTATEIK

SEQ ID NO: 130127 - protein, 15 aa, Borrelia garinii
GTKLAGTATEIKDLE

SEQ ID NO: 130128 - protein, 9 aa, Borrelia garinii
LAGTATEIK

SEQ ID NO: 130129 - protein, 15 aa, Borrelia garinii
TKAVETLKNGIMLEG

SEQ ID NO: 130130 - protein, 9 aa, Borrelia garinii
VETLKNGIM

SEQ ID NO: 130131 - protein, 15 aa, Borrelia garinii
KTAVWSDTSNTLTVS

SEQ ID NO: 130132 - protein, 9 aa, Borrelia garinii
WSDTSNTLT

SEQ ID NO: 130133 - protein, 15 aa, Borrelia garinii
KVFKKQGSLTEETEE

SEQ ID NO: 130134 - protein, 9 aa, Borrelia garinii
FKKQGSLTE

SEQ ID NO: 130135 - protein, 15 aa, Borrelia garinii
VASKVFKKQGSLTEE

SEQ ID NO: 130136 - protein, 9 aa, Borrelia garinii
FKKQGSLTE

SEQ ID NO: 130137 - protein, 15 aa, Borrelia garinii
KVASKVFKKQGSLTE

SEQ ID NO: 130138 - protein, 9 aa, Borrelia garinii
VFKKQGSLT

SEQ ID NO: 130139 - protein, 15 aa, Borrelia garinii
VGGKTSVEIKEGTVT

SEQ ID NO: 130140 - protein, 9 aa, Borrelia garinii
VGGKTSVEI

SEQ ID NO: 130141 - protein, 15 aa, Borrelia garinii
TAVWSDTSNTLTVSA

SEQ ID NO: 130142 - protein, 9 aa, Borrelia garinii
VWSDTSNTL

SEQ ID NO: 130143 - protein, 15 aa, Borrelia garinii
LVLALIACGQKGAEP

SEQ ID NO: 130144 - protein, 9 aa, Borrelia garinii
LVLALIACG

SEQ ID NO: 130145 - protein, 15 aa, Borrelia garinii
TKKTAVWSDTSNTLT

SEQ ID NO: 130146 - protein, 9 aa, Borrelia garinii
VWSDTSNTL

SEQ ID NO: 130147 - protein, 15 aa, Borrelia garinii
KKTAVWSDTSNTLTV

SEQ ID NO: 130148 - protein, 9 aa, Borrelia garinii
WSDTSNTLT

SEQ ID NO: 130149 - protein, 15 aa, Borrelia garinii
LVGGKTSVEIKEGTV

SEQ ID NO: 130150 - protein, 9 aa, Borrelia garinii
VGGKTSVEI

SEQ ID NO: 130151 - protein, 15 aa, Borrelia garinii
KNGIMLEGNLVGGKT

SEQ ID NO: 130152 - protein, 9 aa, Borrelia garinii
IMLEGNLVG

SEQ ID NO: 130153 - protein, 15 aa, Borrelia garinii
ETYKTGKLSTKKITR

SEQ ID NO: 130154 - protein, 9 aa, Borrelia garinii
YKTGKLSTK

SEQ ID NO: 130155 - protein, 15 aa, Borrelia garinii
LVTEDTVKLFNDTKI

SEQ ID NO: 130156 - protein, 9 aa, Borrelia garinii
LVTEDTVKL

SEQ ID NO: 130157 - protein, 15 aa, Borrelia garinii
EETYKTGKLSTKKIT

SEQ ID NO: 130158 - protein, 9 aa, Borrelia garinii
YKTGKLSTK

SEQ ID NO: 130159 - protein, 15 aa, Borrelia garinii
TEETYKTGKLSTKKI

SEQ ID NO: 130160 - protein, 9 aa, Borrelia garinii
YKTGKLSTK

SEQ ID NO: 130161 - protein, 15 aa, Borrelia garinii
LSTKKITRTNGTTLE

SEQ ID NO: 130162 - protein, 9 aa, Borrelia garinii
LSTKKITRT

SEQ ID NO: 130163 - protein, 15 aa, Borrelia garinii
PLVTEDTVKLFNDTK

SEQ ID NO: 130164 - protein, 9 aa, Borrelia garinii
LVTEDTVKL

SEQ ID NO: 130165 - protein, 15 aa, Borrelia garinii
VFLTDGTITVQNYDT

SEQ ID NO: 130166 - protein, 9 aa, Borrelia garinii
FLTDGTITV

SEQ ID NO: 130167 - protein, 15 aa, Borrelia garinii
KLSTKKITRTNGTTL

SEQ ID NO: 130168 - protein, 9 aa, Borrelia garinii
LSTKKITRT

SEQ ID NO: 130169 - protein, 15 aa, Borrelia garinii
VETYDSSNTKVASKV

SEQ ID NO: 130170 - protein, 9 aa, Borrelia garinii
YDSSNTKVA

SEQ ID NO: 130171 - protein, 15 aa, Borrelia garinii
YELRATVDTVELKGV

SEQ ID NO: 130172 - protein, 9 aa, Borrelia garinii
YELRATVDT

SEQ ID NO: 130173 - protein, 15 aa, Borrelia garinii
TITVETYDSSNTKVA

SEQ ID NO: 130174 - protein, 9 aa, Borrelia garinii
VETYDSSNT

SEQ ID NO: 130175 - protein, 15 aa, Borrelia garinii
ITVETYDSSNTKVAS

SEQ ID NO: 130176 - protein, 9 aa, Borrelia garinii
YDSSNTKVA

SEQ ID NO: 130177 - protein, 15 aa, Borrelia garinii
AVWSDTSNTLTVSAD

SEQ ID NO: 130178 - protein, 9 aa, Borrelia garinii
WSDTSNTLT

SEQ ID NO: 130179 - protein, 15 aa, Borrelia garinii
ETYDSSNTKVASKVF

SEQ ID NO: 130180 - protein, 9 aa, Borrelia garinii
YDSSNTKVA

SEQ ID NO: 130181 - protein, 15 aa, Borrelia garinii
IMLEGNLVGGKTSVE

SEQ ID NO: 130182 - protein, 9 aa, Borrelia garinii
IMLEGNLVG

SEQ ID NO: 130183 - protein, 15 aa, Borrelia garinii
EIEKAGTVKLFLDDT

SEQ ID NO: 130184 - protein, 9 aa, Borrelia garinii
IEKAGTVKL

SEQ ID NO: 130185 - protein, 15 aa, Borrelia garinii
NGIMLEGNLVGGKTS

SEQ ID NO: 130186 - protein, 9 aa, Borrelia garinii
IMLEGNLVG

SEQ ID NO: 130187 - protein, 15 aa, Borrelia garinii
IEKAGTVKLFLDDTS

SEQ ID NO: 130188 - protein, 9 aa, Borrelia garinii
IEKAGTVKL

SEQ ID NO: 130189 - protein, 15 aa, Borrelia garinii
FLTDGTITVQNYDTA

SEQ ID NO: 130190 - protein, 9 aa, Borrelia garinii
FLTDGTITV

SEQ ID NO: 130191 - protein, 15 aa, Borrelia garinii
KLFLDDTSSGSTKKT

SEQ ID NO: 130192 - protein, 9 aa, Borrelia garinii
FLDDTSSGS

SEQ ID NO: 130193 - protein, 15 aa, Borrelia garinii
KYELRATVDTVELKG

SEQ ID NO: 130194 - protein, 9 aa, Borrelia garinii
YELRATVDT

SEQ ID NO: 130195 - protein, 15 aa, Borrelia garinii
DTVKLFNDTKIFISK

SEQ ID NO: 130196 - protein, 9 aa, Borrelia garinii
LFNDTKIFI

SEQ ID NO: 130197 - protein, 15 aa, Borrelia garinii
EDTVKLFNDTKIFIS

SEQ ID NO: 130198 - protein, 9 aa, Borrelia garinii
LFNDTKIFI

SEQ ID NO: 130199 - protein, 15 aa, Borrelia garinii
TVKLFNDTKIFISKE

SEQ ID NO: 130200 - protein, 9 aa, Borrelia garinii
LFNDTKIFI

SEQ ID NO: 130201 - protein, 15 aa, Borrelia garinii
TEDTVKLFNDTKIFI

SEQ ID NO: 130202 - protein, 9 aa, Borrelia garinii
KLFNDTKIF

SEQ ID NO: 130203 - protein, 15 aa, Borrelia garinii
VKLFNDTKIFISKEK

SEQ ID NO: 130204 - protein, 9 aa, Borrelia garinii
LFNDTKIFI

SEQ ID NO: 130205 - protein, 15 aa, Borrelia garinii
SKVFKKQGSLTEETE

SEQ ID NO: 130206 - protein, 9 aa, Borrelia garinii
FKKQGSLTE

SEQ ID NO: 130207 - protein, 15 aa, Borrelia garinii
VASKVFKKQGSLTEE

SEQ ID NO: 130208 - protein, 9 aa, Borrelia garinii
FKKQGSLTE

SEQ ID NO: 130209 - protein, 15 aa, Borrelia garinii
ASKVFKKQGSLTEET

SEQ ID NO: 130210 - protein, 9 aa, Borrelia garinii
FKKQGSLTE

SEQ ID NO: 130211 - protein, 15 aa, Borrelia garinii
KVASKVFKKQGSLTE

SEQ ID NO: 130212 - protein, 9 aa, Borrelia garinii
VFKKQGSLT

SEQ ID NO: 130213 - protein, 15 aa, Borrelia garinii
KVFKKQGSLTEETEE

SEQ ID NO: 130214 - protein, 9 aa, Borrelia garinii
FKKQGSLTE

SEQ ID NO: 130215 - protein, 15 aa, Borrelia garinii
TAVWSDTSNTLTVSA

SEQ ID NO: 130216 - protein, 9 aa, Borrelia garinii
VWSDTSNTL

SEQ ID NO: 130217 - protein, 15 aa, Borrelia garinii
TAVWSDTSNTLTVSA

SEQ ID NO: 130218 - protein, 9 aa, Borrelia garinii
WSDTSNTLT

SEQ ID NO: 130219 - protein, 15 aa, Borrelia garinii
AVWSDTSNTLTVSAD

SEQ ID NO: 130220 - protein, 9 aa, Borrelia garinii
TSNTLTVSA

SEQ ID NO: 130221 - protein, 15 aa, Borrelia garinii
TLEYSDMTNDENATK

SEQ ID NO: 130222 - protein, 9 aa, Borrelia garinii
YSDMTNDEN

SEQ ID NO: 130223 - protein, 15 aa, Borrelia garinii
GTTLEYSDMTNDENA

SEQ ID NO: 130224 - protein, 9 aa, Borrelia garinii
YSDMTNDEN

SEQ ID NO: 130225 - protein, 15 aa, Borrelia garinii
NGTTLEYSDMTNDEN

SEQ ID NO: 130226 - protein, 9 aa, Borrelia garinii
EYSDMTNDE

SEQ ID NO: 130227 - protein, 15 aa, Borrelia garinii
TTLEYSDMTNDENAT

SEQ ID NO: 130228 - protein, 9 aa, Borrelia garinii
YSDMTNDEN

SEQ ID NO: 130229 - protein, 15 aa, Borrelia garinii
LEYSDMTNDENATKA

SEQ ID NO: 130230 - protein, 9 aa, Borrelia garinii
YSDMTNDEN

SEQ ID NO: 130231 - protein, 15 aa, Borrelia garinii
ETYDSSNTKVASKVF

SEQ ID NO: 130232 - protein, 9 aa, Borrelia garinii
YDSSNTKVA

SEQ ID NO: 130233 - protein, 15 aa, Borrelia garinii
TYDSSNTKVASKVFK

SEQ ID NO: 130234 - protein, 9 aa, Borrelia garinii
NTKVASKVF

SEQ ID NO: 130235 - protein, 15 aa, Borrelia garinii
YDSSNTKVASKVFKK

SEQ ID NO: 130236 - protein, 9 aa, Borrelia garinii
NTKVASKVF

SEQ ID NO: 130237 - protein, 15 aa, Borrelia garinii
MKKYLLGFALVLALI

SEQ ID NO: 130238 - protein, 9 aa, Borrelia garinii
LGFALVLAL

SEQ ID NO: 130239 - protein, 15 aa, Borrelia garinii
KKYLLGFALVLALIA

SEQ ID NO: 130240 - protein, 9 aa, Borrelia garinii
LGFALVLAL

SEQ ID NO: 130241 - protein, 15 aa, Borrelia garinii
TKAVETLKNGIMLEG

SEQ ID NO: 130242 - protein, 9 aa, Borrelia garinii
VETLKNGIM

SEQ ID NO: 130243 - protein, 15 aa, Borrelia garinii
KAVETLKNGIMLEGN

SEQ ID NO: 130244 - protein, 9 aa, Borrelia garinii
LKNGIMLEG

SEQ ID NO: 130245 - protein, 15 aa, Borrelia garinii
VETLKNGIMLEGNLV

SEQ ID NO: 130246 - protein, 9 aa, Borrelia garinii
LKNGIMLEG

SEQ ID NO: 130247 - protein, 15 aa, Borrelia garinii
AVETLKNGIMLEGNL

SEQ ID NO: 130248 - protein, 9 aa, Borrelia garinii
LKNGIMLEG

SEQ ID NO: 130249 - protein, 15 aa, Borrelia garinii
ETLKNGIMLEGNLVG

SEQ ID NO: 130250 - protein, 9 aa, Borrelia garinii
LKNGIMLEG

SEQ ID NO: 130251 - protein, 15 aa, Borrelia garinii
LSTKKITRTNGTTLE

SEQ ID NO: 130252 - protein, 9 aa, Borrelia garinii
KKITRTNGT

SEQ ID NO: 130253 - protein, 15 aa, Borrelia garinii
EDTVKLFNDTKIFIS

SEQ ID NO: 130254 - protein, 9 aa, Borrelia garinii
VKLFNDTKI

SEQ ID NO: 130255 - protein, 15 aa, Borrelia garinii
DTVKLFNDTKIFISK

SEQ ID NO: 130256 - protein, 9 aa, Borrelia garinii
VKLFNDTKI

SEQ ID NO: 130257 - protein, 15 aa, Borrelia garinii
TYKTGKLSTKKITRT

SEQ ID NO: 130258 - protein, 9 aa, Borrelia garinii
GKLSTKKIT

SEQ ID NO: 130259 - protein, 15 aa, Borrelia garinii
YKTGKLSTKKITRTN

SEQ ID NO: 130260 - protein, 9 aa, Borrelia garinii
LSTKKITRT

SEQ ID NO: 130261 - protein, 15 aa, Borrelia garinii
TGKLSTKKITRTNGT

SEQ ID NO: 130262 - protein, 9 aa, Borrelia garinii
LSTKKITRT

SEQ ID NO: 130263 - protein, 15 aa, Borrelia garinii
GKLSTKKITRTNGTT

SEQ ID NO: 130264 - protein, 9 aa, Borrelia garinii
LSTKKITRT

SEQ ID NO: 130265 - protein, 15 aa, Borrelia garinii
STKKITRTNGTTLEY

SEQ ID NO: 130266 - protein, 9 aa, Borrelia garinii
ITRTNGTTL

SEQ ID NO: 130267 - protein, 15 aa, Borrelia garinii
KTGKLSTKKITRTNG

SEQ ID NO: 130268 - protein, 9 aa, Borrelia garinii
LSTKKITRT

SEQ ID NO: 130269 - protein, 15 aa, Borrelia garinii
KLSTKKITRTNGTTL

SEQ ID NO: 130270 - protein, 9 aa, Borrelia garinii
KKITRTNGT

SEQ ID NO: 130271 - protein, 15 aa, Borrelia garinii
NGIMLEGNLVGGKTS

SEQ ID NO: 130272 - protein, 9 aa, Borrelia garinii
EGNLVGGKT

SEQ ID NO: 130273 - protein, 15 aa, Borrelia garinii
VKLFNDTKIFISKEK

SEQ ID NO: 130274 - protein, 9 aa, Borrelia garinii
LFNDTKIFI

SEQ ID NO: 130275 - protein, 15 aa, Borrelia garinii
IMLEGNLVGGKTSVE

SEQ ID NO: 130276 - protein, 9 aa, Borrelia garinii
EGNLVGGKT

SEQ ID NO: 130277 - protein, 15 aa, Borrelia garinii
MKKYLLGFALVLALI

SEQ ID NO: 130278 - protein, 9 aa, Borrelia garinii
LLGFALVLA

SEQ ID NO: 130279 - protein, 15 aa, Borrelia garinii
KKYLLGFALVLALIA

SEQ ID NO: 130280 - protein, 9 aa, Borrelia garinii
LLGFALVLA

SEQ ID NO: 130281 - protein, 15 aa, Borrelia garinii
KYLLGFALVLALIAC

SEQ ID NO: 130282 - protein, 9 aa, Borrelia garinii
LLGFALVLA

SEQ ID NO: 130283 - protein, 15 aa, Borrelia afzelii
TNSVKELTSPVVAES

SEQ ID NO: 130284 - protein, 9 aa, Borrelia afzelii
VKELTSPVV

SEQ ID NO: 130285 - protein, 15 aa, Borrelia afzelii
NSVKELTSPVVAESP

SEQ ID NO: 130286 - protein, 9 aa, Borrelia afzelii
VKELTSPVV

SEQ ID NO: 130287 - protein, 15 aa, Borrelia afzelii
ALTNSVKELTSPVVA

SEQ ID NO: 130288 - protein, 9 aa, Borrelia afzelii
VKELTSPVV

SEQ ID NO: 130289 - protein, 15 aa, Borrelia afzelii
LTNSVKELTSPVVAE

SEQ ID NO: 130290 - protein, 9 aa, Borrelia afzelii
VKELTSPVV

SEQ ID NO: 130291 - protein, 15 aa, Borrelia afzelii
EALTNSVKELTSPVV

SEQ ID NO: 130292 - protein, 9 aa, Borrelia afzelii
LTNSVKELT

SEQ ID NO: 130293 - protein, 15 aa, Borrelia afzelii
EGLVKAAQEALTNSV

SEQ ID NO: 130294 - protein, 9 aa, Borrelia afzelii
VKAAQEALT

SEQ ID NO: 130295 - protein, 15 aa, Borrelia afzelii
SVKELTSPVVAESPK

SEQ ID NO: 130296 - protein, 9 aa, Borrelia afzelii
VKELTSPVV

SEQ ID NO: 130297 - protein, 15 aa, Borrelia afzelii
VKELTSPVVAESPKK

SEQ ID NO: 130298 - protein, 9 aa, Borrelia afzelii
VKELTSPVV

SEQ ID NO: 130299 - protein, 15 aa, Borrelia afzelii
GLVKAAQEALTNSVK

SEQ ID NO: 130300 - protein, 9 aa, Borrelia afzelii
VKAAQEALT

SEQ ID NO: 130301 - protein, 15 aa, Borrelia afzelii
VEGLVKAAQEALTNS

SEQ ID NO: 130302 - protein, 9 aa, Borrelia afzelii
VKAAQEALT

SEQ ID NO: 130303 - protein, 15 aa, Borrelia afzelii
LAGVHEISTLITEKL

SEQ ID NO: 130304 - protein, 9 aa, Borrelia afzelii
VHEISTLIT

SEQ ID NO: 130305 - protein, 15 aa, Borrelia afzelii
AGVHEISTLITEKLS

SEQ ID NO: 130306 - protein, 9 aa, Borrelia afzelii
VHEISTLIT

SEQ ID NO: 130307 - protein, 15 aa, Borrelia afzelii
SVEGLVKAAQEALTN

SEQ ID NO: 130308 - protein, 9 aa, Borrelia afzelii
VKAAQEALT

SEQ ID NO: 130309 - protein, 15 aa, Borrelia afzelii
KSVEGLVKAAQEALT

SEQ ID NO: 130310 - protein, 9 aa, Borrelia afzelii
LVKAAQEAL

SEQ ID NO: 130311 - protein, 15 aa, Borrelia afzelii
HEISTLITEKLSKLK

SEQ ID NO: 130312 - protein, 9 aa, Borrelia afzelii
ISTLITEKL

SEQ ID NO: 130313 - protein, 15 aa, Borrelia afzelii
VHEISTLITEKLSKL

SEQ ID NO: 130314 - protein, 9 aa, Borrelia afzelii
ISTLITEKL

SEQ ID NO: 130315 - protein, 15 aa, Borrelia afzelii
MKKNTLSAILMTLFL

SEQ ID NO: 130316 - protein, 9 aa, Borrelia afzelii
KNTLSAILM

SEQ ID NO: 130317 - protein, 15 aa, Borrelia afzelii
NTLSAILMTLFLFIS

SEQ ID NO: 130318 - protein, 9 aa, Borrelia afzelii
LSAILMTLF

SEQ ID NO: 130319 - protein, 15 aa, Borrelia afzelii
GVHEISTLITEKLSK

SEQ ID NO: 130320 - protein, 9 aa, Borrelia afzelii
ISTLITEKL

SEQ ID NO: 130321 - protein, 15 aa, Borrelia afzelii
ESLLAGVHEISTLIT

SEQ ID NO: 130322 - protein, 9 aa, Borrelia afzelii
LLAGVHEIS

SEQ ID NO: 130323 - protein, 15 aa, Borrelia afzelii
KNTLSAILMTLFLFI

SEQ ID NO: 130324 - protein, 9 aa, Borrelia afzelii
LSAILMTLF

SEQ ID NO: 130325 - protein, 15 aa, Borrelia afzelii
SLLAGVHEISTLITE

SEQ ID NO: 130326 - protein, 9 aa, Borrelia afzelii
VHEISTLIT

SEQ ID NO: 130327 - protein, 15 aa, Borrelia afzelii
LLAGVHEISTLITEK

SEQ ID NO: 130328 - protein, 9 aa, Borrelia afzelii
VHEISTLIT

SEQ ID NO: 130329 - protein, 15 aa, Borrelia afzelii
TLSAILMTLFLFISC

SEQ ID NO: 130330 - protein, 9 aa, Borrelia afzelii
LMTLFLFIS

SEQ ID NO: 130331 - protein, 15 aa, Borrelia afzelii
KELTSPVVAESPKKP

SEQ ID NO: 130332 - protein, 9 aa, Borrelia afzelii
LTSPVVAES

SEQ ID NO: 130333 - protein, 15 aa, Borrelia afzelii
LSAILMTLFLFISCN

SEQ ID NO: 130334 - protein, 9 aa, Borrelia afzelii
LMTLFLFIS

SEQ ID NO: 130335 - protein, 15 aa, Borrelia afzelii
LVKAAQEALTNSVKE

SEQ ID NO: 130336 - protein, 9 aa, Borrelia afzelii
VKAAQEALT

SEQ ID NO: 130337 - protein, 15 aa, Borrelia afzelii
SAILMTLFLFISCNN

SEQ ID NO: 130338 - protein, 9 aa, Borrelia afzelii
LMTLFLFIS

SEQ ID NO: 130339 - protein, 15 aa, Borrelia afzelii
ISTLITEKLSKLKNS

SEQ ID NO: 130340 - protein, 9 aa, Borrelia afzelii
ISTLITEKL

SEQ ID NO: 130341 - protein, 15 aa, Borrelia afzelii
EISTLITEKLSKLKN

SEQ ID NO: 130342 - protein, 9 aa, Borrelia afzelii
ISTLITEKL

SEQ ID NO: 130343 - protein, 15 aa, Borrelia afzelii
VKAAQEALTNSVKEL

SEQ ID NO: 130344 - protein, 9 aa, Borrelia afzelii
VKAAQEALT

SEQ ID NO: 130345 - protein, 15 aa, Borrelia afzelii
KKNTLSAILMTLFLF

SEQ ID NO: 130346 - protein, 9 aa, Borrelia afzelii
LSAILMTLF

SEQ ID NO: 130347 - protein, 15 aa, Borrelia afzelii
VLAVKEVETLVSSID

SEQ ID NO: 130348 - protein, 9 aa, Borrelia afzelii
VKEVETLVS

SEQ ID NO: 130349 - protein, 15 aa, Borrelia afzelii
LAVKEVETLVSSIDE

SEQ ID NO: 130350 - protein, 9 aa, Borrelia afzelii
VKEVETLVS

SEQ ID NO: 130351 - protein, 15 aa, Borrelia afzelii
AFVLAVKEVETLVSS

SEQ ID NO: 130352 - protein, 9 aa, Borrelia afzelii
VKEVETLVS

SEQ ID NO: 130353 - protein, 15 aa, Borrelia afzelii
AILMTLFLFISCNNS

SEQ ID NO: 130354 - protein, 9 aa, Borrelia afzelii
LMTLFLFIS

SEQ ID NO: 130355 - protein, 15 aa, Borrelia afzelii
NAFVLAVKEVETLVS

SEQ ID NO: 130356 - protein, 9 aa, Borrelia afzelii
LAVKEVETL

SEQ ID NO: 130357 - protein, 15 aa, Borrelia afzelii
FVLAVKEVETLVSSI

SEQ ID NO: 130358 - protein, 9 aa, Borrelia afzelii
VKEVETLVS

SEQ ID NO: 130359 - protein, 15 aa, Borrelia afzelii
FKSVEGLVKAAQEAL

SEQ ID NO: 130360 - protein, 9 aa, Borrelia afzelii
FKSVEGLVK

SEQ ID NO: 130361 - protein, 15 aa, Borrelia afzelii
EEFTNKLRVSHADLG

SEQ ID NO: 130362 - protein, 9 aa, Borrelia afzelii
FTNKLRVSH

SEQ ID NO: 130363 - protein, 15 aa, Borrelia afzelii
VKEVETLVSSIDELA

SEQ ID NO: 130364 - protein, 9 aa, Borrelia afzelii
VKEVETLVS

SEQ ID NO: 130365 - protein, 15 aa, Borrelia afzelii
EFTNKLRVSHADLGK

SEQ ID NO: 130366 - protein, 9 aa, Borrelia afzelii
LRVSHADLG

SEQ ID NO: 130367 - protein, 15 aa, Borrelia afzelii
GKLFKSVEGLVKAAQ

SEQ ID NO: 130368 - protein, 9 aa, Borrelia afzelii
FKSVEGLVK

SEQ ID NO: 130369 - protein, 15 aa, Borrelia afzelii
NNSGKGGDSASTNPA

SEQ ID NO: 130370 - protein, 9 aa, Borrelia afzelii
GKGGDSAST

SEQ ID NO: 130371 - protein, 15 aa, Borrelia afzelii
KLFKSVEGLVKAAQE

SEQ ID NO: 130372 - protein, 9 aa, Borrelia afzelii
FKSVEGLVK

SEQ ID NO: 130373 - protein, 15 aa, Borrelia afzelii
NSGKGGDSASTNPAD

SEQ ID NO: 130374 - protein, 9 aa, Borrelia afzelii
GKGGDSAST

SEQ ID NO: 130375 - protein, 15 aa, Borrelia afzelii
MTLFLFISCNNSGKG

SEQ ID NO: 130376 - protein, 9 aa, Borrelia afzelii
LFISCNNSG

SEQ ID NO: 130377 - protein, 15 aa, Borrelia afzelii
TLFLFISCNNSGKGG

SEQ ID NO: 130378 - protein, 9 aa, Borrelia afzelii
LFISCNNSG

SEQ ID NO: 130379 - protein, 15 aa, Borrelia afzelii
ILMTLFLFISCNNSG

SEQ ID NO: 130380 - protein, 9 aa, Borrelia afzelii
FLFISCNNS

SEQ ID NO: 130381 - protein, 15 aa, Borrelia afzelii
KKAILKTNADKTKGA

SEQ ID NO: 130382 - protein, 9 aa, Borrelia afzelii
ILKTNADKT

SEQ ID NO: 130383 - protein, 15 aa, Borrelia afzelii
LMTLFLFISCNNSGK

SEQ ID NO: 130384 - protein, 9 aa, Borrelia afzelii
LFISCNNSG

SEQ ID NO: 130385 - protein, 15 aa, Borrelia afzelii
AKKAILKTNADKTKG

SEQ ID NO: 130386 - protein, 9 aa, Borrelia afzelii
ILKTNADKT

SEQ ID NO: 130387 - protein, 15 aa, Borrelia afzelii
KAILKTNADKTKGAE

SEQ ID NO: 130388 - protein, 9 aa, Borrelia afzelii
ILKTNADKT

SEQ ID NO: 130389 - protein, 15 aa, Borrelia afzelii
LFLFISCNNSGKGGD

SEQ ID NO: 130390 - protein, 9 aa, Borrelia afzelii
LFISCNNSG

SEQ ID NO: 130391 - protein, 15 aa, Borrelia afzelii
DAKKAILKTNADKTK

SEQ ID NO: 130392 - protein, 9 aa, Borrelia afzelii
ILKTNADKT

SEQ ID NO: 130393 - protein, 15 aa, Borrelia afzelii
DDAKKAILKTNADKT

SEQ ID NO: 130394 - protein, 9 aa, Borrelia afzelii
AILKTNADK

SEQ ID NO: 130395 - protein, 15 aa, Borrelia afzelii
LAVKEVETLVSSIDE

SEQ ID NO: 130396 - protein, 9 aa, Borrelia afzelii
VKEVETLVS

SEQ ID NO: 130397 - protein, 15 aa, Borrelia afzelii
VLAVKEVETLVSSID

SEQ ID NO: 130398 - protein, 9 aa, Borrelia afzelii
VKEVETLVS

SEQ ID NO: 130399 - protein, 15 aa, Borrelia afzelii
VKEVETLVSSIDELA

SEQ ID NO: 130400 - protein, 9 aa, Borrelia afzelii
VKEVETLVS

SEQ ID NO: 130401 - protein, 15 aa, Borrelia afzelii
AVKEVETLVSSIDEL

SEQ ID NO: 130402 - protein, 9 aa, Borrelia afzelii
VKEVETLVS

SEQ ID NO: 130403 - protein, 15 aa, Borrelia afzelii
NAFVLAVKEVETLVS

SEQ ID NO: 130404 - protein, 9 aa, Borrelia afzelii
FVLAVKEVE

SEQ ID NO: 130405 - protein, 15 aa, Borrelia afzelii
TNSVKELTSPVVAES

SEQ ID NO: 130406 - protein, 9 aa, Borrelia afzelii
VKELTSPVV

SEQ ID NO: 130407 - protein, 15 aa, Borrelia afzelii
LTNSVKELTSPVVAE

SEQ ID NO: 130408 - protein, 9 aa, Borrelia afzelii
VKELTSPVV

SEQ ID NO: 130409 - protein, 15 aa, Borrelia afzelii
NSVKELTSPVVAESP

SEQ ID NO: 130410 - protein, 9 aa, Borrelia afzelii
VKELTSPVV

SEQ ID NO: 130411 - protein, 15 aa, Borrelia afzelii
AFVLAVKEVETLVSS

SEQ ID NO: 130412 - protein, 9 aa, Borrelia afzelii
VKEVETLVS

SEQ ID NO: 130413 - protein, 15 aa, Borrelia afzelii
FVLAVKEVETLVSSI

SEQ ID NO: 130414 - protein, 9 aa, Borrelia afzelii
VKEVETLVS

SEQ ID NO: 130415 - protein, 15 aa, Borrelia afzelii
ALTNSVKELTSPVVA

SEQ ID NO: 130416 - protein, 9 aa, Borrelia afzelii
VKELTSPVV

SEQ ID NO: 130417 - protein, 15 aa, Borrelia afzelii
EALTNSVKELTSPVV

SEQ ID NO: 130418 - protein, 9 aa, Borrelia afzelii
SVKELTSPV

SEQ ID NO: 130419 - protein, 15 aa, Borrelia afzelii
LTNSVKELTSPVVAE

SEQ ID NO: 130420 - protein, 9 aa, Borrelia afzelii
VKELTSPVV

SEQ ID NO: 130421 - protein, 15 aa, Borrelia afzelii
TNSVKELTSPVVAES

SEQ ID NO: 130422 - protein, 9 aa, Borrelia afzelii
VKELTSPVV

SEQ ID NO: 130423 - protein, 15 aa, Borrelia afzelii
NSVKELTSPVVAESP

SEQ ID NO: 130424 - protein, 9 aa, Borrelia afzelii
VKELTSPVV

SEQ ID NO: 130425 - protein, 15 aa, Borrelia afzelii
SVKELTSPVVAESPK

SEQ ID NO: 130426 - protein, 9 aa, Borrelia afzelii
VKELTSPVV

SEQ ID NO: 130427 - protein, 15 aa, Borrelia afzelii
VKELTSPVVAESPKK

SEQ ID NO: 130428 - protein, 9 aa, Borrelia afzelii
VKELTSPVV

SEQ ID NO: 130429 - protein, 15 aa, Borrelia afzelii
EISKKITDSNAFVLA

SEQ ID NO: 130430 - protein, 9 aa, Borrelia afzelii
ITDSNAFVL

SEQ ID NO: 130431 - protein, 15 aa, Borrelia afzelii
TEISKKITDSNAFVL

SEQ ID NO: 130432 - protein, 9 aa, Borrelia afzelii
SKKITDSNA

SEQ ID NO: 130433 - protein, 15 aa, Borrelia afzelii
ISKKITDSNAFVLAV

SEQ ID NO: 130434 - protein, 9 aa, Borrelia afzelii
ITDSNAFVL

SEQ ID NO: 130435 - protein, 15 aa, Borrelia afzelii
SKKITDSNAFVLAVK

SEQ ID NO: 130436 - protein, 9 aa, Borrelia afzelii
ITDSNAFVL

SEQ ID NO: 130437 - protein, 15 aa, Borrelia afzelii
KKITDSNAFVLAVKE

SEQ ID NO: 130438 - protein, 9 aa, Borrelia afzelii
ITDSNAFVL

SEQ ID NO: 130439 - protein, 15 aa, Borrelia afzelii
KITDSNAFVLAVKEV

SEQ ID NO: 130440 - protein, 9 aa, Borrelia afzelii
ITDSNAFVL

SEQ ID NO: 130441 - protein, 15 aa, Borrelia afzelii
ITDSNAFVLAVKEVE

SEQ ID NO: 130442 - protein, 9 aa, Borrelia afzelii
ITDSNAFVL

SEQ ID NO: 130443 - protein, 15 aa, Borrelia afzelii
EGLVKAAQEALTNSV

SEQ ID NO: 130444 - protein, 9 aa, Borrelia afzelii
LVKAAQEAL

SEQ ID NO: 130445 - protein, 15 aa, Borrelia afzelii
KSVEGLVKAAQEALT

SEQ ID NO: 130446 - protein, 9 aa, Borrelia afzelii
LVKAAQEAL

SEQ ID NO: 130447 - protein, 15 aa, Borrelia afzelii
SVEGLVKAAQEALTN

SEQ ID NO: 130448 - protein, 9 aa, Borrelia afzelii
LVKAAQEAL

SEQ ID NO: 130449 - protein, 15 aa, Borrelia afzelii
VEGLVKAAQEALTNS

SEQ ID NO: 130450 - protein, 9 aa, Borrelia afzelii
LVKAAQEAL

SEQ ID NO: 130451 - protein, 15 aa, Borrelia afzelii
FKSVEGLVKAAQEAL

SEQ ID NO: 130452 - protein, 9 aa, Borrelia afzelii
VEGLVKAAQ

SEQ ID NO: 130453 - protein, 15 aa, Borrelia afzelii
KKCSEEFTNKLRVSH

SEQ ID NO: 130454 - protein, 9 aa, Borrelia afzelii
EFTNKLRVS

SEQ ID NO: 130455 - protein, 15 aa, Borrelia afzelii
KCSEEFTNKLRVSHA

SEQ ID NO: 130456 - protein, 9 aa, Borrelia afzelii
FTNKLRVSH

SEQ ID NO: 130457 - protein, 15 aa, Borrelia afzelii
CSEEFTNKLRVSHAD

SEQ ID NO: 130458 - protein, 9 aa, Borrelia afzelii
FTNKLRVSH

SEQ ID NO: 130459 - protein, 15 aa, Borrelia afzelii
SEEFTNKLRVSHADL

SEQ ID NO: 130460 - protein, 9 aa, Borrelia afzelii
FTNKLRVSH

SEQ ID NO: 130461 - protein, 15 aa, Borrelia afzelii
EEFTNKLRVSHADLG

SEQ ID NO: 130462 - protein, 9 aa, Borrelia afzelii
FTNKLRVSH

SEQ ID NO: 130463 - protein, 15 aa, Borrelia afzelii
EFTNKLRVSHADLGK

SEQ ID NO: 130464 - protein, 9 aa, Borrelia afzelii
FTNKLRVSH

SEQ ID NO: 130465 - protein, 15 aa, Borrelia afzelii
FTNKLRVSHADLGKQ

SEQ ID NO: 130466 - protein, 9 aa, Borrelia afzelii
FTNKLRVSH

SEQ ID NO: 130467 - protein, 15 aa, Borrelia afzelii
EALTNSVKELTSPVV

SEQ ID NO: 130468 - protein, 9 aa, Borrelia afzelii
LTNSVKELT

SEQ ID NO: 130469 - protein, 15 aa, Borrelia afzelii
QEALTNSVKELTSPV

SEQ ID NO: 130470 - protein, 9 aa, Borrelia afzelii
LTNSVKELT

SEQ ID NO: 130471 - protein, 15 aa, Borrelia afzelii
AAQEALTNSVKELTS

SEQ ID NO: 130472 - protein, 9 aa, Borrelia afzelii
LTNSVKELT

SEQ ID NO: 130473 - protein, 15 aa, Borrelia afzelii
AQEALTNSVKELTSP

SEQ ID NO: 130474 - protein, 9 aa, Borrelia afzelii
LTNSVKELT

SEQ ID NO: 130475 - protein, 15 aa, Borrelia afzelii
ALTNSVKELTSPVVA

SEQ ID NO: 130476 - protein, 9 aa, Borrelia afzelii
LTNSVKELT

SEQ ID NO: 130477 - protein, 15 aa, Borrelia afzelii
KAAQEALTNSVKELT

SEQ ID NO: 130478 - protein, 9 aa, Borrelia afzelii
ALTNSVKEL

SEQ ID NO: 130479 - protein, 15 aa, Borrelia afzelii
LTNSVKELTSPVVAE

SEQ ID NO: 130480 - protein, 9 aa, Borrelia afzelii
LTNSVKELT

SEQ ID NO: 130481 - protein, 15 aa, Borrelia afzelii
MKKNTLSAILMTLFL

SEQ ID NO: 130482 - protein, 9 aa, Borrelia afzelii
MKKNTLSAI

SEQ ID NO: 130483 - protein, 15 aa, Borrelia afzelii
LAGVHEISTLITEKL

SEQ ID NO: 130484 - protein, 9 aa, Borrelia afzelii
VHEISTLIT

SEQ ID NO: 130485 - protein, 15 aa, Borrelia afzelii
AGVHEISTLITEKLS

SEQ ID NO: 130486 - protein, 9 aa, Borrelia afzelii
ISTLITEKL

SEQ ID NO: 130487 - protein, 15 aa, Borrelia afzelii
ALTNSVKELTSPVVA

SEQ ID NO: 130488 - protein, 9 aa, Borrelia afzelii
VKELTSPVV

SEQ ID NO: 130489 - protein, 15 aa, Borrelia afzelii
EALTNSVKELTSPVV

SEQ ID NO: 130490 - protein, 9 aa, Borrelia afzelii
NSVKELTSP

SEQ ID NO: 130491 - protein, 15 aa, Borrelia afzelii
LTNSVKELTSPVVAE

SEQ ID NO: 130492 - protein, 9 aa, Borrelia afzelii
VKELTSPVV

SEQ ID NO: 130493 - protein, 15 aa, Borrelia afzelii
TNSVKELTSPVVAES

SEQ ID NO: 130494 - protein, 9 aa, Borrelia afzelii
VKELTSPVV

SEQ ID NO: 130495 - protein, 15 aa, Borrelia afzelii
NSVKELTSPVVAESP

SEQ ID NO: 130496 - protein, 9 aa, Borrelia afzelii
VKELTSPVV

SEQ ID NO: 130497 - protein, 15 aa, Borrelia afzelii
VKELTSPVVAESPKK

SEQ ID NO: 130498 - protein, 9 aa, Borrelia afzelii
VKELTSPVV

SEQ ID NO: 130499 - protein, 15 aa, Borrelia garinii
NNFVKAMTNVGSFKT

SEQ ID NO: 130500 - protein, 9 aa, Borrelia garinii
VKAMTNVGS

SEQ ID NO: 130501 - protein, 15 aa, Borrelia garinii
NFVKAMTNVGSFKTS

SEQ ID NO: 130502 - protein, 9 aa, Borrelia garinii
VKAMTNVGS

SEQ ID NO: 130503 - protein, 15 aa, Borrelia garinii
AEVNNFVKAMTNVGS

SEQ ID NO: 130504 - protein, 9 aa, Borrelia garinii
FVKAMTNVG

SEQ ID NO: 130505 - protein, 15 aa, Borrelia garinii
VNNFVKAMTNVGSFK

SEQ ID NO: 130506 - protein, 9 aa, Borrelia garinii
VKAMTNVGS

SEQ ID NO: 130507 - protein, 15 aa, Borrelia garinii
EVNNFVKAMTNVGSF

SEQ ID NO: 130508 - protein, 9 aa, Borrelia garinii
VKAMTNVGS

SEQ ID NO: 130509 - protein, 15 aa, Borrelia garinii
FVKAMTNVGSFKTSL

SEQ ID NO: 130510 - protein, 9 aa, Borrelia garinii
MTNVGSFKT

SEQ ID NO: 130511 - protein, 15 aa, Borrelia garinii
VKAMTNVGSFKTSLY

SEQ ID NO: 130512 - protein, 9 aa, Borrelia garinii
MTNVGSFKT

SEQ ID NO: 130513 - protein, 15 aa, Borrelia garinii
NGDWSNLGTLVIRKE

SEQ ID NO: 130514 - protein, 9 aa, Borrelia garinii
WSNLGTLVI

SEQ ID NO: 130515 - protein, 15 aa, Borrelia garinii
GTINGQLRGHSATFF

SEQ ID NO: 130516 - protein, 9 aa, Borrelia garinii
NGQLRGHSA

SEQ ID NO: 130517 - protein, 15 aa, Borrelia garinii
GDWSNLGTLVIRKEQ

SEQ ID NO: 130518 - protein, 9 aa, Borrelia garinii
WSNLGTLVI

SEQ ID NO: 130519 - protein, 15 aa, Borrelia garinii
NNGDWSNLGTLVIRK

SEQ ID NO: 130520 - protein, 9 aa, Borrelia garinii
WSNLGTLVI

SEQ ID NO: 130521 - protein, 15 aa, Borrelia garinii
TINGQLRGHSATFFC

SEQ ID NO: 130522 - protein, 9 aa, Borrelia garinii
LRGHSATFF

SEQ ID NO: 130523 - protein, 15 aa, Borrelia garinii
DNNGDWSNLGTLVIR

SEQ ID NO: 130524 - protein, 9 aa, Borrelia garinii
WSNLGTLVI

SEQ ID NO: 130525 - protein, 15 aa, Borrelia garinii
KDNNGDWSNLGTLVI

SEQ ID NO: 130526 - protein, 9 aa, Borrelia garinii
DWSNLGTLV

SEQ ID NO: 130527 - protein, 15 aa, Borrelia garinii
INGQLRGHSATFFCI

SEQ ID NO: 130528 - protein, 9 aa, Borrelia garinii
LRGHSATFF

SEQ ID NO: 130529 - protein, 15 aa, Borrelia garinii
NGQLRGHSATFFCIE

SEQ ID NO: 130530 - protein, 9 aa, Borrelia garinii
LRGHSATFF

SEQ ID NO: 130531 - protein, 15 aa, Borrelia garinii
LSDQGGLSGQASSDT

SEQ ID NO: 130532 - protein, 9 aa, Borrelia garinii
QGGLSGQAS

SEQ ID NO: 130533 - protein, 15 aa, Borrelia garinii
SDQGGLSGQASSDTI

SEQ ID NO: 130534 - protein, 9 aa, Borrelia garinii
LSGQASSDT

SEQ ID NO: 130535 - protein, 15 aa, Borrelia garinii
GQLRGHSATFFCIEE

SEQ ID NO: 130536 - protein, 9 aa, Borrelia garinii
LRGHSATFF

SEQ ID NO: 130537 - protein, 15 aa, Borrelia garinii
DQGGLSGQASSDTIK

SEQ ID NO: 130538 - protein, 9 aa, Borrelia garinii
LSGQASSDT

SEQ ID NO: 130539 - protein, 15 aa, Borrelia garinii
QGGLSGQASSDTIKF

SEQ ID NO: 130540 - protein, 9 aa, Borrelia garinii
LSGQASSDT

SEQ ID NO: 130541 - protein, 15 aa, Borrelia garinii
GGLSGQASSDTIKFS

SEQ ID NO: 130542 - protein, 9 aa, Borrelia garinii
LSGQASSDT

SEQ ID NO: 130543 - protein, 15 aa, Borrelia garinii
KAMTNVGSFKTSLYY

SEQ ID NO: 130544 - protein, 9 aa, Borrelia garinii
MTNVGSFKT

SEQ ID NO: 130545 - protein, 15 aa, Borrelia garinii
EAEVNNFVKAMTNVG

SEQ ID NO: 130546 - protein, 9 aa, Borrelia garinii
VNNFVKAMT

SEQ ID NO: 130547 - protein, 15 aa, Borrelia garinii
KMKMFIICAVFVLIS

SEQ ID NO: 130548 - protein, 9 aa, Borrelia garinii
MFIICAVFV

SEQ ID NO: 130549 - protein, 15 aa, Borrelia garinii
MKMFIICAVFVLISS

SEQ ID NO: 130550 - protein, 9 aa, Borrelia garinii
MFIICAVFV

SEQ ID NO: 130551 - protein, 15 aa, Borrelia garinii
KKMKMFIICAVFVLI

SEQ ID NO: 130552 - protein, 9 aa, Borrelia garinii
MFIICAVFV

SEQ ID NO: 130553 - protein, 15 aa, Borrelia garinii
NKKMKMFIICAVFVL

SEQ ID NO: 130554 - protein, 9 aa, Borrelia garinii
MFIICAVFV

SEQ ID NO: 130555 - protein, 15 aa, Borrelia garinii
MNKKMKMFIICAVFV

SEQ ID NO: 130556 - protein, 9 aa, Borrelia garinii
MKMFIICAV

SEQ ID NO: 130557 - protein, 15 aa, Borrelia garinii
MFIICAVFVLISSCG

SEQ ID NO: 130558 - protein, 9 aa, Borrelia garinii
MFIICAVFV

SEQ ID NO: 130559 - protein, 15 aa, Borrelia garinii
DWSNLGTLVIRKEQD

SEQ ID NO: 130560 - protein, 9 aa, Borrelia garinii
WSNLGTLVI

SEQ ID NO: 130561 - protein, 15 aa, Borrelia garinii
WSNLGTLVIRKEQDG

SEQ ID NO: 130562 - protein, 9 aa, Borrelia garinii
WSNLGTLVI

SEQ ID NO: 130563 - protein, 15 aa, Borrelia garinii
FIICAVFVLISSCGN

SEQ ID NO: 130564 - protein, 9 aa, Borrelia garinii
VFVLISSCG

SEQ ID NO: 130565 - protein, 15 aa, Borrelia garinii
ICAVFVLISSCGNFR

SEQ ID NO: 130566 - protein, 9 aa, Borrelia garinii
VFVLISSCG

SEQ ID NO: 130567 - protein, 15 aa, Borrelia garinii
MTNVGSFKTSLYYGY

SEQ ID NO: 130568 - protein, 9 aa, Borrelia garinii
MTNVGSFKT

SEQ ID NO: 130569 - protein, 15 aa, Borrelia garinii
CAVFVLISSCGNFRS

SEQ ID NO: 130570 - protein, 9 aa, Borrelia garinii
VFVLISSCG

SEQ ID NO: 130571 - protein, 15 aa, Borrelia garinii
KMFIICAVFVLISSC

SEQ ID NO: 130572 - protein, 9 aa, Borrelia garinii
MFIICAVFV

SEQ ID NO: 130573 - protein, 15 aa, Borrelia garinii
IICAVFVLISSCGNF

SEQ ID NO: 130574 - protein, 9 aa, Borrelia garinii
VFVLISSCG

SEQ ID NO: 130575 - protein, 15 aa, Borrelia garinii
QLRGHSATFFCIEEA

SEQ ID NO: 130576 - protein, 9 aa, Borrelia garinii
LRGHSATFF

SEQ ID NO: 130577 - protein, 15 aa, Borrelia garinii
LRGHSATFFCIEEAE

SEQ ID NO: 130578 - protein, 9 aa, Borrelia garinii
LRGHSATFF

SEQ ID NO: 130579 - protein, 15 aa, Borrelia garinii
AMTNVGSFKTSLYYG

SEQ ID NO: 130580 - protein, 9 aa, Borrelia garinii
MTNVGSFKT

SEQ ID NO: 130581 - protein, 15 aa, Borrelia garinii
SSCGNFRSSLSDQGS

SEQ ID NO: 130582 - protein, 9 aa, Borrelia garinii
FRSSLSDQG

SEQ ID NO: 130583 - protein, 15 aa, Borrelia garinii
GLSGQASSDTIKFSE

SEQ ID NO: 130584 - protein, 9 aa, Borrelia garinii
LSGQASSDT

SEQ ID NO: 130585 - protein, 15 aa, Borrelia garinii
LSGQASSDTIKFSEF

SEQ ID NO: 130586 - protein, 9 aa, Borrelia garinii
LSGQASSDT

SEQ ID NO: 130587 - protein, 15 aa, Borrelia garinii
ISSCGNFRSSLSDQG

SEQ ID NO: 130588 - protein, 9 aa, Borrelia garinii
CGNFRSSLS

SEQ ID NO: 130589 - protein, 15 aa, Borrelia garinii
CGNFRSSLSDQGSLS

SEQ ID NO: 130590 - protein, 9 aa, Borrelia garinii
FRSSLSDQG

SEQ ID NO: 130591 - protein, 15 aa, Borrelia garinii
SCGNFRSSLSDQGSL

SEQ ID NO: 130592 - protein, 9 aa, Borrelia garinii
FRSSLSDQG

SEQ ID NO: 130593 - protein, 15 aa, Borrelia garinii
GNFRSSLSDQGSLSD

SEQ ID NO: 130594 - protein, 9 aa, Borrelia garinii
FRSSLSDQG

SEQ ID NO: 130595 - protein, 15 aa, Borrelia garinii
AVFVLISSCGNFRSS

SEQ ID NO: 130596 - protein, 9 aa, Borrelia garinii
VFVLISSCG

SEQ ID NO: 130597 - protein, 15 aa, Borrelia garinii
DGVETGLNVIGTING

SEQ ID NO: 130598 - protein, 9 aa, Borrelia garinii
VETGLNVIG

SEQ ID NO: 130599 - protein, 15 aa, Borrelia garinii
ETGLNVIGTINGQLR

SEQ ID NO: 130600 - protein, 9 aa, Borrelia garinii
LNVIGTING

SEQ ID NO: 130601 - protein, 15 aa, Borrelia garinii
TGLNVIGTINGQLRG

SEQ ID NO: 130602 - protein, 9 aa, Borrelia garinii
LNVIGTING

SEQ ID NO: 130603 - protein, 15 aa, Borrelia garinii
VFVLISSCGNFRSSL

SEQ ID NO: 130604 - protein, 9 aa, Borrelia garinii
VFVLISSCG

SEQ ID NO: 130605 - protein, 15 aa, Borrelia garinii
GVETGLNVIGTINGQ

SEQ ID NO: 130606 - protein, 9 aa, Borrelia garinii
LNVIGTING

SEQ ID NO: 130607 - protein, 15 aa, Borrelia garinii
VETGLNVIGTINGQL

SEQ ID NO: 130608 - protein, 9 aa, Borrelia garinii
LNVIGTING

SEQ ID NO: 130609 - protein, 15 aa, Borrelia garinii
LNVIGTINGQLRGHS

SEQ ID NO: 130610 - protein, 9 aa, Borrelia garinii
IGTINGQLR

SEQ ID NO: 130611 - protein, 15 aa, Borrelia garinii
NVIGTINGQLRGHSA

SEQ ID NO: 130612 - protein, 9 aa, Borrelia garinii
IGTINGQLR

SEQ ID NO: 130613 - protein, 15 aa, Borrelia garinii
GSLSDQGGLSGQASS

SEQ ID NO: 130614 - protein, 9 aa, Borrelia garinii
LSDQGGLSG

SEQ ID NO: 130615 - protein, 15 aa, Borrelia garinii
QGSLSDQGGLSGQAS

SEQ ID NO: 130616 - protein, 9 aa, Borrelia garinii
LSDQGGLSG

SEQ ID NO: 130617 - protein, 15 aa, Borrelia garinii
QDGVETGLNVIGTIN

SEQ ID NO: 130618 - protein, 9 aa, Borrelia garinii
VETGLNVIG

SEQ ID NO: 130619 - protein, 15 aa, Borrelia garinii
GLNVIGTINGQLRGH

SEQ ID NO: 130620 - protein, 9 aa, Borrelia garinii
IGTINGQLR

SEQ ID NO: 130621 - protein, 15 aa, Borrelia garinii
EQDGVETGLNVIGTI

SEQ ID NO: 130622 - protein, 9 aa, Borrelia garinii
VETGLNVIG

SEQ ID NO: 130623 - protein, 15 aa, Borrelia garinii
KEQDGVETGLNVIGT

SEQ ID NO: 130624 - protein, 9 aa, Borrelia garinii
VETGLNVIG

SEQ ID NO: 130625 - protein, 15 aa, Borrelia garinii
NFRSSLSDQGSLSDQ

SEQ ID NO: 130626 - protein, 9 aa, Borrelia garinii
FRSSLSDQG

SEQ ID NO: 130627 - protein, 15 aa, Borrelia garinii
FVLISSCGNFRSSLS

SEQ ID NO: 130628 - protein, 9 aa, Borrelia garinii
FVLISSCGN

SEQ ID NO: 130629 - protein, 15 aa, Borrelia garinii
AEVNNFVKAMTNVGS

SEQ ID NO: 130630 - protein, 9 aa, Borrelia garinii
FVKAMTNVG

SEQ ID NO: 130631 - protein, 15 aa, Borrelia garinii
VNNFVKAMTNVGSFK

SEQ ID NO: 130632 - protein, 9 aa, Borrelia garinii
FVKAMTNVG

SEQ ID NO: 130633 - protein, 15 aa, Borrelia garinii
NNFVKAMTNVGSFKT

SEQ ID NO: 130634 - protein, 9 aa, Borrelia garinii
FVKAMTNVG

SEQ ID NO: 130635 - protein, 15 aa, Borrelia garinii
EVNNFVKAMTNVGSF

SEQ ID NO: 130636 - protein, 9 aa, Borrelia garinii
FVKAMTNVG

SEQ ID NO: 130637 - protein, 15 aa, Borrelia garinii
EAEVNNFVKAMTNVG

SEQ ID NO: 130638 - protein, 9 aa, Borrelia garinii
VNNFVKAMT

SEQ ID NO: 130639 - protein, 15 aa, Borrelia garinii
NFVKAMTNVGSFKTS

SEQ ID NO: 130640 - protein, 9 aa, Borrelia garinii
FVKAMTNVG

SEQ ID NO: 130641 - protein, 15 aa, Borrelia garinii
FVKAMTNVGSFKTSL

SEQ ID NO: 130642 - protein, 9 aa, Borrelia garinii
FVKAMTNVG

SEQ ID NO: 130643 - protein, 15 aa, Borrelia garinii
IKNKKDNNGDWSNLG

SEQ ID NO: 130644 - protein, 9 aa, Borrelia garinii
IKNKKDNNG

SEQ ID NO: 130645 - protein, 15 aa, Borrelia garinii
KNKKDNNGDWSNLGT

SEQ ID NO: 130646 - protein, 9 aa, Borrelia garinii
NNGDWSNLG

SEQ ID NO: 130647 - protein, 15 aa, Borrelia garinii
NKKDNNGDWSNLGTL

SEQ ID NO: 130648 - protein, 9 aa, Borrelia garinii
NNGDWSNLG

SEQ ID NO: 130649 - protein, 15 aa, Borrelia garinii
KKDNNGDWSNLGTLV

SEQ ID NO: 130650 - protein, 9 aa, Borrelia garinii
NNGDWSNLG

SEQ ID NO: 130651 - protein, 15 aa, Borrelia garinii
KDNNGDWSNLGTLVI

SEQ ID NO: 130652 - protein, 9 aa, Borrelia garinii
NNGDWSNLG

SEQ ID NO: 130653 - protein, 15 aa, Borrelia garinii
AEVNNFVKAMTNVGS

SEQ ID NO: 130654 - protein, 9 aa, Borrelia garinii
FVKAMTNVG

SEQ ID NO: 130655 - protein, 15 aa, Borrelia garinii
NNFVKAMTNVGSFKT

SEQ ID NO: 130656 - protein, 9 aa, Borrelia garinii
FVKAMTNVG

SEQ ID NO: 130657 - protein, 15 aa, Borrelia garinii
VNNFVKAMTNVGSFK

SEQ ID NO: 130658 - protein, 9 aa, Borrelia garinii
FVKAMTNVG

SEQ ID NO: 130659 - protein, 15 aa, Borrelia garinii
EVNNFVKAMTNVGSF

SEQ ID NO: 130660 - protein, 9 aa, Borrelia garinii
FVKAMTNVG

SEQ ID NO: 130661 - protein, 15 aa, Borrelia garinii
EAEVNNFVKAMTNVG

SEQ ID NO: 130662 - protein, 9 aa, Borrelia garinii
VNNFVKAMT

SEQ ID NO: 130663 - protein, 15 aa, Borrelia garinii
CAVFVLISSCGNFRS

SEQ ID NO: 130664 - protein, 9 aa, Borrelia garinii
VFVLISSCG

SEQ ID NO: 130665 - protein, 15 aa, Borrelia garinii
ICAVFVLISSCGNFR

SEQ ID NO: 130666 - protein, 9 aa, Borrelia garinii
VFVLISSCG

SEQ ID NO: 130667 - protein, 15 aa, Borrelia garinii
NFVKAMTNVGSFKTS

SEQ ID NO: 130668 - protein, 9 aa, Borrelia garinii
FVKAMTNVG

SEQ ID NO: 130669 - protein, 15 aa, Borrelia garinii
AEVNNFVKAMTNVGS

SEQ ID NO: 130670 - protein, 9 aa, Borrelia garinii
FVKAMTNVG

SEQ ID NO: 130671 - protein, 15 aa, Borrelia garinii
VNNFVKAMTNVGSFK

SEQ ID NO: 130672 - protein, 9 aa, Borrelia garinii
VKAMTNVGS

SEQ ID NO: 130673 - protein, 15 aa, Borrelia garinii
NNFVKAMTNVGSFKT

SEQ ID NO: 130674 - protein, 9 aa, Borrelia garinii
VKAMTNVGS

SEQ ID NO: 130675 - protein, 15 aa, Borrelia garinii
EVNNFVKAMTNVGSF

SEQ ID NO: 130676 - protein, 9 aa, Borrelia garinii
VKAMTNVGS

SEQ ID NO: 130677 - protein, 15 aa, Borrelia garinii
NFVKAMTNVGSFKTS

SEQ ID NO: 130678 - protein, 9 aa, Borrelia garinii
VKAMTNVGS

SEQ ID NO: 130679 - protein, 15 aa, Borrelia garinii
KDNNGDWSNLGTLVI

SEQ ID NO: 130680 - protein, 9 aa, Borrelia garinii
NNGDWSNLG

SEQ ID NO: 130681 - protein, 15 aa, Borrelia garinii
IKFSEFTVNIKNKKD

SEQ ID NO: 130682 - protein, 9 aa, Borrelia garinii
FSEFTVNIK

SEQ ID NO: 130683 - protein, 15 aa, Borrelia garinii
VKAMTNVGSFKTSLY

SEQ ID NO: 130684 - protein, 9 aa, Borrelia garinii
VKAMTNVGS

SEQ ID NO: 130685 - protein, 15 aa, Borrelia garinii
DNNGDWSNLGTLVIR

SEQ ID NO: 130686 - protein, 9 aa, Borrelia garinii
WSNLGTLVI

SEQ ID NO: 130687 - protein, 15 aa, Borrelia garinii
NNGDWSNLGTLVIRK

SEQ ID NO: 130688 - protein, 9 aa, Borrelia garinii
WSNLGTLVI

SEQ ID NO: 130689 - protein, 15 aa, Borrelia garinii
KDNNGDWSNLGTLVI

SEQ ID NO: 130690 - protein, 9 aa, Borrelia garinii
DWSNLGTLV

SEQ ID NO: 130691 - protein, 15 aa, Borrelia garinii
DNNGDWSNLGTLVIR

SEQ ID NO: 130692 - protein, 9 aa, Borrelia garinii
WSNLGTLVI

SEQ ID NO: 130693 - protein, 15 aa, Borrelia garinii
NNGDWSNLGTLVIRK

SEQ ID NO: 130694 - protein, 9 aa, Borrelia garinii
WSNLGTLVI

SEQ ID NO: 130695 - protein, 15 aa, Borrelia garinii
NGDWSNLGTLVIRKE

SEQ ID NO: 130696 - protein, 9 aa, Borrelia garinii
WSNLGTLVI

SEQ ID NO: 130697 - protein, 15 aa, Borrelia garinii
GDWSNLGTLVIRKEQ

SEQ ID NO: 130698 - protein, 9 aa, Borrelia garinii
WSNLGTLVI

SEQ ID NO: 130699 - protein, 15 aa, Borrelia garinii
KKMKMFIICAVFVLI

SEQ ID NO: 130700 - protein, 9 aa, Borrelia garinii
FIICAVFVL

SEQ ID NO: 130701 - protein, 15 aa, Borrelia garinii
KMKMFIICAVFVLIS

SEQ ID NO: 130702 - protein, 9 aa, Borrelia garinii
FIICAVFVL

SEQ ID NO: 130703 - protein, 15 aa, Borrelia garinii
MKMFIICAVFVLISS

SEQ ID NO: 130704 - protein, 9 aa, Borrelia garinii
FIICAVFVL

SEQ ID NO: 130705 - protein, 15 aa, Borrelia garinii
NKKMKMFIICAVFVL

SEQ ID NO: 130706 - protein, 9 aa, Borrelia garinii
MFIICAVFV

SEQ ID NO: 130707 - protein, 15 aa, Borrelia garinii
KMFIICAVFVLISSC

SEQ ID NO: 130708 - protein, 9 aa, Borrelia garinii
FIICAVFVL

SEQ ID NO: 130709 - protein, 15 aa, Borrelia garinii
MFIICAVFVLISSCG

SEQ ID NO: 130710 - protein, 9 aa, Borrelia garinii
FIICAVFVL

SEQ ID NO: 130711 - protein, 15 aa, Borrelia garinii
NNFVKAMTNVGSFKT

SEQ ID NO: 130712 - protein, 9 aa, Borrelia garinii
FVKAMTNVG

SEQ ID NO: 130713 - protein, 15 aa, Borrelia garinii
AEVNNFVKAMTNVGS

SEQ ID NO: 130714 - protein, 9 aa, Borrelia garinii
FVKAMTNVG

SEQ ID NO: 130715 - protein, 15 aa, Borrelia garinii
EVNNFVKAMTNVGSF

SEQ ID NO: 130716 - protein, 9 aa, Borrelia garinii
FVKAMTNVG

SEQ ID NO: 130717 - protein, 15 aa, Borrelia garinii
VNNFVKAMTNVGSFK

SEQ ID NO: 130718 - protein, 9 aa, Borrelia garinii
FVKAMTNVG

SEQ ID NO: 130719 - protein, 15 aa, Borrelia garinii
EAEVNNFVKAMTNVG

SEQ ID NO: 130720 - protein, 9 aa, Borrelia garinii
VNNFVKAMT

SEQ ID NO: 130721 - protein, 15 aa, Borrelia garinii
NFVKAMTNVGSFKTS

SEQ ID NO: 130722 - protein, 9 aa, Borrelia garinii
FVKAMTNVG

SEQ ID NO: 130723 - protein, 15 aa, Borrelia garinii
FVKAMTNVGSFKTSL

SEQ ID NO: 130724 - protein, 9 aa, Borrelia garinii
FVKAMTNVG

SEQ ID NO: 130725 - protein, 15 aa, Borrelia garinii
NNFVKAMTNVGSFKT

SEQ ID NO: 130726 - protein, 9 aa, Borrelia garinii
VKAMTNVGS

SEQ ID NO: 130727 - protein, 15 aa, Borrelia garinii
NFVKAMTNVGSFKTS

SEQ ID NO: 130728 - protein, 9 aa, Borrelia garinii
MTNVGSFKT

SEQ ID NO: 130729 - protein, 15 aa, Borrelia garinii
AEVNNFVKAMTNVGS

SEQ ID NO: 130730 - protein, 9 aa, Borrelia garinii
VNNFVKAMT

SEQ ID NO: 130731 - protein, 15 aa, Borrelia garinii
EAEVNNFVKAMTNVG

SEQ ID NO: 130732 - protein, 9 aa, Borrelia garinii
VNNFVKAMT

SEQ ID NO: 130733 - protein, 15 aa, Borrelia garinii
VKAMTNVGSFKTSLY

SEQ ID NO: 130734 - protein, 9 aa, Borrelia garinii
MTNVGSFKT

SEQ ID NO: 130735 - protein, 15 aa, Borrelia garinii
ETGLNVIGTINGQLR

SEQ ID NO: 130736 - protein, 9 aa, Borrelia garinii
LNVIGTING

SEQ ID NO: 130737 - protein, 15 aa, Borrelia garinii
TGLNVIGTINGQLRG

SEQ ID NO: 130738 - protein, 9 aa, Borrelia garinii
LNVIGTING

SEQ ID NO: 130739 - protein, 15 aa, Borrelia garinii
KAMTNVGSFKTSLYY

SEQ ID NO: 130740 - protein, 9 aa, Borrelia garinii
VGSFKTSLY

SEQ ID NO: 130741 - protein, 15 aa, Borrelia garinii
SEFTVNIKNKKDNNG

SEQ ID NO: 130742 - protein, 9 aa, Borrelia garinii
FTVNIKNKK

SEQ ID NO: 130743 - protein, 15 aa, Borrelia garinii
EVNNFVKAMTNVGSF

SEQ ID NO: 130744 - protein, 9 aa, Borrelia garinii
FVKAMTNVG

SEQ ID NO: 130745 - protein, 15 aa, Borrelia garinii
VNNFVKAMTNVGSFK

SEQ ID NO: 130746 - protein, 9 aa, Borrelia garinii
FVKAMTNVG

SEQ ID NO: 130747 - protein, 15 aa, Borrelia garinii
NGDWSNLGTLVIRKE

SEQ ID NO: 130748 - protein, 9 aa, Borrelia garinii
WSNLGTLVI

SEQ ID NO: 130749 - protein, 15 aa, Borrelia garinii
NNFVKAMTNVGSFKT

SEQ ID NO: 130750 - protein, 9 aa, Borrelia garinii
FVKAMTNVG

SEQ ID NO: 130751 - protein, 15 aa, Borrelia garinii
KFSEFTVNIKNKKDN

SEQ ID NO: 130752 - protein, 9 aa, Borrelia garinii
FTVNIKNKK

SEQ ID NO: 130753 - protein, 15 aa, Borrelia garinii
FSEFTVNIKNKKDNN

SEQ ID NO: 130754 - protein, 9 aa, Borrelia garinii
FTVNIKNKK

SEQ ID NO: 130755 - protein, 15 aa, Borrelia garinii
GDWSNLGTLVIRKEQ

SEQ ID NO: 130756 - protein, 9 aa, Borrelia garinii
WSNLGTLVI

SEQ ID NO: 130757 - protein, 15 aa, Borrelia garinii
MTNVGSFKTSLYYGY

SEQ ID NO: 130758 - protein, 9 aa, Borrelia garinii
VGSFKTSLY

SEQ ID NO: 130759 - protein, 15 aa, Borrelia garinii
DNNGDWSNLGTLVIR

SEQ ID NO: 130760 - protein, 9 aa, Borrelia garinii
WSNLGTLVI

SEQ ID NO: 130761 - protein, 15 aa, Borrelia garinii
NNGDWSNLGTLVIRK

SEQ ID NO: 130762 - protein, 9 aa, Borrelia garinii
WSNLGTLVI

SEQ ID NO: 130763 - protein, 15 aa, Borrelia garinii
LNVIGTINGQLRGHS

SEQ ID NO: 130764 - protein, 9 aa, Borrelia garinii
IGTINGQLR

SEQ ID NO: 130765 - protein, 15 aa, Borrelia garinii
AMTNVGSFKTSLYYG

SEQ ID NO: 130766 - protein, 9 aa, Borrelia garinii
VGSFKTSLY

SEQ ID NO: 130767 - protein, 15 aa, Borrelia garinii
GLNVIGTINGQLRGH

SEQ ID NO: 130768 - protein, 9 aa, Borrelia garinii
IGTINGQLR

SEQ ID NO: 130769 - protein, 15 aa, Borrelia garinii
NFVKAMTNVGSFKTS

SEQ ID NO: 130770 - protein, 9 aa, Borrelia garinii
MTNVGSFKT

SEQ ID NO: 130771 - protein, 15 aa, Borrelia garinii
KDNNGDWSNLGTLVI

SEQ ID NO: 130772 - protein, 9 aa, Borrelia garinii
DWSNLGTLV

SEQ ID NO: 130773 - protein, 15 aa, Borrelia garinii
FTVNIKNKKDNNGDW

SEQ ID NO: 130774 - protein, 9 aa, Borrelia garinii
FTVNIKNKK

SEQ ID NO: 130775 - protein, 15 aa, Borrelia garinii
EFTVNIKNKKDNNGD

SEQ ID NO: 130776 - protein, 9 aa, Borrelia garinii
FTVNIKNKK

SEQ ID NO: 130777 - protein, 15 aa, Borrelia garinii
TIKFSEFTVNIKNKK

SEQ ID NO: 130778 - protein, 9 aa, Borrelia garinii
EFTVNIKNK

SEQ ID NO: 130779 - protein, 15 aa, Borrelia garinii
IKFSEFTVNIKNKKD

SEQ ID NO: 130780 - protein, 9 aa, Borrelia garinii
FTVNIKNKK

SEQ ID NO: 130781 - protein, 15 aa, Borrelia garinii
FVKAMTNVGSFKTSL

SEQ ID NO: 130782 - protein, 9 aa, Borrelia garinii
MTNVGSFKT

SEQ ID NO: 130783 - protein, 15 aa, Borrelia garinii
EEAEVNNFVKAMTNV

SEQ ID NO: 130784 - protein, 9 aa, Borrelia garinii
VNNFVKAMT

SEQ ID NO: 130785 - protein, 15 aa, Borrelia garinii
DWSNLGTLVIRKEQD

SEQ ID NO: 130786 - protein, 9 aa, Borrelia garinii
WSNLGTLVI

SEQ ID NO: 130787 - protein, 15 aa, Borrelia garinii
VETGLNVIGTINGQL

SEQ ID NO: 130788 - protein, 9 aa, Borrelia garinii
LNVIGTING

SEQ ID NO: 130789 - protein, 15 aa, Borrelia garinii
DGVETGLNVIGTING

SEQ ID NO: 130790 - protein, 9 aa, Borrelia garinii
TGLNVIGTI

SEQ ID NO: 130791 - protein, 15 aa, Borrelia garinii
CIEEAEVNNFVKAMT

SEQ ID NO: 130792 - protein, 9 aa, Borrelia garinii
EVNNFVKAM

SEQ ID NO: 130793 - protein, 15 aa, Borrelia garinii
GVETGLNVIGTINGQ

SEQ ID NO: 130794 - protein, 9 aa, Borrelia garinii
LNVIGTING

SEQ ID NO: 130795 - protein, 15 aa, Borrelia garinii
IEEAEVNNFVKAMTN

SEQ ID NO: 130796 - protein, 9 aa, Borrelia garinii
VNNFVKAMT

SEQ ID NO: 130797 - protein, 15 aa, Borrelia garinii
WSNLGTLVIRKEQDG

SEQ ID NO: 130798 - protein, 9 aa, Borrelia garinii
WSNLGTLVI

SEQ ID NO: 130799 - protein, 15 aa, Borrelia garinii
NVIGTINGQLRGHSA

SEQ ID NO: 130800 - protein, 9 aa, Borrelia garinii
IGTINGQLR

SEQ ID NO: 130801 - protein, 15 aa, Borrelia garinii
TNVGSFKTSLYYGYK

SEQ ID NO: 130802 - protein, 9 aa, Borrelia garinii
VGSFKTSLY

SEQ ID NO: 130803 - protein, 15 aa, Borrelia garinii
VIGTINGQLRGHSAT

SEQ ID NO: 130804 - protein, 9 aa, Borrelia garinii
IGTINGQLR

SEQ ID NO: 130805 - protein, 15 aa, Borrelia garinii
IGTINGQLRGHSATF

SEQ ID NO: 130806 - protein, 9 aa, Borrelia garinii
IGTINGQLR

SEQ ID NO: 130807 - protein, 15 aa, Borrelia garinii
NVGSFKTSLYYGYKE

SEQ ID NO: 130808 - protein, 9 aa, Borrelia garinii
VGSFKTSLY

SEQ ID NO: 130809 - protein, 15 aa, Borrelia garinii
VGSFKTSLYYGYKEE

SEQ ID NO: 130810 - protein, 9 aa, Borrelia garinii
VGSFKTSLY

SEQ ID NO: 130811 - protein, 15 aa, Borrelia garinii
TVNIKNKKDNNGDWS

SEQ ID NO: 130812 - protein, 9 aa, Borrelia garinii
IKNKKDNNG

SEQ ID NO: 130813 - protein, 15 aa, Borrelia garinii
VNIKNKKDNNGDWSN

SEQ ID NO: 130814 - protein, 9 aa, Borrelia garinii
IKNKKDNNG

SEQ ID NO: 130815 - protein, 15 aa, Borrelia garinii
TTKIETINNSEHITF

SEQ ID NO: 130816 - protein, 9 aa, Borrelia garinii
TINNSEHIT

SEQ ID NO: 130817 - protein, 15 aa, Borrelia garinii
TKIETINNSEHITFS

SEQ ID NO: 130818 - protein, 9 aa, Borrelia garinii
TINNSEHIT

SEQ ID NO: 130819 - protein, 15 aa, Borrelia garinii
CAVFVLISSCGNFRS

SEQ ID NO: 130820 - protein, 9 aa, Borrelia garinii
VFVLISSCG

SEQ ID NO: 130821 - protein, 15 aa, Borrelia garinii
ICAVFVLISSCGNFR

SEQ ID NO: 130822 - protein, 9 aa, Borrelia garinii
VFVLISSCG

SEQ ID NO: 130823 - protein, 15 aa, Borrelia garinii
CAVFVLISSCGNFRS

SEQ ID NO: 130824 - protein, 9 aa, Borrelia garinii
VFVLISSCG

SEQ ID NO: 130825 - protein, 15 aa, Borrelia garinii
MFIICAVFVLISSCG

SEQ ID NO: 130826 - protein, 9 aa, Borrelia garinii
CAVFVLISS

SEQ ID NO: 130827 - protein, 15 aa, Borrelia garinii
IICAVFVLISSCGNF

SEQ ID NO: 130828 - protein, 9 aa, Borrelia garinii
VFVLISSCG

SEQ ID NO: 130829 - protein, 15 aa, Borrelia garinii
FIICAVFVLISSCGN

SEQ ID NO: 130830 - protein, 9 aa, Borrelia garinii
VFVLISSCG

SEQ ID NO: 130831 - protein, 15 aa, Borrelia garinii
AVFVLISSCGNFRSS

SEQ ID NO: 130832 - protein, 9 aa, Borrelia garinii
VFVLISSCG

SEQ ID NO: 130833 - protein, 15 aa, Borrelia garinii
SSTNGIKGKEITTKI

SEQ ID NO: 130834 - protein, 9 aa, Borrelia garinii
IKGKEITTK

SEQ ID NO: 130835 - protein, 15 aa, Borrelia garinii
STNGIKGKEITTKIE

SEQ ID NO: 130836 - protein, 9 aa, Borrelia garinii
IKGKEITTK

SEQ ID NO: 130837 - protein, 15 aa, Borrelia garinii
NGIKGKEITTKIETI

SEQ ID NO: 130838 - protein, 9 aa, Borrelia garinii
IKGKEITTK

SEQ ID NO: 130839 - protein, 15 aa, Borrelia garinii
QSSTNGIKGKEITTK

SEQ ID NO: 130840 - protein, 9 aa, Borrelia garinii
STNGIKGKE

SEQ ID NO: 130841 - protein, 15 aa, Borrelia garinii
TNGIKGKEITTKIET

SEQ ID NO: 130842 - protein, 9 aa, Borrelia garinii
IKGKEITTK

SEQ ID NO: 130843 - protein, 15 aa, Borrelia garinii
VFVLISSCGNFRSSL

SEQ ID NO: 130844 - protein, 9 aa, Borrelia garinii
VFVLISSCG

SEQ ID NO: 130845 - protein, 15 aa, Borrelia garinii
EVNNFVKAMTNVGSF

SEQ ID NO: 130846 - protein, 9 aa, Borrelia garinii
VKAMTNVGS

SEQ ID NO: 130847 - protein, 15 aa, Borrelia garinii
VNNFVKAMTNVGSFK

SEQ ID NO: 130848 - protein, 9 aa, Borrelia garinii
VKAMTNVGS

SEQ ID NO: 130849 - protein, 15 aa, Borrelia garinii
NNFVKAMTNVGSFKT

SEQ ID NO: 130850 - protein, 9 aa, Borrelia garinii
VKAMTNVGS

SEQ ID NO: 130851 - protein, 15 aa, Borrelia garinii
AEVNNFVKAMTNVGS

SEQ ID NO: 130852 - protein, 9 aa, Borrelia garinii
FVKAMTNVG

SEQ ID NO: 130853 - protein, 15 aa, Borrelia garinii
NKKMKMFIICAVFVL

SEQ ID NO: 130854 - protein, 9 aa, Borrelia garinii
MKMFIICAV

SEQ ID NO: 130855 - protein, 15 aa, Borrelia garinii
NFVKAMTNVGSFKTS

SEQ ID NO: 130856 - protein, 9 aa, Borrelia garinii
VKAMTNVGS

SEQ ID NO: 130857 - protein, 15 aa, Borrelia garinii
KKMKMFIICAVFVLI

SEQ ID NO: 130858 - protein, 9 aa, Borrelia garinii
MKMFIICAV

SEQ ID NO: 130859 - protein, 15 aa, Borrelia garinii
MNKKMKMFIICAVFV

SEQ ID NO: 130860 - protein, 9 aa, Borrelia garinii
MKMFIICAV

SEQ ID NO: 130861 - protein, 15 aa, Borrelia garinii
TSLYYGYKEEQSSTN

SEQ ID NO: 130862 - protein, 9 aa, Borrelia garinii
YGYKEEQSS

SEQ ID NO: 130863 - protein, 15 aa, Borrelia garinii
SLYYGYKEEQSSTNG

SEQ ID NO: 130864 - protein, 9 aa, Borrelia garinii
YKEEQSSTN

SEQ ID NO: 130865 - protein, 15 aa, Borrelia garinii
YGYKEEQSSTNGIKG

SEQ ID NO: 130866 - protein, 9 aa, Borrelia garinii
YKEEQSSTN

SEQ ID NO: 130867 - protein, 15 aa, Borrelia garinii
YYGYKEEQSSTNGIK

SEQ ID NO: 130868 - protein, 9 aa, Borrelia garinii
YKEEQSSTN

SEQ ID NO: 130869 - protein, 15 aa, Borrelia garinii
LYYGYKEEQSSTNGI

SEQ ID NO: 130870 - protein, 9 aa, Borrelia garinii
YKEEQSSTN

SEQ ID NO: 130871 - protein, 15 aa, Borrelia burgdorferi
PNNSLFNPPPVLPAS

SEQ ID NO: 130872 - protein, 9 aa, Borrelia burgdorferi
LFNPPPVLP

SEQ ID NO: 130873 - protein, 15 aa, Borrelia burgdorferi
NNSLFNPPPVLPASS

SEQ ID NO: 130874 - protein, 9 aa, Borrelia burgdorferi
LFNPPPVLP

SEQ ID NO: 130875 - protein, 15 aa, Borrelia burgdorferi
NSLFNPPPVLPASSH

SEQ ID NO: 130876 - protein, 9 aa, Borrelia burgdorferi
LFNPPPVLP

SEQ ID NO: 130877 - protein, 15 aa, Borrelia burgdorferi
DPNNSLFNPPPVLPA

SEQ ID NO: 130878 - protein, 9 aa, Borrelia burgdorferi
LFNPPPVLP

SEQ ID NO: 130879 - protein, 15 aa, Borrelia burgdorferi
SLFNPPPVLPASSHD

SEQ ID NO: 130880 - protein, 9 aa, Borrelia burgdorferi
FNPPPVLPA

SEQ ID NO: 130881 - protein, 15 aa, Borrelia burgdorferi
DDPNNSLFNPPPVLP

SEQ ID NO: 130882 - protein, 9 aa, Borrelia burgdorferi
DDPNNSLFN

SEQ ID NO: 130883 - protein, 15 aa, Borrelia burgdorferi
LFNPPPVLPASSHDN

SEQ ID NO: 130884 - protein, 9 aa, Borrelia burgdorferi
LFNPPPVLP

SEQ ID NO: 130885 - protein, 15 aa, Borrelia burgdorferi
DNTPVLKAVQAKDGG

SEQ ID NO: 130886 - protein, 9 aa, Borrelia burgdorferi
LKAVQAKDG

SEQ ID NO: 130887 - protein, 15 aa, Borrelia burgdorferi
TPVLKAVQAKDGGQQ

SEQ ID NO: 130888 - protein, 9 aa, Borrelia burgdorferi
LKAVQAKDG

SEQ ID NO: 130889 - protein, 15 aa, Borrelia burgdorferi
HDNTPVLKAVQAKDG

SEQ ID NO: 130890 - protein, 9 aa, Borrelia burgdorferi
TPVLKAVQA

SEQ ID NO: 130891 - protein, 15 aa, Borrelia burgdorferi
NTPVLKAVQAKDGGQ

SEQ ID NO: 130892 - protein, 9 aa, Borrelia burgdorferi
LKAVQAKDG

SEQ ID NO: 130893 - protein, 15 aa, Borrelia burgdorferi
PVLKAVQAKDGGQQE

SEQ ID NO: 130894 - protein, 9 aa, Borrelia burgdorferi
LKAVQAKDG

SEQ ID NO: 130895 - protein, 15 aa, Borrelia burgdorferi
FNPPPVLPASSHDNT

SEQ ID NO: 130896 - protein, 9 aa, Borrelia burgdorferi
FNPPPVLPA

SEQ ID NO: 130897 - protein, 15 aa, Borrelia burgdorferi
NKKMKNLIICAVFVL

SEQ ID NO: 130898 - protein, 9 aa, Borrelia burgdorferi
MKNLIICAV

SEQ ID NO: 130899 - protein, 15 aa, Borrelia burgdorferi
MNKKMKNLIICAVFV

SEQ ID NO: 130900 - protein, 9 aa, Borrelia burgdorferi
MKNLIICAV

SEQ ID NO: 130901 - protein, 15 aa, Borrelia burgdorferi
KKMKNLIICAVFVLI

SEQ ID NO: 130902 - protein, 9 aa, Borrelia burgdorferi
MKNLIICAV

SEQ ID NO: 130903 - protein, 15 aa, Borrelia burgdorferi
YAKELGVNGSYSVND

SEQ ID NO: 130904 - protein, 9 aa, Borrelia burgdorferi
LGVNGSYSV

SEQ ID NO: 130905 - protein, 15 aa, Borrelia burgdorferi
AKELGVNGSYSVNDG

SEQ ID NO: 130906 - protein, 9 aa, Borrelia burgdorferi
LGVNGSYSV

SEQ ID NO: 130907 - protein, 15 aa, Borrelia burgdorferi
LKYAKELGVNGSYSV

SEQ ID NO: 130908 - protein, 9 aa, Borrelia burgdorferi
YAKELGVNG

SEQ ID NO: 130909 - protein, 15 aa, Borrelia burgdorferi
KELGVNGSYSVNDGT

SEQ ID NO: 130910 - protein, 9 aa, Borrelia burgdorferi
LGVNGSYSV

SEQ ID NO: 130911 - protein, 15 aa, Borrelia burgdorferi
KYAKELGVNGSYSVN

SEQ ID NO: 130912 - protein, 9 aa, Borrelia burgdorferi
LGVNGSYSV

SEQ ID NO: 130913 - protein, 15 aa, Borrelia burgdorferi
KMKNLIICAVFVLII

SEQ ID NO: 130914 - protein, 9 aa, Borrelia burgdorferi
MKNLIICAV

SEQ ID NO: 130915 - protein, 15 aa, Borrelia burgdorferi
MKNLIICAVFVLIIS

SEQ ID NO: 130916 - protein, 9 aa, Borrelia burgdorferi
MKNLIICAV

SEQ ID NO: 130917 - protein, 15 aa, Borrelia burgdorferi
VKKQGNIGQKALKYA

SEQ ID NO: 130918 - protein, 9 aa, Borrelia burgdorferi
KQGNIGQKA

SEQ ID NO: 130919 - protein, 15 aa, Borrelia burgdorferi
VLKAVQAKDGGQQEG

SEQ ID NO: 130920 - protein, 9 aa, Borrelia burgdorferi
LKAVQAKDG

SEQ ID NO: 130921 - protein, 15 aa, Borrelia burgdorferi
LKAVQAKDGGQQEGK

SEQ ID NO: 130922 - protein, 9 aa, Borrelia burgdorferi
LKAVQAKDG

SEQ ID NO: 130923 - protein, 15 aa, Borrelia burgdorferi
PPPVLPASSHDNTPV

SEQ ID NO: 130924 - protein, 9 aa, Borrelia burgdorferi
VLPASSHDN

SEQ ID NO: 130925 - protein, 15 aa, Borrelia burgdorferi
NPPPVLPASSHDNTP

SEQ ID NO: 130926 - protein, 9 aa, Borrelia burgdorferi
VLPASSHDN

SEQ ID NO: 130927 - protein, 15 aa, Borrelia burgdorferi
KQGNIGQKALKYAKE

SEQ ID NO: 130928 - protein, 9 aa, Borrelia burgdorferi
IGQKALKYA

SEQ ID NO: 130929 - protein, 15 aa, Borrelia burgdorferi
KKQGNIGQKALKYAK

SEQ ID NO: 130930 - protein, 9 aa, Borrelia burgdorferi
IGQKALKYA

SEQ ID NO: 130931 - protein, 15 aa, Borrelia burgdorferi
QGNIGQKALKYAKEL

SEQ ID NO: 130932 - protein, 9 aa, Borrelia burgdorferi
IGQKALKYA

SEQ ID NO: 130933 - protein, 15 aa, Borrelia burgdorferi
PPVLPASSHDNTPVL

SEQ ID NO: 130934 - protein, 9 aa, Borrelia burgdorferi
VLPASSHDN

SEQ ID NO: 130935 - protein, 15 aa, Borrelia burgdorferi
GNIGQKALKYAKELG

SEQ ID NO: 130936 - protein, 9 aa, Borrelia burgdorferi
IGQKALKYA

SEQ ID NO: 130937 - protein, 15 aa, Borrelia burgdorferi
LGVNGSYSVNDGTNT

SEQ ID NO: 130938 - protein, 9 aa, Borrelia burgdorferi
LGVNGSYSV

SEQ ID NO: 130939 - protein, 15 aa, Borrelia burgdorferi
ELGVNGSYSVNDGTN

SEQ ID NO: 130940 - protein, 9 aa, Borrelia burgdorferi
LGVNGSYSV

SEQ ID NO: 130941 - protein, 15 aa, Borrelia burgdorferi
KEQVESATGESTEKV

SEQ ID NO: 130942 - protein, 9 aa, Borrelia burgdorferi
VESATGEST

SEQ ID NO: 130943 - protein, 15 aa, Borrelia burgdorferi
EQVESATGESTEKVK

SEQ ID NO: 130944 - protein, 9 aa, Borrelia burgdorferi
VESATGEST

SEQ ID NO: 130945 - protein, 15 aa, Borrelia burgdorferi
QKALKYAKELGVNGS

SEQ ID NO: 130946 - protein, 9 aa, Borrelia burgdorferi
YAKELGVNG

SEQ ID NO: 130947 - protein, 15 aa, Borrelia burgdorferi
KALKYAKELGVNGSY

SEQ ID NO: 130948 - protein, 9 aa, Borrelia burgdorferi
YAKELGVNG

SEQ ID NO: 130949 - protein, 15 aa, Borrelia burgdorferi
FLDKELMQGDDPNNS

SEQ ID NO: 130950 - protein, 9 aa, Borrelia burgdorferi
FLDKELMQG

SEQ ID NO: 130951 - protein, 15 aa, Borrelia burgdorferi
LIICAVFVLIISCKI

SEQ ID NO: 130952 - protein, 9 aa, Borrelia burgdorferi
ICAVFVLII

SEQ ID NO: 130953 - protein, 15 aa, Borrelia burgdorferi
ALKYAKELGVNGSYS

SEQ ID NO: 130954 - protein, 9 aa, Borrelia burgdorferi
YAKELGVNG

SEQ ID NO: 130955 - protein, 15 aa, Borrelia burgdorferi
NIGQKALKYAKELGV

SEQ ID NO: 130956 - protein, 9 aa, Borrelia burgdorferi
IGQKALKYA

SEQ ID NO: 130957 - protein, 15 aa, Borrelia burgdorferi
KELMQGDDPNNSLFN

SEQ ID NO: 130958 - protein, 9 aa, Borrelia burgdorferi
MQGDDPNNS

SEQ ID NO: 130959 - protein, 15 aa, Borrelia burgdorferi
IGQKALKYAKELGVN

SEQ ID NO: 130960 - protein, 9 aa, Borrelia burgdorferi
IGQKALKYA

SEQ ID NO: 130961 - protein, 15 aa, Borrelia burgdorferi
QEFKEQVESATGEST

SEQ ID NO: 130962 - protein, 9 aa, Borrelia burgdorferi
FKEQVESAT

SEQ ID NO: 130963 - protein, 15 aa, Borrelia burgdorferi
LDKELMQGDDPNNSL

SEQ ID NO: 130964 - protein, 9 aa, Borrelia burgdorferi
MQGDDPNNS

SEQ ID NO: 130965 - protein, 15 aa, Borrelia burgdorferi
DKELMQGDDPNNSLF

SEQ ID NO: 130966 - protein, 9 aa, Borrelia burgdorferi
MQGDDPNNS

SEQ ID NO: 130967 - protein, 15 aa, Borrelia burgdorferi
FKEQVESATGESTEK

SEQ ID NO: 130968 - protein, 9 aa, Borrelia burgdorferi
VESATGEST

SEQ ID NO: 130969 - protein, 15 aa, Borrelia burgdorferi
ELMQGDDPNNSLFNP

SEQ ID NO: 130970 - protein, 9 aa, Borrelia burgdorferi
MQGDDPNNS

SEQ ID NO: 130971 - protein, 15 aa, Borrelia burgdorferi
FLDKELMQGDDPNNS

SEQ ID NO: 130972 - protein, 9 aa, Borrelia burgdorferi
FLDKELMQG

SEQ ID NO: 130973 - protein, 15 aa, Borrelia burgdorferi
LDKELMQGDDPNNSL

SEQ ID NO: 130974 - protein, 9 aa, Borrelia burgdorferi
MQGDDPNNS

SEQ ID NO: 130975 - protein, 15 aa, Borrelia burgdorferi
KELMQGDDPNNSLFN

SEQ ID NO: 130976 - protein, 9 aa, Borrelia burgdorferi
MQGDDPNNS

SEQ ID NO: 130977 - protein, 15 aa, Borrelia burgdorferi
DKELMQGDDPNNSLF

SEQ ID NO: 130978 - protein, 9 aa, Borrelia burgdorferi
MQGDDPNNS

SEQ ID NO: 130979 - protein, 15 aa, Borrelia burgdorferi
ELMQGDDPNNSLFNP

SEQ ID NO: 130980 - protein, 9 aa, Borrelia burgdorferi
MQGDDPNNS

SEQ ID NO: 130981 - protein, 15 aa, Borrelia burgdorferi
DPNNSLFNPPPVLPA

SEQ ID NO: 130982 - protein, 9 aa, Borrelia burgdorferi
NNSLFNPPP

SEQ ID NO: 130983 - protein, 15 aa, Borrelia burgdorferi
PNNSLFNPPPVLPAS

SEQ ID NO: 130984 - protein, 9 aa, Borrelia burgdorferi
FNPPPVLPA

SEQ ID NO: 130985 - protein, 15 aa, Borrelia burgdorferi
KMKNLIICAVFVLII

SEQ ID NO: 130986 - protein, 9 aa, Borrelia burgdorferi
LIICAVFVL

SEQ ID NO: 130987 - protein, 15 aa, Borrelia burgdorferi
MKNLIICAVFVLIIS

SEQ ID NO: 130988 - protein, 9 aa, Borrelia burgdorferi
LIICAVFVL

SEQ ID NO: 130989 - protein, 15 aa, Borrelia burgdorferi
KNLIICAVFVLIISC

SEQ ID NO: 130990 - protein, 9 aa, Borrelia burgdorferi
LIICAVFVL

SEQ ID NO: 130991 - protein, 15 aa, Borrelia burgdorferi
KKMKNLIICAVFVLI

SEQ ID NO: 130992 - protein, 9 aa, Borrelia burgdorferi
LIICAVFVL

SEQ ID NO: 130993 - protein, 15 aa, Borrelia burgdorferi
NKKMKNLIICAVFVL

SEQ ID NO: 130994 - protein, 9 aa, Borrelia burgdorferi
MKNLIICAV

SEQ ID NO: 130995 - protein, 15 aa, Borrelia burgdorferi
MNKKMKNLIICAVFV

SEQ ID NO: 130996 - protein, 9 aa, Borrelia burgdorferi
MNKKMKNLI

SEQ ID NO: 130997 - protein, 15 aa, Borrelia burgdorferi
KKMKNLIICAVFVLI

SEQ ID NO: 130998 - protein, 9 aa, Borrelia burgdorferi
MKNLIICAV

SEQ ID NO: 130999 - protein, 15 aa, Borrelia burgdorferi
NKKMKNLIICAVFVL

SEQ ID NO: 131000 - protein, 9 aa, Borrelia burgdorferi
MKNLIICAV

SEQ ID NO: 131001 - protein, 15 aa, Borrelia burgdorferi
AKELGVNGSYSVNDG

SEQ ID NO: 131002 - protein, 9 aa, Borrelia burgdorferi
LGVNGSYSV

SEQ ID NO: 131003 - protein, 15 aa, Borrelia burgdorferi
LKYAKELGVNGSYSV

SEQ ID NO: 131004 - protein, 9 aa, Borrelia burgdorferi
AKELGVNGS

SEQ ID NO: 131005 - protein, 15 aa, Borrelia burgdorferi
YAKELGVNGSYSVND

SEQ ID NO: 131006 - protein, 9 aa, Borrelia burgdorferi
LGVNGSYSV

SEQ ID NO: 131007 - protein, 15 aa, Borrelia burgdorferi
KYAKELGVNGSYSVN

SEQ ID NO: 131008 - protein, 9 aa, Borrelia burgdorferi
LGVNGSYSV

SEQ ID NO: 131009 - protein, 15 aa, Borrelia burgdorferi
KELGVNGSYSVNDGT

SEQ ID NO: 131010 - protein, 9 aa, Borrelia burgdorferi
LGVNGSYSV

SEQ ID NO: 131011 - protein, 15 aa, Borrelia burgdorferi
MKNLIICAVFVLIIS

SEQ ID NO: 131012 - protein, 9 aa, Borrelia burgdorferi
MKNLIICAV

SEQ ID NO: 131013 - protein, 15 aa, Borrelia burgdorferi
LGVNGSYSVNDGTNT

SEQ ID NO: 131014 - protein, 9 aa, Borrelia burgdorferi
LGVNGSYSV

SEQ ID NO: 131015 - protein, 15 aa, Borrelia burgdorferi
KMKNLIICAVFVLII

SEQ ID NO: 131016 - protein, 9 aa, Borrelia burgdorferi
MKNLIICAV

SEQ ID NO: 131017 - protein, 15 aa, Borrelia burgdorferi
LIICAVFVLIISCKI

SEQ ID NO: 131018 - protein, 9 aa, Borrelia burgdorferi
VFVLIISCK

SEQ ID NO: 131019 - protein, 15 aa, Borrelia burgdorferi
ICAVFVLIISCKIDA

SEQ ID NO: 131020 - protein, 9 aa, Borrelia burgdorferi
VFVLIISCK

SEQ ID NO: 131021 - protein, 15 aa, Borrelia burgdorferi
CAVFVLIISCKIDAS

SEQ ID NO: 131022 - protein, 9 aa, Borrelia burgdorferi
VFVLIISCK

SEQ ID NO: 131023 - protein, 15 aa, Borrelia burgdorferi
IICAVFVLIISCKID

SEQ ID NO: 131024 - protein, 9 aa, Borrelia burgdorferi
VFVLIISCK

SEQ ID NO: 131025 - protein, 15 aa, Borrelia burgdorferi
CAVFVLIISCKIDAS

SEQ ID NO: 131026 - protein, 9 aa, Borrelia burgdorferi
VFVLIISCK

SEQ ID NO: 131027 - protein, 15 aa, Borrelia burgdorferi
IICAVFVLIISCKID

SEQ ID NO: 131028 - protein, 9 aa, Borrelia burgdorferi
VFVLIISCK

SEQ ID NO: 131029 - protein, 15 aa, Borrelia burgdorferi
ICAVFVLIISCKIDA

SEQ ID NO: 131030 - protein, 9 aa, Borrelia burgdorferi
VFVLIISCK

SEQ ID NO: 131031 - protein, 15 aa, Borrelia burgdorferi
LIICAVFVLIISCKI

SEQ ID NO: 131032 - protein, 9 aa, Borrelia burgdorferi
VFVLIISCK

SEQ ID NO: 131033 - protein, 15 aa, Borrelia burgdorferi
NLIICAVFVLIISCK

SEQ ID NO: 131034 - protein, 9 aa, Borrelia burgdorferi
CAVFVLIIS

SEQ ID NO: 131035 - protein, 15 aa, Borrelia burgdorferi
KKMKNLIICAVFVLI

SEQ ID NO: 131036 - protein, 9 aa, Borrelia burgdorferi
MKNLIICAV

SEQ ID NO: 131037 - protein, 15 aa, Borrelia burgdorferi
NKKMKNLIICAVFVL

SEQ ID NO: 131038 - protein, 9 aa, Borrelia burgdorferi
MKNLIICAV

SEQ ID NO: 131039 - protein, 15 aa, Borrelia burgdorferi
MNKKMKNLIICAVFV

SEQ ID NO: 131040 - protein, 9 aa, Borrelia burgdorferi
MKNLIICAV

SEQ ID NO: 131041 - protein, 15 aa, Borrelia burgdorferi
LFPSYSQSSAMIMPP

SEQ ID NO: 131042 - protein, 9 aa, Borrelia burgdorferi
YSQSSAMIM

SEQ ID NO: 131043 - protein, 15 aa, Borrelia burgdorferi
NWSVLLTPSARLQAY

SEQ ID NO: 131044 - protein, 9 aa, Borrelia burgdorferi
LLTPSARLQ

SEQ ID NO: 131045 - protein, 15 aa, Borrelia burgdorferi
WSVLLTPSARLQAYV

SEQ ID NO: 131046 - protein, 9 aa, Borrelia burgdorferi
LLTPSARLQ

SEQ ID NO: 131047 - protein, 15 aa, Borrelia burgdorferi
SNPNYIPNISSRIIK

SEQ ID NO: 131048 - protein, 9 aa, Borrelia burgdorferi
IPNISSRII

SEQ ID NO: 131049 - protein, 15 aa, Borrelia burgdorferi
NPNYIPNISSRIIKD

SEQ ID NO: 131050 - protein, 9 aa, Borrelia burgdorferi
IPNISSRII

SEQ ID NO: 131051 - protein, 15 aa, Borrelia burgdorferi
PNYIPNISSRIIKDD

SEQ ID NO: 131052 - protein, 9 aa, Borrelia burgdorferi
IPNISSRII

SEQ ID NO: 131053 - protein, 15 aa, Borrelia burgdorferi
WSNPNYIPNISSRII

SEQ ID NO: 131054 - protein, 9 aa, Borrelia burgdorferi
YIPNISSRI

SEQ ID NO: 131055 - protein, 15 aa, Borrelia burgdorferi
FPSYSQSSAMIMPPF

SEQ ID NO: 131056 - protein, 9 aa, Borrelia burgdorferi
YSQSSAMIM

SEQ ID NO: 131057 - protein, 15 aa, Borrelia burgdorferi
GINNWSVLLTPSARL

SEQ ID NO: 131058 - protein, 9 aa, Borrelia burgdorferi
WSVLLTPSA

SEQ ID NO: 131059 - protein, 15 aa, Borrelia burgdorferi
PSYSQSSAMIMPPFK

SEQ ID NO: 131060 - protein, 9 aa, Borrelia burgdorferi
YSQSSAMIM

SEQ ID NO: 131061 - protein, 15 aa, Borrelia burgdorferi
TESLRKLKAHETFKR

SEQ ID NO: 131062 - protein, 9 aa, Borrelia burgdorferi
LRKLKAHET

SEQ ID NO: 131063 - protein, 15 aa, Borrelia burgdorferi
AYVKNSVVAPAVVKS

SEQ ID NO: 131064 - protein, 9 aa, Borrelia burgdorferi
VKNSVVAPA

SEQ ID NO: 131065 - protein, 15 aa, Borrelia burgdorferi
ILGVRVLFPSYSQSS

SEQ ID NO: 131066 - protein, 9 aa, Borrelia burgdorferi
VRVLFPSYS

SEQ ID NO: 131067 - protein, 15 aa, Borrelia burgdorferi
LGVRVLFPSYSQSSA

SEQ ID NO: 131068 - protein, 9 aa, Borrelia burgdorferi
LFPSYSQSS

SEQ ID NO: 131069 - protein, 15 aa, Borrelia burgdorferi
ESLRKLKAHETFKRV

SEQ ID NO: 131070 - protein, 9 aa, Borrelia burgdorferi
LRKLKAHET

SEQ ID NO: 131071 - protein, 15 aa, Borrelia burgdorferi
AKSILFFLLSTVLFA

SEQ ID NO: 131072 - protein, 9 aa, Borrelia burgdorferi
FFLLSTVLF

SEQ ID NO: 131073 - protein, 15 aa, Borrelia burgdorferi
KSILFFLLSTVLFAQ

SEQ ID NO: 131074 - protein, 9 aa, Borrelia burgdorferi
FFLLSTVLF

SEQ ID NO: 131075 - protein, 15 aa, Borrelia burgdorferi
SILFFLLSTVLFAQE

SEQ ID NO: 131076 - protein, 9 aa, Borrelia burgdorferi
FFLLSTVLF

SEQ ID NO: 131077 - protein, 15 aa, Borrelia burgdorferi
EDMNGMEYAYSMGTL

SEQ ID NO: 131078 - protein, 9 aa, Borrelia burgdorferi
MEYAYSMGT

SEQ ID NO: 131079 - protein, 15 aa, Borrelia burgdorferi
YVKNSVVAPAVVKSE

SEQ ID NO: 131080 - protein, 9 aa, Borrelia burgdorferi
VVAPAVVKS

SEQ ID NO: 131081 - protein, 15 aa, Borrelia burgdorferi
VKNSVVAPAVVKSES

SEQ ID NO: 131082 - protein, 9 aa, Borrelia burgdorferi
VVAPAVVKS

SEQ ID NO: 131083 - protein, 15 aa, Borrelia burgdorferi
KNSVVAPAVVKSESK

SEQ ID NO: 131084 - protein, 9 aa, Borrelia burgdorferi
VVAPAVVKS

SEQ ID NO: 131085 - protein, 15 aa, Borrelia burgdorferi
NSVVAPAVVKSESKR

SEQ ID NO: 131086 - protein, 9 aa, Borrelia burgdorferi
VVAPAVVKS

SEQ ID NO: 131087 - protein, 15 aa, Borrelia burgdorferi
FEDMNGMEYAYSMGT

SEQ ID NO: 131088 - protein, 9 aa, Borrelia burgdorferi
MNGMEYAYS

SEQ ID NO: 131089 - protein, 15 aa, Borrelia burgdorferi
GTESLRKLKAHETFK

SEQ ID NO: 131090 - protein, 9 aa, Borrelia burgdorferi
LRKLKAHET

SEQ ID NO: 131091 - protein, 15 aa, Borrelia burgdorferi
DLGINNWSVLLTPSA

SEQ ID NO: 131092 - protein, 9 aa, Borrelia burgdorferi
INNWSVLLT

SEQ ID NO: 131093 - protein, 15 aa, Borrelia burgdorferi
MRFKAFRVSKSHSSK

SEQ ID NO: 131094 - protein, 9 aa, Borrelia burgdorferi
FRVSKSHSS

SEQ ID NO: 131095 - protein, 15 aa, Borrelia burgdorferi
TSGTESLRKLKAHET

SEQ ID NO: 131096 - protein, 9 aa, Borrelia burgdorferi
TESLRKLKA

SEQ ID NO: 131097 - protein, 15 aa, Borrelia burgdorferi
SGTESLRKLKAHETF

SEQ ID NO: 131098 - protein, 9 aa, Borrelia burgdorferi
LRKLKAHET

SEQ ID NO: 131099 - protein, 15 aa, Borrelia burgdorferi
LGINNWSVLLTPSAR

SEQ ID NO: 131100 - protein, 9 aa, Borrelia burgdorferi
INNWSVLLT

SEQ ID NO: 131101 - protein, 15 aa, Borrelia burgdorferi
NYIPNISSRIIKDDV

SEQ ID NO: 131102 - protein, 9 aa, Borrelia burgdorferi
IPNISSRII

SEQ ID NO: 131103 - protein, 15 aa, Borrelia burgdorferi
KMRFKAFRVSKSHSS

SEQ ID NO: 131104 - protein, 9 aa, Borrelia burgdorferi
FKAFRVSKS

SEQ ID NO: 131105 - protein, 15 aa, Borrelia burgdorferi
KAKSILFFLLSTVLF

SEQ ID NO: 131106 - protein, 9 aa, Borrelia burgdorferi
LFFLLSTVL

SEQ ID NO: 131107 - protein, 15 aa, Borrelia burgdorferi
KDDVPNYPLASSKMR

SEQ ID NO: 131108 - protein, 9 aa, Borrelia burgdorferi
NYPLASSKM

SEQ ID NO: 131109 - protein, 15 aa, Borrelia burgdorferi
DDVPNYPLASSKMRF

SEQ ID NO: 131110 - protein, 9 aa, Borrelia burgdorferi
YPLASSKMR

SEQ ID NO: 131111 - protein, 15 aa, Borrelia burgdorferi
SVLLTPSARLQAYVK

SEQ ID NO: 131112 - protein, 9 aa, Borrelia burgdorferi
LLTPSARLQ

SEQ ID NO: 131113 - protein, 15 aa, Borrelia burgdorferi
VRVLFPSYSQSSAMI

SEQ ID NO: 131114 - protein, 9 aa, Borrelia burgdorferi
LFPSYSQSS

SEQ ID NO: 131115 - protein, 15 aa, Borrelia burgdorferi
GVRVLFPSYSQSSAM

SEQ ID NO: 131116 - protein, 9 aa, Borrelia burgdorferi
LFPSYSQSS

SEQ ID NO: 131117 - protein, 15 aa, Borrelia burgdorferi
MNGMEYAYSMGTLKF

SEQ ID NO: 131118 - protein, 9 aa, Borrelia burgdorferi
MEYAYSMGT

SEQ ID NO: 131119 - protein, 15 aa, Borrelia burgdorferi
FKAFRVSKSHSSKVK

SEQ ID NO: 131120 - protein, 9 aa, Borrelia burgdorferi
FRVSKSHSS

SEQ ID NO: 131121 - protein, 15 aa, Borrelia burgdorferi
ILFFLLSTVLFAQET

SEQ ID NO: 131122 - protein, 9 aa, Borrelia burgdorferi
FFLLSTVLF

SEQ ID NO: 131123 - protein, 15 aa, Borrelia burgdorferi
VPNYPLASSKMRFKA

SEQ ID NO: 131124 - protein, 9 aa, Borrelia burgdorferi
YPLASSKMR

SEQ ID NO: 131125 - protein, 15 aa, Borrelia burgdorferi
RFKAFRVSKSHSSKV

SEQ ID NO: 131126 - protein, 9 aa, Borrelia burgdorferi
FRVSKSHSS

SEQ ID NO: 131127 - protein, 15 aa, Borrelia burgdorferi
DVPNYPLASSKMRFK

SEQ ID NO: 131128 - protein, 9 aa, Borrelia burgdorferi
YPLASSKMR

SEQ ID NO: 131129 - protein, 15 aa, Borrelia burgdorferi
YSQSSAMIMPPFKIP

SEQ ID NO: 131130 - protein, 9 aa, Borrelia burgdorferi
YSQSSAMIM

SEQ ID NO: 131131 - protein, 15 aa, Borrelia burgdorferi
DMNGMEYAYSMGTLK

SEQ ID NO: 131132 - protein, 9 aa, Borrelia burgdorferi
MEYAYSMGT

SEQ ID NO: 131133 - protein, 15 aa, Borrelia burgdorferi
KAFRVSKSHSSKVKN

SEQ ID NO: 131134 - protein, 9 aa, Borrelia burgdorferi
FRVSKSHSS

SEQ ID NO: 131135 - protein, 15 aa, Borrelia burgdorferi
NGMEYAYSMGTLKFK

SEQ ID NO: 131136 - protein, 9 aa, Borrelia burgdorferi
MEYAYSMGT

SEQ ID NO: 131137 - protein, 15 aa, Borrelia burgdorferi
SYSQSSAMIMPPFKI

SEQ ID NO: 131138 - protein, 9 aa, Borrelia burgdorferi
YSQSSAMIM

SEQ ID NO: 131139 - protein, 15 aa, Borrelia burgdorferi
GDTILGVRVLFPSYS

SEQ ID NO: 131140 - protein, 9 aa, Borrelia burgdorferi
ILGVRVLFP

SEQ ID NO: 131141 - protein, 15 aa, Borrelia burgdorferi
DTILGVRVLFPSYSQ

SEQ ID NO: 131142 - protein, 9 aa, Borrelia burgdorferi
VRVLFPSYS

SEQ ID NO: 131143 - protein, 15 aa, Borrelia burgdorferi
PNYPLASSKMRFKAF

SEQ ID NO: 131144 - protein, 9 aa, Borrelia burgdorferi
YPLASSKMR

SEQ ID NO: 131145 - protein, 15 aa, Borrelia burgdorferi
TILGVRVLFPSYSQS

SEQ ID NO: 131146 - protein, 9 aa, Borrelia burgdorferi
VRVLFPSYS

SEQ ID NO: 131147 - protein, 15 aa, Borrelia burgdorferi
VDLGINNWSVLLTPS

SEQ ID NO: 131148 - protein, 9 aa, Borrelia burgdorferi
INNWSVLLT

SEQ ID NO: 131149 - protein, 15 aa, Borrelia burgdorferi
MVVDLGINNWSVLLT

SEQ ID NO: 131150 - protein, 9 aa, Borrelia burgdorferi
VVDLGINNW

SEQ ID NO: 131151 - protein, 15 aa, Borrelia burgdorferi
YIPNISSRIIKDDVP

SEQ ID NO: 131152 - protein, 9 aa, Borrelia burgdorferi
IPNISSRII

SEQ ID NO: 131153 - protein, 15 aa, Borrelia burgdorferi
VVDLGINNWSVLLTP

SEQ ID NO: 131154 - protein, 9 aa, Borrelia burgdorferi
INNWSVLLT

SEQ ID NO: 131155 - protein, 15 aa, Borrelia burgdorferi
LFFLLSTVLFAQETD

SEQ ID NO: 131156 - protein, 9 aa, Borrelia burgdorferi
FFLLSTVLF

SEQ ID NO: 131157 - protein, 15 aa, Borrelia burgdorferi
NYVDYVYSGASGIVK

SEQ ID NO: 131158 - protein, 9 aa, Borrelia burgdorferi
VYSGASGIV

SEQ ID NO: 131159 - protein, 15 aa, Borrelia burgdorferi
VLLTPSARLQAYVKN

SEQ ID NO: 131160 - protein, 9 aa, Borrelia burgdorferi
LLTPSARLQ

SEQ ID NO: 131161 - protein, 15 aa, Borrelia burgdorferi
QAYVKNSVVAPAVVK

SEQ ID NO: 131162 - protein, 9 aa, Borrelia burgdorferi
VKNSVVAPA

SEQ ID NO: 131163 - protein, 15 aa, Borrelia burgdorferi
SLRKLKAHETFKRVL

SEQ ID NO: 131164 - protein, 9 aa, Borrelia burgdorferi
LRKLKAHET

SEQ ID NO: 131165 - protein, 15 aa, Borrelia burgdorferi
LRKLKAHETFKRVLK

SEQ ID NO: 131166 - protein, 9 aa, Borrelia burgdorferi
LRKLKAHET

SEQ ID NO: 131167 - protein, 15 aa, Borrelia burgdorferi
IWSNPNYIPNISSRI

SEQ ID NO: 131168 - protein, 9 aa, Borrelia burgdorferi
IWSNPNYIP

SEQ ID NO: 131169 - protein, 15 aa, Borrelia burgdorferi
YVDYVYSGASGIVKP

SEQ ID NO: 131170 - protein, 9 aa, Borrelia burgdorferi
VYSGASGIV

SEQ ID NO: 131171 - protein, 15 aa, Borrelia burgdorferi
VDYVYSGASGIVKPE

SEQ ID NO: 131172 - protein, 9 aa, Borrelia burgdorferi
VYSGASGIV

SEQ ID NO: 131173 - protein, 15 aa, Borrelia burgdorferi
VVAPAVVKSESKRYA

SEQ ID NO: 131174 - protein, 9 aa, Borrelia burgdorferi
VVAPAVVKS

SEQ ID NO: 131175 - protein, 15 aa, Borrelia burgdorferi
LQAYVKNSVVAPAVV

SEQ ID NO: 131176 - protein, 9 aa, Borrelia burgdorferi
VKNSVVAPA

SEQ ID NO: 131177 - protein, 15 aa, Borrelia burgdorferi
RLQAYVKNSVVAPAV

SEQ ID NO: 131178 - protein, 9 aa, Borrelia burgdorferi
VKNSVVAPA

SEQ ID NO: 131179 - protein, 15 aa, Borrelia burgdorferi
SVVAPAVVKSESKRY

SEQ ID NO: 131180 - protein, 9 aa, Borrelia burgdorferi
VVAPAVVKS

SEQ ID NO: 131181 - protein, 15 aa, Borrelia burgdorferi
RKAKSILFFLLSTVL

SEQ ID NO: 131182 - protein, 9 aa, Borrelia burgdorferi
RKAKSILFF

SEQ ID NO: 131183 - protein, 15 aa, Borrelia burgdorferi
ARLQAYVKNSVVAPA

SEQ ID NO: 131184 - protein, 9 aa, Borrelia burgdorferi
YVKNSVVAP

SEQ ID NO: 131185 - protein, 15 aa, Borrelia burgdorferi
SVFKVYETSGTESLR

SEQ ID NO: 131186 - protein, 9 aa, Borrelia burgdorferi
YETSGTESL

SEQ ID NO: 131187 - protein, 15 aa, Borrelia burgdorferi
ESVFKVYETSGTESL

SEQ ID NO: 131188 - protein, 9 aa, Borrelia burgdorferi
FKVYETSGT

SEQ ID NO: 131189 - protein, 15 aa, Borrelia burgdorferi
SSKMRFKAFRVSKSH

SEQ ID NO: 131190 - protein, 9 aa, Borrelia burgdorferi
FKAFRVSKS

SEQ ID NO: 131191 - protein, 15 aa, Borrelia burgdorferi
SKMRFKAFRVSKSHS

SEQ ID NO: 131192 - protein, 9 aa, Borrelia burgdorferi
FKAFRVSKS

SEQ ID NO: 131193 - protein, 15 aa, Borrelia burgdorferi
ASSKMRFKAFRVSKS

SEQ ID NO: 131194 - protein, 9 aa, Borrelia burgdorferi
MRFKAFRVS

SEQ ID NO: 131195 - protein, 15 aa, Borrelia burgdorferi
TNYVDYVYSGASGIV

SEQ ID NO: 131196 - protein, 9 aa, Borrelia burgdorferi
YVYSGASGI

SEQ ID NO: 131197 - protein, 15 aa, Borrelia burgdorferi
IKDDVPNYPLASSKM

SEQ ID NO: 131198 - protein, 9 aa, Borrelia burgdorferi
VPNYPLASS

SEQ ID NO: 131199 - protein, 15 aa, Borrelia burgdorferi
GMEYAYSMGTLKFKG

SEQ ID NO: 131200 - protein, 9 aa, Borrelia burgdorferi
MEYAYSMGT

SEQ ID NO: 131201 - protein, 15 aa, Borrelia burgdorferi
MEYAYSMGTLKFKGW

SEQ ID NO: 131202 - protein, 9 aa, Borrelia burgdorferi
MEYAYSMGT

SEQ ID NO: 131203 - protein, 15 aa, Borrelia burgdorferi
LFEDMNGMEYAYSMG

SEQ ID NO: 131204 - protein, 9 aa, Borrelia burgdorferi
MNGMEYAYS

SEQ ID NO: 131205 - protein, 15 aa, Borrelia burgdorferi
DYVYSGASGIVKPED

SEQ ID NO: 131206 - protein, 9 aa, Borrelia burgdorferi
VYSGASGIV

SEQ ID NO: 131207 - protein, 15 aa, Borrelia burgdorferi
VLFEDMNGMEYAYSM

SEQ ID NO: 131208 - protein, 9 aa, Borrelia burgdorferi
MNGMEYAYS

SEQ ID NO: 131209 - protein, 15 aa, Borrelia burgdorferi
KDLRVLYDKLSVSID

SEQ ID NO: 131210 - protein, 9 aa, Borrelia burgdorferi
LYDKLSVSI

SEQ ID NO: 131211 - protein, 15 aa, Borrelia burgdorferi
VKDLRVLYDKLSVSI

SEQ ID NO: 131212 - protein, 9 aa, Borrelia burgdorferi
LRVLYDKLS

SEQ ID NO: 131213 - protein, 15 aa, Borrelia burgdorferi
FFLLSTVLFAQETDG

SEQ ID NO: 131214 - protein, 9 aa, Borrelia burgdorferi
FFLLSTVLF

SEQ ID NO: 131215 - protein, 15 aa, Borrelia burgdorferi
EVLFEDMNGMEYAYS

SEQ ID NO: 131216 - protein, 9 aa, Borrelia burgdorferi
FEDMNGMEY

SEQ ID NO: 131217 - protein, 15 aa, Borrelia burgdorferi
FKVYETSGTESLRKL

SEQ ID NO: 131218 - protein, 9 aa, Borrelia burgdorferi
YETSGTESL

SEQ ID NO: 131219 - protein, 15 aa, Borrelia burgdorferi
AFRVSKSHSSKVKNF

SEQ ID NO: 131220 - protein, 9 aa, Borrelia burgdorferi
FRVSKSHSS

SEQ ID NO: 131221 - protein, 15 aa, Borrelia burgdorferi
VFKVYETSGTESLRK

SEQ ID NO: 131222 - protein, 9 aa, Borrelia burgdorferi
YETSGTESL

SEQ ID NO: 131223 - protein, 15 aa, Borrelia burgdorferi
NYPLASSKMRFKAFR

SEQ ID NO: 131224 - protein, 9 aa, Borrelia burgdorferi
YPLASSKMR

SEQ ID NO: 131225 - protein, 15 aa, Borrelia burgdorferi
FRVSKSHSSKVKNFI

SEQ ID NO: 131226 - protein, 9 aa, Borrelia burgdorferi
FRVSKSHSS

SEQ ID NO: 131227 - protein, 15 aa, Borrelia burgdorferi
IFYVKDLRVLYDKLS

SEQ ID NO: 131228 - protein, 9 aa, Borrelia burgdorferi
VKDLRVLYD

SEQ ID NO: 131229 - protein, 15 aa, Borrelia burgdorferi
LRVLYDKLSVSIDSD

SEQ ID NO: 131230 - protein, 9 aa, Borrelia burgdorferi
LYDKLSVSI

SEQ ID NO: 131231 - protein, 15 aa, Borrelia burgdorferi
DLRVLYDKLSVSIDS

SEQ ID NO: 131232 - protein, 9 aa, Borrelia burgdorferi
LYDKLSVSI

SEQ ID NO: 131233 - protein, 15 aa, Borrelia burgdorferi
SKRYAGDTILGVRVL

SEQ ID NO: 131234 - protein, 9 aa, Borrelia burgdorferi
YAGDTILGV

SEQ ID NO: 131235 - protein, 15 aa, Borrelia burgdorferi
FAELARDPSSTRLDL

SEQ ID NO: 131236 - protein, 9 aa, Borrelia burgdorferi
ARDPSSTRL

SEQ ID NO: 131237 - protein, 15 aa, Borrelia burgdorferi
LDFAELARDPSSTRL

SEQ ID NO: 131238 - protein, 9 aa, Borrelia burgdorferi
LARDPSSTR

SEQ ID NO: 131239 - protein, 15 aa, Borrelia burgdorferi
FYVKDLRVLYDKLSV

SEQ ID NO: 131240 - protein, 9 aa, Borrelia burgdorferi
LRVLYDKLS

SEQ ID NO: 131241 - protein, 15 aa, Borrelia burgdorferi
DFAELARDPSSTRLD

SEQ ID NO: 131242 - protein, 9 aa, Borrelia burgdorferi
ARDPSSTRL

SEQ ID NO: 131243 - protein, 15 aa, Borrelia burgdorferi
AELARDPSSTRLDLT

SEQ ID NO: 131244 - protein, 9 aa, Borrelia burgdorferi
ARDPSSTRL

SEQ ID NO: 131245 - protein, 15 aa, Borrelia burgdorferi
LLTPSARLQAYVKNS

SEQ ID NO: 131246 - protein, 9 aa, Borrelia burgdorferi
LLTPSARLQ

SEQ ID NO: 131247 - protein, 15 aa, Borrelia burgdorferi
ESKRYAGDTILGVRV

SEQ ID NO: 131248 - protein, 9 aa, Borrelia burgdorferi
YAGDTILGV

SEQ ID NO: 131249 - protein, 15 aa, Borrelia burgdorferi
RIIKDDVPNYPLASS

SEQ ID NO: 131250 - protein, 9 aa, Borrelia burgdorferi
IKDDVPNYP

SEQ ID NO: 131251 - protein, 15 aa, Borrelia burgdorferi
QSSAMIMPPFKIPFY

SEQ ID NO: 131252 - protein, 9 aa, Borrelia burgdorferi
MIMPPFKIP

SEQ ID NO: 131253 - protein, 15 aa, Borrelia burgdorferi
IPNISSRIIKDDVPN

SEQ ID NO: 131254 - protein, 9 aa, Borrelia burgdorferi
IPNISSRII

SEQ ID NO: 131255 - protein, 15 aa, Borrelia burgdorferi
SQSSAMIMPPFKIPF

SEQ ID NO: 131256 - protein, 9 aa, Borrelia burgdorferi
MIMPPFKIP

SEQ ID NO: 131257 - protein, 15 aa, Borrelia burgdorferi
SSAMIMPPFKIPFYS

SEQ ID NO: 131258 - protein, 9 aa, Borrelia burgdorferi
MIMPPFKIP

SEQ ID NO: 131259 - protein, 15 aa, Borrelia burgdorferi
YVYSGASGIVKPEDM

SEQ ID NO: 131260 - protein, 9 aa, Borrelia burgdorferi
VYSGASGIV

SEQ ID NO: 131261 - protein, 15 aa, Borrelia burgdorferi
IIKDDVPNYPLASSK

SEQ ID NO: 131262 - protein, 9 aa, Borrelia burgdorferi
VPNYPLASS

SEQ ID NO: 131263 - protein, 15 aa, Borrelia burgdorferi
KRYAGDTILGVRVLF

SEQ ID NO: 131264 - protein, 9 aa, Borrelia burgdorferi
YAGDTILGV

SEQ ID NO: 131265 - protein, 15 aa, Borrelia burgdorferi
GLIDNIKTMKEIKVS

SEQ ID NO: 131266 - protein, 9 aa, Borrelia burgdorferi
IKTMKEIKV

SEQ ID NO: 131267 - protein, 15 aa, Borrelia burgdorferi
KVYETSGTESLRKLK

SEQ ID NO: 131268 - protein, 9 aa, Borrelia burgdorferi
YETSGTESL

SEQ ID NO: 131269 - protein, 15 aa, Borrelia burgdorferi
RVLYDKLSVSIDSDI

SEQ ID NO: 131270 - protein, 9 aa, Borrelia burgdorferi
LYDKLSVSI

SEQ ID NO: 131271 - protein, 15 aa, Borrelia burgdorferi
KGLIDNIKTMKEIKV

SEQ ID NO: 131272 - protein, 9 aa, Borrelia burgdorferi
IDNIKTMKE

SEQ ID NO: 131273 - protein, 15 aa, Borrelia burgdorferi
IDNIKTMKEIKVSVY

SEQ ID NO: 131274 - protein, 9 aa, Borrelia burgdorferi
IKTMKEIKV

SEQ ID NO: 131275 - protein, 15 aa, Borrelia burgdorferi
SESVFKVYETSGTES

SEQ ID NO: 131276 - protein, 9 aa, Borrelia burgdorferi
FKVYETSGT

SEQ ID NO: 131277 - protein, 15 aa, Borrelia burgdorferi
ADLIWSNPNYIPNIS

SEQ ID NO: 131278 - protein, 9 aa, Borrelia burgdorferi
LIWSNPNYI

SEQ ID NO: 131279 - protein, 15 aa, Borrelia burgdorferi
SARLQAYVKNSVVAP

SEQ ID NO: 131280 - protein, 9 aa, Borrelia burgdorferi
AYVKNSVVA

SEQ ID NO: 131281 - protein, 15 aa, Borrelia burgdorferi
NFIFYVKDLRVLYDK

SEQ ID NO: 131282 - protein, 9 aa, Borrelia burgdorferi
FYVKDLRVL

SEQ ID NO: 131283 - protein, 15 aa, Borrelia burgdorferi
IDSESVFKVYETSGT

SEQ ID NO: 131284 - protein, 9 aa, Borrelia burgdorferi
IDSESVFKV

SEQ ID NO: 131285 - protein, 15 aa, Borrelia burgdorferi
SESKRYAGDTILGVR

SEQ ID NO: 131286 - protein, 9 aa, Borrelia burgdorferi
YAGDTILGV

SEQ ID NO: 131287 - protein, 15 aa, Borrelia burgdorferi
KNFIFYVKDLRVLYD

SEQ ID NO: 131288 - protein, 9 aa, Borrelia burgdorferi
FYVKDLRVL

SEQ ID NO: 131289 - protein, 15 aa, Borrelia burgdorferi
KSESKRYAGDTILGV

SEQ ID NO: 131290 - protein, 9 aa, Borrelia burgdorferi
RYAGDTILG

SEQ ID NO: 131291 - protein, 15 aa, Borrelia burgdorferi
DSESVFKVYETSGTE

SEQ ID NO: 131292 - protein, 9 aa, Borrelia burgdorferi
FKVYETSGT

SEQ ID NO: 131293 - protein, 15 aa, Borrelia burgdorferi
KGWADLIWSNPNYIP

SEQ ID NO: 131294 - protein, 9 aa, Borrelia burgdorferi
LIWSNPNYI

SEQ ID NO: 131295 - protein, 15 aa, Borrelia burgdorferi
GWADLIWSNPNYIPN

SEQ ID NO: 131296 - protein, 9 aa, Borrelia burgdorferi
LIWSNPNYI

SEQ ID NO: 131297 - protein, 15 aa, Borrelia burgdorferi
LIDNIKTMKEIKVSV

SEQ ID NO: 131298 - protein, 9 aa, Borrelia burgdorferi
IKTMKEIKV

SEQ ID NO: 131299 - protein, 15 aa, Borrelia burgdorferi
RYAGDTILGVRVLFP

SEQ ID NO: 131300 - protein, 9 aa, Borrelia burgdorferi
YAGDTILGV

SEQ ID NO: 131301 - protein, 15 aa, Borrelia burgdorferi
WADLIWSNPNYIPNI

SEQ ID NO: 131302 - protein, 9 aa, Borrelia burgdorferi
LIWSNPNYI

SEQ ID NO: 131303 - protein, 15 aa, Borrelia burgdorferi
DNIKTMKEIKVSVYS

SEQ ID NO: 131304 - protein, 9 aa, Borrelia burgdorferi
IKTMKEIKV

SEQ ID NO: 131305 - protein, 15 aa, Borrelia burgdorferi
YAGDTILGVRVLFPS

SEQ ID NO: 131306 - protein, 9 aa, Borrelia burgdorferi
ILGVRVLFP

SEQ ID NO: 131307 - protein, 15 aa, Borrelia burgdorferi
FIFYVKDLRVLYDKL

SEQ ID NO: 131308 - protein, 9 aa, Borrelia burgdorferi
FYVKDLRVL

SEQ ID NO: 131309 - protein, 15 aa, Borrelia burgdorferi
ELARDPSSTRLDLTN

SEQ ID NO: 131310 - protein, 9 aa, Borrelia burgdorferi
ARDPSSTRL

SEQ ID NO: 131311 - protein, 15 aa, Borrelia burgdorferi
YVKDLRVLYDKLSVS

SEQ ID NO: 131312 - protein, 9 aa, Borrelia burgdorferi
LRVLYDKLS

SEQ ID NO: 131313 - protein, 15 aa, Borrelia burgdorferi
APAVVKSESKRYAGD

SEQ ID NO: 131314 - protein, 9 aa, Borrelia burgdorferi
VVKSESKRY

SEQ ID NO: 131315 - protein, 15 aa, Borrelia burgdorferi
VAPAVVKSESKRYAG

SEQ ID NO: 131316 - protein, 9 aa, Borrelia burgdorferi
VVKSESKRY

SEQ ID NO: 131317 - protein, 15 aa, Borrelia burgdorferi
PAVVKSESKRYAGDT

SEQ ID NO: 131318 - protein, 9 aa, Borrelia burgdorferi
VVKSESKRY

SEQ ID NO: 131319 - protein, 15 aa, Borrelia burgdorferi
LASSKMRFKAFRVSK

SEQ ID NO: 131320 - protein, 9 aa, Borrelia burgdorferi
MRFKAFRVS

SEQ ID NO: 131321 - protein, 15 aa, Borrelia burgdorferi
FKGWADLIWSNPNYI

SEQ ID NO: 131322 - protein, 9 aa, Borrelia burgdorferi
FKGWADLIW

SEQ ID NO: 131323 - protein, 15 aa, Borrelia burgdorferi
EYAYSMGTLKFKGWA

SEQ ID NO: 131324 - protein, 9 aa, Borrelia burgdorferi
AYSMGTLKF

SEQ ID NO: 131325 - protein, 15 aa, Borrelia burgdorferi
SAMIMPPFKIPFYSG

SEQ ID NO: 131326 - protein, 9 aa, Borrelia burgdorferi
MIMPPFKIP

SEQ ID NO: 131327 - protein, 15 aa, Borrelia burgdorferi
PLASSKMRFKAFRVS

SEQ ID NO: 131328 - protein, 9 aa, Borrelia burgdorferi
KMRFKAFRV

SEQ ID NO: 131329 - protein, 15 aa, Borrelia burgdorferi
YPLASSKMRFKAFRV

SEQ ID NO: 131330 - protein, 9 aa, Borrelia burgdorferi
YPLASSKMR

SEQ ID NO: 131331 - protein, 15 aa, Borrelia burgdorferi
LLSTVLFAQETDGLA

SEQ ID NO: 131332 - protein, 9 aa, Borrelia burgdorferi
STVLFAQET

SEQ ID NO: 131333 - protein, 15 aa, Borrelia burgdorferi
FLLSTVLFAQETDGL

SEQ ID NO: 131334 - protein, 9 aa, Borrelia burgdorferi
STVLFAQET

SEQ ID NO: 131335 - protein, 15 aa, Borrelia burgdorferi
LTNYVDYVYSGASGI

SEQ ID NO: 131336 - protein, 9 aa, Borrelia burgdorferi
VDYVYSGAS

SEQ ID NO: 131337 - protein, 15 aa, Borrelia burgdorferi
VKNFIFYVKDLRVLY

SEQ ID NO: 131338 - protein, 9 aa, Borrelia burgdorferi
FYVKDLRVL

SEQ ID NO: 131339 - protein, 15 aa, Borrelia burgdorferi
KVKNFIFYVKDLRVL

SEQ ID NO: 131340 - protein, 9 aa, Borrelia burgdorferi
IFYVKDLRV

SEQ ID NO: 131341 - protein, 15 aa, Borrelia burgdorferi
VYSGASGIVKPEDMV

SEQ ID NO: 131342 - protein, 9 aa, Borrelia burgdorferi
VYSGASGIV

SEQ ID NO: 131343 - protein, 15 aa, Borrelia burgdorferi
DLIWSNPNYIPNISS

SEQ ID NO: 131344 - protein, 9 aa, Borrelia burgdorferi
LIWSNPNYI

SEQ ID NO: 131345 - protein, 15 aa, Borrelia burgdorferi
AGDTILGVRVLFPSY

SEQ ID NO: 131346 - protein, 9 aa, Borrelia burgdorferi
ILGVRVLFP

SEQ ID NO: 131347 - protein, 15 aa, Borrelia burgdorferi
VLDFAELARDPSSTR

SEQ ID NO: 131348 - protein, 9 aa, Borrelia burgdorferi
FAELARDPS

SEQ ID NO: 131349 - protein, 15 aa, Borrelia burgdorferi
VKNFIFYVKDLRVLY

SEQ ID NO: 131350 - protein, 9 aa, Borrelia burgdorferi
FIFYVKDLR

SEQ ID NO: 131351 - protein, 15 aa, Borrelia burgdorferi
KNFIFYVKDLRVLYD

SEQ ID NO: 131352 - protein, 9 aa, Borrelia burgdorferi
YVKDLRVLY

SEQ ID NO: 131353 - protein, 15 aa, Borrelia burgdorferi
NFIFYVKDLRVLYDK

SEQ ID NO: 131354 - protein, 9 aa, Borrelia burgdorferi
YVKDLRVLY

SEQ ID NO: 131355 - protein, 15 aa, Borrelia burgdorferi
IFYVKDLRVLYDKLS

SEQ ID NO: 131356 - protein, 9 aa, Borrelia burgdorferi
YVKDLRVLY

SEQ ID NO: 131357 - protein, 15 aa, Borrelia burgdorferi
KNFIFYVKDLRVLYD

SEQ ID NO: 131358 - protein, 9 aa, Borrelia burgdorferi
YVKDLRVLY

SEQ ID NO: 131359 - protein, 15 aa, Borrelia burgdorferi
NFIFYVKDLRVLYDK

SEQ ID NO: 131360 - protein, 9 aa, Borrelia burgdorferi
YVKDLRVLY

SEQ ID NO: 131361 - protein, 15 aa, Borrelia burgdorferi
VKNFIFYVKDLRVLY

SEQ ID NO: 131362 - protein, 9 aa, Borrelia burgdorferi
FIFYVKDLR

SEQ ID NO: 131363 - protein, 15 aa, Borrelia burgdorferi
FIFYVKDLRVLYDKL

SEQ ID NO: 131364 - protein, 9 aa, Borrelia burgdorferi
YVKDLRVLY

SEQ ID NO: 131365 - protein, 15 aa, Borrelia burgdorferi
IFYVKDLRVLYDKLS

SEQ ID NO: 131366 - protein, 9 aa, Borrelia burgdorferi
YVKDLRVLY

SEQ ID NO: 131367 - protein, 15 aa, Borrelia burgdorferi
ILFFLLSTVLFAQET

SEQ ID NO: 131368 - protein, 9 aa, Borrelia burgdorferi
FFLLSTVLF

SEQ ID NO: 131369 - protein, 15 aa, Borrelia burgdorferi
KSILFFLLSTVLFAQ

SEQ ID NO: 131370 - protein, 9 aa, Borrelia burgdorferi
FFLLSTVLF

SEQ ID NO: 131371 - protein, 15 aa, Borrelia burgdorferi
SILFFLLSTVLFAQE

SEQ ID NO: 131372 - protein, 9 aa, Borrelia burgdorferi
FFLLSTVLF

SEQ ID NO: 131373 - protein, 15 aa, Borrelia burgdorferi
AKSILFFLLSTVLFA

SEQ ID NO: 131374 - protein, 9 aa, Borrelia burgdorferi
FFLLSTVLF

SEQ ID NO: 131375 - protein, 15 aa, Borrelia burgdorferi
KAKSILFFLLSTVLF

SEQ ID NO: 131376 - protein, 9 aa, Borrelia burgdorferi
LFFLLSTVL

SEQ ID NO: 131377 - protein, 15 aa, Borrelia burgdorferi
VLDFAELARDPSSTR

SEQ ID NO: 131378 - protein, 9 aa, Borrelia burgdorferi
FAELARDPS

SEQ ID NO: 131379 - protein, 15 aa, Borrelia burgdorferi
LFFLLSTVLFAQETD

SEQ ID NO: 131380 - protein, 9 aa, Borrelia burgdorferi
FLLSTVLFA

SEQ ID NO: 131381 - protein, 15 aa, Borrelia burgdorferi
LDFAELARDPSSTRL

SEQ ID NO: 131382 - protein, 9 aa, Borrelia burgdorferi
LARDPSSTR

SEQ ID NO: 131383 - protein, 15 aa, Borrelia burgdorferi
ARLQAYVKNSVVAPA

SEQ ID NO: 131384 - protein, 9 aa, Borrelia burgdorferi
YVKNSVVAP

SEQ ID NO: 131385 - protein, 15 aa, Borrelia burgdorferi
KMRFKAFRVSKSHSS

SEQ ID NO: 131386 - protein, 9 aa, Borrelia burgdorferi
FKAFRVSKS

SEQ ID NO: 131387 - protein, 15 aa, Borrelia burgdorferi
RLQAYVKNSVVAPAV

SEQ ID NO: 131388 - protein, 9 aa, Borrelia burgdorferi
VKNSVVAPA

SEQ ID NO: 131389 - protein, 15 aa, Borrelia burgdorferi
MRFKAFRVSKSHSSK

SEQ ID NO: 131390 - protein, 9 aa, Borrelia burgdorferi
FRVSKSHSS

SEQ ID NO: 131391 - protein, 15 aa, Borrelia burgdorferi
DFAELARDPSSTRLD

SEQ ID NO: 131392 - protein, 9 aa, Borrelia burgdorferi
LARDPSSTR

SEQ ID NO: 131393 - protein, 15 aa, Borrelia burgdorferi
LQAYVKNSVVAPAVV

SEQ ID NO: 131394 - protein, 9 aa, Borrelia burgdorferi
VKNSVVAPA

SEQ ID NO: 131395 - protein, 15 aa, Borrelia burgdorferi
FYVKDLRVLYDKLSV

SEQ ID NO: 131396 - protein, 9 aa, Borrelia burgdorferi
YVKDLRVLY

SEQ ID NO: 131397 - protein, 15 aa, Borrelia burgdorferi
FAELARDPSSTRLDL

SEQ ID NO: 131398 - protein, 9 aa, Borrelia burgdorferi
LARDPSSTR

SEQ ID NO: 131399 - protein, 15 aa, Borrelia burgdorferi
YVKDLRVLYDKLSVS

SEQ ID NO: 131400 - protein, 9 aa, Borrelia burgdorferi
YVKDLRVLY

SEQ ID NO: 131401 - protein, 15 aa, Borrelia burgdorferi
QAYVKNSVVAPAVVK

SEQ ID NO: 131402 - protein, 9 aa, Borrelia burgdorferi
VKNSVVAPA

SEQ ID NO: 131403 - protein, 15 aa, Borrelia burgdorferi
AELARDPSSTRLDLT

SEQ ID NO: 131404 - protein, 9 aa, Borrelia burgdorferi
LARDPSSTR

SEQ ID NO: 131405 - protein, 15 aa, Borrelia burgdorferi
INNWSVLLTPSARLQ

SEQ ID NO: 131406 - protein, 9 aa, Borrelia burgdorferi
WSVLLTPSA

SEQ ID NO: 131407 - protein, 15 aa, Borrelia burgdorferi
GINNWSVLLTPSARL

SEQ ID NO: 131408 - protein, 9 aa, Borrelia burgdorferi
WSVLLTPSA

SEQ ID NO: 131409 - protein, 15 aa, Borrelia burgdorferi
NNWSVLLTPSARLQA

SEQ ID NO: 131410 - protein, 9 aa, Borrelia burgdorferi
WSVLLTPSA

SEQ ID NO: 131411 - protein, 15 aa, Borrelia burgdorferi
AYVKNSVVAPAVVKS

SEQ ID NO: 131412 - protein, 9 aa, Borrelia burgdorferi
VKNSVVAPA

SEQ ID NO: 131413 - protein, 15 aa, Borrelia burgdorferi
DLGINNWSVLLTPSA

SEQ ID NO: 131414 - protein, 9 aa, Borrelia burgdorferi
GINNWSVLL

SEQ ID NO: 131415 - protein, 15 aa, Borrelia burgdorferi
FFLLSTVLFAQETDG

SEQ ID NO: 131416 - protein, 9 aa, Borrelia burgdorferi
FFLLSTVLF

SEQ ID NO: 131417 - protein, 15 aa, Borrelia burgdorferi
LGINNWSVLLTPSAR

SEQ ID NO: 131418 - protein, 9 aa, Borrelia burgdorferi
WSVLLTPSA

SEQ ID NO: 131419 - protein, 15 aa, Borrelia burgdorferi
FKAFRVSKSHSSKVK

SEQ ID NO: 131420 - protein, 9 aa, Borrelia burgdorferi
FRVSKSHSS

SEQ ID NO: 131421 - protein, 15 aa, Borrelia burgdorferi
RFKAFRVSKSHSSKV

SEQ ID NO: 131422 - protein, 9 aa, Borrelia burgdorferi
FRVSKSHSS

SEQ ID NO: 131423 - protein, 15 aa, Borrelia burgdorferi
LGVRVLFPSYSQSSA

SEQ ID NO: 131424 - protein, 9 aa, Borrelia burgdorferi
LFPSYSQSS

SEQ ID NO: 131425 - protein, 15 aa, Borrelia burgdorferi
ILGVRVLFPSYSQSS

SEQ ID NO: 131426 - protein, 9 aa, Borrelia burgdorferi
VRVLFPSYS

SEQ ID NO: 131427 - protein, 15 aa, Borrelia burgdorferi
GVRVLFPSYSQSSAM

SEQ ID NO: 131428 - protein, 9 aa, Borrelia burgdorferi
LFPSYSQSS

SEQ ID NO: 131429 - protein, 15 aa, Borrelia burgdorferi
NGMEYAYSMGTLKFK

SEQ ID NO: 131430 - protein, 9 aa, Borrelia burgdorferi
MEYAYSMGT

SEQ ID NO: 131431 - protein, 15 aa, Borrelia burgdorferi
MNGMEYAYSMGTLKF

SEQ ID NO: 131432 - protein, 9 aa, Borrelia burgdorferi
MEYAYSMGT

SEQ ID NO: 131433 - protein, 15 aa, Borrelia burgdorferi
INNWSVLLTPSARLQ

SEQ ID NO: 131434 - protein, 9 aa, Borrelia burgdorferi
VLLTPSARL

SEQ ID NO: 131435 - protein, 15 aa, Borrelia burgdorferi
NNWSVLLTPSARLQA

SEQ ID NO: 131436 - protein, 9 aa, Borrelia burgdorferi
VLLTPSARL

SEQ ID NO: 131437 - protein, 15 aa, Borrelia burgdorferi
GINNWSVLLTPSARL

SEQ ID NO: 131438 - protein, 9 aa, Borrelia burgdorferi
WSVLLTPSA

SEQ ID NO: 131439 - protein, 15 aa, Borrelia burgdorferi
NWSVLLTPSARLQAY

SEQ ID NO: 131440 - protein, 9 aa, Borrelia burgdorferi
VLLTPSARL

SEQ ID NO: 131441 - protein, 15 aa, Borrelia burgdorferi
WSVLLTPSARLQAYV

SEQ ID NO: 131442 - protein, 9 aa, Borrelia burgdorferi
VLLTPSARL

SEQ ID NO: 131443 - protein, 15 aa, Borrelia burgdorferi
KGWADLIWSNPNYIP

SEQ ID NO: 131444 - protein, 9 aa, Borrelia burgdorferi
WADLIWSNP

SEQ ID NO: 131445 - protein, 15 aa, Borrelia burgdorferi
FKGWADLIWSNPNYI

SEQ ID NO: 131446 - protein, 9 aa, Borrelia burgdorferi
WADLIWSNP

SEQ ID NO: 131447 - protein, 15 aa, Borrelia burgdorferi
ILGVRVLFPSYSQSS

SEQ ID NO: 131448 - protein, 9 aa, Borrelia burgdorferi
ILGVRVLFP

SEQ ID NO: 131449 - protein, 15 aa, Borrelia burgdorferi
KSILFFLLSTVLFAQ

SEQ ID NO: 131450 - protein, 9 aa, Borrelia burgdorferi
FLLSTVLFA

SEQ ID NO: 131451 - protein, 15 aa, Borrelia burgdorferi
LGINNWSVLLTPSAR

SEQ ID NO: 131452 - protein, 9 aa, Borrelia burgdorferi
WSVLLTPSA

SEQ ID NO: 131453 - protein, 15 aa, Borrelia burgdorferi
DLGINNWSVLLTPSA

SEQ ID NO: 131454 - protein, 9 aa, Borrelia burgdorferi
GINNWSVLL

SEQ ID NO: 131455 - protein, 15 aa, Borrelia burgdorferi
AKSILFFLLSTVLFA

SEQ ID NO: 131456 - protein, 9 aa, Borrelia burgdorferi
ILFFLLSTV

SEQ ID NO: 131457 - protein, 15 aa, Borrelia burgdorferi
GWADLIWSNPNYIPN

SEQ ID NO: 131458 - protein, 9 aa, Borrelia burgdorferi
LIWSNPNYI

SEQ ID NO: 131459 - protein, 15 aa, Borrelia burgdorferi
WADLIWSNPNYIPNI

SEQ ID NO: 131460 - protein, 9 aa, Borrelia burgdorferi
LIWSNPNYI

SEQ ID NO: 131461 - protein, 15 aa, Borrelia burgdorferi
ILFFLLSTVLFAQET

SEQ ID NO: 131462 - protein, 9 aa, Borrelia burgdorferi
FLLSTVLFA

SEQ ID NO: 131463 - protein, 15 aa, Borrelia burgdorferi
SILFFLLSTVLFAQE

SEQ ID NO: 131464 - protein, 9 aa, Borrelia burgdorferi
FLLSTVLFA

SEQ ID NO: 131465 - protein, 15 aa, Borrelia burgdorferi
DTILGVRVLFPSYSQ

SEQ ID NO: 131466 - protein, 9 aa, Borrelia burgdorferi
ILGVRVLFP

SEQ ID NO: 131467 - protein, 15 aa, Borrelia burgdorferi
GDTILGVRVLFPSYS

SEQ ID NO: 131468 - protein, 9 aa, Borrelia burgdorferi
ILGVRVLFP

SEQ ID NO: 131469 - protein, 15 aa, Borrelia burgdorferi
AGDTILGVRVLFPSY

SEQ ID NO: 131470 - protein, 9 aa, Borrelia burgdorferi
ILGVRVLFP

SEQ ID NO: 131471 - protein, 15 aa, Borrelia burgdorferi
RYAGDTILGVRVLFP

SEQ ID NO: 131472 - protein, 9 aa, Borrelia burgdorferi
YAGDTILGV

SEQ ID NO: 131473 - protein, 15 aa, Borrelia burgdorferi
YAGDTILGVRVLFPS

SEQ ID NO: 131474 - protein, 9 aa, Borrelia burgdorferi
ILGVRVLFP

SEQ ID NO: 131475 - protein, 15 aa, Borrelia burgdorferi
LFFLLSTVLFAQETD

SEQ ID NO: 131476 - protein, 9 aa, Borrelia burgdorferi
FLLSTVLFA

SEQ ID NO: 131477 - protein, 15 aa, Borrelia burgdorferi
SVLLTPSARLQAYVK

SEQ ID NO: 131478 - protein, 9 aa, Borrelia burgdorferi
VLLTPSARL

SEQ ID NO: 131479 - protein, 15 aa, Borrelia burgdorferi
IFYVKDLRVLYDKLS

SEQ ID NO: 131480 - protein, 9 aa, Borrelia burgdorferi
VKDLRVLYD

SEQ ID NO: 131481 - protein, 15 aa, Borrelia burgdorferi
FYVKDLRVLYDKLSV

SEQ ID NO: 131482 - protein, 9 aa, Borrelia burgdorferi
VKDLRVLYD

SEQ ID NO: 131483 - protein, 15 aa, Borrelia burgdorferi
KNFIFYVKDLRVLYD

SEQ ID NO: 131484 - protein, 9 aa, Borrelia burgdorferi
YVKDLRVLY

SEQ ID NO: 131485 - protein, 15 aa, Borrelia burgdorferi
NFIFYVKDLRVLYDK

SEQ ID NO: 131486 - protein, 9 aa, Borrelia burgdorferi
VKDLRVLYD

SEQ ID NO: 131487 - protein, 15 aa, Borrelia burgdorferi
FIFYVKDLRVLYDKL

SEQ ID NO: 131488 - protein, 9 aa, Borrelia burgdorferi
VKDLRVLYD

SEQ ID NO: 131489 - protein, 15 aa, Borrelia burgdorferi
FKGWADLIWSNPNYI

SEQ ID NO: 131490 - protein, 9 aa, Borrelia burgdorferi
ADLIWSNPN

SEQ ID NO: 131491 - protein, 15 aa, Borrelia burgdorferi
GWADLIWSNPNYIPN

SEQ ID NO: 131492 - protein, 9 aa, Borrelia burgdorferi
LIWSNPNYI

SEQ ID NO: 131493 - protein, 15 aa, Borrelia burgdorferi
DLGINNWSVLLTPSA

SEQ ID NO: 131494 - protein, 9 aa, Borrelia burgdorferi
INNWSVLLT

SEQ ID NO: 131495 - protein, 15 aa, Borrelia burgdorferi
KGWADLIWSNPNYIP

SEQ ID NO: 131496 - protein, 9 aa, Borrelia burgdorferi
ADLIWSNPN

SEQ ID NO: 131497 - protein, 15 aa, Borrelia burgdorferi
LGINNWSVLLTPSAR

SEQ ID NO: 131498 - protein, 9 aa, Borrelia burgdorferi
INNWSVLLT

SEQ ID NO: 131499 - protein, 15 aa, Borrelia burgdorferi
DLIWSNPNYIPNISS

SEQ ID NO: 131500 - protein, 9 aa, Borrelia burgdorferi
LIWSNPNYI

SEQ ID NO: 131501 - protein, 15 aa, Borrelia burgdorferi
KMRFKAFRVSKSHSS

SEQ ID NO: 131502 - protein, 9 aa, Borrelia burgdorferi
FKAFRVSKS

SEQ ID NO: 131503 - protein, 15 aa, Borrelia burgdorferi
VVDLGINNWSVLLTP

SEQ ID NO: 131504 - protein, 9 aa, Borrelia burgdorferi
INNWSVLLT

SEQ ID NO: 131505 - protein, 15 aa, Borrelia burgdorferi
VDLGINNWSVLLTPS

SEQ ID NO: 131506 - protein, 9 aa, Borrelia burgdorferi
INNWSVLLT

SEQ ID NO: 131507 - protein, 15 aa, Borrelia burgdorferi
MRFKAFRVSKSHSSK

SEQ ID NO: 131508 - protein, 9 aa, Borrelia burgdorferi
FKAFRVSKS

SEQ ID NO: 131509 - protein, 15 aa, Borrelia burgdorferi
MVVDLGINNWSVLLT

SEQ ID NO: 131510 - protein, 9 aa, Borrelia burgdorferi
GINNWSVLL

SEQ ID NO: 131511 - protein, 15 aa, Borrelia burgdorferi
ASSKMRFKAFRVSKS

SEQ ID NO: 131512 - protein, 9 aa, Borrelia burgdorferi
SKMRFKAFR

SEQ ID NO: 131513 - protein, 15 aa, Borrelia burgdorferi
SSKMRFKAFRVSKSH

SEQ ID NO: 131514 - protein, 9 aa, Borrelia burgdorferi
FKAFRVSKS

SEQ ID NO: 131515 - protein, 15 aa, Borrelia burgdorferi
SKMRFKAFRVSKSHS

SEQ ID NO: 131516 - protein, 9 aa, Borrelia burgdorferi
FKAFRVSKS

SEQ ID NO: 131517 - protein, 15 aa, Borrelia burgdorferi
WADLIWSNPNYIPNI

SEQ ID NO: 131518 - protein, 9 aa, Borrelia burgdorferi
LIWSNPNYI

SEQ ID NO: 131519 - protein, 15 aa, Borrelia burgdorferi
LIWSNPNYIPNISSR

SEQ ID NO: 131520 - protein, 9 aa, Borrelia burgdorferi
PNYIPNISS

SEQ ID NO: 131521 - protein, 15 aa, Borrelia burgdorferi
GINNWSVLLTPSARL

SEQ ID NO: 131522 - protein, 9 aa, Borrelia burgdorferi
INNWSVLLT

SEQ ID NO: 131523 - protein, 15 aa, Borrelia burgdorferi
ADLIWSNPNYIPNIS

SEQ ID NO: 131524 - protein, 9 aa, Borrelia burgdorferi
LIWSNPNYI

SEQ ID NO: 131525 - protein, 15 aa, Borrelia burgdorferi
INNWSVLLTPSARLQ

SEQ ID NO: 131526 - protein, 9 aa, Borrelia burgdorferi
INNWSVLLT

SEQ ID NO: 131527 - protein, 15 aa, Borrelia burgdorferi
LKFKGWADLIWSNPN

SEQ ID NO: 131528 - protein, 9 aa, Borrelia burgdorferi
FKGWADLIW

SEQ ID NO: 131529 - protein, 15 aa, Borrelia burgdorferi
YVKDLRVLYDKLSVS

SEQ ID NO: 131530 - protein, 9 aa, Borrelia burgdorferi
VKDLRVLYD

SEQ ID NO: 131531 - protein, 15 aa, Borrelia burgdorferi
VLDFAELARDPSSTR

SEQ ID NO: 131532 - protein, 9 aa, Borrelia burgdorferi
FAELARDPS

SEQ ID NO: 131533 - protein, 15 aa, Borrelia burgdorferi
VKDLRVLYDKLSVSI

SEQ ID NO: 131534 - protein, 9 aa, Borrelia burgdorferi
VKDLRVLYD

SEQ ID NO: 131535 - protein, 15 aa, Borrelia burgdorferi
LDFAELARDPSSTRL

SEQ ID NO: 131536 - protein, 9 aa, Borrelia burgdorferi
LARDPSSTR

SEQ ID NO: 131537 - protein, 15 aa, Borrelia burgdorferi
KFKGWADLIWSNPNY

SEQ ID NO: 131538 - protein, 9 aa, Borrelia burgdorferi
ADLIWSNPN

SEQ ID NO: 131539 - protein, 15 aa, Borrelia burgdorferi
DFAELARDPSSTRLD

SEQ ID NO: 131540 - protein, 9 aa, Borrelia burgdorferi
LARDPSSTR

SEQ ID NO: 131541 - protein, 15 aa, Borrelia burgdorferi
DTILGVRVLFPSYSQ

SEQ ID NO: 131542 - protein, 9 aa, Borrelia burgdorferi
VRVLFPSYS

SEQ ID NO: 131543 - protein, 15 aa, Borrelia burgdorferi
FAELARDPSSTRLDL

SEQ ID NO: 131544 - protein, 9 aa, Borrelia burgdorferi
LARDPSSTR

SEQ ID NO: 131545 - protein, 15 aa, Borrelia burgdorferi
ILGVRVLFPSYSQSS

SEQ ID NO: 131546 - protein, 9 aa, Borrelia burgdorferi
RVLFPSYSQ

SEQ ID NO: 131547 - protein, 15 aa, Borrelia burgdorferi
TILGVRVLFPSYSQS

SEQ ID NO: 131548 - protein, 9 aa, Borrelia burgdorferi
RVLFPSYSQ

SEQ ID NO: 131549 - protein, 15 aa, Borrelia burgdorferi
AELARDPSSTRLDLT

SEQ ID NO: 131550 - protein, 9 aa, Borrelia burgdorferi
LARDPSSTR

SEQ ID NO: 131551 - protein, 15 aa, Borrelia burgdorferi
LGVRVLFPSYSQSSA

SEQ ID NO: 131552 - protein, 9 aa, Borrelia burgdorferi
RVLFPSYSQ

SEQ ID NO: 131553 - protein, 15 aa, Borrelia burgdorferi
WSNPNYIPNISSRII

SEQ ID NO: 131554 - protein, 9 aa, Borrelia burgdorferi
YIPNISSRI

SEQ ID NO: 131555 - protein, 15 aa, Borrelia burgdorferi
SNPNYIPNISSRIIK

SEQ ID NO: 131556 - protein, 9 aa, Borrelia burgdorferi
IPNISSRII

SEQ ID NO: 131557 - protein, 15 aa, Borrelia burgdorferi
NPNYIPNISSRIIKD

SEQ ID NO: 131558 - protein, 9 aa, Borrelia burgdorferi
IPNISSRII

SEQ ID NO: 131559 - protein, 15 aa, Borrelia burgdorferi
PNYIPNISSRIIKDD

SEQ ID NO: 131560 - protein, 9 aa, Borrelia burgdorferi
IPNISSRII

SEQ ID NO: 131561 - protein, 15 aa, Borrelia burgdorferi
NYIPNISSRIIKDDV

SEQ ID NO: 131562 - protein, 9 aa, Borrelia burgdorferi
IPNISSRII

SEQ ID NO: 131563 - protein, 15 aa, Borrelia burgdorferi
YIPNISSRIIKDDVP

SEQ ID NO: 131564 - protein, 9 aa, Borrelia burgdorferi
IPNISSRII

SEQ ID NO: 131565 - protein, 15 aa, Borrelia burgdorferi
NWSVLLTPSARLQAY

SEQ ID NO: 131566 - protein, 9 aa, Borrelia burgdorferi
VLLTPSARL

SEQ ID NO: 131567 - protein, 15 aa, Borrelia burgdorferi
GINNWSVLLTPSARL

SEQ ID NO: 131568 - protein, 9 aa, Borrelia burgdorferi
SVLLTPSAR

SEQ ID NO: 131569 - protein, 15 aa, Borrelia burgdorferi
WSVLLTPSARLQAYV

SEQ ID NO: 131570 - protein, 9 aa, Borrelia burgdorferi
VLLTPSARL

SEQ ID NO: 131571 - protein, 15 aa, Borrelia burgdorferi
INNWSVLLTPSARLQ

SEQ ID NO: 131572 - protein, 9 aa, Borrelia burgdorferi
VLLTPSARL

SEQ ID NO: 131573 - protein, 15 aa, Borrelia burgdorferi
NNWSVLLTPSARLQA

SEQ ID NO: 131574 - protein, 9 aa, Borrelia burgdorferi
VLLTPSARL

SEQ ID NO: 131575 - protein, 15 aa, Borrelia burgdorferi
IWSNPNYIPNISSRI

SEQ ID NO: 131576 - protein, 9 aa, Borrelia burgdorferi
WSNPNYIPN

SEQ ID NO: 131577 - protein, 15 aa, Borrelia burgdorferi
RFKAFRVSKSHSSKV

SEQ ID NO: 131578 - protein, 9 aa, Borrelia burgdorferi
FRVSKSHSS

SEQ ID NO: 131579 - protein, 15 aa, Borrelia burgdorferi
FKAFRVSKSHSSKVK

SEQ ID NO: 131580 - protein, 9 aa, Borrelia burgdorferi
VSKSHSSKV

SEQ ID NO: 131581 - protein, 15 aa, Borrelia burgdorferi
KAFRVSKSHSSKVKN

SEQ ID NO: 131582 - protein, 9 aa, Borrelia burgdorferi
VSKSHSSKV

SEQ ID NO: 131583 - protein, 15 aa, Borrelia burgdorferi
IKTMKEIKVSVYSLG

SEQ ID NO: 131584 - protein, 9 aa, Borrelia burgdorferi
MKEIKVSVY

SEQ ID NO: 131585 - protein, 15 aa, Borrelia burgdorferi
KTMKEIKVSVYSLGY

SEQ ID NO: 131586 - protein, 9 aa, Borrelia burgdorferi
MKEIKVSVY

SEQ ID NO: 131587 - protein, 15 aa, Borrelia burgdorferi
NIKTMKEIKVSVYSL

SEQ ID NO: 131588 - protein, 9 aa, Borrelia burgdorferi
MKEIKVSVY

SEQ ID NO: 131589 - protein, 15 aa, Borrelia burgdorferi
KSILFFLLSTVLFAQ

SEQ ID NO: 131590 - protein, 9 aa, Borrelia burgdorferi
LFFLLSTVL

SEQ ID NO: 131591 - protein, 15 aa, Borrelia burgdorferi
SILFFLLSTVLFAQE

SEQ ID NO: 131592 - protein, 9 aa, Borrelia burgdorferi
LFFLLSTVL

SEQ ID NO: 131593 - protein, 15 aa, Borrelia burgdorferi
AKSILFFLLSTVLFA

SEQ ID NO: 131594 - protein, 9 aa, Borrelia burgdorferi
LFFLLSTVL

SEQ ID NO: 131595 - protein, 15 aa, Borrelia burgdorferi
AFRVSKSHSSKVKNF

SEQ ID NO: 131596 - protein, 9 aa, Borrelia burgdorferi
VSKSHSSKV

SEQ ID NO: 131597 - protein, 15 aa, Borrelia burgdorferi
FRVSKSHSSKVKNFI

SEQ ID NO: 131598 - protein, 9 aa, Borrelia burgdorferi
VSKSHSSKV

SEQ ID NO: 131599 - protein, 15 aa, Borrelia burgdorferi
IDNIKTMKEIKVSVY

SEQ ID NO: 131600 - protein, 9 aa, Borrelia burgdorferi
TMKEIKVSV

SEQ ID NO: 131601 - protein, 15 aa, Borrelia burgdorferi
DNIKTMKEIKVSVYS

SEQ ID NO: 131602 - protein, 9 aa, Borrelia burgdorferi
MKEIKVSVY

SEQ ID NO: 131603 - protein, 15 aa, Borrelia burgdorferi
MVVDLGINNWSVLLT

SEQ ID NO: 131604 - protein, 9 aa, Borrelia burgdorferi
LGINNWSVL

SEQ ID NO: 131605 - protein, 15 aa, Borrelia burgdorferi
KMRFKAFRVSKSHSS

SEQ ID NO: 131606 - protein, 9 aa, Borrelia burgdorferi
FKAFRVSKS

SEQ ID NO: 131607 - protein, 15 aa, Borrelia burgdorferi
VVDLGINNWSVLLTP

SEQ ID NO: 131608 - protein, 9 aa, Borrelia burgdorferi
INNWSVLLT

SEQ ID NO: 131609 - protein, 15 aa, Borrelia burgdorferi
SVLLTPSARLQAYVK

SEQ ID NO: 131610 - protein, 9 aa, Borrelia burgdorferi
VLLTPSARL

SEQ ID NO: 131611 - protein, 15 aa, Borrelia burgdorferi
VLLTPSARLQAYVKN

SEQ ID NO: 131612 - protein, 9 aa, Borrelia burgdorferi
VLLTPSARL

SEQ ID NO: 131613 - protein, 15 aa, Borrelia burgdorferi
KAKSILFFLLSTVLF

SEQ ID NO: 131614 - protein, 9 aa, Borrelia burgdorferi
LFFLLSTVL

SEQ ID NO: 131615 - protein, 15 aa, Borrelia burgdorferi
MRFKAFRVSKSHSSK

SEQ ID NO: 131616 - protein, 9 aa, Borrelia burgdorferi
FRVSKSHSS

SEQ ID NO: 131617 - protein, 15 aa, Borrelia burgdorferi
VDLGINNWSVLLTPS

SEQ ID NO: 131618 - protein, 9 aa, Borrelia burgdorferi
LGINNWSVL

SEQ ID NO: 131619 - protein, 15 aa, Borrelia burgdorferi
RVLFPSYSQSSAMIM

SEQ ID NO: 131620 - protein, 9 aa, Borrelia burgdorferi
LFPSYSQSS

SEQ ID NO: 131621 - protein, 15 aa, Borrelia burgdorferi
VVAPAVVKSESKRYA

SEQ ID NO: 131622 - protein, 9 aa, Borrelia burgdorferi
VVKSESKRY

SEQ ID NO: 131623 - protein, 15 aa, Borrelia burgdorferi
VAPAVVKSESKRYAG

SEQ ID NO: 131624 - protein, 9 aa, Borrelia burgdorferi
VVKSESKRY

SEQ ID NO: 131625 - protein, 15 aa, Borrelia burgdorferi
IPNISSRIIKDDVPN

SEQ ID NO: 131626 - protein, 9 aa, Borrelia burgdorferi
IPNISSRII

SEQ ID NO: 131627 - protein, 15 aa, Borrelia burgdorferi
APAVVKSESKRYAGD

SEQ ID NO: 131628 - protein, 9 aa, Borrelia burgdorferi
VVKSESKRY

SEQ ID NO: 131629 - protein, 15 aa, Borrelia burgdorferi
DMVVDLGINNWSVLL

SEQ ID NO: 131630 - protein, 9 aa, Borrelia burgdorferi
LGINNWSVL

SEQ ID NO: 131631 - protein, 15 aa, Borrelia burgdorferi
SVVAPAVVKSESKRY

SEQ ID NO: 131632 - protein, 9 aa, Borrelia burgdorferi
SVVAPAVVK

SEQ ID NO: 131633 - protein, 15 aa, Borrelia burgdorferi
RKAKSILFFLLSTVL

SEQ ID NO: 131634 - protein, 9 aa, Borrelia burgdorferi
AKSILFFLL

SEQ ID NO: 131635 - protein, 15 aa, Borrelia burgdorferi
PAVVKSESKRYAGDT

SEQ ID NO: 131636 - protein, 9 aa, Borrelia burgdorferi
VVKSESKRY

SEQ ID NO: 131637 - protein, 15 aa, Borrelia burgdorferi
VLFPSYSQSSAMIMP

SEQ ID NO: 131638 - protein, 9 aa, Borrelia burgdorferi
YSQSSAMIM

SEQ ID NO: 131639 - protein, 15 aa, Borrelia burgdorferi
ILFFLLSTVLFAQET

SEQ ID NO: 131640 - protein, 9 aa, Borrelia burgdorferi
LFFLLSTVL

SEQ ID NO: 131641 - protein, 15 aa, Borrelia burgdorferi
NNFVKAMTNVGSFKT

SEQ ID NO: 131642 - protein, 9 aa, Borrelia burgdorferi
FVKAMTNVG

SEQ ID NO: 131643 - protein, 15 aa, Borrelia burgdorferi
AEVNNFVKAMTNVGS

SEQ ID NO: 131644 - protein, 9 aa, Borrelia burgdorferi
FVKAMTNVG

SEQ ID NO: 131645 - protein, 15 aa, Borrelia burgdorferi
EVNNFVKAMTNVGSF

SEQ ID NO: 131646 - protein, 9 aa, Borrelia burgdorferi
FVKAMTNVG

SEQ ID NO: 131647 - protein, 15 aa, Borrelia burgdorferi
VNNFVKAMTNVGSFK

SEQ ID NO: 131648 - protein, 9 aa, Borrelia burgdorferi
FVKAMTNVG

SEQ ID NO: 131649 - protein, 15 aa, Borrelia burgdorferi
EAEVNNFVKAMTNVG

SEQ ID NO: 131650 - protein, 9 aa, Borrelia burgdorferi
VNNFVKAMT

SEQ ID NO: 131651 - protein, 15 aa, Borrelia burgdorferi
NFVKAMTNVGSFKTS

SEQ ID NO: 131652 - protein, 9 aa, Borrelia burgdorferi
FVKAMTNVG

SEQ ID NO: 131653 - protein, 15 aa, Borrelia burgdorferi
FVKAMTNVGSFKTSL

SEQ ID NO: 131654 - protein, 9 aa, Borrelia burgdorferi
FVKAMTNVG

SEQ ID NO: 131655 - protein, 15 aa, Borrelia burgdorferi
ASSKMRFKAFRVSKS

SEQ ID NO: 131656 - protein, 9 aa, Borrelia burgdorferi
MRFKAFRVS

SEQ ID NO: 131657 - protein, 15 aa, Borrelia burgdorferi
LASSKMRFKAFRVSK

SEQ ID NO: 131658 - protein, 9 aa, Borrelia burgdorferi
MRFKAFRVS

SEQ ID NO: 131659 - protein, 15 aa, Borrelia burgdorferi
SSKMRFKAFRVSKSH

SEQ ID NO: 131660 - protein, 9 aa, Borrelia burgdorferi
MRFKAFRVS

SEQ ID NO: 131661 - protein, 15 aa, Borrelia burgdorferi
SKMRFKAFRVSKSHS

SEQ ID NO: 131662 - protein, 9 aa, Borrelia burgdorferi
MRFKAFRVS

SEQ ID NO: 131663 - protein, 15 aa, Borrelia burgdorferi
PLASSKMRFKAFRVS

SEQ ID NO: 131664 - protein, 9 aa, Borrelia burgdorferi
ASSKMRFKA

SEQ ID NO: 131665 - protein, 15 aa, Borrelia burgdorferi
MVVDLGINNWSVLLT

SEQ ID NO: 131666 - protein, 9 aa, Borrelia burgdorferi
LGINNWSVL

SEQ ID NO: 131667 - protein, 15 aa, Borrelia burgdorferi
VVDLGINNWSVLLTP

SEQ ID NO: 131668 - protein, 9 aa, Borrelia burgdorferi
INNWSVLLT

SEQ ID NO: 131669 - protein, 15 aa, Borrelia burgdorferi
VDLGINNWSVLLTPS

SEQ ID NO: 131670 - protein, 9 aa, Borrelia burgdorferi
INNWSVLLT

SEQ ID NO: 131671 - protein, 15 aa, Borrelia burgdorferi
DLGINNWSVLLTPSA

SEQ ID NO: 131672 - protein, 9 aa, Borrelia burgdorferi
INNWSVLLT

SEQ ID NO: 131673 - protein, 15 aa, Borrelia burgdorferi
LGINNWSVLLTPSAR

SEQ ID NO: 131674 - protein, 9 aa, Borrelia burgdorferi
INNWSVLLT

SEQ ID NO: 131675 - protein, 15 aa, Borrelia burgdorferi
DMVVDLGINNWSVLL

SEQ ID NO: 131676 - protein, 9 aa, Borrelia burgdorferi
LGINNWSVL

SEQ ID NO: 131677 - protein, 15 aa, Borrelia burgdorferi
EDMVVDLGINNWSVL

SEQ ID NO: 131678 - protein, 9 aa, Borrelia burgdorferi
VVDLGINNW

SEQ ID NO: 131679 - protein, 15 aa, Borrelia burgdorferi
GINNWSVLLTPSARL

SEQ ID NO: 131680 - protein, 9 aa, Borrelia burgdorferi
INNWSVLLT

SEQ ID NO: 131681 - protein, 15 aa, Borrelia burgdorferi
INNWSVLLTPSARLQ

SEQ ID NO: 131682 - protein, 9 aa, Borrelia burgdorferi
INNWSVLLT

SEQ ID NO: 131683 - protein, 15 aa, Borrelia burgdorferi
SNPNYIPNISSRIIK

SEQ ID NO: 131684 - protein, 9 aa, Borrelia burgdorferi
IPNISSRII

SEQ ID NO: 131685 - protein, 15 aa, Borrelia burgdorferi
NPNYIPNISSRIIKD

SEQ ID NO: 131686 - protein, 9 aa, Borrelia burgdorferi
IPNISSRII

SEQ ID NO: 131687 - protein, 15 aa, Borrelia burgdorferi
AKSILFFLLSTVLFA

SEQ ID NO: 131688 - protein, 9 aa, Borrelia burgdorferi
FFLLSTVLF

SEQ ID NO: 131689 - protein, 15 aa, Borrelia burgdorferi
KSILFFLLSTVLFAQ

SEQ ID NO: 131690 - protein, 9 aa, Borrelia burgdorferi
FFLLSTVLF

SEQ ID NO: 131691 - protein, 15 aa, Borrelia burgdorferi
SILFFLLSTVLFAQE

SEQ ID NO: 131692 - protein, 9 aa, Borrelia burgdorferi
FFLLSTVLF

SEQ ID NO: 131693 - protein, 15 aa, Borrelia burgdorferi
KAKSILFFLLSTVLF

SEQ ID NO: 131694 - protein, 9 aa, Borrelia burgdorferi
ILFFLLSTV

SEQ ID NO: 131695 - protein, 15 aa, Borrelia burgdorferi
WSNPNYIPNISSRII

SEQ ID NO: 131696 - protein, 9 aa, Borrelia burgdorferi
YIPNISSRI

SEQ ID NO: 131697 - protein, 15 aa, Borrelia burgdorferi
ILFFLLSTVLFAQET

SEQ ID NO: 131698 - protein, 9 aa, Borrelia burgdorferi
FFLLSTVLF

SEQ ID NO: 131699 - protein, 15 aa, Borrelia burgdorferi
PNYIPNISSRIIKDD

SEQ ID NO: 131700 - protein, 9 aa, Borrelia burgdorferi
IPNISSRII

SEQ ID NO: 131701 - protein, 15 aa, Borrelia burgdorferi
VKNFIFYVKDLRVLY

SEQ ID NO: 131702 - protein, 9 aa, Borrelia burgdorferi
VKNFIFYVK

SEQ ID NO: 131703 - protein, 15 aa, Borrelia burgdorferi
SKVKNFIFYVKDLRV

SEQ ID NO: 131704 - protein, 9 aa, Borrelia burgdorferi
VKNFIFYVK

SEQ ID NO: 131705 - protein, 15 aa, Borrelia burgdorferi
NYIPNISSRIIKDDV

SEQ ID NO: 131706 - protein, 9 aa, Borrelia burgdorferi
IPNISSRII

SEQ ID NO: 131707 - protein, 15 aa, Borrelia burgdorferi
SSKVKNFIFYVKDLR

SEQ ID NO: 131708 - protein, 9 aa, Borrelia burgdorferi
VKNFIFYVK

SEQ ID NO: 131709 - protein, 15 aa, Borrelia burgdorferi
KSHSSKVKNFIFYVK

SEQ ID NO: 131710 - protein, 9 aa, Borrelia burgdorferi
SKVKNFIFY

SEQ ID NO: 131711 - protein, 15 aa, Borrelia burgdorferi
ARLQAYVKNSVVAPA

SEQ ID NO: 131712 - protein, 9 aa, Borrelia burgdorferi
YVKNSVVAP

SEQ ID NO: 131713 - protein, 15 aa, Borrelia burgdorferi
IWSNPNYIPNISSRI

SEQ ID NO: 131714 - protein, 9 aa, Borrelia burgdorferi
NPNYIPNIS

SEQ ID NO: 131715 - protein, 15 aa, Borrelia burgdorferi
HSSKVKNFIFYVKDL

SEQ ID NO: 131716 - protein, 9 aa, Borrelia burgdorferi
VKNFIFYVK

SEQ ID NO: 131717 - protein, 15 aa, Borrelia burgdorferi
SHSSKVKNFIFYVKD

SEQ ID NO: 131718 - protein, 9 aa, Borrelia burgdorferi
VKNFIFYVK

SEQ ID NO: 131719 - protein, 15 aa, Borrelia burgdorferi
LQAYVKNSVVAPAVV

SEQ ID NO: 131720 - protein, 9 aa, Borrelia burgdorferi
VKNSVVAPA

SEQ ID NO: 131721 - protein, 15 aa, Borrelia burgdorferi
RLQAYVKNSVVAPAV

SEQ ID NO: 131722 - protein, 9 aa, Borrelia burgdorferi
VKNSVVAPA

SEQ ID NO: 131723 - protein, 15 aa, Borrelia burgdorferi
QAYVKNSVVAPAVVK

SEQ ID NO: 131724 - protein, 9 aa, Borrelia burgdorferi
VKNSVVAPA

SEQ ID NO: 131725 - protein, 15 aa, Borrelia burgdorferi
GDTILGVRVLFPSYS

SEQ ID NO: 131726 - protein, 9 aa, Borrelia burgdorferi
LGVRVLFPS

SEQ ID NO: 131727 - protein, 15 aa, Borrelia burgdorferi
YIPNISSRIIKDDVP

SEQ ID NO: 131728 - protein, 9 aa, Borrelia burgdorferi
IPNISSRII

SEQ ID NO: 131729 - protein, 15 aa, Borrelia burgdorferi
IKTMKEIKVSVYSLG

SEQ ID NO: 131730 - protein, 9 aa, Borrelia burgdorferi
MKEIKVSVY

SEQ ID NO: 131731 - protein, 15 aa, Borrelia burgdorferi
ADLIWSNPNYIPNIS

SEQ ID NO: 131732 - protein, 9 aa, Borrelia burgdorferi
LIWSNPNYI

SEQ ID NO: 131733 - protein, 15 aa, Borrelia burgdorferi
DTILGVRVLFPSYSQ

SEQ ID NO: 131734 - protein, 9 aa, Borrelia burgdorferi
LGVRVLFPS

SEQ ID NO: 131735 - protein, 15 aa, Borrelia burgdorferi
LFFLLSTVLFAQETD

SEQ ID NO: 131736 - protein, 9 aa, Borrelia burgdorferi
FFLLSTVLF

SEQ ID NO: 131737 - protein, 15 aa, Borrelia burgdorferi
AYVKNSVVAPAVVKS

SEQ ID NO: 131738 - protein, 9 aa, Borrelia burgdorferi
VKNSVVAPA

SEQ ID NO: 131739 - protein, 15 aa, Borrelia burgdorferi
KGLIDNIKTMKEIKV

SEQ ID NO: 131740 - protein, 9 aa, Borrelia burgdorferi
LIDNIKTMK

SEQ ID NO: 131741 - protein, 15 aa, Borrelia burgdorferi
TILGVRVLFPSYSQS

SEQ ID NO: 131742 - protein, 9 aa, Borrelia burgdorferi
LGVRVLFPS

SEQ ID NO: 131743 - protein, 15 aa, Borrelia burgdorferi
YAGDTILGVRVLFPS

SEQ ID NO: 131744 - protein, 9 aa, Borrelia burgdorferi
TILGVRVLF

SEQ ID NO: 131745 - protein, 15 aa, Borrelia burgdorferi
AGDTILGVRVLFPSY

SEQ ID NO: 131746 - protein, 9 aa, Borrelia burgdorferi
LGVRVLFPS

SEQ ID NO: 131747 - protein, 15 aa, Borrelia burgdorferi
FFLLSTVLFAQETDG

SEQ ID NO: 131748 - protein, 9 aa, Borrelia burgdorferi
FFLLSTVLF

SEQ ID NO: 131749 - protein, 15 aa, Borrelia burgdorferi
LGKGLIDNIKTMKEI

SEQ ID NO: 131750 - protein, 9 aa, Borrelia burgdorferi
LIDNIKTMK

SEQ ID NO: 131751 - protein, 15 aa, Borrelia burgdorferi
KTMKEIKVSVYSLGY

SEQ ID NO: 131752 - protein, 9 aa, Borrelia burgdorferi
IKVSVYSLG

SEQ ID NO: 131753 - protein, 15 aa, Borrelia burgdorferi
KVKNFIFYVKDLRVL

SEQ ID NO: 131754 - protein, 9 aa, Borrelia burgdorferi
VKNFIFYVK

SEQ ID NO: 131755 - protein, 15 aa, Borrelia burgdorferi
DLIWSNPNYIPNISS

SEQ ID NO: 131756 - protein, 9 aa, Borrelia burgdorferi
NPNYIPNIS

SEQ ID NO: 131757 - protein, 15 aa, Borrelia burgdorferi
FLGKGLIDNIKTMKE

SEQ ID NO: 131758 - protein, 9 aa, Borrelia burgdorferi
LIDNIKTMK

SEQ ID NO: 131759 - protein, 15 aa, Borrelia burgdorferi
GKGLIDNIKTMKEIK

SEQ ID NO: 131760 - protein, 9 aa, Borrelia burgdorferi
LIDNIKTMK

SEQ ID NO: 131761 - protein, 15 aa, Borrelia burgdorferi
TMKEIKVSVYSLGYE

SEQ ID NO: 131762 - protein, 9 aa, Borrelia burgdorferi
IKVSVYSLG

SEQ ID NO: 131763 - protein, 15 aa, Borrelia burgdorferi
MKEIKVSVYSLGYEI

SEQ ID NO: 131764 - protein, 9 aa, Borrelia burgdorferi
IKVSVYSLG

SEQ ID NO: 131765 - protein, 15 aa, Borrelia burgdorferi
LIWSNPNYIPNISSR

SEQ ID NO: 131766 - protein, 9 aa, Borrelia burgdorferi
NPNYIPNIS

SEQ ID NO: 131767 - protein, 15 aa, Borrelia burgdorferi
QFLGKGLIDNIKTMK

SEQ ID NO: 131768 - protein, 9 aa, Borrelia burgdorferi
KGLIDNIKT

SEQ ID NO: 131769 - protein, 15 aa, Borrelia burgdorferi
KNFIFYVKDLRVLYD

SEQ ID NO: 131770 - protein, 9 aa, Borrelia burgdorferi
YVKDLRVLY

SEQ ID NO: 131771 - protein, 15 aa, Borrelia burgdorferi
WADLIWSNPNYIPNI

SEQ ID NO: 131772 - protein, 9 aa, Borrelia burgdorferi
LIWSNPNYI

SEQ ID NO: 131773 - protein, 15 aa, Borrelia burgdorferi
SARLQAYVKNSVVAP

SEQ ID NO: 131774 - protein, 9 aa, Borrelia burgdorferi
LQAYVKNSV

SEQ ID NO: 131775 - protein, 15 aa, Borrelia burgdorferi
KEIKVSVYSLGYEID

SEQ ID NO: 131776 - protein, 9 aa, Borrelia burgdorferi
IKVSVYSLG

SEQ ID NO: 131777 - protein, 15 aa, Borrelia burgdorferi
GWADLIWSNPNYIPN

SEQ ID NO: 131778 - protein, 9 aa, Borrelia burgdorferi
LIWSNPNYI

SEQ ID NO: 131779 - protein, 15 aa, Borrelia burgdorferi
GLIDNIKTMKEIKVS

SEQ ID NO: 131780 - protein, 9 aa, Borrelia burgdorferi
LIDNIKTMK

SEQ ID NO: 131781 - protein, 15 aa, Borrelia burgdorferi
YVKNSVVAPAVVKSE

SEQ ID NO: 131782 - protein, 9 aa, Borrelia burgdorferi
VKNSVVAPA

SEQ ID NO: 131783 - protein, 15 aa, Borrelia burgdorferi
KGWADLIWSNPNYIP

SEQ ID NO: 131784 - protein, 9 aa, Borrelia burgdorferi
LIWSNPNYI

SEQ ID NO: 131785 - protein, 15 aa, Borrelia burgdorferi
LGVRVLFPSYSQSSA

SEQ ID NO: 131786 - protein, 9 aa, Borrelia burgdorferi
LGVRVLFPS

SEQ ID NO: 131787 - protein, 15 aa, Borrelia burgdorferi
NFIFYVKDLRVLYDK

SEQ ID NO: 131788 - protein, 9 aa, Borrelia burgdorferi
YVKDLRVLY

SEQ ID NO: 131789 - protein, 15 aa, Borrelia burgdorferi
IFYVKDLRVLYDKLS

SEQ ID NO: 131790 - protein, 9 aa, Borrelia burgdorferi
YVKDLRVLY

SEQ ID NO: 131791 - protein, 15 aa, Borrelia burgdorferi
ILGVRVLFPSYSQSS

SEQ ID NO: 131792 - protein, 9 aa, Borrelia burgdorferi
LGVRVLFPS

SEQ ID NO: 131793 - protein, 15 aa, Borrelia burgdorferi
LIDNIKTMKEIKVSV

SEQ ID NO: 131794 - protein, 9 aa, Borrelia burgdorferi
LIDNIKTMK

SEQ ID NO: 131795 - protein, 15 aa, Borrelia burgdorferi
FIFYVKDLRVLYDKL

SEQ ID NO: 131796 - protein, 9 aa, Borrelia burgdorferi
YVKDLRVLY

SEQ ID NO: 131797 - protein, 15 aa, Borrelia burgdorferi
SSTRLDLTNYVDYVY

SEQ ID NO: 131798 - protein, 9 aa, Borrelia burgdorferi
TRLDLTNYV

SEQ ID NO: 131799 - protein, 15 aa, Borrelia burgdorferi
STRLDLTNYVDYVYS

SEQ ID NO: 131800 - protein, 9 aa, Borrelia burgdorferi
LTNYVDYVY

SEQ ID NO: 131801 - protein, 15 aa, Borrelia burgdorferi
KSILFFLLSTVLFAQ

SEQ ID NO: 131802 - protein, 9 aa, Borrelia burgdorferi
ILFFLLSTV

SEQ ID NO: 131803 - protein, 15 aa, Borrelia burgdorferi
AKSILFFLLSTVLFA

SEQ ID NO: 131804 - protein, 9 aa, Borrelia burgdorferi
ILFFLLSTV

SEQ ID NO: 131805 - protein, 15 aa, Borrelia burgdorferi
SKVKNFIFYVKDLRV

SEQ ID NO: 131806 - protein, 9 aa, Borrelia burgdorferi
VKNFIFYVK

SEQ ID NO: 131807 - protein, 15 aa, Borrelia burgdorferi
RKAKSILFFLLSTVL

SEQ ID NO: 131808 - protein, 9 aa, Borrelia burgdorferi
ILFFLLSTV

SEQ ID NO: 131809 - protein, 15 aa, Borrelia burgdorferi
KAKSILFFLLSTVLF

SEQ ID NO: 131810 - protein, 9 aa, Borrelia burgdorferi
ILFFLLSTV

SEQ ID NO: 131811 - protein, 15 aa, Borrelia burgdorferi
SSKVKNFIFYVKDLR

SEQ ID NO: 131812 - protein, 9 aa, Borrelia burgdorferi
VKNFIFYVK

SEQ ID NO: 131813 - protein, 15 aa, Borrelia burgdorferi
KVKNFIFYVKDLRVL

SEQ ID NO: 131814 - protein, 9 aa, Borrelia burgdorferi
VKNFIFYVK

SEQ ID NO: 131815 - protein, 15 aa, Borrelia burgdorferi
KSHSSKVKNFIFYVK

SEQ ID NO: 131816 - protein, 9 aa, Borrelia burgdorferi
KVKNFIFYV

SEQ ID NO: 131817 - protein, 15 aa, Borrelia burgdorferi
SHSSKVKNFIFYVKD

SEQ ID NO: 131818 - protein, 9 aa, Borrelia burgdorferi
VKNFIFYVK

SEQ ID NO: 131819 - protein, 15 aa, Borrelia burgdorferi
HSSKVKNFIFYVKDL

SEQ ID NO: 131820 - protein, 9 aa, Borrelia burgdorferi
VKNFIFYVK

SEQ ID NO: 131821 - protein, 15 aa, Borrelia burgdorferi
VKNFIFYVKDLRVLY

SEQ ID NO: 131822 - protein, 9 aa, Borrelia burgdorferi
VKNFIFYVK

SEQ ID NO: 131823 - protein, 15 aa, Borrelia burgdorferi
ASSKMRFKAFRVSKS

SEQ ID NO: 131824 - protein, 9 aa, Borrelia burgdorferi
MRFKAFRVS

SEQ ID NO: 131825 - protein, 15 aa, Borrelia burgdorferi
SSKMRFKAFRVSKSH

SEQ ID NO: 131826 - protein, 9 aa, Borrelia burgdorferi
MRFKAFRVS

SEQ ID NO: 131827 - protein, 15 aa, Borrelia burgdorferi
SILFFLLSTVLFAQE

SEQ ID NO: 131828 - protein, 9 aa, Borrelia burgdorferi
LFFLLSTVL

SEQ ID NO: 131829 - protein, 15 aa, Borrelia burgdorferi
KRKAKSILFFLLSTV

SEQ ID NO: 131830 - protein, 9 aa, Borrelia burgdorferi
SILFFLLST

SEQ ID NO: 131831 - protein, 15 aa, Borrelia burgdorferi
SKMRFKAFRVSKSHS

SEQ ID NO: 131832 - protein, 9 aa, Borrelia burgdorferi
MRFKAFRVS

SEQ ID NO: 131833 - protein, 15 aa, Borrelia burgdorferi
LASSKMRFKAFRVSK

SEQ ID NO: 131834 - protein, 9 aa, Borrelia burgdorferi
MRFKAFRVS

SEQ ID NO: 131835 - protein, 15 aa, Borrelia burgdorferi
PLASSKMRFKAFRVS

SEQ ID NO: 131836 - protein, 9 aa, Borrelia burgdorferi
KMRFKAFRV

SEQ ID NO: 131837 - protein, 15 aa, Borrelia burgdorferi
KMRFKAFRVSKSHSS

SEQ ID NO: 131838 - protein, 9 aa, Borrelia burgdorferi
MRFKAFRVS

SEQ ID NO: 131839 - protein, 15 aa, Borrelia burgdorferi
ILGVRVLFPSYSQSS

SEQ ID NO: 131840 - protein, 9 aa, Borrelia burgdorferi
VRVLFPSYS

SEQ ID NO: 131841 - protein, 15 aa, Borrelia burgdorferi
DTILGVRVLFPSYSQ

SEQ ID NO: 131842 - protein, 9 aa, Borrelia burgdorferi
VRVLFPSYS

SEQ ID NO: 131843 - protein, 15 aa, Borrelia burgdorferi
ILFFLLSTVLFAQET

SEQ ID NO: 131844 - protein, 9 aa, Borrelia burgdorferi
ILFFLLSTV

SEQ ID NO: 131845 - protein, 15 aa, Borrelia burgdorferi
TILGVRVLFPSYSQS

SEQ ID NO: 131846 - protein, 9 aa, Borrelia burgdorferi
VRVLFPSYS

SEQ ID NO: 131847 - protein, 15 aa, Borrelia burgdorferi
MRFKAFRVSKSHSSK

SEQ ID NO: 131848 - protein, 9 aa, Borrelia burgdorferi
FRVSKSHSS

SEQ ID NO: 131849 - protein, 15 aa, Borrelia burgdorferi
LGVRVLFPSYSQSSA

SEQ ID NO: 131850 - protein, 9 aa, Borrelia burgdorferi
VRVLFPSYS

SEQ ID NO: 131851 - protein, 15 aa, Borrelia burgdorferi
GDTILGVRVLFPSYS

SEQ ID NO: 131852 - protein, 9 aa, Borrelia burgdorferi
LGVRVLFPS

SEQ ID NO: 131853 - protein, 15 aa, Borrelia burgdorferi
VKDLRVLYDKLSVSI

SEQ ID NO: 131854 - protein, 9 aa, Borrelia burgdorferi
VLYDKLSVS

SEQ ID NO: 131855 - protein, 15 aa, Borrelia burgdorferi
KNFIFYVKDLRVLYD

SEQ ID NO: 131856 - protein, 9 aa, Borrelia burgdorferi
FIFYVKDLR

SEQ ID NO: 131857 - protein, 15 aa, Borrelia burgdorferi
YVKDLRVLYDKLSVS

SEQ ID NO: 131858 - protein, 9 aa, Borrelia burgdorferi
LRVLYDKLS

SEQ ID NO: 131859 - protein, 15 aa, Borrelia burgdorferi
KDLRVLYDKLSVSID

SEQ ID NO: 131860 - protein, 9 aa, Borrelia burgdorferi
VLYDKLSVS

SEQ ID NO: 131861 - protein, 15 aa, Borrelia burgdorferi
VLDFAELARDPSSTR

SEQ ID NO: 131862 - protein, 9 aa, Borrelia burgdorferi
VLDFAELAR

SEQ ID NO: 131863 - protein, 15 aa, Borrelia burgdorferi
DLRVLYDKLSVSIDS

SEQ ID NO: 131864 - protein, 9 aa, Borrelia burgdorferi
VLYDKLSVS

SEQ ID NO: 131865 - protein, 15 aa, Borrelia burgdorferi
LDFAELARDPSSTRL

SEQ ID NO: 131866 - protein, 9 aa, Borrelia burgdorferi
LARDPSSTR

SEQ ID NO: 131867 - protein, 15 aa, Borrelia burgdorferi
TFKRVLKLREKISIA

SEQ ID NO: 131868 - protein, 9 aa, Borrelia burgdorferi
KRVLKLREK

SEQ ID NO: 131869 - protein, 15 aa, Borrelia burgdorferi
GVRVLFPSYSQSSAM

SEQ ID NO: 131870 - protein, 9 aa, Borrelia burgdorferi
VRVLFPSYS

SEQ ID NO: 131871 - protein, 15 aa, Borrelia burgdorferi
NFIFYVKDLRVLYDK

SEQ ID NO: 131872 - protein, 9 aa, Borrelia burgdorferi
FYVKDLRVL

SEQ ID NO: 131873 - protein, 15 aa, Borrelia burgdorferi
ETFKRVLKLREKISI

SEQ ID NO: 131874 - protein, 9 aa, Borrelia burgdorferi
KRVLKLREK

SEQ ID NO: 131875 - protein, 15 aa, Borrelia burgdorferi
RFKAFRVSKSHSSKV

SEQ ID NO: 131876 - protein, 9 aa, Borrelia burgdorferi
FRVSKSHSS

SEQ ID NO: 131877 - protein, 15 aa, Borrelia burgdorferi
LRVLYDKLSVSIDSD

SEQ ID NO: 131878 - protein, 9 aa, Borrelia burgdorferi
VLYDKLSVS

SEQ ID NO: 131879 - protein, 15 aa, Borrelia burgdorferi
LGINNWSVLLTPSAR

SEQ ID NO: 131880 - protein, 9 aa, Borrelia burgdorferi
INNWSVLLT

SEQ ID NO: 131881 - protein, 15 aa, Borrelia burgdorferi
AELARDPSSTRLDLT

SEQ ID NO: 131882 - protein, 9 aa, Borrelia burgdorferi
LARDPSSTR

SEQ ID NO: 131883 - protein, 15 aa, Borrelia burgdorferi
DFAELARDPSSTRLD

SEQ ID NO: 131884 - protein, 9 aa, Borrelia burgdorferi
LARDPSSTR

SEQ ID NO: 131885 - protein, 15 aa, Borrelia burgdorferi
GINNWSVLLTPSARL

SEQ ID NO: 131886 - protein, 9 aa, Borrelia burgdorferi
SVLLTPSAR

SEQ ID NO: 131887 - protein, 15 aa, Borrelia burgdorferi
ADLIWSNPNYIPNIS

SEQ ID NO: 131888 - protein, 9 aa, Borrelia burgdorferi
LIWSNPNYI

SEQ ID NO: 131889 - protein, 15 aa, Borrelia burgdorferi
KGWADLIWSNPNYIP

SEQ ID NO: 131890 - protein, 9 aa, Borrelia burgdorferi
LIWSNPNYI

SEQ ID NO: 131891 - protein, 15 aa, Borrelia burgdorferi
WADLIWSNPNYIPNI

SEQ ID NO: 131892 - protein, 9 aa, Borrelia burgdorferi
LIWSNPNYI

SEQ ID NO: 131893 - protein, 15 aa, Borrelia burgdorferi
GWADLIWSNPNYIPN

SEQ ID NO: 131894 - protein, 9 aa, Borrelia burgdorferi
LIWSNPNYI

SEQ ID NO: 131895 - protein, 15 aa, Borrelia burgdorferi
FKGWADLIWSNPNYI

SEQ ID NO: 131896 - protein, 9 aa, Borrelia burgdorferi
FKGWADLIW

SEQ ID NO: 131897 - protein, 15 aa, Borrelia burgdorferi
DLIWSNPNYIPNISS

SEQ ID NO: 131898 - protein, 9 aa, Borrelia burgdorferi
LIWSNPNYI

SEQ ID NO: 131899 - protein, 15 aa, Borrelia burgdorferi
LIWSNPNYIPNISSR

SEQ ID NO: 131900 - protein, 9 aa, Borrelia burgdorferi
LIWSNPNYI

SEQ ID NO: 131901 - protein, 15 aa, Borrelia burgdorferi
TILGVRVLFPSYSQS

SEQ ID NO: 131902 - protein, 9 aa, Borrelia burgdorferi
VRVLFPSYS

SEQ ID NO: 131903 - protein, 15 aa, Borrelia burgdorferi
DTILGVRVLFPSYSQ

SEQ ID NO: 131904 - protein, 9 aa, Borrelia burgdorferi
VRVLFPSYS

SEQ ID NO: 131905 - protein, 15 aa, Borrelia burgdorferi
GDTILGVRVLFPSYS

SEQ ID NO: 131906 - protein, 9 aa, Borrelia burgdorferi
LGVRVLFPS

SEQ ID NO: 131907 - protein, 15 aa, Borrelia burgdorferi
ILGVRVLFPSYSQSS

SEQ ID NO: 131908 - protein, 9 aa, Borrelia burgdorferi
VRVLFPSYS

SEQ ID NO: 131909 - protein, 15 aa, Borrelia burgdorferi
RIIKDDVPNYPLASS

SEQ ID NO: 131910 - protein, 9 aa, Borrelia burgdorferi
IKDDVPNYP

SEQ ID NO: 131911 - protein, 15 aa, Borrelia burgdorferi
LGVRVLFPSYSQSSA

SEQ ID NO: 131912 - protein, 9 aa, Borrelia burgdorferi
VRVLFPSYS

SEQ ID NO: 131913 - protein, 15 aa, Borrelia burgdorferi
PLASSKMRFKAFRVS

SEQ ID NO: 131914 - protein, 9 aa, Borrelia burgdorferi
LASSKMRFK

SEQ ID NO: 131915 - protein, 15 aa, Borrelia burgdorferi
LASSKMRFKAFRVSK

SEQ ID NO: 131916 - protein, 9 aa, Borrelia burgdorferi
MRFKAFRVS

SEQ ID NO: 131917 - protein, 15 aa, Borrelia burgdorferi
ASSKMRFKAFRVSKS

SEQ ID NO: 131918 - protein, 9 aa, Borrelia burgdorferi
MRFKAFRVS

SEQ ID NO: 131919 - protein, 15 aa, Borrelia burgdorferi
SSKMRFKAFRVSKSH

SEQ ID NO: 131920 - protein, 9 aa, Borrelia burgdorferi
MRFKAFRVS

SEQ ID NO: 131921 - protein, 15 aa, Borrelia burgdorferi
SKMRFKAFRVSKSHS

SEQ ID NO: 131922 - protein, 9 aa, Borrelia burgdorferi
MRFKAFRVS

SEQ ID NO: 131923 - protein, 15 aa, Borrelia burgdorferi
ISSRIIKDDVPNYPL

SEQ ID NO: 131924 - protein, 9 aa, Borrelia burgdorferi
IKDDVPNYP

SEQ ID NO: 131925 - protein, 15 aa, Borrelia burgdorferi
NISSRIIKDDVPNYP

SEQ ID NO: 131926 - protein, 9 aa, Borrelia burgdorferi
SRIIKDDVP

SEQ ID NO: 131927 - protein, 15 aa, Borrelia burgdorferi
SSRIIKDDVPNYPLA

SEQ ID NO: 131928 - protein, 9 aa, Borrelia burgdorferi
IKDDVPNYP

SEQ ID NO: 131929 - protein, 15 aa, Borrelia burgdorferi
SRIIKDDVPNYPLAS

SEQ ID NO: 131930 - protein, 9 aa, Borrelia burgdorferi
IKDDVPNYP

SEQ ID NO: 131931 - protein, 15 aa, Borrelia burgdorferi
IIKDDVPNYPLASSK

SEQ ID NO: 131932 - protein, 9 aa, Borrelia burgdorferi
IKDDVPNYP

SEQ ID NO: 131933 - protein, 15 aa, Borrelia burgdorferi
IKDDVPNYPLASSKM

SEQ ID NO: 131934 - protein, 9 aa, Borrelia burgdorferi
IKDDVPNYP

SEQ ID NO: 131935 - protein, 15 aa, Borrelia burgdorferi
DVPNYPLASSKMRFK

SEQ ID NO: 131936 - protein, 9 aa, Borrelia burgdorferi
YPLASSKMR

SEQ ID NO: 131937 - protein, 15 aa, Borrelia burgdorferi
VPNYPLASSKMRFKA

SEQ ID NO: 131938 - protein, 9 aa, Borrelia burgdorferi
YPLASSKMR

SEQ ID NO: 131939 - protein, 15 aa, Borrelia burgdorferi
PNYPLASSKMRFKAF

SEQ ID NO: 131940 - protein, 9 aa, Borrelia burgdorferi
YPLASSKMR

SEQ ID NO: 131941 - protein, 15 aa, Borrelia burgdorferi
KDDVPNYPLASSKMR

SEQ ID NO: 131942 - protein, 9 aa, Borrelia burgdorferi
NYPLASSKM

SEQ ID NO: 131943 - protein, 15 aa, Borrelia burgdorferi
DDVPNYPLASSKMRF

SEQ ID NO: 131944 - protein, 9 aa, Borrelia burgdorferi
YPLASSKMR

SEQ ID NO: 131945 - protein, 15 aa, Borrelia burgdorferi
ESLRKLKAHETFKRV

SEQ ID NO: 131946 - protein, 9 aa, Borrelia burgdorferi
LKAHETFKR

SEQ ID NO: 131947 - protein, 15 aa, Borrelia burgdorferi
LRKLKAHETFKRVLK

SEQ ID NO: 131948 - protein, 9 aa, Borrelia burgdorferi
LKAHETFKR

SEQ ID NO: 131949 - protein, 15 aa, Borrelia burgdorferi
SLRKLKAHETFKRVL

SEQ ID NO: 131950 - protein, 9 aa, Borrelia burgdorferi
LKAHETFKR

SEQ ID NO: 131951 - protein, 15 aa, Borrelia burgdorferi
RKLKAHETFKRVLKL

SEQ ID NO: 131952 - protein, 9 aa, Borrelia burgdorferi
LKAHETFKR

SEQ ID NO: 131953 - protein, 15 aa, Borrelia burgdorferi
TESLRKLKAHETFKR

SEQ ID NO: 131954 - protein, 9 aa, Borrelia burgdorferi
LRKLKAHET

SEQ ID NO: 131955 - protein, 15 aa, Borrelia burgdorferi
NYPLASSKMRFKAFR

SEQ ID NO: 131956 - protein, 9 aa, Borrelia burgdorferi
YPLASSKMR

SEQ ID NO: 131957 - protein, 15 aa, Borrelia burgdorferi
YPLASSKMRFKAFRV

SEQ ID NO: 131958 - protein, 9 aa, Borrelia burgdorferi
YPLASSKMR

SEQ ID NO: 131959 - protein, 15 aa, Borrelia burgdorferi
WSNPNYIPNISSRII

SEQ ID NO: 131960 - protein, 9 aa, Borrelia burgdorferi
YIPNISSRI

SEQ ID NO: 131961 - protein, 15 aa, Borrelia burgdorferi
IWSNPNYIPNISSRI

SEQ ID NO: 131962 - protein, 9 aa, Borrelia burgdorferi
NYIPNISSR

SEQ ID NO: 131963 - protein, 15 aa, Borrelia burgdorferi
SNPNYIPNISSRIIK

SEQ ID NO: 131964 - protein, 9 aa, Borrelia burgdorferi
YIPNISSRI

SEQ ID NO: 131965 - protein, 15 aa, Borrelia burgdorferi
NPNYIPNISSRIIKD

SEQ ID NO: 131966 - protein, 9 aa, Borrelia burgdorferi
YIPNISSRI

SEQ ID NO: 131967 - protein, 15 aa, Borrelia garinii
QPAKINTPASLSGSQ

SEQ ID NO: 131968 - protein, 9 aa, Borrelia garinii
INTPASLSG

SEQ ID NO: 131969 - protein, 15 aa, Borrelia garinii
PAKINTPASLSGSQA

SEQ ID NO: 131970 - protein, 9 aa, Borrelia garinii
INTPASLSG

SEQ ID NO: 131971 - protein, 15 aa, Borrelia garinii
MQPAKINTPASLSGS

SEQ ID NO: 131972 - protein, 9 aa, Borrelia garinii
INTPASLSG

SEQ ID NO: 131973 - protein, 15 aa, Borrelia garinii
AKINTPASLSGSQAS

SEQ ID NO: 131974 - protein, 9 aa, Borrelia garinii
INTPASLSG

SEQ ID NO: 131975 - protein, 15 aa, Borrelia garinii
ANLFSGEGAQAAQTA

SEQ ID NO: 131976 - protein, 9 aa, Borrelia garinii
FSGEGAQAA

SEQ ID NO: 131977 - protein, 15 aa, Borrelia garinii
VANLFSGEGAQAAQT

SEQ ID NO: 131978 - protein, 9 aa, Borrelia garinii
FSGEGAQAA

SEQ ID NO: 131979 - protein, 15 aa, Borrelia garinii
NLFSGEGAQAAQTAP

SEQ ID NO: 131980 - protein, 9 aa, Borrelia garinii
FSGEGAQAA

SEQ ID NO: 131981 - protein, 15 aa, Borrelia garinii
GMQPAKINTPASLSG

SEQ ID NO: 131982 - protein, 9 aa, Borrelia garinii
KINTPASLS

SEQ ID NO: 131983 - protein, 15 aa, Borrelia garinii
ANVANLFSGEGAQAA

SEQ ID NO: 131984 - protein, 9 aa, Borrelia garinii
VANLFSGEG

SEQ ID NO: 131985 - protein, 15 aa, Borrelia garinii
NVANLFSGEGAQAAQ

SEQ ID NO: 131986 - protein, 9 aa, Borrelia garinii
FSGEGAQAA

SEQ ID NO: 131987 - protein, 15 aa, Borrelia garinii
YNQMHMLSNKSASQN

SEQ ID NO: 131988 - protein, 9 aa, Borrelia garinii
MHMLSNKSA

SEQ ID NO: 131989 - protein, 15 aa, Borrelia garinii
EKVLVRMKELAVQSG

SEQ ID NO: 131990 - protein, 9 aa, Borrelia garinii
VRMKELAVQ

SEQ ID NO: 131991 - protein, 15 aa, Borrelia garinii
KVLVRMKELAVQSGN

SEQ ID NO: 131992 - protein, 9 aa, Borrelia garinii
MKELAVQSG

SEQ ID NO: 131993 - protein, 15 aa, Borrelia garinii
QAQYNQMHMLSNKSA

SEQ ID NO: 131994 - protein, 9 aa, Borrelia garinii
YNQMHMLSN

SEQ ID NO: 131995 - protein, 15 aa, Borrelia garinii
AQYNQMHMLSNKSAS

SEQ ID NO: 131996 - protein, 9 aa, Borrelia garinii
MHMLSNKSA

SEQ ID NO: 131997 - protein, 15 aa, Borrelia garinii
LFSGEGAQAAQTAPV

SEQ ID NO: 131998 - protein, 9 aa, Borrelia garinii
FSGEGAQAA

SEQ ID NO: 131999 - protein, 15 aa, Borrelia garinii
VLVRMKELAVQSGNG

SEQ ID NO: 132000 - protein, 9 aa, Borrelia garinii
MKELAVQSG

SEQ ID NO: 132001 - protein, 15 aa, Borrelia garinii
NQMHMLSNKSASQNV

SEQ ID NO: 132002 - protein, 9 aa, Borrelia garinii
MHMLSNKSA

SEQ ID NO: 132003 - protein, 15 aa, Borrelia garinii
AEELGMQPAKINTPA

SEQ ID NO: 132004 - protein, 9 aa, Borrelia garinii
LGMQPAKIN

SEQ ID NO: 132005 - protein, 15 aa, Borrelia garinii
FSGEGAQAAQTAPVQ

SEQ ID NO: 132006 - protein, 9 aa, Borrelia garinii
FSGEGAQAA

SEQ ID NO: 132007 - protein, 15 aa, Borrelia garinii
TAEELGMQPAKINTP

SEQ ID NO: 132008 - protein, 9 aa, Borrelia garinii
LGMQPAKIN

SEQ ID NO: 132009 - protein, 15 aa, Borrelia garinii
LVRMKELAVQSGNGT

SEQ ID NO: 132010 - protein, 9 aa, Borrelia garinii
MKELAVQSG

SEQ ID NO: 132011 - protein, 15 aa, Borrelia garinii
QYNQMHMLSNKSASQ

SEQ ID NO: 132012 - protein, 9 aa, Borrelia garinii
MHMLSNKSA

SEQ ID NO: 132013 - protein, 15 aa, Borrelia garinii
VRMKELAVQSGNGTY

SEQ ID NO: 132014 - protein, 9 aa, Borrelia garinii
MKELAVQSG

SEQ ID NO: 132015 - protein, 15 aa, Borrelia garinii
RTAEELGMQPAKINT

SEQ ID NO: 132016 - protein, 9 aa, Borrelia garinii
LGMQPAKIN

SEQ ID NO: 132017 - protein, 15 aa, Borrelia garinii
EELGMQPAKINTPAS

SEQ ID NO: 132018 - protein, 9 aa, Borrelia garinii
LGMQPAKIN

SEQ ID NO: 132019 - protein, 15 aa, Borrelia garinii
VRTAEELGMQPAKIN

SEQ ID NO: 132020 - protein, 9 aa, Borrelia garinii
ELGMQPAKI

SEQ ID NO: 132021 - protein, 15 aa, Borrelia garinii
INTPASLSGSQASWT

SEQ ID NO: 132022 - protein, 9 aa, Borrelia garinii
INTPASLSG

SEQ ID NO: 132023 - protein, 15 aa, Borrelia garinii
KINTPASLSGSQASW

SEQ ID NO: 132024 - protein, 9 aa, Borrelia garinii
INTPASLSG

SEQ ID NO: 132025 - protein, 15 aa, Borrelia garinii
VQQEGAQQPAPATAP

SEQ ID NO: 132026 - protein, 9 aa, Borrelia garinii
VQQEGAQQP

SEQ ID NO: 132027 - protein, 15 aa, Borrelia garinii
RMKELAVQSGNGTYS

SEQ ID NO: 132028 - protein, 9 aa, Borrelia garinii
MKELAVQSG

SEQ ID NO: 132029 - protein, 15 aa, Borrelia garinii
MKELAVQSGNGTYSD

SEQ ID NO: 132030 - protein, 9 aa, Borrelia garinii
MKELAVQSG

SEQ ID NO: 132031 - protein, 15 aa, Borrelia garinii
EGVQQEGAQQPAPAT

SEQ ID NO: 132032 - protein, 9 aa, Borrelia garinii
VQQEGAQQP

SEQ ID NO: 132033 - protein, 15 aa, Borrelia garinii
QMHMLSNKSASQNVR

SEQ ID NO: 132034 - protein, 9 aa, Borrelia garinii
MHMLSNKSA

SEQ ID NO: 132035 - protein, 15 aa, Borrelia garinii
MHMLSNKSASQNVRT

SEQ ID NO: 132036 - protein, 9 aa, Borrelia garinii
MHMLSNKSA

SEQ ID NO: 132037 - protein, 15 aa, Borrelia garinii
AIAVNIYAANVANLF

SEQ ID NO: 132038 - protein, 9 aa, Borrelia garinii
VNIYAANVA

SEQ ID NO: 132039 - protein, 15 aa, Borrelia garinii
LGMQPAKINTPASLS

SEQ ID NO: 132040 - protein, 9 aa, Borrelia garinii
LGMQPAKIN

SEQ ID NO: 132041 - protein, 15 aa, Borrelia garinii
IAVNIYAANVANLFS

SEQ ID NO: 132042 - protein, 9 aa, Borrelia garinii
YAANVANLF

SEQ ID NO: 132043 - protein, 15 aa, Borrelia garinii
ELGMQPAKINTPASL

SEQ ID NO: 132044 - protein, 9 aa, Borrelia garinii
LGMQPAKIN

SEQ ID NO: 132045 - protein, 15 aa, Borrelia garinii
QEGVQQEGAQQPAPA

SEQ ID NO: 132046 - protein, 9 aa, Borrelia garinii
VQQEGAQQP

SEQ ID NO: 132047 - protein, 15 aa, Borrelia garinii
AVNIYAANVANLFSG

SEQ ID NO: 132048 - protein, 9 aa, Borrelia garinii
YAANVANLF

SEQ ID NO: 132049 - protein, 15 aa, Borrelia garinii
PVQEGVQQEGAQQPA

SEQ ID NO: 132050 - protein, 9 aa, Borrelia garinii
VQQEGAQQP

SEQ ID NO: 132051 - protein, 15 aa, Borrelia garinii
APVQEGVQQEGAQQP

SEQ ID NO: 132052 - protein, 9 aa, Borrelia garinii
QEGVQQEGA

SEQ ID NO: 132053 - protein, 15 aa, Borrelia garinii
VQEGVQQEGAQQPAP

SEQ ID NO: 132054 - protein, 9 aa, Borrelia garinii
VQQEGAQQP

SEQ ID NO: 132055 - protein, 15 aa, Borrelia garinii
NIYAANVANLFSGEG

SEQ ID NO: 132056 - protein, 9 aa, Borrelia garinii
YAANVANLF

SEQ ID NO: 132057 - protein, 15 aa, Borrelia garinii
QEGAQQPAPATAPSQ

SEQ ID NO: 132058 - protein, 9 aa, Borrelia garinii
QQPAPATAP

SEQ ID NO: 132059 - protein, 15 aa, Borrelia garinii
VNIYAANVANLFSGE

SEQ ID NO: 132060 - protein, 9 aa, Borrelia garinii
YAANVANLF

SEQ ID NO: 132061 - protein, 15 aa, Borrelia garinii
QQEGAQQPAPATAPS

SEQ ID NO: 132062 - protein, 9 aa, Borrelia garinii
QQPAPATAP

SEQ ID NO: 132063 - protein, 15 aa, Borrelia garinii
GVQQEGAQQPAPATA

SEQ ID NO: 132064 - protein, 9 aa, Borrelia garinii
VQQEGAQQP

SEQ ID NO: 132065 - protein, 15 aa, Borrelia garinii
EGAQQPAPATAPSQG

SEQ ID NO: 132066 - protein, 9 aa, Borrelia garinii
QQPAPATAP

SEQ ID NO: 132067 - protein, 15 aa, Borrelia garinii
EAIAVNIYAANVANL

SEQ ID NO: 132068 - protein, 9 aa, Borrelia garinii
VNIYAANVA

SEQ ID NO: 132069 - protein, 15 aa, Borrelia garinii
VEKVLVRMKELAVQS

SEQ ID NO: 132070 - protein, 9 aa, Borrelia garinii
VRMKELAVQ

SEQ ID NO: 132071 - protein, 15 aa, Borrelia garinii
GAQQPAPATAPSQGG

SEQ ID NO: 132072 - protein, 9 aa, Borrelia garinii
QQPAPATAP

SEQ ID NO: 132073 - protein, 15 aa, Borrelia garinii
EVEKVLVRMKELAVQ

SEQ ID NO: 132074 - protein, 9 aa, Borrelia garinii
LVRMKELAV

SEQ ID NO: 132075 - protein, 15 aa, Borrelia garinii
AANVANLFSGEGAQA

SEQ ID NO: 132076 - protein, 9 aa, Borrelia garinii
VANLFSGEG

SEQ ID NO: 132077 - protein, 15 aa, Borrelia garinii
KELAVQSGNGTYSDA

SEQ ID NO: 132078 - protein, 9 aa, Borrelia garinii
VQSGNGTYS

SEQ ID NO: 132079 - protein, 15 aa, Borrelia garinii
DEAIAVNIYAANVAN

SEQ ID NO: 132080 - protein, 9 aa, Borrelia garinii
VNIYAANVA

SEQ ID NO: 132081 - protein, 15 aa, Borrelia garinii
PSQGGVNSPVNVTTT

SEQ ID NO: 132082 - protein, 9 aa, Borrelia garinii
VNSPVNVTT

SEQ ID NO: 132083 - protein, 15 aa, Borrelia garinii
DQAQYNQMHMLSNKS

SEQ ID NO: 132084 - protein, 9 aa, Borrelia garinii
YNQMHMLSN

SEQ ID NO: 132085 - protein, 15 aa, Borrelia garinii
SQGGVNSPVNVTTTV

SEQ ID NO: 132086 - protein, 9 aa, Borrelia garinii
VNSPVNVTT

SEQ ID NO: 132087 - protein, 15 aa, Borrelia garinii
QGGVNSPVNVTTTVD

SEQ ID NO: 132088 - protein, 9 aa, Borrelia garinii
VNSPVNVTT

SEQ ID NO: 132089 - protein, 15 aa, Borrelia garinii
APSQGGVNSPVNVTT

SEQ ID NO: 132090 - protein, 9 aa, Borrelia garinii
GVNSPVNVT

SEQ ID NO: 132091 - protein, 15 aa, Borrelia garinii
QDEAIAVNIYAANVA

SEQ ID NO: 132092 - protein, 9 aa, Borrelia garinii
AVNIYAANV

SEQ ID NO: 132093 - protein, 15 aa, Borrelia garinii
PASLSGSQASWTLRV

SEQ ID NO: 132094 - protein, 9 aa, Borrelia garinii
LSGSQASWT

SEQ ID NO: 132095 - protein, 15 aa, Borrelia garinii
ASLSGSQASWTLRVH

SEQ ID NO: 132096 - protein, 9 aa, Borrelia garinii
LSGSQASWT

SEQ ID NO: 132097 - protein, 15 aa, Borrelia garinii
IYAANVANLFSGEGA

SEQ ID NO: 132098 - protein, 9 aa, Borrelia garinii
VANLFSGEG

SEQ ID NO: 132099 - protein, 15 aa, Borrelia garinii
GGVNSPVNVTTTVDA

SEQ ID NO: 132100 - protein, 9 aa, Borrelia garinii
VNSPVNVTT

SEQ ID NO: 132101 - protein, 15 aa, Borrelia garinii
ELAVQSGNGTYSDAD

SEQ ID NO: 132102 - protein, 9 aa, Borrelia garinii
VQSGNGTYS

SEQ ID NO: 132103 - protein, 15 aa, Borrelia garinii
NTPASLSGSQASWTL

SEQ ID NO: 132104 - protein, 9 aa, Borrelia garinii
LSGSQASWT

SEQ ID NO: 132105 - protein, 15 aa, Borrelia garinii
GEGAQAAQTAPVQEG

SEQ ID NO: 132106 - protein, 9 aa, Borrelia garinii
AQAAQTAPV

SEQ ID NO: 132107 - protein, 15 aa, Borrelia garinii
LAVQSGNGTYSDADR

SEQ ID NO: 132108 - protein, 9 aa, Borrelia garinii
VQSGNGTYS

SEQ ID NO: 132109 - protein, 15 aa, Borrelia garinii
EGAQAAQTAPVQEGV

SEQ ID NO: 132110 - protein, 9 aa, Borrelia garinii
AQAAQTAPV

SEQ ID NO: 132111 - protein, 15 aa, Borrelia garinii
YAANVANLFSGEGAQ

SEQ ID NO: 132112 - protein, 9 aa, Borrelia garinii
VANLFSGEG

SEQ ID NO: 132113 - protein, 15 aa, Borrelia garinii
TPASLSGSQASWTLR

SEQ ID NO: 132114 - protein, 9 aa, Borrelia garinii
LSGSQASWT

SEQ ID NO: 132115 - protein, 15 aa, Borrelia garinii
AQQPAPATAPSQGGV

SEQ ID NO: 132116 - protein, 9 aa, Borrelia garinii
PATAPSQGG

SEQ ID NO: 132117 - protein, 15 aa, Borrelia garinii
ADQAQYNQMHMLSNK

SEQ ID NO: 132118 - protein, 9 aa, Borrelia garinii
YNQMHMLSN

SEQ ID NO: 132119 - protein, 15 aa, Borrelia garinii
HMLSNKSASQNVRTA

SEQ ID NO: 132120 - protein, 9 aa, Borrelia garinii
LSNKSASQN

SEQ ID NO: 132121 - protein, 15 aa, Borrelia garinii
IADQAQYNQMHMLSN

SEQ ID NO: 132122 - protein, 9 aa, Borrelia garinii
QYNQMHMLS

SEQ ID NO: 132123 - protein, 15 aa, Borrelia garinii
SGEGAQAAQTAPVQE

SEQ ID NO: 132124 - protein, 9 aa, Borrelia garinii
AQAAQTAPV

SEQ ID NO: 132125 - protein, 15 aa, Borrelia garinii
VNVTTTVDANTSLAK

SEQ ID NO: 132126 - protein, 9 aa, Borrelia garinii
VTTTVDANT

SEQ ID NO: 132127 - protein, 15 aa, Borrelia garinii
QQPAPATAPSQGGVN

SEQ ID NO: 132128 - protein, 9 aa, Borrelia garinii
PATAPSQGG

SEQ ID NO: 132129 - protein, 15 aa, Borrelia garinii
GVNSPVNVTTTVDAN

SEQ ID NO: 132130 - protein, 9 aa, Borrelia garinii
VNVTTTVDA

SEQ ID NO: 132131 - protein, 15 aa, Borrelia garinii
AQAAQTAPVQEGVQQ

SEQ ID NO: 132132 - protein, 9 aa, Borrelia garinii
AQTAPVQEG

SEQ ID NO: 132133 - protein, 15 aa, Borrelia garinii
GAQAAQTAPVQEGVQ

SEQ ID NO: 132134 - protein, 9 aa, Borrelia garinii
AQTAPVQEG

SEQ ID NO: 132135 - protein, 15 aa, Borrelia garinii
VNSPVNVTTTVDANT

SEQ ID NO: 132136 - protein, 9 aa, Borrelia garinii
VNVTTTVDA

SEQ ID NO: 132137 - protein, 15 aa, Borrelia garinii
SLSGSQASWTLRVHV

SEQ ID NO: 132138 - protein, 9 aa, Borrelia garinii
LSGSQASWT

SEQ ID NO: 132139 - protein, 15 aa, Borrelia garinii
LSGSQASWTLRVHVG

SEQ ID NO: 132140 - protein, 9 aa, Borrelia garinii
LSGSQASWT

SEQ ID NO: 132141 - protein, 15 aa, Borrelia garinii
SKAINFIQTTEGNLN

SEQ ID NO: 132142 - protein, 9 aa, Borrelia garinii
INFIQTTEG

SEQ ID NO: 132143 - protein, 15 aa, Borrelia garinii
NSPVNVTTTVDANTS

SEQ ID NO: 132144 - protein, 9 aa, Borrelia garinii
VNVTTTVDA

SEQ ID NO: 132145 - protein, 15 aa, Borrelia garinii
SPVNVTTTVDANTSL

SEQ ID NO: 132146 - protein, 9 aa, Borrelia garinii
VNVTTTVDA

SEQ ID NO: 132147 - protein, 15 aa, Borrelia garinii
NVTTTVDANTSLAKI

SEQ ID NO: 132148 - protein, 9 aa, Borrelia garinii
VDANTSLAK

SEQ ID NO: 132149 - protein, 15 aa, Borrelia garinii
KAINFIQTTEGNLNE

SEQ ID NO: 132150 - protein, 9 aa, Borrelia garinii
INFIQTTEG

SEQ ID NO: 132151 - protein, 15 aa, Borrelia garinii
QPAPATAPSQGGVNS

SEQ ID NO: 132152 - protein, 9 aa, Borrelia garinii
PATAPSQGG

SEQ ID NO: 132153 - protein, 15 aa, Borrelia garinii
MLSNKSASQNVRTAE

SEQ ID NO: 132154 - protein, 9 aa, Borrelia garinii
LSNKSASQN

SEQ ID NO: 132155 - protein, 15 aa, Borrelia garinii
PAPATAPSQGGVNSP

SEQ ID NO: 132156 - protein, 9 aa, Borrelia garinii
PATAPSQGG

SEQ ID NO: 132157 - protein, 15 aa, Borrelia garinii
VTTTVDANTSLAKIE

SEQ ID NO: 132158 - protein, 9 aa, Borrelia garinii
VDANTSLAK

SEQ ID NO: 132159 - protein, 15 aa, Borrelia garinii
PVNVTTTVDANTSLA

SEQ ID NO: 132160 - protein, 9 aa, Borrelia garinii
VNVTTTVDA

SEQ ID NO: 132161 - protein, 15 aa, Borrelia garinii
QAAQTAPVQEGVQQE

SEQ ID NO: 132162 - protein, 9 aa, Borrelia garinii
AQTAPVQEG

SEQ ID NO: 132163 - protein, 15 aa, Borrelia garinii
QYNQMHMLSNKSASQ

SEQ ID NO: 132164 - protein, 9 aa, Borrelia garinii
QMHMLSNKS

SEQ ID NO: 132165 - protein, 15 aa, Borrelia garinii
YNQMHMLSNKSASQN

SEQ ID NO: 132166 - protein, 9 aa, Borrelia garinii
QMHMLSNKS

SEQ ID NO: 132167 - protein, 15 aa, Borrelia garinii
IAVNIYAANVANLFS

SEQ ID NO: 132168 - protein, 9 aa, Borrelia garinii
YAANVANLF

SEQ ID NO: 132169 - protein, 15 aa, Borrelia garinii
QAQYNQMHMLSNKSA

SEQ ID NO: 132170 - protein, 9 aa, Borrelia garinii
QMHMLSNKS

SEQ ID NO: 132171 - protein, 15 aa, Borrelia garinii
NQMHMLSNKSASQNV

SEQ ID NO: 132172 - protein, 9 aa, Borrelia garinii
MLSNKSASQ

SEQ ID NO: 132173 - protein, 15 aa, Borrelia garinii
AIAVNIYAANVANLF

SEQ ID NO: 132174 - protein, 9 aa, Borrelia garinii
NIYAANVAN

SEQ ID NO: 132175 - protein, 15 aa, Borrelia garinii
NIYAANVANLFSGEG

SEQ ID NO: 132176 - protein, 9 aa, Borrelia garinii
YAANVANLF

SEQ ID NO: 132177 - protein, 15 aa, Borrelia garinii
AVNIYAANVANLFSG

SEQ ID NO: 132178 - protein, 9 aa, Borrelia garinii
YAANVANLF

SEQ ID NO: 132179 - protein, 15 aa, Borrelia garinii
AQYNQMHMLSNKSAS

SEQ ID NO: 132180 - protein, 9 aa, Borrelia garinii
QMHMLSNKS

SEQ ID NO: 132181 - protein, 15 aa, Borrelia garinii
VNIYAANVANLFSGE

SEQ ID NO: 132182 - protein, 9 aa, Borrelia garinii
YAANVANLF

SEQ ID NO: 132183 - protein, 15 aa, Borrelia garinii
QMHMLSNKSASQNVR

SEQ ID NO: 132184 - protein, 9 aa, Borrelia garinii
MLSNKSASQ

SEQ ID NO: 132185 - protein, 15 aa, Borrelia garinii
GVNSPVNVTTTVDAN

SEQ ID NO: 132186 - protein, 9 aa, Borrelia garinii
VNVTTTVDA

SEQ ID NO: 132187 - protein, 15 aa, Borrelia garinii
GGVNSPVNVTTTVDA

SEQ ID NO: 132188 - protein, 9 aa, Borrelia garinii
VNSPVNVTT

SEQ ID NO: 132189 - protein, 15 aa, Borrelia garinii
NSPVNVTTTVDANTS

SEQ ID NO: 132190 - protein, 9 aa, Borrelia garinii
VNVTTTVDA

SEQ ID NO: 132191 - protein, 15 aa, Borrelia garinii
VNSPVNVTTTVDANT

SEQ ID NO: 132192 - protein, 9 aa, Borrelia garinii
VNVTTTVDA

SEQ ID NO: 132193 - protein, 15 aa, Borrelia garinii
ANVANLFSGEGAQAA

SEQ ID NO: 132194 - protein, 9 aa, Borrelia garinii
VANLFSGEG

SEQ ID NO: 132195 - protein, 15 aa, Borrelia garinii
AANVANLFSGEGAQA

SEQ ID NO: 132196 - protein, 9 aa, Borrelia garinii
VANLFSGEG

SEQ ID NO: 132197 - protein, 15 aa, Borrelia garinii
NIYAANVANLFSGEG

SEQ ID NO: 132198 - protein, 9 aa, Borrelia garinii
YAANVANLF

SEQ ID NO: 132199 - protein, 15 aa, Borrelia garinii
IYAANVANLFSGEGA

SEQ ID NO: 132200 - protein, 9 aa, Borrelia garinii
VANLFSGEG

SEQ ID NO: 132201 - protein, 15 aa, Borrelia garinii
YAANVANLFSGEGAQ

SEQ ID NO: 132202 - protein, 9 aa, Borrelia garinii
VANLFSGEG

SEQ ID NO: 132203 - protein, 15 aa, Borrelia garinii
YNQMHMLSNKSASQN

SEQ ID NO: 132204 - protein, 9 aa, Borrelia garinii
MLSNKSASQ

SEQ ID NO: 132205 - protein, 15 aa, Borrelia garinii
QYNQMHMLSNKSASQ

SEQ ID NO: 132206 - protein, 9 aa, Borrelia garinii
QMHMLSNKS

SEQ ID NO: 132207 - protein, 15 aa, Borrelia garinii
NVANLFSGEGAQAAQ

SEQ ID NO: 132208 - protein, 9 aa, Borrelia garinii
VANLFSGEG

SEQ ID NO: 132209 - protein, 15 aa, Borrelia garinii
VANLFSGEGAQAAQT

SEQ ID NO: 132210 - protein, 9 aa, Borrelia garinii
VANLFSGEG

SEQ ID NO: 132211 - protein, 15 aa, Borrelia garinii
NQMHMLSNKSASQNV

SEQ ID NO: 132212 - protein, 9 aa, Borrelia garinii
MLSNKSASQ

SEQ ID NO: 132213 - protein, 15 aa, Borrelia garinii
QMHMLSNKSASQNVR

SEQ ID NO: 132214 - protein, 9 aa, Borrelia garinii
MLSNKSASQ

SEQ ID NO: 132215 - protein, 15 aa, Borrelia garinii
VNVTTTVDANTSLAK

SEQ ID NO: 132216 - protein, 9 aa, Borrelia garinii
TVDANTSLA

SEQ ID NO: 132217 - protein, 15 aa, Borrelia garinii
PVNVTTTVDANTSLA

SEQ ID NO: 132218 - protein, 9 aa, Borrelia garinii
VNVTTTVDA

SEQ ID NO: 132219 - protein, 15 aa, Borrelia garinii
AQYNQMHMLSNKSAS

SEQ ID NO: 132220 - protein, 9 aa, Borrelia garinii
QMHMLSNKS

SEQ ID NO: 132221 - protein, 15 aa, Borrelia garinii
QAQYNQMHMLSNKSA

SEQ ID NO: 132222 - protein, 9 aa, Borrelia garinii
QMHMLSNKS

SEQ ID NO: 132223 - protein, 15 aa, Borrelia garinii
DQAQYNQMHMLSNKS

SEQ ID NO: 132224 - protein, 9 aa, Borrelia garinii
YNQMHMLSN

SEQ ID NO: 132225 - protein, 15 aa, Borrelia garinii
EELGMQPAKINTPAS

SEQ ID NO: 132226 - protein, 9 aa, Borrelia garinii
LGMQPAKIN

SEQ ID NO: 132227 - protein, 15 aa, Borrelia garinii
LGMQPAKINTPASLS

SEQ ID NO: 132228 - protein, 9 aa, Borrelia garinii
PAKINTPAS

SEQ ID NO: 132229 - protein, 15 aa, Borrelia garinii
GGVNSPVNVTTTVDA

SEQ ID NO: 132230 - protein, 9 aa, Borrelia garinii
PVNVTTTVD

SEQ ID NO: 132231 - protein, 15 aa, Borrelia garinii
GVNSPVNVTTTVDAN

SEQ ID NO: 132232 - protein, 9 aa, Borrelia garinii
VNVTTTVDA

SEQ ID NO: 132233 - protein, 15 aa, Borrelia garinii
VNSPVNVTTTVDANT

SEQ ID NO: 132234 - protein, 9 aa, Borrelia garinii
VNVTTTVDA

SEQ ID NO: 132235 - protein, 15 aa, Borrelia garinii
ELGMQPAKINTPASL

SEQ ID NO: 132236 - protein, 9 aa, Borrelia garinii
PAKINTPAS

SEQ ID NO: 132237 - protein, 15 aa, Borrelia garinii
NSPVNVTTTVDANTS

SEQ ID NO: 132238 - protein, 9 aa, Borrelia garinii
VNVTTTVDA

SEQ ID NO: 132239 - protein, 15 aa, Borrelia garinii
GGVNSPVNVTTTVDA

SEQ ID NO: 132240 - protein, 9 aa, Borrelia garinii
PVNVTTTVD

SEQ ID NO: 132241 - protein, 15 aa, Borrelia garinii
GVNSPVNVTTTVDAN

SEQ ID NO: 132242 - protein, 9 aa, Borrelia garinii
VNVTTTVDA

SEQ ID NO: 132243 - protein, 15 aa, Borrelia garinii
IAVNIYAANVANLFS

SEQ ID NO: 132244 - protein, 9 aa, Borrelia garinii
VNIYAANVA

SEQ ID NO: 132245 - protein, 15 aa, Borrelia garinii
AIAVNIYAANVANLF

SEQ ID NO: 132246 - protein, 9 aa, Borrelia garinii
VNIYAANVA

SEQ ID NO: 132247 - protein, 15 aa, Borrelia garinii
EAIAVNIYAANVANL

SEQ ID NO: 132248 - protein, 9 aa, Borrelia garinii
VNIYAANVA

SEQ ID NO: 132249 - protein, 15 aa, Borrelia garinii
AVNIYAANVANLFSG

SEQ ID NO: 132250 - protein, 9 aa, Borrelia garinii
IYAANVANL

SEQ ID NO: 132251 - protein, 15 aa, Borrelia garinii
VNIYAANVANLFSGE

SEQ ID NO: 132252 - protein, 9 aa, Borrelia garinii
IYAANVANL

SEQ ID NO: 132253 - protein, 15 aa, Borrelia garinii
NTSLAKIENAIRMIS

SEQ ID NO: 132254 - protein, 9 aa, Borrelia garinii
AKIENAIRM

SEQ ID NO: 132255 - protein, 15 aa, Borrelia garinii
TSLAKIENAIRMISD

SEQ ID NO: 132256 - protein, 9 aa, Borrelia garinii
IENAIRMIS

SEQ ID NO: 132257 - protein, 15 aa, Borrelia garinii
SLAKIENAIRMISDQ

SEQ ID NO: 132258 - protein, 9 aa, Borrelia garinii
IENAIRMIS

SEQ ID NO: 132259 - protein, 15 aa, Borrelia garinii
RMKELAVQSGNGTYS

SEQ ID NO: 132260 - protein, 9 aa, Borrelia garinii
LAVQSGNGT

SEQ ID NO: 132261 - protein, 15 aa, Borrelia garinii
AIAVNIYAANVANLF

SEQ ID NO: 132262 - protein, 9 aa, Borrelia garinii
VNIYAANVA

SEQ ID NO: 132263 - protein, 15 aa, Borrelia garinii
IAVNIYAANVANLFS

SEQ ID NO: 132264 - protein, 9 aa, Borrelia garinii
VNIYAANVA

SEQ ID NO: 132265 - protein, 15 aa, Borrelia garinii
MKELAVQSGNGTYSD

SEQ ID NO: 132266 - protein, 9 aa, Borrelia garinii
LAVQSGNGT

SEQ ID NO: 132267 - protein, 15 aa, Borrelia garinii
KELAVQSGNGTYSDA

SEQ ID NO: 132268 - protein, 9 aa, Borrelia garinii
LAVQSGNGT

SEQ ID NO: 132269 - protein, 15 aa, Borrelia garinii
LVRMKELAVQSGNGT

SEQ ID NO: 132270 - protein, 9 aa, Borrelia garinii
MKELAVQSG

SEQ ID NO: 132271 - protein, 15 aa, Borrelia garinii
VRMKELAVQSGNGTY

SEQ ID NO: 132272 - protein, 9 aa, Borrelia garinii
LAVQSGNGT

SEQ ID NO: 132273 - protein, 15 aa, Borrelia garinii
AVNIYAANVANLFSG

SEQ ID NO: 132274 - protein, 9 aa, Borrelia garinii
YAANVANLF

SEQ ID NO: 132275 - protein, 15 aa, Borrelia garinii
VNIYAANVANLFSGE

SEQ ID NO: 132276 - protein, 9 aa, Borrelia garinii
YAANVANLF

SEQ ID NO: 132277 - protein, 15 aa, Borrelia garinii
SQGGVNSPVNVTTTV

SEQ ID NO: 132278 - protein, 9 aa, Borrelia garinii
GVNSPVNVT

SEQ ID NO: 132279 - protein, 15 aa, Borrelia garinii
QGGVNSPVNVTTTVD

SEQ ID NO: 132280 - protein, 9 aa, Borrelia garinii
GVNSPVNVT

SEQ ID NO: 132281 - protein, 15 aa, Borrelia garinii
GGVNSPVNVTTTVDA

SEQ ID NO: 132282 - protein, 9 aa, Borrelia garinii
GVNSPVNVT

SEQ ID NO: 132283 - protein, 15 aa, Borrelia garinii
EAIAVNIYAANVANL

SEQ ID NO: 132284 - protein, 9 aa, Borrelia garinii
VNIYAANVA

SEQ ID NO: 132285 - protein, 15 aa, Borrelia garinii
PSQGGVNSPVNVTTT

SEQ ID NO: 132286 - protein, 9 aa, Borrelia garinii
GVNSPVNVT

SEQ ID NO: 132287 - protein, 15 aa, Borrelia garinii
APSQGGVNSPVNVTT

SEQ ID NO: 132288 - protein, 9 aa, Borrelia garinii
GVNSPVNVT

SEQ ID NO: 132289 - protein, 15 aa, Borrelia garinii
QDEAIAVNIYAANVA

SEQ ID NO: 132290 - protein, 9 aa, Borrelia garinii
IAVNIYAAN

SEQ ID NO: 132291 - protein, 15 aa, Borrelia garinii
DEAIAVNIYAANVAN

SEQ ID NO: 132292 - protein, 9 aa, Borrelia garinii
VNIYAANVA

SEQ ID NO: 132293 - protein, 15 aa, Borrelia garinii
GVNSPVNVTTTVDAN

SEQ ID NO: 132294 - protein, 9 aa, Borrelia garinii
GVNSPVNVT

SEQ ID NO: 132295 - protein, 15 aa, Borrelia garinii
ELAVQSGNGTYSDAD

SEQ ID NO: 132296 - protein, 9 aa, Borrelia garinii
LAVQSGNGT

SEQ ID NO: 132297 - protein, 15 aa, Borrelia garinii
LAVQSGNGTYSDADR

SEQ ID NO: 132298 - protein, 9 aa, Borrelia garinii
LAVQSGNGT

SEQ ID NO: 132299 - protein, 15 aa, Borrelia garinii
NIYAANVANLFSGEG

SEQ ID NO: 132300 - protein, 9 aa, Borrelia garinii
YAANVANLF

SEQ ID NO: 132301 - protein, 15 aa, Borrelia garinii
SKAINFIQTTEGNLN

SEQ ID NO: 132302 - protein, 9 aa, Borrelia garinii
INFIQTTEG

SEQ ID NO: 132303 - protein, 15 aa, Borrelia garinii
EKVLVRMKELAVQSG

SEQ ID NO: 132304 - protein, 9 aa, Borrelia garinii
LVRMKELAV

SEQ ID NO: 132305 - protein, 15 aa, Borrelia garinii
KVLVRMKELAVQSGN

SEQ ID NO: 132306 - protein, 9 aa, Borrelia garinii
LVRMKELAV

SEQ ID NO: 132307 - protein, 15 aa, Borrelia garinii
VEKVLVRMKELAVQS

SEQ ID NO: 132308 - protein, 9 aa, Borrelia garinii
LVRMKELAV

SEQ ID NO: 132309 - protein, 15 aa, Borrelia garinii
EVEKVLVRMKELAVQ

SEQ ID NO: 132310 - protein, 9 aa, Borrelia garinii
LVRMKELAV

SEQ ID NO: 132311 - protein, 15 aa, Borrelia garinii
VLVRMKELAVQSGNG

SEQ ID NO: 132312 - protein, 9 aa, Borrelia garinii
VRMKELAVQ

SEQ ID NO: 132313 - protein, 15 aa, Borrelia garinii
LVRMKELAVQSGNGT

SEQ ID NO: 132314 - protein, 9 aa, Borrelia garinii
VRMKELAVQ

SEQ ID NO: 132315 - protein, 15 aa, Borrelia garinii
NEVEKVLVRMKELAV

SEQ ID NO: 132316 - protein, 9 aa, Borrelia garinii
VLVRMKELA

SEQ ID NO: 132317 - protein, 15 aa, Borrelia garinii
QYNQMHMLSNKSASQ

SEQ ID NO: 132318 - protein, 9 aa, Borrelia garinii
MHMLSNKSA

SEQ ID NO: 132319 - protein, 15 aa, Borrelia garinii
YNQMHMLSNKSASQN

SEQ ID NO: 132320 - protein, 9 aa, Borrelia garinii
MHMLSNKSA

SEQ ID NO: 132321 - protein, 15 aa, Borrelia garinii
AQYNQMHMLSNKSAS

SEQ ID NO: 132322 - protein, 9 aa, Borrelia garinii
MHMLSNKSA

SEQ ID NO: 132323 - protein, 15 aa, Borrelia garinii
VRMKELAVQSGNGTY

SEQ ID NO: 132324 - protein, 9 aa, Borrelia garinii
VRMKELAVQ

SEQ ID NO: 132325 - protein, 15 aa, Borrelia garinii
QAQYNQMHMLSNKSA

SEQ ID NO: 132326 - protein, 9 aa, Borrelia garinii
QMHMLSNKS

SEQ ID NO: 132327 - protein, 15 aa, Borrelia garinii
NQMHMLSNKSASQNV

SEQ ID NO: 132328 - protein, 9 aa, Borrelia garinii
MHMLSNKSA

SEQ ID NO: 132329 - protein, 15 aa, Borrelia garinii
QASWTLRVHVGANQD

SEQ ID NO: 132330 - protein, 9 aa, Borrelia garinii
LRVHVGANQ

SEQ ID NO: 132331 - protein, 15 aa, Borrelia garinii
SQASWTLRVHVGANQ

SEQ ID NO: 132332 - protein, 9 aa, Borrelia garinii
QASWTLRVH

SEQ ID NO: 132333 - protein, 15 aa, Borrelia garinii
EVEKVLVRMKELAVQ

SEQ ID NO: 132334 - protein, 9 aa, Borrelia garinii
VEKVLVRMK

SEQ ID NO: 132335 - protein, 15 aa, Borrelia garinii
VEKVLVRMKELAVQS

SEQ ID NO: 132336 - protein, 9 aa, Borrelia garinii
VRMKELAVQ

SEQ ID NO: 132337 - protein, 15 aa, Borrelia garinii
EKVLVRMKELAVQSG

SEQ ID NO: 132338 - protein, 9 aa, Borrelia garinii
VRMKELAVQ

SEQ ID NO: 132339 - protein, 15 aa, Borrelia garinii
KVLVRMKELAVQSGN

SEQ ID NO: 132340 - protein, 9 aa, Borrelia garinii
VRMKELAVQ

SEQ ID NO: 132341 - protein, 15 aa, Borrelia garinii
VLVRMKELAVQSGNG

SEQ ID NO: 132342 - protein, 9 aa, Borrelia garinii
VRMKELAVQ

SEQ ID NO: 132343 - protein, 15 aa, Borrelia garinii
VRMKELAVQSGNGTY

SEQ ID NO: 132344 - protein, 9 aa, Borrelia garinii
VRMKELAVQ

SEQ ID NO: 132345 - protein, 15 aa, Borrelia garinii
LVRMKELAVQSGNGT

SEQ ID NO: 132346 - protein, 9 aa, Borrelia garinii
VRMKELAVQ

SEQ ID NO: 132347 - protein, 15 aa, Borrelia garinii
NTSLAKIENAIRMIS

SEQ ID NO: 132348 - protein, 9 aa, Borrelia garinii
AKIENAIRM

SEQ ID NO: 132349 - protein, 15 aa, Borrelia garinii
TSLAKIENAIRMISD

SEQ ID NO: 132350 - protein, 9 aa, Borrelia garinii
AKIENAIRM

SEQ ID NO: 132351 - protein, 15 aa, Borrelia garinii
DANTSLAKIENAIRM

SEQ ID NO: 132352 - protein, 9 aa, Borrelia garinii
LAKIENAIR

SEQ ID NO: 132353 - protein, 15 aa, Borrelia garinii
ANTSLAKIENAIRMI

SEQ ID NO: 132354 - protein, 9 aa, Borrelia garinii
AKIENAIRM

SEQ ID NO: 132355 - protein, 15 aa, Borrelia garinii
SLAKIENAIRMISDQ

SEQ ID NO: 132356 - protein, 9 aa, Borrelia garinii
AKIENAIRM

SEQ ID NO: 132357 - protein, 15 aa, Borrelia garinii PBi
TTNSILTQSAMAMIA

SEQ ID NO: 132358 - protein, 9 aa, Borrelia garinii PBi
ILTQSAMAM

SEQ ID NO: 132359 - protein, 15 aa, Borrelia garinii PBi
TNSILTQSAMAMIAQ

SEQ ID NO: 132360 - protein, 9 aa, Borrelia garinii PBi
ILTQSAMAM

SEQ ID NO: 132361 - protein, 15 aa, Borrelia garinii PBi
NSILTQSAMAMIAQA

SEQ ID NO: 132362 - protein, 9 aa, Borrelia garinii PBi
ILTQSAMAM

SEQ ID NO: 132363 - protein, 15 aa, Borrelia garinii PBi
STTNSILTQSAMAMI

SEQ ID NO: 132364 - protein, 9 aa, Borrelia garinii PBi
ILTQSAMAM

SEQ ID NO: 132365 - protein, 15 aa, Borrelia garinii PBi
ASTTNSILTQSAMAM

SEQ ID NO: 132366 - protein, 9 aa, Borrelia garinii PBi
TNSILTQSA

SEQ ID NO: 132367 - protein, 15 aa, Borrelia garinii PBi
QPAKINTPASLSGSQ

SEQ ID NO: 132368 - protein, 9 aa, Borrelia garinii PBi
INTPASLSG

SEQ ID NO: 132369 - protein, 15 aa, Borrelia garinii PBi
PAKINTPASLSGSQA

SEQ ID NO: 132370 - protein, 9 aa, Borrelia garinii PBi
INTPASLSG

SEQ ID NO: 132371 - protein, 15 aa, Borrelia garinii PBi
SILTQSAMAMIAQAN

SEQ ID NO: 132372 - protein, 9 aa, Borrelia garinii PBi
ILTQSAMAM

SEQ ID NO: 132373 - protein, 15 aa, Borrelia garinii PBi
MQPAKINTPASLSGS

SEQ ID NO: 132374 - protein, 9 aa, Borrelia garinii PBi
INTPASLSG

SEQ ID NO: 132375 - protein, 15 aa, Borrelia garinii PBi
AKINTPASLSGSQAS

SEQ ID NO: 132376 - protein, 9 aa, Borrelia garinii PBi
INTPASLSG

SEQ ID NO: 132377 - protein, 15 aa, Borrelia garinii PBi
ILTQSAMAMIAQANQ

SEQ ID NO: 132378 - protein, 9 aa, Borrelia garinii PBi
ILTQSAMAM

SEQ ID NO: 132379 - protein, 15 aa, Borrelia garinii PBi
GMQPAKINTPASLSG

SEQ ID NO: 132380 - protein, 9 aa, Borrelia garinii PBi
KINTPASLS

SEQ ID NO: 132381 - protein, 15 aa, Borrelia garinii PBi
NAIRMISDQRANLGA

SEQ ID NO: 132382 - protein, 9 aa, Borrelia garinii PBi
IRMISDQRA

SEQ ID NO: 132383 - protein, 15 aa, Borrelia garinii PBi
ANVANLFSGEGSQAA

SEQ ID NO: 132384 - protein, 9 aa, Borrelia garinii PBi
VANLFSGEG

SEQ ID NO: 132385 - protein, 15 aa, Borrelia garinii PBi
ANLFSGEGSQAAQTA

SEQ ID NO: 132386 - protein, 9 aa, Borrelia garinii PBi
FSGEGSQAA

SEQ ID NO: 132387 - protein, 15 aa, Borrelia garinii PBi
ENAIRMISDQRANLG

SEQ ID NO: 132388 - protein, 9 aa, Borrelia garinii PBi
IRMISDQRA

SEQ ID NO: 132389 - protein, 15 aa, Borrelia garinii PBi
VANLFSGEGSQAAQT

SEQ ID NO: 132390 - protein, 9 aa, Borrelia garinii PBi
FSGEGSQAA

SEQ ID NO: 132391 - protein, 15 aa, Borrelia garinii PBi
NLFSGEGSQAAQTAP

SEQ ID NO: 132392 - protein, 9 aa, Borrelia garinii PBi
FSGEGSQAA

SEQ ID NO: 132393 - protein, 15 aa, Borrelia garinii PBi
NVANLFSGEGSQAAQ

SEQ ID NO: 132394 - protein, 9 aa, Borrelia garinii PBi
FSGEGSQAA

SEQ ID NO: 132395 - protein, 15 aa, Borrelia garinii PBi
YNQMHMLSNKSASQN

SEQ ID NO: 132396 - protein, 9 aa, Borrelia garinii PBi
MHMLSNKSA

SEQ ID NO: 132397 - protein, 15 aa, Borrelia garinii PBi
EKVLVRMKELAVQSG

SEQ ID NO: 132398 - protein, 9 aa, Borrelia garinii PBi
VRMKELAVQ

SEQ ID NO: 132399 - protein, 15 aa, Borrelia garinii PBi
KVLVRMKELAVQSGN

SEQ ID NO: 132400 - protein, 9 aa, Borrelia garinii PBi
MKELAVQSG

SEQ ID NO: 132401 - protein, 15 aa, Borrelia garinii PBi
QAQYNQMHMLSNKSA

SEQ ID NO: 132402 - protein, 9 aa, Borrelia garinii PBi
YNQMHMLSN

SEQ ID NO: 132403 - protein, 15 aa, Borrelia garinii PBi
AQYNQMHMLSNKSAS

SEQ ID NO: 132404 - protein, 9 aa, Borrelia garinii PBi
MHMLSNKSA

SEQ ID NO: 132405 - protein, 15 aa, Borrelia garinii PBi
NQMHMLSNKSASQNV

SEQ ID NO: 132406 - protein, 9 aa, Borrelia garinii PBi
MHMLSNKSA

SEQ ID NO: 132407 - protein, 15 aa, Borrelia garinii PBi
AEELGMQPAKINTPA

SEQ ID NO: 132408 - protein, 9 aa, Borrelia garinii PBi
LGMQPAKIN

SEQ ID NO: 132409 - protein, 15 aa, Borrelia garinii PBi
VLVRMKELAVQSGNG

SEQ ID NO: 132410 - protein, 9 aa, Borrelia garinii PBi
MKELAVQSG

SEQ ID NO: 132411 - protein, 15 aa, Borrelia garinii PBi
TAEELGMQPAKINTP

SEQ ID NO: 132412 - protein, 9 aa, Borrelia garinii PBi
LGMQPAKIN

SEQ ID NO: 132413 - protein, 15 aa, Borrelia garinii PBi
QYNQMHMLSNKSASQ

SEQ ID NO: 132414 - protein, 9 aa, Borrelia garinii PBi
MHMLSNKSA

SEQ ID NO: 132415 - protein, 15 aa, Borrelia garinii PBi
AKIENAIRMISDQRA

SEQ ID NO: 132416 - protein, 9 aa, Borrelia garinii PBi
IENAIRMIS

SEQ ID NO: 132417 - protein, 15 aa, Borrelia garinii PBi
LVRMKELAVQSGNGT

SEQ ID NO: 132418 - protein, 9 aa, Borrelia garinii PBi
MKELAVQSG

SEQ ID NO: 132419 - protein, 15 aa, Borrelia garinii PBi
RTAEELGMQPAKINT

SEQ ID NO: 132420 - protein, 9 aa, Borrelia garinii PBi
LGMQPAKIN

SEQ ID NO: 132421 - protein, 15 aa, Borrelia garinii PBi
EELGMQPAKINTPAS

SEQ ID NO: 132422 - protein, 9 aa, Borrelia garinii PBi
LGMQPAKIN

SEQ ID NO: 132423 - protein, 15 aa, Borrelia garinii PBi
VRMKELAVQSGNGTY

SEQ ID NO: 132424 - protein, 9 aa, Borrelia garinii PBi
MKELAVQSG

SEQ ID NO: 132425 - protein, 15 aa, Borrelia garinii PBi
VRTAEELGMQPAKIN

SEQ ID NO: 132426 - protein, 9 aa, Borrelia garinii PBi
ELGMQPAKI

SEQ ID NO: 132427 - protein, 15 aa, Borrelia garinii PBi
IENAIRMISDQRANL

SEQ ID NO: 132428 - protein, 9 aa, Borrelia garinii PBi
IRMISDQRA

SEQ ID NO: 132429 - protein, 15 aa, Borrelia garinii PBi
KIENAIRMISDQRAN

SEQ ID NO: 132430 - protein, 9 aa, Borrelia garinii PBi
IRMISDQRA

SEQ ID NO: 132431 - protein, 15 aa, Borrelia garinii PBi
INTPASLSGSQASWT

SEQ ID NO: 132432 - protein, 9 aa, Borrelia garinii PBi
INTPASLSG

SEQ ID NO: 132433 - protein, 15 aa, Borrelia garinii PBi
EYAIENLKASYAQIK

SEQ ID NO: 132434 - protein, 9 aa, Borrelia garinii PBi
IENLKASYA

SEQ ID NO: 132435 - protein, 15 aa, Borrelia garinii PBi
LFSGEGSQAAQTAPV

SEQ ID NO: 132436 - protein, 9 aa, Borrelia garinii PBi
FSGEGSQAA

SEQ ID NO: 132437 - protein, 15 aa, Borrelia garinii PBi
YAIENLKASYAQIKD

SEQ ID NO: 132438 - protein, 9 aa, Borrelia garinii PBi
IENLKASYA

SEQ ID NO: 132439 - protein, 15 aa, Borrelia garinii PBi
FSGEGSQAAQTAPVQ

SEQ ID NO: 132440 - protein, 9 aa, Borrelia garinii PBi
FSGEGSQAA

SEQ ID NO: 132441 - protein, 15 aa, Borrelia garinii PBi
KINTPASLSGSQASW

SEQ ID NO: 132442 - protein, 9 aa, Borrelia garinii PBi
INTPASLSG

SEQ ID NO: 132443 - protein, 15 aa, Borrelia garinii PBi
AIRMISDQRANLGAF

SEQ ID NO: 132444 - protein, 9 aa, Borrelia garinii PBi
IRMISDQRA

SEQ ID NO: 132445 - protein, 15 aa, Borrelia garinii PBi
IRMISDQRANLGAFQ

SEQ ID NO: 132446 - protein, 9 aa, Borrelia garinii PBi
IRMISDQRA

SEQ ID NO: 132447 - protein, 15 aa, Borrelia garinii PBi
RMKELAVQSGNGTYS

SEQ ID NO: 132448 - protein, 9 aa, Borrelia garinii PBi
MKELAVQSG

SEQ ID NO: 132449 - protein, 15 aa, Borrelia garinii PBi
MKELAVQSGNGTYSD

SEQ ID NO: 132450 - protein, 9 aa, Borrelia garinii PBi
MKELAVQSG

SEQ ID NO: 132451 - protein, 15 aa, Borrelia garinii PBi
STEYAIENLKASYAQ

SEQ ID NO: 132452 - protein, 9 aa, Borrelia garinii PBi
IENLKASYA

SEQ ID NO: 132453 - protein, 15 aa, Borrelia garinii PBi
DSTEYAIENLKASYA

SEQ ID NO: 132454 - protein, 9 aa, Borrelia garinii PBi
YAIENLKAS

SEQ ID NO: 132455 - protein, 15 aa, Borrelia garinii PBi
TEYAIENLKASYAQI

SEQ ID NO: 132456 - protein, 9 aa, Borrelia garinii PBi
IENLKASYA

SEQ ID NO: 132457 - protein, 15 aa, Borrelia garinii PBi
QMHMLSNKSASQNVR

SEQ ID NO: 132458 - protein, 9 aa, Borrelia garinii PBi
MHMLSNKSA

SEQ ID NO: 132459 - protein, 15 aa, Borrelia garinii PBi
MHMLSNKSASQNVRT

SEQ ID NO: 132460 - protein, 9 aa, Borrelia garinii PBi
MHMLSNKSA

SEQ ID NO: 132461 - protein, 15 aa, Borrelia garinii PBi
TQSAMAMIAQANQVP

SEQ ID NO: 132462 - protein, 9 aa, Borrelia garinii PBi
TQSAMAMIA

SEQ ID NO: 132463 - protein, 15 aa, Borrelia garinii PBi
AIAVNIYAANVANLF

SEQ ID NO: 132464 - protein, 9 aa, Borrelia garinii PBi
VNIYAANVA

SEQ ID NO: 132465 - protein, 15 aa, Borrelia garinii PBi
LGMQPAKINTPASLS

SEQ ID NO: 132466 - protein, 9 aa, Borrelia garinii PBi
LGMQPAKIN

SEQ ID NO: 132467 - protein, 15 aa, Borrelia garinii PBi
IAVNIYAANVANLFS

SEQ ID NO: 132468 - protein, 9 aa, Borrelia garinii PBi
YAANVANLF

SEQ ID NO: 132469 - protein, 15 aa, Borrelia garinii PBi
AIENLKASYAQIKDA

SEQ ID NO: 132470 - protein, 9 aa, Borrelia garinii PBi
LKASYAQIK

SEQ ID NO: 132471 - protein, 15 aa, Borrelia garinii PBi
IENLKASYAQIKDAT

SEQ ID NO: 132472 - protein, 9 aa, Borrelia garinii PBi
LKASYAQIK

SEQ ID NO: 132473 - protein, 15 aa, Borrelia garinii PBi
ELGMQPAKINTPASL

SEQ ID NO: 132474 - protein, 9 aa, Borrelia garinii PBi
LGMQPAKIN

SEQ ID NO: 132475 - protein, 15 aa, Borrelia garinii PBi
LTQSAMAMIAQANQV

SEQ ID NO: 132476 - protein, 9 aa, Borrelia garinii PBi
AMAMIAQAN

SEQ ID NO: 132477 - protein, 15 aa, Borrelia garinii PBi
QSAMAMIAQANQVPQ

SEQ ID NO: 132478 - protein, 9 aa, Borrelia garinii PBi
MIAQANQVP

SEQ ID NO: 132479 - protein, 15 aa, Borrelia garinii PBi
AVNIYAANVANLFSG

SEQ ID NO: 132480 - protein, 9 aa, Borrelia garinii PBi
YAANVANLF

SEQ ID NO: 132481 - protein, 15 aa, Borrelia garinii PBi
NIYAANVANLFSGEG

SEQ ID NO: 132482 - protein, 9 aa, Borrelia garinii PBi
YAANVANLF

SEQ ID NO: 132483 - protein, 15 aa, Borrelia garinii PBi
QEGAQQPAPATAPSQ

SEQ ID NO: 132484 - protein, 9 aa, Borrelia garinii PBi
QQPAPATAP

SEQ ID NO: 132485 - protein, 15 aa, Borrelia garinii PBi
ATMTDEVVASTTNSI

SEQ ID NO: 132486 - protein, 9 aa, Borrelia garinii PBi
MTDEVVAST

SEQ ID NO: 132487 - protein, 15 aa, Borrelia garinii PBi
VNIYAANVANLFSGE

SEQ ID NO: 132488 - protein, 9 aa, Borrelia garinii PBi
YAANVANLF

SEQ ID NO: 132489 - protein, 15 aa, Borrelia garinii PBi
QQEGAQQPAPATAPS

SEQ ID NO: 132490 - protein, 9 aa, Borrelia garinii PBi
QQPAPATAP

SEQ ID NO: 132491 - protein, 15 aa, Borrelia garinii PBi
AQQEGAQQPAPATAP

SEQ ID NO: 132492 - protein, 9 aa, Borrelia garinii PBi
AQQPAPATA

SEQ ID NO: 132493 - protein, 15 aa, Borrelia garinii PBi
MTDEVVASTTNSILT

SEQ ID NO: 132494 - protein, 9 aa, Borrelia garinii PBi
VVASTTNSI

SEQ ID NO: 132495 - protein, 15 aa, Borrelia garinii PBi
TMTDEVVASTTNSIL

SEQ ID NO: 132496 - protein, 9 aa, Borrelia garinii PBi
VVASTTNSI

SEQ ID NO: 132497 - protein, 15 aa, Borrelia garinii PBi
TDEVVASTTNSILTQ

SEQ ID NO: 132498 - protein, 9 aa, Borrelia garinii PBi
VVASTTNSI

SEQ ID NO: 132499 - protein, 15 aa, Borrelia garinii PBi
EGAQQPAPATAPSQG

SEQ ID NO: 132500 - protein, 9 aa, Borrelia garinii PBi
QQPAPATAP

SEQ ID NO: 132501 - protein, 15 aa, Borrelia garinii PBi
AMAMIAQANQVPQYV

SEQ ID NO: 132502 - protein, 9 aa, Borrelia garinii PBi
MIAQANQVP

SEQ ID NO: 132503 - protein, 15 aa, Borrelia garinii PBi
EAIAVNIYAANVANL

SEQ ID NO: 132504 - protein, 9 aa, Borrelia garinii PBi
VNIYAANVA

SEQ ID NO: 132505 - protein, 15 aa, Borrelia garinii PBi
DEVVASTTNSILTQS

SEQ ID NO: 132506 - protein, 9 aa, Borrelia garinii PBi
VVASTTNSI

SEQ ID NO: 132507 - protein, 15 aa, Borrelia garinii PBi
ENLKASYAQIKDATM

SEQ ID NO: 132508 - protein, 9 aa, Borrelia garinii PBi
LKASYAQIK

SEQ ID NO: 132509 - protein, 15 aa, Borrelia garinii PBi
VEKVLVRMKELAVQS

SEQ ID NO: 132510 - protein, 9 aa, Borrelia garinii PBi
VRMKELAVQ

SEQ ID NO: 132511 - protein, 15 aa, Borrelia garinii PBi
SAMAMIAQANQVPQY

SEQ ID NO: 132512 - protein, 9 aa, Borrelia garinii PBi
MIAQANQVP

SEQ ID NO: 132513 - protein, 15 aa, Borrelia garinii PBi
GAQQPAPATAPSQGG

SEQ ID NO: 132514 - protein, 9 aa, Borrelia garinii PBi
QQPAPATAP

SEQ ID NO: 132515 - protein, 15 aa, Borrelia garinii PBi
EVEKVLVRMKELAVQ

SEQ ID NO: 132516 - protein, 9 aa, Borrelia garinii PBi
LVRMKELAV

SEQ ID NO: 132517 - protein, 15 aa, Borrelia garinii PBi
NAQIRGLSQASRNTS

SEQ ID NO: 132518 - protein, 9 aa, Borrelia garinii PBi
IRGLSQASR

SEQ ID NO: 132519 - protein, 15 aa, Borrelia garinii PBi
KELAVQSGNGTYSDA

SEQ ID NO: 132520 - protein, 9 aa, Borrelia garinii PBi
VQSGNGTYS

SEQ ID NO: 132521 - protein, 15 aa, Borrelia garinii PBi
NLKASYAQIKDATMT

SEQ ID NO: 132522 - protein, 9 aa, Borrelia garinii PBi
LKASYAQIK

SEQ ID NO: 132523 - protein, 15 aa, Borrelia garinii PBi
LKASYAQIKDATMTD

SEQ ID NO: 132524 - protein, 9 aa, Borrelia garinii PBi
LKASYAQIK

SEQ ID NO: 132525 - protein, 15 aa, Borrelia garinii PBi
INAQIRGLSQASRNT

SEQ ID NO: 132526 - protein, 9 aa, Borrelia garinii PBi
IRGLSQASR

SEQ ID NO: 132527 - protein, 15 aa, Borrelia garinii PBi
AQIRGLSQASRNTSK

SEQ ID NO: 132528 - protein, 9 aa, Borrelia garinii PBi
IRGLSQASR

SEQ ID NO: 132529 - protein, 15 aa, Borrelia garinii PBi
DEAIAVNIYAANVAN

SEQ ID NO: 132530 - protein, 9 aa, Borrelia garinii PBi
VNIYAANVA

SEQ ID NO: 132531 - protein, 15 aa, Borrelia garinii PBi
PSQGGVNSPVNVTTT

SEQ ID NO: 132532 - protein, 9 aa, Borrelia garinii PBi
VNSPVNVTT

SEQ ID NO: 132533 - protein, 15 aa, Borrelia garinii PBi
DQAQYNQMHMLSNKS

SEQ ID NO: 132534 - protein, 9 aa, Borrelia garinii PBi
YNQMHMLSN

SEQ ID NO: 132535 - protein, 15 aa, Borrelia garinii PBi
SQGGVNSPVNVTTTV

SEQ ID NO: 132536 - protein, 9 aa, Borrelia garinii PBi
VNSPVNVTT

SEQ ID NO: 132537 - protein, 15 aa, Borrelia garinii PBi
QGGVNSPVNVTTTVD

SEQ ID NO: 132538 - protein, 9 aa, Borrelia garinii PBi
VNSPVNVTT

SEQ ID NO: 132539 - protein, 15 aa, Borrelia garinii PBi
APSQGGVNSPVNVTT

SEQ ID NO: 132540 - protein, 9 aa, Borrelia garinii PBi
GVNSPVNVT

SEQ ID NO: 132541 - protein, 15 aa, Borrelia garinii PBi
QDEAIAVNIYAANVA

SEQ ID NO: 132542 - protein, 9 aa, Borrelia garinii PBi
AVNIYAANV

SEQ ID NO: 132543 - protein, 15 aa, Borrelia garinii PBi
PASLSGSQASWTLRV

SEQ ID NO: 132544 - protein, 9 aa, Borrelia garinii PBi
LSGSQASWT

SEQ ID NO: 132545 - protein, 15 aa, Borrelia garinii PBi
ASLSGSQASWTLRVH

SEQ ID NO: 132546 - protein, 9 aa, Borrelia garinii PBi
LSGSQASWT

SEQ ID NO: 132547 - protein, 15 aa, Borrelia garinii PBi
AANVANLFSGEGSQA

SEQ ID NO: 132548 - protein, 9 aa, Borrelia garinii PBi
VANLFSGEG

SEQ ID NO: 132549 - protein, 15 aa, Borrelia garinii PBi
MAMIAQANQVPQYVL

SEQ ID NO: 132550 - protein, 9 aa, Borrelia garinii PBi
MIAQANQVP

SEQ ID NO: 132551 - protein, 15 aa, Borrelia garinii PBi
IYAANVANLFSGEGS

SEQ ID NO: 132552 - protein, 9 aa, Borrelia garinii PBi
VANLFSGEG

SEQ ID NO: 132553 - protein, 15 aa, Borrelia garinii PBi
GGVNSPVNVTTTVDA

SEQ ID NO: 132554 - protein, 9 aa, Borrelia garinii PBi
VNSPVNVTT

SEQ ID NO: 132555 - protein, 15 aa, Borrelia garinii PBi
ELAVQSGNGTYSDAD

SEQ ID NO: 132556 - protein, 9 aa, Borrelia garinii PBi
VQSGNGTYS

SEQ ID NO: 132557 - protein, 15 aa, Borrelia garinii PBi
NTPASLSGSQASWTL

SEQ ID NO: 132558 - protein, 9 aa, Borrelia garinii PBi
LSGSQASWT

SEQ ID NO: 132559 - protein, 15 aa, Borrelia garinii PBi
LAVQSGNGTYSDADR

SEQ ID NO: 132560 - protein, 9 aa, Borrelia garinii PBi
VQSGNGTYS

SEQ ID NO: 132561 - protein, 15 aa, Borrelia garinii PBi
NNSINAANLSKTQEK

SEQ ID NO: 132562 - protein, 9 aa, Borrelia garinii PBi
INAANLSKT

SEQ ID NO: 132563 - protein, 15 aa, Borrelia garinii PBi
RNNSINAANLSKTQE

SEQ ID NO: 132564 - protein, 9 aa, Borrelia garinii PBi
INAANLSKT

SEQ ID NO: 132565 - protein, 15 aa, Borrelia garinii PBi
SRNNSINAANLSKTQ

SEQ ID NO: 132566 - protein, 9 aa, Borrelia garinii PBi
INAANLSKT

SEQ ID NO: 132567 - protein, 15 aa, Borrelia garinii PBi
NSINAANLSKTQEKL

SEQ ID NO: 132568 - protein, 9 aa, Borrelia garinii PBi
INAANLSKT

SEQ ID NO: 132569 - protein, 15 aa, Borrelia garinii PBi
YAANVANLFSGEGSQ

SEQ ID NO: 132570 - protein, 9 aa, Borrelia garinii PBi
VANLFSGEG

SEQ ID NO: 132571 - protein, 15 aa, Borrelia garinii PBi
ASRNNSINAANLSKT

SEQ ID NO: 132572 - protein, 9 aa, Borrelia garinii PBi
NSINAANLS

SEQ ID NO: 132573 - protein, 15 aa, Borrelia garinii PBi
TPASLSGSQASWTLR

SEQ ID NO: 132574 - protein, 9 aa, Borrelia garinii PBi
LSGSQASWT

SEQ ID NO: 132575 - protein, 15 aa, Borrelia garinii PBi
EVVASTTNSILTQSA

SEQ ID NO: 132576 - protein, 9 aa, Borrelia garinii PBi
VVASTTNSI

SEQ ID NO: 132577 - protein, 15 aa, Borrelia garinii PBi
KINAQIRGLSQASRN

SEQ ID NO: 132578 - protein, 9 aa, Borrelia garinii PBi
IRGLSQASR

SEQ ID NO: 132579 - protein, 15 aa, Borrelia garinii PBi
GKINAQIRGLSQASR

SEQ ID NO: 132580 - protein, 9 aa, Borrelia garinii PBi
QIRGLSQAS

SEQ ID NO: 132581 - protein, 15 aa, Borrelia garinii PBi
VVASTTNSILTQSAM

SEQ ID NO: 132582 - protein, 9 aa, Borrelia garinii PBi
VVASTTNSI

SEQ ID NO: 132583 - protein, 15 aa, Borrelia garinii PBi
AQQPAPATAPSQGGV

SEQ ID NO: 132584 - protein, 9 aa, Borrelia garinii PBi
PATAPSQGG

SEQ ID NO: 132585 - protein, 15 aa, Borrelia garinii PBi
EGSQAAQTAPVQEGA

SEQ ID NO: 132586 - protein, 9 aa, Borrelia garinii PBi
AQTAPVQEG

SEQ ID NO: 132587 - protein, 15 aa, Borrelia garinii PBi
GEGSQAAQTAPVQEG

SEQ ID NO: 132588 - protein, 9 aa, Borrelia garinii PBi
SQAAQTAPV

SEQ ID NO: 132589 - protein, 15 aa, Borrelia garinii PBi
ADQAQYNQMHMLSNK

SEQ ID NO: 132590 - protein, 9 aa, Borrelia garinii PBi
YNQMHMLSN

SEQ ID NO: 132591 - protein, 15 aa, Borrelia garinii PBi
HMLSNKSASQNVRTA

SEQ ID NO: 132592 - protein, 9 aa, Borrelia garinii PBi
LSNKSASQN

SEQ ID NO: 132593 - protein, 15 aa, Borrelia garinii PBi
IADQAQYNQMHMLSN

SEQ ID NO: 132594 - protein, 9 aa, Borrelia garinii PBi
QYNQMHMLS

SEQ ID NO: 132595 - protein, 15 aa, Borrelia garinii PBi
VNVTTTVDANTSLAK

SEQ ID NO: 132596 - protein, 9 aa, Borrelia garinii PBi
VTTTVDANT

SEQ ID NO: 132597 - protein, 15 aa, Borrelia garinii PBi
KASYAQIKDATMTDE

SEQ ID NO: 132598 - protein, 9 aa, Borrelia garinii PBi
AQIKDATMT

SEQ ID NO: 132599 - protein, 15 aa, Borrelia garinii PBi
QIRGLSQASRNTSKA

SEQ ID NO: 132600 - protein, 9 aa, Borrelia garinii PBi
IRGLSQASR

SEQ ID NO: 132601 - protein, 15 aa, Borrelia garinii PBi
ASYAQIKDATMTDEV

SEQ ID NO: 132602 - protein, 9 aa, Borrelia garinii PBi
AQIKDATMT

SEQ ID NO: 132603 - protein, 15 aa, Borrelia garinii PBi
QQPAPATAPSQGGVN

SEQ ID NO: 132604 - protein, 9 aa, Borrelia garinii PBi
PATAPSQGG

SEQ ID NO: 132605 - protein, 15 aa, Borrelia garinii PBi
AMIAQANQVPQYVLS

SEQ ID NO: 132606 - protein, 9 aa, Borrelia garinii PBi
MIAQANQVP

SEQ ID NO: 132607 - protein, 15 aa, Borrelia garinii PBi
GVNSPVNVTTTVDAN

SEQ ID NO: 132608 - protein, 9 aa, Borrelia garinii PBi
VNVTTTVDA

SEQ ID NO: 132609 - protein, 15 aa, Borrelia garinii PBi
IRGLSQASRNTSKAI

SEQ ID NO: 132610 - protein, 9 aa, Borrelia garinii PBi
IRGLSQASR

SEQ ID NO: 132611 - protein, 15 aa, Borrelia garinii PBi
RMISDQRANLGAFQN

SEQ ID NO: 132612 - protein, 9 aa, Borrelia garinii PBi
ISDQRANLG

SEQ ID NO: 132613 - protein, 15 aa, Borrelia garinii PBi
GAQQEGAQQPAPATA

SEQ ID NO: 132614 - protein, 9 aa, Borrelia garinii PBi
GAQQPAPAT

SEQ ID NO: 132615 - protein, 15 aa, Borrelia garinii PBi
MIAQANQVPQYVLSL

SEQ ID NO: 132616 - protein, 9 aa, Borrelia garinii PBi
QANQVPQYV

SEQ ID NO: 132617 - protein, 15 aa, Borrelia garinii PBi
GSQAAQTAPVQEGAQ

SEQ ID NO: 132618 - protein, 9 aa, Borrelia garinii PBi
AQTAPVQEG

SEQ ID NO: 132619 - protein, 15 aa, Borrelia garinii PBi
SQAAQTAPVQEGAQQ

SEQ ID NO: 132620 - protein, 9 aa, Borrelia garinii PBi
AQTAPVQEG

SEQ ID NO: 132621 - protein, 15 aa, Borrelia garinii PBi
DATMTDEVVASTTNS

SEQ ID NO: 132622 - protein, 9 aa, Borrelia garinii PBi
MTDEVVAST

SEQ ID NO: 132623 - protein, 15 aa, Borrelia garinii PBi
VNSPVNVTTTVDANT

SEQ ID NO: 132624 - protein, 9 aa, Borrelia garinii PBi
VNVTTTVDA

SEQ ID NO: 132625 - protein, 15 aa, Borrelia garinii PBi
SLSGSQASWTLRVHV

SEQ ID NO: 132626 - protein, 9 aa, Borrelia garinii PBi
LSGSQASWT

SEQ ID NO: 132627 - protein, 15 aa, Borrelia garinii PBi
LSGSQASWTLRVHVG

SEQ ID NO: 132628 - protein, 9 aa, Borrelia garinii PBi
LSGSQASWT

SEQ ID NO: 132629 - protein, 15 aa, Borrelia garinii PBi
SKAINFIQTTEGNLN

SEQ ID NO: 132630 - protein, 9 aa, Borrelia garinii PBi
INFIQTTEG

SEQ ID NO: 132631 - protein, 15 aa, Borrelia garinii PBi
MIINHNTSAINASRN

SEQ ID NO: 132632 - protein, 9 aa, Borrelia garinii PBi
INHNTSAIN

SEQ ID NO: 132633 - protein, 15 aa, Borrelia garinii PBi
SYAQIKDATMTDEVV

SEQ ID NO: 132634 - protein, 9 aa, Borrelia garinii PBi
AQIKDATMT

SEQ ID NO: 132635 - protein, 15 aa, Borrelia garinii PBi
NSPVNVTTTVDANTS

SEQ ID NO: 132636 - protein, 9 aa, Borrelia garinii PBi
VNVTTTVDA

SEQ ID NO: 132637 - protein, 15 aa, Borrelia garinii PBi
SPVNVTTTVDANTSL

SEQ ID NO: 132638 - protein, 9 aa, Borrelia garinii PBi
VNVTTTVDA

SEQ ID NO: 132639 - protein, 15 aa, Borrelia garinii PBi
NVTTTVDANTSLAKI

SEQ ID NO: 132640 - protein, 9 aa, Borrelia garinii PBi
VDANTSLAK

SEQ ID NO: 132641 - protein, 15 aa, Borrelia garinii PBi
KAINFIQTTEGNLNE

SEQ ID NO: 132642 - protein, 9 aa, Borrelia garinii PBi
INFIQTTEG

SEQ ID NO: 132643 - protein, 15 aa, Borrelia garinii PBi
SGEGSQAAQTAPVQE

SEQ ID NO: 132644 - protein, 9 aa, Borrelia garinii PBi
SQAAQTAPV

SEQ ID NO: 132645 - protein, 15 aa, Borrelia garinii PBi
QPAPATAPSQGGVNS

SEQ ID NO: 132646 - protein, 9 aa, Borrelia garinii PBi
PATAPSQGG

SEQ ID NO: 132647 - protein, 15 aa, Borrelia garinii PBi
MLSNKSASQNVRTAE

SEQ ID NO: 132648 - protein, 9 aa, Borrelia garinii PBi
LSNKSASQN

SEQ ID NO: 132649 - protein, 15 aa, Borrelia garinii PBi
IKDATMTDEVVASTT

SEQ ID NO: 132650 - protein, 9 aa, Borrelia garinii PBi
MTDEVVAST

SEQ ID NO: 132651 - protein, 15 aa, Borrelia garinii PBi
KDATMTDEVVASTTN

SEQ ID NO: 132652 - protein, 9 aa, Borrelia garinii PBi
MTDEVVAST

SEQ ID NO: 132653 - protein, 15 aa, Borrelia garinii PBi
PAPATAPSQGGVNSP

SEQ ID NO: 132654 - protein, 9 aa, Borrelia garinii PBi
PATAPSQGG

SEQ ID NO: 132655 - protein, 15 aa, Borrelia garinii PBi
VTTTVDANTSLAKIE

SEQ ID NO: 132656 - protein, 9 aa, Borrelia garinii PBi
VDANTSLAK

SEQ ID NO: 132657 - protein, 15 aa, Borrelia garinii PBi
QIKDATMTDEVVAST

SEQ ID NO: 132658 - protein, 9 aa, Borrelia garinii PBi
DATMTDEVV

SEQ ID NO: 132659 - protein, 15 aa, Borrelia garinii PBi
PVNVTTTVDANTSLA

SEQ ID NO: 132660 - protein, 9 aa, Borrelia garinii PBi
VNVTTTVDA

SEQ ID NO: 132661 - protein, 15 aa, Borrelia garinii PBi
QAAQTAPVQEGAQQE

SEQ ID NO: 132662 - protein, 9 aa, Borrelia garinii PBi
AQTAPVQEG

SEQ ID NO: 132663 - protein, 15 aa, Borrelia garinii PBi
EGAQQEGAQQPAPAT

SEQ ID NO: 132664 - protein, 9 aa, Borrelia garinii PBi
AQQEGAQQP

SEQ ID NO: 132665 - protein, 15 aa, Borrelia garinii PBi
QYNQMHMLSNKSASQ

SEQ ID NO: 132666 - protein, 9 aa, Borrelia garinii PBi
QMHMLSNKS

SEQ ID NO: 132667 - protein, 15 aa, Borrelia garinii PBi
YNQMHMLSNKSASQN

SEQ ID NO: 132668 - protein, 9 aa, Borrelia garinii PBi
QMHMLSNKS

SEQ ID NO: 132669 - protein, 15 aa, Borrelia garinii PBi
IAVNIYAANVANLFS

SEQ ID NO: 132670 - protein, 9 aa, Borrelia garinii PBi
YAANVANLF

SEQ ID NO: 132671 - protein, 15 aa, Borrelia garinii PBi
QAQYNQMHMLSNKSA

SEQ ID NO: 132672 - protein, 9 aa, Borrelia garinii PBi
QMHMLSNKS

SEQ ID NO: 132673 - protein, 15 aa, Borrelia garinii PBi
NQMHMLSNKSASQNV

SEQ ID NO: 132674 - protein, 9 aa, Borrelia garinii PBi
MLSNKSASQ

SEQ ID NO: 132675 - protein, 15 aa, Borrelia garinii PBi
AIAVNIYAANVANLF

SEQ ID NO: 132676 - protein, 9 aa, Borrelia garinii PBi
NIYAANVAN

SEQ ID NO: 132677 - protein, 15 aa, Borrelia garinii PBi
NIYAANVANLFSGEG

SEQ ID NO: 132678 - protein, 9 aa, Borrelia garinii PBi
YAANVANLF

SEQ ID NO: 132679 - protein, 15 aa, Borrelia garinii PBi
AVNIYAANVANLFSG

SEQ ID NO: 132680 - protein, 9 aa, Borrelia garinii PBi
YAANVANLF

SEQ ID NO: 132681 - protein, 15 aa, Borrelia garinii PBi
AQYNQMHMLSNKSAS

SEQ ID NO: 132682 - protein, 9 aa, Borrelia garinii PBi
QMHMLSNKS

SEQ ID NO: 132683 - protein, 15 aa, Borrelia garinii PBi
VNIYAANVANLFSGE

SEQ ID NO: 132684 - protein, 9 aa, Borrelia garinii PBi
YAANVANLF

SEQ ID NO: 132685 - protein, 15 aa, Borrelia garinii PBi
QMHMLSNKSASQNVR

SEQ ID NO: 132686 - protein, 9 aa, Borrelia garinii PBi
MLSNKSASQ

SEQ ID NO: 132687 - protein, 15 aa, Borrelia garinii PBi
GVNSPVNVTTTVDAN

SEQ ID NO: 132688 - protein, 9 aa, Borrelia garinii PBi
VNVTTTVDA

SEQ ID NO: 132689 - protein, 15 aa, Borrelia garinii PBi
GGVNSPVNVTTTVDA

SEQ ID NO: 132690 - protein, 9 aa, Borrelia garinii PBi
VNSPVNVTT

SEQ ID NO: 132691 - protein, 15 aa, Borrelia garinii PBi
NSPVNVTTTVDANTS

SEQ ID NO: 132692 - protein, 9 aa, Borrelia garinii PBi
VNVTTTVDA

SEQ ID NO: 132693 - protein, 15 aa, Borrelia garinii PBi
VNSPVNVTTTVDANT

SEQ ID NO: 132694 - protein, 9 aa, Borrelia garinii PBi
VNVTTTVDA

SEQ ID NO: 132695 - protein, 15 aa, Borrelia garinii PBi
ANVANLFSGEGSQAA

SEQ ID NO: 132696 - protein, 9 aa, Borrelia garinii PBi
VANLFSGEG

SEQ ID NO: 132697 - protein, 15 aa, Borrelia garinii PBi
AANVANLFSGEGSQA

SEQ ID NO: 132698 - protein, 9 aa, Borrelia garinii PBi
VANLFSGEG

SEQ ID NO: 132699 - protein, 15 aa, Borrelia garinii PBi
YAANVANLFSGEGSQ

SEQ ID NO: 132700 - protein, 9 aa, Borrelia garinii PBi
VANLFSGEG

SEQ ID NO: 132701 - protein, 15 aa, Borrelia garinii PBi
NIYAANVANLFSGEG

SEQ ID NO: 132702 - protein, 9 aa, Borrelia garinii PBi
YAANVANLF

SEQ ID NO: 132703 - protein, 15 aa, Borrelia garinii PBi
IYAANVANLFSGEGS

SEQ ID NO: 132704 - protein, 9 aa, Borrelia garinii PBi
VANLFSGEG

SEQ ID NO: 132705 - protein, 15 aa, Borrelia garinii PBi
YNQMHMLSNKSASQN

SEQ ID NO: 132706 - protein, 9 aa, Borrelia garinii PBi
MLSNKSASQ

SEQ ID NO: 132707 - protein, 15 aa, Borrelia garinii PBi
QYNQMHMLSNKSASQ

SEQ ID NO: 132708 - protein, 9 aa, Borrelia garinii PBi
QMHMLSNKS

SEQ ID NO: 132709 - protein, 15 aa, Borrelia garinii PBi
NVANLFSGEGSQAAQ

SEQ ID NO: 132710 - protein, 9 aa, Borrelia garinii PBi
VANLFSGEG

SEQ ID NO: 132711 - protein, 15 aa, Borrelia garinii PBi
VANLFSGEGSQAAQT

SEQ ID NO: 132712 - protein, 9 aa, Borrelia garinii PBi
VANLFSGEG

SEQ ID NO: 132713 - protein, 15 aa, Borrelia garinii PBi
ENAIRMISDQRANLG

SEQ ID NO: 132714 - protein, 9 aa, Borrelia garinii PBi
AIRMISDQR

SEQ ID NO: 132715 - protein, 15 aa, Borrelia garinii PBi
NQMHMLSNKSASQNV

SEQ ID NO: 132716 - protein, 9 aa, Borrelia garinii PBi
MLSNKSASQ

SEQ ID NO: 132717 - protein, 15 aa, Borrelia garinii PBi
NAIRMISDQRANLGA

SEQ ID NO: 132718 - protein, 9 aa, Borrelia garinii PBi
ISDQRANLG

SEQ ID NO: 132719 - protein, 15 aa, Borrelia garinii PBi
QMHMLSNKSASQNVR

SEQ ID NO: 132720 - protein, 9 aa, Borrelia garinii PBi
MLSNKSASQ

SEQ ID NO: 132721 - protein, 15 aa, Borrelia garinii PBi
AIRMISDQRANLGAF

SEQ ID NO: 132722 - protein, 9 aa, Borrelia garinii PBi
ISDQRANLG

SEQ ID NO: 132723 - protein, 15 aa, Borrelia garinii PBi
VNVTTTVDANTSLAK

SEQ ID NO: 132724 - protein, 9 aa, Borrelia garinii PBi
TVDANTSLA

SEQ ID NO: 132725 - protein, 15 aa, Borrelia garinii PBi
PVNVTTTVDANTSLA

SEQ ID NO: 132726 - protein, 9 aa, Borrelia garinii PBi
VNVTTTVDA

SEQ ID NO: 132727 - protein, 15 aa, Borrelia garinii PBi
IRMISDQRANLGAFQ

SEQ ID NO: 132728 - protein, 9 aa, Borrelia garinii PBi
ISDQRANLG

SEQ ID NO: 132729 - protein, 15 aa, Borrelia garinii PBi
AQYNQMHMLSNKSAS

SEQ ID NO: 132730 - protein, 9 aa, Borrelia garinii PBi
QMHMLSNKS

SEQ ID NO: 132731 - protein, 15 aa, Borrelia garinii PBi
QAQYNQMHMLSNKSA

SEQ ID NO: 132732 - protein, 9 aa, Borrelia garinii PBi
QMHMLSNKS

SEQ ID NO: 132733 - protein, 15 aa, Borrelia garinii PBi
DQAQYNQMHMLSNKS

SEQ ID NO: 132734 - protein, 9 aa, Borrelia garinii PBi
YNQMHMLSN

SEQ ID NO: 132735 - protein, 15 aa, Borrelia garinii PBi
RMISDQRANLGAFQN

SEQ ID NO: 132736 - protein, 9 aa, Borrelia garinii PBi
ISDQRANLG

SEQ ID NO: 132737 - protein, 15 aa, Borrelia garinii PBi
EELGMQPAKINTPAS

SEQ ID NO: 132738 - protein, 9 aa, Borrelia garinii PBi
LGMQPAKIN

SEQ ID NO: 132739 - protein, 15 aa, Borrelia garinii PBi
LGMQPAKINTPASLS

SEQ ID NO: 132740 - protein, 9 aa, Borrelia garinii PBi
PAKINTPAS

SEQ ID NO: 132741 - protein, 15 aa, Borrelia garinii PBi
GGVNSPVNVTTTVDA

SEQ ID NO: 132742 - protein, 9 aa, Borrelia garinii PBi
PVNVTTTVD

SEQ ID NO: 132743 - protein, 15 aa, Borrelia garinii PBi
GVNSPVNVTTTVDAN

SEQ ID NO: 132744 - protein, 9 aa, Borrelia garinii PBi
VNVTTTVDA

SEQ ID NO: 132745 - protein, 15 aa, Borrelia garinii PBi
VNSPVNVTTTVDANT

SEQ ID NO: 132746 - protein, 9 aa, Borrelia garinii PBi
VNVTTTVDA

SEQ ID NO: 132747 - protein, 15 aa, Borrelia garinii PBi
ELGMQPAKINTPASL

SEQ ID NO: 132748 - protein, 9 aa, Borrelia garinii PBi
PAKINTPAS

SEQ ID NO: 132749 - protein, 15 aa, Borrelia garinii PBi
NSPVNVTTTVDANTS

SEQ ID NO: 132750 - protein, 9 aa, Borrelia garinii PBi
VNVTTTVDA

SEQ ID NO: 132751 - protein, 15 aa, Borrelia garinii PBi
TMTDEVVASTTNSIL

SEQ ID NO: 132752 - protein, 9 aa, Borrelia garinii PBi
VVASTTNSI

SEQ ID NO: 132753 - protein, 15 aa, Borrelia garinii PBi
MTDEVVASTTNSILT

SEQ ID NO: 132754 - protein, 9 aa, Borrelia garinii PBi
VVASTTNSI

SEQ ID NO: 132755 - protein, 15 aa, Borrelia garinii PBi
TDEVVASTTNSILTQ

SEQ ID NO: 132756 - protein, 9 aa, Borrelia garinii PBi
VVASTTNSI

SEQ ID NO: 132757 - protein, 15 aa, Borrelia garinii PBi
DEVVASTTNSILTQS

SEQ ID NO: 132758 - protein, 9 aa, Borrelia garinii PBi
VVASTTNSI

SEQ ID NO: 132759 - protein, 15 aa, Borrelia garinii PBi
ATMTDEVVASTTNSI

SEQ ID NO: 132760 - protein, 9 aa, Borrelia garinii PBi
TDEVVASTT

SEQ ID NO: 132761 - protein, 15 aa, Borrelia garinii PBi
EVVASTTNSILTQSA

SEQ ID NO: 132762 - protein, 9 aa, Borrelia garinii PBi
VASTTNSIL

SEQ ID NO: 132763 - protein, 15 aa, Borrelia garinii PBi
NHNTSAINASRNNSI

SEQ ID NO: 132764 - protein, 9 aa, Borrelia garinii PBi
TSAINASRN

SEQ ID NO: 132765 - protein, 15 aa, Borrelia garinii PBi
HNTSAINASRNNSIN

SEQ ID NO: 132766 - protein, 9 aa, Borrelia garinii PBi
INASRNNSI

SEQ ID NO: 132767 - protein, 15 aa, Borrelia garinii PBi
TSAINASRNNSINAA

SEQ ID NO: 132768 - protein, 9 aa, Borrelia garinii PBi
INASRNNSI

SEQ ID NO: 132769 - protein, 15 aa, Borrelia garinii PBi
NTSAINASRNNSINA

SEQ ID NO: 132770 - protein, 9 aa, Borrelia garinii PBi
INASRNNSI

SEQ ID NO: 132771 - protein, 15 aa, Borrelia garinii PBi
SAINASRNNSINAAN

SEQ ID NO: 132772 - protein, 9 aa, Borrelia garinii PBi
INASRNNSI

SEQ ID NO: 132773 - protein, 15 aa, Borrelia garinii PBi
VVASTTNSILTQSAM

SEQ ID NO: 132774 - protein, 9 aa, Borrelia garinii PBi
VVASTTNSI

SEQ ID NO: 132775 - protein, 15 aa, Borrelia garinii PBi
GGVNSPVNVTTTVDA

SEQ ID NO: 132776 - protein, 9 aa, Borrelia garinii PBi
PVNVTTTVD

SEQ ID NO: 132777 - protein, 15 aa, Borrelia garinii PBi
GVNSPVNVTTTVDAN

SEQ ID NO: 132778 - protein, 9 aa, Borrelia garinii PBi
VNVTTTVDA

SEQ ID NO: 132779 - protein, 15 aa, Borrelia garinii PBi
MIINHNTSAINASRN

SEQ ID NO: 132780 - protein, 9 aa, Borrelia garinii PBi
IINHNTSAI

SEQ ID NO: 132781 - protein, 15 aa, Borrelia garinii PBi
IAVNIYAANVANLFS

SEQ ID NO: 132782 - protein, 9 aa, Borrelia garinii PBi
VNIYAANVA

SEQ ID NO: 132783 - protein, 15 aa, Borrelia garinii PBi
AIAVNIYAANVANLF

SEQ ID NO: 132784 - protein, 9 aa, Borrelia garinii PBi
VNIYAANVA

SEQ ID NO: 132785 - protein, 15 aa, Borrelia garinii PBi
TTNSILTQSAMAMIA

SEQ ID NO: 132786 - protein, 9 aa, Borrelia garinii PBi
LTQSAMAMI

SEQ ID NO: 132787 - protein, 15 aa, Borrelia garinii PBi
TNSILTQSAMAMIAQ

SEQ ID NO: 132788 - protein, 9 aa, Borrelia garinii PBi
LTQSAMAMI

SEQ ID NO: 132789 - protein, 15 aa, Borrelia garinii PBi
NSILTQSAMAMIAQA

SEQ ID NO: 132790 - protein, 9 aa, Borrelia garinii PBi
LTQSAMAMI

SEQ ID NO: 132791 - protein, 15 aa, Borrelia garinii PBi
SILTQSAMAMIAQAN

SEQ ID NO: 132792 - protein, 9 aa, Borrelia garinii PBi
LTQSAMAMI

SEQ ID NO: 132793 - protein, 15 aa, Borrelia garinii PBi
STTNSILTQSAMAMI

SEQ ID NO: 132794 - protein, 9 aa, Borrelia garinii PBi
ILTQSAMAM

SEQ ID NO: 132795 - protein, 15 aa, Borrelia garinii PBi
EAIAVNIYAANVANL

SEQ ID NO: 132796 - protein, 9 aa, Borrelia garinii PBi
VNIYAANVA

SEQ ID NO: 132797 - protein, 15 aa, Borrelia garinii PBi
AVNIYAANVANLFSG

SEQ ID NO: 132798 - protein, 9 aa, Borrelia garinii PBi
IYAANVANL

SEQ ID NO: 132799 - protein, 15 aa, Borrelia garinii PBi
VNIYAANVANLFSGE

SEQ ID NO: 132800 - protein, 9 aa, Borrelia garinii PBi
IYAANVANL

SEQ ID NO: 132801 - protein, 15 aa, Borrelia garinii PBi
NTSLAKIENAIRMIS

SEQ ID NO: 132802 - protein, 9 aa, Borrelia garinii PBi
AKIENAIRM

SEQ ID NO: 132803 - protein, 15 aa, Borrelia garinii PBi
TSLAKIENAIRMISD

SEQ ID NO: 132804 - protein, 9 aa, Borrelia garinii PBi
IENAIRMIS

SEQ ID NO: 132805 - protein, 15 aa, Borrelia garinii PBi
SLAKIENAIRMISDQ

SEQ ID NO: 132806 - protein, 9 aa, Borrelia garinii PBi
IENAIRMIS

SEQ ID NO: 132807 - protein, 15 aa, Borrelia garinii PBi
RMKELAVQSGNGTYS

SEQ ID NO: 132808 - protein, 9 aa, Borrelia garinii PBi
LAVQSGNGT

SEQ ID NO: 132809 - protein, 15 aa, Borrelia garinii PBi
AIAVNIYAANVANLF

SEQ ID NO: 132810 - protein, 9 aa, Borrelia garinii PBi
VNIYAANVA

SEQ ID NO: 132811 - protein, 15 aa, Borrelia garinii PBi
IAVNIYAANVANLFS

SEQ ID NO: 132812 - protein, 9 aa, Borrelia garinii PBi
VNIYAANVA

SEQ ID NO: 132813 - protein, 15 aa, Borrelia garinii PBi
MKELAVQSGNGTYSD

SEQ ID NO: 132814 - protein, 9 aa, Borrelia garinii PBi
LAVQSGNGT

SEQ ID NO: 132815 - protein, 15 aa, Borrelia garinii PBi
KELAVQSGNGTYSDA

SEQ ID NO: 132816 - protein, 9 aa, Borrelia garinii PBi
LAVQSGNGT

SEQ ID NO: 132817 - protein, 15 aa, Borrelia garinii PBi
LVRMKELAVQSGNGT

SEQ ID NO: 132818 - protein, 9 aa, Borrelia garinii PBi
MKELAVQSG

SEQ ID NO: 132819 - protein, 15 aa, Borrelia garinii PBi
VRMKELAVQSGNGTY

SEQ ID NO: 132820 - protein, 9 aa, Borrelia garinii PBi
LAVQSGNGT

SEQ ID NO: 132821 - protein, 15 aa, Borrelia garinii PBi
AVNIYAANVANLFSG

SEQ ID NO: 132822 - protein, 9 aa, Borrelia garinii PBi
YAANVANLF

SEQ ID NO: 132823 - protein, 15 aa, Borrelia garinii PBi
VNIYAANVANLFSGE

SEQ ID NO: 132824 - protein, 9 aa, Borrelia garinii PBi
YAANVANLF

SEQ ID NO: 132825 - protein, 15 aa, Borrelia garinii PBi
SQGGVNSPVNVTTTV

SEQ ID NO: 132826 - protein, 9 aa, Borrelia garinii PBi
GVNSPVNVT

SEQ ID NO: 132827 - protein, 15 aa, Borrelia garinii PBi
QGGVNSPVNVTTTVD

SEQ ID NO: 132828 - protein, 9 aa, Borrelia garinii PBi
GVNSPVNVT

SEQ ID NO: 132829 - protein, 15 aa, Borrelia garinii PBi
GGVNSPVNVTTTVDA

SEQ ID NO: 132830 - protein, 9 aa, Borrelia garinii PBi
GVNSPVNVT

SEQ ID NO: 132831 - protein, 15 aa, Borrelia garinii PBi
EAIAVNIYAANVANL

SEQ ID NO: 132832 - protein, 9 aa, Borrelia garinii PBi
VNIYAANVA

SEQ ID NO: 132833 - protein, 15 aa, Borrelia garinii PBi
PSQGGVNSPVNVTTT

SEQ ID NO: 132834 - protein, 9 aa, Borrelia garinii PBi
GVNSPVNVT

SEQ ID NO: 132835 - protein, 15 aa, Borrelia garinii PBi
APSQGGVNSPVNVTT

SEQ ID NO: 132836 - protein, 9 aa, Borrelia garinii PBi
GVNSPVNVT

SEQ ID NO: 132837 - protein, 15 aa, Borrelia garinii PBi
QDEAIAVNIYAANVA

SEQ ID NO: 132838 - protein, 9 aa, Borrelia garinii PBi
IAVNIYAAN

SEQ ID NO: 132839 - protein, 15 aa, Borrelia garinii PBi
DEAIAVNIYAANVAN

SEQ ID NO: 132840 - protein, 9 aa, Borrelia garinii PBi
VNIYAANVA

SEQ ID NO: 132841 - protein, 15 aa, Borrelia garinii PBi
GVNSPVNVTTTVDAN

SEQ ID NO: 132842 - protein, 9 aa, Borrelia garinii PBi
GVNSPVNVT

SEQ ID NO: 132843 - protein, 15 aa, Borrelia garinii PBi
ELAVQSGNGTYSDAD

SEQ ID NO: 132844 - protein, 9 aa, Borrelia garinii PBi
LAVQSGNGT

SEQ ID NO: 132845 - protein, 15 aa, Borrelia garinii PBi
LAVQSGNGTYSDADR

SEQ ID NO: 132846 - protein, 9 aa, Borrelia garinii PBi
LAVQSGNGT

SEQ ID NO: 132847 - protein, 15 aa, Borrelia garinii PBi
NIYAANVANLFSGEG

SEQ ID NO: 132848 - protein, 9 aa, Borrelia garinii PBi
YAANVANLF

SEQ ID NO: 132849 - protein, 15 aa, Borrelia garinii PBi
SKAINFIQTTEGNLN

SEQ ID NO: 132850 - protein, 9 aa, Borrelia garinii PBi
INFIQTTEG

SEQ ID NO: 132851 - protein, 15 aa, Borrelia garinii PBi
EKVLVRMKELAVQSG

SEQ ID NO: 132852 - protein, 9 aa, Borrelia garinii PBi
LVRMKELAV

SEQ ID NO: 132853 - protein, 15 aa, Borrelia garinii PBi
KVLVRMKELAVQSGN

SEQ ID NO: 132854 - protein, 9 aa, Borrelia garinii PBi
LVRMKELAV

SEQ ID NO: 132855 - protein, 15 aa, Borrelia garinii PBi
VEKVLVRMKELAVQS

SEQ ID NO: 132856 - protein, 9 aa, Borrelia garinii PBi
LVRMKELAV

SEQ ID NO: 132857 - protein, 15 aa, Borrelia garinii PBi
EVEKVLVRMKELAVQ

SEQ ID NO: 132858 - protein, 9 aa, Borrelia garinii PBi
LVRMKELAV

SEQ ID NO: 132859 - protein, 15 aa, Borrelia garinii PBi
VLVRMKELAVQSGNG

SEQ ID NO: 132860 - protein, 9 aa, Borrelia garinii PBi
VRMKELAVQ

SEQ ID NO: 132861 - protein, 15 aa, Borrelia garinii PBi
LVRMKELAVQSGNGT

SEQ ID NO: 132862 - protein, 9 aa, Borrelia garinii PBi
VRMKELAVQ

SEQ ID NO: 132863 - protein, 15 aa, Borrelia garinii PBi
INAQIRGLSQASRNT

SEQ ID NO: 132864 - protein, 9 aa, Borrelia garinii PBi
IRGLSQASR

SEQ ID NO: 132865 - protein, 15 aa, Borrelia garinii PBi
GKINAQIRGLSQASR

SEQ ID NO: 132866 - protein, 9 aa, Borrelia garinii PBi
QIRGLSQAS

SEQ ID NO: 132867 - protein, 15 aa, Borrelia garinii PBi
NAQIRGLSQASRNTS

SEQ ID NO: 132868 - protein, 9 aa, Borrelia garinii PBi
IRGLSQASR

SEQ ID NO: 132869 - protein, 15 aa, Borrelia garinii PBi
KINAQIRGLSQASRN

SEQ ID NO: 132870 - protein, 9 aa, Borrelia garinii PBi
IRGLSQASR

SEQ ID NO: 132871 - protein, 15 aa, Borrelia garinii PBi
AQIRGLSQASRNTSK

SEQ ID NO: 132872 - protein, 9 aa, Borrelia garinii PBi
IRGLSQASR

SEQ ID NO: 132873 - protein, 15 aa, Borrelia garinii PBi
NEVEKVLVRMKELAV

SEQ ID NO: 132874 - protein, 9 aa, Borrelia garinii PBi
VLVRMKELA

SEQ ID NO: 132875 - protein, 15 aa, Borrelia garinii PBi
KIENAIRMISDQRAN

SEQ ID NO: 132876 - protein, 9 aa, Borrelia garinii PBi
AIRMISDQR

SEQ ID NO: 132877 - protein, 15 aa, Borrelia garinii PBi
IENAIRMISDQRANL

SEQ ID NO: 132878 - protein, 9 aa, Borrelia garinii PBi
AIRMISDQR

SEQ ID NO: 132879 - protein, 15 aa, Borrelia garinii PBi
AKIENAIRMISDQRA

SEQ ID NO: 132880 - protein, 9 aa, Borrelia garinii PBi
AIRMISDQR

SEQ ID NO: 132881 - protein, 15 aa, Borrelia garinii PBi
ENAIRMISDQRANLG

SEQ ID NO: 132882 - protein, 9 aa, Borrelia garinii PBi
AIRMISDQR

SEQ ID NO: 132883 - protein, 15 aa, Borrelia garinii PBi
LAKIENAIRMISDQR

SEQ ID NO: 132884 - protein, 9 aa, Borrelia garinii PBi
LAKIENAIR

SEQ ID NO: 132885 - protein, 15 aa, Borrelia garinii PBi
QYNQMHMLSNKSASQ

SEQ ID NO: 132886 - protein, 9 aa, Borrelia garinii PBi
MHMLSNKSA

SEQ ID NO: 132887 - protein, 15 aa, Borrelia garinii PBi
QIRGLSQASRNTSKA

SEQ ID NO: 132888 - protein, 9 aa, Borrelia garinii PBi
IRGLSQASR

SEQ ID NO: 132889 - protein, 15 aa, Borrelia garinii PBi
YNQMHMLSNKSASQN

SEQ ID NO: 132890 - protein, 9 aa, Borrelia garinii PBi
MHMLSNKSA

SEQ ID NO: 132891 - protein, 15 aa, Borrelia garinii PBi
IRGLSQASRNTSKAI

SEQ ID NO: 132892 - protein, 9 aa, Borrelia garinii PBi
IRGLSQASR

SEQ ID NO: 132893 - protein, 15 aa, Borrelia garinii PBi
AQYNQMHMLSNKSAS

SEQ ID NO: 132894 - protein, 9 aa, Borrelia garinii PBi
MHMLSNKSA

SEQ ID NO: 132895 - protein, 15 aa, Borrelia garinii PBi
VRMKELAVQSGNGTY

SEQ ID NO: 132896 - protein, 9 aa, Borrelia garinii PBi
VRMKELAVQ

SEQ ID NO: 132897 - protein, 15 aa, Borrelia garinii PBi
QAQYNQMHMLSNKSA

SEQ ID NO: 132898 - protein, 9 aa, Borrelia garinii PBi
QMHMLSNKS

SEQ ID NO: 132899 - protein, 15 aa, Borrelia garinii PBi
AIRMISDQRANLGAF

SEQ ID NO: 132900 - protein, 9 aa, Borrelia garinii PBi
AIRMISDQR

SEQ ID NO: 132901 - protein, 15 aa, Borrelia garinii PBi
NQMHMLSNKSASQNV

SEQ ID NO: 132902 - protein, 9 aa, Borrelia garinii PBi
MHMLSNKSA

SEQ ID NO: 132903 - protein, 15 aa, Borrelia garinii PBi
QASWTLRVHVGANQD

SEQ ID NO: 132904 - protein, 9 aa, Borrelia garinii PBi
LRVHVGANQ

SEQ ID NO: 132905 - protein, 15 aa, Borrelia garinii PBi
NAIRMISDQRANLGA

SEQ ID NO: 132906 - protein, 9 aa, Borrelia garinii PBi
AIRMISDQR

SEQ ID NO: 132907 - protein, 15 aa, Borrelia garinii PBi
SQASWTLRVHVGANQ

SEQ ID NO: 132908 - protein, 9 aa, Borrelia garinii PBi
QASWTLRVH

SEQ ID NO: 132909 - protein, 15 aa, Borrelia garinii PBi
EVEKVLVRMKELAVQ

SEQ ID NO: 132910 - protein, 9 aa, Borrelia garinii PBi
VEKVLVRMK

SEQ ID NO: 132911 - protein, 15 aa, Borrelia garinii PBi
VEKVLVRMKELAVQS

SEQ ID NO: 132912 - protein, 9 aa, Borrelia garinii PBi
VRMKELAVQ

SEQ ID NO: 132913 - protein, 15 aa, Borrelia garinii PBi
EKVLVRMKELAVQSG

SEQ ID NO: 132914 - protein, 9 aa, Borrelia garinii PBi
VRMKELAVQ

SEQ ID NO: 132915 - protein, 15 aa, Borrelia garinii PBi
KVLVRMKELAVQSGN

SEQ ID NO: 132916 - protein, 9 aa, Borrelia garinii PBi
VRMKELAVQ

SEQ ID NO: 132917 - protein, 15 aa, Borrelia garinii PBi
VLVRMKELAVQSGNG

SEQ ID NO: 132918 - protein, 9 aa, Borrelia garinii PBi
VRMKELAVQ

SEQ ID NO: 132919 - protein, 15 aa, Borrelia garinii PBi
ENAIRMISDQRANLG

SEQ ID NO: 132920 - protein, 9 aa, Borrelia garinii PBi
IRMISDQRA

SEQ ID NO: 132921 - protein, 15 aa, Borrelia garinii PBi
NAIRMISDQRANLGA

SEQ ID NO: 132922 - protein, 9 aa, Borrelia garinii PBi
IRMISDQRA

SEQ ID NO: 132923 - protein, 15 aa, Borrelia garinii PBi
VRMKELAVQSGNGTY

SEQ ID NO: 132924 - protein, 9 aa, Borrelia garinii PBi
VRMKELAVQ

SEQ ID NO: 132925 - protein, 15 aa, Borrelia garinii PBi
LVRMKELAVQSGNGT

SEQ ID NO: 132926 - protein, 9 aa, Borrelia garinii PBi
VRMKELAVQ

SEQ ID NO: 132927 - protein, 15 aa, Borrelia garinii PBi
AIRMISDQRANLGAF

SEQ ID NO: 132928 - protein, 9 aa, Borrelia garinii PBi
ISDQRANLG

SEQ ID NO: 132929 - protein, 15 aa, Borrelia garinii PBi
IRMISDQRANLGAFQ

SEQ ID NO: 132930 - protein, 9 aa, Borrelia garinii PBi
ISDQRANLG

SEQ ID NO: 132931 - protein, 15 aa, Borrelia garinii PBi
NTSLAKIENAIRMIS

SEQ ID NO: 132932 - protein, 9 aa, Borrelia garinii PBi
AKIENAIRM

SEQ ID NO: 132933 - protein, 15 aa, Borrelia garinii PBi
TSLAKIENAIRMISD

SEQ ID NO: 132934 - protein, 9 aa, Borrelia garinii PBi
AKIENAIRM

SEQ ID NO: 132935 - protein, 15 aa, Borrelia garinii PBi
DANTSLAKIENAIRM

SEQ ID NO: 132936 - protein, 9 aa, Borrelia garinii PBi
LAKIENAIR

SEQ ID NO: 132937 - protein, 15 aa, Borrelia garinii PBi
ANTSLAKIENAIRMI

SEQ ID NO: 132938 - protein, 9 aa, Borrelia garinii PBi
AKIENAIRM

SEQ ID NO: 132939 - protein, 15 aa, Borrelia garinii PBi
SLAKIENAIRMISDQ

SEQ ID NO: 132940 - protein, 9 aa, Borrelia garinii PBi
AKIENAIRM

SEQ ID NO: 132941 - protein, 15 aa, Borrelia Burgdorferi
DVFTSFGGLVAEAFG

SEQ ID NO: 132942 - protein, 9 aa, Borrelia Burgdorferi
FGGLVAEAF

SEQ ID NO: 132943 - protein, 15 aa, Borrelia Burgdorferi
SDVKTYFTTVAAKLE

SEQ ID NO: 132944 - protein, 9 aa, Borrelia Burgdorferi
YFTTVAAKL

SEQ ID NO: 132945 - protein, 15 aa, Borrelia Burgdorferi
LDVFTSFGGLVAEAF

SEQ ID NO: 132946 - protein, 9 aa, Borrelia Burgdorferi
FTSFGGLVA

SEQ ID NO: 132947 - protein, 15 aa, Borrelia Burgdorferi
VKTYFTTVAAKLEKT

SEQ ID NO: 132948 - protein, 9 aa, Borrelia Burgdorferi
YFTTVAAKL

SEQ ID NO: 132949 - protein, 15 aa, Borrelia Burgdorferi
KTYFTTVAAKLEKTK

SEQ ID NO: 132950 - protein, 9 aa, Borrelia Burgdorferi
FTTVAAKLE

SEQ ID NO: 132951 - protein, 15 aa, Borrelia Burgdorferi
KSDVKTYFTTVAAKL

SEQ ID NO: 132952 - protein, 9 aa, Borrelia Burgdorferi
VKTYFTTVA

SEQ ID NO: 132953 - protein, 15 aa, Borrelia Burgdorferi
DVKTYFTTVAAKLEK

SEQ ID NO: 132954 - protein, 9 aa, Borrelia Burgdorferi
YFTTVAAKL

SEQ ID NO: 132955 - protein, 15 aa, Borrelia Burgdorferi
FTSFGGLVAEAFGFK

SEQ ID NO: 132956 - protein, 9 aa, Borrelia Burgdorferi
FGGLVAEAF

SEQ ID NO: 132957 - protein, 15 aa, Borrelia Burgdorferi
VKAVKTAEGASSGTA

SEQ ID NO: 132958 - protein, 9 aa, Borrelia Burgdorferi
VKTAEGASS

SEQ ID NO: 132959 - protein, 15 aa, Borrelia Burgdorferi
VFTSFGGLVAEAFGF

SEQ ID NO: 132960 - protein, 9 aa, Borrelia Burgdorferi
FGGLVAEAF

SEQ ID NO: 132961 - protein, 15 aa, Borrelia Burgdorferi
KAVKTAEGASSGTAA

SEQ ID NO: 132962 - protein, 9 aa, Borrelia Burgdorferi
VKTAEGASS

SEQ ID NO: 132963 - protein, 15 aa, Borrelia Burgdorferi
KLVKAVKTAEGASSG

SEQ ID NO: 132964 - protein, 9 aa, Borrelia Burgdorferi
VKTAEGASS

SEQ ID NO: 132965 - protein, 15 aa, Borrelia Burgdorferi
DKLVKAVKTAEGASS

SEQ ID NO: 132966 - protein, 9 aa, Borrelia Burgdorferi
VKAVKTAEG

SEQ ID NO: 132967 - protein, 15 aa, Borrelia Burgdorferi
LVKAVKTAEGASSGT

SEQ ID NO: 132968 - protein, 9 aa, Borrelia Burgdorferi
VKTAEGASS

SEQ ID NO: 132969 - protein, 15 aa, Borrelia Burgdorferi
TYFTTVAAKLEKTKT

SEQ ID NO: 132970 - protein, 9 aa, Borrelia Burgdorferi
FTTVAAKLE

SEQ ID NO: 132971 - protein, 15 aa, Borrelia Burgdorferi
TSFGGLVAEAFGFKS

SEQ ID NO: 132972 - protein, 9 aa, Borrelia Burgdorferi
FGGLVAEAF

SEQ ID NO: 132973 - protein, 15 aa, Borrelia Burgdorferi
KKSDVKTYFTTVAAK

SEQ ID NO: 132974 - protein, 9 aa, Borrelia Burgdorferi
VKTYFTTVA

SEQ ID NO: 132975 - protein, 15 aa, Borrelia Burgdorferi
AAKVADKASVKGIAK

SEQ ID NO: 132976 - protein, 9 aa, Borrelia Burgdorferi
VADKASVKG

SEQ ID NO: 132977 - protein, 15 aa, Borrelia Burgdorferi
ADAAKVADKASVKGI

SEQ ID NO: 132978 - protein, 9 aa, Borrelia Burgdorferi
VADKASVKG

SEQ ID NO: 132979 - protein, 15 aa, Borrelia Burgdorferi
PKKSDVKTYFTTVAA

SEQ ID NO: 132980 - protein, 9 aa, Borrelia Burgdorferi
VKTYFTTVA

SEQ ID NO: 132981 - protein, 15 aa, Borrelia Burgdorferi
DADAAKVADKASVKG

SEQ ID NO: 132982 - protein, 9 aa, Borrelia Burgdorferi
AAKVADKAS

SEQ ID NO: 132983 - protein, 15 aa, Borrelia Burgdorferi
DAAKVADKASVKGIA

SEQ ID NO: 132984 - protein, 9 aa, Borrelia Burgdorferi
VADKASVKG

SEQ ID NO: 132985 - protein, 15 aa, Borrelia Burgdorferi
AKVADKASVKGIAKG

SEQ ID NO: 132986 - protein, 9 aa, Borrelia Burgdorferi
VADKASVKG

SEQ ID NO: 132987 - protein, 15 aa, Borrelia Burgdorferi
DPKKSDVKTYFTTVA

SEQ ID NO: 132988 - protein, 9 aa, Borrelia Burgdorferi
KSDVKTYFT

SEQ ID NO: 132989 - protein, 15 aa, Borrelia Burgdorferi
AVKTAEGASSGTAAI

SEQ ID NO: 132990 - protein, 9 aa, Borrelia Burgdorferi
VKTAEGASS

SEQ ID NO: 132991 - protein, 15 aa, Borrelia Burgdorferi
VKTAEGASSGTAAIG

SEQ ID NO: 132992 - protein, 9 aa, Borrelia Burgdorferi
VKTAEGASS

SEQ ID NO: 132993 - protein, 15 aa, Borrelia Burgdorferi
YFTTVAAKLEKTKTD

SEQ ID NO: 132994 - protein, 9 aa, Borrelia Burgdorferi
FTTVAAKLE

SEQ ID NO: 132995 - protein, 15 aa, Borrelia Burgdorferi
GEVVADADAAKVADK

SEQ ID NO: 132996 - protein, 9 aa, Borrelia Burgdorferi
VADADAAKV

SEQ ID NO: 132997 - protein, 15 aa, Borrelia Burgdorferi
EVVADADAAKVADKA

SEQ ID NO: 132998 - protein, 9 aa, Borrelia Burgdorferi
VADADAAKV

SEQ ID NO: 132999 - protein, 15 aa, Borrelia Burgdorferi
IGEVVADADAAKVAD

SEQ ID NO: 133000 - protein, 9 aa, Borrelia Burgdorferi
VADADAAKV

SEQ ID NO: 133001 - protein, 15 aa, Borrelia Burgdorferi
AIGEVVADADAAKVA

SEQ ID NO: 133002 - protein, 9 aa, Borrelia Burgdorferi
VADADAAKV

SEQ ID NO: 133003 - protein, 15 aa, Borrelia Burgdorferi
AAIGEVVADADAAKV

SEQ ID NO: 133004 - protein, 9 aa, Borrelia Burgdorferi
VVADADAAK

SEQ ID NO: 133005 - protein, 15 aa, Borrelia Burgdorferi
LLDKLVKAVKTAEGA

SEQ ID NO: 133006 - protein, 9 aa, Borrelia Burgdorferi
VKAVKTAEG

SEQ ID NO: 133007 - protein, 15 aa, Borrelia Burgdorferi
ELLDKLVKAVKTAEG

SEQ ID NO: 133008 - protein, 9 aa, Borrelia Burgdorferi
DKLVKAVKT

SEQ ID NO: 133009 - protein, 15 aa, Borrelia Burgdorferi
LDKLVKAVKTAEGAS

SEQ ID NO: 133010 - protein, 9 aa, Borrelia Burgdorferi
VKAVKTAEG

SEQ ID NO: 133011 - protein, 15 aa, Borrelia Burgdorferi
FTTVAAKLEKTKTDL

SEQ ID NO: 133012 - protein, 9 aa, Borrelia Burgdorferi
FTTVAAKLE

SEQ ID NO: 133013 - protein, 15 aa, Borrelia Burgdorferi
SFGGLVAEAFGFKSD

SEQ ID NO: 133014 - protein, 9 aa, Borrelia Burgdorferi
FGGLVAEAF

SEQ ID NO: 133015 - protein, 15 aa, Borrelia Burgdorferi
FGGLVAEAFGFKSDP

SEQ ID NO: 133016 - protein, 9 aa, Borrelia Burgdorferi
FGGLVAEAF

SEQ ID NO: 133017 - protein, 15 aa, Borrelia Burgdorferi
PTNKFYQSVIQLGNG

SEQ ID NO: 133018 - protein, 9 aa, Borrelia Burgdorferi
FYQSVIQLG

SEQ ID NO: 133019 - protein, 15 aa, Borrelia Burgdorferi
NKFYQSVIQLGNGFL

SEQ ID NO: 133020 - protein, 9 aa, Borrelia Burgdorferi
FYQSVIQLG

SEQ ID NO: 133021 - protein, 15 aa, Borrelia Burgdorferi
DPTNKFYQSVIQLGN

SEQ ID NO: 133022 - protein, 9 aa, Borrelia Burgdorferi
FYQSVIQLG

SEQ ID NO: 133023 - protein, 15 aa, Borrelia Burgdorferi
TNKFYQSVIQLGNGF

SEQ ID NO: 133024 - protein, 9 aa, Borrelia Burgdorferi
FYQSVIQLG

SEQ ID NO: 133025 - protein, 15 aa, Borrelia Burgdorferi
NGFLDVFTSFGGLVA

SEQ ID NO: 133026 - protein, 9 aa, Borrelia Burgdorferi
FLDVFTSFG

SEQ ID NO: 133027 - protein, 15 aa, Borrelia Burgdorferi
KVADKASVKGIAKGI

SEQ ID NO: 133028 - protein, 9 aa, Borrelia Burgdorferi
VADKASVKG

SEQ ID NO: 133029 - protein, 15 aa, Borrelia Burgdorferi
VADKASVKGIAKGIK

SEQ ID NO: 133030 - protein, 9 aa, Borrelia Burgdorferi
VADKASVKG

SEQ ID NO: 133031 - protein, 15 aa, Borrelia Burgdorferi
DDPTNKFYQSVIQLG

SEQ ID NO: 133032 - protein, 9 aa, Borrelia Burgdorferi
NKFYQSVIQ

SEQ ID NO: 133033 - protein, 15 aa, Borrelia Burgdorferi
GFLDVFTSFGGLVAE

SEQ ID NO: 133034 - protein, 9 aa, Borrelia Burgdorferi
FTSFGGLVA

SEQ ID NO: 133035 - protein, 15 aa, Borrelia Burgdorferi
FLDVFTSFGGLVAEA

SEQ ID NO: 133036 - protein, 9 aa, Borrelia Burgdorferi
FTSFGGLVA

SEQ ID NO: 133037 - protein, 15 aa, Borrelia Burgdorferi
VVADADAAKVADKAS

SEQ ID NO: 133038 - protein, 9 aa, Borrelia Burgdorferi
VADADAAKV

SEQ ID NO: 133039 - protein, 15 aa, Borrelia Burgdorferi
VADADAAKVADKASV

SEQ ID NO: 133040 - protein, 9 aa, Borrelia Burgdorferi
VADADAAKV

SEQ ID NO: 133041 - protein, 15 aa, Borrelia Burgdorferi
VSELLDKLVKAVKTA

SEQ ID NO: 133042 - protein, 9 aa, Borrelia Burgdorferi
LLDKLVKAV

SEQ ID NO: 133043 - protein, 15 aa, Borrelia Burgdorferi
SELLDKLVKAVKTAE

SEQ ID NO: 133044 - protein, 9 aa, Borrelia Burgdorferi
LLDKLVKAV

SEQ ID NO: 133045 - protein, 15 aa, Borrelia Burgdorferi
EVSELLDKLVKAVKT

SEQ ID NO: 133046 - protein, 9 aa, Borrelia Burgdorferi
LLDKLVKAV

SEQ ID NO: 133047 - protein, 15 aa, Borrelia Burgdorferi
KTDLNSLPKEKSDIS

SEQ ID NO: 133048 - protein, 9 aa, Borrelia Burgdorferi
LNSLPKEKS

SEQ ID NO: 133049 - protein, 15 aa, Borrelia Burgdorferi
TDLNSLPKEKSDISS

SEQ ID NO: 133050 - protein, 9 aa, Borrelia Burgdorferi
LNSLPKEKS

SEQ ID NO: 133051 - protein, 15 aa, Borrelia Burgdorferi
NGFLDVFTSFGGLVA

SEQ ID NO: 133052 - protein, 9 aa, Borrelia Burgdorferi
FLDVFTSFG

SEQ ID NO: 133053 - protein, 15 aa, Borrelia Burgdorferi
QLGNGFLDVFTSFGG

SEQ ID NO: 133054 - protein, 9 aa, Borrelia Burgdorferi
FLDVFTSFG

SEQ ID NO: 133055 - protein, 15 aa, Borrelia Burgdorferi
GNGFLDVFTSFGGLV

SEQ ID NO: 133056 - protein, 9 aa, Borrelia Burgdorferi
FLDVFTSFG

SEQ ID NO: 133057 - protein, 15 aa, Borrelia Burgdorferi
IQLGNGFLDVFTSFG

SEQ ID NO: 133058 - protein, 9 aa, Borrelia Burgdorferi
QLGNGFLDV

SEQ ID NO: 133059 - protein, 15 aa, Borrelia Burgdorferi
LGNGFLDVFTSFGGL

SEQ ID NO: 133060 - protein, 9 aa, Borrelia Burgdorferi
FLDVFTSFG

SEQ ID NO: 133061 - protein, 15 aa, Borrelia Burgdorferi
GFLDVFTSFGGLVAE

SEQ ID NO: 133062 - protein, 9 aa, Borrelia Burgdorferi
FLDVFTSFG

SEQ ID NO: 133063 - protein, 15 aa, Borrelia Burgdorferi
FLDVFTSFGGLVAEA

SEQ ID NO: 133064 - protein, 9 aa, Borrelia Burgdorferi
FLDVFTSFG

SEQ ID NO: 133065 - protein, 15 aa, Borrelia Burgdorferi
VAEAFGFKSDPKKSD

SEQ ID NO: 133066 - protein, 9 aa, Borrelia Burgdorferi
AFGFKSDPK

SEQ ID NO: 133067 - protein, 15 aa, Borrelia Burgdorferi
AEAFGFKSDPKKSDV

SEQ ID NO: 133068 - protein, 9 aa, Borrelia Burgdorferi
FKSDPKKSD

SEQ ID NO: 133069 - protein, 15 aa, Borrelia Burgdorferi
EAFGFKSDPKKSDVK

SEQ ID NO: 133070 - protein, 9 aa, Borrelia Burgdorferi
FKSDPKKSD

SEQ ID NO: 133071 - protein, 15 aa, Borrelia Burgdorferi
AFGFKSDPKKSDVKT

SEQ ID NO: 133072 - protein, 9 aa, Borrelia Burgdorferi
FKSDPKKSD

SEQ ID NO: 133073 - protein, 15 aa, Borrelia Burgdorferi
FGFKSDPKKSDVKTY

SEQ ID NO: 133074 - protein, 9 aa, Borrelia Burgdorferi
FKSDPKKSD

SEQ ID NO: 133075 - protein, 15 aa, Borrelia Burgdorferi
DPTNKFYQSVIQLGN

SEQ ID NO: 133076 - protein, 9 aa, Borrelia Burgdorferi
TNKFYQSVI

SEQ ID NO: 133077 - protein, 15 aa, Borrelia Burgdorferi
PTNKFYQSVIQLGNG

SEQ ID NO: 133078 - protein, 9 aa, Borrelia Burgdorferi
YQSVIQLGN

SEQ ID NO: 133079 - protein, 15 aa, Borrelia Burgdorferi
KFYQSVIQLGNGFLD

SEQ ID NO: 133080 - protein, 9 aa, Borrelia Burgdorferi
YQSVIQLGN

SEQ ID NO: 133081 - protein, 15 aa, Borrelia Burgdorferi
TNKFYQSVIQLGNGF

SEQ ID NO: 133082 - protein, 9 aa, Borrelia Burgdorferi
YQSVIQLGN

SEQ ID NO: 133083 - protein, 15 aa, Borrelia Burgdorferi
SDVKTYFTTVAAKLE

SEQ ID NO: 133084 - protein, 9 aa, Borrelia Burgdorferi
VKTYFTTVA

SEQ ID NO: 133085 - protein, 15 aa, Borrelia Burgdorferi
KSDVKTYFTTVAAKL

SEQ ID NO: 133086 - protein, 9 aa, Borrelia Burgdorferi
DVKTYFTTV

SEQ ID NO: 133087 - protein, 15 aa, Borrelia Burgdorferi
SDVKTYFTTVAAKLE

SEQ ID NO: 133088 - protein, 9 aa, Borrelia Burgdorferi
YFTTVAAKL

SEQ ID NO: 133089 - protein, 15 aa, Borrelia Burgdorferi
DVKTYFTTVAAKLEK

SEQ ID NO: 133090 - protein, 9 aa, Borrelia Burgdorferi
YFTTVAAKL

SEQ ID NO: 133091 - protein, 15 aa, Borrelia Burgdorferi
VKTYFTTVAAKLEKT

SEQ ID NO: 133092 - protein, 9 aa, Borrelia Burgdorferi
YFTTVAAKL

SEQ ID NO: 133093 - protein, 15 aa, Borrelia Burgdorferi
KTYFTTVAAKLEKTK

SEQ ID NO: 133094 - protein, 9 aa, Borrelia Burgdorferi
YFTTVAAKL

SEQ ID NO: 133095 - protein, 15 aa, Borrelia Burgdorferi
VKTYFTTVAAKLEKT

SEQ ID NO: 133096 - protein, 9 aa, Borrelia Burgdorferi
YFTTVAAKL

SEQ ID NO: 133097 - protein, 15 aa, Borrelia Burgdorferi
SDVKTYFTTVAAKLE

SEQ ID NO: 133098 - protein, 9 aa, Borrelia Burgdorferi
YFTTVAAKL

SEQ ID NO: 133099 - protein, 15 aa, Borrelia Burgdorferi
DVKTYFTTVAAKLEK

SEQ ID NO: 133100 - protein, 9 aa, Borrelia Burgdorferi
YFTTVAAKL

SEQ ID NO: 133101 - protein, 15 aa, Borrelia Burgdorferi
KTYFTTVAAKLEKTK

SEQ ID NO: 133102 - protein, 9 aa, Borrelia Burgdorferi
YFTTVAAKL

SEQ ID NO: 133103 - protein, 15 aa, Borrelia Burgdorferi
NKFYQSVIQLGNGFL

SEQ ID NO: 133104 - protein, 9 aa, Borrelia Burgdorferi
FYQSVIQLG

SEQ ID NO: 133105 - protein, 15 aa, Borrelia Burgdorferi
PTNKFYQSVIQLGNG

SEQ ID NO: 133106 - protein, 9 aa, Borrelia Burgdorferi
FYQSVIQLG

SEQ ID NO: 133107 - protein, 15 aa, Borrelia Burgdorferi
DPTNKFYQSVIQLGN

SEQ ID NO: 133108 - protein, 9 aa, Borrelia Burgdorferi
FYQSVIQLG

SEQ ID NO: 133109 - protein, 15 aa, Borrelia Burgdorferi
DDPTNKFYQSVIQLG

SEQ ID NO: 133110 - protein, 9 aa, Borrelia Burgdorferi
NKFYQSVIQ

SEQ ID NO: 133111 - protein, 15 aa, Borrelia Burgdorferi
GLVAEAFGFKSDPKK

SEQ ID NO: 133112 - protein, 9 aa, Borrelia Burgdorferi
AFGFKSDPK

SEQ ID NO: 133113 - protein, 15 aa, Borrelia Burgdorferi
LVAEAFGFKSDPKKS

SEQ ID NO: 133114 - protein, 9 aa, Borrelia Burgdorferi
AFGFKSDPK

SEQ ID NO: 133115 - protein, 15 aa, Borrelia Burgdorferi
VAEAFGFKSDPKKSD

SEQ ID NO: 133116 - protein, 9 aa, Borrelia Burgdorferi
AFGFKSDPK

SEQ ID NO: 133117 - protein, 15 aa, Borrelia burgdorferi
IFLFLFVVSLSANIE

SEQ ID NO: 133118 - protein, 9 aa, Borrelia burgdorferi
FVVSLSANI

SEQ ID NO: 133119 - protein, 15 aa, Borrelia burgdorferi
FLFLFVVSLSANIEE

SEQ ID NO: 133120 - protein, 9 aa, Borrelia burgdorferi
VVSLSANIE

SEQ ID NO: 133121 - protein, 15 aa, Borrelia burgdorferi
LFLFVVSLSANIEEN

SEQ ID NO: 133122 - protein, 9 aa, Borrelia burgdorferi
FVVSLSANI

SEQ ID NO: 133123 - protein, 15 aa, Borrelia burgdorferi
FLFVVSLSANIEENY

SEQ ID NO: 133124 - protein, 9 aa, Borrelia burgdorferi
FVVSLSANI

SEQ ID NO: 133125 - protein, 15 aa, Borrelia burgdorferi
LIFLFLFVVSLSANI

SEQ ID NO: 133126 - protein, 9 aa, Borrelia burgdorferi
FLFVVSLSA

SEQ ID NO: 133127 - protein, 15 aa, Borrelia burgdorferi
EAIEYLIKIKISTDS

SEQ ID NO: 133128 - protein, 9 aa, Borrelia burgdorferi
IEYLIKIKI

SEQ ID NO: 133129 - protein, 15 aa, Borrelia burgdorferi
AIEYLIKIKISTDSI

SEQ ID NO: 133130 - protein, 9 aa, Borrelia burgdorferi
IKIKISTDS

SEQ ID NO: 133131 - protein, 15 aa, Borrelia burgdorferi
IEYLIKIKISTDSIF

SEQ ID NO: 133132 - protein, 9 aa, Borrelia burgdorferi
IKIKISTDS

SEQ ID NO: 133133 - protein, 15 aa, Borrelia burgdorferi
EYLIKIKISTDSIFL

SEQ ID NO: 133134 - protein, 9 aa, Borrelia burgdorferi
IKIKISTDS

SEQ ID NO: 133135 - protein, 15 aa, Borrelia burgdorferi
YLIKIKISTDSIFLS

SEQ ID NO: 133136 - protein, 9 aa, Borrelia burgdorferi
IKIKISTDS

SEQ ID NO: 133137 - protein, 15 aa, Borrelia burgdorferi
LFVVSLSANIEENYT

SEQ ID NO: 133138 - protein, 9 aa, Borrelia burgdorferi
VVSLSANIE

SEQ ID NO: 133139 - protein, 15 aa, Borrelia burgdorferi
LLIFLFLFVVSLSAN

SEQ ID NO: 133140 - protein, 9 aa, Borrelia burgdorferi
FLFVVSLSA

SEQ ID NO: 133141 - protein, 15 aa, Borrelia burgdorferi
SLLIFLFLFVVSLSA

SEQ ID NO: 133142 - protein, 9 aa, Borrelia burgdorferi
FLFLFVVSL

SEQ ID NO: 133143 - protein, 15 aa, Borrelia burgdorferi
NTVKQILKQILADLP

SEQ ID NO: 133144 - protein, 9 aa, Borrelia burgdorferi
VKQILKQIL

SEQ ID NO: 133145 - protein, 15 aa, Borrelia burgdorferi
VKQILKQILADLPKD

SEQ ID NO: 133146 - protein, 9 aa, Borrelia burgdorferi
LKQILADLP

SEQ ID NO: 133147 - protein, 15 aa, Borrelia burgdorferi
TVKQILKQILADLPK

SEQ ID NO: 133148 - protein, 9 aa, Borrelia burgdorferi
LKQILADLP

SEQ ID NO: 133149 - protein, 15 aa, Borrelia burgdorferi
ISLLIFLFLFVVSLS

SEQ ID NO: 133150 - protein, 9 aa, Borrelia burgdorferi
FLFLFVVSL

SEQ ID NO: 133151 - protein, 15 aa, Borrelia burgdorferi
KISLLIFLFLFVVSL

SEQ ID NO: 133152 - protein, 9 aa, Borrelia burgdorferi
LIFLFLFVV

SEQ ID NO: 133153 - protein, 15 aa, Borrelia burgdorferi
LIKIKISTDSIFLSE

SEQ ID NO: 133154 - protein, 9 aa, Borrelia burgdorferi
IKIKISTDS

SEQ ID NO: 133155 - protein, 15 aa, Borrelia burgdorferi
IKIKISTDSIFLSED

SEQ ID NO: 133156 - protein, 9 aa, Borrelia burgdorferi
IKIKISTDS

SEQ ID NO: 133157 - protein, 15 aa, Borrelia burgdorferi
EDMIRLIGSYPDSIF

SEQ ID NO: 133158 - protein, 9 aa, Borrelia burgdorferi
IRLIGSYPD

SEQ ID NO: 133159 - protein, 15 aa, Borrelia burgdorferi
FVVSLSANIEENYTE

SEQ ID NO: 133160 - protein, 9 aa, Borrelia burgdorferi
FVVSLSANI

SEQ ID NO: 133161 - protein, 15 aa, Borrelia burgdorferi
FLSEDMIRLIGSYPD

SEQ ID NO: 133162 - protein, 9 aa, Borrelia burgdorferi
FLSEDMIRL

SEQ ID NO: 133163 - protein, 15 aa, Borrelia burgdorferi
SEDMIRLIGSYPDSI

SEQ ID NO: 133164 - protein, 9 aa, Borrelia burgdorferi
IRLIGSYPD

SEQ ID NO: 133165 - protein, 15 aa, Borrelia burgdorferi
DMIRLIGSYPDSIFN

SEQ ID NO: 133166 - protein, 9 aa, Borrelia burgdorferi
IRLIGSYPD

SEQ ID NO: 133167 - protein, 15 aa, Borrelia burgdorferi
DSIFLSEDMIRLIGS

SEQ ID NO: 133168 - protein, 9 aa, Borrelia burgdorferi
FLSEDMIRL

SEQ ID NO: 133169 - protein, 15 aa, Borrelia burgdorferi
KSHVFSDAPRIRGDL

SEQ ID NO: 133170 - protein, 9 aa, Borrelia burgdorferi
VFSDAPRIR

SEQ ID NO: 133171 - protein, 15 aa, Borrelia burgdorferi
EKSHVFSDAPRIRGD

SEQ ID NO: 133172 - protein, 9 aa, Borrelia burgdorferi
VFSDAPRIR

SEQ ID NO: 133173 - protein, 15 aa, Borrelia burgdorferi
YEKSHVFSDAPRIRG

SEQ ID NO: 133174 - protein, 9 aa, Borrelia burgdorferi
VFSDAPRIR

SEQ ID NO: 133175 - protein, 15 aa, Borrelia burgdorferi
SIFLSEDMIRLIGSY

SEQ ID NO: 133176 - protein, 9 aa, Borrelia burgdorferi
FLSEDMIRL

SEQ ID NO: 133177 - protein, 15 aa, Borrelia burgdorferi
SHVFSDAPRIRGDLR

SEQ ID NO: 133178 - protein, 9 aa, Borrelia burgdorferi
VFSDAPRIR

SEQ ID NO: 133179 - protein, 15 aa, Borrelia burgdorferi
DSIFNYLIQLNSDKI

SEQ ID NO: 133180 - protein, 9 aa, Borrelia burgdorferi
IFNYLIQLN

SEQ ID NO: 133181 - protein, 15 aa, Borrelia burgdorferi
LLIFLFLFVVSLSAN

SEQ ID NO: 133182 - protein, 9 aa, Borrelia burgdorferi
FLFVVSLSA

SEQ ID NO: 133183 - protein, 15 aa, Borrelia burgdorferi
SLLIFLFLFVVSLSA

SEQ ID NO: 133184 - protein, 9 aa, Borrelia burgdorferi
LFLFVVSLS

SEQ ID NO: 133185 - protein, 15 aa, Borrelia burgdorferi
LIFLFLFVVSLSANI

SEQ ID NO: 133186 - protein, 9 aa, Borrelia burgdorferi
FLFVVSLSA

SEQ ID NO: 133187 - protein, 15 aa, Borrelia burgdorferi
IFLFLFVVSLSANIE

SEQ ID NO: 133188 - protein, 9 aa, Borrelia burgdorferi
FLFVVSLSA

SEQ ID NO: 133189 - protein, 15 aa, Borrelia burgdorferi
FLFLFVVSLSANIEE

SEQ ID NO: 133190 - protein, 9 aa, Borrelia burgdorferi
FLFVVSLSA

SEQ ID NO: 133191 - protein, 15 aa, Borrelia burgdorferi
LFLFVVSLSANIEEN

SEQ ID NO: 133192 - protein, 9 aa, Borrelia burgdorferi
FLFVVSLSA

SEQ ID NO: 133193 - protein, 15 aa, Borrelia burgdorferi
FLFVVSLSANIEENY

SEQ ID NO: 133194 - protein, 9 aa, Borrelia burgdorferi
FLFVVSLSA

SEQ ID NO: 133195 - protein, 15 aa, Borrelia burgdorferi
DNARNNFKKDYSEDK

SEQ ID NO: 133196 - protein, 9 aa, Borrelia burgdorferi
RNNFKKDYS

SEQ ID NO: 133197 - protein, 15 aa, Borrelia burgdorferi
NNFKKDYSEDKANTV

SEQ ID NO: 133198 - protein, 9 aa, Borrelia burgdorferi
FKKDYSEDK

SEQ ID NO: 133199 - protein, 15 aa, Borrelia burgdorferi
NARNNFKKDYSEDKA

SEQ ID NO: 133200 - protein, 9 aa, Borrelia burgdorferi
FKKDYSEDK

SEQ ID NO: 133201 - protein, 15 aa, Borrelia burgdorferi
RNNFKKDYSEDKANT

SEQ ID NO: 133202 - protein, 9 aa, Borrelia burgdorferi
FKKDYSEDK

SEQ ID NO: 133203 - protein, 15 aa, Borrelia burgdorferi
ARNNFKKDYSEDKAN

SEQ ID NO: 133204 - protein, 9 aa, Borrelia burgdorferi
FKKDYSEDK

SEQ ID NO: 133205 - protein, 15 aa, Borrelia burgdorferi
EAIEYLIKIKISTDS

SEQ ID NO: 133206 - protein, 9 aa, Borrelia burgdorferi
YLIKIKIST

SEQ ID NO: 133207 - protein, 15 aa, Borrelia burgdorferi
AIEYLIKIKISTDSI

SEQ ID NO: 133208 - protein, 9 aa, Borrelia burgdorferi
IKIKISTDS

SEQ ID NO: 133209 - protein, 15 aa, Borrelia burgdorferi
IEYLIKIKISTDSIF

SEQ ID NO: 133210 - protein, 9 aa, Borrelia burgdorferi
IKIKISTDS

SEQ ID NO: 133211 - protein, 15 aa, Borrelia burgdorferi
YLIKIKISTDSIFLS

SEQ ID NO: 133212 - protein, 9 aa, Borrelia burgdorferi
IKIKISTDS

SEQ ID NO: 133213 - protein, 15 aa, Borrelia burgdorferi
EYLIKIKISTDSIFL

SEQ ID NO: 133214 - protein, 9 aa, Borrelia burgdorferi
IKIKISTDS

SEQ ID NO: 133215 - protein, 15 aa, Borrelia burgdorferi
LIFLFLFVVSLSANI

SEQ ID NO: 133216 - protein, 9 aa, Borrelia burgdorferi
FLFVVSLSA

SEQ ID NO: 133217 - protein, 15 aa, Borrelia burgdorferi
IFLFLFVVSLSANIE

SEQ ID NO: 133218 - protein, 9 aa, Borrelia burgdorferi
FVVSLSANI

SEQ ID NO: 133219 - protein, 15 aa, Borrelia burgdorferi
FLFLFVVSLSANIEE

SEQ ID NO: 133220 - protein, 9 aa, Borrelia burgdorferi
FVVSLSANI

SEQ ID NO: 133221 - protein, 15 aa, Borrelia burgdorferi
LLIFLFLFVVSLSAN

SEQ ID NO: 133222 - protein, 9 aa, Borrelia burgdorferi
LFLFVVSLS

SEQ ID NO: 133223 - protein, 15 aa, Borrelia burgdorferi
SLLIFLFLFVVSLSA

SEQ ID NO: 133224 - protein, 9 aa, Borrelia burgdorferi
LFLFVVSLS

SEQ ID NO: 133225 - protein, 15 aa, Borrelia burgdorferi
LFLFVVSLSANIEEN

SEQ ID NO: 133226 - protein, 9 aa, Borrelia burgdorferi
FVVSLSANI

SEQ ID NO: 133227 - protein, 15 aa, Borrelia burgdorferi
ISLLIFLFLFVVSLS

SEQ ID NO: 133228 - protein, 9 aa, Borrelia burgdorferi
LLIFLFLFV

SEQ ID NO: 133229 - protein, 15 aa, Borrelia burgdorferi
FLFVVSLSANIEENY

SEQ ID NO: 133230 - protein, 9 aa, Borrelia burgdorferi
FVVSLSANI

SEQ ID NO: 133231 - protein, 15 aa, Borrelia burgdorferi
FLSEDMIRLIGSYPD

SEQ ID NO: 133232 - protein, 9 aa, Borrelia burgdorferi
EDMIRLIGS

SEQ ID NO: 133233 - protein, 15 aa, Borrelia burgdorferi
LSEDMIRLIGSYPDS

SEQ ID NO: 133234 - protein, 9 aa, Borrelia burgdorferi
IRLIGSYPD

SEQ ID NO: 133235 - protein, 15 aa, Borrelia burgdorferi
EDMIRLIGSYPDSIF

SEQ ID NO: 133236 - protein, 9 aa, Borrelia burgdorferi
IRLIGSYPD

SEQ ID NO: 133237 - protein, 15 aa, Borrelia burgdorferi
SEDMIRLIGSYPDSI

SEQ ID NO: 133238 - protein, 9 aa, Borrelia burgdorferi
IRLIGSYPD

SEQ ID NO: 133239 - protein, 15 aa, Borrelia burgdorferi
DMIRLIGSYPDSIFN

SEQ ID NO: 133240 - protein, 9 aa, Borrelia burgdorferi
IRLIGSYPD

SEQ ID NO: 133241 - protein, 15 aa, Borrelia burgdorferi
MIRLIGSYPDSIFNY

SEQ ID NO: 133242 - protein, 9 aa, Borrelia burgdorferi
IRLIGSYPD

SEQ ID NO: 133243 - protein, 15 aa, Borrelia burgdorferi
IRLIGSYPDSIFNYL

SEQ ID NO: 133244 - protein, 9 aa, Borrelia burgdorferi
IRLIGSYPD

SEQ ID NO: 133245 - protein, 15 aa, Borrelia burgdorferi
FLFLFVVSLSANIEE

SEQ ID NO: 133246 - protein, 9 aa, Borrelia burgdorferi
VVSLSANIE

SEQ ID NO: 133247 - protein, 15 aa, Borrelia burgdorferi
IFLFLFVVSLSANIE

SEQ ID NO: 133248 - protein, 9 aa, Borrelia burgdorferi
FVVSLSANI

SEQ ID NO: 133249 - protein, 15 aa, Borrelia burgdorferi
LIFLFLFVVSLSANI

SEQ ID NO: 133250 - protein, 9 aa, Borrelia burgdorferi
LFVVSLSAN

SEQ ID NO: 133251 - protein, 15 aa, Borrelia burgdorferi
FLFLFVVSLSANIEE

SEQ ID NO: 133252 - protein, 9 aa, Borrelia burgdorferi
FVVSLSANI

SEQ ID NO: 133253 - protein, 15 aa, Borrelia burgdorferi
LFLFVVSLSANIEEN

SEQ ID NO: 133254 - protein, 9 aa, Borrelia burgdorferi
FVVSLSANI

SEQ ID NO: 133255 - protein, 15 aa, Borrelia burgdorferi
FLFVVSLSANIEENY

SEQ ID NO: 133256 - protein, 9 aa, Borrelia burgdorferi
FVVSLSANI

SEQ ID NO: 133257 - protein, 15 aa, Borrelia burgdorferi
LFVVSLSANIEENYT

SEQ ID NO: 133258 - protein, 9 aa, Borrelia burgdorferi
FVVSLSANI

SEQ ID NO: 133259 - protein, 15 aa, Borrelia burgdorferi
IEYLIKIKISTDSIF

SEQ ID NO: 133260 - protein, 9 aa, Borrelia burgdorferi
YLIKIKIST

SEQ ID NO: 133261 - protein, 15 aa, Borrelia burgdorferi
EAIEYLIKIKISTDS

SEQ ID NO: 133262 - protein, 9 aa, Borrelia burgdorferi
YLIKIKIST

SEQ ID NO: 133263 - protein, 15 aa, Borrelia burgdorferi
AIEYLIKIKISTDSI

SEQ ID NO: 133264 - protein, 9 aa, Borrelia burgdorferi
IKIKISTDS

SEQ ID NO: 133265 - protein, 15 aa, Borrelia burgdorferi
YLIKIKISTDSIFLS

SEQ ID NO: 133266 - protein, 9 aa, Borrelia burgdorferi
IKIKISTDS

SEQ ID NO: 133267 - protein, 15 aa, Borrelia burgdorferi
EYLIKIKISTDSIFL

SEQ ID NO: 133268 - protein, 9 aa, Borrelia burgdorferi
IKIKISTDS

SEQ ID NO: 133269 - protein, 15 aa, Borrelia burgdorferi
IFLFLFVVSLSANIE

SEQ ID NO: 133270 - protein, 9 aa, Borrelia burgdorferi
LFLFVVSLS

SEQ ID NO: 133271 - protein, 15 aa, Borrelia burgdorferi
LEAIEYLIKIKISTD

SEQ ID NO: 133272 - protein, 9 aa, Borrelia burgdorferi
YLIKIKIST

SEQ ID NO: 133273 - protein, 15 aa, Borrelia burgdorferi
ALEAIEYLIKIKIST

SEQ ID NO: 133274 - protein, 9 aa, Borrelia burgdorferi
IEYLIKIKI

SEQ ID NO: 133275 - protein, 15 aa, Borrelia burgdorferi
FLFLFVVSLSANIEE

SEQ ID NO: 133276 - protein, 9 aa, Borrelia burgdorferi
LFLFVVSLS

SEQ ID NO: 133277 - protein, 15 aa, Borrelia burgdorferi
LIKIKISTDSIFLSE

SEQ ID NO: 133278 - protein, 9 aa, Borrelia burgdorferi
IKISTDSIF

SEQ ID NO: 133279 - protein, 15 aa, Borrelia burgdorferi
LFLFVVSLSANIEEN

SEQ ID NO: 133280 - protein, 9 aa, Borrelia burgdorferi
LFLFVVSLS

SEQ ID NO: 133281 - protein, 15 aa, Borrelia burgdorferi
FLSEDMIRLIGSYPD

SEQ ID NO: 133282 - protein, 9 aa, Borrelia burgdorferi
MIRLIGSYP

SEQ ID NO: 133283 - protein, 15 aa, Borrelia burgdorferi
EDMIRLIGSYPDSIF

SEQ ID NO: 133284 - protein, 9 aa, Borrelia burgdorferi
MIRLIGSYP

SEQ ID NO: 133285 - protein, 15 aa, Borrelia burgdorferi
IKIKISTDSIFLSED

SEQ ID NO: 133286 - protein, 9 aa, Borrelia burgdorferi
IKISTDSIF

SEQ ID NO: 133287 - protein, 15 aa, Borrelia burgdorferi
LSEDMIRLIGSYPDS

SEQ ID NO: 133288 - protein, 9 aa, Borrelia burgdorferi
MIRLIGSYP

SEQ ID NO: 133289 - protein, 15 aa, Borrelia burgdorferi
SEDMIRLIGSYPDSI

SEQ ID NO: 133290 - protein, 9 aa, Borrelia burgdorferi
MIRLIGSYP

SEQ ID NO: 133291 - protein, 15 aa, Borrelia burgdorferi
KEDFNLINKRLDNYD

SEQ ID NO: 133292 - protein, 9 aa, Borrelia burgdorferi
FNLINKRLD

SEQ ID NO: 133293 - protein, 15 aa, Borrelia burgdorferi
IFNYLIQLNSDKIDY

SEQ ID NO: 133294 - protein, 9 aa, Borrelia burgdorferi
LIQLNSDKI

SEQ ID NO: 133295 - protein, 15 aa, Borrelia burgdorferi
SIFNYLIQLNSDKID

SEQ ID NO: 133296 - protein, 9 aa, Borrelia burgdorferi
LIQLNSDKI

SEQ ID NO: 133297 - protein, 15 aa, Borrelia burgdorferi
SKEDFNLINKRLDNY

SEQ ID NO: 133298 - protein, 9 aa, Borrelia burgdorferi
FNLINKRLD

SEQ ID NO: 133299 - protein, 15 aa, Borrelia burgdorferi
EDFNLINKRLDNYDF

SEQ ID NO: 133300 - protein, 9 aa, Borrelia burgdorferi
FNLINKRLD

SEQ ID NO: 133301 - protein, 15 aa, Borrelia burgdorferi
DLRKIGIKEKSVFLD

SEQ ID NO: 133302 - protein, 9 aa, Borrelia burgdorferi
IGIKEKSVF

SEQ ID NO: 133303 - protein, 15 aa, Borrelia burgdorferi
LIFLFLFVVSLSANI

SEQ ID NO: 133304 - protein, 9 aa, Borrelia burgdorferi
LFLFVVSLS

SEQ ID NO: 133305 - protein, 15 aa, Borrelia burgdorferi
DSIFNYLIQLNSDKI

SEQ ID NO: 133306 - protein, 9 aa, Borrelia burgdorferi
IFNYLIQLN

SEQ ID NO: 133307 - protein, 15 aa, Borrelia burgdorferi
RKIGIKEKSVFLDAL

SEQ ID NO: 133308 - protein, 9 aa, Borrelia burgdorferi
IGIKEKSVF

SEQ ID NO: 133309 - protein, 15 aa, Borrelia burgdorferi
LLIFLFLFVVSLSAN

SEQ ID NO: 133310 - protein, 9 aa, Borrelia burgdorferi
LFLFVVSLS

SEQ ID NO: 133311 - protein, 15 aa, Borrelia burgdorferi
LRKIGIKEKSVFLDA

SEQ ID NO: 133312 - protein, 9 aa, Borrelia burgdorferi
IGIKEKSVF

SEQ ID NO: 133313 - protein, 15 aa, Borrelia burgdorferi
ISLLIFLFLFVVSLS

SEQ ID NO: 133314 - protein, 9 aa, Borrelia burgdorferi
ISLLIFLFL

SEQ ID NO: 133315 - protein, 15 aa, Borrelia burgdorferi
GDLRKIGIKEKSVFL

SEQ ID NO: 133316 - protein, 9 aa, Borrelia burgdorferi
IGIKEKSVF

SEQ ID NO: 133317 - protein, 15 aa, Borrelia burgdorferi
RGDLRKIGIKEKSVF

SEQ ID NO: 133318 - protein, 9 aa, Borrelia burgdorferi
LRKIGIKEK

SEQ ID NO: 133319 - protein, 15 aa, Borrelia burgdorferi
FNYLIQLNSDKIDYA

SEQ ID NO: 133320 - protein, 9 aa, Borrelia burgdorferi
LIQLNSDKI

SEQ ID NO: 133321 - protein, 15 aa, Borrelia burgdorferi
SLLIFLFLFVVSLSA

SEQ ID NO: 133322 - protein, 9 aa, Borrelia burgdorferi
LFLFVVSLS

SEQ ID NO: 133323 - protein, 15 aa, Borrelia burgdorferi
EKYGDNARNNFKKDY

SEQ ID NO: 133324 - protein, 9 aa, Borrelia burgdorferi
YGDNARNNF

SEQ ID NO: 133325 - protein, 15 aa, Borrelia burgdorferi
DMIRLIGSYPDSIFN

SEQ ID NO: 133326 - protein, 9 aa, Borrelia burgdorferi
IRLIGSYPD

SEQ ID NO: 133327 - protein, 15 aa, Borrelia burgdorferi
NYLIQLNSDKIDYAE

SEQ ID NO: 133328 - protein, 9 aa, Borrelia burgdorferi
LIQLNSDKI

SEQ ID NO: 133329 - protein, 15 aa, Borrelia burgdorferi
NTVKQILKQILADLP

SEQ ID NO: 133330 - protein, 9 aa, Borrelia burgdorferi
VKQILKQIL

SEQ ID NO: 133331 - protein, 15 aa, Borrelia burgdorferi
YAEKYGDNARNNFKK

SEQ ID NO: 133332 - protein, 9 aa, Borrelia burgdorferi
YGDNARNNF

SEQ ID NO: 133333 - protein, 15 aa, Borrelia burgdorferi
AEKYGDNARNNFKKD

SEQ ID NO: 133334 - protein, 9 aa, Borrelia burgdorferi
YGDNARNNF

SEQ ID NO: 133335 - protein, 15 aa, Borrelia burgdorferi
FSKEDFNLINKRLDN

SEQ ID NO: 133336 - protein, 9 aa, Borrelia burgdorferi
FNLINKRLD

SEQ ID NO: 133337 - protein, 15 aa, Borrelia burgdorferi
AFSKEDFNLINKRLD

SEQ ID NO: 133338 - protein, 9 aa, Borrelia burgdorferi
DFNLINKRL

SEQ ID NO: 133339 - protein, 15 aa, Borrelia burgdorferi
DALEAIEYLIKIKIS

SEQ ID NO: 133340 - protein, 9 aa, Borrelia burgdorferi
IEYLIKIKI

SEQ ID NO: 133341 - protein, 15 aa, Borrelia burgdorferi
DFNLINKRLDNYDFK

SEQ ID NO: 133342 - protein, 9 aa, Borrelia burgdorferi
FNLINKRLD

SEQ ID NO: 133343 - protein, 15 aa, Borrelia burgdorferi
DYAEKYGDNARNNFK

SEQ ID NO: 133344 - protein, 9 aa, Borrelia burgdorferi
YGDNARNNF

SEQ ID NO: 133345 - protein, 15 aa, Borrelia burgdorferi
IDYAEKYGDNARNNF

SEQ ID NO: 133346 - protein, 9 aa, Borrelia burgdorferi
KYGDNARNN

SEQ ID NO: 133347 - protein, 15 aa, Borrelia burgdorferi
ISLLIFLFLFVVSLS

SEQ ID NO: 133348 - protein, 9 aa, Borrelia burgdorferi
LIFLFLFVV

SEQ ID NO: 133349 - protein, 15 aa, Borrelia burgdorferi
KISLLIFLFLFVVSL

SEQ ID NO: 133350 - protein, 9 aa, Borrelia burgdorferi
LIFLFLFVV

SEQ ID NO: 133351 - protein, 15 aa, Borrelia burgdorferi
KKISLLIFLFLFVVS

SEQ ID NO: 133352 - protein, 9 aa, Borrelia burgdorferi
LIFLFLFVV

SEQ ID NO: 133353 - protein, 15 aa, Borrelia burgdorferi
SLLIFLFLFVVSLSA

SEQ ID NO: 133354 - protein, 9 aa, Borrelia burgdorferi
LIFLFLFVV

SEQ ID NO: 133355 - protein, 15 aa, Borrelia burgdorferi
MKKISLLIFLFLFVV

SEQ ID NO: 133356 - protein, 9 aa, Borrelia burgdorferi
LLIFLFLFV

SEQ ID NO: 133357 - protein, 15 aa, Borrelia burgdorferi
LLIFLFLFVVSLSAN

SEQ ID NO: 133358 - protein, 9 aa, Borrelia burgdorferi
LIFLFLFVV

SEQ ID NO: 133359 - protein, 15 aa, Borrelia burgdorferi
LIFLFLFVVSLSANI

SEQ ID NO: 133360 - protein, 9 aa, Borrelia burgdorferi
LIFLFLFVV

SEQ ID NO: 133361 - protein, 15 aa, Borrelia burgdorferi
IFLFLFVVSLSANIE

SEQ ID NO: 133362 - protein, 9 aa, Borrelia burgdorferi
FLFVVSLSA

SEQ ID NO: 133363 - protein, 15 aa, Borrelia burgdorferi
FLFLFVVSLSANIEE

SEQ ID NO: 133364 - protein, 9 aa, Borrelia burgdorferi
FLFVVSLSA

SEQ ID NO: 133365 - protein, 15 aa, Borrelia burgdorferi
SKEDFNLINKRLDNY

SEQ ID NO: 133366 - protein, 9 aa, Borrelia burgdorferi
DFNLINKRL

SEQ ID NO: 133367 - protein, 15 aa, Borrelia burgdorferi
KEDFNLINKRLDNYD

SEQ ID NO: 133368 - protein, 9 aa, Borrelia burgdorferi
LINKRLDNY

SEQ ID NO: 133369 - protein, 15 aa, Borrelia burgdorferi
EDFNLINKRLDNYDF

SEQ ID NO: 133370 - protein, 9 aa, Borrelia burgdorferi
LINKRLDNY

SEQ ID NO: 133371 - protein, 15 aa, Borrelia burgdorferi
DFNLINKRLDNYDFK

SEQ ID NO: 133372 - protein, 9 aa, Borrelia burgdorferi
LINKRLDNY

SEQ ID NO: 133373 - protein, 15 aa, Borrelia burgdorferi
SEDMIRLIGSYPDSI

SEQ ID NO: 133374 - protein, 9 aa, Borrelia burgdorferi
IRLIGSYPD

SEQ ID NO: 133375 - protein, 15 aa, Borrelia burgdorferi
EDMIRLIGSYPDSIF

SEQ ID NO: 133376 - protein, 9 aa, Borrelia burgdorferi
IRLIGSYPD

SEQ ID NO: 133377 - protein, 15 aa, Borrelia burgdorferi
FNLINKRLDNYDFKN

SEQ ID NO: 133378 - protein, 9 aa, Borrelia burgdorferi
LINKRLDNY

SEQ ID NO: 133379 - protein, 15 aa, Borrelia burgdorferi
LFLFVVSLSANIEEN

SEQ ID NO: 133380 - protein, 9 aa, Borrelia burgdorferi
FVVSLSANI

SEQ ID NO: 133381 - protein, 15 aa, Borrelia burgdorferi
IRLIGSYPDSIFNYL

SEQ ID NO: 133382 - protein, 9 aa, Borrelia burgdorferi
LIGSYPDSI

SEQ ID NO: 133383 - protein, 15 aa, Borrelia burgdorferi
FNYLIQLNSDKIDYA

SEQ ID NO: 133384 - protein, 9 aa, Borrelia burgdorferi
YLIQLNSDK

SEQ ID NO: 133385 - protein, 15 aa, Borrelia burgdorferi
DSIFNYLIQLNSDKI

SEQ ID NO: 133386 - protein, 9 aa, Borrelia burgdorferi
YLIQLNSDK

SEQ ID NO: 133387 - protein, 15 aa, Borrelia burgdorferi
IFNYLIQLNSDKIDY

SEQ ID NO: 133388 - protein, 9 aa, Borrelia burgdorferi
YLIQLNSDK

SEQ ID NO: 133389 - protein, 15 aa, Borrelia burgdorferi
SIFNYLIQLNSDKID

SEQ ID NO: 133390 - protein, 9 aa, Borrelia burgdorferi
YLIQLNSDK

SEQ ID NO: 133391 - protein, 15 aa, Borrelia burgdorferi
PDSIFNYLIQLNSDK

SEQ ID NO: 133392 - protein, 9 aa, Borrelia burgdorferi
IFNYLIQLN

SEQ ID NO: 133393 - protein, 15 aa, Borrelia burgdorferi
DNYDFKNEYEKSHVF

SEQ ID NO: 133394 - protein, 9 aa, Borrelia burgdorferi
FKNEYEKSH

SEQ ID NO: 133395 - protein, 15 aa, Borrelia burgdorferi
RLDNYDFKNEYEKSH

SEQ ID NO: 133396 - protein, 9 aa, Borrelia burgdorferi
YDFKNEYEK

SEQ ID NO: 133397 - protein, 15 aa, Borrelia burgdorferi
LDNYDFKNEYEKSHV

SEQ ID NO: 133398 - protein, 9 aa, Borrelia burgdorferi
FKNEYEKSH

SEQ ID NO: 133399 - protein, 15 aa, Borrelia burgdorferi
SSFLTQGTSPSITST

SEQ ID NO: 133400 - protein, 9 aa, Borrelia burgdorferi
LTQGTSPSI

SEQ ID NO: 133401 - protein, 15 aa, Borrelia burgdorferi
ISSFLTQGTSPSITS

SEQ ID NO: 133402 - protein, 9 aa, Borrelia burgdorferi
LTQGTSPSI

SEQ ID NO: 133403 - protein, 15 aa, Borrelia burgdorferi
RPISSFLTQGTSPSI

SEQ ID NO: 133404 - protein, 9 aa, Borrelia burgdorferi
FLTQGTSPS

SEQ ID NO: 133405 - protein, 15 aa, Borrelia burgdorferi
PISSFLTQGTSPSIT

SEQ ID NO: 133406 - protein, 9 aa, Borrelia burgdorferi
LTQGTSPSI

SEQ ID NO: 133407 - protein, 15 aa, Borrelia burgdorferi
SFLTQGTSPSITSTI

SEQ ID NO: 133408 - protein, 9 aa, Borrelia burgdorferi
LTQGTSPSI

SEQ ID NO: 133409 - protein, 15 aa, Borrelia burgdorferi
PRPISSFLTQGTSPS

SEQ ID NO: 133410 - protein, 9 aa, Borrelia burgdorferi
ISSFLTQGT

SEQ ID NO: 133411 - protein, 15 aa, Borrelia burgdorferi
FLTQGTSPSITSTIK

SEQ ID NO: 133412 - protein, 9 aa, Borrelia burgdorferi
LTQGTSPSI

SEQ ID NO: 133413 - protein, 15 aa, Borrelia burgdorferi
NFFTNLEEVRSSIRT

SEQ ID NO: 133414 - protein, 9 aa, Borrelia burgdorferi
FTNLEEVRS

SEQ ID NO: 133415 - protein, 15 aa, Borrelia burgdorferi
PEITEEVIMPIPQTI

SEQ ID NO: 133416 - protein, 9 aa, Borrelia burgdorferi
EVIMPIPQT

SEQ ID NO: 133417 - protein, 15 aa, Borrelia burgdorferi
EITEEVIMPIPQTID

SEQ ID NO: 133418 - protein, 9 aa, Borrelia burgdorferi
VIMPIPQTI

SEQ ID NO: 133419 - protein, 15 aa, Borrelia burgdorferi
ITEEVIMPIPQTIDF

SEQ ID NO: 133420 - protein, 9 aa, Borrelia burgdorferi
VIMPIPQTI

SEQ ID NO: 133421 - protein, 15 aa, Borrelia burgdorferi
TEEVIMPIPQTIDFY

SEQ ID NO: 133422 - protein, 9 aa, Borrelia burgdorferi
VIMPIPQTI

SEQ ID NO: 133423 - protein, 15 aa, Borrelia burgdorferi
SNFFTNLEEVRSSIR

SEQ ID NO: 133424 - protein, 9 aa, Borrelia burgdorferi
FTNLEEVRS

SEQ ID NO: 133425 - protein, 15 aa, Borrelia burgdorferi
DSNFFTNLEEVRSSI

SEQ ID NO: 133426 - protein, 9 aa, Borrelia burgdorferi
FTNLEEVRS

SEQ ID NO: 133427 - protein, 15 aa, Borrelia burgdorferi
GDSNFFTNLEEVRSS

SEQ ID NO: 133428 - protein, 9 aa, Borrelia burgdorferi
FTNLEEVRS

SEQ ID NO: 133429 - protein, 15 aa, Borrelia burgdorferi
GGDSNFFTNLEEVRS

SEQ ID NO: 133430 - protein, 9 aa, Borrelia burgdorferi
GGDSNFFTN

SEQ ID NO: 133431 - protein, 15 aa, Borrelia burgdorferi
EEVIMPIPQTIDFYI

SEQ ID NO: 133432 - protein, 9 aa, Borrelia burgdorferi
VIMPIPQTI

SEQ ID NO: 133433 - protein, 15 aa, Borrelia burgdorferi
IDFYIEPRPISSFLT

SEQ ID NO: 133434 - protein, 9 aa, Borrelia burgdorferi
YIEPRPISS

SEQ ID NO: 133435 - protein, 15 aa, Borrelia burgdorferi
LTQGTSPSITSTIKS

SEQ ID NO: 133436 - protein, 9 aa, Borrelia burgdorferi
LTQGTSPSI

SEQ ID NO: 133437 - protein, 15 aa, Borrelia burgdorferi
DFYIEPRPISSFLTQ

SEQ ID NO: 133438 - protein, 9 aa, Borrelia burgdorferi
YIEPRPISS

SEQ ID NO: 133439 - protein, 15 aa, Borrelia burgdorferi
YIEPRPISSFLTQGT

SEQ ID NO: 133440 - protein, 9 aa, Borrelia burgdorferi
PRPISSFLT

SEQ ID NO: 133441 - protein, 15 aa, Borrelia burgdorferi
IEPRPISSFLTQGTS

SEQ ID NO: 133442 - protein, 9 aa, Borrelia burgdorferi
ISSFLTQGT

SEQ ID NO: 133443 - protein, 15 aa, Borrelia burgdorferi
FYIEPRPISSFLTQG

SEQ ID NO: 133444 - protein, 9 aa, Borrelia burgdorferi
YIEPRPISS

SEQ ID NO: 133445 - protein, 15 aa, Borrelia burgdorferi
FTNLEEVRSSIRTKI

SEQ ID NO: 133446 - protein, 9 aa, Borrelia burgdorferi
FTNLEEVRS

SEQ ID NO: 133447 - protein, 15 aa, Borrelia burgdorferi
EPRPISSFLTQGTSP

SEQ ID NO: 133448 - protein, 9 aa, Borrelia burgdorferi
ISSFLTQGT

SEQ ID NO: 133449 - protein, 15 aa, Borrelia burgdorferi
FFTNLEEVRSSIRTK

SEQ ID NO: 133450 - protein, 9 aa, Borrelia burgdorferi
FTNLEEVRS

SEQ ID NO: 133451 - protein, 15 aa, Borrelia burgdorferi
EVIMPIPQTIDFYIE

SEQ ID NO: 133452 - protein, 9 aa, Borrelia burgdorferi
VIMPIPQTI

SEQ ID NO: 133453 - protein, 15 aa, Borrelia burgdorferi
TIDFYIEPRPISSFL

SEQ ID NO: 133454 - protein, 9 aa, Borrelia burgdorferi
YIEPRPISS

SEQ ID NO: 133455 - protein, 15 aa, Borrelia burgdorferi
INNGLNIVQKITQNI

SEQ ID NO: 133456 - protein, 9 aa, Borrelia burgdorferi
INNGLNIVQ

SEQ ID NO: 133457 - protein, 15 aa, Borrelia burgdorferi
QTIDFYIEPRPISSF

SEQ ID NO: 133458 - protein, 9 aa, Borrelia burgdorferi
YIEPRPISS

SEQ ID NO: 133459 - protein, 15 aa, Borrelia burgdorferi
NNGLNIVQKITQNID

SEQ ID NO: 133460 - protein, 9 aa, Borrelia burgdorferi
IVQKITQNI

SEQ ID NO: 133461 - protein, 15 aa, Borrelia burgdorferi
LNIVQKITQNIDNIT

SEQ ID NO: 133462 - protein, 9 aa, Borrelia burgdorferi
IVQKITQNI

SEQ ID NO: 133463 - protein, 15 aa, Borrelia burgdorferi
NGLNIVQKITQNIDN

SEQ ID NO: 133464 - protein, 9 aa, Borrelia burgdorferi
IVQKITQNI

SEQ ID NO: 133465 - protein, 15 aa, Borrelia burgdorferi
GLNIVQKITQNIDNI

SEQ ID NO: 133466 - protein, 9 aa, Borrelia burgdorferi
IVQKITQNI

SEQ ID NO: 133467 - protein, 15 aa, Borrelia burgdorferi
PQTIDFYIEPRPISS

SEQ ID NO: 133468 - protein, 9 aa, Borrelia burgdorferi
FYIEPRPIS

SEQ ID NO: 133469 - protein, 15 aa, Borrelia burgdorferi
VIMPIPQTIDFYIEP

SEQ ID NO: 133470 - protein, 9 aa, Borrelia burgdorferi
VIMPIPQTI

SEQ ID NO: 133471 - protein, 15 aa, Borrelia burgdorferi
KLSQVAQHAPNSKIE

SEQ ID NO: 133472 - protein, 9 aa, Borrelia burgdorferi
VAQHAPNSK

SEQ ID NO: 133473 - protein, 15 aa, Borrelia burgdorferi
EKLSQVAQHAPNSKI

SEQ ID NO: 133474 - protein, 9 aa, Borrelia burgdorferi
VAQHAPNSK

SEQ ID NO: 133475 - protein, 15 aa, Borrelia burgdorferi
LSQVAQHAPNSKIEK

SEQ ID NO: 133476 - protein, 9 aa, Borrelia burgdorferi
VAQHAPNSK

SEQ ID NO: 133477 - protein, 15 aa, Borrelia burgdorferi
HEKLSQVAQHAPNSK

SEQ ID NO: 133478 - protein, 9 aa, Borrelia burgdorferi
KLSQVAQHA

SEQ ID NO: 133479 - protein, 15 aa, Borrelia burgdorferi
SQVAQHAPNSKIEKV

SEQ ID NO: 133480 - protein, 9 aa, Borrelia burgdorferi
VAQHAPNSK

SEQ ID NO: 133481 - protein, 15 aa, Borrelia burgdorferi
VNCKFDSLNLSTKSV

SEQ ID NO: 133482 - protein, 9 aa, Borrelia burgdorferi
FDSLNLSTK

SEQ ID NO: 133483 - protein, 15 aa, Borrelia burgdorferi
CKFDSLNLSTKSVDD

SEQ ID NO: 133484 - protein, 9 aa, Borrelia burgdorferi
SLNLSTKSV

SEQ ID NO: 133485 - protein, 15 aa, Borrelia burgdorferi
NCKFDSLNLSTKSVD

SEQ ID NO: 133486 - protein, 9 aa, Borrelia burgdorferi
SLNLSTKSV

SEQ ID NO: 133487 - protein, 15 aa, Borrelia burgdorferi
EKLKKYLKDTNNLSA

SEQ ID NO: 133488 - protein, 9 aa, Borrelia burgdorferi
YLKDTNNLS

SEQ ID NO: 133489 - protein, 15 aa, Borrelia burgdorferi
KLKKYLKDTNNLSAI

SEQ ID NO: 133490 - protein, 9 aa, Borrelia burgdorferi
YLKDTNNLS

SEQ ID NO: 133491 - protein, 15 aa, Borrelia burgdorferi
LKKYLKDTNNLSAIE

SEQ ID NO: 133492 - protein, 9 aa, Borrelia burgdorferi
YLKDTNNLS

SEQ ID NO: 133493 - protein, 15 aa, Borrelia burgdorferi
KKYLKDTNNLSAIEE

SEQ ID NO: 133494 - protein, 9 aa, Borrelia burgdorferi
YLKDTNNLS

SEQ ID NO: 133495 - protein, 15 aa, Borrelia burgdorferi
LEKLKKYLKDTNNLS

SEQ ID NO: 133496 - protein, 9 aa, Borrelia burgdorferi
LEKLKKYLK

SEQ ID NO: 133497 - protein, 15 aa, Borrelia burgdorferi
KYLKDTNNLSAIEES

SEQ ID NO: 133498 - protein, 9 aa, Borrelia burgdorferi
YLKDTNNLS

SEQ ID NO: 133499 - protein, 15 aa, Borrelia burgdorferi
YLKDTNNLSAIEESV

SEQ ID NO: 133500 - protein, 9 aa, Borrelia burgdorferi
YLKDTNNLS

SEQ ID NO: 133501 - protein, 15 aa, Borrelia burgdorferi
PQTIDFYIEPRPISS

SEQ ID NO: 133502 - protein, 9 aa, Borrelia burgdorferi
FYIEPRPIS

SEQ ID NO: 133503 - protein, 15 aa, Borrelia burgdorferi
QTIDFYIEPRPISSF

SEQ ID NO: 133504 - protein, 9 aa, Borrelia burgdorferi
FYIEPRPIS

SEQ ID NO: 133505 - protein, 15 aa, Borrelia burgdorferi
IDFYIEPRPISSFLT

SEQ ID NO: 133506 - protein, 9 aa, Borrelia burgdorferi
FYIEPRPIS

SEQ ID NO: 133507 - protein, 15 aa, Borrelia burgdorferi
TIDFYIEPRPISSFL

SEQ ID NO: 133508 - protein, 9 aa, Borrelia burgdorferi
FYIEPRPIS

SEQ ID NO: 133509 - protein, 15 aa, Borrelia burgdorferi
IPQTIDFYIEPRPIS

SEQ ID NO: 133510 - protein, 9 aa, Borrelia burgdorferi
TIDFYIEPR

SEQ ID NO: 133511 - protein, 15 aa, Borrelia burgdorferi
ISSFLTQGTSPSITS

SEQ ID NO: 133512 - protein, 9 aa, Borrelia burgdorferi
FLTQGTSPS

SEQ ID NO: 133513 - protein, 15 aa, Borrelia burgdorferi
SSFLTQGTSPSITST

SEQ ID NO: 133514 - protein, 9 aa, Borrelia burgdorferi
FLTQGTSPS

SEQ ID NO: 133515 - protein, 15 aa, Borrelia burgdorferi
RPISSFLTQGTSPSI

SEQ ID NO: 133516 - protein, 9 aa, Borrelia burgdorferi
FLTQGTSPS

SEQ ID NO: 133517 - protein, 15 aa, Borrelia burgdorferi
PISSFLTQGTSPSIT

SEQ ID NO: 133518 - protein, 9 aa, Borrelia burgdorferi
FLTQGTSPS

SEQ ID NO: 133519 - protein, 15 aa, Borrelia burgdorferi
PRPISSFLTQGTSPS

SEQ ID NO: 133520 - protein, 9 aa, Borrelia burgdorferi
PRPISSFLT

SEQ ID NO: 133521 - protein, 15 aa, Borrelia burgdorferi
DFYIEPRPISSFLTQ

SEQ ID NO: 133522 - protein, 9 aa, Borrelia burgdorferi
FYIEPRPIS

SEQ ID NO: 133523 - protein, 15 aa, Borrelia burgdorferi
EKLKKYLKDTNNLSA

SEQ ID NO: 133524 - protein, 9 aa, Borrelia burgdorferi
YLKDTNNLS

SEQ ID NO: 133525 - protein, 15 aa, Borrelia burgdorferi
KLKKYLKDTNNLSAI

SEQ ID NO: 133526 - protein, 9 aa, Borrelia burgdorferi
LKDTNNLSA

SEQ ID NO: 133527 - protein, 15 aa, Borrelia burgdorferi
LKKYLKDTNNLSAIE

SEQ ID NO: 133528 - protein, 9 aa, Borrelia burgdorferi
LKDTNNLSA

SEQ ID NO: 133529 - protein, 15 aa, Borrelia burgdorferi
KKYLKDTNNLSAIEE

SEQ ID NO: 133530 - protein, 9 aa, Borrelia burgdorferi
LKDTNNLSA

SEQ ID NO: 133531 - protein, 15 aa, Borrelia burgdorferi
EKITHPIFDHITGSG

SEQ ID NO: 133532 - protein, 9 aa, Borrelia burgdorferi
ITHPIFDHI

SEQ ID NO: 133533 - protein, 15 aa, Borrelia burgdorferi
KYLKDTNNLSAIEES

SEQ ID NO: 133534 - protein, 9 aa, Borrelia burgdorferi
LKDTNNLSA

SEQ ID NO: 133535 - protein, 15 aa, Borrelia burgdorferi
KITHPIFDHITGSGN

SEQ ID NO: 133536 - protein, 9 aa, Borrelia burgdorferi
IFDHITGSG

SEQ ID NO: 133537 - protein, 15 aa, Borrelia burgdorferi
ITHPIFDHITGSGNN

SEQ ID NO: 133538 - protein, 9 aa, Borrelia burgdorferi
IFDHITGSG

SEQ ID NO: 133539 - protein, 15 aa, Borrelia burgdorferi
KKYLKDTNNLSAIEE

SEQ ID NO: 133540 - protein, 9 aa, Borrelia burgdorferi
YLKDTNNLS

SEQ ID NO: 133541 - protein, 15 aa, Borrelia burgdorferi
EKLKKYLKDTNNLSA

SEQ ID NO: 133542 - protein, 9 aa, Borrelia burgdorferi
YLKDTNNLS

SEQ ID NO: 133543 - protein, 15 aa, Borrelia burgdorferi
LKKYLKDTNNLSAIE

SEQ ID NO: 133544 - protein, 9 aa, Borrelia burgdorferi
YLKDTNNLS

SEQ ID NO: 133545 - protein, 15 aa, Borrelia burgdorferi
KLKKYLKDTNNLSAI

SEQ ID NO: 133546 - protein, 9 aa, Borrelia burgdorferi
YLKDTNNLS

SEQ ID NO: 133547 - protein, 15 aa, Borrelia burgdorferi
NGLNIVQKITQNIDN

SEQ ID NO: 133548 - protein, 9 aa, Borrelia burgdorferi
VQKITQNID

SEQ ID NO: 133549 - protein, 15 aa, Borrelia burgdorferi
NNGLNIVQKITQNID

SEQ ID NO: 133550 - protein, 9 aa, Borrelia burgdorferi
IVQKITQNI

SEQ ID NO: 133551 - protein, 15 aa, Borrelia burgdorferi
GLNIVQKITQNIDNI

SEQ ID NO: 133552 - protein, 9 aa, Borrelia burgdorferi
VQKITQNID

SEQ ID NO: 133553 - protein, 15 aa, Borrelia burgdorferi
NIVQKITQNIDNITE

SEQ ID NO: 133554 - protein, 9 aa, Borrelia burgdorferi
VQKITQNID

SEQ ID NO: 133555 - protein, 15 aa, Borrelia burgdorferi
LNIVQKITQNIDNIT

SEQ ID NO: 133556 - protein, 9 aa, Borrelia burgdorferi
VQKITQNID

SEQ ID NO: 133557 - protein, 15 aa, Borrelia burgdorferi
LEKLKKYLKDTNNLS

SEQ ID NO: 133558 - protein, 9 aa, Borrelia burgdorferi
LKKYLKDTN

SEQ ID NO: 133559 - protein, 15 aa, Borrelia burgdorferi
EITEEVIMPIPQTID

SEQ ID NO: 133560 - protein, 9 aa, Borrelia burgdorferi
EVIMPIPQT

SEQ ID NO: 133561 - protein, 15 aa, Borrelia burgdorferi
ITEEVIMPIPQTIDF

SEQ ID NO: 133562 - protein, 9 aa, Borrelia burgdorferi
IMPIPQTID

SEQ ID NO: 133563 - protein, 15 aa, Borrelia burgdorferi
TEEVIMPIPQTIDFY

SEQ ID NO: 133564 - protein, 9 aa, Borrelia burgdorferi
IMPIPQTID

SEQ ID NO: 133565 - protein, 15 aa, Borrelia burgdorferi
EEVIMPIPQTIDFYI

SEQ ID NO: 133566 - protein, 9 aa, Borrelia burgdorferi
IMPIPQTID

SEQ ID NO: 133567 - protein, 15 aa, Borrelia burgdorferi
EVIMPIPQTIDFYIE

SEQ ID NO: 133568 - protein, 9 aa, Borrelia burgdorferi
IMPIPQTID

SEQ ID NO: 133569 - protein, 15 aa, Borrelia burgdorferi
GGDSNFFTNLEEVRS

SEQ ID NO: 133570 - protein, 9 aa, Borrelia burgdorferi
SNFFTNLEE

SEQ ID NO: 133571 - protein, 15 aa, Borrelia burgdorferi
LEIGGDSNFFTNLEE

SEQ ID NO: 133572 - protein, 9 aa, Borrelia burgdorferi
DSNFFTNLE

SEQ ID NO: 133573 - protein, 15 aa, Borrelia burgdorferi
IGGDSNFFTNLEEVR

SEQ ID NO: 133574 - protein, 9 aa, Borrelia burgdorferi
SNFFTNLEE

SEQ ID NO: 133575 - protein, 15 aa, Borrelia burgdorferi
KYLKDTNNLSAIEES

SEQ ID NO: 133576 - protein, 9 aa, Borrelia burgdorferi
YLKDTNNLS

SEQ ID NO: 133577 - protein, 15 aa, Borrelia burgdorferi
EIGGDSNFFTNLEEV

SEQ ID NO: 133578 - protein, 9 aa, Borrelia burgdorferi
SNFFTNLEE

SEQ ID NO: 133579 - protein, 15 aa, Borrelia burgdorferi
IVQKITQNIDNITEN

SEQ ID NO: 133580 - protein, 9 aa, Borrelia burgdorferi
VQKITQNID

SEQ ID NO: 133581 - protein, 15 aa, Borrelia burgdorferi
YLKDTNNLSAIEESV

SEQ ID NO: 133582 - protein, 9 aa, Borrelia burgdorferi
YLKDTNNLS

SEQ ID NO: 133583 - protein, 15 aa, Borrelia burgdorferi
VQKITQNIDNITENL

SEQ ID NO: 133584 - protein, 9 aa, Borrelia burgdorferi
VQKITQNID

SEQ ID NO: 133585 - protein, 15 aa, Borrelia burgdorferi
GDSNFFTNLEEVRSS

SEQ ID NO: 133586 - protein, 9 aa, Borrelia burgdorferi
SNFFTNLEE

SEQ ID NO: 133587 - protein, 15 aa, Borrelia burgdorferi
IDFYIEPRPISSFLT

SEQ ID NO: 133588 - protein, 9 aa, Borrelia burgdorferi
FYIEPRPIS

SEQ ID NO: 133589 - protein, 15 aa, Borrelia burgdorferi
PQTIDFYIEPRPISS

SEQ ID NO: 133590 - protein, 9 aa, Borrelia burgdorferi
FYIEPRPIS

SEQ ID NO: 133591 - protein, 15 aa, Borrelia burgdorferi
RPISSFLTQGTSPSI

SEQ ID NO: 133592 - protein, 9 aa, Borrelia burgdorferi
FLTQGTSPS

SEQ ID NO: 133593 - protein, 15 aa, Borrelia burgdorferi
PRPISSFLTQGTSPS

SEQ ID NO: 133594 - protein, 9 aa, Borrelia burgdorferi
ISSFLTQGT

SEQ ID NO: 133595 - protein, 15 aa, Borrelia burgdorferi
QTIDFYIEPRPISSF

SEQ ID NO: 133596 - protein, 9 aa, Borrelia burgdorferi
FYIEPRPIS

SEQ ID NO: 133597 - protein, 15 aa, Borrelia burgdorferi
TIDFYIEPRPISSFL

SEQ ID NO: 133598 - protein, 9 aa, Borrelia burgdorferi
FYIEPRPIS

SEQ ID NO: 133599 - protein, 15 aa, Borrelia burgdorferi
ISSFLTQGTSPSITS

SEQ ID NO: 133600 - protein, 9 aa, Borrelia burgdorferi
FLTQGTSPS

SEQ ID NO: 133601 - protein, 15 aa, Borrelia burgdorferi
TNLEEVRSSIRTKIK

SEQ ID NO: 133602 - protein, 9 aa, Borrelia burgdorferi
LEEVRSSIR

SEQ ID NO: 133603 - protein, 15 aa, Borrelia burgdorferi
FTNLEEVRSSIRTKI

SEQ ID NO: 133604 - protein, 9 aa, Borrelia burgdorferi
LEEVRSSIR

SEQ ID NO: 133605 - protein, 15 aa, Borrelia burgdorferi
SFLTQGTSPSITSTI

SEQ ID NO: 133606 - protein, 9 aa, Borrelia burgdorferi
LTQGTSPSI

SEQ ID NO: 133607 - protein, 15 aa, Borrelia burgdorferi
KDIYNSYIPEVKEEI

SEQ ID NO: 133608 - protein, 9 aa, Borrelia burgdorferi
IYNSYIPEV

SEQ ID NO: 133609 - protein, 15 aa, Borrelia burgdorferi
SSNKDIYNSYIPEVK

SEQ ID NO: 133610 - protein, 9 aa, Borrelia burgdorferi
IYNSYIPEV

SEQ ID NO: 133611 - protein, 15 aa, Borrelia burgdorferi
SNKDIYNSYIPEVKE

SEQ ID NO: 133612 - protein, 9 aa, Borrelia burgdorferi
IYNSYIPEV

SEQ ID NO: 133613 - protein, 15 aa, Borrelia burgdorferi
NKDIYNSYIPEVKEE

SEQ ID NO: 133614 - protein, 9 aa, Borrelia burgdorferi
IYNSYIPEV

SEQ ID NO: 133615 - protein, 15 aa, Borrelia burgdorferi
EKINNGLNIVQKITQ

SEQ ID NO: 133616 - protein, 9 aa, Borrelia burgdorferi
KINNGLNIV

SEQ ID NO: 133617 - protein, 15 aa, Borrelia burgdorferi
LNIVQKITQNIDNIT

SEQ ID NO: 133618 - protein, 9 aa, Borrelia burgdorferi
LNIVQKITQ

SEQ ID NO: 133619 - protein, 15 aa, Borrelia burgdorferi
KINNGLNIVQKITQN

SEQ ID NO: 133620 - protein, 9 aa, Borrelia burgdorferi
LNIVQKITQ

SEQ ID NO: 133621 - protein, 15 aa, Borrelia burgdorferi
INNGLNIVQKITQNI

SEQ ID NO: 133622 - protein, 9 aa, Borrelia burgdorferi
LNIVQKITQ

SEQ ID NO: 133623 - protein, 15 aa, Borrelia burgdorferi
NNGLNIVQKITQNID

SEQ ID NO: 133624 - protein, 9 aa, Borrelia burgdorferi
LNIVQKITQ

SEQ ID NO: 133625 - protein, 15 aa, Borrelia burgdorferi
NGLNIVQKITQNIDN

SEQ ID NO: 133626 - protein, 9 aa, Borrelia burgdorferi
LNIVQKITQ

SEQ ID NO: 133627 - protein, 15 aa, Borrelia burgdorferi
AKEKINNGLNIVQKI

SEQ ID NO: 133628 - protein, 9 aa, Borrelia burgdorferi
KINNGLNIV

SEQ ID NO: 133629 - protein, 15 aa, Borrelia burgdorferi
KEKINNGLNIVQKIT

SEQ ID NO: 133630 - protein, 9 aa, Borrelia burgdorferi
KINNGLNIV

SEQ ID NO: 133631 - protein, 15 aa, Borrelia burgdorferi
ELAKEKINNGLNIVQ

SEQ ID NO: 133632 - protein, 9 aa, Borrelia burgdorferi
KINNGLNIV

SEQ ID NO: 133633 - protein, 15 aa, Borrelia burgdorferi
LAKEKINNGLNIVQK

SEQ ID NO: 133634 - protein, 9 aa, Borrelia burgdorferi
KINNGLNIV

SEQ ID NO: 133635 - protein, 15 aa, Borrelia burgdorferi
GLNIVQKITQNIDNI

SEQ ID NO: 133636 - protein, 9 aa, Borrelia burgdorferi
LNIVQKITQ

SEQ ID NO: 133637 - protein, 15 aa, Borrelia burgdorferi
NIVQKITQNIDNITE

SEQ ID NO: 133638 - protein, 9 aa, Borrelia burgdorferi
ITQNIDNIT

SEQ ID NO: 133639 - protein, 15 aa, Borrelia burgdorferi
KELAKEKINNGLNIV

SEQ ID NO: 133640 - protein, 9 aa, Borrelia burgdorferi
EKINNGLNI

SEQ ID NO: 133641 - protein, 15 aa, Borrelia burgdorferi
MCAFLLLNLVNCKFD

SEQ ID NO: 133642 - protein, 9 aa, Borrelia burgdorferi
LLLNLVNCK

SEQ ID NO: 133643 - protein, 15 aa, Borrelia burgdorferi
IVQKITQNIDNITEN

SEQ ID NO: 133644 - protein, 9 aa, Borrelia burgdorferi
ITQNIDNIT

SEQ ID NO: 133645 - protein, 15 aa, Borrelia burgdorferi
CAFLLLNLVNCKFDS

SEQ ID NO: 133646 - protein, 9 aa, Borrelia burgdorferi
LLLNLVNCK

SEQ ID NO: 133647 - protein, 15 aa, Borrelia burgdorferi
VQKITQNIDNITENL

SEQ ID NO: 133648 - protein, 9 aa, Borrelia burgdorferi
ITQNIDNIT

SEQ ID NO: 133649 - protein, 15 aa, Borrelia burgdorferi
AFLLLNLVNCKFDSL

SEQ ID NO: 133650 - protein, 9 aa, Borrelia burgdorferi
LLLNLVNCK

SEQ ID NO: 133651 - protein, 15 aa, Borrelia burgdorferi
QKITQNIDNITENLN

SEQ ID NO: 133652 - protein, 9 aa, Borrelia burgdorferi
ITQNIDNIT

SEQ ID NO: 133653 - protein, 15 aa, Borrelia burgdorferi
NSIAKLLQHLSKSED

SEQ ID NO: 133654 - protein, 9 aa, Borrelia burgdorferi
IAKLLQHLS

SEQ ID NO: 133655 - protein, 15 aa, Borrelia burgdorferi
NCKFDSLNLSTKSVD

SEQ ID NO: 133656 - protein, 9 aa, Borrelia burgdorferi
SLNLSTKSV

SEQ ID NO: 133657 - protein, 15 aa, Borrelia burgdorferi
CKFDSLNLSTKSVDD

SEQ ID NO: 133658 - protein, 9 aa, Borrelia burgdorferi
LNLSTKSVD

SEQ ID NO: 133659 - protein, 15 aa, Borrelia burgdorferi
RPISSFLTQGTSPSI

SEQ ID NO: 133660 - protein, 9 aa, Borrelia burgdorferi
FLTQGTSPS

SEQ ID NO: 133661 - protein, 15 aa, Borrelia burgdorferi
KFDSLNLSTKSVDDK

SEQ ID NO: 133662 - protein, 9 aa, Borrelia burgdorferi
LNLSTKSVD

SEQ ID NO: 133663 - protein, 15 aa, Borrelia burgdorferi
FLLLNLVNCKFDSLN

SEQ ID NO: 133664 - protein, 9 aa, Borrelia burgdorferi
LLLNLVNCK

SEQ ID NO: 133665 - protein, 15 aa, Borrelia burgdorferi
PISSFLTQGTSPSIT

SEQ ID NO: 133666 - protein, 9 aa, Borrelia burgdorferi
FLTQGTSPS

SEQ ID NO: 133667 - protein, 15 aa, Borrelia burgdorferi
ISSFLTQGTSPSITS

SEQ ID NO: 133668 - protein, 9 aa, Borrelia burgdorferi
FLTQGTSPS

SEQ ID NO: 133669 - protein, 15 aa, Borrelia burgdorferi
PRPISSFLTQGTSPS

SEQ ID NO: 133670 - protein, 9 aa, Borrelia burgdorferi
ISSFLTQGT

SEQ ID NO: 133671 - protein, 15 aa, Borrelia burgdorferi
FDSLNLSTKSVDDKN

SEQ ID NO: 133672 - protein, 9 aa, Borrelia burgdorferi
LNLSTKSVD

SEQ ID NO: 133673 - protein, 15 aa, Borrelia burgdorferi
FTNLEEVRSSIRTKI

SEQ ID NO: 133674 - protein, 9 aa, Borrelia burgdorferi
LEEVRSSIR

SEQ ID NO: 133675 - protein, 15 aa, Borrelia burgdorferi
SSFLTQGTSPSITST

SEQ ID NO: 133676 - protein, 9 aa, Borrelia burgdorferi
FLTQGTSPS

SEQ ID NO: 133677 - protein, 15 aa, Borrelia burgdorferi
SIAKLLQHLSKSEDQ

SEQ ID NO: 133678 - protein, 9 aa, Borrelia burgdorferi
LQHLSKSED

SEQ ID NO: 133679 - protein, 15 aa, Borrelia burgdorferi
IAKLLQHLSKSEDQA

SEQ ID NO: 133680 - protein, 9 aa, Borrelia burgdorferi
LQHLSKSED

SEQ ID NO: 133681 - protein, 15 aa, Borrelia burgdorferi
KITQNIDNITENLNS

SEQ ID NO: 133682 - protein, 9 aa, Borrelia burgdorferi
ITQNIDNIT

SEQ ID NO: 133683 - protein, 15 aa, Borrelia burgdorferi
ITQNIDNITENLNSK

SEQ ID NO: 133684 - protein, 9 aa, Borrelia burgdorferi
ITQNIDNIT

SEQ ID NO: 133685 - protein, 15 aa, Borrelia burgdorferi
DDKNNSIAKLLQHLS

SEQ ID NO: 133686 - protein, 9 aa, Borrelia burgdorferi
DKNNSIAKL

SEQ ID NO: 133687 - protein, 15 aa, Borrelia burgdorferi
TNLEEVRSSIRTKIK

SEQ ID NO: 133688 - protein, 9 aa, Borrelia burgdorferi
VRSSIRTKI

SEQ ID NO: 133689 - protein, 15 aa, Borrelia burgdorferi
FTNLEEVRSSIRTKI

SEQ ID NO: 133690 - protein, 9 aa, Borrelia burgdorferi
LEEVRSSIR

SEQ ID NO: 133691 - protein, 15 aa, Borrelia burgdorferi
TNLEEVRSSIRTKIK

SEQ ID NO: 133692 - protein, 9 aa, Borrelia burgdorferi
LEEVRSSIR

SEQ ID NO: 133693 - protein, 15 aa, Borrelia burgdorferi
FFTNLEEVRSSIRTK

SEQ ID NO: 133694 - protein, 9 aa, Borrelia burgdorferi
LEEVRSSIR

SEQ ID NO: 133695 - protein, 15 aa, Borrelia burgdorferi
EKLSQVAQHAPNSKI

SEQ ID NO: 133696 - protein, 9 aa, Borrelia burgdorferi
VAQHAPNSK

SEQ ID NO: 133697 - protein, 15 aa, Borrelia burgdorferi
HEKLSQVAQHAPNSK

SEQ ID NO: 133698 - protein, 9 aa, Borrelia burgdorferi
EKLSQVAQH

SEQ ID NO: 133699 - protein, 15 aa, Borrelia burgdorferi
KLSQVAQHAPNSKIE

SEQ ID NO: 133700 - protein, 9 aa, Borrelia burgdorferi
VAQHAPNSK

SEQ ID NO: 133701 - protein, 15 aa, Borrelia burgdorferi
LSQVAQHAPNSKIEK

SEQ ID NO: 133702 - protein, 9 aa, Borrelia burgdorferi
VAQHAPNSK

SEQ ID NO: 133703 - protein, 15 aa, Borrelia burgdorferi
SQVAQHAPNSKIEKV

SEQ ID NO: 133704 - protein, 9 aa, Borrelia burgdorferi
VAQHAPNSK

SEQ ID NO: 133705 - protein, 15 aa, Borrelia burgdorferi
QVAQHAPNSKIEKVK

SEQ ID NO: 133706 - protein, 9 aa, Borrelia burgdorferi
VAQHAPNSK

SEQ ID NO: 133707 - protein, 15 aa, Borrelia burgdorferi
VAQHAPNSKIEKVKS

SEQ ID NO: 133708 - protein, 9 aa, Borrelia burgdorferi
VAQHAPNSK

SEQ ID NO: 133709 - protein, 15 aa, Borrelia burgdorferi B31
LDKFNLIQSKITMLK

SEQ ID NO: 133710 - protein, 9 aa, Borrelia burgdorferi B31
FNLIQSKIT

SEQ ID NO: 133711 - protein, 15 aa, Borrelia burgdorferi B31
DKFNLIQSKITMLKV

SEQ ID NO: 133712 - protein, 9 aa, Borrelia burgdorferi B31
FNLIQSKIT

SEQ ID NO: 133713 - protein, 15 aa, Borrelia burgdorferi B31
LCVFYTKLAKKSGKA

SEQ ID NO: 133714 - protein, 9 aa, Borrelia burgdorferi B31
FYTKLAKKS

SEQ ID NO: 133715 - protein, 15 aa, Borrelia burgdorferi B31
CVFYTKLAKKSGKAD

SEQ ID NO: 133716 - protein, 9 aa, Borrelia burgdorferi B31
FYTKLAKKS

SEQ ID NO: 133717 - protein, 15 aa, Borrelia burgdorferi B31
NSNFKILDAYYRRPK

SEQ ID NO: 133718 - protein, 9 aa, Borrelia burgdorferi B31
FKILDAYYR

SEQ ID NO: 133719 - protein, 15 aa, Borrelia burgdorferi B31
SNFKILDAYYRRPKI

SEQ ID NO: 133720 - protein, 9 aa, Borrelia burgdorferi B31
FKILDAYYR

SEQ ID NO: 133721 - protein, 15 aa, Borrelia burgdorferi B31
GNLCVFYTKLAKKSG

SEQ ID NO: 133722 - protein, 9 aa, Borrelia burgdorferi B31
FYTKLAKKS

SEQ ID NO: 133723 - protein, 15 aa, Borrelia burgdorferi B31
NLCVFYTKLAKKSGK

SEQ ID NO: 133724 - protein, 9 aa, Borrelia burgdorferi B31
FYTKLAKKS

SEQ ID NO: 133725 - protein, 15 aa, Borrelia burgdorferi B31
TNSNFKILDAYYRRP

SEQ ID NO: 133726 - protein, 9 aa, Borrelia burgdorferi B31
FKILDAYYR

SEQ ID NO: 133727 - protein, 15 aa, Borrelia burgdorferi B31
IATNSNFKILDAYYR

SEQ ID NO: 133728 - protein, 9 aa, Borrelia burgdorferi B31
NSNFKILDA

SEQ ID NO: 133729 - protein, 15 aa, Borrelia burgdorferi B31
ATNSNFKILDAYYRR

SEQ ID NO: 133730 - protein, 9 aa, Borrelia burgdorferi B31
FKILDAYYR

SEQ ID NO: 133731 - protein, 15 aa, Borrelia burgdorferi B31
KFNLIQSKITMLKVE

SEQ ID NO: 133732 - protein, 9 aa, Borrelia burgdorferi B31
IQSKITMLK

SEQ ID NO: 133733 - protein, 15 aa, Borrelia burgdorferi B31
FNLIQSKITMLKVEN

SEQ ID NO: 133734 - protein, 9 aa, Borrelia burgdorferi B31
IQSKITMLK

SEQ ID NO: 133735 - protein, 15 aa, Borrelia burgdorferi B31
NLDKFNLIQSKITML

SEQ ID NO: 133736 - protein, 9 aa, Borrelia burgdorferi B31
FNLIQSKIT

SEQ ID NO: 133737 - protein, 15 aa, Borrelia burgdorferi B31
AGNLCVFYTKLAKKS

SEQ ID NO: 133738 - protein, 9 aa, Borrelia burgdorferi B31
LCVFYTKLA

SEQ ID NO: 133739 - protein, 15 aa, Borrelia burgdorferi B31
NLIQSKITMLKVENL

SEQ ID NO: 133740 - protein, 9 aa, Borrelia burgdorferi B31
IQSKITMLK

SEQ ID NO: 133741 - protein, 15 aa, Borrelia burgdorferi B31
DNLDKFNLIQSKITM

SEQ ID NO: 133742 - protein, 9 aa, Borrelia burgdorferi B31
FNLIQSKIT

SEQ ID NO: 133743 - protein, 15 aa, Borrelia burgdorferi B31
KDNLDKFNLIQSKIT

SEQ ID NO: 133744 - protein, 9 aa, Borrelia burgdorferi B31
LDKFNLIQS

SEQ ID NO: 133745 - protein, 15 aa, Borrelia burgdorferi B31
VFYTKLAKKSGKADL

SEQ ID NO: 133746 - protein, 9 aa, Borrelia burgdorferi B31
FYTKLAKKS

SEQ ID NO: 133747 - protein, 15 aa, Borrelia burgdorferi B31
IKEIPFTNSLITKII

SEQ ID NO: 133748 - protein, 9 aa, Borrelia burgdorferi B31
FTNSLITKI

SEQ ID NO: 133749 - protein, 15 aa, Borrelia burgdorferi B31
KEIPFTNSLITKIIQ

SEQ ID NO: 133750 - protein, 9 aa, Borrelia burgdorferi B31
FTNSLITKI

SEQ ID NO: 133751 - protein, 15 aa, Borrelia burgdorferi B31
LIQSKITMLKVENLI

SEQ ID NO: 133752 - protein, 9 aa, Borrelia burgdorferi B31
ITMLKVENL

SEQ ID NO: 133753 - protein, 15 aa, Borrelia burgdorferi B31
LDVLLGAGNLCVFYT

SEQ ID NO: 133754 - protein, 9 aa, Borrelia burgdorferi B31
LLGAGNLCV

SEQ ID NO: 133755 - protein, 15 aa, Borrelia burgdorferi B31
DVLLGAGNLCVFYTK

SEQ ID NO: 133756 - protein, 9 aa, Borrelia burgdorferi B31
LLGAGNLCV

SEQ ID NO: 133757 - protein, 15 aa, Borrelia burgdorferi B31
ILFIKLWPSSPNIIA

SEQ ID NO: 133758 - protein, 9 aa, Borrelia burgdorferi B31
LWPSSPNII

SEQ ID NO: 133759 - protein, 15 aa, Borrelia burgdorferi B31
IQSKITMLKVENLIP

SEQ ID NO: 133760 - protein, 9 aa, Borrelia burgdorferi B31
ITMLKVENL

SEQ ID NO: 133761 - protein, 15 aa, Borrelia burgdorferi B31
LIKEIPFTNSLITKI

SEQ ID NO: 133762 - protein, 9 aa, Borrelia burgdorferi B31
IPFTNSLIT

SEQ ID NO: 133763 - protein, 15 aa, Borrelia burgdorferi B31
EIPFTNSLITKIIQP

SEQ ID NO: 133764 - protein, 9 aa, Borrelia burgdorferi B31
FTNSLITKI

SEQ ID NO: 133765 - protein, 15 aa, Borrelia burgdorferi B31
IPFTNSLITKIIQPD

SEQ ID NO: 133766 - protein, 9 aa, Borrelia burgdorferi B31
FTNSLITKI

SEQ ID NO: 133767 - protein, 15 aa, Borrelia burgdorferi B31
FYTKLAKKSGKADLY

SEQ ID NO: 133768 - protein, 9 aa, Borrelia burgdorferi B31
FYTKLAKKS

SEQ ID NO: 133769 - protein, 15 aa, Borrelia burgdorferi B31
NFKILDAYYRRPKIK

SEQ ID NO: 133770 - protein, 9 aa, Borrelia burgdorferi B31
FKILDAYYR

SEQ ID NO: 133771 - protein, 15 aa, Borrelia burgdorferi B31
FKILDAYYRRPKIKE

SEQ ID NO: 133772 - protein, 9 aa, Borrelia burgdorferi B31
FKILDAYYR

SEQ ID NO: 133773 - protein, 15 aa, Borrelia burgdorferi B31
LFIKLWPSSPNIIAT

SEQ ID NO: 133774 - protein, 9 aa, Borrelia burgdorferi B31
LWPSSPNII

SEQ ID NO: 133775 - protein, 15 aa, Borrelia burgdorferi B31
PSLDVLLGAGNLCVF

SEQ ID NO: 133776 - protein, 9 aa, Borrelia burgdorferi B31
LLGAGNLCV

SEQ ID NO: 133777 - protein, 15 aa, Borrelia burgdorferi B31
SLDVLLGAGNLCVFY

SEQ ID NO: 133778 - protein, 9 aa, Borrelia burgdorferi B31
LLGAGNLCV

SEQ ID NO: 133779 - protein, 15 aa, Borrelia burgdorferi B31
TPSLDVLLGAGNLCV

SEQ ID NO: 133780 - protein, 9 aa, Borrelia burgdorferi B31
DVLLGAGNL

SEQ ID NO: 133781 - protein, 15 aa, Borrelia burgdorferi B31
IIKAFQMKNERIISL

SEQ ID NO: 133782 - protein, 9 aa, Borrelia burgdorferi B31
FQMKNERII

SEQ ID NO: 133783 - protein, 15 aa, Borrelia burgdorferi B31
IKAFQMKNERIISLE

SEQ ID NO: 133784 - protein, 9 aa, Borrelia burgdorferi B31
MKNERIISL

SEQ ID NO: 133785 - protein, 15 aa, Borrelia burgdorferi B31
IILFIKLWPSSPNII

SEQ ID NO: 133786 - protein, 9 aa, Borrelia burgdorferi B31
IKLWPSSPN

SEQ ID NO: 133787 - protein, 15 aa, Borrelia burgdorferi B31
KAFQMKNERIISLEI

SEQ ID NO: 133788 - protein, 9 aa, Borrelia burgdorferi B31
MKNERIISL

SEQ ID NO: 133789 - protein, 15 aa, Borrelia burgdorferi B31
KKNFKKNALKLRFSD

SEQ ID NO: 133790 - protein, 9 aa, Borrelia burgdorferi B31
FKKNALKLR

SEQ ID NO: 133791 - protein, 15 aa, Borrelia burgdorferi B31
TKKNFKKNALKLRFS

SEQ ID NO: 133792 - protein, 9 aa, Borrelia burgdorferi B31
FKKNALKLR

SEQ ID NO: 133793 - protein, 15 aa, Borrelia burgdorferi B31
FIKLWPSSPNIIATN

SEQ ID NO: 133794 - protein, 9 aa, Borrelia burgdorferi B31
LWPSSPNII

SEQ ID NO: 133795 - protein, 15 aa, Borrelia burgdorferi B31
KNFKKNALKLRFSDF

SEQ ID NO: 133796 - protein, 9 aa, Borrelia burgdorferi B31
FKKNALKLR

SEQ ID NO: 133797 - protein, 15 aa, Borrelia burgdorferi B31
AFQMKNERIISLEIL

SEQ ID NO: 133798 - protein, 9 aa, Borrelia burgdorferi B31
MKNERIISL

SEQ ID NO: 133799 - protein, 15 aa, Borrelia burgdorferi B31
FKILICLNPNTTRFH

SEQ ID NO: 133800 - protein, 9 aa, Borrelia burgdorferi B31
LICLNPNTT

SEQ ID NO: 133801 - protein, 15 aa, Borrelia burgdorferi B31
KILICLNPNTTRFHI

SEQ ID NO: 133802 - protein, 9 aa, Borrelia burgdorferi B31
LICLNPNTT

SEQ ID NO: 133803 - protein, 15 aa, Borrelia burgdorferi B31
IKLWPSSPNIIATNS

SEQ ID NO: 133804 - protein, 9 aa, Borrelia burgdorferi B31
LWPSSPNII

SEQ ID NO: 133805 - protein, 15 aa, Borrelia burgdorferi B31
VKNLRRVKNKKLGLV

SEQ ID NO: 133806 - protein, 9 aa, Borrelia burgdorferi B31
LRRVKNKKL

SEQ ID NO: 133807 - protein, 15 aa, Borrelia burgdorferi B31
EKIKISLNQSLSPKE

SEQ ID NO: 133808 - protein, 9 aa, Borrelia burgdorferi B31
IKISLNQSL

SEQ ID NO: 133809 - protein, 15 aa, Borrelia burgdorferi B31
FQMKNERIISLEILQ

SEQ ID NO: 133810 - protein, 9 aa, Borrelia burgdorferi B31
MKNERIISL

SEQ ID NO: 133811 - protein, 15 aa, Borrelia burgdorferi B31
LLGAGNLCVFYTKLA

SEQ ID NO: 133812 - protein, 9 aa, Borrelia burgdorferi B31
LLGAGNLCV

SEQ ID NO: 133813 - protein, 15 aa, Borrelia burgdorferi B31
EEKIKISLNQSLSPK

SEQ ID NO: 133814 - protein, 9 aa, Borrelia burgdorferi B31
IKISLNQSL

SEQ ID NO: 133815 - protein, 15 aa, Borrelia burgdorferi B31
KEEKIKISLNQSLSP

SEQ ID NO: 133816 - protein, 9 aa, Borrelia burgdorferi B31
IKISLNQSL

SEQ ID NO: 133817 - protein, 15 aa, Borrelia burgdorferi B31
KSKIQNGKIIKAFQM

SEQ ID NO: 133818 - protein, 9 aa, Borrelia burgdorferi B31
IQNGKIIKA

SEQ ID NO: 133819 - protein, 15 aa, Borrelia burgdorferi B31
SKIQNGKIIKAFQMK

SEQ ID NO: 133820 - protein, 9 aa, Borrelia burgdorferi B31
IQNGKIIKA

SEQ ID NO: 133821 - protein, 15 aa, Borrelia burgdorferi B31
ITKKNFKKNALKLRF

SEQ ID NO: 133822 - protein, 9 aa, Borrelia burgdorferi B31
FKKNALKLR

SEQ ID NO: 133823 - protein, 15 aa, Borrelia burgdorferi B31
MIKMSLNYTEINTLI

SEQ ID NO: 133824 - protein, 9 aa, Borrelia burgdorferi B31
MIKMSLNYT

SEQ ID NO: 133825 - protein, 15 aa, Borrelia burgdorferi B31
FLKSKIQNGKIIKAF

SEQ ID NO: 133826 - protein, 9 aa, Borrelia burgdorferi B31
IQNGKIIKA

SEQ ID NO: 133827 - protein, 15 aa, Borrelia burgdorferi B31
LKSKIQNGKIIKAFQ

SEQ ID NO: 133828 - protein, 9 aa, Borrelia burgdorferi B31
IQNGKIIKA

SEQ ID NO: 133829 - protein, 15 aa, Borrelia burgdorferi B31
DFLKSKIQNGKIIKA

SEQ ID NO: 133830 - protein, 9 aa, Borrelia burgdorferi B31
KSKIQNGKI

SEQ ID NO: 133831 - protein, 15 aa, Borrelia burgdorferi B31
KNLRRVKNKKLGLVI

SEQ ID NO: 133832 - protein, 9 aa, Borrelia burgdorferi B31
VKNKKLGLV

SEQ ID NO: 133833 - protein, 15 aa, Borrelia burgdorferi B31
ILICLNPNTTRFHIT

SEQ ID NO: 133834 - protein, 9 aa, Borrelia burgdorferi B31
LNPNTTRFH

SEQ ID NO: 133835 - protein, 15 aa, Borrelia burgdorferi B31
VLLGAGNLCVFYTKL

SEQ ID NO: 133836 - protein, 9 aa, Borrelia burgdorferi B31
LLGAGNLCV

SEQ ID NO: 133837 - protein, 15 aa, Borrelia burgdorferi B31
LRRVKNKKLGLVIPK

SEQ ID NO: 133838 - protein, 9 aa, Borrelia burgdorferi B31
VKNKKLGLV

SEQ ID NO: 133839 - protein, 15 aa, Borrelia burgdorferi B31
YKEEKIKISLNQSLS

SEQ ID NO: 133840 - protein, 9 aa, Borrelia burgdorferi B31
IKISLNQSL

SEQ ID NO: 133841 - protein, 15 aa, Borrelia burgdorferi B31
NLRRVKNKKLGLVIP

SEQ ID NO: 133842 - protein, 9 aa, Borrelia burgdorferi B31
VKNKKLGLV

SEQ ID NO: 133843 - protein, 15 aa, Borrelia burgdorferi B31
KKFKILICLNPNTTR

SEQ ID NO: 133844 - protein, 9 aa, Borrelia burgdorferi B31
LICLNPNTT

SEQ ID NO: 133845 - protein, 15 aa, Borrelia burgdorferi B31
KFKILICLNPNTTRF

SEQ ID NO: 133846 - protein, 9 aa, Borrelia burgdorferi B31
LICLNPNTT

SEQ ID NO: 133847 - protein, 15 aa, Borrelia burgdorferi B31
NYKEEKIKISLNQSL

SEQ ID NO: 133848 - protein, 9 aa, Borrelia burgdorferi B31
KIKISLNQS

SEQ ID NO: 133849 - protein, 15 aa, Borrelia burgdorferi B31
DLYYTQVKNLRRVKN

SEQ ID NO: 133850 - protein, 9 aa, Borrelia burgdorferi B31
YTQVKNLRR

SEQ ID NO: 133851 - protein, 15 aa, Borrelia burgdorferi B31
HITKKNFKKNALKLR

SEQ ID NO: 133852 - protein, 9 aa, Borrelia burgdorferi B31
NFKKNALKL

SEQ ID NO: 133853 - protein, 15 aa, Borrelia burgdorferi B31
LYYTQVKNLRRVKNK

SEQ ID NO: 133854 - protein, 9 aa, Borrelia burgdorferi B31
VKNLRRVKN

SEQ ID NO: 133855 - protein, 15 aa, Borrelia burgdorferi B31
RRVKNKKLGLVIPKA

SEQ ID NO: 133856 - protein, 9 aa, Borrelia burgdorferi B31
VKNKKLGLV

SEQ ID NO: 133857 - protein, 15 aa, Borrelia burgdorferi B31
LICLNPNTTRFHITK

SEQ ID NO: 133858 - protein, 9 aa, Borrelia burgdorferi B31
LNPNTTRFH

SEQ ID NO: 133859 - protein, 15 aa, Borrelia burgdorferi B31
KIKISLNQSLSPKEN

SEQ ID NO: 133860 - protein, 9 aa, Borrelia burgdorferi B31
IKISLNQSL

SEQ ID NO: 133861 - protein, 15 aa, Borrelia burgdorferi B31
QSKITMLKVENLIPE

SEQ ID NO: 133862 - protein, 9 aa, Borrelia burgdorferi B31
ITMLKVENL

SEQ ID NO: 133863 - protein, 15 aa, Borrelia burgdorferi B31
IKISLNQSLSPKENA

SEQ ID NO: 133864 - protein, 9 aa, Borrelia burgdorferi B31
IKISLNQSL

SEQ ID NO: 133865 - protein, 15 aa, Borrelia burgdorferi B31
SKITMLKVENLIPEE

SEQ ID NO: 133866 - protein, 9 aa, Borrelia burgdorferi B31
ITMLKVENL

SEQ ID NO: 133867 - protein, 15 aa, Borrelia burgdorferi B31
MIILFIKLWPSSPNI

SEQ ID NO: 133868 - protein, 9 aa, Borrelia burgdorferi B31
IKLWPSSPN

SEQ ID NO: 133869 - protein, 15 aa, Borrelia burgdorferi B31
KKGKNSFKTIQNQLK

SEQ ID NO: 133870 - protein, 9 aa, Borrelia burgdorferi B31
KKGKNSFKT

SEQ ID NO: 133871 - protein, 15 aa, Borrelia burgdorferi B31
PFTNSLITKIIQPDY

SEQ ID NO: 133872 - protein, 9 aa, Borrelia burgdorferi B31
FTNSLITKI

SEQ ID NO: 133873 - protein, 15 aa, Borrelia burgdorferi B31
NFKKNALKLRFSDFL

SEQ ID NO: 133874 - protein, 9 aa, Borrelia burgdorferi B31
FKKNALKLR

SEQ ID NO: 133875 - protein, 15 aa, Borrelia burgdorferi B31
YTQVKNLRRVKNKKL

SEQ ID NO: 133876 - protein, 9 aa, Borrelia burgdorferi B31
VKNLRRVKN

SEQ ID NO: 133877 - protein, 15 aa, Borrelia burgdorferi B31
DMIILFIKLWPSSPN

SEQ ID NO: 133878 - protein, 9 aa, Borrelia burgdorferi B31
FIKLWPSSP

SEQ ID NO: 133879 - protein, 15 aa, Borrelia burgdorferi B31
FKKNALKLRFSDFLK

SEQ ID NO: 133880 - protein, 9 aa, Borrelia burgdorferi B31
FKKNALKLR

SEQ ID NO: 133881 - protein, 15 aa, Borrelia burgdorferi B31
KLWPSSPNIIATNSN

SEQ ID NO: 133882 - protein, 9 aa, Borrelia burgdorferi B31
LWPSSPNII

SEQ ID NO: 133883 - protein, 15 aa, Borrelia burgdorferi B31
TQVKNLRRVKNKKLG

SEQ ID NO: 133884 - protein, 9 aa, Borrelia burgdorferi B31
VKNLRRVKN

SEQ ID NO: 133885 - protein, 15 aa, Borrelia burgdorferi B31
KIIQPDYKSLVLEIY

SEQ ID NO: 133886 - protein, 9 aa, Borrelia burgdorferi B31
IIQPDYKSL

SEQ ID NO: 133887 - protein, 15 aa, Borrelia burgdorferi B31
QPDYKSLVLEIYNKI

SEQ ID NO: 133888 - protein, 9 aa, Borrelia burgdorferi B31
YKSLVLEIY

SEQ ID NO: 133889 - protein, 15 aa, Borrelia burgdorferi B31
IIQPDYKSLVLEIYN

SEQ ID NO: 133890 - protein, 9 aa, Borrelia burgdorferi B31
YKSLVLEIY

SEQ ID NO: 133891 - protein, 15 aa, Borrelia burgdorferi B31
IQPDYKSLVLEIYNK

SEQ ID NO: 133892 - protein, 9 aa, Borrelia burgdorferi B31
YKSLVLEIY

SEQ ID NO: 133893 - protein, 15 aa, Borrelia burgdorferi B31
PDYKSLVLEIYNKID

SEQ ID NO: 133894 - protein, 9 aa, Borrelia burgdorferi B31
YKSLVLEIY

SEQ ID NO: 133895 - protein, 15 aa, Borrelia burgdorferi B31
FTNSLITKIIQPDYK

SEQ ID NO: 133896 - protein, 9 aa, Borrelia burgdorferi B31
FTNSLITKI

SEQ ID NO: 133897 - protein, 15 aa, Borrelia burgdorferi B31
YYTQVKNLRRVKNKK

SEQ ID NO: 133898 - protein, 9 aa, Borrelia burgdorferi B31
VKNLRRVKN

SEQ ID NO: 133899 - protein, 15 aa, Borrelia burgdorferi B31
KDMIILFIKLWPSSP

SEQ ID NO: 133900 - protein, 9 aa, Borrelia burgdorferi B31
MIILFIKLW

SEQ ID NO: 133901 - protein, 15 aa, Borrelia burgdorferi B31
KNSFKTIQNQLKDNL

SEQ ID NO: 133902 - protein, 9 aa, Borrelia burgdorferi B31
FKTIQNQLK

SEQ ID NO: 133903 - protein, 15 aa, Borrelia burgdorferi B31
NSFKTIQNQLKDNLD

SEQ ID NO: 133904 - protein, 9 aa, Borrelia burgdorferi B31
FKTIQNQLK

SEQ ID NO: 133905 - protein, 15 aa, Borrelia burgdorferi B31
NTLIKEIPFTNSLIT

SEQ ID NO: 133906 - protein, 9 aa, Borrelia burgdorferi B31
IKEIPFTNS

SEQ ID NO: 133907 - protein, 15 aa, Borrelia burgdorferi B31
FTYCGFEILIGRNAK

SEQ ID NO: 133908 - protein, 9 aa, Borrelia burgdorferi B31
YCGFEILIG

SEQ ID NO: 133909 - protein, 15 aa, Borrelia burgdorferi B31
KEKTPKIGLHFTYCG

SEQ ID NO: 133910 - protein, 9 aa, Borrelia burgdorferi B31
TPKIGLHFT

SEQ ID NO: 133911 - protein, 15 aa, Borrelia burgdorferi B31
HFTYCGFEILIGRNA

SEQ ID NO: 133912 - protein, 9 aa, Borrelia burgdorferi B31
YCGFEILIG

SEQ ID NO: 133913 - protein, 15 aa, Borrelia burgdorferi B31
TLIKEIPFTNSLITK

SEQ ID NO: 133914 - protein, 9 aa, Borrelia burgdorferi B31
IKEIPFTNS

SEQ ID NO: 133915 - protein, 15 aa, Borrelia burgdorferi B31
GKNSFKTIQNQLKDN

SEQ ID NO: 133916 - protein, 9 aa, Borrelia burgdorferi B31
FKTIQNQLK

SEQ ID NO: 133917 - protein, 15 aa, Borrelia burgdorferi B31
EKTPKIGLHFTYCGF

SEQ ID NO: 133918 - protein, 9 aa, Borrelia burgdorferi B31
IGLHFTYCG

SEQ ID NO: 133919 - protein, 15 aa, Borrelia burgdorferi B31
KGKNSFKTIQNQLKD

SEQ ID NO: 133920 - protein, 9 aa, Borrelia burgdorferi B31
FKTIQNQLK

SEQ ID NO: 133921 - protein, 15 aa, Borrelia burgdorferi B31
ICLNPNTTRFHITKK

SEQ ID NO: 133922 - protein, 9 aa, Borrelia burgdorferi B31
LNPNTTRFH

SEQ ID NO: 133923 - protein, 15 aa, Borrelia burgdorferi B31
LWPSSPNIIATNSNF

SEQ ID NO: 133924 - protein, 9 aa, Borrelia burgdorferi B31
LWPSSPNII

SEQ ID NO: 133925 - protein, 15 aa, Borrelia burgdorferi B31
EIFLKAKEIHESNKM

SEQ ID NO: 133926 - protein, 9 aa, Borrelia burgdorferi B31
LKAKEIHES

SEQ ID NO: 133927 - protein, 15 aa, Borrelia burgdorferi B31
IFLKAKEIHESNKMS

SEQ ID NO: 133928 - protein, 9 aa, Borrelia burgdorferi B31
LKAKEIHES

SEQ ID NO: 133929 - protein, 15 aa, Borrelia burgdorferi B31
ADLYYTQVKNLRRVK

SEQ ID NO: 133930 - protein, 9 aa, Borrelia burgdorferi B31
YTQVKNLRR

SEQ ID NO: 133931 - protein, 15 aa, Borrelia burgdorferi B31
MKNERIISLEILQKD

SEQ ID NO: 133932 - protein, 9 aa, Borrelia burgdorferi B31
MKNERIISL

SEQ ID NO: 133933 - protein, 15 aa, Borrelia burgdorferi B31
YCGFEILIGRNAKEN

SEQ ID NO: 133934 - protein, 9 aa, Borrelia burgdorferi B31
FEILIGRNA

SEQ ID NO: 133935 - protein, 15 aa, Borrelia burgdorferi B31
LGAGNLCVFYTKLAK

SEQ ID NO: 133936 - protein, 9 aa, Borrelia burgdorferi B31
LCVFYTKLA

SEQ ID NO: 133937 - protein, 15 aa, Borrelia burgdorferi B31
QMKNERIISLEILQK

SEQ ID NO: 133938 - protein, 9 aa, Borrelia burgdorferi B31
MKNERIISL

SEQ ID NO: 133939 - protein, 15 aa, Borrelia burgdorferi B31
KADLYYTQVKNLRRV

SEQ ID NO: 133940 - protein, 9 aa, Borrelia burgdorferi B31
YTQVKNLRR

SEQ ID NO: 133941 - protein, 15 aa, Borrelia burgdorferi B31
NKKFKILICLNPNTT

SEQ ID NO: 133942 - protein, 9 aa, Borrelia burgdorferi B31
FKILICLNP

SEQ ID NO: 133943 - protein, 15 aa, Borrelia burgdorferi B31
RVKNKKLGLVIPKAE

SEQ ID NO: 133944 - protein, 9 aa, Borrelia burgdorferi B31
VKNKKLGLV

SEQ ID NO: 133945 - protein, 15 aa, Borrelia burgdorferi B31
TPKIGLHFTYCGFEI

SEQ ID NO: 133946 - protein, 9 aa, Borrelia burgdorferi B31
IGLHFTYCG

SEQ ID NO: 133947 - protein, 15 aa, Borrelia burgdorferi B31
KIQNGKIIKAFQMKN

SEQ ID NO: 133948 - protein, 9 aa, Borrelia burgdorferi B31
IQNGKIIKA

SEQ ID NO: 133949 - protein, 15 aa, Borrelia burgdorferi B31
GKIIKAFQMKNERII

SEQ ID NO: 133950 - protein, 9 aa, Borrelia burgdorferi B31
AFQMKNERI

SEQ ID NO: 133951 - protein, 15 aa, Borrelia burgdorferi B31
KTPKIGLHFTYCGFE

SEQ ID NO: 133952 - protein, 9 aa, Borrelia burgdorferi B31
IGLHFTYCG

SEQ ID NO: 133953 - protein, 15 aa, Borrelia burgdorferi B31
VKNKKLGLVIPKAEK

SEQ ID NO: 133954 - protein, 9 aa, Borrelia burgdorferi B31
VKNKKLGLV

SEQ ID NO: 133955 - protein, 15 aa, Borrelia burgdorferi B31
IQNGKIIKAFQMKNE

SEQ ID NO: 133956 - protein, 9 aa, Borrelia burgdorferi B31
IQNGKIIKA

SEQ ID NO: 133957 - protein, 15 aa, Borrelia burgdorferi B31
TEINTLIKEIPFTNS

SEQ ID NO: 133958 - protein, 9 aa, Borrelia burgdorferi B31
INTLIKEIP

SEQ ID NO: 133959 - protein, 15 aa, Borrelia burgdorferi B31
INTLIKEIPFTNSLI

SEQ ID NO: 133960 - protein, 9 aa, Borrelia burgdorferi B31
IKEIPFTNS

SEQ ID NO: 133961 - protein, 15 aa, Borrelia burgdorferi B31
EINTLIKEIPFTNSL

SEQ ID NO: 133962 - protein, 9 aa, Borrelia burgdorferi B31
IKEIPFTNS

SEQ ID NO: 133963 - protein, 15 aa, Borrelia burgdorferi B31
TGEIFLKAKEIHESN

SEQ ID NO: 133964 - protein, 9 aa, Borrelia burgdorferi B31
LKAKEIHES

SEQ ID NO: 133965 - protein, 15 aa, Borrelia burgdorferi B31
TTGEIFLKAKEIHES

SEQ ID NO: 133966 - protein, 9 aa, Borrelia burgdorferi B31
EIFLKAKEI

SEQ ID NO: 133967 - protein, 15 aa, Borrelia burgdorferi B31
GEIFLKAKEIHESNK

SEQ ID NO: 133968 - protein, 9 aa, Borrelia burgdorferi B31
LKAKEIHES

SEQ ID NO: 133969 - protein, 15 aa, Borrelia burgdorferi B31
MELKEEYNNTSYTSY

SEQ ID NO: 133970 - protein, 9 aa, Borrelia burgdorferi B31
EYNNTSYTS

SEQ ID NO: 133971 - protein, 15 aa, Borrelia burgdorferi B31
KIIKAFQMKNERIIS

SEQ ID NO: 133972 - protein, 9 aa, Borrelia burgdorferi B31
FQMKNERII

SEQ ID NO: 133973 - protein, 15 aa, Borrelia burgdorferi B31
DLYYTQVKNLRRVKN

SEQ ID NO: 133974 - protein, 9 aa, Borrelia burgdorferi B31
YYTQVKNLR

SEQ ID NO: 133975 - protein, 15 aa, Borrelia burgdorferi B31
SGKADLYYTQVKNLR

SEQ ID NO: 133976 - protein, 9 aa, Borrelia burgdorferi B31
SGKADLYYT

SEQ ID NO: 133977 - protein, 15 aa, Borrelia burgdorferi B31
GKADLYYTQVKNLRR

SEQ ID NO: 133978 - protein, 9 aa, Borrelia burgdorferi B31
YYTQVKNLR

SEQ ID NO: 133979 - protein, 15 aa, Borrelia burgdorferi B31
KADLYYTQVKNLRRV

SEQ ID NO: 133980 - protein, 9 aa, Borrelia burgdorferi B31
YYTQVKNLR

SEQ ID NO: 133981 - protein, 15 aa, Borrelia burgdorferi B31
ADLYYTQVKNLRRVK

SEQ ID NO: 133982 - protein, 9 aa, Borrelia burgdorferi B31
YYTQVKNLR

SEQ ID NO: 133983 - protein, 15 aa, Borrelia burgdorferi B31
LYYTQVKNLRRVKNK

SEQ ID NO: 133984 - protein, 9 aa, Borrelia burgdorferi B31
YYTQVKNLR

SEQ ID NO: 133985 - protein, 15 aa, Borrelia burgdorferi B31
YYTQVKNLRRVKNKK

SEQ ID NO: 133986 - protein, 9 aa, Borrelia burgdorferi B31
YYTQVKNLR

SEQ ID NO: 133987 - protein, 15 aa, Borrelia burgdorferi B31
MELKEEYNNTSYTSY

SEQ ID NO: 133988 - protein, 9 aa, Borrelia burgdorferi B31
LKEEYNNTS

SEQ ID NO: 133989 - protein, 15 aa, Borrelia burgdorferi B31
IMELKEEYNNTSYTS

SEQ ID NO: 133990 - protein, 9 aa, Borrelia burgdorferi B31
LKEEYNNTS

SEQ ID NO: 133991 - protein, 15 aa, Borrelia burgdorferi B31
DKKIMELKEEYNNTS

SEQ ID NO: 133992 - protein, 9 aa, Borrelia burgdorferi B31
KIMELKEEY

SEQ ID NO: 133993 - protein, 15 aa, Borrelia burgdorferi B31
KKIMELKEEYNNTSY

SEQ ID NO: 133994 - protein, 9 aa, Borrelia burgdorferi B31
LKEEYNNTS

SEQ ID NO: 133995 - protein, 15 aa, Borrelia burgdorferi B31
KIMELKEEYNNTSYT

SEQ ID NO: 133996 - protein, 9 aa, Borrelia burgdorferi B31
LKEEYNNTS

SEQ ID NO: 133997 - protein, 15 aa, Borrelia burgdorferi B31
DMIILFIKLWPSSPN

SEQ ID NO: 133998 - protein, 9 aa, Borrelia burgdorferi B31
LFIKLWPSS

SEQ ID NO: 133999 - protein, 15 aa, Borrelia burgdorferi B31
MIILFIKLWPSSPNI

SEQ ID NO: 134000 - protein, 9 aa, Borrelia burgdorferi B31
LFIKLWPSS

SEQ ID NO: 134001 - protein, 15 aa, Borrelia burgdorferi B31
IILFIKLWPSSPNII

SEQ ID NO: 134002 - protein, 9 aa, Borrelia burgdorferi B31
LFIKLWPSS

SEQ ID NO: 134003 - protein, 15 aa, Borrelia burgdorferi B31
ILFIKLWPSSPNIIA

SEQ ID NO: 134004 - protein, 9 aa, Borrelia burgdorferi B31
IKLWPSSPN

SEQ ID NO: 134005 - protein, 15 aa, Borrelia burgdorferi B31
ELKEEYNNTSYTSYS

SEQ ID NO: 134006 - protein, 9 aa, Borrelia burgdorferi B31
LKEEYNNTS

SEQ ID NO: 134007 - protein, 15 aa, Borrelia burgdorferi B31
LKEEYNNTSYTSYSE

SEQ ID NO: 134008 - protein, 9 aa, Borrelia burgdorferi B31
LKEEYNNTS

SEQ ID NO: 134009 - protein, 15 aa, Borrelia burgdorferi B31
WPSSPNIIATNSNFK

SEQ ID NO: 134010 - protein, 9 aa, Borrelia burgdorferi B31
PNIIATNSN

SEQ ID NO: 134011 - protein, 15 aa, Borrelia burgdorferi B31
PSSPNIIATNSNFKI

SEQ ID NO: 134012 - protein, 9 aa, Borrelia burgdorferi B31
IIATNSNFK

SEQ ID NO: 134013 - protein, 15 aa, Borrelia burgdorferi B31
LFIKLWPSSPNIIAT

SEQ ID NO: 134014 - protein, 9 aa, Borrelia burgdorferi B31
IKLWPSSPN

SEQ ID NO: 134015 - protein, 15 aa, Borrelia burgdorferi B31
SSPNIIATNSNFKIL

SEQ ID NO: 134016 - protein, 9 aa, Borrelia burgdorferi B31
IIATNSNFK

SEQ ID NO: 134017 - protein, 15 aa, Borrelia burgdorferi B31
GAYVFIKNQKNKTPS

SEQ ID NO: 134018 - protein, 9 aa, Borrelia burgdorferi B31
FIKNQKNKT

SEQ ID NO: 134019 - protein, 15 aa, Borrelia burgdorferi B31
PGAYVFIKNQKNKTP

SEQ ID NO: 134020 - protein, 9 aa, Borrelia burgdorferi B31
FIKNQKNKT

SEQ ID NO: 134021 - protein, 15 aa, Borrelia burgdorferi B31
PNIIATNSNFKILDA

SEQ ID NO: 134022 - protein, 9 aa, Borrelia burgdorferi B31
IIATNSNFK

SEQ ID NO: 134023 - protein, 15 aa, Borrelia burgdorferi B31
SPNIIATNSNFKILD

SEQ ID NO: 134024 - protein, 9 aa, Borrelia burgdorferi B31
IIATNSNFK

SEQ ID NO: 134025 - protein, 15 aa, Borrelia burgdorferi B31
KDMIILFIKLWPSSP

SEQ ID NO: 134026 - protein, 9 aa, Borrelia burgdorferi B31
LFIKLWPSS

SEQ ID NO: 134027 - protein, 15 aa, Borrelia burgdorferi B31
YPGAYVFIKNQKNKT

SEQ ID NO: 134028 - protein, 9 aa, Borrelia burgdorferi B31
YVFIKNQKN

SEQ ID NO: 134029 - protein, 15 aa, Borrelia burgdorferi B31
YVFIKNQKNKTPSLD

SEQ ID NO: 134030 - protein, 9 aa, Borrelia burgdorferi B31
FIKNQKNKT

SEQ ID NO: 134031 - protein, 15 aa, Borrelia burgdorferi B31
AYVFIKNQKNKTPSL

SEQ ID NO: 134032 - protein, 9 aa, Borrelia burgdorferi B31
FIKNQKNKT

SEQ ID NO: 134033 - protein, 15 aa, Borrelia burgdorferi B31
LIEKYKKELIVLEKR

SEQ ID NO: 134034 - protein, 9 aa, Borrelia burgdorferi B31
YKKELIVLE

SEQ ID NO: 134035 - protein, 15 aa, Borrelia burgdorferi B31
WPSSPNIIATNSNFK

SEQ ID NO: 134036 - protein, 9 aa, Borrelia burgdorferi B31
PNIIATNSN

SEQ ID NO: 134037 - protein, 15 aa, Borrelia burgdorferi B31
PSSPNIIATNSNFKI

SEQ ID NO: 134038 - protein, 9 aa, Borrelia burgdorferi B31
IIATNSNFK

SEQ ID NO: 134039 - protein, 15 aa, Borrelia burgdorferi B31
FKILICLNPNTTRFH

SEQ ID NO: 134040 - protein, 9 aa, Borrelia burgdorferi B31
ILICLNPNT

SEQ ID NO: 134041 - protein, 15 aa, Borrelia burgdorferi B31
SSPNIIATNSNFKIL

SEQ ID NO: 134042 - protein, 9 aa, Borrelia burgdorferi B31
IIATNSNFK

SEQ ID NO: 134043 - protein, 15 aa, Borrelia burgdorferi B31
KFKILICLNPNTTRF

SEQ ID NO: 134044 - protein, 9 aa, Borrelia burgdorferi B31
ILICLNPNT

SEQ ID NO: 134045 - protein, 15 aa, Borrelia burgdorferi B31
PNIIATNSNFKILDA

SEQ ID NO: 134046 - protein, 9 aa, Borrelia burgdorferi B31
IIATNSNFK

SEQ ID NO: 134047 - protein, 15 aa, Borrelia burgdorferi B31
SPNIIATNSNFKILD

SEQ ID NO: 134048 - protein, 9 aa, Borrelia burgdorferi B31
IIATNSNFK

SEQ ID NO: 134049 - protein, 15 aa, Borrelia burgdorferi B31
KKFKILICLNPNTTR

SEQ ID NO: 134050 - protein, 9 aa, Borrelia burgdorferi B31
ILICLNPNT

SEQ ID NO: 134051 - protein, 15 aa, Borrelia burgdorferi B31
NKKFKILICLNPNTT

SEQ ID NO: 134052 - protein, 9 aa, Borrelia burgdorferi B31
ILICLNPNT

SEQ ID NO: 134053 - protein, 15 aa, Borrelia burgdorferi B31
MIILFIKLWPSSPNI

SEQ ID NO: 134054 - protein, 9 aa, Borrelia burgdorferi B31
FIKLWPSSP

SEQ ID NO: 134055 - protein, 15 aa, Borrelia burgdorferi B31
KILICLNPNTTRFHI

SEQ ID NO: 134056 - protein, 9 aa, Borrelia burgdorferi B31
LICLNPNTT

SEQ ID NO: 134057 - protein, 15 aa, Borrelia burgdorferi B31
IILFIKLWPSSPNII

SEQ ID NO: 134058 - protein, 9 aa, Borrelia burgdorferi B31
KLWPSSPNI

SEQ ID NO: 134059 - protein, 15 aa, Borrelia burgdorferi B31
ILFIKLWPSSPNIIA

SEQ ID NO: 134060 - protein, 9 aa, Borrelia burgdorferi B31
KLWPSSPNI

SEQ ID NO: 134061 - protein, 15 aa, Borrelia burgdorferi B31
SNFKILDAYYRRPKI

SEQ ID NO: 134062 - protein, 9 aa, Borrelia burgdorferi B31
ILDAYYRRP

SEQ ID NO: 134063 - protein, 15 aa, Borrelia burgdorferi B31
TNSNFKILDAYYRRP

SEQ ID NO: 134064 - protein, 9 aa, Borrelia burgdorferi B31
FKILDAYYR

SEQ ID NO: 134065 - protein, 15 aa, Borrelia burgdorferi B31
NSNFKILDAYYRRPK

SEQ ID NO: 134066 - protein, 9 aa, Borrelia burgdorferi B31
ILDAYYRRP

SEQ ID NO: 134067 - protein, 15 aa, Borrelia burgdorferi B31
NFKILDAYYRRPKIK

SEQ ID NO: 134068 - protein, 9 aa, Borrelia burgdorferi B31
ILDAYYRRP

SEQ ID NO: 134069 - protein, 15 aa, Borrelia burgdorferi B31
FKILDAYYRRPKIKE

SEQ ID NO: 134070 - protein, 9 aa, Borrelia burgdorferi B31
ILDAYYRRP

SEQ ID NO: 134071 - protein, 15 aa, Borrelia burgdorferi B31
KDMIILFIKLWPSSP

SEQ ID NO: 134072 - protein, 9 aa, Borrelia burgdorferi B31
MIILFIKLW

SEQ ID NO: 134073 - protein, 15 aa, Borrelia burgdorferi B31
ILICLNPNTTRFHIT

SEQ ID NO: 134074 - protein, 9 aa, Borrelia burgdorferi B31
ILICLNPNT

SEQ ID NO: 134075 - protein, 15 aa, Borrelia burgdorferi B31
DNKKFKILICLNPNT

SEQ ID NO: 134076 - protein, 9 aa, Borrelia burgdorferi B31
FKILICLNP

SEQ ID NO: 134077 - protein, 15 aa, Borrelia burgdorferi B31
NIIATNSNFKILDAY

SEQ ID NO: 134078 - protein, 9 aa, Borrelia burgdorferi B31
IIATNSNFK

SEQ ID NO: 134079 - protein, 15 aa, Borrelia burgdorferi B31
IIATNSNFKILDAYY

SEQ ID NO: 134080 - protein, 9 aa, Borrelia burgdorferi B31
IIATNSNFK

SEQ ID NO: 134081 - protein, 15 aa, Borrelia burgdorferi B31
DMIILFIKLWPSSPN

SEQ ID NO: 134082 - protein, 9 aa, Borrelia burgdorferi B31
FIKLWPSSP

SEQ ID NO: 134083 - protein, 15 aa, Borrelia burgdorferi B31
DMIILFIKLWPSSPN

SEQ ID NO: 134084 - protein, 9 aa, Borrelia burgdorferi B31
FIKLWPSSP

SEQ ID NO: 134085 - protein, 15 aa, Borrelia burgdorferi B31
MIILFIKLWPSSPNI

SEQ ID NO: 134086 - protein, 9 aa, Borrelia burgdorferi B31
IKLWPSSPN

SEQ ID NO: 134087 - protein, 15 aa, Borrelia burgdorferi B31
IILFIKLWPSSPNII

SEQ ID NO: 134088 - protein, 9 aa, Borrelia burgdorferi B31
IKLWPSSPN

SEQ ID NO: 134089 - protein, 15 aa, Borrelia burgdorferi B31
ILFIKLWPSSPNIIA

SEQ ID NO: 134090 - protein, 9 aa, Borrelia burgdorferi B31
IKLWPSSPN

SEQ ID NO: 134091 - protein, 15 aa, Borrelia burgdorferi B31
LFIKLWPSSPNIIAT

SEQ ID NO: 134092 - protein, 9 aa, Borrelia burgdorferi B31
IKLWPSSPN

SEQ ID NO: 134093 - protein, 15 aa, Borrelia burgdorferi B31
FIKLWPSSPNIIATN

SEQ ID NO: 134094 - protein, 9 aa, Borrelia burgdorferi B31
IKLWPSSPN

SEQ ID NO: 134095 - protein, 15 aa, Borrelia burgdorferi B31
IKLWPSSPNIIATNS

SEQ ID NO: 134096 - protein, 9 aa, Borrelia burgdorferi B31
IKLWPSSPN

SEQ ID NO: 134097 - protein, 15 aa, Borrelia burgdorferi B31
DLYYTQVKNLRRVKN

SEQ ID NO: 134098 - protein, 9 aa, Borrelia burgdorferi B31
YTQVKNLRR

SEQ ID NO: 134099 - protein, 15 aa, Borrelia burgdorferi B31
LYYTQVKNLRRVKNK

SEQ ID NO: 134100 - protein, 9 aa, Borrelia burgdorferi B31
YTQVKNLRR

SEQ ID NO: 134101 - protein, 15 aa, Borrelia burgdorferi B31
GKADLYYTQVKNLRR

SEQ ID NO: 134102 - protein, 9 aa, Borrelia burgdorferi B31
YYTQVKNLR

SEQ ID NO: 134103 - protein, 15 aa, Borrelia burgdorferi B31
ADLYYTQVKNLRRVK

SEQ ID NO: 134104 - protein, 9 aa, Borrelia burgdorferi B31
YTQVKNLRR

SEQ ID NO: 134105 - protein, 15 aa, Borrelia burgdorferi B31
KADLYYTQVKNLRRV

SEQ ID NO: 134106 - protein, 9 aa, Borrelia burgdorferi B31
YTQVKNLRR

SEQ ID NO: 134107 - protein, 15 aa, Borrelia burgdorferi B31
KKGKNSFKTIQNQLK

SEQ ID NO: 134108 - protein, 9 aa, Borrelia burgdorferi B31
KNSFKTIQN

SEQ ID NO: 134109 - protein, 15 aa, Borrelia burgdorferi B31
KGKNSFKTIQNQLKD

SEQ ID NO: 134110 - protein, 9 aa, Borrelia burgdorferi B31
KNSFKTIQN

SEQ ID NO: 134111 - protein, 15 aa, Borrelia burgdorferi B31
KDMIILFIKLWPSSP

SEQ ID NO: 134112 - protein, 9 aa, Borrelia burgdorferi B31
ILFIKLWPS

SEQ ID NO: 134113 - protein, 15 aa, Borrelia burgdorferi B31
KLWPSSPNIIATNSN

SEQ ID NO: 134114 - protein, 9 aa, Borrelia burgdorferi B31
WPSSPNIIA

SEQ ID NO: 134115 - protein, 15 aa, Borrelia burgdorferi B31
YYTQVKNLRRVKNKK

SEQ ID NO: 134116 - protein, 9 aa, Borrelia burgdorferi B31
YTQVKNLRR

SEQ ID NO: 134117 - protein, 15 aa, Borrelia burgdorferi B31
GKNSFKTIQNQLKDN

SEQ ID NO: 134118 - protein, 9 aa, Borrelia burgdorferi B31
FKTIQNQLK

SEQ ID NO: 134119 - protein, 15 aa, Borrelia burgdorferi B31
KNSFKTIQNQLKDNL

SEQ ID NO: 134120 - protein, 9 aa, Borrelia burgdorferi B31
FKTIQNQLK

SEQ ID NO: 134121 - protein, 15 aa, Borrelia burgdorferi B31
DSLKQQIKLLENIEN

SEQ ID NO: 134122 - protein, 9 aa, Borrelia burgdorferi B31
LKQQIKLLE

SEQ ID NO: 134123 - protein, 15 aa, Borrelia burgdorferi B31
IKMSLNYTEINTLIK

SEQ ID NO: 134124 - protein, 9 aa, Borrelia burgdorferi B31
IKMSLNYTE

SEQ ID NO: 134125 - protein, 15 aa, Borrelia burgdorferi B31
SLKQQIKLLENIENE

SEQ ID NO: 134126 - protein, 9 aa, Borrelia burgdorferi B31
IKLLENIEN

SEQ ID NO: 134127 - protein, 15 aa, Borrelia burgdorferi B31
LKQQIKLLENIENEK

SEQ ID NO: 134128 - protein, 9 aa, Borrelia burgdorferi B31
IKLLENIEN

SEQ ID NO: 134129 - protein, 15 aa, Borrelia burgdorferi B31
WPSSPNIIATNSNFK

SEQ ID NO: 134130 - protein, 9 aa, Borrelia burgdorferi B31
WPSSPNIIA

SEQ ID NO: 134131 - protein, 15 aa, Borrelia burgdorferi B31
KQQIKLLENIENEKE

SEQ ID NO: 134132 - protein, 9 aa, Borrelia burgdorferi B31
IKLLENIEN

SEQ ID NO: 134133 - protein, 15 aa, Borrelia burgdorferi B31
KMSLNYTEINTLIKE

SEQ ID NO: 134134 - protein, 9 aa, Borrelia burgdorferi B31
YTEINTLIK

SEQ ID NO: 134135 - protein, 15 aa, Borrelia burgdorferi B31
MSLNYTEINTLIKEI

SEQ ID NO: 134136 - protein, 9 aa, Borrelia burgdorferi B31
YTEINTLIK

SEQ ID NO: 134137 - protein, 15 aa, Borrelia burgdorferi B31
SLNYTEINTLIKEIP

SEQ ID NO: 134138 - protein, 9 aa, Borrelia burgdorferi B31
YTEINTLIK

SEQ ID NO: 134139 - protein, 15 aa, Borrelia burgdorferi B31
QQIKLLENIENEKEK

SEQ ID NO: 134140 - protein, 9 aa, Borrelia burgdorferi B31
IKLLENIEN

SEQ ID NO: 134141 - protein, 15 aa, Borrelia burgdorferi B31
KAYKKGKNSFKTIQN

SEQ ID NO: 134142 - protein, 9 aa, Borrelia burgdorferi B31
YKKGKNSFK

SEQ ID NO: 134143 - protein, 15 aa, Borrelia burgdorferi B31
LNYTEINTLIKEIPF

SEQ ID NO: 134144 - protein, 9 aa, Borrelia burgdorferi B31
YTEINTLIK

SEQ ID NO: 134145 - protein, 15 aa, Borrelia burgdorferi B31
AYKKGKNSFKTIQNQ

SEQ ID NO: 134146 - protein, 9 aa, Borrelia burgdorferi B31
KNSFKTIQN

SEQ ID NO: 134147 - protein, 15 aa, Borrelia burgdorferi B31
YTQVKNLRRVKNKKL

SEQ ID NO: 134148 - protein, 9 aa, Borrelia burgdorferi B31
YTQVKNLRR

SEQ ID NO: 134149 - protein, 15 aa, Borrelia burgdorferi B31
LQKDMIILFIKLWPS

SEQ ID NO: 134150 - protein, 9 aa, Borrelia burgdorferi B31
IILFIKLWP

SEQ ID NO: 134151 - protein, 15 aa, Borrelia burgdorferi B31
YKKGKNSFKTIQNQL

SEQ ID NO: 134152 - protein, 9 aa, Borrelia burgdorferi B31
KNSFKTIQN

SEQ ID NO: 134153 - protein, 15 aa, Borrelia burgdorferi B31
LWPSSPNIIATNSNF

SEQ ID NO: 134154 - protein, 9 aa, Borrelia burgdorferi B31
WPSSPNIIA

SEQ ID NO: 134155 - protein, 15 aa, Borrelia burgdorferi B31
QKDMIILFIKLWPSS

SEQ ID NO: 134156 - protein, 9 aa, Borrelia burgdorferi B31
ILFIKLWPS

SEQ ID NO: 134157 - protein, 15 aa, Borrelia burgdorferi B31
NSFKTIQNQLKDNLD

SEQ ID NO: 134158 - protein, 9 aa, Borrelia burgdorferi B31
FKTIQNQLK

SEQ ID NO: 134159 - protein, 15 aa, Borrelia burgdorferi B31
ILICLNPNTTRFHIT

SEQ ID NO: 134160 - protein, 9 aa, Borrelia burgdorferi B31
LNPNTTRFH

SEQ ID NO: 134161 - protein, 15 aa, Borrelia burgdorferi B31
LICLNPNTTRFHITK

SEQ ID NO: 134162 - protein, 9 aa, Borrelia burgdorferi B31
LNPNTTRFH

SEQ ID NO: 134163 - protein, 15 aa, Borrelia burgdorferi B31
KILICLNPNTTRFHI

SEQ ID NO: 134164 - protein, 9 aa, Borrelia burgdorferi B31
LNPNTTRFH

SEQ ID NO: 134165 - protein, 15 aa, Borrelia burgdorferi B31
ICLNPNTTRFHITKK

SEQ ID NO: 134166 - protein, 9 aa, Borrelia burgdorferi B31
LNPNTTRFH

SEQ ID NO: 134167 - protein, 15 aa, Borrelia burgdorferi B31
MELKEEYNNTSYTSY

SEQ ID NO: 134168 - protein, 9 aa, Borrelia burgdorferi B31
EEYNNTSYT

SEQ ID NO: 134169 - protein, 15 aa, Borrelia burgdorferi B31
ELKEEYNNTSYTSYS

SEQ ID NO: 134170 - protein, 9 aa, Borrelia burgdorferi B31
YNNTSYTSY

SEQ ID NO: 134171 - protein, 15 aa, Borrelia burgdorferi B31
KEEYNNTSYTSYSEF

SEQ ID NO: 134172 - protein, 9 aa, Borrelia burgdorferi B31
YNNTSYTSY

SEQ ID NO: 134173 - protein, 15 aa, Borrelia burgdorferi B31
LKEEYNNTSYTSYSE

SEQ ID NO: 134174 - protein, 9 aa, Borrelia burgdorferi B31
YNNTSYTSY

SEQ ID NO: 134175 - protein, 15 aa, Borrelia burgdorferi B31
EEYNNTSYTSYSEFL

SEQ ID NO: 134176 - protein, 9 aa, Borrelia burgdorferi B31
YNNTSYTSY

SEQ ID NO: 134177 - protein, 15 aa, Borrelia burgdorferi B31
CLNPNTTRFHITKKN

SEQ ID NO: 134178 - protein, 9 aa, Borrelia burgdorferi B31
NPNTTRFHI

SEQ ID NO: 134179 - protein, 15 aa, Borrelia burgdorferi B31
SSPNIIATNSNFKIL

SEQ ID NO: 134180 - protein, 9 aa, Borrelia burgdorferi B31
IIATNSNFK

SEQ ID NO: 134181 - protein, 15 aa, Borrelia burgdorferi B31
FKILICLNPNTTRFH

SEQ ID NO: 134182 - protein, 9 aa, Borrelia burgdorferi B31
CLNPNTTRF

SEQ ID NO: 134183 - protein, 15 aa, Borrelia burgdorferi B31
SPNIIATNSNFKILD

SEQ ID NO: 134184 - protein, 9 aa, Borrelia burgdorferi B31
IIATNSNFK

SEQ ID NO: 134185 - protein, 15 aa, Borrelia burgdorferi B31
IKEIPFTNSLITKII

SEQ ID NO: 134186 - protein, 9 aa, Borrelia burgdorferi B31
IPFTNSLIT

SEQ ID NO: 134187 - protein, 15 aa, Borrelia burgdorferi B31
LIKEIPFTNSLITKI

SEQ ID NO: 134188 - protein, 9 aa, Borrelia burgdorferi B31
IPFTNSLIT

SEQ ID NO: 134189 - protein, 15 aa, Borrelia burgdorferi B31
PNIIATNSNFKILDA

SEQ ID NO: 134190 - protein, 9 aa, Borrelia burgdorferi B31
IIATNSNFK

SEQ ID NO: 134191 - protein, 15 aa, Borrelia burgdorferi B31
KEIPFTNSLITKIIQ

SEQ ID NO: 134192 - protein, 9 aa, Borrelia burgdorferi B31
IPFTNSLIT

SEQ ID NO: 134193 - protein, 15 aa, Borrelia burgdorferi B31
PSSPNIIATNSNFKI

SEQ ID NO: 134194 - protein, 9 aa, Borrelia burgdorferi B31
IIATNSNFK

SEQ ID NO: 134195 - protein, 15 aa, Borrelia burgdorferi B31
LNPNTTRFHITKKNF

SEQ ID NO: 134196 - protein, 9 aa, Borrelia burgdorferi B31
LNPNTTRFH

SEQ ID NO: 134197 - protein, 15 aa, Borrelia burgdorferi B31
WPSSPNIIATNSNFK

SEQ ID NO: 134198 - protein, 9 aa, Borrelia burgdorferi B31
NIIATNSNF

SEQ ID NO: 134199 - protein, 15 aa, Borrelia burgdorferi B31
DMIILFIKLWPSSPN

SEQ ID NO: 134200 - protein, 9 aa, Borrelia burgdorferi B31
FIKLWPSSP

SEQ ID NO: 134201 - protein, 15 aa, Borrelia burgdorferi B31
MIILFIKLWPSSPNI

SEQ ID NO: 134202 - protein, 9 aa, Borrelia burgdorferi B31
FIKLWPSSP

SEQ ID NO: 134203 - protein, 15 aa, Borrelia burgdorferi B31
IILFIKLWPSSPNII

SEQ ID NO: 134204 - protein, 9 aa, Borrelia burgdorferi B31
FIKLWPSSP

SEQ ID NO: 134205 - protein, 15 aa, Borrelia burgdorferi B31
KDMIILFIKLWPSSP

SEQ ID NO: 134206 - protein, 9 aa, Borrelia burgdorferi B31
LFIKLWPSS

SEQ ID NO: 134207 - protein, 15 aa, Borrelia burgdorferi B31
GNLCVFYTKLAKKSG

SEQ ID NO: 134208 - protein, 9 aa, Borrelia burgdorferi B31
FYTKLAKKS

SEQ ID NO: 134209 - protein, 15 aa, Borrelia burgdorferi B31
NLCVFYTKLAKKSGK

SEQ ID NO: 134210 - protein, 9 aa, Borrelia burgdorferi B31
YTKLAKKSG

SEQ ID NO: 134211 - protein, 15 aa, Borrelia burgdorferi B31
ILFIKLWPSSPNIIA

SEQ ID NO: 134212 - protein, 9 aa, Borrelia burgdorferi B31
FIKLWPSSP

SEQ ID NO: 134213 - protein, 15 aa, Borrelia burgdorferi B31
LCVFYTKLAKKSGKA

SEQ ID NO: 134214 - protein, 9 aa, Borrelia burgdorferi B31
YTKLAKKSG

SEQ ID NO: 134215 - protein, 15 aa, Borrelia burgdorferi B31
CVFYTKLAKKSGKAD

SEQ ID NO: 134216 - protein, 9 aa, Borrelia burgdorferi B31
YTKLAKKSG

SEQ ID NO: 134217 - protein, 15 aa, Borrelia burgdorferi B31
VFYTKLAKKSGKADL

SEQ ID NO: 134218 - protein, 9 aa, Borrelia burgdorferi B31
YTKLAKKSG

SEQ ID NO: 134219 - protein, 15 aa, Borrelia burgdorferi B31
LFIKLWPSSPNIIAT

SEQ ID NO: 134220 - protein, 9 aa, Borrelia burgdorferi B31
FIKLWPSSP

SEQ ID NO: 134221 - protein, 15 aa, Borrelia burgdorferi B31
PGAYVFIKNQKNKTP

SEQ ID NO: 134222 - protein, 9 aa, Borrelia burgdorferi B31
FIKNQKNKT

SEQ ID NO: 134223 - protein, 15 aa, Borrelia burgdorferi B31
GAYVFIKNQKNKTPS

SEQ ID NO: 134224 - protein, 9 aa, Borrelia burgdorferi B31
FIKNQKNKT

SEQ ID NO: 134225 - protein, 15 aa, Borrelia burgdorferi B31
AYVFIKNQKNKTPSL

SEQ ID NO: 134226 - protein, 9 aa, Borrelia burgdorferi B31
FIKNQKNKT

SEQ ID NO: 134227 - protein, 15 aa, Borrelia burgdorferi B31
YVFIKNQKNKTPSLD

SEQ ID NO: 134228 - protein, 9 aa, Borrelia burgdorferi B31
FIKNQKNKT

SEQ ID NO: 134229 - protein, 15 aa, Borrelia burgdorferi B31
YPGAYVFIKNQKNKT

SEQ ID NO: 134230 - protein, 9 aa, Borrelia burgdorferi B31
YVFIKNQKN

SEQ ID NO: 134231 - protein, 15 aa, Borrelia burgdorferi B31
ILFIKLWPSSPNIIA

SEQ ID NO: 134232 - protein, 9 aa, Borrelia burgdorferi B31
LWPSSPNII

SEQ ID NO: 134233 - protein, 15 aa, Borrelia burgdorferi B31
LFIKLWPSSPNIIAT

SEQ ID NO: 134234 - protein, 9 aa, Borrelia burgdorferi B31
LWPSSPNII

SEQ ID NO: 134235 - protein, 15 aa, Borrelia burgdorferi B31
FIKLWPSSPNIIATN

SEQ ID NO: 134236 - protein, 9 aa, Borrelia burgdorferi B31
LWPSSPNII

SEQ ID NO: 134237 - protein, 15 aa, Borrelia burgdorferi B31
IKLWPSSPNIIATNS

SEQ ID NO: 134238 - protein, 9 aa, Borrelia burgdorferi B31
LWPSSPNII

SEQ ID NO: 134239 - protein, 15 aa, Borrelia burgdorferi B31
IILFIKLWPSSPNII

SEQ ID NO: 134240 - protein, 9 aa, Borrelia burgdorferi B31
KLWPSSPNI

SEQ ID NO: 134241 - protein, 15 aa, Borrelia burgdorferi B31
KLWPSSPNIIATNSN

SEQ ID NO: 134242 - protein, 9 aa, Borrelia burgdorferi B31
LWPSSPNII

SEQ ID NO: 134243 - protein, 15 aa, Borrelia burgdorferi B31
LWPSSPNIIATNSNF

SEQ ID NO: 134244 - protein, 9 aa, Borrelia burgdorferi B31
LWPSSPNII

SEQ ID NO: 134245 - protein, 15 aa, Borrelia burgdorferi B31
IKEIPFTNSLITKII

SEQ ID NO: 134246 - protein, 9 aa, Borrelia burgdorferi B31
FTNSLITKI

SEQ ID NO: 134247 - protein, 15 aa, Borrelia burgdorferi B31
KEIPFTNSLITKIIQ

SEQ ID NO: 134248 - protein, 9 aa, Borrelia burgdorferi B31
FTNSLITKI

SEQ ID NO: 134249 - protein, 15 aa, Borrelia burgdorferi B31
LIKEIPFTNSLITKI

SEQ ID NO: 134250 - protein, 9 aa, Borrelia burgdorferi B31
IPFTNSLIT

SEQ ID NO: 134251 - protein, 15 aa, Borrelia burgdorferi B31
DLYYTQVKNLRRVKN

SEQ ID NO: 134252 - protein, 9 aa, Borrelia burgdorferi B31
QVKNLRRVK

SEQ ID NO: 134253 - protein, 15 aa, Borrelia burgdorferi B31
LYYTQVKNLRRVKNK

SEQ ID NO: 134254 - protein, 9 aa, Borrelia burgdorferi B31
VKNLRRVKN

SEQ ID NO: 134255 - protein, 15 aa, Borrelia burgdorferi B31
YYTQVKNLRRVKNKK

SEQ ID NO: 134256 - protein, 9 aa, Borrelia burgdorferi B31
VKNLRRVKN

SEQ ID NO: 134257 - protein, 15 aa, Borrelia burgdorferi B31
YTQVKNLRRVKNKKL

SEQ ID NO: 134258 - protein, 9 aa, Borrelia burgdorferi B31
VKNLRRVKN

SEQ ID NO: 134259 - protein, 15 aa, Borrelia burgdorferi B31
TQVKNLRRVKNKKLG

SEQ ID NO: 134260 - protein, 9 aa, Borrelia burgdorferi B31
VKNLRRVKN

SEQ ID NO: 134261 - protein, 15 aa, Borrelia burgdorferi B31
QVKNLRRVKNKKLGL

SEQ ID NO: 134262 - protein, 9 aa, Borrelia burgdorferi B31
VKNLRRVKN

SEQ ID NO: 134263 - protein, 15 aa, Borrelia burgdorferi B31
VKNLRRVKNKKLGLV

SEQ ID NO: 134264 - protein, 9 aa, Borrelia burgdorferi B31
VKNLRRVKN

SEQ ID NO: 134265 - protein, 15 aa, Borrelia burgdorferi B31
NLCVFYTKLAKKSGK

SEQ ID NO: 134266 - protein, 9 aa, Borrelia burgdorferi B31
YTKLAKKSG

SEQ ID NO: 134267 - protein, 15 aa, Borrelia burgdorferi B31
LCVFYTKLAKKSGKA

SEQ ID NO: 134268 - protein, 9 aa, Borrelia burgdorferi B31
YTKLAKKSG

SEQ ID NO: 134269 - protein, 15 aa, Borrelia burgdorferi B31
GNLCVFYTKLAKKSG

SEQ ID NO: 134270 - protein, 9 aa, Borrelia burgdorferi B31
FYTKLAKKS

SEQ ID NO: 134271 - protein, 15 aa, Borrelia burgdorferi B31
CVFYTKLAKKSGKAD

SEQ ID NO: 134272 - protein, 9 aa, Borrelia burgdorferi B31
YTKLAKKSG

SEQ ID NO: 134273 - protein, 15 aa, Borrelia burgdorferi B31
VFYTKLAKKSGKADL

SEQ ID NO: 134274 - protein, 9 aa, Borrelia burgdorferi B31
YTKLAKKSG

SEQ ID NO: 134275 - protein, 15 aa, Borrelia burgdorferi B31
FYTKLAKKSGKADLY

SEQ ID NO: 134276 - protein, 9 aa, Borrelia burgdorferi B31
YTKLAKKSG

SEQ ID NO: 134277 - protein, 15 aa, Borrelia burgdorferi B31
KGELILLNINKIQKG

SEQ ID NO: 134278 - protein, 9 aa, Borrelia burgdorferi B31
LILLNINKI

SEQ ID NO: 134279 - protein, 15 aa, Borrelia burgdorferi B31
GELILLNINKIQKGI

SEQ ID NO: 134280 - protein, 9 aa, Borrelia burgdorferi B31
LILLNINKI

SEQ ID NO: 134281 - protein, 15 aa, Borrelia burgdorferi B31
ELILLNINKIQKGIK

SEQ ID NO: 134282 - protein, 9 aa, Borrelia burgdorferi B31
LNINKIQKG

SEQ ID NO: 134283 - protein, 15 aa, Borrelia burgdorferi B31
LILLNINKIQKGIKE

SEQ ID NO: 134284 - protein, 9 aa, Borrelia burgdorferi B31
LNINKIQKG

SEQ ID NO: 134285 - protein, 15 aa, Borrelia burgdorferi B31
EKGELILLNINKIQK

SEQ ID NO: 134286 - protein, 9 aa, Borrelia burgdorferi B31
LILLNINKI

SEQ ID NO: 134287 - protein, 15 aa, Borrelia burgdorferi B31
KEKGELILLNINKIQ

SEQ ID NO: 134288 - protein, 9 aa, Borrelia burgdorferi B31
LILLNINKI

SEQ ID NO: 134289 - protein, 15 aa, Borrelia burgdorferi B31
DLYYTQVKNLRRVKN

SEQ ID NO: 134290 - protein, 9 aa, Borrelia burgdorferi B31
YYTQVKNLR

SEQ ID NO: 134291 - protein, 15 aa, Borrelia burgdorferi B31
VKNLRRVKNKKLGLV

SEQ ID NO: 134292 - protein, 9 aa, Borrelia burgdorferi B31
VKNLRRVKN

SEQ ID NO: 134293 - protein, 15 aa, Borrelia burgdorferi B31
AYVFIKNQKNKTPSL

SEQ ID NO: 134294 - protein, 9 aa, Borrelia burgdorferi B31
FIKNQKNKT

SEQ ID NO: 134295 - protein, 15 aa, Borrelia burgdorferi B31
YVFIKNQKNKTPSLD

SEQ ID NO: 134296 - protein, 9 aa, Borrelia burgdorferi B31
FIKNQKNKT

SEQ ID NO: 134297 - protein, 15 aa, Borrelia burgdorferi B31
GAYVFIKNQKNKTPS

SEQ ID NO: 134298 - protein, 9 aa, Borrelia burgdorferi B31
FIKNQKNKT

SEQ ID NO: 134299 - protein, 15 aa, Borrelia burgdorferi B31
LYYTQVKNLRRVKNK

SEQ ID NO: 134300 - protein, 9 aa, Borrelia burgdorferi B31
VKNLRRVKN

SEQ ID NO: 134301 - protein, 15 aa, Borrelia burgdorferi B31
ILLNINKIQKGIKEI

SEQ ID NO: 134302 - protein, 9 aa, Borrelia burgdorferi B31
LNINKIQKG

SEQ ID NO: 134303 - protein, 15 aa, Borrelia burgdorferi B31
EKEKGELILLNINKI

SEQ ID NO: 134304 - protein, 9 aa, Borrelia burgdorferi B31
KGELILLNI

SEQ ID NO: 134305 - protein, 15 aa, Borrelia burgdorferi B31
YYTQVKNLRRVKNKK

SEQ ID NO: 134306 - protein, 9 aa, Borrelia burgdorferi B31
VKNLRRVKN

SEQ ID NO: 134307 - protein, 15 aa, Borrelia burgdorferi B31
TQVKNLRRVKNKKLG

SEQ ID NO: 134308 - protein, 9 aa, Borrelia burgdorferi B31
VKNLRRVKN

SEQ ID NO: 134309 - protein, 15 aa, Borrelia burgdorferi B31
YTQVKNLRRVKNKKL

SEQ ID NO: 134310 - protein, 9 aa, Borrelia burgdorferi B31
VKNLRRVKN

SEQ ID NO: 134311 - protein, 15 aa, Borrelia burgdorferi B31
PGAYVFIKNQKNKTP

SEQ ID NO: 134312 - protein, 9 aa, Borrelia burgdorferi B31
FIKNQKNKT

SEQ ID NO: 134313 - protein, 15 aa, Borrelia burgdorferi B31
ITKKNFKKNALKLRF

SEQ ID NO: 134314 - protein, 9 aa, Borrelia burgdorferi B31
FKKNALKLR

SEQ ID NO: 134315 - protein, 15 aa, Borrelia burgdorferi B31
HITKKNFKKNALKLR

SEQ ID NO: 134316 - protein, 9 aa, Borrelia burgdorferi B31
KKNFKKNAL

SEQ ID NO: 134317 - protein, 15 aa, Borrelia burgdorferi B31
VFIKNQKNKTPSLDV

SEQ ID NO: 134318 - protein, 9 aa, Borrelia burgdorferi B31
FIKNQKNKT

SEQ ID NO: 134319 - protein, 15 aa, Borrelia burgdorferi B31
LDKFNLIQSKITMLK

SEQ ID NO: 134320 - protein, 9 aa, Borrelia burgdorferi B31
FNLIQSKIT

SEQ ID NO: 134321 - protein, 15 aa, Borrelia burgdorferi B31
DKFNLIQSKITMLKV

SEQ ID NO: 134322 - protein, 9 aa, Borrelia burgdorferi B31
IQSKITMLK

SEQ ID NO: 134323 - protein, 15 aa, Borrelia burgdorferi B31
KNLRRVKNKKLGLVI

SEQ ID NO: 134324 - protein, 9 aa, Borrelia burgdorferi B31
VKNKKLGLV

SEQ ID NO: 134325 - protein, 15 aa, Borrelia burgdorferi B31
NLRRVKNKKLGLVIP

SEQ ID NO: 134326 - protein, 9 aa, Borrelia burgdorferi B31
VKNKKLGLV

SEQ ID NO: 134327 - protein, 15 aa, Borrelia burgdorferi B31
TKKNFKKNALKLRFS

SEQ ID NO: 134328 - protein, 9 aa, Borrelia burgdorferi B31
FKKNALKLR

SEQ ID NO: 134329 - protein, 15 aa, Borrelia burgdorferi B31
LRRVKNKKLGLVIPK

SEQ ID NO: 134330 - protein, 9 aa, Borrelia burgdorferi B31
VKNKKLGLV

SEQ ID NO: 134331 - protein, 15 aa, Borrelia burgdorferi B31
KKNFKKNALKLRFSD

SEQ ID NO: 134332 - protein, 9 aa, Borrelia burgdorferi B31
FKKNALKLR

SEQ ID NO: 134333 - protein, 15 aa, Borrelia burgdorferi B31
FIKNQKNKTPSLDVL

SEQ ID NO: 134334 - protein, 9 aa, Borrelia burgdorferi B31
FIKNQKNKT

SEQ ID NO: 134335 - protein, 15 aa, Borrelia burgdorferi B31
KFNLIQSKITMLKVE

SEQ ID NO: 134336 - protein, 9 aa, Borrelia burgdorferi B31
IQSKITMLK

SEQ ID NO: 134337 - protein, 15 aa, Borrelia burgdorferi B31
QVKNLRRVKNKKLGL

SEQ ID NO: 134338 - protein, 9 aa, Borrelia burgdorferi B31
VKNLRRVKN

SEQ ID NO: 134339 - protein, 15 aa, Borrelia burgdorferi B31
LLNINKIQKGIKEIN

SEQ ID NO: 134340 - protein, 9 aa, Borrelia burgdorferi B31
LNINKIQKG

SEQ ID NO: 134341 - protein, 15 aa, Borrelia burgdorferi B31
FNLIQSKITMLKVEN

SEQ ID NO: 134342 - protein, 9 aa, Borrelia burgdorferi B31
IQSKITMLK

SEQ ID NO: 134343 - protein, 15 aa, Borrelia burgdorferi B31
RRVKNKKLGLVIPKA

SEQ ID NO: 134344 - protein, 9 aa, Borrelia burgdorferi B31
VKNKKLGLV

SEQ ID NO: 134345 - protein, 15 aa, Borrelia burgdorferi B31
YPGAYVFIKNQKNKT

SEQ ID NO: 134346 - protein, 9 aa, Borrelia burgdorferi B31
VFIKNQKNK

SEQ ID NO: 134347 - protein, 15 aa, Borrelia burgdorferi B31
ISLEILQKDMIILFI

SEQ ID NO: 134348 - protein, 9 aa, Borrelia burgdorferi B31
LEILQKDMI

SEQ ID NO: 134349 - protein, 15 aa, Borrelia burgdorferi B31
IISLEILQKDMIILF

SEQ ID NO: 134350 - protein, 9 aa, Borrelia burgdorferi B31
LEILQKDMI

SEQ ID NO: 134351 - protein, 15 aa, Borrelia burgdorferi B31
RVKNKKLGLVIPKAE

SEQ ID NO: 134352 - protein, 9 aa, Borrelia burgdorferi B31
VKNKKLGLV

SEQ ID NO: 134353 - protein, 15 aa, Borrelia burgdorferi B31
VKNKKLGLVIPKAEK

SEQ ID NO: 134354 - protein, 9 aa, Borrelia burgdorferi B31
LGLVIPKAE

SEQ ID NO: 134355 - protein, 15 aa, Borrelia burgdorferi B31
KNFKKNALKLRFSDF

SEQ ID NO: 134356 - protein, 9 aa, Borrelia burgdorferi B31
FKKNALKLR

SEQ ID NO: 134357 - protein, 15 aa, Borrelia burgdorferi B31
IPFTNSLITKIIQPD

SEQ ID NO: 134358 - protein, 9 aa, Borrelia burgdorferi B31
FTNSLITKI

SEQ ID NO: 134359 - protein, 15 aa, Borrelia burgdorferi B31
NLDKFNLIQSKITML

SEQ ID NO: 134360 - protein, 9 aa, Borrelia burgdorferi B31
FNLIQSKIT

SEQ ID NO: 134361 - protein, 15 aa, Borrelia burgdorferi B31
FKILICLNPNTTRFH

SEQ ID NO: 134362 - protein, 9 aa, Borrelia burgdorferi B31
LICLNPNTT

SEQ ID NO: 134363 - protein, 15 aa, Borrelia burgdorferi B31
KKFKILICLNPNTTR

SEQ ID NO: 134364 - protein, 9 aa, Borrelia burgdorferi B31
LICLNPNTT

SEQ ID NO: 134365 - protein, 15 aa, Borrelia burgdorferi B31
IKEIPFTNSLITKII

SEQ ID NO: 134366 - protein, 9 aa, Borrelia burgdorferi B31
FTNSLITKI

SEQ ID NO: 134367 - protein, 15 aa, Borrelia burgdorferi B31
KEIPFTNSLITKIIQ

SEQ ID NO: 134368 - protein, 9 aa, Borrelia burgdorferi B31
FTNSLITKI

SEQ ID NO: 134369 - protein, 15 aa, Borrelia burgdorferi B31
NLIQSKITMLKVENL

SEQ ID NO: 134370 - protein, 9 aa, Borrelia burgdorferi B31
IQSKITMLK

SEQ ID NO: 134371 - protein, 15 aa, Borrelia burgdorferi B31
KILICLNPNTTRFHI

SEQ ID NO: 134372 - protein, 9 aa, Borrelia burgdorferi B31
LICLNPNTT

SEQ ID NO: 134373 - protein, 15 aa, Borrelia burgdorferi B31
KFKILICLNPNTTRF

SEQ ID NO: 134374 - protein, 9 aa, Borrelia burgdorferi B31
LICLNPNTT

SEQ ID NO: 134375 - protein, 15 aa, Borrelia burgdorferi B31
LEILQKDMIILFIKL

SEQ ID NO: 134376 - protein, 9 aa, Borrelia burgdorferi B31
LQKDMIILF

SEQ ID NO: 134377 - protein, 15 aa, Borrelia burgdorferi B31
EIPFTNSLITKIIQP

SEQ ID NO: 134378 - protein, 9 aa, Borrelia burgdorferi B31
FTNSLITKI

SEQ ID NO: 134379 - protein, 15 aa, Borrelia burgdorferi B31
SLEILQKDMIILFIK

SEQ ID NO: 134380 - protein, 9 aa, Borrelia burgdorferi B31
LQKDMIILF

SEQ ID NO: 134381 - protein, 15 aa, Borrelia burgdorferi B31
LNINKIQKGIKEINL

SEQ ID NO: 134382 - protein, 9 aa, Borrelia burgdorferi B31
LNINKIQKG

SEQ ID NO: 134383 - protein, 15 aa, Borrelia burgdorferi B31
IKLDENLIKKIKNQT

SEQ ID NO: 134384 - protein, 9 aa, Borrelia burgdorferi B31
ENLIKKIKN

SEQ ID NO: 134385 - protein, 15 aa, Borrelia burgdorferi B31
LNYTEINTLIKEIPF

SEQ ID NO: 134386 - protein, 9 aa, Borrelia burgdorferi B31
INTLIKEIP

SEQ ID NO: 134387 - protein, 15 aa, Borrelia burgdorferi B31
KADLYYTQVKNLRRV

SEQ ID NO: 134388 - protein, 9 aa, Borrelia burgdorferi B31
YYTQVKNLR

SEQ ID NO: 134389 - protein, 15 aa, Borrelia burgdorferi B31
ADLYYTQVKNLRRVK

SEQ ID NO: 134390 - protein, 9 aa, Borrelia burgdorferi B31
YYTQVKNLR

SEQ ID NO: 134391 - protein, 15 aa, Borrelia burgdorferi B31
SLNYTEINTLIKEIP

SEQ ID NO: 134392 - protein, 9 aa, Borrelia burgdorferi B31
TEINTLIKE

SEQ ID NO: 134393 - protein, 15 aa, Borrelia burgdorferi B31
PFTNSLITKIIQPDY

SEQ ID NO: 134394 - protein, 9 aa, Borrelia burgdorferi B31
FTNSLITKI

SEQ ID NO: 134395 - protein, 15 aa, Borrelia burgdorferi B31
DNLDKFNLIQSKITM

SEQ ID NO: 134396 - protein, 9 aa, Borrelia burgdorferi B31
FNLIQSKIT

SEQ ID NO: 134397 - protein, 15 aa, Borrelia burgdorferi B31
DFLKSKIQNGKIIKA

SEQ ID NO: 134398 - protein, 9 aa, Borrelia burgdorferi B31
LKSKIQNGK

SEQ ID NO: 134399 - protein, 15 aa, Borrelia burgdorferi B31
QPDYKSLVLEIYNKI

SEQ ID NO: 134400 - protein, 9 aa, Borrelia burgdorferi B31
YKSLVLEIY

SEQ ID NO: 134401 - protein, 15 aa, Borrelia burgdorferi B31
NYTEINTLIKEIPFT

SEQ ID NO: 134402 - protein, 9 aa, Borrelia burgdorferi B31
INTLIKEIP

SEQ ID NO: 134403 - protein, 15 aa, Borrelia burgdorferi B31
PDYKSLVLEIYNKID

SEQ ID NO: 134404 - protein, 9 aa, Borrelia burgdorferi B31
YKSLVLEIY

SEQ ID NO: 134405 - protein, 15 aa, Borrelia burgdorferi B31
YTEINTLIKEIPFTN

SEQ ID NO: 134406 - protein, 9 aa, Borrelia burgdorferi B31
INTLIKEIP

SEQ ID NO: 134407 - protein, 15 aa, Borrelia burgdorferi B31
RIISLEILQKDMIIL

SEQ ID NO: 134408 - protein, 9 aa, Borrelia burgdorferi B31
LEILQKDMI

SEQ ID NO: 134409 - protein, 15 aa, Borrelia burgdorferi B31
GKADLYYTQVKNLRR

SEQ ID NO: 134410 - protein, 9 aa, Borrelia burgdorferi B31
YYTQVKNLR

SEQ ID NO: 134411 - protein, 15 aa, Borrelia burgdorferi B31
TEINTLIKEIPFTNS

SEQ ID NO: 134412 - protein, 9 aa, Borrelia burgdorferi B31
INTLIKEIP

SEQ ID NO: 134413 - protein, 15 aa, Borrelia burgdorferi B31
NKKFKILICLNPNTT

SEQ ID NO: 134414 - protein, 9 aa, Borrelia burgdorferi B31
FKILICLNP

SEQ ID NO: 134415 - protein, 15 aa, Borrelia burgdorferi B31
IATNSNFKILDAYYR

SEQ ID NO: 134416 - protein, 9 aa, Borrelia burgdorferi B31
IATNSNFKI

SEQ ID NO: 134417 - protein, 15 aa, Borrelia burgdorferi B31
YKSLVLEIYNKIDNK

SEQ ID NO: 134418 - protein, 9 aa, Borrelia burgdorferi B31
YKSLVLEIY

SEQ ID NO: 134419 - protein, 15 aa, Borrelia burgdorferi B31
KDNLDKFNLIQSKIT

SEQ ID NO: 134420 - protein, 9 aa, Borrelia burgdorferi B31
KFNLIQSKI

SEQ ID NO: 134421 - protein, 15 aa, Borrelia burgdorferi B31
ILICLNPNTTRFHIT

SEQ ID NO: 134422 - protein, 9 aa, Borrelia burgdorferi B31
LICLNPNTT

SEQ ID NO: 134423 - protein, 15 aa, Borrelia burgdorferi B31
LIKEIPFTNSLITKI

SEQ ID NO: 134424 - protein, 9 aa, Borrelia burgdorferi B31
IPFTNSLIT

SEQ ID NO: 134425 - protein, 15 aa, Borrelia burgdorferi B31
DYKSLVLEIYNKIDN

SEQ ID NO: 134426 - protein, 9 aa, Borrelia burgdorferi B31
YKSLVLEIY

SEQ ID NO: 134427 - protein, 15 aa, Borrelia burgdorferi B31
LKSKIQNGKIIKAFQ

SEQ ID NO: 134428 - protein, 9 aa, Borrelia burgdorferi B31
IQNGKIIKA

SEQ ID NO: 134429 - protein, 15 aa, Borrelia burgdorferi B31
FLKSKIQNGKIIKAF

SEQ ID NO: 134430 - protein, 9 aa, Borrelia burgdorferi B31
IQNGKIIKA

SEQ ID NO: 134431 - protein, 15 aa, Borrelia burgdorferi B31
IKNQKNKTPSLDVLL

SEQ ID NO: 134432 - protein, 9 aa, Borrelia burgdorferi B31
IKNQKNKTP

SEQ ID NO: 134433 - protein, 15 aa, Borrelia burgdorferi B31
MIKMSLNYTEINTLI

SEQ ID NO: 134434 - protein, 9 aa, Borrelia burgdorferi B31
MIKMSLNYT

SEQ ID NO: 134435 - protein, 15 aa, Borrelia burgdorferi B31
NFKKNALKLRFSDFL

SEQ ID NO: 134436 - protein, 9 aa, Borrelia burgdorferi B31
FKKNALKLR

SEQ ID NO: 134437 - protein, 15 aa, Borrelia burgdorferi B31
FTNSLITKIIQPDYK

SEQ ID NO: 134438 - protein, 9 aa, Borrelia burgdorferi B31
FTNSLITKI

SEQ ID NO: 134439 - protein, 15 aa, Borrelia burgdorferi B31
LDVLLGAGNLCVFYT

SEQ ID NO: 134440 - protein, 9 aa, Borrelia burgdorferi B31
VLLGAGNLC

SEQ ID NO: 134441 - protein, 15 aa, Borrelia burgdorferi B31
DSLKQQIKLLENIEN

SEQ ID NO: 134442 - protein, 9 aa, Borrelia burgdorferi B31
LKQQIKLLE

SEQ ID NO: 134443 - protein, 15 aa, Borrelia burgdorferi B31
LVLEIYNKIDNKKFK

SEQ ID NO: 134444 - protein, 9 aa, Borrelia burgdorferi B31
IYNKIDNKK

SEQ ID NO: 134445 - protein, 15 aa, Borrelia burgdorferi B31
LIQSKITMLKVENLI

SEQ ID NO: 134446 - protein, 9 aa, Borrelia burgdorferi B31
IQSKITMLK

SEQ ID NO: 134447 - protein, 15 aa, Borrelia burgdorferi B31
SLVLEIYNKIDNKKF

SEQ ID NO: 134448 - protein, 9 aa, Borrelia burgdorferi B31
IYNKIDNKK

SEQ ID NO: 134449 - protein, 15 aa, Borrelia burgdorferi B31
SGKADLYYTQVKNLR

SEQ ID NO: 134450 - protein, 9 aa, Borrelia burgdorferi B31
LYYTQVKNL

SEQ ID NO: 134451 - protein, 15 aa, Borrelia burgdorferi B31
KIIQPDYKSLVLEIY

SEQ ID NO: 134452 - protein, 9 aa, Borrelia burgdorferi B31
IQPDYKSLV

SEQ ID NO: 134453 - protein, 15 aa, Borrelia burgdorferi B31
DMIILFIKLWPSSPN

SEQ ID NO: 134454 - protein, 9 aa, Borrelia burgdorferi B31
IILFIKLWP

SEQ ID NO: 134455 - protein, 15 aa, Borrelia burgdorferi B31
LICLNPNTTRFHITK

SEQ ID NO: 134456 - protein, 9 aa, Borrelia burgdorferi B31
LICLNPNTT

SEQ ID NO: 134457 - protein, 15 aa, Borrelia burgdorferi B31
KITMLKVENLIPEEE

SEQ ID NO: 134458 - protein, 9 aa, Borrelia burgdorferi B31
LKVENLIPE

SEQ ID NO: 134459 - protein, 15 aa, Borrelia burgdorferi B31
FKKNALKLRFSDFLK

SEQ ID NO: 134460 - protein, 9 aa, Borrelia burgdorferi B31
FKKNALKLR

SEQ ID NO: 134461 - protein, 15 aa, Borrelia burgdorferi B31
EILQKDMIILFIKLW

SEQ ID NO: 134462 - protein, 9 aa, Borrelia burgdorferi B31
LQKDMIILF

SEQ ID NO: 134463 - protein, 15 aa, Borrelia burgdorferi B31
NERIISLEILQKDMI

SEQ ID NO: 134464 - protein, 9 aa, Borrelia burgdorferi B31
IISLEILQK

SEQ ID NO: 134465 - protein, 15 aa, Borrelia burgdorferi B31
ERIISLEILQKDMII

SEQ ID NO: 134466 - protein, 9 aa, Borrelia burgdorferi B31
LEILQKDMI

SEQ ID NO: 134467 - protein, 15 aa, Borrelia burgdorferi B31
IILFIKLWPSSPNII

SEQ ID NO: 134468 - protein, 9 aa, Borrelia burgdorferi B31
IKLWPSSPN

SEQ ID NO: 134469 - protein, 15 aa, Borrelia burgdorferi B31
KKLGLVIPKAEKNLH

SEQ ID NO: 134470 - protein, 9 aa, Borrelia burgdorferi B31
LGLVIPKAE

SEQ ID NO: 134471 - protein, 15 aa, Borrelia burgdorferi B31
KSLVLEIYNKIDNKK

SEQ ID NO: 134472 - protein, 9 aa, Borrelia burgdorferi B31
LVLEIYNKI

SEQ ID NO: 134473 - protein, 15 aa, Borrelia burgdorferi B31
DVLLGAGNLCVFYTK

SEQ ID NO: 134474 - protein, 9 aa, Borrelia burgdorferi B31
AGNLCVFYT

SEQ ID NO: 134475 - protein, 15 aa, Borrelia burgdorferi B31
ILFIKLWPSSPNIIA

SEQ ID NO: 134476 - protein, 9 aa, Borrelia burgdorferi B31
IKLWPSSPN

SEQ ID NO: 134477 - protein, 15 aa, Borrelia burgdorferi B31
LNDQIKKTNIKELLI

SEQ ID NO: 134478 - protein, 9 aa, Borrelia burgdorferi B31
DQIKKTNIK

SEQ ID NO: 134479 - protein, 15 aa, Borrelia burgdorferi B31
ITMLKVENLIPEEEY

SEQ ID NO: 134480 - protein, 9 aa, Borrelia burgdorferi B31
LKVENLIPE

SEQ ID NO: 134481 - protein, 15 aa, Borrelia burgdorferi B31
SPNIIATNSNFKILD

SEQ ID NO: 134482 - protein, 9 aa, Borrelia burgdorferi B31
IATNSNFKI

SEQ ID NO: 134483 - protein, 15 aa, Borrelia burgdorferi B31
SSPNIIATNSNFKIL

SEQ ID NO: 134484 - protein, 9 aa, Borrelia burgdorferi B31
IATNSNFKI

SEQ ID NO: 134485 - protein, 15 aa, Borrelia burgdorferi B31
LEIYNKIDNKKFKIL

SEQ ID NO: 134486 - protein, 9 aa, Borrelia burgdorferi B31
IYNKIDNKK

SEQ ID NO: 134487 - protein, 15 aa, Borrelia burgdorferi B31
KNKKLGLVIPKAEKN

SEQ ID NO: 134488 - protein, 9 aa, Borrelia burgdorferi B31
LGLVIPKAE

SEQ ID NO: 134489 - protein, 15 aa, Borrelia burgdorferi B31
SLNDQIKKTNIKELL

SEQ ID NO: 134490 - protein, 9 aa, Borrelia burgdorferi B31
DQIKKTNIK

SEQ ID NO: 134491 - protein, 15 aa, Borrelia burgdorferi B31
VLLGAGNLCVFYTKL

SEQ ID NO: 134492 - protein, 9 aa, Borrelia burgdorferi B31
AGNLCVFYT

SEQ ID NO: 134493 - protein, 15 aa, Borrelia burgdorferi B31
PNIIATNSNFKILDA

SEQ ID NO: 134494 - protein, 9 aa, Borrelia burgdorferi B31
IATNSNFKI

SEQ ID NO: 134495 - protein, 15 aa, Borrelia burgdorferi B31
IQSKITMLKVENLIP

SEQ ID NO: 134496 - protein, 9 aa, Borrelia burgdorferi B31
IQSKITMLK

SEQ ID NO: 134497 - protein, 15 aa, Borrelia burgdorferi B31
ILQKDMIILFIKLWP

SEQ ID NO: 134498 - protein, 9 aa, Borrelia burgdorferi B31
LQKDMIILF

SEQ ID NO: 134499 - protein, 15 aa, Borrelia burgdorferi B31
IQKGIKEINLLNYKE

SEQ ID NO: 134500 - protein, 9 aa, Borrelia burgdorferi B31
IKEINLLNY

SEQ ID NO: 134501 - protein, 15 aa, Borrelia burgdorferi B31
MIILFIKLWPSSPNI

SEQ ID NO: 134502 - protein, 9 aa, Borrelia burgdorferi B31
IKLWPSSPN

SEQ ID NO: 134503 - protein, 15 aa, Borrelia burgdorferi B31
LFIKLWPSSPNIIAT

SEQ ID NO: 134504 - protein, 9 aa, Borrelia burgdorferi B31
IKLWPSSPN

SEQ ID NO: 134505 - protein, 15 aa, Borrelia burgdorferi B31
KIQKGIKEINLLNYK

SEQ ID NO: 134506 - protein, 9 aa, Borrelia burgdorferi B31
IKEINLLNY

SEQ ID NO: 134507 - protein, 15 aa, Borrelia burgdorferi B31
NKKLGLVIPKAEKNL

SEQ ID NO: 134508 - protein, 9 aa, Borrelia burgdorferi B31
LGLVIPKAE

SEQ ID NO: 134509 - protein, 15 aa, Borrelia burgdorferi B31
NKIQKGIKEINLLNY

SEQ ID NO: 134510 - protein, 9 aa, Borrelia burgdorferi B31
KGIKEINLL

SEQ ID NO: 134511 - protein, 15 aa, Borrelia burgdorferi B31
SDFLKSKIQNGKIIK

SEQ ID NO: 134512 - protein, 9 aa, Borrelia burgdorferi B31
LKSKIQNGK

SEQ ID NO: 134513 - protein, 15 aa, Borrelia burgdorferi B31
NSFKTIQNQLKDNLD

SEQ ID NO: 134514 - protein, 9 aa, Borrelia burgdorferi B31
IQNQLKDNL

SEQ ID NO: 134515 - protein, 15 aa, Borrelia burgdorferi B31
QSKITMLKVENLIPE

SEQ ID NO: 134516 - protein, 9 aa, Borrelia burgdorferi B31
ITMLKVENL

SEQ ID NO: 134517 - protein, 15 aa, Borrelia burgdorferi B31
NIIATNSNFKILDAY

SEQ ID NO: 134518 - protein, 9 aa, Borrelia burgdorferi B31
IATNSNFKI

SEQ ID NO: 134519 - protein, 15 aa, Borrelia burgdorferi B31
SKITMLKVENLIPEE

SEQ ID NO: 134520 - protein, 9 aa, Borrelia burgdorferi B31
LKVENLIPE

SEQ ID NO: 134521 - protein, 15 aa, Borrelia burgdorferi B31
IIQPDYKSLVLEIYN

SEQ ID NO: 134522 - protein, 9 aa, Borrelia burgdorferi B31
YKSLVLEIY

SEQ ID NO: 134523 - protein, 15 aa, Borrelia burgdorferi B31
ATNSNFKILDAYYRR

SEQ ID NO: 134524 - protein, 9 aa, Borrelia burgdorferi B31
FKILDAYYR

SEQ ID NO: 134525 - protein, 15 aa, Borrelia burgdorferi B31
KNSFKTIQNQLKDNL

SEQ ID NO: 134526 - protein, 9 aa, Borrelia burgdorferi B31
FKTIQNQLK

SEQ ID NO: 134527 - protein, 15 aa, Borrelia burgdorferi B31
EKRIDSLKQQIKLLE

SEQ ID NO: 134528 - protein, 9 aa, Borrelia burgdorferi B31
IDSLKQQIK

SEQ ID NO: 134529 - protein, 15 aa, Borrelia burgdorferi B31
IDSLKQQIKLLENIE

SEQ ID NO: 134530 - protein, 9 aa, Borrelia burgdorferi B31
LKQQIKLLE

SEQ ID NO: 134531 - protein, 15 aa, Borrelia burgdorferi B31
PSSPNIIATNSNFKI

SEQ ID NO: 134532 - protein, 9 aa, Borrelia burgdorferi B31
PNIIATNSN

SEQ ID NO: 134533 - protein, 15 aa, Borrelia burgdorferi B31
LQKDMIILFIKLWPS

SEQ ID NO: 134534 - protein, 9 aa, Borrelia burgdorferi B31
IILFIKLWP

SEQ ID NO: 134535 - protein, 15 aa, Borrelia burgdorferi B31
RIDSLKQQIKLLENI

SEQ ID NO: 134536 - protein, 9 aa, Borrelia burgdorferi B31
LKQQIKLLE

SEQ ID NO: 134537 - protein, 15 aa, Borrelia burgdorferi B31
QKGIKEINLLNYKEE

SEQ ID NO: 134538 - protein, 9 aa, Borrelia burgdorferi B31
IKEINLLNY

SEQ ID NO: 134539 - protein, 15 aa, Borrelia burgdorferi B31
IQPDYKSLVLEIYNK

SEQ ID NO: 134540 - protein, 9 aa, Borrelia burgdorferi B31
YKSLVLEIY

SEQ ID NO: 134541 - protein, 15 aa, Borrelia burgdorferi B31
DMIILFIKLWPSSPN

SEQ ID NO: 134542 - protein, 9 aa, Borrelia burgdorferi B31
LFIKLWPSS

SEQ ID NO: 134543 - protein, 15 aa, Borrelia burgdorferi B31
KDMIILFIKLWPSSP

SEQ ID NO: 134544 - protein, 9 aa, Borrelia burgdorferi B31
LFIKLWPSS

SEQ ID NO: 134545 - protein, 15 aa, Borrelia burgdorferi B31
MIILFIKLWPSSPNI

SEQ ID NO: 134546 - protein, 9 aa, Borrelia burgdorferi B31
LFIKLWPSS

SEQ ID NO: 134547 - protein, 15 aa, Borrelia burgdorferi B31
QKDMIILFIKLWPSS

SEQ ID NO: 134548 - protein, 9 aa, Borrelia burgdorferi B31
ILFIKLWPS

SEQ ID NO: 134549 - protein, 15 aa, Borrelia burgdorferi B31
IILFIKLWPSSPNII

SEQ ID NO: 134550 - protein, 9 aa, Borrelia burgdorferi B31
LFIKLWPSS

SEQ ID NO: 134551 - protein, 15 aa, Borrelia burgdorferi B31
VKNLRRVKNKKLGLV

SEQ ID NO: 134552 - protein, 9 aa, Borrelia burgdorferi B31
LRRVKNKKL

SEQ ID NO: 134553 - protein, 15 aa, Borrelia burgdorferi B31
ILFIKLWPSSPNIIA

SEQ ID NO: 134554 - protein, 9 aa, Borrelia burgdorferi B31
LFIKLWPSS

SEQ ID NO: 134555 - protein, 15 aa, Borrelia burgdorferi B31
KNLRRVKNKKLGLVI

SEQ ID NO: 134556 - protein, 9 aa, Borrelia burgdorferi B31
VKNKKLGLV

SEQ ID NO: 134557 - protein, 15 aa, Borrelia burgdorferi B31
NLRRVKNKKLGLVIP

SEQ ID NO: 134558 - protein, 9 aa, Borrelia burgdorferi B31
VKNKKLGLV

SEQ ID NO: 134559 - protein, 15 aa, Borrelia burgdorferi B31
LRRVKNKKLGLVIPK

SEQ ID NO: 134560 - protein, 9 aa, Borrelia burgdorferi B31
VKNKKLGLV

SEQ ID NO: 134561 - protein, 15 aa, Borrelia burgdorferi B31
LQKDMIILFIKLWPS

SEQ ID NO: 134562 - protein, 9 aa, Borrelia burgdorferi B31
IILFIKLWP

SEQ ID NO: 134563 - protein, 15 aa, Borrelia burgdorferi B31
RRVKNKKLGLVIPKA

SEQ ID NO: 134564 - protein, 9 aa, Borrelia burgdorferi B31
VKNKKLGLV

SEQ ID NO: 134565 - protein, 15 aa, Borrelia burgdorferi B31
LFIKLWPSSPNIIAT

SEQ ID NO: 134566 - protein, 9 aa, Borrelia burgdorferi B31
LFIKLWPSS

SEQ ID NO: 134567 - protein, 15 aa, Borrelia burgdorferi B31
KENALQYFKAYKKGK

SEQ ID NO: 134568 - protein, 9 aa, Borrelia burgdorferi B31
LQYFKAYKK

SEQ ID NO: 134569 - protein, 15 aa, Borrelia burgdorferi B31
DLYYTQVKNLRRVKN

SEQ ID NO: 134570 - protein, 9 aa, Borrelia burgdorferi B31
YTQVKNLRR

SEQ ID NO: 134571 - protein, 15 aa, Borrelia burgdorferi B31
ENALQYFKAYKKGKN

SEQ ID NO: 134572 - protein, 9 aa, Borrelia burgdorferi B31
LQYFKAYKK

SEQ ID NO: 134573 - protein, 15 aa, Borrelia burgdorferi B31
ADLYYTQVKNLRRVK

SEQ ID NO: 134574 - protein, 9 aa, Borrelia burgdorferi B31
YTQVKNLRR

SEQ ID NO: 134575 - protein, 15 aa, Borrelia burgdorferi B31
LYYTQVKNLRRVKNK

SEQ ID NO: 134576 - protein, 9 aa, Borrelia burgdorferi B31
YTQVKNLRR

SEQ ID NO: 134577 - protein, 15 aa, Borrelia burgdorferi B31
NALQYFKAYKKGKNS

SEQ ID NO: 134578 - protein, 9 aa, Borrelia burgdorferi B31
LQYFKAYKK

SEQ ID NO: 134579 - protein, 15 aa, Borrelia burgdorferi B31
KADLYYTQVKNLRRV

SEQ ID NO: 134580 - protein, 9 aa, Borrelia burgdorferi B31
YTQVKNLRR

SEQ ID NO: 134581 - protein, 15 aa, Borrelia burgdorferi B31
YTQVKNLRRVKNKKL

SEQ ID NO: 134582 - protein, 9 aa, Borrelia burgdorferi B31
YTQVKNLRR

SEQ ID NO: 134583 - protein, 15 aa, Borrelia burgdorferi B31
ATNSNFKILDAYYRR

SEQ ID NO: 134584 - protein, 9 aa, Borrelia burgdorferi B31
FKILDAYYR

SEQ ID NO: 134585 - protein, 15 aa, Borrelia burgdorferi B31
GNLCVFYTKLAKKSG

SEQ ID NO: 134586 - protein, 9 aa, Borrelia burgdorferi B31
VFYTKLAKK

SEQ ID NO: 134587 - protein, 15 aa, Borrelia burgdorferi B31
TNSNFKILDAYYRRP

SEQ ID NO: 134588 - protein, 9 aa, Borrelia burgdorferi B31
FKILDAYYR

SEQ ID NO: 134589 - protein, 15 aa, Borrelia burgdorferi B31
KGELILLNINKIQKG

SEQ ID NO: 134590 - protein, 9 aa, Borrelia burgdorferi B31
LLNINKIQK

SEQ ID NO: 134591 - protein, 15 aa, Borrelia burgdorferi B31
IATNSNFKILDAYYR

SEQ ID NO: 134592 - protein, 9 aa, Borrelia burgdorferi B31
SNFKILDAY

SEQ ID NO: 134593 - protein, 15 aa, Borrelia burgdorferi B31
NLCVFYTKLAKKSGK

SEQ ID NO: 134594 - protein, 9 aa, Borrelia burgdorferi B31
VFYTKLAKK

SEQ ID NO: 134595 - protein, 15 aa, Borrelia burgdorferi B31
LCVFYTKLAKKSGKA

SEQ ID NO: 134596 - protein, 9 aa, Borrelia burgdorferi B31
VFYTKLAKK

SEQ ID NO: 134597 - protein, 15 aa, Borrelia burgdorferi B31
SNFKILDAYYRRPKI

SEQ ID NO: 134598 - protein, 9 aa, Borrelia burgdorferi B31
FKILDAYYR

SEQ ID NO: 134599 - protein, 15 aa, Borrelia burgdorferi B31
NSNFKILDAYYRRPK

SEQ ID NO: 134600 - protein, 9 aa, Borrelia burgdorferi B31
FKILDAYYR

SEQ ID NO: 134601 - protein, 15 aa, Borrelia burgdorferi B31
AGNLCVFYTKLAKKS

SEQ ID NO: 134602 - protein, 9 aa, Borrelia burgdorferi B31
VFYTKLAKK

SEQ ID NO: 134603 - protein, 15 aa, Borrelia burgdorferi B31
EKGELILLNINKIQK

SEQ ID NO: 134604 - protein, 9 aa, Borrelia burgdorferi B31
LILLNINKI

SEQ ID NO: 134605 - protein, 15 aa, Borrelia burgdorferi B31
TQVKNLRRVKNKKLG

SEQ ID NO: 134606 - protein, 9 aa, Borrelia burgdorferi B31
LRRVKNKKL

SEQ ID NO: 134607 - protein, 15 aa, Borrelia burgdorferi B31
YYTQVKNLRRVKNKK

SEQ ID NO: 134608 - protein, 9 aa, Borrelia burgdorferi B31
YTQVKNLRR

SEQ ID NO: 134609 - protein, 15 aa, Borrelia burgdorferi B31
GELILLNINKIQKGI

SEQ ID NO: 134610 - protein, 9 aa, Borrelia burgdorferi B31
LLNINKIQK

SEQ ID NO: 134611 - protein, 15 aa, Borrelia burgdorferi B31
PKENALQYFKAYKKG

SEQ ID NO: 134612 - protein, 9 aa, Borrelia burgdorferi B31
LQYFKAYKK

SEQ ID NO: 134613 - protein, 15 aa, Borrelia burgdorferi B31
VKNKKLGLVIPKAEK

SEQ ID NO: 134614 - protein, 9 aa, Borrelia burgdorferi B31
VKNKKLGLV

SEQ ID NO: 134615 - protein, 15 aa, Borrelia burgdorferi B31
RVKNKKLGLVIPKAE

SEQ ID NO: 134616 - protein, 9 aa, Borrelia burgdorferi B31
VKNKKLGLV

SEQ ID NO: 134617 - protein, 15 aa, Borrelia burgdorferi B31
ILFIKLWPSSPNIIA

SEQ ID NO: 134618 - protein, 9 aa, Borrelia burgdorferi B31
LWPSSPNII

SEQ ID NO: 134619 - protein, 15 aa, Borrelia burgdorferi B31
IILFIKLWPSSPNII

SEQ ID NO: 134620 - protein, 9 aa, Borrelia burgdorferi B31
FIKLWPSSP

SEQ ID NO: 134621 - protein, 15 aa, Borrelia burgdorferi B31
LFIKLWPSSPNIIAT

SEQ ID NO: 134622 - protein, 9 aa, Borrelia burgdorferi B31
LWPSSPNII

SEQ ID NO: 134623 - protein, 15 aa, Borrelia burgdorferi B31
FIKLWPSSPNIIATN

SEQ ID NO: 134624 - protein, 9 aa, Borrelia burgdorferi B31
LWPSSPNII

SEQ ID NO: 134625 - protein, 15 aa, Borrelia burgdorferi B31
IKLWPSSPNIIATNS

SEQ ID NO: 134626 - protein, 9 aa, Borrelia burgdorferi B31
LWPSSPNII

SEQ ID NO: 134627 - protein, 15 aa, Borrelia burgdorferi B31
KKFKILICLNPNTTR

SEQ ID NO: 134628 - protein, 9 aa, Borrelia burgdorferi B31
LICLNPNTT

SEQ ID NO: 134629 - protein, 15 aa, Borrelia burgdorferi B31
FKILICLNPNTTRFH

SEQ ID NO: 134630 - protein, 9 aa, Borrelia burgdorferi B31
LICLNPNTT

SEQ ID NO: 134631 - protein, 15 aa, Borrelia burgdorferi B31
KILICLNPNTTRFHI

SEQ ID NO: 134632 - protein, 9 aa, Borrelia burgdorferi B31
LICLNPNTT

SEQ ID NO: 134633 - protein, 15 aa, Borrelia burgdorferi B31
KFKILICLNPNTTRF

SEQ ID NO: 134634 - protein, 9 aa, Borrelia burgdorferi B31
LICLNPNTT

SEQ ID NO: 134635 - protein, 15 aa, Borrelia burgdorferi B31
RIISLEILQKDMIIL

SEQ ID NO: 134636 - protein, 9 aa, Borrelia burgdorferi B31
LEILQKDMI

SEQ ID NO: 134637 - protein, 15 aa, Borrelia burgdorferi B31
NKKFKILICLNPNTT

SEQ ID NO: 134638 - protein, 9 aa, Borrelia burgdorferi B31
ILICLNPNT

SEQ ID NO: 134639 - protein, 15 aa, Borrelia burgdorferi B31
IISLEILQKDMIILF

SEQ ID NO: 134640 - protein, 9 aa, Borrelia burgdorferi B31
LEILQKDMI

SEQ ID NO: 134641 - protein, 15 aa, Borrelia burgdorferi B31
ISLEILQKDMIILFI

SEQ ID NO: 134642 - protein, 9 aa, Borrelia burgdorferi B31
LEILQKDMI

SEQ ID NO: 134643 - protein, 15 aa, Borrelia burgdorferi B31
MIILFIKLWPSSPNI

SEQ ID NO: 134644 - protein, 9 aa, Borrelia burgdorferi B31
IKLWPSSPN

SEQ ID NO: 134645 - protein, 15 aa, Borrelia burgdorferi B31
KKLGLVIPKAEKNLH

SEQ ID NO: 134646 - protein, 9 aa, Borrelia burgdorferi B31
LGLVIPKAE

SEQ ID NO: 134647 - protein, 15 aa, Borrelia burgdorferi B31
DMIILFIKLWPSSPN

SEQ ID NO: 134648 - protein, 9 aa, Borrelia burgdorferi B31
FIKLWPSSP

SEQ ID NO: 134649 - protein, 15 aa, Borrelia burgdorferi B31
KLGLVIPKAEKNLHI

SEQ ID NO: 134650 - protein, 9 aa, Borrelia burgdorferi B31
IPKAEKNLH

SEQ ID NO: 134651 - protein, 15 aa, Borrelia burgdorferi B31
LGLVIPKAEKNLHIK

SEQ ID NO: 134652 - protein, 9 aa, Borrelia burgdorferi B31
IPKAEKNLH

SEQ ID NO: 134653 - protein, 15 aa, Borrelia burgdorferi B31
GLVIPKAEKNLHIKL

SEQ ID NO: 134654 - protein, 9 aa, Borrelia burgdorferi B31
IPKAEKNLH

SEQ ID NO: 134655 - protein, 15 aa, Borrelia burgdorferi B31
LVIPKAEKNLHIKLD

SEQ ID NO: 134656 - protein, 9 aa, Borrelia burgdorferi B31
IPKAEKNLH

SEQ ID NO: 134657 - protein, 15 aa, Borrelia burgdorferi B31
ERIISLEILQKDMII

SEQ ID NO: 134658 - protein, 9 aa, Borrelia burgdorferi B31
LEILQKDMI

SEQ ID NO: 134659 - protein, 15 aa, Borrelia burgdorferi B31
NERIISLEILQKDMI

SEQ ID NO: 134660 - protein, 9 aa, Borrelia burgdorferi B31
ISLEILQKD

SEQ ID NO: 134661 - protein, 15 aa, Borrelia burgdorferi B31
GKADLYYTQVKNLRR

SEQ ID NO: 134662 - protein, 9 aa, Borrelia burgdorferi B31
YYTQVKNLR

SEQ ID NO: 134663 - protein, 15 aa, Borrelia burgdorferi B31
KADLYYTQVKNLRRV

SEQ ID NO: 134664 - protein, 9 aa, Borrelia burgdorferi B31
YYTQVKNLR

SEQ ID NO: 134665 - protein, 15 aa, Borrelia burgdorferi B31
ADLYYTQVKNLRRVK

SEQ ID NO: 134666 - protein, 9 aa, Borrelia burgdorferi B31
YYTQVKNLR

SEQ ID NO: 134667 - protein, 15 aa, Borrelia burgdorferi B31
KLWPSSPNIIATNSN

SEQ ID NO: 134668 - protein, 9 aa, Borrelia burgdorferi B31
LWPSSPNII

SEQ ID NO: 134669 - protein, 15 aa, Borrelia burgdorferi B31
DLYYTQVKNLRRVKN

SEQ ID NO: 134670 - protein, 9 aa, Borrelia burgdorferi B31
YYTQVKNLR

SEQ ID NO: 134671 - protein, 15 aa, Borrelia burgdorferi B31
DLYYTQVKNLRRVKN

SEQ ID NO: 134672 - protein, 9 aa, Borrelia burgdorferi B31
YYTQVKNLR

SEQ ID NO: 134673 - protein, 15 aa, Borrelia burgdorferi B31
KNSFKTIQNQLKDNL

SEQ ID NO: 134674 - protein, 9 aa, Borrelia burgdorferi B31
FKTIQNQLK

SEQ ID NO: 134675 - protein, 15 aa, Borrelia burgdorferi B31
GKADLYYTQVKNLRR

SEQ ID NO: 134676 - protein, 9 aa, Borrelia burgdorferi B31
YYTQVKNLR

SEQ ID NO: 134677 - protein, 15 aa, Borrelia burgdorferi B31
NSFKTIQNQLKDNLD

SEQ ID NO: 134678 - protein, 9 aa, Borrelia burgdorferi B31
FKTIQNQLK

SEQ ID NO: 134679 - protein, 15 aa, Borrelia burgdorferi B31
ADLYYTQVKNLRRVK

SEQ ID NO: 134680 - protein, 9 aa, Borrelia burgdorferi B31
YYTQVKNLR

SEQ ID NO: 134681 - protein, 15 aa, Borrelia burgdorferi B31
KADLYYTQVKNLRRV

SEQ ID NO: 134682 - protein, 9 aa, Borrelia burgdorferi B31
YYTQVKNLR

SEQ ID NO: 134683 - protein, 15 aa, Borrelia burgdorferi B31
KKGKNSFKTIQNQLK

SEQ ID NO: 134684 - protein, 9 aa, Borrelia burgdorferi B31
KKGKNSFKT

SEQ ID NO: 134685 - protein, 15 aa, Borrelia burgdorferi B31
KGKNSFKTIQNQLKD

SEQ ID NO: 134686 - protein, 9 aa, Borrelia burgdorferi B31
FKTIQNQLK

SEQ ID NO: 134687 - protein, 15 aa, Borrelia burgdorferi B31
GKNSFKTIQNQLKDN

SEQ ID NO: 134688 - protein, 9 aa, Borrelia burgdorferi B31
FKTIQNQLK

SEQ ID NO: 134689 - protein, 15 aa, Borrelia burgdorferi B31
LYYTQVKNLRRVKNK

SEQ ID NO: 134690 - protein, 9 aa, Borrelia burgdorferi B31
YTQVKNLRR

SEQ ID NO: 134691 - protein, 15 aa, Borrelia burgdorferi B31
LQYFKAYKKGKNSFK

SEQ ID NO: 134692 - protein, 9 aa, Borrelia burgdorferi B31
YFKAYKKGK

SEQ ID NO: 134693 - protein, 15 aa, Borrelia burgdorferi B31
NSNFKILDAYYRRPK

SEQ ID NO: 134694 - protein, 9 aa, Borrelia burgdorferi B31
FKILDAYYR

SEQ ID NO: 134695 - protein, 15 aa, Borrelia burgdorferi B31
SNFKILDAYYRRPKI

SEQ ID NO: 134696 - protein, 9 aa, Borrelia burgdorferi B31
FKILDAYYR

SEQ ID NO: 134697 - protein, 15 aa, Borrelia burgdorferi B31
TNSNFKILDAYYRRP

SEQ ID NO: 134698 - protein, 9 aa, Borrelia burgdorferi B31
FKILDAYYR

SEQ ID NO: 134699 - protein, 15 aa, Borrelia burgdorferi B31
YYTQVKNLRRVKNKK

SEQ ID NO: 134700 - protein, 9 aa, Borrelia burgdorferi B31
YYTQVKNLR

SEQ ID NO: 134701 - protein, 15 aa, Borrelia burgdorferi B31
QYFKAYKKGKNSFKT

SEQ ID NO: 134702 - protein, 9 aa, Borrelia burgdorferi B31
YKKGKNSFK

SEQ ID NO: 134703 - protein, 15 aa, Borrelia burgdorferi B31
YFKAYKKGKNSFKTI

SEQ ID NO: 134704 - protein, 9 aa, Borrelia burgdorferi B31
YKKGKNSFK

SEQ ID NO: 134705 - protein, 15 aa, Borrelia burgdorferi B31
GAYVFIKNQKNKTPS

SEQ ID NO: 134706 - protein, 9 aa, Borrelia burgdorferi B31
IKNQKNKTP

SEQ ID NO: 134707 - protein, 15 aa, Borrelia burgdorferi B31
PGAYVFIKNQKNKTP

SEQ ID NO: 134708 - protein, 9 aa, Borrelia burgdorferi B31
YVFIKNQKN

SEQ ID NO: 134709 - protein, 15 aa, Borrelia burgdorferi B31
ENALQYFKAYKKGKN

SEQ ID NO: 134710 - protein, 9 aa, Borrelia burgdorferi B31
YFKAYKKGK

SEQ ID NO: 134711 - protein, 15 aa, Borrelia burgdorferi B31
NALQYFKAYKKGKNS

SEQ ID NO: 134712 - protein, 9 aa, Borrelia burgdorferi B31
YFKAYKKGK

SEQ ID NO: 134713 - protein, 15 aa, Borrelia burgdorferi B31
SGKADLYYTQVKNLR

SEQ ID NO: 134714 - protein, 9 aa, Borrelia burgdorferi B31
ADLYYTQVK

SEQ ID NO: 134715 - protein, 15 aa, Borrelia burgdorferi B31
SFKTIQNQLKDNLDK

SEQ ID NO: 134716 - protein, 9 aa, Borrelia burgdorferi B31
FKTIQNQLK

SEQ ID NO: 134717 - protein, 15 aa, Borrelia burgdorferi B31
ATNSNFKILDAYYRR

SEQ ID NO: 134718 - protein, 9 aa, Borrelia burgdorferi B31
FKILDAYYR

SEQ ID NO: 134719 - protein, 15 aa, Borrelia burgdorferi B31
FKTIQNQLKDNLDKF

SEQ ID NO: 134720 - protein, 9 aa, Borrelia burgdorferi B31
FKTIQNQLK

SEQ ID NO: 134721 - protein, 15 aa, Borrelia burgdorferi B31
LIPEEEYNQEKTAIK

SEQ ID NO: 134722 - protein, 9 aa, Borrelia burgdorferi B31
LIPEEEYNQ

SEQ ID NO: 134723 - protein, 15 aa, Borrelia burgdorferi B31
FKAYKKGKNSFKTIQ

SEQ ID NO: 134724 - protein, 9 aa, Borrelia burgdorferi B31
YKKGKNSFK

SEQ ID NO: 134725 - protein, 15 aa, Borrelia burgdorferi B31
AYVFIKNQKNKTPSL

SEQ ID NO: 134726 - protein, 9 aa, Borrelia burgdorferi B31
IKNQKNKTP

SEQ ID NO: 134727 - protein, 15 aa, Borrelia burgdorferi B31
KAYKKGKNSFKTIQN

SEQ ID NO: 134728 - protein, 9 aa, Borrelia burgdorferi B31
YKKGKNSFK

SEQ ID NO: 134729 - protein, 15 aa, Borrelia burgdorferi B31
IATNSNFKILDAYYR

SEQ ID NO: 134730 - protein, 9 aa, Borrelia burgdorferi B31
IATNSNFKI

SEQ ID NO: 134731 - protein, 15 aa, Borrelia burgdorferi B31
NTTRFHITKKNFKKN

SEQ ID NO: 134732 - protein, 9 aa, Borrelia burgdorferi B31
FHITKKNFK

SEQ ID NO: 134733 - protein, 15 aa, Borrelia burgdorferi B31
KENALQYFKAYKKGK

SEQ ID NO: 134734 - protein, 9 aa, Borrelia burgdorferi B31
LQYFKAYKK

SEQ ID NO: 134735 - protein, 15 aa, Borrelia burgdorferi B31
PNTTRFHITKKNFKK

SEQ ID NO: 134736 - protein, 9 aa, Borrelia burgdorferi B31
FHITKKNFK

SEQ ID NO: 134737 - protein, 15 aa, Borrelia burgdorferi B31
TTRFHITKKNFKKNA

SEQ ID NO: 134738 - protein, 9 aa, Borrelia burgdorferi B31
FHITKKNFK

SEQ ID NO: 134739 - protein, 15 aa, Borrelia burgdorferi B31
YVFIKNQKNKTPSLD

SEQ ID NO: 134740 - protein, 9 aa, Borrelia burgdorferi B31
IKNQKNKTP

SEQ ID NO: 134741 - protein, 15 aa, Borrelia burgdorferi B31
YTQVKNLRRVKNKKL

SEQ ID NO: 134742 - protein, 9 aa, Borrelia burgdorferi B31
YTQVKNLRR

SEQ ID NO: 134743 - protein, 15 aa, Borrelia burgdorferi B31
ALQYFKAYKKGKNSF

SEQ ID NO: 134744 - protein, 9 aa, Borrelia burgdorferi B31
YFKAYKKGK

SEQ ID NO: 134745 - protein, 15 aa, Borrelia burgdorferi B31
NFKILDAYYRRPKIK

SEQ ID NO: 134746 - protein, 9 aa, Borrelia burgdorferi B31
FKILDAYYR

SEQ ID NO: 134747 - protein, 15 aa, Borrelia burgdorferi B31
TRFHITKKNFKKNAL

SEQ ID NO: 134748 - protein, 9 aa, Borrelia burgdorferi B31
FHITKKNFK

SEQ ID NO: 134749 - protein, 15 aa, Borrelia burgdorferi B31
FKILDAYYRRPKIKE

SEQ ID NO: 134750 - protein, 9 aa, Borrelia burgdorferi B31
FKILDAYYR

SEQ ID NO: 134751 - protein, 15 aa, Borrelia burgdorferi B31
PEEEYNQEKTAIKEK

SEQ ID NO: 134752 - protein, 9 aa, Borrelia burgdorferi B31
YNQEKTAIK

SEQ ID NO: 134753 - protein, 15 aa, Borrelia burgdorferi B31
NPNTTRFHITKKNFK

SEQ ID NO: 134754 - protein, 9 aa, Borrelia burgdorferi B31
RFHITKKNF

SEQ ID NO: 134755 - protein, 15 aa, Borrelia burgdorferi B31
IPEEEYNQEKTAIKE

SEQ ID NO: 134756 - protein, 9 aa, Borrelia burgdorferi B31
YNQEKTAIK

SEQ ID NO: 134757 - protein, 15 aa, Borrelia burgdorferi B31
EEEYNQEKTAIKEKE

SEQ ID NO: 134758 - protein, 9 aa, Borrelia burgdorferi B31
YNQEKTAIK

SEQ ID NO: 134759 - protein, 15 aa, Borrelia burgdorferi B31
EEYNQEKTAIKEKEK

SEQ ID NO: 134760 - protein, 9 aa, Borrelia burgdorferi B31
YNQEKTAIK

SEQ ID NO: 134761 - protein, 15 aa, Borrelia burgdorferi B31
VFIKNQKNKTPSLDV

SEQ ID NO: 134762 - protein, 9 aa, Borrelia burgdorferi B31
IKNQKNKTP

SEQ ID NO: 134763 - protein, 15 aa, Borrelia burgdorferi B31
YPGAYVFIKNQKNKT

SEQ ID NO: 134764 - protein, 9 aa, Borrelia burgdorferi B31
YVFIKNQKN

SEQ ID NO: 134765 - protein, 15 aa, Borrelia burgdorferi
VHQSFIPVPVHVTDK

SEQ ID NO: 134766 - protein, 9 aa, Borrelia burgdorferi
FIPVPVHVT

SEQ ID NO: 134767 - protein, 15 aa, Borrelia burgdorferi
LLVHQSFIPVPVHVT

SEQ ID NO: 134768 - protein, 9 aa, Borrelia burgdorferi
HQSFIPVPV

SEQ ID NO: 134769 - protein, 15 aa, Borrelia burgdorferi
LVHQSFIPVPVHVTD

SEQ ID NO: 134770 - protein, 9 aa, Borrelia burgdorferi
FIPVPVHVT

SEQ ID NO: 134771 - protein, 15 aa, Borrelia burgdorferi
HQSFIPVPVHVTDKY

SEQ ID NO: 134772 - protein, 9 aa, Borrelia burgdorferi
FIPVPVHVT

SEQ ID NO: 134773 - protein, 15 aa, Borrelia burgdorferi
QSFIPVPVHVTDKYG

SEQ ID NO: 134774 - protein, 9 aa, Borrelia burgdorferi
FIPVPVHVT

SEQ ID NO: 134775 - protein, 15 aa, Borrelia burgdorferi
ELGIRAIDSKTLEIT

SEQ ID NO: 134776 - protein, 9 aa, Borrelia burgdorferi
IRAIDSKTL

SEQ ID NO: 134777 - protein, 15 aa, Borrelia burgdorferi
LGIRAIDSKTLEITL

SEQ ID NO: 134778 - protein, 9 aa, Borrelia burgdorferi
IRAIDSKTL

SEQ ID NO: 134779 - protein, 15 aa, Borrelia burgdorferi
DSELGIRAIDSKTLE

SEQ ID NO: 134780 - protein, 9 aa, Borrelia burgdorferi
IRAIDSKTL

SEQ ID NO: 134781 - protein, 15 aa, Borrelia burgdorferi
TDSELGIRAIDSKTL

SEQ ID NO: 134782 - protein, 9 aa, Borrelia burgdorferi
ELGIRAIDS

SEQ ID NO: 134783 - protein, 15 aa, Borrelia burgdorferi
SELGIRAIDSKTLEI

SEQ ID NO: 134784 - protein, 9 aa, Borrelia burgdorferi
IRAIDSKTL

SEQ ID NO: 134785 - protein, 15 aa, Borrelia burgdorferi
TLYRGIVTGDPNTGG

SEQ ID NO: 134786 - protein, 9 aa, Borrelia burgdorferi
IVTGDPNTG

SEQ ID NO: 134787 - protein, 15 aa, Borrelia burgdorferi
DTLYRGIVTGDPNTG

SEQ ID NO: 134788 - protein, 9 aa, Borrelia burgdorferi
YRGIVTGDP

SEQ ID NO: 134789 - protein, 15 aa, Borrelia burgdorferi
MKLQRSLSLIIFSLT

SEQ ID NO: 134790 - protein, 9 aa, Borrelia burgdorferi
LQRSLSLII

SEQ ID NO: 134791 - protein, 15 aa, Borrelia burgdorferi
YRGIVTGDPNTGGHK

SEQ ID NO: 134792 - protein, 9 aa, Borrelia burgdorferi
IVTGDPNTG

SEQ ID NO: 134793 - protein, 15 aa, Borrelia burgdorferi
LYRGIVTGDPNTGGH

SEQ ID NO: 134794 - protein, 9 aa, Borrelia burgdorferi
IVTGDPNTG

SEQ ID NO: 134795 - protein, 15 aa, Borrelia burgdorferi
ITFYTTNDSSTAYKM

SEQ ID NO: 134796 - protein, 9 aa, Borrelia burgdorferi
YTTNDSSTA

SEQ ID NO: 134797 - protein, 15 aa, Borrelia burgdorferi
EEITFYTTNDSSTAY

SEQ ID NO: 134798 - protein, 9 aa, Borrelia burgdorferi
YTTNDSSTA

SEQ ID NO: 134799 - protein, 15 aa, Borrelia burgdorferi
SFIPVPVHVTDKYGQ

SEQ ID NO: 134800 - protein, 9 aa, Borrelia burgdorferi
FIPVPVHVT

SEQ ID NO: 134801 - protein, 15 aa, Borrelia burgdorferi
EITFYTTNDSSTAYK

SEQ ID NO: 134802 - protein, 9 aa, Borrelia burgdorferi
YTTNDSSTA

SEQ ID NO: 134803 - protein, 15 aa, Borrelia burgdorferi
LEEITFYTTNDSSTA

SEQ ID NO: 134804 - protein, 9 aa, Borrelia burgdorferi
ITFYTTNDS

SEQ ID NO: 134805 - protein, 15 aa, Borrelia burgdorferi
TFYTTNDSSTAYKMY

SEQ ID NO: 134806 - protein, 9 aa, Borrelia burgdorferi
YTTNDSSTA

SEQ ID NO: 134807 - protein, 15 aa, Borrelia burgdorferi
LRDNLTWSDGVAITA

SEQ ID NO: 134808 - protein, 9 aa, Borrelia burgdorferi
LTWSDGVAI

SEQ ID NO: 134809 - protein, 15 aa, Borrelia burgdorferi
FIPVPVHVTDKYGQN

SEQ ID NO: 134810 - protein, 9 aa, Borrelia burgdorferi
FIPVPVHVT

SEQ ID NO: 134811 - protein, 15 aa, Borrelia burgdorferi
RDNLTWSDGVAITAE

SEQ ID NO: 134812 - protein, 9 aa, Borrelia burgdorferi
LTWSDGVAI

SEQ ID NO: 134813 - protein, 15 aa, Borrelia burgdorferi
RGIVTGDPNTGGHKP

SEQ ID NO: 134814 - protein, 9 aa, Borrelia burgdorferi
IVTGDPNTG

SEQ ID NO: 134815 - protein, 15 aa, Borrelia burgdorferi
DNLTWSDGVAITAEG

SEQ ID NO: 134816 - protein, 9 aa, Borrelia burgdorferi
LTWSDGVAI

SEQ ID NO: 134817 - protein, 15 aa, Borrelia burgdorferi
TSPENMVTSGPFKLK

SEQ ID NO: 134818 - protein, 9 aa, Borrelia burgdorferi
MVTSGPFKL

SEQ ID NO: 134819 - protein, 15 aa, Borrelia burgdorferi
GIRAIDSKTLEITLA

SEQ ID NO: 134820 - protein, 9 aa, Borrelia burgdorferi
IRAIDSKTL

SEQ ID NO: 134821 - protein, 15 aa, Borrelia burgdorferi
NLTWSDGVAITAEGI

SEQ ID NO: 134822 - protein, 9 aa, Borrelia burgdorferi
LTWSDGVAI

SEQ ID NO: 134823 - protein, 15 aa, Borrelia burgdorferi
IRAIDSKTLEITLAS

SEQ ID NO: 134824 - protein, 9 aa, Borrelia burgdorferi
IRAIDSKTL

SEQ ID NO: 134825 - protein, 15 aa, Borrelia burgdorferi
LTWSDGVAITAEGIR

SEQ ID NO: 134826 - protein, 9 aa, Borrelia burgdorferi
LTWSDGVAI

SEQ ID NO: 134827 - protein, 15 aa, Borrelia burgdorferi
PENMVTSGPFKLKER

SEQ ID NO: 134828 - protein, 9 aa, Borrelia burgdorferi
MVTSGPFKL

SEQ ID NO: 134829 - protein, 15 aa, Borrelia burgdorferi
SPENMVTSGPFKLKE

SEQ ID NO: 134830 - protein, 9 aa, Borrelia burgdorferi
MVTSGPFKL

SEQ ID NO: 134831 - protein, 15 aa, Borrelia burgdorferi
WSDGVAITAEGIRKS

SEQ ID NO: 134832 - protein, 9 aa, Borrelia burgdorferi
GVAITAEGI

SEQ ID NO: 134833 - protein, 15 aa, Borrelia burgdorferi
GQNWTSPENMVTSGP

SEQ ID NO: 134834 - protein, 9 aa, Borrelia burgdorferi
WTSPENMVT

SEQ ID NO: 134835 - protein, 15 aa, Borrelia burgdorferi
SDGVAITAEGIRKSY

SEQ ID NO: 134836 - protein, 9 aa, Borrelia burgdorferi
ITAEGIRKS

SEQ ID NO: 134837 - protein, 15 aa, Borrelia burgdorferi
WTSPENMVTSGPFKL

SEQ ID NO: 134838 - protein, 9 aa, Borrelia burgdorferi
WTSPENMVT

SEQ ID NO: 134839 - protein, 15 aa, Borrelia burgdorferi
QNWTSPENMVTSGPF

SEQ ID NO: 134840 - protein, 9 aa, Borrelia burgdorferi
WTSPENMVT

SEQ ID NO: 134841 - protein, 15 aa, Borrelia burgdorferi
FYLRDNLTWSDGVAI

SEQ ID NO: 134842 - protein, 9 aa, Borrelia burgdorferi
LRDNLTWSD

SEQ ID NO: 134843 - protein, 15 aa, Borrelia burgdorferi
YLRDNLTWSDGVAIT

SEQ ID NO: 134844 - protein, 9 aa, Borrelia burgdorferi
LTWSDGVAI

SEQ ID NO: 134845 - protein, 15 aa, Borrelia burgdorferi
TLEITLASPKPYFID

SEQ ID NO: 134846 - protein, 9 aa, Borrelia burgdorferi
LASPKPYFI

SEQ ID NO: 134847 - protein, 15 aa, Borrelia burgdorferi
KTLEITLASPKPYFI

SEQ ID NO: 134848 - protein, 9 aa, Borrelia burgdorferi
ITLASPKPY

SEQ ID NO: 134849 - protein, 15 aa, Borrelia burgdorferi
ENMVTSGPFKLKERI

SEQ ID NO: 134850 - protein, 9 aa, Borrelia burgdorferi
MVTSGPFKL

SEQ ID NO: 134851 - protein, 15 aa, Borrelia burgdorferi
DKYGQNWTSPENMVT

SEQ ID NO: 134852 - protein, 9 aa, Borrelia burgdorferi
GQNWTSPEN

SEQ ID NO: 134853 - protein, 15 aa, Borrelia burgdorferi
KYGQNWTSPENMVTS

SEQ ID NO: 134854 - protein, 9 aa, Borrelia burgdorferi
WTSPENMVT

SEQ ID NO: 134855 - protein, 15 aa, Borrelia burgdorferi
GVAITAEGIRKSYLR

SEQ ID NO: 134856 - protein, 9 aa, Borrelia burgdorferi
ITAEGIRKS

SEQ ID NO: 134857 - protein, 15 aa, Borrelia burgdorferi
LEITLASPKPYFIDL

SEQ ID NO: 134858 - protein, 9 aa, Borrelia burgdorferi
LASPKPYFI

SEQ ID NO: 134859 - protein, 15 aa, Borrelia burgdorferi
DGVAITAEGIRKSYL

SEQ ID NO: 134860 - protein, 9 aa, Borrelia burgdorferi
ITAEGIRKS

SEQ ID NO: 134861 - protein, 15 aa, Borrelia burgdorferi
YGQNWTSPENMVTSG

SEQ ID NO: 134862 - protein, 9 aa, Borrelia burgdorferi
WTSPENMVT

SEQ ID NO: 134863 - protein, 15 aa, Borrelia burgdorferi
KSYLRILNKETGSTY

SEQ ID NO: 134864 - protein, 9 aa, Borrelia burgdorferi
ILNKETGST

SEQ ID NO: 134865 - protein, 15 aa, Borrelia burgdorferi
PYFIDLLVHQSFIPV

SEQ ID NO: 134866 - protein, 9 aa, Borrelia burgdorferi
FIDLLVHQS

SEQ ID NO: 134867 - protein, 15 aa, Borrelia burgdorferi
RKSYLRILNKETGST

SEQ ID NO: 134868 - protein, 9 aa, Borrelia burgdorferi
YLRILNKET

SEQ ID NO: 134869 - protein, 15 aa, Borrelia burgdorferi
GIVTGDPNTGGHKPG

SEQ ID NO: 134870 - protein, 9 aa, Borrelia burgdorferi
IVTGDPNTG

SEQ ID NO: 134871 - protein, 15 aa, Borrelia burgdorferi
EITLASPKPYFIDLL

SEQ ID NO: 134872 - protein, 9 aa, Borrelia burgdorferi
LASPKPYFI

SEQ ID NO: 134873 - protein, 15 aa, Borrelia burgdorferi
KPYFIDLLVHQSFIP

SEQ ID NO: 134874 - protein, 9 aa, Borrelia burgdorferi
FIDLLVHQS

SEQ ID NO: 134875 - protein, 15 aa, Borrelia burgdorferi
GAEPRSLDPQLAEDN

SEQ ID NO: 134876 - protein, 9 aa, Borrelia burgdorferi
PRSLDPQLA

SEQ ID NO: 134877 - protein, 15 aa, Borrelia burgdorferi
AEPRSLDPQLAEDNV

SEQ ID NO: 134878 - protein, 9 aa, Borrelia burgdorferi
PRSLDPQLA

SEQ ID NO: 134879 - protein, 15 aa, Borrelia burgdorferi
SPKPYFIDLLVHQSF

SEQ ID NO: 134880 - protein, 9 aa, Borrelia burgdorferi
FIDLLVHQS

SEQ ID NO: 134881 - protein, 15 aa, Borrelia burgdorferi
PKPYFIDLLVHQSFI

SEQ ID NO: 134882 - protein, 9 aa, Borrelia burgdorferi
FIDLLVHQS

SEQ ID NO: 134883 - protein, 15 aa, Borrelia burgdorferi
ASPKPYFIDLLVHQS

SEQ ID NO: 134884 - protein, 9 aa, Borrelia burgdorferi
YFIDLLVHQ

SEQ ID NO: 134885 - protein, 15 aa, Borrelia burgdorferi
FYTTNDSSTAYKMYV

SEQ ID NO: 134886 - protein, 9 aa, Borrelia burgdorferi
YTTNDSSTA

SEQ ID NO: 134887 - protein, 15 aa, Borrelia burgdorferi
EGVSTKISLGAEPRS

SEQ ID NO: 134888 - protein, 9 aa, Borrelia burgdorferi
VSTKISLGA

SEQ ID NO: 134889 - protein, 15 aa, Borrelia burgdorferi
VAITAEGIRKSYLRI

SEQ ID NO: 134890 - protein, 9 aa, Borrelia burgdorferi
ITAEGIRKS

SEQ ID NO: 134891 - protein, 15 aa, Borrelia burgdorferi
SYLRILNKETGSTYV

SEQ ID NO: 134892 - protein, 9 aa, Borrelia burgdorferi
ILNKETGST

SEQ ID NO: 134893 - protein, 15 aa, Borrelia burgdorferi
ITLASPKPYFIDLLV

SEQ ID NO: 134894 - protein, 9 aa, Borrelia burgdorferi
LASPKPYFI

SEQ ID NO: 134895 - protein, 15 aa, Borrelia burgdorferi
KLQRSLSLIIFSLTV

SEQ ID NO: 134896 - protein, 9 aa, Borrelia burgdorferi
LQRSLSLII

SEQ ID NO: 134897 - protein, 15 aa, Borrelia burgdorferi
LQRSLSLIIFSLTVL

SEQ ID NO: 134898 - protein, 9 aa, Borrelia burgdorferi
LQRSLSLII

SEQ ID NO: 134899 - protein, 15 aa, Borrelia burgdorferi
KERKEGVSTKISLGA

SEQ ID NO: 134900 - protein, 9 aa, Borrelia burgdorferi
RKEGVSTKI

SEQ ID NO: 134901 - protein, 15 aa, Borrelia burgdorferi
YLRILNKETGSTYVD

SEQ ID NO: 134902 - protein, 9 aa, Borrelia burgdorferi
ILNKETGST

SEQ ID NO: 134903 - protein, 15 aa, Borrelia burgdorferi
NMVTSGPFKLKERIP

SEQ ID NO: 134904 - protein, 9 aa, Borrelia burgdorferi
MVTSGPFKL

SEQ ID NO: 134905 - protein, 15 aa, Borrelia burgdorferi
ERKEGVSTKISLGAE

SEQ ID NO: 134906 - protein, 9 aa, Borrelia burgdorferi
VSTKISLGA

SEQ ID NO: 134907 - protein, 15 aa, Borrelia burgdorferi
YTTNDSSTAYKMYVN

SEQ ID NO: 134908 - protein, 9 aa, Borrelia burgdorferi
YTTNDSSTA

SEQ ID NO: 134909 - protein, 15 aa, Borrelia burgdorferi
KEGVSTKISLGAEPR

SEQ ID NO: 134910 - protein, 9 aa, Borrelia burgdorferi
VSTKISLGA

SEQ ID NO: 134911 - protein, 15 aa, Borrelia burgdorferi
AITAEGIRKSYLRIL

SEQ ID NO: 134912 - protein, 9 aa, Borrelia burgdorferi
ITAEGIRKS

SEQ ID NO: 134913 - protein, 15 aa, Borrelia burgdorferi
ITAEGIRKSYLRILN

SEQ ID NO: 134914 - protein, 9 aa, Borrelia burgdorferi
ITAEGIRKS

SEQ ID NO: 134915 - protein, 15 aa, Borrelia burgdorferi
RKEGVSTKISLGAEP

SEQ ID NO: 134916 - protein, 9 aa, Borrelia burgdorferi
VSTKISLGA

SEQ ID NO: 134917 - protein, 15 aa, Borrelia burgdorferi
FIDLLVHQSFIPVPV

SEQ ID NO: 134918 - protein, 9 aa, Borrelia burgdorferi
FIDLLVHQS

SEQ ID NO: 134919 - protein, 15 aa, Borrelia burgdorferi
LRILNKETGSTYVDM

SEQ ID NO: 134920 - protein, 9 aa, Borrelia burgdorferi
ILNKETGST

SEQ ID NO: 134921 - protein, 15 aa, Borrelia burgdorferi
ISLGAEPRSLDPQLA

SEQ ID NO: 134922 - protein, 9 aa, Borrelia burgdorferi
LGAEPRSLD

SEQ ID NO: 134923 - protein, 15 aa, Borrelia burgdorferi
IVTGDPNTGGHKPGL

SEQ ID NO: 134924 - protein, 9 aa, Borrelia burgdorferi
IVTGDPNTG

SEQ ID NO: 134925 - protein, 15 aa, Borrelia burgdorferi
NWTSPENMVTSGPFK

SEQ ID NO: 134926 - protein, 9 aa, Borrelia burgdorferi
WTSPENMVT

SEQ ID NO: 134927 - protein, 15 aa, Borrelia burgdorferi
VSTKISLGAEPRSLD

SEQ ID NO: 134928 - protein, 9 aa, Borrelia burgdorferi
VSTKISLGA

SEQ ID NO: 134929 - protein, 15 aa, Borrelia burgdorferi
EGIRKSYLRILNKET

SEQ ID NO: 134930 - protein, 9 aa, Borrelia burgdorferi
IRKSYLRIL

SEQ ID NO: 134931 - protein, 15 aa, Borrelia burgdorferi
GVSTKISLGAEPRSL

SEQ ID NO: 134932 - protein, 9 aa, Borrelia burgdorferi
VSTKISLGA

SEQ ID NO: 134933 - protein, 15 aa, Borrelia burgdorferi
RSLSLIIFSLTVLCC

SEQ ID NO: 134934 - protein, 9 aa, Borrelia burgdorferi
LIIFSLTVL

SEQ ID NO: 134935 - protein, 15 aa, Borrelia burgdorferi
DSKTLEITLASPKPY

SEQ ID NO: 134936 - protein, 9 aa, Borrelia burgdorferi
EITLASPKP

SEQ ID NO: 134937 - protein, 15 aa, Borrelia burgdorferi
SKTLEITLASPKPYF

SEQ ID NO: 134938 - protein, 9 aa, Borrelia burgdorferi
ITLASPKPY

SEQ ID NO: 134939 - protein, 15 aa, Borrelia burgdorferi
YFIDLLVHQSFIPVP

SEQ ID NO: 134940 - protein, 9 aa, Borrelia burgdorferi
FIDLLVHQS

SEQ ID NO: 134941 - protein, 15 aa, Borrelia burgdorferi
MIDTLYRGIVTGDPN

SEQ ID NO: 134942 - protein, 9 aa, Borrelia burgdorferi
YRGIVTGDP

SEQ ID NO: 134943 - protein, 15 aa, Borrelia burgdorferi
MVTSGPFKLKERIPS

SEQ ID NO: 134944 - protein, 9 aa, Borrelia burgdorferi
MVTSGPFKL

SEQ ID NO: 134945 - protein, 15 aa, Borrelia burgdorferi
KMIDTLYRGIVTGDP

SEQ ID NO: 134946 - protein, 9 aa, Borrelia burgdorferi
MIDTLYRGI

SEQ ID NO: 134947 - protein, 15 aa, Borrelia burgdorferi
SLSLIIFSLTVLCCD

SEQ ID NO: 134948 - protein, 9 aa, Borrelia burgdorferi
IFSLTVLCC

SEQ ID NO: 134949 - protein, 15 aa, Borrelia burgdorferi
PRSLDPQLAEDNVAS

SEQ ID NO: 134950 - protein, 9 aa, Borrelia burgdorferi
PRSLDPQLA

SEQ ID NO: 134951 - protein, 15 aa, Borrelia burgdorferi
LSLIIFSLTVLCCDN

SEQ ID NO: 134952 - protein, 9 aa, Borrelia burgdorferi
IFSLTVLCC

SEQ ID NO: 134953 - protein, 15 aa, Borrelia burgdorferi
IDTLYRGIVTGDPNT

SEQ ID NO: 134954 - protein, 9 aa, Borrelia burgdorferi
YRGIVTGDP

SEQ ID NO: 134955 - protein, 15 aa, Borrelia burgdorferi
EPRSLDPQLAEDNVA

SEQ ID NO: 134956 - protein, 9 aa, Borrelia burgdorferi
PRSLDPQLA

SEQ ID NO: 134957 - protein, 15 aa, Borrelia burgdorferi
SLGAEPRSLDPQLAE

SEQ ID NO: 134958 - protein, 9 aa, Borrelia burgdorferi
PRSLDPQLA

SEQ ID NO: 134959 - protein, 15 aa, Borrelia burgdorferi
IRKSYLRILNKETGS

SEQ ID NO: 134960 - protein, 9 aa, Borrelia burgdorferi
YLRILNKET

SEQ ID NO: 134961 - protein, 15 aa, Borrelia burgdorferi
GIRKSYLRILNKETG

SEQ ID NO: 134962 - protein, 9 aa, Borrelia burgdorferi
IRKSYLRIL

SEQ ID NO: 134963 - protein, 15 aa, Borrelia burgdorferi
DLLVHQSFIPVPVHV

SEQ ID NO: 134964 - protein, 9 aa, Borrelia burgdorferi
LVHQSFIPV

SEQ ID NO: 134965 - protein, 15 aa, Borrelia burgdorferi
LGAEPRSLDPQLAED

SEQ ID NO: 134966 - protein, 9 aa, Borrelia burgdorferi
PRSLDPQLA

SEQ ID NO: 134967 - protein, 15 aa, Borrelia burgdorferi
QRSLSLIIFSLTVLC

SEQ ID NO: 134968 - protein, 9 aa, Borrelia burgdorferi
LIIFSLTVL

SEQ ID NO: 134969 - protein, 15 aa, Borrelia burgdorferi
SLIIFSLTVLCCDNK

SEQ ID NO: 134970 - protein, 9 aa, Borrelia burgdorferi
IFSLTVLCC

SEQ ID NO: 134971 - protein, 15 aa, Borrelia burgdorferi
IDLLVHQSFIPVPVH

SEQ ID NO: 134972 - protein, 9 aa, Borrelia burgdorferi
LVHQSFIPV

SEQ ID NO: 134973 - protein, 15 aa, Borrelia burgdorferi
ASPKPYFIDLLVHQS

SEQ ID NO: 134974 - protein, 9 aa, Borrelia burgdorferi
YFIDLLVHQ

SEQ ID NO: 134975 - protein, 15 aa, Borrelia burgdorferi
SPKPYFIDLLVHQSF

SEQ ID NO: 134976 - protein, 9 aa, Borrelia burgdorferi
YFIDLLVHQ

SEQ ID NO: 134977 - protein, 15 aa, Borrelia burgdorferi
KPYFIDLLVHQSFIP

SEQ ID NO: 134978 - protein, 9 aa, Borrelia burgdorferi
YFIDLLVHQ

SEQ ID NO: 134979 - protein, 15 aa, Borrelia burgdorferi
PKPYFIDLLVHQSFI

SEQ ID NO: 134980 - protein, 9 aa, Borrelia burgdorferi
YFIDLLVHQ

SEQ ID NO: 134981 - protein, 15 aa, Borrelia burgdorferi
LASPKPYFIDLLVHQ

SEQ ID NO: 134982 - protein, 9 aa, Borrelia burgdorferi
PYFIDLLVH

SEQ ID NO: 134983 - protein, 15 aa, Borrelia burgdorferi
PYFIDLLVHQSFIPV

SEQ ID NO: 134984 - protein, 9 aa, Borrelia burgdorferi
YFIDLLVHQ

SEQ ID NO: 134985 - protein, 15 aa, Borrelia burgdorferi
YFIDLLVHQSFIPVP

SEQ ID NO: 134986 - protein, 9 aa, Borrelia burgdorferi
YFIDLLVHQ

SEQ ID NO: 134987 - protein, 15 aa, Borrelia burgdorferi
EEITFYTTNDSSTAY

SEQ ID NO: 134988 - protein, 9 aa, Borrelia burgdorferi
YTTNDSSTA

SEQ ID NO: 134989 - protein, 15 aa, Borrelia burgdorferi
EKYVFEKDNKYYDSN

SEQ ID NO: 134990 - protein, 9 aa, Borrelia burgdorferi
YVFEKDNKY

SEQ ID NO: 134991 - protein, 15 aa, Borrelia burgdorferi
SEKYVFEKDNKYYDS

SEQ ID NO: 134992 - protein, 9 aa, Borrelia burgdorferi
YVFEKDNKY

SEQ ID NO: 134993 - protein, 15 aa, Borrelia burgdorferi
PSEKYVFEKDNKYYD

SEQ ID NO: 134994 - protein, 9 aa, Borrelia burgdorferi
YVFEKDNKY

SEQ ID NO: 134995 - protein, 15 aa, Borrelia burgdorferi
RIPSEKYVFEKDNKY

SEQ ID NO: 134996 - protein, 9 aa, Borrelia burgdorferi
RIPSEKYVF

SEQ ID NO: 134997 - protein, 15 aa, Borrelia burgdorferi
IPSEKYVFEKDNKYY

SEQ ID NO: 134998 - protein, 9 aa, Borrelia burgdorferi
YVFEKDNKY

SEQ ID NO: 134999 - protein, 15 aa, Borrelia burgdorferi
LEEITFYTTNDSSTA

SEQ ID NO: 135000 - protein, 9 aa, Borrelia burgdorferi
ITFYTTNDS

SEQ ID NO: 135001 - protein, 15 aa, Borrelia burgdorferi
EITFYTTNDSSTAYK

SEQ ID NO: 135002 - protein, 9 aa, Borrelia burgdorferi
YTTNDSSTA

SEQ ID NO: 135003 - protein, 15 aa, Borrelia burgdorferi
ITFYTTNDSSTAYKM

SEQ ID NO: 135004 - protein, 9 aa, Borrelia burgdorferi
YTTNDSSTA

SEQ ID NO: 135005 - protein, 15 aa, Borrelia burgdorferi
RKSYLRILNKETGST

SEQ ID NO: 135006 - protein, 9 aa, Borrelia burgdorferi
YLRILNKET

SEQ ID NO: 135007 - protein, 15 aa, Borrelia burgdorferi
KSYLRILNKETGSTY

SEQ ID NO: 135008 - protein, 9 aa, Borrelia burgdorferi
ILNKETGST

SEQ ID NO: 135009 - protein, 15 aa, Borrelia burgdorferi
SYLRILNKETGSTYV

SEQ ID NO: 135010 - protein, 9 aa, Borrelia burgdorferi
ILNKETGST

SEQ ID NO: 135011 - protein, 15 aa, Borrelia burgdorferi
YLRILNKETGSTYVD

SEQ ID NO: 135012 - protein, 9 aa, Borrelia burgdorferi
ILNKETGST

SEQ ID NO: 135013 - protein, 15 aa, Borrelia burgdorferi
LRILNKETGSTYVDM

SEQ ID NO: 135014 - protein, 9 aa, Borrelia burgdorferi
ILNKETGST

SEQ ID NO: 135015 - protein, 15 aa, Borrelia burgdorferi
VTDKYGQNWTSPENM

SEQ ID NO: 135016 - protein, 9 aa, Borrelia burgdorferi
GQNWTSPEN

SEQ ID NO: 135017 - protein, 15 aa, Borrelia burgdorferi
HVTDKYGQNWTSPEN

SEQ ID NO: 135018 - protein, 9 aa, Borrelia burgdorferi
YGQNWTSPE

SEQ ID NO: 135019 - protein, 15 aa, Borrelia burgdorferi
TDKYGQNWTSPENMV

SEQ ID NO: 135020 - protein, 9 aa, Borrelia burgdorferi
GQNWTSPEN

SEQ ID NO: 135021 - protein, 15 aa, Borrelia burgdorferi
DKYGQNWTSPENMVT

SEQ ID NO: 135022 - protein, 9 aa, Borrelia burgdorferi
GQNWTSPEN

SEQ ID NO: 135023 - protein, 15 aa, Borrelia burgdorferi
KYGQNWTSPENMVTS

SEQ ID NO: 135024 - protein, 9 aa, Borrelia burgdorferi
GQNWTSPEN

SEQ ID NO: 135025 - protein, 15 aa, Borrelia burgdorferi
YGQNWTSPENMVTSG

SEQ ID NO: 135026 - protein, 9 aa, Borrelia burgdorferi
GQNWTSPEN

SEQ ID NO: 135027 - protein, 15 aa, Borrelia burgdorferi
GQNWTSPENMVTSGP

SEQ ID NO: 135028 - protein, 9 aa, Borrelia burgdorferi
GQNWTSPEN

SEQ ID NO: 135029 - protein, 15 aa, Borrelia burgdorferi
LVHQSFIPVPVHVTD

SEQ ID NO: 135030 - protein, 9 aa, Borrelia burgdorferi
HQSFIPVPV

SEQ ID NO: 135031 - protein, 15 aa, Borrelia burgdorferi
ELEEITFYTTNDSST

SEQ ID NO: 135032 - protein, 9 aa, Borrelia burgdorferi
ITFYTTNDS

SEQ ID NO: 135033 - protein, 15 aa, Borrelia burgdorferi
LEEITFYTTNDSSTA

SEQ ID NO: 135034 - protein, 9 aa, Borrelia burgdorferi
ITFYTTNDS

SEQ ID NO: 135035 - protein, 15 aa, Borrelia burgdorferi
EVELEEITFYTTNDS

SEQ ID NO: 135036 - protein, 9 aa, Borrelia burgdorferi
EITFYTTND

SEQ ID NO: 135037 - protein, 15 aa, Borrelia burgdorferi
LLVHQSFIPVPVHVT

SEQ ID NO: 135038 - protein, 9 aa, Borrelia burgdorferi
HQSFIPVPV

SEQ ID NO: 135039 - protein, 15 aa, Borrelia burgdorferi
VELEEITFYTTNDSS

SEQ ID NO: 135040 - protein, 9 aa, Borrelia burgdorferi
ITFYTTNDS

SEQ ID NO: 135041 - protein, 15 aa, Borrelia burgdorferi
YPFYLRDNLTWSDGV

SEQ ID NO: 135042 - protein, 9 aa, Borrelia burgdorferi
LRDNLTWSD

SEQ ID NO: 135043 - protein, 15 aa, Borrelia burgdorferi
PFYLRDNLTWSDGVA

SEQ ID NO: 135044 - protein, 9 aa, Borrelia burgdorferi
LRDNLTWSD

SEQ ID NO: 135045 - protein, 15 aa, Borrelia burgdorferi
TAYPFYLRDNLTWSD

SEQ ID NO: 135046 - protein, 9 aa, Borrelia burgdorferi
YLRDNLTWS

SEQ ID NO: 135047 - protein, 15 aa, Borrelia burgdorferi
FYLRDNLTWSDGVAI

SEQ ID NO: 135048 - protein, 9 aa, Borrelia burgdorferi
LRDNLTWSD

SEQ ID NO: 135049 - protein, 15 aa, Borrelia burgdorferi
EEITFYTTNDSSTAY

SEQ ID NO: 135050 - protein, 9 aa, Borrelia burgdorferi
ITFYTTNDS

SEQ ID NO: 135051 - protein, 15 aa, Borrelia burgdorferi
AYPFYLRDNLTWSDG

SEQ ID NO: 135052 - protein, 9 aa, Borrelia burgdorferi
LRDNLTWSD

SEQ ID NO: 135053 - protein, 15 aa, Borrelia burgdorferi
LLVHQSFIPVPVHVT

SEQ ID NO: 135054 - protein, 9 aa, Borrelia burgdorferi
SFIPVPVHV

SEQ ID NO: 135055 - protein, 15 aa, Borrelia burgdorferi
LVHQSFIPVPVHVTD

SEQ ID NO: 135056 - protein, 9 aa, Borrelia burgdorferi
FIPVPVHVT

SEQ ID NO: 135057 - protein, 15 aa, Borrelia burgdorferi
LGIRAIDSKTLEITL

SEQ ID NO: 135058 - protein, 9 aa, Borrelia burgdorferi
IRAIDSKTL

SEQ ID NO: 135059 - protein, 15 aa, Borrelia burgdorferi
VHQSFIPVPVHVTDK

SEQ ID NO: 135060 - protein, 9 aa, Borrelia burgdorferi
FIPVPVHVT

SEQ ID NO: 135061 - protein, 15 aa, Borrelia burgdorferi
HQSFIPVPVHVTDKY

SEQ ID NO: 135062 - protein, 9 aa, Borrelia burgdorferi
FIPVPVHVT

SEQ ID NO: 135063 - protein, 15 aa, Borrelia burgdorferi
ELGIRAIDSKTLEIT

SEQ ID NO: 135064 - protein, 9 aa, Borrelia burgdorferi
IRAIDSKTL

SEQ ID NO: 135065 - protein, 15 aa, Borrelia burgdorferi
MKLQRSLSLIIFSLT

SEQ ID NO: 135066 - protein, 9 aa, Borrelia burgdorferi
MKLQRSLSL

SEQ ID NO: 135067 - protein, 15 aa, Borrelia burgdorferi
SELGIRAIDSKTLEI

SEQ ID NO: 135068 - protein, 9 aa, Borrelia burgdorferi
IRAIDSKTL

SEQ ID NO: 135069 - protein, 15 aa, Borrelia burgdorferi
TDSELGIRAIDSKTL

SEQ ID NO: 135070 - protein, 9 aa, Borrelia burgdorferi
ELGIRAIDS

SEQ ID NO: 135071 - protein, 15 aa, Borrelia burgdorferi
DSELGIRAIDSKTLE

SEQ ID NO: 135072 - protein, 9 aa, Borrelia burgdorferi
IRAIDSKTL

SEQ ID NO: 135073 - protein, 15 aa, Borrelia burgdorferi
QSFIPVPVHVTDKYG

SEQ ID NO: 135074 - protein, 9 aa, Borrelia burgdorferi
FIPVPVHVT

SEQ ID NO: 135075 - protein, 15 aa, Borrelia burgdorferi
MVTSGPFKLKERIPS

SEQ ID NO: 135076 - protein, 9 aa, Borrelia burgdorferi
MVTSGPFKL

SEQ ID NO: 135077 - protein, 15 aa, Borrelia burgdorferi
VTSGPFKLKERIPSE

SEQ ID NO: 135078 - protein, 9 aa, Borrelia burgdorferi
FKLKERIPS

SEQ ID NO: 135079 - protein, 15 aa, Borrelia burgdorferi
SGPFKLKERIPSEKY

SEQ ID NO: 135080 - protein, 9 aa, Borrelia burgdorferi
FKLKERIPS

SEQ ID NO: 135081 - protein, 15 aa, Borrelia burgdorferi
GPFKLKERIPSEKYV

SEQ ID NO: 135082 - protein, 9 aa, Borrelia burgdorferi
FKLKERIPS

SEQ ID NO: 135083 - protein, 15 aa, Borrelia burgdorferi
TSGPFKLKERIPSEK

SEQ ID NO: 135084 - protein, 9 aa, Borrelia burgdorferi
FKLKERIPS

SEQ ID NO: 135085 - protein, 15 aa, Borrelia burgdorferi
SKTLEITLASPKPYF

SEQ ID NO: 135086 - protein, 9 aa, Borrelia burgdorferi
ITLASPKPY

SEQ ID NO: 135087 - protein, 15 aa, Borrelia burgdorferi
KTLEITLASPKPYFI

SEQ ID NO: 135088 - protein, 9 aa, Borrelia burgdorferi
ITLASPKPY

SEQ ID NO: 135089 - protein, 15 aa, Borrelia burgdorferi
DSKTLEITLASPKPY

SEQ ID NO: 135090 - protein, 9 aa, Borrelia burgdorferi
LEITLASPK

SEQ ID NO: 135091 - protein, 15 aa, Borrelia burgdorferi
TLEITLASPKPYFID

SEQ ID NO: 135092 - protein, 9 aa, Borrelia burgdorferi
ITLASPKPY

SEQ ID NO: 135093 - protein, 15 aa, Borrelia burgdorferi
LEITLASPKPYFIDL

SEQ ID NO: 135094 - protein, 9 aa, Borrelia burgdorferi
ITLASPKPY

SEQ ID NO: 135095 - protein, 15 aa, Borrelia burgdorferi
MKLQRSLSLIIFSLT

SEQ ID NO: 135096 - protein, 9 aa, Borrelia burgdorferi
LQRSLSLII

SEQ ID NO: 135097 - protein, 15 aa, Borrelia burgdorferi
KTLEITLASPKPYFI

SEQ ID NO: 135098 - protein, 9 aa, Borrelia burgdorferi
ITLASPKPY

SEQ ID NO: 135099 - protein, 15 aa, Borrelia burgdorferi
MVTSGPFKLKERIPS

SEQ ID NO: 135100 - protein, 9 aa, Borrelia burgdorferi
VTSGPFKLK

SEQ ID NO: 135101 - protein, 15 aa, Borrelia burgdorferi
VTSGPFKLKERIPSE

SEQ ID NO: 135102 - protein, 9 aa, Borrelia burgdorferi
FKLKERIPS

SEQ ID NO: 135103 - protein, 15 aa, Borrelia burgdorferi
TSGPFKLKERIPSEK

SEQ ID NO: 135104 - protein, 9 aa, Borrelia burgdorferi
FKLKERIPS

SEQ ID NO: 135105 - protein, 15 aa, Borrelia burgdorferi
SGPFKLKERIPSEKY

SEQ ID NO: 135106 - protein, 9 aa, Borrelia burgdorferi
FKLKERIPS

SEQ ID NO: 135107 - protein, 15 aa, Borrelia burgdorferi
GPFKLKERIPSEKYV

SEQ ID NO: 135108 - protein, 9 aa, Borrelia burgdorferi
FKLKERIPS

SEQ ID NO: 135109 - protein, 15 aa, Borrelia burgdorferi
QRSLSLIIFSLTVLC

SEQ ID NO: 135110 - protein, 9 aa, Borrelia burgdorferi
LSLIIFSLT

SEQ ID NO: 135111 - protein, 15 aa, Borrelia burgdorferi
RSLSLIIFSLTVLCC

SEQ ID NO: 135112 - protein, 9 aa, Borrelia burgdorferi
LSLIIFSLT

SEQ ID NO: 135113 - protein, 15 aa, Borrelia burgdorferi
LQRSLSLIIFSLTVL

SEQ ID NO: 135114 - protein, 9 aa, Borrelia burgdorferi
LSLIIFSLT

SEQ ID NO: 135115 - protein, 15 aa, Borrelia burgdorferi
LSLIIFSLTVLCCDN

SEQ ID NO: 135116 - protein, 9 aa, Borrelia burgdorferi
LIIFSLTVL

SEQ ID NO: 135117 - protein, 15 aa, Borrelia burgdorferi
SLSLIIFSLTVLCCD

SEQ ID NO: 135118 - protein, 9 aa, Borrelia burgdorferi
LIIFSLTVL

SEQ ID NO: 135119 - protein, 15 aa, Borrelia burgdorferi
STYVDMVKSIIKNGQ

SEQ ID NO: 135120 - protein, 9 aa, Borrelia burgdorferi
YVDMVKSII

SEQ ID NO: 135121 - protein, 15 aa, Borrelia burgdorferi
TYVDMVKSIIKNGQE

SEQ ID NO: 135122 - protein, 9 aa, Borrelia burgdorferi
VKSIIKNGQ

SEQ ID NO: 135123 - protein, 15 aa, Borrelia burgdorferi
YVDMVKSIIKNGQEY

SEQ ID NO: 135124 - protein, 9 aa, Borrelia burgdorferi
VKSIIKNGQ

SEQ ID NO: 135125 - protein, 15 aa, Borrelia burgdorferi
MKLQRSLSLIIFSLT

SEQ ID NO: 135126 - protein, 9 aa, Borrelia burgdorferi
LQRSLSLII

SEQ ID NO: 135127 - protein, 15 aa, Borrelia burgdorferi
VDMVKSIIKNGQEYF

SEQ ID NO: 135128 - protein, 9 aa, Borrelia burgdorferi
VKSIIKNGQ

SEQ ID NO: 135129 - protein, 15 aa, Borrelia burgdorferi
KSYLRILNKETGSTY

SEQ ID NO: 135130 - protein, 9 aa, Borrelia burgdorferi
LRILNKETG

SEQ ID NO: 135131 - protein, 15 aa, Borrelia burgdorferi
KLQRSLSLIIFSLTV

SEQ ID NO: 135132 - protein, 9 aa, Borrelia burgdorferi
LSLIIFSLT

SEQ ID NO: 135133 - protein, 15 aa, Borrelia burgdorferi
SYLRILNKETGSTYV

SEQ ID NO: 135134 - protein, 9 aa, Borrelia burgdorferi
LRILNKETG

SEQ ID NO: 135135 - protein, 15 aa, Borrelia burgdorferi
DMVKSIIKNGQEYFD

SEQ ID NO: 135136 - protein, 9 aa, Borrelia burgdorferi
VKSIIKNGQ

SEQ ID NO: 135137 - protein, 15 aa, Borrelia burgdorferi
SLIIFSLTVLCCDNK

SEQ ID NO: 135138 - protein, 9 aa, Borrelia burgdorferi
LIIFSLTVL

SEQ ID NO: 135139 - protein, 15 aa, Borrelia burgdorferi
KTLEITLASPKPYFI

SEQ ID NO: 135140 - protein, 9 aa, Borrelia burgdorferi
ITLASPKPY

SEQ ID NO: 135141 - protein, 15 aa, Borrelia burgdorferi
GSTYVDMVKSIIKNG

SEQ ID NO: 135142 - protein, 9 aa, Borrelia burgdorferi
YVDMVKSII

SEQ ID NO: 135143 - protein, 15 aa, Borrelia burgdorferi
DSKTLEITLASPKPY

SEQ ID NO: 135144 - protein, 9 aa, Borrelia burgdorferi
KTLEITLAS

SEQ ID NO: 135145 - protein, 15 aa, Borrelia burgdorferi
SKTLEITLASPKPYF

SEQ ID NO: 135146 - protein, 9 aa, Borrelia burgdorferi
ITLASPKPY

SEQ ID NO: 135147 - protein, 15 aa, Borrelia burgdorferi
TLEITLASPKPYFID

SEQ ID NO: 135148 - protein, 9 aa, Borrelia burgdorferi
ITLASPKPY

SEQ ID NO: 135149 - protein, 15 aa, Borrelia burgdorferi
LEITLASPKPYFIDL

SEQ ID NO: 135150 - protein, 9 aa, Borrelia burgdorferi
ITLASPKPY

SEQ ID NO: 135151 - protein, 15 aa, Borrelia burgdorferi
RKSYLRILNKETGST

SEQ ID NO: 135152 - protein, 9 aa, Borrelia burgdorferi
LRILNKETG

SEQ ID NO: 135153 - protein, 15 aa, Borrelia burgdorferi
LIIFSLTVLCCDNKE

SEQ ID NO: 135154 - protein, 9 aa, Borrelia burgdorferi
LIIFSLTVL

SEQ ID NO: 135155 - protein, 15 aa, Borrelia burgdorferi
YLRILNKETGSTYVD

SEQ ID NO: 135156 - protein, 9 aa, Borrelia burgdorferi
LRILNKETG

SEQ ID NO: 135157 - protein, 15 aa, Borrelia burgdorferi
LRILNKETGSTYVDM

SEQ ID NO: 135158 - protein, 9 aa, Borrelia burgdorferi
LRILNKETG

SEQ ID NO: 135159 - protein, 15 aa, Borrelia burgdorferi
IRKSYLRILNKETGS

SEQ ID NO: 135160 - protein, 9 aa, Borrelia burgdorferi
LRILNKETG

SEQ ID NO: 135161 - protein, 15 aa, Borrelia burgdorferi
ETGSTYVDMVKSIIK

SEQ ID NO: 135162 - protein, 9 aa, Borrelia burgdorferi
YVDMVKSII

SEQ ID NO: 135163 - protein, 15 aa, Borrelia burgdorferi
TGSTYVDMVKSIIKN

SEQ ID NO: 135164 - protein, 9 aa, Borrelia burgdorferi
YVDMVKSII

SEQ ID NO: 135165 - protein, 15 aa, Borrelia burgdorferi
GIRKSYLRILNKETG

SEQ ID NO: 135166 - protein, 9 aa, Borrelia burgdorferi
YLRILNKET

SEQ ID NO: 135167 - protein, 15 aa, Borrelia burgdorferi
MVTSGPFKLKERIPS

SEQ ID NO: 135168 - protein, 9 aa, Borrelia burgdorferi
MVTSGPFKL

SEQ ID NO: 135169 - protein, 15 aa, Borrelia burgdorferi
WTSPENMVTSGPFKL

SEQ ID NO: 135170 - protein, 9 aa, Borrelia burgdorferi
ENMVTSGPF

SEQ ID NO: 135171 - protein, 15 aa, Borrelia burgdorferi
TSPENMVTSGPFKLK

SEQ ID NO: 135172 - protein, 9 aa, Borrelia burgdorferi
MVTSGPFKL

SEQ ID NO: 135173 - protein, 15 aa, Borrelia burgdorferi
MVKSIIKNGQEYFDG

SEQ ID NO: 135174 - protein, 9 aa, Borrelia burgdorferi
VKSIIKNGQ

SEQ ID NO: 135175 - protein, 15 aa, Borrelia burgdorferi
SPENMVTSGPFKLKE

SEQ ID NO: 135176 - protein, 9 aa, Borrelia burgdorferi
MVTSGPFKL

SEQ ID NO: 135177 - protein, 15 aa, Borrelia burgdorferi
GPFKLKERIPSEKYV

SEQ ID NO: 135178 - protein, 9 aa, Borrelia burgdorferi
FKLKERIPS

SEQ ID NO: 135179 - protein, 15 aa, Borrelia burgdorferi
VKSIIKNGQEYFDGQ

SEQ ID NO: 135180 - protein, 9 aa, Borrelia burgdorferi
VKSIIKNGQ

SEQ ID NO: 135181 - protein, 15 aa, Borrelia burgdorferi
SGPFKLKERIPSEKY

SEQ ID NO: 135182 - protein, 9 aa, Borrelia burgdorferi
FKLKERIPS

SEQ ID NO: 135183 - protein, 15 aa, Borrelia burgdorferi
TSGPFKLKERIPSEK

SEQ ID NO: 135184 - protein, 9 aa, Borrelia burgdorferi
FKLKERIPS

SEQ ID NO: 135185 - protein, 15 aa, Borrelia burgdorferi
RKSYLRILNKETGST

SEQ ID NO: 135186 - protein, 9 aa, Borrelia burgdorferi
LRILNKETG

SEQ ID NO: 135187 - protein, 15 aa, Borrelia burgdorferi
KSYLRILNKETGSTY

SEQ ID NO: 135188 - protein, 9 aa, Borrelia burgdorferi
LRILNKETG

SEQ ID NO: 135189 - protein, 15 aa, Borrelia burgdorferi
GIRKSYLRILNKETG

SEQ ID NO: 135190 - protein, 9 aa, Borrelia burgdorferi
YLRILNKET

SEQ ID NO: 135191 - protein, 15 aa, Borrelia burgdorferi
IRKSYLRILNKETGS

SEQ ID NO: 135192 - protein, 9 aa, Borrelia burgdorferi
LRILNKETG

SEQ ID NO: 135193 - protein, 15 aa, Borrelia burgdorferi
SYLRILNKETGSTYV

SEQ ID NO: 135194 - protein, 9 aa, Borrelia burgdorferi
LRILNKETG

SEQ ID NO: 135195 - protein, 15 aa, Borrelia burgdorferi
LQRSLSLIIFSLTVL

SEQ ID NO: 135196 - protein, 9 aa, Borrelia burgdorferi
SLIIFSLTV

SEQ ID NO: 135197 - protein, 15 aa, Borrelia burgdorferi
QRSLSLIIFSLTVLC

SEQ ID NO: 135198 - protein, 9 aa, Borrelia burgdorferi
LIIFSLTVL

SEQ ID NO: 135199 - protein, 15 aa, Borrelia burgdorferi
RSLSLIIFSLTVLCC

SEQ ID NO: 135200 - protein, 9 aa, Borrelia burgdorferi
LIIFSLTVL

SEQ ID NO: 135201 - protein, 15 aa, Borrelia burgdorferi
SLSLIIFSLTVLCCD

SEQ ID NO: 135202 - protein, 9 aa, Borrelia burgdorferi
LIIFSLTVL

SEQ ID NO: 135203 - protein, 15 aa, Borrelia burgdorferi
YPFYLRDNLTWSDGV

SEQ ID NO: 135204 - protein, 9 aa, Borrelia burgdorferi
YLRDNLTWS

SEQ ID NO: 135205 - protein, 15 aa, Borrelia burgdorferi
LSLIIFSLTVLCCDN

SEQ ID NO: 135206 - protein, 9 aa, Borrelia burgdorferi
LIIFSLTVL

SEQ ID NO: 135207 - protein, 15 aa, Borrelia burgdorferi
PFYLRDNLTWSDGVA

SEQ ID NO: 135208 - protein, 9 aa, Borrelia burgdorferi
YLRDNLTWS

SEQ ID NO: 135209 - protein, 15 aa, Borrelia burgdorferi
YLRILNKETGSTYVD

SEQ ID NO: 135210 - protein, 9 aa, Borrelia burgdorferi
LRILNKETG

SEQ ID NO: 135211 - protein, 15 aa, Borrelia burgdorferi
AYPFYLRDNLTWSDG

SEQ ID NO: 135212 - protein, 9 aa, Borrelia burgdorferi
YLRDNLTWS

SEQ ID NO: 135213 - protein, 15 aa, Borrelia burgdorferi
GTAYPFYLRDNLTWS

SEQ ID NO: 135214 - protein, 9 aa, Borrelia burgdorferi
FYLRDNLTW

SEQ ID NO: 135215 - protein, 15 aa, Borrelia burgdorferi
LRILNKETGSTYVDM

SEQ ID NO: 135216 - protein, 9 aa, Borrelia burgdorferi
LRILNKETG

SEQ ID NO: 135217 - protein, 15 aa, Borrelia burgdorferi
TAYPFYLRDNLTWSD

SEQ ID NO: 135218 - protein, 9 aa, Borrelia burgdorferi
YLRDNLTWS

SEQ ID NO: 135219 - protein, 15 aa, Borrelia burgdorferi
YFIDLLVHQSFIPVP

SEQ ID NO: 135220 - protein, 9 aa, Borrelia burgdorferi
IDLLVHQSF

SEQ ID NO: 135221 - protein, 15 aa, Borrelia burgdorferi
FIDLLVHQSFIPVPV

SEQ ID NO: 135222 - protein, 9 aa, Borrelia burgdorferi
LVHQSFIPV

SEQ ID NO: 135223 - protein, 15 aa, Borrelia burgdorferi
IDLLVHQSFIPVPVH

SEQ ID NO: 135224 - protein, 9 aa, Borrelia burgdorferi
LVHQSFIPV

SEQ ID NO: 135225 - protein, 15 aa, Borrelia burgdorferi
PYFIDLLVHQSFIPV

SEQ ID NO: 135226 - protein, 9 aa, Borrelia burgdorferi
IDLLVHQSF

SEQ ID NO: 135227 - protein, 15 aa, Borrelia burgdorferi B31
ASLDKIKSLLSTAKS

SEQ ID NO: 135228 - protein, 9 aa, Borrelia burgdorferi B31
IKSLLSTAK

SEQ ID NO: 135229 - protein, 15 aa, Borrelia burgdorferi B31
KASLDKIKSLLSTAK

SEQ ID NO: 135230 - protein, 9 aa, Borrelia burgdorferi B31
LDKIKSLLS

SEQ ID NO: 135231 - protein, 15 aa, Borrelia burgdorferi B31
LDKIKSLLSTAKSYL

SEQ ID NO: 135232 - protein, 9 aa, Borrelia burgdorferi B31
IKSLLSTAK

SEQ ID NO: 135233 - protein, 15 aa, Borrelia burgdorferi B31
SLDKIKSLLSTAKSY

SEQ ID NO: 135234 - protein, 9 aa, Borrelia burgdorferi B31
IKSLLSTAK

SEQ ID NO: 135235 - protein, 15 aa, Borrelia burgdorferi B31
DKIKSLLSTAKSYLE

SEQ ID NO: 135236 - protein, 9 aa, Borrelia burgdorferi B31
IKSLLSTAK

SEQ ID NO: 135237 - protein, 15 aa, Borrelia burgdorferi B31
QFMADAKASMSSTKS

SEQ ID NO: 135238 - protein, 9 aa, Borrelia burgdorferi B31
MADAKASMS

SEQ ID NO: 135239 - protein, 15 aa, Borrelia burgdorferi B31
NKLFILTILFSSVIS

SEQ ID NO: 135240 - protein, 9 aa, Borrelia burgdorferi B31
LTILFSSVI

SEQ ID NO: 135241 - protein, 15 aa, Borrelia burgdorferi B31
KIKSLLSTAKSYLEQ

SEQ ID NO: 135242 - protein, 9 aa, Borrelia burgdorferi B31
IKSLLSTAK

SEQ ID NO: 135243 - protein, 15 aa, Borrelia burgdorferi B31
INKLFILTILFSSVI

SEQ ID NO: 135244 - protein, 9 aa, Borrelia burgdorferi B31
LFILTILFS

SEQ ID NO: 135245 - protein, 15 aa, Borrelia burgdorferi B31
LFILTILFSSVISCK

SEQ ID NO: 135246 - protein, 9 aa, Borrelia burgdorferi B31
LTILFSSVI

SEQ ID NO: 135247 - protein, 15 aa, Borrelia burgdorferi B31
IKSLLSTAKSYLEQT

SEQ ID NO: 135248 - protein, 9 aa, Borrelia burgdorferi B31
IKSLLSTAK

SEQ ID NO: 135249 - protein, 15 aa, Borrelia burgdorferi B31
RGVGSSKANLALLPS

SEQ ID NO: 135250 - protein, 9 aa, Borrelia burgdorferi B31
VGSSKANLA

SEQ ID NO: 135251 - protein, 15 aa, Borrelia burgdorferi B31
KLFILTILFSSVISC

SEQ ID NO: 135252 - protein, 9 aa, Borrelia burgdorferi B31
LTILFSSVI

SEQ ID NO: 135253 - protein, 15 aa, Borrelia burgdorferi B31
YHQFMADAKASMSST

SEQ ID NO: 135254 - protein, 9 aa, Borrelia burgdorferi B31
MADAKASMS

SEQ ID NO: 135255 - protein, 15 aa, Borrelia burgdorferi B31
GYHQFMADAKASMSS

SEQ ID NO: 135256 - protein, 9 aa, Borrelia burgdorferi B31
MADAKASMS

SEQ ID NO: 135257 - protein, 15 aa, Borrelia burgdorferi B31
QTRRGVGSSKANLAL

SEQ ID NO: 135258 - protein, 9 aa, Borrelia burgdorferi B31
VGSSKANLA

SEQ ID NO: 135259 - protein, 15 aa, Borrelia burgdorferi B31
EQTRRGVGSSKANLA

SEQ ID NO: 135260 - protein, 9 aa, Borrelia burgdorferi B31
RRGVGSSKA

SEQ ID NO: 135261 - protein, 15 aa, Borrelia burgdorferi B31
HQFMADAKASMSSTK

SEQ ID NO: 135262 - protein, 9 aa, Borrelia burgdorferi B31
MADAKASMS

SEQ ID NO: 135263 - protein, 15 aa, Borrelia burgdorferi B31
FILTILFSSVISCKL

SEQ ID NO: 135264 - protein, 9 aa, Borrelia burgdorferi B31
LTILFSSVI

SEQ ID NO: 135265 - protein, 15 aa, Borrelia burgdorferi B31
RRGVGSSKANLALLP

SEQ ID NO: 135266 - protein, 9 aa, Borrelia burgdorferi B31
VGSSKANLA

SEQ ID NO: 135267 - protein, 15 aa, Borrelia burgdorferi B31
AGYHQFMADAKASMS

SEQ ID NO: 135268 - protein, 9 aa, Borrelia burgdorferi B31
QFMADAKAS

SEQ ID NO: 135269 - protein, 15 aa, Borrelia burgdorferi B31
MNLINKLFILTILFS

SEQ ID NO: 135270 - protein, 9 aa, Borrelia burgdorferi B31
LINKLFILT

SEQ ID NO: 135271 - protein, 15 aa, Borrelia burgdorferi B31
TRRGVGSSKANLALL

SEQ ID NO: 135272 - protein, 9 aa, Borrelia burgdorferi B31
VGSSKANLA

SEQ ID NO: 135273 - protein, 15 aa, Borrelia burgdorferi B31
FMADAKASMSSTKSL

SEQ ID NO: 135274 - protein, 9 aa, Borrelia burgdorferi B31
MADAKASMS

SEQ ID NO: 135275 - protein, 15 aa, Borrelia burgdorferi B31
MADAKASMSSTKSLL

SEQ ID NO: 135276 - protein, 9 aa, Borrelia burgdorferi B31
MADAKASMS

SEQ ID NO: 135277 - protein, 15 aa, Borrelia burgdorferi B31
LINKLFILTILFSSV

SEQ ID NO: 135278 - protein, 9 aa, Borrelia burgdorferi B31
LFILTILFS

SEQ ID NO: 135279 - protein, 15 aa, Borrelia burgdorferi B31
GVGSSKANLALLPSL

SEQ ID NO: 135280 - protein, 9 aa, Borrelia burgdorferi B31
VGSSKANLA

SEQ ID NO: 135281 - protein, 15 aa, Borrelia burgdorferi B31
VGSSKANLALLPSLE

SEQ ID NO: 135282 - protein, 9 aa, Borrelia burgdorferi B31
VGSSKANLA

SEQ ID NO: 135283 - protein, 15 aa, Borrelia burgdorferi B31
GSSKANLALLPSLEE

SEQ ID NO: 135284 - protein, 9 aa, Borrelia burgdorferi B31
KANLALLPS

SEQ ID NO: 135285 - protein, 15 aa, Borrelia burgdorferi B31
NLINKLFILTILFSS

SEQ ID NO: 135286 - protein, 9 aa, Borrelia burgdorferi B31
LINKLFILT

SEQ ID NO: 135287 - protein, 15 aa, Borrelia burgdorferi B31
SSKANLALLPSLEEA

SEQ ID NO: 135288 - protein, 9 aa, Borrelia burgdorferi B31
LALLPSLEE

SEQ ID NO: 135289 - protein, 15 aa, Borrelia burgdorferi B31
ILTILFSSVISCKLY

SEQ ID NO: 135290 - protein, 9 aa, Borrelia burgdorferi B31
LTILFSSVI

SEQ ID NO: 135291 - protein, 15 aa, Borrelia burgdorferi B31
ADAKASMSSTKSLLE

SEQ ID NO: 135292 - protein, 9 aa, Borrelia burgdorferi B31
KASMSSTKS

SEQ ID NO: 135293 - protein, 15 aa, Borrelia burgdorferi B31
VKASLDKIKSLLSTA

SEQ ID NO: 135294 - protein, 9 aa, Borrelia burgdorferi B31
LDKIKSLLS

SEQ ID NO: 135295 - protein, 15 aa, Borrelia burgdorferi B31
ELNDIYKKLQDMDSR

SEQ ID NO: 135296 - protein, 9 aa, Borrelia burgdorferi B31
YKKLQDMDS

SEQ ID NO: 135297 - protein, 15 aa, Borrelia burgdorferi B31
KVKASLDKIKSLLST

SEQ ID NO: 135298 - protein, 9 aa, Borrelia burgdorferi B31
LDKIKSLLS

SEQ ID NO: 135299 - protein, 15 aa, Borrelia burgdorferi B31
QELNDIYKKLQDMDS

SEQ ID NO: 135300 - protein, 9 aa, Borrelia burgdorferi B31
LNDIYKKLQ

SEQ ID NO: 135301 - protein, 15 aa, Borrelia burgdorferi B31
DAKASMSSTKSLLEV

SEQ ID NO: 135302 - protein, 9 aa, Borrelia burgdorferi B31
KASMSSTKS

SEQ ID NO: 135303 - protein, 15 aa, Borrelia burgdorferi B31
SKANLALLPSLEEAI

SEQ ID NO: 135304 - protein, 9 aa, Borrelia burgdorferi B31
LALLPSLEE

SEQ ID NO: 135305 - protein, 15 aa, Borrelia burgdorferi B31
KANLALLPSLEEAIA

SEQ ID NO: 135306 - protein, 9 aa, Borrelia burgdorferi B31
LALLPSLEE

SEQ ID NO: 135307 - protein, 15 aa, Borrelia burgdorferi B31
LTILFSSVISCKLYK

SEQ ID NO: 135308 - protein, 9 aa, Borrelia burgdorferi B31
LTILFSSVI

SEQ ID NO: 135309 - protein, 15 aa, Borrelia burgdorferi B31
EAIAKVKSNHASADT

SEQ ID NO: 135310 - protein, 9 aa, Borrelia burgdorferi B31
IAKVKSNHA

SEQ ID NO: 135311 - protein, 15 aa, Borrelia burgdorferi B31
AKVKASLDKIKSLLS

SEQ ID NO: 135312 - protein, 9 aa, Borrelia burgdorferi B31
VKASLDKIK

SEQ ID NO: 135313 - protein, 15 aa, Borrelia burgdorferi B31
YAGYHQFMADAKASM

SEQ ID NO: 135314 - protein, 9 aa, Borrelia burgdorferi B31
QFMADAKAS

SEQ ID NO: 135315 - protein, 15 aa, Borrelia burgdorferi B31
EEAIAKVKSNHASAD

SEQ ID NO: 135316 - protein, 9 aa, Borrelia burgdorferi B31
IAKVKSNHA

SEQ ID NO: 135317 - protein, 15 aa, Borrelia burgdorferi B31
NDFEYAQRKADRALE

SEQ ID NO: 135318 - protein, 9 aa, Borrelia burgdorferi B31
YAQRKADRA

SEQ ID NO: 135319 - protein, 15 aa, Borrelia burgdorferi B31
DFEYAQRKADRALEE

SEQ ID NO: 135320 - protein, 9 aa, Borrelia burgdorferi B31
YAQRKADRA

SEQ ID NO: 135321 - protein, 15 aa, Borrelia burgdorferi B31
KNDFEYAQRKADRAL

SEQ ID NO: 135322 - protein, 9 aa, Borrelia burgdorferi B31
YAQRKADRA

SEQ ID NO: 135323 - protein, 15 aa, Borrelia burgdorferi B31
YYAGYHQFMADAKAS

SEQ ID NO: 135324 - protein, 9 aa, Borrelia burgdorferi B31
YYAGYHQFM

SEQ ID NO: 135325 - protein, 15 aa, Borrelia burgdorferi B31
FEYAQRKADRALEEA

SEQ ID NO: 135326 - protein, 9 aa, Borrelia burgdorferi B31
YAQRKADRA

SEQ ID NO: 135327 - protein, 15 aa, Borrelia burgdorferi B31
SLEEAIAKVKSNHAS

SEQ ID NO: 135328 - protein, 9 aa, Borrelia burgdorferi B31
IAKVKSNHA

SEQ ID NO: 135329 - protein, 15 aa, Borrelia burgdorferi B31
GSFNTLKSNDDSKRS

SEQ ID NO: 135330 - protein, 9 aa, Borrelia burgdorferi B31
FNTLKSNDD

SEQ ID NO: 135331 - protein, 15 aa, Borrelia burgdorferi B31
ANLALLPSLEEAIAK

SEQ ID NO: 135332 - protein, 9 aa, Borrelia burgdorferi B31
LALLPSLEE

SEQ ID NO: 135333 - protein, 15 aa, Borrelia burgdorferi B31
LEEAIAKVKSNHASA

SEQ ID NO: 135334 - protein, 9 aa, Borrelia burgdorferi B31
IAKVKSNHA

SEQ ID NO: 135335 - protein, 15 aa, Borrelia burgdorferi B31
AKNDFEYAQRKADRA

SEQ ID NO: 135336 - protein, 9 aa, Borrelia burgdorferi B31
FEYAQRKAD

SEQ ID NO: 135337 - protein, 15 aa, Borrelia burgdorferi B31
AIAKVKSNHASADTH

SEQ ID NO: 135338 - protein, 9 aa, Borrelia burgdorferi B31
VKSNHASAD

SEQ ID NO: 135339 - protein, 15 aa, Borrelia burgdorferi B31
PSLEEAIAKVKSNHA

SEQ ID NO: 135340 - protein, 9 aa, Borrelia burgdorferi B31
LEEAIAKVK

SEQ ID NO: 135341 - protein, 15 aa, Borrelia burgdorferi B31
NGSFNTLKSNDDSKR

SEQ ID NO: 135342 - protein, 9 aa, Borrelia burgdorferi B31
FNTLKSNDD

SEQ ID NO: 135343 - protein, 15 aa, Borrelia burgdorferi B31
IAKVKSNHASADTHC

SEQ ID NO: 135344 - protein, 9 aa, Borrelia burgdorferi B31
VKSNHASAD

SEQ ID NO: 135345 - protein, 15 aa, Borrelia burgdorferi B31
KSLLSTAKSYLEQTR

SEQ ID NO: 135346 - protein, 9 aa, Borrelia burgdorferi B31
LSTAKSYLE

SEQ ID NO: 135347 - protein, 15 aa, Borrelia burgdorferi B31
CKLYKKITYNADQVI

SEQ ID NO: 135348 - protein, 9 aa, Borrelia burgdorferi B31
LYKKITYNA

SEQ ID NO: 135349 - protein, 15 aa, Borrelia burgdorferi B31
RALEEALSNSNASRH

SEQ ID NO: 135350 - protein, 9 aa, Borrelia burgdorferi B31
LEEALSNSN

SEQ ID NO: 135351 - protein, 15 aa, Borrelia burgdorferi B31
AKASMSSTKSLLEVA

SEQ ID NO: 135352 - protein, 9 aa, Borrelia burgdorferi B31
KASMSSTKS

SEQ ID NO: 135353 - protein, 15 aa, Borrelia burgdorferi B31
PSLEEAIAKVKSNHA

SEQ ID NO: 135354 - protein, 9 aa, Borrelia burgdorferi B31
PSLEEAIAK

SEQ ID NO: 135355 - protein, 15 aa, Borrelia burgdorferi B31
SLEEAIAKVKSNHAS

SEQ ID NO: 135356 - protein, 9 aa, Borrelia burgdorferi B31
IAKVKSNHA

SEQ ID NO: 135357 - protein, 15 aa, Borrelia burgdorferi B31
LEEAIAKVKSNHASA

SEQ ID NO: 135358 - protein, 9 aa, Borrelia burgdorferi B31
IAKVKSNHA

SEQ ID NO: 135359 - protein, 15 aa, Borrelia burgdorferi B31
EEAIAKVKSNHASAD

SEQ ID NO: 135360 - protein, 9 aa, Borrelia burgdorferi B31
IAKVKSNHA

SEQ ID NO: 135361 - protein, 15 aa, Borrelia burgdorferi B31
EAIAKVKSNHASADT

SEQ ID NO: 135362 - protein, 9 aa, Borrelia burgdorferi B31
IAKVKSNHA

SEQ ID NO: 135363 - protein, 15 aa, Borrelia burgdorferi B31
IAKVKSNHASADTHC

SEQ ID NO: 135364 - protein, 9 aa, Borrelia burgdorferi B31
IAKVKSNHA

SEQ ID NO: 135365 - protein, 15 aa, Borrelia burgdorferi B31
AIAKVKSNHASADTH

SEQ ID NO: 135366 - protein, 9 aa, Borrelia burgdorferi B31
IAKVKSNHA

SEQ ID NO: 135367 - protein, 15 aa, Borrelia burgdorferi B31
RALEEALSNSNASRH

SEQ ID NO: 135368 - protein, 9 aa, Borrelia burgdorferi B31
EALSNSNAS

SEQ ID NO: 135369 - protein, 15 aa, Borrelia burgdorferi B31
DRALEEALSNSNASR

SEQ ID NO: 135370 - protein, 9 aa, Borrelia burgdorferi B31
EALSNSNAS

SEQ ID NO: 135371 - protein, 15 aa, Borrelia burgdorferi B31
ADRALEEALSNSNAS

SEQ ID NO: 135372 - protein, 9 aa, Borrelia burgdorferi B31
LEEALSNSN

SEQ ID NO: 135373 - protein, 15 aa, Borrelia burgdorferi B31
KASLDKIKSLLSTAK

SEQ ID NO: 135374 - protein, 9 aa, Borrelia burgdorferi B31
LDKIKSLLS

SEQ ID NO: 135375 - protein, 15 aa, Borrelia burgdorferi B31
ASLDKIKSLLSTAKS

SEQ ID NO: 135376 - protein, 9 aa, Borrelia burgdorferi B31
LDKIKSLLS

SEQ ID NO: 135377 - protein, 15 aa, Borrelia burgdorferi B31
LEEALSNSNASRHES

SEQ ID NO: 135378 - protein, 9 aa, Borrelia burgdorferi B31
EALSNSNAS

SEQ ID NO: 135379 - protein, 15 aa, Borrelia burgdorferi B31
ALEEALSNSNASRHE

SEQ ID NO: 135380 - protein, 9 aa, Borrelia burgdorferi B31
EALSNSNAS

SEQ ID NO: 135381 - protein, 15 aa, Borrelia burgdorferi B31
ISCKLYKKITYNADQ

SEQ ID NO: 135382 - protein, 9 aa, Borrelia burgdorferi B31
LYKKITYNA

SEQ ID NO: 135383 - protein, 15 aa, Borrelia burgdorferi B31
VISCKLYKKITYNAD

SEQ ID NO: 135384 - protein, 9 aa, Borrelia burgdorferi B31
LYKKITYNA

SEQ ID NO: 135385 - protein, 15 aa, Borrelia burgdorferi B31
SCKLYKKITYNADQV

SEQ ID NO: 135386 - protein, 9 aa, Borrelia burgdorferi B31
LYKKITYNA

SEQ ID NO: 135387 - protein, 15 aa, Borrelia burgdorferi B31
CKLYKKITYNADQVI

SEQ ID NO: 135388 - protein, 9 aa, Borrelia burgdorferi B31
LYKKITYNA

SEQ ID NO: 135389 - protein, 15 aa, Borrelia burgdorferi B31
NLINKLFILTILFSS

SEQ ID NO: 135390 - protein, 9 aa, Borrelia burgdorferi B31
LFILTILFS

SEQ ID NO: 135391 - protein, 15 aa, Borrelia burgdorferi B31
ADMQPDMQNDNSSSN

SEQ ID NO: 135392 - protein, 9 aa, Borrelia burgdorferi B31
MQPDMQNDN

SEQ ID NO: 135393 - protein, 15 aa, Borrelia burgdorferi B31
LINKLFILTILFSSV

SEQ ID NO: 135394 - protein, 9 aa, Borrelia burgdorferi B31
LFILTILFS

SEQ ID NO: 135395 - protein, 15 aa, Borrelia burgdorferi B31
NKLFILTILFSSVIS

SEQ ID NO: 135396 - protein, 9 aa, Borrelia burgdorferi B31
LFILTILFS

SEQ ID NO: 135397 - protein, 15 aa, Borrelia burgdorferi B31
INKLFILTILFSSVI

SEQ ID NO: 135398 - protein, 9 aa, Borrelia burgdorferi B31
LFILTILFS

SEQ ID NO: 135399 - protein, 15 aa, Borrelia burgdorferi B31
RSVDNTYMDQDTGKK

SEQ ID NO: 135400 - protein, 9 aa, Borrelia burgdorferi B31
VDNTYMDQD

SEQ ID NO: 135401 - protein, 15 aa, Borrelia burgdorferi B31
SVDNTYMDQDTGKKP

SEQ ID NO: 135402 - protein, 9 aa, Borrelia burgdorferi B31
YMDQDTGKK

SEQ ID NO: 135403 - protein, 15 aa, Borrelia burgdorferi B31
VDNTYMDQDTGKKPL

SEQ ID NO: 135404 - protein, 9 aa, Borrelia burgdorferi B31
YMDQDTGKK

SEQ ID NO: 135405 - protein, 15 aa, Borrelia burgdorferi B31
NTYMDQDTGKKPLMA

SEQ ID NO: 135406 - protein, 9 aa, Borrelia burgdorferi B31
YMDQDTGKK

SEQ ID NO: 135407 - protein, 15 aa, Borrelia burgdorferi B31
DNTYMDQDTGKKPLM

SEQ ID NO: 135408 - protein, 9 aa, Borrelia burgdorferi B31
YMDQDTGKK

SEQ ID NO: 135409 - protein, 15 aa, Borrelia burgdorferi B31
NKLFILTILFSSVIS

SEQ ID NO: 135410 - protein, 9 aa, Borrelia burgdorferi B31
ILTILFSSV

SEQ ID NO: 135411 - protein, 15 aa, Borrelia burgdorferi B31
INKLFILTILFSSVI

SEQ ID NO: 135412 - protein, 9 aa, Borrelia burgdorferi B31
ILTILFSSV

SEQ ID NO: 135413 - protein, 15 aa, Borrelia burgdorferi B31
LINKLFILTILFSSV

SEQ ID NO: 135414 - protein, 9 aa, Borrelia burgdorferi B31
LFILTILFS

SEQ ID NO: 135415 - protein, 15 aa, Borrelia burgdorferi B31
LFILTILFSSVISCK

SEQ ID NO: 135416 - protein, 9 aa, Borrelia burgdorferi B31
ILTILFSSV

SEQ ID NO: 135417 - protein, 15 aa, Borrelia burgdorferi B31
KLFILTILFSSVISC

SEQ ID NO: 135418 - protein, 9 aa, Borrelia burgdorferi B31
ILTILFSSV

SEQ ID NO: 135419 - protein, 15 aa, Borrelia burgdorferi B31
EEAIAKVKSNHASAD

SEQ ID NO: 135420 - protein, 9 aa, Borrelia burgdorferi B31
IAKVKSNHA

SEQ ID NO: 135421 - protein, 15 aa, Borrelia burgdorferi B31
EAIAKVKSNHASADT

SEQ ID NO: 135422 - protein, 9 aa, Borrelia burgdorferi B31
IAKVKSNHA

SEQ ID NO: 135423 - protein, 15 aa, Borrelia burgdorferi B31
RALEEALSNSNASRH

SEQ ID NO: 135424 - protein, 9 aa, Borrelia burgdorferi B31
LEEALSNSN

SEQ ID NO: 135425 - protein, 15 aa, Borrelia burgdorferi B31
GSSKANLALLPSLEE

SEQ ID NO: 135426 - protein, 9 aa, Borrelia burgdorferi B31
KANLALLPS

SEQ ID NO: 135427 - protein, 15 aa, Borrelia burgdorferi B31
SSKANLALLPSLEEA

SEQ ID NO: 135428 - protein, 9 aa, Borrelia burgdorferi B31
LALLPSLEE

SEQ ID NO: 135429 - protein, 15 aa, Borrelia burgdorferi B31
KANLALLPSLEEAIA

SEQ ID NO: 135430 - protein, 9 aa, Borrelia burgdorferi B31
LALLPSLEE

SEQ ID NO: 135431 - protein, 15 aa, Borrelia burgdorferi B31
SKANLALLPSLEEAI

SEQ ID NO: 135432 - protein, 9 aa, Borrelia burgdorferi B31
LALLPSLEE

SEQ ID NO: 135433 - protein, 15 aa, Borrelia burgdorferi B31
ANLALLPSLEEAIAK

SEQ ID NO: 135434 - protein, 9 aa, Borrelia burgdorferi B31
LALLPSLEE

SEQ ID NO: 135435 - protein, 15 aa, Borrelia burgdorferi B31
NLALLPSLEEAIAKV

SEQ ID NO: 135436 - protein, 9 aa, Borrelia burgdorferi B31
LALLPSLEE

SEQ ID NO: 135437 - protein, 15 aa, Borrelia burgdorferi B31
LALLPSLEEAIAKVK

SEQ ID NO: 135438 - protein, 9 aa, Borrelia burgdorferi B31
LALLPSLEE

SEQ ID NO: 135439 - protein, 15 aa, Borrelia burgdorferi B31
KSNNGSFNTLKSNDD

SEQ ID NO: 135440 - protein, 9 aa, Borrelia burgdorferi B31
NGSFNTLKS

SEQ ID NO: 135441 - protein, 15 aa, Borrelia burgdorferi B31
SNNGSFNTLKSNDDS

SEQ ID NO: 135442 - protein, 9 aa, Borrelia burgdorferi B31
FNTLKSNDD

SEQ ID NO: 135443 - protein, 15 aa, Borrelia burgdorferi B31
NNGSFNTLKSNDDSK

SEQ ID NO: 135444 - protein, 9 aa, Borrelia burgdorferi B31
FNTLKSNDD

SEQ ID NO: 135445 - protein, 15 aa, Borrelia burgdorferi B31
NGSFNTLKSNDDSKR

SEQ ID NO: 135446 - protein, 9 aa, Borrelia burgdorferi B31
FNTLKSNDD

SEQ ID NO: 135447 - protein, 15 aa, Borrelia burgdorferi B31
GSFNTLKSNDDSKRS

SEQ ID NO: 135448 - protein, 9 aa, Borrelia burgdorferi B31
FNTLKSNDD

SEQ ID NO: 135449 - protein, 15 aa, Borrelia burgdorferi B31
ADAKASMSSTKSLLE

SEQ ID NO: 135450 - protein, 9 aa, Borrelia burgdorferi B31
KASMSSTKS

SEQ ID NO: 135451 - protein, 15 aa, Borrelia burgdorferi B31
DAKASMSSTKSLLEV

SEQ ID NO: 135452 - protein, 9 aa, Borrelia burgdorferi B31
MSSTKSLLE

SEQ ID NO: 135453 - protein, 15 aa, Borrelia burgdorferi B31
KASMSSTKSLLEVAK

SEQ ID NO: 135454 - protein, 9 aa, Borrelia burgdorferi B31
MSSTKSLLE

SEQ ID NO: 135455 - protein, 15 aa, Borrelia burgdorferi B31
ASMSSTKSLLEVAKN

SEQ ID NO: 135456 - protein, 9 aa, Borrelia burgdorferi B31
MSSTKSLLE

SEQ ID NO: 135457 - protein, 15 aa, Borrelia burgdorferi B31
AKASMSSTKSLLEVA

SEQ ID NO: 135458 - protein, 9 aa, Borrelia burgdorferi B31
MSSTKSLLE

SEQ ID NO: 135459 - protein, 15 aa, Borrelia burgdorferi B31
KELNENMTKTNKDFQ

SEQ ID NO: 135460 - protein, 9 aa, Borrelia burgdorferi B31
ENMTKTNKD

SEQ ID NO: 135461 - protein, 15 aa, Borrelia burgdorferi B31
KQKELNENMTKTNKD

SEQ ID NO: 135462 - protein, 9 aa, Borrelia burgdorferi B31
LNENMTKTN

SEQ ID NO: 135463 - protein, 15 aa, Borrelia burgdorferi B31
QKELNENMTKTNKDF

SEQ ID NO: 135464 - protein, 9 aa, Borrelia burgdorferi B31
ENMTKTNKD

SEQ ID NO: 135465 - protein, 15 aa, Borrelia burgdorferi B31
ELNENMTKTNKDFQE

SEQ ID NO: 135466 - protein, 9 aa, Borrelia burgdorferi B31
ENMTKTNKD

SEQ ID NO: 135467 - protein, 15 aa, Borrelia burgdorferi B31
LNENMTKTNKDFQEL

SEQ ID NO: 135468 - protein, 9 aa, Borrelia burgdorferi B31
ENMTKTNKD

SEQ ID NO: 135469 - protein, 15 aa, Borrelia burgdorferi B31
ASLDKIKSLLSTAKS

SEQ ID NO: 135470 - protein, 9 aa, Borrelia burgdorferi B31
LDKIKSLLS

SEQ ID NO: 135471 - protein, 15 aa, Borrelia burgdorferi B31
KASLDKIKSLLSTAK

SEQ ID NO: 135472 - protein, 9 aa, Borrelia burgdorferi B31
LDKIKSLLS

SEQ ID NO: 135473 - protein, 15 aa, Borrelia burgdorferi B31
SFNTLKSNDDSKRSG

SEQ ID NO: 135474 - protein, 9 aa, Borrelia burgdorferi B31
FNTLKSNDD

SEQ ID NO: 135475 - protein, 15 aa, Borrelia burgdorferi B31
FNTLKSNDDSKRSGR

SEQ ID NO: 135476 - protein, 9 aa, Borrelia burgdorferi B31
FNTLKSNDD

SEQ ID NO: 135477 - protein, 15 aa, Borrelia burgdorferi B31
RALEEALSNSNASRH

SEQ ID NO: 135478 - protein, 9 aa, Borrelia burgdorferi B31
RALEEALSN

SEQ ID NO: 135479 - protein, 15 aa, Borrelia burgdorferi B31
ALEEALSNSNASRHE

SEQ ID NO: 135480 - protein, 9 aa, Borrelia burgdorferi B31
LSNSNASRH

SEQ ID NO: 135481 - protein, 15 aa, Borrelia burgdorferi B31
EEALSNSNASRHESY

SEQ ID NO: 135482 - protein, 9 aa, Borrelia burgdorferi B31
LSNSNASRH

SEQ ID NO: 135483 - protein, 15 aa, Borrelia burgdorferi B31
EALSNSNASRHESYY

SEQ ID NO: 135484 - protein, 9 aa, Borrelia burgdorferi B31
LSNSNASRH

SEQ ID NO: 135485 - protein, 15 aa, Borrelia burgdorferi B31
LEEALSNSNASRHES

SEQ ID NO: 135486 - protein, 9 aa, Borrelia burgdorferi B31
LSNSNASRH

SEQ ID NO: 135487 - protein, 15 aa, Borrelia burgdorferi B31
ALSNSNASRHESYYY

SEQ ID NO: 135488 - protein, 9 aa, Borrelia burgdorferi B31
LSNSNASRH

SEQ ID NO: 135489 - protein, 15 aa, Borrelia burgdorferi B31
LSNSNASRHESYYYA

SEQ ID NO: 135490 - protein, 9 aa, Borrelia burgdorferi B31
LSNSNASRH

SEQ ID NO: 135491 - protein, 15 aa, Borrelia burgdorferi B31
DKIKSLLSTAKSYLE

SEQ ID NO: 135492 - protein, 9 aa, Borrelia burgdorferi B31
LLSTAKSYL

SEQ ID NO: 135493 - protein, 15 aa, Borrelia burgdorferi B31
KIKSLLSTAKSYLEQ

SEQ ID NO: 135494 - protein, 9 aa, Borrelia burgdorferi B31
LLSTAKSYL

SEQ ID NO: 135495 - protein, 15 aa, Borrelia burgdorferi B31
IKSLLSTAKSYLEQT

SEQ ID NO: 135496 - protein, 9 aa, Borrelia burgdorferi B31
LLSTAKSYL

SEQ ID NO: 135497 - protein, 15 aa, Borrelia burgdorferi B31
KSLLSTAKSYLEQTR

SEQ ID NO: 135498 - protein, 9 aa, Borrelia burgdorferi B31
LLSTAKSYL

SEQ ID NO: 135499 - protein, 15 aa, Borrelia burgdorferi B31
FILTILFSSVISCKL

SEQ ID NO: 135500 - protein, 9 aa, Borrelia burgdorferi B31
LTILFSSVI

SEQ ID NO: 135501 - protein, 15 aa, Borrelia burgdorferi B31
INKLFILTILFSSVI

SEQ ID NO: 135502 - protein, 9 aa, Borrelia burgdorferi B31
ILTILFSSV

SEQ ID NO: 135503 - protein, 15 aa, Borrelia burgdorferi B31
NKLFILTILFSSVIS

SEQ ID NO: 135504 - protein, 9 aa, Borrelia burgdorferi B31
LTILFSSVI

SEQ ID NO: 135505 - protein, 15 aa, Borrelia burgdorferi B31
LFILTILFSSVISCK

SEQ ID NO: 135506 - protein, 9 aa, Borrelia burgdorferi B31
LTILFSSVI

SEQ ID NO: 135507 - protein, 15 aa, Borrelia burgdorferi B31
KLFILTILFSSVISC

SEQ ID NO: 135508 - protein, 9 aa, Borrelia burgdorferi B31
LTILFSSVI

SEQ ID NO: 135509 - protein, 15 aa, Borrelia burgdorferi B31
LDKIKSLLSTAKSYL

SEQ ID NO: 135510 - protein, 9 aa, Borrelia burgdorferi B31
SLLSTAKSY

SEQ ID NO: 135511 - protein, 15 aa, Borrelia burgdorferi B31
SLLSTAKSYLEQTRR

SEQ ID NO: 135512 - protein, 9 aa, Borrelia burgdorferi B31
LLSTAKSYL

SEQ ID NO: 135513 - protein, 15 aa, Borrelia burgdorferi B31
RALEEALSNSNASRH

SEQ ID NO: 135514 - protein, 9 aa, Borrelia burgdorferi B31
RALEEALSN

SEQ ID NO: 135515 - protein, 15 aa, Borrelia burgdorferi B31
ALEEALSNSNASRHE

SEQ ID NO: 135516 - protein, 9 aa, Borrelia burgdorferi B31
LSNSNASRH

SEQ ID NO: 135517 - protein, 15 aa, Borrelia burgdorferi B31
EEALSNSNASRHESY

SEQ ID NO: 135518 - protein, 9 aa, Borrelia burgdorferi B31
LSNSNASRH

SEQ ID NO: 135519 - protein, 15 aa, Borrelia burgdorferi B31
EALSNSNASRHESYY

SEQ ID NO: 135520 - protein, 9 aa, Borrelia burgdorferi B31
LSNSNASRH

SEQ ID NO: 135521 - protein, 15 aa, Borrelia burgdorferi B31
LEEALSNSNASRHES

SEQ ID NO: 135522 - protein, 9 aa, Borrelia burgdorferi B31
LSNSNASRH

SEQ ID NO: 135523 - protein, 15 aa, Borrelia burgdorferi B31
ALSNSNASRHESYYY

SEQ ID NO: 135524 - protein, 9 aa, Borrelia burgdorferi B31
LSNSNASRH

SEQ ID NO: 135525 - protein, 15 aa, Borrelia burgdorferi B31
LSNSNASRHESYYYA

SEQ ID NO: 135526 - protein, 9 aa, Borrelia burgdorferi B31
LSNSNASRH

SEQ ID NO: 135527 - protein, 15 aa, Borrelia burgdorferi B31
DKIKSLLSTAKSYLE

SEQ ID NO: 135528 - protein, 9 aa, Borrelia burgdorferi B31
LLSTAKSYL

SEQ ID NO: 135529 - protein, 15 aa, Borrelia burgdorferi B31
KIKSLLSTAKSYLEQ

SEQ ID NO: 135530 - protein, 9 aa, Borrelia burgdorferi B31
LLSTAKSYL

SEQ ID NO: 135531 - protein, 15 aa, Borrelia burgdorferi B31
IKSLLSTAKSYLEQT

SEQ ID NO: 135532 - protein, 9 aa, Borrelia burgdorferi B31
LLSTAKSYL

SEQ ID NO: 135533 - protein, 15 aa, Borrelia burgdorferi B31
KSLLSTAKSYLEQTR

SEQ ID NO: 135534 - protein, 9 aa, Borrelia burgdorferi B31
LLSTAKSYL

SEQ ID NO: 135535 - protein, 15 aa, Borrelia burgdorferi B31
FILTILFSSVISCKL

SEQ ID NO: 135536 - protein, 9 aa, Borrelia burgdorferi B31
LTILFSSVI

SEQ ID NO: 135537 - protein, 15 aa, Borrelia burgdorferi B31
INKLFILTILFSSVI

SEQ ID NO: 135538 - protein, 9 aa, Borrelia burgdorferi B31
ILTILFSSV

SEQ ID NO: 135539 - protein, 15 aa, Borrelia burgdorferi B31
NKLFILTILFSSVIS

SEQ ID NO: 135540 - protein, 9 aa, Borrelia burgdorferi B31
LTILFSSVI

SEQ ID NO: 135541 - protein, 15 aa, Borrelia burgdorferi B31
LFILTILFSSVISCK

SEQ ID NO: 135542 - protein, 9 aa, Borrelia burgdorferi B31
LTILFSSVI

SEQ ID NO: 135543 - protein, 15 aa, Borrelia burgdorferi B31
KLFILTILFSSVISC

SEQ ID NO: 135544 - protein, 9 aa, Borrelia burgdorferi B31
LTILFSSVI

SEQ ID NO: 135545 - protein, 15 aa, Borrelia burgdorferi B31
LDKIKSLLSTAKSYL

SEQ ID NO: 135546 - protein, 9 aa, Borrelia burgdorferi B31
SLLSTAKSY

SEQ ID NO: 135547 - protein, 15 aa, Borrelia burgdorferi B31
SLLSTAKSYLEQTRR

SEQ ID NO: 135548 - protein, 9 aa, Borrelia burgdorferi B31
LLSTAKSYL

SEQ ID NO: 135549 - protein, 15 aa, Borrelia burgdorferi B31
MNLINKLFILTILFS

SEQ ID NO: 135550 - protein, 9 aa, Borrelia burgdorferi B31
LINKLFILT

SEQ ID NO: 135551 - protein, 15 aa, Borrelia burgdorferi B31
NLINKLFILTILFSS

SEQ ID NO: 135552 - protein, 9 aa, Borrelia burgdorferi B31
LINKLFILT

SEQ ID NO: 135553 - protein, 15 aa, Borrelia burgdorferi B31
LINKLFILTILFSSV

SEQ ID NO: 135554 - protein, 9 aa, Borrelia burgdorferi B31
LINKLFILT

SEQ ID NO: 135555 - protein, 15 aa, Borrelia burgdorferi B31
INKLFILTILFSSVI

SEQ ID NO: 135556 - protein, 9 aa, Borrelia burgdorferi B31
LFILTILFS

SEQ ID NO: 135557 - protein, 15 aa, Borrelia burgdorferi B31
NKLFILTILFSSVIS

SEQ ID NO: 135558 - protein, 9 aa, Borrelia burgdorferi B31
LFILTILFS

SEQ ID NO: 135559 - protein, 15 aa, Borrelia burgdorferi B31
QVIDKLKSNNGSFNT

SEQ ID NO: 135560 - protein, 9 aa, Borrelia burgdorferi B31
LKSNNGSFN

SEQ ID NO: 135561 - protein, 15 aa, Borrelia burgdorferi B31
VIDKLKSNNGSFNTL

SEQ ID NO: 135562 - protein, 9 aa, Borrelia burgdorferi B31
LKSNNGSFN

SEQ ID NO: 135563 - protein, 15 aa, Borrelia burgdorferi B31
KLFILTILFSSVISC

SEQ ID NO: 135564 - protein, 9 aa, Borrelia burgdorferi B31
LTILFSSVI

SEQ ID NO: 135565 - protein, 15 aa, Borrelia burgdorferi B31
IDKLKSNNGSFNTLK

SEQ ID NO: 135566 - protein, 9 aa, Borrelia burgdorferi B31
LKSNNGSFN

SEQ ID NO: 135567 - protein, 15 aa, Borrelia burgdorferi B31
DKLKSNNGSFNTLKS

SEQ ID NO: 135568 - protein, 9 aa, Borrelia burgdorferi B31
LKSNNGSFN

SEQ ID NO: 135569 - protein, 15 aa, Borrelia burgdorferi B31
LFILTILFSSVISCK

SEQ ID NO: 135570 - protein, 9 aa, Borrelia burgdorferi B31
LTILFSSVI

SEQ ID NO: 135571 - protein, 15 aa, Borrelia burgdorferi B31
DQVIDKLKSNNGSFN

SEQ ID NO: 135572 - protein, 9 aa, Borrelia burgdorferi B31
IDKLKSNNG

SEQ ID NO: 135573 - protein, 15 aa, Borrelia burgdorferi B31
RGVGSSKANLALLPS

SEQ ID NO: 135574 - protein, 9 aa, Borrelia burgdorferi B31
VGSSKANLA

SEQ ID NO: 135575 - protein, 15 aa, Borrelia burgdorferi B31
NKLFILTILFSSVIS

SEQ ID NO: 135576 - protein, 9 aa, Borrelia burgdorferi B31
LFILTILFS

SEQ ID NO: 135577 - protein, 15 aa, Borrelia burgdorferi B31
INKLFILTILFSSVI

SEQ ID NO: 135578 - protein, 9 aa, Borrelia burgdorferi B31
LFILTILFS

SEQ ID NO: 135579 - protein, 15 aa, Borrelia burgdorferi B31
LINKLFILTILFSSV

SEQ ID NO: 135580 - protein, 9 aa, Borrelia burgdorferi B31
LFILTILFS

SEQ ID NO: 135581 - protein, 15 aa, Borrelia burgdorferi B31
NLINKLFILTILFSS

SEQ ID NO: 135582 - protein, 9 aa, Borrelia burgdorferi B31
LFILTILFS

SEQ ID NO: 135583 - protein, 15 aa, Borrelia burgdorferi B31
LFILTILFSSVISCK

SEQ ID NO: 135584 - protein, 9 aa, Borrelia burgdorferi B31
LTILFSSVI

SEQ ID NO: 135585 - protein, 15 aa, Borrelia burgdorferi B31
KLFILTILFSSVISC

SEQ ID NO: 135586 - protein, 9 aa, Borrelia burgdorferi B31
FILTILFSS

SEQ ID NO: 135587 - protein, 15 aa, Borrelia burgdorferi B31
ASLDKIKSLLSTAKS

SEQ ID NO: 135588 - protein, 9 aa, Borrelia burgdorferi B31
IKSLLSTAK

SEQ ID NO: 135589 - protein, 15 aa, Borrelia burgdorferi B31
KASLDKIKSLLSTAK

SEQ ID NO: 135590 - protein, 9 aa, Borrelia burgdorferi B31
LDKIKSLLS

SEQ ID NO: 135591 - protein, 15 aa, Borrelia burgdorferi B31
LDKIKSLLSTAKSYL

SEQ ID NO: 135592 - protein, 9 aa, Borrelia burgdorferi B31
IKSLLSTAK

SEQ ID NO: 135593 - protein, 15 aa, Borrelia burgdorferi B31
MNLINKLFILTILFS

SEQ ID NO: 135594 - protein, 9 aa, Borrelia burgdorferi B31
LINKLFILT

SEQ ID NO: 135595 - protein, 15 aa, Borrelia burgdorferi B31
DKIKSLLSTAKSYLE

SEQ ID NO: 135596 - protein, 9 aa, Borrelia burgdorferi B31
IKSLLSTAK

SEQ ID NO: 135597 - protein, 15 aa, Borrelia burgdorferi B31
FILTILFSSVISCKL

SEQ ID NO: 135598 - protein, 9 aa, Borrelia burgdorferi B31
LTILFSSVI

SEQ ID NO: 135599 - protein, 15 aa, Borrelia burgdorferi B31
SLDKIKSLLSTAKSY

SEQ ID NO: 135600 - protein, 9 aa, Borrelia burgdorferi B31
IKSLLSTAK

SEQ ID NO: 135601 - protein, 15 aa, Borrelia burgdorferi B31
GKKPLMADMQPDMQN

SEQ ID NO: 135602 - protein, 9 aa, Borrelia burgdorferi B31
MADMQPDMQ

SEQ ID NO: 135603 - protein, 15 aa, Borrelia burgdorferi B31
KKPLMADMQPDMQND

SEQ ID NO: 135604 - protein, 9 aa, Borrelia burgdorferi B31
MADMQPDMQ

SEQ ID NO: 135605 - protein, 15 aa, Borrelia burgdorferi B31
KPLMADMQPDMQNDN

SEQ ID NO: 135606 - protein, 9 aa, Borrelia burgdorferi B31
MADMQPDMQ

SEQ ID NO: 135607 - protein, 15 aa, Borrelia burgdorferi B31
PLMADMQPDMQNDNS

SEQ ID NO: 135608 - protein, 9 aa, Borrelia burgdorferi B31
MADMQPDMQ

SEQ ID NO: 135609 - protein, 15 aa, Borrelia burgdorferi B31
TGKKPLMADMQPDMQ

SEQ ID NO: 135610 - protein, 9 aa, Borrelia burgdorferi B31
LMADMQPDM

SEQ ID NO: 135611 - protein, 15 aa, Borrelia burgdorferi B31
LMADMQPDMQNDNSS

SEQ ID NO: 135612 - protein, 9 aa, Borrelia burgdorferi B31
MADMQPDMQ

SEQ ID NO: 135613 - protein, 15 aa, Borrelia burgdorferi B31
MADMQPDMQNDNSSS

SEQ ID NO: 135614 - protein, 9 aa, Borrelia burgdorferi B31
MADMQPDMQ

SEQ ID NO: 135615 - protein, 15 aa, Borrelia burgdorferi B31
TTNSILTQSAMAMIA

SEQ ID NO: 135616 - protein, 9 aa, Borrelia burgdorferi B31
ILTQSAMAM

SEQ ID NO: 135617 - protein, 15 aa, Borrelia burgdorferi B31
TNSILTQSAMAMIAQ

SEQ ID NO: 135618 - protein, 9 aa, Borrelia burgdorferi B31
ILTQSAMAM

SEQ ID NO: 135619 - protein, 15 aa, Borrelia burgdorferi B31
NSILTQSAMAMIAQA

SEQ ID NO: 135620 - protein, 9 aa, Borrelia burgdorferi B31
ILTQSAMAM

SEQ ID NO: 135621 - protein, 15 aa, Borrelia burgdorferi B31
ATTNSILTQSAMAMI

SEQ ID NO: 135622 - protein, 9 aa, Borrelia burgdorferi B31
ILTQSAMAM

SEQ ID NO: 135623 - protein, 15 aa, Borrelia burgdorferi B31
AATTNSILTQSAMAM

SEQ ID NO: 135624 - protein, 9 aa, Borrelia burgdorferi B31
TNSILTQSA

SEQ ID NO: 135625 - protein, 15 aa, Borrelia burgdorferi B31
QPAKINTPASLSGSQ

SEQ ID NO: 135626 - protein, 9 aa, Borrelia burgdorferi B31
INTPASLSG

SEQ ID NO: 135627 - protein, 15 aa, Borrelia burgdorferi B31
PAKINTPASLSGSQA

SEQ ID NO: 135628 - protein, 9 aa, Borrelia burgdorferi B31
INTPASLSG

SEQ ID NO: 135629 - protein, 15 aa, Borrelia burgdorferi B31
SILTQSAMAMIAQAN

SEQ ID NO: 135630 - protein, 9 aa, Borrelia burgdorferi B31
ILTQSAMAM

SEQ ID NO: 135631 - protein, 15 aa, Borrelia burgdorferi B31
MQPAKINTPASLSGS

SEQ ID NO: 135632 - protein, 9 aa, Borrelia burgdorferi B31
INTPASLSG

SEQ ID NO: 135633 - protein, 15 aa, Borrelia burgdorferi B31
AKINTPASLSGSQAS

SEQ ID NO: 135634 - protein, 9 aa, Borrelia burgdorferi B31
INTPASLSG

SEQ ID NO: 135635 - protein, 15 aa, Borrelia burgdorferi B31
ILTQSAMAMIAQANQ

SEQ ID NO: 135636 - protein, 9 aa, Borrelia burgdorferi B31
ILTQSAMAM

SEQ ID NO: 135637 - protein, 15 aa, Borrelia burgdorferi B31
GMQPAKINTPASLSG

SEQ ID NO: 135638 - protein, 9 aa, Borrelia burgdorferi B31
KINTPASLS

SEQ ID NO: 135639 - protein, 15 aa, Borrelia burgdorferi B31
NAIRMISDQRANLGA

SEQ ID NO: 135640 - protein, 9 aa, Borrelia burgdorferi B31
IRMISDQRA

SEQ ID NO: 135641 - protein, 15 aa, Borrelia burgdorferi B31
ENAIRMISDQRANLG

SEQ ID NO: 135642 - protein, 9 aa, Borrelia burgdorferi B31
IRMISDQRA

SEQ ID NO: 135643 - protein, 15 aa, Borrelia burgdorferi B31
ANLFSGEGAQTAQAA

SEQ ID NO: 135644 - protein, 9 aa, Borrelia burgdorferi B31
FSGEGAQTA

SEQ ID NO: 135645 - protein, 15 aa, Borrelia burgdorferi B31
ANVANLFSGEGAQTA

SEQ ID NO: 135646 - protein, 9 aa, Borrelia burgdorferi B31
VANLFSGEG

SEQ ID NO: 135647 - protein, 15 aa, Borrelia burgdorferi B31
VANLFSGEGAQTAQA

SEQ ID NO: 135648 - protein, 9 aa, Borrelia burgdorferi B31
FSGEGAQTA

SEQ ID NO: 135649 - protein, 15 aa, Borrelia burgdorferi B31
NLFSGEGAQTAQAAP

SEQ ID NO: 135650 - protein, 9 aa, Borrelia burgdorferi B31
FSGEGAQTA

SEQ ID NO: 135651 - protein, 15 aa, Borrelia burgdorferi B31
YNQMHMLSNKSASQN

SEQ ID NO: 135652 - protein, 9 aa, Borrelia burgdorferi B31
MHMLSNKSA

SEQ ID NO: 135653 - protein, 15 aa, Borrelia burgdorferi B31
NVANLFSGEGAQTAQ

SEQ ID NO: 135654 - protein, 9 aa, Borrelia burgdorferi B31
FSGEGAQTA

SEQ ID NO: 135655 - protein, 15 aa, Borrelia burgdorferi B31
EKVLVRMKELAVQSG

SEQ ID NO: 135656 - protein, 9 aa, Borrelia burgdorferi B31
VRMKELAVQ

SEQ ID NO: 135657 - protein, 15 aa, Borrelia burgdorferi B31
KVLVRMKELAVQSGN

SEQ ID NO: 135658 - protein, 9 aa, Borrelia burgdorferi B31
MKELAVQSG

SEQ ID NO: 135659 - protein, 15 aa, Borrelia burgdorferi B31
QAQYNQMHMLSNKSA

SEQ ID NO: 135660 - protein, 9 aa, Borrelia burgdorferi B31
YNQMHMLSN

SEQ ID NO: 135661 - protein, 15 aa, Borrelia burgdorferi B31
AQYNQMHMLSNKSAS

SEQ ID NO: 135662 - protein, 9 aa, Borrelia burgdorferi B31
MHMLSNKSA

SEQ ID NO: 135663 - protein, 15 aa, Borrelia burgdorferi B31
NQMHMLSNKSASQNV

SEQ ID NO: 135664 - protein, 9 aa, Borrelia burgdorferi B31
MHMLSNKSA

SEQ ID NO: 135665 - protein, 15 aa, Borrelia burgdorferi B31
AEELGMQPAKINTPA

SEQ ID NO: 135666 - protein, 9 aa, Borrelia burgdorferi B31
LGMQPAKIN

SEQ ID NO: 135667 - protein, 15 aa, Borrelia burgdorferi B31
VLVRMKELAVQSGNG

SEQ ID NO: 135668 - protein, 9 aa, Borrelia burgdorferi B31
MKELAVQSG

SEQ ID NO: 135669 - protein, 15 aa, Borrelia burgdorferi B31
TAEELGMQPAKINTP

SEQ ID NO: 135670 - protein, 9 aa, Borrelia burgdorferi B31
LGMQPAKIN

SEQ ID NO: 135671 - protein, 15 aa, Borrelia burgdorferi B31
QYNQMHMLSNKSASQ

SEQ ID NO: 135672 - protein, 9 aa, Borrelia burgdorferi B31
MHMLSNKSA

SEQ ID NO: 135673 - protein, 15 aa, Borrelia burgdorferi B31
AKIENAIRMISDQRA

SEQ ID NO: 135674 - protein, 9 aa, Borrelia burgdorferi B31
IENAIRMIS

SEQ ID NO: 135675 - protein, 15 aa, Borrelia burgdorferi B31
ATMTDEVVAATTNSI

SEQ ID NO: 135676 - protein, 9 aa, Borrelia burgdorferi B31
MTDEVVAAT

SEQ ID NO: 135677 - protein, 15 aa, Borrelia burgdorferi B31
LVRMKELAVQSGNGT

SEQ ID NO: 135678 - protein, 9 aa, Borrelia burgdorferi B31
MKELAVQSG

SEQ ID NO: 135679 - protein, 15 aa, Borrelia burgdorferi B31
MTDEVVAATTNSILT

SEQ ID NO: 135680 - protein, 9 aa, Borrelia burgdorferi B31
VVAATTNSI

SEQ ID NO: 135681 - protein, 15 aa, Borrelia burgdorferi B31
TDEVVAATTNSILTQ

SEQ ID NO: 135682 - protein, 9 aa, Borrelia burgdorferi B31
VVAATTNSI

SEQ ID NO: 135683 - protein, 15 aa, Borrelia burgdorferi B31
DEVVAATTNSILTQS

SEQ ID NO: 135684 - protein, 9 aa, Borrelia burgdorferi B31
VVAATTNSI

SEQ ID NO: 135685 - protein, 15 aa, Borrelia burgdorferi B31
RTAEELGMQPAKINT

SEQ ID NO: 135686 - protein, 9 aa, Borrelia burgdorferi B31
LGMQPAKIN

SEQ ID NO: 135687 - protein, 15 aa, Borrelia burgdorferi B31
EELGMQPAKINTPAS

SEQ ID NO: 135688 - protein, 9 aa, Borrelia burgdorferi B31
LGMQPAKIN

SEQ ID NO: 135689 - protein, 15 aa, Borrelia burgdorferi B31
TMTDEVVAATTNSIL

SEQ ID NO: 135690 - protein, 9 aa, Borrelia burgdorferi B31
VVAATTNSI

SEQ ID NO: 135691 - protein, 15 aa, Borrelia burgdorferi B31
VRMKELAVQSGNGTY

SEQ ID NO: 135692 - protein, 9 aa, Borrelia burgdorferi B31
MKELAVQSG

SEQ ID NO: 135693 - protein, 15 aa, Borrelia burgdorferi B31
VRTAEELGMQPAKIN

SEQ ID NO: 135694 - protein, 9 aa, Borrelia burgdorferi B31
ELGMQPAKI

SEQ ID NO: 135695 - protein, 15 aa, Borrelia burgdorferi B31
IENAIRMISDQRANL

SEQ ID NO: 135696 - protein, 9 aa, Borrelia burgdorferi B31
IRMISDQRA

SEQ ID NO: 135697 - protein, 15 aa, Borrelia burgdorferi B31
KIENAIRMISDQRAN

SEQ ID NO: 135698 - protein, 9 aa, Borrelia burgdorferi B31
IRMISDQRA

SEQ ID NO: 135699 - protein, 15 aa, Borrelia burgdorferi B31
INTPASLSGSQASWT

SEQ ID NO: 135700 - protein, 9 aa, Borrelia burgdorferi B31
INTPASLSG

SEQ ID NO: 135701 - protein, 15 aa, Borrelia burgdorferi B31
EYAIENLKASYAQIK

SEQ ID NO: 135702 - protein, 9 aa, Borrelia burgdorferi B31
IENLKASYA

SEQ ID NO: 135703 - protein, 15 aa, Borrelia burgdorferi B31
YAIENLKASYAQIKD

SEQ ID NO: 135704 - protein, 9 aa, Borrelia burgdorferi B31
IENLKASYA

SEQ ID NO: 135705 - protein, 15 aa, Borrelia burgdorferi B31
KINTPASLSGSQASW

SEQ ID NO: 135706 - protein, 9 aa, Borrelia burgdorferi B31
INTPASLSG

SEQ ID NO: 135707 - protein, 15 aa, Borrelia burgdorferi B31
LFSGEGAQTAQAAPV

SEQ ID NO: 135708 - protein, 9 aa, Borrelia burgdorferi B31
FSGEGAQTA

SEQ ID NO: 135709 - protein, 15 aa, Borrelia burgdorferi B31
FSGEGAQTAQAAPVQ

SEQ ID NO: 135710 - protein, 9 aa, Borrelia burgdorferi B31
FSGEGAQTA

SEQ ID NO: 135711 - protein, 15 aa, Borrelia burgdorferi B31
AIRMISDQRANLGAF

SEQ ID NO: 135712 - protein, 9 aa, Borrelia burgdorferi B31
IRMISDQRA

SEQ ID NO: 135713 - protein, 15 aa, Borrelia burgdorferi B31
IRMISDQRANLGAFQ

SEQ ID NO: 135714 - protein, 9 aa, Borrelia burgdorferi B31
IRMISDQRA

SEQ ID NO: 135715 - protein, 15 aa, Borrelia burgdorferi B31
VQQEGAQQPAPATAP

SEQ ID NO: 135716 - protein, 9 aa, Borrelia burgdorferi B31
VQQEGAQQP

SEQ ID NO: 135717 - protein, 15 aa, Borrelia burgdorferi B31
RMKELAVQSGNGTYS

SEQ ID NO: 135718 - protein, 9 aa, Borrelia burgdorferi B31
MKELAVQSG

SEQ ID NO: 135719 - protein, 15 aa, Borrelia burgdorferi B31
MKELAVQSGNGTYSD

SEQ ID NO: 135720 - protein, 9 aa, Borrelia burgdorferi B31
MKELAVQSG

SEQ ID NO: 135721 - protein, 15 aa, Borrelia burgdorferi B31
EGVQQEGAQQPAPAT

SEQ ID NO: 135722 - protein, 9 aa, Borrelia burgdorferi B31
VQQEGAQQP

SEQ ID NO: 135723 - protein, 15 aa, Borrelia burgdorferi B31
STEYAIENLKASYAQ

SEQ ID NO: 135724 - protein, 9 aa, Borrelia burgdorferi B31
IENLKASYA

SEQ ID NO: 135725 - protein, 15 aa, Borrelia burgdorferi B31
NSTEYAIENLKASYA

SEQ ID NO: 135726 - protein, 9 aa, Borrelia burgdorferi B31
YAIENLKAS

SEQ ID NO: 135727 - protein, 15 aa, Borrelia burgdorferi B31
TEYAIENLKASYAQI

SEQ ID NO: 135728 - protein, 9 aa, Borrelia burgdorferi B31
IENLKASYA

SEQ ID NO: 135729 - protein, 15 aa, Borrelia burgdorferi B31
QMHMLSNKSASQNVR

SEQ ID NO: 135730 - protein, 9 aa, Borrelia burgdorferi B31
MHMLSNKSA

SEQ ID NO: 135731 - protein, 15 aa, Borrelia burgdorferi B31
MHMLSNKSASQNVRT

SEQ ID NO: 135732 - protein, 9 aa, Borrelia burgdorferi B31
MHMLSNKSA

SEQ ID NO: 135733 - protein, 15 aa, Borrelia burgdorferi B31
TQSAMAMIAQANQVP

SEQ ID NO: 135734 - protein, 9 aa, Borrelia burgdorferi B31
TQSAMAMIA

SEQ ID NO: 135735 - protein, 15 aa, Borrelia burgdorferi B31
AIAVNIYAANVANLF

SEQ ID NO: 135736 - protein, 9 aa, Borrelia burgdorferi B31
VNIYAANVA

SEQ ID NO: 135737 - protein, 15 aa, Borrelia burgdorferi B31
LGMQPAKINTPASLS

SEQ ID NO: 135738 - protein, 9 aa, Borrelia burgdorferi B31
LGMQPAKIN

SEQ ID NO: 135739 - protein, 15 aa, Borrelia burgdorferi B31
IAVNIYAANVANLFS

SEQ ID NO: 135740 - protein, 9 aa, Borrelia burgdorferi B31
YAANVANLF

SEQ ID NO: 135741 - protein, 15 aa, Borrelia burgdorferi B31
AIENLKASYAQIKDA

SEQ ID NO: 135742 - protein, 9 aa, Borrelia burgdorferi B31
LKASYAQIK

SEQ ID NO: 135743 - protein, 15 aa, Borrelia burgdorferi B31
IENLKASYAQIKDAT

SEQ ID NO: 135744 - protein, 9 aa, Borrelia burgdorferi B31
LKASYAQIK

SEQ ID NO: 135745 - protein, 15 aa, Borrelia burgdorferi B31
ELGMQPAKINTPASL

SEQ ID NO: 135746 - protein, 9 aa, Borrelia burgdorferi B31
LGMQPAKIN

SEQ ID NO: 135747 - protein, 15 aa, Borrelia burgdorferi B31
LTQSAMAMIAQANQV

SEQ ID NO: 135748 - protein, 9 aa, Borrelia burgdorferi B31
AMAMIAQAN

SEQ ID NO: 135749 - protein, 15 aa, Borrelia burgdorferi B31
QEGVQQEGAQQPAPA

SEQ ID NO: 135750 - protein, 9 aa, Borrelia burgdorferi B31
VQQEGAQQP

SEQ ID NO: 135751 - protein, 15 aa, Borrelia burgdorferi B31
QSAMAMIAQANQVPQ

SEQ ID NO: 135752 - protein, 9 aa, Borrelia burgdorferi B31
MIAQANQVP

SEQ ID NO: 135753 - protein, 15 aa, Borrelia burgdorferi B31
EVVAATTNSILTQSA

SEQ ID NO: 135754 - protein, 9 aa, Borrelia burgdorferi B31
VVAATTNSI

SEQ ID NO: 135755 - protein, 15 aa, Borrelia burgdorferi B31
AVNIYAANVANLFSG

SEQ ID NO: 135756 - protein, 9 aa, Borrelia burgdorferi B31
YAANVANLF

SEQ ID NO: 135757 - protein, 15 aa, Borrelia burgdorferi B31
PVQEGVQQEGAQQPA

SEQ ID NO: 135758 - protein, 9 aa, Borrelia burgdorferi B31
VQQEGAQQP

SEQ ID NO: 135759 - protein, 15 aa, Borrelia burgdorferi B31
VVAATTNSILTQSAM

SEQ ID NO: 135760 - protein, 9 aa, Borrelia burgdorferi B31
VVAATTNSI

SEQ ID NO: 135761 - protein, 15 aa, Borrelia burgdorferi B31
APVQEGVQQEGAQQP

SEQ ID NO: 135762 - protein, 9 aa, Borrelia burgdorferi B31
QEGVQQEGA

SEQ ID NO: 135763 - protein, 15 aa, Borrelia burgdorferi B31
VQEGVQQEGAQQPAP

SEQ ID NO: 135764 - protein, 9 aa, Borrelia burgdorferi B31
VQQEGAQQP

SEQ ID NO: 135765 - protein, 15 aa, Borrelia burgdorferi B31
NIYAANVANLFSGEG

SEQ ID NO: 135766 - protein, 9 aa, Borrelia burgdorferi B31
YAANVANLF

SEQ ID NO: 135767 - protein, 15 aa, Borrelia burgdorferi B31
QEGAQQPAPATAPSQ

SEQ ID NO: 135768 - protein, 9 aa, Borrelia burgdorferi B31
QQPAPATAP

SEQ ID NO: 135769 - protein, 15 aa, Borrelia burgdorferi B31
VNIYAANVANLFSGE

SEQ ID NO: 135770 - protein, 9 aa, Borrelia burgdorferi B31
YAANVANLF

SEQ ID NO: 135771 - protein, 15 aa, Borrelia burgdorferi B31
QQEGAQQPAPATAPS

SEQ ID NO: 135772 - protein, 9 aa, Borrelia burgdorferi B31
QQPAPATAP

SEQ ID NO: 135773 - protein, 15 aa, Borrelia burgdorferi B31
GVQQEGAQQPAPATA

SEQ ID NO: 135774 - protein, 9 aa, Borrelia burgdorferi B31
VQQEGAQQP

SEQ ID NO: 135775 - protein, 15 aa, Borrelia burgdorferi B31
AANVANLFSGEGAQT

SEQ ID NO: 135776 - protein, 9 aa, Borrelia burgdorferi B31
VANLFSGEG

SEQ ID NO: 135777 - protein, 15 aa, Borrelia burgdorferi B31
EGAQQPAPATAPSQG

SEQ ID NO: 135778 - protein, 9 aa, Borrelia burgdorferi B31
QQPAPATAP

SEQ ID NO: 135779 - protein, 15 aa, Borrelia burgdorferi B31
AMAMIAQANQVPQYV

SEQ ID NO: 135780 - protein, 9 aa, Borrelia burgdorferi B31
MIAQANQVP

SEQ ID NO: 135781 - protein, 15 aa, Borrelia burgdorferi B31
EAIAVNIYAANVANL

SEQ ID NO: 135782 - protein, 9 aa, Borrelia burgdorferi B31
VNIYAANVA

SEQ ID NO: 135783 - protein, 15 aa, Borrelia burgdorferi B31
ENLKASYAQIKDATM

SEQ ID NO: 135784 - protein, 9 aa, Borrelia burgdorferi B31
LKASYAQIK

SEQ ID NO: 135785 - protein, 15 aa, Borrelia burgdorferi B31
VEKVLVRMKELAVQS

SEQ ID NO: 135786 - protein, 9 aa, Borrelia burgdorferi B31
VRMKELAVQ

SEQ ID NO: 135787 - protein, 15 aa, Borrelia burgdorferi B31
SAMAMIAQANQVPQY

SEQ ID NO: 135788 - protein, 9 aa, Borrelia burgdorferi B31
MIAQANQVP

SEQ ID NO: 135789 - protein, 15 aa, Borrelia burgdorferi B31
GAQQPAPATAPSQGG

SEQ ID NO: 135790 - protein, 9 aa, Borrelia burgdorferi B31
QQPAPATAP

SEQ ID NO: 135791 - protein, 15 aa, Borrelia burgdorferi B31
EVEKVLVRMKELAVQ

SEQ ID NO: 135792 - protein, 9 aa, Borrelia burgdorferi B31
LVRMKELAV

SEQ ID NO: 135793 - protein, 15 aa, Borrelia burgdorferi B31
NAQIRGLSQASRNTS

SEQ ID NO: 135794 - protein, 9 aa, Borrelia burgdorferi B31
IRGLSQASR

SEQ ID NO: 135795 - protein, 15 aa, Borrelia burgdorferi B31
KELAVQSGNGTYSDA

SEQ ID NO: 135796 - protein, 9 aa, Borrelia burgdorferi B31
VQSGNGTYS

SEQ ID NO: 135797 - protein, 15 aa, Borrelia burgdorferi B31
NLKASYAQIKDATMT

SEQ ID NO: 135798 - protein, 9 aa, Borrelia burgdorferi B31
LKASYAQIK

SEQ ID NO: 135799 - protein, 15 aa, Borrelia burgdorferi B31
LKASYAQIKDATMTD

SEQ ID NO: 135800 - protein, 9 aa, Borrelia burgdorferi B31
LKASYAQIK

SEQ ID NO: 135801 - protein, 15 aa, Borrelia burgdorferi B31
INAQIRGLSQASRNT

SEQ ID NO: 135802 - protein, 9 aa, Borrelia burgdorferi B31
IRGLSQASR

SEQ ID NO: 135803 - protein, 15 aa, Borrelia burgdorferi B31
AQIRGLSQASRNTSK

SEQ ID NO: 135804 - protein, 9 aa, Borrelia burgdorferi B31
IRGLSQASR

SEQ ID NO: 135805 - protein, 15 aa, Borrelia burgdorferi B31
DEAIAVNIYAANVAN

SEQ ID NO: 135806 - protein, 9 aa, Borrelia burgdorferi B31
VNIYAANVA

SEQ ID NO: 135807 - protein, 15 aa, Borrelia burgdorferi B31
GEGAQTAQAAPVQEG

SEQ ID NO: 135808 - protein, 9 aa, Borrelia burgdorferi B31
AQTAQAAPV

SEQ ID NO: 135809 - protein, 15 aa, Borrelia burgdorferi B31
PSQGGVNSPVNVTTT

SEQ ID NO: 135810 - protein, 9 aa, Borrelia burgdorferi B31
VNSPVNVTT

SEQ ID NO: 135811 - protein, 15 aa, Borrelia burgdorferi B31
DQAQYNQMHMLSNKS

SEQ ID NO: 135812 - protein, 9 aa, Borrelia burgdorferi B31
YNQMHMLSN

SEQ ID NO: 135813 - protein, 15 aa, Borrelia burgdorferi B31
EGAQTAQAAPVQEGV

SEQ ID NO: 135814 - protein, 9 aa, Borrelia burgdorferi B31
AQTAQAAPV

SEQ ID NO: 135815 - protein, 15 aa, Borrelia burgdorferi B31
SQGGVNSPVNVTTTV

SEQ ID NO: 135816 - protein, 9 aa, Borrelia burgdorferi B31
VNSPVNVTT

SEQ ID NO: 135817 - protein, 15 aa, Borrelia burgdorferi B31
QGGVNSPVNVTTTVD

SEQ ID NO: 135818 - protein, 9 aa, Borrelia burgdorferi B31
VNSPVNVTT

SEQ ID NO: 135819 - protein, 15 aa, Borrelia burgdorferi B31
APSQGGVNSPVNVTT

SEQ ID NO: 135820 - protein, 9 aa, Borrelia burgdorferi B31
GVNSPVNVT

SEQ ID NO: 135821 - protein, 15 aa, Borrelia burgdorferi B31
QDEAIAVNIYAANVA

SEQ ID NO: 135822 - protein, 9 aa, Borrelia burgdorferi B31
AVNIYAANV

SEQ ID NO: 135823 - protein, 15 aa, Borrelia burgdorferi B31
PASLSGSQASWTLRV

SEQ ID NO: 135824 - protein, 9 aa, Borrelia burgdorferi B31
LSGSQASWT

SEQ ID NO: 135825 - protein, 15 aa, Borrelia burgdorferi B31
ASLSGSQASWTLRVH

SEQ ID NO: 135826 - protein, 9 aa, Borrelia burgdorferi B31
LSGSQASWT

SEQ ID NO: 135827 - protein, 15 aa, Borrelia burgdorferi B31
MAMIAQANQVPQYVL

SEQ ID NO: 135828 - protein, 9 aa, Borrelia burgdorferi B31
MIAQANQVP

SEQ ID NO: 135829 - protein, 15 aa, Borrelia burgdorferi B31
IYAANVANLFSGEGA

SEQ ID NO: 135830 - protein, 9 aa, Borrelia burgdorferi B31
VANLFSGEG

SEQ ID NO: 135831 - protein, 15 aa, Borrelia burgdorferi B31
GGVNSPVNVTTTVDA

SEQ ID NO: 135832 - protein, 9 aa, Borrelia burgdorferi B31
VNSPVNVTT

SEQ ID NO: 135833 - protein, 15 aa, Borrelia burgdorferi B31
SRNNGINAANLSKTQ

SEQ ID NO: 135834 - protein, 9 aa, Borrelia burgdorferi B31
INAANLSKT

SEQ ID NO: 135835 - protein, 15 aa, Borrelia burgdorferi B31
RNNGINAANLSKTQE

SEQ ID NO: 135836 - protein, 9 aa, Borrelia burgdorferi B31
INAANLSKT

SEQ ID NO: 135837 - protein, 15 aa, Borrelia burgdorferi B31
ASRNNGINAANLSKT

SEQ ID NO: 135838 - protein, 9 aa, Borrelia burgdorferi B31
NGINAANLS

SEQ ID NO: 135839 - protein, 15 aa, Borrelia burgdorferi B31
ELAVQSGNGTYSDAD

SEQ ID NO: 135840 - protein, 9 aa, Borrelia burgdorferi B31
VQSGNGTYS

SEQ ID NO: 135841 - protein, 15 aa, Borrelia burgdorferi B31
NNGINAANLSKTQEK

SEQ ID NO: 135842 - protein, 9 aa, Borrelia burgdorferi B31
INAANLSKT

SEQ ID NO: 135843 - protein, 15 aa, Borrelia burgdorferi B31
NTPASLSGSQASWTL

SEQ ID NO: 135844 - protein, 9 aa, Borrelia burgdorferi B31
LSGSQASWT

SEQ ID NO: 135845 - protein, 15 aa, Borrelia burgdorferi B31
LAVQSGNGTYSDADR

SEQ ID NO: 135846 - protein, 9 aa, Borrelia burgdorferi B31
VQSGNGTYS

SEQ ID NO: 135847 - protein, 15 aa, Borrelia burgdorferi B31
NGINAANLSKTQEKL

SEQ ID NO: 135848 - protein, 9 aa, Borrelia burgdorferi B31
INAANLSKT

SEQ ID NO: 135849 - protein, 15 aa, Borrelia burgdorferi B31
YAANVANLFSGEGAQ

SEQ ID NO: 135850 - protein, 9 aa, Borrelia burgdorferi B31
VANLFSGEG

SEQ ID NO: 135851 - protein, 15 aa, Borrelia burgdorferi B31
TPASLSGSQASWTLR

SEQ ID NO: 135852 - protein, 9 aa, Borrelia burgdorferi B31
LSGSQASWT

SEQ ID NO: 135853 - protein, 15 aa, Borrelia burgdorferi B31
KINAQIRGLSQASRN

SEQ ID NO: 135854 - protein, 9 aa, Borrelia burgdorferi B31
IRGLSQASR

SEQ ID NO: 135855 - protein, 15 aa, Borrelia burgdorferi B31
GKINAQIRGLSQASR

SEQ ID NO: 135856 - protein, 9 aa, Borrelia burgdorferi B31
QIRGLSQAS

SEQ ID NO: 135857 - protein, 15 aa, Borrelia burgdorferi B31
SGEGAQTAQAAPVQE

SEQ ID NO: 135858 - protein, 9 aa, Borrelia burgdorferi B31
AQTAQAAPV

SEQ ID NO: 135859 - protein, 15 aa, Borrelia burgdorferi B31
AQQPAPATAPSQGGV

SEQ ID NO: 135860 - protein, 9 aa, Borrelia burgdorferi B31
PATAPSQGG

SEQ ID NO: 135861 - protein, 15 aa, Borrelia burgdorferi B31
ADQAQYNQMHMLSNK

SEQ ID NO: 135862 - protein, 9 aa, Borrelia burgdorferi B31
YNQMHMLSN

SEQ ID NO: 135863 - protein, 15 aa, Borrelia burgdorferi B31
HMLSNKSASQNVRTA

SEQ ID NO: 135864 - protein, 9 aa, Borrelia burgdorferi B31
LSNKSASQN

SEQ ID NO: 135865 - protein, 15 aa, Borrelia burgdorferi B31
IADQAQYNQMHMLSN

SEQ ID NO: 135866 - protein, 9 aa, Borrelia burgdorferi B31
QYNQMHMLS

SEQ ID NO: 135867 - protein, 15 aa, Borrelia burgdorferi B31
VNVTTTVDANTSLAK

SEQ ID NO: 135868 - protein, 9 aa, Borrelia burgdorferi B31
VTTTVDANT

SEQ ID NO: 135869 - protein, 15 aa, Borrelia burgdorferi B31
KASYAQIKDATMTDE

SEQ ID NO: 135870 - protein, 9 aa, Borrelia burgdorferi B31
AQIKDATMT

SEQ ID NO: 135871 - protein, 15 aa, Borrelia burgdorferi B31
QIRGLSQASRNTSKA

SEQ ID NO: 135872 - protein, 9 aa, Borrelia burgdorferi B31
IRGLSQASR

SEQ ID NO: 135873 - protein, 15 aa, Borrelia burgdorferi B31
ASYAQIKDATMTDEV

SEQ ID NO: 135874 - protein, 9 aa, Borrelia burgdorferi B31
AQIKDATMT

SEQ ID NO: 135875 - protein, 15 aa, Borrelia burgdorferi B31
GAQTAQAAPVQEGVQ

SEQ ID NO: 135876 - protein, 9 aa, Borrelia burgdorferi B31
AQAAPVQEG

SEQ ID NO: 135877 - protein, 15 aa, Borrelia burgdorferi B31
QQPAPATAPSQGGVN

SEQ ID NO: 135878 - protein, 9 aa, Borrelia burgdorferi B31
PATAPSQGG

SEQ ID NO: 135879 - protein, 15 aa, Borrelia burgdorferi B31
AMIAQANQVPQYVLS

SEQ ID NO: 135880 - protein, 9 aa, Borrelia burgdorferi B31
MIAQANQVP

SEQ ID NO: 135881 - protein, 15 aa, Borrelia burgdorferi B31
GVNSPVNVTTTVDAN

SEQ ID NO: 135882 - protein, 9 aa, Borrelia burgdorferi B31
VNVTTTVDA

SEQ ID NO: 135883 - protein, 15 aa, Borrelia burgdorferi B31
IRGLSQASRNTSKAI

SEQ ID NO: 135884 - protein, 9 aa, Borrelia burgdorferi B31
IRGLSQASR

SEQ ID NO: 135885 - protein, 15 aa, Borrelia burgdorferi B31
DATMTDEVVAATTNS

SEQ ID NO: 135886 - protein, 9 aa, Borrelia burgdorferi B31
MTDEVVAAT

SEQ ID NO: 135887 - protein, 15 aa, Borrelia burgdorferi B31
AQTAQAAPVQEGVQQ

SEQ ID NO: 135888 - protein, 9 aa, Borrelia burgdorferi B31
AQAAPVQEG

SEQ ID NO: 135889 - protein, 15 aa, Borrelia burgdorferi B31
RMISDQRANLGAFQN

SEQ ID NO: 135890 - protein, 9 aa, Borrelia burgdorferi B31
ISDQRANLG

SEQ ID NO: 135891 - protein, 15 aa, Borrelia burgdorferi B31
MIAQANQVPQYVLSL

SEQ ID NO: 135892 - protein, 9 aa, Borrelia burgdorferi B31
QANQVPQYV

SEQ ID NO: 135893 - protein, 15 aa, Borrelia burgdorferi B31
VNSPVNVTTTVDANT

SEQ ID NO: 135894 - protein, 9 aa, Borrelia burgdorferi B31
VNVTTTVDA

SEQ ID NO: 135895 - protein, 15 aa, Borrelia burgdorferi B31
SLSGSQASWTLRVHV

SEQ ID NO: 135896 - protein, 9 aa, Borrelia burgdorferi B31
LSGSQASWT

SEQ ID NO: 135897 - protein, 15 aa, Borrelia burgdorferi B31
LSGSQASWTLRVHVG

SEQ ID NO: 135898 - protein, 9 aa, Borrelia burgdorferi B31
LSGSQASWT

SEQ ID NO: 135899 - protein, 15 aa, Borrelia burgdorferi B31
SKAINFIQTTEGNLN

SEQ ID NO: 135900 - protein, 9 aa, Borrelia burgdorferi B31
INFIQTTEG

SEQ ID NO: 135901 - protein, 15 aa, Borrelia burgdorferi B31
MIINHNTSAINASRN

SEQ ID NO: 135902 - protein, 9 aa, Borrelia burgdorferi B31
INHNTSAIN

SEQ ID NO: 135903 - protein, 15 aa, Borrelia burgdorferi B31
SYAQIKDATMTDEVV

SEQ ID NO: 135904 - protein, 9 aa, Borrelia burgdorferi B31
AQIKDATMT

SEQ ID NO: 135905 - protein, 15 aa, Borrelia burgdorferi B31
NSPVNVTTTVDANTS

SEQ ID NO: 135906 - protein, 9 aa, Borrelia burgdorferi B31
VNVTTTVDA

SEQ ID NO: 135907 - protein, 15 aa, Borrelia burgdorferi B31
SPVNVTTTVDANTSL

SEQ ID NO: 135908 - protein, 9 aa, Borrelia burgdorferi B31
VNVTTTVDA

SEQ ID NO: 135909 - protein, 15 aa, Borrelia burgdorferi B31
NVTTTVDANTSLAKI

SEQ ID NO: 135910 - protein, 9 aa, Borrelia burgdorferi B31
VDANTSLAK

SEQ ID NO: 135911 - protein, 15 aa, Borrelia burgdorferi B31
KAINFIQTTEGNLNE

SEQ ID NO: 135912 - protein, 9 aa, Borrelia burgdorferi B31
INFIQTTEG

SEQ ID NO: 135913 - protein, 15 aa, Borrelia burgdorferi B31
QPAPATAPSQGGVNS

SEQ ID NO: 135914 - protein, 9 aa, Borrelia burgdorferi B31
PATAPSQGG

SEQ ID NO: 135915 - protein, 15 aa, Borrelia burgdorferi B31
IKDATMTDEVVAATT

SEQ ID NO: 135916 - protein, 9 aa, Borrelia burgdorferi B31
MTDEVVAAT

SEQ ID NO: 135917 - protein, 15 aa, Borrelia burgdorferi B31
MLSNKSASQNVRTAE

SEQ ID NO: 135918 - protein, 9 aa, Borrelia burgdorferi B31
LSNKSASQN

SEQ ID NO: 135919 - protein, 15 aa, Borrelia burgdorferi B31
KDATMTDEVVAATTN

SEQ ID NO: 135920 - protein, 9 aa, Borrelia burgdorferi B31
MTDEVVAAT

SEQ ID NO: 135921 - protein, 15 aa, Borrelia burgdorferi B31
QIKDATMTDEVVAAT

SEQ ID NO: 135922 - protein, 9 aa, Borrelia burgdorferi B31
DATMTDEVV

SEQ ID NO: 135923 - protein, 15 aa, Borrelia burgdorferi B31
PAPATAPSQGGVNSP

SEQ ID NO: 135924 - protein, 9 aa, Borrelia burgdorferi B31
PATAPSQGG

SEQ ID NO: 135925 - protein, 15 aa, Borrelia burgdorferi B31
QTAQAAPVQEGVQQE

SEQ ID NO: 135926 - protein, 9 aa, Borrelia burgdorferi B31
AQAAPVQEG

SEQ ID NO: 135927 - protein, 15 aa, Borrelia burgdorferi B31
VTTTVDANTSLAKIE

SEQ ID NO: 135928 - protein, 9 aa, Borrelia burgdorferi B31
VDANTSLAK

SEQ ID NO: 135929 - protein, 15 aa, Borrelia burgdorferi B31
PVNVTTTVDANTSLA

SEQ ID NO: 135930 - protein, 9 aa, Borrelia burgdorferi B31
VNVTTTVDA

SEQ ID NO: 135931 - protein, 15 aa, Borrelia burgdorferi B31
VAATTNSILTQSAMA

SEQ ID NO: 135932 - protein, 9 aa, Borrelia burgdorferi B31
TNSILTQSA

SEQ ID NO: 135933 - protein, 15 aa, Borrelia burgdorferi B31
QYNQMHMLSNKSASQ

SEQ ID NO: 135934 - protein, 9 aa, Borrelia burgdorferi B31
QMHMLSNKS

SEQ ID NO: 135935 - protein, 15 aa, Borrelia burgdorferi B31
YNQMHMLSNKSASQN

SEQ ID NO: 135936 - protein, 9 aa, Borrelia burgdorferi B31
QMHMLSNKS

SEQ ID NO: 135937 - protein, 15 aa, Borrelia burgdorferi B31
IAVNIYAANVANLFS

SEQ ID NO: 135938 - protein, 9 aa, Borrelia burgdorferi B31
YAANVANLF

SEQ ID NO: 135939 - protein, 15 aa, Borrelia burgdorferi B31
QAQYNQMHMLSNKSA

SEQ ID NO: 135940 - protein, 9 aa, Borrelia burgdorferi B31
QMHMLSNKS

SEQ ID NO: 135941 - protein, 15 aa, Borrelia burgdorferi B31
NQMHMLSNKSASQNV

SEQ ID NO: 135942 - protein, 9 aa, Borrelia burgdorferi B31
MLSNKSASQ

SEQ ID NO: 135943 - protein, 15 aa, Borrelia burgdorferi B31
AIAVNIYAANVANLF

SEQ ID NO: 135944 - protein, 9 aa, Borrelia burgdorferi B31
NIYAANVAN

SEQ ID NO: 135945 - protein, 15 aa, Borrelia burgdorferi B31
NIYAANVANLFSGEG

SEQ ID NO: 135946 - protein, 9 aa, Borrelia burgdorferi B31
YAANVANLF

SEQ ID NO: 135947 - protein, 15 aa, Borrelia burgdorferi B31
AVNIYAANVANLFSG

SEQ ID NO: 135948 - protein, 9 aa, Borrelia burgdorferi B31
YAANVANLF

SEQ ID NO: 135949 - protein, 15 aa, Borrelia burgdorferi B31
AQYNQMHMLSNKSAS

SEQ ID NO: 135950 - protein, 9 aa, Borrelia burgdorferi B31
QMHMLSNKS

SEQ ID NO: 135951 - protein, 15 aa, Borrelia burgdorferi B31
VNIYAANVANLFSGE

SEQ ID NO: 135952 - protein, 9 aa, Borrelia burgdorferi B31
YAANVANLF

SEQ ID NO: 135953 - protein, 15 aa, Borrelia burgdorferi B31
QMHMLSNKSASQNVR

SEQ ID NO: 135954 - protein, 9 aa, Borrelia burgdorferi B31
MLSNKSASQ

SEQ ID NO: 135955 - protein, 15 aa, Borrelia burgdorferi B31
GVNSPVNVTTTVDAN

SEQ ID NO: 135956 - protein, 9 aa, Borrelia burgdorferi B31
VNVTTTVDA

SEQ ID NO: 135957 - protein, 15 aa, Borrelia burgdorferi B31
GGVNSPVNVTTTVDA

SEQ ID NO: 135958 - protein, 9 aa, Borrelia burgdorferi B31
VNSPVNVTT

SEQ ID NO: 135959 - protein, 15 aa, Borrelia burgdorferi B31
NSPVNVTTTVDANTS

SEQ ID NO: 135960 - protein, 9 aa, Borrelia burgdorferi B31
VNVTTTVDA

SEQ ID NO: 135961 - protein, 15 aa, Borrelia burgdorferi B31
VNSPVNVTTTVDANT

SEQ ID NO: 135962 - protein, 9 aa, Borrelia burgdorferi B31
VNVTTTVDA

SEQ ID NO: 135963 - protein, 15 aa, Borrelia burgdorferi B31
ANVANLFSGEGAQTA

SEQ ID NO: 135964 - protein, 9 aa, Borrelia burgdorferi B31
VANLFSGEG

SEQ ID NO: 135965 - protein, 15 aa, Borrelia burgdorferi B31
AANVANLFSGEGAQT

SEQ ID NO: 135966 - protein, 9 aa, Borrelia burgdorferi B31
VANLFSGEG

SEQ ID NO: 135967 - protein, 15 aa, Borrelia burgdorferi B31
NIYAANVANLFSGEG

SEQ ID NO: 135968 - protein, 9 aa, Borrelia burgdorferi B31
YAANVANLF

SEQ ID NO: 135969 - protein, 15 aa, Borrelia burgdorferi B31
IYAANVANLFSGEGA

SEQ ID NO: 135970 - protein, 9 aa, Borrelia burgdorferi B31
VANLFSGEG

SEQ ID NO: 135971 - protein, 15 aa, Borrelia burgdorferi B31
YAANVANLFSGEGAQ

SEQ ID NO: 135972 - protein, 9 aa, Borrelia burgdorferi B31
VANLFSGEG

SEQ ID NO: 135973 - protein, 15 aa, Borrelia burgdorferi B31
YNQMHMLSNKSASQN

SEQ ID NO: 135974 - protein, 9 aa, Borrelia burgdorferi B31
MLSNKSASQ

SEQ ID NO: 135975 - protein, 15 aa, Borrelia burgdorferi B31
QYNQMHMLSNKSASQ

SEQ ID NO: 135976 - protein, 9 aa, Borrelia burgdorferi B31
QMHMLSNKS

SEQ ID NO: 135977 - protein, 15 aa, Borrelia burgdorferi B31
NVANLFSGEGAQTAQ

SEQ ID NO: 135978 - protein, 9 aa, Borrelia burgdorferi B31
VANLFSGEG

SEQ ID NO: 135979 - protein, 15 aa, Borrelia burgdorferi B31
VANLFSGEGAQTAQA

SEQ ID NO: 135980 - protein, 9 aa, Borrelia burgdorferi B31
VANLFSGEG

SEQ ID NO: 135981 - protein, 15 aa, Borrelia burgdorferi B31
ENAIRMISDQRANLG

SEQ ID NO: 135982 - protein, 9 aa, Borrelia burgdorferi B31
AIRMISDQR

SEQ ID NO: 135983 - protein, 15 aa, Borrelia burgdorferi B31
NQMHMLSNKSASQNV

SEQ ID NO: 135984 - protein, 9 aa, Borrelia burgdorferi B31
MLSNKSASQ

SEQ ID NO: 135985 - protein, 15 aa, Borrelia burgdorferi B31
NAIRMISDQRANLGA

SEQ ID NO: 135986 - protein, 9 aa, Borrelia burgdorferi B31
ISDQRANLG

SEQ ID NO: 135987 - protein, 15 aa, Borrelia burgdorferi B31
QMHMLSNKSASQNVR

SEQ ID NO: 135988 - protein, 9 aa, Borrelia burgdorferi B31
MLSNKSASQ

SEQ ID NO: 135989 - protein, 15 aa, Borrelia burgdorferi B31
AIRMISDQRANLGAF

SEQ ID NO: 135990 - protein, 9 aa, Borrelia burgdorferi B31
ISDQRANLG

SEQ ID NO: 135991 - protein, 15 aa, Borrelia burgdorferi B31
VNVTTTVDANTSLAK

SEQ ID NO: 135992 - protein, 9 aa, Borrelia burgdorferi B31
TVDANTSLA

SEQ ID NO: 135993 - protein, 15 aa, Borrelia burgdorferi B31
PVNVTTTVDANTSLA

SEQ ID NO: 135994 - protein, 9 aa, Borrelia burgdorferi B31
VNVTTTVDA

SEQ ID NO: 135995 - protein, 15 aa, Borrelia burgdorferi B31
IRMISDQRANLGAFQ

SEQ ID NO: 135996 - protein, 9 aa, Borrelia burgdorferi B31
ISDQRANLG

SEQ ID NO: 135997 - protein, 15 aa, Borrelia burgdorferi B31
AQYNQMHMLSNKSAS

SEQ ID NO: 135998 - protein, 9 aa, Borrelia burgdorferi B31
QMHMLSNKS

SEQ ID NO: 135999 - protein, 15 aa, Borrelia burgdorferi B31
QAQYNQMHMLSNKSA

SEQ ID NO: 136000 - protein, 9 aa, Borrelia burgdorferi B31
QMHMLSNKS

SEQ ID NO: 136001 - protein, 15 aa, Borrelia burgdorferi B31
DQAQYNQMHMLSNKS

SEQ ID NO: 136002 - protein, 9 aa, Borrelia burgdorferi B31
YNQMHMLSN

SEQ ID NO: 136003 - protein, 15 aa, Borrelia burgdorferi B31
RMISDQRANLGAFQN

SEQ ID NO: 136004 - protein, 9 aa, Borrelia burgdorferi B31
ISDQRANLG

SEQ ID NO: 136005 - protein, 15 aa, Borrelia burgdorferi B31
MTDEVVAATTNSILT

SEQ ID NO: 136006 - protein, 9 aa, Borrelia burgdorferi B31
VVAATTNSI

SEQ ID NO: 136007 - protein, 15 aa, Borrelia burgdorferi B31
EELGMQPAKINTPAS

SEQ ID NO: 136008 - protein, 9 aa, Borrelia burgdorferi B31
LGMQPAKIN

SEQ ID NO: 136009 - protein, 15 aa, Borrelia burgdorferi B31
LGMQPAKINTPASLS

SEQ ID NO: 136010 - protein, 9 aa, Borrelia burgdorferi B31
PAKINTPAS

SEQ ID NO: 136011 - protein, 15 aa, Borrelia burgdorferi B31
GGVNSPVNVTTTVDA

SEQ ID NO: 136012 - protein, 9 aa, Borrelia burgdorferi B31
PVNVTTTVD

SEQ ID NO: 136013 - protein, 15 aa, Borrelia burgdorferi B31
GVNSPVNVTTTVDAN

SEQ ID NO: 136014 - protein, 9 aa, Borrelia burgdorferi B31
VNVTTTVDA

SEQ ID NO: 136015 - protein, 15 aa, Borrelia burgdorferi B31
VNSPVNVTTTVDANT

SEQ ID NO: 136016 - protein, 9 aa, Borrelia burgdorferi B31
VNVTTTVDA

SEQ ID NO: 136017 - protein, 15 aa, Borrelia burgdorferi B31
ELGMQPAKINTPASL

SEQ ID NO: 136018 - protein, 9 aa, Borrelia burgdorferi B31
PAKINTPAS

SEQ ID NO: 136019 - protein, 15 aa, Borrelia burgdorferi B31
NSPVNVTTTVDANTS

SEQ ID NO: 136020 - protein, 9 aa, Borrelia burgdorferi B31
VNVTTTVDA

SEQ ID NO: 136021 - protein, 15 aa, Borrelia burgdorferi B31
TMTDEVVAATTNSIL

SEQ ID NO: 136022 - protein, 9 aa, Borrelia burgdorferi B31
VVAATTNSI

SEQ ID NO: 136023 - protein, 15 aa, Borrelia burgdorferi B31
MTDEVVAATTNSILT

SEQ ID NO: 136024 - protein, 9 aa, Borrelia burgdorferi B31
VVAATTNSI

SEQ ID NO: 136025 - protein, 15 aa, Borrelia burgdorferi B31
TDEVVAATTNSILTQ

SEQ ID NO: 136026 - protein, 9 aa, Borrelia burgdorferi B31
VVAATTNSI

SEQ ID NO: 136027 - protein, 15 aa, Borrelia burgdorferi B31
DEVVAATTNSILTQS

SEQ ID NO: 136028 - protein, 9 aa, Borrelia burgdorferi B31
VVAATTNSI

SEQ ID NO: 136029 - protein, 15 aa, Borrelia burgdorferi B31
EVVAATTNSILTQSA

SEQ ID NO: 136030 - protein, 9 aa, Borrelia burgdorferi B31
VAATTNSIL

SEQ ID NO: 136031 - protein, 15 aa, Borrelia burgdorferi B31
ATMTDEVVAATTNSI

SEQ ID NO: 136032 - protein, 9 aa, Borrelia burgdorferi B31
ATMTDEVVA

SEQ ID NO: 136033 - protein, 15 aa, Borrelia burgdorferi B31
VVAATTNSILTQSAM

SEQ ID NO: 136034 - protein, 9 aa, Borrelia burgdorferi B31
VVAATTNSI

SEQ ID NO: 136035 - protein, 15 aa, Borrelia burgdorferi B31
QNRLESIKNSTEYAI

SEQ ID NO: 136036 - protein, 9 aa, Borrelia burgdorferi B31
LESIKNSTE

SEQ ID NO: 136037 - protein, 15 aa, Borrelia burgdorferi B31
NRLESIKNSTEYAIE

SEQ ID NO: 136038 - protein, 9 aa, Borrelia burgdorferi B31
IKNSTEYAI

SEQ ID NO: 136039 - protein, 15 aa, Borrelia burgdorferi B31
ESIKNSTEYAIENLK

SEQ ID NO: 136040 - protein, 9 aa, Borrelia burgdorferi B31
IKNSTEYAI

SEQ ID NO: 136041 - protein, 15 aa, Borrelia burgdorferi B31
RLESIKNSTEYAIEN

SEQ ID NO: 136042 - protein, 9 aa, Borrelia burgdorferi B31
IKNSTEYAI

SEQ ID NO: 136043 - protein, 15 aa, Borrelia burgdorferi B31
LESIKNSTEYAIENL

SEQ ID NO: 136044 - protein, 9 aa, Borrelia burgdorferi B31
IKNSTEYAI

SEQ ID NO: 136045 - protein, 15 aa, Borrelia burgdorferi B31
GGVNSPVNVTTTVDA

SEQ ID NO: 136046 - protein, 9 aa, Borrelia burgdorferi B31
PVNVTTTVD

SEQ ID NO: 136047 - protein, 15 aa, Borrelia burgdorferi B31
GVNSPVNVTTTVDAN

SEQ ID NO: 136048 - protein, 9 aa, Borrelia burgdorferi B31
VNVTTTVDA

SEQ ID NO: 136049 - protein, 15 aa, Borrelia burgdorferi B31
MIINHNTSAINASRN

SEQ ID NO: 136050 - protein, 9 aa, Borrelia burgdorferi B31
IINHNTSAI

SEQ ID NO: 136051 - protein, 15 aa, Borrelia burgdorferi B31
IAVNIYAANVANLFS

SEQ ID NO: 136052 - protein, 9 aa, Borrelia burgdorferi B31
VNIYAANVA

SEQ ID NO: 136053 - protein, 15 aa, Borrelia burgdorferi B31
AIAVNIYAANVANLF

SEQ ID NO: 136054 - protein, 9 aa, Borrelia burgdorferi B31
VNIYAANVA

SEQ ID NO: 136055 - protein, 15 aa, Borrelia burgdorferi B31
TTNSILTQSAMAMIA

SEQ ID NO: 136056 - protein, 9 aa, Borrelia burgdorferi B31
LTQSAMAMI

SEQ ID NO: 136057 - protein, 15 aa, Borrelia burgdorferi B31
TNSILTQSAMAMIAQ

SEQ ID NO: 136058 - protein, 9 aa, Borrelia burgdorferi B31
LTQSAMAMI

SEQ ID NO: 136059 - protein, 15 aa, Borrelia burgdorferi B31
NSILTQSAMAMIAQA

SEQ ID NO: 136060 - protein, 9 aa, Borrelia burgdorferi B31
LTQSAMAMI

SEQ ID NO: 136061 - protein, 15 aa, Borrelia burgdorferi B31
SILTQSAMAMIAQAN

SEQ ID NO: 136062 - protein, 9 aa, Borrelia burgdorferi B31
LTQSAMAMI

SEQ ID NO: 136063 - protein, 15 aa, Borrelia burgdorferi B31
ATTNSILTQSAMAMI

SEQ ID NO: 136064 - protein, 9 aa, Borrelia burgdorferi B31
ILTQSAMAM

SEQ ID NO: 136065 - protein, 15 aa, Borrelia burgdorferi B31
EAIAVNIYAANVANL

SEQ ID NO: 136066 - protein, 9 aa, Borrelia burgdorferi B31
VNIYAANVA

SEQ ID NO: 136067 - protein, 15 aa, Borrelia burgdorferi B31
AVNIYAANVANLFSG

SEQ ID NO: 136068 - protein, 9 aa, Borrelia burgdorferi B31
IYAANVANL

SEQ ID NO: 136069 - protein, 15 aa, Borrelia burgdorferi B31
VNIYAANVANLFSGE

SEQ ID NO: 136070 - protein, 9 aa, Borrelia burgdorferi B31
IYAANVANL

SEQ ID NO: 136071 - protein, 15 aa, Borrelia burgdorferi B31
NTSLAKIENAIRMIS

SEQ ID NO: 136072 - protein, 9 aa, Borrelia burgdorferi B31
AKIENAIRM

SEQ ID NO: 136073 - protein, 15 aa, Borrelia burgdorferi B31
TSLAKIENAIRMISD

SEQ ID NO: 136074 - protein, 9 aa, Borrelia burgdorferi B31
IENAIRMIS

SEQ ID NO: 136075 - protein, 15 aa, Borrelia burgdorferi B31
SLAKIENAIRMISDQ

SEQ ID NO: 136076 - protein, 9 aa, Borrelia burgdorferi B31
IENAIRMIS

SEQ ID NO: 136077 - protein, 15 aa, Borrelia burgdorferi B31
ASRNNGINAANLSKT

SEQ ID NO: 136078 - protein, 9 aa, Borrelia burgdorferi B31
NGINAANLS

SEQ ID NO: 136079 - protein, 15 aa, Borrelia burgdorferi B31
SRNNGINAANLSKTQ

SEQ ID NO: 136080 - protein, 9 aa, Borrelia burgdorferi B31
INAANLSKT

SEQ ID NO: 136081 - protein, 15 aa, Borrelia burgdorferi B31
LAKIENAIRMISDQR

SEQ ID NO: 136082 - protein, 9 aa, Borrelia burgdorferi B31
IENAIRMIS

SEQ ID NO: 136083 - protein, 15 aa, Borrelia burgdorferi B31
AKIENAIRMISDQRA

SEQ ID NO: 136084 - protein, 9 aa, Borrelia burgdorferi B31
IENAIRMIS

SEQ ID NO: 136085 - protein, 15 aa, Borrelia burgdorferi B31
RNNGINAANLSKTQE

SEQ ID NO: 136086 - protein, 9 aa, Borrelia burgdorferi B31
INAANLSKT

SEQ ID NO: 136087 - protein, 15 aa, Borrelia burgdorferi B31
MGVSGKINAQIRGLS

SEQ ID NO: 136088 - protein, 9 aa, Borrelia burgdorferi B31
MGVSGKINA

SEQ ID NO: 136089 - protein, 15 aa, Borrelia burgdorferi B31
MIINHNTSAINASRN

SEQ ID NO: 136090 - protein, 9 aa, Borrelia burgdorferi B31
IINHNTSAI

SEQ ID NO: 136091 - protein, 15 aa, Borrelia burgdorferi B31
NNGINAANLSKTQEK

SEQ ID NO: 136092 - protein, 9 aa, Borrelia burgdorferi B31
INAANLSKT

SEQ ID NO: 136093 - protein, 15 aa, Borrelia burgdorferi B31
NGINAANLSKTQEKL

SEQ ID NO: 136094 - protein, 9 aa, Borrelia burgdorferi B31
INAANLSKT

SEQ ID NO: 136095 - protein, 15 aa, Borrelia burgdorferi B31
IINHNTSAINASRNN

SEQ ID NO: 136096 - protein, 9 aa, Borrelia burgdorferi B31
IINHNTSAI

SEQ ID NO: 136097 - protein, 15 aa, Borrelia burgdorferi B31
GVSGKINAQIRGLSQ

SEQ ID NO: 136098 - protein, 9 aa, Borrelia burgdorferi B31
INAQIRGLS

SEQ ID NO: 136099 - protein, 15 aa, Borrelia burgdorferi B31
VSGKINAQIRGLSQA

SEQ ID NO: 136100 - protein, 9 aa, Borrelia burgdorferi B31
INAQIRGLS

SEQ ID NO: 136101 - protein, 15 aa, Borrelia burgdorferi B31
RMKELAVQSGNGTYS

SEQ ID NO: 136102 - protein, 9 aa, Borrelia burgdorferi B31
LAVQSGNGT

SEQ ID NO: 136103 - protein, 15 aa, Borrelia burgdorferi B31
AIAVNIYAANVANLF

SEQ ID NO: 136104 - protein, 9 aa, Borrelia burgdorferi B31
VNIYAANVA

SEQ ID NO: 136105 - protein, 15 aa, Borrelia burgdorferi B31
IENAIRMISDQRANL

SEQ ID NO: 136106 - protein, 9 aa, Borrelia burgdorferi B31
IENAIRMIS

SEQ ID NO: 136107 - protein, 15 aa, Borrelia burgdorferi B31
IAVNIYAANVANLFS

SEQ ID NO: 136108 - protein, 9 aa, Borrelia burgdorferi B31
VNIYAANVA

SEQ ID NO: 136109 - protein, 15 aa, Borrelia burgdorferi B31
MKELAVQSGNGTYSD

SEQ ID NO: 136110 - protein, 9 aa, Borrelia burgdorferi B31
LAVQSGNGT

SEQ ID NO: 136111 - protein, 15 aa, Borrelia burgdorferi B31
SGKINAQIRGLSQAS

SEQ ID NO: 136112 - protein, 9 aa, Borrelia burgdorferi B31
INAQIRGLS

SEQ ID NO: 136113 - protein, 15 aa, Borrelia burgdorferi B31
GKINAQIRGLSQASR

SEQ ID NO: 136114 - protein, 9 aa, Borrelia burgdorferi B31
INAQIRGLS

SEQ ID NO: 136115 - protein, 15 aa, Borrelia burgdorferi B31
KIENAIRMISDQRAN

SEQ ID NO: 136116 - protein, 9 aa, Borrelia burgdorferi B31
IENAIRMIS

SEQ ID NO: 136117 - protein, 15 aa, Borrelia burgdorferi B31
KELAVQSGNGTYSDA

SEQ ID NO: 136118 - protein, 9 aa, Borrelia burgdorferi B31
LAVQSGNGT

SEQ ID NO: 136119 - protein, 15 aa, Borrelia burgdorferi B31
LVRMKELAVQSGNGT

SEQ ID NO: 136120 - protein, 9 aa, Borrelia burgdorferi B31
MKELAVQSG

SEQ ID NO: 136121 - protein, 15 aa, Borrelia burgdorferi B31
VRMKELAVQSGNGTY

SEQ ID NO: 136122 - protein, 9 aa, Borrelia burgdorferi B31
LAVQSGNGT

SEQ ID NO: 136123 - protein, 15 aa, Borrelia burgdorferi B31
AGMGVSGKINAQIRG

SEQ ID NO: 136124 - protein, 9 aa, Borrelia burgdorferi B31
MGVSGKINA

SEQ ID NO: 136125 - protein, 15 aa, Borrelia burgdorferi B31
AVNIYAANVANLFSG

SEQ ID NO: 136126 - protein, 9 aa, Borrelia burgdorferi B31
YAANVANLF

SEQ ID NO: 136127 - protein, 15 aa, Borrelia burgdorferi B31
VNIYAANVANLFSGE

SEQ ID NO: 136128 - protein, 9 aa, Borrelia burgdorferi B31
YAANVANLF

SEQ ID NO: 136129 - protein, 15 aa, Borrelia burgdorferi B31
SQGGVNSPVNVTTTV

SEQ ID NO: 136130 - protein, 9 aa, Borrelia burgdorferi B31
GVNSPVNVT

SEQ ID NO: 136131 - protein, 15 aa, Borrelia burgdorferi B31
QGGVNSPVNVTTTVD

SEQ ID NO: 136132 - protein, 9 aa, Borrelia burgdorferi B31
GVNSPVNVT

SEQ ID NO: 136133 - protein, 15 aa, Borrelia burgdorferi B31
GGVNSPVNVTTTVDA

SEQ ID NO: 136134 - protein, 9 aa, Borrelia burgdorferi B31
GVNSPVNVT

SEQ ID NO: 136135 - protein, 15 aa, Borrelia burgdorferi B31
INASRNNGINAANLS

SEQ ID NO: 136136 - protein, 9 aa, Borrelia burgdorferi B31
SRNNGINAA

SEQ ID NO: 136137 - protein, 15 aa, Borrelia burgdorferi B31
EAIAVNIYAANVANL

SEQ ID NO: 136138 - protein, 9 aa, Borrelia burgdorferi B31
VNIYAANVA

SEQ ID NO: 136139 - protein, 15 aa, Borrelia burgdorferi B31
PSQGGVNSPVNVTTT

SEQ ID NO: 136140 - protein, 9 aa, Borrelia burgdorferi B31
GVNSPVNVT

SEQ ID NO: 136141 - protein, 15 aa, Borrelia burgdorferi B31
APSQGGVNSPVNVTT

SEQ ID NO: 136142 - protein, 9 aa, Borrelia burgdorferi B31
GVNSPVNVT

SEQ ID NO: 136143 - protein, 15 aa, Borrelia burgdorferi B31
QDEAIAVNIYAANVA

SEQ ID NO: 136144 - protein, 9 aa, Borrelia burgdorferi B31
IAVNIYAAN

SEQ ID NO: 136145 - protein, 15 aa, Borrelia burgdorferi B31
DEAIAVNIYAANVAN

SEQ ID NO: 136146 - protein, 9 aa, Borrelia burgdorferi B31
VNIYAANVA

SEQ ID NO: 136147 - protein, 15 aa, Borrelia burgdorferi B31
GVNSPVNVTTTVDAN

SEQ ID NO: 136148 - protein, 9 aa, Borrelia burgdorferi B31
GVNSPVNVT

SEQ ID NO: 136149 - protein, 15 aa, Borrelia burgdorferi B31
NASRNNGINAANLSK

SEQ ID NO: 136150 - protein, 9 aa, Borrelia burgdorferi B31
NGINAANLS

SEQ ID NO: 136151 - protein, 15 aa, Borrelia burgdorferi B31
RGLSQASRNTSKAIN

SEQ ID NO: 136152 - protein, 9 aa, Borrelia burgdorferi B31
LSQASRNTS

SEQ ID NO: 136153 - protein, 15 aa, Borrelia burgdorferi B31
ELAVQSGNGTYSDAD

SEQ ID NO: 136154 - protein, 9 aa, Borrelia burgdorferi B31
LAVQSGNGT

SEQ ID NO: 136155 - protein, 15 aa, Borrelia burgdorferi B31
IRGLSQASRNTSKAI

SEQ ID NO: 136156 - protein, 9 aa, Borrelia burgdorferi B31
LSQASRNTS

SEQ ID NO: 136157 - protein, 15 aa, Borrelia burgdorferi B31
LAVQSGNGTYSDADR

SEQ ID NO: 136158 - protein, 9 aa, Borrelia burgdorferi B31
LAVQSGNGT

SEQ ID NO: 136159 - protein, 15 aa, Borrelia burgdorferi B31
TSAINASRNNGINAA

SEQ ID NO: 136160 - protein, 9 aa, Borrelia burgdorferi B31
AINASRNNG

SEQ ID NO: 136161 - protein, 15 aa, Borrelia burgdorferi B31
QIRGLSQASRNTSKA

SEQ ID NO: 136162 - protein, 9 aa, Borrelia burgdorferi B31
LSQASRNTS

SEQ ID NO: 136163 - protein, 15 aa, Borrelia burgdorferi B31
INHNTSAINASRNNG

SEQ ID NO: 136164 - protein, 9 aa, Borrelia burgdorferi B31
INHNTSAIN

SEQ ID NO: 136165 - protein, 15 aa, Borrelia burgdorferi B31
NAQIRGLSQASRNTS

SEQ ID NO: 136166 - protein, 9 aa, Borrelia burgdorferi B31
RGLSQASRN

SEQ ID NO: 136167 - protein, 15 aa, Borrelia burgdorferi B31
AQIRGLSQASRNTSK

SEQ ID NO: 136168 - protein, 9 aa, Borrelia burgdorferi B31
LSQASRNTS

SEQ ID NO: 136169 - protein, 15 aa, Borrelia burgdorferi B31
QNRLESIKNSTEYAI

SEQ ID NO: 136170 - protein, 9 aa, Borrelia burgdorferi B31
LESIKNSTE

SEQ ID NO: 136171 - protein, 15 aa, Borrelia burgdorferi B31
NIYAANVANLFSGEG

SEQ ID NO: 136172 - protein, 9 aa, Borrelia burgdorferi B31
YAANVANLF

SEQ ID NO: 136173 - protein, 15 aa, Borrelia burgdorferi B31
NRLESIKNSTEYAIE

SEQ ID NO: 136174 - protein, 9 aa, Borrelia burgdorferi B31
IKNSTEYAI

SEQ ID NO: 136175 - protein, 15 aa, Borrelia burgdorferi B31
GMGVSGKINAQIRGL

SEQ ID NO: 136176 - protein, 9 aa, Borrelia burgdorferi B31
MGVSGKINA

SEQ ID NO: 136177 - protein, 15 aa, Borrelia burgdorferi B31
SKAINFIQTTEGNLN

SEQ ID NO: 136178 - protein, 9 aa, Borrelia burgdorferi B31
INFIQTTEG

SEQ ID NO: 136179 - protein, 15 aa, Borrelia burgdorferi B31
EKVLVRMKELAVQSG

SEQ ID NO: 136180 - protein, 9 aa, Borrelia burgdorferi B31
LVRMKELAV

SEQ ID NO: 136181 - protein, 15 aa, Borrelia burgdorferi B31
KVLVRMKELAVQSGN

SEQ ID NO: 136182 - protein, 9 aa, Borrelia burgdorferi B31
LVRMKELAV

SEQ ID NO: 136183 - protein, 15 aa, Borrelia burgdorferi B31
VEKVLVRMKELAVQS

SEQ ID NO: 136184 - protein, 9 aa, Borrelia burgdorferi B31
LVRMKELAV

SEQ ID NO: 136185 - protein, 15 aa, Borrelia burgdorferi B31
EVEKVLVRMKELAVQ

SEQ ID NO: 136186 - protein, 9 aa, Borrelia burgdorferi B31
LVRMKELAV

SEQ ID NO: 136187 - protein, 15 aa, Borrelia burgdorferi B31
VLVRMKELAVQSGNG

SEQ ID NO: 136188 - protein, 9 aa, Borrelia burgdorferi B31
VRMKELAVQ

SEQ ID NO: 136189 - protein, 15 aa, Borrelia burgdorferi B31
LVRMKELAVQSGNGT

SEQ ID NO: 136190 - protein, 9 aa, Borrelia burgdorferi B31
VRMKELAVQ

SEQ ID NO: 136191 - protein, 15 aa, Borrelia burgdorferi B31
INAQIRGLSQASRNT

SEQ ID NO: 136192 - protein, 9 aa, Borrelia burgdorferi B31
IRGLSQASR

SEQ ID NO: 136193 - protein, 15 aa, Borrelia burgdorferi B31
GKINAQIRGLSQASR

SEQ ID NO: 136194 - protein, 9 aa, Borrelia burgdorferi B31
QIRGLSQAS

SEQ ID NO: 136195 - protein, 15 aa, Borrelia burgdorferi B31
NAQIRGLSQASRNTS

SEQ ID NO: 136196 - protein, 9 aa, Borrelia burgdorferi B31
IRGLSQASR

SEQ ID NO: 136197 - protein, 15 aa, Borrelia burgdorferi B31
KINAQIRGLSQASRN

SEQ ID NO: 136198 - protein, 9 aa, Borrelia burgdorferi B31
IRGLSQASR

SEQ ID NO: 136199 - protein, 15 aa, Borrelia burgdorferi B31
AQIRGLSQASRNTSK

SEQ ID NO: 136200 - protein, 9 aa, Borrelia burgdorferi B31
IRGLSQASR

SEQ ID NO: 136201 - protein, 15 aa, Borrelia burgdorferi B31
NEVEKVLVRMKELAV

SEQ ID NO: 136202 - protein, 9 aa, Borrelia burgdorferi B31
VLVRMKELA

SEQ ID NO: 136203 - protein, 15 aa, Borrelia burgdorferi B31
KIENAIRMISDQRAN

SEQ ID NO: 136204 - protein, 9 aa, Borrelia burgdorferi B31
AIRMISDQR

SEQ ID NO: 136205 - protein, 15 aa, Borrelia burgdorferi B31
IENAIRMISDQRANL

SEQ ID NO: 136206 - protein, 9 aa, Borrelia burgdorferi B31
AIRMISDQR

SEQ ID NO: 136207 - protein, 15 aa, Borrelia burgdorferi B31
AKIENAIRMISDQRA

SEQ ID NO: 136208 - protein, 9 aa, Borrelia burgdorferi B31
AIRMISDQR

SEQ ID NO: 136209 - protein, 15 aa, Borrelia burgdorferi B31
ENAIRMISDQRANLG

SEQ ID NO: 136210 - protein, 9 aa, Borrelia burgdorferi B31
AIRMISDQR

SEQ ID NO: 136211 - protein, 15 aa, Borrelia burgdorferi B31
LAKIENAIRMISDQR

SEQ ID NO: 136212 - protein, 9 aa, Borrelia burgdorferi B31
LAKIENAIR

SEQ ID NO: 136213 - protein, 15 aa, Borrelia burgdorferi B31
QYNQMHMLSNKSASQ

SEQ ID NO: 136214 - protein, 9 aa, Borrelia burgdorferi B31
MHMLSNKSA

SEQ ID NO: 136215 - protein, 15 aa, Borrelia burgdorferi B31
QIRGLSQASRNTSKA

SEQ ID NO: 136216 - protein, 9 aa, Borrelia burgdorferi B31
IRGLSQASR

SEQ ID NO: 136217 - protein, 15 aa, Borrelia burgdorferi B31
YNQMHMLSNKSASQN

SEQ ID NO: 136218 - protein, 9 aa, Borrelia burgdorferi B31
MHMLSNKSA

SEQ ID NO: 136219 - protein, 15 aa, Borrelia burgdorferi B31
IRGLSQASRNTSKAI

SEQ ID NO: 136220 - protein, 9 aa, Borrelia burgdorferi B31
IRGLSQASR

SEQ ID NO: 136221 - protein, 15 aa, Borrelia burgdorferi B31
AQYNQMHMLSNKSAS

SEQ ID NO: 136222 - protein, 9 aa, Borrelia burgdorferi B31
MHMLSNKSA

SEQ ID NO: 136223 - protein, 15 aa, Borrelia burgdorferi B31
VRMKELAVQSGNGTY

SEQ ID NO: 136224 - protein, 9 aa, Borrelia burgdorferi B31
VRMKELAVQ

SEQ ID NO: 136225 - protein, 15 aa, Borrelia burgdorferi B31
QAQYNQMHMLSNKSA

SEQ ID NO: 136226 - protein, 9 aa, Borrelia burgdorferi B31
QMHMLSNKS

SEQ ID NO: 136227 - protein, 15 aa, Borrelia burgdorferi B31
AIRMISDQRANLGAF

SEQ ID NO: 136228 - protein, 9 aa, Borrelia burgdorferi B31
AIRMISDQR

SEQ ID NO: 136229 - protein, 15 aa, Borrelia burgdorferi B31
NQMHMLSNKSASQNV

SEQ ID NO: 136230 - protein, 9 aa, Borrelia burgdorferi B31
MHMLSNKSA

SEQ ID NO: 136231 - protein, 15 aa, Borrelia burgdorferi B31
QASWTLRVHVGANQD

SEQ ID NO: 136232 - protein, 9 aa, Borrelia burgdorferi B31
LRVHVGANQ

SEQ ID NO: 136233 - protein, 15 aa, Borrelia burgdorferi B31
NAIRMISDQRANLGA

SEQ ID NO: 136234 - protein, 9 aa, Borrelia burgdorferi B31
AIRMISDQR

SEQ ID NO: 136235 - protein, 15 aa, Borrelia burgdorferi B31
SQASWTLRVHVGANQ

SEQ ID NO: 136236 - protein, 9 aa, Borrelia burgdorferi B31
QASWTLRVH

SEQ ID NO: 136237 - protein, 15 aa, Borrelia burgdorferi B31
EVEKVLVRMKELAVQ

SEQ ID NO: 136238 - protein, 9 aa, Borrelia burgdorferi B31
VEKVLVRMK

SEQ ID NO: 136239 - protein, 15 aa, Borrelia burgdorferi B31
VEKVLVRMKELAVQS

SEQ ID NO: 136240 - protein, 9 aa, Borrelia burgdorferi B31
VRMKELAVQ

SEQ ID NO: 136241 - protein, 15 aa, Borrelia burgdorferi B31
EKVLVRMKELAVQSG

SEQ ID NO: 136242 - protein, 9 aa, Borrelia burgdorferi B31
VRMKELAVQ

SEQ ID NO: 136243 - protein, 15 aa, Borrelia burgdorferi B31
KVLVRMKELAVQSGN

SEQ ID NO: 136244 - protein, 9 aa, Borrelia burgdorferi B31
VRMKELAVQ

SEQ ID NO: 136245 - protein, 15 aa, Borrelia burgdorferi B31
VLVRMKELAVQSGNG

SEQ ID NO: 136246 - protein, 9 aa, Borrelia burgdorferi B31
VRMKELAVQ

SEQ ID NO: 136247 - protein, 15 aa, Borrelia burgdorferi B31
ENAIRMISDQRANLG

SEQ ID NO: 136248 - protein, 9 aa, Borrelia burgdorferi B31
IRMISDQRA

SEQ ID NO: 136249 - protein, 15 aa, Borrelia burgdorferi B31
NAIRMISDQRANLGA

SEQ ID NO: 136250 - protein, 9 aa, Borrelia burgdorferi B31
IRMISDQRA

SEQ ID NO: 136251 - protein, 15 aa, Borrelia burgdorferi B31
VRMKELAVQSGNGTY

SEQ ID NO: 136252 - protein, 9 aa, Borrelia burgdorferi B31
VRMKELAVQ

SEQ ID NO: 136253 - protein, 15 aa, Borrelia burgdorferi B31
LVRMKELAVQSGNGT

SEQ ID NO: 136254 - protein, 9 aa, Borrelia burgdorferi B31
VRMKELAVQ

SEQ ID NO: 136255 - protein, 15 aa, Borrelia burgdorferi B31
AIRMISDQRANLGAF

SEQ ID NO: 136256 - protein, 9 aa, Borrelia burgdorferi B31
ISDQRANLG

SEQ ID NO: 136257 - protein, 15 aa, Borrelia burgdorferi B31
IRMISDQRANLGAFQ

SEQ ID NO: 136258 - protein, 9 aa, Borrelia burgdorferi B31
ISDQRANLG

SEQ ID NO: 136259 - protein, 15 aa, Borrelia burgdorferi B31
NTSLAKIENAIRMIS

SEQ ID NO: 136260 - protein, 9 aa, Borrelia burgdorferi B31
AKIENAIRM

SEQ ID NO: 136261 - protein, 15 aa, Borrelia burgdorferi B31
TSLAKIENAIRMISD

SEQ ID NO: 136262 - protein, 9 aa, Borrelia burgdorferi B31
AKIENAIRM

SEQ ID NO: 136263 - protein, 15 aa, Borrelia burgdorferi B31
DANTSLAKIENAIRM

SEQ ID NO: 136264 - protein, 9 aa, Borrelia burgdorferi B31
LAKIENAIR

SEQ ID NO: 136265 - protein, 15 aa, Borrelia burgdorferi B31
ANTSLAKIENAIRMI

SEQ ID NO: 136266 - protein, 9 aa, Borrelia burgdorferi B31
AKIENAIRM

SEQ ID NO: 136267 - protein, 15 aa, Borrelia burgdorferi B31
SLAKIENAIRMISDQ

SEQ ID NO: 136268 - protein, 9 aa, Borrelia burgdorferi B31
AKIENAIRM

SEQ ID NO: 136269 - protein, 15 aa, Borrelia burgdorferi B31
LTFLSIFTQGYTQFS

SEQ ID NO: 136270 - protein, 9 aa, Borrelia burgdorferi B31
FLSIFTQGY

SEQ ID NO: 136271 - protein, 15 aa, Borrelia burgdorferi B31
TFLSIFTQGYTQFSS

SEQ ID NO: 136272 - protein, 9 aa, Borrelia burgdorferi B31
FTQGYTQFS

SEQ ID NO: 136273 - protein, 15 aa, Borrelia burgdorferi B31
FLSIFTQGYTQFSSH

SEQ ID NO: 136274 - protein, 9 aa, Borrelia burgdorferi B31
FTQGYTQFS

SEQ ID NO: 136275 - protein, 15 aa, Borrelia burgdorferi B31
LSIFTQGYTQFSSHN

SEQ ID NO: 136276 - protein, 9 aa, Borrelia burgdorferi B31
FTQGYTQFS

SEQ ID NO: 136277 - protein, 15 aa, Borrelia burgdorferi B31
SIFTQGYTQFSSHNY

SEQ ID NO: 136278 - protein, 9 aa, Borrelia burgdorferi B31
FTQGYTQFS

SEQ ID NO: 136279 - protein, 15 aa, Borrelia burgdorferi B31
DNVKIRKALTLAIDR

SEQ ID NO: 136280 - protein, 9 aa, Borrelia burgdorferi B31
IRKALTLAI

SEQ ID NO: 136281 - protein, 15 aa, Borrelia burgdorferi B31
LDNVKIRKALTLAID

SEQ ID NO: 136282 - protein, 9 aa, Borrelia burgdorferi B31
IRKALTLAI

SEQ ID NO: 136283 - protein, 15 aa, Borrelia burgdorferi B31
PLDNVKIRKALTLAI

SEQ ID NO: 136284 - protein, 9 aa, Borrelia burgdorferi B31
VKIRKALTL

SEQ ID NO: 136285 - protein, 15 aa, Borrelia burgdorferi B31
VHQSFIPVPVHVTEK

SEQ ID NO: 136286 - protein, 9 aa, Borrelia burgdorferi B31
FIPVPVHVT

SEQ ID NO: 136287 - protein, 15 aa, Borrelia burgdorferi B31
NVKIRKALTLAIDRE

SEQ ID NO: 136288 - protein, 9 aa, Borrelia burgdorferi B31
IRKALTLAI

SEQ ID NO: 136289 - protein, 15 aa, Borrelia burgdorferi B31
VKIRKALTLAIDRET

SEQ ID NO: 136290 - protein, 9 aa, Borrelia burgdorferi B31
IRKALTLAI

SEQ ID NO: 136291 - protein, 15 aa, Borrelia burgdorferi B31
MLVHQSFIPVPVHVT

SEQ ID NO: 136292 - protein, 9 aa, Borrelia burgdorferi B31
HQSFIPVPV

SEQ ID NO: 136293 - protein, 15 aa, Borrelia burgdorferi B31
LVHQSFIPVPVHVTE

SEQ ID NO: 136294 - protein, 9 aa, Borrelia burgdorferi B31
FIPVPVHVT

SEQ ID NO: 136295 - protein, 15 aa, Borrelia burgdorferi B31
HQSFIPVPVHVTEKY

SEQ ID NO: 136296 - protein, 9 aa, Borrelia burgdorferi B31
FIPVPVHVT

SEQ ID NO: 136297 - protein, 15 aa, Borrelia burgdorferi B31
QSFIPVPVHVTEKYG

SEQ ID NO: 136298 - protein, 9 aa, Borrelia burgdorferi B31
FIPVPVHVT

SEQ ID NO: 136299 - protein, 15 aa, Borrelia burgdorferi B31
IFTQGYTQFSSHNYS

SEQ ID NO: 136300 - protein, 9 aa, Borrelia burgdorferi B31
FTQGYTQFS

SEQ ID NO: 136301 - protein, 15 aa, Borrelia burgdorferi B31
TMFRGIVTGDPNTGG

SEQ ID NO: 136302 - protein, 9 aa, Borrelia burgdorferi B31
IVTGDPNTG

SEQ ID NO: 136303 - protein, 15 aa, Borrelia burgdorferi B31
FTQGYTQFSSHNYSN

SEQ ID NO: 136304 - protein, 9 aa, Borrelia burgdorferi B31
FTQGYTQFS

SEQ ID NO: 136305 - protein, 15 aa, Borrelia burgdorferi B31
DTMFRGIVTGDPNTG

SEQ ID NO: 136306 - protein, 9 aa, Borrelia burgdorferi B31
FRGIVTGDP

SEQ ID NO: 136307 - protein, 15 aa, Borrelia burgdorferi B31
FRGIVTGDPNTGGNK

SEQ ID NO: 136308 - protein, 9 aa, Borrelia burgdorferi B31
IVTGDPNTG

SEQ ID NO: 136309 - protein, 15 aa, Borrelia burgdorferi B31
MFRGIVTGDPNTGGN

SEQ ID NO: 136310 - protein, 9 aa, Borrelia burgdorferi B31
IVTGDPNTG

SEQ ID NO: 136311 - protein, 15 aa, Borrelia burgdorferi B31
SLELFNPEIAKTLLA

SEQ ID NO: 136312 - protein, 9 aa, Borrelia burgdorferi B31
FNPEIAKTL

SEQ ID NO: 136313 - protein, 15 aa, Borrelia burgdorferi B31
LELFNPEIAKTLLAE

SEQ ID NO: 136314 - protein, 9 aa, Borrelia burgdorferi B31
FNPEIAKTL

SEQ ID NO: 136315 - protein, 15 aa, Borrelia burgdorferi B31
KSLELFNPEIAKTLL

SEQ ID NO: 136316 - protein, 9 aa, Borrelia burgdorferi B31
FNPEIAKTL

SEQ ID NO: 136317 - protein, 15 aa, Borrelia burgdorferi B31
AKSLELFNPEIAKTL

SEQ ID NO: 136318 - protein, 9 aa, Borrelia burgdorferi B31
LFNPEIAKT

SEQ ID NO: 136319 - protein, 15 aa, Borrelia burgdorferi B31
KIRKALTLAIDRETL

SEQ ID NO: 136320 - protein, 9 aa, Borrelia burgdorferi B31
IRKALTLAI

SEQ ID NO: 136321 - protein, 15 aa, Borrelia burgdorferi B31
ITFYTTNDSSTAYKM

SEQ ID NO: 136322 - protein, 9 aa, Borrelia burgdorferi B31
YTTNDSSTA

SEQ ID NO: 136323 - protein, 15 aa, Borrelia burgdorferi B31
EEITFYTTNDSSTAY

SEQ ID NO: 136324 - protein, 9 aa, Borrelia burgdorferi B31
YTTNDSSTA

SEQ ID NO: 136325 - protein, 15 aa, Borrelia burgdorferi B31
EITFYTTNDSSTAYK

SEQ ID NO: 136326 - protein, 9 aa, Borrelia burgdorferi B31
YTTNDSSTA

SEQ ID NO: 136327 - protein, 15 aa, Borrelia burgdorferi B31
IRKALTLAIDRETLT

SEQ ID NO: 136328 - protein, 9 aa, Borrelia burgdorferi B31
IRKALTLAI

SEQ ID NO: 136329 - protein, 15 aa, Borrelia burgdorferi B31
ELFNPEIAKTLLAEA

SEQ ID NO: 136330 - protein, 9 aa, Borrelia burgdorferi B31
FNPEIAKTL

SEQ ID NO: 136331 - protein, 15 aa, Borrelia burgdorferi B31
SFIPVPVHVTEKYGQ

SEQ ID NO: 136332 - protein, 9 aa, Borrelia burgdorferi B31
FIPVPVHVT

SEQ ID NO: 136333 - protein, 15 aa, Borrelia burgdorferi B31
LEEITFYTTNDSSTA

SEQ ID NO: 136334 - protein, 9 aa, Borrelia burgdorferi B31
ITFYTTNDS

SEQ ID NO: 136335 - protein, 15 aa, Borrelia burgdorferi B31
TFYTTNDSSTAYKMY

SEQ ID NO: 136336 - protein, 9 aa, Borrelia burgdorferi B31
YTTNDSSTA

SEQ ID NO: 136337 - protein, 15 aa, Borrelia burgdorferi B31
FIPVPVHVTEKYGQN

SEQ ID NO: 136338 - protein, 9 aa, Borrelia burgdorferi B31
FIPVPVHVT

SEQ ID NO: 136339 - protein, 15 aa, Borrelia burgdorferi B31
RGIVTGDPNTGGNKP

SEQ ID NO: 136340 - protein, 9 aa, Borrelia burgdorferi B31
IVTGDPNTG

SEQ ID NO: 136341 - protein, 15 aa, Borrelia burgdorferi B31
TSPENMVTSGPFKLK

SEQ ID NO: 136342 - protein, 9 aa, Borrelia burgdorferi B31
MVTSGPFKL

SEQ ID NO: 136343 - protein, 15 aa, Borrelia burgdorferi B31
REKITWSDGVAITAE

SEQ ID NO: 136344 - protein, 9 aa, Borrelia burgdorferi B31
ITWSDGVAI

SEQ ID NO: 136345 - protein, 15 aa, Borrelia burgdorferi B31
LREKITWSDGVAITA

SEQ ID NO: 136346 - protein, 9 aa, Borrelia burgdorferi B31
ITWSDGVAI

SEQ ID NO: 136347 - protein, 15 aa, Borrelia burgdorferi B31
EKITWSDGVAITAEG

SEQ ID NO: 136348 - protein, 9 aa, Borrelia burgdorferi B31
ITWSDGVAI

SEQ ID NO: 136349 - protein, 15 aa, Borrelia burgdorferi B31
YKVLDNGTTPTRRAT

SEQ ID NO: 136350 - protein, 9 aa, Borrelia burgdorferi B31
LDNGTTPTR

SEQ ID NO: 136351 - protein, 15 aa, Borrelia burgdorferi B31
DAIFGSIPPDLIKNL

SEQ ID NO: 136352 - protein, 9 aa, Borrelia burgdorferi B31
FGSIPPDLI

SEQ ID NO: 136353 - protein, 15 aa, Borrelia burgdorferi B31
KITWSDGVAITAEGI

SEQ ID NO: 136354 - protein, 9 aa, Borrelia burgdorferi B31
ITWSDGVAI

SEQ ID NO: 136355 - protein, 15 aa, Borrelia burgdorferi B31
PYFIDMLVHQSFIPV

SEQ ID NO: 136356 - protein, 9 aa, Borrelia burgdorferi B31
FIDMLVHQS

SEQ ID NO: 136357 - protein, 15 aa, Borrelia burgdorferi B31
PENMVTSGPFKLKER

SEQ ID NO: 136358 - protein, 9 aa, Borrelia burgdorferi B31
MVTSGPFKL

SEQ ID NO: 136359 - protein, 15 aa, Borrelia burgdorferi B31
LDAIFGSIPPDLIKN

SEQ ID NO: 136360 - protein, 9 aa, Borrelia burgdorferi B31
FGSIPPDLI

SEQ ID NO: 136361 - protein, 15 aa, Borrelia burgdorferi B31
TYKVLDNGTTPTRRA

SEQ ID NO: 136362 - protein, 9 aa, Borrelia burgdorferi B31
LDNGTTPTR

SEQ ID NO: 136363 - protein, 15 aa, Borrelia burgdorferi B31
IKPLDNVKIRKALTL

SEQ ID NO: 136364 - protein, 9 aa, Borrelia burgdorferi B31
IKPLDNVKI

SEQ ID NO: 136365 - protein, 15 aa, Borrelia burgdorferi B31
KPYFIDMLVHQSFIP

SEQ ID NO: 136366 - protein, 9 aa, Borrelia burgdorferi B31
FIDMLVHQS

SEQ ID NO: 136367 - protein, 15 aa, Borrelia burgdorferi B31
SPENMVTSGPFKLKE

SEQ ID NO: 136368 - protein, 9 aa, Borrelia burgdorferi B31
MVTSGPFKL

SEQ ID NO: 136369 - protein, 15 aa, Borrelia burgdorferi B31
ELDAIFGSIPPDLIK

SEQ ID NO: 136370 - protein, 9 aa, Borrelia burgdorferi B31
FGSIPPDLI

SEQ ID NO: 136371 - protein, 15 aa, Borrelia burgdorferi B31
EELDAIFGSIPPDLI

SEQ ID NO: 136372 - protein, 9 aa, Borrelia burgdorferi B31
IFGSIPPDL

SEQ ID NO: 136373 - protein, 15 aa, Borrelia burgdorferi B31
ITWSDGVAITAEGIR

SEQ ID NO: 136374 - protein, 9 aa, Borrelia burgdorferi B31
ITWSDGVAI

SEQ ID NO: 136375 - protein, 15 aa, Borrelia burgdorferi B31
WSDGVAITAEGIRKS

SEQ ID NO: 136376 - protein, 9 aa, Borrelia burgdorferi B31
GVAITAEGI

SEQ ID NO: 136377 - protein, 15 aa, Borrelia burgdorferi B31
LTYKVLDNGTTPTRR

SEQ ID NO: 136378 - protein, 9 aa, Borrelia burgdorferi B31
VLDNGTTPT

SEQ ID NO: 136379 - protein, 15 aa, Borrelia burgdorferi B31
GQNWTSPENMVTSGP

SEQ ID NO: 136380 - protein, 9 aa, Borrelia burgdorferi B31
WTSPENMVT

SEQ ID NO: 136381 - protein, 15 aa, Borrelia burgdorferi B31
TLTYKVLDNGTTPTR

SEQ ID NO: 136382 - protein, 9 aa, Borrelia burgdorferi B31
YKVLDNGTT

SEQ ID NO: 136383 - protein, 15 aa, Borrelia burgdorferi B31
SDGVAITAEGIRKSY

SEQ ID NO: 136384 - protein, 9 aa, Borrelia burgdorferi B31
ITAEGIRKS

SEQ ID NO: 136385 - protein, 15 aa, Borrelia burgdorferi B31
PKPYFIDMLVHQSFI

SEQ ID NO: 136386 - protein, 9 aa, Borrelia burgdorferi B31
FIDMLVHQS

SEQ ID NO: 136387 - protein, 15 aa, Borrelia burgdorferi B31
WTSPENMVTSGPFKL

SEQ ID NO: 136388 - protein, 9 aa, Borrelia burgdorferi B31
WTSPENMVT

SEQ ID NO: 136389 - protein, 15 aa, Borrelia burgdorferi B31
LFNPEIAKTLLAEAG

SEQ ID NO: 136390 - protein, 9 aa, Borrelia burgdorferi B31
FNPEIAKTL

SEQ ID NO: 136391 - protein, 15 aa, Borrelia burgdorferi B31
SPKPYFIDMLVHQSF

SEQ ID NO: 136392 - protein, 9 aa, Borrelia burgdorferi B31
FIDMLVHQS

SEQ ID NO: 136393 - protein, 15 aa, Borrelia burgdorferi B31
QNWTSPENMVTSGPF

SEQ ID NO: 136394 - protein, 9 aa, Borrelia burgdorferi B31
WTSPENMVT

SEQ ID NO: 136395 - protein, 15 aa, Borrelia burgdorferi B31
NTHIKPLDNVKIRKA

SEQ ID NO: 136396 - protein, 9 aa, Borrelia burgdorferi B31
IKPLDNVKI

SEQ ID NO: 136397 - protein, 15 aa, Borrelia burgdorferi B31
THIKPLDNVKIRKAL

SEQ ID NO: 136398 - protein, 9 aa, Borrelia burgdorferi B31
IKPLDNVKI

SEQ ID NO: 136399 - protein, 15 aa, Borrelia burgdorferi B31
ENMVTSGPFKLKERI

SEQ ID NO: 136400 - protein, 9 aa, Borrelia burgdorferi B31
MVTSGPFKL

SEQ ID NO: 136401 - protein, 15 aa, Borrelia burgdorferi B31
AIFGSIPPDLIKNLK

SEQ ID NO: 136402 - protein, 9 aa, Borrelia burgdorferi B31
FGSIPPDLI

SEQ ID NO: 136403 - protein, 15 aa, Borrelia burgdorferi B31
FNPEIAKTLLAEAGY

SEQ ID NO: 136404 - protein, 9 aa, Borrelia burgdorferi B31
FNPEIAKTL

SEQ ID NO: 136405 - protein, 15 aa, Borrelia burgdorferi B31
ESPKPYFIDMLVHQS

SEQ ID NO: 136406 - protein, 9 aa, Borrelia burgdorferi B31
YFIDMLVHQ

SEQ ID NO: 136407 - protein, 15 aa, Borrelia burgdorferi B31
PDLIKNLKLRSDYYS

SEQ ID NO: 136408 - protein, 9 aa, Borrelia burgdorferi B31
IKNLKLRSD

SEQ ID NO: 136409 - protein, 15 aa, Borrelia burgdorferi B31
KPLDNVKIRKALTLA

SEQ ID NO: 136410 - protein, 9 aa, Borrelia burgdorferi B31
VKIRKALTL

SEQ ID NO: 136411 - protein, 15 aa, Borrelia burgdorferi B31
EKYGQNWTSPENMVT

SEQ ID NO: 136412 - protein, 9 aa, Borrelia burgdorferi B31
GQNWTSPEN

SEQ ID NO: 136413 - protein, 15 aa, Borrelia burgdorferi B31
KYGQNWTSPENMVTS

SEQ ID NO: 136414 - protein, 9 aa, Borrelia burgdorferi B31
WTSPENMVT

SEQ ID NO: 136415 - protein, 15 aa, Borrelia burgdorferi B31
VSFKISLGAEPSSLD

SEQ ID NO: 136416 - protein, 9 aa, Borrelia burgdorferi B31
FKISLGAEP

SEQ ID NO: 136417 - protein, 15 aa, Borrelia burgdorferi B31
GVAITAEGIRKSYLR

SEQ ID NO: 136418 - protein, 9 aa, Borrelia burgdorferi B31
ITAEGIRKS

SEQ ID NO: 136419 - protein, 15 aa, Borrelia burgdorferi B31
DLIKNLKLRSDYYSS

SEQ ID NO: 136420 - protein, 9 aa, Borrelia burgdorferi B31
IKNLKLRSD

SEQ ID NO: 136421 - protein, 15 aa, Borrelia burgdorferi B31
DGVAITAEGIRKSYL

SEQ ID NO: 136422 - protein, 9 aa, Borrelia burgdorferi B31
ITAEGIRKS

SEQ ID NO: 136423 - protein, 15 aa, Borrelia burgdorferi B31
PEIAKTLLAEAGYPN

SEQ ID NO: 136424 - protein, 9 aa, Borrelia burgdorferi B31
AKTLLAEAG

SEQ ID NO: 136425 - protein, 15 aa, Borrelia burgdorferi B31
YGQNWTSPENMVTSG

SEQ ID NO: 136426 - protein, 9 aa, Borrelia burgdorferi B31
WTSPENMVT

SEQ ID NO: 136427 - protein, 15 aa, Borrelia burgdorferi B31
EIAKTLLAEAGYPNG

SEQ ID NO: 136428 - protein, 9 aa, Borrelia burgdorferi B31
AKTLLAEAG

SEQ ID NO: 136429 - protein, 15 aa, Borrelia burgdorferi B31
LKLRSDYYSSAVNAI

SEQ ID NO: 136430 - protein, 9 aa, Borrelia burgdorferi B31
LKLRSDYYS

SEQ ID NO: 136431 - protein, 15 aa, Borrelia burgdorferi B31
FNTHIKPLDNVKIRK

SEQ ID NO: 136432 - protein, 9 aa, Borrelia burgdorferi B31
IKPLDNVKI

SEQ ID NO: 136433 - protein, 15 aa, Borrelia burgdorferi B31
YAFNTHIKPLDNVKI

SEQ ID NO: 136434 - protein, 9 aa, Borrelia burgdorferi B31
FNTHIKPLD

SEQ ID NO: 136435 - protein, 15 aa, Borrelia burgdorferi B31
AFNTHIKPLDNVKIR

SEQ ID NO: 136436 - protein, 9 aa, Borrelia burgdorferi B31
IKPLDNVKI

SEQ ID NO: 136437 - protein, 15 aa, Borrelia burgdorferi B31
KVLDNGTTPTRRATP

SEQ ID NO: 136438 - protein, 9 aa, Borrelia burgdorferi B31
LDNGTTPTR

SEQ ID NO: 136439 - protein, 15 aa, Borrelia burgdorferi B31
NLREKITWSDGVAIT

SEQ ID NO: 136440 - protein, 9 aa, Borrelia burgdorferi B31
ITWSDGVAI

SEQ ID NO: 136441 - protein, 15 aa, Borrelia burgdorferi B31
MKLQRSLFLIIFFLT

SEQ ID NO: 136442 - protein, 9 aa, Borrelia burgdorferi B31
MKLQRSLFL

SEQ ID NO: 136443 - protein, 15 aa, Borrelia burgdorferi B31
GIVTGDPNTGGNKPG

SEQ ID NO: 136444 - protein, 9 aa, Borrelia burgdorferi B31
IVTGDPNTG

SEQ ID NO: 136445 - protein, 15 aa, Borrelia burgdorferi B31
SFKISLGAEPSSLDP

SEQ ID NO: 136446 - protein, 9 aa, Borrelia burgdorferi B31
LGAEPSSLD

SEQ ID NO: 136447 - protein, 15 aa, Borrelia burgdorferi B31
FNLREKITWSDGVAI

SEQ ID NO: 136448 - protein, 9 aa, Borrelia burgdorferi B31
LREKITWSD

SEQ ID NO: 136449 - protein, 15 aa, Borrelia burgdorferi B31
NEEWTTYLNTKANGN

SEQ ID NO: 136450 - protein, 9 aa, Borrelia burgdorferi B31
WTTYLNTKA

SEQ ID NO: 136451 - protein, 15 aa, Borrelia burgdorferi B31
EEWTTYLNTKANGNY

SEQ ID NO: 136452 - protein, 9 aa, Borrelia burgdorferi B31
YLNTKANGN

SEQ ID NO: 136453 - protein, 15 aa, Borrelia burgdorferi B31
IAPIYIYGNSYLFRN

SEQ ID NO: 136454 - protein, 9 aa, Borrelia burgdorferi B31
YIYGNSYLF

SEQ ID NO: 136455 - protein, 15 aa, Borrelia burgdorferi B31
KLRSDYYSSAVNAIY

SEQ ID NO: 136456 - protein, 9 aa, Borrelia burgdorferi B31
YYSSAVNAI

SEQ ID NO: 136457 - protein, 15 aa, Borrelia burgdorferi B31
FIDMLVHQSFIPVPV

SEQ ID NO: 136458 - protein, 9 aa, Borrelia burgdorferi B31
FIDMLVHQS

SEQ ID NO: 136459 - protein, 15 aa, Borrelia burgdorferi B31
ETLTYKVLDNGTTPT

SEQ ID NO: 136460 - protein, 9 aa, Borrelia burgdorferi B31
YKVLDNGTT

SEQ ID NO: 136461 - protein, 15 aa, Borrelia burgdorferi B31
LRSDYYSSAVNAIYF

SEQ ID NO: 136462 - protein, 9 aa, Borrelia burgdorferi B31
YYSSAVNAI

SEQ ID NO: 136463 - protein, 15 aa, Borrelia burgdorferi B31
APIYIYGNSYLFRND

SEQ ID NO: 136464 - protein, 9 aa, Borrelia burgdorferi B31
YIYGNSYLF

SEQ ID NO: 136465 - protein, 15 aa, Borrelia burgdorferi B31
YFIDMLVHQSFIPVP

SEQ ID NO: 136466 - protein, 9 aa, Borrelia burgdorferi B31
FIDMLVHQS

SEQ ID NO: 136467 - protein, 15 aa, Borrelia burgdorferi B31
RSDYYSSAVNAIYFY

SEQ ID NO: 136468 - protein, 9 aa, Borrelia burgdorferi B31
YYSSAVNAI

SEQ ID NO: 136469 - protein, 15 aa, Borrelia burgdorferi B31
FKISLGAEPSSLDPQ

SEQ ID NO: 136470 - protein, 9 aa, Borrelia burgdorferi B31
LGAEPSSLD

SEQ ID NO: 136471 - protein, 15 aa, Borrelia burgdorferi B31
VAITAEGIRKSYLRI

SEQ ID NO: 136472 - protein, 9 aa, Borrelia burgdorferi B31
ITAEGIRKS

SEQ ID NO: 136473 - protein, 15 aa, Borrelia burgdorferi B31
SDYYSSAVNAIYFYA

SEQ ID NO: 136474 - protein, 9 aa, Borrelia burgdorferi B31
YYSSAVNAI

SEQ ID NO: 136475 - protein, 15 aa, Borrelia burgdorferi B31
IGDYADPLTFLSIFT

SEQ ID NO: 136476 - protein, 9 aa, Borrelia burgdorferi B31
YADPLTFLS

SEQ ID NO: 136477 - protein, 15 aa, Borrelia burgdorferi B31
AGWIGDYADPLTFLS

SEQ ID NO: 136478 - protein, 9 aa, Borrelia burgdorferi B31
IGDYADPLT

SEQ ID NO: 136479 - protein, 15 aa, Borrelia burgdorferi B31
PIYIYGNSYLFRNDK

SEQ ID NO: 136480 - protein, 9 aa, Borrelia burgdorferi B31
YIYGNSYLF

SEQ ID NO: 136481 - protein, 15 aa, Borrelia burgdorferi B31
FYTTNDSSTAYKMYE

SEQ ID NO: 136482 - protein, 9 aa, Borrelia burgdorferi B31
YTTNDSSTA

SEQ ID NO: 136483 - protein, 15 aa, Borrelia burgdorferi B31
GDYADPLTFLSIFTQ

SEQ ID NO: 136484 - protein, 9 aa, Borrelia burgdorferi B31
YADPLTFLS

SEQ ID NO: 136485 - protein, 15 aa, Borrelia burgdorferi B31
GWIGDYADPLTFLSI

SEQ ID NO: 136486 - protein, 9 aa, Borrelia burgdorferi B31
YADPLTFLS

SEQ ID NO: 136487 - protein, 15 aa, Borrelia burgdorferi B31
SIPPDLIKNLKLRSD

SEQ ID NO: 136488 - protein, 9 aa, Borrelia burgdorferi B31
LIKNLKLRS

SEQ ID NO: 136489 - protein, 15 aa, Borrelia burgdorferi B31
YADPLTFLSIFTQGY

SEQ ID NO: 136490 - protein, 9 aa, Borrelia burgdorferi B31
YADPLTFLS

SEQ ID NO: 136491 - protein, 15 aa, Borrelia burgdorferi B31
IPPDLIKNLKLRSDY

SEQ ID NO: 136492 - protein, 9 aa, Borrelia burgdorferi B31
IKNLKLRSD

SEQ ID NO: 136493 - protein, 15 aa, Borrelia burgdorferi B31
NMVTSGPFKLKERIP

SEQ ID NO: 136494 - protein, 9 aa, Borrelia burgdorferi B31
MVTSGPFKL

SEQ ID NO: 136495 - protein, 15 aa, Borrelia burgdorferi B31
NPEIAKTLLAEAGYP

SEQ ID NO: 136496 - protein, 9 aa, Borrelia burgdorferi B31
AKTLLAEAG

SEQ ID NO: 136497 - protein, 15 aa, Borrelia burgdorferi B31
LIKNLKLRSDYYSSA

SEQ ID NO: 136498 - protein, 9 aa, Borrelia burgdorferi B31
LKLRSDYYS

SEQ ID NO: 136499 - protein, 15 aa, Borrelia burgdorferi B31
PPDLIKNLKLRSDYY

SEQ ID NO: 136500 - protein, 9 aa, Borrelia burgdorferi B31
IKNLKLRSD

SEQ ID NO: 136501 - protein, 15 aa, Borrelia burgdorferi B31
VLDNGTTPTRRATPN

SEQ ID NO: 136502 - protein, 9 aa, Borrelia burgdorferi B31
NGTTPTRRA

SEQ ID NO: 136503 - protein, 15 aa, Borrelia burgdorferi B31
WIGDYADPLTFLSIF

SEQ ID NO: 136504 - protein, 9 aa, Borrelia burgdorferi B31
YADPLTFLS

SEQ ID NO: 136505 - protein, 15 aa, Borrelia burgdorferi B31
ISLGAEPSSLDPQLA

SEQ ID NO: 136506 - protein, 9 aa, Borrelia burgdorferi B31
LGAEPSSLD

SEQ ID NO: 136507 - protein, 15 aa, Borrelia burgdorferi B31
AITAEGIRKSYLRIL

SEQ ID NO: 136508 - protein, 9 aa, Borrelia burgdorferi B31
ITAEGIRKS

SEQ ID NO: 136509 - protein, 15 aa, Borrelia burgdorferi B31
ITAEGIRKSYLRILN

SEQ ID NO: 136510 - protein, 9 aa, Borrelia burgdorferi B31
ITAEGIRKS

SEQ ID NO: 136511 - protein, 15 aa, Borrelia burgdorferi B31
KISLGAEPSSLDPQL

SEQ ID NO: 136512 - protein, 9 aa, Borrelia burgdorferi B31
LGAEPSSLD

SEQ ID NO: 136513 - protein, 15 aa, Borrelia burgdorferi B31
YTTNDSSTAYKMYEN

SEQ ID NO: 136514 - protein, 9 aa, Borrelia burgdorferi B31
YTTNDSSTA

SEQ ID NO: 136515 - protein, 15 aa, Borrelia burgdorferi B31
GVSFKISLGAEPSSL

SEQ ID NO: 136516 - protein, 9 aa, Borrelia burgdorferi B31
FKISLGAEP

SEQ ID NO: 136517 - protein, 15 aa, Borrelia burgdorferi B31
LAKGWDISSDGTVYT

SEQ ID NO: 136518 - protein, 9 aa, Borrelia burgdorferi B31
GWDISSDGT

SEQ ID NO: 136519 - protein, 15 aa, Borrelia burgdorferi B31
IKNLKLRSDYYSSAV

SEQ ID NO: 136520 - protein, 9 aa, Borrelia burgdorferi B31
LKLRSDYYS

SEQ ID NO: 136521 - protein, 15 aa, Borrelia burgdorferi B31
EKDFPIAPIYIYGNS

SEQ ID NO: 136522 - protein, 9 aa, Borrelia burgdorferi B31
FPIAPIYIY

SEQ ID NO: 136523 - protein, 15 aa, Borrelia burgdorferi B31
IVTGDPNTGGNKPGL

SEQ ID NO: 136524 - protein, 9 aa, Borrelia burgdorferi B31
IVTGDPNTG

SEQ ID NO: 136525 - protein, 15 aa, Borrelia burgdorferi B31
PLTFLSIFTQGYTQF

SEQ ID NO: 136526 - protein, 9 aa, Borrelia burgdorferi B31
FLSIFTQGY

SEQ ID NO: 136527 - protein, 15 aa, Borrelia burgdorferi B31
IEKDFPIAPIYIYGN

SEQ ID NO: 136528 - protein, 9 aa, Borrelia burgdorferi B31
FPIAPIYIY

SEQ ID NO: 136529 - protein, 15 aa, Borrelia burgdorferi B31
AKGWDISSDGTVYTF

SEQ ID NO: 136530 - protein, 9 aa, Borrelia burgdorferi B31
ISSDGTVYT

SEQ ID NO: 136531 - protein, 15 aa, Borrelia burgdorferi B31
GWDISSDGTVYTFNL

SEQ ID NO: 136532 - protein, 9 aa, Borrelia burgdorferi B31
ISSDGTVYT

SEQ ID NO: 136533 - protein, 15 aa, Borrelia burgdorferi B31
EGVSFKISLGAEPSS

SEQ ID NO: 136534 - protein, 9 aa, Borrelia burgdorferi B31
FKISLGAEP

SEQ ID NO: 136535 - protein, 15 aa, Borrelia burgdorferi B31
IAKTLLAEAGYPNGN

SEQ ID NO: 136536 - protein, 9 aa, Borrelia burgdorferi B31
AKTLLAEAG

SEQ ID NO: 136537 - protein, 15 aa, Borrelia burgdorferi B31
KGWDISSDGTVYTFN

SEQ ID NO: 136538 - protein, 9 aa, Borrelia burgdorferi B31
ISSDGTVYT

SEQ ID NO: 136539 - protein, 15 aa, Borrelia burgdorferi B31
EWTTYLNTKANGNYE

SEQ ID NO: 136540 - protein, 9 aa, Borrelia burgdorferi B31
YLNTKANGN

SEQ ID NO: 136541 - protein, 15 aa, Borrelia burgdorferi B31
HIKPLDNVKIRKALT

SEQ ID NO: 136542 - protein, 9 aa, Borrelia burgdorferi B31
IKPLDNVKI

SEQ ID NO: 136543 - protein, 15 aa, Borrelia burgdorferi B31
NWTSPENMVTSGPFK

SEQ ID NO: 136544 - protein, 9 aa, Borrelia burgdorferi B31
WTSPENMVT

SEQ ID NO: 136545 - protein, 15 aa, Borrelia burgdorferi B31
EGIRKSYLRILNKET

SEQ ID NO: 136546 - protein, 9 aa, Borrelia burgdorferi B31
IRKSYLRIL

SEQ ID NO: 136547 - protein, 15 aa, Borrelia burgdorferi B31
AKTLLAEAGYPNGNG

SEQ ID NO: 136548 - protein, 9 aa, Borrelia burgdorferi B31
AKTLLAEAG

SEQ ID NO: 136549 - protein, 15 aa, Borrelia burgdorferi B31
WDISSDGTVYTFNLR

SEQ ID NO: 136550 - protein, 9 aa, Borrelia burgdorferi B31
ISSDGTVYT

SEQ ID NO: 136551 - protein, 15 aa, Borrelia burgdorferi B31
KEGVSFKISLGAEPS

SEQ ID NO: 136552 - protein, 9 aa, Borrelia burgdorferi B31
FKISLGAEP

SEQ ID NO: 136553 - protein, 15 aa, Borrelia burgdorferi B31
WTTYLNTKANGNYEI

SEQ ID NO: 136554 - protein, 9 aa, Borrelia burgdorferi B31
YLNTKANGN

SEQ ID NO: 136555 - protein, 15 aa, Borrelia burgdorferi B31
LDNGTTPTRRATPNF

SEQ ID NO: 136556 - protein, 9 aa, Borrelia burgdorferi B31
NGTTPTRRA

SEQ ID NO: 136557 - protein, 15 aa, Borrelia burgdorferi B31
MIDTMFRGIVTGDPN

SEQ ID NO: 136558 - protein, 9 aa, Borrelia burgdorferi B31
FRGIVTGDP

SEQ ID NO: 136559 - protein, 15 aa, Borrelia burgdorferi B31
ADPLTFLSIFTQGYT

SEQ ID NO: 136560 - protein, 9 aa, Borrelia burgdorferi B31
FLSIFTQGY

SEQ ID NO: 136561 - protein, 15 aa, Borrelia burgdorferi B31
FPIAPIYIYGNSYLF

SEQ ID NO: 136562 - protein, 9 aa, Borrelia burgdorferi B31
IAPIYIYGN

SEQ ID NO: 136563 - protein, 15 aa, Borrelia burgdorferi B31
KMIDTMFRGIVTGDP

SEQ ID NO: 136564 - protein, 9 aa, Borrelia burgdorferi B31
DTMFRGIVT

SEQ ID NO: 136565 - protein, 15 aa, Borrelia burgdorferi B31
IIEKDFPIAPIYIYG

SEQ ID NO: 136566 - protein, 9 aa, Borrelia burgdorferi B31
FPIAPIYIY

SEQ ID NO: 136567 - protein, 15 aa, Borrelia burgdorferi B31
IIIEKDFPIAPIYIY

SEQ ID NO: 136568 - protein, 9 aa, Borrelia burgdorferi B31
DFPIAPIYI

SEQ ID NO: 136569 - protein, 15 aa, Borrelia burgdorferi B31
PNFSSYSYAKSLELF

SEQ ID NO: 136570 - protein, 9 aa, Borrelia burgdorferi B31
YSYAKSLEL

SEQ ID NO: 136571 - protein, 15 aa, Borrelia burgdorferi B31
DPLTFLSIFTQGYTQ

SEQ ID NO: 136572 - protein, 9 aa, Borrelia burgdorferi B31
FLSIFTQGY

SEQ ID NO: 136573 - protein, 15 aa, Borrelia burgdorferi B31
TPNFSSYSYAKSLEL

SEQ ID NO: 136574 - protein, 9 aa, Borrelia burgdorferi B31
FSSYSYAKS

SEQ ID NO: 136575 - protein, 15 aa, Borrelia burgdorferi B31
IFGSIPPDLIKNLKL

SEQ ID NO: 136576 - protein, 9 aa, Borrelia burgdorferi B31
FGSIPPDLI

SEQ ID NO: 136577 - protein, 15 aa, Borrelia burgdorferi B31
PIAPIYIYGNSYLFR

SEQ ID NO: 136578 - protein, 9 aa, Borrelia burgdorferi B31
YIYGNSYLF

SEQ ID NO: 136579 - protein, 15 aa, Borrelia burgdorferi B31
KDFPIAPIYIYGNSY

SEQ ID NO: 136580 - protein, 9 aa, Borrelia burgdorferi B31
FPIAPIYIY

SEQ ID NO: 136581 - protein, 15 aa, Borrelia burgdorferi B31
IYIYGNSYLFRNDKW

SEQ ID NO: 136582 - protein, 9 aa, Borrelia burgdorferi B31
YGNSYLFRN

SEQ ID NO: 136583 - protein, 15 aa, Borrelia burgdorferi B31
IDTMFRGIVTGDPNT

SEQ ID NO: 136584 - protein, 9 aa, Borrelia burgdorferi B31
FRGIVTGDP

SEQ ID NO: 136585 - protein, 15 aa, Borrelia burgdorferi B31
FSSYSYAKSLELFNP

SEQ ID NO: 136586 - protein, 9 aa, Borrelia burgdorferi B31
YSYAKSLEL

SEQ ID NO: 136587 - protein, 15 aa, Borrelia burgdorferi B31
NFSSYSYAKSLELFN

SEQ ID NO: 136588 - protein, 9 aa, Borrelia burgdorferi B31
YSYAKSLEL

SEQ ID NO: 136589 - protein, 15 aa, Borrelia burgdorferi B31
YAKSLELFNPEIAKT

SEQ ID NO: 136590 - protein, 9 aa, Borrelia burgdorferi B31
YAKSLELFN

SEQ ID NO: 136591 - protein, 15 aa, Borrelia burgdorferi B31
MVTSGPFKLKERIPN

SEQ ID NO: 136592 - protein, 9 aa, Borrelia burgdorferi B31
MVTSGPFKL

SEQ ID NO: 136593 - protein, 15 aa, Borrelia burgdorferi B31
NDKWTGWNTNILERF

SEQ ID NO: 136594 - protein, 9 aa, Borrelia burgdorferi B31
WTGWNTNIL

SEQ ID NO: 136595 - protein, 15 aa, Borrelia burgdorferi B31
DKWTGWNTNILERFD

SEQ ID NO: 136596 - protein, 9 aa, Borrelia burgdorferi B31
WTGWNTNIL

SEQ ID NO: 136597 - protein, 15 aa, Borrelia burgdorferi B31
DYYSSAVNAIYFYAF

SEQ ID NO: 136598 - protein, 9 aa, Borrelia burgdorferi B31
YYSSAVNAI

SEQ ID NO: 136599 - protein, 15 aa, Borrelia burgdorferi B31
SSYSYAKSLELFNPE

SEQ ID NO: 136600 - protein, 9 aa, Borrelia burgdorferi B31
YSYAKSLEL

SEQ ID NO: 136601 - protein, 15 aa, Borrelia burgdorferi B31
TTYLNTKANGNYEIA

SEQ ID NO: 136602 - protein, 9 aa, Borrelia burgdorferi B31
YLNTKANGN

SEQ ID NO: 136603 - protein, 15 aa, Borrelia burgdorferi B31
YIYGNSYLFRNDKWT

SEQ ID NO: 136604 - protein, 9 aa, Borrelia burgdorferi B31
YGNSYLFRN

SEQ ID NO: 136605 - protein, 15 aa, Borrelia burgdorferi B31
FGSIPPDLIKNLKLR

SEQ ID NO: 136606 - protein, 9 aa, Borrelia burgdorferi B31
FGSIPPDLI

SEQ ID NO: 136607 - protein, 15 aa, Borrelia burgdorferi B31
SKYVEMVKSVIKNGQ

SEQ ID NO: 136608 - protein, 9 aa, Borrelia burgdorferi B31
VEMVKSVIK

SEQ ID NO: 136609 - protein, 15 aa, Borrelia burgdorferi B31
IRKSYLRILNKETGS

SEQ ID NO: 136610 - protein, 9 aa, Borrelia burgdorferi B31
YLRILNKET

SEQ ID NO: 136611 - protein, 15 aa, Borrelia burgdorferi B31
TLEITLESPKPYFID

SEQ ID NO: 136612 - protein, 9 aa, Borrelia burgdorferi B31
LESPKPYFI

SEQ ID NO: 136613 - protein, 15 aa, Borrelia burgdorferi B31
GSKYVEMVKSVIKNG

SEQ ID NO: 136614 - protein, 9 aa, Borrelia burgdorferi B31
VEMVKSVIK

SEQ ID NO: 136615 - protein, 15 aa, Borrelia burgdorferi B31
KTLEITLESPKPYFI

SEQ ID NO: 136616 - protein, 9 aa, Borrelia burgdorferi B31
ITLESPKPY

SEQ ID NO: 136617 - protein, 15 aa, Borrelia burgdorferi B31
GIRKSYLRILNKETG

SEQ ID NO: 136618 - protein, 9 aa, Borrelia burgdorferi B31
IRKSYLRIL

SEQ ID NO: 136619 - protein, 15 aa, Borrelia burgdorferi B31
NEELDAIFGSIPPDL

SEQ ID NO: 136620 - protein, 9 aa, Borrelia burgdorferi B31
LDAIFGSIP

SEQ ID NO: 136621 - protein, 15 aa, Borrelia burgdorferi B31
IDMLVHQSFIPVPVH

SEQ ID NO: 136622 - protein, 9 aa, Borrelia burgdorferi B31
LVHQSFIPV

SEQ ID NO: 136623 - protein, 15 aa, Borrelia burgdorferi B31
DMLVHQSFIPVPVHV

SEQ ID NO: 136624 - protein, 9 aa, Borrelia burgdorferi B31
LVHQSFIPV

SEQ ID NO: 136625 - protein, 15 aa, Borrelia burgdorferi B31
YYSSAVNAIYFYAFN

SEQ ID NO: 136626 - protein, 9 aa, Borrelia burgdorferi B31
YYSSAVNAI

SEQ ID NO: 136627 - protein, 15 aa, Borrelia burgdorferi B31
ILKLKYNTNEANKKI

SEQ ID NO: 136628 - protein, 9 aa, Borrelia burgdorferi B31
YNTNEANKK

SEQ ID NO: 136629 - protein, 15 aa, Borrelia burgdorferi B31
SLGAEPSSLDPQLAE

SEQ ID NO: 136630 - protein, 9 aa, Borrelia burgdorferi B31
LGAEPSSLD

SEQ ID NO: 136631 - protein, 15 aa, Borrelia burgdorferi B31
DFPIAPIYIYGNSYL

SEQ ID NO: 136632 - protein, 9 aa, Borrelia burgdorferi B31
IAPIYIYGN

SEQ ID NO: 136633 - protein, 15 aa, Borrelia burgdorferi B31
LKLKYNTNEANKKIC

SEQ ID NO: 136634 - protein, 9 aa, Borrelia burgdorferi B31
YNTNEANKK

SEQ ID NO: 136635 - protein, 15 aa, Borrelia burgdorferi B31
RIPNEKYVFEKNNKY

SEQ ID NO: 136636 - protein, 9 aa, Borrelia burgdorferi B31
RIPNEKYVF

SEQ ID NO: 136637 - protein, 15 aa, Borrelia burgdorferi B31
IPNEKYVFEKNNKYY

SEQ ID NO: 136638 - protein, 9 aa, Borrelia burgdorferi B31
YVFEKNNKY

SEQ ID NO: 136639 - protein, 15 aa, Borrelia burgdorferi B31
PNEKYVFEKNNKYYD

SEQ ID NO: 136640 - protein, 9 aa, Borrelia burgdorferi B31
YVFEKNNKY

SEQ ID NO: 136641 - protein, 15 aa, Borrelia burgdorferi B31
NEKYVFEKNNKYYDS

SEQ ID NO: 136642 - protein, 9 aa, Borrelia burgdorferi B31
YVFEKNNKY

SEQ ID NO: 136643 - protein, 15 aa, Borrelia burgdorferi B31
EKYVFEKNNKYYDSN

SEQ ID NO: 136644 - protein, 9 aa, Borrelia burgdorferi B31
YVFEKNNKY

SEQ ID NO: 136645 - protein, 15 aa, Borrelia burgdorferi B31
ESPKPYFIDMLVHQS

SEQ ID NO: 136646 - protein, 9 aa, Borrelia burgdorferi B31
YFIDMLVHQ

SEQ ID NO: 136647 - protein, 15 aa, Borrelia burgdorferi B31
SPKPYFIDMLVHQSF

SEQ ID NO: 136648 - protein, 9 aa, Borrelia burgdorferi B31
YFIDMLVHQ

SEQ ID NO: 136649 - protein, 15 aa, Borrelia burgdorferi B31
KPYFIDMLVHQSFIP

SEQ ID NO: 136650 - protein, 9 aa, Borrelia burgdorferi B31
YFIDMLVHQ

SEQ ID NO: 136651 - protein, 15 aa, Borrelia burgdorferi B31
PKPYFIDMLVHQSFI

SEQ ID NO: 136652 - protein, 9 aa, Borrelia burgdorferi B31
YFIDMLVHQ

SEQ ID NO: 136653 - protein, 15 aa, Borrelia burgdorferi B31
LESPKPYFIDMLVHQ

SEQ ID NO: 136654 - protein, 9 aa, Borrelia burgdorferi B31
PYFIDMLVH

SEQ ID NO: 136655 - protein, 15 aa, Borrelia burgdorferi B31
KYVFEKNNKYYDSNE

SEQ ID NO: 136656 - protein, 9 aa, Borrelia burgdorferi B31
YVFEKNNKY

SEQ ID NO: 136657 - protein, 15 aa, Borrelia burgdorferi B31
YVFEKNNKYYDSNEV

SEQ ID NO: 136658 - protein, 9 aa, Borrelia burgdorferi B31
YVFEKNNKY

SEQ ID NO: 136659 - protein, 15 aa, Borrelia burgdorferi B31
PYFIDMLVHQSFIPV

SEQ ID NO: 136660 - protein, 9 aa, Borrelia burgdorferi B31
YFIDMLVHQ

SEQ ID NO: 136661 - protein, 15 aa, Borrelia burgdorferi B31
YFIDMLVHQSFIPVP

SEQ ID NO: 136662 - protein, 9 aa, Borrelia burgdorferi B31
YFIDMLVHQ

SEQ ID NO: 136663 - protein, 15 aa, Borrelia burgdorferi B31
LDPIKRQDILRQAEE

SEQ ID NO: 136664 - protein, 9 aa, Borrelia burgdorferi B31
IKRQDILRQ

SEQ ID NO: 136665 - protein, 15 aa, Borrelia burgdorferi B31
DLELDPIKRQDILRQ

SEQ ID NO: 136666 - protein, 9 aa, Borrelia burgdorferi B31
DLELDPIKR

SEQ ID NO: 136667 - protein, 15 aa, Borrelia burgdorferi B31
ELDPIKRQDILRQAE

SEQ ID NO: 136668 - protein, 9 aa, Borrelia burgdorferi B31
IKRQDILRQ

SEQ ID NO: 136669 - protein, 15 aa, Borrelia burgdorferi B31
LELDPIKRQDILRQA

SEQ ID NO: 136670 - protein, 9 aa, Borrelia burgdorferi B31
IKRQDILRQ

SEQ ID NO: 136671 - protein, 15 aa, Borrelia burgdorferi B31
DPIKRQDILRQAEEI

SEQ ID NO: 136672 - protein, 9 aa, Borrelia burgdorferi B31
IKRQDILRQ

SEQ ID NO: 136673 - protein, 15 aa, Borrelia burgdorferi B31
EEITFYTTNDSSTAY

SEQ ID NO: 136674 - protein, 9 aa, Borrelia burgdorferi B31
YTTNDSSTA

SEQ ID NO: 136675 - protein, 15 aa, Borrelia burgdorferi B31
LEEITFYTTNDSSTA

SEQ ID NO: 136676 - protein, 9 aa, Borrelia burgdorferi B31
ITFYTTNDS

SEQ ID NO: 136677 - protein, 15 aa, Borrelia burgdorferi B31
EITFYTTNDSSTAYK

SEQ ID NO: 136678 - protein, 9 aa, Borrelia burgdorferi B31
YTTNDSSTA

SEQ ID NO: 136679 - protein, 15 aa, Borrelia burgdorferi B31
ITFYTTNDSSTAYKM

SEQ ID NO: 136680 - protein, 9 aa, Borrelia burgdorferi B31
YTTNDSSTA

SEQ ID NO: 136681 - protein, 15 aa, Borrelia burgdorferi B31
KLRSDYYSSAVNAIY

SEQ ID NO: 136682 - protein, 9 aa, Borrelia burgdorferi B31
YYSSAVNAI

SEQ ID NO: 136683 - protein, 15 aa, Borrelia burgdorferi B31
LRSDYYSSAVNAIYF

SEQ ID NO: 136684 - protein, 9 aa, Borrelia burgdorferi B31
YYSSAVNAI

SEQ ID NO: 136685 - protein, 15 aa, Borrelia burgdorferi B31
LTFLSIFTQGYTQFS

SEQ ID NO: 136686 - protein, 9 aa, Borrelia burgdorferi B31
FLSIFTQGY

SEQ ID NO: 136687 - protein, 15 aa, Borrelia burgdorferi B31
ADPLTFLSIFTQGYT

SEQ ID NO: 136688 - protein, 9 aa, Borrelia burgdorferi B31
FLSIFTQGY

SEQ ID NO: 136689 - protein, 15 aa, Borrelia burgdorferi B31
RKSYLRILNKETGSK

SEQ ID NO: 136690 - protein, 9 aa, Borrelia burgdorferi B31
YLRILNKET

SEQ ID NO: 136691 - protein, 15 aa, Borrelia burgdorferi B31
KSYLRILNKETGSKY

SEQ ID NO: 136692 - protein, 9 aa, Borrelia burgdorferi B31
ILNKETGSK

SEQ ID NO: 136693 - protein, 15 aa, Borrelia burgdorferi B31
YADPLTFLSIFTQGY

SEQ ID NO: 136694 - protein, 9 aa, Borrelia burgdorferi B31
PLTFLSIFT

SEQ ID NO: 136695 - protein, 15 aa, Borrelia burgdorferi B31
VNAIYFYAFNTHIKP

SEQ ID NO: 136696 - protein, 9 aa, Borrelia burgdorferi B31
YFYAFNTHI

SEQ ID NO: 136697 - protein, 15 aa, Borrelia burgdorferi B31
DPLTFLSIFTQGYTQ

SEQ ID NO: 136698 - protein, 9 aa, Borrelia burgdorferi B31
FLSIFTQGY

SEQ ID NO: 136699 - protein, 15 aa, Borrelia burgdorferi B31
AIYFYAFNTHIKPLD

SEQ ID NO: 136700 - protein, 9 aa, Borrelia burgdorferi B31
YFYAFNTHI

SEQ ID NO: 136701 - protein, 15 aa, Borrelia burgdorferi B31
AVNAIYFYAFNTHIK

SEQ ID NO: 136702 - protein, 9 aa, Borrelia burgdorferi B31
YFYAFNTHI

SEQ ID NO: 136703 - protein, 15 aa, Borrelia burgdorferi B31
NAIYFYAFNTHIKPL

SEQ ID NO: 136704 - protein, 9 aa, Borrelia burgdorferi B31
YFYAFNTHI

SEQ ID NO: 136705 - protein, 15 aa, Borrelia burgdorferi B31
PLTFLSIFTQGYTQF

SEQ ID NO: 136706 - protein, 9 aa, Borrelia burgdorferi B31
FLSIFTQGY

SEQ ID NO: 136707 - protein, 15 aa, Borrelia burgdorferi B31
SAVNAIYFYAFNTHI

SEQ ID NO: 136708 - protein, 9 aa, Borrelia burgdorferi B31
IYFYAFNTH

SEQ ID NO: 136709 - protein, 15 aa, Borrelia burgdorferi B31
SYLRILNKETGSKYV

SEQ ID NO: 136710 - protein, 9 aa, Borrelia burgdorferi B31
ILNKETGSK

SEQ ID NO: 136711 - protein, 15 aa, Borrelia burgdorferi B31
VTEKYGQNWTSPENM

SEQ ID NO: 136712 - protein, 9 aa, Borrelia burgdorferi B31
GQNWTSPEN

SEQ ID NO: 136713 - protein, 15 aa, Borrelia burgdorferi B31
HVTEKYGQNWTSPEN

SEQ ID NO: 136714 - protein, 9 aa, Borrelia burgdorferi B31
YGQNWTSPE

SEQ ID NO: 136715 - protein, 15 aa, Borrelia burgdorferi B31
TEKYGQNWTSPENMV

SEQ ID NO: 136716 - protein, 9 aa, Borrelia burgdorferi B31
GQNWTSPEN

SEQ ID NO: 136717 - protein, 15 aa, Borrelia burgdorferi B31
EKYGQNWTSPENMVT

SEQ ID NO: 136718 - protein, 9 aa, Borrelia burgdorferi B31
GQNWTSPEN

SEQ ID NO: 136719 - protein, 15 aa, Borrelia burgdorferi B31
KYGQNWTSPENMVTS

SEQ ID NO: 136720 - protein, 9 aa, Borrelia burgdorferi B31
GQNWTSPEN

SEQ ID NO: 136721 - protein, 15 aa, Borrelia burgdorferi B31
RNDKWTGWNTNILER

SEQ ID NO: 136722 - protein, 9 aa, Borrelia burgdorferi B31
WTGWNTNIL

SEQ ID NO: 136723 - protein, 15 aa, Borrelia burgdorferi B31
LFRNDKWTGWNTNIL

SEQ ID NO: 136724 - protein, 9 aa, Borrelia burgdorferi B31
DKWTGWNTN

SEQ ID NO: 136725 - protein, 15 aa, Borrelia burgdorferi B31
FRNDKWTGWNTNILE

SEQ ID NO: 136726 - protein, 9 aa, Borrelia burgdorferi B31
WTGWNTNIL

SEQ ID NO: 136727 - protein, 15 aa, Borrelia burgdorferi B31
NDKWTGWNTNILERF

SEQ ID NO: 136728 - protein, 9 aa, Borrelia burgdorferi B31
WTGWNTNIL

SEQ ID NO: 136729 - protein, 15 aa, Borrelia burgdorferi B31
DKWTGWNTNILERFD

SEQ ID NO: 136730 - protein, 9 aa, Borrelia burgdorferi B31
WTGWNTNIL

SEQ ID NO: 136731 - protein, 15 aa, Borrelia burgdorferi B31
YGQNWTSPENMVTSG

SEQ ID NO: 136732 - protein, 9 aa, Borrelia burgdorferi B31
GQNWTSPEN

SEQ ID NO: 136733 - protein, 15 aa, Borrelia burgdorferi B31
VSFKISLGAEPSSLD

SEQ ID NO: 136734 - protein, 9 aa, Borrelia burgdorferi B31
VSFKISLGA

SEQ ID NO: 136735 - protein, 15 aa, Borrelia burgdorferi B31
SFKISLGAEPSSLDP

SEQ ID NO: 136736 - protein, 9 aa, Borrelia burgdorferi B31
LGAEPSSLD

SEQ ID NO: 136737 - protein, 15 aa, Borrelia burgdorferi B31
FKISLGAEPSSLDPQ

SEQ ID NO: 136738 - protein, 9 aa, Borrelia burgdorferi B31
LGAEPSSLD

SEQ ID NO: 136739 - protein, 15 aa, Borrelia burgdorferi B31
ISLGAEPSSLDPQLA

SEQ ID NO: 136740 - protein, 9 aa, Borrelia burgdorferi B31
LGAEPSSLD

SEQ ID NO: 136741 - protein, 15 aa, Borrelia burgdorferi B31
KISLGAEPSSLDPQL

SEQ ID NO: 136742 - protein, 9 aa, Borrelia burgdorferi B31
LGAEPSSLD

SEQ ID NO: 136743 - protein, 15 aa, Borrelia burgdorferi B31
FNLREKITWSDGVAI

SEQ ID NO: 136744 - protein, 9 aa, Borrelia burgdorferi B31
LREKITWSD

SEQ ID NO: 136745 - protein, 15 aa, Borrelia burgdorferi B31
ELENEEWTTYLNTKA

SEQ ID NO: 136746 - protein, 9 aa, Borrelia burgdorferi B31
NEEWTTYLN

SEQ ID NO: 136747 - protein, 15 aa, Borrelia burgdorferi B31
TVYTFNLREKITWSD

SEQ ID NO: 136748 - protein, 9 aa, Borrelia burgdorferi B31
TVYTFNLRE

SEQ ID NO: 136749 - protein, 15 aa, Borrelia burgdorferi B31
SLGAEPSSLDPQLAE

SEQ ID NO: 136750 - protein, 9 aa, Borrelia burgdorferi B31
LGAEPSSLD

SEQ ID NO: 136751 - protein, 15 aa, Borrelia burgdorferi B31
LGAEPSSLDPQLAED

SEQ ID NO: 136752 - protein, 9 aa, Borrelia burgdorferi B31
LGAEPSSLD

SEQ ID NO: 136753 - protein, 15 aa, Borrelia burgdorferi B31
YTFNLREKITWSDGV

SEQ ID NO: 136754 - protein, 9 aa, Borrelia burgdorferi B31
LREKITWSD

SEQ ID NO: 136755 - protein, 15 aa, Borrelia burgdorferi B31
LENEEWTTYLNTKAN

SEQ ID NO: 136756 - protein, 9 aa, Borrelia burgdorferi B31
NEEWTTYLN

SEQ ID NO: 136757 - protein, 15 aa, Borrelia burgdorferi B31
TFNLREKITWSDGVA

SEQ ID NO: 136758 - protein, 9 aa, Borrelia burgdorferi B31
LREKITWSD

SEQ ID NO: 136759 - protein, 15 aa, Borrelia burgdorferi B31
IYFYAFNTHIKPLDN

SEQ ID NO: 136760 - protein, 9 aa, Borrelia burgdorferi B31
FNTHIKPLD

SEQ ID NO: 136761 - protein, 15 aa, Borrelia burgdorferi B31
VYTFNLREKITWSDG

SEQ ID NO: 136762 - protein, 9 aa, Borrelia burgdorferi B31
LREKITWSD

SEQ ID NO: 136763 - protein, 15 aa, Borrelia burgdorferi B31
KWTGWNTNILERFDL

SEQ ID NO: 136764 - protein, 9 aa, Borrelia burgdorferi B31
WTGWNTNIL

SEQ ID NO: 136765 - protein, 15 aa, Borrelia burgdorferi B31
AIYFYAFNTHIKPLD

SEQ ID NO: 136766 - protein, 9 aa, Borrelia burgdorferi B31
FYAFNTHIK

SEQ ID NO: 136767 - protein, 15 aa, Borrelia burgdorferi B31
EELDAIFGSIPPDLI

SEQ ID NO: 136768 - protein, 9 aa, Borrelia burgdorferi B31
DAIFGSIPP

SEQ ID NO: 136769 - protein, 15 aa, Borrelia burgdorferi B31
ELDAIFGSIPPDLIK

SEQ ID NO: 136770 - protein, 9 aa, Borrelia burgdorferi B31
FGSIPPDLI

SEQ ID NO: 136771 - protein, 15 aa, Borrelia burgdorferi B31
GQNWTSPENMVTSGP

SEQ ID NO: 136772 - protein, 9 aa, Borrelia burgdorferi B31
GQNWTSPEN

SEQ ID NO: 136773 - protein, 15 aa, Borrelia burgdorferi B31
EFIQNQWKKNLNIDV

SEQ ID NO: 136774 - protein, 9 aa, Borrelia burgdorferi B31
QNQWKKNLN

SEQ ID NO: 136775 - protein, 15 aa, Borrelia burgdorferi B31
ELEEITFYTTNDSST

SEQ ID NO: 136776 - protein, 9 aa, Borrelia burgdorferi B31
ITFYTTNDS

SEQ ID NO: 136777 - protein, 15 aa, Borrelia burgdorferi B31
VELENEEWTTYLNTK

SEQ ID NO: 136778 - protein, 9 aa, Borrelia burgdorferi B31
NEEWTTYLN

SEQ ID NO: 136779 - protein, 15 aa, Borrelia burgdorferi B31
LEEITFYTTNDSSTA

SEQ ID NO: 136780 - protein, 9 aa, Borrelia burgdorferi B31
ITFYTTNDS

SEQ ID NO: 136781 - protein, 15 aa, Borrelia burgdorferi B31
IDVELENEEWTTYLN

SEQ ID NO: 136782 - protein, 9 aa, Borrelia burgdorferi B31
ENEEWTTYL

SEQ ID NO: 136783 - protein, 15 aa, Borrelia burgdorferi B31
DVELENEEWTTYLNT

SEQ ID NO: 136784 - protein, 9 aa, Borrelia burgdorferi B31
NEEWTTYLN

SEQ ID NO: 136785 - protein, 15 aa, Borrelia burgdorferi B31
LVHQSFIPVPVHVTE

SEQ ID NO: 136786 - protein, 9 aa, Borrelia burgdorferi B31
HQSFIPVPV

SEQ ID NO: 136787 - protein, 15 aa, Borrelia burgdorferi B31
MLVHQSFIPVPVHVT

SEQ ID NO: 136788 - protein, 9 aa, Borrelia burgdorferi B31
HQSFIPVPV

SEQ ID NO: 136789 - protein, 15 aa, Borrelia burgdorferi B31
EVELEEITFYTTNDS

SEQ ID NO: 136790 - protein, 9 aa, Borrelia burgdorferi B31
EITFYTTND

SEQ ID NO: 136791 - protein, 15 aa, Borrelia burgdorferi B31
VELEEITFYTTNDSS

SEQ ID NO: 136792 - protein, 9 aa, Borrelia burgdorferi B31
ITFYTTNDS

SEQ ID NO: 136793 - protein, 15 aa, Borrelia burgdorferi B31
FIQNQWKKNLNIDVE

SEQ ID NO: 136794 - protein, 9 aa, Borrelia burgdorferi B31
QNQWKKNLN

SEQ ID NO: 136795 - protein, 15 aa, Borrelia burgdorferi B31
LDAIFGSIPPDLIKN

SEQ ID NO: 136796 - protein, 9 aa, Borrelia burgdorferi B31
FGSIPPDLI

SEQ ID NO: 136797 - protein, 15 aa, Borrelia burgdorferi B31
WTGWNTNILERFDLS

SEQ ID NO: 136798 - protein, 9 aa, Borrelia burgdorferi B31
WTGWNTNIL

SEQ ID NO: 136799 - protein, 15 aa, Borrelia burgdorferi B31
DAIFGSIPPDLIKNL

SEQ ID NO: 136800 - protein, 9 aa, Borrelia burgdorferi B31
FGSIPPDLI

SEQ ID NO: 136801 - protein, 15 aa, Borrelia burgdorferi B31
YFYAFNTHIKPLDNV

SEQ ID NO: 136802 - protein, 9 aa, Borrelia burgdorferi B31
FNTHIKPLD

SEQ ID NO: 136803 - protein, 15 aa, Borrelia burgdorferi B31
FYAFNTHIKPLDNVK

SEQ ID NO: 136804 - protein, 9 aa, Borrelia burgdorferi B31
FNTHIKPLD

SEQ ID NO: 136805 - protein, 15 aa, Borrelia burgdorferi B31
EEITFYTTNDSSTAY

SEQ ID NO: 136806 - protein, 9 aa, Borrelia burgdorferi B31
ITFYTTNDS

SEQ ID NO: 136807 - protein, 15 aa, Borrelia burgdorferi B31
ENEEWTTYLNTKANG

SEQ ID NO: 136808 - protein, 9 aa, Borrelia burgdorferi B31
NEEWTTYLN

SEQ ID NO: 136809 - protein, 15 aa, Borrelia burgdorferi B31
NEEWTTYLNTKANGN

SEQ ID NO: 136810 - protein, 9 aa, Borrelia burgdorferi B31
NEEWTTYLN

SEQ ID NO: 136811 - protein, 15 aa, Borrelia burgdorferi B31
LFRNDKWTGWNTNIL

SEQ ID NO: 136812 - protein, 9 aa, Borrelia burgdorferi B31
NDKWTGWNT

SEQ ID NO: 136813 - protein, 15 aa, Borrelia burgdorferi B31
FRNDKWTGWNTNILE

SEQ ID NO: 136814 - protein, 9 aa, Borrelia burgdorferi B31
WTGWNTNIL

SEQ ID NO: 136815 - protein, 15 aa, Borrelia burgdorferi B31
RSDYYSSAVNAIYFY

SEQ ID NO: 136816 - protein, 9 aa, Borrelia burgdorferi B31
YYSSAVNAI

SEQ ID NO: 136817 - protein, 15 aa, Borrelia burgdorferi B31
SDYYSSAVNAIYFYA

SEQ ID NO: 136818 - protein, 9 aa, Borrelia burgdorferi B31
YYSSAVNAI

SEQ ID NO: 136819 - protein, 15 aa, Borrelia burgdorferi B31
KLRSDYYSSAVNAIY

SEQ ID NO: 136820 - protein, 9 aa, Borrelia burgdorferi B31
YYSSAVNAI

SEQ ID NO: 136821 - protein, 15 aa, Borrelia burgdorferi B31
LRSDYYSSAVNAIYF

SEQ ID NO: 136822 - protein, 9 aa, Borrelia burgdorferi B31
YYSSAVNAI

SEQ ID NO: 136823 - protein, 15 aa, Borrelia burgdorferi B31
NDKWTGWNTNILERF

SEQ ID NO: 136824 - protein, 9 aa, Borrelia burgdorferi B31
WTGWNTNIL

SEQ ID NO: 136825 - protein, 15 aa, Borrelia burgdorferi B31
RNDKWTGWNTNILER

SEQ ID NO: 136826 - protein, 9 aa, Borrelia burgdorferi B31
WTGWNTNIL

SEQ ID NO: 136827 - protein, 15 aa, Borrelia burgdorferi B31
PLDNVKIRKALTLAI

SEQ ID NO: 136828 - protein, 9 aa, Borrelia burgdorferi B31
VKIRKALTL

SEQ ID NO: 136829 - protein, 15 aa, Borrelia burgdorferi B31
DKWTGWNTNILERFD

SEQ ID NO: 136830 - protein, 9 aa, Borrelia burgdorferi B31
WTGWNTNIL

SEQ ID NO: 136831 - protein, 15 aa, Borrelia burgdorferi B31
LDNVKIRKALTLAID

SEQ ID NO: 136832 - protein, 9 aa, Borrelia burgdorferi B31
IRKALTLAI

SEQ ID NO: 136833 - protein, 15 aa, Borrelia burgdorferi B31
DNVKIRKALTLAIDR

SEQ ID NO: 136834 - protein, 9 aa, Borrelia burgdorferi B31
IRKALTLAI

SEQ ID NO: 136835 - protein, 15 aa, Borrelia burgdorferi B31
MLVHQSFIPVPVHVT

SEQ ID NO: 136836 - protein, 9 aa, Borrelia burgdorferi B31
SFIPVPVHV

SEQ ID NO: 136837 - protein, 15 aa, Borrelia burgdorferi B31
LVHQSFIPVPVHVTE

SEQ ID NO: 136838 - protein, 9 aa, Borrelia burgdorferi B31
FIPVPVHVT

SEQ ID NO: 136839 - protein, 15 aa, Borrelia burgdorferi B31
LKLRSDYYSSAVNAI

SEQ ID NO: 136840 - protein, 9 aa, Borrelia burgdorferi B31
RSDYYSSAV

SEQ ID NO: 136841 - protein, 15 aa, Borrelia burgdorferi B31
VHQSFIPVPVHVTEK

SEQ ID NO: 136842 - protein, 9 aa, Borrelia burgdorferi B31
FIPVPVHVT

SEQ ID NO: 136843 - protein, 15 aa, Borrelia burgdorferi B31
NVKIRKALTLAIDRE

SEQ ID NO: 136844 - protein, 9 aa, Borrelia burgdorferi B31
IRKALTLAI

SEQ ID NO: 136845 - protein, 15 aa, Borrelia burgdorferi B31
HQSFIPVPVHVTEKY

SEQ ID NO: 136846 - protein, 9 aa, Borrelia burgdorferi B31
FIPVPVHVT

SEQ ID NO: 136847 - protein, 15 aa, Borrelia burgdorferi B31
VKIRKALTLAIDRET

SEQ ID NO: 136848 - protein, 9 aa, Borrelia burgdorferi B31
IRKALTLAI

SEQ ID NO: 136849 - protein, 15 aa, Borrelia burgdorferi B31
DYYSSAVNAIYFYAF

SEQ ID NO: 136850 - protein, 9 aa, Borrelia burgdorferi B31
YYSSAVNAI

SEQ ID NO: 136851 - protein, 15 aa, Borrelia burgdorferi B31
QSFIPVPVHVTEKYG

SEQ ID NO: 136852 - protein, 9 aa, Borrelia burgdorferi B31
FIPVPVHVT

SEQ ID NO: 136853 - protein, 15 aa, Borrelia burgdorferi B31
MKLQRSLFLIIFFLT

SEQ ID NO: 136854 - protein, 9 aa, Borrelia burgdorferi B31
MKLQRSLFL

SEQ ID NO: 136855 - protein, 15 aa, Borrelia burgdorferi B31
PLDNVKIRKALTLAI

SEQ ID NO: 136856 - protein, 9 aa, Borrelia burgdorferi B31
VKIRKALTL

SEQ ID NO: 136857 - protein, 15 aa, Borrelia burgdorferi B31
LDNVKIRKALTLAID

SEQ ID NO: 136858 - protein, 9 aa, Borrelia burgdorferi B31
IRKALTLAI

SEQ ID NO: 136859 - protein, 15 aa, Borrelia burgdorferi B31
DNVKIRKALTLAIDR

SEQ ID NO: 136860 - protein, 9 aa, Borrelia burgdorferi B31
IRKALTLAI

SEQ ID NO: 136861 - protein, 15 aa, Borrelia burgdorferi B31
NVKIRKALTLAIDRE

SEQ ID NO: 136862 - protein, 9 aa, Borrelia burgdorferi B31
IRKALTLAI

SEQ ID NO: 136863 - protein, 15 aa, Borrelia burgdorferi B31
SDGTVYTFNLREKIT

SEQ ID NO: 136864 - protein, 9 aa, Borrelia burgdorferi B31
YTFNLREKI

SEQ ID NO: 136865 - protein, 15 aa, Borrelia burgdorferi B31
GTVYTFNLREKITWS

SEQ ID NO: 136866 - protein, 9 aa, Borrelia burgdorferi B31
YTFNLREKI

SEQ ID NO: 136867 - protein, 15 aa, Borrelia burgdorferi B31
DGTVYTFNLREKITW

SEQ ID NO: 136868 - protein, 9 aa, Borrelia burgdorferi B31
YTFNLREKI

SEQ ID NO: 136869 - protein, 15 aa, Borrelia burgdorferi B31
SSDGTVYTFNLREKI

SEQ ID NO: 136870 - protein, 9 aa, Borrelia burgdorferi B31
GTVYTFNLR

SEQ ID NO: 136871 - protein, 15 aa, Borrelia burgdorferi B31
TVYTFNLREKITWSD

SEQ ID NO: 136872 - protein, 9 aa, Borrelia burgdorferi B31
YTFNLREKI

SEQ ID NO: 136873 - protein, 15 aa, Borrelia burgdorferi B31
SGPFKLKERIPNEKY

SEQ ID NO: 136874 - protein, 9 aa, Borrelia burgdorferi B31
FKLKERIPN

SEQ ID NO: 136875 - protein, 15 aa, Borrelia burgdorferi B31
MVTSGPFKLKERIPN

SEQ ID NO: 136876 - protein, 9 aa, Borrelia burgdorferi B31
VTSGPFKLK

SEQ ID NO: 136877 - protein, 15 aa, Borrelia burgdorferi B31
VTSGPFKLKERIPNE

SEQ ID NO: 136878 - protein, 9 aa, Borrelia burgdorferi B31
FKLKERIPN

SEQ ID NO: 136879 - protein, 15 aa, Borrelia burgdorferi B31
GPFKLKERIPNEKYV

SEQ ID NO: 136880 - protein, 9 aa, Borrelia burgdorferi B31
FKLKERIPN

SEQ ID NO: 136881 - protein, 15 aa, Borrelia burgdorferi B31
TSGPFKLKERIPNEK

SEQ ID NO: 136882 - protein, 9 aa, Borrelia burgdorferi B31
FKLKERIPN

SEQ ID NO: 136883 - protein, 15 aa, Borrelia burgdorferi B31
SKYVEMVKSVIKNGQ

SEQ ID NO: 136884 - protein, 9 aa, Borrelia burgdorferi B31
VEMVKSVIK

SEQ ID NO: 136885 - protein, 15 aa, Borrelia burgdorferi B31
KYVEMVKSVIKNGQK

SEQ ID NO: 136886 - protein, 9 aa, Borrelia burgdorferi B31
VKSVIKNGQ

SEQ ID NO: 136887 - protein, 15 aa, Borrelia burgdorferi B31
EMVKSVIKNGQKYFD

SEQ ID NO: 136888 - protein, 9 aa, Borrelia burgdorferi B31
VKSVIKNGQ

SEQ ID NO: 136889 - protein, 15 aa, Borrelia burgdorferi B31
YVEMVKSVIKNGQKY

SEQ ID NO: 136890 - protein, 9 aa, Borrelia burgdorferi B31
VKSVIKNGQ

SEQ ID NO: 136891 - protein, 15 aa, Borrelia burgdorferi B31
ETLTYKVLDNGTTPT

SEQ ID NO: 136892 - protein, 9 aa, Borrelia burgdorferi B31
YKVLDNGTT

SEQ ID NO: 136893 - protein, 15 aa, Borrelia burgdorferi B31
TLTYKVLDNGTTPTR

SEQ ID NO: 136894 - protein, 9 aa, Borrelia burgdorferi B31
VLDNGTTPT

SEQ ID NO: 136895 - protein, 15 aa, Borrelia burgdorferi B31
LTYKVLDNGTTPTRR

SEQ ID NO: 136896 - protein, 9 aa, Borrelia burgdorferi B31
VLDNGTTPT

SEQ ID NO: 136897 - protein, 15 aa, Borrelia burgdorferi B31
VEMVKSVIKNGQKYF

SEQ ID NO: 136898 - protein, 9 aa, Borrelia burgdorferi B31
VKSVIKNGQ

SEQ ID NO: 136899 - protein, 15 aa, Borrelia burgdorferi B31
PDLIKNLKLRSDYYS

SEQ ID NO: 136900 - protein, 9 aa, Borrelia burgdorferi B31
LIKNLKLRS

SEQ ID NO: 136901 - protein, 15 aa, Borrelia burgdorferi B31
SIPPDLIKNLKLRSD

SEQ ID NO: 136902 - protein, 9 aa, Borrelia burgdorferi B31
LIKNLKLRS

SEQ ID NO: 136903 - protein, 15 aa, Borrelia burgdorferi B31
IPPDLIKNLKLRSDY

SEQ ID NO: 136904 - protein, 9 aa, Borrelia burgdorferi B31
LIKNLKLRS

SEQ ID NO: 136905 - protein, 15 aa, Borrelia burgdorferi B31
PPDLIKNLKLRSDYY

SEQ ID NO: 136906 - protein, 9 aa, Borrelia burgdorferi B31
LIKNLKLRS

SEQ ID NO: 136907 - protein, 15 aa, Borrelia burgdorferi B31
TYKVLDNGTTPTRRA

SEQ ID NO: 136908 - protein, 9 aa, Borrelia burgdorferi B31
VLDNGTTPT

SEQ ID NO: 136909 - protein, 15 aa, Borrelia burgdorferi B31
YKVLDNGTTPTRRAT

SEQ ID NO: 136910 - protein, 9 aa, Borrelia burgdorferi B31
VLDNGTTPT

SEQ ID NO: 136911 - protein, 15 aa, Borrelia burgdorferi B31
NDKWTGWNTNILERF

SEQ ID NO: 136912 - protein, 9 aa, Borrelia burgdorferi B31
WTGWNTNIL

SEQ ID NO: 136913 - protein, 15 aa, Borrelia burgdorferi B31
DKWTGWNTNILERFD

SEQ ID NO: 136914 - protein, 9 aa, Borrelia burgdorferi B31
WNTNILERF

SEQ ID NO: 136915 - protein, 15 aa, Borrelia burgdorferi B31
KSYLRILNKETGSKY

SEQ ID NO: 136916 - protein, 9 aa, Borrelia burgdorferi B31
LRILNKETG

SEQ ID NO: 136917 - protein, 15 aa, Borrelia burgdorferi B31
DLIKNLKLRSDYYSS

SEQ ID NO: 136918 - protein, 9 aa, Borrelia burgdorferi B31
IKNLKLRSD

SEQ ID NO: 136919 - protein, 15 aa, Borrelia burgdorferi B31
SYLRILNKETGSKYV

SEQ ID NO: 136920 - protein, 9 aa, Borrelia burgdorferi B31
LRILNKETG

SEQ ID NO: 136921 - protein, 15 aa, Borrelia burgdorferi B31
MVKSVIKNGQKYFDG

SEQ ID NO: 136922 - protein, 9 aa, Borrelia burgdorferi B31
VKSVIKNGQ

SEQ ID NO: 136923 - protein, 15 aa, Borrelia burgdorferi B31
VKSVIKNGQKYFDGQ

SEQ ID NO: 136924 - protein, 9 aa, Borrelia burgdorferi B31
VKSVIKNGQ

SEQ ID NO: 136925 - protein, 15 aa, Borrelia burgdorferi B31
GSKYVEMVKSVIKNG

SEQ ID NO: 136926 - protein, 9 aa, Borrelia burgdorferi B31
VEMVKSVIK

SEQ ID NO: 136927 - protein, 15 aa, Borrelia burgdorferi B31
KWTGWNTNILERFDL

SEQ ID NO: 136928 - protein, 9 aa, Borrelia burgdorferi B31
WNTNILERF

SEQ ID NO: 136929 - protein, 15 aa, Borrelia burgdorferi B31
WTGWNTNILERFDLS

SEQ ID NO: 136930 - protein, 9 aa, Borrelia burgdorferi B31
WNTNILERF

SEQ ID NO: 136931 - protein, 15 aa, Borrelia burgdorferi B31
GSIPPDLIKNLKLRS

SEQ ID NO: 136932 - protein, 9 aa, Borrelia burgdorferi B31
PPDLIKNLK

SEQ ID NO: 136933 - protein, 15 aa, Borrelia burgdorferi B31
LIKNLKLRSDYYSSA

SEQ ID NO: 136934 - protein, 9 aa, Borrelia burgdorferi B31
LIKNLKLRS

SEQ ID NO: 136935 - protein, 15 aa, Borrelia burgdorferi B31
TGSKYVEMVKSVIKN

SEQ ID NO: 136936 - protein, 9 aa, Borrelia burgdorferi B31
VEMVKSVIK

SEQ ID NO: 136937 - protein, 15 aa, Borrelia burgdorferi B31
ETGSKYVEMVKSVIK

SEQ ID NO: 136938 - protein, 9 aa, Borrelia burgdorferi B31
YVEMVKSVI

SEQ ID NO: 136939 - protein, 15 aa, Borrelia burgdorferi B31
MKLQRSLFLIIFFLT

SEQ ID NO: 136940 - protein, 9 aa, Borrelia burgdorferi B31
LQRSLFLII

SEQ ID NO: 136941 - protein, 15 aa, Borrelia burgdorferi B31
EFIQNQWKKNLNIDV

SEQ ID NO: 136942 - protein, 9 aa, Borrelia burgdorferi B31
IQNQWKKNL

SEQ ID NO: 136943 - protein, 15 aa, Borrelia burgdorferi B31
LQRSLFLIIFFLTFL

SEQ ID NO: 136944 - protein, 9 aa, Borrelia burgdorferi B31
LFLIIFFLT

SEQ ID NO: 136945 - protein, 15 aa, Borrelia burgdorferi B31
YLRILNKETGSKYVE

SEQ ID NO: 136946 - protein, 9 aa, Borrelia burgdorferi B31
LRILNKETG

SEQ ID NO: 136947 - protein, 15 aa, Borrelia burgdorferi B31
RKSYLRILNKETGSK

SEQ ID NO: 136948 - protein, 9 aa, Borrelia burgdorferi B31
LRILNKETG

SEQ ID NO: 136949 - protein, 15 aa, Borrelia burgdorferi B31
IRKSYLRILNKETGS

SEQ ID NO: 136950 - protein, 9 aa, Borrelia burgdorferi B31
LRILNKETG

SEQ ID NO: 136951 - protein, 15 aa, Borrelia burgdorferi B31
LRILNKETGSKYVEM

SEQ ID NO: 136952 - protein, 9 aa, Borrelia burgdorferi B31
LRILNKETG

SEQ ID NO: 136953 - protein, 15 aa, Borrelia burgdorferi B31
GIRKSYLRILNKETG

SEQ ID NO: 136954 - protein, 9 aa, Borrelia burgdorferi B31
YLRILNKET

SEQ ID NO: 136955 - protein, 15 aa, Borrelia burgdorferi B31
WTSPENMVTSGPFKL

SEQ ID NO: 136956 - protein, 9 aa, Borrelia burgdorferi B31
ENMVTSGPF

SEQ ID NO: 136957 - protein, 15 aa, Borrelia burgdorferi B31
TSPENMVTSGPFKLK

SEQ ID NO: 136958 - protein, 9 aa, Borrelia burgdorferi B31
MVTSGPFKL

SEQ ID NO: 136959 - protein, 15 aa, Borrelia burgdorferi B31
IKPLDNVKIRKALTL

SEQ ID NO: 136960 - protein, 9 aa, Borrelia burgdorferi B31
LDNVKIRKA

SEQ ID NO: 136961 - protein, 15 aa, Borrelia burgdorferi B31
QRSLFLIIFFLTFLC

SEQ ID NO: 136962 - protein, 9 aa, Borrelia burgdorferi B31
LFLIIFFLT

SEQ ID NO: 136963 - protein, 15 aa, Borrelia burgdorferi B31
FIQNQWKKNLNIDVE

SEQ ID NO: 136964 - protein, 9 aa, Borrelia burgdorferi B31
IQNQWKKNL

SEQ ID NO: 136965 - protein, 15 aa, Borrelia burgdorferi B31
RSLFLIIFFLTFLCC

SEQ ID NO: 136966 - protein, 9 aa, Borrelia burgdorferi B31
LFLIIFFLT

SEQ ID NO: 136967 - protein, 15 aa, Borrelia burgdorferi B31
KLQRSLFLIIFFLTF

SEQ ID NO: 136968 - protein, 9 aa, Borrelia burgdorferi B31
LFLIIFFLT

SEQ ID NO: 136969 - protein, 15 aa, Borrelia burgdorferi B31
IQNQWKKNLNIDVEL

SEQ ID NO: 136970 - protein, 9 aa, Borrelia burgdorferi B31
IQNQWKKNL

SEQ ID NO: 136971 - protein, 15 aa, Borrelia burgdorferi B31
IAPIYIYGNSYLFRN

SEQ ID NO: 136972 - protein, 9 aa, Borrelia burgdorferi B31
IYIYGNSYL

SEQ ID NO: 136973 - protein, 15 aa, Borrelia burgdorferi B31
APIYIYGNSYLFRND

SEQ ID NO: 136974 - protein, 9 aa, Borrelia burgdorferi B31
YGNSYLFRN

SEQ ID NO: 136975 - protein, 15 aa, Borrelia burgdorferi B31
PLDNVKIRKALTLAI

SEQ ID NO: 136976 - protein, 9 aa, Borrelia burgdorferi B31
VKIRKALTL

SEQ ID NO: 136977 - protein, 15 aa, Borrelia burgdorferi B31
SPENMVTSGPFKLKE

SEQ ID NO: 136978 - protein, 9 aa, Borrelia burgdorferi B31
MVTSGPFKL

SEQ ID NO: 136979 - protein, 15 aa, Borrelia burgdorferi B31
LDNVKIRKALTLAID

SEQ ID NO: 136980 - protein, 9 aa, Borrelia burgdorferi B31
VKIRKALTL

SEQ ID NO: 136981 - protein, 15 aa, Borrelia burgdorferi B31
PYFIDMLVHQSFIPV

SEQ ID NO: 136982 - protein, 9 aa, Borrelia burgdorferi B31
FIDMLVHQS

SEQ ID NO: 136983 - protein, 15 aa, Borrelia burgdorferi B31
TGWNTNILERFDLSQ

SEQ ID NO: 136984 - protein, 9 aa, Borrelia burgdorferi B31
WNTNILERF

SEQ ID NO: 136985 - protein, 15 aa, Borrelia burgdorferi B31
YAFNTHIKPLDNVKI

SEQ ID NO: 136986 - protein, 9 aa, Borrelia burgdorferi B31
FNTHIKPLD

SEQ ID NO: 136987 - protein, 15 aa, Borrelia burgdorferi B31
KVLDNGTTPTRRATP

SEQ ID NO: 136988 - protein, 9 aa, Borrelia burgdorferi B31
VLDNGTTPT

SEQ ID NO: 136989 - protein, 15 aa, Borrelia burgdorferi B31
KPLDNVKIRKALTLA

SEQ ID NO: 136990 - protein, 9 aa, Borrelia burgdorferi B31
VKIRKALTL

SEQ ID NO: 136991 - protein, 15 aa, Borrelia burgdorferi B31
IKNLKLRSDYYSSAV

SEQ ID NO: 136992 - protein, 9 aa, Borrelia burgdorferi B31
LKLRSDYYS

SEQ ID NO: 136993 - protein, 15 aa, Borrelia burgdorferi B31
RKSYLRILNKETGSK

SEQ ID NO: 136994 - protein, 9 aa, Borrelia burgdorferi B31
LRILNKETG

SEQ ID NO: 136995 - protein, 15 aa, Borrelia burgdorferi B31
KSYLRILNKETGSKY

SEQ ID NO: 136996 - protein, 9 aa, Borrelia burgdorferi B31
LRILNKETG

SEQ ID NO: 136997 - protein, 15 aa, Borrelia burgdorferi B31
SYLRILNKETGSKYV

SEQ ID NO: 136998 - protein, 9 aa, Borrelia burgdorferi B31
LRILNKETG

SEQ ID NO: 136999 - protein, 15 aa, Borrelia burgdorferi B31
GIRKSYLRILNKETG

SEQ ID NO: 137000 - protein, 9 aa, Borrelia burgdorferi B31
YLRILNKET

SEQ ID NO: 137001 - protein, 15 aa, Borrelia burgdorferi B31
IRKSYLRILNKETGS

SEQ ID NO: 137002 - protein, 9 aa, Borrelia burgdorferi B31
LRILNKETG

SEQ ID NO: 137003 - protein, 15 aa, Borrelia burgdorferi B31
YLRILNKETGSKYVE

SEQ ID NO: 137004 - protein, 9 aa, Borrelia burgdorferi B31
LRILNKETG

SEQ ID NO: 137005 - protein, 15 aa, Borrelia burgdorferi B31
LRILNKETGSKYVEM

SEQ ID NO: 137006 - protein, 9 aa, Borrelia burgdorferi B31
LRILNKETG

SEQ ID NO: 137007 - protein, 15 aa, Borrelia burgdorferi B31
PPDLIKNLKLRSDYY

SEQ ID NO: 137008 - protein, 9 aa, Borrelia burgdorferi B31
IKNLKLRSD

SEQ ID NO: 137009 - protein, 15 aa, Borrelia burgdorferi B31
PDLIKNLKLRSDYYS

SEQ ID NO: 137010 - protein, 9 aa, Borrelia burgdorferi B31
IKNLKLRSD

SEQ ID NO: 137011 - protein, 15 aa, Borrelia burgdorferi B31
DLIKNLKLRSDYYSS

SEQ ID NO: 137012 - protein, 9 aa, Borrelia burgdorferi B31
IKNLKLRSD

SEQ ID NO: 137013 - protein, 15 aa, Borrelia burgdorferi B31
SIPPDLIKNLKLRSD

SEQ ID NO: 137014 - protein, 9 aa, Borrelia burgdorferi B31
DLIKNLKLR

SEQ ID NO: 137015 - protein, 15 aa, Borrelia burgdorferi B31
IPPDLIKNLKLRSDY

SEQ ID NO: 137016 - protein, 9 aa, Borrelia burgdorferi B31
IKNLKLRSD

SEQ ID NO: 137017 - protein, 15 aa, Borrelia burgdorferi B31
LIKNLKLRSDYYSSA

SEQ ID NO: 137018 - protein, 9 aa, Borrelia burgdorferi B31
IKNLKLRSD

SEQ ID NO: 137019 - protein, 15 aa, Borrelia burgdorferi B31
IKNLKLRSDYYSSAV

SEQ ID NO: 137020 - protein, 9 aa, Borrelia burgdorferi B31
IKNLKLRSD

SEQ ID NO: 137021 - protein, 15 aa, Borrelia burgdorferi B31
GTVYTFNLREKITWS

SEQ ID NO: 137022 - protein, 9 aa, Borrelia burgdorferi B31
VYTFNLREK

SEQ ID NO: 137023 - protein, 15 aa, Borrelia burgdorferi B31
IAPIYIYGNSYLFRN

SEQ ID NO: 137024 - protein, 9 aa, Borrelia burgdorferi B31
IYGNSYLFR

SEQ ID NO: 137025 - protein, 15 aa, Borrelia burgdorferi B31
YGNSYLFRNDKWTGW

SEQ ID NO: 137026 - protein, 9 aa, Borrelia burgdorferi B31
LFRNDKWTG

SEQ ID NO: 137027 - protein, 15 aa, Borrelia burgdorferi B31
PIAPIYIYGNSYLFR

SEQ ID NO: 137028 - protein, 9 aa, Borrelia burgdorferi B31
IYIYGNSYL

SEQ ID NO: 137029 - protein, 15 aa, Borrelia burgdorferi B31
FKLKERIPNEKYVFE

SEQ ID NO: 137030 - protein, 9 aa, Borrelia burgdorferi B31
LKERIPNEK

SEQ ID NO: 137031 - protein, 15 aa, Borrelia burgdorferi B31
PFKLKERIPNEKYVF

SEQ ID NO: 137032 - protein, 9 aa, Borrelia burgdorferi B31
LKERIPNEK

SEQ ID NO: 137033 - protein, 15 aa, Borrelia burgdorferi B31
GPFKLKERIPNEKYV

SEQ ID NO: 137034 - protein, 9 aa, Borrelia burgdorferi B31
LKERIPNEK

SEQ ID NO: 137035 - protein, 15 aa, Borrelia burgdorferi B31
SGPFKLKERIPNEKY

SEQ ID NO: 137036 - protein, 9 aa, Borrelia burgdorferi B31
LKERIPNEK

SEQ ID NO: 137037 - protein, 15 aa, Borrelia burgdorferi B31
TSGPFKLKERIPNEK

SEQ ID NO: 137038 - protein, 9 aa, Borrelia burgdorferi B31
TSGPFKLKE

SEQ ID NO: 137039 - protein, 15 aa, Borrelia burgdorferi B31
VNAIYFYAFNTHIKP

SEQ ID NO: 137040 - protein, 9 aa, Borrelia burgdorferi B31
IYFYAFNTH

SEQ ID NO: 137041 - protein, 15 aa, Borrelia burgdorferi B31
SAVNAIYFYAFNTHI

SEQ ID NO: 137042 - protein, 9 aa, Borrelia burgdorferi B31
IYFYAFNTH

SEQ ID NO: 137043 - protein, 15 aa, Borrelia burgdorferi B31
SSAVNAIYFYAFNTH

SEQ ID NO: 137044 - protein, 9 aa, Borrelia burgdorferi B31
VNAIYFYAF

SEQ ID NO: 137045 - protein, 15 aa, Borrelia burgdorferi B31
NAIYFYAFNTHIKPL

SEQ ID NO: 137046 - protein, 9 aa, Borrelia burgdorferi B31
IYFYAFNTH

SEQ ID NO: 137047 - protein, 15 aa, Borrelia burgdorferi B31
AVNAIYFYAFNTHIK

SEQ ID NO: 137048 - protein, 9 aa, Borrelia burgdorferi B31
IYFYAFNTH

SEQ ID NO: 137049 - protein, 15 aa, Borrelia burgdorferi B31
YFIDMLVHQSFIPVP

SEQ ID NO: 137050 - protein, 9 aa, Borrelia burgdorferi B31
IDMLVHQSF

SEQ ID NO: 137051 - protein, 15 aa, Borrelia burgdorferi B31
PYFIDMLVHQSFIPV

SEQ ID NO: 137052 - protein, 9 aa, Borrelia burgdorferi B31
IDMLVHQSF

SEQ ID NO: 137053 - protein, 15 aa, Borrelia burgdorferi B31
AIYFYAFNTHIKPLD

SEQ ID NO: 137054 - protein, 9 aa, Borrelia burgdorferi B31
IYFYAFNTH

SEQ ID NO: 137055 - protein, 15 aa, Borrelia burgdorferi B31
IYFYAFNTHIKPLDN

SEQ ID NO: 137056 - protein, 9 aa, Borrelia burgdorferi B31
IYFYAFNTH

SEQ ID NO: 137057 - protein, 15 aa, Borrelia burgdorferi B31
FIDMLVHQSFIPVPV

SEQ ID NO: 137058 - protein, 9 aa, Borrelia burgdorferi B31
LVHQSFIPV

SEQ ID NO: 137059 - protein, 15 aa, Borrelia burgdorferi B31
IDMLVHQSFIPVPVH

SEQ ID NO: 137060 - protein, 9 aa, Borrelia burgdorferi B31
LVHQSFIPV

SEQ ID NO: 137061 - protein, 15 aa, Borrelia burgdorferi B31
KLKERIPNEKYVFEK

SEQ ID NO: 137062 - protein, 9 aa, Borrelia burgdorferi B31
LKERIPNEK

SEQ ID NO: 137063 - protein, 15 aa, Borrelia burgdorferi B31
LKERIPNEKYVFEKN

SEQ ID NO: 137064 - protein, 9 aa, Borrelia burgdorferi B31
LKERIPNEK

SEQ ID NO: 137065 - protein, 15 aa, Borrelia burgdorferi B31
FLIIFFLTFLCCNNK

SEQ ID NO: 137066 - protein, 9 aa, Borrelia burgdorferi B31
IFFLTFLCC

SEQ ID NO: 137067 - protein, 15 aa, Borrelia burgdorferi B31
RSLFLIIFFLTFLCC

SEQ ID NO: 137068 - protein, 9 aa, Borrelia burgdorferi B31
IIFFLTFLC

SEQ ID NO: 137069 - protein, 15 aa, Borrelia burgdorferi B31
SLFLIIFFLTFLCCN

SEQ ID NO: 137070 - protein, 9 aa, Borrelia burgdorferi B31
IFFLTFLCC

SEQ ID NO: 137071 - protein, 15 aa, Borrelia burgdorferi B31
LTYKVLDNGTTPTRR

SEQ ID NO: 137072 - protein, 9 aa, Borrelia burgdorferi B31
LDNGTTPTR

SEQ ID NO: 137073 - protein, 15 aa, Borrelia burgdorferi B31
YKVLDNGTTPTRRAT

SEQ ID NO: 137074 - protein, 9 aa, Borrelia burgdorferi B31
LDNGTTPTR

SEQ ID NO: 137075 - protein, 15 aa, Borrelia burgdorferi B31
TYKVLDNGTTPTRRA

SEQ ID NO: 137076 - protein, 9 aa, Borrelia burgdorferi B31
LDNGTTPTR

SEQ ID NO: 137077 - protein, 15 aa, Borrelia burgdorferi B31
AKSLELFNPEIAKTL

SEQ ID NO: 137078 - protein, 9 aa, Borrelia burgdorferi B31
LFNPEIAKT

SEQ ID NO: 137079 - protein, 15 aa, Borrelia burgdorferi B31
KSLELFNPEIAKTLL

SEQ ID NO: 137080 - protein, 9 aa, Borrelia burgdorferi B31
FNPEIAKTL

SEQ ID NO: 137081 - protein, 15 aa, Borrelia burgdorferi B31
SLELFNPEIAKTLLA

SEQ ID NO: 137082 - protein, 9 aa, Borrelia burgdorferi B31
FNPEIAKTL

SEQ ID NO: 137083 - protein, 15 aa, Borrelia burgdorferi B31
LELFNPEIAKTLLAE

SEQ ID NO: 137084 - protein, 9 aa, Borrelia burgdorferi B31
FNPEIAKTL

SEQ ID NO: 137085 - protein, 15 aa, Borrelia burgdorferi B31
ELFNPEIAKTLLAEA

SEQ ID NO: 137086 - protein, 9 aa, Borrelia burgdorferi B31
FNPEIAKTL

SEQ ID NO: 137087 - protein, 15 aa, Borrelia burgdorferi B31
TLTYKVLDNGTTPTR

SEQ ID NO: 137088 - protein, 9 aa, Borrelia burgdorferi B31
YKVLDNGTT

SEQ ID NO: 137089 - protein, 15 aa, Borrelia burgdorferi B31
KVLDNGTTPTRRATP

SEQ ID NO: 137090 - protein, 9 aa, Borrelia burgdorferi B31
LDNGTTPTR

SEQ ID NO: 137091 - protein, 15 aa, Borrelia burgdorferi B31
KSYLRILNKETGSKY

SEQ ID NO: 137092 - protein, 9 aa, Borrelia burgdorferi B31
ILNKETGSK

SEQ ID NO: 137093 - protein, 15 aa, Borrelia
VKKFVGSMSLMSDVA

SEQ ID NO: 137094 - protein, 9 aa, Borrelia
FVGSMSLMS

SEQ ID NO: 137095 - protein, 15 aa, Borrelia
GVVKKFVGSMSLMSD

SEQ ID NO: 137096 - protein, 9 aa, Borrelia
FVGSMSLMS

SEQ ID NO: 137097 - protein, 15 aa, Borrelia
VVKKFVGSMSLMSDV

SEQ ID NO: 137098 - protein, 9 aa, Borrelia
FVGSMSLMS

SEQ ID NO: 137099 - protein, 15 aa, Borrelia
KKFVGSMSLMSDVAK

SEQ ID NO: 137100 - protein, 9 aa, Borrelia
FVGSMSLMS

SEQ ID NO: 137101 - protein, 15 aa, Borrelia
AGVVKKFVGSMSLMS

SEQ ID NO: 137102 - protein, 9 aa, Borrelia
AGVVKKFVG

SEQ ID NO: 137103 - protein, 15 aa, Borrelia
FVGSMSLMSDVAKGT

SEQ ID NO: 137104 - protein, 9 aa, Borrelia
FVGSMSLMS

SEQ ID NO: 137105 - protein, 15 aa, Borrelia
KFVGSMSLMSDVAKG

SEQ ID NO: 137106 - protein, 9 aa, Borrelia
FVGSMSLMS

SEQ ID NO: 137107 - protein, 15 aa, Borrelia
KKDVRKAISNVVKVA

SEQ ID NO: 137108 - protein, 9 aa, Borrelia
VRKAISNVV

SEQ ID NO: 137109 - protein, 15 aa, Borrelia
AKCSGMVAEGANKVV

SEQ ID NO: 137110 - protein, 9 aa, Borrelia
MVAEGANKV

SEQ ID NO: 137111 - protein, 15 aa, Borrelia
VLAKKDVRKAISNVV

SEQ ID NO: 137112 - protein, 9 aa, Borrelia
LAKKDVRKA

SEQ ID NO: 137113 - protein, 15 aa, Borrelia
LAKKDVRKAISNVVK

SEQ ID NO: 137114 - protein, 9 aa, Borrelia
VRKAISNVV

SEQ ID NO: 137115 - protein, 15 aa, Borrelia
AKKDVRKAISNVVKV

SEQ ID NO: 137116 - protein, 9 aa, Borrelia
VRKAISNVV

SEQ ID NO: 137117 - protein, 15 aa, Borrelia
KDVRKAISNVVKVAQ

SEQ ID NO: 137118 - protein, 9 aa, Borrelia
VRKAISNVV

SEQ ID NO: 137119 - protein, 15 aa, Borrelia
KCSGMVAEGANKVVE

SEQ ID NO: 137120 - protein, 9 aa, Borrelia
MVAEGANKV

SEQ ID NO: 137121 - protein, 15 aa, Borrelia
CSGMVAEGANKVVEM

SEQ ID NO: 137122 - protein, 9 aa, Borrelia
MVAEGANKV

SEQ ID NO: 137123 - protein, 15 aa, Borrelia
VAKCSGMVAEGANKV

SEQ ID NO: 137124 - protein, 9 aa, Borrelia
CSGMVAEGA

SEQ ID NO: 137125 - protein, 15 aa, Borrelia
AKGTVVASQEATIVA

SEQ ID NO: 137126 - protein, 9 aa, Borrelia
VASQEATIV

SEQ ID NO: 137127 - protein, 15 aa, Borrelia
VAKGTVVASQEATIV

SEQ ID NO: 137128 - protein, 9 aa, Borrelia
GTVVASQEA

SEQ ID NO: 137129 - protein, 15 aa, Borrelia
KGTVVASQEATIVAK

SEQ ID NO: 137130 - protein, 9 aa, Borrelia
VASQEATIV

SEQ ID NO: 137131 - protein, 15 aa, Borrelia
GTVVASQEATIVAKC

SEQ ID NO: 137132 - protein, 9 aa, Borrelia
VASQEATIV

SEQ ID NO: 137133 - protein, 15 aa, Borrelia
SGMVAEGANKVVEMS

SEQ ID NO: 137134 - protein, 9 aa, Borrelia
MVAEGANKV

SEQ ID NO: 137135 - protein, 15 aa, Borrelia
ARDLTKVMAISLYMR

SEQ ID NO: 137136 - protein, 9 aa, Borrelia
LTKVMAISL

SEQ ID NO: 137137 - protein, 15 aa, Borrelia
TVVASQEATIVAKCS

SEQ ID NO: 137138 - protein, 9 aa, Borrelia
VASQEATIV

SEQ ID NO: 137139 - protein, 15 aa, Borrelia
ATIVAKCSGMVAEGA

SEQ ID NO: 137140 - protein, 9 aa, Borrelia
IVAKCSGMV

SEQ ID NO: 137141 - protein, 15 aa, Borrelia
SQEATIVAKCSGMVA

SEQ ID NO: 137142 - protein, 9 aa, Borrelia
IVAKCSGMV

SEQ ID NO: 137143 - protein, 15 aa, Borrelia
EATIVAKCSGMVAEG

SEQ ID NO: 137144 - protein, 9 aa, Borrelia
IVAKCSGMV

SEQ ID NO: 137145 - protein, 15 aa, Borrelia
MSLMSDVAKGTVVAS

SEQ ID NO: 137146 - protein, 9 aa, Borrelia
LMSDVAKGT

SEQ ID NO: 137147 - protein, 15 aa, Borrelia
QEATIVAKCSGMVAE

SEQ ID NO: 137148 - protein, 9 aa, Borrelia
IVAKCSGMV

SEQ ID NO: 137149 - protein, 15 aa, Borrelia
TQKAVSVAGEATFLI

SEQ ID NO: 137150 - protein, 9 aa, Borrelia
SVAGEATFL

SEQ ID NO: 137151 - protein, 15 aa, Borrelia
QKAVSVAGEATFLIE

SEQ ID NO: 137152 - protein, 9 aa, Borrelia
VAGEATFLI

SEQ ID NO: 137153 - protein, 15 aa, Borrelia
AVSVAGEATFLIEKQ

SEQ ID NO: 137154 - protein, 9 aa, Borrelia
VAGEATFLI

SEQ ID NO: 137155 - protein, 15 aa, Borrelia
KAVSVAGEATFLIEK

SEQ ID NO: 137156 - protein, 9 aa, Borrelia
VAGEATFLI

SEQ ID NO: 137157 - protein, 15 aa, Borrelia
LMSDVAKGTVVASQE

SEQ ID NO: 137158 - protein, 9 aa, Borrelia
VAKGTVVAS

SEQ ID NO: 137159 - protein, 15 aa, Borrelia
SLMSDVAKGTVVASQ

SEQ ID NO: 137160 - protein, 9 aa, Borrelia
VAKGTVVAS

SEQ ID NO: 137161 - protein, 15 aa, Borrelia
GARDLTKVMAISLYM

SEQ ID NO: 137162 - protein, 9 aa, Borrelia
LTKVMAISL

SEQ ID NO: 137163 - protein, 15 aa, Borrelia
MSDVAKGTVVASQEA

SEQ ID NO: 137164 - protein, 9 aa, Borrelia
VAKGTVVAS

SEQ ID NO: 137165 - protein, 15 aa, Borrelia
ASQEATIVAKCSGMV

SEQ ID NO: 137166 - protein, 9 aa, Borrelia
EATIVAKCS

SEQ ID NO: 137167 - protein, 15 aa, Borrelia
TIVAKCSGMVAEGAN

SEQ ID NO: 137168 - protein, 9 aa, Borrelia
IVAKCSGMV

SEQ ID NO: 137169 - protein, 15 aa, Borrelia
VSVAGEATFLIEKQI

SEQ ID NO: 137170 - protein, 9 aa, Borrelia
VAGEATFLI

SEQ ID NO: 137171 - protein, 15 aa, Borrelia
DVRKAISNVVKVAQG

SEQ ID NO: 137172 - protein, 9 aa, Borrelia
VRKAISNVV

SEQ ID NO: 137173 - protein, 15 aa, Borrelia
GMVAEGANKVVEMSK

SEQ ID NO: 137174 - protein, 9 aa, Borrelia
MVAEGANKV

SEQ ID NO: 137175 - protein, 15 aa, Borrelia
VRKAISNVVKVAQGA

SEQ ID NO: 137176 - protein, 9 aa, Borrelia
VRKAISNVV

SEQ ID NO: 137177 - protein, 15 aa, Borrelia
SDVAKGTVVASQEAT

SEQ ID NO: 137178 - protein, 9 aa, Borrelia
VAKGTVVAS

SEQ ID NO: 137179 - protein, 15 aa, Borrelia
SMSLMSDVAKGTVVA

SEQ ID NO: 137180 - protein, 9 aa, Borrelia
LMSDVAKGT

SEQ ID NO: 137181 - protein, 15 aa, Borrelia
VVASQEATIVAKCSG

SEQ ID NO: 137182 - protein, 9 aa, Borrelia
VASQEATIV

SEQ ID NO: 137183 - protein, 15 aa, Borrelia
IVAKCSGMVAEGANK

SEQ ID NO: 137184 - protein, 9 aa, Borrelia
IVAKCSGMV

SEQ ID NO: 137185 - protein, 15 aa, Borrelia
VASQEATIVAKCSGM

SEQ ID NO: 137186 - protein, 9 aa, Borrelia
VASQEATIV

SEQ ID NO: 137187 - protein, 15 aa, Borrelia
MVAEGANKVVEMSKK

SEQ ID NO: 137188 - protein, 9 aa, Borrelia
MVAEGANKV

SEQ ID NO: 137189 - protein, 15 aa, Borrelia
SNNANILKPQSNVLE

SEQ ID NO: 137190 - protein, 9 aa, Borrelia
ILKPQSNVL

SEQ ID NO: 137191 - protein, 15 aa, Borrelia
NNANILKPQSNVLEH

SEQ ID NO: 137192 - protein, 9 aa, Borrelia
ILKPQSNVL

SEQ ID NO: 137193 - protein, 15 aa, Borrelia
LIINGLLFGFVSLNV

SEQ ID NO: 137194 - protein, 9 aa, Borrelia
INGLLFGFV

SEQ ID NO: 137195 - protein, 15 aa, Borrelia
NANILKPQSNVLEHS

SEQ ID NO: 137196 - protein, 9 aa, Borrelia
ILKPQSNVL

SEQ ID NO: 137197 - protein, 15 aa, Borrelia
ANILKPQSNVLEHSD

SEQ ID NO: 137198 - protein, 9 aa, Borrelia
ILKPQSNVL

SEQ ID NO: 137199 - protein, 15 aa, Borrelia
VGSMSLMSDVAKGTV

SEQ ID NO: 137200 - protein, 9 aa, Borrelia
LMSDVAKGT

SEQ ID NO: 137201 - protein, 15 aa, Borrelia
QGARDLTKVMAISLY

SEQ ID NO: 137202 - protein, 9 aa, Borrelia
LTKVMAISL

SEQ ID NO: 137203 - protein, 15 aa, Borrelia
AQGARDLTKVMAISL

SEQ ID NO: 137204 - protein, 9 aa, Borrelia
ARDLTKVMA

SEQ ID NO: 137205 - protein, 15 aa, Borrelia
MTKIFSNLIINGLLF

SEQ ID NO: 137206 - protein, 9 aa, Borrelia
FSNLIINGL

SEQ ID NO: 137207 - protein, 15 aa, Borrelia
GSMSLMSDVAKGTVV

SEQ ID NO: 137208 - protein, 9 aa, Borrelia
LMSDVAKGT

SEQ ID NO: 137209 - protein, 15 aa, Borrelia
INGLLFGFVSLNVFA

SEQ ID NO: 137210 - protein, 9 aa, Borrelia
LFGFVSLNV

SEQ ID NO: 137211 - protein, 15 aa, Borrelia
IINGLLFGFVSLNVF

SEQ ID NO: 137212 - protein, 9 aa, Borrelia
LFGFVSLNV

SEQ ID NO: 137213 - protein, 15 aa, Borrelia
DVAKGTVVASQEATI

SEQ ID NO: 137214 - protein, 9 aa, Borrelia
VAKGTVVAS

SEQ ID NO: 137215 - protein, 15 aa, Borrelia
KIFSNLIINGLLFGF

SEQ ID NO: 137216 - protein, 9 aa, Borrelia
FSNLIINGL

SEQ ID NO: 137217 - protein, 15 aa, Borrelia
TKIFSNLIINGLLFG

SEQ ID NO: 137218 - protein, 9 aa, Borrelia
FSNLIINGL

SEQ ID NO: 137219 - protein, 15 aa, Borrelia
VKETLMASERALDET

SEQ ID NO: 137220 - protein, 9 aa, Borrelia
ETLMASERA

SEQ ID NO: 137221 - protein, 15 aa, Borrelia
EVKETLMASERALDE

SEQ ID NO: 137222 - protein, 9 aa, Borrelia
ETLMASERA

SEQ ID NO: 137223 - protein, 15 aa, Borrelia
FSNLIINGLLFGFVS

SEQ ID NO: 137224 - protein, 9 aa, Borrelia
INGLLFGFV

SEQ ID NO: 137225 - protein, 15 aa, Borrelia
IFSNLIINGLLFGFV

SEQ ID NO: 137226 - protein, 9 aa, Borrelia
LIINGLLFG

SEQ ID NO: 137227 - protein, 15 aa, Borrelia
ANKVVEMSKKAVQET

SEQ ID NO: 137228 - protein, 9 aa, Borrelia
VVEMSKKAV

SEQ ID NO: 137229 - protein, 15 aa, Borrelia
NILKPQSNVLEHSDQ

SEQ ID NO: 137230 - protein, 9 aa, Borrelia
LKPQSNVLE

SEQ ID NO: 137231 - protein, 15 aa, Borrelia
NKVVEMSKKAVQETQ

SEQ ID NO: 137232 - protein, 9 aa, Borrelia
MSKKAVQET

SEQ ID NO: 137233 - protein, 15 aa, Borrelia
NGLLFGFVSLNVFAD

SEQ ID NO: 137234 - protein, 9 aa, Borrelia
LFGFVSLNV

SEQ ID NO: 137235 - protein, 15 aa, Borrelia
GLLFGFVSLNVFADS

SEQ ID NO: 137236 - protein, 9 aa, Borrelia
LFGFVSLNV

SEQ ID NO: 137237 - protein, 15 aa, Borrelia
SVAGEATFLIEKQIM

SEQ ID NO: 137238 - protein, 9 aa, Borrelia
VAGEATFLI

SEQ ID NO: 137239 - protein, 15 aa, Borrelia
SNLIINGLLFGFVSL

SEQ ID NO: 137240 - protein, 9 aa, Borrelia
INGLLFGFV

SEQ ID NO: 137241 - protein, 15 aa, Borrelia
DSNNANILKPQSNVL

SEQ ID NO: 137242 - protein, 9 aa, Borrelia
ANILKPQSN

SEQ ID NO: 137243 - protein, 15 aa, Borrelia
VVEMSKKAVQETQKA

SEQ ID NO: 137244 - protein, 9 aa, Borrelia
MSKKAVQET

SEQ ID NO: 137245 - protein, 15 aa, Borrelia
NLIINGLLFGFVSLN

SEQ ID NO: 137246 - protein, 9 aa, Borrelia
INGLLFGFV

SEQ ID NO: 137247 - protein, 15 aa, Borrelia
KVVEMSKKAVQETQK

SEQ ID NO: 137248 - protein, 9 aa, Borrelia
MSKKAVQET

SEQ ID NO: 137249 - protein, 15 aa, Borrelia
VAGEATFLIEKQIML

SEQ ID NO: 137250 - protein, 9 aa, Borrelia
VAGEATFLI

SEQ ID NO: 137251 - protein, 15 aa, Borrelia
ISNVVKVAQGARDLT

SEQ ID NO: 137252 - protein, 9 aa, Borrelia
VKVAQGARD

SEQ ID NO: 137253 - protein, 15 aa, Borrelia
QETQKAVSVAGEATF

SEQ ID NO: 137254 - protein, 9 aa, Borrelia
TQKAVSVAG

SEQ ID NO: 137255 - protein, 15 aa, Borrelia
DEVKETLMASERALD

SEQ ID NO: 137256 - protein, 9 aa, Borrelia
ETLMASERA

SEQ ID NO: 137257 - protein, 15 aa, Borrelia
SNVVKVAQGARDLTK

SEQ ID NO: 137258 - protein, 9 aa, Borrelia
VKVAQGARD

SEQ ID NO: 137259 - protein, 15 aa, Borrelia
VQETQKAVSVAGEAT

SEQ ID NO: 137260 - protein, 9 aa, Borrelia
TQKAVSVAG

SEQ ID NO: 137261 - protein, 15 aa, Borrelia
NVVKVAQGARDLTKV

SEQ ID NO: 137262 - protein, 9 aa, Borrelia
VKVAQGARD

SEQ ID NO: 137263 - protein, 15 aa, Borrelia
VDEVKETLMASERAL

SEQ ID NO: 137264 - protein, 9 aa, Borrelia
ETLMASERA

SEQ ID NO: 137265 - protein, 15 aa, Borrelia
QKVLNMVNGLNPSNK

SEQ ID NO: 137266 - protein, 9 aa, Borrelia
MVNGLNPSN

SEQ ID NO: 137267 - protein, 15 aa, Borrelia
LIEKQIMLNKSPNNK

SEQ ID NO: 137268 - protein, 9 aa, Borrelia
IMLNKSPNN

SEQ ID NO: 137269 - protein, 15 aa, Borrelia
KAVQETQKAVSVAGE

SEQ ID NO: 137270 - protein, 9 aa, Borrelia
TQKAVSVAG

SEQ ID NO: 137271 - protein, 15 aa, Borrelia
KKAVQETQKAVSVAG

SEQ ID NO: 137272 - protein, 9 aa, Borrelia
QETQKAVSV

SEQ ID NO: 137273 - protein, 15 aa, Borrelia
KVDEVKETLMASERA

SEQ ID NO: 137274 - protein, 9 aa, Borrelia
VKETLMASE

SEQ ID NO: 137275 - protein, 15 aa, Borrelia
VEMSKKAVQETQKAV

SEQ ID NO: 137276 - protein, 9 aa, Borrelia
MSKKAVQET

SEQ ID NO: 137277 - protein, 15 aa, Borrelia
AVQETQKAVSVAGEA

SEQ ID NO: 137278 - protein, 9 aa, Borrelia
TQKAVSVAG

SEQ ID NO: 137279 - protein, 15 aa, Borrelia
KVLNMVNGLNPSNKD

SEQ ID NO: 137280 - protein, 9 aa, Borrelia
MVNGLNPSN

SEQ ID NO: 137281 - protein, 15 aa, Borrelia
SKLEGVRESSLELVE

SEQ ID NO: 137282 - protein, 9 aa, Borrelia
VRESSLELV

SEQ ID NO: 137283 - protein, 15 aa, Borrelia
SSKLEGVRESSLELV

SEQ ID NO: 137284 - protein, 9 aa, Borrelia
LEGVRESSL

SEQ ID NO: 137285 - protein, 15 aa, Borrelia
KETLMASERALDETV

SEQ ID NO: 137286 - protein, 9 aa, Borrelia
ETLMASERA

SEQ ID NO: 137287 - protein, 15 aa, Borrelia
LEGVRESSLELVESN

SEQ ID NO: 137288 - protein, 9 aa, Borrelia
VRESSLELV

SEQ ID NO: 137289 - protein, 15 aa, Borrelia
VLNMVNGLNPSNKDQ

SEQ ID NO: 137290 - protein, 9 aa, Borrelia
MVNGLNPSN

SEQ ID NO: 137291 - protein, 15 aa, Borrelia
KLEGVRESSLELVES

SEQ ID NO: 137292 - protein, 9 aa, Borrelia
VRESSLELV

SEQ ID NO: 137293 - protein, 15 aa, Borrelia
AISNVVKVAQGARDL

SEQ ID NO: 137294 - protein, 9 aa, Borrelia
VKVAQGARD

SEQ ID NO: 137295 - protein, 15 aa, Borrelia
ETQKAVSVAGEATFL

SEQ ID NO: 137296 - protein, 9 aa, Borrelia
TQKAVSVAG

SEQ ID NO: 137297 - protein, 15 aa, Borrelia
ILKPQSNVLEHSDQK

SEQ ID NO: 137298 - protein, 9 aa, Borrelia
ILKPQSNVL

SEQ ID NO: 137299 - protein, 15 aa, Borrelia
ETLMASERALDETVQ

SEQ ID NO: 137300 - protein, 9 aa, Borrelia
ETLMASERA

SEQ ID NO: 137301 - protein, 15 aa, Borrelia
LNMVNGLNPSNKDQV

SEQ ID NO: 137302 - protein, 9 aa, Borrelia
MVNGLNPSN

SEQ ID NO: 137303 - protein, 15 aa, Borrelia
AQKVLNMVNGLNPSN

SEQ ID NO: 137304 - protein, 9 aa, Borrelia
VLNMVNGLN

SEQ ID NO: 137305 - protein, 15 aa, Borrelia
AGVVKKFVGSMSLMS

SEQ ID NO: 137306 - protein, 9 aa, Borrelia
VKKFVGSMS

SEQ ID NO: 137307 - protein, 15 aa, Borrelia
GVVKKFVGSMSLMSD

SEQ ID NO: 137308 - protein, 9 aa, Borrelia
FVGSMSLMS

SEQ ID NO: 137309 - protein, 15 aa, Borrelia
VVKKFVGSMSLMSDV

SEQ ID NO: 137310 - protein, 9 aa, Borrelia
FVGSMSLMS

SEQ ID NO: 137311 - protein, 15 aa, Borrelia
KKFVGSMSLMSDVAK

SEQ ID NO: 137312 - protein, 9 aa, Borrelia
FVGSMSLMS

SEQ ID NO: 137313 - protein, 15 aa, Borrelia
VKKFVGSMSLMSDVA

SEQ ID NO: 137314 - protein, 9 aa, Borrelia
FVGSMSLMS

SEQ ID NO: 137315 - protein, 15 aa, Borrelia
KFVGSMSLMSDVAKG

SEQ ID NO: 137316 - protein, 9 aa, Borrelia
FVGSMSLMS

SEQ ID NO: 137317 - protein, 15 aa, Borrelia
FVGSMSLMSDVAKGT

SEQ ID NO: 137318 - protein, 9 aa, Borrelia
FVGSMSLMS

SEQ ID NO: 137319 - protein, 15 aa, Borrelia
LAKKDVRKAISNVVK

SEQ ID NO: 137320 - protein, 9 aa, Borrelia
VRKAISNVV

SEQ ID NO: 137321 - protein, 15 aa, Borrelia
VLAKKDVRKAISNVV

SEQ ID NO: 137322 - protein, 9 aa, Borrelia
AKKDVRKAI

SEQ ID NO: 137323 - protein, 15 aa, Borrelia
KDVRKAISNVVKVAQ

SEQ ID NO: 137324 - protein, 9 aa, Borrelia
VRKAISNVV

SEQ ID NO: 137325 - protein, 15 aa, Borrelia
AKKDVRKAISNVVKV

SEQ ID NO: 137326 - protein, 9 aa, Borrelia
VRKAISNVV

SEQ ID NO: 137327 - protein, 15 aa, Borrelia
KKDVRKAISNVVKVA

SEQ ID NO: 137328 - protein, 9 aa, Borrelia
VRKAISNVV

SEQ ID NO: 137329 - protein, 15 aa, Borrelia
MTKIFSNLIINGLLF

SEQ ID NO: 137330 - protein, 9 aa, Borrelia
MTKIFSNLI

SEQ ID NO: 137331 - protein, 15 aa, Borrelia
INGLLFGFVSLNVFA

SEQ ID NO: 137332 - protein, 9 aa, Borrelia
LFGFVSLNV

SEQ ID NO: 137333 - protein, 15 aa, Borrelia
NGLLFGFVSLNVFAD

SEQ ID NO: 137334 - protein, 9 aa, Borrelia
LFGFVSLNV

SEQ ID NO: 137335 - protein, 15 aa, Borrelia
GLLFGFVSLNVFADS

SEQ ID NO: 137336 - protein, 9 aa, Borrelia
LFGFVSLNV

SEQ ID NO: 137337 - protein, 15 aa, Borrelia
QKVLNMVNGLNPSNK

SEQ ID NO: 137338 - protein, 9 aa, Borrelia
VLNMVNGLN

SEQ ID NO: 137339 - protein, 15 aa, Borrelia
EAQKVLNMVNGLNPS

SEQ ID NO: 137340 - protein, 9 aa, Borrelia
VLNMVNGLN

SEQ ID NO: 137341 - protein, 15 aa, Borrelia
QEAQKVLNMVNGLNP

SEQ ID NO: 137342 - protein, 9 aa, Borrelia
VLNMVNGLN

SEQ ID NO: 137343 - protein, 15 aa, Borrelia
AQKVLNMVNGLNPSN

SEQ ID NO: 137344 - protein, 9 aa, Borrelia
VLNMVNGLN

SEQ ID NO: 137345 - protein, 15 aa, Borrelia
VQEAQKVLNMVNGLN

SEQ ID NO: 137346 - protein, 9 aa, Borrelia
QKVLNMVNG

SEQ ID NO: 137347 - protein, 15 aa, Borrelia
KVLNMVNGLNPSNKD

SEQ ID NO: 137348 - protein, 9 aa, Borrelia
VLNMVNGLN

SEQ ID NO: 137349 - protein, 15 aa, Borrelia
VLNMVNGLNPSNKDQ

SEQ ID NO: 137350 - protein, 9 aa, Borrelia
VLNMVNGLN

SEQ ID NO: 137351 - protein, 15 aa, Borrelia
LIINGLLFGFVSLNV

SEQ ID NO: 137352 - protein, 9 aa, Borrelia
LLFGFVSLN

SEQ ID NO: 137353 - protein, 15 aa, Borrelia
INGLLFGFVSLNVFA

SEQ ID NO: 137354 - protein, 9 aa, Borrelia
LFGFVSLNV

SEQ ID NO: 137355 - protein, 15 aa, Borrelia
NGLLFGFVSLNVFAD

SEQ ID NO: 137356 - protein, 9 aa, Borrelia
LFGFVSLNV

SEQ ID NO: 137357 - protein, 15 aa, Borrelia
IINGLLFGFVSLNVF

SEQ ID NO: 137358 - protein, 9 aa, Borrelia
LFGFVSLNV

SEQ ID NO: 137359 - protein, 15 aa, Borrelia
IEKQIMLNKSPNNKE

SEQ ID NO: 137360 - protein, 9 aa, Borrelia
IMLNKSPNN

SEQ ID NO: 137361 - protein, 15 aa, Borrelia
LIEKQIMLNKSPNNK

SEQ ID NO: 137362 - protein, 9 aa, Borrelia
IMLNKSPNN

SEQ ID NO: 137363 - protein, 15 aa, Borrelia
EKQIMLNKSPNNKEL

SEQ ID NO: 137364 - protein, 9 aa, Borrelia
IMLNKSPNN

SEQ ID NO: 137365 - protein, 15 aa, Borrelia
KQIMLNKSPNNKELE

SEQ ID NO: 137366 - protein, 9 aa, Borrelia
IMLNKSPNN

SEQ ID NO: 137367 - protein, 15 aa, Borrelia
GLLFGFVSLNVFADS

SEQ ID NO: 137368 - protein, 9 aa, Borrelia
LFGFVSLNV

SEQ ID NO: 137369 - protein, 15 aa, Borrelia
IEKQIMLNKSPNNKE

SEQ ID NO: 137370 - protein, 9 aa, Borrelia
IMLNKSPNN

SEQ ID NO: 137371 - protein, 15 aa, Borrelia
EKQIMLNKSPNNKEL

SEQ ID NO: 137372 - protein, 9 aa, Borrelia
LNKSPNNKE

SEQ ID NO: 137373 - protein, 15 aa, Borrelia
KQIMLNKSPNNKELE

SEQ ID NO: 137374 - protein, 9 aa, Borrelia
LNKSPNNKE

SEQ ID NO: 137375 - protein, 15 aa, Borrelia
QIMLNKSPNNKELEL

SEQ ID NO: 137376 - protein, 9 aa, Borrelia
LNKSPNNKE

SEQ ID NO: 137377 - protein, 15 aa, Borrelia
IMLNKSPNNKELELT

SEQ ID NO: 137378 - protein, 9 aa, Borrelia
LNKSPNNKE

SEQ ID NO: 137379 - protein, 15 aa, Borrelia
LNKSPNNKELELTKE

SEQ ID NO: 137380 - protein, 9 aa, Borrelia
LNKSPNNKE

SEQ ID NO: 137381 - protein, 15 aa, Borrelia
MLNKSPNNKELELTK

SEQ ID NO: 137382 - protein, 9 aa, Borrelia
LNKSPNNKE

SEQ ID NO: 137383 - protein, 15 aa, Borrelia
VLAKKDVRKAISNVV

SEQ ID NO: 137384 - protein, 9 aa, Borrelia
VLAKKDVRK

SEQ ID NO: 137385 - protein, 15 aa, Borrelia
AKKDVRKAISNVVKV

SEQ ID NO: 137386 - protein, 9 aa, Borrelia
VRKAISNVV

SEQ ID NO: 137387 - protein, 15 aa, Borrelia
KKDVRKAISNVVKVA

SEQ ID NO: 137388 - protein, 9 aa, Borrelia
VRKAISNVV

SEQ ID NO: 137389 - protein, 15 aa, Borrelia
LAKKDVRKAISNVVK

SEQ ID NO: 137390 - protein, 9 aa, Borrelia
VRKAISNVV

SEQ ID NO: 137391 - protein, 15 aa, Borrelia
KDVRKAISNVVKVAQ

SEQ ID NO: 137392 - protein, 9 aa, Borrelia
VRKAISNVV

SEQ ID NO: 137393 - protein, 15 aa, Borrelia
DVRKAISNVVKVAQG

SEQ ID NO: 137394 - protein, 9 aa, Borrelia
VRKAISNVV

SEQ ID NO: 137395 - protein, 15 aa, Borrelia
VRKAISNVVKVAQGA

SEQ ID NO: 137396 - protein, 9 aa, Borrelia
VRKAISNVV

SEQ ID NO: 137397 - protein, 15 aa, Borrelia
KDVRKAISNVVKVAQ

SEQ ID NO: 137398 - protein, 9 aa, Borrelia
VRKAISNVV

SEQ ID NO: 137399 - protein, 15 aa, Borrelia
KKDVRKAISNVVKVA

SEQ ID NO: 137400 - protein, 9 aa, Borrelia
VRKAISNVV

SEQ ID NO: 137401 - protein, 15 aa, Borrelia
AKKDVRKAISNVVKV

SEQ ID NO: 137402 - protein, 9 aa, Borrelia
VRKAISNVV

SEQ ID NO: 137403 - protein, 15 aa, Borrelia
LAKKDVRKAISNVVK

SEQ ID NO: 137404 - protein, 9 aa, Borrelia
VRKAISNVV

SEQ ID NO: 137405 - protein, 15 aa, Borrelia
VLAKKDVRKAISNVV

SEQ ID NO: 137406 - protein, 9 aa, Borrelia
AKKDVRKAI

SEQ ID NO: 137407 - protein, 15 aa, Borrelia
VVKKFVGSMSLMSDV

SEQ ID NO: 137408 - protein, 9 aa, Borrelia
FVGSMSLMS

SEQ ID NO: 137409 - protein, 15 aa, Borrelia
AGVVKKFVGSMSLMS

SEQ ID NO: 137410 - protein, 9 aa, Borrelia
KKFVGSMSL

SEQ ID NO: 137411 - protein, 15 aa, Borrelia
GVVKKFVGSMSLMSD

SEQ ID NO: 137412 - protein, 9 aa, Borrelia
FVGSMSLMS

SEQ ID NO: 137413 - protein, 15 aa, Borrelia
TKIFSNLIINGLLFG

SEQ ID NO: 137414 - protein, 9 aa, Borrelia
FSNLIINGL

SEQ ID NO: 137415 - protein, 15 aa, Borrelia
KIFSNLIINGLLFGF

SEQ ID NO: 137416 - protein, 9 aa, Borrelia
FSNLIINGL

SEQ ID NO: 137417 - protein, 15 aa, Borrelia
IFSNLIINGLLFGFV

SEQ ID NO: 137418 - protein, 9 aa, Borrelia
FSNLIINGL

SEQ ID NO: 137419 - protein, 15 aa, Borrelia
FSNLIINGLLFGFVS

SEQ ID NO: 137420 - protein, 9 aa, Borrelia
FSNLIINGL

SEQ ID NO: 137421 - protein, 15 aa, Borrelia
MTKIFSNLIINGLLF

SEQ ID NO: 137422 - protein, 9 aa, Borrelia
FSNLIINGL

SEQ ID NO: 137423 - protein, 15 aa, Borrelia
EAQKVLNMVNGLNPS

SEQ ID NO: 137424 - protein, 9 aa, Borrelia
LNMVNGLNP

SEQ ID NO: 137425 - protein, 15 aa, Borrelia
AQKVLNMVNGLNPSN

SEQ ID NO: 137426 - protein, 9 aa, Borrelia
LNMVNGLNP

SEQ ID NO: 137427 - protein, 15 aa, Borrelia
QEAQKVLNMVNGLNP

SEQ ID NO: 137428 - protein, 9 aa, Borrelia
KVLNMVNGL

SEQ ID NO: 137429 - protein, 15 aa, Borrelia
QKVLNMVNGLNPSNK

SEQ ID NO: 137430 - protein, 9 aa, Borrelia
LNMVNGLNP

SEQ ID NO: 137431 - protein, 15 aa, Borrelia
KVLNMVNGLNPSNKD

SEQ ID NO: 137432 - protein, 9 aa, Borrelia
LNMVNGLNP

SEQ ID NO: 137433 - protein, 15 aa, Borrelia
KDVRKAISNVVKVAQ

SEQ ID NO: 137434 - protein, 9 aa, Borrelia
VRKAISNVV

SEQ ID NO: 137435 - protein, 15 aa, Borrelia
VLNMVNGLNPSNKDQ

SEQ ID NO: 137436 - protein, 9 aa, Borrelia
LNMVNGLNP

SEQ ID NO: 137437 - protein, 15 aa, Borrelia
GLLFGFVSLNVFADS

SEQ ID NO: 137438 - protein, 9 aa, Borrelia
FGFVSLNVF

SEQ ID NO: 137439 - protein, 15 aa, Borrelia
IEKQIMLNKSPNNKE

SEQ ID NO: 137440 - protein, 9 aa, Borrelia
MLNKSPNNK

SEQ ID NO: 137441 - protein, 15 aa, Borrelia
EKQIMLNKSPNNKEL

SEQ ID NO: 137442 - protein, 9 aa, Borrelia
MLNKSPNNK

SEQ ID NO: 137443 - protein, 15 aa, Borrelia
DVRKAISNVVKVAQG

SEQ ID NO: 137444 - protein, 9 aa, Borrelia
ISNVVKVAQ

SEQ ID NO: 137445 - protein, 15 aa, Borrelia
VRKAISNVVKVAQGA

SEQ ID NO: 137446 - protein, 9 aa, Borrelia
ISNVVKVAQ

SEQ ID NO: 137447 - protein, 15 aa, Borrelia
LLFGFVSLNVFADSN

SEQ ID NO: 137448 - protein, 9 aa, Borrelia
FGFVSLNVF

SEQ ID NO: 137449 - protein, 15 aa, Borrelia
LIEKQIMLNKSPNNK

SEQ ID NO: 137450 - protein, 9 aa, Borrelia
QIMLNKSPN

SEQ ID NO: 137451 - protein, 15 aa, Borrelia
NGLLFGFVSLNVFAD

SEQ ID NO: 137452 - protein, 9 aa, Borrelia
FGFVSLNVF

SEQ ID NO: 137453 - protein, 15 aa, Borrelia
SNLIINGLLFGFVSL

SEQ ID NO: 137454 - protein, 9 aa, Borrelia
LIINGLLFG

SEQ ID NO: 137455 - protein, 15 aa, Borrelia
KAISNVVKVAQGARD

SEQ ID NO: 137456 - protein, 9 aa, Borrelia
ISNVVKVAQ

SEQ ID NO: 137457 - protein, 15 aa, Borrelia
VQEAQKVLNMVNGLN

SEQ ID NO: 137458 - protein, 9 aa, Borrelia
KVLNMVNGL

SEQ ID NO: 137459 - protein, 15 aa, Borrelia
IINGLLFGFVSLNVF

SEQ ID NO: 137460 - protein, 9 aa, Borrelia
IINGLLFGF

SEQ ID NO: 137461 - protein, 15 aa, Borrelia
KQIMLNKSPNNKELE

SEQ ID NO: 137462 - protein, 9 aa, Borrelia
MLNKSPNNK

SEQ ID NO: 137463 - protein, 15 aa, Borrelia
QIMLNKSPNNKELEL

SEQ ID NO: 137464 - protein, 9 aa, Borrelia
MLNKSPNNK

SEQ ID NO: 137465 - protein, 15 aa, Borrelia
GVVKKFVGSMSLMSD

SEQ ID NO: 137466 - protein, 9 aa, Borrelia
VKKFVGSMS

SEQ ID NO: 137467 - protein, 15 aa, Borrelia
INGLLFGFVSLNVFA

SEQ ID NO: 137468 - protein, 9 aa, Borrelia
FGFVSLNVF

SEQ ID NO: 137469 - protein, 15 aa, Borrelia
RKAISNVVKVAQGAR

SEQ ID NO: 137470 - protein, 9 aa, Borrelia
ISNVVKVAQ

SEQ ID NO: 137471 - protein, 15 aa, Borrelia
ARDLTKVMAISLYMR

SEQ ID NO: 137472 - protein, 9 aa, Borrelia
TKVMAISLY

SEQ ID NO: 137473 - protein, 15 aa, Borrelia
LFGFVSLNVFADSNN

SEQ ID NO: 137474 - protein, 9 aa, Borrelia
FGFVSLNVF

SEQ ID NO: 137475 - protein, 15 aa, Borrelia
LNMVNGLNPSNKDQV

SEQ ID NO: 137476 - protein, 9 aa, Borrelia
LNMVNGLNP

SEQ ID NO: 137477 - protein, 15 aa, Borrelia
FGFVSLNVFADSNNA

SEQ ID NO: 137478 - protein, 9 aa, Borrelia
FGFVSLNVF

SEQ ID NO: 137479 - protein, 15 aa, Borrelia
AGVVKKFVGSMSLMS

SEQ ID NO: 137480 - protein, 9 aa, Borrelia
VKKFVGSMS

SEQ ID NO: 137481 - protein, 15 aa, Borrelia
ISNVVKVAQGARDLT

SEQ ID NO: 137482 - protein, 9 aa, Borrelia
ISNVVKVAQ

SEQ ID NO: 137483 - protein, 15 aa, Borrelia
DAGVVKKFVGSMSLM

SEQ ID NO: 137484 - protein, 9 aa, Borrelia
VKKFVGSMS

SEQ ID NO: 137485 - protein, 15 aa, Borrelia
NDAGVVKKFVGSMSL

SEQ ID NO: 137486 - protein, 9 aa, Borrelia
VKKFVGSMS

SEQ ID NO: 137487 - protein, 15 aa, Borrelia
SNDAGVVKKFVGSMS

SEQ ID NO: 137488 - protein, 9 aa, Borrelia
AGVVKKFVG

SEQ ID NO: 137489 - protein, 15 aa, Borrelia
VVKKFVGSMSLMSDV

SEQ ID NO: 137490 - protein, 9 aa, Borrelia
VKKFVGSMS

SEQ ID NO: 137491 - protein, 15 aa, Borrelia
VKKFVGSMSLMSDVA

SEQ ID NO: 137492 - protein, 9 aa, Borrelia
VKKFVGSMS

SEQ ID NO: 137493 - protein, 15 aa, Borrelia
AISNVVKVAQGARDL

SEQ ID NO: 137494 - protein, 9 aa, Borrelia
ISNVVKVAQ

SEQ ID NO: 137495 - protein, 15 aa, Borrelia
NLIINGLLFGFVSLN

SEQ ID NO: 137496 - protein, 9 aa, Borrelia
LIINGLLFG

SEQ ID NO: 137497 - protein, 15 aa, Borrelia
GARDLTKVMAISLYM

SEQ ID NO: 137498 - protein, 9 aa, Borrelia
TKVMAISLY

SEQ ID NO: 137499 - protein, 15 aa, Borrelia
KKDVRKAISNVVKVA

SEQ ID NO: 137500 - protein, 9 aa, Borrelia
VRKAISNVV

SEQ ID NO: 137501 - protein, 15 aa, Borrelia
IMLNKSPNNKELELT

SEQ ID NO: 137502 - protein, 9 aa, Borrelia
MLNKSPNNK

SEQ ID NO: 137503 - protein, 15 aa, Borrelia
QGARDLTKVMAISLY

SEQ ID NO: 137504 - protein, 9 aa, Borrelia
LTKVMAISL

SEQ ID NO: 137505 - protein, 15 aa, Borrelia
ARDLTKVMAISLYMR

SEQ ID NO: 137506 - protein, 9 aa, Borrelia
KVMAISLYM

SEQ ID NO: 137507 - protein, 15 aa, Borrelia
INGLLFGFVSLNVFA

SEQ ID NO: 137508 - protein, 9 aa, Borrelia
LFGFVSLNV

SEQ ID NO: 137509 - protein, 15 aa, Borrelia
IINGLLFGFVSLNVF

SEQ ID NO: 137510 - protein, 9 aa, Borrelia
LFGFVSLNV

SEQ ID NO: 137511 - protein, 15 aa, Borrelia
NGLLFGFVSLNVFAD

SEQ ID NO: 137512 - protein, 9 aa, Borrelia
LFGFVSLNV

SEQ ID NO: 137513 - protein, 15 aa, Borrelia
GLLFGFVSLNVFADS

SEQ ID NO: 137514 - protein, 9 aa, Borrelia
LFGFVSLNV

SEQ ID NO: 137515 - protein, 15 aa, Borrelia
LIINGLLFGFVSLNV

SEQ ID NO: 137516 - protein, 9 aa, Borrelia
INGLLFGFV

SEQ ID NO: 137517 - protein, 15 aa, Borrelia
VLAKKDVRKAISNVV

SEQ ID NO: 137518 - protein, 9 aa, Borrelia
VLAKKDVRK

SEQ ID NO: 137519 - protein, 15 aa, Borrelia
LLFGFVSLNVFADSN

SEQ ID NO: 137520 - protein, 9 aa, Borrelia
LFGFVSLNV

SEQ ID NO: 137521 - protein, 15 aa, Borrelia
LFGFVSLNVFADSNN

SEQ ID NO: 137522 - protein, 9 aa, Borrelia
LFGFVSLNV

SEQ ID NO: 137523 - protein, 15 aa, Borrelia
LAKKDVRKAISNVVK

SEQ ID NO: 137524 - protein, 9 aa, Borrelia
VRKAISNVV

SEQ ID NO: 137525 - protein, 15 aa, Borrelia
KKDVRKAISNVVKVA

SEQ ID NO: 137526 - protein, 9 aa, Borrelia
VRKAISNVV

SEQ ID NO: 137527 - protein, 15 aa, Borrelia
AKKDVRKAISNVVKV

SEQ ID NO: 137528 - protein, 9 aa, Borrelia
VRKAISNVV

SEQ ID NO: 137529 - protein, 15 aa, Borrelia
KDVRKAISNVVKVAQ

SEQ ID NO: 137530 - protein, 9 aa, Borrelia
VRKAISNVV

SEQ ID NO: 137531 - protein, 15 aa, Borrelia
QKVLNMVNGLNPSNK

SEQ ID NO: 137532 - protein, 9 aa, Borrelia
VLNMVNGLN

SEQ ID NO: 137533 - protein, 15 aa, Borrelia
AGVVKKFVGSMSLMS

SEQ ID NO: 137534 - protein, 9 aa, Borrelia
VKKFVGSMS

SEQ ID NO: 137535 - protein, 15 aa, Borrelia
GVVKKFVGSMSLMSD

SEQ ID NO: 137536 - protein, 9 aa, Borrelia
FVGSMSLMS

SEQ ID NO: 137537 - protein, 15 aa, Borrelia
LIEKQIMLNKSPNNK

SEQ ID NO: 137538 - protein, 9 aa, Borrelia
IMLNKSPNN

SEQ ID NO: 137539 - protein, 15 aa, Borrelia
KVLNMVNGLNPSNKD

SEQ ID NO: 137540 - protein, 9 aa, Borrelia
VNGLNPSNK

SEQ ID NO: 137541 - protein, 15 aa, Borrelia
IEKQIMLNKSPNNKE

SEQ ID NO: 137542 - protein, 9 aa, Borrelia
MLNKSPNNK

SEQ ID NO: 137543 - protein, 15 aa, Borrelia
EKQIMLNKSPNNKEL

SEQ ID NO: 137544 - protein, 9 aa, Borrelia
MLNKSPNNK

SEQ ID NO: 137545 - protein, 15 aa, Borrelia
KQIMLNKSPNNKELE

SEQ ID NO: 137546 - protein, 9 aa, Borrelia
MLNKSPNNK

SEQ ID NO: 137547 - protein, 15 aa, Borrelia
VLNMVNGLNPSNKDQ

SEQ ID NO: 137548 - protein, 9 aa, Borrelia
VNGLNPSNK

SEQ ID NO: 137549 - protein, 15 aa, Borrelia
VVKKFVGSMSLMSDV

SEQ ID NO: 137550 - protein, 9 aa, Borrelia
FVGSMSLMS

SEQ ID NO: 137551 - protein, 15 aa, Borrelia
QIMLNKSPNNKELEL

SEQ ID NO: 137552 - protein, 9 aa, Borrelia
MLNKSPNNK

SEQ ID NO: 137553 - protein, 15 aa, Borrelia
VKKFVGSMSLMSDVA

SEQ ID NO: 137554 - protein, 9 aa, Borrelia
FVGSMSLMS

SEQ ID NO: 137555 - protein, 15 aa, Borrelia
LIEKQIMLNKSPNNK

SEQ ID NO: 137556 - protein, 9 aa, Borrelia
LIEKQIMLN

SEQ ID NO: 137557 - protein, 15 aa, Borrelia
EKQIMLNKSPNNKEL

SEQ ID NO: 137558 - protein, 9 aa, Borrelia
MLNKSPNNK

SEQ ID NO: 137559 - protein, 15 aa, Borrelia
IEKQIMLNKSPNNKE

SEQ ID NO: 137560 - protein, 9 aa, Borrelia
MLNKSPNNK

SEQ ID NO: 137561 - protein, 15 aa, Borrelia
KQIMLNKSPNNKELE

SEQ ID NO: 137562 - protein, 9 aa, Borrelia
MLNKSPNNK

SEQ ID NO: 137563 - protein, 15 aa, Borrelia
QIMLNKSPNNKELEL

SEQ ID NO: 137564 - protein, 9 aa, Borrelia
MLNKSPNNK

SEQ ID NO: 137565 - protein, 15 aa, Borrelia
IMLNKSPNNKELELT

SEQ ID NO: 137566 - protein, 9 aa, Borrelia
MLNKSPNNK

SEQ ID NO: 137567 - protein, 15 aa, Borrelia
MLNKSPNNKELELTK

SEQ ID NO: 137568 - protein, 9 aa, Borrelia
MLNKSPNNK

SEQ ID NO: 137569 - protein, 15 aa, Borrelia
IEKQIMLNKSPNNKE

SEQ ID NO: 137570 - protein, 9 aa, Borrelia
MLNKSPNNK

SEQ ID NO: 137571 - protein, 15 aa, Borrelia burgdorferi
IDPITNLGTLQLIDL

SEQ ID NO: 137572 - protein, 9 aa, Borrelia burgdorferi
ITNLGTLQL

SEQ ID NO: 137573 - protein, 15 aa, Borrelia burgdorferi
LEVIDPITNLGTLQL

SEQ ID NO: 137574 - protein, 9 aa, Borrelia burgdorferi
VIDPITNLG

SEQ ID NO: 137575 - protein, 15 aa, Borrelia burgdorferi
EVIDPITNLGTLQLI

SEQ ID NO: 137576 - protein, 9 aa, Borrelia burgdorferi
ITNLGTLQL

SEQ ID NO: 137577 - protein, 15 aa, Borrelia burgdorferi
VIDPITNLGTLQLID

SEQ ID NO: 137578 - protein, 9 aa, Borrelia burgdorferi
ITNLGTLQL

SEQ ID NO: 137579 - protein, 15 aa, Borrelia burgdorferi
DPITNLGTLQLIDLN

SEQ ID NO: 137580 - protein, 9 aa, Borrelia burgdorferi
ITNLGTLQL

SEQ ID NO: 137581 - protein, 15 aa, Borrelia burgdorferi
DYYKGFYIEPALKSL

SEQ ID NO: 137582 - protein, 9 aa, Borrelia burgdorferi
FYIEPALKS

SEQ ID NO: 137583 - protein, 15 aa, Borrelia burgdorferi
YKGFYIEPALKSLTK

SEQ ID NO: 137584 - protein, 9 aa, Borrelia burgdorferi
FYIEPALKS

SEQ ID NO: 137585 - protein, 15 aa, Borrelia burgdorferi
YYKGFYIEPALKSLT

SEQ ID NO: 137586 - protein, 9 aa, Borrelia burgdorferi
FYIEPALKS

SEQ ID NO: 137587 - protein, 15 aa, Borrelia burgdorferi
KGFYIEPALKSLTKE

SEQ ID NO: 137588 - protein, 9 aa, Borrelia burgdorferi
FYIEPALKS

SEQ ID NO: 137589 - protein, 15 aa, Borrelia burgdorferi
LDYYKGFYIEPALKS

SEQ ID NO: 137590 - protein, 9 aa, Borrelia burgdorferi
YKGFYIEPA

SEQ ID NO: 137591 - protein, 15 aa, Borrelia burgdorferi
ITNLGTLQLIDLNTG

SEQ ID NO: 137592 - protein, 9 aa, Borrelia burgdorferi
ITNLGTLQL

SEQ ID NO: 137593 - protein, 15 aa, Borrelia burgdorferi
PITNLGTLQLIDLNT

SEQ ID NO: 137594 - protein, 9 aa, Borrelia burgdorferi
ITNLGTLQL

SEQ ID NO: 137595 - protein, 15 aa, Borrelia burgdorferi
EKLKDFVNMDLEFVN

SEQ ID NO: 137596 - protein, 9 aa, Borrelia burgdorferi
FVNMDLEFV

SEQ ID NO: 137597 - protein, 15 aa, Borrelia burgdorferi
LKDFVNMDLEFVNYK

SEQ ID NO: 137598 - protein, 9 aa, Borrelia burgdorferi
FVNMDLEFV

SEQ ID NO: 137599 - protein, 15 aa, Borrelia burgdorferi
KDFVNMDLEFVNYKG

SEQ ID NO: 137600 - protein, 9 aa, Borrelia burgdorferi
FVNMDLEFV

SEQ ID NO: 137601 - protein, 15 aa, Borrelia burgdorferi
KLKDFVNMDLEFVNY

SEQ ID NO: 137602 - protein, 9 aa, Borrelia burgdorferi
FVNMDLEFV

SEQ ID NO: 137603 - protein, 15 aa, Borrelia burgdorferi
KEKLKDFVNMDLEFV

SEQ ID NO: 137604 - protein, 9 aa, Borrelia burgdorferi
KEKLKDFVN

SEQ ID NO: 137605 - protein, 15 aa, Borrelia burgdorferi
FLIFLNGFPLNARKV

SEQ ID NO: 137606 - protein, 9 aa, Borrelia burgdorferi
FLNGFPLNA

SEQ ID NO: 137607 - protein, 15 aa, Borrelia burgdorferi
LIFLNGFPLNARKVD

SEQ ID NO: 137608 - protein, 9 aa, Borrelia burgdorferi
FLNGFPLNA

SEQ ID NO: 137609 - protein, 15 aa, Borrelia burgdorferi
DELKNLVILDVNTLK

SEQ ID NO: 137610 - protein, 9 aa, Borrelia burgdorferi
LKNLVILDV

SEQ ID NO: 137611 - protein, 15 aa, Borrelia burgdorferi
QDELKNLVILDVNTL

SEQ ID NO: 137612 - protein, 9 aa, Borrelia burgdorferi
LKNLVILDV

SEQ ID NO: 137613 - protein, 15 aa, Borrelia burgdorferi
EEEITKGKSRASLGD

SEQ ID NO: 137614 - protein, 9 aa, Borrelia burgdorferi
ITKGKSRAS

SEQ ID NO: 137615 - protein, 15 aa, Borrelia burgdorferi
LQDELKNLVILDVNT

SEQ ID NO: 137616 - protein, 9 aa, Borrelia burgdorferi
LKNLVILDV

SEQ ID NO: 137617 - protein, 15 aa, Borrelia burgdorferi
KEEEITKGKSRASLG

SEQ ID NO: 137618 - protein, 9 aa, Borrelia burgdorferi
ITKGKSRAS

SEQ ID NO: 137619 - protein, 15 aa, Borrelia burgdorferi
EEITKGKSRASLGDL

SEQ ID NO: 137620 - protein, 9 aa, Borrelia burgdorferi
ITKGKSRAS

SEQ ID NO: 137621 - protein, 15 aa, Borrelia burgdorferi
YLQDELKNLVILDVN

SEQ ID NO: 137622 - protein, 9 aa, Borrelia burgdorferi
LKNLVILDV

SEQ ID NO: 137623 - protein, 15 aa, Borrelia burgdorferi
VKEEEITKGKSRASL

SEQ ID NO: 137624 - protein, 9 aa, Borrelia burgdorferi
ITKGKSRAS

SEQ ID NO: 137625 - protein, 15 aa, Borrelia burgdorferi
EFLARPLTNSNSNSS

SEQ ID NO: 137626 - protein, 9 aa, Borrelia burgdorferi
FLARPLTNS

SEQ ID NO: 137627 - protein, 15 aa, Borrelia burgdorferi
IYLQDELKNLVILDV

SEQ ID NO: 137628 - protein, 9 aa, Borrelia burgdorferi
IYLQDELKN

SEQ ID NO: 137629 - protein, 15 aa, Borrelia burgdorferi
KVKEEEITKGKSRAS

SEQ ID NO: 137630 - protein, 9 aa, Borrelia burgdorferi
EITKGKSRA

SEQ ID NO: 137631 - protein, 15 aa, Borrelia burgdorferi
IGEFLARPLTNSNSN

SEQ ID NO: 137632 - protein, 9 aa, Borrelia burgdorferi
FLARPLTNS

SEQ ID NO: 137633 - protein, 15 aa, Borrelia burgdorferi
GEFLARPLTNSNSNS

SEQ ID NO: 137634 - protein, 9 aa, Borrelia burgdorferi
FLARPLTNS

SEQ ID NO: 137635 - protein, 15 aa, Borrelia burgdorferi
FLARPLTNSNSNSSY

SEQ ID NO: 137636 - protein, 9 aa, Borrelia burgdorferi
LTNSNSNSS

SEQ ID NO: 137637 - protein, 15 aa, Borrelia burgdorferi
FFLIFLNGFPLNARK

SEQ ID NO: 137638 - protein, 9 aa, Borrelia burgdorferi
FLNGFPLNA

SEQ ID NO: 137639 - protein, 15 aa, Borrelia burgdorferi
VGIGEFLARPLTNSN

SEQ ID NO: 137640 - protein, 9 aa, Borrelia burgdorferi
FLARPLTNS

SEQ ID NO: 137641 - protein, 15 aa, Borrelia burgdorferi
GIGEFLARPLTNSNS

SEQ ID NO: 137642 - protein, 9 aa, Borrelia burgdorferi
FLARPLTNS

SEQ ID NO: 137643 - protein, 15 aa, Borrelia burgdorferi
SFFLIFLNGFPLNAR

SEQ ID NO: 137644 - protein, 9 aa, Borrelia burgdorferi
FLNGFPLNA

SEQ ID NO: 137645 - protein, 15 aa, Borrelia burgdorferi
GFYIEPALKSLTKEN

SEQ ID NO: 137646 - protein, 9 aa, Borrelia burgdorferi
FYIEPALKS

SEQ ID NO: 137647 - protein, 15 aa, Borrelia burgdorferi
FYIEPALKSLTKENA

SEQ ID NO: 137648 - protein, 9 aa, Borrelia burgdorferi
FYIEPALKS

SEQ ID NO: 137649 - protein, 15 aa, Borrelia burgdorferi
NFEINKNSSLYVDSK

SEQ ID NO: 137650 - protein, 9 aa, Borrelia burgdorferi
INKNSSLYV

SEQ ID NO: 137651 - protein, 15 aa, Borrelia burgdorferi
SNFEINKNSSLYVDS

SEQ ID NO: 137652 - protein, 9 aa, Borrelia burgdorferi
INKNSSLYV

SEQ ID NO: 137653 - protein, 15 aa, Borrelia burgdorferi
IVGIGEFLARPLTNS

SEQ ID NO: 137654 - protein, 9 aa, Borrelia burgdorferi
IGEFLARPL

SEQ ID NO: 137655 - protein, 15 aa, Borrelia burgdorferi
IFLNGFPLNARKVDK

SEQ ID NO: 137656 - protein, 9 aa, Borrelia burgdorferi
FLNGFPLNA

SEQ ID NO: 137657 - protein, 15 aa, Borrelia burgdorferi
ESNFEINKNSSLYVD

SEQ ID NO: 137658 - protein, 9 aa, Borrelia burgdorferi
INKNSSLYV

SEQ ID NO: 137659 - protein, 15 aa, Borrelia burgdorferi
SESNFEINKNSSLYV

SEQ ID NO: 137660 - protein, 9 aa, Borrelia burgdorferi
EINKNSSLY

SEQ ID NO: 137661 - protein, 15 aa, Borrelia burgdorferi
FEINKNSSLYVDSKM

SEQ ID NO: 137662 - protein, 9 aa, Borrelia burgdorferi
INKNSSLYV

SEQ ID NO: 137663 - protein, 15 aa, Borrelia burgdorferi
LARPLTNSNSNSSYY

SEQ ID NO: 137664 - protein, 9 aa, Borrelia burgdorferi
LTNSNSNSS

SEQ ID NO: 137665 - protein, 15 aa, Borrelia burgdorferi
FSFFLIFLNGFPLNA

SEQ ID NO: 137666 - protein, 9 aa, Borrelia burgdorferi
FFLIFLNGF

SEQ ID NO: 137667 - protein, 15 aa, Borrelia burgdorferi
ARPLTNSNSNSSYYG

SEQ ID NO: 137668 - protein, 9 aa, Borrelia burgdorferi
LTNSNSNSS

SEQ ID NO: 137669 - protein, 15 aa, Borrelia burgdorferi
DFVNMDLEFVNYKGP

SEQ ID NO: 137670 - protein, 9 aa, Borrelia burgdorferi
FVNMDLEFV

SEQ ID NO: 137671 - protein, 15 aa, Borrelia burgdorferi
FVNMDLEFVNYKGPY

SEQ ID NO: 137672 - protein, 9 aa, Borrelia burgdorferi
FVNMDLEFV

SEQ ID NO: 137673 - protein, 15 aa, Borrelia burgdorferi
RPLTNSNSNSSYYGK

SEQ ID NO: 137674 - protein, 9 aa, Borrelia burgdorferi
LTNSNSNSS

SEQ ID NO: 137675 - protein, 15 aa, Borrelia burgdorferi
FLNGFPLNARKVDKE

SEQ ID NO: 137676 - protein, 9 aa, Borrelia burgdorferi
FLNGFPLNA

SEQ ID NO: 137677 - protein, 15 aa, Borrelia burgdorferi
LKNLVILDVNTLKKV

SEQ ID NO: 137678 - protein, 9 aa, Borrelia burgdorferi
LKNLVILDV

SEQ ID NO: 137679 - protein, 15 aa, Borrelia burgdorferi
ELKNLVILDVNTLKK

SEQ ID NO: 137680 - protein, 9 aa, Borrelia burgdorferi
LKNLVILDV

SEQ ID NO: 137681 - protein, 15 aa, Borrelia burgdorferi
LVVIKMDSGKAKLQI

SEQ ID NO: 137682 - protein, 9 aa, Borrelia burgdorferi
VIKMDSGKA

SEQ ID NO: 137683 - protein, 15 aa, Borrelia burgdorferi
DLVVIKMDSGKAKLQ

SEQ ID NO: 137684 - protein, 9 aa, Borrelia burgdorferi
VIKMDSGKA

SEQ ID NO: 137685 - protein, 15 aa, Borrelia burgdorferi
DSILNLRRILTGYII

SEQ ID NO: 137686 - protein, 9 aa, Borrelia burgdorferi
ILNLRRILT

SEQ ID NO: 137687 - protein, 15 aa, Borrelia burgdorferi
LDSILNLRRILTGYI

SEQ ID NO: 137688 - protein, 9 aa, Borrelia burgdorferi
ILNLRRILT

SEQ ID NO: 137689 - protein, 15 aa, Borrelia burgdorferi
EDLDKDLTTMSIDSS

SEQ ID NO: 137690 - protein, 9 aa, Borrelia burgdorferi
DKDLTTMSI

SEQ ID NO: 137691 - protein, 15 aa, Borrelia burgdorferi
EITKGKSRASLGDLN

SEQ ID NO: 137692 - protein, 9 aa, Borrelia burgdorferi
ITKGKSRAS

SEQ ID NO: 137693 - protein, 15 aa, Borrelia burgdorferi
DLDKDLTTMSIDSSS

SEQ ID NO: 137694 - protein, 9 aa, Borrelia burgdorferi
LTTMSIDSS

SEQ ID NO: 137695 - protein, 15 aa, Borrelia burgdorferi
ITKGKSRASLGDLNN

SEQ ID NO: 137696 - protein, 9 aa, Borrelia burgdorferi
ITKGKSRAS

SEQ ID NO: 137697 - protein, 15 aa, Borrelia burgdorferi
KDLVVIKMDSGKAKL

SEQ ID NO: 137698 - protein, 9 aa, Borrelia burgdorferi
VIKMDSGKA

SEQ ID NO: 137699 - protein, 15 aa, Borrelia burgdorferi
IDSLVTDKVIAALLS

SEQ ID NO: 137700 - protein, 9 aa, Borrelia burgdorferi
LVTDKVIAA

SEQ ID NO: 137701 - protein, 15 aa, Borrelia burgdorferi
EKDLVVIKMDSGKAK

SEQ ID NO: 137702 - protein, 9 aa, Borrelia burgdorferi
VIKMDSGKA

SEQ ID NO: 137703 - protein, 15 aa, Borrelia burgdorferi
DSLVTDKVIAALLSE

SEQ ID NO: 137704 - protein, 9 aa, Borrelia burgdorferi
DKVIAALLS

SEQ ID NO: 137705 - protein, 15 aa, Borrelia burgdorferi
ILNLRRILTGYIIKS

SEQ ID NO: 137706 - protein, 9 aa, Borrelia burgdorferi
LRRILTGYI

SEQ ID NO: 137707 - protein, 15 aa, Borrelia burgdorferi
DKDLTTMSIDSSSPV

SEQ ID NO: 137708 - protein, 9 aa, Borrelia burgdorferi
LTTMSIDSS

SEQ ID NO: 137709 - protein, 15 aa, Borrelia burgdorferi
MKKMLLIFSFFLIFL

SEQ ID NO: 137710 - protein, 9 aa, Borrelia burgdorferi
MKKMLLIFS

SEQ ID NO: 137711 - protein, 15 aa, Borrelia burgdorferi
LVTDKVIAALLSENE

SEQ ID NO: 137712 - protein, 9 aa, Borrelia burgdorferi
DKVIAALLS

SEQ ID NO: 137713 - protein, 15 aa, Borrelia burgdorferi
LDKDLTTMSIDSSSP

SEQ ID NO: 137714 - protein, 9 aa, Borrelia burgdorferi
LTTMSIDSS

SEQ ID NO: 137715 - protein, 15 aa, Borrelia burgdorferi
DLTTMSIDSSSPVFL

SEQ ID NO: 137716 - protein, 9 aa, Borrelia burgdorferi
LTTMSIDSS

SEQ ID NO: 137717 - protein, 15 aa, Borrelia burgdorferi
LTTMSIDSSSPVFLE

SEQ ID NO: 137718 - protein, 9 aa, Borrelia burgdorferi
IDSSSPVFL

SEQ ID NO: 137719 - protein, 15 aa, Borrelia burgdorferi
VTDKVIAALLSENEA

SEQ ID NO: 137720 - protein, 9 aa, Borrelia burgdorferi
DKVIAALLS

SEQ ID NO: 137721 - protein, 15 aa, Borrelia burgdorferi
LNLRRILTGYIIKSF

SEQ ID NO: 137722 - protein, 9 aa, Borrelia burgdorferi
LRRILTGYI

SEQ ID NO: 137723 - protein, 15 aa, Borrelia burgdorferi
SLVTDKVIAALLSEN

SEQ ID NO: 137724 - protein, 9 aa, Borrelia burgdorferi
DKVIAALLS

SEQ ID NO: 137725 - protein, 15 aa, Borrelia burgdorferi
KDLTTMSIDSSSPVF

SEQ ID NO: 137726 - protein, 9 aa, Borrelia burgdorferi
LTTMSIDSS

SEQ ID NO: 137727 - protein, 15 aa, Borrelia burgdorferi
TNLGTLQLIDLNTGV

SEQ ID NO: 137728 - protein, 9 aa, Borrelia burgdorferi
LGTLQLIDL

SEQ ID NO: 137729 - protein, 15 aa, Borrelia burgdorferi
SILNLRRILTGYIIK

SEQ ID NO: 137730 - protein, 9 aa, Borrelia burgdorferi
LRRILTGYI

SEQ ID NO: 137731 - protein, 15 aa, Borrelia burgdorferi
VVIKMDSGKAKLQIL

SEQ ID NO: 137732 - protein, 9 aa, Borrelia burgdorferi
IKMDSGKAK

SEQ ID NO: 137733 - protein, 15 aa, Borrelia burgdorferi
SELDSILNLRRILTG

SEQ ID NO: 137734 - protein, 9 aa, Borrelia burgdorferi
ILNLRRILT

SEQ ID NO: 137735 - protein, 15 aa, Borrelia burgdorferi
ENKILPFTSFSVRKN

SEQ ID NO: 137736 - protein, 9 aa, Borrelia burgdorferi
ILPFTSFSV

SEQ ID NO: 137737 - protein, 15 aa, Borrelia burgdorferi
LGTLQLIDLNTGVRL

SEQ ID NO: 137738 - protein, 9 aa, Borrelia burgdorferi
LQLIDLNTG

SEQ ID NO: 137739 - protein, 15 aa, Borrelia burgdorferi
EINKNSSLYVDSKMI

SEQ ID NO: 137740 - protein, 9 aa, Borrelia burgdorferi
INKNSSLYV

SEQ ID NO: 137741 - protein, 15 aa, Borrelia burgdorferi
NKILPFTSFSVRKNF

SEQ ID NO: 137742 - protein, 9 aa, Borrelia burgdorferi
FTSFSVRKN

SEQ ID NO: 137743 - protein, 15 aa, Borrelia burgdorferi
ELDSILNLRRILTGY

SEQ ID NO: 137744 - protein, 9 aa, Borrelia burgdorferi
ILNLRRILT

SEQ ID NO: 137745 - protein, 15 aa, Borrelia burgdorferi
SLYVDSKMILAAVRD

SEQ ID NO: 137746 - protein, 9 aa, Borrelia burgdorferi
YVDSKMILA

SEQ ID NO: 137747 - protein, 15 aa, Borrelia burgdorferi
INKNSSLYVDSKMIL

SEQ ID NO: 137748 - protein, 9 aa, Borrelia burgdorferi
INKNSSLYV

SEQ ID NO: 137749 - protein, 15 aa, Borrelia burgdorferi
LYVDSKMILAAVRDK

SEQ ID NO: 137750 - protein, 9 aa, Borrelia burgdorferi
SKMILAAVR

SEQ ID NO: 137751 - protein, 15 aa, Borrelia burgdorferi
NLRRILTGYIIKSFD

SEQ ID NO: 137752 - protein, 9 aa, Borrelia burgdorferi
ILTGYIIKS

SEQ ID NO: 137753 - protein, 15 aa, Borrelia burgdorferi
IDIDSLVTDKVIAAL

SEQ ID NO: 137754 - protein, 9 aa, Borrelia burgdorferi
LVTDKVIAA

SEQ ID NO: 137755 - protein, 15 aa, Borrelia burgdorferi
VIKMDSGKAKLQILN

SEQ ID NO: 137756 - protein, 9 aa, Borrelia burgdorferi
VIKMDSGKA

SEQ ID NO: 137757 - protein, 15 aa, Borrelia burgdorferi
KSELDSILNLRRILT

SEQ ID NO: 137758 - protein, 9 aa, Borrelia burgdorferi
LDSILNLRR

SEQ ID NO: 137759 - protein, 15 aa, Borrelia burgdorferi
TDKVIAALLSENEAG

SEQ ID NO: 137760 - protein, 9 aa, Borrelia burgdorferi
IAALLSENE

SEQ ID NO: 137761 - protein, 15 aa, Borrelia burgdorferi
DKVIAALLSENEAGV

SEQ ID NO: 137762 - protein, 9 aa, Borrelia burgdorferi
IAALLSENE

SEQ ID NO: 137763 - protein, 15 aa, Borrelia burgdorferi
SSLYVDSKMILAAVR

SEQ ID NO: 137764 - protein, 9 aa, Borrelia burgdorferi
YVDSKMILA

SEQ ID NO: 137765 - protein, 15 aa, Borrelia burgdorferi
PVFLEVIDPITNLGT

SEQ ID NO: 137766 - protein, 9 aa, Borrelia burgdorferi
VIDPITNLG

SEQ ID NO: 137767 - protein, 15 aa, Borrelia burgdorferi
PLTNSNSNSSYYGKY

SEQ ID NO: 137768 - protein, 9 aa, Borrelia burgdorferi
LTNSNSNSS

SEQ ID NO: 137769 - protein, 15 aa, Borrelia burgdorferi
VFLEVIDPITNLGTL

SEQ ID NO: 137770 - protein, 9 aa, Borrelia burgdorferi
VIDPITNLG

SEQ ID NO: 137771 - protein, 15 aa, Borrelia burgdorferi
LQILNKLENLKVVSE

SEQ ID NO: 137772 - protein, 9 aa, Borrelia burgdorferi
LNKLENLKV

SEQ ID NO: 137773 - protein, 15 aa, Borrelia burgdorferi
LTNSNSNSSYYGKYF

SEQ ID NO: 137774 - protein, 9 aa, Borrelia burgdorferi
LTNSNSNSS

SEQ ID NO: 137775 - protein, 15 aa, Borrelia burgdorferi
LRRILTGYIIKSFDY

SEQ ID NO: 137776 - protein, 9 aa, Borrelia burgdorferi
ILTGYIIKS

SEQ ID NO: 137777 - protein, 15 aa, Borrelia burgdorferi
EELLKSKDGKVSKDY

SEQ ID NO: 137778 - protein, 9 aa, Borrelia burgdorferi
LKSKDGKVS

SEQ ID NO: 137779 - protein, 15 aa, Borrelia burgdorferi
RDEELLKSKDGKVSK

SEQ ID NO: 137780 - protein, 9 aa, Borrelia burgdorferi
LKSKDGKVS

SEQ ID NO: 137781 - protein, 15 aa, Borrelia burgdorferi
QILNKLENLKVVSES

SEQ ID NO: 137782 - protein, 9 aa, Borrelia burgdorferi
LNKLENLKV

SEQ ID NO: 137783 - protein, 15 aa, Borrelia burgdorferi
TTMSIDSSSPVFLEV

SEQ ID NO: 137784 - protein, 9 aa, Borrelia burgdorferi
IDSSSPVFL

SEQ ID NO: 137785 - protein, 15 aa, Borrelia burgdorferi
KRDEELLKSKDGKVS

SEQ ID NO: 137786 - protein, 9 aa, Borrelia burgdorferi
EELLKSKDG

SEQ ID NO: 137787 - protein, 15 aa, Borrelia burgdorferi
FLEVIDPITNLGTLQ

SEQ ID NO: 137788 - protein, 9 aa, Borrelia burgdorferi
VIDPITNLG

SEQ ID NO: 137789 - protein, 15 aa, Borrelia burgdorferi
ELLKSKDGKVSKDYE

SEQ ID NO: 137790 - protein, 9 aa, Borrelia burgdorferi
LKSKDGKVS

SEQ ID NO: 137791 - protein, 15 aa, Borrelia burgdorferi
KNLVILDVNTLKKVK

SEQ ID NO: 137792 - protein, 9 aa, Borrelia burgdorferi
LVILDVNTL

SEQ ID NO: 137793 - protein, 15 aa, Borrelia burgdorferi
YVDSKMILAAVRDKD

SEQ ID NO: 137794 - protein, 9 aa, Borrelia burgdorferi
MILAAVRDK

SEQ ID NO: 137795 - protein, 15 aa, Borrelia burgdorferi
NEDLDKDLTTMSIDS

SEQ ID NO: 137796 - protein, 9 aa, Borrelia burgdorferi
LDKDLTTMS

SEQ ID NO: 137797 - protein, 15 aa, Borrelia burgdorferi
LNGFPLNARKVDKEK

SEQ ID NO: 137798 - protein, 9 aa, Borrelia burgdorferi
GFPLNARKV

SEQ ID NO: 137799 - protein, 15 aa, Borrelia burgdorferi
DEELLKSKDGKVSKD

SEQ ID NO: 137800 - protein, 9 aa, Borrelia burgdorferi
LKSKDGKVS

SEQ ID NO: 137801 - protein, 15 aa, Borrelia burgdorferi
IDLNTGVRLKESTQQ

SEQ ID NO: 137802 - protein, 9 aa, Borrelia burgdorferi
IDLNTGVRL

SEQ ID NO: 137803 - protein, 15 aa, Borrelia burgdorferi
LNEDLDKDLTTMSID

SEQ ID NO: 137804 - protein, 9 aa, Borrelia burgdorferi
DKDLTTMSI

SEQ ID NO: 137805 - protein, 15 aa, Borrelia burgdorferi
SLNEDLDKDLTTMSI

SEQ ID NO: 137806 - protein, 9 aa, Borrelia burgdorferi
LDKDLTTMS

SEQ ID NO: 137807 - protein, 15 aa, Borrelia burgdorferi
TMSIDSSSPVFLEVI

SEQ ID NO: 137808 - protein, 9 aa, Borrelia burgdorferi
IDSSSPVFL

SEQ ID NO: 137809 - protein, 15 aa, Borrelia burgdorferi
LEFVNYKGPYDSTNT

SEQ ID NO: 137810 - protein, 9 aa, Borrelia burgdorferi
VNYKGPYDS

SEQ ID NO: 137811 - protein, 15 aa, Borrelia burgdorferi
GTLQLIDLNTGVRLK

SEQ ID NO: 137812 - protein, 9 aa, Borrelia burgdorferi
LQLIDLNTG

SEQ ID NO: 137813 - protein, 15 aa, Borrelia burgdorferi
NLGTLQLIDLNTGVR

SEQ ID NO: 137814 - protein, 9 aa, Borrelia burgdorferi
LQLIDLNTG

SEQ ID NO: 137815 - protein, 15 aa, Borrelia burgdorferi
VDSKMILAAVRDKDD

SEQ ID NO: 137816 - protein, 9 aa, Borrelia burgdorferi
MILAAVRDK

SEQ ID NO: 137817 - protein, 15 aa, Borrelia burgdorferi
EFVNYKGPYDSTNTY

SEQ ID NO: 137818 - protein, 9 aa, Borrelia burgdorferi
VNYKGPYDS

SEQ ID NO: 137819 - protein, 15 aa, Borrelia burgdorferi
DLNTGVRLKESTQQG

SEQ ID NO: 137820 - protein, 9 aa, Borrelia burgdorferi
VRLKESTQQ

SEQ ID NO: 137821 - protein, 15 aa, Borrelia burgdorferi
KSLTKENAGLSRVYS

SEQ ID NO: 137822 - protein, 9 aa, Borrelia burgdorferi
LTKENAGLS

SEQ ID NO: 137823 - protein, 15 aa, Borrelia burgdorferi
MSIDSSSPVFLEVID

SEQ ID NO: 137824 - protein, 9 aa, Borrelia burgdorferi
IDSSSPVFL

SEQ ID NO: 137825 - protein, 15 aa, Borrelia burgdorferi
DIDSLVTDKVIAALL

SEQ ID NO: 137826 - protein, 9 aa, Borrelia burgdorferi
LVTDKVIAA

SEQ ID NO: 137827 - protein, 15 aa, Borrelia burgdorferi
DPKVKDQTTSLNEDL

SEQ ID NO: 137828 - protein, 9 aa, Borrelia burgdorferi
VKDQTTSLN

SEQ ID NO: 137829 - protein, 15 aa, Borrelia burgdorferi
LKSLTKENAGLSRVY

SEQ ID NO: 137830 - protein, 9 aa, Borrelia burgdorferi
LTKENAGLS

SEQ ID NO: 137831 - protein, 15 aa, Borrelia burgdorferi
NTGVRLKESTQQGIQ

SEQ ID NO: 137832 - protein, 9 aa, Borrelia burgdorferi
VRLKESTQQ

SEQ ID NO: 137833 - protein, 15 aa, Borrelia burgdorferi
DIDIDSLVTDKVIAA

SEQ ID NO: 137834 - protein, 9 aa, Borrelia burgdorferi
IDSLVTDKV

SEQ ID NO: 137835 - protein, 15 aa, Borrelia burgdorferi
LNTGVRLKESTQQGI

SEQ ID NO: 137836 - protein, 9 aa, Borrelia burgdorferi
VRLKESTQQ

SEQ ID NO: 137837 - protein, 15 aa, Borrelia burgdorferi
ILPFTSFSVRKNFIY

SEQ ID NO: 137838 - protein, 9 aa, Borrelia burgdorferi
FTSFSVRKN

SEQ ID NO: 137839 - protein, 15 aa, Borrelia burgdorferi
LSENKILPFTSFSVR

SEQ ID NO: 137840 - protein, 9 aa, Borrelia burgdorferi
ILPFTSFSV

SEQ ID NO: 137841 - protein, 15 aa, Borrelia burgdorferi
SENKILPFTSFSVRK

SEQ ID NO: 137842 - protein, 9 aa, Borrelia burgdorferi
ILPFTSFSV

SEQ ID NO: 137843 - protein, 15 aa, Borrelia burgdorferi
IDPKVKDQTTSLNED

SEQ ID NO: 137844 - protein, 9 aa, Borrelia burgdorferi
VKDQTTSLN

SEQ ID NO: 137845 - protein, 15 aa, Borrelia burgdorferi
QKIDPKVKDQTTSLN

SEQ ID NO: 137846 - protein, 9 aa, Borrelia burgdorferi
KVKDQTTSL

SEQ ID NO: 137847 - protein, 15 aa, Borrelia burgdorferi
KIDPKVKDQTTSLNE

SEQ ID NO: 137848 - protein, 9 aa, Borrelia burgdorferi
VKDQTTSLN

SEQ ID NO: 137849 - protein, 15 aa, Borrelia burgdorferi
KILPFTSFSVRKNFI

SEQ ID NO: 137850 - protein, 9 aa, Borrelia burgdorferi
FTSFSVRKN

SEQ ID NO: 137851 - protein, 15 aa, Borrelia burgdorferi
ALKSLTKENAGLSRV

SEQ ID NO: 137852 - protein, 9 aa, Borrelia burgdorferi
LTKENAGLS

SEQ ID NO: 137853 - protein, 15 aa, Borrelia burgdorferi
REKDLVVIKMDSGKA

SEQ ID NO: 137854 - protein, 9 aa, Borrelia burgdorferi
LVVIKMDSG

SEQ ID NO: 137855 - protein, 15 aa, Borrelia burgdorferi
PKVKDQTTSLNEDLD

SEQ ID NO: 137856 - protein, 9 aa, Borrelia burgdorferi
VKDQTTSLN

SEQ ID NO: 137857 - protein, 15 aa, Borrelia burgdorferi
RRILTGYIIKSFDYD

SEQ ID NO: 137858 - protein, 9 aa, Borrelia burgdorferi
ILTGYIIKS

SEQ ID NO: 137859 - protein, 15 aa, Borrelia burgdorferi
SFDYDRSSAELIAKV

SEQ ID NO: 137860 - protein, 9 aa, Borrelia burgdorferi
YDRSSAELI

SEQ ID NO: 137861 - protein, 15 aa, Borrelia burgdorferi
TGVRLKESTQQGIQR

SEQ ID NO: 137862 - protein, 9 aa, Borrelia burgdorferi
VRLKESTQQ

SEQ ID NO: 137863 - protein, 15 aa, Borrelia burgdorferi
IKSFDYDRSSAELIA

SEQ ID NO: 137864 - protein, 9 aa, Borrelia burgdorferi
YDRSSAELI

SEQ ID NO: 137865 - protein, 15 aa, Borrelia burgdorferi
AGLSRVYSQWAGKTQ

SEQ ID NO: 137866 - protein, 9 aa, Borrelia burgdorferi
LSRVYSQWA

SEQ ID NO: 137867 - protein, 15 aa, Borrelia burgdorferi
KSFDYDRSSAELIAK

SEQ ID NO: 137868 - protein, 9 aa, Borrelia burgdorferi
YDRSSAELI

SEQ ID NO: 137869 - protein, 15 aa, Borrelia burgdorferi
FDYDRSSAELIAKVI

SEQ ID NO: 137870 - protein, 9 aa, Borrelia burgdorferi
YDRSSAELI

SEQ ID NO: 137871 - protein, 15 aa, Borrelia burgdorferi
SRVYSQWAGKTQIFI

SEQ ID NO: 137872 - protein, 9 aa, Borrelia burgdorferi
VYSQWAGKT

SEQ ID NO: 137873 - protein, 15 aa, Borrelia burgdorferi
NSSLYVDSKMILAAV

SEQ ID NO: 137874 - protein, 9 aa, Borrelia burgdorferi
YVDSKMILA

SEQ ID NO: 137875 - protein, 15 aa, Borrelia burgdorferi
AKLQILNKLENLKVV

SEQ ID NO: 137876 - protein, 9 aa, Borrelia burgdorferi
LNKLENLKV

SEQ ID NO: 137877 - protein, 15 aa, Borrelia burgdorferi
IKMDSGKAKLQILNK

SEQ ID NO: 137878 - protein, 9 aa, Borrelia burgdorferi
MDSGKAKLQ

SEQ ID NO: 137879 - protein, 15 aa, Borrelia burgdorferi
ILSENKILPFTSFSV

SEQ ID NO: 137880 - protein, 9 aa, Borrelia burgdorferi
NKILPFTSF

SEQ ID NO: 137881 - protein, 15 aa, Borrelia burgdorferi
EQIVGIGEFLARPLT

SEQ ID NO: 137882 - protein, 9 aa, Borrelia burgdorferi
IGEFLARPL

SEQ ID NO: 137883 - protein, 15 aa, Borrelia burgdorferi
IIKSFDYDRSSAELI

SEQ ID NO: 137884 - protein, 9 aa, Borrelia burgdorferi
DYDRSSAEL

SEQ ID NO: 137885 - protein, 15 aa, Borrelia burgdorferi
YEQIVGIGEFLARPL

SEQ ID NO: 137886 - protein, 9 aa, Borrelia burgdorferi
IVGIGEFLA

SEQ ID NO: 137887 - protein, 15 aa, Borrelia burgdorferi
LSRVYSQWAGKTQIF

SEQ ID NO: 137888 - protein, 9 aa, Borrelia burgdorferi
VYSQWAGKT

SEQ ID NO: 137889 - protein, 15 aa, Borrelia burgdorferi
KLQILNKLENLKVVS

SEQ ID NO: 137890 - protein, 9 aa, Borrelia burgdorferi
LNKLENLKV

SEQ ID NO: 137891 - protein, 15 aa, Borrelia burgdorferi
NAGLSRVYSQWAGKT

SEQ ID NO: 137892 - protein, 9 aa, Borrelia burgdorferi
LSRVYSQWA

SEQ ID NO: 137893 - protein, 15 aa, Borrelia burgdorferi
KAKLQILNKLENLKV

SEQ ID NO: 137894 - protein, 9 aa, Borrelia burgdorferi
LQILNKLEN

SEQ ID NO: 137895 - protein, 15 aa, Borrelia burgdorferi
LQLIDLNTGVRLKES

SEQ ID NO: 137896 - protein, 9 aa, Borrelia burgdorferi
IDLNTGVRL

SEQ ID NO: 137897 - protein, 15 aa, Borrelia burgdorferi
DLEFVNYKGPYDSTN

SEQ ID NO: 137898 - protein, 9 aa, Borrelia burgdorferi
VNYKGPYDS

SEQ ID NO: 137899 - protein, 15 aa, Borrelia burgdorferi
GLSRVYSQWAGKTQI

SEQ ID NO: 137900 - protein, 9 aa, Borrelia burgdorferi
VYSQWAGKT

SEQ ID NO: 137901 - protein, 15 aa, Borrelia burgdorferi
ILNKLENLKVVSESN

SEQ ID NO: 137902 - protein, 9 aa, Borrelia burgdorferi
LENLKVVSE

SEQ ID NO: 137903 - protein, 15 aa, Borrelia burgdorferi
PALKSLTKENAGLSR

SEQ ID NO: 137904 - protein, 9 aa, Borrelia burgdorferi
LTKENAGLS

SEQ ID NO: 137905 - protein, 15 aa, Borrelia burgdorferi
ELIAKVITIYNAVYR

SEQ ID NO: 137906 - protein, 9 aa, Borrelia burgdorferi
IAKVITIYN

SEQ ID NO: 137907 - protein, 15 aa, Borrelia burgdorferi
EFLARPLTNSNSNSS

SEQ ID NO: 137908 - protein, 9 aa, Borrelia burgdorferi
LARPLTNSN

SEQ ID NO: 137909 - protein, 15 aa, Borrelia burgdorferi
FLARPLTNSNSNSSY

SEQ ID NO: 137910 - protein, 9 aa, Borrelia burgdorferi
LTNSNSNSS

SEQ ID NO: 137911 - protein, 15 aa, Borrelia burgdorferi
LARPLTNSNSNSSYY

SEQ ID NO: 137912 - protein, 9 aa, Borrelia burgdorferi
LTNSNSNSS

SEQ ID NO: 137913 - protein, 15 aa, Borrelia burgdorferi
ARPLTNSNSNSSYYG

SEQ ID NO: 137914 - protein, 9 aa, Borrelia burgdorferi
LTNSNSNSS

SEQ ID NO: 137915 - protein, 15 aa, Borrelia burgdorferi
RPLTNSNSNSSYYGK

SEQ ID NO: 137916 - protein, 9 aa, Borrelia burgdorferi
LTNSNSNSS

SEQ ID NO: 137917 - protein, 15 aa, Borrelia burgdorferi
LDYYKGFYIEPALKS

SEQ ID NO: 137918 - protein, 9 aa, Borrelia burgdorferi
YKGFYIEPA

SEQ ID NO: 137919 - protein, 15 aa, Borrelia burgdorferi
DYYKGFYIEPALKSL

SEQ ID NO: 137920 - protein, 9 aa, Borrelia burgdorferi
FYIEPALKS

SEQ ID NO: 137921 - protein, 15 aa, Borrelia burgdorferi
VNFARDITDIQGETH

SEQ ID NO: 137922 - protein, 9 aa, Borrelia burgdorferi
FARDITDIQ

SEQ ID NO: 137923 - protein, 15 aa, Borrelia burgdorferi
NEAGVNFARDITDIQ

SEQ ID NO: 137924 - protein, 9 aa, Borrelia burgdorferi
NEAGVNFAR

SEQ ID NO: 137925 - protein, 15 aa, Borrelia burgdorferi
GVNFARDITDIQGET

SEQ ID NO: 137926 - protein, 9 aa, Borrelia burgdorferi
FARDITDIQ

SEQ ID NO: 137927 - protein, 15 aa, Borrelia burgdorferi
EAGVNFARDITDIQG

SEQ ID NO: 137928 - protein, 9 aa, Borrelia burgdorferi
FARDITDIQ

SEQ ID NO: 137929 - protein, 15 aa, Borrelia burgdorferi
AGVNFARDITDIQGE

SEQ ID NO: 137930 - protein, 9 aa, Borrelia burgdorferi
FARDITDIQ

SEQ ID NO: 137931 - protein, 15 aa, Borrelia burgdorferi
YKGFYIEPALKSLTK

SEQ ID NO: 137932 - protein, 9 aa, Borrelia burgdorferi
FYIEPALKS

SEQ ID NO: 137933 - protein, 15 aa, Borrelia burgdorferi
YYKGFYIEPALKSLT

SEQ ID NO: 137934 - protein, 9 aa, Borrelia burgdorferi
FYIEPALKS

SEQ ID NO: 137935 - protein, 15 aa, Borrelia burgdorferi
KGFYIEPALKSLTKE

SEQ ID NO: 137936 - protein, 9 aa, Borrelia burgdorferi
FYIEPALKS

SEQ ID NO: 137937 - protein, 15 aa, Borrelia burgdorferi
LTNSNSNSSYYGKYF

SEQ ID NO: 137938 - protein, 9 aa, Borrelia burgdorferi
LTNSNSNSS

SEQ ID NO: 137939 - protein, 15 aa, Borrelia burgdorferi
PLTNSNSNSSYYGKY

SEQ ID NO: 137940 - protein, 9 aa, Borrelia burgdorferi
LTNSNSNSS

SEQ ID NO: 137941 - protein, 15 aa, Borrelia burgdorferi
NFARDITDIQGETHK

SEQ ID NO: 137942 - protein, 9 aa, Borrelia burgdorferi
FARDITDIQ

SEQ ID NO: 137943 - protein, 15 aa, Borrelia burgdorferi
FARDITDIQGETHKA

SEQ ID NO: 137944 - protein, 9 aa, Borrelia burgdorferi
FARDITDIQ

SEQ ID NO: 137945 - protein, 15 aa, Borrelia burgdorferi
FYIEPALKSLTKENA

SEQ ID NO: 137946 - protein, 9 aa, Borrelia burgdorferi
FYIEPALKS

SEQ ID NO: 137947 - protein, 15 aa, Borrelia burgdorferi
GFYIEPALKSLTKEN

SEQ ID NO: 137948 - protein, 9 aa, Borrelia burgdorferi
FYIEPALKS

SEQ ID NO: 137949 - protein, 15 aa, Borrelia burgdorferi
FSFFLIFLNGFPLNA

SEQ ID NO: 137950 - protein, 9 aa, Borrelia burgdorferi
FFLIFLNGF

SEQ ID NO: 137951 - protein, 15 aa, Borrelia burgdorferi
FFLIFLNGFPLNARK

SEQ ID NO: 137952 - protein, 9 aa, Borrelia burgdorferi
FLNGFPLNA

SEQ ID NO: 137953 - protein, 15 aa, Borrelia burgdorferi
SFFLIFLNGFPLNAR

SEQ ID NO: 137954 - protein, 9 aa, Borrelia burgdorferi
FLNGFPLNA

SEQ ID NO: 137955 - protein, 15 aa, Borrelia burgdorferi
SFFLIFLNGFPLNAR

SEQ ID NO: 137956 - protein, 9 aa, Borrelia burgdorferi
FLIFLNGFP

SEQ ID NO: 137957 - protein, 15 aa, Borrelia burgdorferi
FSFFLIFLNGFPLNA

SEQ ID NO: 137958 - protein, 9 aa, Borrelia burgdorferi
FLIFLNGFP

SEQ ID NO: 137959 - protein, 15 aa, Borrelia burgdorferi
LEVIDPITNLGTLQL

SEQ ID NO: 137960 - protein, 9 aa, Borrelia burgdorferi
VIDPITNLG

SEQ ID NO: 137961 - protein, 15 aa, Borrelia burgdorferi
SPVFLEVIDPITNLG

SEQ ID NO: 137962 - protein, 9 aa, Borrelia burgdorferi
VFLEVIDPI

SEQ ID NO: 137963 - protein, 15 aa, Borrelia burgdorferi
PVFLEVIDPITNLGT

SEQ ID NO: 137964 - protein, 9 aa, Borrelia burgdorferi
VIDPITNLG

SEQ ID NO: 137965 - protein, 15 aa, Borrelia burgdorferi
VFLEVIDPITNLGTL

SEQ ID NO: 137966 - protein, 9 aa, Borrelia burgdorferi
VIDPITNLG

SEQ ID NO: 137967 - protein, 15 aa, Borrelia burgdorferi
FLEVIDPITNLGTLQ

SEQ ID NO: 137968 - protein, 9 aa, Borrelia burgdorferi
VIDPITNLG

SEQ ID NO: 137969 - protein, 15 aa, Borrelia burgdorferi
FFLIFLNGFPLNARK

SEQ ID NO: 137970 - protein, 9 aa, Borrelia burgdorferi
FLNGFPLNA

SEQ ID NO: 137971 - protein, 15 aa, Borrelia burgdorferi
FLIFLNGFPLNARKV

SEQ ID NO: 137972 - protein, 9 aa, Borrelia burgdorferi
FLNGFPLNA

SEQ ID NO: 137973 - protein, 15 aa, Borrelia burgdorferi
IFSFFLIFLNGFPLN

SEQ ID NO: 137974 - protein, 9 aa, Borrelia burgdorferi
FLIFLNGFP

SEQ ID NO: 137975 - protein, 15 aa, Borrelia burgdorferi
LLIFSFFLIFLNGFP

SEQ ID NO: 137976 - protein, 9 aa, Borrelia burgdorferi
SFFLIFLNG

SEQ ID NO: 137977 - protein, 15 aa, Borrelia burgdorferi
LIFSFFLIFLNGFPL

SEQ ID NO: 137978 - protein, 9 aa, Borrelia burgdorferi
FLIFLNGFP

SEQ ID NO: 137979 - protein, 15 aa, Borrelia burgdorferi
EVIDPITNLGTLQLI

SEQ ID NO: 137980 - protein, 9 aa, Borrelia burgdorferi
VIDPITNLG

SEQ ID NO: 137981 - protein, 15 aa, Borrelia burgdorferi
VIDPITNLGTLQLID

SEQ ID NO: 137982 - protein, 9 aa, Borrelia burgdorferi
VIDPITNLG

SEQ ID NO: 137983 - protein, 15 aa, Borrelia burgdorferi
LIFLNGFPLNARKVD

SEQ ID NO: 137984 - protein, 9 aa, Borrelia burgdorferi
FLNGFPLNA

SEQ ID NO: 137985 - protein, 15 aa, Borrelia burgdorferi
EFLARPLTNSNSNSS

SEQ ID NO: 137986 - protein, 9 aa, Borrelia burgdorferi
LARPLTNSN

SEQ ID NO: 137987 - protein, 15 aa, Borrelia burgdorferi
ELKNLVILDVNTLKK

SEQ ID NO: 137988 - protein, 9 aa, Borrelia burgdorferi
VILDVNTLK

SEQ ID NO: 137989 - protein, 15 aa, Borrelia burgdorferi
LKNLVILDVNTLKKV

SEQ ID NO: 137990 - protein, 9 aa, Borrelia burgdorferi
ILDVNTLKK

SEQ ID NO: 137991 - protein, 15 aa, Borrelia burgdorferi
EKDLVVIKMDSGKAK

SEQ ID NO: 137992 - protein, 9 aa, Borrelia burgdorferi
VIKMDSGKA

SEQ ID NO: 137993 - protein, 15 aa, Borrelia burgdorferi
REKDLVVIKMDSGKA

SEQ ID NO: 137994 - protein, 9 aa, Borrelia burgdorferi
LVVIKMDSG

SEQ ID NO: 137995 - protein, 15 aa, Borrelia burgdorferi
FLARPLTNSNSNSSY

SEQ ID NO: 137996 - protein, 9 aa, Borrelia burgdorferi
LTNSNSNSS

SEQ ID NO: 137997 - protein, 15 aa, Borrelia burgdorferi
KNLVILDVNTLKKVK

SEQ ID NO: 137998 - protein, 9 aa, Borrelia burgdorferi
ILDVNTLKK

SEQ ID NO: 137999 - protein, 15 aa, Borrelia burgdorferi
KDLVVIKMDSGKAKL

SEQ ID NO: 138000 - protein, 9 aa, Borrelia burgdorferi
VIKMDSGKA

SEQ ID NO: 138001 - protein, 15 aa, Borrelia burgdorferi
LARPLTNSNSNSSYY

SEQ ID NO: 138002 - protein, 9 aa, Borrelia burgdorferi
LTNSNSNSS

SEQ ID NO: 138003 - protein, 15 aa, Borrelia burgdorferi
GTLQLIDLNTGVRLK

SEQ ID NO: 138004 - protein, 9 aa, Borrelia burgdorferi
LIDLNTGVR

SEQ ID NO: 138005 - protein, 15 aa, Borrelia burgdorferi
NLGTLQLIDLNTGVR

SEQ ID NO: 138006 - protein, 9 aa, Borrelia burgdorferi
LQLIDLNTG

SEQ ID NO: 138007 - protein, 15 aa, Borrelia burgdorferi
IFLNGFPLNARKVDK

SEQ ID NO: 138008 - protein, 9 aa, Borrelia burgdorferi
FLNGFPLNA

SEQ ID NO: 138009 - protein, 15 aa, Borrelia burgdorferi
LGTLQLIDLNTGVRL

SEQ ID NO: 138010 - protein, 9 aa, Borrelia burgdorferi
LIDLNTGVR

SEQ ID NO: 138011 - protein, 15 aa, Borrelia burgdorferi
IGEFLARPLTNSNSN

SEQ ID NO: 138012 - protein, 9 aa, Borrelia burgdorferi
LARPLTNSN

SEQ ID NO: 138013 - protein, 15 aa, Borrelia burgdorferi
GEFLARPLTNSNSNS

SEQ ID NO: 138014 - protein, 9 aa, Borrelia burgdorferi
LARPLTNSN

SEQ ID NO: 138015 - protein, 15 aa, Borrelia burgdorferi
GIGEFLARPLTNSNS

SEQ ID NO: 138016 - protein, 9 aa, Borrelia burgdorferi
LARPLTNSN

SEQ ID NO: 138017 - protein, 15 aa, Borrelia burgdorferi
DLVVIKMDSGKAKLQ

SEQ ID NO: 138018 - protein, 9 aa, Borrelia burgdorferi
VIKMDSGKA

SEQ ID NO: 138019 - protein, 15 aa, Borrelia burgdorferi
LVVIKMDSGKAKLQI

SEQ ID NO: 138020 - protein, 9 aa, Borrelia burgdorferi
VIKMDSGKA

SEQ ID NO: 138021 - protein, 15 aa, Borrelia burgdorferi
TLQLIDLNTGVRLKE

SEQ ID NO: 138022 - protein, 9 aa, Borrelia burgdorferi
LIDLNTGVR

SEQ ID NO: 138023 - protein, 15 aa, Borrelia burgdorferi
VGIGEFLARPLTNSN

SEQ ID NO: 138024 - protein, 9 aa, Borrelia burgdorferi
FLARPLTNS

SEQ ID NO: 138025 - protein, 15 aa, Borrelia burgdorferi
LQLIDLNTGVRLKES

SEQ ID NO: 138026 - protein, 9 aa, Borrelia burgdorferi
LIDLNTGVR

SEQ ID NO: 138027 - protein, 15 aa, Borrelia burgdorferi
ELIAKVITIYNAVYR

SEQ ID NO: 138028 - protein, 9 aa, Borrelia burgdorferi
IAKVITIYN

SEQ ID NO: 138029 - protein, 15 aa, Borrelia burgdorferi
AELIAKVITIYNAVY

SEQ ID NO: 138030 - protein, 9 aa, Borrelia burgdorferi
IAKVITIYN

SEQ ID NO: 138031 - protein, 15 aa, Borrelia burgdorferi
LDYYKGFYIEPALKS

SEQ ID NO: 138032 - protein, 9 aa, Borrelia burgdorferi
YKGFYIEPA

SEQ ID NO: 138033 - protein, 15 aa, Borrelia burgdorferi
DYYKGFYIEPALKSL

SEQ ID NO: 138034 - protein, 9 aa, Borrelia burgdorferi
FYIEPALKS

SEQ ID NO: 138035 - protein, 15 aa, Borrelia burgdorferi
YYKGFYIEPALKSLT

SEQ ID NO: 138036 - protein, 9 aa, Borrelia burgdorferi
FYIEPALKS

SEQ ID NO: 138037 - protein, 15 aa, Borrelia burgdorferi
YKGFYIEPALKSLTK

SEQ ID NO: 138038 - protein, 9 aa, Borrelia burgdorferi
FYIEPALKS

SEQ ID NO: 138039 - protein, 15 aa, Borrelia burgdorferi
IDPKVKDQTTSLNED

SEQ ID NO: 138040 - protein, 9 aa, Borrelia burgdorferi
VKDQTTSLN

SEQ ID NO: 138041 - protein, 15 aa, Borrelia burgdorferi
PKVKDQTTSLNEDLD

SEQ ID NO: 138042 - protein, 9 aa, Borrelia burgdorferi
VKDQTTSLN

SEQ ID NO: 138043 - protein, 15 aa, Borrelia burgdorferi
INEINKEKNLPKPGD

SEQ ID NO: 138044 - protein, 9 aa, Borrelia burgdorferi
INKEKNLPK

SEQ ID NO: 138045 - protein, 15 aa, Borrelia burgdorferi
DPKVKDQTTSLNEDL

SEQ ID NO: 138046 - protein, 9 aa, Borrelia burgdorferi
VKDQTTSLN

SEQ ID NO: 138047 - protein, 15 aa, Borrelia burgdorferi
NEINKEKNLPKPGDV

SEQ ID NO: 138048 - protein, 9 aa, Borrelia burgdorferi
INKEKNLPK

SEQ ID NO: 138049 - protein, 15 aa, Borrelia burgdorferi
KGFYIEPALKSLTKE

SEQ ID NO: 138050 - protein, 9 aa, Borrelia burgdorferi
FYIEPALKS

SEQ ID NO: 138051 - protein, 15 aa, Borrelia burgdorferi
SFFLIFLNGFPLNAR

SEQ ID NO: 138052 - protein, 9 aa, Borrelia burgdorferi
IFLNGFPLN

SEQ ID NO: 138053 - protein, 15 aa, Borrelia burgdorferi
FFLIFLNGFPLNARK

SEQ ID NO: 138054 - protein, 9 aa, Borrelia burgdorferi
LNGFPLNAR

SEQ ID NO: 138055 - protein, 15 aa, Borrelia burgdorferi
IAKVITIYNAVYRGD

SEQ ID NO: 138056 - protein, 9 aa, Borrelia burgdorferi
IAKVITIYN

SEQ ID NO: 138057 - protein, 15 aa, Borrelia burgdorferi
FLIFLNGFPLNARKV

SEQ ID NO: 138058 - protein, 9 aa, Borrelia burgdorferi
LNGFPLNAR

SEQ ID NO: 138059 - protein, 15 aa, Borrelia burgdorferi
RSSAELIAKVITIYN

SEQ ID NO: 138060 - protein, 9 aa, Borrelia burgdorferi
LIAKVITIY

SEQ ID NO: 138061 - protein, 15 aa, Borrelia burgdorferi
SSAELIAKVITIYNA

SEQ ID NO: 138062 - protein, 9 aa, Borrelia burgdorferi
IAKVITIYN

SEQ ID NO: 138063 - protein, 15 aa, Borrelia burgdorferi
SAELIAKVITIYNAV

SEQ ID NO: 138064 - protein, 9 aa, Borrelia burgdorferi
IAKVITIYN

SEQ ID NO: 138065 - protein, 15 aa, Borrelia burgdorferi
LIAKVITIYNAVYRG

SEQ ID NO: 138066 - protein, 9 aa, Borrelia burgdorferi
IAKVITIYN

SEQ ID NO: 138067 - protein, 15 aa, Borrelia burgdorferi
LIFLNGFPLNARKVD

SEQ ID NO: 138068 - protein, 9 aa, Borrelia burgdorferi
LNGFPLNAR

SEQ ID NO: 138069 - protein, 15 aa, Borrelia burgdorferi
IFLNGFPLNARKVDK

SEQ ID NO: 138070 - protein, 9 aa, Borrelia burgdorferi
LNGFPLNAR

SEQ ID NO: 138071 - protein, 15 aa, Borrelia burgdorferi
QKIDPKVKDQTTSLN

SEQ ID NO: 138072 - protein, 9 aa, Borrelia burgdorferi
QKIDPKVKD

SEQ ID NO: 138073 - protein, 15 aa, Borrelia burgdorferi
KIDPKVKDQTTSLNE

SEQ ID NO: 138074 - protein, 9 aa, Borrelia burgdorferi
VKDQTTSLN

SEQ ID NO: 138075 - protein, 15 aa, Borrelia burgdorferi
EINKEKNLPKPGDVS

SEQ ID NO: 138076 - protein, 9 aa, Borrelia burgdorferi
EKNLPKPGD

SEQ ID NO: 138077 - protein, 15 aa, Borrelia burgdorferi
INKEKNLPKPGDVSS

SEQ ID NO: 138078 - protein, 9 aa, Borrelia burgdorferi
EKNLPKPGD

SEQ ID NO: 138079 - protein, 15 aa, Borrelia burgdorferi
SNITETIENLRDQLE

SEQ ID NO: 138080 - protein, 9 aa, Borrelia burgdorferi
TETIENLRD

SEQ ID NO: 138081 - protein, 15 aa, Borrelia burgdorferi
NAWRLAKFSPKNLDE

SEQ ID NO: 138082 - protein, 9 aa, Borrelia burgdorferi
AKFSPKNLD

SEQ ID NO: 138083 - protein, 15 aa, Borrelia burgdorferi
LSENKILPFTSFSVR

SEQ ID NO: 138084 - protein, 9 aa, Borrelia burgdorferi
ILPFTSFSV

SEQ ID NO: 138085 - protein, 15 aa, Borrelia burgdorferi
SENKILPFTSFSVRK

SEQ ID NO: 138086 - protein, 9 aa, Borrelia burgdorferi
ILPFTSFSV

SEQ ID NO: 138087 - protein, 15 aa, Borrelia burgdorferi
ENKILPFTSFSVRKN

SEQ ID NO: 138088 - protein, 9 aa, Borrelia burgdorferi
ILPFTSFSV

SEQ ID NO: 138089 - protein, 15 aa, Borrelia burgdorferi
NKILPFTSFSVRKNF

SEQ ID NO: 138090 - protein, 9 aa, Borrelia burgdorferi
ILPFTSFSV

SEQ ID NO: 138091 - protein, 15 aa, Borrelia burgdorferi
ILSENKILPFTSFSV

SEQ ID NO: 138092 - protein, 9 aa, Borrelia burgdorferi
ILSENKILP

SEQ ID NO: 138093 - protein, 15 aa, Borrelia burgdorferi
ILPFTSFSVRKNFIY

SEQ ID NO: 138094 - protein, 9 aa, Borrelia burgdorferi
ILPFTSFSV

SEQ ID NO: 138095 - protein, 15 aa, Borrelia burgdorferi
KILPFTSFSVRKNFI

SEQ ID NO: 138096 - protein, 9 aa, Borrelia burgdorferi
ILPFTSFSV

SEQ ID NO: 138097 - protein, 15 aa, Borrelia burgdorferi
LARPLTNSNSNSSYY

SEQ ID NO: 138098 - protein, 9 aa, Borrelia burgdorferi
LTNSNSNSS

SEQ ID NO: 138099 - protein, 15 aa, Borrelia burgdorferi
ARPLTNSNSNSSYYG

SEQ ID NO: 138100 - protein, 9 aa, Borrelia burgdorferi
LTNSNSNSS

SEQ ID NO: 138101 - protein, 15 aa, Borrelia burgdorferi
RPLTNSNSNSSYYGK

SEQ ID NO: 138102 - protein, 9 aa, Borrelia burgdorferi
LTNSNSNSS

SEQ ID NO: 138103 - protein, 15 aa, Borrelia burgdorferi
SESNFEINKNSSLYV

SEQ ID NO: 138104 - protein, 9 aa, Borrelia burgdorferi
EINKNSSLY

SEQ ID NO: 138105 - protein, 15 aa, Borrelia burgdorferi
LPFTSFSVRKNFIYL

SEQ ID NO: 138106 - protein, 9 aa, Borrelia burgdorferi
FSVRKNFIY

SEQ ID NO: 138107 - protein, 15 aa, Borrelia burgdorferi
ESNFEINKNSSLYVD

SEQ ID NO: 138108 - protein, 9 aa, Borrelia burgdorferi
INKNSSLYV

SEQ ID NO: 138109 - protein, 15 aa, Borrelia burgdorferi
FDYDRSSAELIAKVI

SEQ ID NO: 138110 - protein, 9 aa, Borrelia burgdorferi
YDRSSAELI

SEQ ID NO: 138111 - protein, 15 aa, Borrelia burgdorferi
SFDYDRSSAELIAKV

SEQ ID NO: 138112 - protein, 9 aa, Borrelia burgdorferi
YDRSSAELI

SEQ ID NO: 138113 - protein, 15 aa, Borrelia burgdorferi
KSFDYDRSSAELIAK

SEQ ID NO: 138114 - protein, 9 aa, Borrelia burgdorferi
YDRSSAELI

SEQ ID NO: 138115 - protein, 15 aa, Borrelia burgdorferi
IKSFDYDRSSAELIA

SEQ ID NO: 138116 - protein, 9 aa, Borrelia burgdorferi
YDRSSAELI

SEQ ID NO: 138117 - protein, 15 aa, Borrelia burgdorferi
IIKSFDYDRSSAELI

SEQ ID NO: 138118 - protein, 9 aa, Borrelia burgdorferi
IIKSFDYDR

SEQ ID NO: 138119 - protein, 15 aa, Borrelia burgdorferi
SVDVFSISSKSELDS

SEQ ID NO: 138120 - protein, 9 aa, Borrelia burgdorferi
FSISSKSEL

SEQ ID NO: 138121 - protein, 15 aa, Borrelia burgdorferi
VDVFSISSKSELDSI

SEQ ID NO: 138122 - protein, 9 aa, Borrelia burgdorferi
FSISSKSEL

SEQ ID NO: 138123 - protein, 15 aa, Borrelia burgdorferi
ASVDVFSISSKSELD

SEQ ID NO: 138124 - protein, 9 aa, Borrelia burgdorferi
FSISSKSEL

SEQ ID NO: 138125 - protein, 15 aa, Borrelia burgdorferi
DVFSISSKSELDSIL

SEQ ID NO: 138126 - protein, 9 aa, Borrelia burgdorferi
FSISSKSEL

SEQ ID NO: 138127 - protein, 15 aa, Borrelia burgdorferi
KASVDVFSISSKSEL

SEQ ID NO: 138128 - protein, 9 aa, Borrelia burgdorferi
DVFSISSKS

SEQ ID NO: 138129 - protein, 15 aa, Borrelia burgdorferi
YDRSSAELIAKVITI

SEQ ID NO: 138130 - protein, 9 aa, Borrelia burgdorferi
YDRSSAELI

SEQ ID NO: 138131 - protein, 15 aa, Borrelia burgdorferi
DYDRSSAELIAKVIT

SEQ ID NO: 138132 - protein, 9 aa, Borrelia burgdorferi
YDRSSAELI

SEQ ID NO: 138133 - protein, 15 aa, Borrelia burgdorferi
SPVFLEVIDPITNLG

SEQ ID NO: 138134 - protein, 9 aa, Borrelia burgdorferi
VFLEVIDPI

SEQ ID NO: 138135 - protein, 15 aa, Borrelia burgdorferi
LNKLENLKVVSESNF

SEQ ID NO: 138136 - protein, 9 aa, Borrelia burgdorferi
LENLKVVSE

SEQ ID NO: 138137 - protein, 15 aa, Borrelia burgdorferi
IAKVITIYNAVYRGD

SEQ ID NO: 138138 - protein, 9 aa, Borrelia burgdorferi
ITIYNAVYR

SEQ ID NO: 138139 - protein, 15 aa, Borrelia burgdorferi
AKVITIYNAVYRGDL

SEQ ID NO: 138140 - protein, 9 aa, Borrelia burgdorferi
ITIYNAVYR

SEQ ID NO: 138141 - protein, 15 aa, Borrelia burgdorferi
ILNKLENLKVVSESN

SEQ ID NO: 138142 - protein, 9 aa, Borrelia burgdorferi
LENLKVVSE

SEQ ID NO: 138143 - protein, 15 aa, Borrelia burgdorferi
GDLNNDKNLMLPEDQ

SEQ ID NO: 138144 - protein, 9 aa, Borrelia burgdorferi
LNNDKNLML

SEQ ID NO: 138145 - protein, 15 aa, Borrelia burgdorferi
SKEEVDNKAINLQKI

SEQ ID NO: 138146 - protein, 9 aa, Borrelia burgdorferi
VDNKAINLQ

SEQ ID NO: 138147 - protein, 15 aa, Borrelia burgdorferi
EINKNSSLYVDSKMI

SEQ ID NO: 138148 - protein, 9 aa, Borrelia burgdorferi
INKNSSLYV

SEQ ID NO: 138149 - protein, 15 aa, Borrelia burgdorferi
KDLVVIKMDSGKAKL

SEQ ID NO: 138150 - protein, 9 aa, Borrelia burgdorferi
IKMDSGKAK

SEQ ID NO: 138151 - protein, 15 aa, Borrelia burgdorferi
KEEVDNKAINLQKID

SEQ ID NO: 138152 - protein, 9 aa, Borrelia burgdorferi
VDNKAINLQ

SEQ ID NO: 138153 - protein, 15 aa, Borrelia burgdorferi
INKNSSLYVDSKMIL

SEQ ID NO: 138154 - protein, 9 aa, Borrelia burgdorferi
INKNSSLYV

SEQ ID NO: 138155 - protein, 15 aa, Borrelia burgdorferi
VFLEVIDPITNLGTL

SEQ ID NO: 138156 - protein, 9 aa, Borrelia burgdorferi
VIDPITNLG

SEQ ID NO: 138157 - protein, 15 aa, Borrelia burgdorferi
KVITIYNAVYRGDLD

SEQ ID NO: 138158 - protein, 9 aa, Borrelia burgdorferi
ITIYNAVYR

SEQ ID NO: 138159 - protein, 15 aa, Borrelia burgdorferi
PVFLEVIDPITNLGT

SEQ ID NO: 138160 - protein, 9 aa, Borrelia burgdorferi
VIDPITNLG

SEQ ID NO: 138161 - protein, 15 aa, Borrelia burgdorferi
NKLENLKVVSESNFE

SEQ ID NO: 138162 - protein, 9 aa, Borrelia burgdorferi
LKVVSESNF

SEQ ID NO: 138163 - protein, 15 aa, Borrelia burgdorferi
IFSFFLIFLNGFPLN

SEQ ID NO: 138164 - protein, 9 aa, Borrelia burgdorferi
LIFLNGFPL

SEQ ID NO: 138165 - protein, 15 aa, Borrelia burgdorferi
FSFFLIFLNGFPLNA

SEQ ID NO: 138166 - protein, 9 aa, Borrelia burgdorferi
LIFLNGFPL

SEQ ID NO: 138167 - protein, 15 aa, Borrelia burgdorferi
EFILSENKILPFTSF

SEQ ID NO: 138168 - protein, 9 aa, Borrelia burgdorferi
ILSENKILP

SEQ ID NO: 138169 - protein, 15 aa, Borrelia burgdorferi
AINLQKIDPKVKDQT

SEQ ID NO: 138170 - protein, 9 aa, Borrelia burgdorferi
INLQKIDPK

SEQ ID NO: 138171 - protein, 15 aa, Borrelia burgdorferi
DLVVIKMDSGKAKLQ

SEQ ID NO: 138172 - protein, 9 aa, Borrelia burgdorferi
IKMDSGKAK

SEQ ID NO: 138173 - protein, 15 aa, Borrelia burgdorferi
MKKMLLIFSFFLIFL

SEQ ID NO: 138174 - protein, 9 aa, Borrelia burgdorferi
LLIFSFFLI

SEQ ID NO: 138175 - protein, 15 aa, Borrelia burgdorferi
DKDLTTMSIDSSSPV

SEQ ID NO: 138176 - protein, 9 aa, Borrelia burgdorferi
LTTMSIDSS

SEQ ID NO: 138177 - protein, 15 aa, Borrelia burgdorferi
SRASLGDLNNDKNLM

SEQ ID NO: 138178 - protein, 9 aa, Borrelia burgdorferi
LGDLNNDKN

SEQ ID NO: 138179 - protein, 15 aa, Borrelia burgdorferi
FLIFLNGFPLNARKV

SEQ ID NO: 138180 - protein, 9 aa, Borrelia burgdorferi
LIFLNGFPL

SEQ ID NO: 138181 - protein, 15 aa, Borrelia burgdorferi
SFFLIFLNGFPLNAR

SEQ ID NO: 138182 - protein, 9 aa, Borrelia burgdorferi
FLIFLNGFP

SEQ ID NO: 138183 - protein, 15 aa, Borrelia burgdorferi
FFLIFLNGFPLNARK

SEQ ID NO: 138184 - protein, 9 aa, Borrelia burgdorferi
LNGFPLNAR

SEQ ID NO: 138185 - protein, 15 aa, Borrelia burgdorferi
FLIFLNGFPLNARKV

SEQ ID NO: 138186 - protein, 9 aa, Borrelia burgdorferi
LNGFPLNAR

SEQ ID NO: 138187 - protein, 15 aa, Borrelia burgdorferi
LIFLNGFPLNARKVD

SEQ ID NO: 138188 - protein, 9 aa, Borrelia burgdorferi
LNGFPLNAR

SEQ ID NO: 138189 - protein, 15 aa, Borrelia burgdorferi
SENKILPFTSFSVRK

SEQ ID NO: 138190 - protein, 9 aa, Borrelia burgdorferi
ILPFTSFSV

SEQ ID NO: 138191 - protein, 15 aa, Borrelia burgdorferi
ENKILPFTSFSVRKN

SEQ ID NO: 138192 - protein, 9 aa, Borrelia burgdorferi
ILPFTSFSV

SEQ ID NO: 138193 - protein, 15 aa, Borrelia burgdorferi
LSENKILPFTSFSVR

SEQ ID NO: 138194 - protein, 9 aa, Borrelia burgdorferi
ILPFTSFSV

SEQ ID NO: 138195 - protein, 15 aa, Borrelia burgdorferi
NKILPFTSFSVRKNF

SEQ ID NO: 138196 - protein, 9 aa, Borrelia burgdorferi
ILPFTSFSV

SEQ ID NO: 138197 - protein, 15 aa, Borrelia burgdorferi
LDSILNLRRILTGYI

SEQ ID NO: 138198 - protein, 9 aa, Borrelia burgdorferi
LNLRRILTG

SEQ ID NO: 138199 - protein, 15 aa, Borrelia burgdorferi
DSILNLRRILTGYII

SEQ ID NO: 138200 - protein, 9 aa, Borrelia burgdorferi
LRRILTGYI

SEQ ID NO: 138201 - protein, 15 aa, Borrelia burgdorferi
IFLNGFPLNARKVDK

SEQ ID NO: 138202 - protein, 9 aa, Borrelia burgdorferi
LNGFPLNAR

SEQ ID NO: 138203 - protein, 15 aa, Borrelia burgdorferi
SILNLRRILTGYIIK

SEQ ID NO: 138204 - protein, 9 aa, Borrelia burgdorferi
LRRILTGYI

SEQ ID NO: 138205 - protein, 15 aa, Borrelia burgdorferi
KILPFTSFSVRKNFI

SEQ ID NO: 138206 - protein, 9 aa, Borrelia burgdorferi
LPFTSFSVR

SEQ ID NO: 138207 - protein, 15 aa, Borrelia burgdorferi
ILNLRRILTGYIIKS

SEQ ID NO: 138208 - protein, 9 aa, Borrelia burgdorferi
LRRILTGYI

SEQ ID NO: 138209 - protein, 15 aa, Borrelia burgdorferi
SELDSILNLRRILTG

SEQ ID NO: 138210 - protein, 9 aa, Borrelia burgdorferi
LDSILNLRR

SEQ ID NO: 138211 - protein, 15 aa, Borrelia burgdorferi
ELDSILNLRRILTGY

SEQ ID NO: 138212 - protein, 9 aa, Borrelia burgdorferi
LNLRRILTG

SEQ ID NO: 138213 - protein, 15 aa, Borrelia burgdorferi
LGTLQLIDLNTGVRL

SEQ ID NO: 138214 - protein, 9 aa, Borrelia burgdorferi
LIDLNTGVR

SEQ ID NO: 138215 - protein, 15 aa, Borrelia burgdorferi
GTLQLIDLNTGVRLK

SEQ ID NO: 138216 - protein, 9 aa, Borrelia burgdorferi
LIDLNTGVR

SEQ ID NO: 138217 - protein, 15 aa, Borrelia burgdorferi
LNLRRILTGYIIKSF

SEQ ID NO: 138218 - protein, 9 aa, Borrelia burgdorferi
LRRILTGYI

SEQ ID NO: 138219 - protein, 15 aa, Borrelia burgdorferi
NLGTLQLIDLNTGVR

SEQ ID NO: 138220 - protein, 9 aa, Borrelia burgdorferi
LQLIDLNTG

SEQ ID NO: 138221 - protein, 15 aa, Borrelia burgdorferi
EKDLVVIKMDSGKAK

SEQ ID NO: 138222 - protein, 9 aa, Borrelia burgdorferi
LVVIKMDSG

SEQ ID NO: 138223 - protein, 15 aa, Borrelia burgdorferi
KDLVVIKMDSGKAKL

SEQ ID NO: 138224 - protein, 9 aa, Borrelia burgdorferi
LVVIKMDSG

SEQ ID NO: 138225 - protein, 15 aa, Borrelia burgdorferi
ILPFTSFSVRKNFIY

SEQ ID NO: 138226 - protein, 9 aa, Borrelia burgdorferi
ILPFTSFSV

SEQ ID NO: 138227 - protein, 15 aa, Borrelia burgdorferi
FLNGFPLNARKVDKE

SEQ ID NO: 138228 - protein, 9 aa, Borrelia burgdorferi
LNGFPLNAR

SEQ ID NO: 138229 - protein, 15 aa, Borrelia burgdorferi
QQGIQRYGIYEREKD

SEQ ID NO: 138230 - protein, 9 aa, Borrelia burgdorferi
IQRYGIYER

SEQ ID NO: 138231 - protein, 15 aa, Borrelia burgdorferi
QGIQRYGIYEREKDL

SEQ ID NO: 138232 - protein, 9 aa, Borrelia burgdorferi
IQRYGIYER

SEQ ID NO: 138233 - protein, 15 aa, Borrelia burgdorferi
TQQGIQRYGIYEREK

SEQ ID NO: 138234 - protein, 9 aa, Borrelia burgdorferi
IQRYGIYER

SEQ ID NO: 138235 - protein, 15 aa, Borrelia burgdorferi
TLQLIDLNTGVRLKE

SEQ ID NO: 138236 - protein, 9 aa, Borrelia burgdorferi
LIDLNTGVR

SEQ ID NO: 138237 - protein, 15 aa, Borrelia burgdorferi
ESTQQGIQRYGIYER

SEQ ID NO: 138238 - protein, 9 aa, Borrelia burgdorferi
QGIQRYGIY

SEQ ID NO: 138239 - protein, 15 aa, Borrelia burgdorferi
NSSYYGKYFINRFID

SEQ ID NO: 138240 - protein, 9 aa, Borrelia burgdorferi
YYGKYFINR

SEQ ID NO: 138241 - protein, 15 aa, Borrelia burgdorferi
SSYYGKYFINRFIDD

SEQ ID NO: 138242 - protein, 9 aa, Borrelia burgdorferi
YYGKYFINR

SEQ ID NO: 138243 - protein, 15 aa, Borrelia burgdorferi
LQLIDLNTGVRLKES

SEQ ID NO: 138244 - protein, 9 aa, Borrelia burgdorferi
LIDLNTGVR

SEQ ID NO: 138245 - protein, 15 aa, Borrelia burgdorferi
STQQGIQRYGIYERE

SEQ ID NO: 138246 - protein, 9 aa, Borrelia burgdorferi
IQRYGIYER

SEQ ID NO: 138247 - protein, 15 aa, Borrelia burgdorferi
SNSSYYGKYFINRFI

SEQ ID NO: 138248 - protein, 9 aa, Borrelia burgdorferi
YYGKYFINR

SEQ ID NO: 138249 - protein, 15 aa, Borrelia burgdorferi
DELKNLVILDVNTLK

SEQ ID NO: 138250 - protein, 9 aa, Borrelia burgdorferi
LKNLVILDV

SEQ ID NO: 138251 - protein, 15 aa, Borrelia burgdorferi
LNGFPLNARKVDKEK

SEQ ID NO: 138252 - protein, 9 aa, Borrelia burgdorferi
LNGFPLNAR

SEQ ID NO: 138253 - protein, 15 aa, Borrelia burgdorferi
SNAWRLAKFSPKNLD

SEQ ID NO: 138254 - protein, 9 aa, Borrelia burgdorferi
WRLAKFSPK

SEQ ID NO: 138255 - protein, 15 aa, Borrelia burgdorferi
DSNAWRLAKFSPKNL

SEQ ID NO: 138256 - protein, 9 aa, Borrelia burgdorferi
WRLAKFSPK

SEQ ID NO: 138257 - protein, 15 aa, Borrelia burgdorferi
NAWRLAKFSPKNLDE

SEQ ID NO: 138258 - protein, 9 aa, Borrelia burgdorferi
WRLAKFSPK

SEQ ID NO: 138259 - protein, 15 aa, Borrelia burgdorferi
DLVVIKMDSGKAKLQ

SEQ ID NO: 138260 - protein, 9 aa, Borrelia burgdorferi
VIKMDSGKA

SEQ ID NO: 138261 - protein, 15 aa, Borrelia burgdorferi
FSFFLIFLNGFPLNA

SEQ ID NO: 138262 - protein, 9 aa, Borrelia burgdorferi
LIFLNGFPL

SEQ ID NO: 138263 - protein, 15 aa, Borrelia burgdorferi
IFSFFLIFLNGFPLN

SEQ ID NO: 138264 - protein, 9 aa, Borrelia burgdorferi
LIFLNGFPL

SEQ ID NO: 138265 - protein, 15 aa, Borrelia burgdorferi
QDELKNLVILDVNTL

SEQ ID NO: 138266 - protein, 9 aa, Borrelia burgdorferi
LKNLVILDV

SEQ ID NO: 138267 - protein, 15 aa, Borrelia burgdorferi
LIFSFFLIFLNGFPL

SEQ ID NO: 138268 - protein, 9 aa, Borrelia burgdorferi
FFLIFLNGF

SEQ ID NO: 138269 - protein, 15 aa, Borrelia burgdorferi
REKDLVVIKMDSGKA

SEQ ID NO: 138270 - protein, 9 aa, Borrelia burgdorferi
LVVIKMDSG

SEQ ID NO: 138271 - protein, 15 aa, Borrelia burgdorferi
ILSENKILPFTSFSV

SEQ ID NO: 138272 - protein, 9 aa, Borrelia burgdorferi
SENKILPFT

SEQ ID NO: 138273 - protein, 15 aa, Borrelia burgdorferi
LVVIKMDSGKAKLQI

SEQ ID NO: 138274 - protein, 9 aa, Borrelia burgdorferi
VIKMDSGKA

SEQ ID NO: 138275 - protein, 15 aa, Borrelia burgdorferi
LLIFSFFLIFLNGFP

SEQ ID NO: 138276 - protein, 9 aa, Borrelia burgdorferi
LLIFSFFLI

SEQ ID NO: 138277 - protein, 15 aa, Borrelia burgdorferi
NSNSSYYGKYFINRF

SEQ ID NO: 138278 - protein, 9 aa, Borrelia burgdorferi
YYGKYFINR

SEQ ID NO: 138279 - protein, 15 aa, Borrelia burgdorferi
ELIAKVITIYNAVYR

SEQ ID NO: 138280 - protein, 9 aa, Borrelia burgdorferi
VITIYNAVY

SEQ ID NO: 138281 - protein, 15 aa, Borrelia burgdorferi
LIAKVITIYNAVYRG

SEQ ID NO: 138282 - protein, 9 aa, Borrelia burgdorferi
ITIYNAVYR

SEQ ID NO: 138283 - protein, 15 aa, Borrelia burgdorferi
DLTTMSIDSSSPVFL

SEQ ID NO: 138284 - protein, 9 aa, Borrelia burgdorferi
MSIDSSSPV

SEQ ID NO: 138285 - protein, 15 aa, Borrelia burgdorferi
LTTMSIDSSSPVFLE

SEQ ID NO: 138286 - protein, 9 aa, Borrelia burgdorferi
MSIDSSSPV

SEQ ID NO: 138287 - protein, 15 aa, Borrelia burgdorferi
TTMSIDSSSPVFLEV

SEQ ID NO: 138288 - protein, 9 aa, Borrelia burgdorferi
MSIDSSSPV

SEQ ID NO: 138289 - protein, 15 aa, Borrelia burgdorferi
KDLTTMSIDSSSPVF

SEQ ID NO: 138290 - protein, 9 aa, Borrelia burgdorferi
MSIDSSSPV

SEQ ID NO: 138291 - protein, 15 aa, Borrelia burgdorferi
DKDLTTMSIDSSSPV

SEQ ID NO: 138292 - protein, 9 aa, Borrelia burgdorferi
TMSIDSSSP

SEQ ID NO: 138293 - protein, 15 aa, Borrelia burgdorferi
AINLQKIDPKVKDQT

SEQ ID NO: 138294 - protein, 9 aa, Borrelia burgdorferi
LQKIDPKVK

SEQ ID NO: 138295 - protein, 15 aa, Borrelia burgdorferi
INLQKIDPKVKDQTT

SEQ ID NO: 138296 - protein, 9 aa, Borrelia burgdorferi
LQKIDPKVK

SEQ ID NO: 138297 - protein, 15 aa, Borrelia burgdorferi
KSELDSILNLRRILT

SEQ ID NO: 138298 - protein, 9 aa, Borrelia burgdorferi
LDSILNLRR

SEQ ID NO: 138299 - protein, 15 aa, Borrelia burgdorferi
SELDSILNLRRILTG

SEQ ID NO: 138300 - protein, 9 aa, Borrelia burgdorferi
LDSILNLRR

SEQ ID NO: 138301 - protein, 15 aa, Borrelia burgdorferi
VNYKGPYDSTNTYEQ

SEQ ID NO: 138302 - protein, 9 aa, Borrelia burgdorferi
VNYKGPYDS

SEQ ID NO: 138303 - protein, 15 aa, Borrelia burgdorferi
KKEFKPVSEVEKLDK

SEQ ID NO: 138304 - protein, 9 aa, Borrelia burgdorferi
FKPVSEVEK

SEQ ID NO: 138305 - protein, 15 aa, Borrelia burgdorferi
LDGKKEFKPVSEVEK

SEQ ID NO: 138306 - protein, 9 aa, Borrelia burgdorferi
LDGKKEFKP

SEQ ID NO: 138307 - protein, 15 aa, Borrelia burgdorferi
KEFKPVSEVEKLDKI

SEQ ID NO: 138308 - protein, 9 aa, Borrelia burgdorferi
FKPVSEVEK

SEQ ID NO: 138309 - protein, 15 aa, Borrelia burgdorferi
DGKKEFKPVSEVEKL

SEQ ID NO: 138310 - protein, 9 aa, Borrelia burgdorferi
FKPVSEVEK

SEQ ID NO: 138311 - protein, 15 aa, Borrelia burgdorferi
GKKEFKPVSEVEKLD

SEQ ID NO: 138312 - protein, 9 aa, Borrelia burgdorferi
FKPVSEVEK

SEQ ID NO: 138313 - protein, 15 aa, Borrelia burgdorferi B31
VYFVPAFVGLGAPHW

SEQ ID NO: 138314 - protein, 9 aa, Borrelia burgdorferi B31
FVPAFVGLG

SEQ ID NO: 138315 - protein, 15 aa, Borrelia burgdorferi B31
YFVPAFVGLGAPHWD

SEQ ID NO: 138316 - protein, 9 aa, Borrelia burgdorferi B31
FVGLGAPHW

SEQ ID NO: 138317 - protein, 15 aa, Borrelia burgdorferi B31
FVPAFVGLGAPHWDS

SEQ ID NO: 138318 - protein, 9 aa, Borrelia burgdorferi B31
FVGLGAPHW

SEQ ID NO: 138319 - protein, 15 aa, Borrelia burgdorferi B31
VPAFVGLGAPHWDSY

SEQ ID NO: 138320 - protein, 9 aa, Borrelia burgdorferi B31
FVGLGAPHW

SEQ ID NO: 138321 - protein, 15 aa, Borrelia burgdorferi B31
PAFVGLGAPHWDSYA

SEQ ID NO: 138322 - protein, 9 aa, Borrelia burgdorferi B31
FVGLGAPHW

SEQ ID NO: 138323 - protein, 15 aa, Borrelia burgdorferi B31
AAYLAGLATGYWQSA

SEQ ID NO: 138324 - protein, 9 aa, Borrelia burgdorferi B31
YLAGLATGY

SEQ ID NO: 138325 - protein, 15 aa, Borrelia burgdorferi B31
QKEFTQIYPQPSWVE

SEQ ID NO: 138326 - protein, 9 aa, Borrelia burgdorferi B31
FTQIYPQPS

SEQ ID NO: 138327 - protein, 15 aa, Borrelia burgdorferi B31
KEFTQIYPQPSWVEH

SEQ ID NO: 138328 - protein, 9 aa, Borrelia burgdorferi B31
FTQIYPQPS

SEQ ID NO: 138329 - protein, 15 aa, Borrelia burgdorferi B31
ALGAAYLAGLATGYW

SEQ ID NO: 138330 - protein, 9 aa, Borrelia burgdorferi B31
YLAGLATGY

SEQ ID NO: 138331 - protein, 15 aa, Borrelia burgdorferi B31
LGAAYLAGLATGYWQ

SEQ ID NO: 138332 - protein, 9 aa, Borrelia burgdorferi B31
YLAGLATGY

SEQ ID NO: 138333 - protein, 15 aa, Borrelia burgdorferi B31
GAAYLAGLATGYWQS

SEQ ID NO: 138334 - protein, 9 aa, Borrelia burgdorferi B31
YLAGLATGY

SEQ ID NO: 138335 - protein, 15 aa, Borrelia burgdorferi B31
AYLAGLATGYWQSAE

SEQ ID NO: 138336 - protein, 9 aa, Borrelia burgdorferi B31
LAGLATGYW

SEQ ID NO: 138337 - protein, 15 aa, Borrelia burgdorferi B31
FAQKEFTQIYPQPSW

SEQ ID NO: 138338 - protein, 9 aa, Borrelia burgdorferi B31
FTQIYPQPS

SEQ ID NO: 138339 - protein, 15 aa, Borrelia burgdorferi B31
GFAQKEFTQIYPQPS

SEQ ID NO: 138340 - protein, 9 aa, Borrelia burgdorferi B31
FAQKEFTQI

SEQ ID NO: 138341 - protein, 15 aa, Borrelia burgdorferi B31
TALGAAYLAGLATGY

SEQ ID NO: 138342 - protein, 9 aa, Borrelia burgdorferi B31
LGAAYLAGL

SEQ ID NO: 138343 - protein, 15 aa, Borrelia burgdorferi B31
AQKEFTQIYPQPSWV

SEQ ID NO: 138344 - protein, 9 aa, Borrelia burgdorferi B31
FTQIYPQPS

SEQ ID NO: 138345 - protein, 15 aa, Borrelia burgdorferi B31
ACLKKGMAKNTYGTG

SEQ ID NO: 138346 - protein, 9 aa, Borrelia burgdorferi B31
LKKGMAKNT

SEQ ID NO: 138347 - protein, 15 aa, Borrelia burgdorferi B31
AFVGLGAPHWDSYAR

SEQ ID NO: 138348 - protein, 9 aa, Borrelia burgdorferi B31
FVGLGAPHW

SEQ ID NO: 138349 - protein, 15 aa, Borrelia burgdorferi B31
QACLKKGMAKNTYGT

SEQ ID NO: 138350 - protein, 9 aa, Borrelia burgdorferi B31
LKKGMAKNT

SEQ ID NO: 138351 - protein, 15 aa, Borrelia burgdorferi B31
EFTQIYPQPSWVEHD

SEQ ID NO: 138352 - protein, 9 aa, Borrelia burgdorferi B31
FTQIYPQPS

SEQ ID NO: 138353 - protein, 15 aa, Borrelia burgdorferi B31
FVGLGAPHWDSYARG

SEQ ID NO: 138354 - protein, 9 aa, Borrelia burgdorferi B31
FVGLGAPHW

SEQ ID NO: 138355 - protein, 15 aa, Borrelia burgdorferi B31
FGQACLKKGMAKNTY

SEQ ID NO: 138356 - protein, 9 aa, Borrelia burgdorferi B31
LKKGMAKNT

SEQ ID NO: 138357 - protein, 15 aa, Borrelia burgdorferi B31
FTQIYPQPSWVEHDP

SEQ ID NO: 138358 - protein, 9 aa, Borrelia burgdorferi B31
FTQIYPQPS

SEQ ID NO: 138359 - protein, 15 aa, Borrelia burgdorferi B31
KVVRPKITETTALGA

SEQ ID NO: 138360 - protein, 9 aa, Borrelia burgdorferi B31
VRPKITETT

SEQ ID NO: 138361 - protein, 15 aa, Borrelia burgdorferi B31
YLAGLATGYWQSAEE

SEQ ID NO: 138362 - protein, 9 aa, Borrelia burgdorferi B31
YLAGLATGY

SEQ ID NO: 138363 - protein, 15 aa, Borrelia burgdorferi B31
TFGQACLKKGMAKNT

SEQ ID NO: 138364 - protein, 9 aa, Borrelia burgdorferi B31
FGQACLKKG

SEQ ID NO: 138365 - protein, 15 aa, Borrelia burgdorferi B31
GQACLKKGMAKNTYG

SEQ ID NO: 138366 - protein, 9 aa, Borrelia burgdorferi B31
LKKGMAKNT

SEQ ID NO: 138367 - protein, 15 aa, Borrelia burgdorferi B31
EGSVFIGGAVIQWLR

SEQ ID NO: 138368 - protein, 9 aa, Borrelia burgdorferi B31
FIGGAVIQW

SEQ ID NO: 138369 - protein, 15 aa, Borrelia burgdorferi B31
GSVFIGGAVIQWLRD

SEQ ID NO: 138370 - protein, 9 aa, Borrelia burgdorferi B31
FIGGAVIQW

SEQ ID NO: 138371 - protein, 15 aa, Borrelia burgdorferi B31
LEGSVFIGGAVIQWL

SEQ ID NO: 138372 - protein, 9 aa, Borrelia burgdorferi B31
FIGGAVIQW

SEQ ID NO: 138373 - protein, 15 aa, Borrelia burgdorferi B31
CKVVRPKITETTALG

SEQ ID NO: 138374 - protein, 9 aa, Borrelia burgdorferi B31
VRPKITETT

SEQ ID NO: 138375 - protein, 15 aa, Borrelia burgdorferi B31
LECKVVRPKITETTA

SEQ ID NO: 138376 - protein, 9 aa, Borrelia burgdorferi B31
VRPKITETT

SEQ ID NO: 138377 - protein, 15 aa, Borrelia burgdorferi B31
ECKVVRPKITETTAL

SEQ ID NO: 138378 - protein, 9 aa, Borrelia burgdorferi B31
VRPKITETT

SEQ ID NO: 138379 - protein, 15 aa, Borrelia burgdorferi B31
LLECKVVRPKITETT

SEQ ID NO: 138380 - protein, 9 aa, Borrelia burgdorferi B31
CKVVRPKIT

SEQ ID NO: 138381 - protein, 15 aa, Borrelia burgdorferi B31
TETTALGAAYLAGLA

SEQ ID NO: 138382 - protein, 9 aa, Borrelia burgdorferi B31
TTALGAAYL

SEQ ID NO: 138383 - protein, 15 aa, Borrelia burgdorferi B31
ITETTALGAAYLAGL

SEQ ID NO: 138384 - protein, 9 aa, Borrelia burgdorferi B31
TTALGAAYL

SEQ ID NO: 138385 - protein, 15 aa, Borrelia burgdorferi B31
SVFIGGAVIQWLRDG

SEQ ID NO: 138386 - protein, 9 aa, Borrelia burgdorferi B31
FIGGAVIQW

SEQ ID NO: 138387 - protein, 15 aa, Borrelia burgdorferi B31
ETTALGAAYLAGLAT

SEQ ID NO: 138388 - protein, 9 aa, Borrelia burgdorferi B31
LGAAYLAGL

SEQ ID NO: 138389 - protein, 15 aa, Borrelia burgdorferi B31
TTALGAAYLAGLATG

SEQ ID NO: 138390 - protein, 9 aa, Borrelia burgdorferi B31
LGAAYLAGL

SEQ ID NO: 138391 - protein, 15 aa, Borrelia burgdorferi B31
LAGLATGYWQSAEEI

SEQ ID NO: 138392 - protein, 9 aa, Borrelia burgdorferi B31
LATGYWQSA

SEQ ID NO: 138393 - protein, 15 aa, Borrelia burgdorferi B31
KALFGAEIPIAGIAG

SEQ ID NO: 138394 - protein, 9 aa, Borrelia burgdorferi B31
FGAEIPIAG

SEQ ID NO: 138395 - protein, 15 aa, Borrelia burgdorferi B31
DKALFGAEIPIAGIA

SEQ ID NO: 138396 - protein, 9 aa, Borrelia burgdorferi B31
FGAEIPIAG

SEQ ID NO: 138397 - protein, 15 aa, Borrelia burgdorferi B31
KTDKALFGAEIPIAG

SEQ ID NO: 138398 - protein, 9 aa, Borrelia burgdorferi B31
LFGAEIPIA

SEQ ID NO: 138399 - protein, 15 aa, Borrelia burgdorferi B31
TDKALFGAEIPIAGI

SEQ ID NO: 138400 - protein, 9 aa, Borrelia burgdorferi B31
FGAEIPIAG

SEQ ID NO: 138401 - protein, 15 aa, Borrelia burgdorferi B31
GVITEAMANARILPN

SEQ ID NO: 138402 - protein, 9 aa, Borrelia burgdorferi B31
ITEAMANAR

SEQ ID NO: 138403 - protein, 15 aa, Borrelia burgdorferi B31
QLGVITEAMANARIL

SEQ ID NO: 138404 - protein, 9 aa, Borrelia burgdorferi B31
ITEAMANAR

SEQ ID NO: 138405 - protein, 15 aa, Borrelia burgdorferi B31
LGVITEAMANARILP

SEQ ID NO: 138406 - protein, 9 aa, Borrelia burgdorferi B31
ITEAMANAR

SEQ ID NO: 138407 - protein, 15 aa, Borrelia burgdorferi B31
NGGVYFVPAFVGLGA

SEQ ID NO: 138408 - protein, 9 aa, Borrelia burgdorferi B31
FVPAFVGLG

SEQ ID NO: 138409 - protein, 15 aa, Borrelia burgdorferi B31
GGVYFVPAFVGLGAP

SEQ ID NO: 138410 - protein, 9 aa, Borrelia burgdorferi B31
FVPAFVGLG

SEQ ID NO: 138411 - protein, 15 aa, Borrelia burgdorferi B31
SVTYVLEGSVFIGGA

SEQ ID NO: 138412 - protein, 9 aa, Borrelia burgdorferi B31
YVLEGSVFI

SEQ ID NO: 138413 - protein, 15 aa, Borrelia burgdorferi B31
PKITETTALGAAYLA

SEQ ID NO: 138414 - protein, 9 aa, Borrelia burgdorferi B31
TTALGAAYL

SEQ ID NO: 138415 - protein, 15 aa, Borrelia burgdorferi B31
TEIWGSQLGVITEAM

SEQ ID NO: 138416 - protein, 9 aa, Borrelia burgdorferi B31
WGSQLGVIT

SEQ ID NO: 138417 - protein, 15 aa, Borrelia burgdorferi B31
KSVTYVLEGSVFIGG

SEQ ID NO: 138418 - protein, 9 aa, Borrelia burgdorferi B31
YVLEGSVFI

SEQ ID NO: 138419 - protein, 15 aa, Borrelia burgdorferi B31
VTYVLEGSVFIGGAV

SEQ ID NO: 138420 - protein, 9 aa, Borrelia burgdorferi B31
YVLEGSVFI

SEQ ID NO: 138421 - protein, 15 aa, Borrelia burgdorferi B31
GSTKAHITRAALESI

SEQ ID NO: 138422 - protein, 9 aa, Borrelia burgdorferi B31
TKAHITRAA

SEQ ID NO: 138423 - protein, 15 aa, Borrelia burgdorferi B31
KKSVTYVLEGSVFIG

SEQ ID NO: 138424 - protein, 9 aa, Borrelia burgdorferi B31
YVLEGSVFI

SEQ ID NO: 138425 - protein, 15 aa, Borrelia burgdorferi B31
PTEIWGSQLGVITEA

SEQ ID NO: 138426 - protein, 9 aa, Borrelia burgdorferi B31
WGSQLGVIT

SEQ ID NO: 138427 - protein, 15 aa, Borrelia burgdorferi B31
DQFAATFGQACLKKG

SEQ ID NO: 138428 - protein, 9 aa, Borrelia burgdorferi B31
FAATFGQAC

SEQ ID NO: 138429 - protein, 15 aa, Borrelia burgdorferi B31
RKKSVTYVLEGSVFI

SEQ ID NO: 138430 - protein, 9 aa, Borrelia burgdorferi B31
VTYVLEGSV

SEQ ID NO: 138431 - protein, 15 aa, Borrelia burgdorferi B31
VFIGGAVIQWLRDGL

SEQ ID NO: 138432 - protein, 9 aa, Borrelia burgdorferi B31
IGGAVIQWL

SEQ ID NO: 138433 - protein, 15 aa, Borrelia burgdorferi B31
DPTEIWGSQLGVITE

SEQ ID NO: 138434 - protein, 9 aa, Borrelia burgdorferi B31
WGSQLGVIT

SEQ ID NO: 138435 - protein, 15 aa, Borrelia burgdorferi B31
VLEGSVFIGGAVIQW

SEQ ID NO: 138436 - protein, 9 aa, Borrelia burgdorferi B31
VFIGGAVIQ

SEQ ID NO: 138437 - protein, 15 aa, Borrelia burgdorferi B31
DNGGVYFVPAFVGLG

SEQ ID NO: 138438 - protein, 9 aa, Borrelia burgdorferi B31
YFVPAFVGL

SEQ ID NO: 138439 - protein, 15 aa, Borrelia burgdorferi B31
HDPTEIWGSQLGVIT

SEQ ID NO: 138440 - protein, 9 aa, Borrelia burgdorferi B31
IWGSQLGVI

SEQ ID NO: 138441 - protein, 15 aa, Borrelia burgdorferi B31
ALFGAEIPIAGIAGD

SEQ ID NO: 138442 - protein, 9 aa, Borrelia burgdorferi B31
FGAEIPIAG

SEQ ID NO: 138443 - protein, 15 aa, Borrelia burgdorferi B31
GVYFVPAFVGLGAPH

SEQ ID NO: 138444 - protein, 9 aa, Borrelia burgdorferi B31
FVPAFVGLG

SEQ ID NO: 138445 - protein, 15 aa, Borrelia burgdorferi B31
LCFGTIDTWILWNLT

SEQ ID NO: 138446 - protein, 9 aa, Borrelia burgdorferi B31
FGTIDTWIL

SEQ ID NO: 138447 - protein, 15 aa, Borrelia burgdorferi B31
SQLGVITEAMANARI

SEQ ID NO: 138448 - protein, 9 aa, Borrelia burgdorferi B31
ITEAMANAR

SEQ ID NO: 138449 - protein, 15 aa, Borrelia burgdorferi B31
RPKITETTALGAAYL

SEQ ID NO: 138450 - protein, 9 aa, Borrelia burgdorferi B31
ITETTALGA

SEQ ID NO: 138451 - protein, 15 aa, Borrelia burgdorferi B31
CLKKGMAKNTYGTGC

SEQ ID NO: 138452 - protein, 9 aa, Borrelia burgdorferi B31
LKKGMAKNT

SEQ ID NO: 138453 - protein, 15 aa, Borrelia burgdorferi B31
VITEAMANARILPNE

SEQ ID NO: 138454 - protein, 9 aa, Borrelia burgdorferi B31
MANARILPN

SEQ ID NO: 138455 - protein, 15 aa, Borrelia burgdorferi B31
VRPKITETTALGAAY

SEQ ID NO: 138456 - protein, 9 aa, Borrelia burgdorferi B31
VRPKITETT

SEQ ID NO: 138457 - protein, 15 aa, Borrelia burgdorferi B31
KITETTALGAAYLAG

SEQ ID NO: 138458 - protein, 9 aa, Borrelia burgdorferi B31
TTALGAAYL

SEQ ID NO: 138459 - protein, 15 aa, Borrelia burgdorferi B31
LKKGMAKNTYGTGCF

SEQ ID NO: 138460 - protein, 9 aa, Borrelia burgdorferi B31
LKKGMAKNT

SEQ ID NO: 138461 - protein, 15 aa, Borrelia burgdorferi B31
FAATFGQACLKKGMA

SEQ ID NO: 138462 - protein, 9 aa, Borrelia burgdorferi B31
FGQACLKKG

SEQ ID NO: 138463 - protein, 15 aa, Borrelia burgdorferi B31
QFAATFGQACLKKGM

SEQ ID NO: 138464 - protein, 9 aa, Borrelia burgdorferi B31
FGQACLKKG

SEQ ID NO: 138465 - protein, 15 aa, Borrelia burgdorferi B31
KAHITRAALESIAFQ

SEQ ID NO: 138466 - protein, 9 aa, Borrelia burgdorferi B31
ITRAALESI

SEQ ID NO: 138467 - protein, 15 aa, Borrelia burgdorferi B31
ELCFGTIDTWILWNL

SEQ ID NO: 138468 - protein, 9 aa, Borrelia burgdorferi B31
FGTIDTWIL

SEQ ID NO: 138469 - protein, 15 aa, Borrelia burgdorferi B31
IQELRVDGGASQNNL

SEQ ID NO: 138470 - protein, 9 aa, Borrelia burgdorferi B31
VDGGASQNN

SEQ ID NO: 138471 - protein, 15 aa, Borrelia burgdorferi B31
ENGELCFGTIDTWIL

SEQ ID NO: 138472 - protein, 9 aa, Borrelia burgdorferi B31
LCFGTIDTW

SEQ ID NO: 138473 - protein, 15 aa, Borrelia burgdorferi B31
GELCFGTIDTWILWN

SEQ ID NO: 138474 - protein, 9 aa, Borrelia burgdorferi B31
FGTIDTWIL

SEQ ID NO: 138475 - protein, 15 aa, Borrelia burgdorferi B31
QELRVDGGASQNNLL

SEQ ID NO: 138476 - protein, 9 aa, Borrelia burgdorferi B31
VDGGASQNN

SEQ ID NO: 138477 - protein, 15 aa, Borrelia burgdorferi B31
NGELCFGTIDTWILW

SEQ ID NO: 138478 - protein, 9 aa, Borrelia burgdorferi B31
FGTIDTWIL

SEQ ID NO: 138479 - protein, 15 aa, Borrelia burgdorferi B31
DELLSILNVPRAILP

SEQ ID NO: 138480 - protein, 9 aa, Borrelia burgdorferi B31
LSILNVPRA

SEQ ID NO: 138481 - protein, 15 aa, Borrelia burgdorferi B31
EIQELRVDGGASQNN

SEQ ID NO: 138482 - protein, 9 aa, Borrelia burgdorferi B31
LRVDGGASQ

SEQ ID NO: 138483 - protein, 15 aa, Borrelia burgdorferi B31
IYNAIVWQDRRTAKI

SEQ ID NO: 138484 - protein, 9 aa, Borrelia burgdorferi B31
IVWQDRRTA

SEQ ID NO: 138485 - protein, 15 aa, Borrelia burgdorferi B31
AATFGQACLKKGMAK

SEQ ID NO: 138486 - protein, 9 aa, Borrelia burgdorferi B31
FGQACLKKG

SEQ ID NO: 138487 - protein, 15 aa, Borrelia burgdorferi B31
ELRVDGGASQNNLLM

SEQ ID NO: 138488 - protein, 9 aa, Borrelia burgdorferi B31
VDGGASQNN

SEQ ID NO: 138489 - protein, 15 aa, Borrelia burgdorferi B31
ELLSILNVPRAILPE

SEQ ID NO: 138490 - protein, 9 aa, Borrelia burgdorferi B31
LNVPRAILP

SEQ ID NO: 138491 - protein, 15 aa, Borrelia burgdorferi B31
ITEAMANARILPNEI

SEQ ID NO: 138492 - protein, 9 aa, Borrelia burgdorferi B31
MANARILPN

SEQ ID NO: 138493 - protein, 15 aa, Borrelia burgdorferi B31
ATFGQACLKKGMAKN

SEQ ID NO: 138494 - protein, 9 aa, Borrelia burgdorferi B31
FGQACLKKG

SEQ ID NO: 138495 - protein, 15 aa, Borrelia burgdorferi B31
LRVDGGASQNNLLMQ

SEQ ID NO: 138496 - protein, 9 aa, Borrelia burgdorferi B31
VDGGASQNN

SEQ ID NO: 138497 - protein, 15 aa, Borrelia burgdorferi B31
YNAIVWQDRRTAKIC

SEQ ID NO: 138498 - protein, 9 aa, Borrelia burgdorferi B31
WQDRRTAKI

SEQ ID NO: 138499 - protein, 15 aa, Borrelia burgdorferi B31
AHITRAALESIAFQS

SEQ ID NO: 138500 - protein, 9 aa, Borrelia burgdorferi B31
ITRAALESI

SEQ ID NO: 138501 - protein, 15 aa, Borrelia burgdorferi B31
GSQLGVITEAMANAR

SEQ ID NO: 138502 - protein, 9 aa, Borrelia burgdorferi B31
VITEAMANA

SEQ ID NO: 138503 - protein, 15 aa, Borrelia burgdorferi B31
YVLEGSVFIGGAVIQ

SEQ ID NO: 138504 - protein, 9 aa, Borrelia burgdorferi B31
YVLEGSVFI

SEQ ID NO: 138505 - protein, 15 aa, Borrelia burgdorferi B31
RGTIIGITRGSTKAH

SEQ ID NO: 138506 - protein, 9 aa, Borrelia burgdorferi B31
GITRGSTKA

SEQ ID NO: 138507 - protein, 15 aa, Borrelia burgdorferi B31
LLSILNVPRAILPEL

SEQ ID NO: 138508 - protein, 9 aa, Borrelia burgdorferi B31
LNVPRAILP

SEQ ID NO: 138509 - protein, 15 aa, Borrelia burgdorferi B31
LSILNVPRAILPELK

SEQ ID NO: 138510 - protein, 9 aa, Borrelia burgdorferi B31
LNVPRAILP

SEQ ID NO: 138511 - protein, 15 aa, Borrelia burgdorferi B31
AGLATGYWQSAEEIV

SEQ ID NO: 138512 - protein, 9 aa, Borrelia burgdorferi B31
LATGYWQSA

SEQ ID NO: 138513 - protein, 15 aa, Borrelia burgdorferi B31
KNTYGTGCFLTVNIG

SEQ ID NO: 138514 - protein, 9 aa, Borrelia burgdorferi B31
YGTGCFLTV

SEQ ID NO: 138515 - protein, 15 aa, Borrelia burgdorferi B31
GMAKNTYGTGCFLTV

SEQ ID NO: 138516 - protein, 9 aa, Borrelia burgdorferi B31
GMAKNTYGT

SEQ ID NO: 138517 - protein, 15 aa, Borrelia burgdorferi B31
WGSQLGVITEAMANA

SEQ ID NO: 138518 - protein, 9 aa, Borrelia burgdorferi B31
WGSQLGVIT

SEQ ID NO: 138519 - protein, 15 aa, Borrelia burgdorferi B31
YILSIDQGTTSSRAM

SEQ ID NO: 138520 - protein, 9 aa, Borrelia burgdorferi B31
IDQGTTSSR

SEQ ID NO: 138521 - protein, 15 aa, Borrelia burgdorferi B31
GTIIGITRGSTKAHI

SEQ ID NO: 138522 - protein, 9 aa, Borrelia burgdorferi B31
ITRGSTKAH

SEQ ID NO: 138523 - protein, 15 aa, Borrelia burgdorferi B31
NAIVWQDRRTAKICD

SEQ ID NO: 138524 - protein, 9 aa, Borrelia burgdorferi B31
WQDRRTAKI

SEQ ID NO: 138525 - protein, 15 aa, Borrelia burgdorferi B31
NTYGTGCFLTVNIGK

SEQ ID NO: 138526 - protein, 9 aa, Borrelia burgdorferi B31
YGTGCFLTV

SEQ ID NO: 138527 - protein, 15 aa, Borrelia burgdorferi B31
TIIGITRGSTKAHIT

SEQ ID NO: 138528 - protein, 9 aa, Borrelia burgdorferi B31
ITRGSTKAH

SEQ ID NO: 138529 - protein, 15 aa, Borrelia burgdorferi B31
AKNTYGTGCFLTVNI

SEQ ID NO: 138530 - protein, 9 aa, Borrelia burgdorferi B31
YGTGCFLTV

SEQ ID NO: 138531 - protein, 15 aa, Borrelia burgdorferi B31
MAKNTYGTGCFLTVN

SEQ ID NO: 138532 - protein, 9 aa, Borrelia burgdorferi B31
YGTGCFLTV

SEQ ID NO: 138533 - protein, 15 aa, Borrelia burgdorferi B31
IIGITRGSTKAHITR

SEQ ID NO: 138534 - protein, 9 aa, Borrelia burgdorferi B31
ITRGSTKAH

SEQ ID NO: 138535 - protein, 15 aa, Borrelia burgdorferi B31
DKLLTSIAWGRKKSV

SEQ ID NO: 138536 - protein, 9 aa, Borrelia burgdorferi B31
LLTSIAWGR

SEQ ID NO: 138537 - protein, 15 aa, Borrelia burgdorferi B31
SILNVPRAILPELKE

SEQ ID NO: 138538 - protein, 9 aa, Borrelia burgdorferi B31
LNVPRAILP

SEQ ID NO: 138539 - protein, 15 aa, Borrelia burgdorferi B31
HATDYSNASRTLLLN

SEQ ID NO: 138540 - protein, 9 aa, Borrelia burgdorferi B31
YSNASRTLL

SEQ ID NO: 138541 - protein, 15 aa, Borrelia burgdorferi B31
ATDYSNASRTLLLNI

SEQ ID NO: 138542 - protein, 9 aa, Borrelia burgdorferi B31
YSNASRTLL

SEQ ID NO: 138543 - protein, 15 aa, Borrelia burgdorferi B31
EHATDYSNASRTLLL

SEQ ID NO: 138544 - protein, 9 aa, Borrelia burgdorferi B31
YSNASRTLL

SEQ ID NO: 138545 - protein, 15 aa, Borrelia burgdorferi B31
KYILSIDQGTTSSRA

SEQ ID NO: 138546 - protein, 9 aa, Borrelia burgdorferi B31
IDQGTTSSR

SEQ ID NO: 138547 - protein, 15 aa, Borrelia burgdorferi B31
GTIDTWILWNLTQKK

SEQ ID NO: 138548 - protein, 9 aa, Borrelia burgdorferi B31
DTWILWNLT

SEQ ID NO: 138549 - protein, 15 aa, Borrelia burgdorferi B31
TDYSNASRTLLLNIK

SEQ ID NO: 138550 - protein, 9 aa, Borrelia burgdorferi B31
YSNASRTLL

SEQ ID NO: 138551 - protein, 15 aa, Borrelia burgdorferi B31
LSIDQGTTSSRAMVF

SEQ ID NO: 138552 - protein, 9 aa, Borrelia burgdorferi B31
IDQGTTSSR

SEQ ID NO: 138553 - protein, 15 aa, Borrelia burgdorferi B31
TIDTWILWNLTQKKE

SEQ ID NO: 138554 - protein, 9 aa, Borrelia burgdorferi B31
ILWNLTQKK

SEQ ID NO: 138555 - protein, 15 aa, Borrelia burgdorferi B31
IGITRGSTKAHITRA

SEQ ID NO: 138556 - protein, 9 aa, Borrelia burgdorferi B31
ITRGSTKAH

SEQ ID NO: 138557 - protein, 15 aa, Borrelia burgdorferi B31
FIGGAVIQWLRDGLE

SEQ ID NO: 138558 - protein, 9 aa, Borrelia burgdorferi B31
FIGGAVIQW

SEQ ID NO: 138559 - protein, 15 aa, Borrelia burgdorferi B31
TEAMANARILPNEID

SEQ ID NO: 138560 - protein, 9 aa, Borrelia burgdorferi B31
MANARILPN

SEQ ID NO: 138561 - protein, 15 aa, Borrelia burgdorferi B31
ILSIDQGTTSSRAMV

SEQ ID NO: 138562 - protein, 9 aa, Borrelia burgdorferi B31
IDQGTTSSR

SEQ ID NO: 138563 - protein, 15 aa, Borrelia burgdorferi B31
AIVWQDRRTAKICDQ

SEQ ID NO: 138564 - protein, 9 aa, Borrelia burgdorferi B31
WQDRRTAKI

SEQ ID NO: 138565 - protein, 15 aa, Borrelia burgdorferi B31
LFGAEIPIAGIAGDQ

SEQ ID NO: 138566 - protein, 9 aa, Borrelia burgdorferi B31
FGAEIPIAG

SEQ ID NO: 138567 - protein, 15 aa, Borrelia burgdorferi B31
GITRGSTKAHITRAA

SEQ ID NO: 138568 - protein, 9 aa, Borrelia burgdorferi B31
ITRGSTKAH

SEQ ID NO: 138569 - protein, 15 aa, Borrelia burgdorferi B31
KEHATDYSNASRTLL

SEQ ID NO: 138570 - protein, 9 aa, Borrelia burgdorferi B31
DYSNASRTL

SEQ ID NO: 138571 - protein, 15 aa, Borrelia burgdorferi B31
LATGYWQSAEEIVSL

SEQ ID NO: 138572 - protein, 9 aa, Borrelia burgdorferi B31
LATGYWQSA

SEQ ID NO: 138573 - protein, 15 aa, Borrelia burgdorferi B31
IVWQDRRTAKICDQL

SEQ ID NO: 138574 - protein, 9 aa, Borrelia burgdorferi B31
WQDRRTAKI

SEQ ID NO: 138575 - protein, 15 aa, Borrelia burgdorferi B31
GLATGYWQSAEEIVS

SEQ ID NO: 138576 - protein, 9 aa, Borrelia burgdorferi B31
LATGYWQSA

SEQ ID NO: 138577 - protein, 15 aa, Borrelia burgdorferi B31
RAILPELKESSTIYG

SEQ ID NO: 138578 - protein, 9 aa, Borrelia burgdorferi B31
LPELKESST

SEQ ID NO: 138579 - protein, 15 aa, Borrelia burgdorferi B31
LLTSIAWGRKKSVTY

SEQ ID NO: 138580 - protein, 9 aa, Borrelia burgdorferi B31
IAWGRKKSV

SEQ ID NO: 138581 - protein, 15 aa, Borrelia burgdorferi B31
AILPELKESSTIYGK

SEQ ID NO: 138582 - protein, 9 aa, Borrelia burgdorferi B31
LKESSTIYG

SEQ ID NO: 138583 - protein, 15 aa, Borrelia burgdorferi B31
HITRAALESIAFQSF

SEQ ID NO: 138584 - protein, 9 aa, Borrelia burgdorferi B31
ITRAALESI

SEQ ID NO: 138585 - protein, 15 aa, Borrelia burgdorferi B31
ITRGSTKAHITRAAL

SEQ ID NO: 138586 - protein, 9 aa, Borrelia burgdorferi B31
TKAHITRAA

SEQ ID NO: 138587 - protein, 15 aa, Borrelia burgdorferi B31
ILPELKESSTIYGKT

SEQ ID NO: 138588 - protein, 9 aa, Borrelia burgdorferi B31
LKESSTIYG

SEQ ID NO: 138589 - protein, 15 aa, Borrelia burgdorferi B31
LPELKESSTIYGKTD

SEQ ID NO: 138590 - protein, 9 aa, Borrelia burgdorferi B31
LKESSTIYG

SEQ ID NO: 138591 - protein, 15 aa, Borrelia burgdorferi B31
IDTWILWNLTQKKEH

SEQ ID NO: 138592 - protein, 9 aa, Borrelia burgdorferi B31
ILWNLTQKK

SEQ ID NO: 138593 - protein, 15 aa, Borrelia burgdorferi B31
DTWILWNLTQKKEHA

SEQ ID NO: 138594 - protein, 9 aa, Borrelia burgdorferi B31
ILWNLTQKK

SEQ ID NO: 138595 - protein, 15 aa, Borrelia burgdorferi B31
LTSIAWGRKKSVTYV

SEQ ID NO: 138596 - protein, 9 aa, Borrelia burgdorferi B31
IAWGRKKSV

SEQ ID NO: 138597 - protein, 15 aa, Borrelia burgdorferi B31
ISHDKLLTSIAWGRK

SEQ ID NO: 138598 - protein, 9 aa, Borrelia burgdorferi B31
LLTSIAWGR

SEQ ID NO: 138599 - protein, 15 aa, Borrelia burgdorferi B31
TSIAWGRKKSVTYVL

SEQ ID NO: 138600 - protein, 9 aa, Borrelia burgdorferi B31
IAWGRKKSV

SEQ ID NO: 138601 - protein, 15 aa, Borrelia burgdorferi B31
IWGSQLGVITEAMAN

SEQ ID NO: 138602 - protein, 9 aa, Borrelia burgdorferi B31
WGSQLGVIT

SEQ ID NO: 138603 - protein, 15 aa, Borrelia burgdorferi B31
FGTIDTWILWNLTQK

SEQ ID NO: 138604 - protein, 9 aa, Borrelia burgdorferi B31
FGTIDTWIL

SEQ ID NO: 138605 - protein, 15 aa, Borrelia burgdorferi B31
IISHDKLLTSIAWGR

SEQ ID NO: 138606 - protein, 9 aa, Borrelia burgdorferi B31
DKLLTSIAW

SEQ ID NO: 138607 - protein, 15 aa, Borrelia burgdorferi B31
TQIYPQPSWVEHDPT

SEQ ID NO: 138608 - protein, 9 aa, Borrelia burgdorferi B31
IYPQPSWVE

SEQ ID NO: 138609 - protein, 15 aa, Borrelia burgdorferi B31
GKTDKALFGAEIPIA

SEQ ID NO: 138610 - protein, 9 aa, Borrelia burgdorferi B31
DKALFGAEI

SEQ ID NO: 138611 - protein, 15 aa, Borrelia burgdorferi B31
TYVLEGSVFIGGAVI

SEQ ID NO: 138612 - protein, 9 aa, Borrelia burgdorferi B31
YVLEGSVFI

SEQ ID NO: 138613 - protein, 15 aa, Borrelia burgdorferi B31
ITRAALESIAFQSFD

SEQ ID NO: 138614 - protein, 9 aa, Borrelia burgdorferi B31
ITRAALESI

SEQ ID NO: 138615 - protein, 15 aa, Borrelia burgdorferi B31
KPIYNAIVWQDRRTA

SEQ ID NO: 138616 - protein, 9 aa, Borrelia burgdorferi B31
YNAIVWQDR

SEQ ID NO: 138617 - protein, 15 aa, Borrelia burgdorferi B31
SHDKLLTSIAWGRKK

SEQ ID NO: 138618 - protein, 9 aa, Borrelia burgdorferi B31
LLTSIAWGR

SEQ ID NO: 138619 - protein, 15 aa, Borrelia burgdorferi B31
CFGTIDTWILWNLTQ

SEQ ID NO: 138620 - protein, 9 aa, Borrelia burgdorferi B31
FGTIDTWIL

SEQ ID NO: 138621 - protein, 15 aa, Borrelia burgdorferi B31
PELKESSTIYGKTDK

SEQ ID NO: 138622 - protein, 9 aa, Borrelia burgdorferi B31
LKESSTIYG

SEQ ID NO: 138623 - protein, 15 aa, Borrelia burgdorferi B31
KLLTSIAWGRKKSVT

SEQ ID NO: 138624 - protein, 9 aa, Borrelia burgdorferi B31
IAWGRKKSV

SEQ ID NO: 138625 - protein, 15 aa, Borrelia burgdorferi B31
TWILWNLTQKKEHAT

SEQ ID NO: 138626 - protein, 9 aa, Borrelia burgdorferi B31
ILWNLTQKK

SEQ ID NO: 138627 - protein, 15 aa, Borrelia burgdorferi B31
SDNGGVYFVPAFVGL

SEQ ID NO: 138628 - protein, 9 aa, Borrelia burgdorferi B31
VYFVPAFVG

SEQ ID NO: 138629 - protein, 15 aa, Borrelia burgdorferi B31
DDELLSILNVPRAIL

SEQ ID NO: 138630 - protein, 9 aa, Borrelia burgdorferi B31
LSILNVPRA

SEQ ID NO: 138631 - protein, 15 aa, Borrelia burgdorferi B31
SSDAEALASSVSDNG

SEQ ID NO: 138632 - protein, 9 aa, Borrelia burgdorferi B31
AEALASSVS

SEQ ID NO: 138633 - protein, 15 aa, Borrelia burgdorferi B31
SIDQGTTSSRAMVFD

SEQ ID NO: 138634 - protein, 9 aa, Borrelia burgdorferi B31
DQGTTSSRA

SEQ ID NO: 138635 - protein, 15 aa, Borrelia burgdorferi B31
EAMANARILPNEIDA

SEQ ID NO: 138636 - protein, 9 aa, Borrelia burgdorferi B31
MANARILPN

SEQ ID NO: 138637 - protein, 15 aa, Borrelia burgdorferi B31
FRKSSDAEALASSVS

SEQ ID NO: 138638 - protein, 9 aa, Borrelia burgdorferi B31
FRKSSDAEA

SEQ ID NO: 138639 - protein, 15 aa, Borrelia burgdorferi B31
SDAEALASSVSDNGG

SEQ ID NO: 138640 - protein, 9 aa, Borrelia burgdorferi B31
AEALASSVS

SEQ ID NO: 138641 - protein, 15 aa, Borrelia burgdorferi B31
FGAEIPIAGIAGDQF

SEQ ID NO: 138642 - protein, 9 aa, Borrelia burgdorferi B31
FGAEIPIAG

SEQ ID NO: 138643 - protein, 15 aa, Borrelia burgdorferi B31
PIYNAIVWQDRRTAK

SEQ ID NO: 138644 - protein, 9 aa, Borrelia burgdorferi B31
YNAIVWQDR

SEQ ID NO: 138645 - protein, 15 aa, Borrelia burgdorferi B31
MKYILSIDQGTTSSR

SEQ ID NO: 138646 - protein, 9 aa, Borrelia burgdorferi B31
MKYILSIDQ

SEQ ID NO: 138647 - protein, 15 aa, Borrelia burgdorferi B31
HDKLLTSIAWGRKKS

SEQ ID NO: 138648 - protein, 9 aa, Borrelia burgdorferi B31
LLTSIAWGR

SEQ ID NO: 138649 - protein, 15 aa, Borrelia burgdorferi B31
WDDELLSILNVPRAI

SEQ ID NO: 138650 - protein, 9 aa, Borrelia burgdorferi B31
LSILNVPRA

SEQ ID NO: 138651 - protein, 15 aa, Borrelia burgdorferi B31
VDGGASQNNLLMQFQ

SEQ ID NO: 138652 - protein, 9 aa, Borrelia burgdorferi B31
VDGGASQNN

SEQ ID NO: 138653 - protein, 15 aa, Borrelia burgdorferi B31
EWDDELLSILNVPRA

SEQ ID NO: 138654 - protein, 9 aa, Borrelia burgdorferi B31
LLSILNVPR

SEQ ID NO: 138655 - protein, 15 aa, Borrelia burgdorferi B31
RVDGGASQNNLLMQF

SEQ ID NO: 138656 - protein, 9 aa, Borrelia burgdorferi B31
VDGGASQNN

SEQ ID NO: 138657 - protein, 15 aa, Borrelia burgdorferi B31
SIAFQSFDILNTMKK

SEQ ID NO: 138658 - protein, 9 aa, Borrelia burgdorferi B31
FQSFDILNT

SEQ ID NO: 138659 - protein, 15 aa, Borrelia burgdorferi B31
DYSNASRTLLLNIKT

SEQ ID NO: 138660 - protein, 9 aa, Borrelia burgdorferi B31
YSNASRTLL

SEQ ID NO: 138661 - protein, 15 aa, Borrelia burgdorferi B31
IAFQSFDILNTMKKS

SEQ ID NO: 138662 - protein, 9 aa, Borrelia burgdorferi B31
FQSFDILNT

SEQ ID NO: 138663 - protein, 15 aa, Borrelia burgdorferi B31
LKESSTIYGKTDKAL

SEQ ID NO: 138664 - protein, 9 aa, Borrelia burgdorferi B31
LKESSTIYG

SEQ ID NO: 138665 - protein, 15 aa, Borrelia burgdorferi B31
AIGITNQRETTVIWE

SEQ ID NO: 138666 - protein, 9 aa, Borrelia burgdorferi B31
ITNQRETTV

SEQ ID NO: 138667 - protein, 15 aa, Borrelia burgdorferi B31
IDQGTTSSRAMVFDK

SEQ ID NO: 138668 - protein, 9 aa, Borrelia burgdorferi B31
IDQGTTSSR

SEQ ID NO: 138669 - protein, 15 aa, Borrelia burgdorferi B31
ENWNKAVGKAKSWIQ

SEQ ID NO: 138670 - protein, 9 aa, Borrelia burgdorferi B31
WNKAVGKAK

SEQ ID NO: 138671 - protein, 15 aa, Borrelia burgdorferi B31
DAIGITNQRETTVIW

SEQ ID NO: 138672 - protein, 9 aa, Borrelia burgdorferi B31
ITNQRETTV

SEQ ID NO: 138673 - protein, 15 aa, Borrelia burgdorferi B31
IGITNQRETTVIWEK

SEQ ID NO: 138674 - protein, 9 aa, Borrelia burgdorferi B31
ITNQRETTV

SEQ ID NO: 138675 - protein, 15 aa, Borrelia burgdorferi B31
ILNVPRAILPELKES

SEQ ID NO: 138676 - protein, 9 aa, Borrelia burgdorferi B31
LNVPRAILP

SEQ ID NO: 138677 - protein, 15 aa, Borrelia burgdorferi B31
IDAIGITNQRETTVI

SEQ ID NO: 138678 - protein, 9 aa, Borrelia burgdorferi B31
ITNQRETTV

SEQ ID NO: 138679 - protein, 15 aa, Borrelia burgdorferi B31
SIAWGRKKSVTYVLE

SEQ ID NO: 138680 - protein, 9 aa, Borrelia burgdorferi B31
WGRKKSVTY

SEQ ID NO: 138681 - protein, 15 aa, Borrelia burgdorferi B31
RGSTKAHITRAALES

SEQ ID NO: 138682 - protein, 9 aa, Borrelia burgdorferi B31
TKAHITRAA

SEQ ID NO: 138683 - protein, 15 aa, Borrelia burgdorferi B31
WDSYARGTIIGITRG

SEQ ID NO: 138684 - protein, 9 aa, Borrelia burgdorferi B31
YARGTIIGI

SEQ ID NO: 138685 - protein, 15 aa, Borrelia burgdorferi B31
IAWGRKKSVTYVLEG

SEQ ID NO: 138686 - protein, 9 aa, Borrelia burgdorferi B31
WGRKKSVTY

SEQ ID NO: 138687 - protein, 15 aa, Borrelia burgdorferi B31
EIDAIGITNQRETTV

SEQ ID NO: 138688 - protein, 9 aa, Borrelia burgdorferi B31
IDAIGITNQ

SEQ ID NO: 138689 - protein, 15 aa, Borrelia burgdorferi B31
DSYARGTIIGITRGS

SEQ ID NO: 138690 - protein, 9 aa, Borrelia burgdorferi B31
YARGTIIGI

SEQ ID NO: 138691 - protein, 15 aa, Borrelia burgdorferi B31
LNVPRAILPELKESS

SEQ ID NO: 138692 - protein, 9 aa, Borrelia burgdorferi B31
LNVPRAILP

SEQ ID NO: 138693 - protein, 15 aa, Borrelia burgdorferi B31
TYGTGCFLTVNIGKE

SEQ ID NO: 138694 - protein, 9 aa, Borrelia burgdorferi B31
YGTGCFLTV

SEQ ID NO: 138695 - protein, 15 aa, Borrelia burgdorferi B31
NTGKPIYNAIVWQDR

SEQ ID NO: 138696 - protein, 9 aa, Borrelia burgdorferi B31
IYNAIVWQD

SEQ ID NO: 138697 - protein, 15 aa, Borrelia burgdorferi B31
IYPQPSWVEHDPTEI

SEQ ID NO: 138698 - protein, 9 aa, Borrelia burgdorferi B31
IYPQPSWVE

SEQ ID NO: 138699 - protein, 15 aa, Borrelia burgdorferi B31
TQKKEHATDYSNASR

SEQ ID NO: 138700 - protein, 9 aa, Borrelia burgdorferi B31
HATDYSNAS

SEQ ID NO: 138701 - protein, 15 aa, Borrelia burgdorferi B31
QKKEHATDYSNASRT

SEQ ID NO: 138702 - protein, 9 aa, Borrelia burgdorferi B31
HATDYSNAS

SEQ ID NO: 138703 - protein, 15 aa, Borrelia burgdorferi B31
LTQKKEHATDYSNAS

SEQ ID NO: 138704 - protein, 9 aa, Borrelia burgdorferi B31
QKKEHATDY

SEQ ID NO: 138705 - protein, 15 aa, Borrelia burgdorferi B31
KKEHATDYSNASRTL

SEQ ID NO: 138706 - protein, 9 aa, Borrelia burgdorferi B31
HATDYSNAS

SEQ ID NO: 138707 - protein, 15 aa, Borrelia burgdorferi B31
KEHATDYSNASRTLL

SEQ ID NO: 138708 - protein, 9 aa, Borrelia burgdorferi B31
HATDYSNAS

SEQ ID NO: 138709 - protein, 15 aa, Borrelia burgdorferi B31
EHATDYSNASRTLLL

SEQ ID NO: 138710 - protein, 9 aa, Borrelia burgdorferi B31
HATDYSNAS

SEQ ID NO: 138711 - protein, 15 aa, Borrelia burgdorferi B31
HATDYSNASRTLLLN

SEQ ID NO: 138712 - protein, 9 aa, Borrelia burgdorferi B31
HATDYSNAS

SEQ ID NO: 138713 - protein, 15 aa, Borrelia burgdorferi B31
FDILNTMKKSIPNFE

SEQ ID NO: 138714 - protein, 9 aa, Borrelia burgdorferi B31
FDILNTMKK

SEQ ID NO: 138715 - protein, 15 aa, Borrelia burgdorferi B31
MKYILSIDQGTTSSR

SEQ ID NO: 138716 - protein, 9 aa, Borrelia burgdorferi B31
MKYILSIDQ

SEQ ID NO: 138717 - protein, 15 aa, Borrelia burgdorferi B31
DILNTMKKSIPNFEI

SEQ ID NO: 138718 - protein, 9 aa, Borrelia burgdorferi B31
MKKSIPNFE

SEQ ID NO: 138719 - protein, 15 aa, Borrelia burgdorferi B31
ILNTMKKSIPNFEIQ

SEQ ID NO: 138720 - protein, 9 aa, Borrelia burgdorferi B31
MKKSIPNFE

SEQ ID NO: 138721 - protein, 15 aa, Borrelia burgdorferi B31
LNTMKKSIPNFEIQE

SEQ ID NO: 138722 - protein, 9 aa, Borrelia burgdorferi B31
MKKSIPNFE

SEQ ID NO: 138723 - protein, 15 aa, Borrelia burgdorferi B31
VYFVPAFVGLGAPHW

SEQ ID NO: 138724 - protein, 9 aa, Borrelia burgdorferi B31
FVPAFVGLG

SEQ ID NO: 138725 - protein, 15 aa, Borrelia burgdorferi B31
YFVPAFVGLGAPHWD

SEQ ID NO: 138726 - protein, 9 aa, Borrelia burgdorferi B31
FVGLGAPHW

SEQ ID NO: 138727 - protein, 15 aa, Borrelia burgdorferi B31
FVPAFVGLGAPHWDS

SEQ ID NO: 138728 - protein, 9 aa, Borrelia burgdorferi B31
FVGLGAPHW

SEQ ID NO: 138729 - protein, 15 aa, Borrelia burgdorferi B31
TIDTWILWNLTQKKE

SEQ ID NO: 138730 - protein, 9 aa, Borrelia burgdorferi B31
ILWNLTQKK

SEQ ID NO: 138731 - protein, 15 aa, Borrelia burgdorferi B31
DTWILWNLTQKKEHA

SEQ ID NO: 138732 - protein, 9 aa, Borrelia burgdorferi B31
ILWNLTQKK

SEQ ID NO: 138733 - protein, 15 aa, Borrelia burgdorferi B31
GTIDTWILWNLTQKK

SEQ ID NO: 138734 - protein, 9 aa, Borrelia burgdorferi B31
DTWILWNLT

SEQ ID NO: 138735 - protein, 15 aa, Borrelia burgdorferi B31
IDTWILWNLTQKKEH

SEQ ID NO: 138736 - protein, 9 aa, Borrelia burgdorferi B31
ILWNLTQKK

SEQ ID NO: 138737 - protein, 15 aa, Borrelia burgdorferi B31
TWILWNLTQKKEHAT

SEQ ID NO: 138738 - protein, 9 aa, Borrelia burgdorferi B31
ILWNLTQKK

SEQ ID NO: 138739 - protein, 15 aa, Borrelia burgdorferi B31
NGGVYFVPAFVGLGA

SEQ ID NO: 138740 - protein, 9 aa, Borrelia burgdorferi B31
FVPAFVGLG

SEQ ID NO: 138741 - protein, 15 aa, Borrelia burgdorferi B31
GVYFVPAFVGLGAPH

SEQ ID NO: 138742 - protein, 9 aa, Borrelia burgdorferi B31
FVPAFVGLG

SEQ ID NO: 138743 - protein, 15 aa, Borrelia burgdorferi B31
GGVYFVPAFVGLGAP

SEQ ID NO: 138744 - protein, 9 aa, Borrelia burgdorferi B31
FVPAFVGLG

SEQ ID NO: 138745 - protein, 15 aa, Borrelia burgdorferi B31
DNGGVYFVPAFVGLG

SEQ ID NO: 138746 - protein, 9 aa, Borrelia burgdorferi B31
GVYFVPAFV

SEQ ID NO: 138747 - protein, 15 aa, Borrelia burgdorferi B31
NASRTLLLNIKTLEW

SEQ ID NO: 138748 - protein, 9 aa, Borrelia burgdorferi B31
LLLNIKTLE

SEQ ID NO: 138749 - protein, 15 aa, Borrelia burgdorferi B31
ASRTLLLNIKTLEWD

SEQ ID NO: 138750 - protein, 9 aa, Borrelia burgdorferi B31
LLNIKTLEW

SEQ ID NO: 138751 - protein, 15 aa, Borrelia burgdorferi B31
SRTLLLNIKTLEWDD

SEQ ID NO: 138752 - protein, 9 aa, Borrelia burgdorferi B31
LLNIKTLEW

SEQ ID NO: 138753 - protein, 15 aa, Borrelia burgdorferi B31
RTLLLNIKTLEWDDE

SEQ ID NO: 138754 - protein, 9 aa, Borrelia burgdorferi B31
LLNIKTLEW

SEQ ID NO: 138755 - protein, 15 aa, Borrelia burgdorferi B31
TKIMWILDNVEGARQ

SEQ ID NO: 138756 - protein, 9 aa, Borrelia burgdorferi B31
IMWILDNVE

SEQ ID NO: 138757 - protein, 15 aa, Borrelia burgdorferi B31
GTKIMWILDNVEGAR

SEQ ID NO: 138758 - protein, 9 aa, Borrelia burgdorferi B31
IMWILDNVE

SEQ ID NO: 138759 - protein, 15 aa, Borrelia burgdorferi B31
EWDDELLSILNVPRA

SEQ ID NO: 138760 - protein, 9 aa, Borrelia burgdorferi B31
LLSILNVPR

SEQ ID NO: 138761 - protein, 15 aa, Borrelia burgdorferi B31
DDELLSILNVPRAIL

SEQ ID NO: 138762 - protein, 9 aa, Borrelia burgdorferi B31
LSILNVPRA

SEQ ID NO: 138763 - protein, 15 aa, Borrelia burgdorferi B31
WDDELLSILNVPRAI

SEQ ID NO: 138764 - protein, 9 aa, Borrelia burgdorferi B31
LSILNVPRA

SEQ ID NO: 138765 - protein, 15 aa, Borrelia burgdorferi B31
DELLSILNVPRAILP

SEQ ID NO: 138766 - protein, 9 aa, Borrelia burgdorferi B31
LSILNVPRA

SEQ ID NO: 138767 - protein, 15 aa, Borrelia burgdorferi B31
TLLLNIKTLEWDDEL

SEQ ID NO: 138768 - protein, 9 aa, Borrelia burgdorferi B31
LLNIKTLEW

SEQ ID NO: 138769 - protein, 15 aa, Borrelia burgdorferi B31
AAYLAGLATGYWQSA

SEQ ID NO: 138770 - protein, 9 aa, Borrelia burgdorferi B31
LAGLATGYW

SEQ ID NO: 138771 - protein, 15 aa, Borrelia burgdorferi B31
AYLAGLATGYWQSAE

SEQ ID NO: 138772 - protein, 9 aa, Borrelia burgdorferi B31
LAGLATGYW

SEQ ID NO: 138773 - protein, 15 aa, Borrelia burgdorferi B31
GSQLGVITEAMANAR

SEQ ID NO: 138774 - protein, 9 aa, Borrelia burgdorferi B31
VITEAMANA

SEQ ID NO: 138775 - protein, 15 aa, Borrelia burgdorferi B31
VPAFVGLGAPHWDSY

SEQ ID NO: 138776 - protein, 9 aa, Borrelia burgdorferi B31
FVGLGAPHW

SEQ ID NO: 138777 - protein, 15 aa, Borrelia burgdorferi B31
LGVITEAMANARILP

SEQ ID NO: 138778 - protein, 9 aa, Borrelia burgdorferi B31
VITEAMANA

SEQ ID NO: 138779 - protein, 15 aa, Borrelia burgdorferi B31
WILWNLTQKKEHATD

SEQ ID NO: 138780 - protein, 9 aa, Borrelia burgdorferi B31
ILWNLTQKK

SEQ ID NO: 138781 - protein, 15 aa, Borrelia burgdorferi B31
SQLGVITEAMANARI

SEQ ID NO: 138782 - protein, 9 aa, Borrelia burgdorferi B31
VITEAMANA

SEQ ID NO: 138783 - protein, 15 aa, Borrelia burgdorferi B31
ILWNLTQKKEHATDY

SEQ ID NO: 138784 - protein, 9 aa, Borrelia burgdorferi B31
ILWNLTQKK

SEQ ID NO: 138785 - protein, 15 aa, Borrelia burgdorferi B31
QLGVITEAMANARIL

SEQ ID NO: 138786 - protein, 9 aa, Borrelia burgdorferi B31
VITEAMANA

SEQ ID NO: 138787 - protein, 15 aa, Borrelia burgdorferi B31
ELLSILNVPRAILPE

SEQ ID NO: 138788 - protein, 9 aa, Borrelia burgdorferi B31
LSILNVPRA

SEQ ID NO: 138789 - protein, 15 aa, Borrelia burgdorferi B31
PAFVGLGAPHWDSYA

SEQ ID NO: 138790 - protein, 9 aa, Borrelia burgdorferi B31
FVGLGAPHW

SEQ ID NO: 138791 - protein, 15 aa, Borrelia burgdorferi B31
SDAEALASSVSDNGG

SEQ ID NO: 138792 - protein, 9 aa, Borrelia burgdorferi B31
LASSVSDNG

SEQ ID NO: 138793 - protein, 15 aa, Borrelia burgdorferi B31
SGTKIMWILDNVEGA

SEQ ID NO: 138794 - protein, 9 aa, Borrelia burgdorferi B31
IMWILDNVE

SEQ ID NO: 138795 - protein, 15 aa, Borrelia burgdorferi B31
QKEFTQIYPQPSWVE

SEQ ID NO: 138796 - protein, 9 aa, Borrelia burgdorferi B31
FTQIYPQPS

SEQ ID NO: 138797 - protein, 15 aa, Borrelia burgdorferi B31
KEFTQIYPQPSWVEH

SEQ ID NO: 138798 - protein, 9 aa, Borrelia burgdorferi B31
IYPQPSWVE

SEQ ID NO: 138799 - protein, 15 aa, Borrelia burgdorferi B31
EFTQIYPQPSWVEHD

SEQ ID NO: 138800 - protein, 9 aa, Borrelia burgdorferi B31
IYPQPSWVE

SEQ ID NO: 138801 - protein, 15 aa, Borrelia burgdorferi B31
FTQIYPQPSWVEHDP

SEQ ID NO: 138802 - protein, 9 aa, Borrelia burgdorferi B31
IYPQPSWVE

SEQ ID NO: 138803 - protein, 15 aa, Borrelia burgdorferi B31
TEAMANARILPNEID

SEQ ID NO: 138804 - protein, 9 aa, Borrelia burgdorferi B31
MANARILPN

SEQ ID NO: 138805 - protein, 15 aa, Borrelia burgdorferi B31
EAMANARILPNEIDA

SEQ ID NO: 138806 - protein, 9 aa, Borrelia burgdorferi B31
ARILPNEID

SEQ ID NO: 138807 - protein, 15 aa, Borrelia burgdorferi B31
TQIYPQPSWVEHDPT

SEQ ID NO: 138808 - protein, 9 aa, Borrelia burgdorferi B31
IYPQPSWVE

SEQ ID NO: 138809 - protein, 15 aa, Borrelia burgdorferi B31
AMANARILPNEIDAI

SEQ ID NO: 138810 - protein, 9 aa, Borrelia burgdorferi B31
ARILPNEID

SEQ ID NO: 138811 - protein, 15 aa, Borrelia burgdorferi B31
MANARILPNEIDAIG

SEQ ID NO: 138812 - protein, 9 aa, Borrelia burgdorferi B31
ARILPNEID

SEQ ID NO: 138813 - protein, 15 aa, Borrelia burgdorferi B31
IYPQPSWVEHDPTEI

SEQ ID NO: 138814 - protein, 9 aa, Borrelia burgdorferi B31
IYPQPSWVE

SEQ ID NO: 138815 - protein, 15 aa, Borrelia burgdorferi B31
ANARILPNEIDAIGI

SEQ ID NO: 138816 - protein, 9 aa, Borrelia burgdorferi B31
ARILPNEID

SEQ ID NO: 138817 - protein, 15 aa, Borrelia burgdorferi B31
QIYPQPSWVEHDPTE

SEQ ID NO: 138818 - protein, 9 aa, Borrelia burgdorferi B31
IYPQPSWVE

SEQ ID NO: 138819 - protein, 15 aa, Borrelia burgdorferi B31
GVITEAMANARILPN

SEQ ID NO: 138820 - protein, 9 aa, Borrelia burgdorferi B31
ITEAMANAR

SEQ ID NO: 138821 - protein, 15 aa, Borrelia burgdorferi B31
GTIDTWILWNLTQKK

SEQ ID NO: 138822 - protein, 9 aa, Borrelia burgdorferi B31
WILWNLTQK

SEQ ID NO: 138823 - protein, 15 aa, Borrelia burgdorferi B31
ITEAMANARILPNEI

SEQ ID NO: 138824 - protein, 9 aa, Borrelia burgdorferi B31
MANARILPN

SEQ ID NO: 138825 - protein, 15 aa, Borrelia burgdorferi B31
FGTIDTWILWNLTQK

SEQ ID NO: 138826 - protein, 9 aa, Borrelia burgdorferi B31
TWILWNLTQ

SEQ ID NO: 138827 - protein, 15 aa, Borrelia burgdorferi B31
TIDTWILWNLTQKKE

SEQ ID NO: 138828 - protein, 9 aa, Borrelia burgdorferi B31
WILWNLTQK

SEQ ID NO: 138829 - protein, 15 aa, Borrelia burgdorferi B31
FAQKEFTQIYPQPSW

SEQ ID NO: 138830 - protein, 9 aa, Borrelia burgdorferi B31
FTQIYPQPS

SEQ ID NO: 138831 - protein, 15 aa, Borrelia burgdorferi B31
FIGGAVIQWLRDGLE

SEQ ID NO: 138832 - protein, 9 aa, Borrelia burgdorferi B31
GAVIQWLRD

SEQ ID NO: 138833 - protein, 15 aa, Borrelia burgdorferi B31
VITEAMANARILPNE

SEQ ID NO: 138834 - protein, 9 aa, Borrelia burgdorferi B31
MANARILPN

SEQ ID NO: 138835 - protein, 15 aa, Borrelia burgdorferi B31
IYNAIVWQDRRTAKI

SEQ ID NO: 138836 - protein, 9 aa, Borrelia burgdorferi B31
IYNAIVWQD

SEQ ID NO: 138837 - protein, 15 aa, Borrelia burgdorferi B31
SGTKIMWILDNVEGA

SEQ ID NO: 138838 - protein, 9 aa, Borrelia burgdorferi B31
IMWILDNVE

SEQ ID NO: 138839 - protein, 15 aa, Borrelia burgdorferi B31
IDTWILWNLTQKKEH

SEQ ID NO: 138840 - protein, 9 aa, Borrelia burgdorferi B31
WILWNLTQK

SEQ ID NO: 138841 - protein, 15 aa, Borrelia burgdorferi B31
IGGAVIQWLRDGLEF

SEQ ID NO: 138842 - protein, 9 aa, Borrelia burgdorferi B31
IQWLRDGLE

SEQ ID NO: 138843 - protein, 15 aa, Borrelia burgdorferi B31
NARILPNEIDAIGIT

SEQ ID NO: 138844 - protein, 9 aa, Borrelia burgdorferi B31
ARILPNEID

SEQ ID NO: 138845 - protein, 15 aa, Borrelia burgdorferi B31
FSGTKIMWILDNVEG

SEQ ID NO: 138846 - protein, 9 aa, Borrelia burgdorferi B31
IMWILDNVE

SEQ ID NO: 138847 - protein, 15 aa, Borrelia burgdorferi B31
ARILPNEIDAIGITN

SEQ ID NO: 138848 - protein, 9 aa, Borrelia burgdorferi B31
ARILPNEID

SEQ ID NO: 138849 - protein, 15 aa, Borrelia burgdorferi B31
AQKEFTQIYPQPSWV

SEQ ID NO: 138850 - protein, 9 aa, Borrelia burgdorferi B31
FTQIYPQPS

SEQ ID NO: 138851 - protein, 15 aa, Borrelia burgdorferi B31
YPQPSWVEHDPTEIW

SEQ ID NO: 138852 - protein, 9 aa, Borrelia burgdorferi B31
WVEHDPTEI

SEQ ID NO: 138853 - protein, 15 aa, Borrelia burgdorferi B31
TKIMWILDNVEGARQ

SEQ ID NO: 138854 - protein, 9 aa, Borrelia burgdorferi B31
IMWILDNVE

SEQ ID NO: 138855 - protein, 15 aa, Borrelia burgdorferi B31
NTGKPIYNAIVWQDR

SEQ ID NO: 138856 - protein, 9 aa, Borrelia burgdorferi B31
IYNAIVWQD

SEQ ID NO: 138857 - protein, 15 aa, Borrelia burgdorferi B31
GTKIMWILDNVEGAR

SEQ ID NO: 138858 - protein, 9 aa, Borrelia burgdorferi B31
IMWILDNVE

SEQ ID NO: 138859 - protein, 15 aa, Borrelia burgdorferi B31
GGAVIQWLRDGLEFF

SEQ ID NO: 138860 - protein, 9 aa, Borrelia burgdorferi B31
IQWLRDGLE

SEQ ID NO: 138861 - protein, 15 aa, Borrelia burgdorferi B31
PQPSWVEHDPTEIWG

SEQ ID NO: 138862 - protein, 9 aa, Borrelia burgdorferi B31
VEHDPTEIW

SEQ ID NO: 138863 - protein, 15 aa, Borrelia burgdorferi B31
GFAQKEFTQIYPQPS

SEQ ID NO: 138864 - protein, 9 aa, Borrelia burgdorferi B31
QKEFTQIYP

SEQ ID NO: 138865 - protein, 15 aa, Borrelia burgdorferi B31
EHATDYSNASRTLLL

SEQ ID NO: 138866 - protein, 9 aa, Borrelia burgdorferi B31
YSNASRTLL

SEQ ID NO: 138867 - protein, 15 aa, Borrelia burgdorferi B31
HATDYSNASRTLLLN

SEQ ID NO: 138868 - protein, 9 aa, Borrelia burgdorferi B31
YSNASRTLL

SEQ ID NO: 138869 - protein, 15 aa, Borrelia burgdorferi B31
ATDYSNASRTLLLNI

SEQ ID NO: 138870 - protein, 9 aa, Borrelia burgdorferi B31
YSNASRTLL

SEQ ID NO: 138871 - protein, 15 aa, Borrelia burgdorferi B31
TDYSNASRTLLLNIK

SEQ ID NO: 138872 - protein, 9 aa, Borrelia burgdorferi B31
YSNASRTLL

SEQ ID NO: 138873 - protein, 15 aa, Borrelia burgdorferi B31
DAIGITNQRETTVIW

SEQ ID NO: 138874 - protein, 9 aa, Borrelia burgdorferi B31
ITNQRETTV

SEQ ID NO: 138875 - protein, 15 aa, Borrelia burgdorferi B31
LSIDQGTTSSRAMVF

SEQ ID NO: 138876 - protein, 9 aa, Borrelia burgdorferi B31
DQGTTSSRA

SEQ ID NO: 138877 - protein, 15 aa, Borrelia burgdorferi B31
IDAIGITNQRETTVI

SEQ ID NO: 138878 - protein, 9 aa, Borrelia burgdorferi B31
ITNQRETTV

SEQ ID NO: 138879 - protein, 15 aa, Borrelia burgdorferi B31
AIGITNQRETTVIWE

SEQ ID NO: 138880 - protein, 9 aa, Borrelia burgdorferi B31
ITNQRETTV

SEQ ID NO: 138881 - protein, 15 aa, Borrelia burgdorferi B31
IGITNQRETTVIWEK

SEQ ID NO: 138882 - protein, 9 aa, Borrelia burgdorferi B31
ITNQRETTV

SEQ ID NO: 138883 - protein, 15 aa, Borrelia burgdorferi B31
SIDQGTTSSRAMVFD

SEQ ID NO: 138884 - protein, 9 aa, Borrelia burgdorferi B31
TTSSRAMVF

SEQ ID NO: 138885 - protein, 15 aa, Borrelia burgdorferi B31
TSIAWGRKKSVTYVL

SEQ ID NO: 138886 - protein, 9 aa, Borrelia burgdorferi B31
WGRKKSVTY

SEQ ID NO: 138887 - protein, 15 aa, Borrelia burgdorferi B31
SIAWGRKKSVTYVLE

SEQ ID NO: 138888 - protein, 9 aa, Borrelia burgdorferi B31
RKKSVTYVL

SEQ ID NO: 138889 - protein, 15 aa, Borrelia burgdorferi B31
IAWGRKKSVTYVLEG

SEQ ID NO: 138890 - protein, 9 aa, Borrelia burgdorferi B31
RKKSVTYVL

SEQ ID NO: 138891 - protein, 15 aa, Borrelia burgdorferi B31
KEHATDYSNASRTLL

SEQ ID NO: 138892 - protein, 9 aa, Borrelia burgdorferi B31
DYSNASRTL

SEQ ID NO: 138893 - protein, 15 aa, Borrelia burgdorferi B31
IDQGTTSSRAMVFDK

SEQ ID NO: 138894 - protein, 9 aa, Borrelia burgdorferi B31
TTSSRAMVF

SEQ ID NO: 138895 - protein, 15 aa, Borrelia burgdorferi B31
AWGRKKSVTYVLEGS

SEQ ID NO: 138896 - protein, 9 aa, Borrelia burgdorferi B31
RKKSVTYVL

SEQ ID NO: 138897 - protein, 15 aa, Borrelia burgdorferi B31
KEFTQIYPQPSWVEH

SEQ ID NO: 138898 - protein, 9 aa, Borrelia burgdorferi B31
IYPQPSWVE

SEQ ID NO: 138899 - protein, 15 aa, Borrelia burgdorferi B31
QKEFTQIYPQPSWVE

SEQ ID NO: 138900 - protein, 9 aa, Borrelia burgdorferi B31
QIYPQPSWV

SEQ ID NO: 138901 - protein, 15 aa, Borrelia burgdorferi B31
EFTQIYPQPSWVEHD

SEQ ID NO: 138902 - protein, 9 aa, Borrelia burgdorferi B31
IYPQPSWVE

SEQ ID NO: 138903 - protein, 15 aa, Borrelia burgdorferi B31
WGRKKSVTYVLEGSV

SEQ ID NO: 138904 - protein, 9 aa, Borrelia burgdorferi B31
RKKSVTYVL

SEQ ID NO: 138905 - protein, 15 aa, Borrelia burgdorferi B31
TQIYPQPSWVEHDPT

SEQ ID NO: 138906 - protein, 9 aa, Borrelia burgdorferi B31
IYPQPSWVE

SEQ ID NO: 138907 - protein, 15 aa, Borrelia burgdorferi B31
DQGTTSSRAMVFDKN

SEQ ID NO: 138908 - protein, 9 aa, Borrelia burgdorferi B31
TTSSRAMVF

SEQ ID NO: 138909 - protein, 15 aa, Borrelia burgdorferi B31
FTQIYPQPSWVEHDP

SEQ ID NO: 138910 - protein, 9 aa, Borrelia burgdorferi B31
IYPQPSWVE

SEQ ID NO: 138911 - protein, 15 aa, Borrelia burgdorferi B31
EIDAIGITNQRETTV

SEQ ID NO: 138912 - protein, 9 aa, Borrelia burgdorferi B31
IGITNQRET

SEQ ID NO: 138913 - protein, 15 aa, Borrelia burgdorferi B31
QGTTSSRAMVFDKNA

SEQ ID NO: 138914 - protein, 9 aa, Borrelia burgdorferi B31
TTSSRAMVF

SEQ ID NO: 138915 - protein, 15 aa, Borrelia burgdorferi B31
EKLLENWNKAVGKAK

SEQ ID NO: 138916 - protein, 9 aa, Borrelia burgdorferi B31
LENWNKAVG

SEQ ID NO: 138917 - protein, 15 aa, Borrelia burgdorferi B31
KLLENWNKAVGKAKS

SEQ ID NO: 138918 - protein, 9 aa, Borrelia burgdorferi B31
WNKAVGKAK

SEQ ID NO: 138919 - protein, 15 aa, Borrelia burgdorferi B31
LLENWNKAVGKAKSW

SEQ ID NO: 138920 - protein, 9 aa, Borrelia burgdorferi B31
WNKAVGKAK

SEQ ID NO: 138921 - protein, 15 aa, Borrelia burgdorferi B31
LENWNKAVGKAKSWI

SEQ ID NO: 138922 - protein, 9 aa, Borrelia burgdorferi B31
WNKAVGKAK

SEQ ID NO: 138923 - protein, 15 aa, Borrelia burgdorferi B31
ENWNKAVGKAKSWIQ

SEQ ID NO: 138924 - protein, 9 aa, Borrelia burgdorferi B31
WNKAVGKAK

SEQ ID NO: 138925 - protein, 15 aa, Borrelia burgdorferi B31
DKLLTSIAWGRKKSV

SEQ ID NO: 138926 - protein, 9 aa, Borrelia burgdorferi B31
SIAWGRKKS

SEQ ID NO: 138927 - protein, 15 aa, Borrelia burgdorferi B31
KLLTSIAWGRKKSVT

SEQ ID NO: 138928 - protein, 9 aa, Borrelia burgdorferi B31
SIAWGRKKS

SEQ ID NO: 138929 - protein, 15 aa, Borrelia burgdorferi B31
LLTSIAWGRKKSVTY

SEQ ID NO: 138930 - protein, 9 aa, Borrelia burgdorferi B31
SIAWGRKKS

SEQ ID NO: 138931 - protein, 15 aa, Borrelia burgdorferi B31
LTSIAWGRKKSVTYV

SEQ ID NO: 138932 - protein, 9 aa, Borrelia burgdorferi B31
SIAWGRKKS

SEQ ID NO: 138933 - protein, 15 aa, Borrelia burgdorferi B31
IDTWILWNLTQKKEH

SEQ ID NO: 138934 - protein, 9 aa, Borrelia burgdorferi B31
WILWNLTQK

SEQ ID NO: 138935 - protein, 15 aa, Borrelia burgdorferi B31
LATGYWQSAEEIVSL

SEQ ID NO: 138936 - protein, 9 aa, Borrelia burgdorferi B31
YWQSAEEIV

SEQ ID NO: 138937 - protein, 15 aa, Borrelia burgdorferi B31
GLATGYWQSAEEIVS

SEQ ID NO: 138938 - protein, 9 aa, Borrelia burgdorferi B31
YWQSAEEIV

SEQ ID NO: 138939 - protein, 15 aa, Borrelia burgdorferi B31
ATGYWQSAEEIVSLW

SEQ ID NO: 138940 - protein, 9 aa, Borrelia burgdorferi B31
YWQSAEEIV

SEQ ID NO: 138941 - protein, 15 aa, Borrelia burgdorferi B31
TGYWQSAEEIVSLWQ

SEQ ID NO: 138942 - protein, 9 aa, Borrelia burgdorferi B31
YWQSAEEIV

SEQ ID NO: 138943 - protein, 15 aa, Borrelia burgdorferi B31
AGLATGYWQSAEEIV

SEQ ID NO: 138944 - protein, 9 aa, Borrelia burgdorferi B31
GYWQSAEEI

SEQ ID NO: 138945 - protein, 15 aa, Borrelia burgdorferi B31
HATDYSNASRTLLLN

SEQ ID NO: 138946 - protein, 9 aa, Borrelia burgdorferi B31
YSNASRTLL

SEQ ID NO: 138947 - protein, 15 aa, Borrelia burgdorferi B31
EHATDYSNASRTLLL

SEQ ID NO: 138948 - protein, 9 aa, Borrelia burgdorferi B31
YSNASRTLL

SEQ ID NO: 138949 - protein, 15 aa, Borrelia burgdorferi B31
WQVDKIFEPSMPKNQ

SEQ ID NO: 138950 - protein, 9 aa, Borrelia burgdorferi B31
IFEPSMPKN

SEQ ID NO: 138951 - protein, 15 aa, Borrelia burgdorferi B31
ATDYSNASRTLLLNI

SEQ ID NO: 138952 - protein, 9 aa, Borrelia burgdorferi B31
YSNASRTLL

SEQ ID NO: 138953 - protein, 15 aa, Borrelia burgdorferi B31
TDYSNASRTLLLNIK

SEQ ID NO: 138954 - protein, 9 aa, Borrelia burgdorferi B31
YSNASRTLL

SEQ ID NO: 138955 - protein, 15 aa, Borrelia burgdorferi B31
GLEFFRKSSDAEALA

SEQ ID NO: 138956 - protein, 9 aa, Borrelia burgdorferi B31
FRKSSDAEA

SEQ ID NO: 138957 - protein, 15 aa, Borrelia burgdorferi B31
LEFFRKSSDAEALAS

SEQ ID NO: 138958 - protein, 9 aa, Borrelia burgdorferi B31
FRKSSDAEA

SEQ ID NO: 138959 - protein, 15 aa, Borrelia burgdorferi B31
DGLEFFRKSSDAEAL

SEQ ID NO: 138960 - protein, 9 aa, Borrelia burgdorferi B31
FRKSSDAEA

SEQ ID NO: 138961 - protein, 15 aa, Borrelia burgdorferi B31
QVDKIFEPSMPKNQK

SEQ ID NO: 138962 - protein, 9 aa, Borrelia burgdorferi B31
FEPSMPKNQ

SEQ ID NO: 138963 - protein, 15 aa, Borrelia burgdorferi B31
VDKIFEPSMPKNQKE

SEQ ID NO: 138964 - protein, 9 aa, Borrelia burgdorferi B31
FEPSMPKNQ

SEQ ID NO: 138965 - protein, 15 aa, Borrelia burgdorferi B31
DKIFEPSMPKNQKEK

SEQ ID NO: 138966 - protein, 9 aa, Borrelia burgdorferi B31
FEPSMPKNQ

SEQ ID NO: 138967 - protein, 15 aa, Borrelia burgdorferi B31
KEHATDYSNASRTLL

SEQ ID NO: 138968 - protein, 9 aa, Borrelia burgdorferi B31
TDYSNASRT

SEQ ID NO: 138969 - protein, 15 aa, Borrelia burgdorferi B31
EFFRKSSDAEALASS

SEQ ID NO: 138970 - protein, 9 aa, Borrelia burgdorferi B31
FRKSSDAEA

SEQ ID NO: 138971 - protein, 15 aa, Borrelia burgdorferi B31
RDGLEFFRKSSDAEA

SEQ ID NO: 138972 - protein, 9 aa, Borrelia burgdorferi B31
FFRKSSDAE

SEQ ID NO: 138973 - protein, 15 aa, Borrelia burgdorferi B31
GYWQSAEEIVSLWQV

SEQ ID NO: 138974 - protein, 9 aa, Borrelia burgdorferi B31
YWQSAEEIV

SEQ ID NO: 138975 - protein, 15 aa, Borrelia burgdorferi B31
KIFEPSMPKNQKEKL

SEQ ID NO: 138976 - protein, 9 aa, Borrelia burgdorferi B31
FEPSMPKNQ

SEQ ID NO: 138977 - protein, 15 aa, Borrelia burgdorferi B31
PHWDSYARGTIIGIT

SEQ ID NO: 138978 - protein, 9 aa, Borrelia burgdorferi B31
WDSYARGTI

SEQ ID NO: 138979 - protein, 15 aa, Borrelia burgdorferi B31
APHWDSYARGTIIGI

SEQ ID NO: 138980 - protein, 9 aa, Borrelia burgdorferi B31
WDSYARGTI

SEQ ID NO: 138981 - protein, 15 aa, Borrelia burgdorferi B31
KLLENWNKAVGKAKS

SEQ ID NO: 138982 - protein, 9 aa, Borrelia burgdorferi B31
LENWNKAVG

SEQ ID NO: 138983 - protein, 15 aa, Borrelia burgdorferi B31
EKLLENWNKAVGKAK

SEQ ID NO: 138984 - protein, 9 aa, Borrelia burgdorferi B31
LENWNKAVG

SEQ ID NO: 138985 - protein, 15 aa, Borrelia burgdorferi B31
IYNAIVWQDRRTAKI

SEQ ID NO: 138986 - protein, 9 aa, Borrelia burgdorferi B31
IVWQDRRTA

SEQ ID NO: 138987 - protein, 15 aa, Borrelia burgdorferi B31
FDILNTMKKSIPNFE

SEQ ID NO: 138988 - protein, 9 aa, Borrelia burgdorferi B31
LNTMKKSIP

SEQ ID NO: 138989 - protein, 15 aa, Borrelia burgdorferi B31
TDYSNASRTLLLNIK

SEQ ID NO: 138990 - protein, 9 aa, Borrelia burgdorferi B31
YSNASRTLL

SEQ ID NO: 138991 - protein, 15 aa, Borrelia burgdorferi B31
FQSFDILNTMKKSIP

SEQ ID NO: 138992 - protein, 9 aa, Borrelia burgdorferi B31
FDILNTMKK

SEQ ID NO: 138993 - protein, 15 aa, Borrelia burgdorferi B31
QSFDILNTMKKSIPN

SEQ ID NO: 138994 - protein, 9 aa, Borrelia burgdorferi B31
LNTMKKSIP

SEQ ID NO: 138995 - protein, 15 aa, Borrelia burgdorferi B31
DILNTMKKSIPNFEI

SEQ ID NO: 138996 - protein, 9 aa, Borrelia burgdorferi B31
LNTMKKSIP

SEQ ID NO: 138997 - protein, 15 aa, Borrelia burgdorferi B31
ATDYSNASRTLLLNI

SEQ ID NO: 138998 - protein, 9 aa, Borrelia burgdorferi B31
YSNASRTLL

SEQ ID NO: 138999 - protein, 15 aa, Borrelia burgdorferi B31
EHATDYSNASRTLLL

SEQ ID NO: 139000 - protein, 9 aa, Borrelia burgdorferi B31
YSNASRTLL

SEQ ID NO: 139001 - protein, 15 aa, Borrelia burgdorferi B31
HATDYSNASRTLLLN

SEQ ID NO: 139002 - protein, 9 aa, Borrelia burgdorferi B31
YSNASRTLL

SEQ ID NO: 139003 - protein, 15 aa, Borrelia burgdorferi B31
SFDILNTMKKSIPNF

SEQ ID NO: 139004 - protein, 9 aa, Borrelia burgdorferi B31
LNTMKKSIP

SEQ ID NO: 139005 - protein, 15 aa, Borrelia burgdorferi B31
ASRTLLLNIKTLEWD

SEQ ID NO: 139006 - protein, 9 aa, Borrelia burgdorferi B31
LLLNIKTLE

SEQ ID NO: 139007 - protein, 15 aa, Borrelia burgdorferi B31
KEHATDYSNASRTLL

SEQ ID NO: 139008 - protein, 9 aa, Borrelia burgdorferi B31
HATDYSNAS

SEQ ID NO: 139009 - protein, 15 aa, Borrelia burgdorferi B31
SRTLLLNIKTLEWDD

SEQ ID NO: 139010 - protein, 9 aa, Borrelia burgdorferi B31
LLLNIKTLE

SEQ ID NO: 139011 - protein, 15 aa, Borrelia burgdorferi B31
RTLLLNIKTLEWDDE

SEQ ID NO: 139012 - protein, 9 aa, Borrelia burgdorferi B31
LLLNIKTLE

SEQ ID NO: 139013 - protein, 15 aa, Borrelia burgdorferi B31
NASRTLLLNIKTLEW

SEQ ID NO: 139014 - protein, 9 aa, Borrelia burgdorferi B31
LLLNIKTLE

SEQ ID NO: 139015 - protein, 15 aa, Borrelia burgdorferi B31
SNASRTLLLNIKTLE

SEQ ID NO: 139016 - protein, 9 aa, Borrelia burgdorferi B31
SRTLLLNIK

SEQ ID NO: 139017 - protein, 15 aa, Borrelia burgdorferi B31
DELLSILNVPRAILP

SEQ ID NO: 139018 - protein, 9 aa, Borrelia burgdorferi B31
LSILNVPRA

SEQ ID NO: 139019 - protein, 15 aa, Borrelia burgdorferi B31
ELLSILNVPRAILPE

SEQ ID NO: 139020 - protein, 9 aa, Borrelia burgdorferi B31
LSILNVPRA

SEQ ID NO: 139021 - protein, 15 aa, Borrelia burgdorferi B31
ILNTMKKSIPNFEIQ

SEQ ID NO: 139022 - protein, 9 aa, Borrelia burgdorferi B31
LNTMKKSIP

SEQ ID NO: 139023 - protein, 15 aa, Borrelia burgdorferi B31
DDELLSILNVPRAIL

SEQ ID NO: 139024 - protein, 9 aa, Borrelia burgdorferi B31
LSILNVPRA

SEQ ID NO: 139025 - protein, 15 aa, Borrelia burgdorferi B31
DYSNASRTLLLNIKT

SEQ ID NO: 139026 - protein, 9 aa, Borrelia burgdorferi B31
YSNASRTLL

SEQ ID NO: 139027 - protein, 15 aa, Borrelia burgdorferi B31
YSNASRTLLLNIKTL

SEQ ID NO: 139028 - protein, 9 aa, Borrelia burgdorferi B31
YSNASRTLL

SEQ ID NO: 139029 - protein, 15 aa, Borrelia burgdorferi B31
LNTMKKSIPNFEIQE

SEQ ID NO: 139030 - protein, 9 aa, Borrelia burgdorferi B31
LNTMKKSIP

SEQ ID NO: 139031 - protein, 15 aa, Borrelia burgdorferi B31
LLSILNVPRAILPEL

SEQ ID NO: 139032 - protein, 9 aa, Borrelia burgdorferi B31
ILNVPRAIL

SEQ ID NO: 139033 - protein, 15 aa, Borrelia burgdorferi B31
TLLLNIKTLEWDDEL

SEQ ID NO: 139034 - protein, 9 aa, Borrelia burgdorferi B31
LLLNIKTLE

SEQ ID NO: 139035 - protein, 15 aa, Borrelia burgdorferi B31
TGCFLTVNIGKEPII

SEQ ID NO: 139036 - protein, 9 aa, Borrelia burgdorferi B31
LTVNIGKEP

SEQ ID NO: 139037 - protein, 15 aa, Borrelia burgdorferi B31
LSILNVPRAILPELK

SEQ ID NO: 139038 - protein, 9 aa, Borrelia burgdorferi B31
ILNVPRAIL

SEQ ID NO: 139039 - protein, 15 aa, Borrelia burgdorferi B31
GCFLTVNIGKEPIIS

SEQ ID NO: 139040 - protein, 9 aa, Borrelia burgdorferi B31
LTVNIGKEP

SEQ ID NO: 139041 - protein, 15 aa, Borrelia burgdorferi B31
LLLNIKTLEWDDELL

SEQ ID NO: 139042 - protein, 9 aa, Borrelia burgdorferi B31
LLLNIKTLE

SEQ ID NO: 139043 - protein, 15 aa, Borrelia burgdorferi B31
AFQSFDILNTMKKSI

SEQ ID NO: 139044 - protein, 9 aa, Borrelia burgdorferi B31
FDILNTMKK

SEQ ID NO: 139045 - protein, 15 aa, Borrelia burgdorferi B31
CFLTVNIGKEPIISH

SEQ ID NO: 139046 - protein, 9 aa, Borrelia burgdorferi B31
LTVNIGKEP

SEQ ID NO: 139047 - protein, 15 aa, Borrelia burgdorferi B31
GTGCFLTVNIGKEPI

SEQ ID NO: 139048 - protein, 9 aa, Borrelia burgdorferi B31
LTVNIGKEP

SEQ ID NO: 139049 - protein, 15 aa, Borrelia burgdorferi B31
WDDELLSILNVPRAI

SEQ ID NO: 139050 - protein, 9 aa, Borrelia burgdorferi B31
LSILNVPRA

SEQ ID NO: 139051 - protein, 15 aa, Borrelia burgdorferi B31
EIWGSQLGVITEAMA

SEQ ID NO: 139052 - protein, 9 aa, Borrelia burgdorferi B31
WGSQLGVIT

SEQ ID NO: 139053 - protein, 15 aa, Borrelia burgdorferi B31
TEIWGSQLGVITEAM

SEQ ID NO: 139054 - protein, 9 aa, Borrelia burgdorferi B31
WGSQLGVIT

SEQ ID NO: 139055 - protein, 15 aa, Borrelia burgdorferi B31
HDPTEIWGSQLGVIT

SEQ ID NO: 139056 - protein, 9 aa, Borrelia burgdorferi B31
TEIWGSQLG

SEQ ID NO: 139057 - protein, 15 aa, Borrelia burgdorferi B31
DPTEIWGSQLGVITE

SEQ ID NO: 139058 - protein, 9 aa, Borrelia burgdorferi B31
WGSQLGVIT

SEQ ID NO: 139059 - protein, 15 aa, Borrelia burgdorferi B31
PTEIWGSQLGVITEA

SEQ ID NO: 139060 - protein, 9 aa, Borrelia burgdorferi B31
WGSQLGVIT

SEQ ID NO: 139061 - protein, 15 aa, Borrelia burgdorferi B31
EWDDELLSILNVPRA

SEQ ID NO: 139062 - protein, 9 aa, Borrelia burgdorferi B31
ELLSILNVP

SEQ ID NO: 139063 - protein, 15 aa, Borrelia burgdorferi B31
KLLENWNKAVGKAKS

SEQ ID NO: 139064 - protein, 9 aa, Borrelia burgdorferi B31
LENWNKAVG

SEQ ID NO: 139065 - protein, 15 aa, Borrelia burgdorferi B31
YGTGCFLTVNIGKEP

SEQ ID NO: 139066 - protein, 9 aa, Borrelia burgdorferi B31
FLTVNIGKE

SEQ ID NO: 139067 - protein, 15 aa, Borrelia burgdorferi B31
FLTVNIGKEPIISHD

SEQ ID NO: 139068 - protein, 9 aa, Borrelia burgdorferi B31
LTVNIGKEP

SEQ ID NO: 139069 - protein, 15 aa, Borrelia burgdorferi B31
IDAIGITNQRETTVI

SEQ ID NO: 139070 - protein, 9 aa, Borrelia burgdorferi B31
IGITNQRET

SEQ ID NO: 139071 - protein, 15 aa, Borrelia burgdorferi B31
DAIGITNQRETTVIW

SEQ ID NO: 139072 - protein, 9 aa, Borrelia burgdorferi B31
IGITNQRET

SEQ ID NO: 139073 - protein, 15 aa, Borrelia burgdorferi B31
IAFQSFDILNTMKKS

SEQ ID NO: 139074 - protein, 9 aa, Borrelia burgdorferi B31
FDILNTMKK

SEQ ID NO: 139075 - protein, 15 aa, Borrelia burgdorferi B31
IAWGRKKSVTYVLEG

SEQ ID NO: 139076 - protein, 9 aa, Borrelia burgdorferi B31
WGRKKSVTY

SEQ ID NO: 139077 - protein, 15 aa, Borrelia burgdorferi B31
SIAWGRKKSVTYVLE

SEQ ID NO: 139078 - protein, 9 aa, Borrelia burgdorferi B31
WGRKKSVTY

SEQ ID NO: 139079 - protein, 15 aa, Borrelia burgdorferi B31
EKLLENWNKAVGKAK

SEQ ID NO: 139080 - protein, 9 aa, Borrelia burgdorferi B31
LENWNKAVG

SEQ ID NO: 139081 - protein, 15 aa, Borrelia burgdorferi B31
TSIAWGRKKSVTYVL

SEQ ID NO: 139082 - protein, 9 aa, Borrelia burgdorferi B31
WGRKKSVTY

SEQ ID NO: 139083 - protein, 15 aa, Borrelia burgdorferi B31
LLTSIAWGRKKSVTY

SEQ ID NO: 139084 - protein, 9 aa, Borrelia burgdorferi B31
LTSIAWGRK

SEQ ID NO: 139085 - protein, 15 aa, Borrelia burgdorferi B31
YARGTIIGITRGSTK

SEQ ID NO: 139086 - protein, 9 aa, Borrelia burgdorferi B31
RGTIIGITR

SEQ ID NO: 139087 - protein, 15 aa, Borrelia burgdorferi B31
SIAFQSFDILNTMKK

SEQ ID NO: 139088 - protein, 9 aa, Borrelia burgdorferi B31
FQSFDILNT

SEQ ID NO: 139089 - protein, 15 aa, Borrelia burgdorferi B31
IDTWILWNLTQKKEH

SEQ ID NO: 139090 - protein, 9 aa, Borrelia burgdorferi B31
WILWNLTQK

SEQ ID NO: 139091 - protein, 15 aa, Borrelia burgdorferi B31
DTWILWNLTQKKEHA

SEQ ID NO: 139092 - protein, 9 aa, Borrelia burgdorferi B31
WILWNLTQK

SEQ ID NO: 139093 - protein, 15 aa, Borrelia burgdorferi B31
TIDTWILWNLTQKKE

SEQ ID NO: 139094 - protein, 9 aa, Borrelia burgdorferi B31
WILWNLTQK

SEQ ID NO: 139095 - protein, 15 aa, Borrelia burgdorferi B31
GTIDTWILWNLTQKK

SEQ ID NO: 139096 - protein, 9 aa, Borrelia burgdorferi B31
WILWNLTQK

SEQ ID NO: 139097 - protein, 15 aa, Borrelia burgdorferi B31
FGTIDTWILWNLTQK

SEQ ID NO: 139098 - protein, 9 aa, Borrelia burgdorferi B31
IDTWILWNL

SEQ ID NO: 139099 - protein, 15 aa, Borrelia burgdorferi B31
DKLLTSIAWGRKKSV

SEQ ID NO: 139100 - protein, 9 aa, Borrelia burgdorferi B31
LLTSIAWGR

SEQ ID NO: 139101 - protein, 15 aa, Borrelia burgdorferi B31
HDKLLTSIAWGRKKS

SEQ ID NO: 139102 - protein, 9 aa, Borrelia burgdorferi B31
LLTSIAWGR

SEQ ID NO: 139103 - protein, 15 aa, Borrelia burgdorferi B31
ISHDKLLTSIAWGRK

SEQ ID NO: 139104 - protein, 9 aa, Borrelia burgdorferi B31
LLTSIAWGR

SEQ ID NO: 139105 - protein, 15 aa, Borrelia burgdorferi B31
SHDKLLTSIAWGRKK

SEQ ID NO: 139106 - protein, 9 aa, Borrelia burgdorferi B31
LLTSIAWGR

SEQ ID NO: 139107 - protein, 15 aa, Borrelia burgdorferi B31
TWILWNLTQKKEHAT

SEQ ID NO: 139108 - protein, 9 aa, Borrelia burgdorferi B31
WILWNLTQK

SEQ ID NO: 139109 - protein, 15 aa, Borrelia burgdorferi B31
LLTSIAWGRKKSVTY

SEQ ID NO: 139110 - protein, 9 aa, Borrelia burgdorferi B31
LTSIAWGRK

SEQ ID NO: 139111 - protein, 15 aa, Borrelia burgdorferi B31
WILWNLTQKKEHATD

SEQ ID NO: 139112 - protein, 9 aa, Borrelia burgdorferi B31
WILWNLTQK

SEQ ID NO: 139113 - protein, 15 aa, Borrelia burgdorferi B31
KLLTSIAWGRKKSVT

SEQ ID NO: 139114 - protein, 9 aa, Borrelia burgdorferi B31
LTSIAWGRK

SEQ ID NO: 139115 - protein, 15 aa, Borrelia burgdorferi B31
LTSIAWGRKKSVTYV

SEQ ID NO: 139116 - protein, 9 aa, Borrelia burgdorferi B31
WGRKKSVTY

SEQ ID NO: 139117 - protein, 15 aa, Borrelia burgdorferi B31
WDDELLSILNVPRAI

SEQ ID NO: 139118 - protein, 9 aa, Borrelia burgdorferi B31
LLSILNVPR

SEQ ID NO: 139119 - protein, 15 aa, Borrelia burgdorferi B31
DDELLSILNVPRAIL

SEQ ID NO: 139120 - protein, 9 aa, Borrelia burgdorferi B31
LLSILNVPR

SEQ ID NO: 139121 - protein, 15 aa, Borrelia burgdorferi B31
EWDDELLSILNVPRA

SEQ ID NO: 139122 - protein, 9 aa, Borrelia burgdorferi B31
LLSILNVPR

SEQ ID NO: 139123 - protein, 15 aa, Borrelia burgdorferi B31
DELLSILNVPRAILP

SEQ ID NO: 139124 - protein, 9 aa, Borrelia burgdorferi B31
LLSILNVPR

SEQ ID NO: 139125 - protein, 15 aa, Borrelia burgdorferi B31
IISHDKLLTSIAWGR

SEQ ID NO: 139126 - protein, 9 aa, Borrelia burgdorferi B31
KLLTSIAWG

SEQ ID NO: 139127 - protein, 15 aa, Borrelia burgdorferi B31
TSIAWGRKKSVTYVL

SEQ ID NO: 139128 - protein, 9 aa, Borrelia burgdorferi B31
WGRKKSVTY

SEQ ID NO: 139129 - protein, 15 aa, Borrelia burgdorferi B31
EKLLENWNKAVGKAK

SEQ ID NO: 139130 - protein, 9 aa, Borrelia burgdorferi B31
LENWNKAVG

SEQ ID NO: 139131 - protein, 15 aa, Borrelia burgdorferi B31
QKEKLLENWNKAVGK

SEQ ID NO: 139132 - protein, 9 aa, Borrelia burgdorferi B31
LENWNKAVG

SEQ ID NO: 139133 - protein, 15 aa, Borrelia burgdorferi B31
NQKEKLLENWNKAVG

SEQ ID NO: 139134 - protein, 9 aa, Borrelia burgdorferi B31
LLENWNKAV

SEQ ID NO: 139135 - protein, 15 aa, Borrelia burgdorferi B31
SIAWGRKKSVTYVLE

SEQ ID NO: 139136 - protein, 9 aa, Borrelia burgdorferi B31
WGRKKSVTY

SEQ ID NO: 139137 - protein, 15 aa, Borrelia burgdorferi B31
KEKLLENWNKAVGKA

SEQ ID NO: 139138 - protein, 9 aa, Borrelia burgdorferi B31
LENWNKAVG

SEQ ID NO: 139139 - protein, 15 aa, Borrelia burgdorferi B31
VYFVPAFVGLGAPHW

SEQ ID NO: 139140 - protein, 9 aa, Borrelia burgdorferi B31
VYFVPAFVG

SEQ ID NO: 139141 - protein, 15 aa, Borrelia burgdorferi B31
AFVGLGAPHWDSYAR

SEQ ID NO: 139142 - protein, 9 aa, Borrelia burgdorferi B31
FVGLGAPHW

SEQ ID NO: 139143 - protein, 15 aa, Borrelia burgdorferi B31
LEWDDELLSILNVPR

SEQ ID NO: 139144 - protein, 9 aa, Borrelia burgdorferi B31
DELLSILNV

SEQ ID NO: 139145 - protein, 15 aa, Borrelia burgdorferi B31
EEIVSLWQVDKIFEP

SEQ ID NO: 139146 - protein, 9 aa, Borrelia burgdorferi B31
VSLWQVDKI

SEQ ID NO: 139147 - protein, 15 aa, Borrelia burgdorferi B31
AEEIVSLWQVDKIFE

SEQ ID NO: 139148 - protein, 9 aa, Borrelia burgdorferi B31
VSLWQVDKI

SEQ ID NO: 139149 - protein, 15 aa, Borrelia burgdorferi B31
EIVSLWQVDKIFEPS

SEQ ID NO: 139150 - protein, 9 aa, Borrelia burgdorferi B31
VSLWQVDKI

SEQ ID NO: 139151 - protein, 15 aa, Borrelia burgdorferi B31
SAEEIVSLWQVDKIF

SEQ ID NO: 139152 - protein, 9 aa, Borrelia burgdorferi B31
VSLWQVDKI

SEQ ID NO: 139153 - protein, 15 aa, Borrelia burgdorferi B31
FSGTKIMWILDNVEG

SEQ ID NO: 139154 - protein, 9 aa, Borrelia burgdorferi B31
KIMWILDNV

SEQ ID NO: 139155 - protein, 15 aa, Borrelia burgdorferi B31
SGTKIMWILDNVEGA

SEQ ID NO: 139156 - protein, 9 aa, Borrelia burgdorferi B31
KIMWILDNV

SEQ ID NO: 139157 - protein, 15 aa, Borrelia burgdorferi B31
GTKIMWILDNVEGAR

SEQ ID NO: 139158 - protein, 9 aa, Borrelia burgdorferi B31
KIMWILDNV

SEQ ID NO: 139159 - protein, 15 aa, Borrelia burgdorferi B31
YFSGTKIMWILDNVE

SEQ ID NO: 139160 - protein, 9 aa, Borrelia burgdorferi B31
KIMWILDNV

SEQ ID NO: 139161 - protein, 15 aa, Borrelia burgdorferi B31
IDTWILWNLTQKKEH

SEQ ID NO: 139162 - protein, 9 aa, Borrelia burgdorferi B31
WILWNLTQK

SEQ ID NO: 139163 - protein, 15 aa, Borrelia burgdorferi B31
DTWILWNLTQKKEHA

SEQ ID NO: 139164 - protein, 9 aa, Borrelia burgdorferi B31
WILWNLTQK

SEQ ID NO: 139165 - protein, 15 aa, Borrelia burgdorferi B31
IVSLWQVDKIFEPSM

SEQ ID NO: 139166 - protein, 9 aa, Borrelia burgdorferi B31
VSLWQVDKI

SEQ ID NO: 139167 - protein, 15 aa, Borrelia burgdorferi B31
TIDTWILWNLTQKKE

SEQ ID NO: 139168 - protein, 9 aa, Borrelia burgdorferi B31
WILWNLTQK

SEQ ID NO: 139169 - protein, 15 aa, Borrelia burgdorferi B31
GTIDTWILWNLTQKK

SEQ ID NO: 139170 - protein, 9 aa, Borrelia burgdorferi B31
WILWNLTQK

SEQ ID NO: 139171 - protein, 15 aa, Borrelia burgdorferi B31
VSLWQVDKIFEPSMP

SEQ ID NO: 139172 - protein, 9 aa, Borrelia burgdorferi B31
VSLWQVDKI

SEQ ID NO: 139173 - protein, 15 aa, Borrelia burgdorferi B31
QSAEEIVSLWQVDKI

SEQ ID NO: 139174 - protein, 9 aa, Borrelia burgdorferi B31
AEEIVSLWQ

SEQ ID NO: 139175 - protein, 15 aa, Borrelia burgdorferi B31
TKIMWILDNVEGARQ

SEQ ID NO: 139176 - protein, 9 aa, Borrelia burgdorferi B31
IMWILDNVE

SEQ ID NO: 139177 - protein, 15 aa, Borrelia burgdorferi B31
AALESIAFQSFDILN

SEQ ID NO: 139178 - protein, 9 aa, Borrelia burgdorferi B31
IAFQSFDIL

SEQ ID NO: 139179 - protein, 15 aa, Borrelia burgdorferi B31
RAALESIAFQSFDIL

SEQ ID NO: 139180 - protein, 9 aa, Borrelia burgdorferi B31
LESIAFQSF

SEQ ID NO: 139181 - protein, 15 aa, Borrelia burgdorferi B31
TWILWNLTQKKEHAT

SEQ ID NO: 139182 - protein, 9 aa, Borrelia burgdorferi B31
WILWNLTQK

SEQ ID NO: 139183 - protein, 15 aa, Borrelia burgdorferi B31
KIMWILDNVEGARQR

SEQ ID NO: 139184 - protein, 9 aa, Borrelia burgdorferi B31
KIMWILDNV

SEQ ID NO: 139185 - protein, 15 aa, Borrelia burgdorferi B31
LESIAFQSFDILNTM

SEQ ID NO: 139186 - protein, 9 aa, Borrelia burgdorferi B31
IAFQSFDIL

SEQ ID NO: 139187 - protein, 15 aa, Borrelia burgdorferi B31
ALESIAFQSFDILNT

SEQ ID NO: 139188 - protein, 9 aa, Borrelia burgdorferi B31
IAFQSFDIL

SEQ ID NO: 139189 - protein, 15 aa, Borrelia burgdorferi B31
EKLLENWNKAVGKAK

SEQ ID NO: 139190 - protein, 9 aa, Borrelia burgdorferi B31
LENWNKAVG

SEQ ID NO: 139191 - protein, 15 aa, Borrelia burgdorferi B31
KLLENWNKAVGKAKS

SEQ ID NO: 139192 - protein, 9 aa, Borrelia burgdorferi B31
WNKAVGKAK

SEQ ID NO: 139193 - protein, 15 aa, Borrelia burgdorferi B31
LENWNKAVGKAKSWI

SEQ ID NO: 139194 - protein, 9 aa, Borrelia burgdorferi B31
WNKAVGKAK

SEQ ID NO: 139195 - protein, 15 aa, Borrelia burgdorferi B31
LLENWNKAVGKAKSW

SEQ ID NO: 139196 - protein, 9 aa, Borrelia burgdorferi B31
WNKAVGKAK

SEQ ID NO: 139197 - protein, 15 aa, Borrelia burgdorferi B31
ENWNKAVGKAKSWIQ

SEQ ID NO: 139198 - protein, 9 aa, Borrelia burgdorferi B31
WNKAVGKAK

SEQ ID NO: 139199 - protein, 15 aa, Borrelia burgdorferi B31
PIYNAIVWQDRRTAK

SEQ ID NO: 139200 - protein, 9 aa, Borrelia burgdorferi B31
YNAIVWQDR

SEQ ID NO: 139201 - protein, 15 aa, Borrelia burgdorferi B31
KPIYNAIVWQDRRTA

SEQ ID NO: 139202 - protein, 9 aa, Borrelia burgdorferi B31
YNAIVWQDR

SEQ ID NO: 139203 - protein, 15 aa, Borrelia burgdorferi B31
GKPIYNAIVWQDRRT

SEQ ID NO: 139204 - protein, 9 aa, Borrelia burgdorferi B31
YNAIVWQDR

SEQ ID NO: 139205 - protein, 15 aa, Borrelia burgdorferi B31
TGKPIYNAIVWQDRR

SEQ ID NO: 139206 - protein, 9 aa, Borrelia burgdorferi B31
YNAIVWQDR

SEQ ID NO: 139207 - protein, 15 aa, Borrelia burgdorferi B31
NTGKPIYNAIVWQDR

SEQ ID NO: 139208 - protein, 9 aa, Borrelia burgdorferi B31
GKPIYNAIV

SEQ ID NO: 139209 - protein, 15 aa, Borrelia burgdorferi B31
IYNAIVWQDRRTAKI

SEQ ID NO: 139210 - protein, 9 aa, Borrelia burgdorferi B31
YNAIVWQDR

SEQ ID NO: 139211 - protein, 15 aa, Borrelia burgdorferi B31
YNAIVWQDRRTAKIC

SEQ ID NO: 139212 - protein, 9 aa, Borrelia burgdorferi B31
YNAIVWQDR

SEQ ID NO: 139213 - protein, 15 aa, Borrelia burgdorferi B31
HDKLLTSIAWGRKKS

SEQ ID NO: 139214 - protein, 9 aa, Borrelia burgdorferi B31
LTSIAWGRK

SEQ ID NO: 139215 - protein, 15 aa, Borrelia burgdorferi B31
DKLLTSIAWGRKKSV

SEQ ID NO: 139216 - protein, 9 aa, Borrelia burgdorferi B31
LTSIAWGRK

SEQ ID NO: 139217 - protein, 15 aa, Borrelia burgdorferi B31
SHDKLLTSIAWGRKK

SEQ ID NO: 139218 - protein, 9 aa, Borrelia burgdorferi B31
LTSIAWGRK

SEQ ID NO: 139219 - protein, 15 aa, Borrelia burgdorferi B31
DKIFEPSMPKNQKEK

SEQ ID NO: 139220 - protein, 9 aa, Borrelia burgdorferi B31
FEPSMPKNQ

SEQ ID NO: 139221 - protein, 15 aa, Borrelia burgdorferi B31
IDTWILWNLTQKKEH

SEQ ID NO: 139222 - protein, 9 aa, Borrelia burgdorferi B31
WILWNLTQK

SEQ ID NO: 139223 - protein, 15 aa, Borrelia burgdorferi B31
KIFEPSMPKNQKEKL

SEQ ID NO: 139224 - protein, 9 aa, Borrelia burgdorferi B31
FEPSMPKNQ

SEQ ID NO: 139225 - protein, 15 aa, Borrelia burgdorferi B31
DTWILWNLTQKKEHA

SEQ ID NO: 139226 - protein, 9 aa, Borrelia burgdorferi B31
WILWNLTQK

SEQ ID NO: 139227 - protein, 15 aa, Borrelia burgdorferi B31
NWNKAVGKAKSWIQN

SEQ ID NO: 139228 - protein, 9 aa, Borrelia burgdorferi B31
WNKAVGKAK

SEQ ID NO: 139229 - protein, 15 aa, Borrelia burgdorferi B31
WNKAVGKAKSWIQNS

SEQ ID NO: 139230 - protein, 9 aa, Borrelia burgdorferi B31
WNKAVGKAK

SEQ ID NO: 139231 - protein, 15 aa, Borrelia burgdorferi B31
GTIDTWILWNLTQKK

SEQ ID NO: 139232 - protein, 9 aa, Borrelia burgdorferi B31
WILWNLTQK

SEQ ID NO: 139233 - protein, 15 aa, Borrelia burgdorferi B31
ISHDKLLTSIAWGRK

SEQ ID NO: 139234 - protein, 9 aa, Borrelia burgdorferi B31
LLTSIAWGR

SEQ ID NO: 139235 - protein, 15 aa, Borrelia burgdorferi B31
KLLTSIAWGRKKSVT

SEQ ID NO: 139236 - protein, 9 aa, Borrelia burgdorferi B31
LTSIAWGRK

SEQ ID NO: 139237 - protein, 15 aa, Borrelia burgdorferi B31
TIDTWILWNLTQKKE

SEQ ID NO: 139238 - protein, 9 aa, Borrelia burgdorferi B31
WILWNLTQK

SEQ ID NO: 139239 - protein, 15 aa, Borrelia burgdorferi B31
QVDKIFEPSMPKNQK

SEQ ID NO: 139240 - protein, 9 aa, Borrelia burgdorferi B31
FEPSMPKNQ

SEQ ID NO: 139241 - protein, 15 aa, Borrelia burgdorferi B31
VDKIFEPSMPKNQKE

SEQ ID NO: 139242 - protein, 9 aa, Borrelia burgdorferi B31
FEPSMPKNQ

SEQ ID NO: 139243 - protein, 15 aa, Borrelia burgdorferi B31
KEFTQIYPQPSWVEH

SEQ ID NO: 139244 - protein, 9 aa, Borrelia burgdorferi B31
IYPQPSWVE

SEQ ID NO: 139245 - protein, 15 aa, Borrelia burgdorferi B31
GTTYKLKSSNFLKLI

SEQ ID NO: 139246 - protein, 9 aa, Borrelia burgdorferi B31
YKLKSSNFL

SEQ ID NO: 139247 - protein, 15 aa, Borrelia burgdorferi B31
LGTTYKLKSSNFLKL

SEQ ID NO: 139248 - protein, 9 aa, Borrelia burgdorferi B31
YKLKSSNFL

SEQ ID NO: 139249 - protein, 15 aa, Borrelia burgdorferi B31
TTYKLKSSNFLKLIE

SEQ ID NO: 139250 - protein, 9 aa, Borrelia burgdorferi B31
YKLKSSNFL

SEQ ID NO: 139251 - protein, 15 aa, Borrelia burgdorferi B31
KLGTTYKLKSSNFLK

SEQ ID NO: 139252 - protein, 9 aa, Borrelia burgdorferi B31
YKLKSSNFL

SEQ ID NO: 139253 - protein, 15 aa, Borrelia burgdorferi B31
KKLGTTYKLKSSNFL

SEQ ID NO: 139254 - protein, 9 aa, Borrelia burgdorferi B31
LGTTYKLKS

SEQ ID NO: 139255 - protein, 15 aa, Borrelia burgdorferi B31
DIYKQIILNFSSNIN

SEQ ID NO: 139256 - protein, 9 aa, Borrelia burgdorferi B31
YKQIILNFS

SEQ ID NO: 139257 - protein, 15 aa, Borrelia burgdorferi B31
KDIYKQIILNFSSNI

SEQ ID NO: 139258 - protein, 9 aa, Borrelia burgdorferi B31
YKQIILNFS

SEQ ID NO: 139259 - protein, 15 aa, Borrelia burgdorferi B31
KKDIYKQIILNFSSN

SEQ ID NO: 139260 - protein, 9 aa, Borrelia burgdorferi B31
YKQIILNFS

SEQ ID NO: 139261 - protein, 15 aa, Borrelia burgdorferi B31
EKKDIYKQIILNFSS

SEQ ID NO: 139262 - protein, 9 aa, Borrelia burgdorferi B31
YKQIILNFS

SEQ ID NO: 139263 - protein, 15 aa, Borrelia burgdorferi B31
QEKKDIYKQIILNFS

SEQ ID NO: 139264 - protein, 9 aa, Borrelia burgdorferi B31
IYKQIILNF

SEQ ID NO: 139265 - protein, 15 aa, Borrelia burgdorferi B31
TYKLKSSNFLKLIEI

SEQ ID NO: 139266 - protein, 9 aa, Borrelia burgdorferi B31
YKLKSSNFL

SEQ ID NO: 139267 - protein, 15 aa, Borrelia burgdorferi B31
EQTIDILVAVRNRNK

SEQ ID NO: 139268 - protein, 9 aa, Borrelia burgdorferi B31
IDILVAVRN

SEQ ID NO: 139269 - protein, 15 aa, Borrelia burgdorferi B31
YKLKSSNFLKLIEIQ

SEQ ID NO: 139270 - protein, 9 aa, Borrelia burgdorferi B31
YKLKSSNFL

SEQ ID NO: 139271 - protein, 15 aa, Borrelia burgdorferi B31
QTIDILVAVRNRNKI

SEQ ID NO: 139272 - protein, 9 aa, Borrelia burgdorferi B31
IDILVAVRN

SEQ ID NO: 139273 - protein, 15 aa, Borrelia burgdorferi B31
SEFYDSLATLKKHIN

SEQ ID NO: 139274 - protein, 9 aa, Borrelia burgdorferi B31
YDSLATLKK

SEQ ID NO: 139275 - protein, 15 aa, Borrelia burgdorferi B31
DSEFYDSLATLKKHI

SEQ ID NO: 139276 - protein, 9 aa, Borrelia burgdorferi B31
YDSLATLKK

SEQ ID NO: 139277 - protein, 15 aa, Borrelia burgdorferi B31
DSLEQTIDILVAVRN

SEQ ID NO: 139278 - protein, 9 aa, Borrelia burgdorferi B31
LEQTIDILV

SEQ ID NO: 139279 - protein, 15 aa, Borrelia burgdorferi B31
KDSEFYDSLATLKKH

SEQ ID NO: 139280 - protein, 9 aa, Borrelia burgdorferi B31
YDSLATLKK

SEQ ID NO: 139281 - protein, 15 aa, Borrelia burgdorferi B31
KKDSEFYDSLATLKK

SEQ ID NO: 139282 - protein, 9 aa, Borrelia burgdorferi B31
FYDSLATLK

SEQ ID NO: 139283 - protein, 15 aa, Borrelia burgdorferi B31
SLEQTIDILVAVRNR

SEQ ID NO: 139284 - protein, 9 aa, Borrelia burgdorferi B31
IDILVAVRN

SEQ ID NO: 139285 - protein, 15 aa, Borrelia burgdorferi B31
LEQTIDILVAVRNRN

SEQ ID NO: 139286 - protein, 9 aa, Borrelia burgdorferi B31
IDILVAVRN

SEQ ID NO: 139287 - protein, 15 aa, Borrelia burgdorferi B31
IYKQIILNFSSNINI

SEQ ID NO: 139288 - protein, 9 aa, Borrelia burgdorferi B31
YKQIILNFS

SEQ ID NO: 139289 - protein, 15 aa, Borrelia burgdorferi B31
YKQIILNFSSNINID

SEQ ID NO: 139290 - protein, 9 aa, Borrelia burgdorferi B31
YKQIILNFS

SEQ ID NO: 139291 - protein, 15 aa, Borrelia burgdorferi B31
EFYDSLATLKKHINK

SEQ ID NO: 139292 - protein, 9 aa, Borrelia burgdorferi B31
YDSLATLKK

SEQ ID NO: 139293 - protein, 15 aa, Borrelia burgdorferi B31
FLKLIEIQNSPYYSQ

SEQ ID NO: 139294 - protein, 9 aa, Borrelia burgdorferi B31
LKLIEIQNS

SEQ ID NO: 139295 - protein, 15 aa, Borrelia burgdorferi B31
LKLIEIQNSPYYSQE

SEQ ID NO: 139296 - protein, 9 aa, Borrelia burgdorferi B31
IQNSPYYSQ

SEQ ID NO: 139297 - protein, 15 aa, Borrelia burgdorferi B31
KVLKYSISSQLYKLE

SEQ ID NO: 139298 - protein, 9 aa, Borrelia burgdorferi B31
LKYSISSQL

SEQ ID NO: 139299 - protein, 15 aa, Borrelia burgdorferi B31
LIEIQNSPYYSQEKK

SEQ ID NO: 139300 - protein, 9 aa, Borrelia burgdorferi B31
IQNSPYYSQ

SEQ ID NO: 139301 - protein, 15 aa, Borrelia burgdorferi B31
KLIEIQNSPYYSQEK

SEQ ID NO: 139302 - protein, 9 aa, Borrelia burgdorferi B31
IQNSPYYSQ

SEQ ID NO: 139303 - protein, 15 aa, Borrelia burgdorferi B31
EEKVLKYSISSQLYK

SEQ ID NO: 139304 - protein, 9 aa, Borrelia burgdorferi B31
LKYSISSQL

SEQ ID NO: 139305 - protein, 15 aa, Borrelia burgdorferi B31
EKVLKYSISSQLYKL

SEQ ID NO: 139306 - protein, 9 aa, Borrelia burgdorferi B31
LKYSISSQL

SEQ ID NO: 139307 - protein, 15 aa, Borrelia burgdorferi B31
IEEKVLKYSISSQLY

SEQ ID NO: 139308 - protein, 9 aa, Borrelia burgdorferi B31
LKYSISSQL

SEQ ID NO: 139309 - protein, 15 aa, Borrelia burgdorferi B31
IDILVAVRNRNKIKI

SEQ ID NO: 139310 - protein, 9 aa, Borrelia burgdorferi B31
IDILVAVRN

SEQ ID NO: 139311 - protein, 15 aa, Borrelia burgdorferi B31
IEIQNSPYYSQEKKD

SEQ ID NO: 139312 - protein, 9 aa, Borrelia burgdorferi B31
IQNSPYYSQ

SEQ ID NO: 139313 - protein, 15 aa, Borrelia burgdorferi B31
TIDILVAVRNRNKIK

SEQ ID NO: 139314 - protein, 9 aa, Borrelia burgdorferi B31
IDILVAVRN

SEQ ID NO: 139315 - protein, 15 aa, Borrelia burgdorferi B31
ECYYKNTQNEAIKKW

SEQ ID NO: 139316 - protein, 9 aa, Borrelia burgdorferi B31
YKNTQNEAI

SEQ ID NO: 139317 - protein, 15 aa, Borrelia burgdorferi B31
YIEEKVLKYSISSQL

SEQ ID NO: 139318 - protein, 9 aa, Borrelia burgdorferi B31
KVLKYSISS

SEQ ID NO: 139319 - protein, 15 aa, Borrelia burgdorferi B31
CYYKNTQNEAIKKWI

SEQ ID NO: 139320 - protein, 9 aa, Borrelia burgdorferi B31
YKNTQNEAI

SEQ ID NO: 139321 - protein, 15 aa, Borrelia burgdorferi B31
YDSLATLKKHINKYI

SEQ ID NO: 139322 - protein, 9 aa, Borrelia burgdorferi B31
YDSLATLKK

SEQ ID NO: 139323 - protein, 15 aa, Borrelia burgdorferi B31
KQIILNFSSNINIDS

SEQ ID NO: 139324 - protein, 9 aa, Borrelia burgdorferi B31
ILNFSSNIN

SEQ ID NO: 139325 - protein, 15 aa, Borrelia burgdorferi B31
FYDSLATLKKHINKY

SEQ ID NO: 139326 - protein, 9 aa, Borrelia burgdorferi B31
YDSLATLKK

SEQ ID NO: 139327 - protein, 15 aa, Borrelia burgdorferi B31
EECYYKNTQNEAIKK

SEQ ID NO: 139328 - protein, 9 aa, Borrelia burgdorferi B31
YKNTQNEAI

SEQ ID NO: 139329 - protein, 15 aa, Borrelia burgdorferi B31
LEECYYKNTQNEAIK

SEQ ID NO: 139330 - protein, 9 aa, Borrelia burgdorferi B31
YKNTQNEAI

SEQ ID NO: 139331 - protein, 15 aa, Borrelia burgdorferi B31
SLEECYYKNTQNEAI

SEQ ID NO: 139332 - protein, 9 aa, Borrelia burgdorferi B31
YYKNTQNEA

SEQ ID NO: 139333 - protein, 15 aa, Borrelia burgdorferi B31
QIILNFSSNINIDSL

SEQ ID NO: 139334 - protein, 9 aa, Borrelia burgdorferi B31
ILNFSSNIN

SEQ ID NO: 139335 - protein, 15 aa, Borrelia burgdorferi B31
EECYYKNTQNEAIKK

SEQ ID NO: 139336 - protein, 9 aa, Borrelia burgdorferi B31
YYKNTQNEA

SEQ ID NO: 139337 - protein, 15 aa, Borrelia burgdorferi B31
ECYYKNTQNEAIKKW

SEQ ID NO: 139338 - protein, 9 aa, Borrelia burgdorferi B31
YYKNTQNEA

SEQ ID NO: 139339 - protein, 15 aa, Borrelia burgdorferi B31
LEECYYKNTQNEAIK

SEQ ID NO: 139340 - protein, 9 aa, Borrelia burgdorferi B31
YYKNTQNEA

SEQ ID NO: 139341 - protein, 15 aa, Borrelia burgdorferi B31
SLEECYYKNTQNEAI

SEQ ID NO: 139342 - protein, 9 aa, Borrelia burgdorferi B31
YYKNTQNEA

SEQ ID NO: 139343 - protein, 15 aa, Borrelia burgdorferi B31
TSLEECYYKNTQNEA

SEQ ID NO: 139344 - protein, 9 aa, Borrelia burgdorferi B31
TSLEECYYK

SEQ ID NO: 139345 - protein, 15 aa, Borrelia burgdorferi B31
DIYKQIILNFSSNIN

SEQ ID NO: 139346 - protein, 9 aa, Borrelia burgdorferi B31
YKQIILNFS

SEQ ID NO: 139347 - protein, 15 aa, Borrelia burgdorferi B31
KKDIYKQIILNFSSN

SEQ ID NO: 139348 - protein, 9 aa, Borrelia burgdorferi B31
YKQIILNFS

SEQ ID NO: 139349 - protein, 15 aa, Borrelia burgdorferi B31
QEKKDIYKQIILNFS

SEQ ID NO: 139350 - protein, 9 aa, Borrelia burgdorferi B31
IYKQIILNF

SEQ ID NO: 139351 - protein, 15 aa, Borrelia burgdorferi B31
EKKDIYKQIILNFSS

SEQ ID NO: 139352 - protein, 9 aa, Borrelia burgdorferi B31
YKQIILNFS

SEQ ID NO: 139353 - protein, 15 aa, Borrelia burgdorferi B31
KDIYKQIILNFSSNI

SEQ ID NO: 139354 - protein, 9 aa, Borrelia burgdorferi B31
YKQIILNFS

SEQ ID NO: 139355 - protein, 15 aa, Borrelia burgdorferi B31
SNFLKLIEIQNSPYY

SEQ ID NO: 139356 - protein, 9 aa, Borrelia burgdorferi B31
LIEIQNSPY

SEQ ID NO: 139357 - protein, 15 aa, Borrelia burgdorferi B31
NFLKLIEIQNSPYYS

SEQ ID NO: 139358 - protein, 9 aa, Borrelia burgdorferi B31
IEIQNSPYY

SEQ ID NO: 139359 - protein, 15 aa, Borrelia burgdorferi B31
FLKLIEIQNSPYYSQ

SEQ ID NO: 139360 - protein, 9 aa, Borrelia burgdorferi B31
IEIQNSPYY

SEQ ID NO: 139361 - protein, 15 aa, Borrelia burgdorferi B31
LKLIEIQNSPYYSQE

SEQ ID NO: 139362 - protein, 9 aa, Borrelia burgdorferi B31
IEIQNSPYY

SEQ ID NO: 139363 - protein, 15 aa, Borrelia burgdorferi B31
IYKQIILNFSSNINI

SEQ ID NO: 139364 - protein, 9 aa, Borrelia burgdorferi B31
YKQIILNFS

SEQ ID NO: 139365 - protein, 15 aa, Borrelia burgdorferi B31
CYYKNTQNEAIKKWI

SEQ ID NO: 139366 - protein, 9 aa, Borrelia burgdorferi B31
YYKNTQNEA

SEQ ID NO: 139367 - protein, 15 aa, Borrelia burgdorferi B31
KLIEIQNSPYYSQEK

SEQ ID NO: 139368 - protein, 9 aa, Borrelia burgdorferi B31
IEIQNSPYY

SEQ ID NO: 139369 - protein, 15 aa, Borrelia burgdorferi B31
YYKNTQNEAIKKWIL

SEQ ID NO: 139370 - protein, 9 aa, Borrelia burgdorferi B31
YYKNTQNEA

SEQ ID NO: 139371 - protein, 15 aa, Borrelia burgdorferi B31
YKQIILNFSSNINID

SEQ ID NO: 139372 - protein, 9 aa, Borrelia burgdorferi B31
YKQIILNFS

SEQ ID NO: 139373 - protein, 15 aa, Borrelia burgdorferi B31
KKLGTTYKLKSSNFL

SEQ ID NO: 139374 - protein, 9 aa, Borrelia burgdorferi B31
LGTTYKLKS

SEQ ID NO: 139375 - protein, 15 aa, Borrelia burgdorferi B31
LGTTYKLKSSNFLKL

SEQ ID NO: 139376 - protein, 9 aa, Borrelia burgdorferi B31
YKLKSSNFL

SEQ ID NO: 139377 - protein, 15 aa, Borrelia burgdorferi B31
KLGTTYKLKSSNFLK

SEQ ID NO: 139378 - protein, 9 aa, Borrelia burgdorferi B31
YKLKSSNFL

SEQ ID NO: 139379 - protein, 15 aa, Borrelia burgdorferi B31
TTYKLKSSNFLKLIE

SEQ ID NO: 139380 - protein, 9 aa, Borrelia burgdorferi B31
YKLKSSNFL

SEQ ID NO: 139381 - protein, 15 aa, Borrelia burgdorferi B31
GTTYKLKSSNFLKLI

SEQ ID NO: 139382 - protein, 9 aa, Borrelia burgdorferi B31
YKLKSSNFL

SEQ ID NO: 139383 - protein, 15 aa, Borrelia burgdorferi B31
DIYKQIILNFSSNIN

SEQ ID NO: 139384 - protein, 9 aa, Borrelia burgdorferi B31
IILNFSSNI

SEQ ID NO: 139385 - protein, 15 aa, Borrelia burgdorferi B31
IYKQIILNFSSNINI

SEQ ID NO: 139386 - protein, 9 aa, Borrelia burgdorferi B31
ILNFSSNIN

SEQ ID NO: 139387 - protein, 15 aa, Borrelia burgdorferi B31
YKQIILNFSSNINID

SEQ ID NO: 139388 - protein, 9 aa, Borrelia burgdorferi B31
ILNFSSNIN

SEQ ID NO: 139389 - protein, 15 aa, Borrelia burgdorferi B31
KQIILNFSSNINIDS

SEQ ID NO: 139390 - protein, 9 aa, Borrelia burgdorferi B31
ILNFSSNIN

SEQ ID NO: 139391 - protein, 15 aa, Borrelia burgdorferi B31
QIILNFSSNINIDSL

SEQ ID NO: 139392 - protein, 9 aa, Borrelia burgdorferi B31
ILNFSSNIN

SEQ ID NO: 139393 - protein, 15 aa, Borrelia burgdorferi B31
EQTIDILVAVRNRNK

SEQ ID NO: 139394 - protein, 9 aa, Borrelia burgdorferi B31
ILVAVRNRN

SEQ ID NO: 139395 - protein, 15 aa, Borrelia burgdorferi B31
QTIDILVAVRNRNKI

SEQ ID NO: 139396 - protein, 9 aa, Borrelia burgdorferi B31
ILVAVRNRN

SEQ ID NO: 139397 - protein, 15 aa, Borrelia burgdorferi B31
TIDILVAVRNRNKIK

SEQ ID NO: 139398 - protein, 9 aa, Borrelia burgdorferi B31
ILVAVRNRN

SEQ ID NO: 139399 - protein, 15 aa, Borrelia burgdorferi B31
LEQTIDILVAVRNRN

SEQ ID NO: 139400 - protein, 9 aa, Borrelia burgdorferi B31
TIDILVAVR

SEQ ID NO: 139401 - protein, 15 aa, Borrelia burgdorferi B31
IDILVAVRNRNKIKI

SEQ ID NO: 139402 - protein, 9 aa, Borrelia burgdorferi B31
ILVAVRNRN

SEQ ID NO: 139403 - protein, 15 aa, Borrelia burgdorferi B31
KDIYKQIILNFSSNI

SEQ ID NO: 139404 - protein, 9 aa, Borrelia burgdorferi B31
YKQIILNFS

SEQ ID NO: 139405 - protein, 15 aa, Borrelia burgdorferi B31
IILNFSSNINIDSLE

SEQ ID NO: 139406 - protein, 9 aa, Borrelia burgdorferi B31
ILNFSSNIN

SEQ ID NO: 139407 - protein, 15 aa, Borrelia burgdorferi B31
KQIILNFSSNINIDS

SEQ ID NO: 139408 - protein, 9 aa, Borrelia burgdorferi B31
ILNFSSNIN

SEQ ID NO: 139409 - protein, 15 aa, Borrelia burgdorferi B31
DIYKQIILNFSSNIN

SEQ ID NO: 139410 - protein, 9 aa, Borrelia burgdorferi B31
YKQIILNFS

SEQ ID NO: 139411 - protein, 15 aa, Borrelia burgdorferi B31
QIILNFSSNINIDSL

SEQ ID NO: 139412 - protein, 9 aa, Borrelia burgdorferi B31
ILNFSSNIN

SEQ ID NO: 139413 - protein, 15 aa, Borrelia burgdorferi B31
YKQIILNFSSNINID

SEQ ID NO: 139414 - protein, 9 aa, Borrelia burgdorferi B31
ILNFSSNIN

SEQ ID NO: 139415 - protein, 15 aa, Borrelia burgdorferi B31
IYKQIILNFSSNINI

SEQ ID NO: 139416 - protein, 9 aa, Borrelia burgdorferi B31
ILNFSSNIN

SEQ ID NO: 139417 - protein, 15 aa, Borrelia burgdorferi B31
ILNFSSNINIDSLEQ

SEQ ID NO: 139418 - protein, 9 aa, Borrelia burgdorferi B31
ILNFSSNIN

SEQ ID NO: 139419 - protein, 15 aa, Borrelia burgdorferi B31
IILNFSSNINIDSLE

SEQ ID NO: 139420 - protein, 9 aa, Borrelia burgdorferi B31
ILNFSSNIN

SEQ ID NO: 139421 - protein, 15 aa, Borrelia burgdorferi B31
GTTYKLKSSNFLKLI

SEQ ID NO: 139422 - protein, 9 aa, Borrelia burgdorferi B31
YKLKSSNFL

SEQ ID NO: 139423 - protein, 15 aa, Borrelia burgdorferi B31
LGTTYKLKSSNFLKL

SEQ ID NO: 139424 - protein, 9 aa, Borrelia burgdorferi B31
YKLKSSNFL

SEQ ID NO: 139425 - protein, 15 aa, Borrelia burgdorferi B31
KKLGTTYKLKSSNFL

SEQ ID NO: 139426 - protein, 9 aa, Borrelia burgdorferi B31
TYKLKSSNF

SEQ ID NO: 139427 - protein, 15 aa, Borrelia burgdorferi B31
KLGTTYKLKSSNFLK

SEQ ID NO: 139428 - protein, 9 aa, Borrelia burgdorferi B31
YKLKSSNFL

SEQ ID NO: 139429 - protein, 15 aa, Borrelia burgdorferi B31
TTYKLKSSNFLKLIE

SEQ ID NO: 139430 - protein, 9 aa, Borrelia burgdorferi B31
YKLKSSNFL

SEQ ID NO: 139431 - protein, 15 aa, Borrelia burgdorferi B31
GTTYKLKSSNFLKLI

SEQ ID NO: 139432 - protein, 9 aa, Borrelia burgdorferi B31
YKLKSSNFL

SEQ ID NO: 139433 - protein, 15 aa, Borrelia burgdorferi B31
TTYKLKSSNFLKLIE

SEQ ID NO: 139434 - protein, 9 aa, Borrelia burgdorferi B31
YKLKSSNFL

SEQ ID NO: 139435 - protein, 15 aa, Borrelia burgdorferi B31
LGTTYKLKSSNFLKL

SEQ ID NO: 139436 - protein, 9 aa, Borrelia burgdorferi B31
YKLKSSNFL

SEQ ID NO: 139437 - protein, 15 aa, Borrelia burgdorferi B31
EKVLKYSISSQLYKL

SEQ ID NO: 139438 - protein, 9 aa, Borrelia burgdorferi B31
LKYSISSQL

SEQ ID NO: 139439 - protein, 15 aa, Borrelia burgdorferi B31
EEKVLKYSISSQLYK

SEQ ID NO: 139440 - protein, 9 aa, Borrelia burgdorferi B31
LKYSISSQL

SEQ ID NO: 139441 - protein, 15 aa, Borrelia burgdorferi B31
KVLKYSISSQLYKLE

SEQ ID NO: 139442 - protein, 9 aa, Borrelia burgdorferi B31
LKYSISSQL

SEQ ID NO: 139443 - protein, 15 aa, Borrelia burgdorferi B31
KLGTTYKLKSSNFLK

SEQ ID NO: 139444 - protein, 9 aa, Borrelia burgdorferi B31
YKLKSSNFL

SEQ ID NO: 139445 - protein, 15 aa, Borrelia burgdorferi B31
KKLGTTYKLKSSNFL

SEQ ID NO: 139446 - protein, 9 aa, Borrelia burgdorferi B31
LGTTYKLKS

SEQ ID NO: 139447 - protein, 15 aa, Borrelia burgdorferi B31
IEEKVLKYSISSQLY

SEQ ID NO: 139448 - protein, 9 aa, Borrelia burgdorferi B31
LKYSISSQL

SEQ ID NO: 139449 - protein, 15 aa, Borrelia burgdorferi B31
YIEEKVLKYSISSQL

SEQ ID NO: 139450 - protein, 9 aa, Borrelia burgdorferi B31
VLKYSISSQ

SEQ ID NO: 139451 - protein, 15 aa, Borrelia burgdorferi B31
VLKYSISSQLYKLEK

SEQ ID NO: 139452 - protein, 9 aa, Borrelia burgdorferi B31
YSISSQLYK

SEQ ID NO: 139453 - protein, 15 aa, Borrelia burgdorferi B31
IYKQIILNFSSNINI

SEQ ID NO: 139454 - protein, 9 aa, Borrelia burgdorferi B31
ILNFSSNIN

SEQ ID NO: 139455 - protein, 15 aa, Borrelia burgdorferi B31
YKQIILNFSSNINID

SEQ ID NO: 139456 - protein, 9 aa, Borrelia burgdorferi B31
LNFSSNINI

SEQ ID NO: 139457 - protein, 15 aa, Borrelia burgdorferi B31
TYKLKSSNFLKLIEI

SEQ ID NO: 139458 - protein, 9 aa, Borrelia burgdorferi B31
YKLKSSNFL

SEQ ID NO: 139459 - protein, 15 aa, Borrelia burgdorferi B31
KQIILNFSSNINIDS

SEQ ID NO: 139460 - protein, 9 aa, Borrelia burgdorferi B31
LNFSSNINI

SEQ ID NO: 139461 - protein, 15 aa, Borrelia burgdorferi B31
QIILNFSSNINIDSL

SEQ ID NO: 139462 - protein, 9 aa, Borrelia burgdorferi B31
LNFSSNINI

SEQ ID NO: 139463 - protein, 15 aa, Borrelia burgdorferi B31
YKLKSSNFLKLIEIQ

SEQ ID NO: 139464 - protein, 9 aa, Borrelia burgdorferi B31
YKLKSSNFL

SEQ ID NO: 139465 - protein, 15 aa, Borrelia burgdorferi B31
LKYSISSQLYKLEKP

SEQ ID NO: 139466 - protein, 9 aa, Borrelia burgdorferi B31
YSISSQLYK

SEQ ID NO: 139467 - protein, 15 aa, Borrelia burgdorferi B31
RNKIKILNILNKNLK

SEQ ID NO: 139468 - protein, 9 aa, Borrelia burgdorferi B31
IKILNILNK

SEQ ID NO: 139469 - protein, 15 aa, Borrelia burgdorferi B31
VRNRNKIKILNILNK

SEQ ID NO: 139470 - protein, 9 aa, Borrelia burgdorferi B31
VRNRNKIKI

SEQ ID NO: 139471 - protein, 15 aa, Borrelia burgdorferi B31
ILVAVRNRNKIKILN

SEQ ID NO: 139472 - protein, 9 aa, Borrelia burgdorferi B31
VRNRNKIKI

SEQ ID NO: 139473 - protein, 15 aa, Borrelia burgdorferi B31
NRNKIKILNILNKNL

SEQ ID NO: 139474 - protein, 9 aa, Borrelia burgdorferi B31
IKILNILNK

SEQ ID NO: 139475 - protein, 15 aa, Borrelia burgdorferi B31
DILVAVRNRNKIKIL

SEQ ID NO: 139476 - protein, 9 aa, Borrelia burgdorferi B31
VRNRNKIKI

SEQ ID NO: 139477 - protein, 15 aa, Borrelia burgdorferi B31
DIYKQIILNFSSNIN

SEQ ID NO: 139478 - protein, 9 aa, Borrelia burgdorferi B31
YKQIILNFS

SEQ ID NO: 139479 - protein, 15 aa, Borrelia burgdorferi B31
IDILVAVRNRNKIKI

SEQ ID NO: 139480 - protein, 9 aa, Borrelia burgdorferi B31
VAVRNRNKI

SEQ ID NO: 139481 - protein, 15 aa, Borrelia burgdorferi B31
RNRNKIKILNILNKN

SEQ ID NO: 139482 - protein, 9 aa, Borrelia burgdorferi B31
IKILNILNK

SEQ ID NO: 139483 - protein, 15 aa, Borrelia burgdorferi B31
IYKQIILNFSSNINI

SEQ ID NO: 139484 - protein, 9 aa, Borrelia burgdorferi B31
ILNFSSNIN

SEQ ID NO: 139485 - protein, 15 aa, Borrelia burgdorferi B31
VAVRNRNKIKILNIL

SEQ ID NO: 139486 - protein, 9 aa, Borrelia burgdorferi B31
VRNRNKIKI

SEQ ID NO: 139487 - protein, 15 aa, Borrelia burgdorferi B31
YKQIILNFSSNINID

SEQ ID NO: 139488 - protein, 9 aa, Borrelia burgdorferi B31
ILNFSSNIN

SEQ ID NO: 139489 - protein, 15 aa, Borrelia burgdorferi B31
LVAVRNRNKIKILNI

SEQ ID NO: 139490 - protein, 9 aa, Borrelia burgdorferi B31
VRNRNKIKI

SEQ ID NO: 139491 - protein, 15 aa, Borrelia burgdorferi B31
KQIILNFSSNINIDS

SEQ ID NO: 139492 - protein, 9 aa, Borrelia burgdorferi B31
ILNFSSNIN

SEQ ID NO: 139493 - protein, 15 aa, Borrelia burgdorferi B31
QIILNFSSNINIDSL

SEQ ID NO: 139494 - protein, 9 aa, Borrelia burgdorferi B31
ILNFSSNIN

SEQ ID NO: 139495 - protein, 15 aa, Borrelia burgdorferi B31
AVRNRNKIKILNILN

SEQ ID NO: 139496 - protein, 9 aa, Borrelia burgdorferi B31
VRNRNKIKI

SEQ ID NO: 139497 - protein, 15 aa, Borrelia burgdorferi B31
KDIYKQIILNFSSNI

SEQ ID NO: 139498 - protein, 9 aa, Borrelia burgdorferi B31
YKQIILNFS

SEQ ID NO: 139499 - protein, 15 aa, Borrelia burgdorferi B31
QTIDILVAVRNRNKI

SEQ ID NO: 139500 - protein, 9 aa, Borrelia burgdorferi B31
ILVAVRNRN

SEQ ID NO: 139501 - protein, 15 aa, Borrelia burgdorferi B31
TIDILVAVRNRNKIK

SEQ ID NO: 139502 - protein, 9 aa, Borrelia burgdorferi B31
VAVRNRNKI

SEQ ID NO: 139503 - protein, 15 aa, Borrelia burgdorferi B31
IILNFSSNINIDSLE

SEQ ID NO: 139504 - protein, 9 aa, Borrelia burgdorferi B31
ILNFSSNIN

SEQ ID NO: 139505 - protein, 15 aa, Borrelia burgdorferi B31
LGTTYKLKSSNFLKL

SEQ ID NO: 139506 - protein, 9 aa, Borrelia burgdorferi B31
YKLKSSNFL

SEQ ID NO: 139507 - protein, 15 aa, Borrelia burgdorferi B31
KKDIYKQIILNFSSN

SEQ ID NO: 139508 - protein, 9 aa, Borrelia burgdorferi B31
YKQIILNFS

SEQ ID NO: 139509 - protein, 15 aa, Borrelia burgdorferi B31
QEKKDIYKQIILNFS

SEQ ID NO: 139510 - protein, 9 aa, Borrelia burgdorferi B31
IYKQIILNF

SEQ ID NO: 139511 - protein, 15 aa, Borrelia burgdorferi B31
EKKDIYKQIILNFSS

SEQ ID NO: 139512 - protein, 9 aa, Borrelia burgdorferi B31
YKQIILNFS

SEQ ID NO: 139513 - protein, 15 aa, Borrelia burgdorferi B31
KEANLNTKKLGTTYK

SEQ ID NO: 139514 - protein, 9 aa, Borrelia burgdorferi B31
ANLNTKKLG

SEQ ID NO: 139515 - protein, 15 aa, Borrelia burgdorferi B31
ISKEANLNTKKLGTT

SEQ ID NO: 139516 - protein, 9 aa, Borrelia burgdorferi B31
ANLNTKKLG

SEQ ID NO: 139517 - protein, 15 aa, Borrelia burgdorferi B31
KKLGTTYKLKSSNFL

SEQ ID NO: 139518 - protein, 9 aa, Borrelia burgdorferi B31
LGTTYKLKS

SEQ ID NO: 139519 - protein, 15 aa, Borrelia burgdorferi B31
GTTYKLKSSNFLKLI

SEQ ID NO: 139520 - protein, 9 aa, Borrelia burgdorferi B31
YKLKSSNFL

SEQ ID NO: 139521 - protein, 15 aa, Borrelia burgdorferi B31
SKEANLNTKKLGTTY

SEQ ID NO: 139522 - protein, 9 aa, Borrelia burgdorferi B31
ANLNTKKLG

SEQ ID NO: 139523 - protein, 15 aa, Borrelia burgdorferi B31
TTYKLKSSNFLKLIE

SEQ ID NO: 139524 - protein, 9 aa, Borrelia burgdorferi B31
YKLKSSNFL

SEQ ID NO: 139525 - protein, 15 aa, Borrelia burgdorferi B31
ILNFSSNINIDSLEQ

SEQ ID NO: 139526 - protein, 9 aa, Borrelia burgdorferi B31
ILNFSSNIN

SEQ ID NO: 139527 - protein, 15 aa, Borrelia burgdorferi B31
EANLNTKKLGTTYKL

SEQ ID NO: 139528 - protein, 9 aa, Borrelia burgdorferi B31
LNTKKLGTT

SEQ ID NO: 139529 - protein, 15 aa, Borrelia burgdorferi B31
KLGTTYKLKSSNFLK

SEQ ID NO: 139530 - protein, 9 aa, Borrelia burgdorferi B31
YKLKSSNFL

SEQ ID NO: 139531 - protein, 15 aa, Borrelia burgdorferi B31
ANLNTKKLGTTYKLK

SEQ ID NO: 139532 - protein, 9 aa, Borrelia burgdorferi B31
LNTKKLGTT

SEQ ID NO: 139533 - protein, 15 aa, Borrelia burgdorferi B31
KWILEIVRNKNFIQI

SEQ ID NO: 139534 - protein, 9 aa, Borrelia burgdorferi B31
IVRNKNFIQ

SEQ ID NO: 139535 - protein, 15 aa, Borrelia burgdorferi B31
ILEIVRNKNFIQISK

SEQ ID NO: 139536 - protein, 9 aa, Borrelia burgdorferi B31
VRNKNFIQI

SEQ ID NO: 139537 - protein, 15 aa, Borrelia burgdorferi B31
TYKLKSSNFLKLIEI

SEQ ID NO: 139538 - protein, 9 aa, Borrelia burgdorferi B31
YKLKSSNFL

SEQ ID NO: 139539 - protein, 15 aa, Borrelia burgdorferi B31
WILEIVRNKNFIQIS

SEQ ID NO: 139540 - protein, 9 aa, Borrelia burgdorferi B31
IVRNKNFIQ

SEQ ID NO: 139541 - protein, 15 aa, Borrelia burgdorferi B31
YKLKSSNFLKLIEIQ

SEQ ID NO: 139542 - protein, 9 aa, Borrelia burgdorferi B31
YKLKSSNFL

SEQ ID NO: 139543 - protein, 15 aa, Borrelia burgdorferi B31
LEIVRNKNFIQISKE

SEQ ID NO: 139544 - protein, 9 aa, Borrelia burgdorferi B31
VRNKNFIQI

SEQ ID NO: 139545 - protein, 15 aa, Borrelia burgdorferi B31
FLKLIEIQNSPYYSQ

SEQ ID NO: 139546 - protein, 9 aa, Borrelia burgdorferi B31
IEIQNSPYY

SEQ ID NO: 139547 - protein, 15 aa, Borrelia burgdorferi B31
LEQTIDILVAVRNRN

SEQ ID NO: 139548 - protein, 9 aa, Borrelia burgdorferi B31
IDILVAVRN

SEQ ID NO: 139549 - protein, 15 aa, Borrelia burgdorferi B31
IQISKEANLNTKKLG

SEQ ID NO: 139550 - protein, 9 aa, Borrelia burgdorferi B31
EANLNTKKL

SEQ ID NO: 139551 - protein, 15 aa, Borrelia burgdorferi B31
LKLIEIQNSPYYSQE

SEQ ID NO: 139552 - protein, 9 aa, Borrelia burgdorferi B31
IEIQNSPYY

SEQ ID NO: 139553 - protein, 15 aa, Borrelia burgdorferi B31
DSLATLKKHINKYIE

SEQ ID NO: 139554 - protein, 9 aa, Borrelia burgdorferi B31
LATLKKHIN

SEQ ID NO: 139555 - protein, 15 aa, Borrelia burgdorferi B31
YDSLATLKKHINKYI

SEQ ID NO: 139556 - protein, 9 aa, Borrelia burgdorferi B31
LATLKKHIN

SEQ ID NO: 139557 - protein, 15 aa, Borrelia burgdorferi B31
NLNTKKLGTTYKLKS

SEQ ID NO: 139558 - protein, 9 aa, Borrelia burgdorferi B31
LNTKKLGTT

SEQ ID NO: 139559 - protein, 15 aa, Borrelia burgdorferi B31
EQTIDILVAVRNRNK

SEQ ID NO: 139560 - protein, 9 aa, Borrelia burgdorferi B31
ILVAVRNRN

SEQ ID NO: 139561 - protein, 15 aa, Borrelia burgdorferi B31
LNTKKLGTTYKLKSS

SEQ ID NO: 139562 - protein, 9 aa, Borrelia burgdorferi B31
LNTKKLGTT

SEQ ID NO: 139563 - protein, 15 aa, Borrelia burgdorferi B31
RNKIKILNILNKNLK

SEQ ID NO: 139564 - protein, 9 aa, Borrelia burgdorferi B31
IKILNILNK

SEQ ID NO: 139565 - protein, 15 aa, Borrelia burgdorferi B31
NRNKIKILNILNKNL

SEQ ID NO: 139566 - protein, 9 aa, Borrelia burgdorferi B31
IKILNILNK

SEQ ID NO: 139567 - protein, 15 aa, Borrelia burgdorferi B31
VRNRNKIKILNILNK

SEQ ID NO: 139568 - protein, 9 aa, Borrelia burgdorferi B31
VRNRNKIKI

SEQ ID NO: 139569 - protein, 15 aa, Borrelia burgdorferi B31
RNRNKIKILNILNKN

SEQ ID NO: 139570 - protein, 9 aa, Borrelia burgdorferi B31
IKILNILNK

SEQ ID NO: 139571 - protein, 15 aa, Borrelia burgdorferi B31
IDILVAVRNRNKIKI

SEQ ID NO: 139572 - protein, 9 aa, Borrelia burgdorferi B31
LVAVRNRNK

SEQ ID NO: 139573 - protein, 15 aa, Borrelia burgdorferi B31
DILVAVRNRNKIKIL

SEQ ID NO: 139574 - protein, 9 aa, Borrelia burgdorferi B31
LVAVRNRNK

SEQ ID NO: 139575 - protein, 15 aa, Borrelia burgdorferi B31
NEAIKKWILEIVRNK

SEQ ID NO: 139576 - protein, 9 aa, Borrelia burgdorferi B31
IKKWILEIV

SEQ ID NO: 139577 - protein, 15 aa, Borrelia burgdorferi B31
EAIKKWILEIVRNKN

SEQ ID NO: 139578 - protein, 9 aa, Borrelia burgdorferi B31
IKKWILEIV

SEQ ID NO: 139579 - protein, 15 aa, Borrelia burgdorferi B31
KWILEIVRNKNFIQI

SEQ ID NO: 139580 - protein, 9 aa, Borrelia burgdorferi B31
IVRNKNFIQ

SEQ ID NO: 139581 - protein, 15 aa, Borrelia burgdorferi B31
WILEIVRNKNFIQIS

SEQ ID NO: 139582 - protein, 9 aa, Borrelia burgdorferi B31
VRNKNFIQI

SEQ ID NO: 139583 - protein, 15 aa, Borrelia burgdorferi B31
QNEAIKKWILEIVRN

SEQ ID NO: 139584 - protein, 9 aa, Borrelia burgdorferi B31
IKKWILEIV

SEQ ID NO: 139585 - protein, 15 aa, Borrelia burgdorferi B31
TIDILVAVRNRNKIK

SEQ ID NO: 139586 - protein, 9 aa, Borrelia burgdorferi B31
LVAVRNRNK

SEQ ID NO: 139587 - protein, 15 aa, Borrelia burgdorferi B31
LVAVRNRNKIKILNI

SEQ ID NO: 139588 - protein, 9 aa, Borrelia burgdorferi B31
LVAVRNRNK

SEQ ID NO: 139589 - protein, 15 aa, Borrelia burgdorferi B31
ILVAVRNRNKIKILN

SEQ ID NO: 139590 - protein, 9 aa, Borrelia burgdorferi B31
LVAVRNRNK

SEQ ID NO: 139591 - protein, 15 aa, Borrelia burgdorferi B31
QTIDILVAVRNRNKI

SEQ ID NO: 139592 - protein, 9 aa, Borrelia burgdorferi B31
LVAVRNRNK

SEQ ID NO: 139593 - protein, 15 aa, Borrelia burgdorferi B31
TQNEAIKKWILEIVR

SEQ ID NO: 139594 - protein, 9 aa, Borrelia burgdorferi B31
IKKWILEIV

SEQ ID NO: 139595 - protein, 15 aa, Borrelia burgdorferi B31
NTQNEAIKKWILEIV

SEQ ID NO: 139596 - protein, 9 aa, Borrelia burgdorferi B31
EAIKKWILE

SEQ ID NO: 139597 - protein, 15 aa, Borrelia burgdorferi B31
ILEIVRNKNFIQISK

SEQ ID NO: 139598 - protein, 9 aa, Borrelia burgdorferi B31
VRNKNFIQI

SEQ ID NO: 139599 - protein, 15 aa, Borrelia burgdorferi B31
SISSQLYKLEKPEII

SEQ ID NO: 139600 - protein, 9 aa, Borrelia burgdorferi B31
LYKLEKPEI

SEQ ID NO: 139601 - protein, 15 aa, Borrelia burgdorferi B31
SQLYKLEKPEIIELI

SEQ ID NO: 139602 - protein, 9 aa, Borrelia burgdorferi B31
YKLEKPEII

SEQ ID NO: 139603 - protein, 15 aa, Borrelia burgdorferi B31
SSQLYKLEKPEIIEL

SEQ ID NO: 139604 - protein, 9 aa, Borrelia burgdorferi B31
YKLEKPEII

SEQ ID NO: 139605 - protein, 15 aa, Borrelia burgdorferi B31
ISSQLYKLEKPEIIE

SEQ ID NO: 139606 - protein, 9 aa, Borrelia burgdorferi B31
YKLEKPEII

SEQ ID NO: 139607 - protein, 15 aa, Borrelia burgdorferi B31
EQTIDILVAVRNRNK

SEQ ID NO: 139608 - protein, 9 aa, Borrelia burgdorferi B31
ILVAVRNRN

SEQ ID NO: 139609 - protein, 15 aa, Borrelia burgdorferi B31
QTIDILVAVRNRNKI

SEQ ID NO: 139610 - protein, 9 aa, Borrelia burgdorferi B31
LVAVRNRNK

SEQ ID NO: 139611 - protein, 15 aa, Borrelia burgdorferi B31
IDILVAVRNRNKIKI

SEQ ID NO: 139612 - protein, 9 aa, Borrelia burgdorferi B31
LVAVRNRNK

SEQ ID NO: 139613 - protein, 15 aa, Borrelia burgdorferi B31
TIDILVAVRNRNKIK

SEQ ID NO: 139614 - protein, 9 aa, Borrelia burgdorferi B31
LVAVRNRNK

SEQ ID NO: 139615 - protein, 15 aa, Borrelia burgdorferi B31
IKISNDYEKEKNAFN

SEQ ID NO: 139616 - protein, 9 aa, Borrelia burgdorferi B31
ISNDYEKEK

SEQ ID NO: 139617 - protein, 15 aa, Borrelia burgdorferi B31
GTLTAKFAMEGSILT

SEQ ID NO: 139618 - protein, 9 aa, Borrelia burgdorferi B31
LTAKFAMEG

SEQ ID NO: 139619 - protein, 15 aa, Borrelia burgdorferi B31
LTAKFAMEGSILTRS

SEQ ID NO: 139620 - protein, 9 aa, Borrelia burgdorferi B31
FAMEGSILT

SEQ ID NO: 139621 - protein, 15 aa, Borrelia burgdorferi B31
TAKFAMEGSILTRSK

SEQ ID NO: 139622 - protein, 9 aa, Borrelia burgdorferi B31
FAMEGSILT

SEQ ID NO: 139623 - protein, 15 aa, Borrelia burgdorferi B31
AKFAMEGSILTRSKL

SEQ ID NO: 139624 - protein, 9 aa, Borrelia burgdorferi B31
FAMEGSILT

SEQ ID NO: 139625 - protein, 15 aa, Borrelia burgdorferi B31
TLTAKFAMEGSILTR

SEQ ID NO: 139626 - protein, 9 aa, Borrelia burgdorferi B31
FAMEGSILT

SEQ ID NO: 139627 - protein, 15 aa, Borrelia burgdorferi B31
KRMTMIYRSADTWYT

SEQ ID NO: 139628 - protein, 9 aa, Borrelia burgdorferi B31
KRMTMIYRS

SEQ ID NO: 139629 - protein, 15 aa, Borrelia burgdorferi B31
RMTMIYRSADTWYTW

SEQ ID NO: 139630 - protein, 9 aa, Borrelia burgdorferi B31
YRSADTWYT

SEQ ID NO: 139631 - protein, 15 aa, Borrelia burgdorferi B31
MTMIYRSADTWYTWY

SEQ ID NO: 139632 - protein, 9 aa, Borrelia burgdorferi B31
YRSADTWYT

SEQ ID NO: 139633 - protein, 15 aa, Borrelia burgdorferi B31
TMIYRSADTWYTWYW

SEQ ID NO: 139634 - protein, 9 aa, Borrelia burgdorferi B31
YRSADTWYT

SEQ ID NO: 139635 - protein, 15 aa, Borrelia burgdorferi B31
MIYRSADTWYTWYWA

SEQ ID NO: 139636 - protein, 9 aa, Borrelia burgdorferi B31
YRSADTWYT

SEQ ID NO: 139637 - protein, 15 aa, Borrelia burgdorferi B31
RINFKGKLVKRMTMI

SEQ ID NO: 139638 - protein, 9 aa, Borrelia burgdorferi B31
FKGKLVKRM

SEQ ID NO: 139639 - protein, 15 aa, Borrelia burgdorferi B31
DFSRINFKGKLVKRM

SEQ ID NO: 139640 - protein, 9 aa, Borrelia burgdorferi B31
DFSRINFKG

SEQ ID NO: 139641 - protein, 15 aa, Borrelia burgdorferi B31
FSRINFKGKLVKRMT

SEQ ID NO: 139642 - protein, 9 aa, Borrelia burgdorferi B31
FKGKLVKRM

SEQ ID NO: 139643 - protein, 15 aa, Borrelia burgdorferi B31
SRINFKGKLVKRMTM

SEQ ID NO: 139644 - protein, 9 aa, Borrelia burgdorferi B31
FKGKLVKRM

SEQ ID NO: 139645 - protein, 15 aa, Borrelia burgdorferi B31
INFKGKLVKRMTMIY

SEQ ID NO: 139646 - protein, 9 aa, Borrelia burgdorferi B31
FKGKLVKRM

SEQ ID NO: 139647 - protein, 15 aa, Borrelia burgdorferi B31
KFAMEGSILTRSKLI

SEQ ID NO: 139648 - protein, 9 aa, Borrelia burgdorferi B31
FAMEGSILT

SEQ ID NO: 139649 - protein, 15 aa, Borrelia burgdorferi B31
FAMEGSILTRSKLIQ

SEQ ID NO: 139650 - protein, 9 aa, Borrelia burgdorferi B31
FAMEGSILT

SEQ ID NO: 139651 - protein, 15 aa, Borrelia burgdorferi B31
KTPVGTLTAKFAMEG

SEQ ID NO: 139652 - protein, 9 aa, Borrelia burgdorferi B31
VGTLTAKFA

SEQ ID NO: 139653 - protein, 15 aa, Borrelia burgdorferi B31
TPVGTLTAKFAMEGS

SEQ ID NO: 139654 - protein, 9 aa, Borrelia burgdorferi B31
VGTLTAKFA

SEQ ID NO: 139655 - protein, 15 aa, Borrelia burgdorferi B31
IYRSADTWYTWYWAE

SEQ ID NO: 139656 - protein, 9 aa, Borrelia burgdorferi B31
YRSADTWYT

SEQ ID NO: 139657 - protein, 15 aa, Borrelia burgdorferi B31
YRSADTWYTWYWAEE

SEQ ID NO: 139658 - protein, 9 aa, Borrelia burgdorferi B31
YRSADTWYT

SEQ ID NO: 139659 - protein, 15 aa, Borrelia burgdorferi B31
VGTLTAKFAMEGSIL

SEQ ID NO: 139660 - protein, 9 aa, Borrelia burgdorferi B31
LTAKFAMEG

SEQ ID NO: 139661 - protein, 15 aa, Borrelia burgdorferi B31
NFKGKLVKRMTMIYR

SEQ ID NO: 139662 - protein, 9 aa, Borrelia burgdorferi B31
FKGKLVKRM

SEQ ID NO: 139663 - protein, 15 aa, Borrelia burgdorferi B31
FKGKLVKRMTMIYRS

SEQ ID NO: 139664 - protein, 9 aa, Borrelia burgdorferi B31
FKGKLVKRM

SEQ ID NO: 139665 - protein, 15 aa, Borrelia burgdorferi B31
PVGTLTAKFAMEGSI

SEQ ID NO: 139666 - protein, 9 aa, Borrelia burgdorferi B31
LTAKFAMEG

SEQ ID NO: 139667 - protein, 15 aa, Borrelia burgdorferi B31
FLEKTPVGTLTAKFA

SEQ ID NO: 139668 - protein, 9 aa, Borrelia burgdorferi B31
FLEKTPVGT

SEQ ID NO: 139669 - protein, 15 aa, Borrelia burgdorferi B31
LEKTPVGTLTAKFAM

SEQ ID NO: 139670 - protein, 9 aa, Borrelia burgdorferi B31
VGTLTAKFA

SEQ ID NO: 139671 - protein, 15 aa, Borrelia burgdorferi B31
EKTPVGTLTAKFAME

SEQ ID NO: 139672 - protein, 9 aa, Borrelia burgdorferi B31
VGTLTAKFA

SEQ ID NO: 139673 - protein, 15 aa, Borrelia burgdorferi B31
YAYKVLGISSAPKLS

SEQ ID NO: 139674 - protein, 9 aa, Borrelia burgdorferi B31
YKVLGISSA

SEQ ID NO: 139675 - protein, 15 aa, Borrelia burgdorferi B31
TAKFAMEGSILTRSK

SEQ ID NO: 139676 - protein, 9 aa, Borrelia burgdorferi B31
FAMEGSILT

SEQ ID NO: 139677 - protein, 15 aa, Borrelia burgdorferi B31
AKFAMEGSILTRSKL

SEQ ID NO: 139678 - protein, 9 aa, Borrelia burgdorferi B31
FAMEGSILT

SEQ ID NO: 139679 - protein, 15 aa, Borrelia burgdorferi B31
LTAKFAMEGSILTRS

SEQ ID NO: 139680 - protein, 9 aa, Borrelia burgdorferi B31
FAMEGSILT

SEQ ID NO: 139681 - protein, 15 aa, Borrelia burgdorferi B31
TLTAKFAMEGSILTR

SEQ ID NO: 139682 - protein, 9 aa, Borrelia burgdorferi B31
FAMEGSILT

SEQ ID NO: 139683 - protein, 15 aa, Borrelia burgdorferi B31
GTLTAKFAMEGSILT

SEQ ID NO: 139684 - protein, 9 aa, Borrelia burgdorferi B31
GTLTAKFAM

SEQ ID NO: 139685 - protein, 15 aa, Borrelia burgdorferi B31
EHMILFFLEKTPVGT

SEQ ID NO: 139686 - protein, 9 aa, Borrelia burgdorferi B31
FFLEKTPVG

SEQ ID NO: 139687 - protein, 15 aa, Borrelia burgdorferi B31
LEHMILFFLEKTPVG

SEQ ID NO: 139688 - protein, 9 aa, Borrelia burgdorferi B31
LFFLEKTPV

SEQ ID NO: 139689 - protein, 15 aa, Borrelia burgdorferi B31
HMILFFLEKTPVGTL

SEQ ID NO: 139690 - protein, 9 aa, Borrelia burgdorferi B31
FFLEKTPVG

SEQ ID NO: 139691 - protein, 15 aa, Borrelia burgdorferi B31
MILFFLEKTPVGTLT

SEQ ID NO: 139692 - protein, 9 aa, Borrelia burgdorferi B31
FFLEKTPVG

SEQ ID NO: 139693 - protein, 15 aa, Borrelia burgdorferi B31
ILFFLEKTPVGTLTA

SEQ ID NO: 139694 - protein, 9 aa, Borrelia burgdorferi B31
FFLEKTPVG

SEQ ID NO: 139695 - protein, 15 aa, Borrelia burgdorferi B31
KFAMEGSILTRSKLI

SEQ ID NO: 139696 - protein, 9 aa, Borrelia burgdorferi B31
FAMEGSILT

SEQ ID NO: 139697 - protein, 15 aa, Borrelia burgdorferi B31
FAMEGSILTRSKLIQ

SEQ ID NO: 139698 - protein, 9 aa, Borrelia burgdorferi B31
FAMEGSILT

SEQ ID NO: 139699 - protein, 15 aa, Borrelia burgdorferi B31
RKEYEITKNAPSLDS

SEQ ID NO: 139700 - protein, 9 aa, Borrelia burgdorferi B31
YEITKNAPS

SEQ ID NO: 139701 - protein, 15 aa, Borrelia burgdorferi B31
KEYEITKNAPSLDSL

SEQ ID NO: 139702 - protein, 9 aa, Borrelia burgdorferi B31
YEITKNAPS

SEQ ID NO: 139703 - protein, 15 aa, Borrelia burgdorferi B31
TRSKLIQAFTNTNKF

SEQ ID NO: 139704 - protein, 9 aa, Borrelia burgdorferi B31
LIQAFTNTN

SEQ ID NO: 139705 - protein, 15 aa, Borrelia burgdorferi B31
RSKLIQAFTNTNKFC

SEQ ID NO: 139706 - protein, 9 aa, Borrelia burgdorferi B31
LIQAFTNTN

SEQ ID NO: 139707 - protein, 15 aa, Borrelia burgdorferi B31
FKGKLVKRMTMIYRS

SEQ ID NO: 139708 - protein, 9 aa, Borrelia burgdorferi B31
LVKRMTMIY

SEQ ID NO: 139709 - protein, 15 aa, Borrelia burgdorferi B31
NFKGKLVKRMTMIYR

SEQ ID NO: 139710 - protein, 9 aa, Borrelia burgdorferi B31
LVKRMTMIY

SEQ ID NO: 139711 - protein, 15 aa, Borrelia burgdorferi B31
KGKLVKRMTMIYRSA

SEQ ID NO: 139712 - protein, 9 aa, Borrelia burgdorferi B31
LVKRMTMIY

SEQ ID NO: 139713 - protein, 15 aa, Borrelia burgdorferi B31
SKLIQAFTNTNKFCI

SEQ ID NO: 139714 - protein, 9 aa, Borrelia burgdorferi B31
LIQAFTNTN

SEQ ID NO: 139715 - protein, 15 aa, Borrelia burgdorferi B31
GKLVKRMTMIYRSAD

SEQ ID NO: 139716 - protein, 9 aa, Borrelia burgdorferi B31
LVKRMTMIY

SEQ ID NO: 139717 - protein, 15 aa, Borrelia burgdorferi B31
IDNRKEYEITKNAPS

SEQ ID NO: 139718 - protein, 9 aa, Borrelia burgdorferi B31
EYEITKNAP

SEQ ID NO: 139719 - protein, 15 aa, Borrelia burgdorferi B31
DNRKEYEITKNAPSL

SEQ ID NO: 139720 - protein, 9 aa, Borrelia burgdorferi B31
YEITKNAPS

SEQ ID NO: 139721 - protein, 15 aa, Borrelia burgdorferi B31
NRKEYEITKNAPSLD

SEQ ID NO: 139722 - protein, 9 aa, Borrelia burgdorferi B31
YEITKNAPS

SEQ ID NO: 139723 - protein, 15 aa, Borrelia burgdorferi B31
LFFLEKTPVGTLTAK

SEQ ID NO: 139724 - protein, 9 aa, Borrelia burgdorferi B31
FFLEKTPVG

SEQ ID NO: 139725 - protein, 15 aa, Borrelia burgdorferi B31
INFKGKLVKRMTMIY

SEQ ID NO: 139726 - protein, 9 aa, Borrelia burgdorferi B31
FKGKLVKRM

SEQ ID NO: 139727 - protein, 15 aa, Borrelia burgdorferi B31
LTRSKLIQAFTNTNK

SEQ ID NO: 139728 - protein, 9 aa, Borrelia burgdorferi B31
LIQAFTNTN

SEQ ID NO: 139729 - protein, 15 aa, Borrelia burgdorferi B31
TRSKLIQAFTNTNKF

SEQ ID NO: 139730 - protein, 9 aa, Borrelia burgdorferi B31
LIQAFTNTN

SEQ ID NO: 139731 - protein, 15 aa, Borrelia burgdorferi B31
RSKLIQAFTNTNKFC

SEQ ID NO: 139732 - protein, 9 aa, Borrelia burgdorferi B31
LIQAFTNTN

SEQ ID NO: 139733 - protein, 15 aa, Borrelia burgdorferi B31
ILTRSKLIQAFTNTN

SEQ ID NO: 139734 - protein, 9 aa, Borrelia burgdorferi B31
KLIQAFTNT

SEQ ID NO: 139735 - protein, 15 aa, Borrelia burgdorferi B31
SKLIQAFTNTNKFCI

SEQ ID NO: 139736 - protein, 9 aa, Borrelia burgdorferi B31
LIQAFTNTN

SEQ ID NO: 139737 - protein, 15 aa, Borrelia burgdorferi B31
KLIQAFTNTNKFCIP

SEQ ID NO: 139738 - protein, 9 aa, Borrelia burgdorferi B31
LIQAFTNTN

SEQ ID NO: 139739 - protein, 15 aa, Borrelia burgdorferi B31
IDPEYLLPPFTSQSG

SEQ ID NO: 139740 - protein, 9 aa, Borrelia burgdorferi B31
LLPPFTSQS

SEQ ID NO: 139741 - protein, 15 aa, Borrelia burgdorferi B31
PEYLLPPFTSQSGSK

SEQ ID NO: 139742 - protein, 9 aa, Borrelia burgdorferi B31
LLPPFTSQS

SEQ ID NO: 139743 - protein, 15 aa, Borrelia burgdorferi B31
DPEYLLPPFTSQSGS

SEQ ID NO: 139744 - protein, 9 aa, Borrelia burgdorferi B31
LLPPFTSQS

SEQ ID NO: 139745 - protein, 15 aa, Borrelia burgdorferi B31
LIQAFTNTNKFCIPD

SEQ ID NO: 139746 - protein, 9 aa, Borrelia burgdorferi B31
LIQAFTNTN

SEQ ID NO: 139747 - protein, 15 aa, Borrelia burgdorferi B31
EYLLPPFTSQSGSKE

SEQ ID NO: 139748 - protein, 9 aa, Borrelia burgdorferi B31
LLPPFTSQS

SEQ ID NO: 139749 - protein, 15 aa, Borrelia burgdorferi B31
EIDPEYLLPPFTSQS

SEQ ID NO: 139750 - protein, 9 aa, Borrelia burgdorferi B31
YLLPPFTSQ

SEQ ID NO: 139751 - protein, 15 aa, Borrelia burgdorferi B31
LEHMILFFLEKTPVG

SEQ ID NO: 139752 - protein, 9 aa, Borrelia burgdorferi B31
ILFFLEKTP

SEQ ID NO: 139753 - protein, 15 aa, Borrelia burgdorferi B31
EHMILFFLEKTPVGT

SEQ ID NO: 139754 - protein, 9 aa, Borrelia burgdorferi B31
FFLEKTPVG

SEQ ID NO: 139755 - protein, 15 aa, Borrelia burgdorferi B31
HMILFFLEKTPVGTL

SEQ ID NO: 139756 - protein, 9 aa, Borrelia burgdorferi B31
FFLEKTPVG

SEQ ID NO: 139757 - protein, 15 aa, Borrelia burgdorferi B31
YLLPPFTSQSGSKET

SEQ ID NO: 139758 - protein, 9 aa, Borrelia burgdorferi B31
LLPPFTSQS

SEQ ID NO: 139759 - protein, 15 aa, Borrelia burgdorferi B31
YRSADTWYTWYWAEE

SEQ ID NO: 139760 - protein, 9 aa, Borrelia burgdorferi B31
YRSADTWYT

SEQ ID NO: 139761 - protein, 15 aa, Borrelia burgdorferi B31
KRMTMIYRSADTWYT

SEQ ID NO: 139762 - protein, 9 aa, Borrelia burgdorferi B31
MTMIYRSAD

SEQ ID NO: 139763 - protein, 15 aa, Borrelia burgdorferi B31
ADTWYTWYWAEEIMS

SEQ ID NO: 139764 - protein, 9 aa, Borrelia burgdorferi B31
WYTWYWAEE

SEQ ID NO: 139765 - protein, 15 aa, Borrelia burgdorferi B31
RKEYEITKNAPSLDS

SEQ ID NO: 139766 - protein, 9 aa, Borrelia burgdorferi B31
YEITKNAPS

SEQ ID NO: 139767 - protein, 15 aa, Borrelia burgdorferi B31
KEYEITKNAPSLDSL

SEQ ID NO: 139768 - protein, 9 aa, Borrelia burgdorferi B31
YEITKNAPS

SEQ ID NO: 139769 - protein, 15 aa, Borrelia burgdorferi B31
RSADTWYTWYWAEEI

SEQ ID NO: 139770 - protein, 9 aa, Borrelia burgdorferi B31
WYTWYWAEE

SEQ ID NO: 139771 - protein, 15 aa, Borrelia burgdorferi B31
RMTMIYRSADTWYTW

SEQ ID NO: 139772 - protein, 9 aa, Borrelia burgdorferi B31
YRSADTWYT

SEQ ID NO: 139773 - protein, 15 aa, Borrelia burgdorferi B31
MTMIYRSADTWYTWY

SEQ ID NO: 139774 - protein, 9 aa, Borrelia burgdorferi B31
YRSADTWYT

SEQ ID NO: 139775 - protein, 15 aa, Borrelia burgdorferi B31
TMIYRSADTWYTWYW

SEQ ID NO: 139776 - protein, 9 aa, Borrelia burgdorferi B31
YRSADTWYT

SEQ ID NO: 139777 - protein, 15 aa, Borrelia burgdorferi B31
DTWYTWYWAEEIMSP

SEQ ID NO: 139778 - protein, 9 aa, Borrelia burgdorferi B31
WYWAEEIMS

SEQ ID NO: 139779 - protein, 15 aa, Borrelia burgdorferi B31
MIYRSADTWYTWYWA

SEQ ID NO: 139780 - protein, 9 aa, Borrelia burgdorferi B31
YRSADTWYT

SEQ ID NO: 139781 - protein, 15 aa, Borrelia burgdorferi B31
TRSKLIQAFTNTNKF

SEQ ID NO: 139782 - protein, 9 aa, Borrelia burgdorferi B31
IQAFTNTNK

SEQ ID NO: 139783 - protein, 15 aa, Borrelia burgdorferi B31
LTRSKLIQAFTNTNK

SEQ ID NO: 139784 - protein, 9 aa, Borrelia burgdorferi B31
LIQAFTNTN

SEQ ID NO: 139785 - protein, 15 aa, Borrelia burgdorferi B31
RSKLIQAFTNTNKFC

SEQ ID NO: 139786 - protein, 9 aa, Borrelia burgdorferi B31
IQAFTNTNK

SEQ ID NO: 139787 - protein, 15 aa, Borrelia burgdorferi B31
SKLIQAFTNTNKFCI

SEQ ID NO: 139788 - protein, 9 aa, Borrelia burgdorferi B31
IQAFTNTNK

SEQ ID NO: 139789 - protein, 15 aa, Borrelia burgdorferi B31
SADTWYTWYWAEEIM

SEQ ID NO: 139790 - protein, 9 aa, Borrelia burgdorferi B31
YTWYWAEEI

SEQ ID NO: 139791 - protein, 15 aa, Borrelia burgdorferi B31
TWYTWYWAEEIMSPF

SEQ ID NO: 139792 - protein, 9 aa, Borrelia burgdorferi B31
YTWYWAEEI

SEQ ID NO: 139793 - protein, 15 aa, Borrelia burgdorferi B31
EYEITKNAPSLDSLI

SEQ ID NO: 139794 - protein, 9 aa, Borrelia burgdorferi B31
TKNAPSLDS

SEQ ID NO: 139795 - protein, 15 aa, Borrelia burgdorferi B31
YEITKNAPSLDSLIE

SEQ ID NO: 139796 - protein, 9 aa, Borrelia burgdorferi B31
TKNAPSLDS

SEQ ID NO: 139797 - protein, 15 aa, Borrelia burgdorferi B31
KLIQAFTNTNKFCIP

SEQ ID NO: 139798 - protein, 9 aa, Borrelia burgdorferi B31
IQAFTNTNK

SEQ ID NO: 139799 - protein, 15 aa, Borrelia burgdorferi B31
WYTWYWAEEIMSPFI

SEQ ID NO: 139800 - protein, 9 aa, Borrelia burgdorferi B31
WYWAEEIMS

SEQ ID NO: 139801 - protein, 15 aa, Borrelia burgdorferi B31
IYRSADTWYTWYWAE

SEQ ID NO: 139802 - protein, 9 aa, Borrelia burgdorferi B31
YRSADTWYT

SEQ ID NO: 139803 - protein, 15 aa, Borrelia burgdorferi B31
NRKEYEITKNAPSLD

SEQ ID NO: 139804 - protein, 9 aa, Borrelia burgdorferi B31
YEITKNAPS

SEQ ID NO: 139805 - protein, 15 aa, Borrelia burgdorferi B31
IDNRKEYEITKNAPS

SEQ ID NO: 139806 - protein, 9 aa, Borrelia burgdorferi B31
EYEITKNAP

SEQ ID NO: 139807 - protein, 15 aa, Borrelia burgdorferi B31
DNRKEYEITKNAPSL

SEQ ID NO: 139808 - protein, 9 aa, Borrelia burgdorferi B31
YEITKNAPS

SEQ ID NO: 139809 - protein, 15 aa, Borrelia burgdorferi B31
LIQAFTNTNKFCIPD

SEQ ID NO: 139810 - protein, 9 aa, Borrelia burgdorferi B31
IQAFTNTNK

SEQ ID NO: 139811 - protein, 15 aa, Borrelia burgdorferi B31
GKLVKRMTMIYRSAD

SEQ ID NO: 139812 - protein, 9 aa, Borrelia burgdorferi B31
VKRMTMIYR

SEQ ID NO: 139813 - protein, 15 aa, Borrelia burgdorferi B31
KLVKRMTMIYRSADT

SEQ ID NO: 139814 - protein, 9 aa, Borrelia burgdorferi B31
VKRMTMIYR

SEQ ID NO: 139815 - protein, 15 aa, Borrelia burgdorferi B31
YTWYWAEEIMSPFIT

SEQ ID NO: 139816 - protein, 9 aa, Borrelia burgdorferi B31
WYWAEEIMS

SEQ ID NO: 139817 - protein, 15 aa, Borrelia burgdorferi B31
SKLIQAFTNTNKFCI

SEQ ID NO: 139818 - protein, 9 aa, Borrelia burgdorferi B31
IQAFTNTNK

SEQ ID NO: 139819 - protein, 15 aa, Borrelia burgdorferi B31
KLIQAFTNTNKFCIP

SEQ ID NO: 139820 - protein, 9 aa, Borrelia burgdorferi B31
FTNTNKFCI

SEQ ID NO: 139821 - protein, 15 aa, Borrelia burgdorferi B31
LIQAFTNTNKFCIPD

SEQ ID NO: 139822 - protein, 9 aa, Borrelia burgdorferi B31
FTNTNKFCI

SEQ ID NO: 139823 - protein, 15 aa, Borrelia burgdorferi B31
IQAFTNTNKFCIPDG

SEQ ID NO: 139824 - protein, 9 aa, Borrelia burgdorferi B31
FTNTNKFCI

SEQ ID NO: 139825 - protein, 15 aa, Borrelia burgdorferi B31
QAFTNTNKFCIPDGR

SEQ ID NO: 139826 - protein, 9 aa, Borrelia burgdorferi B31
FTNTNKFCI

SEQ ID NO: 139827 - protein, 15 aa, Borrelia burgdorferi B31
IKKKLENTKTRIQFR

SEQ ID NO: 139828 - protein, 9 aa, Borrelia burgdorferi B31
LENTKTRIQ

SEQ ID NO: 139829 - protein, 15 aa, Borrelia burgdorferi B31
KKKLENTKTRIQFRN

SEQ ID NO: 139830 - protein, 9 aa, Borrelia burgdorferi B31
LENTKTRIQ

SEQ ID NO: 139831 - protein, 15 aa, Borrelia burgdorferi B31
KKLENTKTRIQFRNG

SEQ ID NO: 139832 - protein, 9 aa, Borrelia burgdorferi B31
LENTKTRIQ

SEQ ID NO: 139833 - protein, 15 aa, Borrelia burgdorferi B31
EIKKKLENTKTRIQF

SEQ ID NO: 139834 - protein, 9 aa, Borrelia burgdorferi B31
LENTKTRIQ

SEQ ID NO: 139835 - protein, 15 aa, Borrelia burgdorferi B31
TEIKKKLENTKTRIQ

SEQ ID NO: 139836 - protein, 9 aa, Borrelia burgdorferi B31
KLENTKTRI

SEQ ID NO: 139837 - protein, 15 aa, Borrelia burgdorferi B31
KFAMEGSILTRSKLI

SEQ ID NO: 139838 - protein, 9 aa, Borrelia burgdorferi B31
GSILTRSKL

SEQ ID NO: 139839 - protein, 15 aa, Borrelia burgdorferi B31
MEGSILTRSKLIQAF

SEQ ID NO: 139840 - protein, 9 aa, Borrelia burgdorferi B31
SILTRSKLI

SEQ ID NO: 139841 - protein, 15 aa, Borrelia burgdorferi B31
AMEGSILTRSKLIQA

SEQ ID NO: 139842 - protein, 9 aa, Borrelia burgdorferi B31
SILTRSKLI

SEQ ID NO: 139843 - protein, 15 aa, Borrelia burgdorferi B31
FAMEGSILTRSKLIQ

SEQ ID NO: 139844 - protein, 9 aa, Borrelia burgdorferi B31
SILTRSKLI

SEQ ID NO: 139845 - protein, 15 aa, Borrelia burgdorferi B31
EGSILTRSKLIQAFT

SEQ ID NO: 139846 - protein, 9 aa, Borrelia burgdorferi B31
SILTRSKLI

SEQ ID NO: 139847 - protein, 15 aa, Borrelia burgdorferi B31
RMTMIYRSADTWYTW

SEQ ID NO: 139848 - protein, 9 aa, Borrelia burgdorferi B31
YRSADTWYT

SEQ ID NO: 139849 - protein, 15 aa, Borrelia burgdorferi B31
YAYKVLGISSAPKLS

SEQ ID NO: 139850 - protein, 9 aa, Borrelia burgdorferi B31
LGISSAPKL

SEQ ID NO: 139851 - protein, 15 aa, Borrelia burgdorferi B31
AYKVLGISSAPKLSG

SEQ ID NO: 139852 - protein, 9 aa, Borrelia burgdorferi B31
LGISSAPKL

SEQ ID NO: 139853 - protein, 15 aa, Borrelia burgdorferi B31
YKVLGISSAPKLSGR

SEQ ID NO: 139854 - protein, 9 aa, Borrelia burgdorferi B31
LGISSAPKL

SEQ ID NO: 139855 - protein, 15 aa, Borrelia burgdorferi B31
CYAYKVLGISSAPKL

SEQ ID NO: 139856 - protein, 9 aa, Borrelia burgdorferi B31
VLGISSAPK

SEQ ID NO: 139857 - protein, 15 aa, Borrelia burgdorferi B31
KVLGISSAPKLSGRF

SEQ ID NO: 139858 - protein, 9 aa, Borrelia burgdorferi B31
LGISSAPKL

SEQ ID NO: 139859 - protein, 15 aa, Borrelia burgdorferi B31
VLGISSAPKLSGRFL

SEQ ID NO: 139860 - protein, 9 aa, Borrelia burgdorferi B31
LGISSAPKL

SEQ ID NO: 139861 - protein, 15 aa, Borrelia burgdorferi B31
LGISSAPKLSGRFLR

SEQ ID NO: 139862 - protein, 9 aa, Borrelia burgdorferi B31
LGISSAPKL

SEQ ID NO: 139863 - protein, 15 aa, Borrelia burgdorferi B31
NFKGKLVKRMTMIYR

SEQ ID NO: 139864 - protein, 9 aa, Borrelia burgdorferi B31
LVKRMTMIY

SEQ ID NO: 139865 - protein, 15 aa, Borrelia burgdorferi B31
FKGKLVKRMTMIYRS

SEQ ID NO: 139866 - protein, 9 aa, Borrelia burgdorferi B31
VKRMTMIYR

SEQ ID NO: 139867 - protein, 15 aa, Borrelia burgdorferi B31
KGKLVKRMTMIYRSA

SEQ ID NO: 139868 - protein, 9 aa, Borrelia burgdorferi B31
VKRMTMIYR

SEQ ID NO: 139869 - protein, 15 aa, Borrelia burgdorferi B31
GKLVKRMTMIYRSAD

SEQ ID NO: 139870 - protein, 9 aa, Borrelia burgdorferi B31
VKRMTMIYR

SEQ ID NO: 139871 - protein, 15 aa, Borrelia burgdorferi B31
KLVKRMTMIYRSADT

SEQ ID NO: 139872 - protein, 9 aa, Borrelia burgdorferi B31
VKRMTMIYR

SEQ ID NO: 139873 - protein, 15 aa, Borrelia burgdorferi B31
INFKGKLVKRMTMIY

SEQ ID NO: 139874 - protein, 9 aa, Borrelia burgdorferi B31
GKLVKRMTM

SEQ ID NO: 139875 - protein, 15 aa, Borrelia burgdorferi B31
CYAYKVLGISSAPKL

SEQ ID NO: 139876 - protein, 9 aa, Borrelia burgdorferi B31
YKVLGISSA

SEQ ID NO: 139877 - protein, 15 aa, Borrelia burgdorferi B31
YAYKVLGISSAPKLS

SEQ ID NO: 139878 - protein, 9 aa, Borrelia burgdorferi B31
LGISSAPKL

SEQ ID NO: 139879 - protein, 15 aa, Borrelia burgdorferi B31
LVKRMTMIYRSADTW

SEQ ID NO: 139880 - protein, 9 aa, Borrelia burgdorferi B31
VKRMTMIYR

SEQ ID NO: 139881 - protein, 15 aa, Borrelia burgdorferi B31
TRIQFRNGNKIDSLG

SEQ ID NO: 139882 - protein, 9 aa, Borrelia burgdorferi B31
IQFRNGNKI

SEQ ID NO: 139883 - protein, 15 aa, Borrelia burgdorferi B31
SRINFKGKLVKRMTM

SEQ ID NO: 139884 - protein, 9 aa, Borrelia burgdorferi B31
INFKGKLVK

SEQ ID NO: 139885 - protein, 15 aa, Borrelia burgdorferi B31
AYKVLGISSAPKLSG

SEQ ID NO: 139886 - protein, 9 aa, Borrelia burgdorferi B31
LGISSAPKL

SEQ ID NO: 139887 - protein, 15 aa, Borrelia burgdorferi B31
YKVLGISSAPKLSGR

SEQ ID NO: 139888 - protein, 9 aa, Borrelia burgdorferi B31
LGISSAPKL

SEQ ID NO: 139889 - protein, 15 aa, Borrelia burgdorferi B31
IQFRNGNKIDSLGYQ

SEQ ID NO: 139890 - protein, 9 aa, Borrelia burgdorferi B31
FRNGNKIDS

SEQ ID NO: 139891 - protein, 15 aa, Borrelia burgdorferi B31
RINFKGKLVKRMTMI

SEQ ID NO: 139892 - protein, 9 aa, Borrelia burgdorferi B31
GKLVKRMTM

SEQ ID NO: 139893 - protein, 15 aa, Borrelia burgdorferi B31
VKRMTMIYRSADTWY

SEQ ID NO: 139894 - protein, 9 aa, Borrelia burgdorferi B31
VKRMTMIYR

SEQ ID NO: 139895 - protein, 15 aa, Borrelia burgdorferi B31
KTRIQFRNGNKIDSL

SEQ ID NO: 139896 - protein, 9 aa, Borrelia burgdorferi B31
IQFRNGNKI

SEQ ID NO: 139897 - protein, 15 aa, Borrelia burgdorferi B31
RIQFRNGNKIDSLGY

SEQ ID NO: 139898 - protein, 9 aa, Borrelia burgdorferi B31
IQFRNGNKI

SEQ ID NO: 139899 - protein, 15 aa, Borrelia burgdorferi B31
TKTRIQFRNGNKIDS

SEQ ID NO: 139900 - protein, 9 aa, Borrelia burgdorferi B31
IQFRNGNKI

SEQ ID NO: 139901 - protein, 15 aa, Borrelia burgdorferi B31
FSRINFKGKLVKRMT

SEQ ID NO: 139902 - protein, 9 aa, Borrelia burgdorferi B31
INFKGKLVK

SEQ ID NO: 139903 - protein, 15 aa, Borrelia burgdorferi B31
SKLIQAFTNTNKFCI

SEQ ID NO: 139904 - protein, 9 aa, Borrelia burgdorferi B31
IQAFTNTNK

SEQ ID NO: 139905 - protein, 15 aa, Borrelia burgdorferi B31
KEYEITKNAPSLDSL

SEQ ID NO: 139906 - protein, 9 aa, Borrelia burgdorferi B31
ITKNAPSLD

SEQ ID NO: 139907 - protein, 15 aa, Borrelia burgdorferi B31
RKEYEITKNAPSLDS

SEQ ID NO: 139908 - protein, 9 aa, Borrelia burgdorferi B31
ITKNAPSLD

SEQ ID NO: 139909 - protein, 15 aa, Borrelia burgdorferi B31
KLIQAFTNTNKFCIP

SEQ ID NO: 139910 - protein, 9 aa, Borrelia burgdorferi B31
FTNTNKFCI

SEQ ID NO: 139911 - protein, 15 aa, Borrelia burgdorferi B31
FAMEGSILTRSKLIQ

SEQ ID NO: 139912 - protein, 9 aa, Borrelia burgdorferi B31
FAMEGSILT

SEQ ID NO: 139913 - protein, 15 aa, Borrelia burgdorferi B31
EYEITKNAPSLDSLI

SEQ ID NO: 139914 - protein, 9 aa, Borrelia burgdorferi B31
ITKNAPSLD

SEQ ID NO: 139915 - protein, 15 aa, Borrelia burgdorferi B31
YEITKNAPSLDSLIE

SEQ ID NO: 139916 - protein, 9 aa, Borrelia burgdorferi B31
ITKNAPSLD

SEQ ID NO: 139917 - protein, 15 aa, Borrelia burgdorferi B31
NCYAYKVLGISSAPK

SEQ ID NO: 139918 - protein, 9 aa, Borrelia burgdorferi B31
YKVLGISSA

SEQ ID NO: 139919 - protein, 15 aa, Borrelia burgdorferi B31
FKGKLVKRMTMIYRS

SEQ ID NO: 139920 - protein, 9 aa, Borrelia burgdorferi B31
VKRMTMIYR

SEQ ID NO: 139921 - protein, 15 aa, Borrelia burgdorferi B31
KLVKRMTMIYRSADT

SEQ ID NO: 139922 - protein, 9 aa, Borrelia burgdorferi B31
VKRMTMIYR

SEQ ID NO: 139923 - protein, 15 aa, Borrelia burgdorferi B31
GKLVKRMTMIYRSAD

SEQ ID NO: 139924 - protein, 9 aa, Borrelia burgdorferi B31
VKRMTMIYR

SEQ ID NO: 139925 - protein, 15 aa, Borrelia burgdorferi B31
NFKGKLVKRMTMIYR

SEQ ID NO: 139926 - protein, 9 aa, Borrelia burgdorferi B31
FKGKLVKRM

SEQ ID NO: 139927 - protein, 15 aa, Borrelia burgdorferi B31
KGKLVKRMTMIYRSA

SEQ ID NO: 139928 - protein, 9 aa, Borrelia burgdorferi B31
VKRMTMIYR

SEQ ID NO: 139929 - protein, 15 aa, Borrelia burgdorferi B31
VKRMTMIYRSADTWY

SEQ ID NO: 139930 - protein, 9 aa, Borrelia burgdorferi B31
VKRMTMIYR

SEQ ID NO: 139931 - protein, 15 aa, Borrelia burgdorferi B31
LVKRMTMIYRSADTW

SEQ ID NO: 139932 - protein, 9 aa, Borrelia burgdorferi B31
VKRMTMIYR

SEQ ID NO: 139933 - protein, 15 aa, Borrelia burgdorferi B31
NCYAYKVLGISSAPK

SEQ ID NO: 139934 - protein, 9 aa, Borrelia burgdorferi B31
YKVLGISSA

SEQ ID NO: 139935 - protein, 15 aa, Borrelia burgdorferi B31
YAYKVLGISSAPKLS

SEQ ID NO: 139936 - protein, 9 aa, Borrelia burgdorferi B31
VLGISSAPK

SEQ ID NO: 139937 - protein, 15 aa, Borrelia burgdorferi B31
CYAYKVLGISSAPKL

SEQ ID NO: 139938 - protein, 9 aa, Borrelia burgdorferi B31
VLGISSAPK

SEQ ID NO: 139939 - protein, 15 aa, Borrelia burgdorferi B31
AYKVLGISSAPKLSG

SEQ ID NO: 139940 - protein, 9 aa, Borrelia burgdorferi B31
VLGISSAPK

SEQ ID NO: 139941 - protein, 15 aa, Borrelia burgdorferi B31
LEHMILFFLEKTPVG

SEQ ID NO: 139942 - protein, 9 aa, Borrelia burgdorferi B31
LFFLEKTPV

SEQ ID NO: 139943 - protein, 15 aa, Borrelia burgdorferi B31
YKVLGISSAPKLSGR

SEQ ID NO: 139944 - protein, 9 aa, Borrelia burgdorferi B31
VLGISSAPK

SEQ ID NO: 139945 - protein, 15 aa, Borrelia burgdorferi B31
EHMILFFLEKTPVGT

SEQ ID NO: 139946 - protein, 9 aa, Borrelia burgdorferi B31
LFFLEKTPV

SEQ ID NO: 139947 - protein, 15 aa, Borrelia burgdorferi B31
HMILFFLEKTPVGTL

SEQ ID NO: 139948 - protein, 9 aa, Borrelia burgdorferi B31
LFFLEKTPV

SEQ ID NO: 139949 - protein, 15 aa, Borrelia burgdorferi B31
MILFFLEKTPVGTLT

SEQ ID NO: 139950 - protein, 9 aa, Borrelia burgdorferi B31
LFFLEKTPV

SEQ ID NO: 139951 - protein, 15 aa, Borrelia burgdorferi B31
DFSRINFKGKLVKRM

SEQ ID NO: 139952 - protein, 9 aa, Borrelia burgdorferi B31
INFKGKLVK

SEQ ID NO: 139953 - protein, 15 aa, Borrelia burgdorferi B31
FSRINFKGKLVKRMT

SEQ ID NO: 139954 - protein, 9 aa, Borrelia burgdorferi B31
INFKGKLVK

SEQ ID NO: 139955 - protein, 15 aa, Borrelia burgdorferi B31
LDFSRINFKGKLVKR

SEQ ID NO: 139956 - protein, 9 aa, Borrelia burgdorferi B31
INFKGKLVK

SEQ ID NO: 139957 - protein, 15 aa, Borrelia burgdorferi B31
YLEHMILFFLEKTPV

SEQ ID NO: 139958 - protein, 9 aa, Borrelia burgdorferi B31
ILFFLEKTP

SEQ ID NO: 139959 - protein, 15 aa, Borrelia burgdorferi B31
SRINFKGKLVKRMTM

SEQ ID NO: 139960 - protein, 9 aa, Borrelia burgdorferi B31
INFKGKLVK

SEQ ID NO: 139961 - protein, 15 aa, Borrelia burgdorferi B31
LSGRFLRHYDSGGST

SEQ ID NO: 139962 - protein, 9 aa, Borrelia burgdorferi B31
LRHYDSGGS

SEQ ID NO: 139963 - protein, 15 aa, Borrelia burgdorferi B31
KLSGRFLRHYDSGGS

SEQ ID NO: 139964 - protein, 9 aa, Borrelia burgdorferi B31
FLRHYDSGG

SEQ ID NO: 139965 - protein, 15 aa, Borrelia burgdorferi B31
SGRFLRHYDSGGSTD

SEQ ID NO: 139966 - protein, 9 aa, Borrelia burgdorferi B31
LRHYDSGGS

SEQ ID NO: 139967 - protein, 15 aa, Borrelia burgdorferi B31
GRFLRHYDSGGSTDS

SEQ ID NO: 139968 - protein, 9 aa, Borrelia burgdorferi B31
LRHYDSGGS

SEQ ID NO: 139969 - protein, 15 aa, Borrelia burgdorferi B31
DLDFSRINFKGKLVK

SEQ ID NO: 139970 - protein, 9 aa, Borrelia burgdorferi B31
RINFKGKLV

SEQ ID NO: 139971 - protein, 15 aa, Borrelia burgdorferi B31
ILFFLEKTPVGTLTA

SEQ ID NO: 139972 - protein, 9 aa, Borrelia burgdorferi B31
LFFLEKTPV

SEQ ID NO: 139973 - protein, 15 aa, Borrelia burgdorferi B31
RINFKGKLVKRMTMI

SEQ ID NO: 139974 - protein, 9 aa, Borrelia burgdorferi B31
INFKGKLVK

SEQ ID NO: 139975 - protein, 15 aa, Borrelia burgdorferi B31
RFLRHYDSGGSTDSD

SEQ ID NO: 139976 - protein, 9 aa, Borrelia burgdorferi B31
LRHYDSGGS

SEQ ID NO: 139977 - protein, 15 aa, Borrelia burgdorferi B31
LTRSKLIQAFTNTNK

SEQ ID NO: 139978 - protein, 9 aa, Borrelia burgdorferi B31
LIQAFTNTN

SEQ ID NO: 139979 - protein, 15 aa, Borrelia burgdorferi B31
FSRINFKGKLVKRMT

SEQ ID NO: 139980 - protein, 9 aa, Borrelia burgdorferi B31
FKGKLVKRM

SEQ ID NO: 139981 - protein, 15 aa, Borrelia burgdorferi B31
DFSRINFKGKLVKRM

SEQ ID NO: 139982 - protein, 9 aa, Borrelia burgdorferi B31
INFKGKLVK

SEQ ID NO: 139983 - protein, 15 aa, Borrelia burgdorferi B31
SRINFKGKLVKRMTM

SEQ ID NO: 139984 - protein, 9 aa, Borrelia burgdorferi B31
FKGKLVKRM

SEQ ID NO: 139985 - protein, 15 aa, Borrelia burgdorferi B31
RINFKGKLVKRMTMI

SEQ ID NO: 139986 - protein, 9 aa, Borrelia burgdorferi B31
FKGKLVKRM

SEQ ID NO: 139987 - protein, 15 aa, Borrelia burgdorferi B31
INFKGKLVKRMTMIY

SEQ ID NO: 139988 - protein, 9 aa, Borrelia burgdorferi B31
FKGKLVKRM

SEQ ID NO: 139989 - protein, 15 aa, Borrelia burgdorferi B31
FKGKLVKRMTMIYRS

SEQ ID NO: 139990 - protein, 9 aa, Borrelia burgdorferi B31
FKGKLVKRM

SEQ ID NO: 139991 - protein, 15 aa, Borrelia burgdorferi B31
NFKGKLVKRMTMIYR

SEQ ID NO: 139992 - protein, 9 aa, Borrelia burgdorferi B31
FKGKLVKRM

SEQ ID NO: 139993 - protein, 15 aa, Borrelia burgdorferi B31
KRMTMIYRSADTWYT

SEQ ID NO: 139994 - protein, 9 aa, Borrelia burgdorferi B31
MTMIYRSAD

SEQ ID NO: 139995 - protein, 15 aa, Borrelia burgdorferi B31
AKFAMEGSILTRSKL

SEQ ID NO: 139996 - protein, 9 aa, Borrelia burgdorferi B31
FAMEGSILT

SEQ ID NO: 139997 - protein, 15 aa, Borrelia burgdorferi B31
TAKFAMEGSILTRSK

SEQ ID NO: 139998 - protein, 9 aa, Borrelia burgdorferi B31
FAMEGSILT

SEQ ID NO: 139999 - protein, 15 aa, Borrelia burgdorferi B31
RMTMIYRSADTWYTW

SEQ ID NO: 140000 - protein, 9 aa, Borrelia burgdorferi B31
YRSADTWYT

SEQ ID NO: 140001 - protein, 15 aa, Borrelia burgdorferi B31
MTMIYRSADTWYTWY

SEQ ID NO: 140002 - protein, 9 aa, Borrelia burgdorferi B31
YRSADTWYT

SEQ ID NO: 140003 - protein, 15 aa, Borrelia burgdorferi B31
TMIYRSADTWYTWYW

SEQ ID NO: 140004 - protein, 9 aa, Borrelia burgdorferi B31
YRSADTWYT

SEQ ID NO: 140005 - protein, 15 aa, Borrelia burgdorferi B31
MIYRSADTWYTWYWA

SEQ ID NO: 140006 - protein, 9 aa, Borrelia burgdorferi B31
YRSADTWYT

SEQ ID NO: 140007 - protein, 15 aa, Borrelia burgdorferi B31
LTAKFAMEGSILTRS

SEQ ID NO: 140008 - protein, 9 aa, Borrelia burgdorferi B31
FAMEGSILT

SEQ ID NO: 140009 - protein, 15 aa, Borrelia burgdorferi B31
TLTAKFAMEGSILTR

SEQ ID NO: 140010 - protein, 9 aa, Borrelia burgdorferi B31
FAMEGSILT

SEQ ID NO: 140011 - protein, 15 aa, Borrelia burgdorferi B31
KILIIVVLTSTFLLG

SEQ ID NO: 140012 - protein, 9 aa, Borrelia burgdorferi B31
IVVLTSTFL

SEQ ID NO: 140013 - protein, 15 aa, Borrelia burgdorferi B31
IKILIIVVLTSTFLL

SEQ ID NO: 140014 - protein, 9 aa, Borrelia burgdorferi B31
IVVLTSTFL

SEQ ID NO: 140015 - protein, 15 aa, Borrelia burgdorferi B31
ILIIVVLTSTFLLGI

SEQ ID NO: 140016 - protein, 9 aa, Borrelia burgdorferi B31
IVVLTSTFL

SEQ ID NO: 140017 - protein, 15 aa, Borrelia burgdorferi B31
LIIVVLTSTFLLGII

SEQ ID NO: 140018 - protein, 9 aa, Borrelia burgdorferi B31
IVVLTSTFL

SEQ ID NO: 140019 - protein, 15 aa, Borrelia burgdorferi B31
KIKILIIVVLTSTFL

SEQ ID NO: 140020 - protein, 9 aa, Borrelia burgdorferi B31
IKILIIVVL

SEQ ID NO: 140021 - protein, 15 aa, Borrelia burgdorferi B31
IIVVLTSTFLLGIIF

SEQ ID NO: 140022 - protein, 9 aa, Borrelia burgdorferi B31
IVVLTSTFL

SEQ ID NO: 140023 - protein, 15 aa, Borrelia burgdorferi B31
IVVLTSTFLLGIIFS

SEQ ID NO: 140024 - protein, 9 aa, Borrelia burgdorferi B31
IVVLTSTFL

SEQ ID NO: 140025 - protein, 15 aa, Borrelia burgdorferi B31
KEKIKILIIVVLTST

SEQ ID NO: 140026 - protein, 9 aa, Borrelia burgdorferi B31
IKILIIVVL

SEQ ID NO: 140027 - protein, 15 aa, Borrelia burgdorferi B31
EKIKILIIVVLTSTF

SEQ ID NO: 140028 - protein, 9 aa, Borrelia burgdorferi B31
IKILIIVVL

SEQ ID NO: 140029 - protein, 15 aa, Borrelia burgdorferi B31
NKEKIKILIIVVLTS

SEQ ID NO: 140030 - protein, 9 aa, Borrelia burgdorferi B31
IKILIIVVL

SEQ ID NO: 140031 - protein, 15 aa, Borrelia burgdorferi B31
INKEKIKILIIVVLT

SEQ ID NO: 140032 - protein, 9 aa, Borrelia burgdorferi B31
IKILIIVVL

SEQ ID NO: 140033 - protein, 15 aa, Borrelia burgdorferi B31
SINKEKIKILIIVVL

SEQ ID NO: 140034 - protein, 9 aa, Borrelia burgdorferi B31
INKEKIKIL

SEQ ID NO: 140035 - protein, 15 aa, Borrelia burgdorferi B31
KIETELEGTLTKLGK

SEQ ID NO: 140036 - protein, 9 aa, Borrelia burgdorferi B31
LEGTLTKLG

SEQ ID NO: 140037 - protein, 15 aa, Borrelia burgdorferi B31
SKIETELEGTLTKLG

SEQ ID NO: 140038 - protein, 9 aa, Borrelia burgdorferi B31
ETELEGTLT

SEQ ID NO: 140039 - protein, 15 aa, Borrelia burgdorferi B31
IETELEGTLTKLGKD

SEQ ID NO: 140040 - protein, 9 aa, Borrelia burgdorferi B31
LEGTLTKLG

SEQ ID NO: 140041 - protein, 15 aa, Borrelia burgdorferi B31
ETELEGTLTKLGKDW

SEQ ID NO: 140042 - protein, 9 aa, Borrelia burgdorferi B31
LEGTLTKLG

SEQ ID NO: 140043 - protein, 15 aa, Borrelia burgdorferi B31
TELEGTLTKLGKDWI

SEQ ID NO: 140044 - protein, 9 aa, Borrelia burgdorferi B31
LEGTLTKLG

SEQ ID NO: 140045 - protein, 15 aa, Borrelia burgdorferi B31
NKNKGVFMTKPKIFS

SEQ ID NO: 140046 - protein, 9 aa, Borrelia burgdorferi B31
VFMTKPKIF

SEQ ID NO: 140047 - protein, 15 aa, Borrelia burgdorferi B31
NKGVFMTKPKIFSIN

SEQ ID NO: 140048 - protein, 9 aa, Borrelia burgdorferi B31
FMTKPKIFS

SEQ ID NO: 140049 - protein, 15 aa, Borrelia burgdorferi B31
KGVFMTKPKIFSINK

SEQ ID NO: 140050 - protein, 9 aa, Borrelia burgdorferi B31
FMTKPKIFS

SEQ ID NO: 140051 - protein, 15 aa, Borrelia burgdorferi B31
KNKGVFMTKPKIFSI

SEQ ID NO: 140052 - protein, 9 aa, Borrelia burgdorferi B31
FMTKPKIFS

SEQ ID NO: 140053 - protein, 15 aa, Borrelia burgdorferi B31
KDEYYYTTSKWTFFD

SEQ ID NO: 140054 - protein, 9 aa, Borrelia burgdorferi B31
YYYTTSKWT

SEQ ID NO: 140055 - protein, 15 aa, Borrelia burgdorferi B31
DKDEYYYTTSKWTFF

SEQ ID NO: 140056 - protein, 9 aa, Borrelia burgdorferi B31
YYYTTSKWT

SEQ ID NO: 140057 - protein, 15 aa, Borrelia burgdorferi B31
DEYYYTTSKWTFFDV

SEQ ID NO: 140058 - protein, 9 aa, Borrelia burgdorferi B31
YYYTTSKWT

SEQ ID NO: 140059 - protein, 15 aa, Borrelia burgdorferi B31
GVFMTKPKIFSINKE

SEQ ID NO: 140060 - protein, 9 aa, Borrelia burgdorferi B31
FMTKPKIFS

SEQ ID NO: 140061 - protein, 15 aa, Borrelia burgdorferi B31
LEGTLTKLGKDWILT

SEQ ID NO: 140062 - protein, 9 aa, Borrelia burgdorferi B31
LEGTLTKLG

SEQ ID NO: 140063 - protein, 15 aa, Borrelia burgdorferi B31
ELEGTLTKLGKDWIL

SEQ ID NO: 140064 - protein, 9 aa, Borrelia burgdorferi B31
LEGTLTKLG

SEQ ID NO: 140065 - protein, 15 aa, Borrelia burgdorferi B31
KQINKNKGVFMTKPK

SEQ ID NO: 140066 - protein, 9 aa, Borrelia burgdorferi B31
INKNKGVFM

SEQ ID NO: 140067 - protein, 15 aa, Borrelia burgdorferi B31
EKQINKNKGVFMTKP

SEQ ID NO: 140068 - protein, 9 aa, Borrelia burgdorferi B31
INKNKGVFM

SEQ ID NO: 140069 - protein, 15 aa, Borrelia burgdorferi B31
KEKQINKNKGVFMTK

SEQ ID NO: 140070 - protein, 9 aa, Borrelia burgdorferi B31
INKNKGVFM

SEQ ID NO: 140071 - protein, 15 aa, Borrelia burgdorferi B31
LNNQKMTKERPLNII

SEQ ID NO: 140072 - protein, 9 aa, Borrelia burgdorferi B31
MTKERPLNI

SEQ ID NO: 140073 - protein, 15 aa, Borrelia burgdorferi B31
EKEKQINKNKGVFMT

SEQ ID NO: 140074 - protein, 9 aa, Borrelia burgdorferi B31
INKNKGVFM

SEQ ID NO: 140075 - protein, 15 aa, Borrelia burgdorferi B31
YNLQYKIEVKWSNKS

SEQ ID NO: 140076 - protein, 9 aa, Borrelia burgdorferi B31
YKIEVKWSN

SEQ ID NO: 140077 - protein, 15 aa, Borrelia burgdorferi B31
LQYKIEVKWSNKSVN

SEQ ID NO: 140078 - protein, 9 aa, Borrelia burgdorferi B31
IEVKWSNKS

SEQ ID NO: 140079 - protein, 15 aa, Borrelia burgdorferi B31
QYKIEVKWSNKSVNN

SEQ ID NO: 140080 - protein, 9 aa, Borrelia burgdorferi B31
IEVKWSNKS

SEQ ID NO: 140081 - protein, 15 aa, Borrelia burgdorferi B31
NLQYKIEVKWSNKSV

SEQ ID NO: 140082 - protein, 9 aa, Borrelia burgdorferi B31
IEVKWSNKS

SEQ ID NO: 140083 - protein, 15 aa, Borrelia burgdorferi B31
YKIEVKWSNKSVNNI

SEQ ID NO: 140084 - protein, 9 aa, Borrelia burgdorferi B31
IEVKWSNKS

SEQ ID NO: 140085 - protein, 15 aa, Borrelia burgdorferi B31
KIEVKWSNKSVNNIE

SEQ ID NO: 140086 - protein, 9 aa, Borrelia burgdorferi B31
IEVKWSNKS

SEQ ID NO: 140087 - protein, 15 aa, Borrelia burgdorferi B31
IEVKWSNKSVNNIEV

SEQ ID NO: 140088 - protein, 9 aa, Borrelia burgdorferi B31
IEVKWSNKS

SEQ ID NO: 140089 - protein, 15 aa, Borrelia burgdorferi B31
DKDEYYYTTSKWTFF

SEQ ID NO: 140090 - protein, 9 aa, Borrelia burgdorferi B31
YYYTTSKWT

SEQ ID NO: 140091 - protein, 15 aa, Borrelia burgdorferi B31
FLLGIIFSNENKVAR

SEQ ID NO: 140092 - protein, 9 aa, Borrelia burgdorferi B31
LGIIFSNEN

SEQ ID NO: 140093 - protein, 15 aa, Borrelia burgdorferi B31
KDEYYYTTSKWTFFD

SEQ ID NO: 140094 - protein, 9 aa, Borrelia burgdorferi B31
YYYTTSKWT

SEQ ID NO: 140095 - protein, 15 aa, Borrelia burgdorferi B31
DEYYYTTSKWTFFDV

SEQ ID NO: 140096 - protein, 9 aa, Borrelia burgdorferi B31
YYYTTSKWT

SEQ ID NO: 140097 - protein, 15 aa, Borrelia burgdorferi B31
KDKDEYYYTTSKWTF

SEQ ID NO: 140098 - protein, 9 aa, Borrelia burgdorferi B31
YYYTTSKWT

SEQ ID NO: 140099 - protein, 15 aa, Borrelia burgdorferi B31
KILIIVVLTSTFLLG

SEQ ID NO: 140100 - protein, 9 aa, Borrelia burgdorferi B31
IIVVLTSTF

SEQ ID NO: 140101 - protein, 15 aa, Borrelia burgdorferi B31
ILIIVVLTSTFLLGI

SEQ ID NO: 140102 - protein, 9 aa, Borrelia burgdorferi B31
VLTSTFLLG

SEQ ID NO: 140103 - protein, 15 aa, Borrelia burgdorferi B31
TFLLGIIFSNENKVA

SEQ ID NO: 140104 - protein, 9 aa, Borrelia burgdorferi B31
LLGIIFSNE

SEQ ID NO: 140105 - protein, 15 aa, Borrelia burgdorferi B31
STFLLGIIFSNENKV

SEQ ID NO: 140106 - protein, 9 aa, Borrelia burgdorferi B31
LLGIIFSNE

SEQ ID NO: 140107 - protein, 15 aa, Borrelia burgdorferi B31
FLLGIIFSNENKVAR

SEQ ID NO: 140108 - protein, 9 aa, Borrelia burgdorferi B31
LLGIIFSNE

SEQ ID NO: 140109 - protein, 15 aa, Borrelia burgdorferi B31
TSTFLLGIIFSNENK

SEQ ID NO: 140110 - protein, 9 aa, Borrelia burgdorferi B31
LLGIIFSNE

SEQ ID NO: 140111 - protein, 15 aa, Borrelia burgdorferi B31
LTSTFLLGIIFSNEN

SEQ ID NO: 140112 - protein, 9 aa, Borrelia burgdorferi B31
LLGIIFSNE

SEQ ID NO: 140113 - protein, 15 aa, Borrelia burgdorferi B31
KIKILIIVVLTSTFL

SEQ ID NO: 140114 - protein, 9 aa, Borrelia burgdorferi B31
ILIIVVLTS

SEQ ID NO: 140115 - protein, 15 aa, Borrelia burgdorferi B31
IKILIIVVLTSTFLL

SEQ ID NO: 140116 - protein, 9 aa, Borrelia burgdorferi B31
ILIIVVLTS

SEQ ID NO: 140117 - protein, 15 aa, Borrelia burgdorferi B31
LIIVVLTSTFLLGII

SEQ ID NO: 140118 - protein, 9 aa, Borrelia burgdorferi B31
VLTSTFLLG

SEQ ID NO: 140119 - protein, 15 aa, Borrelia burgdorferi B31
VLTSTFLLGIIFSNE

SEQ ID NO: 140120 - protein, 9 aa, Borrelia burgdorferi B31
VLTSTFLLG

SEQ ID NO: 140121 - protein, 15 aa, Borrelia burgdorferi B31
LLGIIFSNENKVARI

SEQ ID NO: 140122 - protein, 9 aa, Borrelia burgdorferi B31
LLGIIFSNE

SEQ ID NO: 140123 - protein, 15 aa, Borrelia burgdorferi B31
KDWILTYNKQNIPVD

SEQ ID NO: 140124 - protein, 9 aa, Borrelia burgdorferi B31
WILTYNKQN

SEQ ID NO: 140125 - protein, 15 aa, Borrelia burgdorferi B31
DWILTYNKQNIPVDN

SEQ ID NO: 140126 - protein, 9 aa, Borrelia burgdorferi B31
YNKQNIPVD

SEQ ID NO: 140127 - protein, 15 aa, Borrelia burgdorferi B31
WILTYNKQNIPVDNK

SEQ ID NO: 140128 - protein, 9 aa, Borrelia burgdorferi B31
YNKQNIPVD

SEQ ID NO: 140129 - protein, 15 aa, Borrelia burgdorferi B31
LQYKIEVKWSNKSVN

SEQ ID NO: 140130 - protein, 9 aa, Borrelia burgdorferi B31
IEVKWSNKS

SEQ ID NO: 140131 - protein, 15 aa, Borrelia burgdorferi B31
QYKIEVKWSNKSVNN

SEQ ID NO: 140132 - protein, 9 aa, Borrelia burgdorferi B31
IEVKWSNKS

SEQ ID NO: 140133 - protein, 15 aa, Borrelia burgdorferi B31
YKIEVKWSNKSVNNI

SEQ ID NO: 140134 - protein, 9 aa, Borrelia burgdorferi B31
IEVKWSNKS

SEQ ID NO: 140135 - protein, 15 aa, Borrelia burgdorferi B31
IEVKWSNKSVNNIEV

SEQ ID NO: 140136 - protein, 9 aa, Borrelia burgdorferi B31
IEVKWSNKS

SEQ ID NO: 140137 - protein, 15 aa, Borrelia burgdorferi B31
ILTYNKQNIPVDNKK

SEQ ID NO: 140138 - protein, 9 aa, Borrelia burgdorferi B31
YNKQNIPVD

SEQ ID NO: 140139 - protein, 15 aa, Borrelia burgdorferi B31
KIEVKWSNKSVNNIE

SEQ ID NO: 140140 - protein, 9 aa, Borrelia burgdorferi B31
IEVKWSNKS

SEQ ID NO: 140141 - protein, 15 aa, Borrelia burgdorferi B31
LTYNKQNIPVDNKKV

SEQ ID NO: 140142 - protein, 9 aa, Borrelia burgdorferi B31
YNKQNIPVD

SEQ ID NO: 140143 - protein, 15 aa, Borrelia burgdorferi B31
NLQYKIEVKWSNKSV

SEQ ID NO: 140144 - protein, 9 aa, Borrelia burgdorferi B31
IEVKWSNKS

SEQ ID NO: 140145 - protein, 15 aa, Borrelia burgdorferi B31
YNLQYKIEVKWSNKS

SEQ ID NO: 140146 - protein, 9 aa, Borrelia burgdorferi B31
YKIEVKWSN

SEQ ID NO: 140147 - protein, 15 aa, Borrelia burgdorferi B31
TKLGKDWILTYNKQN

SEQ ID NO: 140148 - protein, 9 aa, Borrelia burgdorferi B31
KDWILTYNK

SEQ ID NO: 140149 - protein, 15 aa, Borrelia burgdorferi B31
KFFDFDFNLISKIET

SEQ ID NO: 140150 - protein, 9 aa, Borrelia burgdorferi B31
FDFDFNLIS

SEQ ID NO: 140151 - protein, 15 aa, Borrelia burgdorferi B31
KLGKDWILTYNKQNI

SEQ ID NO: 140152 - protein, 9 aa, Borrelia burgdorferi B31
WILTYNKQN

SEQ ID NO: 140153 - protein, 15 aa, Borrelia burgdorferi B31
LGKDWILTYNKQNIP

SEQ ID NO: 140154 - protein, 9 aa, Borrelia burgdorferi B31
WILTYNKQN

SEQ ID NO: 140155 - protein, 15 aa, Borrelia burgdorferi B31
IGENPSFKLFDNNNK

SEQ ID NO: 140156 - protein, 9 aa, Borrelia burgdorferi B31
ENPSFKLFD

SEQ ID NO: 140157 - protein, 15 aa, Borrelia burgdorferi B31
GKDWILTYNKQNIPV

SEQ ID NO: 140158 - protein, 9 aa, Borrelia burgdorferi B31
WILTYNKQN

SEQ ID NO: 140159 - protein, 15 aa, Borrelia burgdorferi B31
LIIVVLTSTFLLGII

SEQ ID NO: 140160 - protein, 9 aa, Borrelia burgdorferi B31
IVVLTSTFL

SEQ ID NO: 140161 - protein, 15 aa, Borrelia burgdorferi B31
ILIIVVLTSTFLLGI

SEQ ID NO: 140162 - protein, 9 aa, Borrelia burgdorferi B31
IVVLTSTFL

SEQ ID NO: 140163 - protein, 15 aa, Borrelia burgdorferi B31
IKILIIVVLTSTFLL

SEQ ID NO: 140164 - protein, 9 aa, Borrelia burgdorferi B31
IVVLTSTFL

SEQ ID NO: 140165 - protein, 15 aa, Borrelia burgdorferi B31
KILIIVVLTSTFLLG

SEQ ID NO: 140166 - protein, 9 aa, Borrelia burgdorferi B31
IVVLTSTFL

SEQ ID NO: 140167 - protein, 15 aa, Borrelia burgdorferi B31
DEYYYTTSKWTFFDV

SEQ ID NO: 140168 - protein, 9 aa, Borrelia burgdorferi B31
YYTTSKWTF

SEQ ID NO: 140169 - protein, 15 aa, Borrelia burgdorferi B31
DKDEYYYTTSKWTFF

SEQ ID NO: 140170 - protein, 9 aa, Borrelia burgdorferi B31
YYTTSKWTF

SEQ ID NO: 140171 - protein, 15 aa, Borrelia burgdorferi B31
KDEYYYTTSKWTFFD

SEQ ID NO: 140172 - protein, 9 aa, Borrelia burgdorferi B31
YYTTSKWTF

SEQ ID NO: 140173 - protein, 15 aa, Borrelia burgdorferi B31
KIKILIIVVLTSTFL

SEQ ID NO: 140174 - protein, 9 aa, Borrelia burgdorferi B31
IIVVLTSTF

SEQ ID NO: 140175 - protein, 15 aa, Borrelia burgdorferi B31
EYYYTTSKWTFFDVF

SEQ ID NO: 140176 - protein, 9 aa, Borrelia burgdorferi B31
YYTTSKWTF

SEQ ID NO: 140177 - protein, 15 aa, Borrelia burgdorferi B31
IIVVLTSTFLLGIIF

SEQ ID NO: 140178 - protein, 9 aa, Borrelia burgdorferi B31
IVVLTSTFL

SEQ ID NO: 140179 - protein, 15 aa, Borrelia burgdorferi B31
KDKDEYYYTTSKWTF

SEQ ID NO: 140180 - protein, 9 aa, Borrelia burgdorferi B31
YYYTTSKWT

SEQ ID NO: 140181 - protein, 15 aa, Borrelia burgdorferi B31
IVVLTSTFLLGIIFS

SEQ ID NO: 140182 - protein, 9 aa, Borrelia burgdorferi B31
IVVLTSTFL

SEQ ID NO: 140183 - protein, 15 aa, Borrelia burgdorferi B31
YYYTTSKWTFFDVFD

SEQ ID NO: 140184 - protein, 9 aa, Borrelia burgdorferi B31
YTTSKWTFF

SEQ ID NO: 140185 - protein, 15 aa, Borrelia burgdorferi B31
YYTTSKWTFFDVFDL

SEQ ID NO: 140186 - protein, 9 aa, Borrelia burgdorferi B31
YYTTSKWTF

SEQ ID NO: 140187 - protein, 15 aa, Borrelia burgdorferi B31
KNKGVFMTKPKIFSI

SEQ ID NO: 140188 - protein, 9 aa, Borrelia burgdorferi B31
VFMTKPKIF

SEQ ID NO: 140189 - protein, 15 aa, Borrelia burgdorferi B31
NKGVFMTKPKIFSIN

SEQ ID NO: 140190 - protein, 9 aa, Borrelia burgdorferi B31
VFMTKPKIF

SEQ ID NO: 140191 - protein, 15 aa, Borrelia burgdorferi B31
KGVFMTKPKIFSINK

SEQ ID NO: 140192 - protein, 9 aa, Borrelia burgdorferi B31
VFMTKPKIF

SEQ ID NO: 140193 - protein, 15 aa, Borrelia burgdorferi B31
INKNKGVFMTKPKIF

SEQ ID NO: 140194 - protein, 9 aa, Borrelia burgdorferi B31
INKNKGVFM

SEQ ID NO: 140195 - protein, 15 aa, Borrelia burgdorferi B31
KKDKDEYYYTTSKWT

SEQ ID NO: 140196 - protein, 9 aa, Borrelia burgdorferi B31
EYYYTTSKW

SEQ ID NO: 140197 - protein, 15 aa, Borrelia burgdorferi B31
NKNKGVFMTKPKIFS

SEQ ID NO: 140198 - protein, 9 aa, Borrelia burgdorferi B31
VFMTKPKIF

SEQ ID NO: 140199 - protein, 15 aa, Borrelia burgdorferi B31
DKDEYYYTTSKWTFF

SEQ ID NO: 140200 - protein, 9 aa, Borrelia burgdorferi B31
YYYTTSKWT

SEQ ID NO: 140201 - protein, 15 aa, Borrelia burgdorferi B31
KDEYYYTTSKWTFFD

SEQ ID NO: 140202 - protein, 9 aa, Borrelia burgdorferi B31
YYYTTSKWT

SEQ ID NO: 140203 - protein, 15 aa, Borrelia burgdorferi B31
DEYYYTTSKWTFFDV

SEQ ID NO: 140204 - protein, 9 aa, Borrelia burgdorferi B31
YYYTTSKWT

SEQ ID NO: 140205 - protein, 15 aa, Borrelia burgdorferi B31
KDKDEYYYTTSKWTF

SEQ ID NO: 140206 - protein, 9 aa, Borrelia burgdorferi B31
YYYTTSKWT

SEQ ID NO: 140207 - protein, 15 aa, Borrelia burgdorferi B31
DENVYLTKNIFLSYK

SEQ ID NO: 140208 - protein, 9 aa, Borrelia burgdorferi B31
LTKNIFLSY

SEQ ID NO: 140209 - protein, 15 aa, Borrelia burgdorferi B31
SDENVYLTKNIFLSY

SEQ ID NO: 140210 - protein, 9 aa, Borrelia burgdorferi B31
NVYLTKNIF

SEQ ID NO: 140211 - protein, 15 aa, Borrelia burgdorferi B31
ENVYLTKNIFLSYKG

SEQ ID NO: 140212 - protein, 9 aa, Borrelia burgdorferi B31
LTKNIFLSY

SEQ ID NO: 140213 - protein, 15 aa, Borrelia burgdorferi B31
NVYLTKNIFLSYKGN

SEQ ID NO: 140214 - protein, 9 aa, Borrelia burgdorferi B31
LTKNIFLSY

SEQ ID NO: 140215 - protein, 15 aa, Borrelia burgdorferi B31
EKIKILIIVVLTSTF

SEQ ID NO: 140216 - protein, 9 aa, Borrelia burgdorferi B31
IKILIIVVL

SEQ ID NO: 140217 - protein, 15 aa, Borrelia burgdorferi B31
KEKIKILIIVVLTST

SEQ ID NO: 140218 - protein, 9 aa, Borrelia burgdorferi B31
IKILIIVVL

SEQ ID NO: 140219 - protein, 15 aa, Borrelia burgdorferi B31
SINKEKIKILIIVVL

SEQ ID NO: 140220 - protein, 9 aa, Borrelia burgdorferi B31
EKIKILIIV

SEQ ID NO: 140221 - protein, 15 aa, Borrelia burgdorferi B31
INKEKIKILIIVVLT

SEQ ID NO: 140222 - protein, 9 aa, Borrelia burgdorferi B31
IKILIIVVL

SEQ ID NO: 140223 - protein, 15 aa, Borrelia burgdorferi B31
NKEKIKILIIVVLTS

SEQ ID NO: 140224 - protein, 9 aa, Borrelia burgdorferi B31
IKILIIVVL

SEQ ID NO: 140225 - protein, 15 aa, Borrelia burgdorferi B31
IKILIIVVLTSTFLL

SEQ ID NO: 140226 - protein, 9 aa, Borrelia burgdorferi B31
IKILIIVVL

SEQ ID NO: 140227 - protein, 15 aa, Borrelia burgdorferi B31
KIKILIIVVLTSTFL

SEQ ID NO: 140228 - protein, 9 aa, Borrelia burgdorferi B31
IKILIIVVL

SEQ ID NO: 140229 - protein, 15 aa, Borrelia burgdorferi B31
DGLYFLNNQKMTKER

SEQ ID NO: 140230 - protein, 9 aa, Borrelia burgdorferi B31
LNNQKMTKE

SEQ ID NO: 140231 - protein, 15 aa, Borrelia burgdorferi B31
KILIIVVLTSTFLLG

SEQ ID NO: 140232 - protein, 9 aa, Borrelia burgdorferi B31
LIIVVLTST

SEQ ID NO: 140233 - protein, 15 aa, Borrelia burgdorferi B31
SFKLFDNNNKLLTEI

SEQ ID NO: 140234 - protein, 9 aa, Borrelia burgdorferi B31
FDNNNKLLT

SEQ ID NO: 140235 - protein, 15 aa, Borrelia burgdorferi B31
FKLFDNNNKLLTEIF

SEQ ID NO: 140236 - protein, 9 aa, Borrelia burgdorferi B31
FDNNNKLLT

SEQ ID NO: 140237 - protein, 15 aa, Borrelia burgdorferi B31
KDGLYFLNNQKMTKE

SEQ ID NO: 140238 - protein, 9 aa, Borrelia burgdorferi B31
YFLNNQKMT

SEQ ID NO: 140239 - protein, 15 aa, Borrelia burgdorferi B31
PSFKLFDNNNKLLTE

SEQ ID NO: 140240 - protein, 9 aa, Borrelia burgdorferi B31
FDNNNKLLT

SEQ ID NO: 140241 - protein, 15 aa, Borrelia burgdorferi B31
NPSFKLFDNNNKLLT

SEQ ID NO: 140242 - protein, 9 aa, Borrelia burgdorferi B31
LFDNNNKLL

SEQ ID NO: 140243 - protein, 15 aa, Borrelia burgdorferi B31
KLFDNNNKLLTEIFV

SEQ ID NO: 140244 - protein, 9 aa, Borrelia burgdorferi B31
FDNNNKLLT

SEQ ID NO: 140245 - protein, 15 aa, Borrelia burgdorferi B31
GLYFLNNQKMTKERP

SEQ ID NO: 140246 - protein, 9 aa, Borrelia burgdorferi B31
LNNQKMTKE

SEQ ID NO: 140247 - protein, 15 aa, Borrelia burgdorferi B31
EKEKQINKNKGVFMT

SEQ ID NO: 140248 - protein, 9 aa, Borrelia burgdorferi B31
INKNKGVFM

SEQ ID NO: 140249 - protein, 15 aa, Borrelia burgdorferi B31
KEKQINKNKGVFMTK

SEQ ID NO: 140250 - protein, 9 aa, Borrelia burgdorferi B31
INKNKGVFM

SEQ ID NO: 140251 - protein, 15 aa, Borrelia burgdorferi B31
KQINKNKGVFMTKPK

SEQ ID NO: 140252 - protein, 9 aa, Borrelia burgdorferi B31
INKNKGVFM

SEQ ID NO: 140253 - protein, 15 aa, Borrelia burgdorferi B31
EKQINKNKGVFMTKP

SEQ ID NO: 140254 - protein, 9 aa, Borrelia burgdorferi B31
INKNKGVFM

SEQ ID NO: 140255 - protein, 15 aa, Borrelia burgdorferi B31
LYFLNNQKMTKERPL

SEQ ID NO: 140256 - protein, 9 aa, Borrelia burgdorferi B31
LNNQKMTKE

SEQ ID NO: 140257 - protein, 15 aa, Borrelia burgdorferi B31
ILIIVVLTSTFLLGI

SEQ ID NO: 140258 - protein, 9 aa, Borrelia burgdorferi B31
IIVVLTSTF

SEQ ID NO: 140259 - protein, 15 aa, Borrelia burgdorferi B31
LIIVVLTSTFLLGII

SEQ ID NO: 140260 - protein, 9 aa, Borrelia burgdorferi B31
VVLTSTFLL

SEQ ID NO: 140261 - protein, 15 aa, Borrelia burgdorferi B31
YFLNNQKMTKERPLN

SEQ ID NO: 140262 - protein, 9 aa, Borrelia burgdorferi B31
LNNQKMTKE

SEQ ID NO: 140263 - protein, 15 aa, Borrelia burgdorferi B31
YKIEVKWSNKSVNNI

SEQ ID NO: 140264 - protein, 9 aa, Borrelia burgdorferi B31
VKWSNKSVN

SEQ ID NO: 140265 - protein, 15 aa, Borrelia burgdorferi B31
QINKNKGVFMTKPKI

SEQ ID NO: 140266 - protein, 9 aa, Borrelia burgdorferi B31
INKNKGVFM

SEQ ID NO: 140267 - protein, 15 aa, Borrelia burgdorferi B31
LEKEKQINKNKGVFM

SEQ ID NO: 140268 - protein, 9 aa, Borrelia burgdorferi B31
QINKNKGVF

SEQ ID NO: 140269 - protein, 15 aa, Borrelia burgdorferi B31
IEVKWSNKSVNNIEV

SEQ ID NO: 140270 - protein, 9 aa, Borrelia burgdorferi B31
WSNKSVNNI

SEQ ID NO: 140271 - protein, 15 aa, Borrelia burgdorferi B31
LFDNNNKLLTEIFVG

SEQ ID NO: 140272 - protein, 9 aa, Borrelia burgdorferi B31
FDNNNKLLT

SEQ ID NO: 140273 - protein, 15 aa, Borrelia burgdorferi B31
KIEVKWSNKSVNNIE

SEQ ID NO: 140274 - protein, 9 aa, Borrelia burgdorferi B31
WSNKSVNNI

SEQ ID NO: 140275 - protein, 15 aa, Borrelia burgdorferi B31
FDFDFNLISKIETEL

SEQ ID NO: 140276 - protein, 9 aa, Borrelia burgdorferi B31
FNLISKIET

SEQ ID NO: 140277 - protein, 15 aa, Borrelia burgdorferi B31
KFFDFDFNLISKIET

SEQ ID NO: 140278 - protein, 9 aa, Borrelia burgdorferi B31
FDFNLISKI

SEQ ID NO: 140279 - protein, 15 aa, Borrelia burgdorferi B31
FFDFDFNLISKIETE

SEQ ID NO: 140280 - protein, 9 aa, Borrelia burgdorferi B31
FNLISKIET

SEQ ID NO: 140281 - protein, 15 aa, Borrelia burgdorferi B31
FDNNNKLLTEIFVGK

SEQ ID NO: 140282 - protein, 9 aa, Borrelia burgdorferi B31
FDNNNKLLT

SEQ ID NO: 140283 - protein, 15 aa, Borrelia burgdorferi B31
KENENNINNNYEIIS

SEQ ID NO: 140284 - protein, 9 aa, Borrelia burgdorferi B31
NENNINNNY

SEQ ID NO: 140285 - protein, 15 aa, Borrelia burgdorferi B31
DFDFNLISKIETELE

SEQ ID NO: 140286 - protein, 9 aa, Borrelia burgdorferi B31
FNLISKIET

SEQ ID NO: 140287 - protein, 15 aa, Borrelia burgdorferi B31
FDFNLISKIETELEG

SEQ ID NO: 140288 - protein, 9 aa, Borrelia burgdorferi B31
FNLISKIET

SEQ ID NO: 140289 - protein, 15 aa, Borrelia burgdorferi B31
SKDGLYFLNNQKMTK

SEQ ID NO: 140290 - protein, 9 aa, Borrelia burgdorferi B31
YFLNNQKMT

SEQ ID NO: 140291 - protein, 15 aa, Borrelia burgdorferi B31
VKWSNKSVNNIEVYF

SEQ ID NO: 140292 - protein, 9 aa, Borrelia burgdorferi B31
WSNKSVNNI

SEQ ID NO: 140293 - protein, 15 aa, Borrelia burgdorferi B31
IIVVLTSTFLLGIIF

SEQ ID NO: 140294 - protein, 9 aa, Borrelia burgdorferi B31
VVLTSTFLL

SEQ ID NO: 140295 - protein, 15 aa, Borrelia burgdorferi B31
EVKWSNKSVNNIEVY

SEQ ID NO: 140296 - protein, 9 aa, Borrelia burgdorferi B31
WSNKSVNNI

SEQ ID NO: 140297 - protein, 15 aa, Borrelia burgdorferi B31
INKNKGVFMTKPKIF

SEQ ID NO: 140298 - protein, 9 aa, Borrelia burgdorferi B31
INKNKGVFM

SEQ ID NO: 140299 - protein, 15 aa, Borrelia burgdorferi B31
ENENNINNNYEIISK

SEQ ID NO: 140300 - protein, 9 aa, Borrelia burgdorferi B31
INNNYEIIS

SEQ ID NO: 140301 - protein, 15 aa, Borrelia burgdorferi B31
NENNINNNYEIISKD

SEQ ID NO: 140302 - protein, 9 aa, Borrelia burgdorferi B31
INNNYEIIS

SEQ ID NO: 140303 - protein, 15 aa, Borrelia burgdorferi B31
NNINNNYEIISKDGL

SEQ ID NO: 140304 - protein, 9 aa, Borrelia burgdorferi B31
INNNYEIIS

SEQ ID NO: 140305 - protein, 15 aa, Borrelia burgdorferi B31
ENNINNNYEIISKDG

SEQ ID NO: 140306 - protein, 9 aa, Borrelia burgdorferi B31
INNNYEIIS

SEQ ID NO: 140307 - protein, 15 aa, Borrelia burgdorferi B31
LENLSFKIIRKLNKE

SEQ ID NO: 140308 - protein, 9 aa, Borrelia burgdorferi B31
FKIIRKLNK

SEQ ID NO: 140309 - protein, 15 aa, Borrelia burgdorferi B31
KLENLSFKIIRKLNK

SEQ ID NO: 140310 - protein, 9 aa, Borrelia burgdorferi B31
LENLSFKII

SEQ ID NO: 140311 - protein, 15 aa, Borrelia burgdorferi B31
SDENVYLTKNIFLSY

SEQ ID NO: 140312 - protein, 9 aa, Borrelia burgdorferi B31
YLTKNIFLS

SEQ ID NO: 140313 - protein, 15 aa, Borrelia burgdorferi B31
FLNNQKMTKERPLNI

SEQ ID NO: 140314 - protein, 9 aa, Borrelia burgdorferi B31
LNNQKMTKE

SEQ ID NO: 140315 - protein, 15 aa, Borrelia burgdorferi B31
DENVYLTKNIFLSYK

SEQ ID NO: 140316 - protein, 9 aa, Borrelia burgdorferi B31
YLTKNIFLS

SEQ ID NO: 140317 - protein, 15 aa, Borrelia burgdorferi B31
EKNTKLENLSFKIIR

SEQ ID NO: 140318 - protein, 9 aa, Borrelia burgdorferi B31
LENLSFKII

SEQ ID NO: 140319 - protein, 15 aa, Borrelia burgdorferi B31
QEKNTKLENLSFKII

SEQ ID NO: 140320 - protein, 9 aa, Borrelia burgdorferi B31
KNTKLENLS

SEQ ID NO: 140321 - protein, 15 aa, Borrelia burgdorferi B31
ENVYLTKNIFLSYKG

SEQ ID NO: 140322 - protein, 9 aa, Borrelia burgdorferi B31
YLTKNIFLS

SEQ ID NO: 140323 - protein, 15 aa, Borrelia burgdorferi B31
KNTKLENLSFKIIRK

SEQ ID NO: 140324 - protein, 9 aa, Borrelia burgdorferi B31
LENLSFKII

SEQ ID NO: 140325 - protein, 15 aa, Borrelia burgdorferi B31
NTKLENLSFKIIRKL

SEQ ID NO: 140326 - protein, 9 aa, Borrelia burgdorferi B31
LENLSFKII

SEQ ID NO: 140327 - protein, 15 aa, Borrelia burgdorferi B31
KWSNKSVNNIEVYFN

SEQ ID NO: 140328 - protein, 9 aa, Borrelia burgdorferi B31
WSNKSVNNI

SEQ ID NO: 140329 - protein, 15 aa, Borrelia burgdorferi B31
TKLENLSFKIIRKLN

SEQ ID NO: 140330 - protein, 9 aa, Borrelia burgdorferi B31
LENLSFKII

SEQ ID NO: 140331 - protein, 15 aa, Borrelia burgdorferi B31
PVDNKKVNSLIKALD

SEQ ID NO: 140332 - protein, 9 aa, Borrelia burgdorferi B31
KKVNSLIKA

SEQ ID NO: 140333 - protein, 15 aa, Borrelia burgdorferi B31
NVYLTKNIFLSYKGN

SEQ ID NO: 140334 - protein, 9 aa, Borrelia burgdorferi B31
YLTKNIFLS

SEQ ID NO: 140335 - protein, 15 aa, Borrelia burgdorferi B31
WSNKSVNNIEVYFNK

SEQ ID NO: 140336 - protein, 9 aa, Borrelia burgdorferi B31
WSNKSVNNI

SEQ ID NO: 140337 - protein, 15 aa, Borrelia burgdorferi B31
VDNKKVNSLIKALDE

SEQ ID NO: 140338 - protein, 9 aa, Borrelia burgdorferi B31
VNSLIKALD

SEQ ID NO: 140339 - protein, 15 aa, Borrelia burgdorferi B31
INNNYEIISKDGLYF

SEQ ID NO: 140340 - protein, 9 aa, Borrelia burgdorferi B31
INNNYEIIS

SEQ ID NO: 140341 - protein, 15 aa, Borrelia burgdorferi B31
DWILTYNKQNIPVDN

SEQ ID NO: 140342 - protein, 9 aa, Borrelia burgdorferi B31
LTYNKQNIP

SEQ ID NO: 140343 - protein, 15 aa, Borrelia burgdorferi B31
ISKDGLYFLNNQKMT

SEQ ID NO: 140344 - protein, 9 aa, Borrelia burgdorferi B31
LYFLNNQKM

SEQ ID NO: 140345 - protein, 15 aa, Borrelia burgdorferi B31
KDWILTYNKQNIPVD

SEQ ID NO: 140346 - protein, 9 aa, Borrelia burgdorferi B31
LTYNKQNIP

SEQ ID NO: 140347 - protein, 15 aa, Borrelia burgdorferi B31
IVVLTSTFLLGIIFS

SEQ ID NO: 140348 - protein, 9 aa, Borrelia burgdorferi B31
VVLTSTFLL

SEQ ID NO: 140349 - protein, 15 aa, Borrelia burgdorferi B31
NINNNYEIISKDGLY

SEQ ID NO: 140350 - protein, 9 aa, Borrelia burgdorferi B31
INNNYEIIS

SEQ ID NO: 140351 - protein, 15 aa, Borrelia burgdorferi B31
FNLISKIETELEGTL

SEQ ID NO: 140352 - protein, 9 aa, Borrelia burgdorferi B31
FNLISKIET

SEQ ID NO: 140353 - protein, 15 aa, Borrelia burgdorferi B31
DFNLISKIETELEGT

SEQ ID NO: 140354 - protein, 9 aa, Borrelia burgdorferi B31
FNLISKIET

SEQ ID NO: 140355 - protein, 15 aa, Borrelia burgdorferi B31
LQYKIEVKWSNKSVN

SEQ ID NO: 140356 - protein, 9 aa, Borrelia burgdorferi B31
IEVKWSNKS

SEQ ID NO: 140357 - protein, 15 aa, Borrelia burgdorferi B31
GSDENVYLTKNIFLS

SEQ ID NO: 140358 - protein, 9 aa, Borrelia burgdorferi B31
VYLTKNIFL

SEQ ID NO: 140359 - protein, 15 aa, Borrelia burgdorferi B31
WILTYNKQNIPVDNK

SEQ ID NO: 140360 - protein, 9 aa, Borrelia burgdorferi B31
LTYNKQNIP

SEQ ID NO: 140361 - protein, 15 aa, Borrelia burgdorferi B31
GKDWILTYNKQNIPV

SEQ ID NO: 140362 - protein, 9 aa, Borrelia burgdorferi B31
LTYNKQNIP

SEQ ID NO: 140363 - protein, 15 aa, Borrelia burgdorferi B31
VYLTKNIFLSYKGNS

SEQ ID NO: 140364 - protein, 9 aa, Borrelia burgdorferi B31
YLTKNIFLS

SEQ ID NO: 140365 - protein, 15 aa, Borrelia burgdorferi B31
DNKKVNSLIKALDEL

SEQ ID NO: 140366 - protein, 9 aa, Borrelia burgdorferi B31
VNSLIKALD

SEQ ID NO: 140367 - protein, 15 aa, Borrelia burgdorferi B31
KALDELQKNKLVSRD

SEQ ID NO: 140368 - protein, 9 aa, Borrelia burgdorferi B31
LQKNKLVSR

SEQ ID NO: 140369 - protein, 15 aa, Borrelia burgdorferi B31
QYKIEVKWSNKSVNN

SEQ ID NO: 140370 - protein, 9 aa, Borrelia burgdorferi B31
VKWSNKSVN

SEQ ID NO: 140371 - protein, 15 aa, Borrelia burgdorferi B31
LGKDWILTYNKQNIP

SEQ ID NO: 140372 - protein, 9 aa, Borrelia burgdorferi B31
ILTYNKQNI

SEQ ID NO: 140373 - protein, 15 aa, Borrelia burgdorferi B31
FLLGIIFSNENKVAR

SEQ ID NO: 140374 - protein, 9 aa, Borrelia burgdorferi B31
LGIIFSNEN

SEQ ID NO: 140375 - protein, 15 aa, Borrelia burgdorferi B31
IKALDELQKNKLVSR

SEQ ID NO: 140376 - protein, 9 aa, Borrelia burgdorferi B31
LDELQKNKL

SEQ ID NO: 140377 - protein, 15 aa, Borrelia burgdorferi B31
LGIIFSNENKVARIL

SEQ ID NO: 140378 - protein, 9 aa, Borrelia burgdorferi B31
FSNENKVAR

SEQ ID NO: 140379 - protein, 15 aa, Borrelia burgdorferi B31
LLGIIFSNENKVARI

SEQ ID NO: 140380 - protein, 9 aa, Borrelia burgdorferi B31
FSNENKVAR

SEQ ID NO: 140381 - protein, 15 aa, Borrelia burgdorferi B31
YLTKNIFLSYKGNSY

SEQ ID NO: 140382 - protein, 9 aa, Borrelia burgdorferi B31
YLTKNIFLS

SEQ ID NO: 140383 - protein, 15 aa, Borrelia burgdorferi B31
LDELQKNKLVSRDQK

SEQ ID NO: 140384 - protein, 9 aa, Borrelia burgdorferi B31
LQKNKLVSR

SEQ ID NO: 140385 - protein, 15 aa, Borrelia burgdorferi B31
IPVDNKKVNSLIKAL

SEQ ID NO: 140386 - protein, 9 aa, Borrelia burgdorferi B31
VDNKKVNSL

SEQ ID NO: 140387 - protein, 15 aa, Borrelia burgdorferi B31
VVLTSTFLLGIIFSN

SEQ ID NO: 140388 - protein, 9 aa, Borrelia burgdorferi B31
VVLTSTFLL

SEQ ID NO: 140389 - protein, 15 aa, Borrelia burgdorferi B31
NIPVDNKKVNSLIKA

SEQ ID NO: 140390 - protein, 9 aa, Borrelia burgdorferi B31
VDNKKVNSL

SEQ ID NO: 140391 - protein, 15 aa, Borrelia burgdorferi B31
ALDELQKNKLVSRDQ

SEQ ID NO: 140392 - protein, 9 aa, Borrelia burgdorferi B31
LQKNKLVSR

SEQ ID NO: 140393 - protein, 15 aa, Borrelia burgdorferi B31
NKKVNSLIKALDELQ

SEQ ID NO: 140394 - protein, 9 aa, Borrelia burgdorferi B31
VNSLIKALD

SEQ ID NO: 140395 - protein, 15 aa, Borrelia burgdorferi B31
LNNQKMTKERPLNII

SEQ ID NO: 140396 - protein, 9 aa, Borrelia burgdorferi B31
LNNQKMTKE

SEQ ID NO: 140397 - protein, 15 aa, Borrelia burgdorferi B31
KILIIVVLTSTFLLG

SEQ ID NO: 140398 - protein, 9 aa, Borrelia burgdorferi B31
IVVLTSTFL

SEQ ID NO: 140399 - protein, 15 aa, Borrelia burgdorferi B31
KIKILIIVVLTSTFL

SEQ ID NO: 140400 - protein, 9 aa, Borrelia burgdorferi B31
ILIIVVLTS

SEQ ID NO: 140401 - protein, 15 aa, Borrelia burgdorferi B31
IKILIIVVLTSTFLL

SEQ ID NO: 140402 - protein, 9 aa, Borrelia burgdorferi B31
IVVLTSTFL

SEQ ID NO: 140403 - protein, 15 aa, Borrelia burgdorferi B31
ILIIVVLTSTFLLGI

SEQ ID NO: 140404 - protein, 9 aa, Borrelia burgdorferi B31
IVVLTSTFL

SEQ ID NO: 140405 - protein, 15 aa, Borrelia burgdorferi B31
KLENLSFKIIRKLNK

SEQ ID NO: 140406 - protein, 9 aa, Borrelia burgdorferi B31
NLSFKIIRK

SEQ ID NO: 140407 - protein, 15 aa, Borrelia burgdorferi B31
LENLSFKIIRKLNKE

SEQ ID NO: 140408 - protein, 9 aa, Borrelia burgdorferi B31
FKIIRKLNK

SEQ ID NO: 140409 - protein, 15 aa, Borrelia burgdorferi B31
YLTKNIFLSYKGNSY

SEQ ID NO: 140410 - protein, 9 aa, Borrelia burgdorferi B31
TKNIFLSYK

SEQ ID NO: 140411 - protein, 15 aa, Borrelia burgdorferi B31
LIIVVLTSTFLLGII

SEQ ID NO: 140412 - protein, 9 aa, Borrelia burgdorferi B31
IVVLTSTFL

SEQ ID NO: 140413 - protein, 15 aa, Borrelia burgdorferi B31
ENLSFKIIRKLNKEN

SEQ ID NO: 140414 - protein, 9 aa, Borrelia burgdorferi B31
FKIIRKLNK

SEQ ID NO: 140415 - protein, 15 aa, Borrelia burgdorferi B31
YKIEVKWSNKSVNNI

SEQ ID NO: 140416 - protein, 9 aa, Borrelia burgdorferi B31
IEVKWSNKS

SEQ ID NO: 140417 - protein, 15 aa, Borrelia burgdorferi B31
FLLGIIFSNENKVAR

SEQ ID NO: 140418 - protein, 9 aa, Borrelia burgdorferi B31
LGIIFSNEN

SEQ ID NO: 140419 - protein, 15 aa, Borrelia burgdorferi B31
LLGIIFSNENKVARI

SEQ ID NO: 140420 - protein, 9 aa, Borrelia burgdorferi B31
FSNENKVAR

SEQ ID NO: 140421 - protein, 15 aa, Borrelia burgdorferi B31
LGIIFSNENKVARIL

SEQ ID NO: 140422 - protein, 9 aa, Borrelia burgdorferi B31
FSNENKVAR

SEQ ID NO: 140423 - protein, 15 aa, Borrelia burgdorferi B31
GIIFSNENKVARILE

SEQ ID NO: 140424 - protein, 9 aa, Borrelia burgdorferi B31
FSNENKVAR

SEQ ID NO: 140425 - protein, 15 aa, Borrelia burgdorferi B31
IIFSNENKVARILEE

SEQ ID NO: 140426 - protein, 9 aa, Borrelia burgdorferi B31
FSNENKVAR

SEQ ID NO: 140427 - protein, 15 aa, Borrelia burgdorferi B31
LQYKIEVKWSNKSVN

SEQ ID NO: 140428 - protein, 9 aa, Borrelia burgdorferi B31
YKIEVKWSN

SEQ ID NO: 140429 - protein, 15 aa, Borrelia burgdorferi B31
YNLQYKIEVKWSNKS

SEQ ID NO: 140430 - protein, 9 aa, Borrelia burgdorferi B31
YKIEVKWSN

SEQ ID NO: 140431 - protein, 15 aa, Borrelia burgdorferi B31
NLQYKIEVKWSNKSV

SEQ ID NO: 140432 - protein, 9 aa, Borrelia burgdorferi B31
YKIEVKWSN

SEQ ID NO: 140433 - protein, 15 aa, Borrelia burgdorferi B31
DKDEYYYTTSKWTFF

SEQ ID NO: 140434 - protein, 9 aa, Borrelia burgdorferi B31
YYYTTSKWT

SEQ ID NO: 140435 - protein, 15 aa, Borrelia burgdorferi B31
KDEYYYTTSKWTFFD

SEQ ID NO: 140436 - protein, 9 aa, Borrelia burgdorferi B31
YYYTTSKWT

SEQ ID NO: 140437 - protein, 15 aa, Borrelia burgdorferi B31
DEYYYTTSKWTFFDV

SEQ ID NO: 140438 - protein, 9 aa, Borrelia burgdorferi B31
YYYTTSKWT

SEQ ID NO: 140439 - protein, 15 aa, Borrelia burgdorferi B31
KDGLYFLNNQKMTKE

SEQ ID NO: 140440 - protein, 9 aa, Borrelia burgdorferi B31
LYFLNNQKM

SEQ ID NO: 140441 - protein, 15 aa, Borrelia burgdorferi B31
DGLYFLNNQKMTKER

SEQ ID NO: 140442 - protein, 9 aa, Borrelia burgdorferi B31
LYFLNNQKM

SEQ ID NO: 140443 - protein, 15 aa, Borrelia burgdorferi B31
KDKDEYYYTTSKWTF

SEQ ID NO: 140444 - protein, 9 aa, Borrelia burgdorferi B31
YYYTTSKWT

SEQ ID NO: 140445 - protein, 15 aa, Borrelia burgdorferi B31
DYNLQYKIEVKWSNK

SEQ ID NO: 140446 - protein, 9 aa, Borrelia burgdorferi B31
YKIEVKWSN

SEQ ID NO: 140447 - protein, 15 aa, Borrelia burgdorferi B31
SKDGLYFLNNQKMTK

SEQ ID NO: 140448 - protein, 9 aa, Borrelia burgdorferi B31
LYFLNNQKM

SEQ ID NO: 140449 - protein, 15 aa, Borrelia burgdorferi B31
DDYNLQYKIEVKWSN

SEQ ID NO: 140450 - protein, 9 aa, Borrelia burgdorferi B31
YNLQYKIEV

SEQ ID NO: 140451 - protein, 15 aa, Borrelia burgdorferi B31
FSNENKVARILEEKF

SEQ ID NO: 140452 - protein, 9 aa, Borrelia burgdorferi B31
FSNENKVAR

SEQ ID NO: 140453 - protein, 15 aa, Borrelia burgdorferi B31
IFSNENKVARILEEK

SEQ ID NO: 140454 - protein, 9 aa, Borrelia burgdorferi B31
FSNENKVAR

SEQ ID NO: 140455 - protein, 15 aa, Borrelia burgdorferi B31
EYYYTTSKWTFFDVF

SEQ ID NO: 140456 - protein, 9 aa, Borrelia burgdorferi B31
YYYTTSKWT

SEQ ID NO: 140457 - protein, 15 aa, Borrelia burgdorferi B31
YKIEVKWSNKSVNNI

SEQ ID NO: 140458 - protein, 9 aa, Borrelia burgdorferi B31
YKIEVKWSN

SEQ ID NO: 140459 - protein, 15 aa, Borrelia burgdorferi B31
QYKIEVKWSNKSVNN

SEQ ID NO: 140460 - protein, 9 aa, Borrelia burgdorferi B31
YKIEVKWSN

SEQ ID NO: 140461 - protein, 15 aa, Borrelia burgdorferi B31
GLYFLNNQKMTKERP

SEQ ID NO: 140462 - protein, 9 aa, Borrelia burgdorferi B31
LYFLNNQKM

SEQ ID NO: 140463 - protein, 15 aa, Borrelia burgdorferi B31
ENLSFKIIRKLNKEN

SEQ ID NO: 140464 - protein, 9 aa, Borrelia burgdorferi B31
FKIIRKLNK

SEQ ID NO: 140465 - protein, 15 aa, Borrelia burgdorferi B31
NLSFKIIRKLNKENE

SEQ ID NO: 140466 - protein, 9 aa, Borrelia burgdorferi B31
FKIIRKLNK

SEQ ID NO: 140467 - protein, 15 aa, Borrelia burgdorferi B31
LSFKIIRKLNKENEN

SEQ ID NO: 140468 - protein, 9 aa, Borrelia burgdorferi B31
FKIIRKLNK

SEQ ID NO: 140469 - protein, 15 aa, Borrelia burgdorferi B31
LYFLNNQKMTKERPL

SEQ ID NO: 140470 - protein, 9 aa, Borrelia burgdorferi B31
LYFLNNQKM

SEQ ID NO: 140471 - protein, 15 aa, Borrelia burgdorferi B31
KKDKDEYYYTTSKWT

SEQ ID NO: 140472 - protein, 9 aa, Borrelia burgdorferi B31
DEYYYTTSK

SEQ ID NO: 140473 - protein, 15 aa, Borrelia burgdorferi B31
KLENLSFKIIRKLNK

SEQ ID NO: 140474 - protein, 9 aa, Borrelia burgdorferi B31
LSFKIIRKL

SEQ ID NO: 140475 - protein, 15 aa, Borrelia burgdorferi B31
LENLSFKIIRKLNKE

SEQ ID NO: 140476 - protein, 9 aa, Borrelia burgdorferi B31
FKIIRKLNK

SEQ ID NO: 140477 - protein, 15 aa, Borrelia burgdorferi B31
THTLFGTTPMQRIHK

SEQ ID NO: 140478 - protein, 9 aa, Borrelia burgdorferi B31
FGTTPMQRI

SEQ ID NO: 140479 - protein, 15 aa, Borrelia burgdorferi B31
HTLFGTTPMQRIHKY

SEQ ID NO: 140480 - protein, 9 aa, Borrelia burgdorferi B31
FGTTPMQRI

SEQ ID NO: 140481 - protein, 15 aa, Borrelia burgdorferi B31
TITHTLFGTTPMQRI

SEQ ID NO: 140482 - protein, 9 aa, Borrelia burgdorferi B31
LFGTTPMQR

SEQ ID NO: 140483 - protein, 15 aa, Borrelia burgdorferi B31
ITHTLFGTTPMQRIH

SEQ ID NO: 140484 - protein, 9 aa, Borrelia burgdorferi B31
FGTTPMQRI

SEQ ID NO: 140485 - protein, 15 aa, Borrelia burgdorferi B31
TLFGTTPMQRIHKYD

SEQ ID NO: 140486 - protein, 9 aa, Borrelia burgdorferi B31
FGTTPMQRI

SEQ ID NO: 140487 - protein, 15 aa, Borrelia burgdorferi B31
KEDMKILYSEIAELR

SEQ ID NO: 140488 - protein, 9 aa, Borrelia burgdorferi B31
MKILYSEIA

SEQ ID NO: 140489 - protein, 15 aa, Borrelia burgdorferi B31
EDMKILYSEIAELRK

SEQ ID NO: 140490 - protein, 9 aa, Borrelia burgdorferi B31
MKILYSEIA

SEQ ID NO: 140491 - protein, 15 aa, Borrelia burgdorferi B31
IDTKEDMKILYSEIA

SEQ ID NO: 140492 - protein, 9 aa, Borrelia burgdorferi B31
IDTKEDMKI

SEQ ID NO: 140493 - protein, 15 aa, Borrelia burgdorferi B31
TKEDMKILYSEIAEL

SEQ ID NO: 140494 - protein, 9 aa, Borrelia burgdorferi B31
MKILYSEIA

SEQ ID NO: 140495 - protein, 15 aa, Borrelia burgdorferi B31
DTKEDMKILYSEIAE

SEQ ID NO: 140496 - protein, 9 aa, Borrelia burgdorferi B31
MKILYSEIA

SEQ ID NO: 140497 - protein, 15 aa, Borrelia burgdorferi B31
IIFTLFLSQACNLST

SEQ ID NO: 140498 - protein, 9 aa, Borrelia burgdorferi B31
FLSQACNLS

SEQ ID NO: 140499 - protein, 15 aa, Borrelia burgdorferi B31
IFTLFLSQACNLSTM

SEQ ID NO: 140500 - protein, 9 aa, Borrelia burgdorferi B31
LSQACNLST

SEQ ID NO: 140501 - protein, 15 aa, Borrelia burgdorferi B31
IIIFTLFLSQACNLS

SEQ ID NO: 140502 - protein, 9 aa, Borrelia burgdorferi B31
IFTLFLSQA

SEQ ID NO: 140503 - protein, 15 aa, Borrelia burgdorferi B31
KKLIIIFTLFLSQAC

SEQ ID NO: 140504 - protein, 9 aa, Borrelia burgdorferi B31
IFTLFLSQA

SEQ ID NO: 140505 - protein, 15 aa, Borrelia burgdorferi B31
LFGTTPMQRIHKYDQ

SEQ ID NO: 140506 - protein, 9 aa, Borrelia burgdorferi B31
FGTTPMQRI

SEQ ID NO: 140507 - protein, 15 aa, Borrelia burgdorferi B31
TLFLSQACNLSTMHK

SEQ ID NO: 140508 - protein, 9 aa, Borrelia burgdorferi B31
LSQACNLST

SEQ ID NO: 140509 - protein, 15 aa, Borrelia burgdorferi B31
MKKLIIIFTLFLSQA

SEQ ID NO: 140510 - protein, 9 aa, Borrelia burgdorferi B31
LIIIFTLFL

SEQ ID NO: 140511 - protein, 15 aa, Borrelia burgdorferi B31
FTLFLSQACNLSTMH

SEQ ID NO: 140512 - protein, 9 aa, Borrelia burgdorferi B31
LSQACNLST

SEQ ID NO: 140513 - protein, 15 aa, Borrelia burgdorferi B31
DMKILYSEIAELRKK

SEQ ID NO: 140514 - protein, 9 aa, Borrelia burgdorferi B31
MKILYSEIA

SEQ ID NO: 140515 - protein, 15 aa, Borrelia burgdorferi B31
MKILYSEIAELRKKL

SEQ ID NO: 140516 - protein, 9 aa, Borrelia burgdorferi B31
MKILYSEIA

SEQ ID NO: 140517 - protein, 15 aa, Borrelia burgdorferi B31
LIIIFTLFLSQACNL

SEQ ID NO: 140518 - protein, 9 aa, Borrelia burgdorferi B31
IFTLFLSQA

SEQ ID NO: 140519 - protein, 15 aa, Borrelia burgdorferi B31
KLIIIFTLFLSQACN

SEQ ID NO: 140520 - protein, 9 aa, Borrelia burgdorferi B31
IFTLFLSQA

SEQ ID NO: 140521 - protein, 15 aa, Borrelia burgdorferi B31
NRVVNAWLNSPSHKE

SEQ ID NO: 140522 - protein, 9 aa, Borrelia burgdorferi B31
VVNAWLNSP

SEQ ID NO: 140523 - protein, 15 aa, Borrelia burgdorferi B31
FGTTPMQRIHKYDQS

SEQ ID NO: 140524 - protein, 9 aa, Borrelia burgdorferi B31
FGTTPMQRI

SEQ ID NO: 140525 - protein, 15 aa, Borrelia burgdorferi B31
RTITHTLFGTTPMQR

SEQ ID NO: 140526 - protein, 9 aa, Borrelia burgdorferi B31
THTLFGTTP

SEQ ID NO: 140527 - protein, 15 aa, Borrelia burgdorferi B31
LFLSQACNLSTMHKI

SEQ ID NO: 140528 - protein, 9 aa, Borrelia burgdorferi B31
LSQACNLST

SEQ ID NO: 140529 - protein, 15 aa, Borrelia burgdorferi B31
RVVNAWLNSPSHKEA

SEQ ID NO: 140530 - protein, 9 aa, Borrelia burgdorferi B31
WLNSPSHKE

SEQ ID NO: 140531 - protein, 15 aa, Borrelia burgdorferi B31
VVNAWLNSPSHKEAL

SEQ ID NO: 140532 - protein, 9 aa, Borrelia burgdorferi B31
WLNSPSHKE

SEQ ID NO: 140533 - protein, 15 aa, Borrelia burgdorferi B31
VNAWLNSPSHKEALI

SEQ ID NO: 140534 - protein, 9 aa, Borrelia burgdorferi B31
WLNSPSHKE

SEQ ID NO: 140535 - protein, 15 aa, Borrelia burgdorferi B31
TDKIGGYRLKTTDNI

SEQ ID NO: 140536 - protein, 9 aa, Borrelia burgdorferi B31
IGGYRLKTT

SEQ ID NO: 140537 - protein, 15 aa, Borrelia burgdorferi B31
DKIGGYRLKTTDNID

SEQ ID NO: 140538 - protein, 9 aa, Borrelia burgdorferi B31
IGGYRLKTT

SEQ ID NO: 140539 - protein, 15 aa, Borrelia burgdorferi B31
VAKEYAIKLGENRTI

SEQ ID NO: 140540 - protein, 9 aa, Borrelia burgdorferi B31
VAKEYAIKL

SEQ ID NO: 140541 - protein, 15 aa, Borrelia burgdorferi B31
NAWLNSPSHKEALIN

SEQ ID NO: 140542 - protein, 9 aa, Borrelia burgdorferi B31
WLNSPSHKE

SEQ ID NO: 140543 - protein, 15 aa, Borrelia burgdorferi B31
FLSQACNLSTMHKID

SEQ ID NO: 140544 - protein, 9 aa, Borrelia burgdorferi B31
LSQACNLST

SEQ ID NO: 140545 - protein, 15 aa, Borrelia burgdorferi B31
TDTDKIGGYRLKTTD

SEQ ID NO: 140546 - protein, 9 aa, Borrelia burgdorferi B31
IGGYRLKTT

SEQ ID NO: 140547 - protein, 15 aa, Borrelia burgdorferi B31
DTDKIGGYRLKTTDN

SEQ ID NO: 140548 - protein, 9 aa, Borrelia burgdorferi B31
IGGYRLKTT

SEQ ID NO: 140549 - protein, 15 aa, Borrelia burgdorferi B31
NTDTDKIGGYRLKTT

SEQ ID NO: 140550 - protein, 9 aa, Borrelia burgdorferi B31
TDKIGGYRL

SEQ ID NO: 140551 - protein, 15 aa, Borrelia burgdorferi B31
IELNRVVNAWLNSPS

SEQ ID NO: 140552 - protein, 9 aa, Borrelia burgdorferi B31
VVNAWLNSP

SEQ ID NO: 140553 - protein, 15 aa, Borrelia burgdorferi B31
LSQACNLSTMHKIDT

SEQ ID NO: 140554 - protein, 9 aa, Borrelia burgdorferi B31
LSQACNLST

SEQ ID NO: 140555 - protein, 15 aa, Borrelia burgdorferi B31
KIGGYRLKTTDNIDI

SEQ ID NO: 140556 - protein, 9 aa, Borrelia burgdorferi B31
IGGYRLKTT

SEQ ID NO: 140557 - protein, 15 aa, Borrelia burgdorferi B31
FNLTREILASGIELN

SEQ ID NO: 140558 - protein, 9 aa, Borrelia burgdorferi B31
LTREILASG

SEQ ID NO: 140559 - protein, 15 aa, Borrelia burgdorferi B31
IGGYRLKTTDNIDIF

SEQ ID NO: 140560 - protein, 9 aa, Borrelia burgdorferi B31
IGGYRLKTT

SEQ ID NO: 140561 - protein, 15 aa, Borrelia burgdorferi B31
LNRVVNAWLNSPSHK

SEQ ID NO: 140562 - protein, 9 aa, Borrelia burgdorferi B31
VVNAWLNSP

SEQ ID NO: 140563 - protein, 15 aa, Borrelia burgdorferi B31
ELNRVVNAWLNSPSH

SEQ ID NO: 140564 - protein, 9 aa, Borrelia burgdorferi B31
VVNAWLNSP

SEQ ID NO: 140565 - protein, 15 aa, Borrelia burgdorferi B31
EYAIKLGENRTITHT

SEQ ID NO: 140566 - protein, 9 aa, Borrelia burgdorferi B31
IKLGENRTI

SEQ ID NO: 140567 - protein, 15 aa, Borrelia burgdorferi B31
DQSFNLTREILASGI

SEQ ID NO: 140568 - protein, 9 aa, Borrelia burgdorferi B31
LTREILASG

SEQ ID NO: 140569 - protein, 15 aa, Borrelia burgdorferi B31
KEYAIKLGENRTITH

SEQ ID NO: 140570 - protein, 9 aa, Borrelia burgdorferi B31
IKLGENRTI

SEQ ID NO: 140571 - protein, 15 aa, Borrelia burgdorferi B31
QSFNLTREILASGIE

SEQ ID NO: 140572 - protein, 9 aa, Borrelia burgdorferi B31
LTREILASG

SEQ ID NO: 140573 - protein, 15 aa, Borrelia burgdorferi B31
EKVAKEYAIKLGENR

SEQ ID NO: 140574 - protein, 9 aa, Borrelia burgdorferi B31
VAKEYAIKL

SEQ ID NO: 140575 - protein, 15 aa, Borrelia burgdorferi B31
YAIKLGENRTITHTL

SEQ ID NO: 140576 - protein, 9 aa, Borrelia burgdorferi B31
IKLGENRTI

SEQ ID NO: 140577 - protein, 15 aa, Borrelia burgdorferi B31
GIELNRVVNAWLNSP

SEQ ID NO: 140578 - protein, 9 aa, Borrelia burgdorferi B31
IELNRVVNA

SEQ ID NO: 140579 - protein, 15 aa, Borrelia burgdorferi B31
LTREILASGIELNRV

SEQ ID NO: 140580 - protein, 9 aa, Borrelia burgdorferi B31
ILASGIELN

SEQ ID NO: 140581 - protein, 15 aa, Borrelia burgdorferi B31
SFNLTREILASGIEL

SEQ ID NO: 140582 - protein, 9 aa, Borrelia burgdorferi B31
LTREILASG

SEQ ID NO: 140583 - protein, 15 aa, Borrelia burgdorferi B31
DTLEKVAKEYAIKLG

SEQ ID NO: 140584 - protein, 9 aa, Borrelia burgdorferi B31
VAKEYAIKL

SEQ ID NO: 140585 - protein, 15 aa, Borrelia burgdorferi B31
LEKVAKEYAIKLGEN

SEQ ID NO: 140586 - protein, 9 aa, Borrelia burgdorferi B31
VAKEYAIKL

SEQ ID NO: 140587 - protein, 15 aa, Borrelia burgdorferi B31
KEDMKILYSEIAELR

SEQ ID NO: 140588 - protein, 9 aa, Borrelia burgdorferi B31
MKILYSEIA

SEQ ID NO: 140589 - protein, 15 aa, Borrelia burgdorferi B31
EDMKILYSEIAELRK

SEQ ID NO: 140590 - protein, 9 aa, Borrelia burgdorferi B31
MKILYSEIA

SEQ ID NO: 140591 - protein, 15 aa, Borrelia burgdorferi B31
IDTKEDMKILYSEIA

SEQ ID NO: 140592 - protein, 9 aa, Borrelia burgdorferi B31
TKEDMKILY

SEQ ID NO: 140593 - protein, 15 aa, Borrelia burgdorferi B31
DTKEDMKILYSEIAE

SEQ ID NO: 140594 - protein, 9 aa, Borrelia burgdorferi B31
MKILYSEIA

SEQ ID NO: 140595 - protein, 15 aa, Borrelia burgdorferi B31
TKEDMKILYSEIAEL

SEQ ID NO: 140596 - protein, 9 aa, Borrelia burgdorferi B31
MKILYSEIA

SEQ ID NO: 140597 - protein, 15 aa, Borrelia burgdorferi B31
DMKILYSEIAELRKK

SEQ ID NO: 140598 - protein, 9 aa, Borrelia burgdorferi B31
MKILYSEIA

SEQ ID NO: 140599 - protein, 15 aa, Borrelia burgdorferi B31
MKILYSEIAELRKKL

SEQ ID NO: 140600 - protein, 9 aa, Borrelia burgdorferi B31
MKILYSEIA

SEQ ID NO: 140601 - protein, 15 aa, Borrelia burgdorferi B31
IIIFTLFLSQACNLS

SEQ ID NO: 140602 - protein, 9 aa, Borrelia burgdorferi B31
IIFTLFLSQ

SEQ ID NO: 140603 - protein, 15 aa, Borrelia burgdorferi B31
IIFTLFLSQACNLST

SEQ ID NO: 140604 - protein, 9 aa, Borrelia burgdorferi B31
FLSQACNLS

SEQ ID NO: 140605 - protein, 15 aa, Borrelia burgdorferi B31
IFTLFLSQACNLSTM

SEQ ID NO: 140606 - protein, 9 aa, Borrelia burgdorferi B31
FLSQACNLS

SEQ ID NO: 140607 - protein, 15 aa, Borrelia burgdorferi B31
FTLFLSQACNLSTMH

SEQ ID NO: 140608 - protein, 9 aa, Borrelia burgdorferi B31
FLSQACNLS

SEQ ID NO: 140609 - protein, 15 aa, Borrelia burgdorferi B31
TLFLSQACNLSTMHK

SEQ ID NO: 140610 - protein, 9 aa, Borrelia burgdorferi B31
FLSQACNLS

SEQ ID NO: 140611 - protein, 15 aa, Borrelia burgdorferi B31
NRVVNAWLNSPSHKE

SEQ ID NO: 140612 - protein, 9 aa, Borrelia burgdorferi B31
VVNAWLNSP

SEQ ID NO: 140613 - protein, 15 aa, Borrelia burgdorferi B31
ELNRVVNAWLNSPSH

SEQ ID NO: 140614 - protein, 9 aa, Borrelia burgdorferi B31
VVNAWLNSP

SEQ ID NO: 140615 - protein, 15 aa, Borrelia burgdorferi B31
LNRVVNAWLNSPSHK

SEQ ID NO: 140616 - protein, 9 aa, Borrelia burgdorferi B31
VVNAWLNSP

SEQ ID NO: 140617 - protein, 15 aa, Borrelia burgdorferi B31
GIELNRVVNAWLNSP

SEQ ID NO: 140618 - protein, 9 aa, Borrelia burgdorferi B31
ELNRVVNAW

SEQ ID NO: 140619 - protein, 15 aa, Borrelia burgdorferi B31
IELNRVVNAWLNSPS

SEQ ID NO: 140620 - protein, 9 aa, Borrelia burgdorferi B31
VVNAWLNSP

SEQ ID NO: 140621 - protein, 15 aa, Borrelia burgdorferi B31
RVVNAWLNSPSHKEA

SEQ ID NO: 140622 - protein, 9 aa, Borrelia burgdorferi B31
VVNAWLNSP

SEQ ID NO: 140623 - protein, 15 aa, Borrelia burgdorferi B31
VVNAWLNSPSHKEAL

SEQ ID NO: 140624 - protein, 9 aa, Borrelia burgdorferi B31
VVNAWLNSP

SEQ ID NO: 140625 - protein, 15 aa, Borrelia burgdorferi B31
IIIFTLFLSQACNLS

SEQ ID NO: 140626 - protein, 9 aa, Borrelia burgdorferi B31
IFTLFLSQA

SEQ ID NO: 140627 - protein, 15 aa, Borrelia burgdorferi B31
IIFTLFLSQACNLST

SEQ ID NO: 140628 - protein, 9 aa, Borrelia burgdorferi B31
FLSQACNLS

SEQ ID NO: 140629 - protein, 15 aa, Borrelia burgdorferi B31
RTITHTLFGTTPMQR

SEQ ID NO: 140630 - protein, 9 aa, Borrelia burgdorferi B31
ITHTLFGTT

SEQ ID NO: 140631 - protein, 15 aa, Borrelia burgdorferi B31
TLFLSQACNLSTMHK

SEQ ID NO: 140632 - protein, 9 aa, Borrelia burgdorferi B31
FLSQACNLS

SEQ ID NO: 140633 - protein, 15 aa, Borrelia burgdorferi B31
MKKLIIIFTLFLSQA

SEQ ID NO: 140634 - protein, 9 aa, Borrelia burgdorferi B31
LIIIFTLFL

SEQ ID NO: 140635 - protein, 15 aa, Borrelia burgdorferi B31
KKLIIIFTLFLSQAC

SEQ ID NO: 140636 - protein, 9 aa, Borrelia burgdorferi B31
LIIIFTLFL

SEQ ID NO: 140637 - protein, 15 aa, Borrelia burgdorferi B31
IFTLFLSQACNLSTM

SEQ ID NO: 140638 - protein, 9 aa, Borrelia burgdorferi B31
FLSQACNLS

SEQ ID NO: 140639 - protein, 15 aa, Borrelia burgdorferi B31
HKEALINTDTDKIGG

SEQ ID NO: 140640 - protein, 9 aa, Borrelia burgdorferi B31
LINTDTDKI

SEQ ID NO: 140641 - protein, 15 aa, Borrelia burgdorferi B31
FTLFLSQACNLSTMH

SEQ ID NO: 140642 - protein, 9 aa, Borrelia burgdorferi B31
FLSQACNLS

SEQ ID NO: 140643 - protein, 15 aa, Borrelia burgdorferi B31
SHKEALINTDTDKIG

SEQ ID NO: 140644 - protein, 9 aa, Borrelia burgdorferi B31
LINTDTDKI

SEQ ID NO: 140645 - protein, 15 aa, Borrelia burgdorferi B31
NRTITHTLFGTTPMQ

SEQ ID NO: 140646 - protein, 9 aa, Borrelia burgdorferi B31
ITHTLFGTT

SEQ ID NO: 140647 - protein, 15 aa, Borrelia burgdorferi B31
TITHTLFGTTPMQRI

SEQ ID NO: 140648 - protein, 9 aa, Borrelia burgdorferi B31
ITHTLFGTT

SEQ ID NO: 140649 - protein, 15 aa, Borrelia burgdorferi B31
PSHKEALINTDTDKI

SEQ ID NO: 140650 - protein, 9 aa, Borrelia burgdorferi B31
EALINTDTD

SEQ ID NO: 140651 - protein, 15 aa, Borrelia burgdorferi B31
KEALINTDTDKIGGY

SEQ ID NO: 140652 - protein, 9 aa, Borrelia burgdorferi B31
LINTDTDKI

SEQ ID NO: 140653 - protein, 15 aa, Borrelia burgdorferi B31
EALINTDTDKIGGYR

SEQ ID NO: 140654 - protein, 9 aa, Borrelia burgdorferi B31
LINTDTDKI

SEQ ID NO: 140655 - protein, 15 aa, Borrelia burgdorferi B31
GENRTITHTLFGTTP

SEQ ID NO: 140656 - protein, 9 aa, Borrelia burgdorferi B31
ITHTLFGTT

SEQ ID NO: 140657 - protein, 15 aa, Borrelia burgdorferi B31
IELNRVVNAWLNSPS

SEQ ID NO: 140658 - protein, 9 aa, Borrelia burgdorferi B31
NRVVNAWLN

SEQ ID NO: 140659 - protein, 15 aa, Borrelia burgdorferi B31
ELNRVVNAWLNSPSH

SEQ ID NO: 140660 - protein, 9 aa, Borrelia burgdorferi B31
VNAWLNSPS

SEQ ID NO: 140661 - protein, 15 aa, Borrelia burgdorferi B31
NRVVNAWLNSPSHKE

SEQ ID NO: 140662 - protein, 9 aa, Borrelia burgdorferi B31
VNAWLNSPS

SEQ ID NO: 140663 - protein, 15 aa, Borrelia burgdorferi B31
LNRVVNAWLNSPSHK

SEQ ID NO: 140664 - protein, 9 aa, Borrelia burgdorferi B31
VNAWLNSPS

SEQ ID NO: 140665 - protein, 15 aa, Borrelia burgdorferi B31
RVVNAWLNSPSHKEA

SEQ ID NO: 140666 - protein, 9 aa, Borrelia burgdorferi B31
VNAWLNSPS

SEQ ID NO: 140667 - protein, 15 aa, Borrelia burgdorferi B31
VVNAWLNSPSHKEAL

SEQ ID NO: 140668 - protein, 9 aa, Borrelia burgdorferi B31
VNAWLNSPS

SEQ ID NO: 140669 - protein, 15 aa, Borrelia burgdorferi B31
VNAWLNSPSHKEALI

SEQ ID NO: 140670 - protein, 9 aa, Borrelia burgdorferi B31
VNAWLNSPS

SEQ ID NO: 140671 - protein, 15 aa, Borrelia burgdorferi B31
IIIFTLFLSQACNLS

SEQ ID NO: 140672 - protein, 9 aa, Borrelia burgdorferi B31
FTLFLSQAC

SEQ ID NO: 140673 - protein, 15 aa, Borrelia burgdorferi B31
KKLIIIFTLFLSQAC

SEQ ID NO: 140674 - protein, 9 aa, Borrelia burgdorferi B31
IIIFTLFLS

SEQ ID NO: 140675 - protein, 15 aa, Borrelia burgdorferi B31
IIFTLFLSQACNLST

SEQ ID NO: 140676 - protein, 9 aa, Borrelia burgdorferi B31
FLSQACNLS

SEQ ID NO: 140677 - protein, 15 aa, Borrelia burgdorferi B31
GIELNRVVNAWLNSP

SEQ ID NO: 140678 - protein, 9 aa, Borrelia burgdorferi B31
NRVVNAWLN

SEQ ID NO: 140679 - protein, 15 aa, Borrelia burgdorferi B31
KLIIIFTLFLSQACN

SEQ ID NO: 140680 - protein, 9 aa, Borrelia burgdorferi B31
IIIFTLFLS

SEQ ID NO: 140681 - protein, 15 aa, Borrelia burgdorferi B31
HKYDQSFNLTREILA

SEQ ID NO: 140682 - protein, 9 aa, Borrelia burgdorferi B31
YDQSFNLTR

SEQ ID NO: 140683 - protein, 15 aa, Borrelia burgdorferi B31
FTLFLSQACNLSTMH

SEQ ID NO: 140684 - protein, 9 aa, Borrelia burgdorferi B31
FLSQACNLS

SEQ ID NO: 140685 - protein, 15 aa, Borrelia burgdorferi B31
IFTLFLSQACNLSTM

SEQ ID NO: 140686 - protein, 9 aa, Borrelia burgdorferi B31
FLSQACNLS

SEQ ID NO: 140687 - protein, 15 aa, Borrelia burgdorferi B31
VNAWLNSPSHKEALI

SEQ ID NO: 140688 - protein, 9 aa, Borrelia burgdorferi B31
WLNSPSHKE

SEQ ID NO: 140689 - protein, 15 aa, Borrelia burgdorferi B31
VVNAWLNSPSHKEAL

SEQ ID NO: 140690 - protein, 9 aa, Borrelia burgdorferi B31
WLNSPSHKE

SEQ ID NO: 140691 - protein, 15 aa, Borrelia burgdorferi B31
NAWLNSPSHKEALIN

SEQ ID NO: 140692 - protein, 9 aa, Borrelia burgdorferi B31
WLNSPSHKE

SEQ ID NO: 140693 - protein, 15 aa, Borrelia burgdorferi B31
RVVNAWLNSPSHKEA

SEQ ID NO: 140694 - protein, 9 aa, Borrelia burgdorferi B31
WLNSPSHKE

SEQ ID NO: 140695 - protein, 15 aa, Borrelia burgdorferi B31
NRVVNAWLNSPSHKE

SEQ ID NO: 140696 - protein, 9 aa, Borrelia burgdorferi B31
VNAWLNSPS

SEQ ID NO: 140697 - protein, 15 aa, Borrelia burgdorferi B31
MKKLIIIFTLFLSQA

SEQ ID NO: 140698 - protein, 9 aa, Borrelia burgdorferi B31
IIIFTLFLS

SEQ ID NO: 140699 - protein, 15 aa, Borrelia burgdorferi B31
KKLIIIFTLFLSQAC

SEQ ID NO: 140700 - protein, 9 aa, Borrelia burgdorferi B31
IIIFTLFLS

SEQ ID NO: 140701 - protein, 15 aa, Borrelia burgdorferi B31
IELNRVVNAWLNSPS

SEQ ID NO: 140702 - protein, 9 aa, Borrelia burgdorferi B31
VVNAWLNSP

SEQ ID NO: 140703 - protein, 15 aa, Borrelia burgdorferi B31
KLIIIFTLFLSQACN

SEQ ID NO: 140704 - protein, 9 aa, Borrelia burgdorferi B31
IIIFTLFLS

SEQ ID NO: 140705 - protein, 15 aa, Borrelia burgdorferi B31
ELNRVVNAWLNSPSH

SEQ ID NO: 140706 - protein, 9 aa, Borrelia burgdorferi B31
VVNAWLNSP

SEQ ID NO: 140707 - protein, 15 aa, Borrelia burgdorferi B31
LNRVVNAWLNSPSHK

SEQ ID NO: 140708 - protein, 9 aa, Borrelia burgdorferi B31
VVNAWLNSP

SEQ ID NO: 140709 - protein, 15 aa, Borrelia burgdorferi B31
NRVVNAWLNSPSHKE

SEQ ID NO: 140710 - protein, 9 aa, Borrelia burgdorferi B31
VVNAWLNSP

SEQ ID NO: 140711 - protein, 15 aa, Borrelia burgdorferi B31
GIELNRVVNAWLNSP

SEQ ID NO: 140712 - protein, 9 aa, Borrelia burgdorferi B31
LNRVVNAWL

SEQ ID NO: 140713 - protein, 15 aa, Borrelia burgdorferi B31
IIIFTLFLSQACNLS

SEQ ID NO: 140714 - protein, 9 aa, Borrelia burgdorferi B31
IIIFTLFLS

SEQ ID NO: 140715 - protein, 15 aa, Borrelia burgdorferi B31
RVVNAWLNSPSHKEA

SEQ ID NO: 140716 - protein, 9 aa, Borrelia burgdorferi B31
VNAWLNSPS

SEQ ID NO: 140717 - protein, 15 aa, Borrelia burgdorferi B31
LIIIFTLFLSQACNL

SEQ ID NO: 140718 - protein, 9 aa, Borrelia burgdorferi B31
IIIFTLFLS

SEQ ID NO: 140719 - protein, 15 aa, Borrelia burgdorferi B31
DNIDIFVVLFGKRKY

SEQ ID NO: 140720 - protein, 9 aa, Borrelia burgdorferi B31
IFVVLFGKR

SEQ ID NO: 140721 - protein, 15 aa, Borrelia burgdorferi B31
NIDIFVVLFGKRKYK

SEQ ID NO: 140722 - protein, 9 aa, Borrelia burgdorferi B31
IFVVLFGKR

SEQ ID NO: 140723 - protein, 15 aa, Borrelia burgdorferi B31
DNIDIFVVLFGKRKY

SEQ ID NO: 140724 - protein, 9 aa, Borrelia burgdorferi B31
IFVVLFGKR

SEQ ID NO: 140725 - protein, 15 aa, Borrelia burgdorferi B31
IDIFVVLFGKRKYKN

SEQ ID NO: 140726 - protein, 9 aa, Borrelia burgdorferi B31
IFVVLFGKR

SEQ ID NO: 140727 - protein, 15 aa, Borrelia burgdorferi B31
LNRVVNAWLNSPSHK

SEQ ID NO: 140728 - protein, 9 aa, Borrelia burgdorferi B31
VNAWLNSPS

SEQ ID NO: 140729 - protein, 15 aa, Borrelia burgdorferi B31
ELNRVVNAWLNSPSH

SEQ ID NO: 140730 - protein, 9 aa, Borrelia burgdorferi B31
VNAWLNSPS

SEQ ID NO: 140731 - protein, 15 aa, Borrelia burgdorferi B31
NRVVNAWLNSPSHKE

SEQ ID NO: 140732 - protein, 9 aa, Borrelia burgdorferi B31
VNAWLNSPS

SEQ ID NO: 140733 - protein, 15 aa, Borrelia burgdorferi B31
TDNIDIFVVLFGKRK

SEQ ID NO: 140734 - protein, 9 aa, Borrelia burgdorferi B31
IFVVLFGKR

SEQ ID NO: 140735 - protein, 15 aa, Borrelia burgdorferi B31
RVVNAWLNSPSHKEA

SEQ ID NO: 140736 - protein, 9 aa, Borrelia burgdorferi B31
VNAWLNSPS

SEQ ID NO: 140737 - protein, 15 aa, Borrelia burgdorferi B31
IELNRVVNAWLNSPS

SEQ ID NO: 140738 - protein, 9 aa, Borrelia burgdorferi B31
LNRVVNAWL

SEQ ID NO: 140739 - protein, 15 aa, Borrelia burgdorferi B31
KKLIIIFTLFLSQAC

SEQ ID NO: 140740 - protein, 9 aa, Borrelia burgdorferi B31
IIIFTLFLS

SEQ ID NO: 140741 - protein, 15 aa, Borrelia burgdorferi B31
KLIIIFTLFLSQACN

SEQ ID NO: 140742 - protein, 9 aa, Borrelia burgdorferi B31
IIIFTLFLS

SEQ ID NO: 140743 - protein, 15 aa, Borrelia burgdorferi B31
MKKLIIIFTLFLSQA

SEQ ID NO: 140744 - protein, 9 aa, Borrelia burgdorferi B31
IIIFTLFLS

SEQ ID NO: 140745 - protein, 15 aa, Borrelia burgdorferi B31
SEIAELRKKLNLNHL

SEQ ID NO: 140746 - protein, 9 aa, Borrelia burgdorferi B31
LRKKLNLNH

SEQ ID NO: 140747 - protein, 15 aa, Borrelia burgdorferi B31
YSEIAELRKKLNLNH

SEQ ID NO: 140748 - protein, 9 aa, Borrelia burgdorferi B31
ELRKKLNLN

SEQ ID NO: 140749 - protein, 15 aa, Borrelia burgdorferi B31
EIAELRKKLNLNHLE

SEQ ID NO: 140750 - protein, 9 aa, Borrelia burgdorferi B31
LRKKLNLNH

SEQ ID NO: 140751 - protein, 15 aa, Borrelia burgdorferi B31
IAELRKKLNLNHLEI

SEQ ID NO: 140752 - protein, 9 aa, Borrelia burgdorferi B31
LRKKLNLNH

SEQ ID NO: 140753 - protein, 15 aa, Borrelia burgdorferi B31
AELRKKLNLNHLEID

SEQ ID NO: 140754 - protein, 9 aa, Borrelia burgdorferi B31
LRKKLNLNH

SEQ ID NO: 140755 - protein, 15 aa, Borrelia burgdorferi B31
TTDNIDIFVVLFGKR

SEQ ID NO: 140756 - protein, 9 aa, Borrelia burgdorferi B31
DIFVVLFGK

SEQ ID NO: 140757 - protein, 15 aa, Borrelia burgdorferi B31
VVNAWLNSPSHKEAL

SEQ ID NO: 140758 - protein, 9 aa, Borrelia burgdorferi B31
VNAWLNSPS

SEQ ID NO: 140759 - protein, 15 aa, Borrelia burgdorferi B31
RTITHTLFGTTPMQR

SEQ ID NO: 140760 - protein, 9 aa, Borrelia burgdorferi B31
ITHTLFGTT

SEQ ID NO: 140761 - protein, 15 aa, Borrelia burgdorferi B31
LIIIFTLFLSQACNL

SEQ ID NO: 140762 - protein, 9 aa, Borrelia burgdorferi B31
IIIFTLFLS

SEQ ID NO: 140763 - protein, 15 aa, Borrelia burgdorferi B31
TITHTLFGTTPMQRI

SEQ ID NO: 140764 - protein, 9 aa, Borrelia burgdorferi B31
LFGTTPMQR

SEQ ID NO: 140765 - protein, 15 aa, Borrelia burgdorferi B31
HTLFGTTPMQRIHKY

SEQ ID NO: 140766 - protein, 9 aa, Borrelia burgdorferi B31
LFGTTPMQR

SEQ ID NO: 140767 - protein, 15 aa, Borrelia burgdorferi B31
THTLFGTTPMQRIHK

SEQ ID NO: 140768 - protein, 9 aa, Borrelia burgdorferi B31
LFGTTPMQR

SEQ ID NO: 140769 - protein, 15 aa, Borrelia burgdorferi B31
SLTPEEAEKLESLKV

SEQ ID NO: 140770 - protein, 9 aa, Borrelia burgdorferi B31
LTPEEAEKL

SEQ ID NO: 140771 - protein, 15 aa, Borrelia burgdorferi B31
MQRISILLMLLAVFS

SEQ ID NO: 140772 - protein, 9 aa, Borrelia burgdorferi B31
MQRISILLM

SEQ ID NO: 140773 - protein, 15 aa, Borrelia burgdorferi B31
ISILLMLLAVFSCKQ

SEQ ID NO: 140774 - protein, 9 aa, Borrelia burgdorferi B31
LLMLLAVFS

SEQ ID NO: 140775 - protein, 15 aa, Borrelia burgdorferi B31
QRISILLMLLAVFSC

SEQ ID NO: 140776 - protein, 9 aa, Borrelia burgdorferi B31
LLMLLAVFS

SEQ ID NO: 140777 - protein, 15 aa, Borrelia burgdorferi B31
RISILLMLLAVFSCK

SEQ ID NO: 140778 - protein, 9 aa, Borrelia burgdorferi B31
LLMLLAVFS

SEQ ID NO: 140779 - protein, 15 aa, Borrelia burgdorferi B31
SILLMLLAVFSCKQF

SEQ ID NO: 140780 - protein, 9 aa, Borrelia burgdorferi B31
LLMLLAVFS

SEQ ID NO: 140781 - protein, 15 aa, Borrelia burgdorferi B31
ILLMLLAVFSCKQFG

SEQ ID NO: 140782 - protein, 9 aa, Borrelia burgdorferi B31
LLMLLAVFS

SEQ ID NO: 140783 - protein, 15 aa, Borrelia burgdorferi B31
LLMLLAVFSCKQFGD

SEQ ID NO: 140784 - protein, 9 aa, Borrelia burgdorferi B31
LLMLLAVFS

SEQ ID NO: 140785 - protein, 15 aa, Borrelia burgdorferi B31
ISSFDNISSIVSKAV

SEQ ID NO: 140786 - protein, 9 aa, Borrelia burgdorferi B31
FDNISSIVS

SEQ ID NO: 140787 - protein, 15 aa, Borrelia burgdorferi B31
SSFDNISSIVSKAVD

SEQ ID NO: 140788 - protein, 9 aa, Borrelia burgdorferi B31
FDNISSIVS

SEQ ID NO: 140789 - protein, 15 aa, Borrelia burgdorferi B31
KEFISSFDNISSIVS

SEQ ID NO: 140790 - protein, 9 aa, Borrelia burgdorferi B31
FISSFDNIS

SEQ ID NO: 140791 - protein, 15 aa, Borrelia burgdorferi B31
FISSFDNISSIVSKA

SEQ ID NO: 140792 - protein, 9 aa, Borrelia burgdorferi B31
FDNISSIVS

SEQ ID NO: 140793 - protein, 15 aa, Borrelia burgdorferi B31
SLKVFLKDAMSVNGR

SEQ ID NO: 140794 - protein, 9 aa, Borrelia burgdorferi B31
LKDAMSVNG

SEQ ID NO: 140795 - protein, 15 aa, Borrelia burgdorferi B31
LKVFLKDAMSVNGRE

SEQ ID NO: 140796 - protein, 9 aa, Borrelia burgdorferi B31
LKDAMSVNG

SEQ ID NO: 140797 - protein, 15 aa, Borrelia burgdorferi B31
EFISSFDNISSIVSK

SEQ ID NO: 140798 - protein, 9 aa, Borrelia burgdorferi B31
FDNISSIVS

SEQ ID NO: 140799 - protein, 15 aa, Borrelia burgdorferi B31
ESLKVFLKDAMSVNG

SEQ ID NO: 140800 - protein, 9 aa, Borrelia burgdorferi B31
VFLKDAMSV

SEQ ID NO: 140801 - protein, 15 aa, Borrelia burgdorferi B31
KVFLKDAMSVNGREE

SEQ ID NO: 140802 - protein, 9 aa, Borrelia burgdorferi B31
LKDAMSVNG

SEQ ID NO: 140803 - protein, 15 aa, Borrelia burgdorferi B31
FDNISSIVSKAVDAS

SEQ ID NO: 140804 - protein, 9 aa, Borrelia burgdorferi B31
ISSIVSKAV

SEQ ID NO: 140805 - protein, 15 aa, Borrelia burgdorferi B31
VFLKDAMSVNGREEA

SEQ ID NO: 140806 - protein, 9 aa, Borrelia burgdorferi B31
LKDAMSVNG

SEQ ID NO: 140807 - protein, 15 aa, Borrelia burgdorferi B31
SFDNISSIVSKAVDA

SEQ ID NO: 140808 - protein, 9 aa, Borrelia burgdorferi B31
ISSIVSKAV

SEQ ID NO: 140809 - protein, 15 aa, Borrelia burgdorferi B31
MMQRISILLMLLAVF

SEQ ID NO: 140810 - protein, 9 aa, Borrelia burgdorferi B31
MMQRISILL

SEQ ID NO: 140811 - protein, 15 aa, Borrelia burgdorferi B31
DNISSIVSKAVDASK

SEQ ID NO: 140812 - protein, 9 aa, Borrelia burgdorferi B31
ISSIVSKAV

SEQ ID NO: 140813 - protein, 15 aa, Borrelia burgdorferi B31
LESLKVFLKDAMSVN

SEQ ID NO: 140814 - protein, 9 aa, Borrelia burgdorferi B31
VFLKDAMSV

SEQ ID NO: 140815 - protein, 15 aa, Borrelia burgdorferi B31
KLESLKVFLKDAMSV

SEQ ID NO: 140816 - protein, 9 aa, Borrelia burgdorferi B31
SLKVFLKDA

SEQ ID NO: 140817 - protein, 15 aa, Borrelia burgdorferi B31
DVVKDLIPKEISLTP

SEQ ID NO: 140818 - protein, 9 aa, Borrelia burgdorferi B31
VKDLIPKEI

SEQ ID NO: 140819 - protein, 15 aa, Borrelia burgdorferi B31
IPKEISLTPEEAEKL

SEQ ID NO: 140820 - protein, 9 aa, Borrelia burgdorferi B31
IPKEISLTP

SEQ ID NO: 140821 - protein, 15 aa, Borrelia burgdorferi B31
SDVVKDLIPKEISLT

SEQ ID NO: 140822 - protein, 9 aa, Borrelia burgdorferi B31
VKDLIPKEI

SEQ ID NO: 140823 - protein, 15 aa, Borrelia burgdorferi B31
PKEISLTPEEAEKLE

SEQ ID NO: 140824 - protein, 9 aa, Borrelia burgdorferi B31
LTPEEAEKL

SEQ ID NO: 140825 - protein, 15 aa, Borrelia burgdorferi B31
EISLTPEEAEKLESL

SEQ ID NO: 140826 - protein, 9 aa, Borrelia burgdorferi B31
LTPEEAEKL

SEQ ID NO: 140827 - protein, 15 aa, Borrelia burgdorferi B31
FLKDAMSVNGREEAL

SEQ ID NO: 140828 - protein, 9 aa, Borrelia burgdorferi B31
LKDAMSVNG

SEQ ID NO: 140829 - protein, 15 aa, Borrelia burgdorferi B31
KEISLTPEEAEKLES

SEQ ID NO: 140830 - protein, 9 aa, Borrelia burgdorferi B31
LTPEEAEKL

SEQ ID NO: 140831 - protein, 15 aa, Borrelia burgdorferi B31
ISLTPEEAEKLESLK

SEQ ID NO: 140832 - protein, 9 aa, Borrelia burgdorferi B31
LTPEEAEKL

SEQ ID NO: 140833 - protein, 15 aa, Borrelia burgdorferi B31
VVKDLIPKEISLTPE

SEQ ID NO: 140834 - protein, 9 aa, Borrelia burgdorferi B31
LIPKEISLT

SEQ ID NO: 140835 - protein, 15 aa, Borrelia burgdorferi B31
VKDLIPKEISLTPEE

SEQ ID NO: 140836 - protein, 9 aa, Borrelia burgdorferi B31
LIPKEISLT

SEQ ID NO: 140837 - protein, 15 aa, Borrelia burgdorferi B31
ISSIVSKAVDASKKR

SEQ ID NO: 140838 - protein, 9 aa, Borrelia burgdorferi B31
ISSIVSKAV

SEQ ID NO: 140839 - protein, 15 aa, Borrelia burgdorferi B31
NISSIVSKAVDASKK

SEQ ID NO: 140840 - protein, 9 aa, Borrelia burgdorferi B31
ISSIVSKAV

SEQ ID NO: 140841 - protein, 15 aa, Borrelia burgdorferi B31
EEIFKVIKKVLTESE

SEQ ID NO: 140842 - protein, 9 aa, Borrelia burgdorferi B31
FKVIKKVLT

SEQ ID NO: 140843 - protein, 15 aa, Borrelia burgdorferi B31
EIFKVIKKVLTESES

SEQ ID NO: 140844 - protein, 9 aa, Borrelia burgdorferi B31
FKVIKKVLT

SEQ ID NO: 140845 - protein, 15 aa, Borrelia burgdorferi B31
LKDAMSVNGREEALK

SEQ ID NO: 140846 - protein, 9 aa, Borrelia burgdorferi B31
LKDAMSVNG

SEQ ID NO: 140847 - protein, 15 aa, Borrelia burgdorferi B31
VCYKIKNSKGEALSL

SEQ ID NO: 140848 - protein, 9 aa, Borrelia burgdorferi B31
IKNSKGEAL

SEQ ID NO: 140849 - protein, 15 aa, Borrelia burgdorferi B31
KDLIPKEISLTPEEA

SEQ ID NO: 140850 - protein, 9 aa, Borrelia burgdorferi B31
LIPKEISLT

SEQ ID NO: 140851 - protein, 15 aa, Borrelia burgdorferi B31
YKIKNSKGEALSLFF

SEQ ID NO: 140852 - protein, 9 aa, Borrelia burgdorferi B31
IKNSKGEAL

SEQ ID NO: 140853 - protein, 15 aa, Borrelia burgdorferi B31
CYKIKNSKGEALSLF

SEQ ID NO: 140854 - protein, 9 aa, Borrelia burgdorferi B31
IKNSKGEAL

SEQ ID NO: 140855 - protein, 15 aa, Borrelia burgdorferi B31
NEEIFKVIKKVLTES

SEQ ID NO: 140856 - protein, 9 aa, Borrelia burgdorferi B31
FKVIKKVLT

SEQ ID NO: 140857 - protein, 15 aa, Borrelia burgdorferi B31
YVCYKIKNSKGEALS

SEQ ID NO: 140858 - protein, 9 aa, Borrelia burgdorferi B31
IKNSKGEAL

SEQ ID NO: 140859 - protein, 15 aa, Borrelia burgdorferi B31
EYVCYKIKNSKGEAL

SEQ ID NO: 140860 - protein, 9 aa, Borrelia burgdorferi B31
YKIKNSKGE

SEQ ID NO: 140861 - protein, 15 aa, Borrelia burgdorferi B31
IDSGNGIPLVVSDVV

SEQ ID NO: 140862 - protein, 9 aa, Borrelia burgdorferi B31
GNGIPLVVS

SEQ ID NO: 140863 - protein, 15 aa, Borrelia burgdorferi B31
LTEIDSGNGIPLVVS

SEQ ID NO: 140864 - protein, 9 aa, Borrelia burgdorferi B31
IDSGNGIPL

SEQ ID NO: 140865 - protein, 15 aa, Borrelia burgdorferi B31
TEIDSGNGIPLVVSD

SEQ ID NO: 140866 - protein, 9 aa, Borrelia burgdorferi B31
GNGIPLVVS

SEQ ID NO: 140867 - protein, 15 aa, Borrelia burgdorferi B31
VSDVVKDLIPKEISL

SEQ ID NO: 140868 - protein, 9 aa, Borrelia burgdorferi B31
VKDLIPKEI

SEQ ID NO: 140869 - protein, 15 aa, Borrelia burgdorferi B31
VVSDVVKDLIPKEIS

SEQ ID NO: 140870 - protein, 9 aa, Borrelia burgdorferi B31
VKDLIPKEI

SEQ ID NO: 140871 - protein, 15 aa, Borrelia burgdorferi B31
CNEEIFKVIKKVLTE

SEQ ID NO: 140872 - protein, 9 aa, Borrelia burgdorferi B31
FKVIKKVLT

SEQ ID NO: 140873 - protein, 15 aa, Borrelia burgdorferi B31
KCNEEIFKVIKKVLT

SEQ ID NO: 140874 - protein, 9 aa, Borrelia burgdorferi B31
IFKVIKKVL

SEQ ID NO: 140875 - protein, 15 aa, Borrelia burgdorferi B31
LVVSDVVKDLIPKEI

SEQ ID NO: 140876 - protein, 9 aa, Borrelia burgdorferi B31
LVVSDVVKD

SEQ ID NO: 140877 - protein, 15 aa, Borrelia burgdorferi B31
LTPEEAEKLESLKVF

SEQ ID NO: 140878 - protein, 9 aa, Borrelia burgdorferi B31
LTPEEAEKL

SEQ ID NO: 140879 - protein, 15 aa, Borrelia burgdorferi B31
YKEFFDWLSKDVNRQ

SEQ ID NO: 140880 - protein, 9 aa, Borrelia burgdorferi B31
FFDWLSKDV

SEQ ID NO: 140881 - protein, 15 aa, Borrelia burgdorferi B31
IFKVIKKVLTESESN

SEQ ID NO: 140882 - protein, 9 aa, Borrelia burgdorferi B31
FKVIKKVLT

SEQ ID NO: 140883 - protein, 15 aa, Borrelia burgdorferi B31
FKVIKKVLTESESNN

SEQ ID NO: 140884 - protein, 9 aa, Borrelia burgdorferi B31
FKVIKKVLT

SEQ ID NO: 140885 - protein, 15 aa, Borrelia burgdorferi B31
KEFFDWLSKDVNRQK

SEQ ID NO: 140886 - protein, 9 aa, Borrelia burgdorferi B31
WLSKDVNRQ

SEQ ID NO: 140887 - protein, 15 aa, Borrelia burgdorferi B31
DSGNGIPLVVSDVVK

SEQ ID NO: 140888 - protein, 9 aa, Borrelia burgdorferi B31
GNGIPLVVS

SEQ ID NO: 140889 - protein, 15 aa, Borrelia burgdorferi B31
DLIPKEISLTPEEAE

SEQ ID NO: 140890 - protein, 9 aa, Borrelia burgdorferi B31
LIPKEISLT

SEQ ID NO: 140891 - protein, 15 aa, Borrelia burgdorferi B31
EIDSGNGIPLVVSDV

SEQ ID NO: 140892 - protein, 9 aa, Borrelia burgdorferi B31
GNGIPLVVS

SEQ ID NO: 140893 - protein, 15 aa, Borrelia burgdorferi B31
ESNNELKNLKNYGNV

SEQ ID NO: 140894 - protein, 9 aa, Borrelia burgdorferi B31
LKNLKNYGN

SEQ ID NO: 140895 - protein, 15 aa, Borrelia burgdorferi B31
KEFISSFDNISSIVS

SEQ ID NO: 140896 - protein, 9 aa, Borrelia burgdorferi B31
FISSFDNIS

SEQ ID NO: 140897 - protein, 15 aa, Borrelia burgdorferi B31
EIFKVIKKVLTESES

SEQ ID NO: 140898 - protein, 9 aa, Borrelia burgdorferi B31
FKVIKKVLT

SEQ ID NO: 140899 - protein, 15 aa, Borrelia burgdorferi B31
EEIFKVIKKVLTESE

SEQ ID NO: 140900 - protein, 9 aa, Borrelia burgdorferi B31
FKVIKKVLT

SEQ ID NO: 140901 - protein, 15 aa, Borrelia burgdorferi B31
NEEIFKVIKKVLTES

SEQ ID NO: 140902 - protein, 9 aa, Borrelia burgdorferi B31
FKVIKKVLT

SEQ ID NO: 140903 - protein, 15 aa, Borrelia burgdorferi B31
NRQKEFISSFDNISS

SEQ ID NO: 140904 - protein, 9 aa, Borrelia burgdorferi B31
FISSFDNIS

SEQ ID NO: 140905 - protein, 15 aa, Borrelia burgdorferi B31
RQKEFISSFDNISSI

SEQ ID NO: 140906 - protein, 9 aa, Borrelia burgdorferi B31
FISSFDNIS

SEQ ID NO: 140907 - protein, 15 aa, Borrelia burgdorferi B31
QKEFISSFDNISSIV

SEQ ID NO: 140908 - protein, 9 aa, Borrelia burgdorferi B31
FISSFDNIS

SEQ ID NO: 140909 - protein, 15 aa, Borrelia burgdorferi B31
ISILLMLLAVFSCKQ

SEQ ID NO: 140910 - protein, 9 aa, Borrelia burgdorferi B31
MLLAVFSCK

SEQ ID NO: 140911 - protein, 15 aa, Borrelia burgdorferi B31
SLFFQKVVDAFGADP

SEQ ID NO: 140912 - protein, 9 aa, Borrelia burgdorferi B31
FQKVVDAFG

SEQ ID NO: 140913 - protein, 15 aa, Borrelia burgdorferi B31
LFFQKVVDAFGADPY

SEQ ID NO: 140914 - protein, 9 aa, Borrelia burgdorferi B31
VVDAFGADP

SEQ ID NO: 140915 - protein, 15 aa, Borrelia burgdorferi B31
FQKVVDAFGADPYKK

SEQ ID NO: 140916 - protein, 9 aa, Borrelia burgdorferi B31
VVDAFGADP

SEQ ID NO: 140917 - protein, 15 aa, Borrelia burgdorferi B31
FFQKVVDAFGADPYK

SEQ ID NO: 140918 - protein, 9 aa, Borrelia burgdorferi B31
VVDAFGADP

SEQ ID NO: 140919 - protein, 15 aa, Borrelia burgdorferi B31
SILLMLLAVFSCKQF

SEQ ID NO: 140920 - protein, 9 aa, Borrelia burgdorferi B31
LLAVFSCKQ

SEQ ID NO: 140921 - protein, 15 aa, Borrelia burgdorferi B31
ILLMLLAVFSCKQFG

SEQ ID NO: 140922 - protein, 9 aa, Borrelia burgdorferi B31
LLAVFSCKQ

SEQ ID NO: 140923 - protein, 15 aa, Borrelia burgdorferi B31
QKVVDAFGADPYKKD

SEQ ID NO: 140924 - protein, 9 aa, Borrelia burgdorferi B31
VVDAFGADP

SEQ ID NO: 140925 - protein, 15 aa, Borrelia burgdorferi B31
ESLKVFLKDAMSVNG

SEQ ID NO: 140926 - protein, 9 aa, Borrelia burgdorferi B31
FLKDAMSVN

SEQ ID NO: 140927 - protein, 15 aa, Borrelia burgdorferi B31
SLKVFLKDAMSVNGR

SEQ ID NO: 140928 - protein, 9 aa, Borrelia burgdorferi B31
LKDAMSVNG

SEQ ID NO: 140929 - protein, 15 aa, Borrelia burgdorferi B31
LKVFLKDAMSVNGRE

SEQ ID NO: 140930 - protein, 9 aa, Borrelia burgdorferi B31
LKDAMSVNG

SEQ ID NO: 140931 - protein, 15 aa, Borrelia burgdorferi B31
KSYKEFFDWLSKDVN

SEQ ID NO: 140932 - protein, 9 aa, Borrelia burgdorferi B31
YKEFFDWLS

SEQ ID NO: 140933 - protein, 15 aa, Borrelia burgdorferi B31
EKSYKEFFDWLSKDV

SEQ ID NO: 140934 - protein, 9 aa, Borrelia burgdorferi B31
YKEFFDWLS

SEQ ID NO: 140935 - protein, 15 aa, Borrelia burgdorferi B31
YEKSYKEFFDWLSKD

SEQ ID NO: 140936 - protein, 9 aa, Borrelia burgdorferi B31
YKEFFDWLS

SEQ ID NO: 140937 - protein, 15 aa, Borrelia burgdorferi B31
YKEFFDWLSKDVNRQ

SEQ ID NO: 140938 - protein, 9 aa, Borrelia burgdorferi B31
YKEFFDWLS

SEQ ID NO: 140939 - protein, 15 aa, Borrelia burgdorferi B31
EYEKSYKEFFDWLSK

SEQ ID NO: 140940 - protein, 9 aa, Borrelia burgdorferi B31
YKEFFDWLS

SEQ ID NO: 140941 - protein, 15 aa, Borrelia burgdorferi B31
AEYEKSYKEFFDWLS

SEQ ID NO: 140942 - protein, 9 aa, Borrelia burgdorferi B31
YEKSYKEFF

SEQ ID NO: 140943 - protein, 15 aa, Borrelia burgdorferi B31
SYKEFFDWLSKDVNR

SEQ ID NO: 140944 - protein, 9 aa, Borrelia burgdorferi B31
YKEFFDWLS

SEQ ID NO: 140945 - protein, 15 aa, Borrelia burgdorferi B31
KEFISSFDNISSIVS

SEQ ID NO: 140946 - protein, 9 aa, Borrelia burgdorferi B31
ISSFDNISS

SEQ ID NO: 140947 - protein, 15 aa, Borrelia burgdorferi B31
EFISSFDNISSIVSK

SEQ ID NO: 140948 - protein, 9 aa, Borrelia burgdorferi B31
FDNISSIVS

SEQ ID NO: 140949 - protein, 15 aa, Borrelia burgdorferi B31
NRQKEFISSFDNISS

SEQ ID NO: 140950 - protein, 9 aa, Borrelia burgdorferi B31
FISSFDNIS

SEQ ID NO: 140951 - protein, 15 aa, Borrelia burgdorferi B31
RQKEFISSFDNISSI

SEQ ID NO: 140952 - protein, 9 aa, Borrelia burgdorferi B31
ISSFDNISS

SEQ ID NO: 140953 - protein, 15 aa, Borrelia burgdorferi B31
QKEFISSFDNISSIV

SEQ ID NO: 140954 - protein, 9 aa, Borrelia burgdorferi B31
ISSFDNISS

SEQ ID NO: 140955 - protein, 15 aa, Borrelia burgdorferi B31
FISSFDNISSIVSKA

SEQ ID NO: 140956 - protein, 9 aa, Borrelia burgdorferi B31
FDNISSIVS

SEQ ID NO: 140957 - protein, 15 aa, Borrelia burgdorferi B31
KEFFDWLSKDVNRQK

SEQ ID NO: 140958 - protein, 9 aa, Borrelia burgdorferi B31
FDWLSKDVN

SEQ ID NO: 140959 - protein, 15 aa, Borrelia burgdorferi B31
EFFDWLSKDVNRQKE

SEQ ID NO: 140960 - protein, 9 aa, Borrelia burgdorferi B31
FDWLSKDVN

SEQ ID NO: 140961 - protein, 15 aa, Borrelia burgdorferi B31
ISSFDNISSIVSKAV

SEQ ID NO: 140962 - protein, 9 aa, Borrelia burgdorferi B31
FDNISSIVS

SEQ ID NO: 140963 - protein, 15 aa, Borrelia burgdorferi B31
ISSFDNISSIVSKAV

SEQ ID NO: 140964 - protein, 9 aa, Borrelia burgdorferi B31
SFDNISSIV

SEQ ID NO: 140965 - protein, 15 aa, Borrelia burgdorferi B31
SSFDNISSIVSKAVD

SEQ ID NO: 140966 - protein, 9 aa, Borrelia burgdorferi B31
ISSIVSKAV

SEQ ID NO: 140967 - protein, 15 aa, Borrelia burgdorferi B31
SFDNISSIVSKAVDA

SEQ ID NO: 140968 - protein, 9 aa, Borrelia burgdorferi B31
ISSIVSKAV

SEQ ID NO: 140969 - protein, 15 aa, Borrelia burgdorferi B31
FDNISSIVSKAVDAS

SEQ ID NO: 140970 - protein, 9 aa, Borrelia burgdorferi B31
ISSIVSKAV

SEQ ID NO: 140971 - protein, 15 aa, Borrelia burgdorferi B31
DNISSIVSKAVDASK

SEQ ID NO: 140972 - protein, 9 aa, Borrelia burgdorferi B31
ISSIVSKAV

SEQ ID NO: 140973 - protein, 15 aa, Borrelia burgdorferi B31
NEEIFKVIKKVLTES

SEQ ID NO: 140974 - protein, 9 aa, Borrelia burgdorferi B31
FKVIKKVLT

SEQ ID NO: 140975 - protein, 15 aa, Borrelia burgdorferi B31
EEIFKVIKKVLTESE

SEQ ID NO: 140976 - protein, 9 aa, Borrelia burgdorferi B31
FKVIKKVLT

SEQ ID NO: 140977 - protein, 15 aa, Borrelia burgdorferi B31
KCNEEIFKVIKKVLT

SEQ ID NO: 140978 - protein, 9 aa, Borrelia burgdorferi B31
IFKVIKKVL

SEQ ID NO: 140979 - protein, 15 aa, Borrelia burgdorferi B31
CNEEIFKVIKKVLTE

SEQ ID NO: 140980 - protein, 9 aa, Borrelia burgdorferi B31
FKVIKKVLT

SEQ ID NO: 140981 - protein, 15 aa, Borrelia burgdorferi B31
EIFKVIKKVLTESES

SEQ ID NO: 140982 - protein, 9 aa, Borrelia burgdorferi B31
FKVIKKVLT

SEQ ID NO: 140983 - protein, 15 aa, Borrelia burgdorferi B31
IFKVIKKVLTESESN

SEQ ID NO: 140984 - protein, 9 aa, Borrelia burgdorferi B31
FKVIKKVLT

SEQ ID NO: 140985 - protein, 15 aa, Borrelia burgdorferi B31
FKVIKKVLTESESNN

SEQ ID NO: 140986 - protein, 9 aa, Borrelia burgdorferi B31
FKVIKKVLT

SEQ ID NO: 140987 - protein, 15 aa, Borrelia burgdorferi B31
MQRISILLMLLAVFS

SEQ ID NO: 140988 - protein, 9 aa, Borrelia burgdorferi B31
MQRISILLM

SEQ ID NO: 140989 - protein, 15 aa, Borrelia burgdorferi B31
MMQRISILLMLLAVF

SEQ ID NO: 140990 - protein, 9 aa, Borrelia burgdorferi B31
MQRISILLM

SEQ ID NO: 140991 - protein, 15 aa, Borrelia burgdorferi B31
SESNNELKNLKNYGN

SEQ ID NO: 140992 - protein, 9 aa, Borrelia burgdorferi B31
SNNELKNLK

SEQ ID NO: 140993 - protein, 15 aa, Borrelia burgdorferi B31
QRISILLMLLAVFSC

SEQ ID NO: 140994 - protein, 9 aa, Borrelia burgdorferi B31
ISILLMLLA

SEQ ID NO: 140995 - protein, 15 aa, Borrelia burgdorferi B31
ESNNELKNLKNYGNV

SEQ ID NO: 140996 - protein, 9 aa, Borrelia burgdorferi B31
LKNLKNYGN

SEQ ID NO: 140997 - protein, 15 aa, Borrelia burgdorferi B31
RISILLMLLAVFSCK

SEQ ID NO: 140998 - protein, 9 aa, Borrelia burgdorferi B31
ISILLMLLA

SEQ ID NO: 140999 - protein, 15 aa, Borrelia burgdorferi B31
ISILLMLLAVFSCKQ

SEQ ID NO: 141000 - protein, 9 aa, Borrelia burgdorferi B31
ISILLMLLA

SEQ ID NO: 141001 - protein, 15 aa, Borrelia burgdorferi B31
ESLKVFLKDAMSVNG

SEQ ID NO: 141002 - protein, 9 aa, Borrelia burgdorferi B31
LKVFLKDAM

SEQ ID NO: 141003 - protein, 15 aa, Borrelia burgdorferi B31
LESLKVFLKDAMSVN

SEQ ID NO: 141004 - protein, 9 aa, Borrelia burgdorferi B31
LKVFLKDAM

SEQ ID NO: 141005 - protein, 15 aa, Borrelia burgdorferi B31
EYVCYKIKNSKGEAL

SEQ ID NO: 141006 - protein, 9 aa, Borrelia burgdorferi B31
YKIKNSKGE

SEQ ID NO: 141007 - protein, 15 aa, Borrelia burgdorferi B31
ISSFDNISSIVSKAV

SEQ ID NO: 141008 - protein, 9 aa, Borrelia burgdorferi B31
FDNISSIVS

SEQ ID NO: 141009 - protein, 15 aa, Borrelia burgdorferi B31
SSFDNISSIVSKAVD

SEQ ID NO: 141010 - protein, 9 aa, Borrelia burgdorferi B31
FDNISSIVS

SEQ ID NO: 141011 - protein, 15 aa, Borrelia burgdorferi B31
AEKLESLKVFLKDAM

SEQ ID NO: 141012 - protein, 9 aa, Borrelia burgdorferi B31
LESLKVFLK

SEQ ID NO: 141013 - protein, 15 aa, Borrelia burgdorferi B31
EFISSFDNISSIVSK

SEQ ID NO: 141014 - protein, 9 aa, Borrelia burgdorferi B31
FDNISSIVS

SEQ ID NO: 141015 - protein, 15 aa, Borrelia burgdorferi B31
YVCYKIKNSKGEALS

SEQ ID NO: 141016 - protein, 9 aa, Borrelia burgdorferi B31
IKNSKGEAL

SEQ ID NO: 141017 - protein, 15 aa, Borrelia burgdorferi B31
FISSFDNISSIVSKA

SEQ ID NO: 141018 - protein, 9 aa, Borrelia burgdorferi B31
FDNISSIVS

SEQ ID NO: 141019 - protein, 15 aa, Borrelia burgdorferi B31
VCYKIKNSKGEALSL

SEQ ID NO: 141020 - protein, 9 aa, Borrelia burgdorferi B31
IKNSKGEAL

SEQ ID NO: 141021 - protein, 15 aa, Borrelia burgdorferi B31
EKLESLKVFLKDAMS

SEQ ID NO: 141022 - protein, 9 aa, Borrelia burgdorferi B31
LKVFLKDAM

SEQ ID NO: 141023 - protein, 15 aa, Borrelia burgdorferi B31
LVVSDVVKDLIPKEI

SEQ ID NO: 141024 - protein, 9 aa, Borrelia burgdorferi B31
VSDVVKDLI

SEQ ID NO: 141025 - protein, 15 aa, Borrelia burgdorferi B31
NGIPLVVSDVVKDLI

SEQ ID NO: 141026 - protein, 9 aa, Borrelia burgdorferi B31
LVVSDVVKD

SEQ ID NO: 141027 - protein, 15 aa, Borrelia burgdorferi B31
KEFISSFDNISSIVS

SEQ ID NO: 141028 - protein, 9 aa, Borrelia burgdorferi B31
SFDNISSIV

SEQ ID NO: 141029 - protein, 15 aa, Borrelia burgdorferi B31
MQRISILLMLLAVFS

SEQ ID NO: 141030 - protein, 9 aa, Borrelia burgdorferi B31
ILLMLLAVF

SEQ ID NO: 141031 - protein, 15 aa, Borrelia burgdorferi B31
RISILLMLLAVFSCK

SEQ ID NO: 141032 - protein, 9 aa, Borrelia burgdorferi B31
ILLMLLAVF

SEQ ID NO: 141033 - protein, 15 aa, Borrelia burgdorferi B31
MMQRISILLMLLAVF

SEQ ID NO: 141034 - protein, 9 aa, Borrelia burgdorferi B31
MMQRISILL

SEQ ID NO: 141035 - protein, 15 aa, Borrelia burgdorferi B31
ISILLMLLAVFSCKQ

SEQ ID NO: 141036 - protein, 9 aa, Borrelia burgdorferi B31
ILLMLLAVF

SEQ ID NO: 141037 - protein, 15 aa, Borrelia burgdorferi B31
QRISILLMLLAVFSC

SEQ ID NO: 141038 - protein, 9 aa, Borrelia burgdorferi B31
ILLMLLAVF

SEQ ID NO: 141039 - protein, 15 aa, Borrelia burgdorferi B31
SILLMLLAVFSCKQF

SEQ ID NO: 141040 - protein, 9 aa, Borrelia burgdorferi B31
LLMLLAVFS

SEQ ID NO: 141041 - protein, 15 aa, Borrelia burgdorferi B31
RISILLMLLAVFSCK

SEQ ID NO: 141042 - protein, 9 aa, Borrelia burgdorferi B31
ILLMLLAVF

SEQ ID NO: 141043 - protein, 15 aa, Borrelia burgdorferi B31
ISILLMLLAVFSCKQ

SEQ ID NO: 141044 - protein, 9 aa, Borrelia burgdorferi B31
MLLAVFSCK

SEQ ID NO: 141045 - protein, 15 aa, Borrelia burgdorferi B31
SILLMLLAVFSCKQF

SEQ ID NO: 141046 - protein, 9 aa, Borrelia burgdorferi B31
MLLAVFSCK

SEQ ID NO: 141047 - protein, 15 aa, Borrelia burgdorferi B31
ILLMLLAVFSCKQFG

SEQ ID NO: 141048 - protein, 9 aa, Borrelia burgdorferi B31
MLLAVFSCK

SEQ ID NO: 141049 - protein, 15 aa, Borrelia burgdorferi B31
YKEFFDWLSKDVNRQ

SEQ ID NO: 141050 - protein, 9 aa, Borrelia burgdorferi B31
FDWLSKDVN

SEQ ID NO: 141051 - protein, 15 aa, Borrelia burgdorferi B31
KEFFDWLSKDVNRQK

SEQ ID NO: 141052 - protein, 9 aa, Borrelia burgdorferi B31
FDWLSKDVN

SEQ ID NO: 141053 - protein, 15 aa, Borrelia garinii PBi
VSFFNNICGIITKAV

SEQ ID NO: 141054 - protein, 9 aa, Borrelia garinii PBi
FNNICGIIT

SEQ ID NO: 141055 - protein, 15 aa, Borrelia garinii PBi
SFFNNICGIITKAVD

SEQ ID NO: 141056 - protein, 9 aa, Borrelia garinii PBi
ICGIITKAV

SEQ ID NO: 141057 - protein, 15 aa, Borrelia garinii PBi
NNELANLKNLNSYNL

SEQ ID NO: 141058 - protein, 9 aa, Borrelia garinii PBi
LANLKNLNS

SEQ ID NO: 141059 - protein, 15 aa, Borrelia garinii PBi
NELANLKNLNSYNLN

SEQ ID NO: 141060 - protein, 9 aa, Borrelia garinii PBi
LKNLNSYNL

SEQ ID NO: 141061 - protein, 15 aa, Borrelia garinii PBi
LANLKNLNSYNLNSN

SEQ ID NO: 141062 - protein, 9 aa, Borrelia garinii PBi
LKNLNSYNL

SEQ ID NO: 141063 - protein, 15 aa, Borrelia garinii PBi
ELANLKNLNSYNLNS

SEQ ID NO: 141064 - protein, 9 aa, Borrelia garinii PBi
LKNLNSYNL

SEQ ID NO: 141065 - protein, 15 aa, Borrelia garinii PBi
ANLKNLNSYNLNSNN

SEQ ID NO: 141066 - protein, 9 aa, Borrelia garinii PBi
LKNLNSYNL

SEQ ID NO: 141067 - protein, 15 aa, Borrelia garinii PBi
FNNICGIITKAVDAS

SEQ ID NO: 141068 - protein, 9 aa, Borrelia garinii PBi
ICGIITKAV

SEQ ID NO: 141069 - protein, 15 aa, Borrelia garinii PBi
FFNNICGIITKAVDA

SEQ ID NO: 141070 - protein, 9 aa, Borrelia garinii PBi
ICGIITKAV

SEQ ID NO: 141071 - protein, 15 aa, Borrelia garinii PBi
SEEFERLEALKTFLK

SEQ ID NO: 141072 - protein, 9 aa, Borrelia garinii PBi
FERLEALKT

SEQ ID NO: 141073 - protein, 15 aa, Borrelia garinii PBi
EEFERLEALKTFLKD

SEQ ID NO: 141074 - protein, 9 aa, Borrelia garinii PBi
FERLEALKT

SEQ ID NO: 141075 - protein, 15 aa, Borrelia garinii PBi
NNICGIITKAVDASK

SEQ ID NO: 141076 - protein, 9 aa, Borrelia garinii PBi
ICGIITKAV

SEQ ID NO: 141077 - protein, 15 aa, Borrelia garinii PBi
TSEEFERLEALKTFL

SEQ ID NO: 141078 - protein, 9 aa, Borrelia garinii PBi
FERLEALKT

SEQ ID NO: 141079 - protein, 15 aa, Borrelia garinii PBi
VLTSEEFERLEALKT

SEQ ID NO: 141080 - protein, 9 aa, Borrelia garinii PBi
VLTSEEFER

SEQ ID NO: 141081 - protein, 15 aa, Borrelia garinii PBi
LTSEEFERLEALKTF

SEQ ID NO: 141082 - protein, 9 aa, Borrelia garinii PBi
FERLEALKT

SEQ ID NO: 141083 - protein, 15 aa, Borrelia garinii PBi
KDQIIEKGPVLTSEE

SEQ ID NO: 141084 - protein, 9 aa, Borrelia garinii PBi
IIEKGPVLT

SEQ ID NO: 141085 - protein, 15 aa, Borrelia garinii PBi
DQIIEKGPVLTSEEF

SEQ ID NO: 141086 - protein, 9 aa, Borrelia garinii PBi
IIEKGPVLT

SEQ ID NO: 141087 - protein, 15 aa, Borrelia garinii PBi
MKRISILSILLLLLL

SEQ ID NO: 141088 - protein, 9 aa, Borrelia garinii PBi
ILSILLLLL

SEQ ID NO: 141089 - protein, 15 aa, Borrelia garinii PBi
NLKNLNSYNLNSNNK

SEQ ID NO: 141090 - protein, 9 aa, Borrelia garinii PBi
LKNLNSYNL

SEQ ID NO: 141091 - protein, 15 aa, Borrelia garinii PBi
SKDQIIEKGPVLTSE

SEQ ID NO: 141092 - protein, 9 aa, Borrelia garinii PBi
IIEKGPVLT

SEQ ID NO: 141093 - protein, 15 aa, Borrelia garinii PBi
ESKDQIIEKGPVLTS

SEQ ID NO: 141094 - protein, 9 aa, Borrelia garinii PBi
IIEKGPVLT

SEQ ID NO: 141095 - protein, 15 aa, Borrelia garinii PBi
KRISILSILLLLLLF

SEQ ID NO: 141096 - protein, 9 aa, Borrelia garinii PBi
ILSILLLLL

SEQ ID NO: 141097 - protein, 15 aa, Borrelia garinii PBi
RISILSILLLLLLFS

SEQ ID NO: 141098 - protein, 9 aa, Borrelia garinii PBi
ILSILLLLL

SEQ ID NO: 141099 - protein, 15 aa, Borrelia garinii PBi
ISILSILLLLLLFSC

SEQ ID NO: 141100 - protein, 9 aa, Borrelia garinii PBi
ILSILLLLL

SEQ ID NO: 141101 - protein, 15 aa, Borrelia garinii PBi
FVSFFNNICGIITKA

SEQ ID NO: 141102 - protein, 9 aa, Borrelia garinii PBi
FNNICGIIT

SEQ ID NO: 141103 - protein, 15 aa, Borrelia garinii PBi
EFVSFFNNICGIITK

SEQ ID NO: 141104 - protein, 9 aa, Borrelia garinii PBi
FNNICGIIT

SEQ ID NO: 141105 - protein, 15 aa, Borrelia garinii PBi
YGDVKSLTEVATDLE

SEQ ID NO: 141106 - protein, 9 aa, Borrelia garinii PBi
VKSLTEVAT

SEQ ID NO: 141107 - protein, 15 aa, Borrelia garinii PBi
QYGDVKSLTEVATDL

SEQ ID NO: 141108 - protein, 9 aa, Borrelia garinii PBi
VKSLTEVAT

SEQ ID NO: 141109 - protein, 15 aa, Borrelia garinii PBi
KEFVSFFNNICGIIT

SEQ ID NO: 141110 - protein, 9 aa, Borrelia garinii PBi
VSFFNNICG

SEQ ID NO: 141111 - protein, 15 aa, Borrelia garinii PBi
GDVKSLTEVATDLED

SEQ ID NO: 141112 - protein, 9 aa, Borrelia garinii PBi
VKSLTEVAT

SEQ ID NO: 141113 - protein, 15 aa, Borrelia garinii PBi
KQYGDVKSLTEVATD

SEQ ID NO: 141114 - protein, 9 aa, Borrelia garinii PBi
VKSLTEVAT

SEQ ID NO: 141115 - protein, 15 aa, Borrelia garinii PBi
CKQYGDVKSLTEVAT

SEQ ID NO: 141116 - protein, 9 aa, Borrelia garinii PBi
YGDVKSLTE

SEQ ID NO: 141117 - protein, 15 aa, Borrelia garinii PBi
EFERLEALKTFLKDA

SEQ ID NO: 141118 - protein, 9 aa, Borrelia garinii PBi
FERLEALKT

SEQ ID NO: 141119 - protein, 15 aa, Borrelia garinii PBi
FERLEALKTFLKDAM

SEQ ID NO: 141120 - protein, 9 aa, Borrelia garinii PBi
FERLEALKT

SEQ ID NO: 141121 - protein, 15 aa, Borrelia garinii PBi
SILSILLLLLLFSCK

SEQ ID NO: 141122 - protein, 9 aa, Borrelia garinii PBi
LSILLLLLL

SEQ ID NO: 141123 - protein, 15 aa, Borrelia garinii PBi
NICGIITKAVDASKK

SEQ ID NO: 141124 - protein, 9 aa, Borrelia garinii PBi
ICGIITKAV

SEQ ID NO: 141125 - protein, 15 aa, Borrelia garinii PBi
ICGIITKAVDASKKR

SEQ ID NO: 141126 - protein, 9 aa, Borrelia garinii PBi
ICGIITKAV

SEQ ID NO: 141127 - protein, 15 aa, Borrelia garinii PBi
VESKDQIIEKGPVLT

SEQ ID NO: 141128 - protein, 9 aa, Borrelia garinii PBi
DQIIEKGPV

SEQ ID NO: 141129 - protein, 15 aa, Borrelia garinii PBi
QIIEKGPVLTSEEFE

SEQ ID NO: 141130 - protein, 9 aa, Borrelia garinii PBi
IIEKGPVLT

SEQ ID NO: 141131 - protein, 15 aa, Borrelia garinii PBi
ILSILLLLLLFSCKQ

SEQ ID NO: 141132 - protein, 9 aa, Borrelia garinii PBi
ILLLLLLFS

SEQ ID NO: 141133 - protein, 15 aa, Borrelia garinii PBi
LSILLLLLLFSCKQY

SEQ ID NO: 141134 - protein, 9 aa, Borrelia garinii PBi
ILLLLLLFS

SEQ ID NO: 141135 - protein, 15 aa, Borrelia garinii PBi
IIEKGPVLTSEEFER

SEQ ID NO: 141136 - protein, 9 aa, Borrelia garinii PBi
IIEKGPVLT

SEQ ID NO: 141137 - protein, 15 aa, Borrelia garinii PBi
SLFFQKVADAFGTQE

SEQ ID NO: 141138 - protein, 9 aa, Borrelia garinii PBi
FQKVADAFG

SEQ ID NO: 141139 - protein, 15 aa, Borrelia garinii PBi
DLSLFFQKVADAFGT

SEQ ID NO: 141140 - protein, 9 aa, Borrelia garinii PBi
FQKVADAFG

SEQ ID NO: 141141 - protein, 15 aa, Borrelia garinii PBi
LSLFFQKVADAFGTQ

SEQ ID NO: 141142 - protein, 9 aa, Borrelia garinii PBi
FQKVADAFG

SEQ ID NO: 141143 - protein, 15 aa, Borrelia garinii PBi
DVKSLTEVATDLEDD

SEQ ID NO: 141144 - protein, 9 aa, Borrelia garinii PBi
VKSLTEVAT

SEQ ID NO: 141145 - protein, 15 aa, Borrelia garinii PBi
VKSLTEVATDLEDDN

SEQ ID NO: 141146 - protein, 9 aa, Borrelia garinii PBi
VKSLTEVAT

SEQ ID NO: 141147 - protein, 15 aa, Borrelia garinii PBi
ALKTFLKDAMGVNGR

SEQ ID NO: 141148 - protein, 9 aa, Borrelia garinii PBi
LKDAMGVNG

SEQ ID NO: 141149 - protein, 15 aa, Borrelia garinii PBi
LKTFLKDAMGVNGRE

SEQ ID NO: 141150 - protein, 9 aa, Borrelia garinii PBi
LKDAMGVNG

SEQ ID NO: 141151 - protein, 15 aa, Borrelia garinii PBi
LFFQKVADAFGTQEY

SEQ ID NO: 141152 - protein, 9 aa, Borrelia garinii PBi
FQKVADAFG

SEQ ID NO: 141153 - protein, 15 aa, Borrelia garinii PBi
EALKTFLKDAMGVNG

SEQ ID NO: 141154 - protein, 9 aa, Borrelia garinii PBi
TFLKDAMGV

SEQ ID NO: 141155 - protein, 15 aa, Borrelia garinii PBi
KTFLKDAMGVNGREG

SEQ ID NO: 141156 - protein, 9 aa, Borrelia garinii PBi
LKDAMGVNG

SEQ ID NO: 141157 - protein, 15 aa, Borrelia garinii PBi
TFLKDAMGVNGREGD

SEQ ID NO: 141158 - protein, 9 aa, Borrelia garinii PBi
LKDAMGVNG

SEQ ID NO: 141159 - protein, 15 aa, Borrelia garinii PBi
YKEFFDWLSKDVNRQ

SEQ ID NO: 141160 - protein, 9 aa, Borrelia garinii PBi
FFDWLSKDV

SEQ ID NO: 141161 - protein, 15 aa, Borrelia garinii PBi
DDLSLFFQKVADAFG

SEQ ID NO: 141162 - protein, 9 aa, Borrelia garinii PBi
FFQKVADAF

SEQ ID NO: 141163 - protein, 15 aa, Borrelia garinii PBi
LEDDNSFASGSVESK

SEQ ID NO: 141164 - protein, 9 aa, Borrelia garinii PBi
SFASGSVES

SEQ ID NO: 141165 - protein, 15 aa, Borrelia garinii PBi
EDDNSFASGSVESKD

SEQ ID NO: 141166 - protein, 9 aa, Borrelia garinii PBi
FASGSVESK

SEQ ID NO: 141167 - protein, 15 aa, Borrelia garinii PBi
KEFFDWLSKDVNRQK

SEQ ID NO: 141168 - protein, 9 aa, Borrelia garinii PBi
WLSKDVNRQ

SEQ ID NO: 141169 - protein, 15 aa, Borrelia garinii PBi
DDNSFASGSVESKDQ

SEQ ID NO: 141170 - protein, 9 aa, Borrelia garinii PBi
FASGSVESK

SEQ ID NO: 141171 - protein, 15 aa, Borrelia garinii PBi
DNSFASGSVESKDQI

SEQ ID NO: 141172 - protein, 9 aa, Borrelia garinii PBi
FASGSVESK

SEQ ID NO: 141173 - protein, 15 aa, Borrelia garinii PBi
SENNNELANLKNLNS

SEQ ID NO: 141174 - protein, 9 aa, Borrelia garinii PBi
NNNELANLK

SEQ ID NO: 141175 - protein, 15 aa, Borrelia garinii PBi
LGFNEYVCYDIKTRT

SEQ ID NO: 141176 - protein, 9 aa, Borrelia garinii PBi
LGFNEYVCY

SEQ ID NO: 141177 - protein, 15 aa, Borrelia garinii PBi
EYVCYDIKTRTGDDL

SEQ ID NO: 141178 - protein, 9 aa, Borrelia garinii PBi
VCYDIKTRT

SEQ ID NO: 141179 - protein, 15 aa, Borrelia garinii PBi
FNEYVCYDIKTRTGD

SEQ ID NO: 141180 - protein, 9 aa, Borrelia garinii PBi
VCYDIKTRT

SEQ ID NO: 141181 - protein, 15 aa, Borrelia garinii PBi
NEYVCYDIKTRTGDD

SEQ ID NO: 141182 - protein, 9 aa, Borrelia garinii PBi
VCYDIKTRT

SEQ ID NO: 141183 - protein, 15 aa, Borrelia garinii PBi
GFNEYVCYDIKTRTG

SEQ ID NO: 141184 - protein, 9 aa, Borrelia garinii PBi
VCYDIKTRT

SEQ ID NO: 141185 - protein, 15 aa, Borrelia garinii PBi
ILSILLLLLLFSCKQ

SEQ ID NO: 141186 - protein, 9 aa, Borrelia garinii PBi
ILLLLLLFS

SEQ ID NO: 141187 - protein, 15 aa, Borrelia garinii PBi
SILLLLLLFSCKQYG

SEQ ID NO: 141188 - protein, 9 aa, Borrelia garinii PBi
LLLLFSCKQ

SEQ ID NO: 141189 - protein, 15 aa, Borrelia garinii PBi
ILLLLLLFSCKQYGD

SEQ ID NO: 141190 - protein, 9 aa, Borrelia garinii PBi
LLLLFSCKQ

SEQ ID NO: 141191 - protein, 15 aa, Borrelia garinii PBi
LSILLLLLLFSCKQY

SEQ ID NO: 141192 - protein, 9 aa, Borrelia garinii PBi
LLLLFSCKQ

SEQ ID NO: 141193 - protein, 15 aa, Borrelia garinii PBi
LLLLLLFSCKQYGDV

SEQ ID NO: 141194 - protein, 9 aa, Borrelia garinii PBi
LLLLFSCKQ

SEQ ID NO: 141195 - protein, 15 aa, Borrelia garinii PBi
KSYKEFFDWLSKDVN

SEQ ID NO: 141196 - protein, 9 aa, Borrelia garinii PBi
YKEFFDWLS

SEQ ID NO: 141197 - protein, 15 aa, Borrelia garinii PBi
NRQKEFVSFFNNICG

SEQ ID NO: 141198 - protein, 9 aa, Borrelia garinii PBi
FVSFFNNIC

SEQ ID NO: 141199 - protein, 15 aa, Borrelia garinii PBi
VNRQKEFVSFFNNIC

SEQ ID NO: 141200 - protein, 9 aa, Borrelia garinii PBi
QKEFVSFFN

SEQ ID NO: 141201 - protein, 15 aa, Borrelia garinii PBi
RQKEFVSFFNNICGI

SEQ ID NO: 141202 - protein, 9 aa, Borrelia garinii PBi
FVSFFNNIC

SEQ ID NO: 141203 - protein, 15 aa, Borrelia garinii PBi
QKEFVSFFNNICGII

SEQ ID NO: 141204 - protein, 9 aa, Borrelia garinii PBi
FVSFFNNIC

SEQ ID NO: 141205 - protein, 15 aa, Borrelia garinii PBi
KEFVSFFNNICGIIT

SEQ ID NO: 141206 - protein, 9 aa, Borrelia garinii PBi
FVSFFNNIC

SEQ ID NO: 141207 - protein, 15 aa, Borrelia garinii PBi
EKSYKEFFDWLSKDV

SEQ ID NO: 141208 - protein, 9 aa, Borrelia garinii PBi
YKEFFDWLS

SEQ ID NO: 141209 - protein, 15 aa, Borrelia garinii PBi
YEKSYKEFFDWLSKD

SEQ ID NO: 141210 - protein, 9 aa, Borrelia garinii PBi
YKEFFDWLS

SEQ ID NO: 141211 - protein, 15 aa, Borrelia garinii PBi
YKEFFDWLSKDVNRQ

SEQ ID NO: 141212 - protein, 9 aa, Borrelia garinii PBi
YKEFFDWLS

SEQ ID NO: 141213 - protein, 15 aa, Borrelia garinii PBi
EYEKSYKEFFDWLSK

SEQ ID NO: 141214 - protein, 9 aa, Borrelia garinii PBi
YKEFFDWLS

SEQ ID NO: 141215 - protein, 15 aa, Borrelia garinii PBi
AEYEKSYKEFFDWLS

SEQ ID NO: 141216 - protein, 9 aa, Borrelia garinii PBi
YEKSYKEFF

SEQ ID NO: 141217 - protein, 15 aa, Borrelia garinii PBi
SYKEFFDWLSKDVNR

SEQ ID NO: 141218 - protein, 9 aa, Borrelia garinii PBi
YKEFFDWLS

SEQ ID NO: 141219 - protein, 15 aa, Borrelia garinii PBi
EFVSFFNNICGIITK

SEQ ID NO: 141220 - protein, 9 aa, Borrelia garinii PBi
FVSFFNNIC

SEQ ID NO: 141221 - protein, 15 aa, Borrelia garinii PBi
FVSFFNNICGIITKA

SEQ ID NO: 141222 - protein, 9 aa, Borrelia garinii PBi
FVSFFNNIC

SEQ ID NO: 141223 - protein, 15 aa, Borrelia garinii PBi
KVIKRVFTESENNNE

SEQ ID NO: 141224 - protein, 9 aa, Borrelia garinii PBi
IKRVFTESE

SEQ ID NO: 141225 - protein, 15 aa, Borrelia garinii PBi
EIFKVIKRVFTESEN

SEQ ID NO: 141226 - protein, 9 aa, Borrelia garinii PBi
IKRVFTESE

SEQ ID NO: 141227 - protein, 15 aa, Borrelia garinii PBi
KEFFDWLSKDVNRQK

SEQ ID NO: 141228 - protein, 9 aa, Borrelia garinii PBi
FDWLSKDVN

SEQ ID NO: 141229 - protein, 15 aa, Borrelia garinii PBi
FKVIKRVFTESENNN

SEQ ID NO: 141230 - protein, 9 aa, Borrelia garinii PBi
IKRVFTESE

SEQ ID NO: 141231 - protein, 15 aa, Borrelia garinii PBi
IFKVIKRVFTESENN

SEQ ID NO: 141232 - protein, 9 aa, Borrelia garinii PBi
IKRVFTESE

SEQ ID NO: 141233 - protein, 15 aa, Borrelia garinii PBi
EEIFKVIKRVFTESE

SEQ ID NO: 141234 - protein, 9 aa, Borrelia garinii PBi
FKVIKRVFT

SEQ ID NO: 141235 - protein, 15 aa, Borrelia garinii PBi
EFFDWLSKDVNRQKE

SEQ ID NO: 141236 - protein, 9 aa, Borrelia garinii PBi
FDWLSKDVN

SEQ ID NO: 141237 - protein, 15 aa, Borrelia garinii PBi
VIKRVFTESENNNEL

SEQ ID NO: 141238 - protein, 9 aa, Borrelia garinii PBi
IKRVFTESE

SEQ ID NO: 141239 - protein, 15 aa, Borrelia garinii PBi
NNELANLKNLNSYNL

SEQ ID NO: 141240 - protein, 9 aa, Borrelia garinii PBi
NLKNLNSYN

SEQ ID NO: 141241 - protein, 15 aa, Borrelia garinii PBi
ANLKNLNSYNLNSNN

SEQ ID NO: 141242 - protein, 9 aa, Borrelia garinii PBi
LKNLNSYNL

SEQ ID NO: 141243 - protein, 15 aa, Borrelia garinii PBi
NELANLKNLNSYNLN

SEQ ID NO: 141244 - protein, 9 aa, Borrelia garinii PBi
LKNLNSYNL

SEQ ID NO: 141245 - protein, 15 aa, Borrelia garinii PBi
ELANLKNLNSYNLNS

SEQ ID NO: 141246 - protein, 9 aa, Borrelia garinii PBi
LKNLNSYNL

SEQ ID NO: 141247 - protein, 15 aa, Borrelia garinii PBi
LANLKNLNSYNLNSN

SEQ ID NO: 141248 - protein, 9 aa, Borrelia garinii PBi
LKNLNSYNL

SEQ ID NO: 141249 - protein, 15 aa, Borrelia garinii PBi
CNEEIFKVIKRVFTE

SEQ ID NO: 141250 - protein, 9 aa, Borrelia garinii PBi
IFKVIKRVF

SEQ ID NO: 141251 - protein, 15 aa, Borrelia garinii PBi
NEEIFKVIKRVFTES

SEQ ID NO: 141252 - protein, 9 aa, Borrelia garinii PBi
IFKVIKRVF

SEQ ID NO: 141253 - protein, 15 aa, Borrelia garinii PBi
KCNEEIFKVIKRVFT

SEQ ID NO: 141254 - protein, 9 aa, Borrelia garinii PBi
IFKVIKRVF

SEQ ID NO: 141255 - protein, 15 aa, Borrelia garinii PBi
EEIFKVIKRVFTESE

SEQ ID NO: 141256 - protein, 9 aa, Borrelia garinii PBi
IFKVIKRVF

SEQ ID NO: 141257 - protein, 15 aa, Borrelia garinii PBi
NNELANLKNLNSYNL

SEQ ID NO: 141258 - protein, 9 aa, Borrelia garinii PBi
LANLKNLNS

SEQ ID NO: 141259 - protein, 15 aa, Borrelia garinii PBi
ELANLKNLNSYNLNS

SEQ ID NO: 141260 - protein, 9 aa, Borrelia garinii PBi
LKNLNSYNL

SEQ ID NO: 141261 - protein, 15 aa, Borrelia garinii PBi
LANLKNLNSYNLNSN

SEQ ID NO: 141262 - protein, 9 aa, Borrelia garinii PBi
LKNLNSYNL

SEQ ID NO: 141263 - protein, 15 aa, Borrelia garinii PBi
ANLKNLNSYNLNSNN

SEQ ID NO: 141264 - protein, 9 aa, Borrelia garinii PBi
LKNLNSYNL

SEQ ID NO: 141265 - protein, 15 aa, Borrelia garinii PBi
KEFVSFFNNICGIIT

SEQ ID NO: 141266 - protein, 9 aa, Borrelia garinii PBi
FFNNICGII

SEQ ID NO: 141267 - protein, 15 aa, Borrelia garinii PBi
VSFFNNICGIITKAV

SEQ ID NO: 141268 - protein, 9 aa, Borrelia garinii PBi
FNNICGIIT

SEQ ID NO: 141269 - protein, 15 aa, Borrelia garinii PBi
EFVSFFNNICGIITK

SEQ ID NO: 141270 - protein, 9 aa, Borrelia garinii PBi
FNNICGIIT

SEQ ID NO: 141271 - protein, 15 aa, Borrelia garinii PBi
FVSFFNNICGIITKA

SEQ ID NO: 141272 - protein, 9 aa, Borrelia garinii PBi
FNNICGIIT

SEQ ID NO: 141273 - protein, 15 aa, Borrelia garinii PBi
MKRISILSILLLLLL

SEQ ID NO: 141274 - protein, 9 aa, Borrelia garinii PBi
ISILSILLL

SEQ ID NO: 141275 - protein, 15 aa, Borrelia garinii PBi
SFFNNICGIITKAVD

SEQ ID NO: 141276 - protein, 9 aa, Borrelia garinii PBi
FNNICGIIT

SEQ ID NO: 141277 - protein, 15 aa, Borrelia garinii PBi
KRISILSILLLLLLF

SEQ ID NO: 141278 - protein, 9 aa, Borrelia garinii PBi
ISILSILLL

SEQ ID NO: 141279 - protein, 15 aa, Borrelia garinii PBi
NLKNLNSYNLNSNNK

SEQ ID NO: 141280 - protein, 9 aa, Borrelia garinii PBi
LKNLNSYNL

SEQ ID NO: 141281 - protein, 15 aa, Borrelia garinii PBi
ISILSILLLLLLFSC

SEQ ID NO: 141282 - protein, 9 aa, Borrelia garinii PBi
ISILSILLL

SEQ ID NO: 141283 - protein, 15 aa, Borrelia garinii PBi
RISILSILLLLLLFS

SEQ ID NO: 141284 - protein, 9 aa, Borrelia garinii PBi
ISILSILLL

SEQ ID NO: 141285 - protein, 15 aa, Borrelia garinii PBi
NEEIFKVIKRVFTES

SEQ ID NO: 141286 - protein, 9 aa, Borrelia garinii PBi
FKVIKRVFT

SEQ ID NO: 141287 - protein, 15 aa, Borrelia garinii PBi
EEIFKVIKRVFTESE

SEQ ID NO: 141288 - protein, 9 aa, Borrelia garinii PBi
FKVIKRVFT

SEQ ID NO: 141289 - protein, 15 aa, Borrelia garinii PBi
FFNNICGIITKAVDA

SEQ ID NO: 141290 - protein, 9 aa, Borrelia garinii PBi
FNNICGIIT

SEQ ID NO: 141291 - protein, 15 aa, Borrelia garinii PBi
ASKKRYNSNPKSLGF

SEQ ID NO: 141292 - protein, 9 aa, Borrelia garinii PBi
YNSNPKSLG

SEQ ID NO: 141293 - protein, 15 aa, Borrelia garinii PBi
KCNEEIFKVIKRVFT

SEQ ID NO: 141294 - protein, 9 aa, Borrelia garinii PBi
IFKVIKRVF

SEQ ID NO: 141295 - protein, 15 aa, Borrelia garinii PBi
DASKKRYNSNPKSLG

SEQ ID NO: 141296 - protein, 9 aa, Borrelia garinii PBi
KKRYNSNPK

SEQ ID NO: 141297 - protein, 15 aa, Borrelia garinii PBi
CNEEIFKVIKRVFTE

SEQ ID NO: 141298 - protein, 9 aa, Borrelia garinii PBi
FKVIKRVFT

SEQ ID NO: 141299 - protein, 15 aa, Borrelia garinii PBi
SKKRYNSNPKSLGFN

SEQ ID NO: 141300 - protein, 9 aa, Borrelia garinii PBi
YNSNPKSLG

SEQ ID NO: 141301 - protein, 15 aa, Borrelia garinii PBi
FNNICGIITKAVDAS

SEQ ID NO: 141302 - protein, 9 aa, Borrelia garinii PBi
FNNICGIIT

SEQ ID NO: 141303 - protein, 15 aa, Borrelia garinii PBi
EIFKVIKRVFTESEN

SEQ ID NO: 141304 - protein, 9 aa, Borrelia garinii PBi
FKVIKRVFT

SEQ ID NO: 141305 - protein, 15 aa, Borrelia garinii PBi
KKRYNSNPKSLGFNE

SEQ ID NO: 141306 - protein, 9 aa, Borrelia garinii PBi
YNSNPKSLG

SEQ ID NO: 141307 - protein, 15 aa, Borrelia garinii PBi
KRYNSNPKSLGFNEY

SEQ ID NO: 141308 - protein, 9 aa, Borrelia garinii PBi
YNSNPKSLG

SEQ ID NO: 141309 - protein, 15 aa, Borrelia garinii PBi
SILSILLLLLLFSCK

SEQ ID NO: 141310 - protein, 9 aa, Borrelia garinii PBi
LSILLLLLL

SEQ ID NO: 141311 - protein, 15 aa, Borrelia garinii PBi
IFKVIKRVFTESENN

SEQ ID NO: 141312 - protein, 9 aa, Borrelia garinii PBi
FKVIKRVFT

SEQ ID NO: 141313 - protein, 15 aa, Borrelia garinii PBi
FERLEALKTFLKDAM

SEQ ID NO: 141314 - protein, 9 aa, Borrelia garinii PBi
LEALKTFLK

SEQ ID NO: 141315 - protein, 15 aa, Borrelia garinii PBi
ERLEALKTFLKDAMG

SEQ ID NO: 141316 - protein, 9 aa, Borrelia garinii PBi
LEALKTFLK

SEQ ID NO: 141317 - protein, 15 aa, Borrelia garinii PBi
ILSILLLLLLFSCKQ

SEQ ID NO: 141318 - protein, 9 aa, Borrelia garinii PBi
LSILLLLLL

SEQ ID NO: 141319 - protein, 15 aa, Borrelia garinii PBi
ENNNELANLKNLNSY

SEQ ID NO: 141320 - protein, 9 aa, Borrelia garinii PBi
LANLKNLNS

SEQ ID NO: 141321 - protein, 15 aa, Borrelia garinii PBi
NNNELANLKNLNSYN

SEQ ID NO: 141322 - protein, 9 aa, Borrelia garinii PBi
LANLKNLNS

SEQ ID NO: 141323 - protein, 15 aa, Borrelia garinii PBi
LSILLLLLLFSCKQY

SEQ ID NO: 141324 - protein, 9 aa, Borrelia garinii PBi
LSILLLLLL

SEQ ID NO: 141325 - protein, 15 aa, Borrelia garinii PBi
FKVIKRVFTESENNN

SEQ ID NO: 141326 - protein, 9 aa, Borrelia garinii PBi
FKVIKRVFT

SEQ ID NO: 141327 - protein, 15 aa, Borrelia garinii PBi
EALKTFLKDAMGVNG

SEQ ID NO: 141328 - protein, 9 aa, Borrelia garinii PBi
LKTFLKDAM

SEQ ID NO: 141329 - protein, 15 aa, Borrelia garinii PBi
ESKDQIIEKGPVLTS

SEQ ID NO: 141330 - protein, 9 aa, Borrelia garinii PBi
IIEKGPVLT

SEQ ID NO: 141331 - protein, 15 aa, Borrelia garinii PBi
LEALKTFLKDAMGVN

SEQ ID NO: 141332 - protein, 9 aa, Borrelia garinii PBi
LKTFLKDAM

SEQ ID NO: 141333 - protein, 15 aa, Borrelia garinii PBi
NNELANLKNLNSYNL

SEQ ID NO: 141334 - protein, 9 aa, Borrelia garinii PBi
LANLKNLNS

SEQ ID NO: 141335 - protein, 15 aa, Borrelia garinii PBi
NELANLKNLNSYNLN

SEQ ID NO: 141336 - protein, 9 aa, Borrelia garinii PBi
LANLKNLNS

SEQ ID NO: 141337 - protein, 15 aa, Borrelia garinii PBi
ELANLKNLNSYNLNS

SEQ ID NO: 141338 - protein, 9 aa, Borrelia garinii PBi
LKNLNSYNL

SEQ ID NO: 141339 - protein, 15 aa, Borrelia garinii PBi
LANLKNLNSYNLNSN

SEQ ID NO: 141340 - protein, 9 aa, Borrelia garinii PBi
LKNLNSYNL

SEQ ID NO: 141341 - protein, 15 aa, Borrelia garinii PBi
ENNNELANLKNLNSY

SEQ ID NO: 141342 - protein, 9 aa, Borrelia garinii PBi
LANLKNLNS

SEQ ID NO: 141343 - protein, 15 aa, Borrelia garinii PBi
NNNELANLKNLNSYN

SEQ ID NO: 141344 - protein, 9 aa, Borrelia garinii PBi
LANLKNLNS

SEQ ID NO: 141345 - protein, 15 aa, Borrelia garinii PBi
ANLKNLNSYNLNSNN

SEQ ID NO: 141346 - protein, 9 aa, Borrelia garinii PBi
LKNLNSYNL

SEQ ID NO: 141347 - protein, 15 aa, Borrelia garinii PBi
LSILLLLLLFSCKQY

SEQ ID NO: 141348 - protein, 9 aa, Borrelia garinii PBi
LLLLLFSCK

SEQ ID NO: 141349 - protein, 15 aa, Borrelia garinii PBi
SENNNELANLKNLNS

SEQ ID NO: 141350 - protein, 9 aa, Borrelia garinii PBi
NELANLKNL

SEQ ID NO: 141351 - protein, 15 aa, Borrelia garinii PBi
SILLLLLLFSCKQYG

SEQ ID NO: 141352 - protein, 9 aa, Borrelia garinii PBi
LLLLLFSCK

SEQ ID NO: 141353 - protein, 15 aa, Borrelia garinii PBi
ILSILLLLLLFSCKQ

SEQ ID NO: 141354 - protein, 9 aa, Borrelia garinii PBi
LLLLLFSCK

SEQ ID NO: 141355 - protein, 15 aa, Borrelia garinii PBi
SILSILLLLLLFSCK

SEQ ID NO: 141356 - protein, 9 aa, Borrelia garinii PBi
LLLLLLFSC

SEQ ID NO: 141357 - protein, 15 aa, Borrelia garinii PBi
LSILLLLLLFSCKQY

SEQ ID NO: 141358 - protein, 9 aa, Borrelia garinii PBi
LLLLLFSCK

SEQ ID NO: 141359 - protein, 15 aa, Borrelia garinii PBi
ILSILLLLLLFSCKQ

SEQ ID NO: 141360 - protein, 9 aa, Borrelia garinii PBi
LLLLLFSCK

SEQ ID NO: 141361 - protein, 15 aa, Borrelia garinii PBi
SILLLLLLFSCKQYG

SEQ ID NO: 141362 - protein, 9 aa, Borrelia garinii PBi
LLLLLFSCK

SEQ ID NO: 141363 - protein, 15 aa, Borrelia garinii PBi
ILLLLLLFSCKQYGD

SEQ ID NO: 141364 - protein, 9 aa, Borrelia garinii PBi
LLLLLFSCK

SEQ ID NO: 141365 - protein, 15 aa, Borrelia garinii PBi
YKEFFDWLSKDVNRQ

SEQ ID NO: 141366 - protein, 9 aa, Borrelia garinii PBi
FDWLSKDVN

SEQ ID NO: 141367 - protein, 15 aa, Borrelia garinii PBi
KEFFDWLSKDVNRQK

SEQ ID NO: 141368 - protein, 9 aa, Borrelia garinii PBi
FDWLSKDVN

SEQ ID NO: 141369 - protein, 15 aa, Borrelia burgdorferi B31
DGLIANASSNSSLSD

SEQ ID NO: 141370 - protein, 9 aa, Borrelia burgdorferi B31
IANASSNSS

SEQ ID NO: 141371 - protein, 15 aa, Borrelia burgdorferi B31
RQADGLIANASSNSS

SEQ ID NO: 141372 - protein, 9 aa, Borrelia burgdorferi B31
LIANASSNS

SEQ ID NO: 141373 - protein, 15 aa, Borrelia burgdorferi B31
QADGLIANASSNSSL

SEQ ID NO: 141374 - protein, 9 aa, Borrelia burgdorferi B31
IANASSNSS

SEQ ID NO: 141375 - protein, 15 aa, Borrelia burgdorferi B31
ADGLIANASSNSSLS

SEQ ID NO: 141376 - protein, 9 aa, Borrelia burgdorferi B31
IANASSNSS

SEQ ID NO: 141377 - protein, 15 aa, Borrelia burgdorferi B31
GLIANASSNSSLSDS

SEQ ID NO: 141378 - protein, 9 aa, Borrelia burgdorferi B31
IANASSNSS

SEQ ID NO: 141379 - protein, 15 aa, Borrelia burgdorferi B31
LIRELMISGLGTQIS

SEQ ID NO: 141380 - protein, 9 aa, Borrelia burgdorferi B31
MISGLGTQI

SEQ ID NO: 141381 - protein, 15 aa, Borrelia burgdorferi B31
ELMISGLGTQISFEL

SEQ ID NO: 141382 - protein, 9 aa, Borrelia burgdorferi B31
ISGLGTQIS

SEQ ID NO: 141383 - protein, 15 aa, Borrelia burgdorferi B31
IRELMISGLGTQISF

SEQ ID NO: 141384 - protein, 9 aa, Borrelia burgdorferi B31
ISGLGTQIS

SEQ ID NO: 141385 - protein, 15 aa, Borrelia burgdorferi B31
RELMISGLGTQISFE

SEQ ID NO: 141386 - protein, 9 aa, Borrelia burgdorferi B31
ISGLGTQIS

SEQ ID NO: 141387 - protein, 15 aa, Borrelia burgdorferi B31
LMISGLGTQISFELA

SEQ ID NO: 141388 - protein, 9 aa, Borrelia burgdorferi B31
ISGLGTQIS

SEQ ID NO: 141389 - protein, 15 aa, Borrelia burgdorferi B31
KQRIPIQAVTTVPGN

SEQ ID NO: 141390 - protein, 9 aa, Borrelia burgdorferi B31
IQAVTTVPG

SEQ ID NO: 141391 - protein, 15 aa, Borrelia burgdorferi B31
TKQRIPIQAVTTVPG

SEQ ID NO: 141392 - protein, 9 aa, Borrelia burgdorferi B31
IPIQAVTTV

SEQ ID NO: 141393 - protein, 15 aa, Borrelia burgdorferi B31
QRIPIQAVTTVPGNT

SEQ ID NO: 141394 - protein, 9 aa, Borrelia burgdorferi B31
IQAVTTVPG

SEQ ID NO: 141395 - protein, 15 aa, Borrelia burgdorferi B31
IPIQAVTTVPGNTRT

SEQ ID NO: 141396 - protein, 9 aa, Borrelia burgdorferi B31
IQAVTTVPG

SEQ ID NO: 141397 - protein, 15 aa, Borrelia burgdorferi B31
RIPIQAVTTVPGNTR

SEQ ID NO: 141398 - protein, 9 aa, Borrelia burgdorferi B31
IQAVTTVPG

SEQ ID NO: 141399 - protein, 15 aa, Borrelia burgdorferi B31
LIANASSNSSLSDSK

SEQ ID NO: 141400 - protein, 9 aa, Borrelia burgdorferi B31
IANASSNSS

SEQ ID NO: 141401 - protein, 15 aa, Borrelia burgdorferi B31
IANASSNSSLSDSKS

SEQ ID NO: 141402 - protein, 9 aa, Borrelia burgdorferi B31
IANASSNSS

SEQ ID NO: 141403 - protein, 15 aa, Borrelia burgdorferi B31
MISGLGTQISFELAL

SEQ ID NO: 141404 - protein, 9 aa, Borrelia burgdorferi B31
ISGLGTQIS

SEQ ID NO: 141405 - protein, 15 aa, Borrelia burgdorferi B31
ISGLGTQISFELALE

SEQ ID NO: 141406 - protein, 9 aa, Borrelia burgdorferi B31
ISGLGTQIS

SEQ ID NO: 141407 - protein, 15 aa, Borrelia burgdorferi B31
SNLPKTTAARAASLT

SEQ ID NO: 141408 - protein, 9 aa, Borrelia burgdorferi B31
LPKTTAARA

SEQ ID NO: 141409 - protein, 15 aa, Borrelia burgdorferi B31
LSNLPKTTAARAASL

SEQ ID NO: 141410 - protein, 9 aa, Borrelia burgdorferi B31
LPKTTAARA

SEQ ID NO: 141411 - protein, 15 aa, Borrelia burgdorferi B31
AKTVAAAPNKGSQNQ

SEQ ID NO: 141412 - protein, 9 aa, Borrelia burgdorferi B31
VAAAPNKGS

SEQ ID NO: 141413 - protein, 15 aa, Borrelia burgdorferi B31
SQAAKTVAAAPNKGS

SEQ ID NO: 141414 - protein, 9 aa, Borrelia burgdorferi B31
TVAAAPNKG

SEQ ID NO: 141415 - protein, 15 aa, Borrelia burgdorferi B31
AAKTVAAAPNKGSQN

SEQ ID NO: 141416 - protein, 9 aa, Borrelia burgdorferi B31
VAAAPNKGS

SEQ ID NO: 141417 - protein, 15 aa, Borrelia burgdorferi B31
QAAKTVAAAPNKGSQ

SEQ ID NO: 141418 - protein, 9 aa, Borrelia burgdorferi B31
VAAAPNKGS

SEQ ID NO: 141419 - protein, 15 aa, Borrelia burgdorferi B31
GSKLQTLKNELIRAI

SEQ ID NO: 141420 - protein, 9 aa, Borrelia burgdorferi B31
LQTLKNELI

SEQ ID NO: 141421 - protein, 15 aa, Borrelia burgdorferi B31
IQAVTTVPGNTRTFN

SEQ ID NO: 141422 - protein, 9 aa, Borrelia burgdorferi B31
IQAVTTVPG

SEQ ID NO: 141423 - protein, 15 aa, Borrelia burgdorferi B31
PIQAVTTVPGNTRTF

SEQ ID NO: 141424 - protein, 9 aa, Borrelia burgdorferi B31
IQAVTTVPG

SEQ ID NO: 141425 - protein, 15 aa, Borrelia burgdorferi B31
SKLQTLKNELIRAIS

SEQ ID NO: 141426 - protein, 9 aa, Borrelia burgdorferi B31
LKNELIRAI

SEQ ID NO: 141427 - protein, 15 aa, Borrelia burgdorferi B31
ADLSNLPKTTAARAA

SEQ ID NO: 141428 - protein, 9 aa, Borrelia burgdorferi B31
LPKTTAARA

SEQ ID NO: 141429 - protein, 15 aa, Borrelia burgdorferi B31
SSAVQTTTSSGSKLQ

SEQ ID NO: 141430 - protein, 9 aa, Borrelia burgdorferi B31
VQTTTSSGS

SEQ ID NO: 141431 - protein, 15 aa, Borrelia burgdorferi B31
KNKVKGILNKAADDQ

SEQ ID NO: 141432 - protein, 9 aa, Borrelia burgdorferi B31
VKGILNKAA

SEQ ID NO: 141433 - protein, 15 aa, Borrelia burgdorferi B31
TNSSSAVQTTTSSGS

SEQ ID NO: 141434 - protein, 9 aa, Borrelia burgdorferi B31
TNSSSAVQT

SEQ ID NO: 141435 - protein, 15 aa, Borrelia burgdorferi B31
NLPKTTAARAASLTK

SEQ ID NO: 141436 - protein, 9 aa, Borrelia burgdorferi B31
TTAARAASL

SEQ ID NO: 141437 - protein, 15 aa, Borrelia burgdorferi B31
SAVQTTTSSGSKLQT

SEQ ID NO: 141438 - protein, 9 aa, Borrelia burgdorferi B31
VQTTTSSGS

SEQ ID NO: 141439 - protein, 15 aa, Borrelia burgdorferi B31
NKVKGILNKAADDQE

SEQ ID NO: 141440 - protein, 9 aa, Borrelia burgdorferi B31
VKGILNKAA

SEQ ID NO: 141441 - protein, 15 aa, Borrelia burgdorferi B31
TMKLKELKSKLNQIL

SEQ ID NO: 141442 - protein, 9 aa, Borrelia burgdorferi B31
LKELKSKLN

SEQ ID NO: 141443 - protein, 15 aa, Borrelia burgdorferi B31
SSSAVQTTTSSGSKL

SEQ ID NO: 141444 - protein, 9 aa, Borrelia burgdorferi B31
VQTTTSSGS

SEQ ID NO: 141445 - protein, 15 aa, Borrelia burgdorferi B31
MKLKELKSKLNQILD

SEQ ID NO: 141446 - protein, 9 aa, Borrelia burgdorferi B31
LKELKSKLN

SEQ ID NO: 141447 - protein, 15 aa, Borrelia burgdorferi B31
NSSSAVQTTTSSGSK

SEQ ID NO: 141448 - protein, 9 aa, Borrelia burgdorferi B31
VQTTTSSGS

SEQ ID NO: 141449 - protein, 15 aa, Borrelia burgdorferi B31
KTVAAAPNKGSQNQP

SEQ ID NO: 141450 - protein, 9 aa, Borrelia burgdorferi B31
VAAAPNKGS

SEQ ID NO: 141451 - protein, 15 aa, Borrelia burgdorferi B31
LPKTTAARAASLTKQ

SEQ ID NO: 141452 - protein, 9 aa, Borrelia burgdorferi B31
TTAARAASL

SEQ ID NO: 141453 - protein, 15 aa, Borrelia burgdorferi B31
SADLSNLPKTTAARA

SEQ ID NO: 141454 - protein, 9 aa, Borrelia burgdorferi B31
LSNLPKTTA

SEQ ID NO: 141455 - protein, 15 aa, Borrelia burgdorferi B31
SLTKQRIPIQAVTTV

SEQ ID NO: 141456 - protein, 9 aa, Borrelia burgdorferi B31
RIPIQAVTT

SEQ ID NO: 141457 - protein, 15 aa, Borrelia burgdorferi B31
LTKQRIPIQAVTTVP

SEQ ID NO: 141458 - protein, 9 aa, Borrelia burgdorferi B31
IPIQAVTTV

SEQ ID NO: 141459 - protein, 15 aa, Borrelia burgdorferi B31
KLQTLKNELIRAISE

SEQ ID NO: 141460 - protein, 9 aa, Borrelia burgdorferi B31
LKNELIRAI

SEQ ID NO: 141461 - protein, 15 aa, Borrelia burgdorferi B31
LQTLKNELIRAISEE

SEQ ID NO: 141462 - protein, 9 aa, Borrelia burgdorferi B31
LKNELIRAI

SEQ ID NO: 141463 - protein, 15 aa, Borrelia burgdorferi B31
SRQADGLIANASSNS

SEQ ID NO: 141464 - protein, 9 aa, Borrelia burgdorferi B31
ADGLIANAS

SEQ ID NO: 141465 - protein, 15 aa, Borrelia burgdorferi B31
DLSNLPKTTAARAAS

SEQ ID NO: 141466 - protein, 9 aa, Borrelia burgdorferi B31
LPKTTAARA

SEQ ID NO: 141467 - protein, 15 aa, Borrelia burgdorferi B31
EDYKNKVKGILNKAA

SEQ ID NO: 141468 - protein, 9 aa, Borrelia burgdorferi B31
YKNKVKGIL

SEQ ID NO: 141469 - protein, 15 aa, Borrelia burgdorferi B31
YKNKVKGILNKAADD

SEQ ID NO: 141470 - protein, 9 aa, Borrelia burgdorferi B31
VKGILNKAA

SEQ ID NO: 141471 - protein, 15 aa, Borrelia burgdorferi B31
DYKNKVKGILNKAAD

SEQ ID NO: 141472 - protein, 9 aa, Borrelia burgdorferi B31
VKGILNKAA

SEQ ID NO: 141473 - protein, 15 aa, Borrelia burgdorferi B31
FALNYSFSQPTRQQT

SEQ ID NO: 141474 - protein, 9 aa, Borrelia burgdorferi B31
LNYSFSQPT

SEQ ID NO: 141475 - protein, 15 aa, Borrelia burgdorferi B31
MKIKPLIQLKLLGLF

SEQ ID NO: 141476 - protein, 9 aa, Borrelia burgdorferi B31
MKIKPLIQL

SEQ ID NO: 141477 - protein, 15 aa, Borrelia burgdorferi B31
TFALNYSFSQPTRQQ

SEQ ID NO: 141478 - protein, 9 aa, Borrelia burgdorferi B31
LNYSFSQPT

SEQ ID NO: 141479 - protein, 15 aa, Borrelia burgdorferi B31
QTLKNELIRAISEEK

SEQ ID NO: 141480 - protein, 9 aa, Borrelia burgdorferi B31
LKNELIRAI

SEQ ID NO: 141481 - protein, 15 aa, Borrelia burgdorferi B31
SLIRELMISGLGTQI

SEQ ID NO: 141482 - protein, 9 aa, Borrelia burgdorferi B31
IRELMISGL

SEQ ID NO: 141483 - protein, 15 aa, Borrelia burgdorferi B31
LKELKSKLNQILDKR

SEQ ID NO: 141484 - protein, 9 aa, Borrelia burgdorferi B31
LKSKLNQIL

SEQ ID NO: 141485 - protein, 15 aa, Borrelia burgdorferi B31
KLKELKSKLNQILDK

SEQ ID NO: 141486 - protein, 9 aa, Borrelia burgdorferi B31
LKSKLNQIL

SEQ ID NO: 141487 - protein, 15 aa, Borrelia burgdorferi B31
PKTTAARAASLTKQR

SEQ ID NO: 141488 - protein, 9 aa, Borrelia burgdorferi B31
TTAARAASL

SEQ ID NO: 141489 - protein, 15 aa, Borrelia burgdorferi B31
PTFALNYSFSQPTRQ

SEQ ID NO: 141490 - protein, 9 aa, Borrelia burgdorferi B31
LNYSFSQPT

SEQ ID NO: 141491 - protein, 15 aa, Borrelia burgdorferi B31
KVYDRSYAPQLNSNT

SEQ ID NO: 141492 - protein, 9 aa, Borrelia burgdorferi B31
YDRSYAPQL

SEQ ID NO: 141493 - protein, 15 aa, Borrelia burgdorferi B31
LPTFALNYSFSQPTR

SEQ ID NO: 141494 - protein, 9 aa, Borrelia burgdorferi B31
LNYSFSQPT

SEQ ID NO: 141495 - protein, 15 aa, Borrelia burgdorferi B31
KGSQNQQAAPSPQLQ

SEQ ID NO: 141496 - protein, 9 aa, Borrelia burgdorferi B31
QQAAPSPQL

SEQ ID NO: 141497 - protein, 15 aa, Borrelia burgdorferi B31
GLPTFALNYSFSQPT

SEQ ID NO: 141498 - protein, 9 aa, Borrelia burgdorferi B31
LPTFALNYS

SEQ ID NO: 141499 - protein, 15 aa, Borrelia burgdorferi B31
NKGSQNQQAAPSPQL

SEQ ID NO: 141500 - protein, 9 aa, Borrelia burgdorferi B31
SQNQQAAPS

SEQ ID NO: 141501 - protein, 15 aa, Borrelia burgdorferi B31
GSQNQQAAPSPQLQS

SEQ ID NO: 141502 - protein, 9 aa, Borrelia burgdorferi B31
QQAAPSPQL

SEQ ID NO: 141503 - protein, 15 aa, Borrelia burgdorferi B31
LSFSADLSNLPKTTA

SEQ ID NO: 141504 - protein, 9 aa, Borrelia burgdorferi B31
FSADLSNLP

SEQ ID NO: 141505 - protein, 15 aa, Borrelia burgdorferi B31
SQNQQAAPSPQLQSL

SEQ ID NO: 141506 - protein, 9 aa, Borrelia burgdorferi B31
QQAAPSPQL

SEQ ID NO: 141507 - protein, 15 aa, Borrelia burgdorferi B31
DSAFELLDVISSAKV

SEQ ID NO: 141508 - protein, 9 aa, Borrelia burgdorferi B31
FELLDVISS

SEQ ID NO: 141509 - protein, 15 aa, Borrelia burgdorferi B31
YDQFKMKDSAFELLD

SEQ ID NO: 141510 - protein, 9 aa, Borrelia burgdorferi B31
FKMKDSAFE

SEQ ID NO: 141511 - protein, 15 aa, Borrelia burgdorferi B31
TYDQFKMKDSAFELL

SEQ ID NO: 141512 - protein, 9 aa, Borrelia burgdorferi B31
FKMKDSAFE

SEQ ID NO: 141513 - protein, 15 aa, Borrelia burgdorferi B31
SAFELLDVISSAKVY

SEQ ID NO: 141514 - protein, 9 aa, Borrelia burgdorferi B31
LDVISSAKV

SEQ ID NO: 141515 - protein, 15 aa, Borrelia burgdorferi B31
QNQQAAPSPQLQSLS

SEQ ID NO: 141516 - protein, 9 aa, Borrelia burgdorferi B31
QQAAPSPQL

SEQ ID NO: 141517 - protein, 15 aa, Borrelia burgdorferi B31
DQFKMKDSAFELLDV

SEQ ID NO: 141518 - protein, 9 aa, Borrelia burgdorferi B31
FKMKDSAFE

SEQ ID NO: 141519 - protein, 15 aa, Borrelia burgdorferi B31
FDFTMKLKELKSKLN

SEQ ID NO: 141520 - protein, 9 aa, Borrelia burgdorferi B31
FTMKLKELK

SEQ ID NO: 141521 - protein, 15 aa, Borrelia burgdorferi B31
KVKGILNKAADDQET

SEQ ID NO: 141522 - protein, 9 aa, Borrelia burgdorferi B31
VKGILNKAA

SEQ ID NO: 141523 - protein, 15 aa, Borrelia burgdorferi B31
VKGILNKAADDQETT

SEQ ID NO: 141524 - protein, 9 aa, Borrelia burgdorferi B31
VKGILNKAA

SEQ ID NO: 141525 - protein, 15 aa, Borrelia burgdorferi B31
DFTMKLKELKSKLNQ

SEQ ID NO: 141526 - protein, 9 aa, Borrelia burgdorferi B31
LKELKSKLN

SEQ ID NO: 141527 - protein, 15 aa, Borrelia burgdorferi B31
TVAAAPNKGSQNQPQ

SEQ ID NO: 141528 - protein, 9 aa, Borrelia burgdorferi B31
VAAAPNKGS

SEQ ID NO: 141529 - protein, 15 aa, Borrelia burgdorferi B31
FTMKLKELKSKLNQI

SEQ ID NO: 141530 - protein, 9 aa, Borrelia burgdorferi B31
LKELKSKLN

SEQ ID NO: 141531 - protein, 15 aa, Borrelia burgdorferi B31
AELKKQSQAAKTVAA

SEQ ID NO: 141532 - protein, 9 aa, Borrelia burgdorferi B31
KQSQAAKTV

SEQ ID NO: 141533 - protein, 15 aa, Borrelia burgdorferi B31
FELLDVISSAKVYDR

SEQ ID NO: 141534 - protein, 9 aa, Borrelia burgdorferi B31
LDVISSAKV

SEQ ID NO: 141535 - protein, 15 aa, Borrelia burgdorferi B31
IKPLIQLKLLGLFLF

SEQ ID NO: 141536 - protein, 9 aa, Borrelia burgdorferi B31
LIQLKLLGL

SEQ ID NO: 141537 - protein, 15 aa, Borrelia burgdorferi B31
VYDRSYAPQLNSNTP

SEQ ID NO: 141538 - protein, 9 aa, Borrelia burgdorferi B31
YAPQLNSNT

SEQ ID NO: 141539 - protein, 15 aa, Borrelia burgdorferi B31
KPLIQLKLLGLFLFS

SEQ ID NO: 141540 - protein, 9 aa, Borrelia burgdorferi B31
LIQLKLLGL

SEQ ID NO: 141541 - protein, 15 aa, Borrelia burgdorferi B31
ALNYSFSQPTRQQTN

SEQ ID NO: 141542 - protein, 9 aa, Borrelia burgdorferi B31
LNYSFSQPT

SEQ ID NO: 141543 - protein, 15 aa, Borrelia burgdorferi B31
LNYSFSQPTRQQTNS

SEQ ID NO: 141544 - protein, 9 aa, Borrelia burgdorferi B31
LNYSFSQPT

SEQ ID NO: 141545 - protein, 15 aa, Borrelia burgdorferi B31
SSGSKLQTLKNELIR

SEQ ID NO: 141546 - protein, 9 aa, Borrelia burgdorferi B31
LQTLKNELI

SEQ ID NO: 141547 - protein, 15 aa, Borrelia burgdorferi B31
FSADLSNLPKTTAAR

SEQ ID NO: 141548 - protein, 9 aa, Borrelia burgdorferi B31
LSNLPKTTA

SEQ ID NO: 141549 - protein, 15 aa, Borrelia burgdorferi B31
ETYDQFKMKDSAFEL

SEQ ID NO: 141550 - protein, 9 aa, Borrelia burgdorferi B31
FKMKDSAFE

SEQ ID NO: 141551 - protein, 15 aa, Borrelia burgdorferi B31
SGSKLQTLKNELIRA

SEQ ID NO: 141552 - protein, 9 aa, Borrelia burgdorferi B31
LQTLKNELI

SEQ ID NO: 141553 - protein, 15 aa, Borrelia burgdorferi B31
TSSGSKLQTLKNELI

SEQ ID NO: 141554 - protein, 9 aa, Borrelia burgdorferi B31
GSKLQTLKN

SEQ ID NO: 141555 - protein, 15 aa, Borrelia burgdorferi B31
AFELLDVISSAKVYD

SEQ ID NO: 141556 - protein, 9 aa, Borrelia burgdorferi B31
LDVISSAKV

SEQ ID NO: 141557 - protein, 15 aa, Borrelia burgdorferi B31
ELKKQSQAAKTVAAA

SEQ ID NO: 141558 - protein, 9 aa, Borrelia burgdorferi B31
SQAAKTVAA

SEQ ID NO: 141559 - protein, 15 aa, Borrelia burgdorferi B31
AVQTTTSSGSKLQTL

SEQ ID NO: 141560 - protein, 9 aa, Borrelia burgdorferi B31
VQTTTSSGS

SEQ ID NO: 141561 - protein, 15 aa, Borrelia burgdorferi B31
SFSADLSNLPKTTAA

SEQ ID NO: 141562 - protein, 9 aa, Borrelia burgdorferi B31
LSNLPKTTA

SEQ ID NO: 141563 - protein, 15 aa, Borrelia burgdorferi B31
RETYDQFKMKDSAFE

SEQ ID NO: 141564 - protein, 9 aa, Borrelia burgdorferi B31
QFKMKDSAF

SEQ ID NO: 141565 - protein, 15 aa, Borrelia burgdorferi B31
YDRSYAPQLNSNTPE

SEQ ID NO: 141566 - protein, 9 aa, Borrelia burgdorferi B31
YAPQLNSNT

SEQ ID NO: 141567 - protein, 15 aa, Borrelia burgdorferi B31
KRYLDNMQNARQSVL

SEQ ID NO: 141568 - protein, 9 aa, Borrelia burgdorferi B31
LDNMQNARQ

SEQ ID NO: 141569 - protein, 15 aa, Borrelia burgdorferi B31
RYLDNMQNARQSVLE

SEQ ID NO: 141570 - protein, 9 aa, Borrelia burgdorferi B31
MQNARQSVL

SEQ ID NO: 141571 - protein, 15 aa, Borrelia burgdorferi B31
VQTTTSSGSKLQTLK

SEQ ID NO: 141572 - protein, 9 aa, Borrelia burgdorferi B31
VQTTTSSGS

SEQ ID NO: 141573 - protein, 15 aa, Borrelia burgdorferi B31
ELLDVISSAKVYDRS

SEQ ID NO: 141574 - protein, 9 aa, Borrelia burgdorferi B31
LDVISSAKV

SEQ ID NO: 141575 - protein, 15 aa, Borrelia burgdorferi B31
NSRNSGLPTFALNYS

SEQ ID NO: 141576 - protein, 9 aa, Borrelia burgdorferi B31
NSGLPTFAL

SEQ ID NO: 141577 - protein, 15 aa, Borrelia burgdorferi B31
KTTAARAASLTKQRI

SEQ ID NO: 141578 - protein, 9 aa, Borrelia burgdorferi B31
TAARAASLT

SEQ ID NO: 141579 - protein, 15 aa, Borrelia burgdorferi B31
ASLTKQRIPIQAVTT

SEQ ID NO: 141580 - protein, 9 aa, Borrelia burgdorferi B31
LTKQRIPIQ

SEQ ID NO: 141581 - protein, 15 aa, Borrelia burgdorferi B31
LKKQSQAAKTVAAAP

SEQ ID NO: 141582 - protein, 9 aa, Borrelia burgdorferi B31
SQAAKTVAA

SEQ ID NO: 141583 - protein, 15 aa, Borrelia burgdorferi B31
KIKPLIQLKLLGLFL

SEQ ID NO: 141584 - protein, 9 aa, Borrelia burgdorferi B31
LIQLKLLGL

SEQ ID NO: 141585 - protein, 15 aa, Borrelia burgdorferi B31
TLKNELIRAISEEKN

SEQ ID NO: 141586 - protein, 9 aa, Borrelia burgdorferi B31
LKNELIRAI

SEQ ID NO: 141587 - protein, 15 aa, Borrelia burgdorferi B31
LKNELIRAISEEKNK

SEQ ID NO: 141588 - protein, 9 aa, Borrelia burgdorferi B31
LKNELIRAI

SEQ ID NO: 141589 - protein, 15 aa, Borrelia burgdorferi B31
KELKSKLNQILDKRK

SEQ ID NO: 141590 - protein, 9 aa, Borrelia burgdorferi B31
LKSKLNQIL

SEQ ID NO: 141591 - protein, 15 aa, Borrelia burgdorferi B31
QAVTTVPGNTRTFNS

SEQ ID NO: 141592 - protein, 9 aa, Borrelia burgdorferi B31
VTTVPGNTR

SEQ ID NO: 141593 - protein, 15 aa, Borrelia burgdorferi B31
RTFNSRNSGLPTFAL

SEQ ID NO: 141594 - protein, 9 aa, Borrelia burgdorferi B31
FNSRNSGLP

SEQ ID NO: 141595 - protein, 15 aa, Borrelia burgdorferi B31
SRNSGLPTFALNYSF

SEQ ID NO: 141596 - protein, 9 aa, Borrelia burgdorferi B31
LPTFALNYS

SEQ ID NO: 141597 - protein, 15 aa, Borrelia burgdorferi B31
YLDNMQNARQSVLEA

SEQ ID NO: 141598 - protein, 9 aa, Borrelia burgdorferi B31
MQNARQSVL

SEQ ID NO: 141599 - protein, 15 aa, Borrelia burgdorferi B31
VAAAPNKGSQNQPQT

SEQ ID NO: 141600 - protein, 9 aa, Borrelia burgdorferi B31
VAAAPNKGS

SEQ ID NO: 141601 - protein, 15 aa, Borrelia burgdorferi B31
QPTRQQTNSSSAVQT

SEQ ID NO: 141602 - protein, 9 aa, Borrelia burgdorferi B31
QQTNSSSAV

SEQ ID NO: 141603 - protein, 15 aa, Borrelia burgdorferi B31
PTRQQTNSSSAVQTT

SEQ ID NO: 141604 - protein, 9 aa, Borrelia burgdorferi B31
TNSSSAVQT

SEQ ID NO: 141605 - protein, 15 aa, Borrelia burgdorferi B31
QSQAAKTVAAAPNKG

SEQ ID NO: 141606 - protein, 9 aa, Borrelia burgdorferi B31
SQAAKTVAA

SEQ ID NO: 141607 - protein, 15 aa, Borrelia burgdorferi B31
TRQQTNSSSAVQTTT

SEQ ID NO: 141608 - protein, 9 aa, Borrelia burgdorferi B31
TNSSSAVQT

SEQ ID NO: 141609 - protein, 15 aa, Borrelia burgdorferi B31
RSYAPQLNSNTPEAE

SEQ ID NO: 141610 - protein, 9 aa, Borrelia burgdorferi B31
YAPQLNSNT

SEQ ID NO: 141611 - protein, 15 aa, Borrelia burgdorferi B31
FKMKDSAFELLDVIS

SEQ ID NO: 141612 - protein, 9 aa, Borrelia burgdorferi B31
FKMKDSAFE

SEQ ID NO: 141613 - protein, 15 aa, Borrelia burgdorferi B31
LIQLKLLGLFLFSCT

SEQ ID NO: 141614 - protein, 9 aa, Borrelia burgdorferi B31
LKLLGLFLF

SEQ ID NO: 141615 - protein, 15 aa, Borrelia burgdorferi B31
KKQSQAAKTVAAAPN

SEQ ID NO: 141616 - protein, 9 aa, Borrelia burgdorferi B31
SQAAKTVAA

SEQ ID NO: 141617 - protein, 15 aa, Borrelia burgdorferi B31
LDNMQNARQSVLEAY

SEQ ID NO: 141618 - protein, 9 aa, Borrelia burgdorferi B31
MQNARQSVL

SEQ ID NO: 141619 - protein, 15 aa, Borrelia burgdorferi B31
VAAELKKQSQAAKTV

SEQ ID NO: 141620 - protein, 9 aa, Borrelia burgdorferi B31
KKQSQAAKT

SEQ ID NO: 141621 - protein, 15 aa, Borrelia burgdorferi B31
KQSQAAKTVAAAPNK

SEQ ID NO: 141622 - protein, 9 aa, Borrelia burgdorferi B31
SQAAKTVAA

SEQ ID NO: 141623 - protein, 15 aa, Borrelia burgdorferi B31
DRSYAPQLNSNTPEA

SEQ ID NO: 141624 - protein, 9 aa, Borrelia burgdorferi B31
YAPQLNSNT

SEQ ID NO: 141625 - protein, 15 aa, Borrelia burgdorferi B31
AAELKKQSQAAKTVA

SEQ ID NO: 141626 - protein, 9 aa, Borrelia burgdorferi B31
KQSQAAKTV

SEQ ID NO: 141627 - protein, 15 aa, Borrelia burgdorferi B31
HSLIRELMISGLGTQ

SEQ ID NO: 141628 - protein, 9 aa, Borrelia burgdorferi B31
IRELMISGL

SEQ ID NO: 141629 - protein, 15 aa, Borrelia burgdorferi B31
PLIQLKLLGLFLFSC

SEQ ID NO: 141630 - protein, 9 aa, Borrelia burgdorferi B31
LKLLGLFLF

SEQ ID NO: 141631 - protein, 15 aa, Borrelia burgdorferi B31
NSGLPTFALNYSFSQ

SEQ ID NO: 141632 - protein, 9 aa, Borrelia burgdorferi B31
LPTFALNYS

SEQ ID NO: 141633 - protein, 15 aa, Borrelia burgdorferi B31
QFKMKDSAFELLDVI

SEQ ID NO: 141634 - protein, 9 aa, Borrelia burgdorferi B31
FKMKDSAFE

SEQ ID NO: 141635 - protein, 15 aa, Borrelia burgdorferi B31
RQQTNSSSAVQTTTS

SEQ ID NO: 141636 - protein, 9 aa, Borrelia burgdorferi B31
TNSSSAVQT

SEQ ID NO: 141637 - protein, 15 aa, Borrelia burgdorferi B31
NHSLIRELMISGLGT

SEQ ID NO: 141638 - protein, 9 aa, Borrelia burgdorferi B31
IRELMISGL

SEQ ID NO: 141639 - protein, 15 aa, Borrelia burgdorferi B31
DNMQNARQSVLEAYI

SEQ ID NO: 141640 - protein, 9 aa, Borrelia burgdorferi B31
MQNARQSVL

SEQ ID NO: 141641 - protein, 15 aa, Borrelia burgdorferi B31
TTAARAASLTKQRIP

SEQ ID NO: 141642 - protein, 9 aa, Borrelia burgdorferi B31
TTAARAASL

SEQ ID NO: 141643 - protein, 15 aa, Borrelia burgdorferi B31
QQTNSSSAVQTTTSS

SEQ ID NO: 141644 - protein, 9 aa, Borrelia burgdorferi B31
TNSSSAVQT

SEQ ID NO: 141645 - protein, 15 aa, Borrelia burgdorferi B31
RNSGLPTFALNYSFS

SEQ ID NO: 141646 - protein, 9 aa, Borrelia burgdorferi B31
LPTFALNYS

SEQ ID NO: 141647 - protein, 15 aa, Borrelia burgdorferi B31
AKVYDRSYAPQLNSN

SEQ ID NO: 141648 - protein, 9 aa, Borrelia burgdorferi B31
YDRSYAPQL

SEQ ID NO: 141649 - protein, 15 aa, Borrelia burgdorferi B31
TFNSRNSGLPTFALN

SEQ ID NO: 141650 - protein, 9 aa, Borrelia burgdorferi B31
FNSRNSGLP

SEQ ID NO: 141651 - protein, 15 aa, Borrelia burgdorferi B31
SLSFSADLSNLPKTT

SEQ ID NO: 141652 - protein, 9 aa, Borrelia burgdorferi B31
FSADLSNLP

SEQ ID NO: 141653 - protein, 15 aa, Borrelia burgdorferi B31
FNSRNSGLPTFALNY

SEQ ID NO: 141654 - protein, 9 aa, Borrelia burgdorferi B31
FNSRNSGLP

SEQ ID NO: 141655 - protein, 15 aa, Borrelia burgdorferi B31
MKDSAFELLDVISSA

SEQ ID NO: 141656 - protein, 9 aa, Borrelia burgdorferi B31
FELLDVISS

SEQ ID NO: 141657 - protein, 15 aa, Borrelia burgdorferi B31
QLQSLSFSADLSNLP

SEQ ID NO: 141658 - protein, 9 aa, Borrelia burgdorferi B31
LQSLSFSAD

SEQ ID NO: 141659 - protein, 15 aa, Borrelia burgdorferi B31
IQLKLLGLFLFSCTI

SEQ ID NO: 141660 - protein, 9 aa, Borrelia burgdorferi B31
LKLLGLFLF

SEQ ID NO: 141661 - protein, 15 aa, Borrelia burgdorferi B31
LQSLSFSADLSNLPK

SEQ ID NO: 141662 - protein, 9 aa, Borrelia burgdorferi B31
FSADLSNLP

SEQ ID NO: 141663 - protein, 15 aa, Borrelia burgdorferi B31
SSAKVYDRSYAPQLN

SEQ ID NO: 141664 - protein, 9 aa, Borrelia burgdorferi B31
YDRSYAPQL

SEQ ID NO: 141665 - protein, 15 aa, Borrelia burgdorferi B31
KMKDSAFELLDVISS

SEQ ID NO: 141666 - protein, 9 aa, Borrelia burgdorferi B31
MKDSAFELL

SEQ ID NO: 141667 - protein, 15 aa, Borrelia burgdorferi B31
AVTTVPGNTRTFNSR

SEQ ID NO: 141668 - protein, 9 aa, Borrelia burgdorferi B31
VTTVPGNTR

SEQ ID NO: 141669 - protein, 15 aa, Borrelia burgdorferi B31
KKRYLDNMQNARQSV

SEQ ID NO: 141670 - protein, 9 aa, Borrelia burgdorferi B31
LDNMQNARQ

SEQ ID NO: 141671 - protein, 15 aa, Borrelia burgdorferi B31
NQQAAPSPQLQSLSF

SEQ ID NO: 141672 - protein, 9 aa, Borrelia burgdorferi B31
QQAAPSPQL

SEQ ID NO: 141673 - protein, 15 aa, Borrelia burgdorferi B31
NYSFSQPTRQQTNSS

SEQ ID NO: 141674 - protein, 9 aa, Borrelia burgdorferi B31
FSQPTRQQT

SEQ ID NO: 141675 - protein, 15 aa, Borrelia burgdorferi B31
IKKRYLDNMQNARQS

SEQ ID NO: 141676 - protein, 9 aa, Borrelia burgdorferi B31
LDNMQNARQ

SEQ ID NO: 141677 - protein, 15 aa, Borrelia burgdorferi B31
LKLLGLFLFSCTIDA

SEQ ID NO: 141678 - protein, 9 aa, Borrelia burgdorferi B31
LLGLFLFSC

SEQ ID NO: 141679 - protein, 15 aa, Borrelia burgdorferi B31
QSLSFSADLSNLPKT

SEQ ID NO: 141680 - protein, 9 aa, Borrelia burgdorferi B31
FSADLSNLP

SEQ ID NO: 141681 - protein, 15 aa, Borrelia burgdorferi B31
NQNHSLIRELMISGL

SEQ ID NO: 141682 - protein, 9 aa, Borrelia burgdorferi B31
LIRELMISG

SEQ ID NO: 141683 - protein, 15 aa, Borrelia burgdorferi B31
QNHSLIRELMISGLG

SEQ ID NO: 141684 - protein, 9 aa, Borrelia burgdorferi B31
IRELMISGL

SEQ ID NO: 141685 - protein, 15 aa, Borrelia burgdorferi B31
AASLTKQRIPIQAVT

SEQ ID NO: 141686 - protein, 9 aa, Borrelia burgdorferi B31
LTKQRIPIQ

SEQ ID NO: 141687 - protein, 15 aa, Borrelia burgdorferi B31
GSIMEALYNENQNHS

SEQ ID NO: 141688 - protein, 9 aa, Borrelia burgdorferi B31
MEALYNENQ

SEQ ID NO: 141689 - protein, 15 aa, Borrelia burgdorferi B31
SIMEALYNENQNHSL

SEQ ID NO: 141690 - protein, 9 aa, Borrelia burgdorferi B31
LYNENQNHS

SEQ ID NO: 141691 - protein, 15 aa, Borrelia burgdorferi B31
MEALYNENQNHSLIR

SEQ ID NO: 141692 - protein, 9 aa, Borrelia burgdorferi B31
LYNENQNHS

SEQ ID NO: 141693 - protein, 15 aa, Borrelia burgdorferi B31
IMEALYNENQNHSLI

SEQ ID NO: 141694 - protein, 9 aa, Borrelia burgdorferi B31
LYNENQNHS

SEQ ID NO: 141695 - protein, 15 aa, Borrelia burgdorferi B31
EALYNENQNHSLIRE

SEQ ID NO: 141696 - protein, 9 aa, Borrelia burgdorferi B31
LYNENQNHS

SEQ ID NO: 141697 - protein, 15 aa, Borrelia burgdorferi B31
RQADGLIANASSNSS

SEQ ID NO: 141698 - protein, 9 aa, Borrelia burgdorferi B31
LIANASSNS

SEQ ID NO: 141699 - protein, 15 aa, Borrelia burgdorferi B31
QADGLIANASSNSSL

SEQ ID NO: 141700 - protein, 9 aa, Borrelia burgdorferi B31
IANASSNSS

SEQ ID NO: 141701 - protein, 15 aa, Borrelia burgdorferi B31
ADGLIANASSNSSLS

SEQ ID NO: 141702 - protein, 9 aa, Borrelia burgdorferi B31
IANASSNSS

SEQ ID NO: 141703 - protein, 15 aa, Borrelia burgdorferi B31
DGLIANASSNSSLSD

SEQ ID NO: 141704 - protein, 9 aa, Borrelia burgdorferi B31
IANASSNSS

SEQ ID NO: 141705 - protein, 15 aa, Borrelia burgdorferi B31
GLIANASSNSSLSDS

SEQ ID NO: 141706 - protein, 9 aa, Borrelia burgdorferi B31
IANASSNSS

SEQ ID NO: 141707 - protein, 15 aa, Borrelia burgdorferi B31
LSFSADLSNLPKTTA

SEQ ID NO: 141708 - protein, 9 aa, Borrelia burgdorferi B31
FSADLSNLP

SEQ ID NO: 141709 - protein, 15 aa, Borrelia burgdorferi B31
LQSLSFSADLSNLPK

SEQ ID NO: 141710 - protein, 9 aa, Borrelia burgdorferi B31
FSADLSNLP

SEQ ID NO: 141711 - protein, 15 aa, Borrelia burgdorferi B31
QSLSFSADLSNLPKT

SEQ ID NO: 141712 - protein, 9 aa, Borrelia burgdorferi B31
FSADLSNLP

SEQ ID NO: 141713 - protein, 15 aa, Borrelia burgdorferi B31
SLSFSADLSNLPKTT

SEQ ID NO: 141714 - protein, 9 aa, Borrelia burgdorferi B31
FSADLSNLP

SEQ ID NO: 141715 - protein, 15 aa, Borrelia burgdorferi B31
QLQSLSFSADLSNLP

SEQ ID NO: 141716 - protein, 9 aa, Borrelia burgdorferi B31
LSFSADLSN

SEQ ID NO: 141717 - protein, 15 aa, Borrelia burgdorferi B31
LYNENQNHSLIRELM

SEQ ID NO: 141718 - protein, 9 aa, Borrelia burgdorferi B31
LYNENQNHS

SEQ ID NO: 141719 - protein, 15 aa, Borrelia burgdorferi B31
ALYNENQNHSLIREL

SEQ ID NO: 141720 - protein, 9 aa, Borrelia burgdorferi B31
LYNENQNHS

SEQ ID NO: 141721 - protein, 15 aa, Borrelia burgdorferi B31
LIANASSNSSLSDSK

SEQ ID NO: 141722 - protein, 9 aa, Borrelia burgdorferi B31
IANASSNSS

SEQ ID NO: 141723 - protein, 15 aa, Borrelia burgdorferi B31
IANASSNSSLSDSKS

SEQ ID NO: 141724 - protein, 9 aa, Borrelia burgdorferi B31
IANASSNSS

SEQ ID NO: 141725 - protein, 15 aa, Borrelia burgdorferi B31
FSADLSNLPKTTAAR

SEQ ID NO: 141726 - protein, 9 aa, Borrelia burgdorferi B31
FSADLSNLP

SEQ ID NO: 141727 - protein, 15 aa, Borrelia burgdorferi B31
SFSADLSNLPKTTAA

SEQ ID NO: 141728 - protein, 9 aa, Borrelia burgdorferi B31
FSADLSNLP

SEQ ID NO: 141729 - protein, 15 aa, Borrelia burgdorferi B31
PTFALNYSFSQPTRQ

SEQ ID NO: 141730 - protein, 9 aa, Borrelia burgdorferi B31
FALNYSFSQ

SEQ ID NO: 141731 - protein, 15 aa, Borrelia burgdorferi B31
LPTFALNYSFSQPTR

SEQ ID NO: 141732 - protein, 9 aa, Borrelia burgdorferi B31
FALNYSFSQ

SEQ ID NO: 141733 - protein, 15 aa, Borrelia burgdorferi B31
EIFNQDYLNAKINSF

SEQ ID NO: 141734 - protein, 9 aa, Borrelia burgdorferi B31
FNQDYLNAK

SEQ ID NO: 141735 - protein, 15 aa, Borrelia burgdorferi B31
GLPTFALNYSFSQPT

SEQ ID NO: 141736 - protein, 9 aa, Borrelia burgdorferi B31
FALNYSFSQ

SEQ ID NO: 141737 - protein, 15 aa, Borrelia burgdorferi B31
SGLPTFALNYSFSQP

SEQ ID NO: 141738 - protein, 9 aa, Borrelia burgdorferi B31
FALNYSFSQ

SEQ ID NO: 141739 - protein, 15 aa, Borrelia burgdorferi B31
NSGLPTFALNYSFSQ

SEQ ID NO: 141740 - protein, 9 aa, Borrelia burgdorferi B31
LPTFALNYS

SEQ ID NO: 141741 - protein, 15 aa, Borrelia burgdorferi B31
IFNQDYLNAKINSFD

SEQ ID NO: 141742 - protein, 9 aa, Borrelia burgdorferi B31
YLNAKINSF

SEQ ID NO: 141743 - protein, 15 aa, Borrelia burgdorferi B31
FALNYSFSQPTRQQT

SEQ ID NO: 141744 - protein, 9 aa, Borrelia burgdorferi B31
FALNYSFSQ

SEQ ID NO: 141745 - protein, 15 aa, Borrelia burgdorferi B31
TFALNYSFSQPTRQQ

SEQ ID NO: 141746 - protein, 9 aa, Borrelia burgdorferi B31
FALNYSFSQ

SEQ ID NO: 141747 - protein, 15 aa, Borrelia burgdorferi B31
FNQDYLNAKINSFDF

SEQ ID NO: 141748 - protein, 9 aa, Borrelia burgdorferi B31
YLNAKINSF

SEQ ID NO: 141749 - protein, 15 aa, Borrelia burgdorferi B31
RQADGLIANASSNSS

SEQ ID NO: 141750 - protein, 9 aa, Borrelia burgdorferi B31
LIANASSNS

SEQ ID NO: 141751 - protein, 15 aa, Borrelia burgdorferi B31
ADGLIANASSNSSLS

SEQ ID NO: 141752 - protein, 9 aa, Borrelia burgdorferi B31
IANASSNSS

SEQ ID NO: 141753 - protein, 15 aa, Borrelia burgdorferi B31
DGLIANASSNSSLSD

SEQ ID NO: 141754 - protein, 9 aa, Borrelia burgdorferi B31
IANASSNSS

SEQ ID NO: 141755 - protein, 15 aa, Borrelia burgdorferi B31
QADGLIANASSNSSL

SEQ ID NO: 141756 - protein, 9 aa, Borrelia burgdorferi B31
IANASSNSS

SEQ ID NO: 141757 - protein, 15 aa, Borrelia burgdorferi B31
GLIANASSNSSLSDS

SEQ ID NO: 141758 - protein, 9 aa, Borrelia burgdorferi B31
IANASSNSS

SEQ ID NO: 141759 - protein, 15 aa, Borrelia burgdorferi B31
DRSYAPQLNSNTPEA

SEQ ID NO: 141760 - protein, 9 aa, Borrelia burgdorferi B31
YAPQLNSNT

SEQ ID NO: 141761 - protein, 15 aa, Borrelia burgdorferi B31
RSYAPQLNSNTPEAE

SEQ ID NO: 141762 - protein, 9 aa, Borrelia burgdorferi B31
QLNSNTPEA

SEQ ID NO: 141763 - protein, 15 aa, Borrelia burgdorferi B31
SYAPQLNSNTPEAEN

SEQ ID NO: 141764 - protein, 9 aa, Borrelia burgdorferi B31
QLNSNTPEA

SEQ ID NO: 141765 - protein, 15 aa, Borrelia burgdorferi B31
HSLIRELMISGLGTQ

SEQ ID NO: 141766 - protein, 9 aa, Borrelia burgdorferi B31
LIRELMISG

SEQ ID NO: 141767 - protein, 15 aa, Borrelia burgdorferi B31
LIRELMISGLGTQIS

SEQ ID NO: 141768 - protein, 9 aa, Borrelia burgdorferi B31
LMISGLGTQ

SEQ ID NO: 141769 - protein, 15 aa, Borrelia burgdorferi B31
YAPQLNSNTPEAENE

SEQ ID NO: 141770 - protein, 9 aa, Borrelia burgdorferi B31
QLNSNTPEA

SEQ ID NO: 141771 - protein, 15 aa, Borrelia burgdorferi B31
LSFSADLSNLPKTTA

SEQ ID NO: 141772 - protein, 9 aa, Borrelia burgdorferi B31
FSADLSNLP

SEQ ID NO: 141773 - protein, 15 aa, Borrelia burgdorferi B31
SLIRELMISGLGTQI

SEQ ID NO: 141774 - protein, 9 aa, Borrelia burgdorferi B31
LMISGLGTQ

SEQ ID NO: 141775 - protein, 15 aa, Borrelia burgdorferi B31
RELMISGLGTQISFE

SEQ ID NO: 141776 - protein, 9 aa, Borrelia burgdorferi B31
LMISGLGTQ

SEQ ID NO: 141777 - protein, 15 aa, Borrelia burgdorferi B31
LIANASSNSSLSDSK

SEQ ID NO: 141778 - protein, 9 aa, Borrelia burgdorferi B31
IANASSNSS

SEQ ID NO: 141779 - protein, 15 aa, Borrelia burgdorferi B31
IANASSNSSLSDSKS

SEQ ID NO: 141780 - protein, 9 aa, Borrelia burgdorferi B31
IANASSNSS

SEQ ID NO: 141781 - protein, 15 aa, Borrelia burgdorferi B31
IRELMISGLGTQISF

SEQ ID NO: 141782 - protein, 9 aa, Borrelia burgdorferi B31
LMISGLGTQ

SEQ ID NO: 141783 - protein, 15 aa, Borrelia burgdorferi B31
APQLNSNTPEAENER

SEQ ID NO: 141784 - protein, 9 aa, Borrelia burgdorferi B31
QLNSNTPEA

SEQ ID NO: 141785 - protein, 15 aa, Borrelia burgdorferi B31
LQSLSFSADLSNLPK

SEQ ID NO: 141786 - protein, 9 aa, Borrelia burgdorferi B31
FSADLSNLP

SEQ ID NO: 141787 - protein, 15 aa, Borrelia burgdorferi B31
RIPIQAVTTVPGNTR

SEQ ID NO: 141788 - protein, 9 aa, Borrelia burgdorferi B31
IQAVTTVPG

SEQ ID NO: 141789 - protein, 15 aa, Borrelia burgdorferi B31
IPIQAVTTVPGNTRT

SEQ ID NO: 141790 - protein, 9 aa, Borrelia burgdorferi B31
IQAVTTVPG

SEQ ID NO: 141791 - protein, 15 aa, Borrelia burgdorferi B31
KQRIPIQAVTTVPGN

SEQ ID NO: 141792 - protein, 9 aa, Borrelia burgdorferi B31
IQAVTTVPG

SEQ ID NO: 141793 - protein, 15 aa, Borrelia burgdorferi B31
TKQRIPIQAVTTVPG

SEQ ID NO: 141794 - protein, 9 aa, Borrelia burgdorferi B31
KQRIPIQAV

SEQ ID NO: 141795 - protein, 15 aa, Borrelia burgdorferi B31
QRIPIQAVTTVPGNT

SEQ ID NO: 141796 - protein, 9 aa, Borrelia burgdorferi B31
IQAVTTVPG

SEQ ID NO: 141797 - protein, 15 aa, Borrelia burgdorferi B31
PIQAVTTVPGNTRTF

SEQ ID NO: 141798 - protein, 9 aa, Borrelia burgdorferi B31
IQAVTTVPG

SEQ ID NO: 141799 - protein, 15 aa, Borrelia burgdorferi B31
IQAVTTVPGNTRTFN

SEQ ID NO: 141800 - protein, 9 aa, Borrelia burgdorferi B31
IQAVTTVPG

SEQ ID NO: 141801 - protein, 15 aa, Borrelia burgdorferi B31
SQAAKTVAAAPNKGS

SEQ ID NO: 141802 - protein, 9 aa, Borrelia burgdorferi B31
AKTVAAAPN

SEQ ID NO: 141803 - protein, 15 aa, Borrelia burgdorferi B31
AKTVAAAPNKGSQNQ

SEQ ID NO: 141804 - protein, 9 aa, Borrelia burgdorferi B31
VAAAPNKGS

SEQ ID NO: 141805 - protein, 15 aa, Borrelia burgdorferi B31
QAAKTVAAAPNKGSQ

SEQ ID NO: 141806 - protein, 9 aa, Borrelia burgdorferi B31
VAAAPNKGS

SEQ ID NO: 141807 - protein, 15 aa, Borrelia burgdorferi B31
AAKTVAAAPNKGSQN

SEQ ID NO: 141808 - protein, 9 aa, Borrelia burgdorferi B31
VAAAPNKGS

SEQ ID NO: 141809 - protein, 15 aa, Borrelia burgdorferi B31
KTVAAAPNKGSQNQP

SEQ ID NO: 141810 - protein, 9 aa, Borrelia burgdorferi B31
VAAAPNKGS

SEQ ID NO: 141811 - protein, 15 aa, Borrelia burgdorferi B31
LQSLSFSADLSNLPK

SEQ ID NO: 141812 - protein, 9 aa, Borrelia burgdorferi B31
FSADLSNLP

SEQ ID NO: 141813 - protein, 15 aa, Borrelia burgdorferi B31
DNMQNARQSVLEAYI

SEQ ID NO: 141814 - protein, 9 aa, Borrelia burgdorferi B31
MQNARQSVL

SEQ ID NO: 141815 - protein, 15 aa, Borrelia burgdorferi B31
KRYLDNMQNARQSVL

SEQ ID NO: 141816 - protein, 9 aa, Borrelia burgdorferi B31
DNMQNARQS

SEQ ID NO: 141817 - protein, 15 aa, Borrelia burgdorferi B31
YLDNMQNARQSVLEA

SEQ ID NO: 141818 - protein, 9 aa, Borrelia burgdorferi B31
MQNARQSVL

SEQ ID NO: 141819 - protein, 15 aa, Borrelia burgdorferi B31
LDNMQNARQSVLEAY

SEQ ID NO: 141820 - protein, 9 aa, Borrelia burgdorferi B31
MQNARQSVL

SEQ ID NO: 141821 - protein, 15 aa, Borrelia burgdorferi B31
RYLDNMQNARQSVLE

SEQ ID NO: 141822 - protein, 9 aa, Borrelia burgdorferi B31
MQNARQSVL

SEQ ID NO: 141823 - protein, 15 aa, Borrelia burgdorferi B31
SNLPKTTAARAASLT

SEQ ID NO: 141824 - protein, 9 aa, Borrelia burgdorferi B31
LPKTTAARA

SEQ ID NO: 141825 - protein, 15 aa, Borrelia burgdorferi B31
LSNLPKTTAARAASL

SEQ ID NO: 141826 - protein, 9 aa, Borrelia burgdorferi B31
LPKTTAARA

SEQ ID NO: 141827 - protein, 15 aa, Borrelia burgdorferi B31
NLPKTTAARAASLTK

SEQ ID NO: 141828 - protein, 9 aa, Borrelia burgdorferi B31
TTAARAASL

SEQ ID NO: 141829 - protein, 15 aa, Borrelia burgdorferi B31
LPKTTAARAASLTKQ

SEQ ID NO: 141830 - protein, 9 aa, Borrelia burgdorferi B31
TTAARAASL

SEQ ID NO: 141831 - protein, 15 aa, Borrelia burgdorferi B31
ADLSNLPKTTAARAA

SEQ ID NO: 141832 - protein, 9 aa, Borrelia burgdorferi B31
LPKTTAARA

SEQ ID NO: 141833 - protein, 15 aa, Borrelia burgdorferi B31
DLSNLPKTTAARAAS

SEQ ID NO: 141834 - protein, 9 aa, Borrelia burgdorferi B31
LPKTTAARA

SEQ ID NO: 141835 - protein, 15 aa, Borrelia burgdorferi B31
SADLSNLPKTTAARA

SEQ ID NO: 141836 - protein, 9 aa, Borrelia burgdorferi B31
LSNLPKTTA

SEQ ID NO: 141837 - protein, 15 aa, Borrelia burgdorferi B31
MQNARQSVLEAYISI

SEQ ID NO: 141838 - protein, 9 aa, Borrelia burgdorferi B31
MQNARQSVL

SEQ ID NO: 141839 - protein, 15 aa, Borrelia burgdorferi B31
NMQNARQSVLEAYIS

SEQ ID NO: 141840 - protein, 9 aa, Borrelia burgdorferi B31
MQNARQSVL

SEQ ID NO: 141841 - protein, 15 aa, Borrelia burgdorferi B31
PKTTAARAASLTKQR

SEQ ID NO: 141842 - protein, 9 aa, Borrelia burgdorferi B31
TTAARAASL

SEQ ID NO: 141843 - protein, 15 aa, Borrelia burgdorferi B31
DNMQNARQSVLEAYI

SEQ ID NO: 141844 - protein, 9 aa, Borrelia burgdorferi B31
MQNARQSVL

SEQ ID NO: 141845 - protein, 15 aa, Borrelia burgdorferi B31
LDNMQNARQSVLEAY

SEQ ID NO: 141846 - protein, 9 aa, Borrelia burgdorferi B31
MQNARQSVL

SEQ ID NO: 141847 - protein, 15 aa, Borrelia burgdorferi B31
YLDNMQNARQSVLEA

SEQ ID NO: 141848 - protein, 9 aa, Borrelia burgdorferi B31
MQNARQSVL

SEQ ID NO: 141849 - protein, 15 aa, Borrelia burgdorferi B31
RYLDNMQNARQSVLE

SEQ ID NO: 141850 - protein, 9 aa, Borrelia burgdorferi B31
MQNARQSVL

SEQ ID NO: 141851 - protein, 15 aa, Borrelia burgdorferi B31
KRYLDNMQNARQSVL

SEQ ID NO: 141852 - protein, 9 aa, Borrelia burgdorferi B31
LDNMQNARQ

SEQ ID NO: 141853 - protein, 15 aa, Borrelia burgdorferi B31
LIQLKLLGLFLFSCT

SEQ ID NO: 141854 - protein, 9 aa, Borrelia burgdorferi B31
LKLLGLFLF

SEQ ID NO: 141855 - protein, 15 aa, Borrelia burgdorferi B31
IKPLIQLKLLGLFLF

SEQ ID NO: 141856 - protein, 9 aa, Borrelia burgdorferi B31
IQLKLLGLF

SEQ ID NO: 141857 - protein, 15 aa, Borrelia burgdorferi B31
IQLKLLGLFLFSCTI

SEQ ID NO: 141858 - protein, 9 aa, Borrelia burgdorferi B31
LKLLGLFLF

SEQ ID NO: 141859 - protein, 15 aa, Borrelia burgdorferi B31
KPLIQLKLLGLFLFS

SEQ ID NO: 141860 - protein, 9 aa, Borrelia burgdorferi B31
LKLLGLFLF

SEQ ID NO: 141861 - protein, 15 aa, Borrelia burgdorferi B31
PLIQLKLLGLFLFSC

SEQ ID NO: 141862 - protein, 9 aa, Borrelia burgdorferi B31
LKLLGLFLF

SEQ ID NO: 141863 - protein, 15 aa, Borrelia burgdorferi B31
ANLNEDYKNKVKGIL

SEQ ID NO: 141864 - protein, 9 aa, Borrelia burgdorferi B31
LNEDYKNKV

SEQ ID NO: 141865 - protein, 15 aa, Borrelia burgdorferi B31
QLKLLGLFLFSCTID

SEQ ID NO: 141866 - protein, 9 aa, Borrelia burgdorferi B31
LKLLGLFLF

SEQ ID NO: 141867 - protein, 15 aa, Borrelia burgdorferi B31
NLNEDYKNKVKGILN

SEQ ID NO: 141868 - protein, 9 aa, Borrelia burgdorferi B31
YKNKVKGIL

SEQ ID NO: 141869 - protein, 15 aa, Borrelia burgdorferi B31
LNEDYKNKVKGILNK

SEQ ID NO: 141870 - protein, 9 aa, Borrelia burgdorferi B31
YKNKVKGIL

SEQ ID NO: 141871 - protein, 15 aa, Borrelia burgdorferi B31
LKLLGLFLFSCTIDA

SEQ ID NO: 141872 - protein, 9 aa, Borrelia burgdorferi B31
LKLLGLFLF

SEQ ID NO: 141873 - protein, 15 aa, Borrelia burgdorferi B31
RIPIQAVTTVPGNTR

SEQ ID NO: 141874 - protein, 9 aa, Borrelia burgdorferi B31
IQAVTTVPG

SEQ ID NO: 141875 - protein, 15 aa, Borrelia burgdorferi B31
IPIQAVTTVPGNTRT

SEQ ID NO: 141876 - protein, 9 aa, Borrelia burgdorferi B31
IQAVTTVPG

SEQ ID NO: 141877 - protein, 15 aa, Borrelia burgdorferi B31
EDYKNKVKGILNKAA

SEQ ID NO: 141878 - protein, 9 aa, Borrelia burgdorferi B31
YKNKVKGIL

SEQ ID NO: 141879 - protein, 15 aa, Borrelia burgdorferi B31
NEDYKNKVKGILNKA

SEQ ID NO: 141880 - protein, 9 aa, Borrelia burgdorferi B31
YKNKVKGIL

SEQ ID NO: 141881 - protein, 15 aa, Borrelia burgdorferi B31
TKQRIPIQAVTTVPG

SEQ ID NO: 141882 - protein, 9 aa, Borrelia burgdorferi B31
IPIQAVTTV

SEQ ID NO: 141883 - protein, 15 aa, Borrelia burgdorferi B31
QRIPIQAVTTVPGNT

SEQ ID NO: 141884 - protein, 9 aa, Borrelia burgdorferi B31
IQAVTTVPG

SEQ ID NO: 141885 - protein, 15 aa, Borrelia burgdorferi B31
KQRIPIQAVTTVPGN

SEQ ID NO: 141886 - protein, 9 aa, Borrelia burgdorferi B31
IQAVTTVPG

SEQ ID NO: 141887 - protein, 15 aa, Borrelia burgdorferi B31
QADGLIANASSNSSL

SEQ ID NO: 141888 - protein, 9 aa, Borrelia burgdorferi B31
IANASSNSS

SEQ ID NO: 141889 - protein, 15 aa, Borrelia burgdorferi B31
ADGLIANASSNSSLS

SEQ ID NO: 141890 - protein, 9 aa, Borrelia burgdorferi B31
IANASSNSS

SEQ ID NO: 141891 - protein, 15 aa, Borrelia burgdorferi B31
DGLIANASSNSSLSD

SEQ ID NO: 141892 - protein, 9 aa, Borrelia burgdorferi B31
IANASSNSS

SEQ ID NO: 141893 - protein, 15 aa, Borrelia burgdorferi B31
RQADGLIANASSNSS

SEQ ID NO: 141894 - protein, 9 aa, Borrelia burgdorferi B31
LIANASSNS

SEQ ID NO: 141895 - protein, 15 aa, Borrelia burgdorferi B31
IQAVTTVPGNTRTFN

SEQ ID NO: 141896 - protein, 9 aa, Borrelia burgdorferi B31
IQAVTTVPG

SEQ ID NO: 141897 - protein, 15 aa, Borrelia burgdorferi B31
DYKNKVKGILNKAAD

SEQ ID NO: 141898 - protein, 9 aa, Borrelia burgdorferi B31
YKNKVKGIL

SEQ ID NO: 141899 - protein, 15 aa, Borrelia burgdorferi B31
GLIANASSNSSLSDS

SEQ ID NO: 141900 - protein, 9 aa, Borrelia burgdorferi B31
IANASSNSS

SEQ ID NO: 141901 - protein, 15 aa, Borrelia burgdorferi B31
PIQAVTTVPGNTRTF

SEQ ID NO: 141902 - protein, 9 aa, Borrelia burgdorferi B31
IQAVTTVPG

SEQ ID NO: 141903 - protein, 15 aa, Borrelia burgdorferi B31
YKNKVKGILNKAADD

SEQ ID NO: 141904 - protein, 9 aa, Borrelia burgdorferi B31
YKNKVKGIL

SEQ ID NO: 141905 - protein, 15 aa, Borrelia burgdorferi B31
MKIKPLIQLKLLGLF

SEQ ID NO: 141906 - protein, 9 aa, Borrelia burgdorferi B31
IKPLIQLKL

SEQ ID NO: 141907 - protein, 15 aa, Borrelia burgdorferi B31
LSFSADLSNLPKTTA

SEQ ID NO: 141908 - protein, 9 aa, Borrelia burgdorferi B31
FSADLSNLP

SEQ ID NO: 141909 - protein, 15 aa, Borrelia burgdorferi B31
NQDYLNAKINSFDFT

SEQ ID NO: 141910 - protein, 9 aa, Borrelia burgdorferi B31
YLNAKINSF

SEQ ID NO: 141911 - protein, 15 aa, Borrelia burgdorferi B31
SFSADLSNLPKTTAA

SEQ ID NO: 141912 - protein, 9 aa, Borrelia burgdorferi B31
LSNLPKTTA

SEQ ID NO: 141913 - protein, 15 aa, Borrelia burgdorferi B31
KRYLDNMQNARQSVL

SEQ ID NO: 141914 - protein, 9 aa, Borrelia burgdorferi B31
YLDNMQNAR

SEQ ID NO: 141915 - protein, 15 aa, Borrelia burgdorferi B31
FSADLSNLPKTTAAR

SEQ ID NO: 141916 - protein, 9 aa, Borrelia burgdorferi B31
LSNLPKTTA

SEQ ID NO: 141917 - protein, 15 aa, Borrelia burgdorferi B31
ELMISGLGTQISFEL

SEQ ID NO: 141918 - protein, 9 aa, Borrelia burgdorferi B31
ISGLGTQIS

SEQ ID NO: 141919 - protein, 15 aa, Borrelia burgdorferi B31
QDYLNAKINSFDFTM

SEQ ID NO: 141920 - protein, 9 aa, Borrelia burgdorferi B31
YLNAKINSF

SEQ ID NO: 141921 - protein, 15 aa, Borrelia burgdorferi B31
KIKPLIQLKLLGLFL

SEQ ID NO: 141922 - protein, 9 aa, Borrelia burgdorferi B31
IQLKLLGLF

SEQ ID NO: 141923 - protein, 15 aa, Borrelia burgdorferi B31
LIANASSNSSLSDSK

SEQ ID NO: 141924 - protein, 9 aa, Borrelia burgdorferi B31
IANASSNSS

SEQ ID NO: 141925 - protein, 15 aa, Borrelia burgdorferi B31
DYLNAKINSFDFTMK

SEQ ID NO: 141926 - protein, 9 aa, Borrelia burgdorferi B31
YLNAKINSF

SEQ ID NO: 141927 - protein, 15 aa, Borrelia burgdorferi B31
LIRELMISGLGTQIS

SEQ ID NO: 141928 - protein, 9 aa, Borrelia burgdorferi B31
IRELMISGL

SEQ ID NO: 141929 - protein, 15 aa, Borrelia burgdorferi B31
RYLDNMQNARQSVLE

SEQ ID NO: 141930 - protein, 9 aa, Borrelia burgdorferi B31
MQNARQSVL

SEQ ID NO: 141931 - protein, 15 aa, Borrelia burgdorferi B31
YLNAKINSFDFTMKL

SEQ ID NO: 141932 - protein, 9 aa, Borrelia burgdorferi B31
YLNAKINSF

SEQ ID NO: 141933 - protein, 15 aa, Borrelia burgdorferi B31
SADLSNLPKTTAARA

SEQ ID NO: 141934 - protein, 9 aa, Borrelia burgdorferi B31
LSNLPKTTA

SEQ ID NO: 141935 - protein, 15 aa, Borrelia burgdorferi B31
LMISGLGTQISFELA

SEQ ID NO: 141936 - protein, 9 aa, Borrelia burgdorferi B31
LGTQISFEL

SEQ ID NO: 141937 - protein, 15 aa, Borrelia burgdorferi B31
IRELMISGLGTQISF

SEQ ID NO: 141938 - protein, 9 aa, Borrelia burgdorferi B31
ISGLGTQIS

SEQ ID NO: 141939 - protein, 15 aa, Borrelia burgdorferi B31
ADLSNLPKTTAARAA

SEQ ID NO: 141940 - protein, 9 aa, Borrelia burgdorferi B31
LSNLPKTTA

SEQ ID NO: 141941 - protein, 15 aa, Borrelia burgdorferi B31
FNQDYLNAKINSFDF

SEQ ID NO: 141942 - protein, 9 aa, Borrelia burgdorferi B31
YLNAKINSF

SEQ ID NO: 141943 - protein, 15 aa, Borrelia burgdorferi B31
IFNQDYLNAKINSFD

SEQ ID NO: 141944 - protein, 9 aa, Borrelia burgdorferi B31
YLNAKINSF

SEQ ID NO: 141945 - protein, 15 aa, Borrelia burgdorferi B31
EIFNQDYLNAKINSF

SEQ ID NO: 141946 - protein, 9 aa, Borrelia burgdorferi B31
FNQDYLNAK

SEQ ID NO: 141947 - protein, 15 aa, Borrelia burgdorferi B31
YLDNMQNARQSVLEA

SEQ ID NO: 141948 - protein, 9 aa, Borrelia burgdorferi B31
MQNARQSVL

SEQ ID NO: 141949 - protein, 15 aa, Borrelia burgdorferi B31
IKPLIQLKLLGLFLF

SEQ ID NO: 141950 - protein, 9 aa, Borrelia burgdorferi B31
LIQLKLLGL

SEQ ID NO: 141951 - protein, 15 aa, Borrelia burgdorferi B31
FTMKLKELKSKLNQI

SEQ ID NO: 141952 - protein, 9 aa, Borrelia burgdorferi B31
MKLKELKSK

SEQ ID NO: 141953 - protein, 15 aa, Borrelia burgdorferi B31
FDFTMKLKELKSKLN

SEQ ID NO: 141954 - protein, 9 aa, Borrelia burgdorferi B31
MKLKELKSK

SEQ ID NO: 141955 - protein, 15 aa, Borrelia burgdorferi B31
KPLIQLKLLGLFLFS

SEQ ID NO: 141956 - protein, 9 aa, Borrelia burgdorferi B31
LIQLKLLGL

SEQ ID NO: 141957 - protein, 15 aa, Borrelia burgdorferi B31
DFTMKLKELKSKLNQ

SEQ ID NO: 141958 - protein, 9 aa, Borrelia burgdorferi B31
MKLKELKSK

SEQ ID NO: 141959 - protein, 15 aa, Borrelia burgdorferi B31
LIQLKLLGLFLFSCT

SEQ ID NO: 141960 - protein, 9 aa, Borrelia burgdorferi B31
LIQLKLLGL

SEQ ID NO: 141961 - protein, 15 aa, Borrelia burgdorferi B31
PLIQLKLLGLFLFSC

SEQ ID NO: 141962 - protein, 9 aa, Borrelia burgdorferi B31
LIQLKLLGL

SEQ ID NO: 141963 - protein, 15 aa, Borrelia burgdorferi B31
SFDFTMKLKELKSKL

SEQ ID NO: 141964 - protein, 9 aa, Borrelia burgdorferi B31
MKLKELKSK

SEQ ID NO: 141965 - protein, 15 aa, Borrelia burgdorferi B31
NSFDFTMKLKELKSK

SEQ ID NO: 141966 - protein, 9 aa, Borrelia burgdorferi B31
TMKLKELKS

SEQ ID NO: 141967 - protein, 15 aa, Borrelia burgdorferi B31
MKIKPLIQLKLLGLF

SEQ ID NO: 141968 - protein, 9 aa, Borrelia burgdorferi B31
LIQLKLLGL

SEQ ID NO: 141969 - protein, 15 aa, Borrelia burgdorferi B31
LIQLKLLGLFLFSCT

SEQ ID NO: 141970 - protein, 9 aa, Borrelia burgdorferi B31
LKLLGLFLF

SEQ ID NO: 141971 - protein, 15 aa, Borrelia burgdorferi B31
KPLIQLKLLGLFLFS

SEQ ID NO: 141972 - protein, 9 aa, Borrelia burgdorferi B31
LKLLGLFLF

SEQ ID NO: 141973 - protein, 15 aa, Borrelia burgdorferi B31
IKPLIQLKLLGLFLF

SEQ ID NO: 141974 - protein, 9 aa, Borrelia burgdorferi B31
LIQLKLLGL

SEQ ID NO: 141975 - protein, 15 aa, Borrelia burgdorferi B31
IQLKLLGLFLFSCTI

SEQ ID NO: 141976 - protein, 9 aa, Borrelia burgdorferi B31
LKLLGLFLF

SEQ ID NO: 141977 - protein, 15 aa, Borrelia burgdorferi B31
PLIQLKLLGLFLFSC

SEQ ID NO: 141978 - protein, 9 aa, Borrelia burgdorferi B31
LKLLGLFLF

SEQ ID NO: 141979 - protein, 15 aa, Borrelia burgdorferi B31
LKLLGLFLFSCTIDA

SEQ ID NO: 141980 - protein, 9 aa, Borrelia burgdorferi B31
LKLLGLFLF

SEQ ID NO: 141981 - protein, 15 aa, Borrelia burgdorferi B31
QLKLLGLFLFSCTID

SEQ ID NO: 141982 - protein, 9 aa, Borrelia burgdorferi B31
LKLLGLFLF

SEQ ID NO: 141983 - protein, 15 aa, Borrelia burgdorferi B31
SGLPTFALNYSFSQP

SEQ ID NO: 141984 - protein, 9 aa, Borrelia burgdorferi B31
LPTFALNYS

SEQ ID NO: 141985 - protein, 15 aa, Borrelia burgdorferi B31
FALNYSFSQPTRQQT

SEQ ID NO: 141986 - protein, 9 aa, Borrelia burgdorferi B31
YSFSQPTRQ

SEQ ID NO: 141987 - protein, 15 aa, Borrelia burgdorferi B31
LNYSFSQPTRQQTNS

SEQ ID NO: 141988 - protein, 9 aa, Borrelia burgdorferi B31
YSFSQPTRQ

SEQ ID NO: 141989 - protein, 15 aa, Borrelia burgdorferi B31
PTFALNYSFSQPTRQ

SEQ ID NO: 141990 - protein, 9 aa, Borrelia burgdorferi B31
FALNYSFSQ

SEQ ID NO: 141991 - protein, 15 aa, Borrelia burgdorferi B31
NSGLPTFALNYSFSQ

SEQ ID NO: 141992 - protein, 9 aa, Borrelia burgdorferi B31
LPTFALNYS

SEQ ID NO: 141993 - protein, 15 aa, Borrelia burgdorferi B31
ALNYSFSQPTRQQTN

SEQ ID NO: 141994 - protein, 9 aa, Borrelia burgdorferi B31
YSFSQPTRQ

SEQ ID NO: 141995 - protein, 15 aa, Borrelia burgdorferi B31
TFALNYSFSQPTRQQ

SEQ ID NO: 141996 - protein, 9 aa, Borrelia burgdorferi B31
YSFSQPTRQ

SEQ ID NO: 141997 - protein, 15 aa, Borrelia burgdorferi B31
SRNSGLPTFALNYSF

SEQ ID NO: 141998 - protein, 9 aa, Borrelia burgdorferi B31
LPTFALNYS

SEQ ID NO: 141999 - protein, 15 aa, Borrelia burgdorferi B31
RNSGLPTFALNYSFS

SEQ ID NO: 142000 - protein, 9 aa, Borrelia burgdorferi B31
LPTFALNYS

SEQ ID NO: 142001 - protein, 15 aa, Borrelia burgdorferi B31
NSRNSGLPTFALNYS

SEQ ID NO: 142002 - protein, 9 aa, Borrelia burgdorferi B31
GLPTFALNY

SEQ ID NO: 142003 - protein, 15 aa, Borrelia burgdorferi B31
IKKRYLDNMQNARQS

SEQ ID NO: 142004 - protein, 9 aa, Borrelia burgdorferi B31
LDNMQNARQ

SEQ ID NO: 142005 - protein, 15 aa, Borrelia burgdorferi B31
KRYLDNMQNARQSVL

SEQ ID NO: 142006 - protein, 9 aa, Borrelia burgdorferi B31
LDNMQNARQ

SEQ ID NO: 142007 - protein, 15 aa, Borrelia burgdorferi B31
KKRYLDNMQNARQSV

SEQ ID NO: 142008 - protein, 9 aa, Borrelia burgdorferi B31
LDNMQNARQ

SEQ ID NO: 142009 - protein, 15 aa, Borrelia burgdorferi B31
YIKKRYLDNMQNARQ

SEQ ID NO: 142010 - protein, 9 aa, Borrelia burgdorferi B31
IKKRYLDNM

SEQ ID NO: 142011 - protein, 15 aa, Borrelia burgdorferi B31
RYLDNMQNARQSVLE

SEQ ID NO: 142012 - protein, 9 aa, Borrelia burgdorferi B31
LDNMQNARQ

SEQ ID NO: 142013 - protein, 15 aa, Borrelia burgdorferi B31
VYDRSYAPQLNSNTP

SEQ ID NO: 142014 - protein, 9 aa, Borrelia burgdorferi B31
YAPQLNSNT

SEQ ID NO: 142015 - protein, 15 aa, Borrelia burgdorferi B31
KVYDRSYAPQLNSNT

SEQ ID NO: 142016 - protein, 9 aa, Borrelia burgdorferi B31
YDRSYAPQL

SEQ ID NO: 142017 - protein, 15 aa, Borrelia burgdorferi B31
DRSYAPQLNSNTPEA

SEQ ID NO: 142018 - protein, 9 aa, Borrelia burgdorferi B31
YAPQLNSNT

SEQ ID NO: 142019 - protein, 15 aa, Borrelia burgdorferi B31
RSYAPQLNSNTPEAE

SEQ ID NO: 142020 - protein, 9 aa, Borrelia burgdorferi B31
YAPQLNSNT

SEQ ID NO: 142021 - protein, 15 aa, Borrelia burgdorferi B31
YDRSYAPQLNSNTPE

SEQ ID NO: 142022 - protein, 9 aa, Borrelia burgdorferi B31
YAPQLNSNT

SEQ ID NO: 142023 - protein, 15 aa, Borrelia burgdorferi B31
FALNYSFSQPTRQQT

SEQ ID NO: 142024 - protein, 9 aa, Borrelia burgdorferi B31
YSFSQPTRQ

SEQ ID NO: 142025 - protein, 15 aa, Borrelia burgdorferi B31
ALNYSFSQPTRQQTN

SEQ ID NO: 142026 - protein, 9 aa, Borrelia burgdorferi B31
YSFSQPTRQ

SEQ ID NO: 142027 - protein, 15 aa, Borrelia burgdorferi B31
LNYSFSQPTRQQTNS

SEQ ID NO: 142028 - protein, 9 aa, Borrelia burgdorferi B31
YSFSQPTRQ

SEQ ID NO: 142029 - protein, 15 aa, Borrelia burgdorferi B31
TFALNYSFSQPTRQQ

SEQ ID NO: 142030 - protein, 9 aa, Borrelia burgdorferi B31
YSFSQPTRQ

SEQ ID NO: 142031 - protein, 15 aa, Borrelia burgdorferi B31
PTFALNYSFSQPTRQ

SEQ ID NO: 142032 - protein, 9 aa, Borrelia burgdorferi B31
NYSFSQPTR

SEQ ID NO: 142033 - protein, 15 aa, Borrelia burgdorferi B31
FDFTMKLKELKSKLN

SEQ ID NO: 142034 - protein, 9 aa, Borrelia burgdorferi B31
FTMKLKELK

SEQ ID NO: 142035 - protein, 15 aa, Borrelia garinii PBi
TYDQFKMKDSAFTLL

SEQ ID NO: 142036 - protein, 9 aa, Borrelia garinii PBi
FKMKDSAFT

SEQ ID NO: 142037 - protein, 15 aa, Borrelia garinii PBi
YDQFKMKDSAFTLLD

SEQ ID NO: 142038 - protein, 9 aa, Borrelia garinii PBi
FKMKDSAFT

SEQ ID NO: 142039 - protein, 15 aa, Borrelia garinii PBi
DQFKMKDSAFTLLDV

SEQ ID NO: 142040 - protein, 9 aa, Borrelia garinii PBi
FKMKDSAFT

SEQ ID NO: 142041 - protein, 15 aa, Borrelia garinii PBi
RETYDQFKMKDSAFT

SEQ ID NO: 142042 - protein, 9 aa, Borrelia garinii PBi
RETYDQFKM

SEQ ID NO: 142043 - protein, 15 aa, Borrelia garinii PBi
ETYDQFKMKDSAFTL

SEQ ID NO: 142044 - protein, 9 aa, Borrelia garinii PBi
FKMKDSAFT

SEQ ID NO: 142045 - protein, 15 aa, Borrelia garinii PBi
ASQASQVASSASQAS

SEQ ID NO: 142046 - protein, 9 aa, Borrelia garinii PBi
ASQVASSAS

SEQ ID NO: 142047 - protein, 15 aa, Borrelia garinii PBi
ASQVASSASQASPVA

SEQ ID NO: 142048 - protein, 9 aa, Borrelia garinii PBi
VASSASQAS

SEQ ID NO: 142049 - protein, 15 aa, Borrelia garinii PBi
SQVASSASQASPVAS

SEQ ID NO: 142050 - protein, 9 aa, Borrelia garinii PBi
VASSASQAS

SEQ ID NO: 142051 - protein, 15 aa, Borrelia garinii PBi
SQASQVASSASQASP

SEQ ID NO: 142052 - protein, 9 aa, Borrelia garinii PBi
VASSASQAS

SEQ ID NO: 142053 - protein, 15 aa, Borrelia garinii PBi
QASQVASSASQASPV

SEQ ID NO: 142054 - protein, 9 aa, Borrelia garinii PBi
VASSASQAS

SEQ ID NO: 142055 - protein, 15 aa, Borrelia garinii PBi
QFKMKDSAFTLLDVI

SEQ ID NO: 142056 - protein, 9 aa, Borrelia garinii PBi
FKMKDSAFT

SEQ ID NO: 142057 - protein, 15 aa, Borrelia garinii PBi
FKMKDSAFTLLDVIS

SEQ ID NO: 142058 - protein, 9 aa, Borrelia garinii PBi
FKMKDSAFT

SEQ ID NO: 142059 - protein, 15 aa, Borrelia garinii PBi
ATPPKQIASAQAIQT

SEQ ID NO: 142060 - protein, 9 aa, Borrelia garinii PBi
PKQIASAQA

SEQ ID NO: 142061 - protein, 15 aa, Borrelia garinii PBi
TPPKQIASAQAIQTV

SEQ ID NO: 142062 - protein, 9 aa, Borrelia garinii PBi
IASAQAIQT

SEQ ID NO: 142063 - protein, 15 aa, Borrelia garinii PBi
PKQIASAQAIQTVPN

SEQ ID NO: 142064 - protein, 9 aa, Borrelia garinii PBi
IASAQAIQT

SEQ ID NO: 142065 - protein, 15 aa, Borrelia garinii PBi
PPKQIASAQAIQTVP

SEQ ID NO: 142066 - protein, 9 aa, Borrelia garinii PBi
IASAQAIQT

SEQ ID NO: 142067 - protein, 15 aa, Borrelia garinii PBi
KQIASAQAIQTVPNN

SEQ ID NO: 142068 - protein, 9 aa, Borrelia garinii PBi
IASAQAIQT

SEQ ID NO: 142069 - protein, 15 aa, Borrelia garinii PBi
SPATNVQATPPKQIA

SEQ ID NO: 142070 - protein, 9 aa, Borrelia garinii PBi
VQATPPKQI

SEQ ID NO: 142071 - protein, 15 aa, Borrelia garinii PBi
ASPATNVQATPPKQI

SEQ ID NO: 142072 - protein, 9 aa, Borrelia garinii PBi
ATNVQATPP

SEQ ID NO: 142073 - protein, 15 aa, Borrelia garinii PBi
ATNVQATPPKQIASA

SEQ ID NO: 142074 - protein, 9 aa, Borrelia garinii PBi
VQATPPKQI

SEQ ID NO: 142075 - protein, 15 aa, Borrelia garinii PBi
PATNVQATPPKQIAS

SEQ ID NO: 142076 - protein, 9 aa, Borrelia garinii PBi
VQATPPKQI

SEQ ID NO: 142077 - protein, 15 aa, Borrelia garinii PBi
VASSASQASPVASPA

SEQ ID NO: 142078 - protein, 9 aa, Borrelia garinii PBi
VASSASQAS

SEQ ID NO: 142079 - protein, 15 aa, Borrelia garinii PBi
SPLQKLKNNLLRRIA

SEQ ID NO: 142080 - protein, 9 aa, Borrelia garinii PBi
LKNNLLRRI

SEQ ID NO: 142081 - protein, 15 aa, Borrelia garinii PBi
QVASSASQASPVASP

SEQ ID NO: 142082 - protein, 9 aa, Borrelia garinii PBi
VASSASQAS

SEQ ID NO: 142083 - protein, 15 aa, Borrelia garinii PBi
TNVQATPPKQIASAQ

SEQ ID NO: 142084 - protein, 9 aa, Borrelia garinii PBi
VQATPPKQI

SEQ ID NO: 142085 - protein, 15 aa, Borrelia garinii PBi
NSPLQKLKNNLLRRI

SEQ ID NO: 142086 - protein, 9 aa, Borrelia garinii PBi
LQKLKNNLL

SEQ ID NO: 142087 - protein, 15 aa, Borrelia garinii PBi
IASAQAIQTVPNNTS

SEQ ID NO: 142088 - protein, 9 aa, Borrelia garinii PBi
IASAQAIQT

SEQ ID NO: 142089 - protein, 15 aa, Borrelia garinii PBi
PLQKLKNNLLRRIAE

SEQ ID NO: 142090 - protein, 9 aa, Borrelia garinii PBi
LKNNLLRRI

SEQ ID NO: 142091 - protein, 15 aa, Borrelia garinii PBi
LQKLKNNLLRRIAEE

SEQ ID NO: 142092 - protein, 9 aa, Borrelia garinii PBi
LKNNLLRRI

SEQ ID NO: 142093 - protein, 15 aa, Borrelia garinii PBi
QKLKNNLLRRIAEEK

SEQ ID NO: 142094 - protein, 9 aa, Borrelia garinii PBi
LKNNLLRRI

SEQ ID NO: 142095 - protein, 15 aa, Borrelia garinii PBi
QIASAQAIQTVPNNT

SEQ ID NO: 142096 - protein, 9 aa, Borrelia garinii PBi
IASAQAIQT

SEQ ID NO: 142097 - protein, 15 aa, Borrelia garinii PBi
VQATPPKQIASAQAI

SEQ ID NO: 142098 - protein, 9 aa, Borrelia garinii PBi
VQATPPKQI

SEQ ID NO: 142099 - protein, 15 aa, Borrelia garinii PBi
YTFSSSFSQPTSQTN

SEQ ID NO: 142100 - protein, 9 aa, Borrelia garinii PBi
FSSSFSQPT

SEQ ID NO: 142101 - protein, 15 aa, Borrelia garinii PBi
SLIISGLGIQISLES

SEQ ID NO: 142102 - protein, 9 aa, Borrelia garinii PBi
ISGLGIQIS

SEQ ID NO: 142103 - protein, 15 aa, Borrelia garinii PBi
NVQATPPKQIASAQA

SEQ ID NO: 142104 - protein, 9 aa, Borrelia garinii PBi
VQATPPKQI

SEQ ID NO: 142105 - protein, 15 aa, Borrelia garinii PBi
QYTFSSSFSQPTSQT

SEQ ID NO: 142106 - protein, 9 aa, Borrelia garinii PBi
FSSSFSQPT

SEQ ID NO: 142107 - protein, 15 aa, Borrelia garinii PBi
QTNFNNSQSNNVLTN

SEQ ID NO: 142108 - protein, 9 aa, Borrelia garinii PBi
FNNSQSNNV

SEQ ID NO: 142109 - protein, 15 aa, Borrelia garinii PBi
TNFNNSQSNNVLTNY

SEQ ID NO: 142110 - protein, 9 aa, Borrelia garinii PBi
FNNSQSNNV

SEQ ID NO: 142111 - protein, 15 aa, Borrelia garinii PBi
LIISGLGIQISLEST

SEQ ID NO: 142112 - protein, 9 aa, Borrelia garinii PBi
ISGLGIQIS

SEQ ID NO: 142113 - protein, 15 aa, Borrelia garinii PBi
SQTNFNNSQSNNVLT

SEQ ID NO: 142114 - protein, 9 aa, Borrelia garinii PBi
FNNSQSNNV

SEQ ID NO: 142115 - protein, 15 aa, Borrelia garinii PBi
TSQTNFNNSQSNNVL

SEQ ID NO: 142116 - protein, 9 aa, Borrelia garinii PBi
FNNSQSNNV

SEQ ID NO: 142117 - protein, 15 aa, Borrelia garinii PBi
PTSQTNFNNSQSNNV

SEQ ID NO: 142118 - protein, 9 aa, Borrelia garinii PBi
QTNFNNSQS

SEQ ID NO: 142119 - protein, 15 aa, Borrelia garinii PBi
SVFDRGSAPQLSSNT

SEQ ID NO: 142120 - protein, 9 aa, Borrelia garinii PBi
FDRGSAPQL

SEQ ID NO: 142121 - protein, 15 aa, Borrelia garinii PBi
IRSLIISGLGIQISL

SEQ ID NO: 142122 - protein, 9 aa, Borrelia garinii PBi
ISGLGIQIS

SEQ ID NO: 142123 - protein, 15 aa, Borrelia garinii PBi
ISVFDRGSAPQLSSN

SEQ ID NO: 142124 - protein, 9 aa, Borrelia garinii PBi
FDRGSAPQL

SEQ ID NO: 142125 - protein, 15 aa, Borrelia garinii PBi
LIRSLIISGLGIQIS

SEQ ID NO: 142126 - protein, 9 aa, Borrelia garinii PBi
IISGLGIQI

SEQ ID NO: 142127 - protein, 15 aa, Borrelia garinii PBi
PQQYTFSSSFSQPTS

SEQ ID NO: 142128 - protein, 9 aa, Borrelia garinii PBi
FSSSFSQPT

SEQ ID NO: 142129 - protein, 15 aa, Borrelia garinii PBi
QQYTFSSSFSQPTSQ

SEQ ID NO: 142130 - protein, 9 aa, Borrelia garinii PBi
FSSSFSQPT

SEQ ID NO: 142131 - protein, 15 aa, Borrelia garinii PBi
NISVFDRGSAPQLSS

SEQ ID NO: 142132 - protein, 9 aa, Borrelia garinii PBi
FDRGSAPQL

SEQ ID NO: 142133 - protein, 15 aa, Borrelia garinii PBi
KPQQYTFSSSFSQPT

SEQ ID NO: 142134 - protein, 9 aa, Borrelia garinii PBi
YTFSSSFSQ

SEQ ID NO: 142135 - protein, 15 aa, Borrelia garinii PBi
RSLIISGLGIQISLE

SEQ ID NO: 142136 - protein, 9 aa, Borrelia garinii PBi
ISGLGIQIS

SEQ ID NO: 142137 - protein, 15 aa, Borrelia garinii PBi
SNISVFDRGSAPQLS

SEQ ID NO: 142138 - protein, 9 aa, Borrelia garinii PBi
FDRGSAPQL

SEQ ID NO: 142139 - protein, 15 aa, Borrelia garinii PBi
AQAIQTVPNNTSTPN

SEQ ID NO: 142140 - protein, 9 aa, Borrelia garinii PBi
IQTVPNNTS

SEQ ID NO: 142141 - protein, 15 aa, Borrelia garinii PBi
QAIQTVPNNTSTPNQ

SEQ ID NO: 142142 - protein, 9 aa, Borrelia garinii PBi
IQTVPNNTS

SEQ ID NO: 142143 - protein, 15 aa, Borrelia garinii PBi
NQVNPGNPMQIANQA

SEQ ID NO: 142144 - protein, 9 aa, Borrelia garinii PBi
VNPGNPMQI

SEQ ID NO: 142145 - protein, 15 aa, Borrelia garinii PBi
KEWLNYADAIITNTS

SEQ ID NO: 142146 - protein, 9 aa, Borrelia garinii PBi
LNYADAIIT

SEQ ID NO: 142147 - protein, 15 aa, Borrelia garinii PBi
ANQVNPGNPMQIANQ

SEQ ID NO: 142148 - protein, 9 aa, Borrelia garinii PBi
VNPGNPMQI

SEQ ID NO: 142149 - protein, 15 aa, Borrelia garinii PBi
EWLNYADAIITNTSS

SEQ ID NO: 142150 - protein, 9 aa, Borrelia garinii PBi
LNYADAIIT

SEQ ID NO: 142151 - protein, 15 aa, Borrelia garinii PBi
PANQVNPGNPMQIAN

SEQ ID NO: 142152 - protein, 9 aa, Borrelia garinii PBi
VNPGNPMQI

SEQ ID NO: 142153 - protein, 15 aa, Borrelia garinii PBi
NPANQVNPGNPMQIA

SEQ ID NO: 142154 - protein, 9 aa, Borrelia garinii PBi
VNPGNPMQI

SEQ ID NO: 142155 - protein, 15 aa, Borrelia garinii PBi
FSSSFSQPTSQTNFN

SEQ ID NO: 142156 - protein, 9 aa, Borrelia garinii PBi
FSSSFSQPT

SEQ ID NO: 142157 - protein, 15 aa, Borrelia garinii PBi
TFSSSFSQPTSQTNF

SEQ ID NO: 142158 - protein, 9 aa, Borrelia garinii PBi
FSSSFSQPT

SEQ ID NO: 142159 - protein, 15 aa, Borrelia garinii PBi
KKEWLNYADAIITNT

SEQ ID NO: 142160 - protein, 9 aa, Borrelia garinii PBi
LNYADAIIT

SEQ ID NO: 142161 - protein, 15 aa, Borrelia garinii PBi
ASQASPVASPATNVQ

SEQ ID NO: 142162 - protein, 9 aa, Borrelia garinii PBi
ASPVASPAT

SEQ ID NO: 142163 - protein, 15 aa, Borrelia garinii PBi
IISGLGIQISLESTL

SEQ ID NO: 142164 - protein, 9 aa, Borrelia garinii PBi
LGIQISLES

SEQ ID NO: 142165 - protein, 15 aa, Borrelia garinii PBi
ASAQAIQTVPNNTST

SEQ ID NO: 142166 - protein, 9 aa, Borrelia garinii PBi
IQTVPNNTS

SEQ ID NO: 142167 - protein, 15 aa, Borrelia garinii PBi
SQASPVASPATNVQA

SEQ ID NO: 142168 - protein, 9 aa, Borrelia garinii PBi
VASPATNVQ

SEQ ID NO: 142169 - protein, 15 aa, Borrelia garinii PBi
VFDRGSAPQLSSNTP

SEQ ID NO: 142170 - protein, 9 aa, Borrelia garinii PBi
DRGSAPQLS

SEQ ID NO: 142171 - protein, 15 aa, Borrelia garinii PBi
ISGLGIQISLESTLE

SEQ ID NO: 142172 - protein, 9 aa, Borrelia garinii PBi
LGIQISLES

SEQ ID NO: 142173 - protein, 15 aa, Borrelia garinii PBi
KLKNNLLRRIAEEKN

SEQ ID NO: 142174 - protein, 9 aa, Borrelia garinii PBi
LKNNLLRRI

SEQ ID NO: 142175 - protein, 15 aa, Borrelia garinii PBi
LNPANQVNPGNPMQI

SEQ ID NO: 142176 - protein, 9 aa, Borrelia garinii PBi
NQVNPGNPM

SEQ ID NO: 142177 - protein, 15 aa, Borrelia garinii PBi
DSAFTLLDVISNISV

SEQ ID NO: 142178 - protein, 9 aa, Borrelia garinii PBi
FTLLDVISN

SEQ ID NO: 142179 - protein, 15 aa, Borrelia garinii PBi
NYRHQTQPSFVVPVY

SEQ ID NO: 142180 - protein, 9 aa, Borrelia garinii PBi
HQTQPSFVV

SEQ ID NO: 142181 - protein, 15 aa, Borrelia garinii PBi
PNQSIIKPQQYTFSS

SEQ ID NO: 142182 - protein, 9 aa, Borrelia garinii PBi
IKPQQYTFS

SEQ ID NO: 142183 - protein, 15 aa, Borrelia garinii PBi
PSFVVPVYSGNSPLQ

SEQ ID NO: 142184 - protein, 9 aa, Borrelia garinii PBi
VVPVYSGNS

SEQ ID NO: 142185 - protein, 15 aa, Borrelia garinii PBi
IIKPQQYTFSSSFSQ

SEQ ID NO: 142186 - protein, 9 aa, Borrelia garinii PBi
IKPQQYTFS

SEQ ID NO: 142187 - protein, 15 aa, Borrelia garinii PBi
SAFTLLDVISNISVF

SEQ ID NO: 142188 - protein, 9 aa, Borrelia garinii PBi
FTLLDVISN

SEQ ID NO: 142189 - protein, 15 aa, Borrelia garinii PBi
TPNQSIIKPQQYTFS

SEQ ID NO: 142190 - protein, 9 aa, Borrelia garinii PBi
QSIIKPQQY

SEQ ID NO: 142191 - protein, 15 aa, Borrelia garinii PBi
QIANQANQANQANQA

SEQ ID NO: 142192 - protein, 9 aa, Borrelia garinii PBi
IANQANQAN

SEQ ID NO: 142193 - protein, 15 aa, Borrelia garinii PBi
IANQANQANQANQAN

SEQ ID NO: 142194 - protein, 9 aa, Borrelia garinii PBi
IANQANQAN

SEQ ID NO: 142195 - protein, 15 aa, Borrelia garinii PBi
IKPQQYTFSSSFSQP

SEQ ID NO: 142196 - protein, 9 aa, Borrelia garinii PBi
IKPQQYTFS

SEQ ID NO: 142197 - protein, 15 aa, Borrelia garinii PBi
YSGNSPLQKLKNNLL

SEQ ID NO: 142198 - protein, 9 aa, Borrelia garinii PBi
YSGNSPLQK

SEQ ID NO: 142199 - protein, 15 aa, Borrelia garinii PBi
YRHQTQPSFVVPVYS

SEQ ID NO: 142200 - protein, 9 aa, Borrelia garinii PBi
HQTQPSFVV

SEQ ID NO: 142201 - protein, 15 aa, Borrelia garinii PBi
PVYSGNSPLQKLKNN

SEQ ID NO: 142202 - protein, 9 aa, Borrelia garinii PBi
YSGNSPLQK

SEQ ID NO: 142203 - protein, 15 aa, Borrelia garinii PBi
IESFNTQYLNTIINS

SEQ ID NO: 142204 - protein, 9 aa, Borrelia garinii PBi
FNTQYLNTI

SEQ ID NO: 142205 - protein, 15 aa, Borrelia garinii PBi
ILYQENQNHSLIRSL

SEQ ID NO: 142206 - protein, 9 aa, Borrelia garinii PBi
YQENQNHSL

SEQ ID NO: 142207 - protein, 15 aa, Borrelia garinii PBi
KIESFNTQYLNTIIN

SEQ ID NO: 142208 - protein, 9 aa, Borrelia garinii PBi
FNTQYLNTI

SEQ ID NO: 142209 - protein, 15 aa, Borrelia garinii PBi
SFNTQYLNTIINSYT

SEQ ID NO: 142210 - protein, 9 aa, Borrelia garinii PBi
FNTQYLNTI

SEQ ID NO: 142211 - protein, 15 aa, Borrelia garinii PBi
PVASPATNVQATPPK

SEQ ID NO: 142212 - protein, 9 aa, Borrelia garinii PBi
VASPATNVQ

SEQ ID NO: 142213 - protein, 15 aa, Borrelia garinii PBi
NLQGLNPANQVNPGN

SEQ ID NO: 142214 - protein, 9 aa, Borrelia garinii PBi
LQGLNPANQ

SEQ ID NO: 142215 - protein, 15 aa, Borrelia garinii PBi
NILYQENQNHSLIRS

SEQ ID NO: 142216 - protein, 9 aa, Borrelia garinii PBi
YQENQNHSL

SEQ ID NO: 142217 - protein, 15 aa, Borrelia garinii PBi
FNTQYLNTIINSYTF

SEQ ID NO: 142218 - protein, 9 aa, Borrelia garinii PBi
LNTIINSYT

SEQ ID NO: 142219 - protein, 15 aa, Borrelia garinii PBi
QTVPNNTSTPNQSII

SEQ ID NO: 142220 - protein, 9 aa, Borrelia garinii PBi
VPNNTSTPN

SEQ ID NO: 142221 - protein, 15 aa, Borrelia garinii PBi
KDSAFTLLDVISNIS

SEQ ID NO: 142222 - protein, 9 aa, Borrelia garinii PBi
FTLLDVISN

SEQ ID NO: 142223 - protein, 15 aa, Borrelia garinii PBi
ESFNTQYLNTIINSY

SEQ ID NO: 142224 - protein, 9 aa, Borrelia garinii PBi
FNTQYLNTI

SEQ ID NO: 142225 - protein, 15 aa, Borrelia garinii PBi
YAMMDFDQAKTTEFG

SEQ ID NO: 142226 - protein, 9 aa, Borrelia garinii PBi
FDQAKTTEF

SEQ ID NO: 142227 - protein, 15 aa, Borrelia garinii PBi
QASQASQASQVASSA

SEQ ID NO: 142228 - protein, 9 aa, Borrelia garinii PBi
QASQASQVA

SEQ ID NO: 142229 - protein, 15 aa, Borrelia garinii PBi
SGNSPLQKLKNNLLR

SEQ ID NO: 142230 - protein, 9 aa, Borrelia garinii PBi
LQKLKNNLL

SEQ ID NO: 142231 - protein, 15 aa, Borrelia garinii PBi
SASQASPVASPATNV

SEQ ID NO: 142232 - protein, 9 aa, Borrelia garinii PBi
ASPVASPAT

SEQ ID NO: 142233 - protein, 15 aa, Borrelia garinii PBi
NQANQASQASQASQV

SEQ ID NO: 142234 - protein, 9 aa, Borrelia garinii PBi
QASQASQAS

SEQ ID NO: 142235 - protein, 15 aa, Borrelia garinii PBi
NQASQASQASQVASS

SEQ ID NO: 142236 - protein, 9 aa, Borrelia garinii PBi
QASQASQVA

SEQ ID NO: 142237 - protein, 15 aa, Borrelia garinii PBi
QATPPKQIASAQAIQ

SEQ ID NO: 142238 - protein, 9 aa, Borrelia garinii PBi
KQIASAQAI

SEQ ID NO: 142239 - protein, 15 aa, Borrelia garinii PBi
KLKELESKLNSILAE

SEQ ID NO: 142240 - protein, 9 aa, Borrelia garinii PBi
LKELESKLN

SEQ ID NO: 142241 - protein, 15 aa, Borrelia garinii PBi
ASQASQASQVASSAS

SEQ ID NO: 142242 - protein, 9 aa, Borrelia garinii PBi
QASQASQVA

SEQ ID NO: 142243 - protein, 15 aa, Borrelia garinii PBi
LKELESKLNSILAEK

SEQ ID NO: 142244 - protein, 9 aa, Borrelia garinii PBi
LKELESKLN

SEQ ID NO: 142245 - protein, 15 aa, Borrelia garinii PBi
KYLDKMQDARQSALD

SEQ ID NO: 142246 - protein, 9 aa, Borrelia garinii PBi
DKMQDARQS

SEQ ID NO: 142247 - protein, 15 aa, Borrelia garinii PBi
KISINTGSNATKNKT

SEQ ID NO: 142248 - protein, 9 aa, Borrelia garinii PBi
INTGSNATK

SEQ ID NO: 142249 - protein, 15 aa, Borrelia garinii PBi
ASSASQASPVASPAT

SEQ ID NO: 142250 - protein, 9 aa, Borrelia garinii PBi
ASQASPVAS

SEQ ID NO: 142251 - protein, 15 aa, Borrelia garinii PBi
NKYLDKMQDARQSAL

SEQ ID NO: 142252 - protein, 9 aa, Borrelia garinii PBi
DKMQDARQS

SEQ ID NO: 142253 - protein, 15 aa, Borrelia garinii PBi
LQGLNPANQVNPGNP

SEQ ID NO: 142254 - protein, 9 aa, Borrelia garinii PBi
LQGLNPANQ

SEQ ID NO: 142255 - protein, 15 aa, Borrelia garinii PBi
SFSQPTSQTNFNNSQ

SEQ ID NO: 142256 - protein, 9 aa, Borrelia garinii PBi
FSQPTSQTN

SEQ ID NO: 142257 - protein, 15 aa, Borrelia garinii PBi
TQYLNTIINSYTFKD

SEQ ID NO: 142258 - protein, 9 aa, Borrelia garinii PBi
LNTIINSYT

SEQ ID NO: 142259 - protein, 15 aa, Borrelia garinii PBi
YLDKMQDARQSALDL

SEQ ID NO: 142260 - protein, 9 aa, Borrelia garinii PBi
DKMQDARQS

SEQ ID NO: 142261 - protein, 15 aa, Borrelia garinii PBi
SERNRLYAMMDFDQA

SEQ ID NO: 142262 - protein, 9 aa, Borrelia garinii PBi
RNRLYAMMD

SEQ ID NO: 142263 - protein, 15 aa, Borrelia garinii PBi
AFTLLDVISNISVFD

SEQ ID NO: 142264 - protein, 9 aa, Borrelia garinii PBi
LLDVISNIS

SEQ ID NO: 142265 - protein, 15 aa, Borrelia garinii PBi
FTLLDVISNISVFDR

SEQ ID NO: 142266 - protein, 9 aa, Borrelia garinii PBi
LLDVISNIS

SEQ ID NO: 142267 - protein, 15 aa, Borrelia garinii PBi
AKISINTGSNATKNK

SEQ ID NO: 142268 - protein, 9 aa, Borrelia garinii PBi
INTGSNATK

SEQ ID NO: 142269 - protein, 15 aa, Borrelia garinii PBi
GNSPLQKLKNNLLRR

SEQ ID NO: 142270 - protein, 9 aa, Borrelia garinii PBi
LQKLKNNLL

SEQ ID NO: 142271 - protein, 15 aa, Borrelia garinii PBi
IKVAGLQKNTQSKKN

SEQ ID NO: 142272 - protein, 9 aa, Borrelia garinii PBi
IKVAGLQKN

SEQ ID NO: 142273 - protein, 15 aa, Borrelia garinii PBi
QAKISINTGSNATKN

SEQ ID NO: 142274 - protein, 9 aa, Borrelia garinii PBi
INTGSNATK

SEQ ID NO: 142275 - protein, 15 aa, Borrelia garinii PBi
DQAKISINTGSNATK

SEQ ID NO: 142276 - protein, 9 aa, Borrelia garinii PBi
SINTGSNAT

SEQ ID NO: 142277 - protein, 15 aa, Borrelia garinii PBi
NIKVAGLQKNTQSKK

SEQ ID NO: 142278 - protein, 9 aa, Borrelia garinii PBi
IKVAGLQKN

SEQ ID NO: 142279 - protein, 15 aa, Borrelia garinii PBi
NRLYAMMDFDQAKTT

SEQ ID NO: 142280 - protein, 9 aa, Borrelia garinii PBi
YAMMDFDQA

SEQ ID NO: 142281 - protein, 15 aa, Borrelia garinii PBi
LYAMMDFDQAKTTEF

SEQ ID NO: 142282 - protein, 9 aa, Borrelia garinii PBi
YAMMDFDQA

SEQ ID NO: 142283 - protein, 15 aa, Borrelia garinii PBi
RLYAMMDFDQAKTTE

SEQ ID NO: 142284 - protein, 9 aa, Borrelia garinii PBi
YAMMDFDQA

SEQ ID NO: 142285 - protein, 15 aa, Borrelia garinii PBi
NTQYLNTIINSYTFK

SEQ ID NO: 142286 - protein, 9 aa, Borrelia garinii PBi
LNTIINSYT

SEQ ID NO: 142287 - protein, 15 aa, Borrelia garinii PBi
SSASQASPVASPATN

SEQ ID NO: 142288 - protein, 9 aa, Borrelia garinii PBi
ASQASPVAS

SEQ ID NO: 142289 - protein, 15 aa, Borrelia garinii PBi
RNRLYAMMDFDQAKT

SEQ ID NO: 142290 - protein, 9 aa, Borrelia garinii PBi
YAMMDFDQA

SEQ ID NO: 142291 - protein, 15 aa, Borrelia garinii PBi
VASPATNVQATPPKQ

SEQ ID NO: 142292 - protein, 9 aa, Borrelia garinii PBi
VASPATNVQ

SEQ ID NO: 142293 - protein, 15 aa, Borrelia garinii PBi
ERNRLYAMMDFDQAK

SEQ ID NO: 142294 - protein, 9 aa, Borrelia garinii PBi
YAMMDFDQA

SEQ ID NO: 142295 - protein, 15 aa, Borrelia garinii PBi
YQENQNHSLIRSLII

SEQ ID NO: 142296 - protein, 9 aa, Borrelia garinii PBi
YQENQNHSL

SEQ ID NO: 142297 - protein, 15 aa, Borrelia garinii PBi
AMMDFDQAKTTEFGS

SEQ ID NO: 142298 - protein, 9 aa, Borrelia garinii PBi
FDQAKTTEF

SEQ ID NO: 142299 - protein, 15 aa, Borrelia garinii PBi
VYSGNSPLQKLKNNL

SEQ ID NO: 142300 - protein, 9 aa, Borrelia garinii PBi
YSGNSPLQK

SEQ ID NO: 142301 - protein, 15 aa, Borrelia garinii PBi
IITNTSSNSKRNDPQ

SEQ ID NO: 142302 - protein, 9 aa, Borrelia garinii PBi
ITNTSSNSK

SEQ ID NO: 142303 - protein, 15 aa, Borrelia garinii PBi
IKNKYLDKMQDARQS

SEQ ID NO: 142304 - protein, 9 aa, Borrelia garinii PBi
IKNKYLDKM

SEQ ID NO: 142305 - protein, 15 aa, Borrelia garinii PBi
QYLNTIINSYTFKDK

SEQ ID NO: 142306 - protein, 9 aa, Borrelia garinii PBi
LNTIINSYT

SEQ ID NO: 142307 - protein, 15 aa, Borrelia garinii PBi
ENQNHSLIRSLIISG

SEQ ID NO: 142308 - protein, 9 aa, Borrelia garinii PBi
NQNHSLIRS

SEQ ID NO: 142309 - protein, 15 aa, Borrelia garinii PBi
ESFNTQYLNTIINSY

SEQ ID NO: 142310 - protein, 9 aa, Borrelia garinii PBi
FNTQYLNTI

SEQ ID NO: 142311 - protein, 15 aa, Borrelia garinii PBi
SFNTQYLNTIINSYT

SEQ ID NO: 142312 - protein, 9 aa, Borrelia garinii PBi
YLNTIINSY

SEQ ID NO: 142313 - protein, 15 aa, Borrelia garinii PBi
FNTQYLNTIINSYTF

SEQ ID NO: 142314 - protein, 9 aa, Borrelia garinii PBi
YLNTIINSY

SEQ ID NO: 142315 - protein, 15 aa, Borrelia garinii PBi
TQYLNTIINSYTFKD

SEQ ID NO: 142316 - protein, 9 aa, Borrelia garinii PBi
YLNTIINSY

SEQ ID NO: 142317 - protein, 15 aa, Borrelia garinii PBi
NTQYLNTIINSYTFK

SEQ ID NO: 142318 - protein, 9 aa, Borrelia garinii PBi
YLNTIINSY

SEQ ID NO: 142319 - protein, 15 aa, Borrelia garinii PBi
GSIMNILYQENQNHS

SEQ ID NO: 142320 - protein, 9 aa, Borrelia garinii PBi
MNILYQENQ

SEQ ID NO: 142321 - protein, 15 aa, Borrelia garinii PBi
SIMNILYQENQNHSL

SEQ ID NO: 142322 - protein, 9 aa, Borrelia garinii PBi
LYQENQNHS

SEQ ID NO: 142323 - protein, 15 aa, Borrelia garinii PBi
MNILYQENQNHSLIR

SEQ ID NO: 142324 - protein, 9 aa, Borrelia garinii PBi
LYQENQNHS

SEQ ID NO: 142325 - protein, 15 aa, Borrelia garinii PBi
NILYQENQNHSLIRS

SEQ ID NO: 142326 - protein, 9 aa, Borrelia garinii PBi
LYQENQNHS

SEQ ID NO: 142327 - protein, 15 aa, Borrelia garinii PBi
IMNILYQENQNHSLI

SEQ ID NO: 142328 - protein, 9 aa, Borrelia garinii PBi
LYQENQNHS

SEQ ID NO: 142329 - protein, 15 aa, Borrelia garinii PBi
QYLNTIINSYTFKDK

SEQ ID NO: 142330 - protein, 9 aa, Borrelia garinii PBi
YLNTIINSY

SEQ ID NO: 142331 - protein, 15 aa, Borrelia garinii PBi
YLNTIINSYTFKDKL

SEQ ID NO: 142332 - protein, 9 aa, Borrelia garinii PBi
YLNTIINSY

SEQ ID NO: 142333 - protein, 15 aa, Borrelia garinii PBi
SFVVPVYSGNSPLQK

SEQ ID NO: 142334 - protein, 9 aa, Borrelia garinii PBi
VYSGNSPLQ

SEQ ID NO: 142335 - protein, 15 aa, Borrelia garinii PBi
PSFVVPVYSGNSPLQ

SEQ ID NO: 142336 - protein, 9 aa, Borrelia garinii PBi
VVPVYSGNS

SEQ ID NO: 142337 - protein, 15 aa, Borrelia garinii PBi
VPVYSGNSPLQKLKN

SEQ ID NO: 142338 - protein, 9 aa, Borrelia garinii PBi
VYSGNSPLQ

SEQ ID NO: 142339 - protein, 15 aa, Borrelia garinii PBi
VVPVYSGNSPLQKLK

SEQ ID NO: 142340 - protein, 9 aa, Borrelia garinii PBi
VYSGNSPLQ

SEQ ID NO: 142341 - protein, 15 aa, Borrelia garinii PBi
FVVPVYSGNSPLQKL

SEQ ID NO: 142342 - protein, 9 aa, Borrelia garinii PBi
VYSGNSPLQ

SEQ ID NO: 142343 - protein, 15 aa, Borrelia garinii PBi
SLIISGLGIQISLES

SEQ ID NO: 142344 - protein, 9 aa, Borrelia garinii PBi
ISGLGIQIS

SEQ ID NO: 142345 - protein, 15 aa, Borrelia garinii PBi
LIISGLGIQISLEST

SEQ ID NO: 142346 - protein, 9 aa, Borrelia garinii PBi
LGIQISLES

SEQ ID NO: 142347 - protein, 15 aa, Borrelia garinii PBi
SGLGIQISLESTLEE

SEQ ID NO: 142348 - protein, 9 aa, Borrelia garinii PBi
LGIQISLES

SEQ ID NO: 142349 - protein, 15 aa, Borrelia garinii PBi
ISGLGIQISLESTLE

SEQ ID NO: 142350 - protein, 9 aa, Borrelia garinii PBi
LGIQISLES

SEQ ID NO: 142351 - protein, 15 aa, Borrelia garinii PBi
RETYDQFKMKDSAFT

SEQ ID NO: 142352 - protein, 9 aa, Borrelia garinii PBi
TYDQFKMKD

SEQ ID NO: 142353 - protein, 15 aa, Borrelia garinii PBi
IISGLGIQISLESTL

SEQ ID NO: 142354 - protein, 9 aa, Borrelia garinii PBi
LGIQISLES

SEQ ID NO: 142355 - protein, 15 aa, Borrelia garinii PBi
NYADAIITNTSSNSK

SEQ ID NO: 142356 - protein, 9 aa, Borrelia garinii PBi
IITNTSSNS

SEQ ID NO: 142357 - protein, 15 aa, Borrelia garinii PBi
PTSQTNFNNSQSNNV

SEQ ID NO: 142358 - protein, 9 aa, Borrelia garinii PBi
SQTNFNNSQ

SEQ ID NO: 142359 - protein, 15 aa, Borrelia garinii PBi
YADAIITNTSSNSKR

SEQ ID NO: 142360 - protein, 9 aa, Borrelia garinii PBi
ITNTSSNSK

SEQ ID NO: 142361 - protein, 15 aa, Borrelia garinii PBi
ADAIITNTSSNSKRN

SEQ ID NO: 142362 - protein, 9 aa, Borrelia garinii PBi
ITNTSSNSK

SEQ ID NO: 142363 - protein, 15 aa, Borrelia garinii PBi
ETYDQFKMKDSAFTL

SEQ ID NO: 142364 - protein, 9 aa, Borrelia garinii PBi
FKMKDSAFT

SEQ ID NO: 142365 - protein, 15 aa, Borrelia garinii PBi
TSQTNFNNSQSNNVL

SEQ ID NO: 142366 - protein, 9 aa, Borrelia garinii PBi
FNNSQSNNV

SEQ ID NO: 142367 - protein, 15 aa, Borrelia garinii PBi
TYDQFKMKDSAFTLL

SEQ ID NO: 142368 - protein, 9 aa, Borrelia garinii PBi
FKMKDSAFT

SEQ ID NO: 142369 - protein, 15 aa, Borrelia garinii PBi
SQTNFNNSQSNNVLT

SEQ ID NO: 142370 - protein, 9 aa, Borrelia garinii PBi
FNNSQSNNV

SEQ ID NO: 142371 - protein, 15 aa, Borrelia garinii PBi
QTNFNNSQSNNVLTN

SEQ ID NO: 142372 - protein, 9 aa, Borrelia garinii PBi
FNNSQSNNV

SEQ ID NO: 142373 - protein, 15 aa, Borrelia garinii PBi
DQFKMKDSAFTLLDV

SEQ ID NO: 142374 - protein, 9 aa, Borrelia garinii PBi
FKMKDSAFT

SEQ ID NO: 142375 - protein, 15 aa, Borrelia garinii PBi
TNFNNSQSNNVLTNY

SEQ ID NO: 142376 - protein, 9 aa, Borrelia garinii PBi
FNNSQSNNV

SEQ ID NO: 142377 - protein, 15 aa, Borrelia garinii PBi
YDQFKMKDSAFTLLD

SEQ ID NO: 142378 - protein, 9 aa, Borrelia garinii PBi
FKMKDSAFT

SEQ ID NO: 142379 - protein, 15 aa, Borrelia garinii PBi
DAIITNTSSNSKRND

SEQ ID NO: 142380 - protein, 9 aa, Borrelia garinii PBi
ITNTSSNSK

SEQ ID NO: 142381 - protein, 15 aa, Borrelia garinii PBi
AIITNTSSNSKRNDP

SEQ ID NO: 142382 - protein, 9 aa, Borrelia garinii PBi
ITNTSSNSK

SEQ ID NO: 142383 - protein, 15 aa, Borrelia garinii PBi
ILYQENQNHSLIRSL

SEQ ID NO: 142384 - protein, 9 aa, Borrelia garinii PBi
LYQENQNHS

SEQ ID NO: 142385 - protein, 15 aa, Borrelia garinii PBi
LYQENQNHSLIRSLI

SEQ ID NO: 142386 - protein, 9 aa, Borrelia garinii PBi
LYQENQNHS

SEQ ID NO: 142387 - protein, 15 aa, Borrelia garinii PBi
ANLNKDYKNKVEELL

SEQ ID NO: 142388 - protein, 9 aa, Borrelia garinii PBi
LNKDYKNKV

SEQ ID NO: 142389 - protein, 15 aa, Borrelia garinii PBi
TIDANLNKDYKNKVE

SEQ ID NO: 142390 - protein, 9 aa, Borrelia garinii PBi
LNKDYKNKV

SEQ ID NO: 142391 - protein, 15 aa, Borrelia garinii PBi
CTIDANLNKDYKNKV

SEQ ID NO: 142392 - protein, 9 aa, Borrelia garinii PBi
DANLNKDYK

SEQ ID NO: 142393 - protein, 15 aa, Borrelia garinii PBi
IDANLNKDYKNKVEE

SEQ ID NO: 142394 - protein, 9 aa, Borrelia garinii PBi
LNKDYKNKV

SEQ ID NO: 142395 - protein, 15 aa, Borrelia garinii PBi
DANLNKDYKNKVEEL

SEQ ID NO: 142396 - protein, 9 aa, Borrelia garinii PBi
LNKDYKNKV

SEQ ID NO: 142397 - protein, 15 aa, Borrelia garinii PBi
KPQQYTFSSSFSQPT

SEQ ID NO: 142398 - protein, 9 aa, Borrelia garinii PBi
YTFSSSFSQ

SEQ ID NO: 142399 - protein, 15 aa, Borrelia garinii PBi
QQYTFSSSFSQPTSQ

SEQ ID NO: 142400 - protein, 9 aa, Borrelia garinii PBi
YTFSSSFSQ

SEQ ID NO: 142401 - protein, 15 aa, Borrelia garinii PBi
PQQYTFSSSFSQPTS

SEQ ID NO: 142402 - protein, 9 aa, Borrelia garinii PBi
YTFSSSFSQ

SEQ ID NO: 142403 - protein, 15 aa, Borrelia garinii PBi
VYSGNSPLQKLKNNL

SEQ ID NO: 142404 - protein, 9 aa, Borrelia garinii PBi
VYSGNSPLQ

SEQ ID NO: 142405 - protein, 15 aa, Borrelia garinii PBi
FTLLDVISNISVFDR

SEQ ID NO: 142406 - protein, 9 aa, Borrelia garinii PBi
LLDVISNIS

SEQ ID NO: 142407 - protein, 15 aa, Borrelia garinii PBi
TQYLNTIINSYTFKD

SEQ ID NO: 142408 - protein, 9 aa, Borrelia garinii PBi
YLNTIINSY

SEQ ID NO: 142409 - protein, 15 aa, Borrelia garinii PBi
SFNTQYLNTIINSYT

SEQ ID NO: 142410 - protein, 9 aa, Borrelia garinii PBi
YLNTIINSY

SEQ ID NO: 142411 - protein, 15 aa, Borrelia garinii PBi
ESFNTQYLNTIINSY

SEQ ID NO: 142412 - protein, 9 aa, Borrelia garinii PBi
SFNTQYLNT

SEQ ID NO: 142413 - protein, 15 aa, Borrelia garinii PBi
FNTQYLNTIINSYTF

SEQ ID NO: 142414 - protein, 9 aa, Borrelia garinii PBi
YLNTIINSY

SEQ ID NO: 142415 - protein, 15 aa, Borrelia garinii PBi
NTQYLNTIINSYTFK

SEQ ID NO: 142416 - protein, 9 aa, Borrelia garinii PBi
YLNTIINSY

SEQ ID NO: 142417 - protein, 15 aa, Borrelia garinii PBi
NKVEELLNSSTDDQA

SEQ ID NO: 142418 - protein, 9 aa, Borrelia garinii PBi
LLNSSTDDQ

SEQ ID NO: 142419 - protein, 15 aa, Borrelia garinii PBi
KNKVEELLNSSTDDQ

SEQ ID NO: 142420 - protein, 9 aa, Borrelia garinii PBi
VEELLNSST

SEQ ID NO: 142421 - protein, 15 aa, Borrelia garinii PBi
KVEELLNSSTDDQAK

SEQ ID NO: 142422 - protein, 9 aa, Borrelia garinii PBi
LLNSSTDDQ

SEQ ID NO: 142423 - protein, 15 aa, Borrelia garinii PBi
VEELLNSSTDDQAKI

SEQ ID NO: 142424 - protein, 9 aa, Borrelia garinii PBi
LLNSSTDDQ

SEQ ID NO: 142425 - protein, 15 aa, Borrelia garinii PBi
EELLNSSTDDQAKIS

SEQ ID NO: 142426 - protein, 9 aa, Borrelia garinii PBi
LLNSSTDDQ

SEQ ID NO: 142427 - protein, 15 aa, Borrelia garinii PBi
QYLNTIINSYTFKDK

SEQ ID NO: 142428 - protein, 9 aa, Borrelia garinii PBi
YLNTIINSY

SEQ ID NO: 142429 - protein, 15 aa, Borrelia garinii PBi
YLNTIINSYTFKDKL

SEQ ID NO: 142430 - protein, 9 aa, Borrelia garinii PBi
YLNTIINSY

SEQ ID NO: 142431 - protein, 15 aa, Borrelia garinii PBi
NYADAIITNTSSNSK

SEQ ID NO: 142432 - protein, 9 aa, Borrelia garinii PBi
IITNTSSNS

SEQ ID NO: 142433 - protein, 15 aa, Borrelia garinii PBi
YADAIITNTSSNSKR

SEQ ID NO: 142434 - protein, 9 aa, Borrelia garinii PBi
ITNTSSNSK

SEQ ID NO: 142435 - protein, 15 aa, Borrelia garinii PBi
ADAIITNTSSNSKRN

SEQ ID NO: 142436 - protein, 9 aa, Borrelia garinii PBi
ITNTSSNSK

SEQ ID NO: 142437 - protein, 15 aa, Borrelia garinii PBi
DAIITNTSSNSKRND

SEQ ID NO: 142438 - protein, 9 aa, Borrelia garinii PBi
ITNTSSNSK

SEQ ID NO: 142439 - protein, 15 aa, Borrelia garinii PBi
AIITNTSSNSKRNDP

SEQ ID NO: 142440 - protein, 9 aa, Borrelia garinii PBi
ITNTSSNSK

SEQ ID NO: 142441 - protein, 15 aa, Borrelia garinii PBi
QAIQTVPNNTSTPNQ

SEQ ID NO: 142442 - protein, 9 aa, Borrelia garinii PBi
TVPNNTSTP

SEQ ID NO: 142443 - protein, 15 aa, Borrelia garinii PBi
ELLNSSTDDQAKISI

SEQ ID NO: 142444 - protein, 9 aa, Borrelia garinii PBi
LLNSSTDDQ

SEQ ID NO: 142445 - protein, 15 aa, Borrelia garinii PBi
GSIMNILYQENQNHS

SEQ ID NO: 142446 - protein, 9 aa, Borrelia garinii PBi
ILYQENQNH

SEQ ID NO: 142447 - protein, 15 aa, Borrelia garinii PBi
LLNSSTDDQAKISIN

SEQ ID NO: 142448 - protein, 9 aa, Borrelia garinii PBi
LLNSSTDDQ

SEQ ID NO: 142449 - protein, 15 aa, Borrelia garinii PBi
FGSIMNILYQENQNH

SEQ ID NO: 142450 - protein, 9 aa, Borrelia garinii PBi
IMNILYQEN

SEQ ID NO: 142451 - protein, 15 aa, Borrelia garinii PBi
AIQTVPNNTSTPNQS

SEQ ID NO: 142452 - protein, 9 aa, Borrelia garinii PBi
TVPNNTSTP

SEQ ID NO: 142453 - protein, 15 aa, Borrelia garinii PBi
LNYADAIITNTSSNS

SEQ ID NO: 142454 - protein, 9 aa, Borrelia garinii PBi
YADAIITNT

SEQ ID NO: 142455 - protein, 15 aa, Borrelia garinii PBi
IQTVPNNTSTPNQSI

SEQ ID NO: 142456 - protein, 9 aa, Borrelia garinii PBi
TVPNNTSTP

SEQ ID NO: 142457 - protein, 15 aa, Borrelia garinii PBi
AQAIQTVPNNTSTPN

SEQ ID NO: 142458 - protein, 9 aa, Borrelia garinii PBi
TVPNNTSTP

SEQ ID NO: 142459 - protein, 15 aa, Borrelia garinii PBi
SIMNILYQENQNHSL

SEQ ID NO: 142460 - protein, 9 aa, Borrelia garinii PBi
ILYQENQNH

SEQ ID NO: 142461 - protein, 15 aa, Borrelia garinii PBi
SAQAIQTVPNNTSTP

SEQ ID NO: 142462 - protein, 9 aa, Borrelia garinii PBi
IQTVPNNTS

SEQ ID NO: 142463 - protein, 15 aa, Borrelia garinii PBi
IMNILYQENQNHSLI

SEQ ID NO: 142464 - protein, 9 aa, Borrelia garinii PBi
ILYQENQNH

SEQ ID NO: 142465 - protein, 15 aa, Borrelia garinii PBi
SQASPVASPATNVQA

SEQ ID NO: 142466 - protein, 9 aa, Borrelia garinii PBi
VASPATNVQ

SEQ ID NO: 142467 - protein, 15 aa, Borrelia garinii PBi
ASQASPVASPATNVQ

SEQ ID NO: 142468 - protein, 9 aa, Borrelia garinii PBi
PVASPATNV

SEQ ID NO: 142469 - protein, 15 aa, Borrelia garinii PBi
ASPVASPATNVQATP

SEQ ID NO: 142470 - protein, 9 aa, Borrelia garinii PBi
VASPATNVQ

SEQ ID NO: 142471 - protein, 15 aa, Borrelia garinii PBi
IASAQAIQTVPNNTS

SEQ ID NO: 142472 - protein, 9 aa, Borrelia garinii PBi
AQAIQTVPN

SEQ ID NO: 142473 - protein, 15 aa, Borrelia garinii PBi
ASAQAIQTVPNNTST

SEQ ID NO: 142474 - protein, 9 aa, Borrelia garinii PBi
IQTVPNNTS

SEQ ID NO: 142475 - protein, 15 aa, Borrelia garinii PBi
SAQAIQTVPNNTSTP

SEQ ID NO: 142476 - protein, 9 aa, Borrelia garinii PBi
IQTVPNNTS

SEQ ID NO: 142477 - protein, 15 aa, Borrelia garinii PBi
AQAIQTVPNNTSTPN

SEQ ID NO: 142478 - protein, 9 aa, Borrelia garinii PBi
IQTVPNNTS

SEQ ID NO: 142479 - protein, 15 aa, Borrelia garinii PBi
QAIQTVPNNTSTPNQ

SEQ ID NO: 142480 - protein, 9 aa, Borrelia garinii PBi
IQTVPNNTS

SEQ ID NO: 142481 - protein, 15 aa, Borrelia garinii PBi
AIQTVPNNTSTPNQS

SEQ ID NO: 142482 - protein, 9 aa, Borrelia garinii PBi
IQTVPNNTS

SEQ ID NO: 142483 - protein, 15 aa, Borrelia garinii PBi
IQTVPNNTSTPNQSI

SEQ ID NO: 142484 - protein, 9 aa, Borrelia garinii PBi
IQTVPNNTS

SEQ ID NO: 142485 - protein, 15 aa, Borrelia garinii PBi
ASPATNVQATPPKQI

SEQ ID NO: 142486 - protein, 9 aa, Borrelia garinii PBi
TNVQATPPK

SEQ ID NO: 142487 - protein, 15 aa, Borrelia garinii PBi
SGLGIQISLESTLEE

SEQ ID NO: 142488 - protein, 9 aa, Borrelia garinii PBi
LGIQISLES

SEQ ID NO: 142489 - protein, 15 aa, Borrelia garinii PBi
SPATNVQATPPKQIA

SEQ ID NO: 142490 - protein, 9 aa, Borrelia garinii PBi
VQATPPKQI

SEQ ID NO: 142491 - protein, 15 aa, Borrelia garinii PBi
PATNVQATPPKQIAS

SEQ ID NO: 142492 - protein, 9 aa, Borrelia garinii PBi
VQATPPKQI

SEQ ID NO: 142493 - protein, 15 aa, Borrelia garinii PBi
KMKDSAFTLLDVISN

SEQ ID NO: 142494 - protein, 9 aa, Borrelia garinii PBi
KDSAFTLLD

SEQ ID NO: 142495 - protein, 15 aa, Borrelia garinii PBi
LGIQISLESTLEEIE

SEQ ID NO: 142496 - protein, 9 aa, Borrelia garinii PBi
ISLESTLEE

SEQ ID NO: 142497 - protein, 15 aa, Borrelia garinii PBi
LTNYRHQTQPSFVVP

SEQ ID NO: 142498 - protein, 9 aa, Borrelia garinii PBi
HQTQPSFVV

SEQ ID NO: 142499 - protein, 15 aa, Borrelia garinii PBi
GIQISLESTLEEIEK

SEQ ID NO: 142500 - protein, 9 aa, Borrelia garinii PBi
ISLESTLEE

SEQ ID NO: 142501 - protein, 15 aa, Borrelia garinii PBi
VLTNYRHQTQPSFVV

SEQ ID NO: 142502 - protein, 9 aa, Borrelia garinii PBi
YRHQTQPSF

SEQ ID NO: 142503 - protein, 15 aa, Borrelia garinii PBi
GLGIQISLESTLEEI

SEQ ID NO: 142504 - protein, 9 aa, Borrelia garinii PBi
ISLESTLEE

SEQ ID NO: 142505 - protein, 15 aa, Borrelia garinii PBi
ATNVQATPPKQIASA

SEQ ID NO: 142506 - protein, 9 aa, Borrelia garinii PBi
VQATPPKQI

SEQ ID NO: 142507 - protein, 15 aa, Borrelia garinii PBi
EKKIESFNTQYLNTI

SEQ ID NO: 142508 - protein, 9 aa, Borrelia garinii PBi
IESFNTQYL

SEQ ID NO: 142509 - protein, 15 aa, Borrelia garinii PBi
IQISLESTLEEIEKK

SEQ ID NO: 142510 - protein, 9 aa, Borrelia garinii PBi
ISLESTLEE

SEQ ID NO: 142511 - protein, 15 aa, Borrelia garinii PBi
TNVQATPPKQIASAQ

SEQ ID NO: 142512 - protein, 9 aa, Borrelia garinii PBi
VQATPPKQI

SEQ ID NO: 142513 - protein, 15 aa, Borrelia garinii PBi
KKIESFNTQYLNTII

SEQ ID NO: 142514 - protein, 9 aa, Borrelia garinii PBi
IESFNTQYL

SEQ ID NO: 142515 - protein, 15 aa, Borrelia garinii PBi
TNYRHQTQPSFVVPV

SEQ ID NO: 142516 - protein, 9 aa, Borrelia garinii PBi
HQTQPSFVV

SEQ ID NO: 142517 - protein, 15 aa, Borrelia garinii PBi
DQFKMKDSAFTLLDV

SEQ ID NO: 142518 - protein, 9 aa, Borrelia garinii PBi
KDSAFTLLD

SEQ ID NO: 142519 - protein, 15 aa, Borrelia garinii PBi
YDQFKMKDSAFTLLD

SEQ ID NO: 142520 - protein, 9 aa, Borrelia garinii PBi
FKMKDSAFT

SEQ ID NO: 142521 - protein, 15 aa, Borrelia garinii PBi
TQYLNTIINSYTFKD

SEQ ID NO: 142522 - protein, 9 aa, Borrelia garinii PBi
LNTIINSYT

SEQ ID NO: 142523 - protein, 15 aa, Borrelia garinii PBi
TQYLNTIINSYTFKD

SEQ ID NO: 142524 - protein, 9 aa, Borrelia garinii PBi
YLNTIINSY

SEQ ID NO: 142525 - protein, 15 aa, Borrelia garinii PBi
NQNHSLIRSLIISGL

SEQ ID NO: 142526 - protein, 9 aa, Borrelia garinii PBi
HSLIRSLII

SEQ ID NO: 142527 - protein, 15 aa, Borrelia garinii PBi
QNHSLIRSLIISGLG

SEQ ID NO: 142528 - protein, 9 aa, Borrelia garinii PBi
HSLIRSLII

SEQ ID NO: 142529 - protein, 15 aa, Borrelia garinii PBi
FNTQYLNTIINSYTF

SEQ ID NO: 142530 - protein, 9 aa, Borrelia garinii PBi
YLNTIINSY

SEQ ID NO: 142531 - protein, 15 aa, Borrelia garinii PBi
NTQYLNTIINSYTFK

SEQ ID NO: 142532 - protein, 9 aa, Borrelia garinii PBi
YLNTIINSY

SEQ ID NO: 142533 - protein, 15 aa, Borrelia garinii PBi
ADAIITNTSSNSKRN

SEQ ID NO: 142534 - protein, 9 aa, Borrelia garinii PBi
ITNTSSNSK

SEQ ID NO: 142535 - protein, 15 aa, Borrelia garinii PBi
NYADAIITNTSSNSK

SEQ ID NO: 142536 - protein, 9 aa, Borrelia garinii PBi
IITNTSSNS

SEQ ID NO: 142537 - protein, 15 aa, Borrelia garinii PBi
YADAIITNTSSNSKR

SEQ ID NO: 142538 - protein, 9 aa, Borrelia garinii PBi
ITNTSSNSK

SEQ ID NO: 142539 - protein, 15 aa, Borrelia garinii PBi
VLTNYRHQTQPSFVV

SEQ ID NO: 142540 - protein, 9 aa, Borrelia garinii PBi
RHQTQPSFV

SEQ ID NO: 142541 - protein, 15 aa, Borrelia garinii PBi
TNYRHQTQPSFVVPV

SEQ ID NO: 142542 - protein, 9 aa, Borrelia garinii PBi
HQTQPSFVV

SEQ ID NO: 142543 - protein, 15 aa, Borrelia garinii PBi
YQENQNHSLIRSLII

SEQ ID NO: 142544 - protein, 9 aa, Borrelia garinii PBi
NHSLIRSLI

SEQ ID NO: 142545 - protein, 15 aa, Borrelia garinii PBi
QENQNHSLIRSLIIS

SEQ ID NO: 142546 - protein, 9 aa, Borrelia garinii PBi
HSLIRSLII

SEQ ID NO: 142547 - protein, 15 aa, Borrelia garinii PBi
SQTNFNNSQSNNVLT

SEQ ID NO: 142548 - protein, 9 aa, Borrelia garinii PBi
FNNSQSNNV

SEQ ID NO: 142549 - protein, 15 aa, Borrelia garinii PBi
DAIITNTSSNSKRND

SEQ ID NO: 142550 - protein, 9 aa, Borrelia garinii PBi
ITNTSSNSK

SEQ ID NO: 142551 - protein, 15 aa, Borrelia garinii PBi
ENQNHSLIRSLIISG

SEQ ID NO: 142552 - protein, 9 aa, Borrelia garinii PBi
HSLIRSLII

SEQ ID NO: 142553 - protein, 15 aa, Borrelia garinii PBi
TSQTNFNNSQSNNVL

SEQ ID NO: 142554 - protein, 9 aa, Borrelia garinii PBi
FNNSQSNNV

SEQ ID NO: 142555 - protein, 15 aa, Borrelia garinii PBi
QTNFNNSQSNNVLTN

SEQ ID NO: 142556 - protein, 9 aa, Borrelia garinii PBi
FNNSQSNNV

SEQ ID NO: 142557 - protein, 15 aa, Borrelia garinii PBi
TNFNNSQSNNVLTNY

SEQ ID NO: 142558 - protein, 9 aa, Borrelia garinii PBi
FNNSQSNNV

SEQ ID NO: 142559 - protein, 15 aa, Borrelia garinii PBi
LTNYRHQTQPSFVVP

SEQ ID NO: 142560 - protein, 9 aa, Borrelia garinii PBi
HQTQPSFVV

SEQ ID NO: 142561 - protein, 15 aa, Borrelia garinii PBi
SFNTQYLNTIINSYT

SEQ ID NO: 142562 - protein, 9 aa, Borrelia garinii PBi
YLNTIINSY

SEQ ID NO: 142563 - protein, 15 aa, Borrelia garinii PBi
PTSQTNFNNSQSNNV

SEQ ID NO: 142564 - protein, 9 aa, Borrelia garinii PBi
NFNNSQSNN

SEQ ID NO: 142565 - protein, 15 aa, Borrelia garinii PBi
QQYTFSSSFSQPTSQ

SEQ ID NO: 142566 - protein, 9 aa, Borrelia garinii PBi
YTFSSSFSQ

SEQ ID NO: 142567 - protein, 15 aa, Borrelia garinii PBi
KPQQYTFSSSFSQPT

SEQ ID NO: 142568 - protein, 9 aa, Borrelia garinii PBi
YTFSSSFSQ

SEQ ID NO: 142569 - protein, 15 aa, Borrelia garinii PBi
PQQYTFSSSFSQPTS

SEQ ID NO: 142570 - protein, 9 aa, Borrelia garinii PBi
YTFSSSFSQ

SEQ ID NO: 142571 - protein, 15 aa, Borrelia garinii PBi
IIKPQQYTFSSSFSQ

SEQ ID NO: 142572 - protein, 9 aa, Borrelia garinii PBi
IIKPQQYTF

SEQ ID NO: 142573 - protein, 15 aa, Borrelia garinii PBi
IKPQQYTFSSSFSQP

SEQ ID NO: 142574 - protein, 9 aa, Borrelia garinii PBi
YTFSSSFSQ

SEQ ID NO: 142575 - protein, 15 aa, Borrelia garinii PBi
KKEWLNYADAIITNT

SEQ ID NO: 142576 - protein, 9 aa, Borrelia garinii PBi
WLNYADAII

SEQ ID NO: 142577 - protein, 15 aa, Borrelia garinii PBi
AEKKEWLNYADAIIT

SEQ ID NO: 142578 - protein, 9 aa, Borrelia garinii PBi
WLNYADAII

SEQ ID NO: 142579 - protein, 15 aa, Borrelia garinii PBi
EKKEWLNYADAIITN

SEQ ID NO: 142580 - protein, 9 aa, Borrelia garinii PBi
WLNYADAII

SEQ ID NO: 142581 - protein, 15 aa, Borrelia garinii PBi
KEWLNYADAIITNTS

SEQ ID NO: 142582 - protein, 9 aa, Borrelia garinii PBi
WLNYADAII

SEQ ID NO: 142583 - protein, 15 aa, Borrelia garinii PBi
QYTFSSSFSQPTSQT

SEQ ID NO: 142584 - protein, 9 aa, Borrelia garinii PBi
YTFSSSFSQ

SEQ ID NO: 142585 - protein, 15 aa, Borrelia garinii PBi
YTFSSSFSQPTSQTN

SEQ ID NO: 142586 - protein, 9 aa, Borrelia garinii PBi
YTFSSSFSQ

SEQ ID NO: 142587 - protein, 15 aa, Borrelia garinii PBi
LAEKKEWLNYADAII

SEQ ID NO: 142588 - protein, 9 aa, Borrelia garinii PBi
LAEKKEWLN

SEQ ID NO: 142589 - protein, 15 aa, Borrelia garinii PBi
TPPKQIASAQAIQTV

SEQ ID NO: 142590 - protein, 9 aa, Borrelia garinii PBi
KQIASAQAI

SEQ ID NO: 142591 - protein, 15 aa, Borrelia garinii PBi
ATPPKQIASAQAIQT

SEQ ID NO: 142592 - protein, 9 aa, Borrelia garinii PBi
KQIASAQAI

SEQ ID NO: 142593 - protein, 15 aa, Borrelia garinii PBi
HSLIRSLIISGLGIQ

SEQ ID NO: 142594 - protein, 9 aa, Borrelia garinii PBi
LIRSLIISG

SEQ ID NO: 142595 - protein, 15 aa, Borrelia garinii PBi
PPKQIASAQAIQTVP

SEQ ID NO: 142596 - protein, 9 aa, Borrelia garinii PBi
KQIASAQAI

SEQ ID NO: 142597 - protein, 15 aa, Borrelia garinii PBi
SLIRSLIISGLGIQI

SEQ ID NO: 142598 - protein, 9 aa, Borrelia garinii PBi
LIISGLGIQ

SEQ ID NO: 142599 - protein, 15 aa, Borrelia garinii PBi
LIRSLIISGLGIQIS

SEQ ID NO: 142600 - protein, 9 aa, Borrelia garinii PBi
LIISGLGIQ

SEQ ID NO: 142601 - protein, 15 aa, Borrelia garinii PBi
IRSLIISGLGIQISL

SEQ ID NO: 142602 - protein, 9 aa, Borrelia garinii PBi
LIISGLGIQ

SEQ ID NO: 142603 - protein, 15 aa, Borrelia garinii PBi
RSLIISGLGIQISLE

SEQ ID NO: 142604 - protein, 9 aa, Borrelia garinii PBi
LIISGLGIQ

SEQ ID NO: 142605 - protein, 15 aa, Borrelia garinii PBi
QTNFNNSQSNNVLTN

SEQ ID NO: 142606 - protein, 9 aa, Borrelia garinii PBi
FNNSQSNNV

SEQ ID NO: 142607 - protein, 15 aa, Borrelia garinii PBi
SQTNFNNSQSNNVLT

SEQ ID NO: 142608 - protein, 9 aa, Borrelia garinii PBi
FNNSQSNNV

SEQ ID NO: 142609 - protein, 15 aa, Borrelia garinii PBi
TNFNNSQSNNVLTNY

SEQ ID NO: 142610 - protein, 9 aa, Borrelia garinii PBi
FNNSQSNNV

SEQ ID NO: 142611 - protein, 15 aa, Borrelia garinii PBi
NSPLQKLKNNLLRRI

SEQ ID NO: 142612 - protein, 9 aa, Borrelia garinii PBi
LQKLKNNLL

SEQ ID NO: 142613 - protein, 15 aa, Borrelia garinii PBi
SPLQKLKNNLLRRIA

SEQ ID NO: 142614 - protein, 9 aa, Borrelia garinii PBi
LKNNLLRRI

SEQ ID NO: 142615 - protein, 15 aa, Borrelia garinii PBi
PLQKLKNNLLRRIAE

SEQ ID NO: 142616 - protein, 9 aa, Borrelia garinii PBi
LKNNLLRRI

SEQ ID NO: 142617 - protein, 15 aa, Borrelia garinii PBi
LQKLKNNLLRRIAEE

SEQ ID NO: 142618 - protein, 9 aa, Borrelia garinii PBi
LKNNLLRRI

SEQ ID NO: 142619 - protein, 15 aa, Borrelia garinii PBi
QSLGQYIKNKYLDKM

SEQ ID NO: 142620 - protein, 9 aa, Borrelia garinii PBi
LGQYIKNKY

SEQ ID NO: 142621 - protein, 15 aa, Borrelia garinii PBi
QKLKNNLLRRIAEEK

SEQ ID NO: 142622 - protein, 9 aa, Borrelia garinii PBi
LKNNLLRRI

SEQ ID NO: 142623 - protein, 15 aa, Borrelia garinii PBi
SLGQYIKNKYLDKMQ

SEQ ID NO: 142624 - protein, 9 aa, Borrelia garinii PBi
LGQYIKNKY

SEQ ID NO: 142625 - protein, 15 aa, Borrelia garinii PBi
LGQYIKNKYLDKMQD

SEQ ID NO: 142626 - protein, 9 aa, Borrelia garinii PBi
LGQYIKNKY

SEQ ID NO: 142627 - protein, 15 aa, Borrelia garinii PBi
PQSLGQYIKNKYLDK

SEQ ID NO: 142628 - protein, 9 aa, Borrelia garinii PBi
LGQYIKNKY

SEQ ID NO: 142629 - protein, 15 aa, Borrelia garinii PBi
DPQSLGQYIKNKYLD

SEQ ID NO: 142630 - protein, 9 aa, Borrelia garinii PBi
LGQYIKNKY

SEQ ID NO: 142631 - protein, 15 aa, Borrelia garinii PBi
TQYLNTIINSYTFKD

SEQ ID NO: 142632 - protein, 9 aa, Borrelia garinii PBi
LNTIINSYT

SEQ ID NO: 142633 - protein, 15 aa, Borrelia garinii PBi
NDPQSLGQYIKNKYL

SEQ ID NO: 142634 - protein, 9 aa, Borrelia garinii PBi
LGQYIKNKY

SEQ ID NO: 142635 - protein, 15 aa, Borrelia garinii PBi
FNTQYLNTIINSYTF

SEQ ID NO: 142636 - protein, 9 aa, Borrelia garinii PBi
YLNTIINSY

SEQ ID NO: 142637 - protein, 15 aa, Borrelia garinii PBi
RNDPQSLGQYIKNKY

SEQ ID NO: 142638 - protein, 9 aa, Borrelia garinii PBi
PQSLGQYIK

SEQ ID NO: 142639 - protein, 15 aa, Borrelia garinii PBi
SFNTQYLNTIINSYT

SEQ ID NO: 142640 - protein, 9 aa, Borrelia garinii PBi
YLNTIINSY

SEQ ID NO: 142641 - protein, 15 aa, Borrelia garinii PBi
KLKNNLLRRIAEEKN

SEQ ID NO: 142642 - protein, 9 aa, Borrelia garinii PBi
LKNNLLRRI

SEQ ID NO: 142643 - protein, 15 aa, Borrelia garinii PBi
NTQYLNTIINSYTFK

SEQ ID NO: 142644 - protein, 9 aa, Borrelia garinii PBi
YLNTIINSY

SEQ ID NO: 142645 - protein, 15 aa, Borrelia garinii PBi
QYLNTIINSYTFKDK

SEQ ID NO: 142646 - protein, 9 aa, Borrelia garinii PBi
LNTIINSYT

SEQ ID NO: 142647 - protein, 15 aa, Borrelia garinii PBi
AQAIQTVPNNTSTPN

SEQ ID NO: 142648 - protein, 9 aa, Borrelia garinii PBi
IQTVPNNTS

SEQ ID NO: 142649 - protein, 15 aa, Borrelia garinii PBi
QAIQTVPNNTSTPNQ

SEQ ID NO: 142650 - protein, 9 aa, Borrelia garinii PBi
VPNNTSTPN

SEQ ID NO: 142651 - protein, 15 aa, Borrelia garinii PBi
LKNNLLRRIAEEKNK

SEQ ID NO: 142652 - protein, 9 aa, Borrelia garinii PBi
LKNNLLRRI

SEQ ID NO: 142653 - protein, 15 aa, Borrelia garinii PBi
FTLLDVISNISVFDR

SEQ ID NO: 142654 - protein, 9 aa, Borrelia garinii PBi
LLDVISNIS

SEQ ID NO: 142655 - protein, 15 aa, Borrelia garinii PBi
ESFNTQYLNTIINSY

SEQ ID NO: 142656 - protein, 9 aa, Borrelia garinii PBi
FNTQYLNTI

SEQ ID NO: 142657 - protein, 15 aa, Borrelia garinii PBi
HSLIRSLIISGLGIQ

SEQ ID NO: 142658 - protein, 9 aa, Borrelia garinii PBi
IRSLIISGL

SEQ ID NO: 142659 - protein, 15 aa, Borrelia garinii PBi
YLNTIINSYTFKDKL

SEQ ID NO: 142660 - protein, 9 aa, Borrelia garinii PBi
IINSYTFKD

SEQ ID NO: 142661 - protein, 15 aa, Borrelia garinii PBi
SLIISGLGIQISLES

SEQ ID NO: 142662 - protein, 9 aa, Borrelia garinii PBi
LIISGLGIQ

SEQ ID NO: 142663 - protein, 15 aa, Borrelia garinii PBi
SLIRSLIISGLGIQI

SEQ ID NO: 142664 - protein, 9 aa, Borrelia garinii PBi
IRSLIISGL

SEQ ID NO: 142665 - protein, 15 aa, Borrelia garinii PBi
LIISGLGIQISLEST

SEQ ID NO: 142666 - protein, 9 aa, Borrelia garinii PBi
LGIQISLES

SEQ ID NO: 142667 - protein, 15 aa, Borrelia garinii PBi
IQTVPNNTSTPNQSI

SEQ ID NO: 142668 - protein, 9 aa, Borrelia garinii PBi
VPNNTSTPN

SEQ ID NO: 142669 - protein, 15 aa, Borrelia garinii PBi
AIQTVPNNTSTPNQS

SEQ ID NO: 142670 - protein, 9 aa, Borrelia garinii PBi
VPNNTSTPN

SEQ ID NO: 142671 - protein, 15 aa, Borrelia garinii PBi
TLLDVISNISVFDRG

SEQ ID NO: 142672 - protein, 9 aa, Borrelia garinii PBi
ISNISVFDR

SEQ ID NO: 142673 - protein, 15 aa, Borrelia garinii PBi
IISGLGIQISLESTL

SEQ ID NO: 142674 - protein, 9 aa, Borrelia garinii PBi
LGIQISLES

SEQ ID NO: 142675 - protein, 15 aa, Borrelia garinii PBi
LLDVISNISVFDRGS

SEQ ID NO: 142676 - protein, 9 aa, Borrelia garinii PBi
ISNISVFDR

SEQ ID NO: 142677 - protein, 15 aa, Borrelia garinii PBi
ISGLGIQISLESTLE

SEQ ID NO: 142678 - protein, 9 aa, Borrelia garinii PBi
LGIQISLES

SEQ ID NO: 142679 - protein, 15 aa, Borrelia garinii PBi
GNSPLQKLKNNLLRR

SEQ ID NO: 142680 - protein, 9 aa, Borrelia garinii PBi
LQKLKNNLL

SEQ ID NO: 142681 - protein, 15 aa, Borrelia garinii PBi
LIRSLIISGLGIQIS

SEQ ID NO: 142682 - protein, 9 aa, Borrelia garinii PBi
LIISGLGIQ

SEQ ID NO: 142683 - protein, 15 aa, Borrelia garinii PBi
IRSLIISGLGIQISL

SEQ ID NO: 142684 - protein, 9 aa, Borrelia garinii PBi
LIISGLGIQ

SEQ ID NO: 142685 - protein, 15 aa, Borrelia garinii PBi
YADAIITNTSSNSKR

SEQ ID NO: 142686 - protein, 9 aa, Borrelia garinii PBi
IITNTSSNS

SEQ ID NO: 142687 - protein, 15 aa, Borrelia garinii PBi
NYADAIITNTSSNSK

SEQ ID NO: 142688 - protein, 9 aa, Borrelia garinii PBi
IITNTSSNS

SEQ ID NO: 142689 - protein, 15 aa, Borrelia garinii PBi
RQSALDLYLNITEIR

SEQ ID NO: 142690 - protein, 9 aa, Borrelia garinii PBi
ALDLYLNIT

SEQ ID NO: 142691 - protein, 15 aa, Borrelia garinii PBi
ADAIITNTSSNSKRN

SEQ ID NO: 142692 - protein, 9 aa, Borrelia garinii PBi
IITNTSSNS

SEQ ID NO: 142693 - protein, 15 aa, Borrelia garinii PBi
SGLGIQISLESTLEE

SEQ ID NO: 142694 - protein, 9 aa, Borrelia garinii PBi
LGIQISLES

SEQ ID NO: 142695 - protein, 15 aa, Borrelia garinii PBi
DAIITNTSSNSKRND

SEQ ID NO: 142696 - protein, 9 aa, Borrelia garinii PBi
IITNTSSNS

SEQ ID NO: 142697 - protein, 15 aa, Borrelia garinii PBi
SGNSPLQKLKNNLLR

SEQ ID NO: 142698 - protein, 9 aa, Borrelia garinii PBi
LQKLKNNLL

SEQ ID NO: 142699 - protein, 15 aa, Borrelia garinii PBi
TEFGSIMNILYQENQ

SEQ ID NO: 142700 - protein, 9 aa, Borrelia garinii PBi
FGSIMNILY

SEQ ID NO: 142701 - protein, 15 aa, Borrelia garinii PBi
LNTIINSYTFKDKLK

SEQ ID NO: 142702 - protein, 9 aa, Borrelia garinii PBi
LNTIINSYT

SEQ ID NO: 142703 - protein, 15 aa, Borrelia garinii PBi
YSGNSPLQKLKNNLL

SEQ ID NO: 142704 - protein, 9 aa, Borrelia garinii PBi
YSGNSPLQK

SEQ ID NO: 142705 - protein, 15 aa, Borrelia garinii PBi
AFTLLDVISNISVFD

SEQ ID NO: 142706 - protein, 9 aa, Borrelia garinii PBi
LLDVISNIS

SEQ ID NO: 142707 - protein, 15 aa, Borrelia garinii PBi
QGLNPANQVNPGNPM

SEQ ID NO: 142708 - protein, 9 aa, Borrelia garinii PBi
LNPANQVNP

SEQ ID NO: 142709 - protein, 15 aa, Borrelia garinii PBi
TTEFGSIMNILYQEN

SEQ ID NO: 142710 - protein, 9 aa, Borrelia garinii PBi
FGSIMNILY

SEQ ID NO: 142711 - protein, 15 aa, Borrelia garinii PBi
DQAKISINTGSNATK

SEQ ID NO: 142712 - protein, 9 aa, Borrelia garinii PBi
ISINTGSNA

SEQ ID NO: 142713 - protein, 15 aa, Borrelia garinii PBi
NQNHSLIRSLIISGL

SEQ ID NO: 142714 - protein, 9 aa, Borrelia garinii PBi
LIRSLIISG

SEQ ID NO: 142715 - protein, 15 aa, Borrelia garinii PBi
LNYADAIITNTSSNS

SEQ ID NO: 142716 - protein, 9 aa, Borrelia garinii PBi
LNYADAIIT

SEQ ID NO: 142717 - protein, 15 aa, Borrelia garinii PBi
KTTEFGSIMNILYQE

SEQ ID NO: 142718 - protein, 9 aa, Borrelia garinii PBi
FGSIMNILY

SEQ ID NO: 142719 - protein, 15 aa, Borrelia garinii PBi
DDQAKISINTGSNAT

SEQ ID NO: 142720 - protein, 9 aa, Borrelia garinii PBi
ISINTGSNA

SEQ ID NO: 142721 - protein, 15 aa, Borrelia garinii PBi
AKISINTGSNATKNK

SEQ ID NO: 142722 - protein, 9 aa, Borrelia garinii PBi
ISINTGSNA

SEQ ID NO: 142723 - protein, 15 aa, Borrelia garinii PBi
QAKISINTGSNATKN

SEQ ID NO: 142724 - protein, 9 aa, Borrelia garinii PBi
ISINTGSNA

SEQ ID NO: 142725 - protein, 15 aa, Borrelia garinii PBi
QTVPNNTSTPNQSII

SEQ ID NO: 142726 - protein, 9 aa, Borrelia garinii PBi
VPNNTSTPN

SEQ ID NO: 142727 - protein, 15 aa, Borrelia garinii PBi
NHSLIRSLIISGLGI

SEQ ID NO: 142728 - protein, 9 aa, Borrelia garinii PBi
IRSLIISGL

SEQ ID NO: 142729 - protein, 15 aa, Borrelia garinii PBi
TNFNNSQSNNVLTNY

SEQ ID NO: 142730 - protein, 9 aa, Borrelia garinii PBi
FNNSQSNNV

SEQ ID NO: 142731 - protein, 15 aa, Borrelia garinii PBi
LNPANQVNPGNPMQI

SEQ ID NO: 142732 - protein, 9 aa, Borrelia garinii PBi
NQVNPGNPM

SEQ ID NO: 142733 - protein, 15 aa, Borrelia garinii PBi
LDVISNISVFDRGSA

SEQ ID NO: 142734 - protein, 9 aa, Borrelia garinii PBi
ISNISVFDR

SEQ ID NO: 142735 - protein, 15 aa, Borrelia garinii PBi
TKNKTNIKVAGLQKN

SEQ ID NO: 142736 - protein, 9 aa, Borrelia garinii PBi
NKTNIKVAG

SEQ ID NO: 142737 - protein, 15 aa, Borrelia garinii PBi
NFNNSQSNNVLTNYR

SEQ ID NO: 142738 - protein, 9 aa, Borrelia garinii PBi
FNNSQSNNV

SEQ ID NO: 142739 - protein, 15 aa, Borrelia garinii PBi
QNHSLIRSLIISGLG

SEQ ID NO: 142740 - protein, 9 aa, Borrelia garinii PBi
IRSLIISGL

SEQ ID NO: 142741 - protein, 15 aa, Borrelia garinii PBi
FNNSQSNNVLTNYRH

SEQ ID NO: 142742 - protein, 9 aa, Borrelia garinii PBi
FNNSQSNNV

SEQ ID NO: 142743 - protein, 15 aa, Borrelia garinii PBi
GQYIKNKYLDKMQDA

SEQ ID NO: 142744 - protein, 9 aa, Borrelia garinii PBi
IKNKYLDKM

SEQ ID NO: 142745 - protein, 15 aa, Borrelia garinii PBi
QYIKNKYLDKMQDAR

SEQ ID NO: 142746 - protein, 9 aa, Borrelia garinii PBi
IKNKYLDKM

SEQ ID NO: 142747 - protein, 15 aa, Borrelia garinii PBi
SAFTLLDVISNISVF

SEQ ID NO: 142748 - protein, 9 aa, Borrelia garinii PBi
LLDVISNIS

SEQ ID NO: 142749 - protein, 15 aa, Borrelia garinii PBi
GLNPANQVNPGNPMQ

SEQ ID NO: 142750 - protein, 9 aa, Borrelia garinii PBi
NQVNPGNPM

SEQ ID NO: 142751 - protein, 15 aa, Borrelia garinii PBi
RSLIISGLGIQISLE

SEQ ID NO: 142752 - protein, 9 aa, Borrelia garinii PBi
LIISGLGIQ

SEQ ID NO: 142753 - protein, 15 aa, Borrelia garinii PBi
AIITNTSSNSKRNDP

SEQ ID NO: 142754 - protein, 9 aa, Borrelia garinii PBi
IITNTSSNS

SEQ ID NO: 142755 - protein, 15 aa, Borrelia garinii PBi
AKTTEFGSIMNILYQ

SEQ ID NO: 142756 - protein, 9 aa, Borrelia garinii PBi
FGSIMNILY

SEQ ID NO: 142757 - protein, 15 aa, Borrelia garinii PBi
KISINTGSNATKNKT

SEQ ID NO: 142758 - protein, 9 aa, Borrelia garinii PBi
ISINTGSNA

SEQ ID NO: 142759 - protein, 15 aa, Borrelia garinii PBi
QTNFNNSQSNNVLTN

SEQ ID NO: 142760 - protein, 9 aa, Borrelia garinii PBi
FNNSQSNNV

SEQ ID NO: 142761 - protein, 15 aa, Borrelia garinii PBi
DSAFTLLDVISNISV

SEQ ID NO: 142762 - protein, 9 aa, Borrelia garinii PBi
LLDVISNIS

SEQ ID NO: 142763 - protein, 15 aa, Borrelia garinii PBi
SQTNFNNSQSNNVLT

SEQ ID NO: 142764 - protein, 9 aa, Borrelia garinii PBi
FNNSQSNNV

SEQ ID NO: 142765 - protein, 15 aa, Borrelia garinii PBi
TSQTNFNNSQSNNVL

SEQ ID NO: 142766 - protein, 9 aa, Borrelia garinii PBi
FNNSQSNNV

SEQ ID NO: 142767 - protein, 15 aa, Borrelia garinii PBi
QAKTTEFGSIMNILY

SEQ ID NO: 142768 - protein, 9 aa, Borrelia garinii PBi
EFGSIMNIL

SEQ ID NO: 142769 - protein, 15 aa, Borrelia garinii PBi
GLGIQISLESTLEEI

SEQ ID NO: 142770 - protein, 9 aa, Borrelia garinii PBi
LGIQISLES

SEQ ID NO: 142771 - protein, 15 aa, Borrelia garinii PBi
LGIQISLESTLEEIE

SEQ ID NO: 142772 - protein, 9 aa, Borrelia garinii PBi
LGIQISLES

SEQ ID NO: 142773 - protein, 15 aa, Borrelia garinii PBi
KDSAFTLLDVISNIS

SEQ ID NO: 142774 - protein, 9 aa, Borrelia garinii PBi
FTLLDVISN

SEQ ID NO: 142775 - protein, 15 aa, Borrelia garinii PBi
EFGSIMNILYQENQN

SEQ ID NO: 142776 - protein, 9 aa, Borrelia garinii PBi
FGSIMNILY

SEQ ID NO: 142777 - protein, 15 aa, Borrelia garinii PBi
NKTNIKVAGLQKNTQ

SEQ ID NO: 142778 - protein, 9 aa, Borrelia garinii PBi
IKVAGLQKN

SEQ ID NO: 142779 - protein, 15 aa, Borrelia garinii PBi
ANLNKDYKNKVEELL

SEQ ID NO: 142780 - protein, 9 aa, Borrelia garinii PBi
LNKDYKNKV

SEQ ID NO: 142781 - protein, 15 aa, Borrelia garinii PBi
PTSQTNFNNSQSNNV

SEQ ID NO: 142782 - protein, 9 aa, Borrelia garinii PBi
NFNNSQSNN

SEQ ID NO: 142783 - protein, 15 aa, Borrelia garinii PBi
DVISNISVFDRGSAP

SEQ ID NO: 142784 - protein, 9 aa, Borrelia garinii PBi
ISNISVFDR

SEQ ID NO: 142785 - protein, 15 aa, Borrelia garinii PBi
PANQVNPGNPMQIAN

SEQ ID NO: 142786 - protein, 9 aa, Borrelia garinii PBi
NQVNPGNPM

SEQ ID NO: 142787 - protein, 15 aa, Borrelia garinii PBi
NPANQVNPGNPMQIA

SEQ ID NO: 142788 - protein, 9 aa, Borrelia garinii PBi
NQVNPGNPM

SEQ ID NO: 142789 - protein, 15 aa, Borrelia garinii PBi
TDDQAKISINTGSNA

SEQ ID NO: 142790 - protein, 9 aa, Borrelia garinii PBi
AKISINTGS

SEQ ID NO: 142791 - protein, 15 aa, Borrelia garinii PBi
SQSNNVLTNYRHQTQ

SEQ ID NO: 142792 - protein, 9 aa, Borrelia garinii PBi
SNNVLTNYR

SEQ ID NO: 142793 - protein, 15 aa, Borrelia garinii PBi
ISINTGSNATKNKTN

SEQ ID NO: 142794 - protein, 9 aa, Borrelia garinii PBi
ISINTGSNA

SEQ ID NO: 142795 - protein, 15 aa, Borrelia garinii PBi
SAQAIQTVPNNTSTP

SEQ ID NO: 142796 - protein, 9 aa, Borrelia garinii PBi
IQTVPNNTS

SEQ ID NO: 142797 - protein, 15 aa, Borrelia garinii PBi
NSQSNNVLTNYRHQT

SEQ ID NO: 142798 - protein, 9 aa, Borrelia garinii PBi
SNNVLTNYR

SEQ ID NO: 142799 - protein, 15 aa, Borrelia garinii PBi
NIKVAGLQKNTQSKK

SEQ ID NO: 142800 - protein, 9 aa, Borrelia garinii PBi
IKVAGLQKN

SEQ ID NO: 142801 - protein, 15 aa, Borrelia garinii PBi
NSPLQKLKNNLLRRI

SEQ ID NO: 142802 - protein, 9 aa, Borrelia garinii PBi
QKLKNNLLR

SEQ ID NO: 142803 - protein, 15 aa, Borrelia garinii PBi
SPLQKLKNNLLRRIA

SEQ ID NO: 142804 - protein, 9 aa, Borrelia garinii PBi
QKLKNNLLR

SEQ ID NO: 142805 - protein, 15 aa, Borrelia garinii PBi
HSLIRSLIISGLGIQ

SEQ ID NO: 142806 - protein, 9 aa, Borrelia garinii PBi
LIRSLIISG

SEQ ID NO: 142807 - protein, 15 aa, Borrelia garinii PBi
PLQKLKNNLLRRIAE

SEQ ID NO: 142808 - protein, 9 aa, Borrelia garinii PBi
QKLKNNLLR

SEQ ID NO: 142809 - protein, 15 aa, Borrelia garinii PBi
NQNHSLIRSLIISGL

SEQ ID NO: 142810 - protein, 9 aa, Borrelia garinii PBi
LIRSLIISG

SEQ ID NO: 142811 - protein, 15 aa, Borrelia garinii PBi
GNSPLQKLKNNLLRR

SEQ ID NO: 142812 - protein, 9 aa, Borrelia garinii PBi
LQKLKNNLL

SEQ ID NO: 142813 - protein, 15 aa, Borrelia garinii PBi
QNHSLIRSLIISGLG

SEQ ID NO: 142814 - protein, 9 aa, Borrelia garinii PBi
LIRSLIISG

SEQ ID NO: 142815 - protein, 15 aa, Borrelia garinii PBi
NHSLIRSLIISGLGI

SEQ ID NO: 142816 - protein, 9 aa, Borrelia garinii PBi
LIRSLIISG

SEQ ID NO: 142817 - protein, 15 aa, Borrelia garinii PBi
TQYLNTIINSYTFKD

SEQ ID NO: 142818 - protein, 9 aa, Borrelia garinii PBi
YLNTIINSY

SEQ ID NO: 142819 - protein, 15 aa, Borrelia garinii PBi
YSGNSPLQKLKNNLL

SEQ ID NO: 142820 - protein, 9 aa, Borrelia garinii PBi
SPLQKLKNN

SEQ ID NO: 142821 - protein, 15 aa, Borrelia garinii PBi
NSPLQKLKNNLLRRI

SEQ ID NO: 142822 - protein, 9 aa, Borrelia garinii PBi
LQKLKNNLL

SEQ ID NO: 142823 - protein, 15 aa, Borrelia garinii PBi
SPLQKLKNNLLRRIA

SEQ ID NO: 142824 - protein, 9 aa, Borrelia garinii PBi
LQKLKNNLL

SEQ ID NO: 142825 - protein, 15 aa, Borrelia garinii PBi
GNSPLQKLKNNLLRR

SEQ ID NO: 142826 - protein, 9 aa, Borrelia garinii PBi
LQKLKNNLL

SEQ ID NO: 142827 - protein, 15 aa, Borrelia garinii PBi
SGNSPLQKLKNNLLR

SEQ ID NO: 142828 - protein, 9 aa, Borrelia garinii PBi
LQKLKNNLL

SEQ ID NO: 142829 - protein, 15 aa, Borrelia garinii PBi
RETYDQFKMKDSAFT

SEQ ID NO: 142830 - protein, 9 aa, Borrelia garinii PBi
YDQFKMKDS

SEQ ID NO: 142831 - protein, 15 aa, Borrelia garinii PBi
ETYDQFKMKDSAFTL

SEQ ID NO: 142832 - protein, 9 aa, Borrelia garinii PBi
FKMKDSAFT

SEQ ID NO: 142833 - protein, 15 aa, Borrelia garinii PBi
TYDQFKMKDSAFTLL

SEQ ID NO: 142834 - protein, 9 aa, Borrelia garinii PBi
FKMKDSAFT

SEQ ID NO: 142835 - protein, 15 aa, Borrelia garinii PBi
YDQFKMKDSAFTLLD

SEQ ID NO: 142836 - protein, 9 aa, Borrelia garinii PBi
FKMKDSAFT

SEQ ID NO: 142837 - protein, 15 aa, Borrelia garinii PBi
DQFKMKDSAFTLLDV

SEQ ID NO: 142838 - protein, 9 aa, Borrelia garinii PBi
FKMKDSAFT

SEQ ID NO: 142839 - protein, 15 aa, Borrelia burgdorferi B31
IKINIITMILTLICI

SEQ ID NO: 142840 - protein, 9 aa, Borrelia burgdorferi B31
IITMILTLI

SEQ ID NO: 142841 - protein, 15 aa, Borrelia burgdorferi B31
IIKINIITMILTLIC

SEQ ID NO: 142842 - protein, 9 aa, Borrelia burgdorferi B31
IITMILTLI

SEQ ID NO: 142843 - protein, 15 aa, Borrelia burgdorferi B31
KINIITMILTLICIS

SEQ ID NO: 142844 - protein, 9 aa, Borrelia burgdorferi B31
IITMILTLI

SEQ ID NO: 142845 - protein, 15 aa, Borrelia burgdorferi B31
INIITMILTLICISC

SEQ ID NO: 142846 - protein, 9 aa, Borrelia burgdorferi B31
IITMILTLI

SEQ ID NO: 142847 - protein, 15 aa, Borrelia burgdorferi B31
NIIKINIITMILTLI

SEQ ID NO: 142848 - protein, 9 aa, Borrelia burgdorferi B31
INIITMILT

SEQ ID NO: 142849 - protein, 15 aa, Borrelia burgdorferi B31
SDEKFMGTTASELKA

SEQ ID NO: 142850 - protein, 9 aa, Borrelia burgdorferi B31
FMGTTASEL

SEQ ID NO: 142851 - protein, 15 aa, Borrelia burgdorferi B31
ASDEKFMGTTASELK

SEQ ID NO: 142852 - protein, 9 aa, Borrelia burgdorferi B31
FMGTTASEL

SEQ ID NO: 142853 - protein, 15 aa, Borrelia burgdorferi B31
DEKFMGTTASELKAI

SEQ ID NO: 142854 - protein, 9 aa, Borrelia burgdorferi B31
FMGTTASEL

SEQ ID NO: 142855 - protein, 15 aa, Borrelia burgdorferi B31
EKFMGTTASELKAIG

SEQ ID NO: 142856 - protein, 9 aa, Borrelia burgdorferi B31
FMGTTASEL

SEQ ID NO: 142857 - protein, 15 aa, Borrelia burgdorferi B31
AKITNEESNLLDTYI

SEQ ID NO: 142858 - protein, 9 aa, Borrelia burgdorferi B31
ITNEESNLL

SEQ ID NO: 142859 - protein, 15 aa, Borrelia burgdorferi B31
NIITMILTLICISCA

SEQ ID NO: 142860 - protein, 9 aa, Borrelia burgdorferi B31
IITMILTLI

SEQ ID NO: 142861 - protein, 15 aa, Borrelia burgdorferi B31
QIAKITNEESNLLDT

SEQ ID NO: 142862 - protein, 9 aa, Borrelia burgdorferi B31
ITNEESNLL

SEQ ID NO: 142863 - protein, 15 aa, Borrelia burgdorferi B31
IAKITNEESNLLDTY

SEQ ID NO: 142864 - protein, 9 aa, Borrelia burgdorferi B31
ITNEESNLL

SEQ ID NO: 142865 - protein, 15 aa, Borrelia burgdorferi B31
IQIAKITNEESNLLD

SEQ ID NO: 142866 - protein, 9 aa, Borrelia burgdorferi B31
ITNEESNLL

SEQ ID NO: 142867 - protein, 15 aa, Borrelia burgdorferi B31
DIQIAKITNEESNLL

SEQ ID NO: 142868 - protein, 9 aa, Borrelia burgdorferi B31
IAKITNEES

SEQ ID NO: 142869 - protein, 15 aa, Borrelia burgdorferi B31
GASDEKFMGTTASEL

SEQ ID NO: 142870 - protein, 9 aa, Borrelia burgdorferi B31
EKFMGTTAS

SEQ ID NO: 142871 - protein, 15 aa, Borrelia burgdorferi B31
IITMILTLICISCAP

SEQ ID NO: 142872 - protein, 9 aa, Borrelia burgdorferi B31
IITMILTLI

SEQ ID NO: 142873 - protein, 15 aa, Borrelia burgdorferi B31
NKYYKDSDSLQSAFY

SEQ ID NO: 142874 - protein, 9 aa, Borrelia burgdorferi B31
YKDSDSLQS

SEQ ID NO: 142875 - protein, 15 aa, Borrelia burgdorferi B31
HFNKYYKDSDSLQSA

SEQ ID NO: 142876 - protein, 9 aa, Borrelia burgdorferi B31
YKDSDSLQS

SEQ ID NO: 142877 - protein, 15 aa, Borrelia burgdorferi B31
FNKYYKDSDSLQSAF

SEQ ID NO: 142878 - protein, 9 aa, Borrelia burgdorferi B31
YKDSDSLQS

SEQ ID NO: 142879 - protein, 15 aa, Borrelia burgdorferi B31
EHFNKYYKDSDSLQS

SEQ ID NO: 142880 - protein, 9 aa, Borrelia burgdorferi B31
NKYYKDSDS

SEQ ID NO: 142881 - protein, 15 aa, Borrelia burgdorferi B31
LNIIKINIITMILTL

SEQ ID NO: 142882 - protein, 9 aa, Borrelia burgdorferi B31
INIITMILT

SEQ ID NO: 142883 - protein, 15 aa, Borrelia burgdorferi B31
KLNIIKINIITMILT

SEQ ID NO: 142884 - protein, 9 aa, Borrelia burgdorferi B31
IKINIITMI

SEQ ID NO: 142885 - protein, 15 aa, Borrelia burgdorferi B31
KFMGTTASELKAIGK

SEQ ID NO: 142886 - protein, 9 aa, Borrelia burgdorferi B31
FMGTTASEL

SEQ ID NO: 142887 - protein, 15 aa, Borrelia burgdorferi B31
IAANFLYRIALDIQL

SEQ ID NO: 142888 - protein, 9 aa, Borrelia burgdorferi B31
IAANFLYRI

SEQ ID NO: 142889 - protein, 15 aa, Borrelia burgdorferi B31
KITNEESNLLDTYIR

SEQ ID NO: 142890 - protein, 9 aa, Borrelia burgdorferi B31
ITNEESNLL

SEQ ID NO: 142891 - protein, 15 aa, Borrelia burgdorferi B31
FMGTTASELKAIGKE

SEQ ID NO: 142892 - protein, 9 aa, Borrelia burgdorferi B31
FMGTTASEL

SEQ ID NO: 142893 - protein, 15 aa, Borrelia burgdorferi B31
ITNEESNLLDTYIRA

SEQ ID NO: 142894 - protein, 9 aa, Borrelia burgdorferi B31
ITNEESNLL

SEQ ID NO: 142895 - protein, 15 aa, Borrelia burgdorferi B31
PKIAANFLYRIALDI

SEQ ID NO: 142896 - protein, 9 aa, Borrelia burgdorferi B31
IAANFLYRI

SEQ ID NO: 142897 - protein, 15 aa, Borrelia burgdorferi B31
ENDPKIAANFLYRIA

SEQ ID NO: 142898 - protein, 9 aa, Borrelia burgdorferi B31
IAANFLYRI

SEQ ID NO: 142899 - protein, 15 aa, Borrelia burgdorferi B31
YENDPKIAANFLYRI

SEQ ID NO: 142900 - protein, 9 aa, Borrelia burgdorferi B31
DPKIAANFL

SEQ ID NO: 142901 - protein, 15 aa, Borrelia burgdorferi B31
KNQYDIQIAKITNEE

SEQ ID NO: 142902 - protein, 9 aa, Borrelia burgdorferi B31
YDIQIAKIT

SEQ ID NO: 142903 - protein, 15 aa, Borrelia burgdorferi B31
NQYDIQIAKITNEES

SEQ ID NO: 142904 - protein, 9 aa, Borrelia burgdorferi B31
YDIQIAKIT

SEQ ID NO: 142905 - protein, 15 aa, Borrelia burgdorferi B31
RKNQYDIQIAKITNE

SEQ ID NO: 142906 - protein, 9 aa, Borrelia burgdorferi B31
YDIQIAKIT

SEQ ID NO: 142907 - protein, 15 aa, Borrelia burgdorferi B31
NDPKIAANFLYRIAL

SEQ ID NO: 142908 - protein, 9 aa, Borrelia burgdorferi B31
IAANFLYRI

SEQ ID NO: 142909 - protein, 15 aa, Borrelia burgdorferi B31
EDRKNQYDIQIAKIT

SEQ ID NO: 142910 - protein, 9 aa, Borrelia burgdorferi B31
RKNQYDIQI

SEQ ID NO: 142911 - protein, 15 aa, Borrelia burgdorferi B31
DRKNQYDIQIAKITN

SEQ ID NO: 142912 - protein, 9 aa, Borrelia burgdorferi B31
YDIQIAKIT

SEQ ID NO: 142913 - protein, 15 aa, Borrelia burgdorferi B31
DPKIAANFLYRIALD

SEQ ID NO: 142914 - protein, 9 aa, Borrelia burgdorferi B31
IAANFLYRI

SEQ ID NO: 142915 - protein, 15 aa, Borrelia burgdorferi B31
AKLNIIKINIITMIL

SEQ ID NO: 142916 - protein, 9 aa, Borrelia burgdorferi B31
IKINIITMI

SEQ ID NO: 142917 - protein, 15 aa, Borrelia burgdorferi B31
ANFLYRIALDIQLKL

SEQ ID NO: 142918 - protein, 9 aa, Borrelia burgdorferi B31
YRIALDIQL

SEQ ID NO: 142919 - protein, 15 aa, Borrelia burgdorferi B31
AANFLYRIALDIQLK

SEQ ID NO: 142920 - protein, 9 aa, Borrelia burgdorferi B31
YRIALDIQL

SEQ ID NO: 142921 - protein, 15 aa, Borrelia burgdorferi B31
NFLYRIALDIQLKLE

SEQ ID NO: 142922 - protein, 9 aa, Borrelia burgdorferi B31
YRIALDIQL

SEQ ID NO: 142923 - protein, 15 aa, Borrelia burgdorferi B31
ITMILTLICISCAPF

SEQ ID NO: 142924 - protein, 9 aa, Borrelia burgdorferi B31
ITMILTLIC

SEQ ID NO: 142925 - protein, 15 aa, Borrelia burgdorferi B31
ENEKMLLKRFLLSSL

SEQ ID NO: 142926 - protein, 9 aa, Borrelia burgdorferi B31
MLLKRFLLS

SEQ ID NO: 142927 - protein, 15 aa, Borrelia burgdorferi B31
EKMLLKRFLLSSLDY

SEQ ID NO: 142928 - protein, 9 aa, Borrelia burgdorferi B31
MLLKRFLLS

SEQ ID NO: 142929 - protein, 15 aa, Borrelia burgdorferi B31
FLYRIALDIQLKLEK

SEQ ID NO: 142930 - protein, 9 aa, Borrelia burgdorferi B31
YRIALDIQL

SEQ ID NO: 142931 - protein, 15 aa, Borrelia burgdorferi B31
NEKMLLKRFLLSSLD

SEQ ID NO: 142932 - protein, 9 aa, Borrelia burgdorferi B31
MLLKRFLLS

SEQ ID NO: 142933 - protein, 15 aa, Borrelia burgdorferi B31
APFNKINPKANENTK

SEQ ID NO: 142934 - protein, 9 aa, Borrelia burgdorferi B31
INPKANENT

SEQ ID NO: 142935 - protein, 15 aa, Borrelia burgdorferi B31
CAPFNKINPKANENT

SEQ ID NO: 142936 - protein, 9 aa, Borrelia burgdorferi B31
FNKINPKAN

SEQ ID NO: 142937 - protein, 15 aa, Borrelia burgdorferi B31
TMILTLICISCAPFN

SEQ ID NO: 142938 - protein, 9 aa, Borrelia burgdorferi B31
LTLICISCA

SEQ ID NO: 142939 - protein, 15 aa, Borrelia burgdorferi B31
FNKINPKANENTKLK

SEQ ID NO: 142940 - protein, 9 aa, Borrelia burgdorferi B31
INPKANENT

SEQ ID NO: 142941 - protein, 15 aa, Borrelia burgdorferi B31
KIAANFLYRIALDIQ

SEQ ID NO: 142942 - protein, 9 aa, Borrelia burgdorferi B31
IAANFLYRI

SEQ ID NO: 142943 - protein, 15 aa, Borrelia burgdorferi B31
PFNKINPKANENTKL

SEQ ID NO: 142944 - protein, 9 aa, Borrelia burgdorferi B31
INPKANENT

SEQ ID NO: 142945 - protein, 15 aa, Borrelia burgdorferi B31
KMLLKRFLLSSLDYK

SEQ ID NO: 142946 - protein, 9 aa, Borrelia burgdorferi B31
LKRFLLSSL

SEQ ID NO: 142947 - protein, 15 aa, Borrelia burgdorferi B31
MLLKRFLLSSLDYKK

SEQ ID NO: 142948 - protein, 9 aa, Borrelia burgdorferi B31
LKRFLLSSL

SEQ ID NO: 142949 - protein, 15 aa, Borrelia burgdorferi B31
MILTLICISCAPFNK

SEQ ID NO: 142950 - protein, 9 aa, Borrelia burgdorferi B31
ICISCAPFN

SEQ ID NO: 142951 - protein, 15 aa, Borrelia burgdorferi B31
LQLQEKFKKTLNKTL

SEQ ID NO: 142952 - protein, 9 aa, Borrelia burgdorferi B31
KFKKTLNKT

SEQ ID NO: 142953 - protein, 15 aa, Borrelia burgdorferi B31
LQEKFKKTLNKTLED

SEQ ID NO: 142954 - protein, 9 aa, Borrelia burgdorferi B31
FKKTLNKTL

SEQ ID NO: 142955 - protein, 15 aa, Borrelia burgdorferi B31
QLQEKFKKTLNKTLE

SEQ ID NO: 142956 - protein, 9 aa, Borrelia burgdorferi B31
FKKTLNKTL

SEQ ID NO: 142957 - protein, 15 aa, Borrelia burgdorferi B31
NENEKMLLKRFLLSS

SEQ ID NO: 142958 - protein, 9 aa, Borrelia burgdorferi B31
MLLKRFLLS

SEQ ID NO: 142959 - protein, 15 aa, Borrelia burgdorferi B31
QEKFKKTLNKTLEDY

SEQ ID NO: 142960 - protein, 9 aa, Borrelia burgdorferi B31
FKKTLNKTL

SEQ ID NO: 142961 - protein, 15 aa, Borrelia burgdorferi B31
EDYRKNTNNIQENKV

SEQ ID NO: 142962 - protein, 9 aa, Borrelia burgdorferi B31
YRKNTNNIQ

SEQ ID NO: 142963 - protein, 15 aa, Borrelia burgdorferi B31
LEDYRKNTNNIQENK

SEQ ID NO: 142964 - protein, 9 aa, Borrelia burgdorferi B31
YRKNTNNIQ

SEQ ID NO: 142965 - protein, 15 aa, Borrelia burgdorferi B31
TLEDYRKNTNNIQEN

SEQ ID NO: 142966 - protein, 9 aa, Borrelia burgdorferi B31
YRKNTNNIQ

SEQ ID NO: 142967 - protein, 15 aa, Borrelia burgdorferi B31
KTLEDYRKNTNNIQE

SEQ ID NO: 142968 - protein, 9 aa, Borrelia burgdorferi B31
YRKNTNNIQ

SEQ ID NO: 142969 - protein, 15 aa, Borrelia burgdorferi B31
NKTLEDYRKNTNNIQ

SEQ ID NO: 142970 - protein, 9 aa, Borrelia burgdorferi B31
LEDYRKNTN

SEQ ID NO: 142971 - protein, 15 aa, Borrelia burgdorferi B31
YRKNTNNIQENKVLA

SEQ ID NO: 142972 - protein, 9 aa, Borrelia burgdorferi B31
YRKNTNNIQ

SEQ ID NO: 142973 - protein, 15 aa, Borrelia burgdorferi B31
DYRKNTNNIQENKVL

SEQ ID NO: 142974 - protein, 9 aa, Borrelia burgdorferi B31
YRKNTNNIQ

SEQ ID NO: 142975 - protein, 15 aa, Borrelia burgdorferi B31
EHFNKYYKDSDSLQS

SEQ ID NO: 142976 - protein, 9 aa, Borrelia burgdorferi B31
YYKDSDSLQ

SEQ ID NO: 142977 - protein, 15 aa, Borrelia burgdorferi B31
HFNKYYKDSDSLQSA

SEQ ID NO: 142978 - protein, 9 aa, Borrelia burgdorferi B31
YKDSDSLQS

SEQ ID NO: 142979 - protein, 15 aa, Borrelia burgdorferi B31
FNKYYKDSDSLQSAF

SEQ ID NO: 142980 - protein, 9 aa, Borrelia burgdorferi B31
YKDSDSLQS

SEQ ID NO: 142981 - protein, 15 aa, Borrelia burgdorferi B31
NKYYKDSDSLQSAFY

SEQ ID NO: 142982 - protein, 9 aa, Borrelia burgdorferi B31
YKDSDSLQS

SEQ ID NO: 142983 - protein, 15 aa, Borrelia burgdorferi B31
EKLINNYENDPKIAA

SEQ ID NO: 142984 - protein, 9 aa, Borrelia burgdorferi B31
LINNYENDP

SEQ ID NO: 142985 - protein, 15 aa, Borrelia burgdorferi B31
KLINNYENDPKIAAN

SEQ ID NO: 142986 - protein, 9 aa, Borrelia burgdorferi B31
YENDPKIAA

SEQ ID NO: 142987 - protein, 15 aa, Borrelia burgdorferi B31
LINNYENDPKIAANF

SEQ ID NO: 142988 - protein, 9 aa, Borrelia burgdorferi B31
YENDPKIAA

SEQ ID NO: 142989 - protein, 15 aa, Borrelia burgdorferi B31
NNYENDPKIAANFLY

SEQ ID NO: 142990 - protein, 9 aa, Borrelia burgdorferi B31
YENDPKIAA

SEQ ID NO: 142991 - protein, 15 aa, Borrelia burgdorferi B31
INNYENDPKIAANFL

SEQ ID NO: 142992 - protein, 9 aa, Borrelia burgdorferi B31
YENDPKIAA

SEQ ID NO: 142993 - protein, 15 aa, Borrelia burgdorferi B31
DIQIAKITNEESNLL

SEQ ID NO: 142994 - protein, 9 aa, Borrelia burgdorferi B31
IAKITNEES

SEQ ID NO: 142995 - protein, 15 aa, Borrelia burgdorferi B31
IQIAKITNEESNLLD

SEQ ID NO: 142996 - protein, 9 aa, Borrelia burgdorferi B31
ITNEESNLL

SEQ ID NO: 142997 - protein, 15 aa, Borrelia burgdorferi B31
IQIAKITNEESNLLD

SEQ ID NO: 142998 - protein, 9 aa, Borrelia burgdorferi B31
IAKITNEES

SEQ ID NO: 142999 - protein, 15 aa, Borrelia burgdorferi B31
DIQIAKITNEESNLL

SEQ ID NO: 143000 - protein, 9 aa, Borrelia burgdorferi B31
IAKITNEES

SEQ ID NO: 143001 - protein, 15 aa, Borrelia burgdorferi B31
NQYDIQIAKITNEES

SEQ ID NO: 143002 - protein, 9 aa, Borrelia burgdorferi B31
QIAKITNEE

SEQ ID NO: 143003 - protein, 15 aa, Borrelia burgdorferi B31
QYDIQIAKITNEESN

SEQ ID NO: 143004 - protein, 9 aa, Borrelia burgdorferi B31
IAKITNEES

SEQ ID NO: 143005 - protein, 15 aa, Borrelia burgdorferi B31
YDIQIAKITNEESNL

SEQ ID NO: 143006 - protein, 9 aa, Borrelia burgdorferi B31
IAKITNEES

SEQ ID NO: 143007 - protein, 15 aa, Borrelia burgdorferi B31
IIKINIITMILTLIC

SEQ ID NO: 143008 - protein, 9 aa, Borrelia burgdorferi B31
INIITMILT

SEQ ID NO: 143009 - protein, 15 aa, Borrelia burgdorferi B31
IKINIITMILTLICI

SEQ ID NO: 143010 - protein, 9 aa, Borrelia burgdorferi B31
ITMILTLIC

SEQ ID NO: 143011 - protein, 15 aa, Borrelia burgdorferi B31
QIAKITNEESNLLDT

SEQ ID NO: 143012 - protein, 9 aa, Borrelia burgdorferi B31
IAKITNEES

SEQ ID NO: 143013 - protein, 15 aa, Borrelia burgdorferi B31
KINIITMILTLICIS

SEQ ID NO: 143014 - protein, 9 aa, Borrelia burgdorferi B31
ITMILTLIC

SEQ ID NO: 143015 - protein, 15 aa, Borrelia burgdorferi B31
INIITMILTLICISC

SEQ ID NO: 143016 - protein, 9 aa, Borrelia burgdorferi B31
ITMILTLIC

SEQ ID NO: 143017 - protein, 15 aa, Borrelia burgdorferi B31
IAKITNEESNLLDTY

SEQ ID NO: 143018 - protein, 9 aa, Borrelia burgdorferi B31
IAKITNEES

SEQ ID NO: 143019 - protein, 15 aa, Borrelia burgdorferi B31
NIITMILTLICISCA

SEQ ID NO: 143020 - protein, 9 aa, Borrelia burgdorferi B31
ITMILTLIC

SEQ ID NO: 143021 - protein, 15 aa, Borrelia burgdorferi B31
LEDYRKNTNNIQENK

SEQ ID NO: 143022 - protein, 9 aa, Borrelia burgdorferi B31
YRKNTNNIQ

SEQ ID NO: 143023 - protein, 15 aa, Borrelia burgdorferi B31
EDYRKNTNNIQENKV

SEQ ID NO: 143024 - protein, 9 aa, Borrelia burgdorferi B31
YRKNTNNIQ

SEQ ID NO: 143025 - protein, 15 aa, Borrelia burgdorferi B31
TLEDYRKNTNNIQEN

SEQ ID NO: 143026 - protein, 9 aa, Borrelia burgdorferi B31
YRKNTNNIQ

SEQ ID NO: 143027 - protein, 15 aa, Borrelia burgdorferi B31
KTLEDYRKNTNNIQE

SEQ ID NO: 143028 - protein, 9 aa, Borrelia burgdorferi B31
YRKNTNNIQ

SEQ ID NO: 143029 - protein, 15 aa, Borrelia burgdorferi B31
EILEKLINNYENDPK

SEQ ID NO: 143030 - protein, 9 aa, Borrelia burgdorferi B31
LEKLINNYE

SEQ ID NO: 143031 - protein, 15 aa, Borrelia burgdorferi B31
EKLINNYENDPKIAA

SEQ ID NO: 143032 - protein, 9 aa, Borrelia burgdorferi B31
INNYENDPK

SEQ ID NO: 143033 - protein, 15 aa, Borrelia burgdorferi B31
KEILEKLINNYENDP

SEQ ID NO: 143034 - protein, 9 aa, Borrelia burgdorferi B31
LEKLINNYE

SEQ ID NO: 143035 - protein, 15 aa, Borrelia burgdorferi B31
LKEILEKLINNYEND

SEQ ID NO: 143036 - protein, 9 aa, Borrelia burgdorferi B31
LEKLINNYE

SEQ ID NO: 143037 - protein, 15 aa, Borrelia burgdorferi B31
TLKEILEKLINNYEN

SEQ ID NO: 143038 - protein, 9 aa, Borrelia burgdorferi B31
LEKLINNYE

SEQ ID NO: 143039 - protein, 15 aa, Borrelia burgdorferi B31
EHFNKYYKDSDSLQS

SEQ ID NO: 143040 - protein, 9 aa, Borrelia burgdorferi B31
FNKYYKDSD

SEQ ID NO: 143041 - protein, 15 aa, Borrelia burgdorferi B31
DEKFMGTTASELKAI

SEQ ID NO: 143042 - protein, 9 aa, Borrelia burgdorferi B31
FMGTTASEL

SEQ ID NO: 143043 - protein, 15 aa, Borrelia burgdorferi B31
EKFMGTTASELKAIG

SEQ ID NO: 143044 - protein, 9 aa, Borrelia burgdorferi B31
FMGTTASEL

SEQ ID NO: 143045 - protein, 15 aa, Borrelia burgdorferi B31
GASDEKFMGTTASEL

SEQ ID NO: 143046 - protein, 9 aa, Borrelia burgdorferi B31
KFMGTTASE

SEQ ID NO: 143047 - protein, 15 aa, Borrelia burgdorferi B31
ASDEKFMGTTASELK

SEQ ID NO: 143048 - protein, 9 aa, Borrelia burgdorferi B31
FMGTTASEL

SEQ ID NO: 143049 - protein, 15 aa, Borrelia burgdorferi B31
SDEKFMGTTASELKA

SEQ ID NO: 143050 - protein, 9 aa, Borrelia burgdorferi B31
FMGTTASEL

SEQ ID NO: 143051 - protein, 15 aa, Borrelia burgdorferi B31
KFMGTTASELKAIGK

SEQ ID NO: 143052 - protein, 9 aa, Borrelia burgdorferi B31
FMGTTASEL

SEQ ID NO: 143053 - protein, 15 aa, Borrelia burgdorferi B31
FMGTTASELKAIGKE

SEQ ID NO: 143054 - protein, 9 aa, Borrelia burgdorferi B31
FMGTTASEL

SEQ ID NO: 143055 - protein, 15 aa, Borrelia burgdorferi B31
LQLQEKFKKTLNKTL

SEQ ID NO: 143056 - protein, 9 aa, Borrelia burgdorferi B31
KFKKTLNKT

SEQ ID NO: 143057 - protein, 15 aa, Borrelia burgdorferi B31
QEKFKKTLNKTLEDY

SEQ ID NO: 143058 - protein, 9 aa, Borrelia burgdorferi B31
FKKTLNKTL

SEQ ID NO: 143059 - protein, 15 aa, Borrelia burgdorferi B31
QLQEKFKKTLNKTLE

SEQ ID NO: 143060 - protein, 9 aa, Borrelia burgdorferi B31
FKKTLNKTL

SEQ ID NO: 143061 - protein, 15 aa, Borrelia burgdorferi B31
LQEKFKKTLNKTLED

SEQ ID NO: 143062 - protein, 9 aa, Borrelia burgdorferi B31
FKKTLNKTL

SEQ ID NO: 143063 - protein, 15 aa, Borrelia burgdorferi B31
EKFKKTLNKTLEDYR

SEQ ID NO: 143064 - protein, 9 aa, Borrelia burgdorferi B31
FKKTLNKTL

SEQ ID NO: 143065 - protein, 15 aa, Borrelia burgdorferi B31
TKLKKNTRLKKPANP

SEQ ID NO: 143066 - protein, 9 aa, Borrelia burgdorferi B31
LKKNTRLKK

SEQ ID NO: 143067 - protein, 15 aa, Borrelia burgdorferi B31
ENTKLKKNTRLKKPA

SEQ ID NO: 143068 - protein, 9 aa, Borrelia burgdorferi B31
LKKNTRLKK

SEQ ID NO: 143069 - protein, 15 aa, Borrelia burgdorferi B31
NTKLKKNTRLKKPAN

SEQ ID NO: 143070 - protein, 9 aa, Borrelia burgdorferi B31
LKKNTRLKK

SEQ ID NO: 143071 - protein, 15 aa, Borrelia burgdorferi B31
ANENTKLKKNTRLKK

SEQ ID NO: 143072 - protein, 9 aa, Borrelia burgdorferi B31
ENTKLKKNT

SEQ ID NO: 143073 - protein, 15 aa, Borrelia burgdorferi B31
NENTKLKKNTRLKKP

SEQ ID NO: 143074 - protein, 9 aa, Borrelia burgdorferi B31
LKKNTRLKK

SEQ ID NO: 143075 - protein, 15 aa, Borrelia burgdorferi B31
ENTKLKKNTRLKKPA

SEQ ID NO: 143076 - protein, 9 aa, Borrelia burgdorferi B31
LKKNTRLKK

SEQ ID NO: 143077 - protein, 15 aa, Borrelia burgdorferi B31
ANENTKLKKNTRLKK

SEQ ID NO: 143078 - protein, 9 aa, Borrelia burgdorferi B31
ANENTKLKK

SEQ ID NO: 143079 - protein, 15 aa, Borrelia burgdorferi B31
NTKLKKNTRLKKPAN

SEQ ID NO: 143080 - protein, 9 aa, Borrelia burgdorferi B31
LKKNTRLKK

SEQ ID NO: 143081 - protein, 15 aa, Borrelia burgdorferi B31
NENTKLKKNTRLKKP

SEQ ID NO: 143082 - protein, 9 aa, Borrelia burgdorferi B31
LKKNTRLKK

SEQ ID NO: 143083 - protein, 15 aa, Borrelia burgdorferi B31
TKLKKNTRLKKPANP

SEQ ID NO: 143084 - protein, 9 aa, Borrelia burgdorferi B31
LKKNTRLKK

SEQ ID NO: 143085 - protein, 15 aa, Borrelia burgdorferi B31
KLKKNTRLKKPANPG

SEQ ID NO: 143086 - protein, 9 aa, Borrelia burgdorferi B31
LKKNTRLKK

SEQ ID NO: 143087 - protein, 15 aa, Borrelia burgdorferi B31
LKKNTRLKKPANPGE

SEQ ID NO: 143088 - protein, 9 aa, Borrelia burgdorferi B31
LKKNTRLKK

SEQ ID NO: 143089 - protein, 15 aa, Borrelia burgdorferi B31
KLNIIKINIITMILT

SEQ ID NO: 143090 - protein, 9 aa, Borrelia burgdorferi B31
IKINIITMI

SEQ ID NO: 143091 - protein, 15 aa, Borrelia burgdorferi B31
LNIIKINIITMILTL

SEQ ID NO: 143092 - protein, 9 aa, Borrelia burgdorferi B31
IKINIITMI

SEQ ID NO: 143093 - protein, 15 aa, Borrelia burgdorferi B31
NIIKINIITMILTLI

SEQ ID NO: 143094 - protein, 9 aa, Borrelia burgdorferi B31
IKINIITMI

SEQ ID NO: 143095 - protein, 15 aa, Borrelia burgdorferi B31
IIKINIITMILTLIC

SEQ ID NO: 143096 - protein, 9 aa, Borrelia burgdorferi B31
INIITMILT

SEQ ID NO: 143097 - protein, 15 aa, Borrelia burgdorferi B31
IKINIITMILTLICI

SEQ ID NO: 143098 - protein, 9 aa, Borrelia burgdorferi B31
INIITMILT

SEQ ID NO: 143099 - protein, 15 aa, Borrelia burgdorferi B31
AKLNIIKINIITMIL

SEQ ID NO: 143100 - protein, 9 aa, Borrelia burgdorferi B31
IKINIITMI

SEQ ID NO: 143101 - protein, 15 aa, Borrelia burgdorferi B31
KAKLNIIKINIITMI

SEQ ID NO: 143102 - protein, 9 aa, Borrelia burgdorferi B31
LNIIKINII

SEQ ID NO: 143103 - protein, 15 aa, Borrelia burgdorferi B31
KINIITMILTLICIS

SEQ ID NO: 143104 - protein, 9 aa, Borrelia burgdorferi B31
INIITMILT

SEQ ID NO: 143105 - protein, 15 aa, Borrelia burgdorferi B31
INIITMILTLICISC

SEQ ID NO: 143106 - protein, 9 aa, Borrelia burgdorferi B31
INIITMILT

SEQ ID NO: 143107 - protein, 15 aa, Borrelia burgdorferi B31
KKAKLNIIKINIITM

SEQ ID NO: 143108 - protein, 9 aa, Borrelia burgdorferi B31
LNIIKINII

SEQ ID NO: 143109 - protein, 15 aa, Borrelia burgdorferi B31
MKKAKLNIIKINIIT

SEQ ID NO: 143110 - protein, 9 aa, Borrelia burgdorferi B31
LNIIKINII

SEQ ID NO: 143111 - protein, 15 aa, Borrelia burgdorferi B31
NIITMILTLICISCA

SEQ ID NO: 143112 - protein, 9 aa, Borrelia burgdorferi B31
IITMILTLI

SEQ ID NO: 143113 - protein, 15 aa, Borrelia burgdorferi B31
IITMILTLICISCAP

SEQ ID NO: 143114 - protein, 9 aa, Borrelia burgdorferi B31
IITMILTLI

SEQ ID NO: 143115 - protein, 15 aa, Borrelia burgdorferi B31
ANENTKLKKNTRLKK

SEQ ID NO: 143116 - protein, 9 aa, Borrelia burgdorferi B31
NTKLKKNTR

SEQ ID NO: 143117 - protein, 15 aa, Borrelia burgdorferi B31
NENTKLKKNTRLKKP

SEQ ID NO: 143118 - protein, 9 aa, Borrelia burgdorferi B31
LKKNTRLKK

SEQ ID NO: 143119 - protein, 15 aa, Borrelia burgdorferi B31
ENTKLKKNTRLKKPA

SEQ ID NO: 143120 - protein, 9 aa, Borrelia burgdorferi B31
LKKNTRLKK

SEQ ID NO: 143121 - protein, 15 aa, Borrelia burgdorferi B31
NTKLKKNTRLKKPAN

SEQ ID NO: 143122 - protein, 9 aa, Borrelia burgdorferi B31
LKKNTRLKK

SEQ ID NO: 143123 - protein, 15 aa, Borrelia burgdorferi B31
TKLKKNTRLKKPANP

SEQ ID NO: 143124 - protein, 9 aa, Borrelia burgdorferi B31
LKKNTRLKK

SEQ ID NO: 143125 - protein, 15 aa, Borrelia burgdorferi B31
RKNQYDIQIAKITNE

SEQ ID NO: 143126 - protein, 9 aa, Borrelia burgdorferi B31
YDIQIAKIT

SEQ ID NO: 143127 - protein, 15 aa, Borrelia burgdorferi B31
NQYDIQIAKITNEES

SEQ ID NO: 143128 - protein, 9 aa, Borrelia burgdorferi B31
IQIAKITNE

SEQ ID NO: 143129 - protein, 15 aa, Borrelia burgdorferi B31
KNQYDIQIAKITNEE

SEQ ID NO: 143130 - protein, 9 aa, Borrelia burgdorferi B31
IQIAKITNE

SEQ ID NO: 143131 - protein, 15 aa, Borrelia burgdorferi B31
KMLLKRFLLSSLDYK

SEQ ID NO: 143132 - protein, 9 aa, Borrelia burgdorferi B31
LKRFLLSSL

SEQ ID NO: 143133 - protein, 15 aa, Borrelia burgdorferi B31
MLLKRFLLSSLDYKK

SEQ ID NO: 143134 - protein, 9 aa, Borrelia burgdorferi B31
LKRFLLSSL

SEQ ID NO: 143135 - protein, 15 aa, Borrelia burgdorferi B31
ENEKMLLKRFLLSSL

SEQ ID NO: 143136 - protein, 9 aa, Borrelia burgdorferi B31
MLLKRFLLS

SEQ ID NO: 143137 - protein, 15 aa, Borrelia burgdorferi B31
NEKMLLKRFLLSSLD

SEQ ID NO: 143138 - protein, 9 aa, Borrelia burgdorferi B31
LKRFLLSSL

SEQ ID NO: 143139 - protein, 15 aa, Borrelia burgdorferi B31
EKMLLKRFLLSSLDY

SEQ ID NO: 143140 - protein, 9 aa, Borrelia burgdorferi B31
LKRFLLSSL

SEQ ID NO: 143141 - protein, 15 aa, Borrelia burgdorferi B31
LLKRFLLSSLDYKKE

SEQ ID NO: 143142 - protein, 9 aa, Borrelia burgdorferi B31
LKRFLLSSL

SEQ ID NO: 143143 - protein, 15 aa, Borrelia burgdorferi B31
LKRFLLSSLDYKKEN

SEQ ID NO: 143144 - protein, 9 aa, Borrelia burgdorferi B31
LKRFLLSSL

SEQ ID NO: 143145 - protein, 15 aa, Borrelia burgdorferi B31
NENEKMLLKRFLLSS

SEQ ID NO: 143146 - protein, 9 aa, Borrelia burgdorferi B31
MLLKRFLLS

SEQ ID NO: 143147 - protein, 15 aa, Borrelia burgdorferi B31
INIITMILTLICISC

SEQ ID NO: 143148 - protein, 9 aa, Borrelia burgdorferi B31
IITMILTLI

SEQ ID NO: 143149 - protein, 15 aa, Borrelia burgdorferi B31
NFLYRIALDIQLKLE

SEQ ID NO: 143150 - protein, 9 aa, Borrelia burgdorferi B31
LYRIALDIQ

SEQ ID NO: 143151 - protein, 15 aa, Borrelia burgdorferi B31
ANFLYRIALDIQLKL

SEQ ID NO: 143152 - protein, 9 aa, Borrelia burgdorferi B31
LYRIALDIQ

SEQ ID NO: 143153 - protein, 15 aa, Borrelia burgdorferi B31
IAANFLYRIALDIQL

SEQ ID NO: 143154 - protein, 9 aa, Borrelia burgdorferi B31
LYRIALDIQ

SEQ ID NO: 143155 - protein, 15 aa, Borrelia burgdorferi B31
AANFLYRIALDIQLK

SEQ ID NO: 143156 - protein, 9 aa, Borrelia burgdorferi B31
LYRIALDIQ

SEQ ID NO: 143157 - protein, 15 aa, Borrelia burgdorferi B31
KIAANFLYRIALDIQ

SEQ ID NO: 143158 - protein, 9 aa, Borrelia burgdorferi B31
FLYRIALDI

SEQ ID NO: 143159 - protein, 15 aa, Borrelia burgdorferi B31
LYRIALDIQLKLEKH

SEQ ID NO: 143160 - protein, 9 aa, Borrelia burgdorferi B31
LYRIALDIQ

SEQ ID NO: 143161 - protein, 15 aa, Borrelia burgdorferi B31
FLYRIALDIQLKLEK

SEQ ID NO: 143162 - protein, 9 aa, Borrelia burgdorferi B31
LYRIALDIQ

SEQ ID NO: 143163 - protein, 15 aa, Borrelia burgdorferi B31
NKTLEDYRKNTNNIQ

SEQ ID NO: 143164 - protein, 9 aa, Borrelia burgdorferi B31
LEDYRKNTN

SEQ ID NO: 143165 - protein, 15 aa, Borrelia burgdorferi B31
KTLEDYRKNTNNIQE

SEQ ID NO: 143166 - protein, 9 aa, Borrelia burgdorferi B31
YRKNTNNIQ

SEQ ID NO: 143167 - protein, 15 aa, Borrelia burgdorferi B31
APFNKINPKANENTK

SEQ ID NO: 143168 - protein, 9 aa, Borrelia burgdorferi B31
FNKINPKAN

SEQ ID NO: 143169 - protein, 15 aa, Borrelia burgdorferi B31
CAPFNKINPKANENT

SEQ ID NO: 143170 - protein, 9 aa, Borrelia burgdorferi B31
FNKINPKAN

SEQ ID NO: 143171 - protein, 15 aa, Borrelia burgdorferi B31
CISCAPFNKINPKAN

SEQ ID NO: 143172 - protein, 9 aa, Borrelia burgdorferi B31
ISCAPFNKI

SEQ ID NO: 143173 - protein, 15 aa, Borrelia burgdorferi B31
ISCAPFNKINPKANE

SEQ ID NO: 143174 - protein, 9 aa, Borrelia burgdorferi B31
FNKINPKAN

SEQ ID NO: 143175 - protein, 15 aa, Borrelia burgdorferi B31
SCAPFNKINPKANEN

SEQ ID NO: 143176 - protein, 9 aa, Borrelia burgdorferi B31
FNKINPKAN

SEQ ID NO: 143177 - protein, 15 aa, Borrelia burgdorferi B31
FNKINPKANENTKLK

SEQ ID NO: 143178 - protein, 9 aa, Borrelia burgdorferi B31
FNKINPKAN

SEQ ID NO: 143179 - protein, 15 aa, Borrelia garinii PBi
KLNIIKLNILTTTLT

SEQ ID NO: 143180 - protein, 9 aa, Borrelia garinii PBi
KLNILTTTL

SEQ ID NO: 143181 - protein, 15 aa, Borrelia garinii PBi
LNIIKLNILTTTLTL

SEQ ID NO: 143182 - protein, 9 aa, Borrelia garinii PBi
LNILTTTLT

SEQ ID NO: 143183 - protein, 15 aa, Borrelia garinii PBi
NIIKLNILTTTLTLI

SEQ ID NO: 143184 - protein, 9 aa, Borrelia garinii PBi
LNILTTTLT

SEQ ID NO: 143185 - protein, 15 aa, Borrelia garinii PBi
IIKLNILTTTLTLIC

SEQ ID NO: 143186 - protein, 9 aa, Borrelia garinii PBi
LNILTTTLT

SEQ ID NO: 143187 - protein, 15 aa, Borrelia garinii PBi
IKLNILTTTLTLICI

SEQ ID NO: 143188 - protein, 9 aa, Borrelia garinii PBi
LNILTTTLT

SEQ ID NO: 143189 - protein, 15 aa, Borrelia garinii PBi
KLNILTTTLTLICIS

SEQ ID NO: 143190 - protein, 9 aa, Borrelia garinii PBi
LNILTTTLT

SEQ ID NO: 143191 - protein, 15 aa, Borrelia garinii PBi
LNILTTTLTLICISC

SEQ ID NO: 143192 - protein, 9 aa, Borrelia garinii PBi
LNILTTTLT

SEQ ID NO: 143193 - protein, 15 aa, Borrelia garinii PBi
EPLREKYPEATASKL

SEQ ID NO: 143194 - protein, 9 aa, Borrelia garinii PBi
LREKYPEAT

SEQ ID NO: 143195 - protein, 15 aa, Borrelia garinii PBi
DEKMQMKKIIYSSLN

SEQ ID NO: 143196 - protein, 9 aa, Borrelia garinii PBi
MQMKKIIYS

SEQ ID NO: 143197 - protein, 15 aa, Borrelia garinii PBi
EDEKMQMKKIIYSSL

SEQ ID NO: 143198 - protein, 9 aa, Borrelia garinii PBi
MQMKKIIYS

SEQ ID NO: 143199 - protein, 15 aa, Borrelia garinii PBi
EKMQMKKIIYSSLNY

SEQ ID NO: 143200 - protein, 9 aa, Borrelia garinii PBi
MQMKKIIYS

SEQ ID NO: 143201 - protein, 15 aa, Borrelia garinii PBi
TKLNIIKLNILTTTL

SEQ ID NO: 143202 - protein, 9 aa, Borrelia garinii PBi
IKLNILTTT

SEQ ID NO: 143203 - protein, 15 aa, Borrelia garinii PBi
PEDEKMQMKKIIYSS

SEQ ID NO: 143204 - protein, 9 aa, Borrelia garinii PBi
MQMKKIIYS

SEQ ID NO: 143205 - protein, 15 aa, Borrelia garinii PBi
LPEDEKMQMKKIIYS

SEQ ID NO: 143206 - protein, 9 aa, Borrelia garinii PBi
DEKMQMKKI

SEQ ID NO: 143207 - protein, 15 aa, Borrelia garinii PBi
IKENFKKALNKTIDA

SEQ ID NO: 143208 - protein, 9 aa, Borrelia garinii PBi
FKKALNKTI

SEQ ID NO: 143209 - protein, 15 aa, Borrelia garinii PBi
LREKYPEATASKLET

SEQ ID NO: 143210 - protein, 9 aa, Borrelia garinii PBi
YPEATASKL

SEQ ID NO: 143211 - protein, 15 aa, Borrelia garinii PBi
KTKLNIIKLNILTTT

SEQ ID NO: 143212 - protein, 9 aa, Borrelia garinii PBi
IIKLNILTT

SEQ ID NO: 143213 - protein, 15 aa, Borrelia garinii PBi
KENFKKALNKTIDAY

SEQ ID NO: 143214 - protein, 9 aa, Borrelia garinii PBi
FKKALNKTI

SEQ ID NO: 143215 - protein, 15 aa, Borrelia garinii PBi
PLREKYPEATASKLE

SEQ ID NO: 143216 - protein, 9 aa, Borrelia garinii PBi
YPEATASKL

SEQ ID NO: 143217 - protein, 15 aa, Borrelia garinii PBi
KLETTLKILEAQKEK

SEQ ID NO: 143218 - protein, 9 aa, Borrelia garinii PBi
LKILEAQKE

SEQ ID NO: 143219 - protein, 15 aa, Borrelia garinii PBi
KIKENFKKALNKTID

SEQ ID NO: 143220 - protein, 9 aa, Borrelia garinii PBi
FKKALNKTI

SEQ ID NO: 143221 - protein, 15 aa, Borrelia garinii PBi
SKLETTLKILEAQKE

SEQ ID NO: 143222 - protein, 9 aa, Borrelia garinii PBi
ETTLKILEA

SEQ ID NO: 143223 - protein, 15 aa, Borrelia garinii PBi
LKIKENFKKALNKTI

SEQ ID NO: 143224 - protein, 9 aa, Borrelia garinii PBi
NFKKALNKT

SEQ ID NO: 143225 - protein, 15 aa, Borrelia garinii PBi
ETTLKILEAQKEKEN

SEQ ID NO: 143226 - protein, 9 aa, Borrelia garinii PBi
LKILEAQKE

SEQ ID NO: 143227 - protein, 15 aa, Borrelia garinii PBi
LETTLKILEAQKEKE

SEQ ID NO: 143228 - protein, 9 aa, Borrelia garinii PBi
LKILEAQKE

SEQ ID NO: 143229 - protein, 15 aa, Borrelia garinii PBi
NILTTTLTLICISCA

SEQ ID NO: 143230 - protein, 9 aa, Borrelia garinii PBi
LTTTLTLIC

SEQ ID NO: 143231 - protein, 15 aa, Borrelia garinii PBi
TTLKILEAQKEKENI

SEQ ID NO: 143232 - protein, 9 aa, Borrelia garinii PBi
LKILEAQKE

SEQ ID NO: 143233 - protein, 15 aa, Borrelia garinii PBi
ENFKKALNKTIDAYN

SEQ ID NO: 143234 - protein, 9 aa, Borrelia garinii PBi
FKKALNKTI

SEQ ID NO: 143235 - protein, 15 aa, Borrelia garinii PBi
MQMKKIIYSSLNYET

SEQ ID NO: 143236 - protein, 9 aa, Borrelia garinii PBi
MQMKKIIYS

SEQ ID NO: 143237 - protein, 15 aa, Borrelia garinii PBi
ILTTTLTLICISCAV

SEQ ID NO: 143238 - protein, 9 aa, Borrelia garinii PBi
LTLICISCA

SEQ ID NO: 143239 - protein, 15 aa, Borrelia garinii PBi
LEPLREKYPEATASK

SEQ ID NO: 143240 - protein, 9 aa, Borrelia garinii PBi
LREKYPEAT

SEQ ID NO: 143241 - protein, 15 aa, Borrelia garinii PBi
REKYPEATASKLETT

SEQ ID NO: 143242 - protein, 9 aa, Borrelia garinii PBi
YPEATASKL

SEQ ID NO: 143243 - protein, 15 aa, Borrelia garinii PBi
EKYPEATASKLETTL

SEQ ID NO: 143244 - protein, 9 aa, Borrelia garinii PBi
YPEATASKL

SEQ ID NO: 143245 - protein, 15 aa, Borrelia garinii PBi
KMQMKKIIYSSLNYE

SEQ ID NO: 143246 - protein, 9 aa, Borrelia garinii PBi
MQMKKIIYS

SEQ ID NO: 143247 - protein, 15 aa, Borrelia garinii PBi
DLEPLREKYPEATAS

SEQ ID NO: 143248 - protein, 9 aa, Borrelia garinii PBi
LREKYPEAT

SEQ ID NO: 143249 - protein, 15 aa, Borrelia garinii PBi
KDLEPLREKYPEATA

SEQ ID NO: 143250 - protein, 9 aa, Borrelia garinii PBi
LREKYPEAT

SEQ ID NO: 143251 - protein, 15 aa, Borrelia garinii PBi
NKDLEPLREKYPEAT

SEQ ID NO: 143252 - protein, 9 aa, Borrelia garinii PBi
LEPLREKYP

SEQ ID NO: 143253 - protein, 15 aa, Borrelia garinii PBi
LTTTLTLICISCAVN

SEQ ID NO: 143254 - protein, 9 aa, Borrelia garinii PBi
LTLICISCA

SEQ ID NO: 143255 - protein, 15 aa, Borrelia garinii PBi
KKTKLNIIKLNILTT

SEQ ID NO: 143256 - protein, 9 aa, Borrelia garinii PBi
LNIIKLNIL

SEQ ID NO: 143257 - protein, 15 aa, Borrelia garinii PBi
TTTLTLICISCAVNK

SEQ ID NO: 143258 - protein, 9 aa, Borrelia garinii PBi
LTLICISCA

SEQ ID NO: 143259 - protein, 15 aa, Borrelia garinii PBi
NFKKALNKTIDAYNQ

SEQ ID NO: 143260 - protein, 9 aa, Borrelia garinii PBi
FKKALNKTI

SEQ ID NO: 143261 - protein, 15 aa, Borrelia garinii PBi
QEILEKLDKNLQHKK

SEQ ID NO: 143262 - protein, 9 aa, Borrelia garinii PBi
LEKLDKNLQ

SEQ ID NO: 143263 - protein, 15 aa, Borrelia garinii PBi
EILEKLDKNLQHKKI

SEQ ID NO: 143264 - protein, 9 aa, Borrelia garinii PBi
LEKLDKNLQ

SEQ ID NO: 143265 - protein, 15 aa, Borrelia garinii PBi
QIDFLKTFKTDPHDS

SEQ ID NO: 143266 - protein, 9 aa, Borrelia garinii PBi
LKTFKTDPH

SEQ ID NO: 143267 - protein, 15 aa, Borrelia garinii PBi
LQEILEKLDKNLQHK

SEQ ID NO: 143268 - protein, 9 aa, Borrelia garinii PBi
LEKLDKNLQ

SEQ ID NO: 143269 - protein, 15 aa, Borrelia garinii PBi
IIKLNILTTTLTLIC

SEQ ID NO: 143270 - protein, 9 aa, Borrelia garinii PBi
LNILTTTLT

SEQ ID NO: 143271 - protein, 15 aa, Borrelia garinii PBi
NTQIDFLKTFKTDPH

SEQ ID NO: 143272 - protein, 9 aa, Borrelia garinii PBi
FLKTFKTDP

SEQ ID NO: 143273 - protein, 15 aa, Borrelia garinii PBi
IDFLKTFKTDPHDSL

SEQ ID NO: 143274 - protein, 9 aa, Borrelia garinii PBi
LKTFKTDPH

SEQ ID NO: 143275 - protein, 15 aa, Borrelia garinii PBi
ILQEILEKLDKNLQH

SEQ ID NO: 143276 - protein, 9 aa, Borrelia garinii PBi
LEKLDKNLQ

SEQ ID NO: 143277 - protein, 15 aa, Borrelia garinii PBi
TQIDFLKTFKTDPHD

SEQ ID NO: 143278 - protein, 9 aa, Borrelia garinii PBi
LKTFKTDPH

SEQ ID NO: 143279 - protein, 15 aa, Borrelia garinii PBi
IKLNILTTTLTLICI

SEQ ID NO: 143280 - protein, 9 aa, Borrelia garinii PBi
LNILTTTLT

SEQ ID NO: 143281 - protein, 15 aa, Borrelia garinii PBi
KILQEILEKLDKNLQ

SEQ ID NO: 143282 - protein, 9 aa, Borrelia garinii PBi
EILEKLDKN

SEQ ID NO: 143283 - protein, 15 aa, Borrelia garinii PBi
KLNIIKLNILTTTLT

SEQ ID NO: 143284 - protein, 9 aa, Borrelia garinii PBi
IIKLNILTT

SEQ ID NO: 143285 - protein, 15 aa, Borrelia garinii PBi
LNIIKLNILTTTLTL

SEQ ID NO: 143286 - protein, 9 aa, Borrelia garinii PBi
LNILTTTLT

SEQ ID NO: 143287 - protein, 15 aa, Borrelia garinii PBi
NIIKLNILTTTLTLI

SEQ ID NO: 143288 - protein, 9 aa, Borrelia garinii PBi
LNILTTTLT

SEQ ID NO: 143289 - protein, 15 aa, Borrelia garinii PBi
DFLKTFKTDPHDSLP

SEQ ID NO: 143290 - protein, 9 aa, Borrelia garinii PBi
LKTFKTDPH

SEQ ID NO: 143291 - protein, 15 aa, Borrelia garinii PBi
INENYKEFNSLKPIY

SEQ ID NO: 143292 - protein, 9 aa, Borrelia garinii PBi
YKEFNSLKP

SEQ ID NO: 143293 - protein, 15 aa, Borrelia garinii PBi
IDFLKTFKTDPHDSL

SEQ ID NO: 143294 - protein, 9 aa, Borrelia garinii PBi
FLKTFKTDP

SEQ ID NO: 143295 - protein, 15 aa, Borrelia garinii PBi
NTQIDFLKTFKTDPH

SEQ ID NO: 143296 - protein, 9 aa, Borrelia garinii PBi
FLKTFKTDP

SEQ ID NO: 143297 - protein, 15 aa, Borrelia garinii PBi
TQIDFLKTFKTDPHD

SEQ ID NO: 143298 - protein, 9 aa, Borrelia garinii PBi
FLKTFKTDP

SEQ ID NO: 143299 - protein, 15 aa, Borrelia garinii PBi
QIDFLKTFKTDPHDS

SEQ ID NO: 143300 - protein, 9 aa, Borrelia garinii PBi
FLKTFKTDP

SEQ ID NO: 143301 - protein, 15 aa, Borrelia garinii PBi
DNTQIDFLKTFKTDP

SEQ ID NO: 143302 - protein, 9 aa, Borrelia garinii PBi
IDFLKTFKT

SEQ ID NO: 143303 - protein, 15 aa, Borrelia garinii PBi
DFLKTFKTDPHDSLP

SEQ ID NO: 143304 - protein, 9 aa, Borrelia garinii PBi
FLKTFKTDP

SEQ ID NO: 143305 - protein, 15 aa, Borrelia garinii PBi
IIKLNILTTTLTLIC

SEQ ID NO: 143306 - protein, 9 aa, Borrelia garinii PBi
KLNILTTTL

SEQ ID NO: 143307 - protein, 15 aa, Borrelia garinii PBi
FLKTFKTDPHDSLPE

SEQ ID NO: 143308 - protein, 9 aa, Borrelia garinii PBi
FLKTFKTDP

SEQ ID NO: 143309 - protein, 15 aa, Borrelia garinii PBi
NIIKLNILTTTLTLI

SEQ ID NO: 143310 - protein, 9 aa, Borrelia garinii PBi
KLNILTTTL

SEQ ID NO: 143311 - protein, 15 aa, Borrelia garinii PBi
KLNIIKLNILTTTLT

SEQ ID NO: 143312 - protein, 9 aa, Borrelia garinii PBi
KLNILTTTL

SEQ ID NO: 143313 - protein, 15 aa, Borrelia garinii PBi
LNIIKLNILTTTLTL

SEQ ID NO: 143314 - protein, 9 aa, Borrelia garinii PBi
KLNILTTTL

SEQ ID NO: 143315 - protein, 15 aa, Borrelia garinii PBi
KHINENYKEFNSLKP

SEQ ID NO: 143316 - protein, 9 aa, Borrelia garinii PBi
NYKEFNSLK

SEQ ID NO: 143317 - protein, 15 aa, Borrelia garinii PBi
HINENYKEFNSLKPI

SEQ ID NO: 143318 - protein, 9 aa, Borrelia garinii PBi
YKEFNSLKP

SEQ ID NO: 143319 - protein, 15 aa, Borrelia garinii PBi
INENYKEFNSLKPIY

SEQ ID NO: 143320 - protein, 9 aa, Borrelia garinii PBi
YKEFNSLKP

SEQ ID NO: 143321 - protein, 15 aa, Borrelia garinii PBi
ENIKNFVNKFQDLEP

SEQ ID NO: 143322 - protein, 9 aa, Borrelia garinii PBi
IKNFVNKFQ

SEQ ID NO: 143323 - protein, 15 aa, Borrelia garinii PBi
MQMKKIIYSSLNYET

SEQ ID NO: 143324 - protein, 9 aa, Borrelia garinii PBi
KKIIYSSLN

SEQ ID NO: 143325 - protein, 15 aa, Borrelia garinii PBi
IIKLNILTTTLTLIC

SEQ ID NO: 143326 - protein, 9 aa, Borrelia garinii PBi
ILTTTLTLI

SEQ ID NO: 143327 - protein, 15 aa, Borrelia garinii PBi
IKLNILTTTLTLICI

SEQ ID NO: 143328 - protein, 9 aa, Borrelia garinii PBi
ILTTTLTLI

SEQ ID NO: 143329 - protein, 15 aa, Borrelia garinii PBi
NIIKLNILTTTLTLI

SEQ ID NO: 143330 - protein, 9 aa, Borrelia garinii PBi
LNILTTTLT

SEQ ID NO: 143331 - protein, 15 aa, Borrelia garinii PBi
EPLREKYPEATASKL

SEQ ID NO: 143332 - protein, 9 aa, Borrelia garinii PBi
LREKYPEAT

SEQ ID NO: 143333 - protein, 15 aa, Borrelia garinii PBi
PLREKYPEATASKLE

SEQ ID NO: 143334 - protein, 9 aa, Borrelia garinii PBi
YPEATASKL

SEQ ID NO: 143335 - protein, 15 aa, Borrelia garinii PBi
LREKYPEATASKLET

SEQ ID NO: 143336 - protein, 9 aa, Borrelia garinii PBi
YPEATASKL

SEQ ID NO: 143337 - protein, 15 aa, Borrelia garinii PBi
REKYPEATASKLETT

SEQ ID NO: 143338 - protein, 9 aa, Borrelia garinii PBi
YPEATASKL

SEQ ID NO: 143339 - protein, 15 aa, Borrelia garinii PBi
EKYPEATASKLETTL

SEQ ID NO: 143340 - protein, 9 aa, Borrelia garinii PBi
YPEATASKL

SEQ ID NO: 143341 - protein, 15 aa, Borrelia garinii PBi
KLNILTTTLTLICIS

SEQ ID NO: 143342 - protein, 9 aa, Borrelia garinii PBi
ILTTTLTLI

SEQ ID NO: 143343 - protein, 15 aa, Borrelia garinii PBi
LKIKENFKKALNKTI

SEQ ID NO: 143344 - protein, 9 aa, Borrelia garinii PBi
IKENFKKAL

SEQ ID NO: 143345 - protein, 15 aa, Borrelia garinii PBi
KENFKKALNKTIDAY

SEQ ID NO: 143346 - protein, 9 aa, Borrelia garinii PBi
FKKALNKTI

SEQ ID NO: 143347 - protein, 15 aa, Borrelia garinii PBi
IKENFKKALNKTIDA

SEQ ID NO: 143348 - protein, 9 aa, Borrelia garinii PBi
FKKALNKTI

SEQ ID NO: 143349 - protein, 15 aa, Borrelia garinii PBi
KIKENFKKALNKTID

SEQ ID NO: 143350 - protein, 9 aa, Borrelia garinii PBi
FKKALNKTI

SEQ ID NO: 143351 - protein, 15 aa, Borrelia garinii PBi
ENFKKALNKTIDAYN

SEQ ID NO: 143352 - protein, 9 aa, Borrelia garinii PBi
FKKALNKTI

SEQ ID NO: 143353 - protein, 15 aa, Borrelia garinii PBi
KLNIIKLNILTTTLT

SEQ ID NO: 143354 - protein, 9 aa, Borrelia garinii PBi
IKLNILTTT

SEQ ID NO: 143355 - protein, 15 aa, Borrelia garinii PBi
LNIIKLNILTTTLTL

SEQ ID NO: 143356 - protein, 9 aa, Borrelia garinii PBi
LNILTTTLT

SEQ ID NO: 143357 - protein, 15 aa, Borrelia garinii PBi
NIIKLNILTTTLTLI

SEQ ID NO: 143358 - protein, 9 aa, Borrelia garinii PBi
LNILTTTLT

SEQ ID NO: 143359 - protein, 15 aa, Borrelia garinii PBi
IIKLNILTTTLTLIC

SEQ ID NO: 143360 - protein, 9 aa, Borrelia garinii PBi
LNILTTTLT

SEQ ID NO: 143361 - protein, 15 aa, Borrelia garinii PBi
IKLNILTTTLTLICI

SEQ ID NO: 143362 - protein, 9 aa, Borrelia garinii PBi
LNILTTTLT

SEQ ID NO: 143363 - protein, 15 aa, Borrelia garinii PBi
KTKLNIIKLNILTTT

SEQ ID NO: 143364 - protein, 9 aa, Borrelia garinii PBi
LNIIKLNIL

SEQ ID NO: 143365 - protein, 15 aa, Borrelia garinii PBi
TKLNIIKLNILTTTL

SEQ ID NO: 143366 - protein, 9 aa, Borrelia garinii PBi
IKLNILTTT

SEQ ID NO: 143367 - protein, 15 aa, Borrelia garinii PBi
KLNILTTTLTLICIS

SEQ ID NO: 143368 - protein, 9 aa, Borrelia garinii PBi
LNILTTTLT

SEQ ID NO: 143369 - protein, 15 aa, Borrelia garinii PBi
LNILTTTLTLICISC

SEQ ID NO: 143370 - protein, 9 aa, Borrelia garinii PBi
LNILTTTLT

SEQ ID NO: 143371 - protein, 15 aa, Borrelia garinii PBi
KKTKLNIIKLNILTT

SEQ ID NO: 143372 - protein, 9 aa, Borrelia garinii PBi
LNIIKLNIL

SEQ ID NO: 143373 - protein, 15 aa, Borrelia garinii PBi
MKKTKLNIIKLNILT

SEQ ID NO: 143374 - protein, 9 aa, Borrelia garinii PBi
LNIIKLNIL

SEQ ID NO: 143375 - protein, 15 aa, Borrelia garinii PBi
QSRLDIISKVIKNPI

SEQ ID NO: 143376 - protein, 9 aa, Borrelia garinii PBi
LDIISKVIK

SEQ ID NO: 143377 - protein, 15 aa, Borrelia garinii PBi
SRLDIISKVIKNPIK

SEQ ID NO: 143378 - protein, 9 aa, Borrelia garinii PBi
ISKVIKNPI

SEQ ID NO: 143379 - protein, 15 aa, Borrelia garinii PBi
RLDIISKVIKNPIKD

SEQ ID NO: 143380 - protein, 9 aa, Borrelia garinii PBi
ISKVIKNPI

SEQ ID NO: 143381 - protein, 15 aa, Borrelia garinii PBi
DIISKVIKNPIKDEL

SEQ ID NO: 143382 - protein, 9 aa, Borrelia garinii PBi
ISKVIKNPI

SEQ ID NO: 143383 - protein, 15 aa, Borrelia garinii PBi
LDIISKVIKNPIKDE

SEQ ID NO: 143384 - protein, 9 aa, Borrelia garinii PBi
ISKVIKNPI

SEQ ID NO: 143385 - protein, 15 aa, Borrelia garinii PBi
IISKVIKNPIKDELQ

SEQ ID NO: 143386 - protein, 9 aa, Borrelia garinii PBi
IKNPIKDEL

SEQ ID NO: 143387 - protein, 15 aa, Borrelia garinii PBi
ISKVIKNPIKDELQI

SEQ ID NO: 143388 - protein, 9 aa, Borrelia garinii PBi
IKNPIKDEL

SEQ ID NO: 143389 - protein, 15 aa, Borrelia garinii PBi
YDIPIIIQSRLDIIS

SEQ ID NO: 143390 - protein, 9 aa, Borrelia garinii PBi
IPIIIQSRL

SEQ ID NO: 143391 - protein, 15 aa, Borrelia garinii PBi
FIYDIPIIIQSRLDI

SEQ ID NO: 143392 - protein, 9 aa, Borrelia garinii PBi
IPIIIQSRL

SEQ ID NO: 143393 - protein, 15 aa, Borrelia garinii PBi
IYDIPIIIQSRLDII

SEQ ID NO: 143394 - protein, 9 aa, Borrelia garinii PBi
IPIIIQSRL

SEQ ID NO: 143395 - protein, 15 aa, Borrelia garinii PBi
IIIQSRLDIISKVIK

SEQ ID NO: 143396 - protein, 9 aa, Borrelia garinii PBi
IIIQSRLDI

SEQ ID NO: 143397 - protein, 15 aa, Borrelia garinii PBi
IPIIIQSRLDIISKV

SEQ ID NO: 143398 - protein, 9 aa, Borrelia garinii PBi
IIIQSRLDI

SEQ ID NO: 143399 - protein, 15 aa, Borrelia garinii PBi
IQSRLDIISKVIKNP

SEQ ID NO: 143400 - protein, 9 aa, Borrelia garinii PBi
LDIISKVIK

SEQ ID NO: 143401 - protein, 15 aa, Borrelia garinii PBi
EDEKMQMKKIIYSSL

SEQ ID NO: 143402 - protein, 9 aa, Borrelia garinii PBi
MQMKKIIYS

SEQ ID NO: 143403 - protein, 15 aa, Borrelia garinii PBi
DIPIIIQSRLDIISK

SEQ ID NO: 143404 - protein, 9 aa, Borrelia garinii PBi
IIIQSRLDI

SEQ ID NO: 143405 - protein, 15 aa, Borrelia garinii PBi
IIQSRLDIISKVIKN

SEQ ID NO: 143406 - protein, 9 aa, Borrelia garinii PBi
LDIISKVIK

SEQ ID NO: 143407 - protein, 15 aa, Borrelia garinii PBi
EKMQMKKIIYSSLNY

SEQ ID NO: 143408 - protein, 9 aa, Borrelia garinii PBi
MQMKKIIYS

SEQ ID NO: 143409 - protein, 15 aa, Borrelia garinii PBi
KNFIYDIPIIIQSRL

SEQ ID NO: 143410 - protein, 9 aa, Borrelia garinii PBi
FIYDIPIII

SEQ ID NO: 143411 - protein, 15 aa, Borrelia garinii PBi
DEKMQMKKIIYSSLN

SEQ ID NO: 143412 - protein, 9 aa, Borrelia garinii PBi
MQMKKIIYS

SEQ ID NO: 143413 - protein, 15 aa, Borrelia garinii PBi
MQMKKIIYSSLNYET

SEQ ID NO: 143414 - protein, 9 aa, Borrelia garinii PBi
MQMKKIIYS

SEQ ID NO: 143415 - protein, 15 aa, Borrelia garinii PBi
KMQMKKIIYSSLNYE

SEQ ID NO: 143416 - protein, 9 aa, Borrelia garinii PBi
MQMKKIIYS

SEQ ID NO: 143417 - protein, 15 aa, Borrelia garinii PBi
PEDEKMQMKKIIYSS

SEQ ID NO: 143418 - protein, 9 aa, Borrelia garinii PBi
MQMKKIIYS

SEQ ID NO: 143419 - protein, 15 aa, Borrelia garinii PBi
NFIYDIPIIIQSRLD

SEQ ID NO: 143420 - protein, 9 aa, Borrelia garinii PBi
IPIIIQSRL

SEQ ID NO: 143421 - protein, 15 aa, Borrelia garinii PBi
LPEDEKMQMKKIIYS

SEQ ID NO: 143422 - protein, 9 aa, Borrelia garinii PBi
EKMQMKKII

SEQ ID NO: 143423 - protein, 15 aa, Borrelia garinii PBi
NPIKDELQILNQKEI

SEQ ID NO: 143424 - protein, 9 aa, Borrelia garinii PBi
IKDELQILN

SEQ ID NO: 143425 - protein, 15 aa, Borrelia garinii PBi
IKDELQILNQKEIEE

SEQ ID NO: 143426 - protein, 9 aa, Borrelia garinii PBi
LQILNQKEI

SEQ ID NO: 143427 - protein, 15 aa, Borrelia garinii PBi
PIKDELQILNQKEIE

SEQ ID NO: 143428 - protein, 9 aa, Borrelia garinii PBi
LQILNQKEI

SEQ ID NO: 143429 - protein, 15 aa, Borrelia garinii PBi
KDELQILNQKEIEEL

SEQ ID NO: 143430 - protein, 9 aa, Borrelia garinii PBi
LQILNQKEI

SEQ ID NO: 143431 - protein, 15 aa, Borrelia garinii PBi
IEELLMRIESELKIK

SEQ ID NO: 143432 - protein, 9 aa, Borrelia garinii PBi
LMRIESELK

SEQ ID NO: 143433 - protein, 15 aa, Borrelia garinii PBi
EIEELLMRIESELKI

SEQ ID NO: 143434 - protein, 9 aa, Borrelia garinii PBi
LMRIESELK

SEQ ID NO: 143435 - protein, 15 aa, Borrelia garinii PBi
KEIEELLMRIESELK

SEQ ID NO: 143436 - protein, 9 aa, Borrelia garinii PBi
LLMRIESEL

SEQ ID NO: 143437 - protein, 15 aa, Borrelia garinii PBi
EELLMRIESELKIKE

SEQ ID NO: 143438 - protein, 9 aa, Borrelia garinii PBi
LMRIESELK

SEQ ID NO: 143439 - protein, 15 aa, Borrelia garinii PBi
ELLMRIESELKIKEN

SEQ ID NO: 143440 - protein, 9 aa, Borrelia garinii PBi
LMRIESELK

SEQ ID NO: 143441 - protein, 15 aa, Borrelia garinii PBi
ILQEILEKLDKNLQH

SEQ ID NO: 143442 - protein, 9 aa, Borrelia garinii PBi
LEKLDKNLQ

SEQ ID NO: 143443 - protein, 15 aa, Borrelia garinii PBi
LQEILEKLDKNLQHK

SEQ ID NO: 143444 - protein, 9 aa, Borrelia garinii PBi
LEKLDKNLQ

SEQ ID NO: 143445 - protein, 15 aa, Borrelia garinii PBi
QEILEKLDKNLQHKK

SEQ ID NO: 143446 - protein, 9 aa, Borrelia garinii PBi
LEKLDKNLQ

SEQ ID NO: 143447 - protein, 15 aa, Borrelia garinii PBi
EILEKLDKNLQHKKI

SEQ ID NO: 143448 - protein, 9 aa, Borrelia garinii PBi
LEKLDKNLQ

SEQ ID NO: 143449 - protein, 15 aa, Borrelia garinii PBi
KILQEILEKLDKNLQ

SEQ ID NO: 143450 - protein, 9 aa, Borrelia garinii PBi
ILQEILEKL

SEQ ID NO: 143451 - protein, 15 aa, Borrelia garinii PBi
LKIKENFKKALNKTI

SEQ ID NO: 143452 - protein, 9 aa, Borrelia garinii PBi
LKIKENFKK

SEQ ID NO: 143453 - protein, 15 aa, Borrelia garinii PBi
NKFQDLEPSKKQNKD

SEQ ID NO: 143454 - protein, 9 aa, Borrelia garinii PBi
FQDLEPSKK

SEQ ID NO: 143455 - protein, 15 aa, Borrelia garinii PBi
VNKFQDLEPSKKQNK

SEQ ID NO: 143456 - protein, 9 aa, Borrelia garinii PBi
FQDLEPSKK

SEQ ID NO: 143457 - protein, 15 aa, Borrelia garinii PBi
ESELKIKENFKKALN

SEQ ID NO: 143458 - protein, 9 aa, Borrelia garinii PBi
LKIKENFKK

SEQ ID NO: 143459 - protein, 15 aa, Borrelia garinii PBi
IESELKIKENFKKAL

SEQ ID NO: 143460 - protein, 9 aa, Borrelia garinii PBi
LKIKENFKK

SEQ ID NO: 143461 - protein, 15 aa, Borrelia garinii PBi
SELKIKENFKKALNK

SEQ ID NO: 143462 - protein, 9 aa, Borrelia garinii PBi
LKIKENFKK

SEQ ID NO: 143463 - protein, 15 aa, Borrelia garinii PBi
RIESELKIKENFKKA

SEQ ID NO: 143464 - protein, 9 aa, Borrelia garinii PBi
LKIKENFKK

SEQ ID NO: 143465 - protein, 15 aa, Borrelia garinii PBi
MRIESELKIKENFKK

SEQ ID NO: 143466 - protein, 9 aa, Borrelia garinii PBi
IESELKIKE

SEQ ID NO: 143467 - protein, 15 aa, Borrelia garinii PBi
KFQDLEPSKKQNKDL

SEQ ID NO: 143468 - protein, 9 aa, Borrelia garinii PBi
LEPSKKQNK

SEQ ID NO: 143469 - protein, 15 aa, Borrelia burgdorferi B31
PEYYRNMPRPTAYQQ

SEQ ID NO: 143470 - protein, 9 aa, Borrelia burgdorferi B31
YRNMPRPTA

SEQ ID NO: 143471 - protein, 15 aa, Borrelia burgdorferi B31
SPEYYRNMPRPTAYQ

SEQ ID NO: 143472 - protein, 9 aa, Borrelia burgdorferi B31
YRNMPRPTA

SEQ ID NO: 143473 - protein, 15 aa, Borrelia burgdorferi B31
GSPEYYRNMPRPTAY

SEQ ID NO: 143474 - protein, 9 aa, Borrelia burgdorferi B31
YRNMPRPTA

SEQ ID NO: 143475 - protein, 15 aa, Borrelia burgdorferi B31
EGSPEYYRNMPRPTA

SEQ ID NO: 143476 - protein, 9 aa, Borrelia burgdorferi B31
YYRNMPRPT

SEQ ID NO: 143477 - protein, 15 aa, Borrelia burgdorferi B31
EYYRNMPRPTAYQQY

SEQ ID NO: 143478 - protein, 9 aa, Borrelia burgdorferi B31
YRNMPRPTA

SEQ ID NO: 143479 - protein, 15 aa, Borrelia burgdorferi B31
MRILVGVCIIALALL

SEQ ID NO: 143480 - protein, 9 aa, Borrelia burgdorferi B31
MRILVGVCI

SEQ ID NO: 143481 - protein, 15 aa, Borrelia burgdorferi B31
YYRNMPRPTAYQQYL

SEQ ID NO: 143482 - protein, 9 aa, Borrelia burgdorferi B31
YRNMPRPTA

SEQ ID NO: 143483 - protein, 15 aa, Borrelia burgdorferi B31
LKDPNYRGVVLPVSD

SEQ ID NO: 143484 - protein, 9 aa, Borrelia burgdorferi B31
YRGVVLPVS

SEQ ID NO: 143485 - protein, 15 aa, Borrelia burgdorferi B31
DPNYRGVVLPVSDYN

SEQ ID NO: 143486 - protein, 9 aa, Borrelia burgdorferi B31
YRGVVLPVS

SEQ ID NO: 143487 - protein, 15 aa, Borrelia burgdorferi B31
SLKDPNYRGVVLPVS

SEQ ID NO: 143488 - protein, 9 aa, Borrelia burgdorferi B31
LKDPNYRGV

SEQ ID NO: 143489 - protein, 15 aa, Borrelia burgdorferi B31
KDPNYRGVVLPVSDY

SEQ ID NO: 143490 - protein, 9 aa, Borrelia burgdorferi B31
YRGVVLPVS

SEQ ID NO: 143491 - protein, 15 aa, Borrelia burgdorferi B31
PNYRGVVLPVSDYNE

SEQ ID NO: 143492 - protein, 9 aa, Borrelia burgdorferi B31
YRGVVLPVS

SEQ ID NO: 143493 - protein, 15 aa, Borrelia burgdorferi B31
YRNMPRPTAYQQYLK

SEQ ID NO: 143494 - protein, 9 aa, Borrelia burgdorferi B31
YRNMPRPTA

SEQ ID NO: 143495 - protein, 15 aa, Borrelia burgdorferi B31
NKFFLDLGSEQSKDL

SEQ ID NO: 143496 - protein, 9 aa, Borrelia burgdorferi B31
FLDLGSEQS

SEQ ID NO: 143497 - protein, 15 aa, Borrelia burgdorferi B31
KFFLDLGSEQSKDLI

SEQ ID NO: 143498 - protein, 9 aa, Borrelia burgdorferi B31
FLDLGSEQS

SEQ ID NO: 143499 - protein, 15 aa, Borrelia burgdorferi B31
ILVGVCIIALALLGC

SEQ ID NO: 143500 - protein, 9 aa, Borrelia burgdorferi B31
VCIIALALL

SEQ ID NO: 143501 - protein, 15 aa, Borrelia burgdorferi B31
LVGVCIIALALLGCY

SEQ ID NO: 143502 - protein, 9 aa, Borrelia burgdorferi B31
VCIIALALL

SEQ ID NO: 143503 - protein, 15 aa, Borrelia burgdorferi B31
RILVGVCIIALALLG

SEQ ID NO: 143504 - protein, 9 aa, Borrelia burgdorferi B31
VCIIALALL

SEQ ID NO: 143505 - protein, 15 aa, Borrelia burgdorferi B31
VGVCIIALALLGCYL

SEQ ID NO: 143506 - protein, 9 aa, Borrelia burgdorferi B31
VCIIALALL

SEQ ID NO: 143507 - protein, 15 aa, Borrelia burgdorferi B31
EGIFSSLKLYASEHR

SEQ ID NO: 143508 - protein, 9 aa, Borrelia burgdorferi B31
FSSLKLYAS

SEQ ID NO: 143509 - protein, 15 aa, Borrelia burgdorferi B31
GIFSSLKLYASEHRL

SEQ ID NO: 143510 - protein, 9 aa, Borrelia burgdorferi B31
FSSLKLYAS

SEQ ID NO: 143511 - protein, 15 aa, Borrelia burgdorferi B31
FNKFFLDLGSEQSKD

SEQ ID NO: 143512 - protein, 9 aa, Borrelia burgdorferi B31
FLDLGSEQS

SEQ ID NO: 143513 - protein, 15 aa, Borrelia burgdorferi B31
YFNKFFLDLGSEQSK

SEQ ID NO: 143514 - protein, 9 aa, Borrelia burgdorferi B31
FLDLGSEQS

SEQ ID NO: 143515 - protein, 15 aa, Borrelia burgdorferi B31
EYFNKFFLDLGSEQS

SEQ ID NO: 143516 - protein, 9 aa, Borrelia burgdorferi B31
FNKFFLDLG

SEQ ID NO: 143517 - protein, 15 aa, Borrelia burgdorferi B31
TEGIFSSLKLYASEH

SEQ ID NO: 143518 - protein, 9 aa, Borrelia burgdorferi B31
FSSLKLYAS

SEQ ID NO: 143519 - protein, 15 aa, Borrelia burgdorferi B31
GVCIIALALLGCYLP

SEQ ID NO: 143520 - protein, 9 aa, Borrelia burgdorferi B31
IIALALLGC

SEQ ID NO: 143521 - protein, 15 aa, Borrelia burgdorferi B31
IVTEGIFSSLKLYAS

SEQ ID NO: 143522 - protein, 9 aa, Borrelia burgdorferi B31
IVTEGIFSS

SEQ ID NO: 143523 - protein, 15 aa, Borrelia burgdorferi B31
VTEGIFSSLKLYASE

SEQ ID NO: 143524 - protein, 9 aa, Borrelia burgdorferi B31
FSSLKLYAS

SEQ ID NO: 143525 - protein, 15 aa, Borrelia burgdorferi B31
VCIIALALLGCYLPD

SEQ ID NO: 143526 - protein, 9 aa, Borrelia burgdorferi B31
IIALALLGC

SEQ ID NO: 143527 - protein, 15 aa, Borrelia burgdorferi B31
VKRYDYNRPVPILPT

SEQ ID NO: 143528 - protein, 9 aa, Borrelia burgdorferi B31
YNRPVPILP

SEQ ID NO: 143529 - protein, 15 aa, Borrelia burgdorferi B31
NYRGVVLPVSDYNEE

SEQ ID NO: 143530 - protein, 9 aa, Borrelia burgdorferi B31
YRGVVLPVS

SEQ ID NO: 143531 - protein, 15 aa, Borrelia burgdorferi B31
FFLDLGSEQSKDLIK

SEQ ID NO: 143532 - protein, 9 aa, Borrelia burgdorferi B31
FLDLGSEQS

SEQ ID NO: 143533 - protein, 15 aa, Borrelia burgdorferi B31
FLDLGSEQSKDLIKL

SEQ ID NO: 143534 - protein, 9 aa, Borrelia burgdorferi B31
FLDLGSEQS

SEQ ID NO: 143535 - protein, 15 aa, Borrelia burgdorferi B31
YRGVVLPVSDYNEEY

SEQ ID NO: 143536 - protein, 9 aa, Borrelia burgdorferi B31
YRGVVLPVS

SEQ ID NO: 143537 - protein, 15 aa, Borrelia burgdorferi B31
FSSLKLYASEHRLLV

SEQ ID NO: 143538 - protein, 9 aa, Borrelia burgdorferi B31
FSSLKLYAS

SEQ ID NO: 143539 - protein, 15 aa, Borrelia burgdorferi B31
IFSSLKLYASEHRLL

SEQ ID NO: 143540 - protein, 9 aa, Borrelia burgdorferi B31
FSSLKLYAS

SEQ ID NO: 143541 - protein, 15 aa, Borrelia burgdorferi B31
KVKRYDYNRPVPILP

SEQ ID NO: 143542 - protein, 9 aa, Borrelia burgdorferi B31
YDYNRPVPI

SEQ ID NO: 143543 - protein, 15 aa, Borrelia burgdorferi B31
EEGSPEYYRNMPRPT

SEQ ID NO: 143544 - protein, 9 aa, Borrelia burgdorferi B31
EYYRNMPRP

SEQ ID NO: 143545 - protein, 15 aa, Borrelia burgdorferi B31
NKFMRIVRWLYSCIE

SEQ ID NO: 143546 - protein, 9 aa, Borrelia burgdorferi B31
MRIVRWLYS

SEQ ID NO: 143547 - protein, 15 aa, Borrelia burgdorferi B31
KFMRIVRWLYSCIEE

SEQ ID NO: 143548 - protein, 9 aa, Borrelia burgdorferi B31
VRWLYSCIE

SEQ ID NO: 143549 - protein, 15 aa, Borrelia burgdorferi B31
CIIALALLGCYLPDN

SEQ ID NO: 143550 - protein, 9 aa, Borrelia burgdorferi B31
IIALALLGC

SEQ ID NO: 143551 - protein, 15 aa, Borrelia burgdorferi B31
SSLKLYASEHRLLVE

SEQ ID NO: 143552 - protein, 9 aa, Borrelia burgdorferi B31
LKLYASEHR

SEQ ID NO: 143553 - protein, 15 aa, Borrelia burgdorferi B31
IIALALLGCYLPDNQ

SEQ ID NO: 143554 - protein, 9 aa, Borrelia burgdorferi B31
IIALALLGC

SEQ ID NO: 143555 - protein, 15 aa, Borrelia burgdorferi B31
FMRIVRWLYSCIEEL

SEQ ID NO: 143556 - protein, 9 aa, Borrelia burgdorferi B31
VRWLYSCIE

SEQ ID NO: 143557 - protein, 15 aa, Borrelia burgdorferi B31
MRIVRWLYSCIEELY

SEQ ID NO: 143558 - protein, 9 aa, Borrelia burgdorferi B31
VRWLYSCIE

SEQ ID NO: 143559 - protein, 15 aa, Borrelia burgdorferi B31
QTFFENSESSDMGSD

SEQ ID NO: 143560 - protein, 9 aa, Borrelia burgdorferi B31
FENSESSDM

SEQ ID NO: 143561 - protein, 15 aa, Borrelia burgdorferi B31
TFFENSESSDMGSDE

SEQ ID NO: 143562 - protein, 9 aa, Borrelia burgdorferi B31
FENSESSDM

SEQ ID NO: 143563 - protein, 15 aa, Borrelia burgdorferi B31
VQTFFENSESSDMGS

SEQ ID NO: 143564 - protein, 9 aa, Borrelia burgdorferi B31
FENSESSDM

SEQ ID NO: 143565 - protein, 15 aa, Borrelia burgdorferi B31
AVQTFFENSESSDMG

SEQ ID NO: 143566 - protein, 9 aa, Borrelia burgdorferi B31
FENSESSDM

SEQ ID NO: 143567 - protein, 15 aa, Borrelia burgdorferi B31
QAVQTFFENSESSDM

SEQ ID NO: 143568 - protein, 9 aa, Borrelia burgdorferi B31
TFFENSESS

SEQ ID NO: 143569 - protein, 15 aa, Borrelia burgdorferi B31
RNMPRPTAYQQYLKV

SEQ ID NO: 143570 - protein, 9 aa, Borrelia burgdorferi B31
MPRPTAYQQ

SEQ ID NO: 143571 - protein, 15 aa, Borrelia burgdorferi B31
LDLGSEQSKDLIKLF

SEQ ID NO: 143572 - protein, 9 aa, Borrelia burgdorferi B31
LGSEQSKDL

SEQ ID NO: 143573 - protein, 15 aa, Borrelia burgdorferi B31
DLIKLFIMVKNEQNN

SEQ ID NO: 143574 - protein, 9 aa, Borrelia burgdorferi B31
LFIMVKNEQ

SEQ ID NO: 143575 - protein, 15 aa, Borrelia burgdorferi B31
IKLFIMVKNEQNNNK

SEQ ID NO: 143576 - protein, 9 aa, Borrelia burgdorferi B31
LFIMVKNEQ

SEQ ID NO: 143577 - protein, 15 aa, Borrelia burgdorferi B31
KDLIKLFIMVKNEQN

SEQ ID NO: 143578 - protein, 9 aa, Borrelia burgdorferi B31
LFIMVKNEQ

SEQ ID NO: 143579 - protein, 15 aa, Borrelia burgdorferi B31
LIKLFIMVKNEQNNN

SEQ ID NO: 143580 - protein, 9 aa, Borrelia burgdorferi B31
LFIMVKNEQ

SEQ ID NO: 143581 - protein, 15 aa, Borrelia burgdorferi B31
SKDLIKLFIMVKNEQ

SEQ ID NO: 143582 - protein, 9 aa, Borrelia burgdorferi B31
IKLFIMVKN

SEQ ID NO: 143583 - protein, 15 aa, Borrelia burgdorferi B31
PEYYRNMPRPTAYQQ

SEQ ID NO: 143584 - protein, 9 aa, Borrelia burgdorferi B31
YRNMPRPTA

SEQ ID NO: 143585 - protein, 15 aa, Borrelia burgdorferi B31
SPEYYRNMPRPTAYQ

SEQ ID NO: 143586 - protein, 9 aa, Borrelia burgdorferi B31
YRNMPRPTA

SEQ ID NO: 143587 - protein, 15 aa, Borrelia burgdorferi B31
EGSPEYYRNMPRPTA

SEQ ID NO: 143588 - protein, 9 aa, Borrelia burgdorferi B31
YYRNMPRPT

SEQ ID NO: 143589 - protein, 15 aa, Borrelia burgdorferi B31
GSPEYYRNMPRPTAY

SEQ ID NO: 143590 - protein, 9 aa, Borrelia burgdorferi B31
YRNMPRPTA

SEQ ID NO: 143591 - protein, 15 aa, Borrelia burgdorferi B31
KLFIMVKNEQNNNKF

SEQ ID NO: 143592 - protein, 9 aa, Borrelia burgdorferi B31
LFIMVKNEQ

SEQ ID NO: 143593 - protein, 15 aa, Borrelia burgdorferi B31
EYYRNMPRPTAYQQY

SEQ ID NO: 143594 - protein, 9 aa, Borrelia burgdorferi B31
YRNMPRPTA

SEQ ID NO: 143595 - protein, 15 aa, Borrelia burgdorferi B31
LFIMVKNEQNNNKFM

SEQ ID NO: 143596 - protein, 9 aa, Borrelia burgdorferi B31
LFIMVKNEQ

SEQ ID NO: 143597 - protein, 15 aa, Borrelia burgdorferi B31
EYFNKFFLDLGSEQS

SEQ ID NO: 143598 - protein, 9 aa, Borrelia burgdorferi B31
FFLDLGSEQ

SEQ ID NO: 143599 - protein, 15 aa, Borrelia burgdorferi B31
YYRNMPRPTAYQQYL

SEQ ID NO: 143600 - protein, 9 aa, Borrelia burgdorferi B31
YRNMPRPTA

SEQ ID NO: 143601 - protein, 15 aa, Borrelia burgdorferi B31
QNNNKFMRIVRWLYS

SEQ ID NO: 143602 - protein, 9 aa, Borrelia burgdorferi B31
FMRIVRWLY

SEQ ID NO: 143603 - protein, 15 aa, Borrelia burgdorferi B31
NNNKFMRIVRWLYSC

SEQ ID NO: 143604 - protein, 9 aa, Borrelia burgdorferi B31
FMRIVRWLY

SEQ ID NO: 143605 - protein, 15 aa, Borrelia burgdorferi B31
YFNKFFLDLGSEQSK

SEQ ID NO: 143606 - protein, 9 aa, Borrelia burgdorferi B31
FFLDLGSEQ

SEQ ID NO: 143607 - protein, 15 aa, Borrelia burgdorferi B31
IKLFIMVKNEQNNNK

SEQ ID NO: 143608 - protein, 9 aa, Borrelia burgdorferi B31
LFIMVKNEQ

SEQ ID NO: 143609 - protein, 15 aa, Borrelia burgdorferi B31
DLIKLFIMVKNEQNN

SEQ ID NO: 143610 - protein, 9 aa, Borrelia burgdorferi B31
LFIMVKNEQ

SEQ ID NO: 143611 - protein, 15 aa, Borrelia burgdorferi B31
LIKLFIMVKNEQNNN

SEQ ID NO: 143612 - protein, 9 aa, Borrelia burgdorferi B31
LFIMVKNEQ

SEQ ID NO: 143613 - protein, 15 aa, Borrelia burgdorferi B31
KLFIMVKNEQNNNKF

SEQ ID NO: 143614 - protein, 9 aa, Borrelia burgdorferi B31
VKNEQNNNK

SEQ ID NO: 143615 - protein, 15 aa, Borrelia burgdorferi B31
LFIMVKNEQNNNKFM

SEQ ID NO: 143616 - protein, 9 aa, Borrelia burgdorferi B31
VKNEQNNNK

SEQ ID NO: 143617 - protein, 15 aa, Borrelia burgdorferi B31
KDLIKLFIMVKNEQN

SEQ ID NO: 143618 - protein, 9 aa, Borrelia burgdorferi B31
LFIMVKNEQ

SEQ ID NO: 143619 - protein, 15 aa, Borrelia burgdorferi B31
SKDLIKLFIMVKNEQ

SEQ ID NO: 143620 - protein, 9 aa, Borrelia burgdorferi B31
IKLFIMVKN

SEQ ID NO: 143621 - protein, 15 aa, Borrelia burgdorferi B31
NKFMRIVRWLYSCIE

SEQ ID NO: 143622 - protein, 9 aa, Borrelia burgdorferi B31
MRIVRWLYS

SEQ ID NO: 143623 - protein, 15 aa, Borrelia burgdorferi B31
KFMRIVRWLYSCIEE

SEQ ID NO: 143624 - protein, 9 aa, Borrelia burgdorferi B31
MRIVRWLYS

SEQ ID NO: 143625 - protein, 15 aa, Borrelia burgdorferi B31
FMRIVRWLYSCIEEL

SEQ ID NO: 143626 - protein, 9 aa, Borrelia burgdorferi B31
VRWLYSCIE

SEQ ID NO: 143627 - protein, 15 aa, Borrelia burgdorferi B31
PEYYRNMPRPTAYQQ

SEQ ID NO: 143628 - protein, 9 aa, Borrelia burgdorferi B31
YRNMPRPTA

SEQ ID NO: 143629 - protein, 15 aa, Borrelia burgdorferi B31
SPEYYRNMPRPTAYQ

SEQ ID NO: 143630 - protein, 9 aa, Borrelia burgdorferi B31
YRNMPRPTA

SEQ ID NO: 143631 - protein, 15 aa, Borrelia burgdorferi B31
KDLIKLFIMVKNEQN

SEQ ID NO: 143632 - protein, 9 aa, Borrelia burgdorferi B31
IKLFIMVKN

SEQ ID NO: 143633 - protein, 15 aa, Borrelia burgdorferi B31
GSPEYYRNMPRPTAY

SEQ ID NO: 143634 - protein, 9 aa, Borrelia burgdorferi B31
YRNMPRPTA

SEQ ID NO: 143635 - protein, 15 aa, Borrelia burgdorferi B31
EYYRNMPRPTAYQQY

SEQ ID NO: 143636 - protein, 9 aa, Borrelia burgdorferi B31
YRNMPRPTA

SEQ ID NO: 143637 - protein, 15 aa, Borrelia burgdorferi B31
EGSPEYYRNMPRPTA

SEQ ID NO: 143638 - protein, 9 aa, Borrelia burgdorferi B31
YYRNMPRPT

SEQ ID NO: 143639 - protein, 15 aa, Borrelia burgdorferi B31
MRIVRWLYSCIEELY

SEQ ID NO: 143640 - protein, 9 aa, Borrelia burgdorferi B31
VRWLYSCIE

SEQ ID NO: 143641 - protein, 15 aa, Borrelia burgdorferi B31
DLIKLFIMVKNEQNN

SEQ ID NO: 143642 - protein, 9 aa, Borrelia burgdorferi B31
FIMVKNEQN

SEQ ID NO: 143643 - protein, 15 aa, Borrelia burgdorferi B31
IKLFIMVKNEQNNNK

SEQ ID NO: 143644 - protein, 9 aa, Borrelia burgdorferi B31
FIMVKNEQN

SEQ ID NO: 143645 - protein, 15 aa, Borrelia burgdorferi B31
LIKLFIMVKNEQNNN

SEQ ID NO: 143646 - protein, 9 aa, Borrelia burgdorferi B31
FIMVKNEQN

SEQ ID NO: 143647 - protein, 15 aa, Borrelia burgdorferi B31
KLFIMVKNEQNNNKF

SEQ ID NO: 143648 - protein, 9 aa, Borrelia burgdorferi B31
FIMVKNEQN

SEQ ID NO: 143649 - protein, 15 aa, Borrelia burgdorferi B31
RIVRWLYSCIEELYS

SEQ ID NO: 143650 - protein, 9 aa, Borrelia burgdorferi B31
VRWLYSCIE

SEQ ID NO: 143651 - protein, 15 aa, Borrelia burgdorferi B31
NNKFMRIVRWLYSCI

SEQ ID NO: 143652 - protein, 9 aa, Borrelia burgdorferi B31
MRIVRWLYS

SEQ ID NO: 143653 - protein, 15 aa, Borrelia burgdorferi B31
NNNKFMRIVRWLYSC

SEQ ID NO: 143654 - protein, 9 aa, Borrelia burgdorferi B31
MRIVRWLYS

SEQ ID NO: 143655 - protein, 15 aa, Borrelia burgdorferi B31
QNNNKFMRIVRWLYS

SEQ ID NO: 143656 - protein, 9 aa, Borrelia burgdorferi B31
FMRIVRWLY

SEQ ID NO: 143657 - protein, 15 aa, Borrelia burgdorferi B31
YYRNMPRPTAYQQYL

SEQ ID NO: 143658 - protein, 9 aa, Borrelia burgdorferi B31
YRNMPRPTA

SEQ ID NO: 143659 - protein, 15 aa, Borrelia burgdorferi B31
YRNMPRPTAYQQYLK

SEQ ID NO: 143660 - protein, 9 aa, Borrelia burgdorferi B31
YRNMPRPTA

SEQ ID NO: 143661 - protein, 15 aa, Borrelia burgdorferi B31
LFIMVKNEQNNNKFM

SEQ ID NO: 143662 - protein, 9 aa, Borrelia burgdorferi B31
FIMVKNEQN

SEQ ID NO: 143663 - protein, 15 aa, Borrelia burgdorferi B31
IVRWLYSCIEELYSP

SEQ ID NO: 143664 - protein, 9 aa, Borrelia burgdorferi B31
VRWLYSCIE

SEQ ID NO: 143665 - protein, 15 aa, Borrelia burgdorferi B31
NNKFMRIVRWLYSCI

SEQ ID NO: 143666 - protein, 9 aa, Borrelia burgdorferi B31
FMRIVRWLY

SEQ ID NO: 143667 - protein, 15 aa, Borrelia burgdorferi B31
NKFMRIVRWLYSCIE

SEQ ID NO: 143668 - protein, 9 aa, Borrelia burgdorferi B31
FMRIVRWLY

SEQ ID NO: 143669 - protein, 15 aa, Borrelia burgdorferi B31
QNNNKFMRIVRWLYS

SEQ ID NO: 143670 - protein, 9 aa, Borrelia burgdorferi B31
FMRIVRWLY

SEQ ID NO: 143671 - protein, 15 aa, Borrelia burgdorferi B31
NNNKFMRIVRWLYSC

SEQ ID NO: 143672 - protein, 9 aa, Borrelia burgdorferi B31
FMRIVRWLY

SEQ ID NO: 143673 - protein, 15 aa, Borrelia burgdorferi B31
KFMRIVRWLYSCIEE

SEQ ID NO: 143674 - protein, 9 aa, Borrelia burgdorferi B31
MRIVRWLYS

SEQ ID NO: 143675 - protein, 15 aa, Borrelia burgdorferi B31
EYYRNMPRPTAYQQY

SEQ ID NO: 143676 - protein, 9 aa, Borrelia burgdorferi B31
YRNMPRPTA

SEQ ID NO: 143677 - protein, 15 aa, Borrelia burgdorferi B31
PEYYRNMPRPTAYQQ

SEQ ID NO: 143678 - protein, 9 aa, Borrelia burgdorferi B31
YRNMPRPTA

SEQ ID NO: 143679 - protein, 15 aa, Borrelia burgdorferi B31
EGSPEYYRNMPRPTA

SEQ ID NO: 143680 - protein, 9 aa, Borrelia burgdorferi B31
YYRNMPRPT

SEQ ID NO: 143681 - protein, 15 aa, Borrelia burgdorferi B31
GSPEYYRNMPRPTAY

SEQ ID NO: 143682 - protein, 9 aa, Borrelia burgdorferi B31
YRNMPRPTA

SEQ ID NO: 143683 - protein, 15 aa, Borrelia burgdorferi B31
SPEYYRNMPRPTAYQ

SEQ ID NO: 143684 - protein, 9 aa, Borrelia burgdorferi B31
YRNMPRPTA

SEQ ID NO: 143685 - protein, 15 aa, Borrelia burgdorferi B31
YYRNMPRPTAYQQYL

SEQ ID NO: 143686 - protein, 9 aa, Borrelia burgdorferi B31
YRNMPRPTA

SEQ ID NO: 143687 - protein, 15 aa, Borrelia burgdorferi B31
YRNMPRPTAYQQYLK

SEQ ID NO: 143688 - protein, 9 aa, Borrelia burgdorferi B31
YRNMPRPTA

SEQ ID NO: 143689 - protein, 15 aa, Borrelia burgdorferi B31
SKDLIKLFIMVKNEQ

SEQ ID NO: 143690 - protein, 9 aa, Borrelia burgdorferi B31
IKLFIMVKN

SEQ ID NO: 143691 - protein, 15 aa, Borrelia burgdorferi B31
KDLIKLFIMVKNEQN

SEQ ID NO: 143692 - protein, 9 aa, Borrelia burgdorferi B31
IKLFIMVKN

SEQ ID NO: 143693 - protein, 15 aa, Borrelia burgdorferi B31
DLIKLFIMVKNEQNN

SEQ ID NO: 143694 - protein, 9 aa, Borrelia burgdorferi B31
IKLFIMVKN

SEQ ID NO: 143695 - protein, 15 aa, Borrelia burgdorferi B31
IKLFIMVKNEQNNNK

SEQ ID NO: 143696 - protein, 9 aa, Borrelia burgdorferi B31
LFIMVKNEQ

SEQ ID NO: 143697 - protein, 15 aa, Borrelia burgdorferi B31
HRLLVEIKKTLISLK

SEQ ID NO: 143698 - protein, 9 aa, Borrelia burgdorferi B31
VEIKKTLIS

SEQ ID NO: 143699 - protein, 15 aa, Borrelia burgdorferi B31
LIKLFIMVKNEQNNN

SEQ ID NO: 143700 - protein, 9 aa, Borrelia burgdorferi B31
LFIMVKNEQ

SEQ ID NO: 143701 - protein, 15 aa, Borrelia burgdorferi B31
EQSKDLIKLFIMVKN

SEQ ID NO: 143702 - protein, 9 aa, Borrelia burgdorferi B31
SKDLIKLFI

SEQ ID NO: 143703 - protein, 15 aa, Borrelia burgdorferi B31
RLLVEIKKTLISLKD

SEQ ID NO: 143704 - protein, 9 aa, Borrelia burgdorferi B31
VEIKKTLIS

SEQ ID NO: 143705 - protein, 15 aa, Borrelia burgdorferi B31
QSKDLIKLFIMVKNE

SEQ ID NO: 143706 - protein, 9 aa, Borrelia burgdorferi B31
IKLFIMVKN

SEQ ID NO: 143707 - protein, 15 aa, Borrelia burgdorferi B31
GSPEYYRNMPRPTAY

SEQ ID NO: 143708 - protein, 9 aa, Borrelia burgdorferi B31
YYRNMPRPT

SEQ ID NO: 143709 - protein, 15 aa, Borrelia burgdorferi B31
SPEYYRNMPRPTAYQ

SEQ ID NO: 143710 - protein, 9 aa, Borrelia burgdorferi B31
YYRNMPRPT

SEQ ID NO: 143711 - protein, 15 aa, Borrelia burgdorferi B31
PEYYRNMPRPTAYQQ

SEQ ID NO: 143712 - protein, 9 aa, Borrelia burgdorferi B31
YYRNMPRPT

SEQ ID NO: 143713 - protein, 15 aa, Borrelia burgdorferi B31
LLVEIKKTLISLKDP

SEQ ID NO: 143714 - protein, 9 aa, Borrelia burgdorferi B31
VEIKKTLIS

SEQ ID NO: 143715 - protein, 15 aa, Borrelia burgdorferi B31
EHRLLVEIKKTLISL

SEQ ID NO: 143716 - protein, 9 aa, Borrelia burgdorferi B31
VEIKKTLIS

SEQ ID NO: 143717 - protein, 15 aa, Borrelia burgdorferi B31
SEHRLLVEIKKTLIS

SEQ ID NO: 143718 - protein, 9 aa, Borrelia burgdorferi B31
LVEIKKTLI

SEQ ID NO: 143719 - protein, 15 aa, Borrelia burgdorferi B31
EGSPEYYRNMPRPTA

SEQ ID NO: 143720 - protein, 9 aa, Borrelia burgdorferi B31
YYRNMPRPT

SEQ ID NO: 143721 - protein, 15 aa, Borrelia burgdorferi B31
MRILVGVCIIALALL

SEQ ID NO: 143722 - protein, 9 aa, Borrelia burgdorferi B31
MRILVGVCI

SEQ ID NO: 143723 - protein, 15 aa, Borrelia burgdorferi B31
EYYRNMPRPTAYQQY

SEQ ID NO: 143724 - protein, 9 aa, Borrelia burgdorferi B31
YYRNMPRPT

SEQ ID NO: 143725 - protein, 15 aa, Borrelia burgdorferi B31
IMVKNEQNNNKFMRI

SEQ ID NO: 143726 - protein, 9 aa, Borrelia burgdorferi B31
EQNNNKFMR

SEQ ID NO: 143727 - protein, 15 aa, Borrelia burgdorferi B31
GVCIIALALLGCYLP

SEQ ID NO: 143728 - protein, 9 aa, Borrelia burgdorferi B31
IALALLGCY

SEQ ID NO: 143729 - protein, 15 aa, Borrelia burgdorferi B31
VCIIALALLGCYLPD

SEQ ID NO: 143730 - protein, 9 aa, Borrelia burgdorferi B31
LALLGCYLP

SEQ ID NO: 143731 - protein, 15 aa, Borrelia burgdorferi B31
VKNEQNNNKFMRIVR

SEQ ID NO: 143732 - protein, 9 aa, Borrelia burgdorferi B31
EQNNNKFMR

SEQ ID NO: 143733 - protein, 15 aa, Borrelia burgdorferi B31
MVKNEQNNNKFMRIV

SEQ ID NO: 143734 - protein, 9 aa, Borrelia burgdorferi B31
EQNNNKFMR

SEQ ID NO: 143735 - protein, 15 aa, Borrelia burgdorferi B31
LVEIKKTLISLKDPN

SEQ ID NO: 143736 - protein, 9 aa, Borrelia burgdorferi B31
VEIKKTLIS

SEQ ID NO: 143737 - protein, 15 aa, Borrelia burgdorferi B31
FIMVKNEQNNNKFMR

SEQ ID NO: 143738 - protein, 9 aa, Borrelia burgdorferi B31
VKNEQNNNK

SEQ ID NO: 143739 - protein, 15 aa, Borrelia burgdorferi B31
YYRNMPRPTAYQQYL

SEQ ID NO: 143740 - protein, 9 aa, Borrelia burgdorferi B31
YYRNMPRPT

SEQ ID NO: 143741 - protein, 15 aa, Borrelia burgdorferi B31
KNEQNNNKFMRIVRW

SEQ ID NO: 143742 - protein, 9 aa, Borrelia burgdorferi B31
EQNNNKFMR

SEQ ID NO: 143743 - protein, 15 aa, Borrelia burgdorferi B31
EQNNNKFMRIVRWLY

SEQ ID NO: 143744 - protein, 9 aa, Borrelia burgdorferi B31
EQNNNKFMR

SEQ ID NO: 143745 - protein, 15 aa, Borrelia burgdorferi B31
LVGVCIIALALLGCY

SEQ ID NO: 143746 - protein, 9 aa, Borrelia burgdorferi B31
VCIIALALL

SEQ ID NO: 143747 - protein, 15 aa, Borrelia burgdorferi B31
CIIALALLGCYLPDN

SEQ ID NO: 143748 - protein, 9 aa, Borrelia burgdorferi B31
LALLGCYLP

SEQ ID NO: 143749 - protein, 15 aa, Borrelia burgdorferi B31
VGVCIIALALLGCYL

SEQ ID NO: 143750 - protein, 9 aa, Borrelia burgdorferi B31
VCIIALALL

SEQ ID NO: 143751 - protein, 15 aa, Borrelia burgdorferi B31
VEIKKTLISLKDPNY

SEQ ID NO: 143752 - protein, 9 aa, Borrelia burgdorferi B31
VEIKKTLIS

SEQ ID NO: 143753 - protein, 15 aa, Borrelia burgdorferi B31
QNNNKFMRIVRWLYS

SEQ ID NO: 143754 - protein, 9 aa, Borrelia burgdorferi B31
FMRIVRWLY

SEQ ID NO: 143755 - protein, 15 aa, Borrelia burgdorferi B31
NKFMRIVRWLYSCIE

SEQ ID NO: 143756 - protein, 9 aa, Borrelia burgdorferi B31
MRIVRWLYS

SEQ ID NO: 143757 - protein, 15 aa, Borrelia burgdorferi B31
NNKFMRIVRWLYSCI

SEQ ID NO: 143758 - protein, 9 aa, Borrelia burgdorferi B31
MRIVRWLYS

SEQ ID NO: 143759 - protein, 15 aa, Borrelia burgdorferi B31
KFMRIVRWLYSCIEE

SEQ ID NO: 143760 - protein, 9 aa, Borrelia burgdorferi B31
MRIVRWLYS

SEQ ID NO: 143761 - protein, 15 aa, Borrelia burgdorferi B31
NNNKFMRIVRWLYSC

SEQ ID NO: 143762 - protein, 9 aa, Borrelia burgdorferi B31
MRIVRWLYS

SEQ ID NO: 143763 - protein, 15 aa, Borrelia burgdorferi B31
QNNNKFMRIVRWLYS

SEQ ID NO: 143764 - protein, 9 aa, Borrelia burgdorferi B31
FMRIVRWLY

SEQ ID NO: 143765 - protein, 15 aa, Borrelia burgdorferi B31
FMRIVRWLYSCIEEL

SEQ ID NO: 143766 - protein, 9 aa, Borrelia burgdorferi B31
MRIVRWLYS

SEQ ID NO: 143767 - protein, 15 aa, Borrelia burgdorferi B31
MRIVRWLYSCIEELY

SEQ ID NO: 143768 - protein, 9 aa, Borrelia burgdorferi B31
MRIVRWLYS

SEQ ID NO: 143769 - protein, 15 aa, Borrelia burgdorferi B31
EGIFSSLKLYASEHR

SEQ ID NO: 143770 - protein, 9 aa, Borrelia burgdorferi B31
FSSLKLYAS

SEQ ID NO: 143771 - protein, 15 aa, Borrelia burgdorferi B31
GIFSSLKLYASEHRL

SEQ ID NO: 143772 - protein, 9 aa, Borrelia burgdorferi B31
LKLYASEHR

SEQ ID NO: 143773 - protein, 15 aa, Borrelia burgdorferi B31
FSSLKLYASEHRLLV

SEQ ID NO: 143774 - protein, 9 aa, Borrelia burgdorferi B31
LKLYASEHR

SEQ ID NO: 143775 - protein, 15 aa, Borrelia burgdorferi B31
IFSSLKLYASEHRLL

SEQ ID NO: 143776 - protein, 9 aa, Borrelia burgdorferi B31
LKLYASEHR

SEQ ID NO: 143777 - protein, 15 aa, Borrelia burgdorferi B31
SSLKLYASEHRLLVE

SEQ ID NO: 143778 - protein, 9 aa, Borrelia burgdorferi B31
LKLYASEHR

SEQ ID NO: 143779 - protein, 15 aa, Borrelia burgdorferi B31
PNYRGVVLPVSDYNE

SEQ ID NO: 143780 - protein, 9 aa, Borrelia burgdorferi B31
YRGVVLPVS

SEQ ID NO: 143781 - protein, 15 aa, Borrelia burgdorferi B31
LKDPNYRGVVLPVSD

SEQ ID NO: 143782 - protein, 9 aa, Borrelia burgdorferi B31
YRGVVLPVS

SEQ ID NO: 143783 - protein, 15 aa, Borrelia burgdorferi B31
KDPNYRGVVLPVSDY

SEQ ID NO: 143784 - protein, 9 aa, Borrelia burgdorferi B31
YRGVVLPVS

SEQ ID NO: 143785 - protein, 15 aa, Borrelia burgdorferi B31
SLKDPNYRGVVLPVS

SEQ ID NO: 143786 - protein, 9 aa, Borrelia burgdorferi B31
PNYRGVVLP

SEQ ID NO: 143787 - protein, 15 aa, Borrelia burgdorferi B31
DPNYRGVVLPVSDYN

SEQ ID NO: 143788 - protein, 9 aa, Borrelia burgdorferi B31
YRGVVLPVS

SEQ ID NO: 143789 - protein, 15 aa, Borrelia burgdorferi B31
SKDLIKLFIMVKNEQ

SEQ ID NO: 143790 - protein, 9 aa, Borrelia burgdorferi B31
LIKLFIMVK

SEQ ID NO: 143791 - protein, 15 aa, Borrelia burgdorferi B31
KDLIKLFIMVKNEQN

SEQ ID NO: 143792 - protein, 9 aa, Borrelia burgdorferi B31
LIKLFIMVK

SEQ ID NO: 143793 - protein, 15 aa, Borrelia burgdorferi B31
EQSKDLIKLFIMVKN

SEQ ID NO: 143794 - protein, 9 aa, Borrelia burgdorferi B31
LIKLFIMVK

SEQ ID NO: 143795 - protein, 15 aa, Borrelia burgdorferi B31
QSKDLIKLFIMVKNE

SEQ ID NO: 143796 - protein, 9 aa, Borrelia burgdorferi B31
LIKLFIMVK

SEQ ID NO: 143797 - protein, 15 aa, Borrelia burgdorferi B31
EIKKTLISLKDPNYR

SEQ ID NO: 143798 - protein, 9 aa, Borrelia burgdorferi B31
LISLKDPNY

SEQ ID NO: 143799 - protein, 15 aa, Borrelia burgdorferi B31
KKTLISLKDPNYRGV

SEQ ID NO: 143800 - protein, 9 aa, Borrelia burgdorferi B31
ISLKDPNYR

SEQ ID NO: 143801 - protein, 15 aa, Borrelia burgdorferi B31
KTLISLKDPNYRGVV

SEQ ID NO: 143802 - protein, 9 aa, Borrelia burgdorferi B31
ISLKDPNYR

SEQ ID NO: 143803 - protein, 15 aa, Borrelia burgdorferi B31
IKKTLISLKDPNYRG

SEQ ID NO: 143804 - protein, 9 aa, Borrelia burgdorferi B31
ISLKDPNYR

SEQ ID NO: 143805 - protein, 15 aa, Borrelia burgdorferi B31
TLISLKDPNYRGVVL

SEQ ID NO: 143806 - protein, 9 aa, Borrelia burgdorferi B31
ISLKDPNYR

SEQ ID NO: 143807 - protein, 15 aa, Borrelia burgdorferi B31
LISLKDPNYRGVVLP

SEQ ID NO: 143808 - protein, 9 aa, Borrelia burgdorferi B31
ISLKDPNYR

SEQ ID NO: 143809 - protein, 15 aa, Borrelia burgdorferi B31
ISLKDPNYRGVVLPV

SEQ ID NO: 143810 - protein, 9 aa, Borrelia burgdorferi B31
ISLKDPNYR

SEQ ID NO: 143811 - protein, 15 aa, Borrelia burgdorferi B31
IIALALLGCYLPDNQ

SEQ ID NO: 143812 - protein, 9 aa, Borrelia burgdorferi B31
LALLGCYLP

SEQ ID NO: 143813 - protein, 15 aa, Borrelia burgdorferi B31
IALALLGCYLPDNQE

SEQ ID NO: 143814 - protein, 9 aa, Borrelia burgdorferi B31
LGCYLPDNQ

SEQ ID NO: 143815 - protein, 15 aa, Borrelia burgdorferi B31
ALALLGCYLPDNQEQ

SEQ ID NO: 143816 - protein, 9 aa, Borrelia burgdorferi B31
LGCYLPDNQ

SEQ ID NO: 143817 - protein, 15 aa, Borrelia burgdorferi B31
LALLGCYLPDNQEQA

SEQ ID NO: 143818 - protein, 9 aa, Borrelia burgdorferi B31
LGCYLPDNQ

SEQ ID NO: 143819 - protein, 15 aa, Borrelia burgdorferi B31
ALLGCYLPDNQEQAV

SEQ ID NO: 143820 - protein, 9 aa, Borrelia burgdorferi B31
LGCYLPDNQ

SEQ ID NO: 143821 - protein, 15 aa, Borrelia burgdorferi B31
NKFMRIVRWLYSCIE

SEQ ID NO: 143822 - protein, 9 aa, Borrelia burgdorferi B31
IVRWLYSCI

SEQ ID NO: 143823 - protein, 15 aa, Borrelia burgdorferi B31
KFMRIVRWLYSCIEE

SEQ ID NO: 143824 - protein, 9 aa, Borrelia burgdorferi B31
IVRWLYSCI

SEQ ID NO: 143825 - protein, 15 aa, Borrelia burgdorferi B31
FMRIVRWLYSCIEEL

SEQ ID NO: 143826 - protein, 9 aa, Borrelia burgdorferi B31
IVRWLYSCI

SEQ ID NO: 143827 - protein, 15 aa, Borrelia burgdorferi B31
GSPEYYRNMPRPTAY

SEQ ID NO: 143828 - protein, 9 aa, Borrelia burgdorferi B31
YRNMPRPTA

SEQ ID NO: 143829 - protein, 15 aa, Borrelia burgdorferi B31
SPEYYRNMPRPTAYQ

SEQ ID NO: 143830 - protein, 9 aa, Borrelia burgdorferi B31
YRNMPRPTA

SEQ ID NO: 143831 - protein, 15 aa, Borrelia burgdorferi B31
PEYYRNMPRPTAYQQ

SEQ ID NO: 143832 - protein, 9 aa, Borrelia burgdorferi B31
YRNMPRPTA

SEQ ID NO: 143833 - protein, 15 aa, Borrelia burgdorferi B31
EYYRNMPRPTAYQQY

SEQ ID NO: 143834 - protein, 9 aa, Borrelia burgdorferi B31
YRNMPRPTA

SEQ ID NO: 143835 - protein, 15 aa, Borrelia burgdorferi B31
EGSPEYYRNMPRPTA

SEQ ID NO: 143836 - protein, 9 aa, Borrelia burgdorferi B31
YYRNMPRPT

SEQ ID NO: 143837 - protein, 15 aa, Borrelia burgdorferi B31
IKLFIMVKNEQNNNK

SEQ ID NO: 143838 - protein, 9 aa, Borrelia burgdorferi B31
LFIMVKNEQ

SEQ ID NO: 143839 - protein, 15 aa, Borrelia burgdorferi B31
KLFIMVKNEQNNNKF

SEQ ID NO: 143840 - protein, 9 aa, Borrelia burgdorferi B31
VKNEQNNNK

SEQ ID NO: 143841 - protein, 15 aa, Borrelia burgdorferi B31
LFIMVKNEQNNNKFM

SEQ ID NO: 143842 - protein, 9 aa, Borrelia burgdorferi B31
VKNEQNNNK

SEQ ID NO: 143843 - protein, 15 aa, Borrelia burgdorferi B31
IMVKNEQNNNKFMRI

SEQ ID NO: 143844 - protein, 9 aa, Borrelia burgdorferi B31
VKNEQNNNK

SEQ ID NO: 143845 - protein, 15 aa, Borrelia burgdorferi B31
FIMVKNEQNNNKFMR

SEQ ID NO: 143846 - protein, 9 aa, Borrelia burgdorferi B31
VKNEQNNNK

SEQ ID NO: 143847 - protein, 15 aa, Borrelia burgdorferi B31
TAYQQYLKVKRYDYN

SEQ ID NO: 143848 - protein, 9 aa, Borrelia burgdorferi B31
YQQYLKVKR

SEQ ID NO: 143849 - protein, 15 aa, Borrelia burgdorferi B31
YYRNMPRPTAYQQYL

SEQ ID NO: 143850 - protein, 9 aa, Borrelia burgdorferi B31
YRNMPRPTA

SEQ ID NO: 143851 - protein, 15 aa, Borrelia burgdorferi B31
YRNMPRPTAYQQYLK

SEQ ID NO: 143852 - protein, 9 aa, Borrelia burgdorferi B31
YRNMPRPTA

SEQ ID NO: 143853 - protein, 15 aa, Borrelia burgdorferi B31
NIFKLFFASMLFVMA

SEQ ID NO: 143854 - protein, 9 aa, Borrelia burgdorferi B31
FFASMLFVM

SEQ ID NO: 143855 - protein, 15 aa, Borrelia burgdorferi B31
IFKLFFASMLFVMAC

SEQ ID NO: 143856 - protein, 9 aa, Borrelia burgdorferi B31
FASMLFVMA

SEQ ID NO: 143857 - protein, 15 aa, Borrelia burgdorferi B31
FKLFFASMLFVMACK

SEQ ID NO: 143858 - protein, 9 aa, Borrelia burgdorferi B31
FASMLFVMA

SEQ ID NO: 143859 - protein, 15 aa, Borrelia burgdorferi B31
KLFFASMLFVMACKA

SEQ ID NO: 143860 - protein, 9 aa, Borrelia burgdorferi B31
FASMLFVMA

SEQ ID NO: 143861 - protein, 15 aa, Borrelia burgdorferi B31
LFFASMLFVMACKAY

SEQ ID NO: 143862 - protein, 9 aa, Borrelia burgdorferi B31
FASMLFVMA

SEQ ID NO: 143863 - protein, 15 aa, Borrelia burgdorferi B31
NSFQDKLAAKLAALK

SEQ ID NO: 143864 - protein, 9 aa, Borrelia burgdorferi B31
FQDKLAAKL

SEQ ID NO: 143865 - protein, 15 aa, Borrelia burgdorferi B31
DKLAAKLAALKAAKN

SEQ ID NO: 143866 - protein, 9 aa, Borrelia burgdorferi B31
LAAKLAALK

SEQ ID NO: 143867 - protein, 15 aa, Borrelia burgdorferi B31
SFQDKLAAKLAALKA

SEQ ID NO: 143868 - protein, 9 aa, Borrelia burgdorferi B31
LAAKLAALK

SEQ ID NO: 143869 - protein, 15 aa, Borrelia burgdorferi B31
FQDKLAAKLAALKAA

SEQ ID NO: 143870 - protein, 9 aa, Borrelia burgdorferi B31
LAAKLAALK

SEQ ID NO: 143871 - protein, 15 aa, Borrelia burgdorferi B31
QNSFQDKLAAKLAAL

SEQ ID NO: 143872 - protein, 9 aa, Borrelia burgdorferi B31
FQDKLAAKL

SEQ ID NO: 143873 - protein, 15 aa, Borrelia burgdorferi B31
LQNSFQDKLAAKLAA

SEQ ID NO: 143874 - protein, 9 aa, Borrelia burgdorferi B31
FQDKLAAKL

SEQ ID NO: 143875 - protein, 15 aa, Borrelia burgdorferi B31
KLAAKLAALKAAKNT

SEQ ID NO: 143876 - protein, 9 aa, Borrelia burgdorferi B31
LAALKAAKN

SEQ ID NO: 143877 - protein, 15 aa, Borrelia burgdorferi B31
NLQNSFQDKLAAKLA

SEQ ID NO: 143878 - protein, 9 aa, Borrelia burgdorferi B31
FQDKLAAKL

SEQ ID NO: 143879 - protein, 15 aa, Borrelia burgdorferi B31
FFASMLFVMACKAYV

SEQ ID NO: 143880 - protein, 9 aa, Borrelia burgdorferi B31
FASMLFVMA

SEQ ID NO: 143881 - protein, 15 aa, Borrelia burgdorferi B31
FASMLFVMACKAYVE

SEQ ID NO: 143882 - protein, 9 aa, Borrelia burgdorferi B31
FASMLFVMA

SEQ ID NO: 143883 - protein, 15 aa, Borrelia burgdorferi B31
QDKLAAKLAALKAAK

SEQ ID NO: 143884 - protein, 9 aa, Borrelia burgdorferi B31
LAAKLAALK

SEQ ID NO: 143885 - protein, 15 aa, Borrelia burgdorferi B31
LAAKLAALKAAKNTI

SEQ ID NO: 143886 - protein, 9 aa, Borrelia burgdorferi B31
LAALKAAKN

SEQ ID NO: 143887 - protein, 15 aa, Borrelia burgdorferi B31
AKLVGVTVPLLGSNT

SEQ ID NO: 143888 - protein, 9 aa, Borrelia burgdorferi B31
LVGVTVPLL

SEQ ID NO: 143889 - protein, 15 aa, Borrelia burgdorferi B31
AAKLAALKAAKNTIE

SEQ ID NO: 143890 - protein, 9 aa, Borrelia burgdorferi B31
LAALKAAKN

SEQ ID NO: 143891 - protein, 15 aa, Borrelia burgdorferi B31
EAKLVGVTVPLLGSN

SEQ ID NO: 143892 - protein, 9 aa, Borrelia burgdorferi B31
LVGVTVPLL

SEQ ID NO: 143893 - protein, 15 aa, Borrelia burgdorferi B31
LNLQNSFQDKLAAKL

SEQ ID NO: 143894 - protein, 9 aa, Borrelia burgdorferi B31
LNLQNSFQD

SEQ ID NO: 143895 - protein, 15 aa, Borrelia burgdorferi B31
SEAKLVGVTVPLLGS

SEQ ID NO: 143896 - protein, 9 aa, Borrelia burgdorferi B31
LVGVTVPLL

SEQ ID NO: 143897 - protein, 15 aa, Borrelia burgdorferi B31
KLVGVTVPLLGSNTS

SEQ ID NO: 143898 - protein, 9 aa, Borrelia burgdorferi B31
LVGVTVPLL

SEQ ID NO: 143899 - protein, 15 aa, Borrelia burgdorferi B31
AKLAALKAAKNTIEN

SEQ ID NO: 143900 - protein, 9 aa, Borrelia burgdorferi B31
LAALKAAKN

SEQ ID NO: 143901 - protein, 15 aa, Borrelia burgdorferi B31
WSEAKLVGVTVPLLG

SEQ ID NO: 143902 - protein, 9 aa, Borrelia burgdorferi B31
LVGVTVPLL

SEQ ID NO: 143903 - protein, 15 aa, Borrelia burgdorferi B31
LVGVTVPLLGSNTSG

SEQ ID NO: 143904 - protein, 9 aa, Borrelia burgdorferi B31
LVGVTVPLL

SEQ ID NO: 143905 - protein, 15 aa, Borrelia burgdorferi B31
IWSEAKLVGVTVPLL

SEQ ID NO: 143906 - protein, 9 aa, Borrelia burgdorferi B31
EAKLVGVTV

SEQ ID NO: 143907 - protein, 15 aa, Borrelia burgdorferi B31
GVTVPLLGSNTSGNG

SEQ ID NO: 143908 - protein, 9 aa, Borrelia burgdorferi B31
VPLLGSNTS

SEQ ID NO: 143909 - protein, 15 aa, Borrelia burgdorferi B31
VGVTVPLLGSNTSGN

SEQ ID NO: 143910 - protein, 9 aa, Borrelia burgdorferi B31
VPLLGSNTS

SEQ ID NO: 143911 - protein, 15 aa, Borrelia burgdorferi B31
VTVPLLGSNTSGNGD

SEQ ID NO: 143912 - protein, 9 aa, Borrelia burgdorferi B31
VPLLGSNTS

SEQ ID NO: 143913 - protein, 15 aa, Borrelia burgdorferi B31
SMLFVMACKAYVEEK

SEQ ID NO: 143914 - protein, 9 aa, Borrelia burgdorferi B31
FVMACKAYV

SEQ ID NO: 143915 - protein, 15 aa, Borrelia burgdorferi B31
ASMLFVMACKAYVEE

SEQ ID NO: 143916 - protein, 9 aa, Borrelia burgdorferi B31
FVMACKAYV

SEQ ID NO: 143917 - protein, 15 aa, Borrelia burgdorferi B31
MLFVMACKAYVEEKK

SEQ ID NO: 143918 - protein, 9 aa, Borrelia burgdorferi B31
FVMACKAYV

SEQ ID NO: 143919 - protein, 15 aa, Borrelia burgdorferi B31
KNIFKLFFASMLFVM

SEQ ID NO: 143920 - protein, 9 aa, Borrelia burgdorferi B31
FKLFFASML

SEQ ID NO: 143921 - protein, 15 aa, Borrelia burgdorferi B31
NKNIFKLFFASMLFV

SEQ ID NO: 143922 - protein, 9 aa, Borrelia burgdorferi B31
FKLFFASML

SEQ ID NO: 143923 - protein, 15 aa, Borrelia burgdorferi B31
KLAALKAAKNTIENI

SEQ ID NO: 143924 - protein, 9 aa, Borrelia burgdorferi B31
LAALKAAKN

SEQ ID NO: 143925 - protein, 15 aa, Borrelia burgdorferi B31
LAALKAAKNTIENIT

SEQ ID NO: 143926 - protein, 9 aa, Borrelia burgdorferi B31
LAALKAAKN

SEQ ID NO: 143927 - protein, 15 aa, Borrelia burgdorferi B31
MRNKNIFKLFFASML

SEQ ID NO: 143928 - protein, 9 aa, Borrelia burgdorferi B31
IFKLFFASM

SEQ ID NO: 143929 - protein, 15 aa, Borrelia burgdorferi B31
RNKNIFKLFFASMLF

SEQ ID NO: 143930 - protein, 9 aa, Borrelia burgdorferi B31
FKLFFASML

SEQ ID NO: 143931 - protein, 15 aa, Borrelia burgdorferi B31
TVPLLGSNTSGNGDK

SEQ ID NO: 143932 - protein, 9 aa, Borrelia burgdorferi B31
VPLLGSNTS

SEQ ID NO: 143933 - protein, 15 aa, Borrelia burgdorferi B31
VPLLGSNTSGNGDKM

SEQ ID NO: 143934 - protein, 9 aa, Borrelia burgdorferi B31
VPLLGSNTS

SEQ ID NO: 143935 - protein, 15 aa, Borrelia burgdorferi B31
LFVMACKAYVEEKKE

SEQ ID NO: 143936 - protein, 9 aa, Borrelia burgdorferi B31
FVMACKAYV

SEQ ID NO: 143937 - protein, 15 aa, Borrelia burgdorferi B31
FVMACKAYVEEKKEI

SEQ ID NO: 143938 - protein, 9 aa, Borrelia burgdorferi B31
FVMACKAYV

SEQ ID NO: 143939 - protein, 15 aa, Borrelia burgdorferi B31
AELKEKLLNLQNSFQ

SEQ ID NO: 143940 - protein, 9 aa, Borrelia burgdorferi B31
LKEKLLNLQ

SEQ ID NO: 143941 - protein, 15 aa, Borrelia burgdorferi B31
LKEKLLNLQNSFQDK

SEQ ID NO: 143942 - protein, 9 aa, Borrelia burgdorferi B31
LLNLQNSFQ

SEQ ID NO: 143943 - protein, 15 aa, Borrelia burgdorferi B31
ELKEKLLNLQNSFQD

SEQ ID NO: 143944 - protein, 9 aa, Borrelia burgdorferi B31
LLNLQNSFQ

SEQ ID NO: 143945 - protein, 15 aa, Borrelia burgdorferi B31
KEKLLNLQNSFQDKL

SEQ ID NO: 143946 - protein, 9 aa, Borrelia burgdorferi B31
LLNLQNSFQ

SEQ ID NO: 143947 - protein, 15 aa, Borrelia burgdorferi B31
EKLLNLQNSFQDKLA

SEQ ID NO: 143948 - protein, 9 aa, Borrelia burgdorferi B31
LLNLQNSFQ

SEQ ID NO: 143949 - protein, 15 aa, Borrelia burgdorferi B31
KLLNLQNSFQDKLAA

SEQ ID NO: 143950 - protein, 9 aa, Borrelia burgdorferi B31
LLNLQNSFQ

SEQ ID NO: 143951 - protein, 15 aa, Borrelia burgdorferi B31
LLNLQNSFQDKLAAK

SEQ ID NO: 143952 - protein, 9 aa, Borrelia burgdorferi B31
LLNLQNSFQ

SEQ ID NO: 143953 - protein, 15 aa, Borrelia burgdorferi B31
GVTVPLLGSNTSGNG

SEQ ID NO: 143954 - protein, 9 aa, Borrelia burgdorferi B31
LLGSNTSGN

SEQ ID NO: 143955 - protein, 15 aa, Borrelia burgdorferi B31
VTVPLLGSNTSGNGD

SEQ ID NO: 143956 - protein, 9 aa, Borrelia burgdorferi B31
LLGSNTSGN

SEQ ID NO: 143957 - protein, 15 aa, Borrelia burgdorferi B31
VGVTVPLLGSNTSGN

SEQ ID NO: 143958 - protein, 9 aa, Borrelia burgdorferi B31
VPLLGSNTS

SEQ ID NO: 143959 - protein, 15 aa, Borrelia burgdorferi B31
TVPLLGSNTSGNGDK

SEQ ID NO: 143960 - protein, 9 aa, Borrelia burgdorferi B31
LLGSNTSGN

SEQ ID NO: 143961 - protein, 15 aa, Borrelia burgdorferi B31
VPLLGSNTSGNGDKM

SEQ ID NO: 143962 - protein, 9 aa, Borrelia burgdorferi B31
LLGSNTSGN

SEQ ID NO: 143963 - protein, 15 aa, Borrelia burgdorferi B31
FFASMLFVMACKAYV

SEQ ID NO: 143964 - protein, 9 aa, Borrelia burgdorferi B31
LFVMACKAY

SEQ ID NO: 143965 - protein, 15 aa, Borrelia burgdorferi B31
FASMLFVMACKAYVE

SEQ ID NO: 143966 - protein, 9 aa, Borrelia burgdorferi B31
FVMACKAYV

SEQ ID NO: 143967 - protein, 15 aa, Borrelia burgdorferi B31
ASMLFVMACKAYVEE

SEQ ID NO: 143968 - protein, 9 aa, Borrelia burgdorferi B31
FVMACKAYV

SEQ ID NO: 143969 - protein, 15 aa, Borrelia burgdorferi B31
SMLFVMACKAYVEEK

SEQ ID NO: 143970 - protein, 9 aa, Borrelia burgdorferi B31
FVMACKAYV

SEQ ID NO: 143971 - protein, 15 aa, Borrelia burgdorferi B31
MLFVMACKAYVEEKK

SEQ ID NO: 143972 - protein, 9 aa, Borrelia burgdorferi B31
FVMACKAYV

SEQ ID NO: 143973 - protein, 15 aa, Borrelia burgdorferi B31
KNIFKLFFASMLFVM

SEQ ID NO: 143974 - protein, 9 aa, Borrelia burgdorferi B31
LFFASMLFV

SEQ ID NO: 143975 - protein, 15 aa, Borrelia burgdorferi B31
NIFKLFFASMLFVMA

SEQ ID NO: 143976 - protein, 9 aa, Borrelia burgdorferi B31
LFFASMLFV

SEQ ID NO: 143977 - protein, 15 aa, Borrelia burgdorferi B31
IFKLFFASMLFVMAC

SEQ ID NO: 143978 - protein, 9 aa, Borrelia burgdorferi B31
LFFASMLFV

SEQ ID NO: 143979 - protein, 15 aa, Borrelia burgdorferi B31
FKLFFASMLFVMACK

SEQ ID NO: 143980 - protein, 9 aa, Borrelia burgdorferi B31
LFFASMLFV

SEQ ID NO: 143981 - protein, 15 aa, Borrelia burgdorferi B31
NKNIFKLFFASMLFV

SEQ ID NO: 143982 - protein, 9 aa, Borrelia burgdorferi B31
FKLFFASML

SEQ ID NO: 143983 - protein, 15 aa, Borrelia burgdorferi B31
KLFFASMLFVMACKA

SEQ ID NO: 143984 - protein, 9 aa, Borrelia burgdorferi B31
FFASMLFVM

SEQ ID NO: 143985 - protein, 15 aa, Borrelia burgdorferi B31
KLVGVTVPLLGSNTS

SEQ ID NO: 143986 - protein, 9 aa, Borrelia burgdorferi B31
VGVTVPLLG

SEQ ID NO: 143987 - protein, 15 aa, Borrelia burgdorferi B31
GVTVPLLGSNTSGNG

SEQ ID NO: 143988 - protein, 9 aa, Borrelia burgdorferi B31
VPLLGSNTS

SEQ ID NO: 143989 - protein, 15 aa, Borrelia burgdorferi B31
VTVPLLGSNTSGNGD

SEQ ID NO: 143990 - protein, 9 aa, Borrelia burgdorferi B31
VPLLGSNTS

SEQ ID NO: 143991 - protein, 15 aa, Borrelia burgdorferi B31
VGVTVPLLGSNTSGN

SEQ ID NO: 143992 - protein, 9 aa, Borrelia burgdorferi B31
VPLLGSNTS

SEQ ID NO: 143993 - protein, 15 aa, Borrelia burgdorferi B31
LVGVTVPLLGSNTSG

SEQ ID NO: 143994 - protein, 9 aa, Borrelia burgdorferi B31
VPLLGSNTS

SEQ ID NO: 143995 - protein, 15 aa, Borrelia burgdorferi B31
WSEAKLVGVTVPLLG

SEQ ID NO: 143996 - protein, 9 aa, Borrelia burgdorferi B31
AKLVGVTVP

SEQ ID NO: 143997 - protein, 15 aa, Borrelia burgdorferi B31
SEAKLVGVTVPLLGS

SEQ ID NO: 143998 - protein, 9 aa, Borrelia burgdorferi B31
VGVTVPLLG

SEQ ID NO: 143999 - protein, 15 aa, Borrelia burgdorferi B31
VPLLGSNTSGNGDKM

SEQ ID NO: 144000 - protein, 9 aa, Borrelia burgdorferi B31
VPLLGSNTS

SEQ ID NO: 144001 - protein, 15 aa, Borrelia burgdorferi B31
TVPLLGSNTSGNGDK

SEQ ID NO: 144002 - protein, 9 aa, Borrelia burgdorferi B31
VPLLGSNTS

SEQ ID NO: 144003 - protein, 15 aa, Borrelia burgdorferi B31
EAKLVGVTVPLLGSN

SEQ ID NO: 144004 - protein, 9 aa, Borrelia burgdorferi B31
VGVTVPLLG

SEQ ID NO: 144005 - protein, 15 aa, Borrelia burgdorferi B31
AKLVGVTVPLLGSNT

SEQ ID NO: 144006 - protein, 9 aa, Borrelia burgdorferi B31
VGVTVPLLG

SEQ ID NO: 144007 - protein, 15 aa, Borrelia burgdorferi B31
ELKEKLLNLQNSFQD

SEQ ID NO: 144008 - protein, 9 aa, Borrelia burgdorferi B31
LLNLQNSFQ

SEQ ID NO: 144009 - protein, 15 aa, Borrelia burgdorferi B31
LKEKLLNLQNSFQDK

SEQ ID NO: 144010 - protein, 9 aa, Borrelia burgdorferi B31
LLNLQNSFQ

SEQ ID NO: 144011 - protein, 15 aa, Borrelia burgdorferi B31
AELKEKLLNLQNSFQ

SEQ ID NO: 144012 - protein, 9 aa, Borrelia burgdorferi B31
LKEKLLNLQ

SEQ ID NO: 144013 - protein, 15 aa, Borrelia burgdorferi B31
KEKLLNLQNSFQDKL

SEQ ID NO: 144014 - protein, 9 aa, Borrelia burgdorferi B31
LLNLQNSFQ

SEQ ID NO: 144015 - protein, 15 aa, Borrelia burgdorferi B31
EKLLNLQNSFQDKLA

SEQ ID NO: 144016 - protein, 9 aa, Borrelia burgdorferi B31
LLNLQNSFQ

SEQ ID NO: 144017 - protein, 15 aa, Borrelia burgdorferi B31
MEDVLALVNDSSGGK

SEQ ID NO: 144018 - protein, 9 aa, Borrelia burgdorferi B31
VLALVNDSS

SEQ ID NO: 144019 - protein, 15 aa, Borrelia burgdorferi B31
EDVLALVNDSSGGKF

SEQ ID NO: 144020 - protein, 9 aa, Borrelia burgdorferi B31
VLALVNDSS

SEQ ID NO: 144021 - protein, 15 aa, Borrelia burgdorferi B31
DVLALVNDSSGGKFK

SEQ ID NO: 144022 - protein, 9 aa, Borrelia burgdorferi B31
LVNDSSGGK

SEQ ID NO: 144023 - protein, 15 aa, Borrelia burgdorferi B31
KNIFKLFFASMLFVM

SEQ ID NO: 144024 - protein, 9 aa, Borrelia burgdorferi B31
IFKLFFASM

SEQ ID NO: 144025 - protein, 15 aa, Borrelia burgdorferi B31
VLALVNDSSGGKFKD

SEQ ID NO: 144026 - protein, 9 aa, Borrelia burgdorferi B31
LVNDSSGGK

SEQ ID NO: 144027 - protein, 15 aa, Borrelia burgdorferi B31
AELKEKLLNLQNSFQ

SEQ ID NO: 144028 - protein, 9 aa, Borrelia burgdorferi B31
LKEKLLNLQ

SEQ ID NO: 144029 - protein, 15 aa, Borrelia burgdorferi B31
DIGNAELKEKLLNLQ

SEQ ID NO: 144030 - protein, 9 aa, Borrelia burgdorferi B31
DIGNAELKE

SEQ ID NO: 144031 - protein, 15 aa, Borrelia burgdorferi B31
IGNAELKEKLLNLQN

SEQ ID NO: 144032 - protein, 9 aa, Borrelia burgdorferi B31
LKEKLLNLQ

SEQ ID NO: 144033 - protein, 15 aa, Borrelia burgdorferi B31
GNAELKEKLLNLQNS

SEQ ID NO: 144034 - protein, 9 aa, Borrelia burgdorferi B31
LKEKLLNLQ

SEQ ID NO: 144035 - protein, 15 aa, Borrelia burgdorferi B31
NAELKEKLLNLQNSF

SEQ ID NO: 144036 - protein, 9 aa, Borrelia burgdorferi B31
LKEKLLNLQ

SEQ ID NO: 144037 - protein, 15 aa, Borrelia burgdorferi B31
ELKEKLLNLQNSFQD

SEQ ID NO: 144038 - protein, 9 aa, Borrelia burgdorferi B31
LKEKLLNLQ

SEQ ID NO: 144039 - protein, 15 aa, Borrelia burgdorferi B31
LKEKLLNLQNSFQDK

SEQ ID NO: 144040 - protein, 9 aa, Borrelia burgdorferi B31
LKEKLLNLQ

SEQ ID NO: 144041 - protein, 15 aa, Borrelia burgdorferi B31
KLVGVTVPLLGSNTS

SEQ ID NO: 144042 - protein, 9 aa, Borrelia burgdorferi B31
VGVTVPLLG

SEQ ID NO: 144043 - protein, 15 aa, Borrelia burgdorferi B31
IFNLGQILSKLSQDS

SEQ ID NO: 144044 - protein, 9 aa, Borrelia burgdorferi B31
LGQILSKLS

SEQ ID NO: 144045 - protein, 15 aa, Borrelia burgdorferi B31
FNLGQILSKLSQDSN

SEQ ID NO: 144046 - protein, 9 aa, Borrelia burgdorferi B31
LGQILSKLS

SEQ ID NO: 144047 - protein, 15 aa, Borrelia burgdorferi B31
GKIFNLGQILSKLSQ

SEQ ID NO: 144048 - protein, 9 aa, Borrelia burgdorferi B31
LGQILSKLS

SEQ ID NO: 144049 - protein, 15 aa, Borrelia burgdorferi B31
EGKIFNLGQILSKLS

SEQ ID NO: 144050 - protein, 9 aa, Borrelia burgdorferi B31
IFNLGQILS

SEQ ID NO: 144051 - protein, 15 aa, Borrelia burgdorferi B31
KIFNLGQILSKLSQD

SEQ ID NO: 144052 - protein, 9 aa, Borrelia burgdorferi B31
LGQILSKLS

SEQ ID NO: 144053 - protein, 15 aa, Borrelia burgdorferi B31
LGQILSKLSQDSNYR

SEQ ID NO: 144054 - protein, 9 aa, Borrelia burgdorferi B31
ILSKLSQDS

SEQ ID NO: 144055 - protein, 15 aa, Borrelia burgdorferi B31
SKIFFNANSTVHFDS

SEQ ID NO: 144056 - protein, 9 aa, Borrelia burgdorferi B31
FFNANSTVH

SEQ ID NO: 144057 - protein, 15 aa, Borrelia burgdorferi B31
KIFFNANSTVHFDSH

SEQ ID NO: 144058 - protein, 9 aa, Borrelia burgdorferi B31
FNANSTVHF

SEQ ID NO: 144059 - protein, 15 aa, Borrelia burgdorferi B31
NLGQILSKLSQDSNY

SEQ ID NO: 144060 - protein, 9 aa, Borrelia burgdorferi B31
ILSKLSQDS

SEQ ID NO: 144061 - protein, 15 aa, Borrelia burgdorferi B31
FSKIFFNANSTVHFD

SEQ ID NO: 144062 - protein, 9 aa, Borrelia burgdorferi B31
FFNANSTVH

SEQ ID NO: 144063 - protein, 15 aa, Borrelia burgdorferi B31
IFSKIFFNANSTVHF

SEQ ID NO: 144064 - protein, 9 aa, Borrelia burgdorferi B31
FFNANSTVH

SEQ ID NO: 144065 - protein, 15 aa, Borrelia burgdorferi B31
LIAIFLLHVLTVLIL

SEQ ID NO: 144066 - protein, 9 aa, Borrelia burgdorferi B31
LLHVLTVLI

SEQ ID NO: 144067 - protein, 15 aa, Borrelia burgdorferi B31
IFFNANSTVHFDSHE

SEQ ID NO: 144068 - protein, 9 aa, Borrelia burgdorferi B31
FNANSTVHF

SEQ ID NO: 144069 - protein, 15 aa, Borrelia burgdorferi B31
DIILDLVNTTTNILA

SEQ ID NO: 144070 - protein, 9 aa, Borrelia burgdorferi B31
LVNTTTNIL

SEQ ID NO: 144071 - protein, 15 aa, Borrelia burgdorferi B31
IAIFLLHVLTVLILI

SEQ ID NO: 144072 - protein, 9 aa, Borrelia burgdorferi B31
LLHVLTVLI

SEQ ID NO: 144073 - protein, 15 aa, Borrelia burgdorferi B31
NDTLRSKNSRAQFAN

SEQ ID NO: 144074 - protein, 9 aa, Borrelia burgdorferi B31
LRSKNSRAQ

SEQ ID NO: 144075 - protein, 15 aa, Borrelia burgdorferi B31
AIFLLHVLTVLILIS

SEQ ID NO: 144076 - protein, 9 aa, Borrelia burgdorferi B31
LLHVLTVLI

SEQ ID NO: 144077 - protein, 15 aa, Borrelia burgdorferi B31
LNDTLRSKNSRAQFA

SEQ ID NO: 144078 - protein, 9 aa, Borrelia burgdorferi B31
LRSKNSRAQ

SEQ ID NO: 144079 - protein, 15 aa, Borrelia burgdorferi B31
DTLRSKNSRAQFANI

SEQ ID NO: 144080 - protein, 9 aa, Borrelia burgdorferi B31
LRSKNSRAQ

SEQ ID NO: 144081 - protein, 15 aa, Borrelia burgdorferi B31
IILDLVNTTTNILAP

SEQ ID NO: 144082 - protein, 9 aa, Borrelia burgdorferi B31
LVNTTTNIL

SEQ ID NO: 144083 - protein, 15 aa, Borrelia burgdorferi B31
ILDLVNTTTNILAPI

SEQ ID NO: 144084 - protein, 9 aa, Borrelia burgdorferi B31
LVNTTTNIL

SEQ ID NO: 144085 - protein, 15 aa, Borrelia burgdorferi B31
IFLLHVLTVLILISC

SEQ ID NO: 144086 - protein, 9 aa, Borrelia burgdorferi B31
LLHVLTVLI

SEQ ID NO: 144087 - protein, 15 aa, Borrelia burgdorferi B31
HDIILDLVNTTTNIL

SEQ ID NO: 144088 - protein, 9 aa, Borrelia burgdorferi B31
ILDLVNTTT

SEQ ID NO: 144089 - protein, 15 aa, Borrelia burgdorferi B31
KLIAIFLLHVLTVLI

SEQ ID NO: 144090 - protein, 9 aa, Borrelia burgdorferi B31
IFLLHVLTV

SEQ ID NO: 144091 - protein, 15 aa, Borrelia burgdorferi B31
LDLVNTTTNILAPIQ

SEQ ID NO: 144092 - protein, 9 aa, Borrelia burgdorferi B31
LVNTTTNIL

SEQ ID NO: 144093 - protein, 15 aa, Borrelia burgdorferi B31
GQILSKLSQDSNYRG

SEQ ID NO: 144094 - protein, 9 aa, Borrelia burgdorferi B31
ILSKLSQDS

SEQ ID NO: 144095 - protein, 15 aa, Borrelia burgdorferi B31
EIFSKIFFNANSTVH

SEQ ID NO: 144096 - protein, 9 aa, Borrelia burgdorferi B31
IFFNANSTV

SEQ ID NO: 144097 - protein, 15 aa, Borrelia burgdorferi B31
YNTNPDLQTDVSKLN

SEQ ID NO: 144098 - protein, 9 aa, Borrelia burgdorferi B31
YNTNPDLQT

SEQ ID NO: 144099 - protein, 15 aa, Borrelia burgdorferi B31
SKLNDTLRSKNSRAQ

SEQ ID NO: 144100 - protein, 9 aa, Borrelia burgdorferi B31
NDTLRSKNS

SEQ ID NO: 144101 - protein, 15 aa, Borrelia burgdorferi B31
KETLINRGFSIQLAM

SEQ ID NO: 144102 - protein, 9 aa, Borrelia burgdorferi B31
INRGFSIQL

SEQ ID NO: 144103 - protein, 15 aa, Borrelia burgdorferi B31
VKETLINRGFSIQLA

SEQ ID NO: 144104 - protein, 9 aa, Borrelia burgdorferi B31
INRGFSIQL

SEQ ID NO: 144105 - protein, 15 aa, Borrelia burgdorferi B31
NKLIAIFLLHVLTVL

SEQ ID NO: 144106 - protein, 9 aa, Borrelia burgdorferi B31
LIAIFLLHV

SEQ ID NO: 144107 - protein, 15 aa, Borrelia burgdorferi B31
ETLINRGFSIQLAME

SEQ ID NO: 144108 - protein, 9 aa, Borrelia burgdorferi B31
INRGFSIQL

SEQ ID NO: 144109 - protein, 15 aa, Borrelia burgdorferi B31
TLINRGFSIQLAMEE

SEQ ID NO: 144110 - protein, 9 aa, Borrelia burgdorferi B31
INRGFSIQL

SEQ ID NO: 144111 - protein, 15 aa, Borrelia burgdorferi B31
KLNDTLRSKNSRAQF

SEQ ID NO: 144112 - protein, 9 aa, Borrelia burgdorferi B31
LRSKNSRAQ

SEQ ID NO: 144113 - protein, 15 aa, Borrelia burgdorferi B31
NNKLIAIFLLHVLTV

SEQ ID NO: 144114 - protein, 9 aa, Borrelia burgdorferi B31
LIAIFLLHV

SEQ ID NO: 144115 - protein, 15 aa, Borrelia burgdorferi B31
LKNNKLIAIFLLHVL

SEQ ID NO: 144116 - protein, 9 aa, Borrelia burgdorferi B31
LIAIFLLHV

SEQ ID NO: 144117 - protein, 15 aa, Borrelia burgdorferi B31
FFNANSTVHFDSHEY

SEQ ID NO: 144118 - protein, 9 aa, Borrelia burgdorferi B31
FNANSTVHF

SEQ ID NO: 144119 - protein, 15 aa, Borrelia burgdorferi B31
FLLHVLTVLILISCS

SEQ ID NO: 144120 - protein, 9 aa, Borrelia burgdorferi B31
LHVLTVLIL

SEQ ID NO: 144121 - protein, 15 aa, Borrelia burgdorferi B31
TLRSKNSRAQFANIH

SEQ ID NO: 144122 - protein, 9 aa, Borrelia burgdorferi B31
LRSKNSRAQ

SEQ ID NO: 144123 - protein, 15 aa, Borrelia burgdorferi B31
LLHVLTVLILISCSL

SEQ ID NO: 144124 - protein, 9 aa, Borrelia burgdorferi B31
LLHVLTVLI

SEQ ID NO: 144125 - protein, 15 aa, Borrelia burgdorferi B31
LRSKNSRAQFANIHD

SEQ ID NO: 144126 - protein, 9 aa, Borrelia burgdorferi B31
LRSKNSRAQ

SEQ ID NO: 144127 - protein, 15 aa, Borrelia burgdorferi B31
ILKNNKLIAIFLLHV

SEQ ID NO: 144128 - protein, 9 aa, Borrelia burgdorferi B31
LKNNKLIAI

SEQ ID NO: 144129 - protein, 15 aa, Borrelia burgdorferi B31
KNNKLIAIFLLHVLT

SEQ ID NO: 144130 - protein, 9 aa, Borrelia burgdorferi B31
LIAIFLLHV

SEQ ID NO: 144131 - protein, 15 aa, Borrelia burgdorferi B31
VLTVLILISCSLEVK

SEQ ID NO: 144132 - protein, 9 aa, Borrelia burgdorferi B31
ILISCSLEV

SEQ ID NO: 144133 - protein, 15 aa, Borrelia burgdorferi B31
HVLTVLILISCSLEV

SEQ ID NO: 144134 - protein, 9 aa, Borrelia burgdorferi B31
VLILISCSL

SEQ ID NO: 144135 - protein, 15 aa, Borrelia burgdorferi B31
LTVLILISCSLEVKD

SEQ ID NO: 144136 - protein, 9 aa, Borrelia burgdorferi B31
ILISCSLEV

SEQ ID NO: 144137 - protein, 15 aa, Borrelia burgdorferi B31
SNYRGLVKETLINRG

SEQ ID NO: 144138 - protein, 9 aa, Borrelia burgdorferi B31
YRGLVKETL

SEQ ID NO: 144139 - protein, 15 aa, Borrelia burgdorferi B31
LVKETLINRGFSIQL

SEQ ID NO: 144140 - protein, 9 aa, Borrelia burgdorferi B31
LINRGFSIQ

SEQ ID NO: 144141 - protein, 15 aa, Borrelia burgdorferi B31
IDEYNTNPDLQTDVS

SEQ ID NO: 144142 - protein, 9 aa, Borrelia burgdorferi B31
YNTNPDLQT

SEQ ID NO: 144143 - protein, 15 aa, Borrelia burgdorferi B31
DEYNTNPDLQTDVSK

SEQ ID NO: 144144 - protein, 9 aa, Borrelia burgdorferi B31
YNTNPDLQT

SEQ ID NO: 144145 - protein, 15 aa, Borrelia burgdorferi B31
LHVLTVLILISCSLE

SEQ ID NO: 144146 - protein, 9 aa, Borrelia burgdorferi B31
VLILISCSL

SEQ ID NO: 144147 - protein, 15 aa, Borrelia burgdorferi B31
DNILKNNKLIAIFLL

SEQ ID NO: 144148 - protein, 9 aa, Borrelia burgdorferi B31
LKNNKLIAI

SEQ ID NO: 144149 - protein, 15 aa, Borrelia burgdorferi B31
NILKNNKLIAIFLLH

SEQ ID NO: 144150 - protein, 9 aa, Borrelia burgdorferi B31
LKNNKLIAI

SEQ ID NO: 144151 - protein, 15 aa, Borrelia burgdorferi B31
KDNILKNNKLIAIFL

SEQ ID NO: 144152 - protein, 9 aa, Borrelia burgdorferi B31
LKNNKLIAI

SEQ ID NO: 144153 - protein, 15 aa, Borrelia burgdorferi B31
LIDEYNTNPDLQTDV

SEQ ID NO: 144154 - protein, 9 aa, Borrelia burgdorferi B31
YNTNPDLQT

SEQ ID NO: 144155 - protein, 15 aa, Borrelia burgdorferi B31
DLIDEYNTNPDLQTD

SEQ ID NO: 144156 - protein, 9 aa, Borrelia burgdorferi B31
YNTNPDLQT

SEQ ID NO: 144157 - protein, 15 aa, Borrelia burgdorferi B31
ENIIQISEMDSSRGE

SEQ ID NO: 144158 - protein, 9 aa, Borrelia burgdorferi B31
ISEMDSSRG

SEQ ID NO: 144159 - protein, 15 aa, Borrelia burgdorferi B31
DSNYRGLVKETLINR

SEQ ID NO: 144160 - protein, 9 aa, Borrelia burgdorferi B31
YRGLVKETL

SEQ ID NO: 144161 - protein, 15 aa, Borrelia burgdorferi B31
SENIIQISEMDSSRG

SEQ ID NO: 144162 - protein, 9 aa, Borrelia burgdorferi B31
IIQISEMDS

SEQ ID NO: 144163 - protein, 15 aa, Borrelia burgdorferi B31
DDLIDEYNTNPDLQT

SEQ ID NO: 144164 - protein, 9 aa, Borrelia burgdorferi B31
LIDEYNTNP

SEQ ID NO: 144165 - protein, 15 aa, Borrelia burgdorferi B31
IIQISEMDSSRGEPN

SEQ ID NO: 144166 - protein, 9 aa, Borrelia burgdorferi B31
ISEMDSSRG

SEQ ID NO: 144167 - protein, 15 aa, Borrelia burgdorferi B31
LINRGFSIQLAMEEI

SEQ ID NO: 144168 - protein, 9 aa, Borrelia burgdorferi B31
INRGFSIQL

SEQ ID NO: 144169 - protein, 15 aa, Borrelia burgdorferi B31
NIIQISEMDSSRGEP

SEQ ID NO: 144170 - protein, 9 aa, Borrelia burgdorferi B31
ISEMDSSRG

SEQ ID NO: 144171 - protein, 15 aa, Borrelia burgdorferi B31
TVLILISCSLEVKDS

SEQ ID NO: 144172 - protein, 9 aa, Borrelia burgdorferi B31
ILISCSLEV

SEQ ID NO: 144173 - protein, 15 aa, Borrelia burgdorferi B31
QILSKLSQDSNYRGL

SEQ ID NO: 144174 - protein, 9 aa, Borrelia burgdorferi B31
ILSKLSQDS

SEQ ID NO: 144175 - protein, 15 aa, Borrelia burgdorferi B31
ILSKLSQDSNYRGLV

SEQ ID NO: 144176 - protein, 9 aa, Borrelia burgdorferi B31
ILSKLSQDS

SEQ ID NO: 144177 - protein, 15 aa, Borrelia burgdorferi B31
LSQDSNYRGLVKETL

SEQ ID NO: 144178 - protein, 9 aa, Borrelia burgdorferi B31
LSQDSNYRG

SEQ ID NO: 144179 - protein, 15 aa, Borrelia burgdorferi B31
IQISEMDSSRGEPND

SEQ ID NO: 144180 - protein, 9 aa, Borrelia burgdorferi B31
ISEMDSSRG

SEQ ID NO: 144181 - protein, 15 aa, Borrelia burgdorferi B31
PNDQFGMRAEIFSKI

SEQ ID NO: 144182 - protein, 9 aa, Borrelia burgdorferi B31
FGMRAEIFS

SEQ ID NO: 144183 - protein, 15 aa, Borrelia burgdorferi B31
VLILISCSLEVKDSN

SEQ ID NO: 144184 - protein, 9 aa, Borrelia burgdorferi B31
ILISCSLEV

SEQ ID NO: 144185 - protein, 15 aa, Borrelia burgdorferi B31
NDQFGMRAEIFSKIF

SEQ ID NO: 144186 - protein, 9 aa, Borrelia burgdorferi B31
FGMRAEIFS

SEQ ID NO: 144187 - protein, 15 aa, Borrelia burgdorferi B31
MKDNILKNNKLIAIF

SEQ ID NO: 144188 - protein, 9 aa, Borrelia burgdorferi B31
LKNNKLIAI

SEQ ID NO: 144189 - protein, 15 aa, Borrelia burgdorferi B31
NPDLQTDVSKLNDTL

SEQ ID NO: 144190 - protein, 9 aa, Borrelia burgdorferi B31
LQTDVSKLN

SEQ ID NO: 144191 - protein, 15 aa, Borrelia burgdorferi B31
NTNPDLQTDVSKLND

SEQ ID NO: 144192 - protein, 9 aa, Borrelia burgdorferi B31
LQTDVSKLN

SEQ ID NO: 144193 - protein, 15 aa, Borrelia burgdorferi B31
TNPDLQTDVSKLNDT

SEQ ID NO: 144194 - protein, 9 aa, Borrelia burgdorferi B31
LQTDVSKLN

SEQ ID NO: 144195 - protein, 15 aa, Borrelia burgdorferi B31
PDLQTDVSKLNDTLR

SEQ ID NO: 144196 - protein, 9 aa, Borrelia burgdorferi B31
LQTDVSKLN

SEQ ID NO: 144197 - protein, 15 aa, Borrelia burgdorferi B31
INRGFSIQLAMEEIS

SEQ ID NO: 144198 - protein, 9 aa, Borrelia burgdorferi B31
INRGFSIQL

SEQ ID NO: 144199 - protein, 15 aa, Borrelia burgdorferi B31
NAPKKILDPEVAKLI

SEQ ID NO: 144200 - protein, 9 aa, Borrelia burgdorferi B31
KKILDPEVA

SEQ ID NO: 144201 - protein, 15 aa, Borrelia burgdorferi B31
APKKILDPEVAKLIQ

SEQ ID NO: 144202 - protein, 9 aa, Borrelia burgdorferi B31
LDPEVAKLI

SEQ ID NO: 144203 - protein, 15 aa, Borrelia burgdorferi B31
NEGKIFNLGQILSKL

SEQ ID NO: 144204 - protein, 9 aa, Borrelia burgdorferi B31
IFNLGQILS

SEQ ID NO: 144205 - protein, 15 aa, Borrelia burgdorferi B31
QDSNYRGLVKETLIN

SEQ ID NO: 144206 - protein, 9 aa, Borrelia burgdorferi B31
YRGLVKETL

SEQ ID NO: 144207 - protein, 15 aa, Borrelia burgdorferi B31
KKILDPEVAKLIQKI

SEQ ID NO: 144208 - protein, 9 aa, Borrelia burgdorferi B31
LDPEVAKLI

SEQ ID NO: 144209 - protein, 15 aa, Borrelia burgdorferi B31
FNEGKIFNLGQILSK

SEQ ID NO: 144210 - protein, 9 aa, Borrelia burgdorferi B31
IFNLGQILS

SEQ ID NO: 144211 - protein, 15 aa, Borrelia burgdorferi B31
YRGLVKETLINRGFS

SEQ ID NO: 144212 - protein, 9 aa, Borrelia burgdorferi B31
YRGLVKETL

SEQ ID NO: 144213 - protein, 15 aa, Borrelia burgdorferi B31
NYRGLVKETLINRGF

SEQ ID NO: 144214 - protein, 9 aa, Borrelia burgdorferi B31
YRGLVKETL

SEQ ID NO: 144215 - protein, 15 aa, Borrelia burgdorferi B31
PKKILDPEVAKLIQK

SEQ ID NO: 144216 - protein, 9 aa, Borrelia burgdorferi B31
LDPEVAKLI

SEQ ID NO: 144217 - protein, 15 aa, Borrelia burgdorferi B31
SQDSNYRGLVKETLI

SEQ ID NO: 144218 - protein, 9 aa, Borrelia burgdorferi B31
YRGLVKETL

SEQ ID NO: 144219 - protein, 15 aa, Borrelia burgdorferi B31
GEPNDQFGMRAEIFS

SEQ ID NO: 144220 - protein, 9 aa, Borrelia burgdorferi B31
QFGMRAEIF

SEQ ID NO: 144221 - protein, 15 aa, Borrelia burgdorferi B31
EPNDQFGMRAEIFSK

SEQ ID NO: 144222 - protein, 9 aa, Borrelia burgdorferi B31
FGMRAEIFS

SEQ ID NO: 144223 - protein, 15 aa, Borrelia burgdorferi B31
DQFGMRAEIFSKIFF

SEQ ID NO: 144224 - protein, 9 aa, Borrelia burgdorferi B31
FGMRAEIFS

SEQ ID NO: 144225 - protein, 15 aa, Borrelia burgdorferi B31
FNANSTVHFDSHEYT

SEQ ID NO: 144226 - protein, 9 aa, Borrelia burgdorferi B31
FNANSTVHF

SEQ ID NO: 144227 - protein, 15 aa, Borrelia burgdorferi B31
EERRMLYTSLNFNEG

SEQ ID NO: 144228 - protein, 9 aa, Borrelia burgdorferi B31
RRMLYTSLN

SEQ ID NO: 144229 - protein, 15 aa, Borrelia burgdorferi B31
KILDPEVAKLIQKIL

SEQ ID NO: 144230 - protein, 9 aa, Borrelia burgdorferi B31
LDPEVAKLI

SEQ ID NO: 144231 - protein, 15 aa, Borrelia burgdorferi B31
VAINNLKNPTKPAAG

SEQ ID NO: 144232 - protein, 9 aa, Borrelia burgdorferi B31
LKNPTKPAA

SEQ ID NO: 144233 - protein, 15 aa, Borrelia burgdorferi B31
INNLKNPTKPAAGKN

SEQ ID NO: 144234 - protein, 9 aa, Borrelia burgdorferi B31
LKNPTKPAA

SEQ ID NO: 144235 - protein, 15 aa, Borrelia burgdorferi B31
NNLKNPTKPAAGKNK

SEQ ID NO: 144236 - protein, 9 aa, Borrelia burgdorferi B31
LKNPTKPAA

SEQ ID NO: 144237 - protein, 15 aa, Borrelia burgdorferi B31
NIHDIILDLVNTTTN

SEQ ID NO: 144238 - protein, 9 aa, Borrelia burgdorferi B31
ILDLVNTTT

SEQ ID NO: 144239 - protein, 15 aa, Borrelia burgdorferi B31
IHDIILDLVNTTTNI

SEQ ID NO: 144240 - protein, 9 aa, Borrelia burgdorferi B31
ILDLVNTTT

SEQ ID NO: 144241 - protein, 15 aa, Borrelia burgdorferi B31
AINNLKNPTKPAAGK

SEQ ID NO: 144242 - protein, 9 aa, Borrelia burgdorferi B31
LKNPTKPAA

SEQ ID NO: 144243 - protein, 15 aa, Borrelia burgdorferi B31
GKVENLLVAINNLKN

SEQ ID NO: 144244 - protein, 9 aa, Borrelia burgdorferi B31
VENLLVAIN

SEQ ID NO: 144245 - protein, 15 aa, Borrelia burgdorferi B31
LVAINNLKNPTKPAA

SEQ ID NO: 144246 - protein, 9 aa, Borrelia burgdorferi B31
INNLKNPTK

SEQ ID NO: 144247 - protein, 15 aa, Borrelia burgdorferi B31
ANIHDIILDLVNTTT

SEQ ID NO: 144248 - protein, 9 aa, Borrelia burgdorferi B31
IILDLVNTT

SEQ ID NO: 144249 - protein, 15 aa, Borrelia burgdorferi B31
LQTDVSKLNDTLRSK

SEQ ID NO: 144250 - protein, 9 aa, Borrelia burgdorferi B31
LQTDVSKLN

SEQ ID NO: 144251 - protein, 15 aa, Borrelia burgdorferi B31
DLQTDVSKLNDTLRS

SEQ ID NO: 144252 - protein, 9 aa, Borrelia burgdorferi B31
LQTDVSKLN

SEQ ID NO: 144253 - protein, 15 aa, Borrelia burgdorferi B31
IFSKIFFNANSTVHF

SEQ ID NO: 144254 - protein, 9 aa, Borrelia burgdorferi B31
FFNANSTVH

SEQ ID NO: 144255 - protein, 15 aa, Borrelia burgdorferi B31
FSKIFFNANSTVHFD

SEQ ID NO: 144256 - protein, 9 aa, Borrelia burgdorferi B31
FFNANSTVH

SEQ ID NO: 144257 - protein, 15 aa, Borrelia burgdorferi B31
SKIFFNANSTVHFDS

SEQ ID NO: 144258 - protein, 9 aa, Borrelia burgdorferi B31
FFNANSTVH

SEQ ID NO: 144259 - protein, 15 aa, Borrelia burgdorferi B31
KIFFNANSTVHFDSH

SEQ ID NO: 144260 - protein, 9 aa, Borrelia burgdorferi B31
FFNANSTVH

SEQ ID NO: 144261 - protein, 15 aa, Borrelia burgdorferi B31
EIFSKIFFNANSTVH

SEQ ID NO: 144262 - protein, 9 aa, Borrelia burgdorferi B31
FSKIFFNAN

SEQ ID NO: 144263 - protein, 15 aa, Borrelia burgdorferi B31
IILDLVNTTTNILAP

SEQ ID NO: 144264 - protein, 9 aa, Borrelia burgdorferi B31
LVNTTTNIL

SEQ ID NO: 144265 - protein, 15 aa, Borrelia burgdorferi B31
DIILDLVNTTTNILA

SEQ ID NO: 144266 - protein, 9 aa, Borrelia burgdorferi B31
LVNTTTNIL

SEQ ID NO: 144267 - protein, 15 aa, Borrelia burgdorferi B31
LDLVNTTTNILAPIQ

SEQ ID NO: 144268 - protein, 9 aa, Borrelia burgdorferi B31
LVNTTTNIL

SEQ ID NO: 144269 - protein, 15 aa, Borrelia burgdorferi B31
ILDLVNTTTNILAPI

SEQ ID NO: 144270 - protein, 9 aa, Borrelia burgdorferi B31
LVNTTTNIL

SEQ ID NO: 144271 - protein, 15 aa, Borrelia burgdorferi B31
HDIILDLVNTTTNIL

SEQ ID NO: 144272 - protein, 9 aa, Borrelia burgdorferi B31
IILDLVNTT

SEQ ID NO: 144273 - protein, 15 aa, Borrelia burgdorferi B31
IFFNANSTVHFDSHE

SEQ ID NO: 144274 - protein, 9 aa, Borrelia burgdorferi B31
FFNANSTVH

SEQ ID NO: 144275 - protein, 15 aa, Borrelia burgdorferi B31
FFNANSTVHFDSHEY

SEQ ID NO: 144276 - protein, 9 aa, Borrelia burgdorferi B31
FFNANSTVH

SEQ ID NO: 144277 - protein, 15 aa, Borrelia burgdorferi B31
ETLYNDFEKLTSLKE

SEQ ID NO: 144278 - protein, 9 aa, Borrelia burgdorferi B31
YNDFEKLTS

SEQ ID NO: 144279 - protein, 15 aa, Borrelia burgdorferi B31
TLYNDFEKLTSLKEK

SEQ ID NO: 144280 - protein, 9 aa, Borrelia burgdorferi B31
FEKLTSLKE

SEQ ID NO: 144281 - protein, 15 aa, Borrelia burgdorferi B31
ENLLVAINNLKNPTK

SEQ ID NO: 144282 - protein, 9 aa, Borrelia burgdorferi B31
LLVAINNLK

SEQ ID NO: 144283 - protein, 15 aa, Borrelia burgdorferi B31
LYNDFEKLTSLKEKW

SEQ ID NO: 144284 - protein, 9 aa, Borrelia burgdorferi B31
FEKLTSLKE

SEQ ID NO: 144285 - protein, 15 aa, Borrelia burgdorferi B31
VENLLVAINNLKNPT

SEQ ID NO: 144286 - protein, 9 aa, Borrelia burgdorferi B31
LVAINNLKN

SEQ ID NO: 144287 - protein, 15 aa, Borrelia burgdorferi B31
SCSLEVKDSNESKKH

SEQ ID NO: 144288 - protein, 9 aa, Borrelia burgdorferi B31
LEVKDSNES

SEQ ID NO: 144289 - protein, 15 aa, Borrelia burgdorferi B31
CSLEVKDSNESKKHK

SEQ ID NO: 144290 - protein, 9 aa, Borrelia burgdorferi B31
LEVKDSNES

SEQ ID NO: 144291 - protein, 15 aa, Borrelia burgdorferi B31
ISCSLEVKDSNESKK

SEQ ID NO: 144292 - protein, 9 aa, Borrelia burgdorferi B31
LEVKDSNES

SEQ ID NO: 144293 - protein, 15 aa, Borrelia burgdorferi B31
LISCSLEVKDSNESK

SEQ ID NO: 144294 - protein, 9 aa, Borrelia burgdorferi B31
LEVKDSNES

SEQ ID NO: 144295 - protein, 15 aa, Borrelia burgdorferi B31
KVENLLVAINNLKNP

SEQ ID NO: 144296 - protein, 9 aa, Borrelia burgdorferi B31
LLVAINNLK

SEQ ID NO: 144297 - protein, 15 aa, Borrelia burgdorferi B31
YNDFEKLTSLKEKWL

SEQ ID NO: 144298 - protein, 9 aa, Borrelia burgdorferi B31
FEKLTSLKE

SEQ ID NO: 144299 - protein, 15 aa, Borrelia burgdorferi B31
GKVENLLVAINNLKN

SEQ ID NO: 144300 - protein, 9 aa, Borrelia burgdorferi B31
LLVAINNLK

SEQ ID NO: 144301 - protein, 15 aa, Borrelia burgdorferi B31
ILISCSLEVKDSNES

SEQ ID NO: 144302 - protein, 9 aa, Borrelia burgdorferi B31
ILISCSLEV

SEQ ID NO: 144303 - protein, 15 aa, Borrelia burgdorferi B31
NDFEKLTSLKEKWLK

SEQ ID NO: 144304 - protein, 9 aa, Borrelia burgdorferi B31
FEKLTSLKE

SEQ ID NO: 144305 - protein, 15 aa, Borrelia burgdorferi B31
EERRMLYTSLNFNEG

SEQ ID NO: 144306 - protein, 9 aa, Borrelia burgdorferi B31
MLYTSLNFN

SEQ ID NO: 144307 - protein, 15 aa, Borrelia burgdorferi B31
NLLVAINNLKNPTKP

SEQ ID NO: 144308 - protein, 9 aa, Borrelia burgdorferi B31
LVAINNLKN

SEQ ID NO: 144309 - protein, 15 aa, Borrelia burgdorferi B31
ENLLVAINNLKNPTK

SEQ ID NO: 144310 - protein, 9 aa, Borrelia burgdorferi B31
LLVAINNLK

SEQ ID NO: 144311 - protein, 15 aa, Borrelia burgdorferi B31
HDIILDLVNTTTNIL

SEQ ID NO: 144312 - protein, 9 aa, Borrelia burgdorferi B31
ILDLVNTTT

SEQ ID NO: 144313 - protein, 15 aa, Borrelia burgdorferi B31
DIILDLVNTTTNILA

SEQ ID NO: 144314 - protein, 9 aa, Borrelia burgdorferi B31
ILDLVNTTT

SEQ ID NO: 144315 - protein, 15 aa, Borrelia burgdorferi B31
VENLLVAINNLKNPT

SEQ ID NO: 144316 - protein, 9 aa, Borrelia burgdorferi B31
LLVAINNLK

SEQ ID NO: 144317 - protein, 15 aa, Borrelia burgdorferi B31
KVENLLVAINNLKNP

SEQ ID NO: 144318 - protein, 9 aa, Borrelia burgdorferi B31
LLVAINNLK

SEQ ID NO: 144319 - protein, 15 aa, Borrelia burgdorferi B31
GKVENLLVAINNLKN

SEQ ID NO: 144320 - protein, 9 aa, Borrelia burgdorferi B31
LLVAINNLK

SEQ ID NO: 144321 - protein, 15 aa, Borrelia burgdorferi B31
KGKVENLLVAINNLK

SEQ ID NO: 144322 - protein, 9 aa, Borrelia burgdorferi B31
VENLLVAIN

SEQ ID NO: 144323 - protein, 15 aa, Borrelia burgdorferi B31
ANIHDIILDLVNTTT

SEQ ID NO: 144324 - protein, 9 aa, Borrelia burgdorferi B31
IILDLVNTT

SEQ ID NO: 144325 - protein, 15 aa, Borrelia burgdorferi B31
NIHDIILDLVNTTTN

SEQ ID NO: 144326 - protein, 9 aa, Borrelia burgdorferi B31
ILDLVNTTT

SEQ ID NO: 144327 - protein, 15 aa, Borrelia burgdorferi B31
IHDIILDLVNTTTNI

SEQ ID NO: 144328 - protein, 9 aa, Borrelia burgdorferi B31
ILDLVNTTT

SEQ ID NO: 144329 - protein, 15 aa, Borrelia burgdorferi B31
IILDLVNTTTNILAP

SEQ ID NO: 144330 - protein, 9 aa, Borrelia burgdorferi B31
LVNTTTNIL

SEQ ID NO: 144331 - protein, 15 aa, Borrelia burgdorferi B31
ILDLVNTTTNILAPI

SEQ ID NO: 144332 - protein, 9 aa, Borrelia burgdorferi B31
LVNTTTNIL

SEQ ID NO: 144333 - protein, 15 aa, Borrelia burgdorferi B31
NLLVAINNLKNPTKP

SEQ ID NO: 144334 - protein, 9 aa, Borrelia burgdorferi B31
LLVAINNLK

SEQ ID NO: 144335 - protein, 15 aa, Borrelia burgdorferi B31
LLVAINNLKNPTKPA

SEQ ID NO: 144336 - protein, 9 aa, Borrelia burgdorferi B31
LLVAINNLK

SEQ ID NO: 144337 - protein, 15 aa, Borrelia burgdorferi B31
RRMLYTSLNFNEGKI

SEQ ID NO: 144338 - protein, 9 aa, Borrelia burgdorferi B31
MLYTSLNFN

SEQ ID NO: 144339 - protein, 15 aa, Borrelia burgdorferi B31
EERRMLYTSLNFNEG

SEQ ID NO: 144340 - protein, 9 aa, Borrelia burgdorferi B31
MLYTSLNFN

SEQ ID NO: 144341 - protein, 15 aa, Borrelia burgdorferi B31
ERRMLYTSLNFNEGK

SEQ ID NO: 144342 - protein, 9 aa, Borrelia burgdorferi B31
MLYTSLNFN

SEQ ID NO: 144343 - protein, 15 aa, Borrelia burgdorferi B31
DDLIDEYNTNPDLQT

SEQ ID NO: 144344 - protein, 9 aa, Borrelia burgdorferi B31
LIDEYNTNP

SEQ ID NO: 144345 - protein, 15 aa, Borrelia burgdorferi B31
EIFSKIFFNANSTVH

SEQ ID NO: 144346 - protein, 9 aa, Borrelia burgdorferi B31
FSKIFFNAN

SEQ ID NO: 144347 - protein, 15 aa, Borrelia burgdorferi B31
TDDLIDEYNTNPDLQ

SEQ ID NO: 144348 - protein, 9 aa, Borrelia burgdorferi B31
LIDEYNTNP

SEQ ID NO: 144349 - protein, 15 aa, Borrelia burgdorferi B31
KDTDDLIDEYNTNPD

SEQ ID NO: 144350 - protein, 9 aa, Borrelia burgdorferi B31
LIDEYNTNP

SEQ ID NO: 144351 - protein, 15 aa, Borrelia burgdorferi B31
GLVKETLINRGFSIQ

SEQ ID NO: 144352 - protein, 9 aa, Borrelia burgdorferi B31
VKETLINRG

SEQ ID NO: 144353 - protein, 15 aa, Borrelia burgdorferi B31
DTDDLIDEYNTNPDL

SEQ ID NO: 144354 - protein, 9 aa, Borrelia burgdorferi B31
LIDEYNTNP

SEQ ID NO: 144355 - protein, 15 aa, Borrelia burgdorferi B31
LKDTDDLIDEYNTNP

SEQ ID NO: 144356 - protein, 9 aa, Borrelia burgdorferi B31
LKDTDDLID

SEQ ID NO: 144357 - protein, 15 aa, Borrelia burgdorferi B31
SNYRGLVKETLINRG

SEQ ID NO: 144358 - protein, 9 aa, Borrelia burgdorferi B31
LVKETLINR

SEQ ID NO: 144359 - protein, 15 aa, Borrelia burgdorferi B31
IFSKIFFNANSTVHF

SEQ ID NO: 144360 - protein, 9 aa, Borrelia burgdorferi B31
FFNANSTVH

SEQ ID NO: 144361 - protein, 15 aa, Borrelia burgdorferi B31
YRGLVKETLINRGFS

SEQ ID NO: 144362 - protein, 9 aa, Borrelia burgdorferi B31
VKETLINRG

SEQ ID NO: 144363 - protein, 15 aa, Borrelia burgdorferi B31
NYRGLVKETLINRGF

SEQ ID NO: 144364 - protein, 9 aa, Borrelia burgdorferi B31
VKETLINRG

SEQ ID NO: 144365 - protein, 15 aa, Borrelia burgdorferi B31
KLIAIFLLHVLTVLI

SEQ ID NO: 144366 - protein, 9 aa, Borrelia burgdorferi B31
IFLLHVLTV

SEQ ID NO: 144367 - protein, 15 aa, Borrelia burgdorferi B31
RGLVKETLINRGFSI

SEQ ID NO: 144368 - protein, 9 aa, Borrelia burgdorferi B31
VKETLINRG

SEQ ID NO: 144369 - protein, 15 aa, Borrelia burgdorferi B31
NIIQISEMDSSRGEP

SEQ ID NO: 144370 - protein, 9 aa, Borrelia burgdorferi B31
ISEMDSSRG

SEQ ID NO: 144371 - protein, 15 aa, Borrelia burgdorferi B31
FSKIFFNANSTVHFD

SEQ ID NO: 144372 - protein, 9 aa, Borrelia burgdorferi B31
FFNANSTVH

SEQ ID NO: 144373 - protein, 15 aa, Borrelia burgdorferi B31
YTEERRMLYTSLNFN

SEQ ID NO: 144374 - protein, 9 aa, Borrelia burgdorferi B31
ERRMLYTSL

SEQ ID NO: 144375 - protein, 15 aa, Borrelia burgdorferi B31
IIQISEMDSSRGEPN

SEQ ID NO: 144376 - protein, 9 aa, Borrelia burgdorferi B31
ISEMDSSRG

SEQ ID NO: 144377 - protein, 15 aa, Borrelia burgdorferi B31
TEERRMLYTSLNFNE

SEQ ID NO: 144378 - protein, 9 aa, Borrelia burgdorferi B31
MLYTSLNFN

SEQ ID NO: 144379 - protein, 15 aa, Borrelia burgdorferi B31
IQISEMDSSRGEPND

SEQ ID NO: 144380 - protein, 9 aa, Borrelia burgdorferi B31
ISEMDSSRG

SEQ ID NO: 144381 - protein, 15 aa, Borrelia burgdorferi B31
LIAIFLLHVLTVLIL

SEQ ID NO: 144382 - protein, 9 aa, Borrelia burgdorferi B31
LLHVLTVLI

SEQ ID NO: 144383 - protein, 15 aa, Borrelia burgdorferi B31
SENIIQISEMDSSRG

SEQ ID NO: 144384 - protein, 9 aa, Borrelia burgdorferi B31
IQISEMDSS

SEQ ID NO: 144385 - protein, 15 aa, Borrelia burgdorferi B31
ENIIQISEMDSSRGE

SEQ ID NO: 144386 - protein, 9 aa, Borrelia burgdorferi B31
ISEMDSSRG

SEQ ID NO: 144387 - protein, 15 aa, Borrelia burgdorferi B31
SKIFFNANSTVHFDS

SEQ ID NO: 144388 - protein, 9 aa, Borrelia burgdorferi B31
FFNANSTVH

SEQ ID NO: 144389 - protein, 15 aa, Borrelia burgdorferi B31
IAIFLLHVLTVLILI

SEQ ID NO: 144390 - protein, 9 aa, Borrelia burgdorferi B31
LLHVLTVLI

SEQ ID NO: 144391 - protein, 15 aa, Borrelia burgdorferi B31
KIFFNANSTVHFDSH

SEQ ID NO: 144392 - protein, 9 aa, Borrelia burgdorferi B31
FFNANSTVH

SEQ ID NO: 144393 - protein, 15 aa, Borrelia burgdorferi B31
LDLVNTTTNILAPIQ

SEQ ID NO: 144394 - protein, 9 aa, Borrelia burgdorferi B31
LVNTTTNIL

SEQ ID NO: 144395 - protein, 15 aa, Borrelia burgdorferi B31
RMLYTSLNFNEGKIF

SEQ ID NO: 144396 - protein, 9 aa, Borrelia burgdorferi B31
MLYTSLNFN

SEQ ID NO: 144397 - protein, 15 aa, Borrelia burgdorferi B31
MLYTSLNFNEGKIFN

SEQ ID NO: 144398 - protein, 9 aa, Borrelia burgdorferi B31
MLYTSLNFN

SEQ ID NO: 144399 - protein, 15 aa, Borrelia burgdorferi B31
ENLLVAINNLKNPTK

SEQ ID NO: 144400 - protein, 9 aa, Borrelia burgdorferi B31
LVAINNLKN

SEQ ID NO: 144401 - protein, 15 aa, Borrelia burgdorferi B31
DDLIDEYNTNPDLQT

SEQ ID NO: 144402 - protein, 9 aa, Borrelia burgdorferi B31
IDEYNTNPD

SEQ ID NO: 144403 - protein, 15 aa, Borrelia burgdorferi B31
DLIDEYNTNPDLQTD

SEQ ID NO: 144404 - protein, 9 aa, Borrelia burgdorferi B31
IDEYNTNPD

SEQ ID NO: 144405 - protein, 15 aa, Borrelia burgdorferi B31
NLLVAINNLKNPTKP

SEQ ID NO: 144406 - protein, 9 aa, Borrelia burgdorferi B31
LVAINNLKN

SEQ ID NO: 144407 - protein, 15 aa, Borrelia burgdorferi B31
GKVENLLVAINNLKN

SEQ ID NO: 144408 - protein, 9 aa, Borrelia burgdorferi B31
VENLLVAIN

SEQ ID NO: 144409 - protein, 15 aa, Borrelia burgdorferi B31
KVENLLVAINNLKNP

SEQ ID NO: 144410 - protein, 9 aa, Borrelia burgdorferi B31
LVAINNLKN

SEQ ID NO: 144411 - protein, 15 aa, Borrelia burgdorferi B31
VENLLVAINNLKNPT

SEQ ID NO: 144412 - protein, 9 aa, Borrelia burgdorferi B31
LVAINNLKN

SEQ ID NO: 144413 - protein, 15 aa, Borrelia burgdorferi B31
ETLYNDFEKLTSLKE

SEQ ID NO: 144414 - protein, 9 aa, Borrelia burgdorferi B31
YNDFEKLTS

SEQ ID NO: 144415 - protein, 15 aa, Borrelia burgdorferi B31
TLYNDFEKLTSLKEK

SEQ ID NO: 144416 - protein, 9 aa, Borrelia burgdorferi B31
FEKLTSLKE

SEQ ID NO: 144417 - protein, 15 aa, Borrelia burgdorferi B31
IILDLVNTTTNILAP

SEQ ID NO: 144418 - protein, 9 aa, Borrelia burgdorferi B31
VNTTTNILA

SEQ ID NO: 144419 - protein, 15 aa, Borrelia burgdorferi B31
KDTDDLIDEYNTNPD

SEQ ID NO: 144420 - protein, 9 aa, Borrelia burgdorferi B31
LIDEYNTNP

SEQ ID NO: 144421 - protein, 15 aa, Borrelia burgdorferi B31
DIILDLVNTTTNILA

SEQ ID NO: 144422 - protein, 9 aa, Borrelia burgdorferi B31
LVNTTTNIL

SEQ ID NO: 144423 - protein, 15 aa, Borrelia burgdorferi B31
TDDLIDEYNTNPDLQ

SEQ ID NO: 144424 - protein, 9 aa, Borrelia burgdorferi B31
IDEYNTNPD

SEQ ID NO: 144425 - protein, 15 aa, Borrelia burgdorferi B31
EERRMLYTSLNFNEG

SEQ ID NO: 144426 - protein, 9 aa, Borrelia burgdorferi B31
RRMLYTSLN

SEQ ID NO: 144427 - protein, 15 aa, Borrelia burgdorferi B31
DTDDLIDEYNTNPDL

SEQ ID NO: 144428 - protein, 9 aa, Borrelia burgdorferi B31
IDEYNTNPD

SEQ ID NO: 144429 - protein, 15 aa, Borrelia burgdorferi B31
LYNDFEKLTSLKEKW

SEQ ID NO: 144430 - protein, 9 aa, Borrelia burgdorferi B31
FEKLTSLKE

SEQ ID NO: 144431 - protein, 15 aa, Borrelia burgdorferi B31
LDLVNTTTNILAPIQ

SEQ ID NO: 144432 - protein, 9 aa, Borrelia burgdorferi B31
VNTTTNILA

SEQ ID NO: 144433 - protein, 15 aa, Borrelia burgdorferi B31
ILDLVNTTTNILAPI

SEQ ID NO: 144434 - protein, 9 aa, Borrelia burgdorferi B31
VNTTTNILA

SEQ ID NO: 144435 - protein, 15 aa, Borrelia burgdorferi B31
YNDFEKLTSLKEKWL

SEQ ID NO: 144436 - protein, 9 aa, Borrelia burgdorferi B31
FEKLTSLKE

SEQ ID NO: 144437 - protein, 15 aa, Borrelia burgdorferi B31
TEERRMLYTSLNFNE

SEQ ID NO: 144438 - protein, 9 aa, Borrelia burgdorferi B31
RRMLYTSLN

SEQ ID NO: 144439 - protein, 15 aa, Borrelia burgdorferi B31
HEYTEERRMLYTSLN

SEQ ID NO: 144440 - protein, 9 aa, Borrelia burgdorferi B31
YTEERRMLY

SEQ ID NO: 144441 - protein, 15 aa, Borrelia burgdorferi B31
LLVAINNLKNPTKPA

SEQ ID NO: 144442 - protein, 9 aa, Borrelia burgdorferi B31
LVAINNLKN

SEQ ID NO: 144443 - protein, 15 aa, Borrelia burgdorferi B31
NDFEKLTSLKEKWLK

SEQ ID NO: 144444 - protein, 9 aa, Borrelia burgdorferi B31
FEKLTSLKE

SEQ ID NO: 144445 - protein, 15 aa, Borrelia burgdorferi B31
LIDEYNTNPDLQTDV

SEQ ID NO: 144446 - protein, 9 aa, Borrelia burgdorferi B31
IDEYNTNPD

SEQ ID NO: 144447 - protein, 15 aa, Borrelia burgdorferi B31
YTEERRMLYTSLNFN

SEQ ID NO: 144448 - protein, 9 aa, Borrelia burgdorferi B31
RRMLYTSLN

SEQ ID NO: 144449 - protein, 15 aa, Borrelia burgdorferi B31
IDEYNTNPDLQTDVS

SEQ ID NO: 144450 - protein, 9 aa, Borrelia burgdorferi B31
IDEYNTNPD

SEQ ID NO: 144451 - protein, 15 aa, Borrelia burgdorferi B31
LVAINNLKNPTKPAA

SEQ ID NO: 144452 - protein, 9 aa, Borrelia burgdorferi B31
LVAINNLKN

SEQ ID NO: 144453 - protein, 15 aa, Borrelia burgdorferi B31
EYTEERRMLYTSLNF

SEQ ID NO: 144454 - protein, 9 aa, Borrelia burgdorferi B31
RRMLYTSLN

SEQ ID NO: 144455 - protein, 15 aa, Borrelia burgdorferi B31
YNTNPDLQTDVSKLN

SEQ ID NO: 144456 - protein, 9 aa, Borrelia burgdorferi B31
YNTNPDLQT

SEQ ID NO: 144457 - protein, 15 aa, Borrelia burgdorferi B31
ERRMLYTSLNFNEGK

SEQ ID NO: 144458 - protein, 9 aa, Borrelia burgdorferi B31
RRMLYTSLN

SEQ ID NO: 144459 - protein, 15 aa, Borrelia burgdorferi B31
EIFSKIFFNANSTVH

SEQ ID NO: 144460 - protein, 9 aa, Borrelia burgdorferi B31
IFFNANSTV

SEQ ID NO: 144461 - protein, 15 aa, Borrelia burgdorferi B31
IFSKIFFNANSTVHF

SEQ ID NO: 144462 - protein, 9 aa, Borrelia burgdorferi B31
FFNANSTVH

SEQ ID NO: 144463 - protein, 15 aa, Borrelia burgdorferi B31
FSKIFFNANSTVHFD

SEQ ID NO: 144464 - protein, 9 aa, Borrelia burgdorferi B31
FFNANSTVH

SEQ ID NO: 144465 - protein, 15 aa, Borrelia burgdorferi B31
SKIFFNANSTVHFDS

SEQ ID NO: 144466 - protein, 9 aa, Borrelia burgdorferi B31
FFNANSTVH

SEQ ID NO: 144467 - protein, 15 aa, Borrelia burgdorferi B31
KIFFNANSTVHFDSH

SEQ ID NO: 144468 - protein, 9 aa, Borrelia burgdorferi B31
FFNANSTVH

SEQ ID NO: 144469 - protein, 15 aa, Borrelia burgdorferi B31
IFFNANSTVHFDSHE

SEQ ID NO: 144470 - protein, 9 aa, Borrelia burgdorferi B31
FFNANSTVH

SEQ ID NO: 144471 - protein, 15 aa, Borrelia burgdorferi B31
FFNANSTVHFDSHEY

SEQ ID NO: 144472 - protein, 9 aa, Borrelia burgdorferi B31
FFNANSTVH

SEQ ID NO: 144473 - protein, 15 aa, Borrelia burgdorferi B31
HDIILDLVNTTTNIL

SEQ ID NO: 144474 - protein, 9 aa, Borrelia burgdorferi B31
DLVNTTTNI

SEQ ID NO: 144475 - protein, 15 aa, Borrelia burgdorferi B31
DIILDLVNTTTNILA

SEQ ID NO: 144476 - protein, 9 aa, Borrelia burgdorferi B31
LVNTTTNIL

SEQ ID NO: 144477 - protein, 15 aa, Borrelia burgdorferi B31
ILDLVNTTTNILAPI

SEQ ID NO: 144478 - protein, 9 aa, Borrelia burgdorferi B31
LVNTTTNIL

SEQ ID NO: 144479 - protein, 15 aa, Borrelia burgdorferi B31
LDLVNTTTNILAPIQ

SEQ ID NO: 144480 - protein, 9 aa, Borrelia burgdorferi B31
LVNTTTNIL

SEQ ID NO: 144481 - protein, 15 aa, Borrelia burgdorferi B31
IILDLVNTTTNILAP

SEQ ID NO: 144482 - protein, 9 aa, Borrelia burgdorferi B31
LVNTTTNIL

SEQ ID NO: 144483 - protein, 15 aa, Borrelia burgdorferi B31
LNDTLRSKNSRAQFA

SEQ ID NO: 144484 - protein, 9 aa, Borrelia burgdorferi B31
LRSKNSRAQ

SEQ ID NO: 144485 - protein, 15 aa, Borrelia burgdorferi B31
NDTLRSKNSRAQFAN

SEQ ID NO: 144486 - protein, 9 aa, Borrelia burgdorferi B31
LRSKNSRAQ

SEQ ID NO: 144487 - protein, 15 aa, Borrelia burgdorferi B31
DTLRSKNSRAQFANI

SEQ ID NO: 144488 - protein, 9 aa, Borrelia burgdorferi B31
LRSKNSRAQ

SEQ ID NO: 144489 - protein, 15 aa, Borrelia burgdorferi B31
LIAIFLLHVLTVLIL

SEQ ID NO: 144490 - protein, 9 aa, Borrelia burgdorferi B31
LLHVLTVLI

SEQ ID NO: 144491 - protein, 15 aa, Borrelia burgdorferi B31
IAIFLLHVLTVLILI

SEQ ID NO: 144492 - protein, 9 aa, Borrelia burgdorferi B31
LHVLTVLIL

SEQ ID NO: 144493 - protein, 15 aa, Borrelia burgdorferi B31
TLRSKNSRAQFANIH

SEQ ID NO: 144494 - protein, 9 aa, Borrelia burgdorferi B31
SKNSRAQFA

SEQ ID NO: 144495 - protein, 15 aa, Borrelia burgdorferi B31
LRSKNSRAQFANIHD

SEQ ID NO: 144496 - protein, 9 aa, Borrelia burgdorferi B31
SKNSRAQFA

SEQ ID NO: 144497 - protein, 15 aa, Borrelia burgdorferi B31
RMLYTSLNFNEGKIF

SEQ ID NO: 144498 - protein, 9 aa, Borrelia burgdorferi B31
YTSLNFNEG

SEQ ID NO: 144499 - protein, 15 aa, Borrelia burgdorferi B31
RRMLYTSLNFNEGKI

SEQ ID NO: 144500 - protein, 9 aa, Borrelia burgdorferi B31
YTSLNFNEG

SEQ ID NO: 144501 - protein, 15 aa, Borrelia burgdorferi B31
ERRMLYTSLNFNEGK

SEQ ID NO: 144502 - protein, 9 aa, Borrelia burgdorferi B31
YTSLNFNEG

SEQ ID NO: 144503 - protein, 15 aa, Borrelia burgdorferi B31
MLYTSLNFNEGKIFN

SEQ ID NO: 144504 - protein, 9 aa, Borrelia burgdorferi B31
YTSLNFNEG

SEQ ID NO: 144505 - protein, 15 aa, Borrelia burgdorferi B31
EERRMLYTSLNFNEG

SEQ ID NO: 144506 - protein, 9 aa, Borrelia burgdorferi B31
MLYTSLNFN

SEQ ID NO: 144507 - protein, 15 aa, Borrelia burgdorferi B31
MKDNILKNNKLIAIF

SEQ ID NO: 144508 - protein, 9 aa, Borrelia burgdorferi B31
LKNNKLIAI

SEQ ID NO: 144509 - protein, 15 aa, Borrelia burgdorferi B31
KDNILKNNKLIAIFL

SEQ ID NO: 144510 - protein, 9 aa, Borrelia burgdorferi B31
LKNNKLIAI

SEQ ID NO: 144511 - protein, 15 aa, Borrelia burgdorferi B31
DNILKNNKLIAIFLL

SEQ ID NO: 144512 - protein, 9 aa, Borrelia burgdorferi B31
LKNNKLIAI

SEQ ID NO: 144513 - protein, 15 aa, Borrelia burgdorferi B31
NILKNNKLIAIFLLH

SEQ ID NO: 144514 - protein, 9 aa, Borrelia burgdorferi B31
LKNNKLIAI

SEQ ID NO: 144515 - protein, 15 aa, Borrelia burgdorferi B31
ENLLVAINNLKNPTK

SEQ ID NO: 144516 - protein, 9 aa, Borrelia burgdorferi B31
AINNLKNPT

SEQ ID NO: 144517 - protein, 15 aa, Borrelia burgdorferi B31
DIILDLVNTTTNILA

SEQ ID NO: 144518 - protein, 9 aa, Borrelia burgdorferi B31
LVNTTTNIL

SEQ ID NO: 144519 - protein, 15 aa, Borrelia burgdorferi B31
HDIILDLVNTTTNIL

SEQ ID NO: 144520 - protein, 9 aa, Borrelia burgdorferi B31
IILDLVNTT

SEQ ID NO: 144521 - protein, 15 aa, Borrelia burgdorferi B31
IILDLVNTTTNILAP

SEQ ID NO: 144522 - protein, 9 aa, Borrelia burgdorferi B31
LVNTTTNIL

SEQ ID NO: 144523 - protein, 15 aa, Borrelia burgdorferi B31
NLLVAINNLKNPTKP

SEQ ID NO: 144524 - protein, 9 aa, Borrelia burgdorferi B31
AINNLKNPT

SEQ ID NO: 144525 - protein, 15 aa, Borrelia burgdorferi B31
VENLLVAINNLKNPT

SEQ ID NO: 144526 - protein, 9 aa, Borrelia burgdorferi B31
VAINNLKNP

SEQ ID NO: 144527 - protein, 15 aa, Borrelia burgdorferi B31
ILDLVNTTTNILAPI

SEQ ID NO: 144528 - protein, 9 aa, Borrelia burgdorferi B31
LVNTTTNIL

SEQ ID NO: 144529 - protein, 15 aa, Borrelia burgdorferi B31
LLVAINNLKNPTKPA

SEQ ID NO: 144530 - protein, 9 aa, Borrelia burgdorferi B31
AINNLKNPT

SEQ ID NO: 144531 - protein, 15 aa, Borrelia burgdorferi B31
LDLVNTTTNILAPIQ

SEQ ID NO: 144532 - protein, 9 aa, Borrelia burgdorferi B31
LVNTTTNIL

SEQ ID NO: 144533 - protein, 15 aa, Borrelia burgdorferi B31
GKIFNLGQILSKLSQ

SEQ ID NO: 144534 - protein, 9 aa, Borrelia burgdorferi B31
IFNLGQILS

SEQ ID NO: 144535 - protein, 15 aa, Borrelia burgdorferi B31
EGKIFNLGQILSKLS

SEQ ID NO: 144536 - protein, 9 aa, Borrelia burgdorferi B31
IFNLGQILS

SEQ ID NO: 144537 - protein, 15 aa, Borrelia burgdorferi B31
ILKNNKLIAIFLLHV

SEQ ID NO: 144538 - protein, 9 aa, Borrelia burgdorferi B31
LKNNKLIAI

SEQ ID NO: 144539 - protein, 15 aa, Borrelia burgdorferi B31
LVAINNLKNPTKPAA

SEQ ID NO: 144540 - protein, 9 aa, Borrelia burgdorferi B31
AINNLKNPT

SEQ ID NO: 144541 - protein, 15 aa, Borrelia burgdorferi B31
LKNNKLIAIFLLHVL

SEQ ID NO: 144542 - protein, 9 aa, Borrelia burgdorferi B31
LKNNKLIAI

SEQ ID NO: 144543 - protein, 15 aa, Borrelia burgdorferi B31
NEGKIFNLGQILSKL

SEQ ID NO: 144544 - protein, 9 aa, Borrelia burgdorferi B31
IFNLGQILS

SEQ ID NO: 144545 - protein, 15 aa, Borrelia burgdorferi B31
FNEGKIFNLGQILSK

SEQ ID NO: 144546 - protein, 9 aa, Borrelia burgdorferi B31
IFNLGQILS

SEQ ID NO: 144547 - protein, 15 aa, Borrelia burgdorferi B31
NFNEGKIFNLGQILS

SEQ ID NO: 144548 - protein, 9 aa, Borrelia burgdorferi B31
GKIFNLGQI

SEQ ID NO: 144549 - protein, 15 aa, Borrelia burgdorferi B31
KVENLLVAINNLKNP

SEQ ID NO: 144550 - protein, 9 aa, Borrelia burgdorferi B31
LLVAINNLK

SEQ ID NO: 144551 - protein, 15 aa, Borrelia burgdorferi B31
IFLLHVLTVLILISC

SEQ ID NO: 144552 - protein, 9 aa, Borrelia burgdorferi B31
LLHVLTVLI

SEQ ID NO: 144553 - protein, 15 aa, Borrelia burgdorferi B31
AIFLLHVLTVLILIS

SEQ ID NO: 144554 - protein, 9 aa, Borrelia burgdorferi B31
LLHVLTVLI

SEQ ID NO: 144555 - protein, 15 aa, Borrelia burgdorferi B31
KIFNLGQILSKLSQD

SEQ ID NO: 144556 - protein, 9 aa, Borrelia burgdorferi B31
IFNLGQILS

SEQ ID NO: 144557 - protein, 15 aa, Borrelia burgdorferi B31
IFNLGQILSKLSQDS

SEQ ID NO: 144558 - protein, 9 aa, Borrelia burgdorferi B31
IFNLGQILS

SEQ ID NO: 144559 - protein, 15 aa, Borrelia burgdorferi B31
VAINNLKNPTKPAAG

SEQ ID NO: 144560 - protein, 9 aa, Borrelia burgdorferi B31
AINNLKNPT

SEQ ID NO: 144561 - protein, 15 aa, Borrelia burgdorferi B31
IAIFLLHVLTVLILI

SEQ ID NO: 144562 - protein, 9 aa, Borrelia burgdorferi B31
LLHVLTVLI

SEQ ID NO: 144563 - protein, 15 aa, Borrelia burgdorferi B31
LIAIFLLHVLTVLIL

SEQ ID NO: 144564 - protein, 9 aa, Borrelia burgdorferi B31
LLHVLTVLI

SEQ ID NO: 144565 - protein, 15 aa, Borrelia burgdorferi B31
FLLHVLTVLILISCS

SEQ ID NO: 144566 - protein, 9 aa, Borrelia burgdorferi B31
LLHVLTVLI

SEQ ID NO: 144567 - protein, 15 aa, Borrelia burgdorferi B31
KLIAIFLLHVLTVLI

SEQ ID NO: 144568 - protein, 9 aa, Borrelia burgdorferi B31
IAIFLLHVL

SEQ ID NO: 144569 - protein, 15 aa, Borrelia burgdorferi B31
IFSKIFFNANSTVHF

SEQ ID NO: 144570 - protein, 9 aa, Borrelia burgdorferi B31
FFNANSTVH

SEQ ID NO: 144571 - protein, 15 aa, Borrelia burgdorferi B31
FSKIFFNANSTVHFD

SEQ ID NO: 144572 - protein, 9 aa, Borrelia burgdorferi B31
FNANSTVHF

SEQ ID NO: 144573 - protein, 15 aa, Borrelia burgdorferi B31
SKIFFNANSTVHFDS

SEQ ID NO: 144574 - protein, 9 aa, Borrelia burgdorferi B31
FNANSTVHF

SEQ ID NO: 144575 - protein, 15 aa, Borrelia burgdorferi B31
LLHVLTVLILISCSL

SEQ ID NO: 144576 - protein, 9 aa, Borrelia burgdorferi B31
LLHVLTVLI

SEQ ID NO: 144577 - protein, 15 aa, Borrelia burgdorferi B31
KIFFNANSTVHFDSH

SEQ ID NO: 144578 - protein, 9 aa, Borrelia burgdorferi B31
FNANSTVHF

SEQ ID NO: 144579 - protein, 15 aa, Borrelia burgdorferi B31
IHDIILDLVNTTTNI

SEQ ID NO: 144580 - protein, 9 aa, Borrelia burgdorferi B31
IILDLVNTT

SEQ ID NO: 144581 - protein, 15 aa, Borrelia burgdorferi B31
IFFNANSTVHFDSHE

SEQ ID NO: 144582 - protein, 9 aa, Borrelia burgdorferi B31
FNANSTVHF

SEQ ID NO: 144583 - protein, 15 aa, Borrelia burgdorferi B31
GKVENLLVAINNLKN

SEQ ID NO: 144584 - protein, 9 aa, Borrelia burgdorferi B31
LLVAINNLK

SEQ ID NO: 144585 - protein, 15 aa, Borrelia burgdorferi B31
KGKVENLLVAINNLK

SEQ ID NO: 144586 - protein, 9 aa, Borrelia burgdorferi B31
VENLLVAIN

SEQ ID NO: 144587 - protein, 15 aa, Borrelia burgdorferi B31
AINNLKNPTKPAAGK

SEQ ID NO: 144588 - protein, 9 aa, Borrelia burgdorferi B31
AINNLKNPT

SEQ ID NO: 144589 - protein, 15 aa, Borrelia burgdorferi B31
GLVKETLINRGFSIQ

SEQ ID NO: 144590 - protein, 9 aa, Borrelia burgdorferi B31
VKETLINRG

SEQ ID NO: 144591 - protein, 15 aa, Borrelia burgdorferi B31
NIHDIILDLVNTTTN

SEQ ID NO: 144592 - protein, 9 aa, Borrelia burgdorferi B31
IILDLVNTT

SEQ ID NO: 144593 - protein, 15 aa, Borrelia burgdorferi B31
LHVLTVLILISCSLE

SEQ ID NO: 144594 - protein, 9 aa, Borrelia burgdorferi B31
VLTVLILIS

SEQ ID NO: 144595 - protein, 15 aa, Borrelia burgdorferi B31
LVKETLINRGFSIQL

SEQ ID NO: 144596 - protein, 9 aa, Borrelia burgdorferi B31
LINRGFSIQ

SEQ ID NO: 144597 - protein, 15 aa, Borrelia burgdorferi B31
VKETLINRGFSIQLA

SEQ ID NO: 144598 - protein, 9 aa, Borrelia burgdorferi B31
LINRGFSIQ

SEQ ID NO: 144599 - protein, 15 aa, Borrelia burgdorferi B31
ANIHDIILDLVNTTT

SEQ ID NO: 144600 - protein, 9 aa, Borrelia burgdorferi B31
IILDLVNTT

SEQ ID NO: 144601 - protein, 15 aa, Borrelia burgdorferi B31
HVLTVLILISCSLEV

SEQ ID NO: 144602 - protein, 9 aa, Borrelia burgdorferi B31
LTVLILISC

SEQ ID NO: 144603 - protein, 15 aa, Borrelia burgdorferi B31
KETLINRGFSIQLAM

SEQ ID NO: 144604 - protein, 9 aa, Borrelia burgdorferi B31
LINRGFSIQ

SEQ ID NO: 144605 - protein, 15 aa, Borrelia burgdorferi B31
FANIHDIILDLVNTT

SEQ ID NO: 144606 - protein, 9 aa, Borrelia burgdorferi B31
IHDIILDLV

SEQ ID NO: 144607 - protein, 15 aa, Borrelia burgdorferi B31
ETLINRGFSIQLAME

SEQ ID NO: 144608 - protein, 9 aa, Borrelia burgdorferi B31
LINRGFSIQ

SEQ ID NO: 144609 - protein, 15 aa, Borrelia burgdorferi B31
NKLIAIFLLHVLTVL

SEQ ID NO: 144610 - protein, 9 aa, Borrelia burgdorferi B31
IAIFLLHVL

SEQ ID NO: 144611 - protein, 15 aa, Borrelia burgdorferi B31
DKLQQLNKPNLETLY

SEQ ID NO: 144612 - protein, 9 aa, Borrelia burgdorferi B31
LQQLNKPNL

SEQ ID NO: 144613 - protein, 15 aa, Borrelia burgdorferi B31
VKDKLQQLNKPNLET

SEQ ID NO: 144614 - protein, 9 aa, Borrelia burgdorferi B31
LQQLNKPNL

SEQ ID NO: 144615 - protein, 15 aa, Borrelia burgdorferi B31
NVKDKLQQLNKPNLE

SEQ ID NO: 144616 - protein, 9 aa, Borrelia burgdorferi B31
LQQLNKPNL

SEQ ID NO: 144617 - protein, 15 aa, Borrelia burgdorferi B31
VLTVLILISCSLEVK

SEQ ID NO: 144618 - protein, 9 aa, Borrelia burgdorferi B31
LTVLILISC

SEQ ID NO: 144619 - protein, 15 aa, Borrelia burgdorferi B31
FFNANSTVHFDSHEY

SEQ ID NO: 144620 - protein, 9 aa, Borrelia burgdorferi B31
FNANSTVHF

SEQ ID NO: 144621 - protein, 15 aa, Borrelia burgdorferi B31
KDKLQQLNKPNLETL

SEQ ID NO: 144622 - protein, 9 aa, Borrelia burgdorferi B31
LQQLNKPNL

SEQ ID NO: 144623 - protein, 15 aa, Borrelia burgdorferi B31
EEISAKILNVKDKLQ

SEQ ID NO: 144624 - protein, 9 aa, Borrelia burgdorferi B31
ISAKILNVK

SEQ ID NO: 144625 - protein, 15 aa, Borrelia burgdorferi B31
DPEVAKLIQKILDRS

SEQ ID NO: 144626 - protein, 9 aa, Borrelia burgdorferi B31
VAKLIQKIL

SEQ ID NO: 144627 - protein, 15 aa, Borrelia burgdorferi B31
PEVAKLIQKILDRSE

SEQ ID NO: 144628 - protein, 9 aa, Borrelia burgdorferi B31
LIQKILDRS

SEQ ID NO: 144629 - protein, 15 aa, Borrelia burgdorferi B31
ISAKILNVKDKLQQL

SEQ ID NO: 144630 - protein, 9 aa, Borrelia burgdorferi B31
ISAKILNVK

SEQ ID NO: 144631 - protein, 15 aa, Borrelia burgdorferi B31
EISAKILNVKDKLQQ

SEQ ID NO: 144632 - protein, 9 aa, Borrelia burgdorferi B31
ISAKILNVK

SEQ ID NO: 144633 - protein, 15 aa, Borrelia burgdorferi B31
EVAKLIQKILDRSEN

SEQ ID NO: 144634 - protein, 9 aa, Borrelia burgdorferi B31
LIQKILDRS

SEQ ID NO: 144635 - protein, 15 aa, Borrelia burgdorferi B31
LNVKDKLQQLNKPNL

SEQ ID NO: 144636 - protein, 9 aa, Borrelia burgdorferi B31
DKLQQLNKP

SEQ ID NO: 144637 - protein, 15 aa, Borrelia burgdorferi B31
ENLLVAINNLKNPTK

SEQ ID NO: 144638 - protein, 9 aa, Borrelia burgdorferi B31
LLVAINNLK

SEQ ID NO: 144639 - protein, 15 aa, Borrelia burgdorferi B31
NLLVAINNLKNPTKP

SEQ ID NO: 144640 - protein, 9 aa, Borrelia burgdorferi B31
INNLKNPTK

SEQ ID NO: 144641 - protein, 15 aa, Borrelia burgdorferi B31
LLVAINNLKNPTKPA

SEQ ID NO: 144642 - protein, 9 aa, Borrelia burgdorferi B31
INNLKNPTK

SEQ ID NO: 144643 - protein, 15 aa, Borrelia burgdorferi B31
NKLIAIFLLHVLTVL

SEQ ID NO: 144644 - protein, 9 aa, Borrelia burgdorferi B31
LIAIFLLHV

SEQ ID NO: 144645 - protein, 15 aa, Borrelia burgdorferi B31
LIAIFLLHVLTVLIL

SEQ ID NO: 144646 - protein, 9 aa, Borrelia burgdorferi B31
IFLLHVLTV

SEQ ID NO: 144647 - protein, 15 aa, Borrelia burgdorferi B31
EIFSKIFFNANSTVH

SEQ ID NO: 144648 - protein, 9 aa, Borrelia burgdorferi B31
SKIFFNANS

SEQ ID NO: 144649 - protein, 15 aa, Borrelia burgdorferi B31
IFSKIFFNANSTVHF

SEQ ID NO: 144650 - protein, 9 aa, Borrelia burgdorferi B31
FFNANSTVH

SEQ ID NO: 144651 - protein, 15 aa, Borrelia burgdorferi B31
LVAINNLKNPTKPAA

SEQ ID NO: 144652 - protein, 9 aa, Borrelia burgdorferi B31
INNLKNPTK

SEQ ID NO: 144653 - protein, 15 aa, Borrelia burgdorferi B31
VAINNLKNPTKPAAG

SEQ ID NO: 144654 - protein, 9 aa, Borrelia burgdorferi B31
INNLKNPTK

SEQ ID NO: 144655 - protein, 15 aa, Borrelia burgdorferi B31
IAIFLLHVLTVLILI

SEQ ID NO: 144656 - protein, 9 aa, Borrelia burgdorferi B31
IFLLHVLTV

SEQ ID NO: 144657 - protein, 15 aa, Borrelia burgdorferi B31
SNYRGLVKETLINRG

SEQ ID NO: 144658 - protein, 9 aa, Borrelia burgdorferi B31
LVKETLINR

SEQ ID NO: 144659 - protein, 15 aa, Borrelia burgdorferi B31
KLIAIFLLHVLTVLI

SEQ ID NO: 144660 - protein, 9 aa, Borrelia burgdorferi B31
IFLLHVLTV

SEQ ID NO: 144661 - protein, 15 aa, Borrelia burgdorferi B31
FSKIFFNANSTVHFD

SEQ ID NO: 144662 - protein, 9 aa, Borrelia burgdorferi B31
FFNANSTVH

SEQ ID NO: 144663 - protein, 15 aa, Borrelia burgdorferi B31
SKIFFNANSTVHFDS

SEQ ID NO: 144664 - protein, 9 aa, Borrelia burgdorferi B31
FFNANSTVH

SEQ ID NO: 144665 - protein, 15 aa, Borrelia burgdorferi B31
YRGLVKETLINRGFS

SEQ ID NO: 144666 - protein, 9 aa, Borrelia burgdorferi B31
LVKETLINR

SEQ ID NO: 144667 - protein, 15 aa, Borrelia burgdorferi B31
RGLVKETLINRGFSI

SEQ ID NO: 144668 - protein, 9 aa, Borrelia burgdorferi B31
LVKETLINR

SEQ ID NO: 144669 - protein, 15 aa, Borrelia burgdorferi B31
NYRGLVKETLINRGF

SEQ ID NO: 144670 - protein, 9 aa, Borrelia burgdorferi B31
LVKETLINR

SEQ ID NO: 144671 - protein, 15 aa, Borrelia burgdorferi B31
NNKLIAIFLLHVLTV

SEQ ID NO: 144672 - protein, 9 aa, Borrelia burgdorferi B31
LIAIFLLHV

SEQ ID NO: 144673 - protein, 15 aa, Borrelia burgdorferi B31
DSNYRGLVKETLINR

SEQ ID NO: 144674 - protein, 9 aa, Borrelia burgdorferi B31
YRGLVKETL

SEQ ID NO: 144675 - protein, 15 aa, Borrelia burgdorferi B31
AIFLLHVLTVLILIS

SEQ ID NO: 144676 - protein, 9 aa, Borrelia burgdorferi B31
LHVLTVLIL

SEQ ID NO: 144677 - protein, 15 aa, Borrelia burgdorferi B31
KIFFNANSTVHFDSH

SEQ ID NO: 144678 - protein, 9 aa, Borrelia burgdorferi B31
FFNANSTVH

SEQ ID NO: 144679 - protein, 15 aa, Borrelia burgdorferi B31
IFLLHVLTVLILISC

SEQ ID NO: 144680 - protein, 9 aa, Borrelia burgdorferi B31
LHVLTVLIL

SEQ ID NO: 144681 - protein, 15 aa, Borrelia burgdorferi B31
LKNNKLIAIFLLHVL

SEQ ID NO: 144682 - protein, 9 aa, Borrelia burgdorferi B31
LIAIFLLHV

SEQ ID NO: 144683 - protein, 15 aa, Borrelia burgdorferi B31
VLTVLILISCSLEVK

SEQ ID NO: 144684 - protein, 9 aa, Borrelia burgdorferi B31
VLILISCSL

SEQ ID NO: 144685 - protein, 15 aa, Borrelia burgdorferi B31
GLVKETLINRGFSIQ

SEQ ID NO: 144686 - protein, 9 aa, Borrelia burgdorferi B31
LVKETLINR

SEQ ID NO: 144687 - protein, 15 aa, Borrelia burgdorferi B31
LTVLILISCSLEVKD

SEQ ID NO: 144688 - protein, 9 aa, Borrelia burgdorferi B31
VLILISCSL

SEQ ID NO: 144689 - protein, 15 aa, Borrelia burgdorferi B31
LVKETLINRGFSIQL

SEQ ID NO: 144690 - protein, 9 aa, Borrelia burgdorferi B31
LVKETLINR

SEQ ID NO: 144691 - protein, 15 aa, Borrelia burgdorferi B31
VENLLVAINNLKNPT

SEQ ID NO: 144692 - protein, 9 aa, Borrelia burgdorferi B31
LLVAINNLK

SEQ ID NO: 144693 - protein, 15 aa, Borrelia burgdorferi B31
FLLHVLTVLILISCS

SEQ ID NO: 144694 - protein, 9 aa, Borrelia burgdorferi B31
LHVLTVLIL

SEQ ID NO: 144695 - protein, 15 aa, Borrelia burgdorferi B31
KVENLLVAINNLKNP

SEQ ID NO: 144696 - protein, 9 aa, Borrelia burgdorferi B31
LLVAINNLK

SEQ ID NO: 144697 - protein, 15 aa, Borrelia burgdorferi B31
HVLTVLILISCSLEV

SEQ ID NO: 144698 - protein, 9 aa, Borrelia burgdorferi B31
VLILISCSL

SEQ ID NO: 144699 - protein, 15 aa, Borrelia burgdorferi B31
LLHVLTVLILISCSL

SEQ ID NO: 144700 - protein, 9 aa, Borrelia burgdorferi B31
LTVLILISC

SEQ ID NO: 144701 - protein, 15 aa, Borrelia burgdorferi B31
KNNKLIAIFLLHVLT

SEQ ID NO: 144702 - protein, 9 aa, Borrelia burgdorferi B31
LIAIFLLHV

SEQ ID NO: 144703 - protein, 15 aa, Borrelia burgdorferi B31
LHVLTVLILISCSLE

SEQ ID NO: 144704 - protein, 9 aa, Borrelia burgdorferi B31
VLILISCSL

SEQ ID NO: 144705 - protein, 15 aa, Borrelia burgdorferi B31
AINNLKNPTKPAAGK

SEQ ID NO: 144706 - protein, 9 aa, Borrelia burgdorferi B31
INNLKNPTK

SEQ ID NO: 144707 - protein, 15 aa, Borrelia burgdorferi B31
ILKNNKLIAIFLLHV

SEQ ID NO: 144708 - protein, 9 aa, Borrelia burgdorferi B31
LKNNKLIAI

SEQ ID NO: 144709 - protein, 15 aa, Borrelia burgdorferi B31
SKLNDTLRSKNSRAQ

SEQ ID NO: 144710 - protein, 9 aa, Borrelia burgdorferi B31
TLRSKNSRA

SEQ ID NO: 144711 - protein, 15 aa, Borrelia burgdorferi B31
AKLIQKILDRSENII

SEQ ID NO: 144712 - protein, 9 aa, Borrelia burgdorferi B31
LIQKILDRS

SEQ ID NO: 144713 - protein, 15 aa, Borrelia burgdorferi B31
VAINNLKNPTKPAAG

SEQ ID NO: 144714 - protein, 9 aa, Borrelia burgdorferi B31
INNLKNPTK

SEQ ID NO: 144715 - protein, 15 aa, Borrelia burgdorferi B31
ENLLVAINNLKNPTK

SEQ ID NO: 144716 - protein, 9 aa, Borrelia burgdorferi B31
LLVAINNLK

SEQ ID NO: 144717 - protein, 15 aa, Borrelia burgdorferi B31
LVAINNLKNPTKPAA

SEQ ID NO: 144718 - protein, 9 aa, Borrelia burgdorferi B31
INNLKNPTK

SEQ ID NO: 144719 - protein, 15 aa, Borrelia burgdorferi B31
NLLVAINNLKNPTKP

SEQ ID NO: 144720 - protein, 9 aa, Borrelia burgdorferi B31
INNLKNPTK

SEQ ID NO: 144721 - protein, 15 aa, Borrelia burgdorferi B31
SKLNDTLRSKNSRAQ

SEQ ID NO: 144722 - protein, 9 aa, Borrelia burgdorferi B31
LNDTLRSKN

SEQ ID NO: 144723 - protein, 15 aa, Borrelia burgdorferi B31
LLVAINNLKNPTKPA

SEQ ID NO: 144724 - protein, 9 aa, Borrelia burgdorferi B31
INNLKNPTK

SEQ ID NO: 144725 - protein, 15 aa, Borrelia burgdorferi B31
KLNDTLRSKNSRAQF

SEQ ID NO: 144726 - protein, 9 aa, Borrelia burgdorferi B31
LRSKNSRAQ

SEQ ID NO: 144727 - protein, 15 aa, Borrelia burgdorferi B31
LNDTLRSKNSRAQFA

SEQ ID NO: 144728 - protein, 9 aa, Borrelia burgdorferi B31
LRSKNSRAQ

SEQ ID NO: 144729 - protein, 15 aa, Borrelia garinii PBi
IFSKIFFNAGSTVTF

SEQ ID NO: 144730 - protein, 9 aa, Borrelia garinii PBi
FFNAGSTVT

SEQ ID NO: 144731 - protein, 15 aa, Borrelia garinii PBi
FSKIFFNAGSTVTFD

SEQ ID NO: 144732 - protein, 9 aa, Borrelia garinii PBi
FFNAGSTVT

SEQ ID NO: 144733 - protein, 15 aa, Borrelia garinii PBi
SKIFFNAGSTVTFDD

SEQ ID NO: 144734 - protein, 9 aa, Borrelia garinii PBi
FFNAGSTVT

SEQ ID NO: 144735 - protein, 15 aa, Borrelia garinii PBi
KIFFNAGSTVTFDDN

SEQ ID NO: 144736 - protein, 9 aa, Borrelia garinii PBi
FFNAGSTVT

SEQ ID NO: 144737 - protein, 15 aa, Borrelia garinii PBi
EIFSKIFFNAGSTVT

SEQ ID NO: 144738 - protein, 9 aa, Borrelia garinii PBi
EIFSKIFFN

SEQ ID NO: 144739 - protein, 15 aa, Borrelia garinii PBi
IFFNAGSTVTFDDNE

SEQ ID NO: 144740 - protein, 9 aa, Borrelia garinii PBi
FFNAGSTVT

SEQ ID NO: 144741 - protein, 15 aa, Borrelia garinii PBi
FFNAGSTVTFDDNEY

SEQ ID NO: 144742 - protein, 9 aa, Borrelia garinii PBi
FFNAGSTVT

SEQ ID NO: 144743 - protein, 15 aa, Borrelia garinii PBi
ILNLGKILSKLSQDS

SEQ ID NO: 144744 - protein, 9 aa, Borrelia garinii PBi
LGKILSKLS

SEQ ID NO: 144745 - protein, 15 aa, Borrelia garinii PBi
LNLGKILSKLSQDSN

SEQ ID NO: 144746 - protein, 9 aa, Borrelia garinii PBi
LGKILSKLS

SEQ ID NO: 144747 - protein, 15 aa, Borrelia garinii PBi
NKILNLGKILSKLSQ

SEQ ID NO: 144748 - protein, 9 aa, Borrelia garinii PBi
LGKILSKLS

SEQ ID NO: 144749 - protein, 15 aa, Borrelia garinii PBi
ENKILNLGKILSKLS

SEQ ID NO: 144750 - protein, 9 aa, Borrelia garinii PBi
ILNLGKILS

SEQ ID NO: 144751 - protein, 15 aa, Borrelia garinii PBi
FLLHILTGLILLSCS

SEQ ID NO: 144752 - protein, 9 aa, Borrelia garinii PBi
LTGLILLSC

SEQ ID NO: 144753 - protein, 15 aa, Borrelia garinii PBi
IFLLHILTGLILLSC

SEQ ID NO: 144754 - protein, 9 aa, Borrelia garinii PBi
ILTGLILLS

SEQ ID NO: 144755 - protein, 15 aa, Borrelia garinii PBi
LGKILSKLSQDSNYR

SEQ ID NO: 144756 - protein, 9 aa, Borrelia garinii PBi
ILSKLSQDS

SEQ ID NO: 144757 - protein, 15 aa, Borrelia garinii PBi
NIILNLINTTTNILA

SEQ ID NO: 144758 - protein, 9 aa, Borrelia garinii PBi
ILNLINTTT

SEQ ID NO: 144759 - protein, 15 aa, Borrelia garinii PBi
NLGKILSKLSQDSNY

SEQ ID NO: 144760 - protein, 9 aa, Borrelia garinii PBi
ILSKLSQDS

SEQ ID NO: 144761 - protein, 15 aa, Borrelia garinii PBi
LHILTGLILLSCSLE

SEQ ID NO: 144762 - protein, 9 aa, Borrelia garinii PBi
ILTGLILLS

SEQ ID NO: 144763 - protein, 15 aa, Borrelia garinii PBi
LLHILTGLILLSCSL

SEQ ID NO: 144764 - protein, 9 aa, Borrelia garinii PBi
ILTGLILLS

SEQ ID NO: 144765 - protein, 15 aa, Borrelia garinii PBi
HNIILNLINTTTNIL

SEQ ID NO: 144766 - protein, 9 aa, Borrelia garinii PBi
ILNLINTTT

SEQ ID NO: 144767 - protein, 15 aa, Borrelia garinii PBi
KILNLGKILSKLSQD

SEQ ID NO: 144768 - protein, 9 aa, Borrelia garinii PBi
LGKILSKLS

SEQ ID NO: 144769 - protein, 15 aa, Borrelia garinii PBi
TDIHNIILNLINTTT

SEQ ID NO: 144770 - protein, 9 aa, Borrelia garinii PBi
IHNIILNLI

SEQ ID NO: 144771 - protein, 15 aa, Borrelia garinii PBi
IILNLINTTTNILAP

SEQ ID NO: 144772 - protein, 9 aa, Borrelia garinii PBi
LINTTTNIL

SEQ ID NO: 144773 - protein, 15 aa, Borrelia garinii PBi
AIFLLHILTGLILLS

SEQ ID NO: 144774 - protein, 9 aa, Borrelia garinii PBi
LHILTGLIL

SEQ ID NO: 144775 - protein, 15 aa, Borrelia garinii PBi
ILNLINTTTNILAPI

SEQ ID NO: 144776 - protein, 9 aa, Borrelia garinii PBi
LINTTTNIL

SEQ ID NO: 144777 - protein, 15 aa, Borrelia garinii PBi
GKILSKLSQDSNYRS

SEQ ID NO: 144778 - protein, 9 aa, Borrelia garinii PBi
ILSKLSQDS

SEQ ID NO: 144779 - protein, 15 aa, Borrelia garinii PBi
DIHNIILNLINTTTN

SEQ ID NO: 144780 - protein, 9 aa, Borrelia garinii PBi
ILNLINTTT

SEQ ID NO: 144781 - protein, 15 aa, Borrelia garinii PBi
IHNIILNLINTTTNI

SEQ ID NO: 144782 - protein, 9 aa, Borrelia garinii PBi
ILNLINTTT

SEQ ID NO: 144783 - protein, 15 aa, Borrelia garinii PBi
HILTGLILLSCSLEV

SEQ ID NO: 144784 - protein, 9 aa, Borrelia garinii PBi
LTGLILLSC

SEQ ID NO: 144785 - protein, 15 aa, Borrelia garinii PBi
VKEILINRGFSIQLA

SEQ ID NO: 144786 - protein, 9 aa, Borrelia garinii PBi
INRGFSIQL

SEQ ID NO: 144787 - protein, 15 aa, Borrelia garinii PBi
IKDYNANPELRTDIS

SEQ ID NO: 144788 - protein, 9 aa, Borrelia garinii PBi
YNANPELRT

SEQ ID NO: 144789 - protein, 15 aa, Borrelia garinii PBi
LVAINTLKNPPKTAG

SEQ ID NO: 144790 - protein, 9 aa, Borrelia garinii PBi
LVAINTLKN

SEQ ID NO: 144791 - protein, 15 aa, Borrelia garinii PBi
KEILINRGFSIQLAI

SEQ ID NO: 144792 - protein, 9 aa, Borrelia garinii PBi
INRGFSIQL

SEQ ID NO: 144793 - protein, 15 aa, Borrelia garinii PBi
DIIKDYNANPELRTD

SEQ ID NO: 144794 - protein, 9 aa, Borrelia garinii PBi
YNANPELRT

SEQ ID NO: 144795 - protein, 15 aa, Borrelia garinii PBi
IIKDYNANPELRTDI

SEQ ID NO: 144796 - protein, 9 aa, Borrelia garinii PBi
YNANPELRT

SEQ ID NO: 144797 - protein, 15 aa, Borrelia garinii PBi
KDYNANPELRTDISK

SEQ ID NO: 144798 - protein, 9 aa, Borrelia garinii PBi
YNANPELRT

SEQ ID NO: 144799 - protein, 15 aa, Borrelia garinii PBi
DDIIKDYNANPELRT

SEQ ID NO: 144800 - protein, 9 aa, Borrelia garinii PBi
DYNANPELR

SEQ ID NO: 144801 - protein, 15 aa, Borrelia garinii PBi
EILINRGFSIQLAIE

SEQ ID NO: 144802 - protein, 9 aa, Borrelia garinii PBi
INRGFSIQL

SEQ ID NO: 144803 - protein, 15 aa, Borrelia garinii PBi
INTLKNPPKTAGKNK

SEQ ID NO: 144804 - protein, 9 aa, Borrelia garinii PBi
LKNPPKTAG

SEQ ID NO: 144805 - protein, 15 aa, Borrelia garinii PBi
YNANPELRTDISKLN

SEQ ID NO: 144806 - protein, 9 aa, Borrelia garinii PBi
YNANPELRT

SEQ ID NO: 144807 - protein, 15 aa, Borrelia garinii PBi
AINTLKNPPKTAGKN

SEQ ID NO: 144808 - protein, 9 aa, Borrelia garinii PBi
LKNPPKTAG

SEQ ID NO: 144809 - protein, 15 aa, Borrelia garinii PBi
LNLINTTTNILAPIQ

SEQ ID NO: 144810 - protein, 9 aa, Borrelia garinii PBi
LINTTTNIL

SEQ ID NO: 144811 - protein, 15 aa, Borrelia garinii PBi
NTLKNPPKTAGKNKS

SEQ ID NO: 144812 - protein, 9 aa, Borrelia garinii PBi
LKNPPKTAG

SEQ ID NO: 144813 - protein, 15 aa, Borrelia garinii PBi
ILINRGFSIQLAIEE

SEQ ID NO: 144814 - protein, 9 aa, Borrelia garinii PBi
INRGFSIQL

SEQ ID NO: 144815 - protein, 15 aa, Borrelia garinii PBi
VAINTLKNPPKTAGK

SEQ ID NO: 144816 - protein, 9 aa, Borrelia garinii PBi
LKNPPKTAG

SEQ ID NO: 144817 - protein, 15 aa, Borrelia garinii PBi
LVKEILINRGFSIQL

SEQ ID NO: 144818 - protein, 9 aa, Borrelia garinii PBi
ILINRGFSI

SEQ ID NO: 144819 - protein, 15 aa, Borrelia garinii PBi
LIAIFLLHILTGLIL

SEQ ID NO: 144820 - protein, 9 aa, Borrelia garinii PBi
LLHILTGLI

SEQ ID NO: 144821 - protein, 15 aa, Borrelia garinii PBi
IAIFLLHILTGLILL

SEQ ID NO: 144822 - protein, 9 aa, Borrelia garinii PBi
LHILTGLIL

SEQ ID NO: 144823 - protein, 15 aa, Borrelia garinii PBi
ILTGLILLSCSLEVN

SEQ ID NO: 144824 - protein, 9 aa, Borrelia garinii PBi
ILTGLILLS

SEQ ID NO: 144825 - protein, 15 aa, Borrelia garinii PBi
FNAGSTVTFDDNEYV

SEQ ID NO: 144826 - protein, 9 aa, Borrelia garinii PBi
FNAGSTVTF

SEQ ID NO: 144827 - protein, 15 aa, Borrelia garinii PBi
PTVDNLLVAINTLKN

SEQ ID NO: 144828 - protein, 9 aa, Borrelia garinii PBi
VDNLLVAIN

SEQ ID NO: 144829 - protein, 15 aa, Borrelia garinii PBi
TVDNLLVAINTLKNP

SEQ ID NO: 144830 - protein, 9 aa, Borrelia garinii PBi
LVAINTLKN

SEQ ID NO: 144831 - protein, 15 aa, Borrelia garinii PBi
NDYIISKNSKAQFTD

SEQ ID NO: 144832 - protein, 9 aa, Borrelia garinii PBi
SKNSKAQFT

SEQ ID NO: 144833 - protein, 15 aa, Borrelia garinii PBi
LNDYIISKNSKAQFT

SEQ ID NO: 144834 - protein, 9 aa, Borrelia garinii PBi
IISKNSKAQ

SEQ ID NO: 144835 - protein, 15 aa, Borrelia garinii PBi
DNLLVAINTLKNPPK

SEQ ID NO: 144836 - protein, 9 aa, Borrelia garinii PBi
LVAINTLKN

SEQ ID NO: 144837 - protein, 15 aa, Borrelia garinii PBi
VDNLLVAINTLKNPP

SEQ ID NO: 144838 - protein, 9 aa, Borrelia garinii PBi
LVAINTLKN

SEQ ID NO: 144839 - protein, 15 aa, Borrelia garinii PBi
DYIISKNSKAQFTDI

SEQ ID NO: 144840 - protein, 9 aa, Borrelia garinii PBi
SKNSKAQFT

SEQ ID NO: 144841 - protein, 15 aa, Borrelia garinii PBi
FTDIHNIILNLINTT

SEQ ID NO: 144842 - protein, 9 aa, Borrelia garinii PBi
IHNIILNLI

SEQ ID NO: 144843 - protein, 15 aa, Borrelia garinii PBi
LTGLILLSCSLEVNQ

SEQ ID NO: 144844 - protein, 9 aa, Borrelia garinii PBi
LTGLILLSC

SEQ ID NO: 144845 - protein, 15 aa, Borrelia garinii PBi
AQFTDIHNIILNLIN

SEQ ID NO: 144846 - protein, 9 aa, Borrelia garinii PBi
IHNIILNLI

SEQ ID NO: 144847 - protein, 15 aa, Borrelia garinii PBi
KILSKLSQDSNYRSL

SEQ ID NO: 144848 - protein, 9 aa, Borrelia garinii PBi
ILSKLSQDS

SEQ ID NO: 144849 - protein, 15 aa, Borrelia garinii PBi
MKNNKLIAIFLLHIL

SEQ ID NO: 144850 - protein, 9 aa, Borrelia garinii PBi
LIAIFLLHI

SEQ ID NO: 144851 - protein, 15 aa, Borrelia garinii PBi
NLLVAINTLKNPPKT

SEQ ID NO: 144852 - protein, 9 aa, Borrelia garinii PBi
LVAINTLKN

SEQ ID NO: 144853 - protein, 15 aa, Borrelia garinii PBi
ILSKLSQDSNYRSLV

SEQ ID NO: 144854 - protein, 9 aa, Borrelia garinii PBi
ILSKLSQDS

SEQ ID NO: 144855 - protein, 15 aa, Borrelia garinii PBi
QFTDIHNIILNLINT

SEQ ID NO: 144856 - protein, 9 aa, Borrelia garinii PBi
IHNIILNLI

SEQ ID NO: 144857 - protein, 15 aa, Borrelia garinii PBi
KAQFTDIHNIILNLI

SEQ ID NO: 144858 - protein, 9 aa, Borrelia garinii PBi
FTDIHNIIL

SEQ ID NO: 144859 - protein, 15 aa, Borrelia garinii PBi
NKLIAIFLLHILTGL

SEQ ID NO: 144860 - protein, 9 aa, Borrelia garinii PBi
LIAIFLLHI

SEQ ID NO: 144861 - protein, 15 aa, Borrelia garinii PBi
SLVKEILINRGFSIQ

SEQ ID NO: 144862 - protein, 9 aa, Borrelia garinii PBi
VKEILINRG

SEQ ID NO: 144863 - protein, 15 aa, Borrelia garinii PBi
NNKLIAIFLLHILTG

SEQ ID NO: 144864 - protein, 9 aa, Borrelia garinii PBi
LIAIFLLHI

SEQ ID NO: 144865 - protein, 15 aa, Borrelia garinii PBi
KLIAIFLLHILTGLI

SEQ ID NO: 144866 - protein, 9 aa, Borrelia garinii PBi
IAIFLLHIL

SEQ ID NO: 144867 - protein, 15 aa, Borrelia garinii PBi
SNYRSLVKEILINRG

SEQ ID NO: 144868 - protein, 9 aa, Borrelia garinii PBi
YRSLVKEIL

SEQ ID NO: 144869 - protein, 15 aa, Borrelia garinii PBi
DYNANPELRTDISKL

SEQ ID NO: 144870 - protein, 9 aa, Borrelia garinii PBi
YNANPELRT

SEQ ID NO: 144871 - protein, 15 aa, Borrelia garinii PBi
LINRGFSIQLAIEEI

SEQ ID NO: 144872 - protein, 9 aa, Borrelia garinii PBi
INRGFSIQL

SEQ ID NO: 144873 - protein, 15 aa, Borrelia garinii PBi
KNNKLIAIFLLHILT

SEQ ID NO: 144874 - protein, 9 aa, Borrelia garinii PBi
LIAIFLLHI

SEQ ID NO: 144875 - protein, 15 aa, Borrelia garinii PBi
YIISKNSKAQFTDIH

SEQ ID NO: 144876 - protein, 9 aa, Borrelia garinii PBi
SKNSKAQFT

SEQ ID NO: 144877 - protein, 15 aa, Borrelia garinii PBi
TLKNPPKTAGKNKSN

SEQ ID NO: 144878 - protein, 9 aa, Borrelia garinii PBi
LKNPPKTAG

SEQ ID NO: 144879 - protein, 15 aa, Borrelia garinii PBi
NANPELRTDISKLND

SEQ ID NO: 144880 - protein, 9 aa, Borrelia garinii PBi
LRTDISKLN

SEQ ID NO: 144881 - protein, 15 aa, Borrelia garinii PBi
RSLVKEILINRGFSI

SEQ ID NO: 144882 - protein, 9 aa, Borrelia garinii PBi
VKEILINRG

SEQ ID NO: 144883 - protein, 15 aa, Borrelia garinii PBi
LKNPPKTAGKNKSNS

SEQ ID NO: 144884 - protein, 9 aa, Borrelia garinii PBi
LKNPPKTAG

SEQ ID NO: 144885 - protein, 15 aa, Borrelia garinii PBi
PELRTDISKLNDYII

SEQ ID NO: 144886 - protein, 9 aa, Borrelia garinii PBi
LRTDISKLN

SEQ ID NO: 144887 - protein, 15 aa, Borrelia garinii PBi
NPELRTDISKLNDYI

SEQ ID NO: 144888 - protein, 9 aa, Borrelia garinii PBi
LRTDISKLN

SEQ ID NO: 144889 - protein, 15 aa, Borrelia garinii PBi
ANPELRTDISKLNDY

SEQ ID NO: 144890 - protein, 9 aa, Borrelia garinii PBi
LRTDISKLN

SEQ ID NO: 144891 - protein, 15 aa, Borrelia garinii PBi
IISKNSKAQFTDIHN

SEQ ID NO: 144892 - protein, 9 aa, Borrelia garinii PBi
SKNSKAQFT

SEQ ID NO: 144893 - protein, 15 aa, Borrelia garinii PBi
KPTVDNLLVAINTLK

SEQ ID NO: 144894 - protein, 9 aa, Borrelia garinii PBi
VDNLLVAIN

SEQ ID NO: 144895 - protein, 15 aa, Borrelia garinii PBi
AIEEISLRTLNVKDK

SEQ ID NO: 144896 - protein, 9 aa, Borrelia garinii PBi
EISLRTLNV

SEQ ID NO: 144897 - protein, 15 aa, Borrelia garinii PBi
IEEISLRTLNVKDKI

SEQ ID NO: 144898 - protein, 9 aa, Borrelia garinii PBi
LRTLNVKDK

SEQ ID NO: 144899 - protein, 15 aa, Borrelia garinii PBi
NENKILNLGKILSKL

SEQ ID NO: 144900 - protein, 9 aa, Borrelia garinii PBi
ILNLGKILS

SEQ ID NO: 144901 - protein, 15 aa, Borrelia garinii PBi
YRSLVKEILINRGFS

SEQ ID NO: 144902 - protein, 9 aa, Borrelia garinii PBi
VKEILINRG

SEQ ID NO: 144903 - protein, 15 aa, Borrelia garinii PBi
TGLILLSCSLEVNQD

SEQ ID NO: 144904 - protein, 9 aa, Borrelia garinii PBi
ILLSCSLEV

SEQ ID NO: 144905 - protein, 15 aa, Borrelia garinii PBi
NYRSLVKEILINRGF

SEQ ID NO: 144906 - protein, 9 aa, Borrelia garinii PBi
VKEILINRG

SEQ ID NO: 144907 - protein, 15 aa, Borrelia garinii PBi
INRGFSIQLAIEEIS

SEQ ID NO: 144908 - protein, 9 aa, Borrelia garinii PBi
INRGFSIQL

SEQ ID NO: 144909 - protein, 15 aa, Borrelia garinii PBi
FNENKILNLGKILSK

SEQ ID NO: 144910 - protein, 9 aa, Borrelia garinii PBi
ILNLGKILS

SEQ ID NO: 144911 - protein, 15 aa, Borrelia garinii PBi
LLVAINTLKNPPKTA

SEQ ID NO: 144912 - protein, 9 aa, Borrelia garinii PBi
LVAINTLKN

SEQ ID NO: 144913 - protein, 15 aa, Borrelia garinii PBi
GLILLSCSLEVNQDD

SEQ ID NO: 144914 - protein, 9 aa, Borrelia garinii PBi
ILLSCSLEV

SEQ ID NO: 144915 - protein, 15 aa, Borrelia garinii PBi
IQLAIEEISLRTLNV

SEQ ID NO: 144916 - protein, 9 aa, Borrelia garinii PBi
LAIEEISLR

SEQ ID NO: 144917 - protein, 15 aa, Borrelia garinii PBi
SKLNDYIISKNSKAQ

SEQ ID NO: 144918 - protein, 9 aa, Borrelia garinii PBi
YIISKNSKA

SEQ ID NO: 144919 - protein, 15 aa, Borrelia garinii PBi
KLNDYIISKNSKAQF

SEQ ID NO: 144920 - protein, 9 aa, Borrelia garinii PBi
IISKNSKAQ

SEQ ID NO: 144921 - protein, 15 aa, Borrelia garinii PBi
AKELIQKILERSEDI

SEQ ID NO: 144922 - protein, 9 aa, Borrelia garinii PBi
LIQKILERS

SEQ ID NO: 144923 - protein, 15 aa, Borrelia garinii PBi
EAKELIQKILERSED

SEQ ID NO: 144924 - protein, 9 aa, Borrelia garinii PBi
LIQKILERS

SEQ ID NO: 144925 - protein, 15 aa, Borrelia garinii PBi
PEAKELIQKILERSE

SEQ ID NO: 144926 - protein, 9 aa, Borrelia garinii PBi
LIQKILERS

SEQ ID NO: 144927 - protein, 15 aa, Borrelia garinii PBi
KELIQKILERSEDIV

SEQ ID NO: 144928 - protein, 9 aa, Borrelia garinii PBi
LIQKILERS

SEQ ID NO: 144929 - protein, 15 aa, Borrelia garinii PBi
IILNLINTTTNILAP

SEQ ID NO: 144930 - protein, 9 aa, Borrelia garinii PBi
LINTTTNIL

SEQ ID NO: 144931 - protein, 15 aa, Borrelia garinii PBi
NIILNLINTTTNILA

SEQ ID NO: 144932 - protein, 9 aa, Borrelia garinii PBi
LINTTTNIL

SEQ ID NO: 144933 - protein, 15 aa, Borrelia garinii PBi
LNLINTTTNILAPIQ

SEQ ID NO: 144934 - protein, 9 aa, Borrelia garinii PBi
LINTTTNIL

SEQ ID NO: 144935 - protein, 15 aa, Borrelia garinii PBi
ILNLINTTTNILAPI

SEQ ID NO: 144936 - protein, 9 aa, Borrelia garinii PBi
LINTTTNIL

SEQ ID NO: 144937 - protein, 15 aa, Borrelia garinii PBi
HNIILNLINTTTNIL

SEQ ID NO: 144938 - protein, 9 aa, Borrelia garinii PBi
LNLINTTTN

SEQ ID NO: 144939 - protein, 15 aa, Borrelia garinii PBi
DNLLVAINTLKNPPK

SEQ ID NO: 144940 - protein, 9 aa, Borrelia garinii PBi
LVAINTLKN

SEQ ID NO: 144941 - protein, 15 aa, Borrelia garinii PBi
VDNLLVAINTLKNPP

SEQ ID NO: 144942 - protein, 9 aa, Borrelia garinii PBi
LVAINTLKN

SEQ ID NO: 144943 - protein, 15 aa, Borrelia garinii PBi
NLLVAINTLKNPPKT

SEQ ID NO: 144944 - protein, 9 aa, Borrelia garinii PBi
LVAINTLKN

SEQ ID NO: 144945 - protein, 15 aa, Borrelia garinii PBi
TVDNLLVAINTLKNP

SEQ ID NO: 144946 - protein, 9 aa, Borrelia garinii PBi
LVAINTLKN

SEQ ID NO: 144947 - protein, 15 aa, Borrelia garinii PBi
IFSKIFFNAGSTVTF

SEQ ID NO: 144948 - protein, 9 aa, Borrelia garinii PBi
FFNAGSTVT

SEQ ID NO: 144949 - protein, 15 aa, Borrelia garinii PBi
PTVDNLLVAINTLKN

SEQ ID NO: 144950 - protein, 9 aa, Borrelia garinii PBi
LLVAINTLK

SEQ ID NO: 144951 - protein, 15 aa, Borrelia garinii PBi
FSKIFFNAGSTVTFD

SEQ ID NO: 144952 - protein, 9 aa, Borrelia garinii PBi
FFNAGSTVT

SEQ ID NO: 144953 - protein, 15 aa, Borrelia garinii PBi
SKIFFNAGSTVTFDD

SEQ ID NO: 144954 - protein, 9 aa, Borrelia garinii PBi
FFNAGSTVT

SEQ ID NO: 144955 - protein, 15 aa, Borrelia garinii PBi
KIFFNAGSTVTFDDN

SEQ ID NO: 144956 - protein, 9 aa, Borrelia garinii PBi
FFNAGSTVT

SEQ ID NO: 144957 - protein, 15 aa, Borrelia garinii PBi
EIFSKIFFNAGSTVT

SEQ ID NO: 144958 - protein, 9 aa, Borrelia garinii PBi
FSKIFFNAG

SEQ ID NO: 144959 - protein, 15 aa, Borrelia garinii PBi
NEYVNERRILYTSLN

SEQ ID NO: 144960 - protein, 9 aa, Borrelia garinii PBi
YVNERRILY

SEQ ID NO: 144961 - protein, 15 aa, Borrelia garinii PBi
LVAINTLKNPPKTAG

SEQ ID NO: 144962 - protein, 9 aa, Borrelia garinii PBi
LVAINTLKN

SEQ ID NO: 144963 - protein, 15 aa, Borrelia garinii PBi
DIHNIILNLINTTTN

SEQ ID NO: 144964 - protein, 9 aa, Borrelia garinii PBi
IILNLINTT

SEQ ID NO: 144965 - protein, 15 aa, Borrelia garinii PBi
IHNIILNLINTTTNI

SEQ ID NO: 144966 - protein, 9 aa, Borrelia garinii PBi
IILNLINTT

SEQ ID NO: 144967 - protein, 15 aa, Borrelia garinii PBi
LLVAINTLKNPPKTA

SEQ ID NO: 144968 - protein, 9 aa, Borrelia garinii PBi
LVAINTLKN

SEQ ID NO: 144969 - protein, 15 aa, Borrelia garinii PBi
HNIILNLINTTTNIL

SEQ ID NO: 144970 - protein, 9 aa, Borrelia garinii PBi
ILNLINTTT

SEQ ID NO: 144971 - protein, 15 aa, Borrelia garinii PBi
NIILNLINTTTNILA

SEQ ID NO: 144972 - protein, 9 aa, Borrelia garinii PBi
ILNLINTTT

SEQ ID NO: 144973 - protein, 15 aa, Borrelia garinii PBi
TDIHNIILNLINTTT

SEQ ID NO: 144974 - protein, 9 aa, Borrelia garinii PBi
IILNLINTT

SEQ ID NO: 144975 - protein, 15 aa, Borrelia garinii PBi
DIHNIILNLINTTTN

SEQ ID NO: 144976 - protein, 9 aa, Borrelia garinii PBi
ILNLINTTT

SEQ ID NO: 144977 - protein, 15 aa, Borrelia garinii PBi
IHNIILNLINTTTNI

SEQ ID NO: 144978 - protein, 9 aa, Borrelia garinii PBi
ILNLINTTT

SEQ ID NO: 144979 - protein, 15 aa, Borrelia garinii PBi
IILNLINTTTNILAP

SEQ ID NO: 144980 - protein, 9 aa, Borrelia garinii PBi
ILNLINTTT

SEQ ID NO: 144981 - protein, 15 aa, Borrelia garinii PBi
KLIAIFLLHILTGLI

SEQ ID NO: 144982 - protein, 9 aa, Borrelia garinii PBi
IFLLHILTG

SEQ ID NO: 144983 - protein, 15 aa, Borrelia garinii PBi
ILNLINTTTNILAPI

SEQ ID NO: 144984 - protein, 9 aa, Borrelia garinii PBi
ILNLINTTT

SEQ ID NO: 144985 - protein, 15 aa, Borrelia garinii PBi
LIAIFLLHILTGLIL

SEQ ID NO: 144986 - protein, 9 aa, Borrelia garinii PBi
LLHILTGLI

SEQ ID NO: 144987 - protein, 15 aa, Borrelia garinii PBi
IAIFLLHILTGLILL

SEQ ID NO: 144988 - protein, 9 aa, Borrelia garinii PBi
LLHILTGLI

SEQ ID NO: 144989 - protein, 15 aa, Borrelia garinii PBi
IFLLHILTGLILLSC

SEQ ID NO: 144990 - protein, 9 aa, Borrelia garinii PBi
LLHILTGLI

SEQ ID NO: 144991 - protein, 15 aa, Borrelia garinii PBi
AIFLLHILTGLILLS

SEQ ID NO: 144992 - protein, 9 aa, Borrelia garinii PBi
LLHILTGLI

SEQ ID NO: 144993 - protein, 15 aa, Borrelia garinii PBi
VDNLLVAINTLKNPP

SEQ ID NO: 144994 - protein, 9 aa, Borrelia garinii PBi
LLVAINTLK

SEQ ID NO: 144995 - protein, 15 aa, Borrelia garinii PBi
DNLLVAINTLKNPPK

SEQ ID NO: 144996 - protein, 9 aa, Borrelia garinii PBi
LLVAINTLK

SEQ ID NO: 144997 - protein, 15 aa, Borrelia garinii PBi
NLLVAINTLKNPPKT

SEQ ID NO: 144998 - protein, 9 aa, Borrelia garinii PBi
LLVAINTLK

SEQ ID NO: 144999 - protein, 15 aa, Borrelia garinii PBi
RRILYTSLNFNENKI

SEQ ID NO: 145000 - protein, 9 aa, Borrelia garinii PBi
ILYTSLNFN

SEQ ID NO: 145001 - protein, 15 aa, Borrelia garinii PBi
ERRILYTSLNFNENK

SEQ ID NO: 145002 - protein, 9 aa, Borrelia garinii PBi
ILYTSLNFN

SEQ ID NO: 145003 - protein, 15 aa, Borrelia garinii PBi
NERRILYTSLNFNEN

SEQ ID NO: 145004 - protein, 9 aa, Borrelia garinii PBi
ILYTSLNFN

SEQ ID NO: 145005 - protein, 15 aa, Borrelia garinii PBi
YVNERRILYTSLNFN

SEQ ID NO: 145006 - protein, 9 aa, Borrelia garinii PBi
ERRILYTSL

SEQ ID NO: 145007 - protein, 15 aa, Borrelia garinii PBi
EIFSKIFFNAGSTVT

SEQ ID NO: 145008 - protein, 9 aa, Borrelia garinii PBi
FSKIFFNAG

SEQ ID NO: 145009 - protein, 15 aa, Borrelia garinii PBi
TVDNLLVAINTLKNP

SEQ ID NO: 145010 - protein, 9 aa, Borrelia garinii PBi
LLVAINTLK

SEQ ID NO: 145011 - protein, 15 aa, Borrelia garinii PBi
VNERRILYTSLNFNE

SEQ ID NO: 145012 - protein, 9 aa, Borrelia garinii PBi
ILYTSLNFN

SEQ ID NO: 145013 - protein, 15 aa, Borrelia garinii PBi
LLVAINTLKNPPKTA

SEQ ID NO: 145014 - protein, 9 aa, Borrelia garinii PBi
LLVAINTLK

SEQ ID NO: 145015 - protein, 15 aa, Borrelia garinii PBi
PTVDNLLVAINTLKN

SEQ ID NO: 145016 - protein, 9 aa, Borrelia garinii PBi
LLVAINTLK

SEQ ID NO: 145017 - protein, 15 aa, Borrelia garinii PBi
FLLHILTGLILLSCS

SEQ ID NO: 145018 - protein, 9 aa, Borrelia garinii PBi
LLHILTGLI

SEQ ID NO: 145019 - protein, 15 aa, Borrelia garinii PBi
LLHILTGLILLSCSL

SEQ ID NO: 145020 - protein, 9 aa, Borrelia garinii PBi
LLHILTGLI

SEQ ID NO: 145021 - protein, 15 aa, Borrelia garinii PBi
LNLINTTTNILAPIQ

SEQ ID NO: 145022 - protein, 9 aa, Borrelia garinii PBi
LINTTTNIL

SEQ ID NO: 145023 - protein, 15 aa, Borrelia garinii PBi
IFSKIFFNAGSTVTF

SEQ ID NO: 145024 - protein, 9 aa, Borrelia garinii PBi
FFNAGSTVT

SEQ ID NO: 145025 - protein, 15 aa, Borrelia garinii PBi
DDIIKDYNANPELRT

SEQ ID NO: 145026 - protein, 9 aa, Borrelia garinii PBi
IIKDYNANP

SEQ ID NO: 145027 - protein, 15 aa, Borrelia garinii PBi
KDVDDIIKDYNANPE

SEQ ID NO: 145028 - protein, 9 aa, Borrelia garinii PBi
IIKDYNANP

SEQ ID NO: 145029 - protein, 15 aa, Borrelia garinii PBi
VDDIIKDYNANPELR

SEQ ID NO: 145030 - protein, 9 aa, Borrelia garinii PBi
IIKDYNANP

SEQ ID NO: 145031 - protein, 15 aa, Borrelia garinii PBi
DVDDIIKDYNANPEL

SEQ ID NO: 145032 - protein, 9 aa, Borrelia garinii PBi
IIKDYNANP

SEQ ID NO: 145033 - protein, 15 aa, Borrelia garinii PBi
FSKIFFNAGSTVTFD

SEQ ID NO: 145034 - protein, 9 aa, Borrelia garinii PBi
FFNAGSTVT

SEQ ID NO: 145035 - protein, 15 aa, Borrelia garinii PBi
SLVKEILINRGFSIQ

SEQ ID NO: 145036 - protein, 9 aa, Borrelia garinii PBi
VKEILINRG

SEQ ID NO: 145037 - protein, 15 aa, Borrelia garinii PBi
KPTVDNLLVAINTLK

SEQ ID NO: 145038 - protein, 9 aa, Borrelia garinii PBi
VDNLLVAIN

SEQ ID NO: 145039 - protein, 15 aa, Borrelia garinii PBi
RILYTSLNFNENKIL

SEQ ID NO: 145040 - protein, 9 aa, Borrelia garinii PBi
ILYTSLNFN

SEQ ID NO: 145041 - protein, 15 aa, Borrelia garinii PBi
DNLLVAINTLKNPPK

SEQ ID NO: 145042 - protein, 9 aa, Borrelia garinii PBi
LVAINTLKN

SEQ ID NO: 145043 - protein, 15 aa, Borrelia garinii PBi
NLLVAINTLKNPPKT

SEQ ID NO: 145044 - protein, 9 aa, Borrelia garinii PBi
LVAINTLKN

SEQ ID NO: 145045 - protein, 15 aa, Borrelia garinii PBi
LLVAINTLKNPPKTA

SEQ ID NO: 145046 - protein, 9 aa, Borrelia garinii PBi
LVAINTLKN

SEQ ID NO: 145047 - protein, 15 aa, Borrelia garinii PBi
LVAINTLKNPPKTAG

SEQ ID NO: 145048 - protein, 9 aa, Borrelia garinii PBi
LVAINTLKN

SEQ ID NO: 145049 - protein, 15 aa, Borrelia garinii PBi
PTVDNLLVAINTLKN

SEQ ID NO: 145050 - protein, 9 aa, Borrelia garinii PBi
VDNLLVAIN

SEQ ID NO: 145051 - protein, 15 aa, Borrelia garinii PBi
VDNLLVAINTLKNPP

SEQ ID NO: 145052 - protein, 9 aa, Borrelia garinii PBi
LVAINTLKN

SEQ ID NO: 145053 - protein, 15 aa, Borrelia garinii PBi
TVDNLLVAINTLKNP

SEQ ID NO: 145054 - protein, 9 aa, Borrelia garinii PBi
LVAINTLKN

SEQ ID NO: 145055 - protein, 15 aa, Borrelia garinii PBi
IILNLINTTTNILAP

SEQ ID NO: 145056 - protein, 9 aa, Borrelia garinii PBi
INTTTNILA

SEQ ID NO: 145057 - protein, 15 aa, Borrelia garinii PBi
NIILNLINTTTNILA

SEQ ID NO: 145058 - protein, 9 aa, Borrelia garinii PBi
LNLINTTTN

SEQ ID NO: 145059 - protein, 15 aa, Borrelia garinii PBi
LNLINTTTNILAPIQ

SEQ ID NO: 145060 - protein, 9 aa, Borrelia garinii PBi
INTTTNILA

SEQ ID NO: 145061 - protein, 15 aa, Borrelia garinii PBi
ILNLINTTTNILAPI

SEQ ID NO: 145062 - protein, 9 aa, Borrelia garinii PBi
INTTTNILA

SEQ ID NO: 145063 - protein, 15 aa, Borrelia garinii PBi
NERRILYTSLNFNEN

SEQ ID NO: 145064 - protein, 9 aa, Borrelia garinii PBi
RRILYTSLN

SEQ ID NO: 145065 - protein, 15 aa, Borrelia garinii PBi
KTLYHDFNKLIPLKE

SEQ ID NO: 145066 - protein, 9 aa, Borrelia garinii PBi
LYHDFNKLI

SEQ ID NO: 145067 - protein, 15 aa, Borrelia garinii PBi
ERRILYTSLNFNENK

SEQ ID NO: 145068 - protein, 9 aa, Borrelia garinii PBi
YTSLNFNEN

SEQ ID NO: 145069 - protein, 15 aa, Borrelia garinii PBi
TLYHDFNKLIPLKEK

SEQ ID NO: 145070 - protein, 9 aa, Borrelia garinii PBi
FNKLIPLKE

SEQ ID NO: 145071 - protein, 15 aa, Borrelia garinii PBi
RRILYTSLNFNENKI

SEQ ID NO: 145072 - protein, 9 aa, Borrelia garinii PBi
YTSLNFNEN

SEQ ID NO: 145073 - protein, 15 aa, Borrelia garinii PBi
HNIILNLINTTTNIL

SEQ ID NO: 145074 - protein, 9 aa, Borrelia garinii PBi
LNLINTTTN

SEQ ID NO: 145075 - protein, 15 aa, Borrelia garinii PBi
VNERRILYTSLNFNE

SEQ ID NO: 145076 - protein, 9 aa, Borrelia garinii PBi
RRILYTSLN

SEQ ID NO: 145077 - protein, 15 aa, Borrelia garinii PBi
VAINTLKNPPKTAGK

SEQ ID NO: 145078 - protein, 9 aa, Borrelia garinii PBi
INTLKNPPK

SEQ ID NO: 145079 - protein, 15 aa, Borrelia garinii PBi
YNANPELRTDISKLN

SEQ ID NO: 145080 - protein, 9 aa, Borrelia garinii PBi
YNANPELRT

SEQ ID NO: 145081 - protein, 15 aa, Borrelia garinii PBi
LYHDFNKLIPLKEKW

SEQ ID NO: 145082 - protein, 9 aa, Borrelia garinii PBi
FNKLIPLKE

SEQ ID NO: 145083 - protein, 15 aa, Borrelia garinii PBi
NEYVNERRILYTSLN

SEQ ID NO: 145084 - protein, 9 aa, Borrelia garinii PBi
YVNERRILY

SEQ ID NO: 145085 - protein, 15 aa, Borrelia garinii PBi
HNIILNLINTTTNIL

SEQ ID NO: 145086 - protein, 9 aa, Borrelia garinii PBi
ILNLINTTT

SEQ ID NO: 145087 - protein, 15 aa, Borrelia garinii PBi
NIILNLINTTTNILA

SEQ ID NO: 145088 - protein, 9 aa, Borrelia garinii PBi
LINTTTNIL

SEQ ID NO: 145089 - protein, 15 aa, Borrelia garinii PBi
ILNLINTTTNILAPI

SEQ ID NO: 145090 - protein, 9 aa, Borrelia garinii PBi
LINTTTNIL

SEQ ID NO: 145091 - protein, 15 aa, Borrelia garinii PBi
LNLINTTTNILAPIQ

SEQ ID NO: 145092 - protein, 9 aa, Borrelia garinii PBi
LINTTTNIL

SEQ ID NO: 145093 - protein, 15 aa, Borrelia garinii PBi
IFSKIFFNAGSTVTF

SEQ ID NO: 145094 - protein, 9 aa, Borrelia garinii PBi
FFNAGSTVT

SEQ ID NO: 145095 - protein, 15 aa, Borrelia garinii PBi
FSKIFFNAGSTVTFD

SEQ ID NO: 145096 - protein, 9 aa, Borrelia garinii PBi
FFNAGSTVT

SEQ ID NO: 145097 - protein, 15 aa, Borrelia garinii PBi
IILNLINTTTNILAP

SEQ ID NO: 145098 - protein, 9 aa, Borrelia garinii PBi
LINTTTNIL

SEQ ID NO: 145099 - protein, 15 aa, Borrelia garinii PBi
EIFSKIFFNAGSTVT

SEQ ID NO: 145100 - protein, 9 aa, Borrelia garinii PBi
IFFNAGSTV

SEQ ID NO: 145101 - protein, 15 aa, Borrelia garinii PBi
SKIFFNAGSTVTFDD

SEQ ID NO: 145102 - protein, 9 aa, Borrelia garinii PBi
FFNAGSTVT

SEQ ID NO: 145103 - protein, 15 aa, Borrelia garinii PBi
KIFFNAGSTVTFDDN

SEQ ID NO: 145104 - protein, 9 aa, Borrelia garinii PBi
FFNAGSTVT

SEQ ID NO: 145105 - protein, 15 aa, Borrelia garinii PBi
IFFNAGSTVTFDDNE

SEQ ID NO: 145106 - protein, 9 aa, Borrelia garinii PBi
FFNAGSTVT

SEQ ID NO: 145107 - protein, 15 aa, Borrelia garinii PBi
FFNAGSTVTFDDNEY

SEQ ID NO: 145108 - protein, 9 aa, Borrelia garinii PBi
FFNAGSTVT

SEQ ID NO: 145109 - protein, 15 aa, Borrelia garinii PBi
NNSSKMKKLSKNAKN

SEQ ID NO: 145110 - protein, 9 aa, Borrelia garinii PBi
MKKLSKNAK

SEQ ID NO: 145111 - protein, 15 aa, Borrelia garinii PBi
ENNSSKMKKLSKNAK

SEQ ID NO: 145112 - protein, 9 aa, Borrelia garinii PBi
NSSKMKKLS

SEQ ID NO: 145113 - protein, 15 aa, Borrelia garinii PBi
SKMKKLSKNAKNKKP

SEQ ID NO: 145114 - protein, 9 aa, Borrelia garinii PBi
MKKLSKNAK

SEQ ID NO: 145115 - protein, 15 aa, Borrelia garinii PBi
NSSKMKKLSKNAKNK

SEQ ID NO: 145116 - protein, 9 aa, Borrelia garinii PBi
MKKLSKNAK

SEQ ID NO: 145117 - protein, 15 aa, Borrelia garinii PBi
SSKMKKLSKNAKNKK

SEQ ID NO: 145118 - protein, 9 aa, Borrelia garinii PBi
MKKLSKNAK

SEQ ID NO: 145119 - protein, 15 aa, Borrelia garinii PBi
HDFNKLIPLKEKWLK

SEQ ID NO: 145120 - protein, 9 aa, Borrelia garinii PBi
FNKLIPLKE

SEQ ID NO: 145121 - protein, 15 aa, Borrelia garinii PBi
YHDFNKLIPLKEKWL

SEQ ID NO: 145122 - protein, 9 aa, Borrelia garinii PBi
FNKLIPLKE

SEQ ID NO: 145123 - protein, 15 aa, Borrelia garinii PBi
LYHDFNKLIPLKEKW

SEQ ID NO: 145124 - protein, 9 aa, Borrelia garinii PBi
FNKLIPLKE

SEQ ID NO: 145125 - protein, 15 aa, Borrelia garinii PBi
KTLYHDFNKLIPLKE

SEQ ID NO: 145126 - protein, 9 aa, Borrelia garinii PBi
YHDFNKLIP

SEQ ID NO: 145127 - protein, 15 aa, Borrelia garinii PBi
TLYHDFNKLIPLKEK

SEQ ID NO: 145128 - protein, 9 aa, Borrelia garinii PBi
FNKLIPLKE

SEQ ID NO: 145129 - protein, 15 aa, Borrelia garinii PBi
KMKKLSKNAKNKKPT

SEQ ID NO: 145130 - protein, 9 aa, Borrelia garinii PBi
MKKLSKNAK

SEQ ID NO: 145131 - protein, 15 aa, Borrelia garinii PBi
MKKLSKNAKNKKPTV

SEQ ID NO: 145132 - protein, 9 aa, Borrelia garinii PBi
MKKLSKNAK

SEQ ID NO: 145133 - protein, 15 aa, Borrelia garinii PBi
IFSKIFFNAGSTVTF

SEQ ID NO: 145134 - protein, 9 aa, Borrelia garinii PBi
FFNAGSTVT

SEQ ID NO: 145135 - protein, 15 aa, Borrelia garinii PBi
FSKIFFNAGSTVTFD

SEQ ID NO: 145136 - protein, 9 aa, Borrelia garinii PBi
FFNAGSTVT

SEQ ID NO: 145137 - protein, 15 aa, Borrelia garinii PBi
SKIFFNAGSTVTFDD

SEQ ID NO: 145138 - protein, 9 aa, Borrelia garinii PBi
FFNAGSTVT

SEQ ID NO: 145139 - protein, 15 aa, Borrelia garinii PBi
KIFFNAGSTVTFDDN

SEQ ID NO: 145140 - protein, 9 aa, Borrelia garinii PBi
FFNAGSTVT

SEQ ID NO: 145141 - protein, 15 aa, Borrelia garinii PBi
EIFSKIFFNAGSTVT

SEQ ID NO: 145142 - protein, 9 aa, Borrelia garinii PBi
KIFFNAGST

SEQ ID NO: 145143 - protein, 15 aa, Borrelia garinii PBi
IFFNAGSTVTFDDNE

SEQ ID NO: 145144 - protein, 9 aa, Borrelia garinii PBi
FFNAGSTVT

SEQ ID NO: 145145 - protein, 15 aa, Borrelia garinii PBi
SSKMKKLSKNAKNKK

SEQ ID NO: 145146 - protein, 9 aa, Borrelia garinii PBi
MKKLSKNAK

SEQ ID NO: 145147 - protein, 15 aa, Borrelia garinii PBi
SKMKKLSKNAKNKKP

SEQ ID NO: 145148 - protein, 9 aa, Borrelia garinii PBi
MKKLSKNAK

SEQ ID NO: 145149 - protein, 15 aa, Borrelia garinii PBi
ENNSSKMKKLSKNAK

SEQ ID NO: 145150 - protein, 9 aa, Borrelia garinii PBi
SKMKKLSKN

SEQ ID NO: 145151 - protein, 15 aa, Borrelia garinii PBi
NSSKMKKLSKNAKNK

SEQ ID NO: 145152 - protein, 9 aa, Borrelia garinii PBi
MKKLSKNAK

SEQ ID NO: 145153 - protein, 15 aa, Borrelia garinii PBi
NNSSKMKKLSKNAKN

SEQ ID NO: 145154 - protein, 9 aa, Borrelia garinii PBi
MKKLSKNAK

SEQ ID NO: 145155 - protein, 15 aa, Borrelia garinii PBi
NFNENKILNLGKILS

SEQ ID NO: 145156 - protein, 9 aa, Borrelia garinii PBi
NKILNLGKI

SEQ ID NO: 145157 - protein, 15 aa, Borrelia garinii PBi
FNENKILNLGKILSK

SEQ ID NO: 145158 - protein, 9 aa, Borrelia garinii PBi
ILNLGKILS

SEQ ID NO: 145159 - protein, 15 aa, Borrelia garinii PBi
NENKILNLGKILSKL

SEQ ID NO: 145160 - protein, 9 aa, Borrelia garinii PBi
ILNLGKILS

SEQ ID NO: 145161 - protein, 15 aa, Borrelia garinii PBi
ENKILNLGKILSKLS

SEQ ID NO: 145162 - protein, 9 aa, Borrelia garinii PBi
ILNLGKILS

SEQ ID NO: 145163 - protein, 15 aa, Borrelia garinii PBi
NKILNLGKILSKLSQ

SEQ ID NO: 145164 - protein, 9 aa, Borrelia garinii PBi
ILNLGKILS

SEQ ID NO: 145165 - protein, 15 aa, Borrelia garinii PBi
HNIILNLINTTTNIL

SEQ ID NO: 145166 - protein, 9 aa, Borrelia garinii PBi
ILNLINTTT

SEQ ID NO: 145167 - protein, 15 aa, Borrelia garinii PBi
DIHNIILNLINTTTN

SEQ ID NO: 145168 - protein, 9 aa, Borrelia garinii PBi
IILNLINTT

SEQ ID NO: 145169 - protein, 15 aa, Borrelia garinii PBi
IHNIILNLINTTTNI

SEQ ID NO: 145170 - protein, 9 aa, Borrelia garinii PBi
IILNLINTT

SEQ ID NO: 145171 - protein, 15 aa, Borrelia garinii PBi
NIILNLINTTTNILA

SEQ ID NO: 145172 - protein, 9 aa, Borrelia garinii PBi
ILNLINTTT

SEQ ID NO: 145173 - protein, 15 aa, Borrelia garinii PBi
TDIHNIILNLINTTT

SEQ ID NO: 145174 - protein, 9 aa, Borrelia garinii PBi
IHNIILNLI

SEQ ID NO: 145175 - protein, 15 aa, Borrelia garinii PBi
IILNLINTTTNILAP

SEQ ID NO: 145176 - protein, 9 aa, Borrelia garinii PBi
LINTTTNIL

SEQ ID NO: 145177 - protein, 15 aa, Borrelia garinii PBi
FTDIHNIILNLINTT

SEQ ID NO: 145178 - protein, 9 aa, Borrelia garinii PBi
IHNIILNLI

SEQ ID NO: 145179 - protein, 15 aa, Borrelia garinii PBi
ILNLINTTTNILAPI

SEQ ID NO: 145180 - protein, 9 aa, Borrelia garinii PBi
LINTTTNIL

SEQ ID NO: 145181 - protein, 15 aa, Borrelia garinii PBi
KILNLGKILSKLSQD

SEQ ID NO: 145182 - protein, 9 aa, Borrelia garinii PBi
ILNLGKILS

SEQ ID NO: 145183 - protein, 15 aa, Borrelia garinii PBi
ILNLGKILSKLSQDS

SEQ ID NO: 145184 - protein, 9 aa, Borrelia garinii PBi
ILNLGKILS

SEQ ID NO: 145185 - protein, 15 aa, Borrelia garinii PBi
LNLINTTTNILAPIQ

SEQ ID NO: 145186 - protein, 9 aa, Borrelia garinii PBi
LINTTTNIL

SEQ ID NO: 145187 - protein, 15 aa, Borrelia garinii PBi
QFTDIHNIILNLINT

SEQ ID NO: 145188 - protein, 9 aa, Borrelia garinii PBi
IHNIILNLI

SEQ ID NO: 145189 - protein, 15 aa, Borrelia garinii PBi
KAQFTDIHNIILNLI

SEQ ID NO: 145190 - protein, 9 aa, Borrelia garinii PBi
DIHNIILNL

SEQ ID NO: 145191 - protein, 15 aa, Borrelia garinii PBi
AQFTDIHNIILNLIN

SEQ ID NO: 145192 - protein, 9 aa, Borrelia garinii PBi
IHNIILNLI

SEQ ID NO: 145193 - protein, 15 aa, Borrelia garinii PBi
MKNNKLIAIFLLHIL

SEQ ID NO: 145194 - protein, 9 aa, Borrelia garinii PBi
MKNNKLIAI

SEQ ID NO: 145195 - protein, 15 aa, Borrelia garinii PBi
DNLLVAINTLKNPPK

SEQ ID NO: 145196 - protein, 9 aa, Borrelia garinii PBi
VAINTLKNP

SEQ ID NO: 145197 - protein, 15 aa, Borrelia garinii PBi
IFSKIFFNAGSTVTF

SEQ ID NO: 145198 - protein, 9 aa, Borrelia garinii PBi
FFNAGSTVT

SEQ ID NO: 145199 - protein, 15 aa, Borrelia garinii PBi
FSKIFFNAGSTVTFD

SEQ ID NO: 145200 - protein, 9 aa, Borrelia garinii PBi
FFNAGSTVT

SEQ ID NO: 145201 - protein, 15 aa, Borrelia garinii PBi
SLVKEILINRGFSIQ

SEQ ID NO: 145202 - protein, 9 aa, Borrelia garinii PBi
VKEILINRG

SEQ ID NO: 145203 - protein, 15 aa, Borrelia garinii PBi
SKIFFNAGSTVTFDD

SEQ ID NO: 145204 - protein, 9 aa, Borrelia garinii PBi
FFNAGSTVT

SEQ ID NO: 145205 - protein, 15 aa, Borrelia garinii PBi
TVDNLLVAINTLKNP

SEQ ID NO: 145206 - protein, 9 aa, Borrelia garinii PBi
LLVAINTLK

SEQ ID NO: 145207 - protein, 15 aa, Borrelia garinii PBi
VDNLLVAINTLKNPP

SEQ ID NO: 145208 - protein, 9 aa, Borrelia garinii PBi
VAINTLKNP

SEQ ID NO: 145209 - protein, 15 aa, Borrelia garinii PBi
NLLVAINTLKNPPKT

SEQ ID NO: 145210 - protein, 9 aa, Borrelia garinii PBi
VAINTLKNP

SEQ ID NO: 145211 - protein, 15 aa, Borrelia garinii PBi
KIFFNAGSTVTFDDN

SEQ ID NO: 145212 - protein, 9 aa, Borrelia garinii PBi
FFNAGSTVT

SEQ ID NO: 145213 - protein, 15 aa, Borrelia garinii PBi
LVKEILINRGFSIQL

SEQ ID NO: 145214 - protein, 9 aa, Borrelia garinii PBi
LINRGFSIQ

SEQ ID NO: 145215 - protein, 15 aa, Borrelia garinii PBi
VKEILINRGFSIQLA

SEQ ID NO: 145216 - protein, 9 aa, Borrelia garinii PBi
LINRGFSIQ

SEQ ID NO: 145217 - protein, 15 aa, Borrelia garinii PBi
SKMKKLSKNAKNKKP

SEQ ID NO: 145218 - protein, 9 aa, Borrelia garinii PBi
MKKLSKNAK

SEQ ID NO: 145219 - protein, 15 aa, Borrelia garinii PBi
SSKMKKLSKNAKNKK

SEQ ID NO: 145220 - protein, 9 aa, Borrelia garinii PBi
MKKLSKNAK

SEQ ID NO: 145221 - protein, 15 aa, Borrelia garinii PBi
LLVAINTLKNPPKTA

SEQ ID NO: 145222 - protein, 9 aa, Borrelia garinii PBi
VAINTLKNP

SEQ ID NO: 145223 - protein, 15 aa, Borrelia garinii PBi
LVAINTLKNPPKTAG

SEQ ID NO: 145224 - protein, 9 aa, Borrelia garinii PBi
VAINTLKNP

SEQ ID NO: 145225 - protein, 15 aa, Borrelia garinii PBi
KEILINRGFSIQLAI

SEQ ID NO: 145226 - protein, 9 aa, Borrelia garinii PBi
LINRGFSIQ

SEQ ID NO: 145227 - protein, 15 aa, Borrelia garinii PBi
IAIFLLHILTGLILL

SEQ ID NO: 145228 - protein, 9 aa, Borrelia garinii PBi
LHILTGLIL

SEQ ID NO: 145229 - protein, 15 aa, Borrelia garinii PBi
MKKLSKNAKNKKPTV

SEQ ID NO: 145230 - protein, 9 aa, Borrelia garinii PBi
LSKNAKNKK

SEQ ID NO: 145231 - protein, 15 aa, Borrelia garinii PBi
KMKKLSKNAKNKKPT

SEQ ID NO: 145232 - protein, 9 aa, Borrelia garinii PBi
LSKNAKNKK

SEQ ID NO: 145233 - protein, 15 aa, Borrelia garinii PBi
LIAIFLLHILTGLIL

SEQ ID NO: 145234 - protein, 9 aa, Borrelia garinii PBi
LLHILTGLI

SEQ ID NO: 145235 - protein, 15 aa, Borrelia garinii PBi
AIFLLHILTGLILLS

SEQ ID NO: 145236 - protein, 9 aa, Borrelia garinii PBi
LHILTGLIL

SEQ ID NO: 145237 - protein, 15 aa, Borrelia garinii PBi
EIFSKIFFNAGSTVT

SEQ ID NO: 145238 - protein, 9 aa, Borrelia garinii PBi
IFFNAGSTV

SEQ ID NO: 145239 - protein, 15 aa, Borrelia garinii PBi
PTVDNLLVAINTLKN

SEQ ID NO: 145240 - protein, 9 aa, Borrelia garinii PBi
LLVAINTLK

SEQ ID NO: 145241 - protein, 15 aa, Borrelia garinii PBi
ENNSSKMKKLSKNAK

SEQ ID NO: 145242 - protein, 9 aa, Borrelia garinii PBi
SKMKKLSKN

SEQ ID NO: 145243 - protein, 15 aa, Borrelia garinii PBi
NNSSKMKKLSKNAKN

SEQ ID NO: 145244 - protein, 9 aa, Borrelia garinii PBi
MKKLSKNAK

SEQ ID NO: 145245 - protein, 15 aa, Borrelia garinii PBi
NSSKMKKLSKNAKNK

SEQ ID NO: 145246 - protein, 9 aa, Borrelia garinii PBi
MKKLSKNAK

SEQ ID NO: 145247 - protein, 15 aa, Borrelia garinii PBi
IFLLHILTGLILLSC

SEQ ID NO: 145248 - protein, 9 aa, Borrelia garinii PBi
LHILTGLIL

SEQ ID NO: 145249 - protein, 15 aa, Borrelia garinii PBi
IFFNAGSTVTFDDNE

SEQ ID NO: 145250 - protein, 9 aa, Borrelia garinii PBi
FFNAGSTVT

SEQ ID NO: 145251 - protein, 15 aa, Borrelia garinii PBi
LNFNENKILNLGKIL

SEQ ID NO: 145252 - protein, 9 aa, Borrelia garinii PBi
NENKILNLG

SEQ ID NO: 145253 - protein, 15 aa, Borrelia garinii PBi
VAINTLKNPPKTAGK

SEQ ID NO: 145254 - protein, 9 aa, Borrelia garinii PBi
LKNPPKTAG

SEQ ID NO: 145255 - protein, 15 aa, Borrelia garinii PBi
SLNFNENKILNLGKI

SEQ ID NO: 145256 - protein, 9 aa, Borrelia garinii PBi
NENKILNLG

SEQ ID NO: 145257 - protein, 15 aa, Borrelia garinii PBi
KLIAIFLLHILTGLI

SEQ ID NO: 145258 - protein, 9 aa, Borrelia garinii PBi
IAIFLLHIL

SEQ ID NO: 145259 - protein, 15 aa, Borrelia garinii PBi
EILINRGFSIQLAIE

SEQ ID NO: 145260 - protein, 9 aa, Borrelia garinii PBi
LINRGFSIQ

SEQ ID NO: 145261 - protein, 15 aa, Borrelia garinii PBi
FLLHILTGLILLSCS

SEQ ID NO: 145262 - protein, 9 aa, Borrelia garinii PBi
LHILTGLIL

SEQ ID NO: 145263 - protein, 15 aa, Borrelia garinii PBi
KKLSKNAKNKKPTVD

SEQ ID NO: 145264 - protein, 9 aa, Borrelia garinii PBi
LSKNAKNKK

SEQ ID NO: 145265 - protein, 15 aa, Borrelia garinii PBi
VKDKIQHLNKPNLKT

SEQ ID NO: 145266 - protein, 9 aa, Borrelia garinii PBi
IQHLNKPNL

SEQ ID NO: 145267 - protein, 15 aa, Borrelia garinii PBi
LNVKDKIQHLNKPNL

SEQ ID NO: 145268 - protein, 9 aa, Borrelia garinii PBi
VKDKIQHLN

SEQ ID NO: 145269 - protein, 15 aa, Borrelia garinii PBi
DKIQHLNKPNLKTLY

SEQ ID NO: 145270 - protein, 9 aa, Borrelia garinii PBi
IQHLNKPNL

SEQ ID NO: 145271 - protein, 15 aa, Borrelia garinii PBi
NEYVNERRILYTSLN

SEQ ID NO: 145272 - protein, 9 aa, Borrelia garinii PBi
YVNERRILY

SEQ ID NO: 145273 - protein, 15 aa, Borrelia garinii PBi
NVKDKIQHLNKPNLK

SEQ ID NO: 145274 - protein, 9 aa, Borrelia garinii PBi
IQHLNKPNL

SEQ ID NO: 145275 - protein, 15 aa, Borrelia garinii PBi
RSLVKEILINRGFSI

SEQ ID NO: 145276 - protein, 9 aa, Borrelia garinii PBi
VKEILINRG

SEQ ID NO: 145277 - protein, 15 aa, Borrelia garinii PBi
KPTVDNLLVAINTLK

SEQ ID NO: 145278 - protein, 9 aa, Borrelia garinii PBi
VDNLLVAIN

SEQ ID NO: 145279 - protein, 15 aa, Borrelia garinii PBi
DNEYVNERRILYTSL

SEQ ID NO: 145280 - protein, 9 aa, Borrelia garinii PBi
YVNERRILY

SEQ ID NO: 145281 - protein, 15 aa, Borrelia garinii PBi
YTSLNFNENKILNLG

SEQ ID NO: 145282 - protein, 9 aa, Borrelia garinii PBi
LNFNENKIL

SEQ ID NO: 145283 - protein, 15 aa, Borrelia garinii PBi
SNYRSLVKEILINRG

SEQ ID NO: 145284 - protein, 9 aa, Borrelia garinii PBi
YRSLVKEIL

SEQ ID NO: 145285 - protein, 15 aa, Borrelia garinii PBi
DDNEYVNERRILYTS

SEQ ID NO: 145286 - protein, 9 aa, Borrelia garinii PBi
YVNERRILY

SEQ ID NO: 145287 - protein, 15 aa, Borrelia garinii PBi
FDDNEYVNERRILYT

SEQ ID NO: 145288 - protein, 9 aa, Borrelia garinii PBi
YVNERRILY

SEQ ID NO: 145289 - protein, 15 aa, Borrelia garinii PBi
TSLNFNENKILNLGK

SEQ ID NO: 145290 - protein, 9 aa, Borrelia garinii PBi
NENKILNLG

SEQ ID NO: 145291 - protein, 15 aa, Borrelia garinii PBi
KDKIQHLNKPNLKTL

SEQ ID NO: 145292 - protein, 9 aa, Borrelia garinii PBi
IQHLNKPNL

SEQ ID NO: 145293 - protein, 15 aa, Borrelia garinii PBi
FFNAGSTVTFDDNEY

SEQ ID NO: 145294 - protein, 9 aa, Borrelia garinii PBi
FFNAGSTVT

SEQ ID NO: 145295 - protein, 15 aa, Borrelia garinii PBi
YRSLVKEILINRGFS

SEQ ID NO: 145296 - protein, 9 aa, Borrelia garinii PBi
VKEILINRG

SEQ ID NO: 145297 - protein, 15 aa, Borrelia garinii PBi
TFDDNEYVNERRILY

SEQ ID NO: 145298 - protein, 9 aa, Borrelia garinii PBi
EYVNERRIL

SEQ ID NO: 145299 - protein, 15 aa, Borrelia garinii PBi
NKLIAIFLLHILTGL

SEQ ID NO: 145300 - protein, 9 aa, Borrelia garinii PBi
IAIFLLHIL

SEQ ID NO: 145301 - protein, 15 aa, Borrelia garinii PBi
KIQHLNKPNLKTLYH

SEQ ID NO: 145302 - protein, 9 aa, Borrelia garinii PBi
IQHLNKPNL

SEQ ID NO: 145303 - protein, 15 aa, Borrelia garinii PBi
LLHILTGLILLSCSL

SEQ ID NO: 145304 - protein, 9 aa, Borrelia garinii PBi
LHILTGLIL

SEQ ID NO: 145305 - protein, 15 aa, Borrelia garinii PBi
IEEISLRTLNVKDKI

SEQ ID NO: 145306 - protein, 9 aa, Borrelia garinii PBi
ISLRTLNVK

SEQ ID NO: 145307 - protein, 15 aa, Borrelia garinii PBi
NYRSLVKEILINRGF

SEQ ID NO: 145308 - protein, 9 aa, Borrelia garinii PBi
VKEILINRG

SEQ ID NO: 145309 - protein, 15 aa, Borrelia garinii PBi
EEISLRTLNVKDKIQ

SEQ ID NO: 145310 - protein, 9 aa, Borrelia garinii PBi
ISLRTLNVK

SEQ ID NO: 145311 - protein, 15 aa, Borrelia garinii PBi
ILINRGFSIQLAIEE

SEQ ID NO: 145312 - protein, 9 aa, Borrelia garinii PBi
LINRGFSIQ

SEQ ID NO: 145313 - protein, 15 aa, Borrelia garinii PBi
YVNERRILYTSLNFN

SEQ ID NO: 145314 - protein, 9 aa, Borrelia garinii PBi
YVNERRILY

SEQ ID NO: 145315 - protein, 15 aa, Borrelia garinii PBi
IQHLNKPNLKTLYHD

SEQ ID NO: 145316 - protein, 9 aa, Borrelia garinii PBi
IQHLNKPNL

SEQ ID NO: 145317 - protein, 15 aa, Borrelia garinii PBi
AINTLKNPPKTAGKN

SEQ ID NO: 145318 - protein, 9 aa, Borrelia garinii PBi
LKNPPKTAG

SEQ ID NO: 145319 - protein, 15 aa, Borrelia garinii PBi
LHILTGLILLSCSLE

SEQ ID NO: 145320 - protein, 9 aa, Borrelia garinii PBi
LHILTGLIL

SEQ ID NO: 145321 - protein, 15 aa, Borrelia garinii PBi
EYVNERRILYTSLNF

SEQ ID NO: 145322 - protein, 9 aa, Borrelia garinii PBi
YVNERRILY

SEQ ID NO: 145323 - protein, 15 aa, Borrelia garinii PBi
KLSKNAKNKKPTVDN

SEQ ID NO: 145324 - protein, 9 aa, Borrelia garinii PBi
LSKNAKNKK

SEQ ID NO: 145325 - protein, 15 aa, Borrelia garinii PBi
LNLGKILSKLSQDSN

SEQ ID NO: 145326 - protein, 9 aa, Borrelia garinii PBi
LGKILSKLS

SEQ ID NO: 145327 - protein, 15 aa, Borrelia garinii PBi
LSKNAKNKKPTVDNL

SEQ ID NO: 145328 - protein, 9 aa, Borrelia garinii PBi
LSKNAKNKK

SEQ ID NO: 145329 - protein, 15 aa, Borrelia garinii PBi
ISLRTLNVKDKIQHL

SEQ ID NO: 145330 - protein, 9 aa, Borrelia garinii PBi
ISLRTLNVK

SEQ ID NO: 145331 - protein, 15 aa, Borrelia garinii PBi
IAIFLLHILTGLILL

SEQ ID NO: 145332 - protein, 9 aa, Borrelia garinii PBi
IFLLHILTG

SEQ ID NO: 145333 - protein, 15 aa, Borrelia garinii PBi
LIAIFLLHILTGLIL

SEQ ID NO: 145334 - protein, 9 aa, Borrelia garinii PBi
IFLLHILTG

SEQ ID NO: 145335 - protein, 15 aa, Borrelia garinii PBi
DNLLVAINTLKNPPK

SEQ ID NO: 145336 - protein, 9 aa, Borrelia garinii PBi
LLVAINTLK

SEQ ID NO: 145337 - protein, 15 aa, Borrelia garinii PBi
IFLLHILTGLILLSC

SEQ ID NO: 145338 - protein, 9 aa, Borrelia garinii PBi
IFLLHILTG

SEQ ID NO: 145339 - protein, 15 aa, Borrelia garinii PBi
RSLVKEILINRGFSI

SEQ ID NO: 145340 - protein, 9 aa, Borrelia garinii PBi
LVKEILINR

SEQ ID NO: 145341 - protein, 15 aa, Borrelia garinii PBi
ENKILNLGKILSKLS

SEQ ID NO: 145342 - protein, 9 aa, Borrelia garinii PBi
ILNLGKILS

SEQ ID NO: 145343 - protein, 15 aa, Borrelia garinii PBi
AIFLLHILTGLILLS

SEQ ID NO: 145344 - protein, 9 aa, Borrelia garinii PBi
IFLLHILTG

SEQ ID NO: 145345 - protein, 15 aa, Borrelia garinii PBi
NKILNLGKILSKLSQ

SEQ ID NO: 145346 - protein, 9 aa, Borrelia garinii PBi
ILNLGKILS

SEQ ID NO: 145347 - protein, 15 aa, Borrelia garinii PBi
KLIAIFLLHILTGLI

SEQ ID NO: 145348 - protein, 9 aa, Borrelia garinii PBi
IFLLHILTG

SEQ ID NO: 145349 - protein, 15 aa, Borrelia garinii PBi
NENKILNLGKILSKL

SEQ ID NO: 145350 - protein, 9 aa, Borrelia garinii PBi
ILNLGKILS

SEQ ID NO: 145351 - protein, 15 aa, Borrelia garinii PBi
NKLIAIFLLHILTGL

SEQ ID NO: 145352 - protein, 9 aa, Borrelia garinii PBi
IFLLHILTG

SEQ ID NO: 145353 - protein, 15 aa, Borrelia garinii PBi
FNENKILNLGKILSK

SEQ ID NO: 145354 - protein, 9 aa, Borrelia garinii PBi
ILNLGKILS

SEQ ID NO: 145355 - protein, 15 aa, Borrelia garinii PBi
SLVKEILINRGFSIQ

SEQ ID NO: 145356 - protein, 9 aa, Borrelia garinii PBi
LVKEILINR

SEQ ID NO: 145357 - protein, 15 aa, Borrelia garinii PBi
SNYRSLVKEILINRG

SEQ ID NO: 145358 - protein, 9 aa, Borrelia garinii PBi
LVKEILINR

SEQ ID NO: 145359 - protein, 15 aa, Borrelia garinii PBi
YRSLVKEILINRGFS

SEQ ID NO: 145360 - protein, 9 aa, Borrelia garinii PBi
LVKEILINR

SEQ ID NO: 145361 - protein, 15 aa, Borrelia garinii PBi
NYRSLVKEILINRGF

SEQ ID NO: 145362 - protein, 9 aa, Borrelia garinii PBi
LVKEILINR

SEQ ID NO: 145363 - protein, 15 aa, Borrelia garinii PBi
LVKEILINRGFSIQL

SEQ ID NO: 145364 - protein, 9 aa, Borrelia garinii PBi
LVKEILINR

SEQ ID NO: 145365 - protein, 15 aa, Borrelia garinii PBi
TDIHNIILNLINTTT

SEQ ID NO: 145366 - protein, 9 aa, Borrelia garinii PBi
IHNIILNLI

SEQ ID NO: 145367 - protein, 15 aa, Borrelia garinii PBi
NNKLIAIFLLHILTG

SEQ ID NO: 145368 - protein, 9 aa, Borrelia garinii PBi
LIAIFLLHI

SEQ ID NO: 145369 - protein, 15 aa, Borrelia garinii PBi
NLLVAINTLKNPPKT

SEQ ID NO: 145370 - protein, 9 aa, Borrelia garinii PBi
INTLKNPPK

SEQ ID NO: 145371 - protein, 15 aa, Borrelia garinii PBi
LVAINTLKNPPKTAG

SEQ ID NO: 145372 - protein, 9 aa, Borrelia garinii PBi
INTLKNPPK

SEQ ID NO: 145373 - protein, 15 aa, Borrelia garinii PBi
LLVAINTLKNPPKTA

SEQ ID NO: 145374 - protein, 9 aa, Borrelia garinii PBi
INTLKNPPK

SEQ ID NO: 145375 - protein, 15 aa, Borrelia garinii PBi
IHNIILNLINTTTNI

SEQ ID NO: 145376 - protein, 9 aa, Borrelia garinii PBi
ILNLINTTT

SEQ ID NO: 145377 - protein, 15 aa, Borrelia garinii PBi
DSNYRSLVKEILINR

SEQ ID NO: 145378 - protein, 9 aa, Borrelia garinii PBi
YRSLVKEIL

SEQ ID NO: 145379 - protein, 15 aa, Borrelia garinii PBi
DIHNIILNLINTTTN

SEQ ID NO: 145380 - protein, 9 aa, Borrelia garinii PBi
ILNLINTTT

SEQ ID NO: 145381 - protein, 15 aa, Borrelia garinii PBi
KILNLGKILSKLSQD

SEQ ID NO: 145382 - protein, 9 aa, Borrelia garinii PBi
LNLGKILSK

SEQ ID NO: 145383 - protein, 15 aa, Borrelia garinii PBi
VAINTLKNPPKTAGK

SEQ ID NO: 145384 - protein, 9 aa, Borrelia garinii PBi
INTLKNPPK

SEQ ID NO: 145385 - protein, 15 aa, Borrelia garinii PBi
ILNLGKILSKLSQDS

SEQ ID NO: 145386 - protein, 9 aa, Borrelia garinii PBi
ILNLGKILS

SEQ ID NO: 145387 - protein, 15 aa, Borrelia garinii PBi
HNIILNLINTTTNIL

SEQ ID NO: 145388 - protein, 9 aa, Borrelia garinii PBi
ILNLINTTT

SEQ ID NO: 145389 - protein, 15 aa, Borrelia garinii PBi
VDNLLVAINTLKNPP

SEQ ID NO: 145390 - protein, 9 aa, Borrelia garinii PBi
LLVAINTLK

SEQ ID NO: 145391 - protein, 15 aa, Borrelia garinii PBi
NIILNLINTTTNILA

SEQ ID NO: 145392 - protein, 9 aa, Borrelia garinii PBi
ILNLINTTT

SEQ ID NO: 145393 - protein, 15 aa, Borrelia garinii PBi
FLLHILTGLILLSCS

SEQ ID NO: 145394 - protein, 9 aa, Borrelia garinii PBi
LHILTGLIL

SEQ ID NO: 145395 - protein, 15 aa, Borrelia garinii PBi
IQLAIEEISLRTLNV

SEQ ID NO: 145396 - protein, 9 aa, Borrelia garinii PBi
LAIEEISLR

SEQ ID NO: 145397 - protein, 15 aa, Borrelia garinii PBi
IEEISLRTLNVKDKI

SEQ ID NO: 145398 - protein, 9 aa, Borrelia garinii PBi
ISLRTLNVK

SEQ ID NO: 145399 - protein, 15 aa, Borrelia garinii PBi
QLAIEEISLRTLNVK

SEQ ID NO: 145400 - protein, 9 aa, Borrelia garinii PBi
IEEISLRTL

SEQ ID NO: 145401 - protein, 15 aa, Borrelia garinii PBi
AIEEISLRTLNVKDK

SEQ ID NO: 145402 - protein, 9 aa, Borrelia garinii PBi
ISLRTLNVK

SEQ ID NO: 145403 - protein, 15 aa, Borrelia garinii PBi
LAIEEISLRTLNVKD

SEQ ID NO: 145404 - protein, 9 aa, Borrelia garinii PBi
ISLRTLNVK

SEQ ID NO: 145405 - protein, 15 aa, Borrelia garinii PBi
EEISLRTLNVKDKIQ

SEQ ID NO: 145406 - protein, 9 aa, Borrelia garinii PBi
ISLRTLNVK

SEQ ID NO: 145407 - protein, 15 aa, Borrelia garinii PBi
EISLRTLNVKDKIQH

SEQ ID NO: 145408 - protein, 9 aa, Borrelia garinii PBi
ISLRTLNVK

SEQ ID NO: 145409 - protein, 15 aa, Borrelia garinii PBi
ISLRTLNVKDKIQHL

SEQ ID NO: 145410 - protein, 9 aa, Borrelia garinii PBi
ISLRTLNVK

SEQ ID NO: 145411 - protein, 15 aa, Borrelia garinii PBi
SLVKEILINRGFSIQ

SEQ ID NO: 145412 - protein, 9 aa, Borrelia garinii PBi
VKEILINRG

SEQ ID NO: 145413 - protein, 15 aa, Borrelia garinii PBi
FDDNEYVNERRILYT

SEQ ID NO: 145414 - protein, 9 aa, Borrelia garinii PBi
YVNERRILY

SEQ ID NO: 145415 - protein, 15 aa, Borrelia burgdorferi
TLFSTKLTQMYSTRL

SEQ ID NO: 145416 - protein, 9 aa, Borrelia burgdorferi
FSTKLTQMY

SEQ ID NO: 145417 - protein, 15 aa, Borrelia burgdorferi
LFSTKLTQMYSTRLD

SEQ ID NO: 145418 - protein, 9 aa, Borrelia burgdorferi
LTQMYSTRL

SEQ ID NO: 145419 - protein, 15 aa, Borrelia burgdorferi
FSTKLTQMYSTRLDN

SEQ ID NO: 145420 - protein, 9 aa, Borrelia burgdorferi
LTQMYSTRL

SEQ ID NO: 145421 - protein, 15 aa, Borrelia burgdorferi
STKLTQMYSTRLDNL

SEQ ID NO: 145422 - protein, 9 aa, Borrelia burgdorferi
LTQMYSTRL

SEQ ID NO: 145423 - protein, 15 aa, Borrelia burgdorferi
TKLTQMYSTRLDNLA

SEQ ID NO: 145424 - protein, 9 aa, Borrelia burgdorferi
LTQMYSTRL

SEQ ID NO: 145425 - protein, 15 aa, Borrelia burgdorferi
KLTQMYSTRLDNLAK

SEQ ID NO: 145426 - protein, 9 aa, Borrelia burgdorferi
LTQMYSTRL

SEQ ID NO: 145427 - protein, 15 aa, Borrelia burgdorferi
LTQMYSTRLDNLAKA

SEQ ID NO: 145428 - protein, 9 aa, Borrelia burgdorferi
LTQMYSTRL

SEQ ID NO: 145429 - protein, 15 aa, Borrelia burgdorferi
YDTYTLFSTKLTQMY

SEQ ID NO: 145430 - protein, 9 aa, Borrelia burgdorferi
YTLFSTKLT

SEQ ID NO: 145431 - protein, 15 aa, Borrelia burgdorferi
DTYTLFSTKLTQMYS

SEQ ID NO: 145432 - protein, 9 aa, Borrelia burgdorferi
YTLFSTKLT

SEQ ID NO: 145433 - protein, 15 aa, Borrelia burgdorferi
NLYEAYKAIVTSILL

SEQ ID NO: 145434 - protein, 9 aa, Borrelia burgdorferi
YKAIVTSIL

SEQ ID NO: 145435 - protein, 15 aa, Borrelia burgdorferi
SNLYEAYKAIVTSIL

SEQ ID NO: 145436 - protein, 9 aa, Borrelia burgdorferi
YEAYKAIVT

SEQ ID NO: 145437 - protein, 15 aa, Borrelia burgdorferi
YEAYKAIVTSILLMR

SEQ ID NO: 145438 - protein, 9 aa, Borrelia burgdorferi
YKAIVTSIL

SEQ ID NO: 145439 - protein, 15 aa, Borrelia burgdorferi
EAYKAIVTSILLMRD

SEQ ID NO: 145440 - protein, 9 aa, Borrelia burgdorferi
YKAIVTSIL

SEQ ID NO: 145441 - protein, 15 aa, Borrelia burgdorferi
LYEAYKAIVTSILLM

SEQ ID NO: 145442 - protein, 9 aa, Borrelia burgdorferi
YKAIVTSIL

SEQ ID NO: 145443 - protein, 15 aa, Borrelia burgdorferi
KKVKSKYLALGLLFG

SEQ ID NO: 145444 - protein, 9 aa, Borrelia burgdorferi
VKSKYLALG

SEQ ID NO: 145445 - protein, 15 aa, Borrelia burgdorferi
IYDTYTLFSTKLTQM

SEQ ID NO: 145446 - protein, 9 aa, Borrelia burgdorferi
YTLFSTKLT

SEQ ID NO: 145447 - protein, 15 aa, Borrelia burgdorferi
NKIYDTYTLFSTKLT

SEQ ID NO: 145448 - protein, 9 aa, Borrelia burgdorferi
TYTLFSTKL

SEQ ID NO: 145449 - protein, 15 aa, Borrelia burgdorferi
KIYDTYTLFSTKLTQ

SEQ ID NO: 145450 - protein, 9 aa, Borrelia burgdorferi
YTLFSTKLT

SEQ ID NO: 145451 - protein, 15 aa, Borrelia burgdorferi
TYTLFSTKLTQMYST

SEQ ID NO: 145452 - protein, 9 aa, Borrelia burgdorferi
YTLFSTKLT

SEQ ID NO: 145453 - protein, 15 aa, Borrelia burgdorferi
KVKSKYLALGLLFGF

SEQ ID NO: 145454 - protein, 9 aa, Borrelia burgdorferi
YLALGLLFG

SEQ ID NO: 145455 - protein, 15 aa, Borrelia burgdorferi
VKSKYLALGLLFGFI

SEQ ID NO: 145456 - protein, 9 aa, Borrelia burgdorferi
YLALGLLFG

SEQ ID NO: 145457 - protein, 15 aa, Borrelia burgdorferi
KSKYLALGLLFGFIS

SEQ ID NO: 145458 - protein, 9 aa, Borrelia burgdorferi
YLALGLLFG

SEQ ID NO: 145459 - protein, 15 aa, Borrelia burgdorferi
SKYLALGLLFGFISC

SEQ ID NO: 145460 - protein, 9 aa, Borrelia burgdorferi
YLALGLLFG

SEQ ID NO: 145461 - protein, 15 aa, Borrelia burgdorferi
YTLFSTKLTQMYSTR

SEQ ID NO: 145462 - protein, 9 aa, Borrelia burgdorferi
YTLFSTKLT

SEQ ID NO: 145463 - protein, 15 aa, Borrelia burgdorferi
QDEYKGMTQGSLNSL

SEQ ID NO: 145464 - protein, 9 aa, Borrelia burgdorferi
YKGMTQGSL

SEQ ID NO: 145465 - protein, 15 aa, Borrelia burgdorferi
DEYKGMTQGSLNSLS

SEQ ID NO: 145466 - protein, 9 aa, Borrelia burgdorferi
MTQGSLNSL

SEQ ID NO: 145467 - protein, 15 aa, Borrelia burgdorferi
AYKAIVTSILLMRDS

SEQ ID NO: 145468 - protein, 9 aa, Borrelia burgdorferi
YKAIVTSIL

SEQ ID NO: 145469 - protein, 15 aa, Borrelia burgdorferi
YKAIVTSILLMRDSL

SEQ ID NO: 145470 - protein, 9 aa, Borrelia burgdorferi
YKAIVTSIL

SEQ ID NO: 145471 - protein, 15 aa, Borrelia burgdorferi
EYKGMTQGSLNSLSG

SEQ ID NO: 145472 - protein, 9 aa, Borrelia burgdorferi
MTQGSLNSL

SEQ ID NO: 145473 - protein, 15 aa, Borrelia burgdorferi
YKGMTQGSLNSLSGE

SEQ ID NO: 145474 - protein, 9 aa, Borrelia burgdorferi
MTQGSLNSL

SEQ ID NO: 145475 - protein, 15 aa, Borrelia burgdorferi
MKKVKSKYLALGLLF

SEQ ID NO: 145476 - protein, 9 aa, Borrelia burgdorferi
VKSKYLALG

SEQ ID NO: 145477 - protein, 15 aa, Borrelia burgdorferi
GMTQGSLNSLSGESG

SEQ ID NO: 145478 - protein, 9 aa, Borrelia burgdorferi
MTQGSLNSL

SEQ ID NO: 145479 - protein, 15 aa, Borrelia burgdorferi
MTQGSLNSLSGESGE

SEQ ID NO: 145480 - protein, 9 aa, Borrelia burgdorferi
LNSLSGESG

SEQ ID NO: 145481 - protein, 15 aa, Borrelia burgdorferi
KGMTQGSLNSLSGES

SEQ ID NO: 145482 - protein, 9 aa, Borrelia burgdorferi
MTQGSLNSL

SEQ ID NO: 145483 - protein, 15 aa, Borrelia burgdorferi
YLALGLLFGFISCDL

SEQ ID NO: 145484 - protein, 9 aa, Borrelia burgdorferi
YLALGLLFG

SEQ ID NO: 145485 - protein, 15 aa, Borrelia burgdorferi
AEIKTLIAKIKEQSN

SEQ ID NO: 145486 - protein, 9 aa, Borrelia burgdorferi
IKTLIAKIK

SEQ ID NO: 145487 - protein, 15 aa, Borrelia burgdorferi
EAEIKTLIAKIKEQS

SEQ ID NO: 145488 - protein, 9 aa, Borrelia burgdorferi
IKTLIAKIK

SEQ ID NO: 145489 - protein, 15 aa, Borrelia burgdorferi
ENIEAEIKTLIAKIK

SEQ ID NO: 145490 - protein, 9 aa, Borrelia burgdorferi
EAEIKTLIA

SEQ ID NO: 145491 - protein, 15 aa, Borrelia burgdorferi
NIEAEIKTLIAKIKE

SEQ ID NO: 145492 - protein, 9 aa, Borrelia burgdorferi
IKTLIAKIK

SEQ ID NO: 145493 - protein, 15 aa, Borrelia burgdorferi
IEAEIKTLIAKIKEQ

SEQ ID NO: 145494 - protein, 9 aa, Borrelia burgdorferi
IKTLIAKIK

SEQ ID NO: 145495 - protein, 15 aa, Borrelia burgdorferi
KYLALGLLFGFISCD

SEQ ID NO: 145496 - protein, 9 aa, Borrelia burgdorferi
YLALGLLFG

SEQ ID NO: 145497 - protein, 15 aa, Borrelia burgdorferi
FKTLLNYIQVSVKTA

SEQ ID NO: 145498 - protein, 9 aa, Borrelia burgdorferi
FKTLLNYIQ

SEQ ID NO: 145499 - protein, 15 aa, Borrelia burgdorferi
QGSLNSLSGESGELK

SEQ ID NO: 145500 - protein, 9 aa, Borrelia burgdorferi
LNSLSGESG

SEQ ID NO: 145501 - protein, 15 aa, Borrelia burgdorferi
TQGSLNSLSGESGEL

SEQ ID NO: 145502 - protein, 9 aa, Borrelia burgdorferi
LNSLSGESG

SEQ ID NO: 145503 - protein, 15 aa, Borrelia burgdorferi
LNYIQVSVKTAANFV

SEQ ID NO: 145504 - protein, 9 aa, Borrelia burgdorferi
YIQVSVKTA

SEQ ID NO: 145505 - protein, 15 aa, Borrelia burgdorferi
LLNYIQVSVKTAANF

SEQ ID NO: 145506 - protein, 9 aa, Borrelia burgdorferi
YIQVSVKTA

SEQ ID NO: 145507 - protein, 15 aa, Borrelia burgdorferi
QSNLYEAYKAIVTSI

SEQ ID NO: 145508 - protein, 9 aa, Borrelia burgdorferi
YEAYKAIVT

SEQ ID NO: 145509 - protein, 15 aa, Borrelia burgdorferi
EQSNLYEAYKAIVTS

SEQ ID NO: 145510 - protein, 9 aa, Borrelia burgdorferi
YEAYKAIVT

SEQ ID NO: 145511 - protein, 15 aa, Borrelia burgdorferi
GSLNSLSGESGELKE

SEQ ID NO: 145512 - protein, 9 aa, Borrelia burgdorferi
LNSLSGESG

SEQ ID NO: 145513 - protein, 15 aa, Borrelia burgdorferi
EKNFKTLLNYIQVSV

SEQ ID NO: 145514 - protein, 9 aa, Borrelia burgdorferi
FKTLLNYIQ

SEQ ID NO: 145515 - protein, 15 aa, Borrelia burgdorferi
TLLNYIQVSVKTAAN

SEQ ID NO: 145516 - protein, 9 aa, Borrelia burgdorferi
YIQVSVKTA

SEQ ID NO: 145517 - protein, 15 aa, Borrelia burgdorferi
KEQSNLYEAYKAIVT

SEQ ID NO: 145518 - protein, 9 aa, Borrelia burgdorferi
LYEAYKAIV

SEQ ID NO: 145519 - protein, 15 aa, Borrelia burgdorferi
KNFKTLLNYIQVSVK

SEQ ID NO: 145520 - protein, 9 aa, Borrelia burgdorferi
FKTLLNYIQ

SEQ ID NO: 145521 - protein, 15 aa, Borrelia burgdorferi
KTLLNYIQVSVKTAA

SEQ ID NO: 145522 - protein, 9 aa, Borrelia burgdorferi
YIQVSVKTA

SEQ ID NO: 145523 - protein, 15 aa, Borrelia burgdorferi
QQDEYKGMTQGSLNS

SEQ ID NO: 145524 - protein, 9 aa, Borrelia burgdorferi
YKGMTQGSL

SEQ ID NO: 145525 - protein, 15 aa, Borrelia burgdorferi
NYIQVSVKTAANFVY

SEQ ID NO: 145526 - protein, 9 aa, Borrelia burgdorferi
YIQVSVKTA

SEQ ID NO: 145527 - protein, 15 aa, Borrelia burgdorferi
DLEKNFKTLLNYIQV

SEQ ID NO: 145528 - protein, 9 aa, Borrelia burgdorferi
FKTLLNYIQ

SEQ ID NO: 145529 - protein, 15 aa, Borrelia burgdorferi
EDLEKNFKTLLNYIQ

SEQ ID NO: 145530 - protein, 9 aa, Borrelia burgdorferi
EKNFKTLLN

SEQ ID NO: 145531 - protein, 15 aa, Borrelia burgdorferi
YIQVSVKTAANFVYI

SEQ ID NO: 145532 - protein, 9 aa, Borrelia burgdorferi
YIQVSVKTA

SEQ ID NO: 145533 - protein, 15 aa, Borrelia burgdorferi
INKIYDTYTLFSTKL

SEQ ID NO: 145534 - protein, 9 aa, Borrelia burgdorferi
YDTYTLFST

SEQ ID NO: 145535 - protein, 15 aa, Borrelia burgdorferi
KAIVTSILLMRDSLK

SEQ ID NO: 145536 - protein, 9 aa, Borrelia burgdorferi
VTSILLMRD

SEQ ID NO: 145537 - protein, 15 aa, Borrelia burgdorferi
EGVKYNVDSAINTIN

SEQ ID NO: 145538 - protein, 9 aa, Borrelia burgdorferi
YNVDSAINT

SEQ ID NO: 145539 - protein, 15 aa, Borrelia burgdorferi
LEKNFKTLLNYIQVS

SEQ ID NO: 145540 - protein, 9 aa, Borrelia burgdorferi
FKTLLNYIQ

SEQ ID NO: 145541 - protein, 15 aa, Borrelia burgdorferi
EPYIHSLKRDSANKS

SEQ ID NO: 145542 - protein, 9 aa, Borrelia burgdorferi
IHSLKRDSA

SEQ ID NO: 145543 - protein, 15 aa, Borrelia burgdorferi
HSLKRDSANKSNFLQ

SEQ ID NO: 145544 - protein, 9 aa, Borrelia burgdorferi
LKRDSANKS

SEQ ID NO: 145545 - protein, 15 aa, Borrelia burgdorferi
IHSLKRDSANKSNFL

SEQ ID NO: 145546 - protein, 9 aa, Borrelia burgdorferi
LKRDSANKS

SEQ ID NO: 145547 - protein, 15 aa, Borrelia burgdorferi
PYIHSLKRDSANKSN

SEQ ID NO: 145548 - protein, 9 aa, Borrelia burgdorferi
LKRDSANKS

SEQ ID NO: 145549 - protein, 15 aa, Borrelia burgdorferi
GVKYNVDSAINTINK

SEQ ID NO: 145550 - protein, 9 aa, Borrelia burgdorferi
YNVDSAINT

SEQ ID NO: 145551 - protein, 15 aa, Borrelia burgdorferi
LEGVKYNVDSAINTI

SEQ ID NO: 145552 - protein, 9 aa, Borrelia burgdorferi
YNVDSAINT

SEQ ID NO: 145553 - protein, 15 aa, Borrelia burgdorferi
YLEGVKYNVDSAINT

SEQ ID NO: 145554 - protein, 9 aa, Borrelia burgdorferi
VKYNVDSAI

SEQ ID NO: 145555 - protein, 15 aa, Borrelia burgdorferi
YIHSLKRDSANKSNF

SEQ ID NO: 145556 - protein, 9 aa, Borrelia burgdorferi
LKRDSANKS

SEQ ID NO: 145557 - protein, 15 aa, Borrelia burgdorferi
NEIDITIDSDLRPKS

SEQ ID NO: 145558 - protein, 9 aa, Borrelia burgdorferi
ITIDSDLRP

SEQ ID NO: 145559 - protein, 15 aa, Borrelia burgdorferi
EIDITIDSDLRPKSS

SEQ ID NO: 145560 - protein, 9 aa, Borrelia burgdorferi
ITIDSDLRP

SEQ ID NO: 145561 - protein, 15 aa, Borrelia burgdorferi
IDITIDSDLRPKSSL

SEQ ID NO: 145562 - protein, 9 aa, Borrelia burgdorferi
ITIDSDLRP

SEQ ID NO: 145563 - protein, 15 aa, Borrelia burgdorferi
ITIDSDLRPKSSLQD

SEQ ID NO: 145564 - protein, 9 aa, Borrelia burgdorferi
IDSDLRPKS

SEQ ID NO: 145565 - protein, 15 aa, Borrelia burgdorferi
DITIDSDLRPKSSLQ

SEQ ID NO: 145566 - protein, 9 aa, Borrelia burgdorferi
IDSDLRPKS

SEQ ID NO: 145567 - protein, 15 aa, Borrelia burgdorferi
PYIHSLKRDSANKSN

SEQ ID NO: 145568 - protein, 9 aa, Borrelia burgdorferi
LKRDSANKS

SEQ ID NO: 145569 - protein, 15 aa, Borrelia burgdorferi
EPYIHSLKRDSANKS

SEQ ID NO: 145570 - protein, 9 aa, Borrelia burgdorferi
IHSLKRDSA

SEQ ID NO: 145571 - protein, 15 aa, Borrelia burgdorferi
YIHSLKRDSANKSNF

SEQ ID NO: 145572 - protein, 9 aa, Borrelia burgdorferi
LKRDSANKS

SEQ ID NO: 145573 - protein, 15 aa, Borrelia burgdorferi
IHSLKRDSANKSNFL

SEQ ID NO: 145574 - protein, 9 aa, Borrelia burgdorferi
LKRDSANKS

SEQ ID NO: 145575 - protein, 15 aa, Borrelia burgdorferi
HSLKRDSANKSNFLQ

SEQ ID NO: 145576 - protein, 9 aa, Borrelia burgdorferi
LKRDSANKS

SEQ ID NO: 145577 - protein, 15 aa, Borrelia burgdorferi
SLKRDSANKSNFLQK

SEQ ID NO: 145578 - protein, 9 aa, Borrelia burgdorferi
LKRDSANKS

SEQ ID NO: 145579 - protein, 15 aa, Borrelia burgdorferi
LKRDSANKSNFLQKN

SEQ ID NO: 145580 - protein, 9 aa, Borrelia burgdorferi
LKRDSANKS

SEQ ID NO: 145581 - protein, 15 aa, Borrelia burgdorferi
NKIYDTYTLFSTKLT

SEQ ID NO: 145582 - protein, 9 aa, Borrelia burgdorferi
IYDTYTLFS

SEQ ID NO: 145583 - protein, 15 aa, Borrelia burgdorferi
AANFVYINDTHAKRK

SEQ ID NO: 145584 - protein, 9 aa, Borrelia burgdorferi
FVYINDTHA

SEQ ID NO: 145585 - protein, 15 aa, Borrelia burgdorferi
ANFVYINDTHAKRKL

SEQ ID NO: 145586 - protein, 9 aa, Borrelia burgdorferi
FVYINDTHA

SEQ ID NO: 145587 - protein, 15 aa, Borrelia burgdorferi
FKTLLNYIQVSVKTA

SEQ ID NO: 145588 - protein, 9 aa, Borrelia burgdorferi
NYIQVSVKT

SEQ ID NO: 145589 - protein, 15 aa, Borrelia burgdorferi
TAANFVYINDTHAKR

SEQ ID NO: 145590 - protein, 9 aa, Borrelia burgdorferi
FVYINDTHA

SEQ ID NO: 145591 - protein, 15 aa, Borrelia burgdorferi
TINKIYDTYTLFSTK

SEQ ID NO: 145592 - protein, 9 aa, Borrelia burgdorferi
IYDTYTLFS

SEQ ID NO: 145593 - protein, 15 aa, Borrelia burgdorferi
NTINKIYDTYTLFST

SEQ ID NO: 145594 - protein, 9 aa, Borrelia burgdorferi
IYDTYTLFS

SEQ ID NO: 145595 - protein, 15 aa, Borrelia burgdorferi
INTINKIYDTYTLFS

SEQ ID NO: 145596 - protein, 9 aa, Borrelia burgdorferi
INKIYDTYT

SEQ ID NO: 145597 - protein, 15 aa, Borrelia burgdorferi
INKIYDTYTLFSTKL

SEQ ID NO: 145598 - protein, 9 aa, Borrelia burgdorferi
IYDTYTLFS

SEQ ID NO: 145599 - protein, 15 aa, Borrelia burgdorferi
IKTLIAKIKEQSNLY

SEQ ID NO: 145600 - protein, 9 aa, Borrelia burgdorferi
LIAKIKEQS

SEQ ID NO: 145601 - protein, 15 aa, Borrelia burgdorferi
KTLIAKIKEQSNLYE

SEQ ID NO: 145602 - protein, 9 aa, Borrelia burgdorferi
KIKEQSNLY

SEQ ID NO: 145603 - protein, 15 aa, Borrelia burgdorferi
NFKTLLNYIQVSVKT

SEQ ID NO: 145604 - protein, 9 aa, Borrelia burgdorferi
FKTLLNYIQ

SEQ ID NO: 145605 - protein, 15 aa, Borrelia burgdorferi
TLLNYIQVSVKTAAN

SEQ ID NO: 145606 - protein, 9 aa, Borrelia burgdorferi
NYIQVSVKT

SEQ ID NO: 145607 - protein, 15 aa, Borrelia burgdorferi
LLNYIQVSVKTAANF

SEQ ID NO: 145608 - protein, 9 aa, Borrelia burgdorferi
NYIQVSVKT

SEQ ID NO: 145609 - protein, 15 aa, Borrelia burgdorferi
KTLLNYIQVSVKTAA

SEQ ID NO: 145610 - protein, 9 aa, Borrelia burgdorferi
NYIQVSVKT

SEQ ID NO: 145611 - protein, 15 aa, Borrelia burgdorferi
TLIAKIKEQSNLYEA

SEQ ID NO: 145612 - protein, 9 aa, Borrelia burgdorferi
KIKEQSNLY

SEQ ID NO: 145613 - protein, 15 aa, Borrelia burgdorferi
LIAKIKEQSNLYEAY

SEQ ID NO: 145614 - protein, 9 aa, Borrelia burgdorferi
KIKEQSNLY

SEQ ID NO: 145615 - protein, 15 aa, Borrelia burgdorferi
IAKIKEQSNLYEAYK

SEQ ID NO: 145616 - protein, 9 aa, Borrelia burgdorferi
KIKEQSNLY

SEQ ID NO: 145617 - protein, 15 aa, Borrelia burgdorferi
AANFVYINDTHAKRK

SEQ ID NO: 145618 - protein, 9 aa, Borrelia burgdorferi
FVYINDTHA

SEQ ID NO: 145619 - protein, 15 aa, Borrelia burgdorferi
ANFVYINDTHAKRKL

SEQ ID NO: 145620 - protein, 9 aa, Borrelia burgdorferi
FVYINDTHA

SEQ ID NO: 145621 - protein, 15 aa, Borrelia burgdorferi
EDLEKNFKTLLNYIQ

SEQ ID NO: 145622 - protein, 9 aa, Borrelia burgdorferi
EKNFKTLLN

SEQ ID NO: 145623 - protein, 15 aa, Borrelia burgdorferi
DLEKNFKTLLNYIQV

SEQ ID NO: 145624 - protein, 9 aa, Borrelia burgdorferi
EKNFKTLLN

SEQ ID NO: 145625 - protein, 15 aa, Borrelia burgdorferi
FTKEDLEKNFKTLLN

SEQ ID NO: 145626 - protein, 9 aa, Borrelia burgdorferi
LEKNFKTLL

SEQ ID NO: 145627 - protein, 15 aa, Borrelia burgdorferi
TKEDLEKNFKTLLNY

SEQ ID NO: 145628 - protein, 9 aa, Borrelia burgdorferi
EKNFKTLLN

SEQ ID NO: 145629 - protein, 15 aa, Borrelia burgdorferi
NKIYDTYTLFSTKLT

SEQ ID NO: 145630 - protein, 9 aa, Borrelia burgdorferi
IYDTYTLFS

SEQ ID NO: 145631 - protein, 15 aa, Borrelia burgdorferi
KEDLEKNFKTLLNYI

SEQ ID NO: 145632 - protein, 9 aa, Borrelia burgdorferi
EKNFKTLLN

SEQ ID NO: 145633 - protein, 15 aa, Borrelia burgdorferi
KTLIAKIKEQSNLYE

SEQ ID NO: 145634 - protein, 9 aa, Borrelia burgdorferi
IAKIKEQSN

SEQ ID NO: 145635 - protein, 15 aa, Borrelia burgdorferi
TLIAKIKEQSNLYEA

SEQ ID NO: 145636 - protein, 9 aa, Borrelia burgdorferi
IKEQSNLYE

SEQ ID NO: 145637 - protein, 15 aa, Borrelia burgdorferi
IAKIKEQSNLYEAYK

SEQ ID NO: 145638 - protein, 9 aa, Borrelia burgdorferi
IKEQSNLYE

SEQ ID NO: 145639 - protein, 15 aa, Borrelia burgdorferi
AKIKEQSNLYEAYKA

SEQ ID NO: 145640 - protein, 9 aa, Borrelia burgdorferi
IKEQSNLYE

SEQ ID NO: 145641 - protein, 15 aa, Borrelia burgdorferi
LIAKIKEQSNLYEAY

SEQ ID NO: 145642 - protein, 9 aa, Borrelia burgdorferi
IKEQSNLYE

SEQ ID NO: 145643 - protein, 15 aa, Borrelia burgdorferi
LEKNFKTLLNYIQVS

SEQ ID NO: 145644 - protein, 9 aa, Borrelia burgdorferi
EKNFKTLLN

SEQ ID NO: 145645 - protein, 15 aa, Borrelia burgdorferi
EKNFKTLLNYIQVSV

SEQ ID NO: 145646 - protein, 9 aa, Borrelia burgdorferi
EKNFKTLLN

SEQ ID NO: 145647 - protein, 15 aa, Borrelia burgdorferi
IYDTYTLFSTKLTQM

SEQ ID NO: 145648 - protein, 9 aa, Borrelia burgdorferi
YTLFSTKLT

SEQ ID NO: 145649 - protein, 15 aa, Borrelia burgdorferi
KIYDTYTLFSTKLTQ

SEQ ID NO: 145650 - protein, 9 aa, Borrelia burgdorferi
YTLFSTKLT

SEQ ID NO: 145651 - protein, 15 aa, Borrelia burgdorferi
INTINKIYDTYTLFS

SEQ ID NO: 145652 - protein, 9 aa, Borrelia burgdorferi
INTINKIYD

SEQ ID NO: 145653 - protein, 15 aa, Borrelia burgdorferi
YDTYTLFSTKLTQMY

SEQ ID NO: 145654 - protein, 9 aa, Borrelia burgdorferi
YTLFSTKLT

SEQ ID NO: 145655 - protein, 15 aa, Borrelia burgdorferi
ITIDSDLRPKSSLQD

SEQ ID NO: 145656 - protein, 9 aa, Borrelia burgdorferi
ITIDSDLRP

SEQ ID NO: 145657 - protein, 15 aa, Borrelia burgdorferi
DTYTLFSTKLTQMYS

SEQ ID NO: 145658 - protein, 9 aa, Borrelia burgdorferi
YTLFSTKLT

SEQ ID NO: 145659 - protein, 15 aa, Borrelia burgdorferi
IKEQSNLYEAYKAIV

SEQ ID NO: 145660 - protein, 9 aa, Borrelia burgdorferi
IKEQSNLYE

SEQ ID NO: 145661 - protein, 15 aa, Borrelia burgdorferi
TIDSDLRPKSSLQDI

SEQ ID NO: 145662 - protein, 9 aa, Borrelia burgdorferi
LRPKSSLQD

SEQ ID NO: 145663 - protein, 15 aa, Borrelia burgdorferi
IDSDLRPKSSLQDIA

SEQ ID NO: 145664 - protein, 9 aa, Borrelia burgdorferi
LRPKSSLQD

SEQ ID NO: 145665 - protein, 15 aa, Borrelia burgdorferi
YIQVSVKTAANFVYI

SEQ ID NO: 145666 - protein, 9 aa, Borrelia burgdorferi
VKTAANFVY

SEQ ID NO: 145667 - protein, 15 aa, Borrelia burgdorferi
LYEAYKAIVTSILLM

SEQ ID NO: 145668 - protein, 9 aa, Borrelia burgdorferi
YKAIVTSIL

SEQ ID NO: 145669 - protein, 15 aa, Borrelia burgdorferi
YEAYKAIVTSILLMR

SEQ ID NO: 145670 - protein, 9 aa, Borrelia burgdorferi
YKAIVTSIL

SEQ ID NO: 145671 - protein, 15 aa, Borrelia burgdorferi
IQVSVKTAANFVYIN

SEQ ID NO: 145672 - protein, 9 aa, Borrelia burgdorferi
VKTAANFVY

SEQ ID NO: 145673 - protein, 15 aa, Borrelia burgdorferi
NYIQVSVKTAANFVY

SEQ ID NO: 145674 - protein, 9 aa, Borrelia burgdorferi
SVKTAANFV

SEQ ID NO: 145675 - protein, 15 aa, Borrelia burgdorferi
QVSVKTAANFVYIND

SEQ ID NO: 145676 - protein, 9 aa, Borrelia burgdorferi
VKTAANFVY

SEQ ID NO: 145677 - protein, 15 aa, Borrelia burgdorferi
EAYKAIVTSILLMRD

SEQ ID NO: 145678 - protein, 9 aa, Borrelia burgdorferi
YKAIVTSIL

SEQ ID NO: 145679 - protein, 15 aa, Borrelia burgdorferi
NLYEAYKAIVTSILL

SEQ ID NO: 145680 - protein, 9 aa, Borrelia burgdorferi
YKAIVTSIL

SEQ ID NO: 145681 - protein, 15 aa, Borrelia burgdorferi
SNLYEAYKAIVTSIL

SEQ ID NO: 145682 - protein, 9 aa, Borrelia burgdorferi
AYKAIVTSI

SEQ ID NO: 145683 - protein, 15 aa, Borrelia burgdorferi
VSVKTAANFVYINDT

SEQ ID NO: 145684 - protein, 9 aa, Borrelia burgdorferi
VKTAANFVY

SEQ ID NO: 145685 - protein, 15 aa, Borrelia burgdorferi
AYKAIVTSILLMRDS

SEQ ID NO: 145686 - protein, 9 aa, Borrelia burgdorferi
YKAIVTSIL

SEQ ID NO: 145687 - protein, 15 aa, Borrelia burgdorferi
YKAIVTSILLMRDSL

SEQ ID NO: 145688 - protein, 9 aa, Borrelia burgdorferi
YKAIVTSIL

SEQ ID NO: 145689 - protein, 15 aa, Borrelia burgdorferi
SVKTAANFVYINDTH

SEQ ID NO: 145690 - protein, 9 aa, Borrelia burgdorferi
VKTAANFVY

SEQ ID NO: 145691 - protein, 15 aa, Borrelia burgdorferi
LNYIQVSVKTAANFV

SEQ ID NO: 145692 - protein, 9 aa, Borrelia burgdorferi
VSVKTAANF

SEQ ID NO: 145693 - protein, 15 aa, Borrelia burgdorferi
ESIKKPMNKKGKGKI

SEQ ID NO: 145694 - protein, 9 aa, Borrelia burgdorferi
SIKKPMNKK

SEQ ID NO: 145695 - protein, 15 aa, Borrelia burgdorferi
SNLYEAYKAIVTSIL

SEQ ID NO: 145696 - protein, 9 aa, Borrelia burgdorferi
YEAYKAIVT

SEQ ID NO: 145697 - protein, 15 aa, Borrelia burgdorferi
NLYEAYKAIVTSILL

SEQ ID NO: 145698 - protein, 9 aa, Borrelia burgdorferi
YEAYKAIVT

SEQ ID NO: 145699 - protein, 15 aa, Borrelia burgdorferi
QSNLYEAYKAIVTSI

SEQ ID NO: 145700 - protein, 9 aa, Borrelia burgdorferi
YEAYKAIVT

SEQ ID NO: 145701 - protein, 15 aa, Borrelia burgdorferi
EQSNLYEAYKAIVTS

SEQ ID NO: 145702 - protein, 9 aa, Borrelia burgdorferi
YEAYKAIVT

SEQ ID NO: 145703 - protein, 15 aa, Borrelia burgdorferi
KEQSNLYEAYKAIVT

SEQ ID NO: 145704 - protein, 9 aa, Borrelia burgdorferi
LYEAYKAIV

SEQ ID NO: 145705 - protein, 15 aa, Borrelia burgdorferi
YDTYTLFSTKLTQMY

SEQ ID NO: 145706 - protein, 9 aa, Borrelia burgdorferi
YTLFSTKLT

SEQ ID NO: 145707 - protein, 15 aa, Borrelia burgdorferi
DTYTLFSTKLTQMYS

SEQ ID NO: 145708 - protein, 9 aa, Borrelia burgdorferi
YTLFSTKLT

SEQ ID NO: 145709 - protein, 15 aa, Borrelia burgdorferi
YEAYKAIVTSILLMR

SEQ ID NO: 145710 - protein, 9 aa, Borrelia burgdorferi
YEAYKAIVT

SEQ ID NO: 145711 - protein, 15 aa, Borrelia burgdorferi
IYDTYTLFSTKLTQM

SEQ ID NO: 145712 - protein, 9 aa, Borrelia burgdorferi
YTLFSTKLT

SEQ ID NO: 145713 - protein, 15 aa, Borrelia burgdorferi
KIYDTYTLFSTKLTQ

SEQ ID NO: 145714 - protein, 9 aa, Borrelia burgdorferi
YTLFSTKLT

SEQ ID NO: 145715 - protein, 15 aa, Borrelia burgdorferi
LYEAYKAIVTSILLM

SEQ ID NO: 145716 - protein, 9 aa, Borrelia burgdorferi
YEAYKAIVT

SEQ ID NO: 145717 - protein, 15 aa, Borrelia burgdorferi
NKIYDTYTLFSTKLT

SEQ ID NO: 145718 - protein, 9 aa, Borrelia burgdorferi
IYDTYTLFS

SEQ ID NO: 145719 - protein, 15 aa, Borrelia burgdorferi
EAYKAIVTSILLMRD

SEQ ID NO: 145720 - protein, 9 aa, Borrelia burgdorferi
YKAIVTSIL

SEQ ID NO: 145721 - protein, 15 aa, Borrelia burgdorferi
YEAYKAIVTSILLMR

SEQ ID NO: 145722 - protein, 9 aa, Borrelia burgdorferi
YKAIVTSIL

SEQ ID NO: 145723 - protein, 15 aa, Borrelia burgdorferi
YDTYTLFSTKLTQMY

SEQ ID NO: 145724 - protein, 9 aa, Borrelia burgdorferi
YTLFSTKLT

SEQ ID NO: 145725 - protein, 15 aa, Borrelia burgdorferi
DTYTLFSTKLTQMYS

SEQ ID NO: 145726 - protein, 9 aa, Borrelia burgdorferi
YTLFSTKLT

SEQ ID NO: 145727 - protein, 15 aa, Borrelia burgdorferi
IYDTYTLFSTKLTQM

SEQ ID NO: 145728 - protein, 9 aa, Borrelia burgdorferi
YTLFSTKLT

SEQ ID NO: 145729 - protein, 15 aa, Borrelia burgdorferi
NKIYDTYTLFSTKLT

SEQ ID NO: 145730 - protein, 9 aa, Borrelia burgdorferi
NKIYDTYTL

SEQ ID NO: 145731 - protein, 15 aa, Borrelia burgdorferi
AYKAIVTSILLMRDS

SEQ ID NO: 145732 - protein, 9 aa, Borrelia burgdorferi
IVTSILLMR

SEQ ID NO: 145733 - protein, 15 aa, Borrelia burgdorferi
YKAIVTSILLMRDSL

SEQ ID NO: 145734 - protein, 9 aa, Borrelia burgdorferi
IVTSILLMR

SEQ ID NO: 145735 - protein, 15 aa, Borrelia burgdorferi
KIYDTYTLFSTKLTQ

SEQ ID NO: 145736 - protein, 9 aa, Borrelia burgdorferi
YTLFSTKLT

SEQ ID NO: 145737 - protein, 15 aa, Borrelia burgdorferi
NYIQVSVKTAANFVY

SEQ ID NO: 145738 - protein, 9 aa, Borrelia burgdorferi
IQVSVKTAA

SEQ ID NO: 145739 - protein, 15 aa, Borrelia burgdorferi
YTLFSTKLTQMYSTR

SEQ ID NO: 145740 - protein, 9 aa, Borrelia burgdorferi
YTLFSTKLT

SEQ ID NO: 145741 - protein, 15 aa, Borrelia burgdorferi
LYEAYKAIVTSILLM

SEQ ID NO: 145742 - protein, 9 aa, Borrelia burgdorferi
YKAIVTSIL

SEQ ID NO: 145743 - protein, 15 aa, Borrelia burgdorferi
TYTLFSTKLTQMYST

SEQ ID NO: 145744 - protein, 9 aa, Borrelia burgdorferi
YTLFSTKLT

SEQ ID NO: 145745 - protein, 15 aa, Borrelia burgdorferi
KTLLNYIQVSVKTAA

SEQ ID NO: 145746 - protein, 9 aa, Borrelia burgdorferi
LLNYIQVSV

SEQ ID NO: 145747 - protein, 15 aa, Borrelia burgdorferi
KNFKTLLNYIQVSVK

SEQ ID NO: 145748 - protein, 9 aa, Borrelia burgdorferi
LLNYIQVSV

SEQ ID NO: 145749 - protein, 15 aa, Borrelia burgdorferi
ENIEAEIKTLIAKIK

SEQ ID NO: 145750 - protein, 9 aa, Borrelia burgdorferi
IEAEIKTLI

SEQ ID NO: 145751 - protein, 15 aa, Borrelia burgdorferi
NLYEAYKAIVTSILL

SEQ ID NO: 145752 - protein, 9 aa, Borrelia burgdorferi
YKAIVTSIL

SEQ ID NO: 145753 - protein, 15 aa, Borrelia burgdorferi
FKTLLNYIQVSVKTA

SEQ ID NO: 145754 - protein, 9 aa, Borrelia burgdorferi
LLNYIQVSV

SEQ ID NO: 145755 - protein, 15 aa, Borrelia burgdorferi
EKNFKTLLNYIQVSV

SEQ ID NO: 145756 - protein, 9 aa, Borrelia burgdorferi
FKTLLNYIQ

SEQ ID NO: 145757 - protein, 15 aa, Borrelia burgdorferi
SNLYEAYKAIVTSIL

SEQ ID NO: 145758 - protein, 9 aa, Borrelia burgdorferi
YEAYKAIVT

SEQ ID NO: 145759 - protein, 15 aa, Borrelia burgdorferi
NFKTLLNYIQVSVKT

SEQ ID NO: 145760 - protein, 9 aa, Borrelia burgdorferi
LNYIQVSVK

SEQ ID NO: 145761 - protein, 15 aa, Borrelia burgdorferi
TLLNYIQVSVKTAAN

SEQ ID NO: 145762 - protein, 9 aa, Borrelia burgdorferi
IQVSVKTAA

SEQ ID NO: 145763 - protein, 15 aa, Borrelia burgdorferi
IEAEIKTLIAKIKEQ

SEQ ID NO: 145764 - protein, 9 aa, Borrelia burgdorferi
IKTLIAKIK

SEQ ID NO: 145765 - protein, 15 aa, Borrelia burgdorferi
NIEAEIKTLIAKIKE

SEQ ID NO: 145766 - protein, 9 aa, Borrelia burgdorferi
IKTLIAKIK

SEQ ID NO: 145767 - protein, 15 aa, Borrelia burgdorferi
DYEEIRLSNRYQSYL

SEQ ID NO: 145768 - protein, 9 aa, Borrelia burgdorferi
IRLSNRYQS

SEQ ID NO: 145769 - protein, 15 aa, Borrelia burgdorferi
KSKYLALGLLFGFIS

SEQ ID NO: 145770 - protein, 9 aa, Borrelia burgdorferi
YLALGLLFG

SEQ ID NO: 145771 - protein, 15 aa, Borrelia burgdorferi
KAIVTSILLMRDSLK

SEQ ID NO: 145772 - protein, 9 aa, Borrelia burgdorferi
IVTSILLMR

SEQ ID NO: 145773 - protein, 15 aa, Borrelia burgdorferi
YEEIRLSNRYQSYLE

SEQ ID NO: 145774 - protein, 9 aa, Borrelia burgdorferi
IRLSNRYQS

SEQ ID NO: 145775 - protein, 15 aa, Borrelia burgdorferi
YIQVSVKTAANFVYI

SEQ ID NO: 145776 - protein, 9 aa, Borrelia burgdorferi
VKTAANFVY

SEQ ID NO: 145777 - protein, 15 aa, Borrelia burgdorferi
DDYEEIRLSNRYQSY

SEQ ID NO: 145778 - protein, 9 aa, Borrelia burgdorferi
IRLSNRYQS

SEQ ID NO: 145779 - protein, 15 aa, Borrelia burgdorferi
EDDYEEIRLSNRYQS

SEQ ID NO: 145780 - protein, 9 aa, Borrelia burgdorferi
EEIRLSNRY

SEQ ID NO: 145781 - protein, 15 aa, Borrelia burgdorferi
SKYLALGLLFGFISC

SEQ ID NO: 145782 - protein, 9 aa, Borrelia burgdorferi
LGLLFGFIS

SEQ ID NO: 145783 - protein, 15 aa, Borrelia burgdorferi
EEIRLSNRYQSYLEG

SEQ ID NO: 145784 - protein, 9 aa, Borrelia burgdorferi
IRLSNRYQS

SEQ ID NO: 145785 - protein, 15 aa, Borrelia burgdorferi
LLNYIQVSVKTAANF

SEQ ID NO: 145786 - protein, 9 aa, Borrelia burgdorferi
IQVSVKTAA

SEQ ID NO: 145787 - protein, 15 aa, Borrelia burgdorferi
EAEIKTLIAKIKEQS

SEQ ID NO: 145788 - protein, 9 aa, Borrelia burgdorferi
IKTLIAKIK

SEQ ID NO: 145789 - protein, 15 aa, Borrelia burgdorferi
AEIKTLIAKIKEQSN

SEQ ID NO: 145790 - protein, 9 aa, Borrelia burgdorferi
IKTLIAKIK

SEQ ID NO: 145791 - protein, 15 aa, Borrelia burgdorferi
EDLEKNFKTLLNYIQ

SEQ ID NO: 145792 - protein, 9 aa, Borrelia burgdorferi
EKNFKTLLN

SEQ ID NO: 145793 - protein, 15 aa, Borrelia burgdorferi
IQVSVKTAANFVYIN

SEQ ID NO: 145794 - protein, 9 aa, Borrelia burgdorferi
VKTAANFVY

SEQ ID NO: 145795 - protein, 15 aa, Borrelia burgdorferi
KYLALGLLFGFISCD

SEQ ID NO: 145796 - protein, 9 aa, Borrelia burgdorferi
LGLLFGFIS

SEQ ID NO: 145797 - protein, 15 aa, Borrelia burgdorferi
VDSAINTINKIYDTY

SEQ ID NO: 145798 - protein, 9 aa, Borrelia burgdorferi
INTINKIYD

SEQ ID NO: 145799 - protein, 15 aa, Borrelia burgdorferi
YNVDSAINTINKIYD

SEQ ID NO: 145800 - protein, 9 aa, Borrelia burgdorferi
SAINTINKI

SEQ ID NO: 145801 - protein, 15 aa, Borrelia burgdorferi
DLEKNFKTLLNYIQV

SEQ ID NO: 145802 - protein, 9 aa, Borrelia burgdorferi
FKTLLNYIQ

SEQ ID NO: 145803 - protein, 15 aa, Borrelia burgdorferi
LALGLLFGFISCDLF

SEQ ID NO: 145804 - protein, 9 aa, Borrelia burgdorferi
LGLLFGFIS

SEQ ID NO: 145805 - protein, 15 aa, Borrelia burgdorferi
SAINTINKIYDTYTL

SEQ ID NO: 145806 - protein, 9 aa, Borrelia burgdorferi
INTINKIYD

SEQ ID NO: 145807 - protein, 15 aa, Borrelia burgdorferi
YLALGLLFGFISCDL

SEQ ID NO: 145808 - protein, 9 aa, Borrelia burgdorferi
LGLLFGFIS

SEQ ID NO: 145809 - protein, 15 aa, Borrelia burgdorferi
NVDSAINTINKIYDT

SEQ ID NO: 145810 - protein, 9 aa, Borrelia burgdorferi
INTINKIYD

SEQ ID NO: 145811 - protein, 15 aa, Borrelia burgdorferi
LNYIQVSVKTAANFV

SEQ ID NO: 145812 - protein, 9 aa, Borrelia burgdorferi
IQVSVKTAA

SEQ ID NO: 145813 - protein, 15 aa, Borrelia burgdorferi
DSAINTINKIYDTYT

SEQ ID NO: 145814 - protein, 9 aa, Borrelia burgdorferi
INTINKIYD

SEQ ID NO: 145815 - protein, 15 aa, Borrelia burgdorferi
ANKSNFLQKNVILEE

SEQ ID NO: 145816 - protein, 9 aa, Borrelia burgdorferi
SNFLQKNVI

SEQ ID NO: 145817 - protein, 15 aa, Borrelia burgdorferi
NKSNFLQKNVILEEE

SEQ ID NO: 145818 - protein, 9 aa, Borrelia burgdorferi
SNFLQKNVI

SEQ ID NO: 145819 - protein, 15 aa, Borrelia burgdorferi
LEKNFKTLLNYIQVS

SEQ ID NO: 145820 - protein, 9 aa, Borrelia burgdorferi
FKTLLNYIQ

SEQ ID NO: 145821 - protein, 15 aa, Borrelia burgdorferi
EPYIHSLKRDSANKS

SEQ ID NO: 145822 - protein, 9 aa, Borrelia burgdorferi
IHSLKRDSA

SEQ ID NO: 145823 - protein, 15 aa, Borrelia burgdorferi
KAIVTSILLMRDSLK

SEQ ID NO: 145824 - protein, 9 aa, Borrelia burgdorferi
IVTSILLMR

SEQ ID NO: 145825 - protein, 15 aa, Borrelia burgdorferi
IVTSILLMRDSLKEV

SEQ ID NO: 145826 - protein, 9 aa, Borrelia burgdorferi
IVTSILLMR

SEQ ID NO: 145827 - protein, 15 aa, Borrelia burgdorferi
YEAYKAIVTSILLMR

SEQ ID NO: 145828 - protein, 9 aa, Borrelia burgdorferi
YEAYKAIVT

SEQ ID NO: 145829 - protein, 15 aa, Borrelia burgdorferi
AIVTSILLMRDSLKE

SEQ ID NO: 145830 - protein, 9 aa, Borrelia burgdorferi
IVTSILLMR

SEQ ID NO: 145831 - protein, 15 aa, Borrelia burgdorferi
KGKIARKKGKSKVSR

SEQ ID NO: 145832 - protein, 9 aa, Borrelia burgdorferi
IARKKGKSK

SEQ ID NO: 145833 - protein, 15 aa, Borrelia burgdorferi
GKIARKKGKSKVSRK

SEQ ID NO: 145834 - protein, 9 aa, Borrelia burgdorferi
IARKKGKSK

SEQ ID NO: 145835 - protein, 15 aa, Borrelia burgdorferi
EAYKAIVTSILLMRD

SEQ ID NO: 145836 - protein, 9 aa, Borrelia burgdorferi
IVTSILLMR

SEQ ID NO: 145837 - protein, 15 aa, Borrelia burgdorferi
AYKAIVTSILLMRDS

SEQ ID NO: 145838 - protein, 9 aa, Borrelia burgdorferi
IVTSILLMR

SEQ ID NO: 145839 - protein, 15 aa, Borrelia burgdorferi
YKAIVTSILLMRDSL

SEQ ID NO: 145840 - protein, 9 aa, Borrelia burgdorferi
IVTSILLMR

SEQ ID NO: 145841 - protein, 15 aa, Borrelia burgdorferi
KKGKGKIARKKGKSK

SEQ ID NO: 145842 - protein, 9 aa, Borrelia burgdorferi
KKGKGKIAR

SEQ ID NO: 145843 - protein, 15 aa, Borrelia burgdorferi
GKGKIARKKGKSKVS

SEQ ID NO: 145844 - protein, 9 aa, Borrelia burgdorferi
IARKKGKSK

SEQ ID NO: 145845 - protein, 15 aa, Borrelia burgdorferi
KGKGKIARKKGKSKV

SEQ ID NO: 145846 - protein, 9 aa, Borrelia burgdorferi
IARKKGKSK

SEQ ID NO: 145847 - protein, 15 aa, Borrelia burgdorferi
TSILLMRDSLKEVQG

SEQ ID NO: 145848 - protein, 9 aa, Borrelia burgdorferi
ILLMRDSLK

SEQ ID NO: 145849 - protein, 15 aa, Borrelia burgdorferi
VTSILLMRDSLKEVQ

SEQ ID NO: 145850 - protein, 9 aa, Borrelia burgdorferi
ILLMRDSLK

SEQ ID NO: 145851 - protein, 15 aa, Borrelia burgdorferi
GKSKVSRKEPYIHSL

SEQ ID NO: 145852 - protein, 9 aa, Borrelia burgdorferi
VSRKEPYIH

SEQ ID NO: 145853 - protein, 15 aa, Borrelia burgdorferi
KSKVSRKEPYIHSLK

SEQ ID NO: 145854 - protein, 9 aa, Borrelia burgdorferi
VSRKEPYIH

SEQ ID NO: 145855 - protein, 15 aa, Borrelia burgdorferi
KKGKSKVSRKEPYIH

SEQ ID NO: 145856 - protein, 9 aa, Borrelia burgdorferi
KKGKSKVSR

SEQ ID NO: 145857 - protein, 15 aa, Borrelia burgdorferi
KGKSKVSRKEPYIHS

SEQ ID NO: 145858 - protein, 9 aa, Borrelia burgdorferi
VSRKEPYIH

SEQ ID NO: 145859 - protein, 15 aa, Borrelia burgdorferi
SKVSRKEPYIHSLKR

SEQ ID NO: 145860 - protein, 9 aa, Borrelia burgdorferi
VSRKEPYIH

SEQ ID NO: 145861 - protein, 15 aa, Borrelia burgdorferi
VSRKEPYIHSLKRDS

SEQ ID NO: 145862 - protein, 9 aa, Borrelia burgdorferi
VSRKEPYIH

SEQ ID NO: 145863 - protein, 15 aa, Borrelia burgdorferi
KVSRKEPYIHSLKRD

SEQ ID NO: 145864 - protein, 9 aa, Borrelia burgdorferi
VSRKEPYIH

SEQ ID NO: 145865 - protein, 15 aa, Borrelia burgdorferi
KTELLKEQSETRKEK

SEQ ID NO: 145866 - protein, 9 aa, Borrelia burgdorferi
LLKEQSETR

SEQ ID NO: 145867 - protein, 15 aa, Borrelia burgdorferi
TELLKEQSETRKEKI

SEQ ID NO: 145868 - protein, 9 aa, Borrelia burgdorferi
LLKEQSETR

SEQ ID NO: 145869 - protein, 15 aa, Borrelia burgdorferi
TSEESIKKPMNKKGK

SEQ ID NO: 145870 - protein, 9 aa, Borrelia burgdorferi
IKKPMNKKG

SEQ ID NO: 145871 - protein, 15 aa, Borrelia burgdorferi
SEESIKKPMNKKGKG

SEQ ID NO: 145872 - protein, 9 aa, Borrelia burgdorferi
KKPMNKKGK

SEQ ID NO: 145873 - protein, 15 aa, Borrelia burgdorferi
SLKTELLKEQSETRK

SEQ ID NO: 145874 - protein, 9 aa, Borrelia burgdorferi
LLKEQSETR

SEQ ID NO: 145875 - protein, 15 aa, Borrelia burgdorferi
LKTELLKEQSETRKE

SEQ ID NO: 145876 - protein, 9 aa, Borrelia burgdorferi
LLKEQSETR

SEQ ID NO: 145877 - protein, 15 aa, Borrelia burgdorferi
ESIKKPMNKKGKGKI

SEQ ID NO: 145878 - protein, 9 aa, Borrelia burgdorferi
KKPMNKKGK

SEQ ID NO: 145879 - protein, 15 aa, Borrelia burgdorferi
EESIKKPMNKKGKGK

SEQ ID NO: 145880 - protein, 9 aa, Borrelia burgdorferi
KKPMNKKGK

SEQ ID NO: 145881 - protein, 15 aa, Borrelia burgdorferi
AANFVYINDTHAKRK

SEQ ID NO: 145882 - protein, 9 aa, Borrelia burgdorferi
YINDTHAKR

SEQ ID NO: 145883 - protein, 15 aa, Borrelia burgdorferi
ANFVYINDTHAKRKL

SEQ ID NO: 145884 - protein, 9 aa, Borrelia burgdorferi
INDTHAKRK

SEQ ID NO: 145885 - protein, 15 aa, Borrelia burgdorferi
NFVYINDTHAKRKLE

SEQ ID NO: 145886 - protein, 9 aa, Borrelia burgdorferi
INDTHAKRK

SEQ ID NO: 145887 - protein, 15 aa, Borrelia burgdorferi
FVYINDTHAKRKLEN

SEQ ID NO: 145888 - protein, 9 aa, Borrelia burgdorferi
INDTHAKRK

SEQ ID NO: 145889 - protein, 15 aa, Borrelia burgdorferi
ELLKEQSETRKEKIQ

SEQ ID NO: 145890 - protein, 9 aa, Borrelia burgdorferi
LKEQSETRK

SEQ ID NO: 145891 - protein, 15 aa, Borrelia afzelii
YDNYTLLSTKQTQMY

SEQ ID NO: 145892 - protein, 9 aa, Borrelia afzelii
YTLLSTKQT

SEQ ID NO: 145893 - protein, 15 aa, Borrelia afzelii
VKIYDNYTLLSTKQT

SEQ ID NO: 145894 - protein, 9 aa, Borrelia afzelii
YDNYTLLST

SEQ ID NO: 145895 - protein, 15 aa, Borrelia afzelii
KIYDNYTLLSTKQTQ

SEQ ID NO: 145896 - protein, 9 aa, Borrelia afzelii
YTLLSTKQT

SEQ ID NO: 145897 - protein, 15 aa, Borrelia afzelii
DNYTLLSTKQTQMYS

SEQ ID NO: 145898 - protein, 9 aa, Borrelia afzelii
YTLLSTKQT

SEQ ID NO: 145899 - protein, 15 aa, Borrelia afzelii
IYDNYTLLSTKQTQM

SEQ ID NO: 145900 - protein, 9 aa, Borrelia afzelii
YTLLSTKQT

SEQ ID NO: 145901 - protein, 15 aa, Borrelia afzelii
DEHKRMLQGSLSFLS

SEQ ID NO: 145902 - protein, 9 aa, Borrelia afzelii
KRMLQGSLS

SEQ ID NO: 145903 - protein, 15 aa, Borrelia afzelii
EHKRMLQGSLSFLSG

SEQ ID NO: 145904 - protein, 9 aa, Borrelia afzelii
LQGSLSFLS

SEQ ID NO: 145905 - protein, 15 aa, Borrelia afzelii
HKRMLQGSLSFLSGE

SEQ ID NO: 145906 - protein, 9 aa, Borrelia afzelii
LQGSLSFLS

SEQ ID NO: 145907 - protein, 15 aa, Borrelia afzelii
KRMLQGSLSFLSGES

SEQ ID NO: 145908 - protein, 9 aa, Borrelia afzelii
LQGSLSFLS

SEQ ID NO: 145909 - protein, 15 aa, Borrelia afzelii
RMLQGSLSFLSGESG

SEQ ID NO: 145910 - protein, 9 aa, Borrelia afzelii
LQGSLSFLS

SEQ ID NO: 145911 - protein, 15 aa, Borrelia afzelii
NYTLLSTKQTQMYST

SEQ ID NO: 145912 - protein, 9 aa, Borrelia afzelii
YTLLSTKQT

SEQ ID NO: 145913 - protein, 15 aa, Borrelia afzelii
YTLLSTKQTQMYSTR

SEQ ID NO: 145914 - protein, 9 aa, Borrelia afzelii
YTLLSTKQT

SEQ ID NO: 145915 - protein, 15 aa, Borrelia afzelii
LLNYIQVSARTATNF

SEQ ID NO: 145916 - protein, 9 aa, Borrelia afzelii
YIQVSARTA

SEQ ID NO: 145917 - protein, 15 aa, Borrelia afzelii
YLEGVKYNVSSAIKT

SEQ ID NO: 145918 - protein, 9 aa, Borrelia afzelii
VKYNVSSAI

SEQ ID NO: 145919 - protein, 15 aa, Borrelia afzelii
LEGVKYNVSSAIKTI

SEQ ID NO: 145920 - protein, 9 aa, Borrelia afzelii
YNVSSAIKT

SEQ ID NO: 145921 - protein, 15 aa, Borrelia afzelii
EGVKYNVSSAIKTIV

SEQ ID NO: 145922 - protein, 9 aa, Borrelia afzelii
YNVSSAIKT

SEQ ID NO: 145923 - protein, 15 aa, Borrelia afzelii
TLLNYIQVSARTATN

SEQ ID NO: 145924 - protein, 9 aa, Borrelia afzelii
YIQVSARTA

SEQ ID NO: 145925 - protein, 15 aa, Borrelia afzelii
LNYIQVSARTATNFV

SEQ ID NO: 145926 - protein, 9 aa, Borrelia afzelii
YIQVSARTA

SEQ ID NO: 145927 - protein, 15 aa, Borrelia afzelii
KTLLNYIQVSARTAT

SEQ ID NO: 145928 - protein, 9 aa, Borrelia afzelii
YIQVSARTA

SEQ ID NO: 145929 - protein, 15 aa, Borrelia afzelii
LKTLLNYIQVSARTA

SEQ ID NO: 145930 - protein, 9 aa, Borrelia afzelii
NYIQVSART

SEQ ID NO: 145931 - protein, 15 aa, Borrelia afzelii
GVKYNVSSAIKTIVK

SEQ ID NO: 145932 - protein, 9 aa, Borrelia afzelii
YNVSSAIKT

SEQ ID NO: 145933 - protein, 15 aa, Borrelia afzelii
VKYNVSSAIKTIVKI

SEQ ID NO: 145934 - protein, 9 aa, Borrelia afzelii
YNVSSAIKT

SEQ ID NO: 145935 - protein, 15 aa, Borrelia afzelii
NYIQVSARTATNFVY

SEQ ID NO: 145936 - protein, 9 aa, Borrelia afzelii
YIQVSARTA

SEQ ID NO: 145937 - protein, 15 aa, Borrelia afzelii
MKIKSKCLALGLLFG

SEQ ID NO: 145938 - protein, 9 aa, Borrelia afzelii
IKSKCLALG

SEQ ID NO: 145939 - protein, 15 aa, Borrelia afzelii
TLLSTKQTQMYSTRL

SEQ ID NO: 145940 - protein, 9 aa, Borrelia afzelii
LSTKQTQMY

SEQ ID NO: 145941 - protein, 15 aa, Borrelia afzelii
LQGSLSFLSGESGEL

SEQ ID NO: 145942 - protein, 9 aa, Borrelia afzelii
LQGSLSFLS

SEQ ID NO: 145943 - protein, 15 aa, Borrelia afzelii
MLQGSLSFLSGESGE

SEQ ID NO: 145944 - protein, 9 aa, Borrelia afzelii
LQGSLSFLS

SEQ ID NO: 145945 - protein, 15 aa, Borrelia afzelii
YIQVSARTATNFVYA

SEQ ID NO: 145946 - protein, 9 aa, Borrelia afzelii
YIQVSARTA

SEQ ID NO: 145947 - protein, 15 aa, Borrelia afzelii
EDYYYDGETRLSNRY

SEQ ID NO: 145948 - protein, 9 aa, Borrelia afzelii
YYDGETRLS

SEQ ID NO: 145949 - protein, 15 aa, Borrelia afzelii
EEDYYYDGETRLSNR

SEQ ID NO: 145950 - protein, 9 aa, Borrelia afzelii
YYDGETRLS

SEQ ID NO: 145951 - protein, 15 aa, Borrelia afzelii
DYYYDGETRLSNRYE

SEQ ID NO: 145952 - protein, 9 aa, Borrelia afzelii
YYDGETRLS

SEQ ID NO: 145953 - protein, 15 aa, Borrelia afzelii
LEEDYYYDGETRLSN

SEQ ID NO: 145954 - protein, 9 aa, Borrelia afzelii
YYDGETRLS

SEQ ID NO: 145955 - protein, 15 aa, Borrelia afzelii
LSTKQTQMYSTRLDN

SEQ ID NO: 145956 - protein, 9 aa, Borrelia afzelii
QTQMYSTRL

SEQ ID NO: 145957 - protein, 15 aa, Borrelia afzelii
KTIVKIYDNYTLLST

SEQ ID NO: 145958 - protein, 9 aa, Borrelia afzelii
IYDNYTLLS

SEQ ID NO: 145959 - protein, 15 aa, Borrelia afzelii
LLSTKQTQMYSTRLD

SEQ ID NO: 145960 - protein, 9 aa, Borrelia afzelii
QTQMYSTRL

SEQ ID NO: 145961 - protein, 15 aa, Borrelia afzelii
AIVRSILLMKDSLKI

SEQ ID NO: 145962 - protein, 9 aa, Borrelia afzelii
VRSILLMKD

SEQ ID NO: 145963 - protein, 15 aa, Borrelia afzelii
VRSILLMKDSLKIIE

SEQ ID NO: 145964 - protein, 9 aa, Borrelia afzelii
LLMKDSLKI

SEQ ID NO: 145965 - protein, 15 aa, Borrelia afzelii
TKQTQMYSTRLDNLA

SEQ ID NO: 145966 - protein, 9 aa, Borrelia afzelii
QTQMYSTRL

SEQ ID NO: 145967 - protein, 15 aa, Borrelia afzelii
IVRSILLMKDSLKII

SEQ ID NO: 145968 - protein, 9 aa, Borrelia afzelii
LLMKDSLKI

SEQ ID NO: 145969 - protein, 15 aa, Borrelia afzelii
RSILLMKDSLKIIEI

SEQ ID NO: 145970 - protein, 9 aa, Borrelia afzelii
LLMKDSLKI

SEQ ID NO: 145971 - protein, 15 aa, Borrelia afzelii
SLEEDYYYDGETRLS

SEQ ID NO: 145972 - protein, 9 aa, Borrelia afzelii
YYYDGETRL

SEQ ID NO: 145973 - protein, 15 aa, Borrelia afzelii
KYNVSSAIKTIVKIY

SEQ ID NO: 145974 - protein, 9 aa, Borrelia afzelii
YNVSSAIKT

SEQ ID NO: 145975 - protein, 15 aa, Borrelia afzelii
TIVKIYDNYTLLSTK

SEQ ID NO: 145976 - protein, 9 aa, Borrelia afzelii
YDNYTLLST

SEQ ID NO: 145977 - protein, 15 aa, Borrelia afzelii
SILLMKDSLKIIEIV

SEQ ID NO: 145978 - protein, 9 aa, Borrelia afzelii
LLMKDSLKI

SEQ ID NO: 145979 - protein, 15 aa, Borrelia afzelii
YNVSSAIKTIVKIYD

SEQ ID NO: 145980 - protein, 9 aa, Borrelia afzelii
YNVSSAIKT

SEQ ID NO: 145981 - protein, 15 aa, Borrelia afzelii
IVKIYDNYTLLSTKQ

SEQ ID NO: 145982 - protein, 9 aa, Borrelia afzelii
YDNYTLLST

SEQ ID NO: 145983 - protein, 15 aa, Borrelia afzelii
KIKSKCLALGLLFGF

SEQ ID NO: 145984 - protein, 9 aa, Borrelia afzelii
IKSKCLALG

SEQ ID NO: 145985 - protein, 15 aa, Borrelia afzelii
IKSKCLALGLLFGFI

SEQ ID NO: 145986 - protein, 9 aa, Borrelia afzelii
IKSKCLALG

SEQ ID NO: 145987 - protein, 15 aa, Borrelia afzelii
STKQTQMYSTRLDNL

SEQ ID NO: 145988 - protein, 9 aa, Borrelia afzelii
QTQMYSTRL

SEQ ID NO: 145989 - protein, 15 aa, Borrelia afzelii
KSDLQAISGSNSISY

SEQ ID NO: 145990 - protein, 9 aa, Borrelia afzelii
LQAISGSNS

SEQ ID NO: 145991 - protein, 15 aa, Borrelia afzelii
SDLQAISGSNSISYT

SEQ ID NO: 145992 - protein, 9 aa, Borrelia afzelii
LQAISGSNS

SEQ ID NO: 145993 - protein, 15 aa, Borrelia afzelii
KQTQMYSTRLDNLAK

SEQ ID NO: 145994 - protein, 9 aa, Borrelia afzelii
QTQMYSTRL

SEQ ID NO: 145995 - protein, 15 aa, Borrelia afzelii
QTQMYSTRLDNLAKA

SEQ ID NO: 145996 - protein, 9 aa, Borrelia afzelii
QTQMYSTRL

SEQ ID NO: 145997 - protein, 15 aa, Borrelia afzelii
YYYDGETRLSNRYES

SEQ ID NO: 145998 - protein, 9 aa, Borrelia afzelii
YYDGETRLS

SEQ ID NO: 145999 - protein, 15 aa, Borrelia afzelii
QDEHKRMLQGSLSFL

SEQ ID NO: 146000 - protein, 9 aa, Borrelia afzelii
KRMLQGSLS

SEQ ID NO: 146001 - protein, 15 aa, Borrelia afzelii
LRLKSDLQAISGSNS

SEQ ID NO: 146002 - protein, 9 aa, Borrelia afzelii
KSDLQAISG

SEQ ID NO: 146003 - protein, 15 aa, Borrelia afzelii
RLKSDLQAISGSNSI

SEQ ID NO: 146004 - protein, 9 aa, Borrelia afzelii
LQAISGSNS

SEQ ID NO: 146005 - protein, 15 aa, Borrelia afzelii
LKSDLQAISGSNSIS

SEQ ID NO: 146006 - protein, 9 aa, Borrelia afzelii
LQAISGSNS

SEQ ID NO: 146007 - protein, 15 aa, Borrelia afzelii
SEEEILKTKLLRERP

SEQ ID NO: 146008 - protein, 9 aa, Borrelia afzelii
LKTKLLRER

SEQ ID NO: 146009 - protein, 15 aa, Borrelia afzelii
YYDGETRLSNRYESY

SEQ ID NO: 146010 - protein, 9 aa, Borrelia afzelii
YYDGETRLS

SEQ ID NO: 146011 - protein, 15 aa, Borrelia afzelii
EEILKTKLLRERPET

SEQ ID NO: 146012 - protein, 9 aa, Borrelia afzelii
LKTKLLRER

SEQ ID NO: 146013 - protein, 15 aa, Borrelia afzelii
EEEILKTKLLRERPE

SEQ ID NO: 146014 - protein, 9 aa, Borrelia afzelii
LKTKLLRER

SEQ ID NO: 146015 - protein, 15 aa, Borrelia afzelii
ISEEEILKTKLLRER

SEQ ID NO: 146016 - protein, 9 aa, Borrelia afzelii
EEILKTKLL

SEQ ID NO: 146017 - protein, 15 aa, Borrelia afzelii
ILLMKDSLKIIEIVI

SEQ ID NO: 146018 - protein, 9 aa, Borrelia afzelii
LLMKDSLKI

SEQ ID NO: 146019 - protein, 15 aa, Borrelia afzelii
KDLKTLLNYIQVSAR

SEQ ID NO: 146020 - protein, 9 aa, Borrelia afzelii
LKTLLNYIQ

SEQ ID NO: 146021 - protein, 15 aa, Borrelia afzelii
EILKTKLLRERPETR

SEQ ID NO: 146022 - protein, 9 aa, Borrelia afzelii
LKTKLLRER

SEQ ID NO: 146023 - protein, 15 aa, Borrelia afzelii
EKDLKTLLNYIQVSA

SEQ ID NO: 146024 - protein, 9 aa, Borrelia afzelii
LKTLLNYIQ

SEQ ID NO: 146025 - protein, 15 aa, Borrelia afzelii
DLKTLLNYIQVSART

SEQ ID NO: 146026 - protein, 9 aa, Borrelia afzelii
LKTLLNYIQ

SEQ ID NO: 146027 - protein, 15 aa, Borrelia afzelii
IKTIVKIYDNYTLLS

SEQ ID NO: 146028 - protein, 9 aa, Borrelia afzelii
VKIYDNYTL

SEQ ID NO: 146029 - protein, 15 aa, Borrelia afzelii
LLMKDSLKIIEIVID

SEQ ID NO: 146030 - protein, 9 aa, Borrelia afzelii
LLMKDSLKI

SEQ ID NO: 146031 - protein, 15 aa, Borrelia afzelii
ELEKDLKTLLNYIQV

SEQ ID NO: 146032 - protein, 9 aa, Borrelia afzelii
LKTLLNYIQ

SEQ ID NO: 146033 - protein, 15 aa, Borrelia afzelii
EELEKDLKTLLNYIQ

SEQ ID NO: 146034 - protein, 9 aa, Borrelia afzelii
EKDLKTLLN

SEQ ID NO: 146035 - protein, 15 aa, Borrelia afzelii
EAYKAIVRSILLMKD

SEQ ID NO: 146036 - protein, 9 aa, Borrelia afzelii
YKAIVRSIL

SEQ ID NO: 146037 - protein, 15 aa, Borrelia afzelii
LEKDLKTLLNYIQVS

SEQ ID NO: 146038 - protein, 9 aa, Borrelia afzelii
LKTLLNYIQ

SEQ ID NO: 146039 - protein, 15 aa, Borrelia afzelii
SYLEGVKYNVSSAIK

SEQ ID NO: 146040 - protein, 9 aa, Borrelia afzelii
VKYNVSSAI

SEQ ID NO: 146041 - protein, 15 aa, Borrelia afzelii
DLYEAYKAIVRSILL

SEQ ID NO: 146042 - protein, 9 aa, Borrelia afzelii
YEAYKAIVR

SEQ ID NO: 146043 - protein, 15 aa, Borrelia afzelii
DLQAISGSNSISYTD

SEQ ID NO: 146044 - protein, 9 aa, Borrelia afzelii
LQAISGSNS

SEQ ID NO: 146045 - protein, 15 aa, Borrelia afzelii
SDLYEAYKAIVRSIL

SEQ ID NO: 146046 - protein, 9 aa, Borrelia afzelii
YEAYKAIVR

SEQ ID NO: 146047 - protein, 15 aa, Borrelia afzelii
LQAISGSNSISYTDE

SEQ ID NO: 146048 - protein, 9 aa, Borrelia afzelii
LQAISGSNS

SEQ ID NO: 146049 - protein, 15 aa, Borrelia afzelii
QMYSTRLDNLAKAKA

SEQ ID NO: 146050 - protein, 9 aa, Borrelia afzelii
YSTRLDNLA

SEQ ID NO: 146051 - protein, 15 aa, Borrelia afzelii
ETEIKNLILKIKGQS

SEQ ID NO: 146052 - protein, 9 aa, Borrelia afzelii
IKNLILKIK

SEQ ID NO: 146053 - protein, 15 aa, Borrelia afzelii
TEIKNLILKIKGQSD

SEQ ID NO: 146054 - protein, 9 aa, Borrelia afzelii
IKNLILKIK

SEQ ID NO: 146055 - protein, 15 aa, Borrelia afzelii
IETEIKNLILKIKGQ

SEQ ID NO: 146056 - protein, 9 aa, Borrelia afzelii
IKNLILKIK

SEQ ID NO: 146057 - protein, 15 aa, Borrelia afzelii
AIETEIKNLILKIKG

SEQ ID NO: 146058 - protein, 9 aa, Borrelia afzelii
IKNLILKIK

SEQ ID NO: 146059 - protein, 15 aa, Borrelia afzelii
QGSLSFLSGESGELK

SEQ ID NO: 146060 - protein, 9 aa, Borrelia afzelii
FLSGESGEL

SEQ ID NO: 146061 - protein, 15 aa, Borrelia afzelii
AYKAIVRSILLMKDS

SEQ ID NO: 146062 - protein, 9 aa, Borrelia afzelii
VRSILLMKD

SEQ ID NO: 146063 - protein, 15 aa, Borrelia afzelii
DAIETEIKNLILKIK

SEQ ID NO: 146064 - protein, 9 aa, Borrelia afzelii
EIKNLILKI

SEQ ID NO: 146065 - protein, 15 aa, Borrelia afzelii
IQVSARTATNFVYAR

SEQ ID NO: 146066 - protein, 9 aa, Borrelia afzelii
VSARTATNF

SEQ ID NO: 146067 - protein, 15 aa, Borrelia afzelii
YKAIVRSILLMKDSL

SEQ ID NO: 146068 - protein, 9 aa, Borrelia afzelii
VRSILLMKD

SEQ ID NO: 146069 - protein, 15 aa, Borrelia afzelii
KAIVRSILLMKDSLK

SEQ ID NO: 146070 - protein, 9 aa, Borrelia afzelii
VRSILLMKD

SEQ ID NO: 146071 - protein, 15 aa, Borrelia afzelii
GSLSFLSGESGELKD

SEQ ID NO: 146072 - protein, 9 aa, Borrelia afzelii
FLSGESGEL

SEQ ID NO: 146073 - protein, 15 aa, Borrelia afzelii
ESYLEGVKYNVSSAI

SEQ ID NO: 146074 - protein, 9 aa, Borrelia afzelii
LEGVKYNVS

SEQ ID NO: 146075 - protein, 15 aa, Borrelia afzelii
STRLDNLAKAKAREE

SEQ ID NO: 146076 - protein, 9 aa, Borrelia afzelii
LDNLAKAKA

SEQ ID NO: 146077 - protein, 15 aa, Borrelia afzelii
TRLDNLAKAKAREEA

SEQ ID NO: 146078 - protein, 9 aa, Borrelia afzelii
LDNLAKAKA

SEQ ID NO: 146079 - protein, 15 aa, Borrelia afzelii
NEIDFTIDSDLRLKS

SEQ ID NO: 146080 - protein, 9 aa, Borrelia afzelii
FTIDSDLRL

SEQ ID NO: 146081 - protein, 15 aa, Borrelia afzelii
IDFTIDSDLRLKSDL

SEQ ID NO: 146082 - protein, 9 aa, Borrelia afzelii
FTIDSDLRL

SEQ ID NO: 146083 - protein, 15 aa, Borrelia afzelii
EIDFTIDSDLRLKSD

SEQ ID NO: 146084 - protein, 9 aa, Borrelia afzelii
FTIDSDLRL

SEQ ID NO: 146085 - protein, 15 aa, Borrelia afzelii
FTIDSDLRLKSDLQA

SEQ ID NO: 146086 - protein, 9 aa, Borrelia afzelii
IDSDLRLKS

SEQ ID NO: 146087 - protein, 15 aa, Borrelia afzelii
DFTIDSDLRLKSDLQ

SEQ ID NO: 146088 - protein, 9 aa, Borrelia afzelii
IDSDLRLKS

SEQ ID NO: 146089 - protein, 15 aa, Borrelia afzelii
ESNEIDFTIDSDLRL

SEQ ID NO: 146090 - protein, 9 aa, Borrelia afzelii
NEIDFTIDS

SEQ ID NO: 146091 - protein, 15 aa, Borrelia afzelii
SNEIDFTIDSDLRLK

SEQ ID NO: 146092 - protein, 9 aa, Borrelia afzelii
FTIDSDLRL

SEQ ID NO: 146093 - protein, 15 aa, Borrelia afzelii
NAVKKDPFNHHVKRE

SEQ ID NO: 146094 - protein, 9 aa, Borrelia afzelii
VKKDPFNHH

SEQ ID NO: 146095 - protein, 15 aa, Borrelia afzelii
GNAVKKDPFNHHVKR

SEQ ID NO: 146096 - protein, 9 aa, Borrelia afzelii
VKKDPFNHH

SEQ ID NO: 146097 - protein, 15 aa, Borrelia afzelii
KVEGNAVKKDPFNHH

SEQ ID NO: 146098 - protein, 9 aa, Borrelia afzelii
KVEGNAVKK

SEQ ID NO: 146099 - protein, 15 aa, Borrelia afzelii
EGNAVKKDPFNHHVK

SEQ ID NO: 146100 - protein, 9 aa, Borrelia afzelii
VKKDPFNHH

SEQ ID NO: 146101 - protein, 15 aa, Borrelia afzelii
VEGNAVKKDPFNHHV

SEQ ID NO: 146102 - protein, 9 aa, Borrelia afzelii
VKKDPFNHH

SEQ ID NO: 146103 - protein, 15 aa, Borrelia afzelii
NHHVKRESVNNSNLS

SEQ ID NO: 146104 - protein, 9 aa, Borrelia afzelii
VKRESVNNS

SEQ ID NO: 146105 - protein, 15 aa, Borrelia afzelii
HHVKRESVNNSNLSQ

SEQ ID NO: 146106 - protein, 9 aa, Borrelia afzelii
VKRESVNNS

SEQ ID NO: 146107 - protein, 15 aa, Borrelia afzelii
DPFNHHVKRESVNNS

SEQ ID NO: 146108 - protein, 9 aa, Borrelia afzelii
FNHHVKRES

SEQ ID NO: 146109 - protein, 15 aa, Borrelia afzelii
PFNHHVKRESVNNSN

SEQ ID NO: 146110 - protein, 9 aa, Borrelia afzelii
VKRESVNNS

SEQ ID NO: 146111 - protein, 15 aa, Borrelia afzelii
VKIYDNYTLLSTKQT

SEQ ID NO: 146112 - protein, 9 aa, Borrelia afzelii
IYDNYTLLS

SEQ ID NO: 146113 - protein, 15 aa, Borrelia afzelii
IVKIYDNYTLLSTKQ

SEQ ID NO: 146114 - protein, 9 aa, Borrelia afzelii
IYDNYTLLS

SEQ ID NO: 146115 - protein, 15 aa, Borrelia afzelii
FNHHVKRESVNNSNL

SEQ ID NO: 146116 - protein, 9 aa, Borrelia afzelii
VKRESVNNS

SEQ ID NO: 146117 - protein, 15 aa, Borrelia afzelii
IKTIVKIYDNYTLLS

SEQ ID NO: 146118 - protein, 9 aa, Borrelia afzelii
IVKIYDNYT

SEQ ID NO: 146119 - protein, 15 aa, Borrelia afzelii
KTIVKIYDNYTLLST

SEQ ID NO: 146120 - protein, 9 aa, Borrelia afzelii
IYDNYTLLS

SEQ ID NO: 146121 - protein, 15 aa, Borrelia afzelii
TIVKIYDNYTLLSTK

SEQ ID NO: 146122 - protein, 9 aa, Borrelia afzelii
IYDNYTLLS

SEQ ID NO: 146123 - protein, 15 aa, Borrelia afzelii
VKKDPFNHHVKRESV

SEQ ID NO: 146124 - protein, 9 aa, Borrelia afzelii
VKKDPFNHH

SEQ ID NO: 146125 - protein, 15 aa, Borrelia afzelii
AVKKDPFNHHVKRES

SEQ ID NO: 146126 - protein, 9 aa, Borrelia afzelii
VKKDPFNHH

SEQ ID NO: 146127 - protein, 15 aa, Borrelia afzelii
HVKRESVNNSNLSQK

SEQ ID NO: 146128 - protein, 9 aa, Borrelia afzelii
VKRESVNNS

SEQ ID NO: 146129 - protein, 15 aa, Borrelia afzelii
VKRESVNNSNLSQKN

SEQ ID NO: 146130 - protein, 9 aa, Borrelia afzelii
VKRESVNNS

SEQ ID NO: 146131 - protein, 15 aa, Borrelia afzelii
IKTIVKIYDNYTLLS

SEQ ID NO: 146132 - protein, 9 aa, Borrelia afzelii
IKTIVKIYD

SEQ ID NO: 146133 - protein, 15 aa, Borrelia afzelii
VKIYDNYTLLSTKQT

SEQ ID NO: 146134 - protein, 9 aa, Borrelia afzelii
IYDNYTLLS

SEQ ID NO: 146135 - protein, 15 aa, Borrelia afzelii
SSAIKTIVKIYDNYT

SEQ ID NO: 146136 - protein, 9 aa, Borrelia afzelii
IKTIVKIYD

SEQ ID NO: 146137 - protein, 15 aa, Borrelia afzelii
KTIVKIYDNYTLLST

SEQ ID NO: 146138 - protein, 9 aa, Borrelia afzelii
IYDNYTLLS

SEQ ID NO: 146139 - protein, 15 aa, Borrelia afzelii
SAIKTIVKIYDNYTL

SEQ ID NO: 146140 - protein, 9 aa, Borrelia afzelii
IKTIVKIYD

SEQ ID NO: 146141 - protein, 15 aa, Borrelia afzelii
NYIQVSARTATNFVY

SEQ ID NO: 146142 - protein, 9 aa, Borrelia afzelii
VSARTATNF

SEQ ID NO: 146143 - protein, 15 aa, Borrelia afzelii
YIQVSARTATNFVYA

SEQ ID NO: 146144 - protein, 9 aa, Borrelia afzelii
ARTATNFVY

SEQ ID NO: 146145 - protein, 15 aa, Borrelia afzelii
IQVSARTATNFVYAR

SEQ ID NO: 146146 - protein, 9 aa, Borrelia afzelii
ARTATNFVY

SEQ ID NO: 146147 - protein, 15 aa, Borrelia afzelii
DLYEAYKAIVRSILL

SEQ ID NO: 146148 - protein, 9 aa, Borrelia afzelii
YKAIVRSIL

SEQ ID NO: 146149 - protein, 15 aa, Borrelia afzelii
LYEAYKAIVRSILLM

SEQ ID NO: 146150 - protein, 9 aa, Borrelia afzelii
YKAIVRSIL

SEQ ID NO: 146151 - protein, 15 aa, Borrelia afzelii
YEAYKAIVRSILLMK

SEQ ID NO: 146152 - protein, 9 aa, Borrelia afzelii
YKAIVRSIL

SEQ ID NO: 146153 - protein, 15 aa, Borrelia afzelii
SDLYEAYKAIVRSIL

SEQ ID NO: 146154 - protein, 9 aa, Borrelia afzelii
YEAYKAIVR

SEQ ID NO: 146155 - protein, 15 aa, Borrelia afzelii
QVSARTATNFVYARE

SEQ ID NO: 146156 - protein, 9 aa, Borrelia afzelii
ARTATNFVY

SEQ ID NO: 146157 - protein, 15 aa, Borrelia afzelii
EAYKAIVRSILLMKD

SEQ ID NO: 146158 - protein, 9 aa, Borrelia afzelii
YKAIVRSIL

SEQ ID NO: 146159 - protein, 15 aa, Borrelia afzelii
VSARTATNFVYAREI

SEQ ID NO: 146160 - protein, 9 aa, Borrelia afzelii
ARTATNFVY

SEQ ID NO: 146161 - protein, 15 aa, Borrelia afzelii
LNYIQVSARTATNFV

SEQ ID NO: 146162 - protein, 9 aa, Borrelia afzelii
VSARTATNF

SEQ ID NO: 146163 - protein, 15 aa, Borrelia afzelii
EGVKYNVSSAIKTIV

SEQ ID NO: 146164 - protein, 9 aa, Borrelia afzelii
VKYNVSSAI

SEQ ID NO: 146165 - protein, 15 aa, Borrelia afzelii
LLNYIQVSARTATNF

SEQ ID NO: 146166 - protein, 9 aa, Borrelia afzelii
IQVSARTAT

SEQ ID NO: 146167 - protein, 15 aa, Borrelia afzelii
EGVKYNVSSAIKTIV

SEQ ID NO: 146168 - protein, 9 aa, Borrelia afzelii
YNVSSAIKT

SEQ ID NO: 146169 - protein, 15 aa, Borrelia afzelii
LEGVKYNVSSAIKTI

SEQ ID NO: 146170 - protein, 9 aa, Borrelia afzelii
YNVSSAIKT

SEQ ID NO: 146171 - protein, 15 aa, Borrelia afzelii
GVKYNVSSAIKTIVK

SEQ ID NO: 146172 - protein, 9 aa, Borrelia afzelii
YNVSSAIKT

SEQ ID NO: 146173 - protein, 15 aa, Borrelia afzelii
VKYNVSSAIKTIVKI

SEQ ID NO: 146174 - protein, 9 aa, Borrelia afzelii
YNVSSAIKT

SEQ ID NO: 146175 - protein, 15 aa, Borrelia afzelii
YLEGVKYNVSSAIKT

SEQ ID NO: 146176 - protein, 9 aa, Borrelia afzelii
VKYNVSSAI

SEQ ID NO: 146177 - protein, 15 aa, Borrelia afzelii
KTLLNYIQVSARTAT

SEQ ID NO: 146178 - protein, 9 aa, Borrelia afzelii
YIQVSARTA

SEQ ID NO: 146179 - protein, 15 aa, Borrelia afzelii
LNYIQVSARTATNFV

SEQ ID NO: 146180 - protein, 9 aa, Borrelia afzelii
YIQVSARTA

SEQ ID NO: 146181 - protein, 15 aa, Borrelia afzelii
KYNVSSAIKTIVKIY

SEQ ID NO: 146182 - protein, 9 aa, Borrelia afzelii
YNVSSAIKT

SEQ ID NO: 146183 - protein, 15 aa, Borrelia afzelii
TLLNYIQVSARTATN

SEQ ID NO: 146184 - protein, 9 aa, Borrelia afzelii
YIQVSARTA

SEQ ID NO: 146185 - protein, 15 aa, Borrelia afzelii
LLNYIQVSARTATNF

SEQ ID NO: 146186 - protein, 9 aa, Borrelia afzelii
YIQVSARTA

SEQ ID NO: 146187 - protein, 15 aa, Borrelia afzelii
YNVSSAIKTIVKIYD

SEQ ID NO: 146188 - protein, 9 aa, Borrelia afzelii
YNVSSAIKT

SEQ ID NO: 146189 - protein, 15 aa, Borrelia afzelii
DAIETEIKNLILKIK

SEQ ID NO: 146190 - protein, 9 aa, Borrelia afzelii
IETEIKNLI

SEQ ID NO: 146191 - protein, 15 aa, Borrelia afzelii
AIETEIKNLILKIKG

SEQ ID NO: 146192 - protein, 9 aa, Borrelia afzelii
IKNLILKIK

SEQ ID NO: 146193 - protein, 15 aa, Borrelia afzelii
IETEIKNLILKIKGQ

SEQ ID NO: 146194 - protein, 9 aa, Borrelia afzelii
IKNLILKIK

SEQ ID NO: 146195 - protein, 15 aa, Borrelia afzelii
ETEIKNLILKIKGQS

SEQ ID NO: 146196 - protein, 9 aa, Borrelia afzelii
IKNLILKIK

SEQ ID NO: 146197 - protein, 15 aa, Borrelia afzelii
TEIKNLILKIKGQSD

SEQ ID NO: 146198 - protein, 9 aa, Borrelia afzelii
IKNLILKIK

SEQ ID NO: 146199 - protein, 15 aa, Borrelia afzelii
EIKNLILKIKGQSDL

SEQ ID NO: 146200 - protein, 9 aa, Borrelia afzelii
IKNLILKIK

SEQ ID NO: 146201 - protein, 15 aa, Borrelia afzelii
IKNLILKIKGQSDLY

SEQ ID NO: 146202 - protein, 9 aa, Borrelia afzelii
IKNLILKIK

SEQ ID NO: 146203 - protein, 15 aa, Borrelia afzelii
EGVKYNVSSAIKTIV

SEQ ID NO: 146204 - protein, 9 aa, Borrelia afzelii
YNVSSAIKT

SEQ ID NO: 146205 - protein, 15 aa, Borrelia afzelii
LEGVKYNVSSAIKTI

SEQ ID NO: 146206 - protein, 9 aa, Borrelia afzelii
YNVSSAIKT

SEQ ID NO: 146207 - protein, 15 aa, Borrelia afzelii
YLEGVKYNVSSAIKT

SEQ ID NO: 146208 - protein, 9 aa, Borrelia afzelii
VKYNVSSAI

SEQ ID NO: 146209 - protein, 15 aa, Borrelia afzelii
GVKYNVSSAIKTIVK

SEQ ID NO: 146210 - protein, 9 aa, Borrelia afzelii
YNVSSAIKT

SEQ ID NO: 146211 - protein, 15 aa, Borrelia afzelii
VKYNVSSAIKTIVKI

SEQ ID NO: 146212 - protein, 9 aa, Borrelia afzelii
YNVSSAIKT

SEQ ID NO: 146213 - protein, 15 aa, Borrelia afzelii
VKIYDNYTLLSTKQT

SEQ ID NO: 146214 - protein, 9 aa, Borrelia afzelii
IYDNYTLLS

SEQ ID NO: 146215 - protein, 15 aa, Borrelia afzelii
KTLLNYIQVSARTAT

SEQ ID NO: 146216 - protein, 9 aa, Borrelia afzelii
LLNYIQVSA

SEQ ID NO: 146217 - protein, 15 aa, Borrelia afzelii
EAYKAIVRSILLMKD

SEQ ID NO: 146218 - protein, 9 aa, Borrelia afzelii
YKAIVRSIL

SEQ ID NO: 146219 - protein, 15 aa, Borrelia afzelii
TLLNYIQVSARTATN

SEQ ID NO: 146220 - protein, 9 aa, Borrelia afzelii
IQVSARTAT

SEQ ID NO: 146221 - protein, 15 aa, Borrelia afzelii
YEAYKAIVRSILLMK

SEQ ID NO: 146222 - protein, 9 aa, Borrelia afzelii
YKAIVRSIL

SEQ ID NO: 146223 - protein, 15 aa, Borrelia afzelii
HVKRESVNNSNLSQK

SEQ ID NO: 146224 - protein, 9 aa, Borrelia afzelii
ESVNNSNLS

SEQ ID NO: 146225 - protein, 15 aa, Borrelia afzelii
VKRESVNNSNLSQKN

SEQ ID NO: 146226 - protein, 9 aa, Borrelia afzelii
VNNSNLSQK

SEQ ID NO: 146227 - protein, 15 aa, Borrelia afzelii
LLNYIQVSARTATNF

SEQ ID NO: 146228 - protein, 9 aa, Borrelia afzelii
IQVSARTAT

SEQ ID NO: 146229 - protein, 15 aa, Borrelia afzelii
LNYIQVSARTATNFV

SEQ ID NO: 146230 - protein, 9 aa, Borrelia afzelii
IQVSARTAT

SEQ ID NO: 146231 - protein, 15 aa, Borrelia afzelii
NYIQVSARTATNFVY

SEQ ID NO: 146232 - protein, 9 aa, Borrelia afzelii
IQVSARTAT

SEQ ID NO: 146233 - protein, 15 aa, Borrelia afzelii
KIYDNYTLLSTKQTQ

SEQ ID NO: 146234 - protein, 9 aa, Borrelia afzelii
YTLLSTKQT

SEQ ID NO: 146235 - protein, 15 aa, Borrelia afzelii
IYDNYTLLSTKQTQM

SEQ ID NO: 146236 - protein, 9 aa, Borrelia afzelii
YTLLSTKQT

SEQ ID NO: 146237 - protein, 15 aa, Borrelia afzelii
YDNYTLLSTKQTQMY

SEQ ID NO: 146238 - protein, 9 aa, Borrelia afzelii
YTLLSTKQT

SEQ ID NO: 146239 - protein, 15 aa, Borrelia afzelii
KRESVNNSNLSQKNV

SEQ ID NO: 146240 - protein, 9 aa, Borrelia afzelii
VNNSNLSQK

SEQ ID NO: 146241 - protein, 15 aa, Borrelia afzelii
RESVNNSNLSQKNVI

SEQ ID NO: 146242 - protein, 9 aa, Borrelia afzelii
VNNSNLSQK

SEQ ID NO: 146243 - protein, 15 aa, Borrelia afzelii
YKAIVRSILLMKDSL

SEQ ID NO: 146244 - protein, 9 aa, Borrelia afzelii
IVRSILLMK

SEQ ID NO: 146245 - protein, 15 aa, Borrelia afzelii
AYKAIVRSILLMKDS

SEQ ID NO: 146246 - protein, 9 aa, Borrelia afzelii
IVRSILLMK

SEQ ID NO: 146247 - protein, 15 aa, Borrelia afzelii
DNYTLLSTKQTQMYS

SEQ ID NO: 146248 - protein, 9 aa, Borrelia afzelii
YTLLSTKQT

SEQ ID NO: 146249 - protein, 15 aa, Borrelia afzelii
KDLKTLLNYIQVSAR

SEQ ID NO: 146250 - protein, 9 aa, Borrelia afzelii
LKTLLNYIQ

SEQ ID NO: 146251 - protein, 15 aa, Borrelia afzelii
ESVNNSNLSQKNVIS

SEQ ID NO: 146252 - protein, 9 aa, Borrelia afzelii
VNNSNLSQK

SEQ ID NO: 146253 - protein, 15 aa, Borrelia afzelii
YNVSSAIKTIVKIYD

SEQ ID NO: 146254 - protein, 9 aa, Borrelia afzelii
YNVSSAIKT

SEQ ID NO: 146255 - protein, 15 aa, Borrelia afzelii
KNLILKIKGQSDLYE

SEQ ID NO: 146256 - protein, 9 aa, Borrelia afzelii
LKIKGQSDL

SEQ ID NO: 146257 - protein, 15 aa, Borrelia afzelii
LYEAYKAIVRSILLM

SEQ ID NO: 146258 - protein, 9 aa, Borrelia afzelii
YKAIVRSIL

SEQ ID NO: 146259 - protein, 15 aa, Borrelia afzelii
DLKTLLNYIQVSART

SEQ ID NO: 146260 - protein, 9 aa, Borrelia afzelii
LNYIQVSAR

SEQ ID NO: 146261 - protein, 15 aa, Borrelia afzelii
EKDLKTLLNYIQVSA

SEQ ID NO: 146262 - protein, 9 aa, Borrelia afzelii
LKTLLNYIQ

SEQ ID NO: 146263 - protein, 15 aa, Borrelia afzelii
LKTLLNYIQVSARTA

SEQ ID NO: 146264 - protein, 9 aa, Borrelia afzelii
LNYIQVSAR

SEQ ID NO: 146265 - protein, 15 aa, Borrelia afzelii
LDAIETEIKNLILKI

SEQ ID NO: 146266 - protein, 9 aa, Borrelia afzelii
IETEIKNLI

SEQ ID NO: 146267 - protein, 15 aa, Borrelia afzelii
KYNVSSAIKTIVKIY

SEQ ID NO: 146268 - protein, 9 aa, Borrelia afzelii
YNVSSAIKT

SEQ ID NO: 146269 - protein, 15 aa, Borrelia afzelii
KTIVKIYDNYTLLST

SEQ ID NO: 146270 - protein, 9 aa, Borrelia afzelii
VKIYDNYTL

SEQ ID NO: 146271 - protein, 15 aa, Borrelia afzelii
HHVKRESVNNSNLSQ

SEQ ID NO: 146272 - protein, 9 aa, Borrelia afzelii
VKRESVNNS

SEQ ID NO: 146273 - protein, 15 aa, Borrelia afzelii
IKTIVKIYDNYTLLS

SEQ ID NO: 146274 - protein, 9 aa, Borrelia afzelii
VKIYDNYTL

SEQ ID NO: 146275 - protein, 15 aa, Borrelia afzelii
SAIKTIVKIYDNYTL

SEQ ID NO: 146276 - protein, 9 aa, Borrelia afzelii
IKTIVKIYD

SEQ ID NO: 146277 - protein, 15 aa, Borrelia afzelii
NHHVKRESVNNSNLS

SEQ ID NO: 146278 - protein, 9 aa, Borrelia afzelii
VKRESVNNS

SEQ ID NO: 146279 - protein, 15 aa, Borrelia afzelii
DLYEAYKAIVRSILL

SEQ ID NO: 146280 - protein, 9 aa, Borrelia afzelii
YKAIVRSIL

SEQ ID NO: 146281 - protein, 15 aa, Borrelia afzelii
KAIVRSILLMKDSLK

SEQ ID NO: 146282 - protein, 9 aa, Borrelia afzelii
IVRSILLMK

SEQ ID NO: 146283 - protein, 15 aa, Borrelia afzelii
SYLEGVKYNVSSAIK

SEQ ID NO: 146284 - protein, 9 aa, Borrelia afzelii
VKYNVSSAI

SEQ ID NO: 146285 - protein, 15 aa, Borrelia afzelii
YIQVSARTATNFVYA

SEQ ID NO: 146286 - protein, 9 aa, Borrelia afzelii
IQVSARTAT

SEQ ID NO: 146287 - protein, 15 aa, Borrelia afzelii
TIVKIYDNYTLLSTK

SEQ ID NO: 146288 - protein, 9 aa, Borrelia afzelii
VKIYDNYTL

SEQ ID NO: 146289 - protein, 15 aa, Borrelia afzelii
KLDAIETEIKNLILK

SEQ ID NO: 146290 - protein, 9 aa, Borrelia afzelii
IETEIKNLI

SEQ ID NO: 146291 - protein, 15 aa, Borrelia afzelii
IQVSARTATNFVYAR

SEQ ID NO: 146292 - protein, 9 aa, Borrelia afzelii
IQVSARTAT

SEQ ID NO: 146293 - protein, 15 aa, Borrelia afzelii
YTLLSTKQTQMYSTR

SEQ ID NO: 146294 - protein, 9 aa, Borrelia afzelii
YTLLSTKQT

SEQ ID NO: 146295 - protein, 15 aa, Borrelia afzelii
LALGLLFGFISCDLF

SEQ ID NO: 146296 - protein, 9 aa, Borrelia afzelii
LGLLFGFIS

SEQ ID NO: 146297 - protein, 15 aa, Borrelia afzelii
ESYLEGVKYNVSSAI

SEQ ID NO: 146298 - protein, 9 aa, Borrelia afzelii
LEGVKYNVS

SEQ ID NO: 146299 - protein, 15 aa, Borrelia afzelii
SDLYEAYKAIVRSIL

SEQ ID NO: 146300 - protein, 9 aa, Borrelia afzelii
EAYKAIVRS

SEQ ID NO: 146301 - protein, 15 aa, Borrelia afzelii
NYTLLSTKQTQMYST

SEQ ID NO: 146302 - protein, 9 aa, Borrelia afzelii
YTLLSTKQT

SEQ ID NO: 146303 - protein, 15 aa, Borrelia afzelii
KSKCLALGLLFGFIS

SEQ ID NO: 146304 - protein, 9 aa, Borrelia afzelii
LALGLLFGF

SEQ ID NO: 146305 - protein, 15 aa, Borrelia afzelii
SKCLALGLLFGFISC

SEQ ID NO: 146306 - protein, 9 aa, Borrelia afzelii
LGLLFGFIS

SEQ ID NO: 146307 - protein, 15 aa, Borrelia afzelii
EELEKDLKTLLNYIQ

SEQ ID NO: 146308 - protein, 9 aa, Borrelia afzelii
LEKDLKTLL

SEQ ID NO: 146309 - protein, 15 aa, Borrelia afzelii
KCLALGLLFGFISCD

SEQ ID NO: 146310 - protein, 9 aa, Borrelia afzelii
LGLLFGFIS

SEQ ID NO: 146311 - protein, 15 aa, Borrelia afzelii
CLALGLLFGFISCDL

SEQ ID NO: 146312 - protein, 9 aa, Borrelia afzelii
LGLLFGFIS

SEQ ID NO: 146313 - protein, 15 aa, Borrelia afzelii
AIVRSILLMKDSLKI

SEQ ID NO: 146314 - protein, 9 aa, Borrelia afzelii
ILLMKDSLK

SEQ ID NO: 146315 - protein, 15 aa, Borrelia afzelii
LEKDLKTLLNYIQVS

SEQ ID NO: 146316 - protein, 9 aa, Borrelia afzelii
LKTLLNYIQ

SEQ ID NO: 146317 - protein, 15 aa, Borrelia afzelii
IVRSILLMKDSLKII

SEQ ID NO: 146318 - protein, 9 aa, Borrelia afzelii
ILLMKDSLK

SEQ ID NO: 146319 - protein, 15 aa, Borrelia afzelii
ELEKDLKTLLNYIQV

SEQ ID NO: 146320 - protein, 9 aa, Borrelia afzelii
LKTLLNYIQ

SEQ ID NO: 146321 - protein, 15 aa, Borrelia afzelii
NLILKIKGQSDLYEA

SEQ ID NO: 146322 - protein, 9 aa, Borrelia afzelii
LKIKGQSDL

SEQ ID NO: 146323 - protein, 15 aa, Borrelia afzelii
IVKIYDNYTLLSTKQ

SEQ ID NO: 146324 - protein, 9 aa, Borrelia afzelii
IYDNYTLLS

SEQ ID NO: 146325 - protein, 15 aa, Borrelia afzelii
LILKIKGQSDLYEAY

SEQ ID NO: 146326 - protein, 9 aa, Borrelia afzelii
LKIKGQSDL

SEQ ID NO: 146327 - protein, 15 aa, Borrelia afzelii
VRSILLMKDSLKIIE

SEQ ID NO: 146328 - protein, 9 aa, Borrelia afzelii
ILLMKDSLK

SEQ ID NO: 146329 - protein, 15 aa, Borrelia afzelii
SVNNSNLSQKNVISE

SEQ ID NO: 146330 - protein, 9 aa, Borrelia afzelii
VNNSNLSQK

SEQ ID NO: 146331 - protein, 15 aa, Borrelia afzelii
MKIKSKCLALGLLFG

SEQ ID NO: 146332 - protein, 9 aa, Borrelia afzelii
MKIKSKCLA

SEQ ID NO: 146333 - protein, 15 aa, Borrelia afzelii
RKLDAIETEIKNLIL

SEQ ID NO: 146334 - protein, 9 aa, Borrelia afzelii
IETEIKNLI

SEQ ID NO: 146335 - protein, 15 aa, Borrelia afzelii
AIKTIVKIYDNYTLL

SEQ ID NO: 146336 - protein, 9 aa, Borrelia afzelii
VKIYDNYTL

SEQ ID NO: 146337 - protein, 15 aa, Borrelia afzelii
DPFNHHVKRESVNNS

SEQ ID NO: 146338 - protein, 9 aa, Borrelia afzelii
FNHHVKRES

SEQ ID NO: 146339 - protein, 15 aa, Borrelia afzelii
KRKLDAIETEIKNLI

SEQ ID NO: 146340 - protein, 9 aa, Borrelia afzelii
KLDAIETEI

SEQ ID NO: 146341 - protein, 15 aa, Borrelia afzelii
EILKTKLLRERPETR

SEQ ID NO: 146342 - protein, 9 aa, Borrelia afzelii
LKTKLLRER

SEQ ID NO: 146343 - protein, 15 aa, Borrelia afzelii
ILKTKLLRERPETRK

SEQ ID NO: 146344 - protein, 9 aa, Borrelia afzelii
LLRERPETR

SEQ ID NO: 146345 - protein, 15 aa, Borrelia afzelii
LKTKLLRERPETRKE

SEQ ID NO: 146346 - protein, 9 aa, Borrelia afzelii
LLRERPETR

SEQ ID NO: 146347 - protein, 15 aa, Borrelia afzelii
KTKLLRERPETRKEE

SEQ ID NO: 146348 - protein, 9 aa, Borrelia afzelii
LLRERPETR

SEQ ID NO: 146349 - protein, 15 aa, Borrelia afzelii
TKLLRERPETRKEEI

SEQ ID NO: 146350 - protein, 9 aa, Borrelia afzelii
LLRERPETR

SEQ ID NO: 146351 - protein, 15 aa, Borrelia afzelii
KAIVRSILLMKDSLK

SEQ ID NO: 146352 - protein, 9 aa, Borrelia afzelii
IVRSILLMK

SEQ ID NO: 146353 - protein, 15 aa, Borrelia afzelii
YEAYKAIVRSILLMK

SEQ ID NO: 146354 - protein, 9 aa, Borrelia afzelii
YEAYKAIVR

SEQ ID NO: 146355 - protein, 15 aa, Borrelia afzelii
AIVRSILLMKDSLKI

SEQ ID NO: 146356 - protein, 9 aa, Borrelia afzelii
IVRSILLMK

SEQ ID NO: 146357 - protein, 15 aa, Borrelia afzelii
IVRSILLMKDSLKII

SEQ ID NO: 146358 - protein, 9 aa, Borrelia afzelii
IVRSILLMK

SEQ ID NO: 146359 - protein, 15 aa, Borrelia afzelii
AYKAIVRSILLMKDS

SEQ ID NO: 146360 - protein, 9 aa, Borrelia afzelii
IVRSILLMK

SEQ ID NO: 146361 - protein, 15 aa, Borrelia afzelii
EAYKAIVRSILLMKD

SEQ ID NO: 146362 - protein, 9 aa, Borrelia afzelii
IVRSILLMK

SEQ ID NO: 146363 - protein, 15 aa, Borrelia afzelii
YKAIVRSILLMKDSL

SEQ ID NO: 146364 - protein, 9 aa, Borrelia afzelii
IVRSILLMK

SEQ ID NO: 146365 - protein, 15 aa, Borrelia afzelii
KLLRERPETRKEEIQ

SEQ ID NO: 146366 - protein, 9 aa, Borrelia afzelii
LLRERPETR

SEQ ID NO: 146367 - protein, 15 aa, Borrelia afzelii
ETEIKNLILKIKGQS

SEQ ID NO: 146368 - protein, 9 aa, Borrelia afzelii
IKNLILKIK

SEQ ID NO: 146369 - protein, 15 aa, Borrelia afzelii
TEIKNLILKIKGQSD

SEQ ID NO: 146370 - protein, 9 aa, Borrelia afzelii
IKNLILKIK

SEQ ID NO: 146371 - protein, 15 aa, Borrelia afzelii
LLRERPETRKEEIQK

SEQ ID NO: 146372 - protein, 9 aa, Borrelia afzelii
LLRERPETR

SEQ ID NO: 146373 - protein, 15 aa, Borrelia afzelii
ISEEEILKTKLLRER

SEQ ID NO: 146374 - protein, 9 aa, Borrelia afzelii
EILKTKLLR

SEQ ID NO: 146375 - protein, 15 aa, Borrelia afzelii
SEEEILKTKLLRERP

SEQ ID NO: 146376 - protein, 9 aa, Borrelia afzelii
LKTKLLRER

SEQ ID NO: 146377 - protein, 15 aa, Borrelia afzelii
EEEILKTKLLRERPE

SEQ ID NO: 146378 - protein, 9 aa, Borrelia afzelii
LKTKLLRER

SEQ ID NO: 146379 - protein, 15 aa, Borrelia afzelii
IETEIKNLILKIKGQ

SEQ ID NO: 146380 - protein, 9 aa, Borrelia afzelii
IKNLILKIK

SEQ ID NO: 146381 - protein, 15 aa, Borrelia afzelii
EEILKTKLLRERPET

SEQ ID NO: 146382 - protein, 9 aa, Borrelia afzelii
LKTKLLRER

SEQ ID NO: 146383 - protein, 15 aa, Borrelia afzelii
AIETEIKNLILKIKG

SEQ ID NO: 146384 - protein, 9 aa, Borrelia afzelii
IKNLILKIK

SEQ ID NO: 146385 - protein, 15 aa, Borrelia afzelii
DAIETEIKNLILKIK

SEQ ID NO: 146386 - protein, 9 aa, Borrelia afzelii
TEIKNLILK

SEQ ID NO: 146387 - protein, 15 aa, Borrelia afzelii
VRSILLMKDSLKIIE

SEQ ID NO: 146388 - protein, 9 aa, Borrelia afzelii
LLMKDSLKI

SEQ ID NO: 146389 - protein, 15 aa, Borrelia afzelii
RSILLMKDSLKIIEI

SEQ ID NO: 146390 - protein, 9 aa, Borrelia afzelii
LLMKDSLKI

SEQ ID NO: 146391 - protein, 15 aa, Borrelia afzelii
ATNFVYAREIYSKRK

SEQ ID NO: 146392 - protein, 9 aa, Borrelia afzelii
VYAREIYSK

SEQ ID NO: 146393 - protein, 15 aa, Borrelia afzelii
TNFVYAREIYSKRKL

SEQ ID NO: 146394 - protein, 9 aa, Borrelia afzelii
VYAREIYSK

SEQ ID NO: 146395 - protein, 15 aa, Borrelia afzelii
KDLKTLLNYIQVSAR

SEQ ID NO: 146396 - protein, 9 aa, Borrelia afzelii
LLNYIQVSA

SEQ ID NO: 146397 - protein, 15 aa, Borrelia afzelii
TATNFVYAREIYSKR

SEQ ID NO: 146398 - protein, 9 aa, Borrelia afzelii
VYAREIYSK

SEQ ID NO: 146399 - protein, 15 aa, Borrelia afzelii
NFVYAREIYSKRKLD

SEQ ID NO: 146400 - protein, 9 aa, Borrelia afzelii
VYAREIYSK

SEQ ID NO: 146401 - protein, 15 aa, Borrelia afzelii
ILKTKLLRERPETRK

SEQ ID NO: 146402 - protein, 9 aa, Borrelia afzelii
LLRERPETR

SEQ ID NO: 146403 - protein, 15 aa, Borrelia afzelii
LKTKLLRERPETRKE

SEQ ID NO: 146404 - protein, 9 aa, Borrelia afzelii
LRERPETRK

SEQ ID NO: 146405 - protein, 15 aa, Borrelia afzelii
ATNFVYAREIYSKRK

SEQ ID NO: 146406 - protein, 9 aa, Borrelia afzelii
YAREIYSKR

SEQ ID NO: 146407 - protein, 15 aa, Borrelia afzelii
TNFVYAREIYSKRKL

SEQ ID NO: 146408 - protein, 9 aa, Borrelia afzelii
YAREIYSKR

SEQ ID NO: 146409 - protein, 15 aa, Borrelia afzelii
NFVYAREIYSKRKLD

SEQ ID NO: 146410 - protein, 9 aa, Borrelia afzelii
YAREIYSKR

SEQ ID NO: 146411 - protein, 15 aa, Borrelia afzelii
FVYAREIYSKRKLDA

SEQ ID NO: 146412 - protein, 9 aa, Borrelia afzelii
YAREIYSKR

SEQ ID NO: 146413 - protein, 15 aa, Borrelia afzelii
EILKTKLLRERPETR

SEQ ID NO: 146414 - protein, 9 aa, Borrelia afzelii
LKTKLLRER

SEQ ID NO: 146415 - protein, 15 aa, Borrelia afzelii
VYAREIYSKRKLDAI

SEQ ID NO: 146416 - protein, 9 aa, Borrelia afzelii
YAREIYSKR

SEQ ID NO: 146417 - protein, 15 aa, Borrelia afzelii
TATNFVYAREIYSKR

SEQ ID NO: 146418 - protein, 9 aa, Borrelia afzelii
VYAREIYSK

SEQ ID NO: 146419 - protein, 15 aa, Borrelia afzelii
ILKTKLLRERPETRK

SEQ ID NO: 146420 - protein, 9 aa, Borrelia afzelii
LLRERPETR

SEQ ID NO: 146421 - protein, 15 aa, Borrelia afzelii
KTKLLRERPETRKEE

SEQ ID NO: 146422 - protein, 9 aa, Borrelia afzelii
LLRERPETR

SEQ ID NO: 146423 - protein, 15 aa, Borrelia afzelii
LKTKLLRERPETRKE

SEQ ID NO: 146424 - protein, 9 aa, Borrelia afzelii
LLRERPETR

SEQ ID NO: 146425 - protein, 15 aa, Borrelia afzelii
TKLLRERPETRKEEI

SEQ ID NO: 146426 - protein, 9 aa, Borrelia afzelii
LLRERPETR

SEQ ID NO: 146427 - protein, 15 aa, Borrelia garinii
TLFSTKLTQMYSTRL

SEQ ID NO: 146428 - protein, 9 aa, Borrelia garinii
FSTKLTQMY

SEQ ID NO: 146429 - protein, 15 aa, Borrelia garinii
LFSTKLTQMYSTRLD

SEQ ID NO: 146430 - protein, 9 aa, Borrelia garinii
LTQMYSTRL

SEQ ID NO: 146431 - protein, 15 aa, Borrelia garinii
FSTKLTQMYSTRLDN

SEQ ID NO: 146432 - protein, 9 aa, Borrelia garinii
LTQMYSTRL

SEQ ID NO: 146433 - protein, 15 aa, Borrelia garinii
STKLTQMYSTRLDNL

SEQ ID NO: 146434 - protein, 9 aa, Borrelia garinii
LTQMYSTRL

SEQ ID NO: 146435 - protein, 15 aa, Borrelia garinii
TKLTQMYSTRLDNLA

SEQ ID NO: 146436 - protein, 9 aa, Borrelia garinii
LTQMYSTRL

SEQ ID NO: 146437 - protein, 15 aa, Borrelia garinii
KLTQMYSTRLDNLAK

SEQ ID NO: 146438 - protein, 9 aa, Borrelia garinii
LTQMYSTRL

SEQ ID NO: 146439 - protein, 15 aa, Borrelia garinii
LTQMYSTRLDNLAKA

SEQ ID NO: 146440 - protein, 9 aa, Borrelia garinii
LTQMYSTRL

SEQ ID NO: 146441 - protein, 15 aa, Borrelia garinii
YSAYKAIVSSILLMR

SEQ ID NO: 146442 - protein, 9 aa, Borrelia garinii
YKAIVSSIL

SEQ ID NO: 146443 - protein, 15 aa, Borrelia garinii
NLYSAYKAIVSSILL

SEQ ID NO: 146444 - protein, 9 aa, Borrelia garinii
YKAIVSSIL

SEQ ID NO: 146445 - protein, 15 aa, Borrelia garinii
LYSAYKAIVSSILLM

SEQ ID NO: 146446 - protein, 9 aa, Borrelia garinii
YKAIVSSIL

SEQ ID NO: 146447 - protein, 15 aa, Borrelia garinii
SAYKAIVSSILLMRD

SEQ ID NO: 146448 - protein, 9 aa, Borrelia garinii
YKAIVSSIL

SEQ ID NO: 146449 - protein, 15 aa, Borrelia garinii
SNLYSAYKAIVSSIL

SEQ ID NO: 146450 - protein, 9 aa, Borrelia garinii
YSAYKAIVS

SEQ ID NO: 146451 - protein, 15 aa, Borrelia garinii
YDTYTLFSTKLTQMY

SEQ ID NO: 146452 - protein, 9 aa, Borrelia garinii
YTLFSTKLT

SEQ ID NO: 146453 - protein, 15 aa, Borrelia garinii
DTYTLFSTKLTQMYS

SEQ ID NO: 146454 - protein, 9 aa, Borrelia garinii
YTLFSTKLT

SEQ ID NO: 146455 - protein, 15 aa, Borrelia garinii
KKVKSKYLALGLLFG

SEQ ID NO: 146456 - protein, 9 aa, Borrelia garinii
VKSKYLALG

SEQ ID NO: 146457 - protein, 15 aa, Borrelia garinii
IYDTYTLFSTKLTQM

SEQ ID NO: 146458 - protein, 9 aa, Borrelia garinii
YTLFSTKLT

SEQ ID NO: 146459 - protein, 15 aa, Borrelia garinii
NKIYDTYTLFSTKLT

SEQ ID NO: 146460 - protein, 9 aa, Borrelia garinii
TYTLFSTKL

SEQ ID NO: 146461 - protein, 15 aa, Borrelia garinii
KIYDTYTLFSTKLTQ

SEQ ID NO: 146462 - protein, 9 aa, Borrelia garinii
YTLFSTKLT

SEQ ID NO: 146463 - protein, 15 aa, Borrelia garinii
TYTLFSTKLTQMYST

SEQ ID NO: 146464 - protein, 9 aa, Borrelia garinii
YTLFSTKLT

SEQ ID NO: 146465 - protein, 15 aa, Borrelia garinii
KVKSKYLALGLLFGF

SEQ ID NO: 146466 - protein, 9 aa, Borrelia garinii
YLALGLLFG

SEQ ID NO: 146467 - protein, 15 aa, Borrelia garinii
VKSKYLALGLLFGFI

SEQ ID NO: 146468 - protein, 9 aa, Borrelia garinii
YLALGLLFG

SEQ ID NO: 146469 - protein, 15 aa, Borrelia garinii
KSKYLALGLLFGFIS

SEQ ID NO: 146470 - protein, 9 aa, Borrelia garinii
YLALGLLFG

SEQ ID NO: 146471 - protein, 15 aa, Borrelia garinii
SKYLALGLLFGFISC

SEQ ID NO: 146472 - protein, 9 aa, Borrelia garinii
YLALGLLFG

SEQ ID NO: 146473 - protein, 15 aa, Borrelia garinii
YTLFSTKLTQMYSTR

SEQ ID NO: 146474 - protein, 9 aa, Borrelia garinii
YTLFSTKLT

SEQ ID NO: 146475 - protein, 15 aa, Borrelia garinii
AYKAIVSSILLMRDS

SEQ ID NO: 146476 - protein, 9 aa, Borrelia garinii
YKAIVSSIL

SEQ ID NO: 146477 - protein, 15 aa, Borrelia garinii
YKAIVSSILLMRDSL

SEQ ID NO: 146478 - protein, 9 aa, Borrelia garinii
YKAIVSSIL

SEQ ID NO: 146479 - protein, 15 aa, Borrelia garinii
HSFKRDAANKSNFLQ

SEQ ID NO: 146480 - protein, 9 aa, Borrelia garinii
FKRDAANKS

SEQ ID NO: 146481 - protein, 15 aa, Borrelia garinii
IHSFKRDAANKSNFL

SEQ ID NO: 146482 - protein, 9 aa, Borrelia garinii
FKRDAANKS

SEQ ID NO: 146483 - protein, 15 aa, Borrelia garinii
DEYKGMTKGSLNSLS

SEQ ID NO: 146484 - protein, 9 aa, Borrelia garinii
MTKGSLNSL

SEQ ID NO: 146485 - protein, 15 aa, Borrelia garinii
PFIHSFKRDAANKSN

SEQ ID NO: 146486 - protein, 9 aa, Borrelia garinii
FKRDAANKS

SEQ ID NO: 146487 - protein, 15 aa, Borrelia garinii
MKKVKSKYLALGLLF

SEQ ID NO: 146488 - protein, 9 aa, Borrelia garinii
VKSKYLALG

SEQ ID NO: 146489 - protein, 15 aa, Borrelia garinii
QDEYKGMTKGSLNSL

SEQ ID NO: 146490 - protein, 9 aa, Borrelia garinii
YKGMTKGSL

SEQ ID NO: 146491 - protein, 15 aa, Borrelia garinii
EPFIHSFKRDAANKS

SEQ ID NO: 146492 - protein, 9 aa, Borrelia garinii
FIHSFKRDA

SEQ ID NO: 146493 - protein, 15 aa, Borrelia garinii
FIHSFKRDAANKSNF

SEQ ID NO: 146494 - protein, 9 aa, Borrelia garinii
FKRDAANKS

SEQ ID NO: 146495 - protein, 15 aa, Borrelia garinii
GMTKGSLNSLSGESG

SEQ ID NO: 146496 - protein, 9 aa, Borrelia garinii
MTKGSLNSL

SEQ ID NO: 146497 - protein, 15 aa, Borrelia garinii
EYKGMTKGSLNSLSG

SEQ ID NO: 146498 - protein, 9 aa, Borrelia garinii
MTKGSLNSL

SEQ ID NO: 146499 - protein, 15 aa, Borrelia garinii
YKGMTKGSLNSLSGE

SEQ ID NO: 146500 - protein, 9 aa, Borrelia garinii
MTKGSLNSL

SEQ ID NO: 146501 - protein, 15 aa, Borrelia garinii
MTKGSLNSLSGESGE

SEQ ID NO: 146502 - protein, 9 aa, Borrelia garinii
LNSLSGESG

SEQ ID NO: 146503 - protein, 15 aa, Borrelia garinii
YLALGLLFGFISCDL

SEQ ID NO: 146504 - protein, 9 aa, Borrelia garinii
YLALGLLFG

SEQ ID NO: 146505 - protein, 15 aa, Borrelia garinii
ENIEAKIKTLIAKIK

SEQ ID NO: 146506 - protein, 9 aa, Borrelia garinii
EAKIKTLIA

SEQ ID NO: 146507 - protein, 15 aa, Borrelia garinii
NIEAKIKTLIAKIKE

SEQ ID NO: 146508 - protein, 9 aa, Borrelia garinii
IKTLIAKIK

SEQ ID NO: 146509 - protein, 15 aa, Borrelia garinii
EAKIKTLIAKIKEKS

SEQ ID NO: 146510 - protein, 9 aa, Borrelia garinii
IKTLIAKIK

SEQ ID NO: 146511 - protein, 15 aa, Borrelia garinii
AKIKTLIAKIKEKSN

SEQ ID NO: 146512 - protein, 9 aa, Borrelia garinii
IKTLIAKIK

SEQ ID NO: 146513 - protein, 15 aa, Borrelia garinii
IEAKIKTLIAKIKEK

SEQ ID NO: 146514 - protein, 9 aa, Borrelia garinii
IKTLIAKIK

SEQ ID NO: 146515 - protein, 15 aa, Borrelia garinii
KYLALGLLFGFISCD

SEQ ID NO: 146516 - protein, 9 aa, Borrelia garinii
YLALGLLFG

SEQ ID NO: 146517 - protein, 15 aa, Borrelia garinii
FKTLLNYIQVSVKTA

SEQ ID NO: 146518 - protein, 9 aa, Borrelia garinii
FKTLLNYIQ

SEQ ID NO: 146519 - protein, 15 aa, Borrelia garinii
KGSLNSLSGESGELK

SEQ ID NO: 146520 - protein, 9 aa, Borrelia garinii
LNSLSGESG

SEQ ID NO: 146521 - protein, 15 aa, Borrelia garinii
LLNYIQVSVKTATNF

SEQ ID NO: 146522 - protein, 9 aa, Borrelia garinii
YIQVSVKTA

SEQ ID NO: 146523 - protein, 15 aa, Borrelia garinii
TKGSLNSLSGESGEL

SEQ ID NO: 146524 - protein, 9 aa, Borrelia garinii
LNSLSGESG

SEQ ID NO: 146525 - protein, 15 aa, Borrelia garinii
LNYIQVSVKTATNFV

SEQ ID NO: 146526 - protein, 9 aa, Borrelia garinii
YIQVSVKTA

SEQ ID NO: 146527 - protein, 15 aa, Borrelia garinii
KGMTKGSLNSLSGES

SEQ ID NO: 146528 - protein, 9 aa, Borrelia garinii
MTKGSLNSL

SEQ ID NO: 146529 - protein, 15 aa, Borrelia garinii
GSLNSLSGESGELKE

SEQ ID NO: 146530 - protein, 9 aa, Borrelia garinii
LNSLSGESG

SEQ ID NO: 146531 - protein, 15 aa, Borrelia garinii
EKNFKTLLNYIQVSV

SEQ ID NO: 146532 - protein, 9 aa, Borrelia garinii
FKTLLNYIQ

SEQ ID NO: 146533 - protein, 15 aa, Borrelia garinii
TLLNYIQVSVKTATN

SEQ ID NO: 146534 - protein, 9 aa, Borrelia garinii
YIQVSVKTA

SEQ ID NO: 146535 - protein, 15 aa, Borrelia garinii
KNFKTLLNYIQVSVK

SEQ ID NO: 146536 - protein, 9 aa, Borrelia garinii
FKTLLNYIQ

SEQ ID NO: 146537 - protein, 15 aa, Borrelia garinii
KTLLNYIQVSVKTAT

SEQ ID NO: 146538 - protein, 9 aa, Borrelia garinii
YIQVSVKTA

SEQ ID NO: 146539 - protein, 15 aa, Borrelia garinii
DLEKNFKTLLNYIQV

SEQ ID NO: 146540 - protein, 9 aa, Borrelia garinii
FKTLLNYIQ

SEQ ID NO: 146541 - protein, 15 aa, Borrelia garinii
EDLEKNFKTLLNYIQ

SEQ ID NO: 146542 - protein, 9 aa, Borrelia garinii
EKNFKTLLN

SEQ ID NO: 146543 - protein, 15 aa, Borrelia garinii
SFKRDAANKSNFLQK

SEQ ID NO: 146544 - protein, 9 aa, Borrelia garinii
FKRDAANKS

SEQ ID NO: 146545 - protein, 15 aa, Borrelia garinii
INKIYDTYTLFSTKL

SEQ ID NO: 146546 - protein, 9 aa, Borrelia garinii
YDTYTLFST

SEQ ID NO: 146547 - protein, 15 aa, Borrelia garinii
QQDEYKGMTKGSLNS

SEQ ID NO: 146548 - protein, 9 aa, Borrelia garinii
YKGMTKGSL

SEQ ID NO: 146549 - protein, 15 aa, Borrelia garinii
FKRDAANKSNFLQKN

SEQ ID NO: 146550 - protein, 9 aa, Borrelia garinii
FKRDAANKS

SEQ ID NO: 146551 - protein, 15 aa, Borrelia garinii
EGVKYNVDSAINTIN

SEQ ID NO: 146552 - protein, 9 aa, Borrelia garinii
YNVDSAINT

SEQ ID NO: 146553 - protein, 15 aa, Borrelia garinii
LEKNFKTLLNYIQVS

SEQ ID NO: 146554 - protein, 9 aa, Borrelia garinii
FKTLLNYIQ

SEQ ID NO: 146555 - protein, 15 aa, Borrelia garinii
GVKYNVDSAINTINK

SEQ ID NO: 146556 - protein, 9 aa, Borrelia garinii
YNVDSAINT

SEQ ID NO: 146557 - protein, 15 aa, Borrelia garinii
LEGVKYNVDSAINTI

SEQ ID NO: 146558 - protein, 9 aa, Borrelia garinii
YNVDSAINT

SEQ ID NO: 146559 - protein, 15 aa, Borrelia garinii
YLEGVKYNVDSAINT

SEQ ID NO: 146560 - protein, 9 aa, Borrelia garinii
VKYNVDSAI

SEQ ID NO: 146561 - protein, 15 aa, Borrelia garinii
NYIQVSVKTATNFVY

SEQ ID NO: 146562 - protein, 9 aa, Borrelia garinii
YIQVSVKTA

SEQ ID NO: 146563 - protein, 15 aa, Borrelia garinii
VKYNVDSAINTINKI

SEQ ID NO: 146564 - protein, 9 aa, Borrelia garinii
YNVDSAINT

SEQ ID NO: 146565 - protein, 15 aa, Borrelia garinii
SSLQDIAGSNSISYT

SEQ ID NO: 146566 - protein, 9 aa, Borrelia garinii
IAGSNSISY

SEQ ID NO: 146567 - protein, 15 aa, Borrelia garinii
KSSLQDIAGSNSISY

SEQ ID NO: 146568 - protein, 9 aa, Borrelia garinii
LQDIAGSNS

SEQ ID NO: 146569 - protein, 15 aa, Borrelia garinii
EKSNLYSAYKAIVSS

SEQ ID NO: 146570 - protein, 9 aa, Borrelia garinii
YSAYKAIVS

SEQ ID NO: 146571 - protein, 15 aa, Borrelia garinii
KSNLYSAYKAIVSSI

SEQ ID NO: 146572 - protein, 9 aa, Borrelia garinii
YSAYKAIVS

SEQ ID NO: 146573 - protein, 15 aa, Borrelia garinii
ITIDSDLRPKSSLQD

SEQ ID NO: 146574 - protein, 9 aa, Borrelia garinii
DSDLRPKSS

SEQ ID NO: 146575 - protein, 15 aa, Borrelia garinii
KEKSNLYSAYKAIVS

SEQ ID NO: 146576 - protein, 9 aa, Borrelia garinii
LYSAYKAIV

SEQ ID NO: 146577 - protein, 15 aa, Borrelia garinii
TIDSDLRPKSSLQDI

SEQ ID NO: 146578 - protein, 9 aa, Borrelia garinii
LRPKSSLQD

SEQ ID NO: 146579 - protein, 15 aa, Borrelia garinii
DSDLRPKSSLQDIAG

SEQ ID NO: 146580 - protein, 9 aa, Borrelia garinii
LRPKSSLQD

SEQ ID NO: 146581 - protein, 15 aa, Borrelia garinii
NFKTLLNYIQVSVKT

SEQ ID NO: 146582 - protein, 9 aa, Borrelia garinii
FKTLLNYIQ

SEQ ID NO: 146583 - protein, 15 aa, Borrelia garinii
IDSDLRPKSSLQDIA

SEQ ID NO: 146584 - protein, 9 aa, Borrelia garinii
LRPKSSLQD

SEQ ID NO: 146585 - protein, 15 aa, Borrelia garinii
NTINKIYDTYTLFST

SEQ ID NO: 146586 - protein, 9 aa, Borrelia garinii
INKIYDTYT

SEQ ID NO: 146587 - protein, 15 aa, Borrelia garinii
YIQVSVKTATNFVYI

SEQ ID NO: 146588 - protein, 9 aa, Borrelia garinii
YIQVSVKTA

SEQ ID NO: 146589 - protein, 15 aa, Borrelia garinii
KQQDEYKGMTKGSLN

SEQ ID NO: 146590 - protein, 9 aa, Borrelia garinii
YKGMTKGSL

SEQ ID NO: 146591 - protein, 15 aa, Borrelia garinii
SDLRPKSSLQDIAGS

SEQ ID NO: 146592 - protein, 9 aa, Borrelia garinii
LRPKSSLQD

SEQ ID NO: 146593 - protein, 15 aa, Borrelia garinii
QKQQDEYKGMTKGSL

SEQ ID NO: 146594 - protein, 9 aa, Borrelia garinii
QKQQDEYKG

SEQ ID NO: 146595 - protein, 15 aa, Borrelia garinii
SLQDIAGSNSISYTD

SEQ ID NO: 146596 - protein, 9 aa, Borrelia garinii
IAGSNSISY

SEQ ID NO: 146597 - protein, 15 aa, Borrelia garinii
LRPKSSLQDIAGSNS

SEQ ID NO: 146598 - protein, 9 aa, Borrelia garinii
LRPKSSLQD

SEQ ID NO: 146599 - protein, 15 aa, Borrelia garinii
LQDIAGSNSISYTDE

SEQ ID NO: 146600 - protein, 9 aa, Borrelia garinii
IAGSNSISY

SEQ ID NO: 146601 - protein, 15 aa, Borrelia garinii
KIKTLIAKIKEKSNL

SEQ ID NO: 146602 - protein, 9 aa, Borrelia garinii
IKTLIAKIK

SEQ ID NO: 146603 - protein, 15 aa, Borrelia garinii
IKTLIAKIKEKSNLY

SEQ ID NO: 146604 - protein, 9 aa, Borrelia garinii
IKTLIAKIK

SEQ ID NO: 146605 - protein, 15 aa, Borrelia garinii
TINKIYDTYTLFSTK

SEQ ID NO: 146606 - protein, 9 aa, Borrelia garinii
YDTYTLFST

SEQ ID NO: 146607 - protein, 15 aa, Borrelia garinii
QMYSTRLDNLAKAKA

SEQ ID NO: 146608 - protein, 9 aa, Borrelia garinii
YSTRLDNLA

SEQ ID NO: 146609 - protein, 15 aa, Borrelia garinii
KAIVSSILLMRDSLK

SEQ ID NO: 146610 - protein, 9 aa, Borrelia garinii
IVSSILLMR

SEQ ID NO: 146611 - protein, 15 aa, Borrelia garinii
TNFVYINEMHAKRKL

SEQ ID NO: 146612 - protein, 9 aa, Borrelia garinii
INEMHAKRK

SEQ ID NO: 146613 - protein, 15 aa, Borrelia garinii
ATNFVYINEMHAKRK

SEQ ID NO: 146614 - protein, 9 aa, Borrelia garinii
FVYINEMHA

SEQ ID NO: 146615 - protein, 15 aa, Borrelia garinii
SLNSLSGESGELKET

SEQ ID NO: 146616 - protein, 9 aa, Borrelia garinii
LNSLSGESG

SEQ ID NO: 146617 - protein, 15 aa, Borrelia garinii
LNSLSGESGELKETI

SEQ ID NO: 146618 - protein, 9 aa, Borrelia garinii
LNSLSGESG

SEQ ID NO: 146619 - protein, 15 aa, Borrelia garinii
FVYINEMHAKRKLEN

SEQ ID NO: 146620 - protein, 9 aa, Borrelia garinii
INEMHAKRK

SEQ ID NO: 146621 - protein, 15 aa, Borrelia garinii
NFVYINEMHAKRKLE

SEQ ID NO: 146622 - protein, 9 aa, Borrelia garinii
INEMHAKRK

SEQ ID NO: 146623 - protein, 15 aa, Borrelia garinii
AIVSSILLMRDSLKE

SEQ ID NO: 146624 - protein, 9 aa, Borrelia garinii
VSSILLMRD

SEQ ID NO: 146625 - protein, 15 aa, Borrelia garinii
QDIAGSNSISYTDEI

SEQ ID NO: 146626 - protein, 9 aa, Borrelia garinii
IAGSNSISY

SEQ ID NO: 146627 - protein, 15 aa, Borrelia garinii
NEIDITIDSDLRPKS

SEQ ID NO: 146628 - protein, 9 aa, Borrelia garinii
ITIDSDLRP

SEQ ID NO: 146629 - protein, 15 aa, Borrelia garinii
EIDITIDSDLRPKSS

SEQ ID NO: 146630 - protein, 9 aa, Borrelia garinii
ITIDSDLRP

SEQ ID NO: 146631 - protein, 15 aa, Borrelia garinii
IDITIDSDLRPKSSL

SEQ ID NO: 146632 - protein, 9 aa, Borrelia garinii
ITIDSDLRP

SEQ ID NO: 146633 - protein, 15 aa, Borrelia garinii
ITIDSDLRPKSSLQD

SEQ ID NO: 146634 - protein, 9 aa, Borrelia garinii
IDSDLRPKS

SEQ ID NO: 146635 - protein, 15 aa, Borrelia garinii
DITIDSDLRPKSSLQ

SEQ ID NO: 146636 - protein, 9 aa, Borrelia garinii
IDSDLRPKS

SEQ ID NO: 146637 - protein, 15 aa, Borrelia garinii
PFIHSFKRDAANKSN

SEQ ID NO: 146638 - protein, 9 aa, Borrelia garinii
FKRDAANKS

SEQ ID NO: 146639 - protein, 15 aa, Borrelia garinii
EPFIHSFKRDAANKS

SEQ ID NO: 146640 - protein, 9 aa, Borrelia garinii
IHSFKRDAA

SEQ ID NO: 146641 - protein, 15 aa, Borrelia garinii
FIHSFKRDAANKSNF

SEQ ID NO: 146642 - protein, 9 aa, Borrelia garinii
FKRDAANKS

SEQ ID NO: 146643 - protein, 15 aa, Borrelia garinii
HSFKRDAANKSNFLQ

SEQ ID NO: 146644 - protein, 9 aa, Borrelia garinii
FKRDAANKS

SEQ ID NO: 146645 - protein, 15 aa, Borrelia garinii
IHSFKRDAANKSNFL

SEQ ID NO: 146646 - protein, 9 aa, Borrelia garinii
FKRDAANKS

SEQ ID NO: 146647 - protein, 15 aa, Borrelia garinii
SFKRDAANKSNFLQK

SEQ ID NO: 146648 - protein, 9 aa, Borrelia garinii
FKRDAANKS

SEQ ID NO: 146649 - protein, 15 aa, Borrelia garinii
FKRDAANKSNFLQKN

SEQ ID NO: 146650 - protein, 9 aa, Borrelia garinii
FKRDAANKS

SEQ ID NO: 146651 - protein, 15 aa, Borrelia garinii
TATNFVYINEMHAKR

SEQ ID NO: 146652 - protein, 9 aa, Borrelia garinii
FVYINEMHA

SEQ ID NO: 146653 - protein, 15 aa, Borrelia garinii
TNFVYINEMHAKRKL

SEQ ID NO: 146654 - protein, 9 aa, Borrelia garinii
FVYINEMHA

SEQ ID NO: 146655 - protein, 15 aa, Borrelia garinii
ATNFVYINEMHAKRK

SEQ ID NO: 146656 - protein, 9 aa, Borrelia garinii
FVYINEMHA

SEQ ID NO: 146657 - protein, 15 aa, Borrelia garinii
KTATNFVYINEMHAK

SEQ ID NO: 146658 - protein, 9 aa, Borrelia garinii
FVYINEMHA

SEQ ID NO: 146659 - protein, 15 aa, Borrelia garinii
VKTATNFVYINEMHA

SEQ ID NO: 146660 - protein, 9 aa, Borrelia garinii
TNFVYINEM

SEQ ID NO: 146661 - protein, 15 aa, Borrelia garinii
KTLIAKIKEKSNLYS

SEQ ID NO: 146662 - protein, 9 aa, Borrelia garinii
KIKEKSNLY

SEQ ID NO: 146663 - protein, 15 aa, Borrelia garinii
IKTLIAKIKEKSNLY

SEQ ID NO: 146664 - protein, 9 aa, Borrelia garinii
LIAKIKEKS

SEQ ID NO: 146665 - protein, 15 aa, Borrelia garinii
TLIAKIKEKSNLYSA

SEQ ID NO: 146666 - protein, 9 aa, Borrelia garinii
KIKEKSNLY

SEQ ID NO: 146667 - protein, 15 aa, Borrelia garinii
LIAKIKEKSNLYSAY

SEQ ID NO: 146668 - protein, 9 aa, Borrelia garinii
KIKEKSNLY

SEQ ID NO: 146669 - protein, 15 aa, Borrelia garinii
IAKIKEKSNLYSAYK

SEQ ID NO: 146670 - protein, 9 aa, Borrelia garinii
KIKEKSNLY

SEQ ID NO: 146671 - protein, 15 aa, Borrelia garinii
NKIYDTYTLFSTKLT

SEQ ID NO: 146672 - protein, 9 aa, Borrelia garinii
IYDTYTLFS

SEQ ID NO: 146673 - protein, 15 aa, Borrelia garinii
FKTLLNYIQVSVKTA

SEQ ID NO: 146674 - protein, 9 aa, Borrelia garinii
NYIQVSVKT

SEQ ID NO: 146675 - protein, 15 aa, Borrelia garinii
TINKIYDTYTLFSTK

SEQ ID NO: 146676 - protein, 9 aa, Borrelia garinii
IYDTYTLFS

SEQ ID NO: 146677 - protein, 15 aa, Borrelia garinii
NTINKIYDTYTLFST

SEQ ID NO: 146678 - protein, 9 aa, Borrelia garinii
IYDTYTLFS

SEQ ID NO: 146679 - protein, 15 aa, Borrelia garinii
INTINKIYDTYTLFS

SEQ ID NO: 146680 - protein, 9 aa, Borrelia garinii
INKIYDTYT

SEQ ID NO: 146681 - protein, 15 aa, Borrelia garinii
INKIYDTYTLFSTKL

SEQ ID NO: 146682 - protein, 9 aa, Borrelia garinii
IYDTYTLFS

SEQ ID NO: 146683 - protein, 15 aa, Borrelia garinii
FVYINEMHAKRKLEN

SEQ ID NO: 146684 - protein, 9 aa, Borrelia garinii
FVYINEMHA

SEQ ID NO: 146685 - protein, 15 aa, Borrelia garinii
NFKTLLNYIQVSVKT

SEQ ID NO: 146686 - protein, 9 aa, Borrelia garinii
FKTLLNYIQ

SEQ ID NO: 146687 - protein, 15 aa, Borrelia garinii
NFVYINEMHAKRKLE

SEQ ID NO: 146688 - protein, 9 aa, Borrelia garinii
FVYINEMHA

SEQ ID NO: 146689 - protein, 15 aa, Borrelia garinii
LLNYIQVSVKTATNF

SEQ ID NO: 146690 - protein, 9 aa, Borrelia garinii
NYIQVSVKT

SEQ ID NO: 146691 - protein, 15 aa, Borrelia garinii
TLLNYIQVSVKTATN

SEQ ID NO: 146692 - protein, 9 aa, Borrelia garinii
NYIQVSVKT

SEQ ID NO: 146693 - protein, 15 aa, Borrelia garinii
SAYKAIVSSILLMRD

SEQ ID NO: 146694 - protein, 9 aa, Borrelia garinii
YKAIVSSIL

SEQ ID NO: 146695 - protein, 15 aa, Borrelia garinii
YSAYKAIVSSILLMR

SEQ ID NO: 146696 - protein, 9 aa, Borrelia garinii
YKAIVSSIL

SEQ ID NO: 146697 - protein, 15 aa, Borrelia garinii
KTLLNYIQVSVKTAT

SEQ ID NO: 146698 - protein, 9 aa, Borrelia garinii
NYIQVSVKT

SEQ ID NO: 146699 - protein, 15 aa, Borrelia garinii
ATNFVYINEMHAKRK

SEQ ID NO: 146700 - protein, 9 aa, Borrelia garinii
FVYINEMHA

SEQ ID NO: 146701 - protein, 15 aa, Borrelia garinii
TNFVYINEMHAKRKL

SEQ ID NO: 146702 - protein, 9 aa, Borrelia garinii
FVYINEMHA

SEQ ID NO: 146703 - protein, 15 aa, Borrelia garinii
TATNFVYINEMHAKR

SEQ ID NO: 146704 - protein, 9 aa, Borrelia garinii
FVYINEMHA

SEQ ID NO: 146705 - protein, 15 aa, Borrelia garinii
EDLEKNFKTLLNYIQ

SEQ ID NO: 146706 - protein, 9 aa, Borrelia garinii
EKNFKTLLN

SEQ ID NO: 146707 - protein, 15 aa, Borrelia garinii
DLEKNFKTLLNYIQV

SEQ ID NO: 146708 - protein, 9 aa, Borrelia garinii
EKNFKTLLN

SEQ ID NO: 146709 - protein, 15 aa, Borrelia garinii
FTKEDLEKNFKTLLN

SEQ ID NO: 146710 - protein, 9 aa, Borrelia garinii
LEKNFKTLL

SEQ ID NO: 146711 - protein, 15 aa, Borrelia garinii
TKEDLEKNFKTLLNY

SEQ ID NO: 146712 - protein, 9 aa, Borrelia garinii
EKNFKTLLN

SEQ ID NO: 146713 - protein, 15 aa, Borrelia garinii
NKIYDTYTLFSTKLT

SEQ ID NO: 146714 - protein, 9 aa, Borrelia garinii
IYDTYTLFS

SEQ ID NO: 146715 - protein, 15 aa, Borrelia garinii
KEDLEKNFKTLLNYI

SEQ ID NO: 146716 - protein, 9 aa, Borrelia garinii
EKNFKTLLN

SEQ ID NO: 146717 - protein, 15 aa, Borrelia garinii
LEKNFKTLLNYIQVS

SEQ ID NO: 146718 - protein, 9 aa, Borrelia garinii
EKNFKTLLN

SEQ ID NO: 146719 - protein, 15 aa, Borrelia garinii
EKNFKTLLNYIQVSV

SEQ ID NO: 146720 - protein, 9 aa, Borrelia garinii
EKNFKTLLN

SEQ ID NO: 146721 - protein, 15 aa, Borrelia garinii
IYDTYTLFSTKLTQM

SEQ ID NO: 146722 - protein, 9 aa, Borrelia garinii
YTLFSTKLT

SEQ ID NO: 146723 - protein, 15 aa, Borrelia garinii
KIYDTYTLFSTKLTQ

SEQ ID NO: 146724 - protein, 9 aa, Borrelia garinii
YTLFSTKLT

SEQ ID NO: 146725 - protein, 15 aa, Borrelia garinii
INTINKIYDTYTLFS

SEQ ID NO: 146726 - protein, 9 aa, Borrelia garinii
INTINKIYD

SEQ ID NO: 146727 - protein, 15 aa, Borrelia garinii
YDTYTLFSTKLTQMY

SEQ ID NO: 146728 - protein, 9 aa, Borrelia garinii
YTLFSTKLT

SEQ ID NO: 146729 - protein, 15 aa, Borrelia garinii
ITIDSDLRPKSSLQD

SEQ ID NO: 146730 - protein, 9 aa, Borrelia garinii
ITIDSDLRP

SEQ ID NO: 146731 - protein, 15 aa, Borrelia garinii
DTYTLFSTKLTQMYS

SEQ ID NO: 146732 - protein, 9 aa, Borrelia garinii
YTLFSTKLT

SEQ ID NO: 146733 - protein, 15 aa, Borrelia garinii
TIDSDLRPKSSLQDI

SEQ ID NO: 146734 - protein, 9 aa, Borrelia garinii
LRPKSSLQD

SEQ ID NO: 146735 - protein, 15 aa, Borrelia garinii
IDSDLRPKSSLQDIA

SEQ ID NO: 146736 - protein, 9 aa, Borrelia garinii
LRPKSSLQD

SEQ ID NO: 146737 - protein, 15 aa, Borrelia garinii
LYSAYKAIVSSILLM

SEQ ID NO: 146738 - protein, 9 aa, Borrelia garinii
YKAIVSSIL

SEQ ID NO: 146739 - protein, 15 aa, Borrelia garinii
YSAYKAIVSSILLMR

SEQ ID NO: 146740 - protein, 9 aa, Borrelia garinii
YKAIVSSIL

SEQ ID NO: 146741 - protein, 15 aa, Borrelia garinii
SAYKAIVSSILLMRD

SEQ ID NO: 146742 - protein, 9 aa, Borrelia garinii
YKAIVSSIL

SEQ ID NO: 146743 - protein, 15 aa, Borrelia garinii
NLYSAYKAIVSSILL

SEQ ID NO: 146744 - protein, 9 aa, Borrelia garinii
YKAIVSSIL

SEQ ID NO: 146745 - protein, 15 aa, Borrelia garinii
SNLYSAYKAIVSSIL

SEQ ID NO: 146746 - protein, 9 aa, Borrelia garinii
YSAYKAIVS

SEQ ID NO: 146747 - protein, 15 aa, Borrelia garinii
YIQVSVKTATNFVYI

SEQ ID NO: 146748 - protein, 9 aa, Borrelia garinii
VKTATNFVY

SEQ ID NO: 146749 - protein, 15 aa, Borrelia garinii
IQVSVKTATNFVYIN

SEQ ID NO: 146750 - protein, 9 aa, Borrelia garinii
VKTATNFVY

SEQ ID NO: 146751 - protein, 15 aa, Borrelia garinii
NYIQVSVKTATNFVY

SEQ ID NO: 146752 - protein, 9 aa, Borrelia garinii
SVKTATNFV

SEQ ID NO: 146753 - protein, 15 aa, Borrelia garinii
QVSVKTATNFVYINE

SEQ ID NO: 146754 - protein, 9 aa, Borrelia garinii
VKTATNFVY

SEQ ID NO: 146755 - protein, 15 aa, Borrelia garinii
VSVKTATNFVYINEM

SEQ ID NO: 146756 - protein, 9 aa, Borrelia garinii
VKTATNFVY

SEQ ID NO: 146757 - protein, 15 aa, Borrelia garinii
AYKAIVSSILLMRDS

SEQ ID NO: 146758 - protein, 9 aa, Borrelia garinii
YKAIVSSIL

SEQ ID NO: 146759 - protein, 15 aa, Borrelia garinii
YKAIVSSILLMRDSL

SEQ ID NO: 146760 - protein, 9 aa, Borrelia garinii
YKAIVSSIL

SEQ ID NO: 146761 - protein, 15 aa, Borrelia garinii
SVKTATNFVYINEMH

SEQ ID NO: 146762 - protein, 9 aa, Borrelia garinii
VKTATNFVY

SEQ ID NO: 146763 - protein, 15 aa, Borrelia garinii
LNYIQVSVKTATNFV

SEQ ID NO: 146764 - protein, 9 aa, Borrelia garinii
VSVKTATNF

SEQ ID NO: 146765 - protein, 15 aa, Borrelia garinii
VKTATNFVYINEMHA

SEQ ID NO: 146766 - protein, 9 aa, Borrelia garinii
VKTATNFVY

SEQ ID NO: 146767 - protein, 15 aa, Borrelia garinii
ESIKKPMNKKGKGKI

SEQ ID NO: 146768 - protein, 9 aa, Borrelia garinii
SIKKPMNKK

SEQ ID NO: 146769 - protein, 15 aa, Borrelia garinii
SNLYSAYKAIVSSIL

SEQ ID NO: 146770 - protein, 9 aa, Borrelia garinii
YSAYKAIVS

SEQ ID NO: 146771 - protein, 15 aa, Borrelia garinii
LYSAYKAIVSSILLM

SEQ ID NO: 146772 - protein, 9 aa, Borrelia garinii
YKAIVSSIL

SEQ ID NO: 146773 - protein, 15 aa, Borrelia garinii
YSAYKAIVSSILLMR

SEQ ID NO: 146774 - protein, 9 aa, Borrelia garinii
AIVSSILLM

SEQ ID NO: 146775 - protein, 15 aa, Borrelia garinii
YDTYTLFSTKLTQMY

SEQ ID NO: 146776 - protein, 9 aa, Borrelia garinii
YTLFSTKLT

SEQ ID NO: 146777 - protein, 15 aa, Borrelia garinii
DTYTLFSTKLTQMYS

SEQ ID NO: 146778 - protein, 9 aa, Borrelia garinii
YTLFSTKLT

SEQ ID NO: 146779 - protein, 15 aa, Borrelia garinii
IYDTYTLFSTKLTQM

SEQ ID NO: 146780 - protein, 9 aa, Borrelia garinii
YTLFSTKLT

SEQ ID NO: 146781 - protein, 15 aa, Borrelia garinii
NLYSAYKAIVSSILL

SEQ ID NO: 146782 - protein, 9 aa, Borrelia garinii
YSAYKAIVS

SEQ ID NO: 146783 - protein, 15 aa, Borrelia garinii
KIYDTYTLFSTKLTQ

SEQ ID NO: 146784 - protein, 9 aa, Borrelia garinii
YTLFSTKLT

SEQ ID NO: 146785 - protein, 15 aa, Borrelia garinii
NKIYDTYTLFSTKLT

SEQ ID NO: 146786 - protein, 9 aa, Borrelia garinii
IYDTYTLFS

SEQ ID NO: 146787 - protein, 15 aa, Borrelia garinii
NYIQVSVKTATNFVY

SEQ ID NO: 146788 - protein, 9 aa, Borrelia garinii
IQVSVKTAT

SEQ ID NO: 146789 - protein, 15 aa, Borrelia garinii
KTLLNYIQVSVKTAT

SEQ ID NO: 146790 - protein, 9 aa, Borrelia garinii
LLNYIQVSV

SEQ ID NO: 146791 - protein, 15 aa, Borrelia garinii
YDTYTLFSTKLTQMY

SEQ ID NO: 146792 - protein, 9 aa, Borrelia garinii
YTLFSTKLT

SEQ ID NO: 146793 - protein, 15 aa, Borrelia garinii
DTYTLFSTKLTQMYS

SEQ ID NO: 146794 - protein, 9 aa, Borrelia garinii
YTLFSTKLT

SEQ ID NO: 146795 - protein, 15 aa, Borrelia garinii
TLLNYIQVSVKTATN

SEQ ID NO: 146796 - protein, 9 aa, Borrelia garinii
IQVSVKTAT

SEQ ID NO: 146797 - protein, 15 aa, Borrelia garinii
LLNYIQVSVKTATNF

SEQ ID NO: 146798 - protein, 9 aa, Borrelia garinii
IQVSVKTAT

SEQ ID NO: 146799 - protein, 15 aa, Borrelia garinii
LNYIQVSVKTATNFV

SEQ ID NO: 146800 - protein, 9 aa, Borrelia garinii
IQVSVKTAT

SEQ ID NO: 146801 - protein, 15 aa, Borrelia garinii
IYDTYTLFSTKLTQM

SEQ ID NO: 146802 - protein, 9 aa, Borrelia garinii
YTLFSTKLT

SEQ ID NO: 146803 - protein, 15 aa, Borrelia garinii
YIQVSVKTATNFVYI

SEQ ID NO: 146804 - protein, 9 aa, Borrelia garinii
IQVSVKTAT

SEQ ID NO: 146805 - protein, 15 aa, Borrelia garinii
IQVSVKTATNFVYIN

SEQ ID NO: 146806 - protein, 9 aa, Borrelia garinii
IQVSVKTAT

SEQ ID NO: 146807 - protein, 15 aa, Borrelia garinii
NKIYDTYTLFSTKLT

SEQ ID NO: 146808 - protein, 9 aa, Borrelia garinii
NKIYDTYTL

SEQ ID NO: 146809 - protein, 15 aa, Borrelia garinii
ENIEAKIKTLIAKIK

SEQ ID NO: 146810 - protein, 9 aa, Borrelia garinii
IEAKIKTLI

SEQ ID NO: 146811 - protein, 15 aa, Borrelia garinii
KIYDTYTLFSTKLTQ

SEQ ID NO: 146812 - protein, 9 aa, Borrelia garinii
YTLFSTKLT

SEQ ID NO: 146813 - protein, 15 aa, Borrelia garinii
NIEAKIKTLIAKIKE

SEQ ID NO: 146814 - protein, 9 aa, Borrelia garinii
IKTLIAKIK

SEQ ID NO: 146815 - protein, 15 aa, Borrelia garinii
IEAKIKTLIAKIKEK

SEQ ID NO: 146816 - protein, 9 aa, Borrelia garinii
IKTLIAKIK

SEQ ID NO: 146817 - protein, 15 aa, Borrelia garinii
YTLFSTKLTQMYSTR

SEQ ID NO: 146818 - protein, 9 aa, Borrelia garinii
YTLFSTKLT

SEQ ID NO: 146819 - protein, 15 aa, Borrelia garinii
TYTLFSTKLTQMYST

SEQ ID NO: 146820 - protein, 9 aa, Borrelia garinii
YTLFSTKLT

SEQ ID NO: 146821 - protein, 15 aa, Borrelia garinii
SAYKAIVSSILLMRD

SEQ ID NO: 146822 - protein, 9 aa, Borrelia garinii
IVSSILLMR

SEQ ID NO: 146823 - protein, 15 aa, Borrelia garinii
KNFKTLLNYIQVSVK

SEQ ID NO: 146824 - protein, 9 aa, Borrelia garinii
LLNYIQVSV

SEQ ID NO: 146825 - protein, 15 aa, Borrelia garinii
YSAYKAIVSSILLMR

SEQ ID NO: 146826 - protein, 9 aa, Borrelia garinii
YKAIVSSIL

SEQ ID NO: 146827 - protein, 15 aa, Borrelia garinii
FKTLLNYIQVSVKTA

SEQ ID NO: 146828 - protein, 9 aa, Borrelia garinii
LLNYIQVSV

SEQ ID NO: 146829 - protein, 15 aa, Borrelia garinii
EKNFKTLLNYIQVSV

SEQ ID NO: 146830 - protein, 9 aa, Borrelia garinii
FKTLLNYIQ

SEQ ID NO: 146831 - protein, 15 aa, Borrelia garinii
EAKIKTLIAKIKEKS

SEQ ID NO: 146832 - protein, 9 aa, Borrelia garinii
IKTLIAKIK

SEQ ID NO: 146833 - protein, 15 aa, Borrelia garinii
NFKTLLNYIQVSVKT

SEQ ID NO: 146834 - protein, 9 aa, Borrelia garinii
LNYIQVSVK

SEQ ID NO: 146835 - protein, 15 aa, Borrelia garinii
AKIKTLIAKIKEKSN

SEQ ID NO: 146836 - protein, 9 aa, Borrelia garinii
IKTLIAKIK

SEQ ID NO: 146837 - protein, 15 aa, Borrelia garinii
AYKAIVSSILLMRDS

SEQ ID NO: 146838 - protein, 9 aa, Borrelia garinii
IVSSILLMR

SEQ ID NO: 146839 - protein, 15 aa, Borrelia garinii
DYEEIRLSNRYQSYL

SEQ ID NO: 146840 - protein, 9 aa, Borrelia garinii
IRLSNRYQS

SEQ ID NO: 146841 - protein, 15 aa, Borrelia garinii
KSKYLALGLLFGFIS

SEQ ID NO: 146842 - protein, 9 aa, Borrelia garinii
YLALGLLFG

SEQ ID NO: 146843 - protein, 15 aa, Borrelia garinii
YKAIVSSILLMRDSL

SEQ ID NO: 146844 - protein, 9 aa, Borrelia garinii
IVSSILLMR

SEQ ID NO: 146845 - protein, 15 aa, Borrelia garinii
YEEIRLSNRYQSYLE

SEQ ID NO: 146846 - protein, 9 aa, Borrelia garinii
IRLSNRYQS

SEQ ID NO: 146847 - protein, 15 aa, Borrelia garinii
DDYEEIRLSNRYQSY

SEQ ID NO: 146848 - protein, 9 aa, Borrelia garinii
IRLSNRYQS

SEQ ID NO: 146849 - protein, 15 aa, Borrelia garinii
EDDYEEIRLSNRYQS

SEQ ID NO: 146850 - protein, 9 aa, Borrelia garinii
EEIRLSNRY

SEQ ID NO: 146851 - protein, 15 aa, Borrelia garinii
SKYLALGLLFGFISC

SEQ ID NO: 146852 - protein, 9 aa, Borrelia garinii
LGLLFGFIS

SEQ ID NO: 146853 - protein, 15 aa, Borrelia garinii
EEIRLSNRYQSYLEG

SEQ ID NO: 146854 - protein, 9 aa, Borrelia garinii
IRLSNRYQS

SEQ ID NO: 146855 - protein, 15 aa, Borrelia garinii
ANKSNFLQKNVMLEE

SEQ ID NO: 146856 - protein, 9 aa, Borrelia garinii
SNFLQKNVM

SEQ ID NO: 146857 - protein, 15 aa, Borrelia garinii
EDLEKNFKTLLNYIQ

SEQ ID NO: 146858 - protein, 9 aa, Borrelia garinii
EKNFKTLLN

SEQ ID NO: 146859 - protein, 15 aa, Borrelia garinii
NKSNFLQKNVMLEEE

SEQ ID NO: 146860 - protein, 9 aa, Borrelia garinii
SNFLQKNVM

SEQ ID NO: 146861 - protein, 15 aa, Borrelia garinii
KYLALGLLFGFISCD

SEQ ID NO: 146862 - protein, 9 aa, Borrelia garinii
LGLLFGFIS

SEQ ID NO: 146863 - protein, 15 aa, Borrelia garinii
VDSAINTINKIYDTY

SEQ ID NO: 146864 - protein, 9 aa, Borrelia garinii
INTINKIYD

SEQ ID NO: 146865 - protein, 15 aa, Borrelia garinii
YNVDSAINTINKIYD

SEQ ID NO: 146866 - protein, 9 aa, Borrelia garinii
SAINTINKI

SEQ ID NO: 146867 - protein, 15 aa, Borrelia garinii
DLEKNFKTLLNYIQV

SEQ ID NO: 146868 - protein, 9 aa, Borrelia garinii
FKTLLNYIQ

SEQ ID NO: 146869 - protein, 15 aa, Borrelia garinii
LALGLLFGFISCDLF

SEQ ID NO: 146870 - protein, 9 aa, Borrelia garinii
LGLLFGFIS

SEQ ID NO: 146871 - protein, 15 aa, Borrelia garinii
SAINTINKIYDTYTL

SEQ ID NO: 146872 - protein, 9 aa, Borrelia garinii
INTINKIYD

SEQ ID NO: 146873 - protein, 15 aa, Borrelia garinii
KAIVSSILLMRDSLK

SEQ ID NO: 146874 - protein, 9 aa, Borrelia garinii
IVSSILLMR

SEQ ID NO: 146875 - protein, 15 aa, Borrelia garinii
YLALGLLFGFISCDL

SEQ ID NO: 146876 - protein, 9 aa, Borrelia garinii
LGLLFGFIS

SEQ ID NO: 146877 - protein, 15 aa, Borrelia garinii
NVDSAINTINKIYDT

SEQ ID NO: 146878 - protein, 9 aa, Borrelia garinii
INTINKIYD

SEQ ID NO: 146879 - protein, 15 aa, Borrelia garinii
DSAINTINKIYDTYT

SEQ ID NO: 146880 - protein, 9 aa, Borrelia garinii
INTINKIYD

SEQ ID NO: 146881 - protein, 15 aa, Borrelia garinii
RKLENIEAKIKTLIA

SEQ ID NO: 146882 - protein, 9 aa, Borrelia garinii
IEAKIKTLI

SEQ ID NO: 146883 - protein, 15 aa, Borrelia garinii
KLENIEAKIKTLIAK

SEQ ID NO: 146884 - protein, 9 aa, Borrelia garinii
IEAKIKTLI

SEQ ID NO: 146885 - protein, 15 aa, Borrelia garinii
KRKLENIEAKIKTLI

SEQ ID NO: 146886 - protein, 9 aa, Borrelia garinii
ENIEAKIKT

SEQ ID NO: 146887 - protein, 15 aa, Borrelia garinii
LEKNFKTLLNYIQVS

SEQ ID NO: 146888 - protein, 9 aa, Borrelia garinii
FKTLLNYIQ

SEQ ID NO: 146889 - protein, 15 aa, Borrelia garinii
LENIEAKIKTLIAKI

SEQ ID NO: 146890 - protein, 9 aa, Borrelia garinii
IEAKIKTLI

SEQ ID NO: 146891 - protein, 15 aa, Borrelia garinii
LYSAYKAIVSSILLM

SEQ ID NO: 146892 - protein, 9 aa, Borrelia garinii
YKAIVSSIL

SEQ ID NO: 146893 - protein, 15 aa, Borrelia garinii
IKTLIAKIKEKSNLY

SEQ ID NO: 146894 - protein, 9 aa, Borrelia garinii
IKTLIAKIK

SEQ ID NO: 146895 - protein, 15 aa, Borrelia garinii
KSNFLQKNVMLEEES

SEQ ID NO: 146896 - protein, 9 aa, Borrelia garinii
SNFLQKNVM

SEQ ID NO: 146897 - protein, 15 aa, Borrelia garinii
KAIVSSILLMRDSLK

SEQ ID NO: 146898 - protein, 9 aa, Borrelia garinii
IVSSILLMR

SEQ ID NO: 146899 - protein, 15 aa, Borrelia garinii
IVSSILLMRDSLKEV

SEQ ID NO: 146900 - protein, 9 aa, Borrelia garinii
IVSSILLMR

SEQ ID NO: 146901 - protein, 15 aa, Borrelia garinii
AIVSSILLMRDSLKE

SEQ ID NO: 146902 - protein, 9 aa, Borrelia garinii
IVSSILLMR

SEQ ID NO: 146903 - protein, 15 aa, Borrelia garinii
YSAYKAIVSSILLMR

SEQ ID NO: 146904 - protein, 9 aa, Borrelia garinii
YKAIVSSIL

SEQ ID NO: 146905 - protein, 15 aa, Borrelia garinii
SAYKAIVSSILLMRD

SEQ ID NO: 146906 - protein, 9 aa, Borrelia garinii
IVSSILLMR

SEQ ID NO: 146907 - protein, 15 aa, Borrelia garinii
AYKAIVSSILLMRDS

SEQ ID NO: 146908 - protein, 9 aa, Borrelia garinii
IVSSILLMR

SEQ ID NO: 146909 - protein, 15 aa, Borrelia garinii
YKAIVSSILLMRDSL

SEQ ID NO: 146910 - protein, 9 aa, Borrelia garinii
IVSSILLMR

SEQ ID NO: 146911 - protein, 15 aa, Borrelia garinii
KKGKGKIARKNGKSK

SEQ ID NO: 146912 - protein, 9 aa, Borrelia garinii
KKGKGKIAR

SEQ ID NO: 146913 - protein, 15 aa, Borrelia garinii
VSSILLMRDSLKEVQ

SEQ ID NO: 146914 - protein, 9 aa, Borrelia garinii
ILLMRDSLK

SEQ ID NO: 146915 - protein, 15 aa, Borrelia garinii
SSILLMRDSLKEVQY

SEQ ID NO: 146916 - protein, 9 aa, Borrelia garinii
ILLMRDSLK

SEQ ID NO: 146917 - protein, 15 aa, Borrelia garinii
GKGKIARKNGKSKVS

SEQ ID NO: 146918 - protein, 9 aa, Borrelia garinii
IARKNGKSK

SEQ ID NO: 146919 - protein, 15 aa, Borrelia garinii
KGKIARKNGKSKVSG

SEQ ID NO: 146920 - protein, 9 aa, Borrelia garinii
IARKNGKSK

SEQ ID NO: 146921 - protein, 15 aa, Borrelia garinii
GKSKVSGKEPFIHSF

SEQ ID NO: 146922 - protein, 9 aa, Borrelia garinii
VSGKEPFIH

SEQ ID NO: 146923 - protein, 15 aa, Borrelia garinii
KNGKSKVSGKEPFIH

SEQ ID NO: 146924 - protein, 9 aa, Borrelia garinii
SKVSGKEPF

SEQ ID NO: 146925 - protein, 15 aa, Borrelia garinii
NGKSKVSGKEPFIHS

SEQ ID NO: 146926 - protein, 9 aa, Borrelia garinii
VSGKEPFIH

SEQ ID NO: 146927 - protein, 15 aa, Borrelia garinii
KSKVSGKEPFIHSFK

SEQ ID NO: 146928 - protein, 9 aa, Borrelia garinii
VSGKEPFIH

SEQ ID NO: 146929 - protein, 15 aa, Borrelia garinii
SKVSGKEPFIHSFKR

SEQ ID NO: 146930 - protein, 9 aa, Borrelia garinii
VSGKEPFIH

SEQ ID NO: 146931 - protein, 15 aa, Borrelia garinii
VSGKEPFIHSFKRDA

SEQ ID NO: 146932 - protein, 9 aa, Borrelia garinii
VSGKEPFIH

SEQ ID NO: 146933 - protein, 15 aa, Borrelia garinii
ATNFVYINEMHAKRK

SEQ ID NO: 146934 - protein, 9 aa, Borrelia garinii
YINEMHAKR

SEQ ID NO: 146935 - protein, 15 aa, Borrelia garinii
TNFVYINEMHAKRKL

SEQ ID NO: 146936 - protein, 9 aa, Borrelia garinii
INEMHAKRK

SEQ ID NO: 146937 - protein, 15 aa, Borrelia garinii
NFVYINEMHAKRKLE

SEQ ID NO: 146938 - protein, 9 aa, Borrelia garinii
INEMHAKRK

SEQ ID NO: 146939 - protein, 15 aa, Borrelia garinii
FVYINEMHAKRKLEN

SEQ ID NO: 146940 - protein, 9 aa, Borrelia garinii
INEMHAKRK

SEQ ID NO: 146941 - protein, 15 aa, Borrelia garinii
VYINEMHAKRKLENI

SEQ ID NO: 146942 - protein, 9 aa, Borrelia garinii
INEMHAKRK

SEQ ID NO: 146943 - protein, 15 aa, Borrelia garinii
YINEMHAKRKLENIE

SEQ ID NO: 146944 - protein, 9 aa, Borrelia garinii
INEMHAKRK

SEQ ID NO: 146945 - protein, 15 aa, Borrelia garinii
KTELLKEQSETRKEK

SEQ ID NO: 146946 - protein, 9 aa, Borrelia garinii
LLKEQSETR

SEQ ID NO: 146947 - protein, 15 aa, Borrelia garinii
TELLKEQSETRKEKI

SEQ ID NO: 146948 - protein, 9 aa, Borrelia garinii
LLKEQSETR

SEQ ID NO: 146949 - protein, 15 aa, Borrelia garinii
TSEESIKKPMNKKGK

SEQ ID NO: 146950 - protein, 9 aa, Borrelia garinii
IKKPMNKKG

SEQ ID NO: 146951 - protein, 15 aa, Borrelia garinii
SEESIKKPMNKKGKG

SEQ ID NO: 146952 - protein, 9 aa, Borrelia garinii
KKPMNKKGK

SEQ ID NO: 146953 - protein, 15 aa, Borrelia garinii
SLKTELLKEQSETRK

SEQ ID NO: 146954 - protein, 9 aa, Borrelia garinii
LLKEQSETR

SEQ ID NO: 146955 - protein, 15 aa, Borrelia garinii
LKTELLKEQSETRKE

SEQ ID NO: 146956 - protein, 9 aa, Borrelia garinii
LLKEQSETR

SEQ ID NO: 146957 - protein, 15 aa, Borrelia garinii
ESIKKPMNKKGKGKI

SEQ ID NO: 146958 - protein, 9 aa, Borrelia garinii
KKPMNKKGK

SEQ ID NO: 146959 - protein, 15 aa, Borrelia garinii
EESIKKPMNKKGKGK

SEQ ID NO: 146960 - protein, 9 aa, Borrelia garinii
KKPMNKKGK

SEQ ID NO: 146961 - protein, 15 aa, Borrelia garinii
ELLKEQSETRKEKIQ

SEQ ID NO: 146962 - protein, 9 aa, Borrelia garinii
LKEQSETRK

SEQ ID NO: 146963 - protein, 240 aa, Borrelia Burgdorferi
MKKSFLSIYMLISISLLSCDVSRLNQRNIDELKIFVEKAKYYSIKLDAIYSEYTGAYNDIMTYIMTYSEGTSSDKSKVNQAISILKKDNKIVNKFKELEKIIEEYKPMFLSKLIDDFAIELDQAVDNDVSNARHVADSYEKLRKSVALAYIESFDVISSKFVDSKFVEASKKFVNKAKEFVEENDLIALKCIVKTIGDMVNDREINSRSRYNNFYKKEADFLGAAVELEGAYKAIKQTLL

SEQ ID NO: 146964 - protein, 255 aa, Borrelia garinii
MKKTKLNIIKLNILTTILTLICISCAVDKIDPESKSKTNTKDFENKSQDLEPSNTKNKDLEPLEKNSKETIISKLEKMIKDLEDQKDQEDTEIAKITNTQIDFLENFKSEPHDTISEDIEMKIKRIIYSSLNYEIEKINTLKEILDKLYKNHKYKTTARNFILNISIKIQFQIENALELMKEEIEDASEILNQERYEILLKHVEPSLNLKQKFEKILNETIKAYNQDLDNIKSNEDQLAHMDENYKEFDPLNLDY

SEQ ID NO: 146965 - protein, 506 aa, BORRELIA GARINII PBI
MKYKKIRINLNLKRKSGILLNISSLPSKYGIGDLGKGAYKFIDFLFASSQSYWQMFAYSPIDFTRSPPYSIFSAFAGNVYYIDLEALDKFIDSDLNLLKENETRYSDLKKLSFKDKFLKEAALNFINRASVDEVRSFEKFKKKSSYWLLDFASFVAFKEYFLKDSRDAFNVLFDRGILIRNEKDLFKLRNILSKEIKVQEVLQYFFFSQFQALKRYANDKGIELVMNLPLFIAYDSADVWAHQKYFKLRFDASKDKVAGISPDYFLEQEQAWDSPAYSWNVLKNVKYEWWAKRIGILRKYIDVIKIDHFRGFVSTWEVGVGEAYAFNGLWVKSPGRDFFNFILNEIKDLKIWVEDFENDLEDVSRLRDFFNFPGMRIMKLAFDFDSDNQNLPHNYIKNCIVYTGIGDNSTIREFVNSLDDLHKKYIFDYLNTNEDFVVWDMIRSAMSSVSDSVIIPMQDYINLGNEFRANIPKNTLNNWIFRLLESDLDATLSKNISFITRLYGRT

SEQ ID NO: 146966 - protein, 273 aa, BORRELIA AFZELII
MKKYLLGIGLILALIACKQNVSSLDEKNSASVDLPGEMKVLVSKEKDKDGKYSLKATVDKIELKGTSDKDNGSGVLEGTKDDKSKAKLTIADDLSKTTFELFKEDGKTLVSRKVSSKDKTSTDEMFNEKGELSAKTMTRENGTKLEYTEMKSDGTGKAKEVLKNFTLEGKVANDKVTLEVKEGTVTLSKEIAKSGEVTVALNDTNTTQATKKTGAWDSKTSTLTISVNSKKTTQLVFTKQDTITVQKYDSAGTNLEGTAVEIKTLDELKNALK

SEQ ID NO: 146967 - protein, 274 aa, BORRELIA GARINII
MKKYLLGIGLILALIACKQNVSSLDEKNSVSVDLPGGMKVLVSKEKDKDGKYSLMATVEKLELKGTSDKNNGSGTLEGEKTDKSKVKLTIAEDLSKTTFEIFKEDGKTLVSKKVTLKDKSSTEEKFNEKGEISEKTIVRANGTRLEYTDIKSDGSGKAKEVLKDFTLEGTLAADGKTTLKVTEGTVVLSKNILKSGEITVALDDSDTTQATKKTGKWDSKTSTLTISVNSQKTKNLVFTKEDTITVQKYDSAGTNLEGKAVEITTLEKLKDALK

SEQ ID NO: 146968 - protein, 299 aa, BORRELIA AFZELII PKO
MKQYLLVFALVLALIACSQKGTEPKSTSQDHNDQEIINSDNTPKDSKKDLTVLAEENSVPLFNGNKIFVSKEKNSAGKYELRATVDTVELKGVSDKNNGSGKLEGTKADKTKVAMTIADDLNTITVETYDASNKKTGSEVVKKQGSVIKESYKANKLDSKKITRENETTLEYSEMTDSSNATKAVETLKNGIKLEGSLVGGKTTVKLTEGTITLTREIEQDGKVKIYLNDTTSGSTKKTATWNETTNTLTISADSKKTKDFVFLTDGTITVQAYDTAGTKLEGNSSEIKDLAALKAALK

SEQ ID NO: 146969 - protein, 296 aa, BORRELIA BURGDORFERI B31
  Xaa can be any naturally occurring amino acid
  VARIANT 147: Xaa = Any Amino Acid
MRLLIGFALALALIGCAQKGAESIGSQKENDLNLEDSSKKSHQNAKQDLPAVTEDSVSLFNGNKIFVSKEKNSSGKYDLRATIDQVELKGTSDKNNGSGTLEGSKPDKSKVKLTVSADLNTVTLEAFDASNQKISSKVTKKQGSITXETLKANKLDSKKLTRSNGTTLEYSQITDADNATKAVETLKNSIKLEGSLVGGKTTVEIKEGTVTLKREIEKDGKVKVFLNDTAGSNKKTGKWEDSTSTLTISADSKKTKDLVFLTDGTITVQQYNTAGTSLEGSASEIKNLSELKNALK

SEQ ID NO: 146970 - protein, 199 aa, BORRELIA GARINII
ILMTLFLFISCNNSGGDTASTNPDESAKGPNLTVISKKITDSNAFVLAVKEVEALISSIDELANKAIGKVIHQNNGLNANAGQNGSLLAGAYAISTLITEKLSKLKNSEELNKKIEEAKNHSEAFTNRLKGSHAQLGVAAATDDHAKEAILKSNPTKDKGAKELKDLSESVESLAKAAQEALANSVKELTNPVVAESPK

SEQ ID NO: 146971 - protein, 210 aa, BORRELIA BURGDORFERI B31
MKKNTLSAILMTLFLFISCNNSGKDGNTSANSADESVKGPNLTEISKKITDSNAVLLAVKEVEALLSSIDEIAAKAIGKKIHQNNGLDTENNHNGSLLAGAYAISTLIKQKLDGLKNEGLKEKIDAAKKCSETFTNKLKEKHTDLGKEGVTDADAKEAILKTNGTKTKGAEELGKLFESVEVLSKAAKEMLANSVKELTSPVVAESPKKP

SEQ ID NO: 146972 - protein, 293 aa, BORRELIA GARINII
MKKISSAIFIVAFLALIGCKNNVGGDDKKDTAASIFYQSIINLGNGFIEVFNAFSGLVADAFSKADPKKSDVKTYFDSITKTLKDTKTKLEDISKEKTGGEKTPAVEGIAEVVKTVGEWLDGLIKAAEGGGKAADGGGSDKIGNVAAGGGAGADKESVNGIAGAIKGIVEAAKKVEGVKFAPKAAADAAAADGNKKAGKLFGTAAGADAGDVKDAAAAVGAVSGEQILNAIVTAAGQAGQAGKKADEAKNAIEAAIGAAGDADFGDDIKKKNDQIAAALVLRGVAKDGKFAGA

SEQ ID NO: 146973 - protein, 298 aa, BORRELIA AFZELII PKO
MKKISSAIFLTALLVFINCKNNAVGKGNDDKDSVKTFYESIINLGNGFIDVFNAFSGLVADTFFKSDPKKSDVKTYFESISSTLKATKGKLDELVSAKKGEGGSVKASVESAVDEVSKWLEEMIKAAEEAAKVGGTGGDGKIGDSAANHGAKADKDSVKGIAKGIKGIVDAAGKALGEKGALKDVKAAADDEANADAGKLFAGNANAAVGAAADIAKAAGAVTAVSGEQILKAIVEAAGDPANQAGKKAEEAKNPIAAAIGTDDDNGAAFKDEMKKSDKIAAAIVLRGVAKDGKFAVK

SEQ ID NO: 146974 - protein, 8 aa, BORRELIA BURGDORFERI
MKKSFLSI

SEQ ID NO: 146975 - protein, 8 aa, BORRELIA BURGDORFERI
KKSFLSIY

SEQ ID NO: 146976 - protein, 8 aa, BORRELIA BURGDORFERI
KSFLSIYM

SEQ ID NO: 146977 - protein, 8 aa, BORRELIA BURGDORFERI
SFLSIYML

SEQ ID NO: 146978 - protein, 8 aa, BORRELIA BURGDORFERI
FLSIYMLI

SEQ ID NO: 146979 - protein, 8 aa, BORRELIA BURGDORFERI
LSIYMLIS

SEQ ID NO: 146980 - protein, 8 aa, BORRELIA BURGDORFERI
SIYMLISI

SEQ ID NO: 146981 - protein, 8 aa, BORRELIA BURGDORFERI
IYMLISIS

SEQ ID NO: 146982 - protein, 8 aa, BORRELIA BURGDORFERI
YMLISISL

SEQ ID NO: 146983 - protein, 8 aa, BORRELIA BURGDORFERI
MLISISLL

SEQ ID NO: 146984 - protein, 8 aa, BORRELIA BURGDORFERI
LISISLLS

SEQ ID NO: 146985 - protein, 8 aa, BORRELIA BURGDORFERI
ISISLLSC

SEQ ID NO: 146986 - protein, 8 aa, BORRELIA BURGDORFERI
SISLLSCD

SEQ ID NO: 146987 - protein, 8 aa, BORRELIA BURGDORFERI
ISLLSCDV

SEQ ID NO: 146988 - protein, 8 aa, BORRELIA BURGDORFERI
SLLSCDVS

SEQ ID NO: 146989 - protein, 8 aa, BORRELIA BURGDORFERI
LLSCDVSR

SEQ ID NO: 146990 - protein, 8 aa, BORRELIA BURGDORFERI
LSCDVSRL

SEQ ID NO: 146991 - protein, 8 aa, BORRELIA BURGDORFERI
SCDVSRLN

SEQ ID NO: 146992 - protein, 8 aa, BORRELIA BURGDORFERI
CDVSRLNQ

SEQ ID NO: 146993 - protein, 8 aa, BORRELIA BURGDORFERI
DVSRLNQR

SEQ ID NO: 146994 - protein, 8 aa, BORRELIA BURGDORFERI
VSRLNQRN

SEQ ID NO: 146995 - protein, 8 aa, BORRELIA BURGDORFERI
SRLNQRNI

SEQ ID NO: 146996 - protein, 8 aa, BORRELIA BURGDORFERI
RLNQRNID

SEQ ID NO: 146997 - protein, 8 aa, BORRELIA BURGDORFERI
LNQRNIDE

SEQ ID NO: 146998 - protein, 8 aa, BORRELIA BURGDORFERI
NQRNIDEL

SEQ ID NO: 146999 - protein, 8 aa, BORRELIA BURGDORFERI
QRNIDELK

SEQ ID NO: 147000 - protein, 8 aa, BORRELIA BURGDORFERI
RNIDELKI

SEQ ID NO: 147001 - protein, 8 aa, BORRELIA BURGDORFERI
NIDELKIF

SEQ ID NO: 147002 - protein, 8 aa, BORRELIA BURGDORFERI
IDELKIFV

SEQ ID NO: 147003 - protein, 8 aa, BORRELIA BURGDORFERI
DELKIFVE

SEQ ID NO: 147004 - protein, 8 aa, BORRELIA BURGDORFERI
ELKIFVEK

SEQ ID NO: 147005 - protein, 8 aa, BORRELIA BURGDORFERI
LKIFVEKA

SEQ ID NO: 147006 - protein, 8 aa, BORRELIA BURGDORFERI
KIFVEKAK

SEQ ID NO: 147007 - protein, 8 aa, BORRELIA BURGDORFERI
IFVEKAKY

SEQ ID NO: 147008 - protein, 8 aa, BORRELIA BURGDORFERI
FVEKAKYY

SEQ ID NO: 147009 - protein, 8 aa, BORRELIA BURGDORFERI
VEKAKYYS

SEQ ID NO: 147010 - protein, 8 aa, BORRELIA BURGDORFERI
EKAKYYSI

SEQ ID NO: 147011 - protein, 8 aa, BORRELIA BURGDORFERI
KAKYYSIK

SEQ ID NO: 147012 - protein, 8 aa, BORRELIA BURGDORFERI
AKYYSIKL

SEQ ID NO: 147013 - protein, 8 aa, BORRELIA BURGDORFERI
KYYSIKLD

SEQ ID NO: 147014 - protein, 8 aa, BORRELIA BURGDORFERI
YYSIKLDA

SEQ ID NO: 147015 - protein, 8 aa, BORRELIA BURGDORFERI
YSIKLDAI

SEQ ID NO: 147016 - protein, 8 aa, BORRELIA BURGDORFERI
SIKLDAIY

SEQ ID NO: 147017 - protein, 8 aa, BORRELIA BURGDORFERI
IKLDAIYS

SEQ ID NO: 147018 - protein, 8 aa, BORRELIA BURGDORFERI
KLDAIYSE

SEQ ID NO: 147019 - protein, 8 aa, BORRELIA BURGDORFERI
LDAIYSEY

SEQ ID NO: 147020 - protein, 8 aa, BORRELIA BURGDORFERI
DAIYSEYT

SEQ ID NO: 147021 - protein, 8 aa, BORRELIA BURGDORFERI
AIYSEYTG

SEQ ID NO: 147022 - protein, 8 aa, BORRELIA BURGDORFERI
IYSEYTGA

SEQ ID NO: 147023 - protein, 8 aa, BORRELIA BURGDORFERI
YSEYTGAY

SEQ ID NO: 147024 - protein, 8 aa, BORRELIA BURGDORFERI
SEYTGAYN

SEQ ID NO: 147025 - protein, 8 aa, BORRELIA BURGDORFERI
EYTGAYND

SEQ ID NO: 147026 - protein, 8 aa, BORRELIA BURGDORFERI
YTGAYNDI

SEQ ID NO: 147027 - protein, 8 aa, BORRELIA BURGDORFERI
TGAYNDIM

SEQ ID NO: 147028 - protein, 8 aa, BORRELIA BURGDORFERI
GAYNDIMT

SEQ ID NO: 147029 - protein, 8 aa, BORRELIA BURGDORFERI
AYNDIMTY

SEQ ID NO: 147030 - protein, 8 aa, BORRELIA BURGDORFERI
YNDIMTYI

SEQ ID NO: 147031 - protein, 8 aa, BORRELIA BURGDORFERI
NDIMTYIM

SEQ ID NO: 147032 - protein, 8 aa, BORRELIA BURGDORFERI
DIMTYIMT

SEQ ID NO: 147033 - protein, 8 aa, BORRELIA BURGDORFERI
IMTYIMTY

SEQ ID NO: 147034 - protein, 8 aa, BORRELIA BURGDORFERI
MTYIMTYS

SEQ ID NO: 147035 - protein, 8 aa, BORRELIA BURGDORFERI
TYIMTYSE

SEQ ID NO: 147036 - protein, 8 aa, BORRELIA BURGDORFERI
YIMTYSEG

SEQ ID NO: 147037 - protein, 8 aa, BORRELIA BURGDORFERI
IMTYSEGT

SEQ ID NO: 147038 - protein, 8 aa, BORRELIA BURGDORFERI
MTYSEGTS

SEQ ID NO: 147039 - protein, 8 aa, BORRELIA BURGDORFERI
TYSEGTSS

SEQ ID NO: 147040 - protein, 8 aa, BORRELIA BURGDORFERI
YSEGTSSD

SEQ ID NO: 147041 - protein, 8 aa, BORRELIA BURGDORFERI
SEGTSSDK

SEQ ID NO: 147042 - protein, 8 aa, BORRELIA BURGDORFERI
EGTSSDKS

SEQ ID NO: 147043 - protein, 8 aa, BORRELIA BURGDORFERI
GTSSDKSK

SEQ ID NO: 147044 - protein, 8 aa, BORRELIA BURGDORFERI
TSSDKSKV

SEQ ID NO: 147045 - protein, 8 aa, BORRELIA BURGDORFERI
SSDKSKVN

SEQ ID NO: 147046 - protein, 8 aa, BORRELIA BURGDORFERI
SDKSKVNQ

SEQ ID NO: 147047 - protein, 8 aa, BORRELIA BURGDORFERI
DKSKVNQA

SEQ ID NO: 147048 - protein, 8 aa, BORRELIA BURGDORFERI
KSKVNQAI

SEQ ID NO: 147049 - protein, 8 aa, BORRELIA BURGDORFERI
SKVNQAIS

SEQ ID NO: 147050 - protein, 8 aa, BORRELIA BURGDORFERI
KVNQAISI

SEQ ID NO: 147051 - protein, 8 aa, BORRELIA BURGDORFERI
VNQAISIL

SEQ ID NO: 147052 - protein, 8 aa, BORRELIA BURGDORFERI
NQAISILK

SEQ ID NO: 147053 - protein, 8 aa, BORRELIA BURGDORFERI
QAISILKK

SEQ ID NO: 147054 - protein, 8 aa, BORRELIA BURGDORFERI
AISILKKD

SEQ ID NO: 147055 - protein, 8 aa, BORRELIA BURGDORFERI
ISILKKDN

SEQ ID NO: 147056 - protein, 8 aa, BORRELIA BURGDORFERI
SILKKDNK

SEQ ID NO: 147057 - protein, 8 aa, BORRELIA BURGDORFERI
ILKKDNKI

SEQ ID NO: 147058 - protein, 8 aa, BORRELIA BURGDORFERI
LKKDNKIV

SEQ ID NO: 147059 - protein, 8 aa, BORRELIA BURGDORFERI
KKDNKIVN

SEQ ID NO: 147060 - protein, 8 aa, BORRELIA BURGDORFERI
KDNKIVNK

SEQ ID NO: 147061 - protein, 8 aa, BORRELIA BURGDORFERI
DNKIVNKF

SEQ ID NO: 147062 - protein, 8 aa, BORRELIA BURGDORFERI
NKIVNKFK

SEQ ID NO: 147063 - protein, 8 aa, BORRELIA BURGDORFERI
KIVNKFKE

SEQ ID NO: 147064 - protein, 8 aa, BORRELIA BURGDORFERI
IVNKFKEL

SEQ ID NO: 147065 - protein, 8 aa, BORRELIA BURGDORFERI
VNKFKELE

SEQ ID NO: 147066 - protein, 8 aa, BORRELIA BURGDORFERI
NKFKELEK

SEQ ID NO: 147067 - protein, 8 aa, BORRELIA BURGDORFERI
KFKELEKI

SEQ ID NO: 147068 - protein, 8 aa, BORRELIA BURGDORFERI
FKELEKII

SEQ ID NO: 147069 - protein, 8 aa, BORRELIA BURGDORFERI
KELEKIIE

SEQ ID NO: 147070 - protein, 8 aa, BORRELIA BURGDORFERI
ELEKIIEE

SEQ ID NO: 147071 - protein, 8 aa, BORRELIA BURGDORFERI
LEKIIEEY

SEQ ID NO: 147072 - protein, 8 aa, BORRELIA BURGDORFERI
EKIIEEYK

SEQ ID NO: 147073 - protein, 8 aa, BORRELIA BURGDORFERI
KIIEEYKP

SEQ ID NO: 147074 - protein, 8 aa, BORRELIA BURGDORFERI
IIEEYKPM

SEQ ID NO: 147075 - protein, 8 aa, BORRELIA BURGDORFERI
IEEYKPMF

SEQ ID NO: 147076 - protein, 8 aa, BORRELIA BURGDORFERI
EEYKPMFL

SEQ ID NO: 147077 - protein, 8 aa, BORRELIA BURGDORFERI
EYKPMFLS

SEQ ID NO: 147078 - protein, 8 aa, BORRELIA BURGDORFERI
YKPMFLSK

SEQ ID NO: 147079 - protein, 8 aa, BORRELIA BURGDORFERI
KPMFLSKL

SEQ ID NO: 147080 - protein, 8 aa, BORRELIA BURGDORFERI
PMFLSKLI

SEQ ID NO: 147081 - protein, 8 aa, BORRELIA BURGDORFERI
MFLSKLID

SEQ ID NO: 147082 - protein, 8 aa, BORRELIA BURGDORFERI
FLSKLIDD

SEQ ID NO: 147083 - protein, 8 aa, BORRELIA BURGDORFERI
LSKLIDDF

SEQ ID NO: 147084 - protein, 8 aa, BORRELIA BURGDORFERI
SKLIDDFA

SEQ ID NO: 147085 - protein, 8 aa, BORRELIA BURGDORFERI
KLIDDFAI

SEQ ID NO: 147086 - protein, 8 aa, BORRELIA BURGDORFERI
LIDDFAIE

SEQ ID NO: 147087 - protein, 8 aa, BORRELIA BURGDORFERI
IDDFAIEL

SEQ ID NO: 147088 - protein, 8 aa, BORRELIA BURGDORFERI
DDFAIELD

SEQ ID NO: 147089 - protein, 8 aa, BORRELIA BURGDORFERI
DFAIELDQ

SEQ ID NO: 147090 - protein, 8 aa, BORRELIA BURGDORFERI
FAIELDQA

SEQ ID NO: 147091 - protein, 8 aa, BORRELIA BURGDORFERI
AIELDQAV

SEQ ID NO: 147092 - protein, 8 aa, BORRELIA BURGDORFERI
IELDQAVD

SEQ ID NO: 147093 - protein, 8 aa, BORRELIA BURGDORFERI
ELDQAVDN

SEQ ID NO: 147094 - protein, 8 aa, BORRELIA BURGDORFERI
LDQAVDND

SEQ ID NO: 147095 - protein, 8 aa, BORRELIA BURGDORFERI
DQAVDNDV

SEQ ID NO: 147096 - protein, 8 aa, BORRELIA BURGDORFERI
QAVDNDVS

SEQ ID NO: 147097 - protein, 8 aa, BORRELIA BURGDORFERI
AVDNDVSN

SEQ ID NO: 147098 - protein, 8 aa, BORRELIA BURGDORFERI
VDNDVSNA

SEQ ID NO: 147099 - protein, 8 aa, BORRELIA BURGDORFERI
DNDVSNAR

SEQ ID NO: 147100 - protein, 8 aa, BORRELIA BURGDORFERI
NDVSNARH

SEQ ID NO: 147101 - protein, 8 aa, BORRELIA BURGDORFERI
DVSNARHV

SEQ ID NO: 147102 - protein, 8 aa, BORRELIA BURGDORFERI
VSNARHVA

SEQ ID NO: 147103 - protein, 8 aa, BORRELIA BURGDORFERI
SNARHVAD

SEQ ID NO: 147104 - protein, 8 aa, BORRELIA BURGDORFERI
NARHVADS

SEQ ID NO: 147105 - protein, 8 aa, BORRELIA BURGDORFERI
ARHVADSY

SEQ ID NO: 147106 - protein, 8 aa, BORRELIA BURGDORFERI
RHVADSYE

SEQ ID NO: 147107 - protein, 8 aa, BORRELIA BURGDORFERI
HVADSYEK

SEQ ID NO: 147108 - protein, 8 aa, BORRELIA BURGDORFERI
VADSYEKL

SEQ ID NO: 147109 - protein, 8 aa, BORRELIA BURGDORFERI
ADSYEKLR

SEQ ID NO: 147110 - protein, 8 aa, BORRELIA BURGDORFERI
DSYEKLRK

SEQ ID NO: 147111 - protein, 8 aa, BORRELIA BURGDORFERI
SYEKLRKS

SEQ ID NO: 147112 - protein, 8 aa, BORRELIA BURGDORFERI
YEKLRKSV

SEQ ID NO: 147113 - protein, 8 aa, BORRELIA BURGDORFERI
EKLRKSVA

SEQ ID NO: 147114 - protein, 8 aa, BORRELIA BURGDORFERI
KLRKSVAL

SEQ ID NO: 147115 - protein, 8 aa, BORRELIA BURGDORFERI
LRKSVALA

SEQ ID NO: 147116 - protein, 8 aa, BORRELIA BURGDORFERI
RKSVALAY

SEQ ID NO: 147117 - protein, 8 aa, BORRELIA BURGDORFERI
KSVALAYI

SEQ ID NO: 147118 - protein, 8 aa, BORRELIA BURGDORFERI
SVALAYIE

SEQ ID NO: 147119 - protein, 8 aa, BORRELIA BURGDORFERI
VALAYIES

SEQ ID NO: 147120 - protein, 8 aa, BORRELIA BURGDORFERI
ALAYIESF

SEQ ID NO: 147121 - protein, 8 aa, BORRELIA BURGDORFERI
LAYIESFD

SEQ ID NO: 147122 - protein, 8 aa, BORRELIA BURGDORFERI
AYIESFDV

SEQ ID NO: 147123 - protein, 8 aa, BORRELIA BURGDORFERI
YIESFDVI

SEQ ID NO: 147124 - protein, 8 aa, BORRELIA BURGDORFERI
IESFDVIS

SEQ ID NO: 147125 - protein, 8 aa, BORRELIA BURGDORFERI
ESFDVISS

SEQ ID NO: 147126 - protein, 8 aa, BORRELIA BURGDORFERI
SFDVISSK

SEQ ID NO: 147127 - protein, 8 aa, BORRELIA BURGDORFERI
FDVISSKF

SEQ ID NO: 147128 - protein, 8 aa, BORRELIA BURGDORFERI
DVISSKFV

SEQ ID NO: 147129 - protein, 8 aa, BORRELIA BURGDORFERI
VISSKFVD

SEQ ID NO: 147130 - protein, 8 aa, BORRELIA BURGDORFERI
ISSKFVDS

SEQ ID NO: 147131 - protein, 8 aa, BORRELIA BURGDORFERI
SSKFVDSK

SEQ ID NO: 147132 - protein, 8 aa, BORRELIA BURGDORFERI
SKFVDSKF

SEQ ID NO: 147133 - protein, 8 aa, BORRELIA BURGDORFERI
KFVDSKFV

SEQ ID NO: 147134 - protein, 8 aa, BORRELIA BURGDORFERI
FVDSKFVE

SEQ ID NO: 147135 - protein, 8 aa, BORRELIA BURGDORFERI
VDSKFVEA

SEQ ID NO: 147136 - protein, 8 aa, BORRELIA BURGDORFERI
DSKFVEAS

SEQ ID NO: 147137 - protein, 8 aa, BORRELIA BURGDORFERI
SKFVEASK

SEQ ID NO: 147138 - protein, 8 aa, BORRELIA BURGDORFERI
KFVEASKK

SEQ ID NO: 147139 - protein, 8 aa, BORRELIA BURGDORFERI
FVEASKKF

SEQ ID NO: 147140 - protein, 8 aa, BORRELIA BURGDORFERI
VEASKKFV

SEQ ID NO: 147141 - protein, 8 aa, BORRELIA BURGDORFERI
EASKKFVN

SEQ ID NO: 147142 - protein, 8 aa, BORRELIA BURGDORFERI
ASKKFVNK

SEQ ID NO: 147143 - protein, 8 aa, BORRELIA BURGDORFERI
SKKFVNKA

SEQ ID NO: 147144 - protein, 8 aa, BORRELIA BURGDORFERI
KKFVNKAK

SEQ ID NO: 147145 - protein, 8 aa, BORRELIA BURGDORFERI
KFVNKAKE

SEQ ID NO: 147146 - protein, 8 aa, BORRELIA BURGDORFERI
FVNKAKEF

SEQ ID NO: 147147 - protein, 8 aa, BORRELIA BURGDORFERI
VNKAKEFV

SEQ ID NO: 147148 - protein, 8 aa, BORRELIA BURGDORFERI
NKAKEFVE

SEQ ID NO: 147149 - protein, 8 aa, BORRELIA BURGDORFERI
KAKEFVEE

SEQ ID NO: 147150 - protein, 8 aa, BORRELIA BURGDORFERI
AKEFVEEN

SEQ ID NO: 147151 - protein, 8 aa, BORRELIA BURGDORFERI
KEFVEEND

SEQ ID NO: 147152 - protein, 8 aa, BORRELIA BURGDORFERI
EFVEENDL

SEQ ID NO: 147153 - protein, 8 aa, BORRELIA BURGDORFERI
FVEENDLI

SEQ ID NO: 147154 - protein, 8 aa, BORRELIA BURGDORFERI
VEENDLIA

SEQ ID NO: 147155 - protein, 8 aa, BORRELIA BURGDORFERI
EENDLIAL

SEQ ID NO: 147156 - protein, 8 aa, BORRELIA BURGDORFERI
ENDLIALK

SEQ ID NO: 147157 - protein, 8 aa, BORRELIA BURGDORFERI
NDLIALKC

SEQ ID NO: 147158 - protein, 8 aa, BORRELIA BURGDORFERI
DLIALKCI

SEQ ID NO: 147159 - protein, 8 aa, BORRELIA BURGDORFERI
LIALKCIV

SEQ ID NO: 147160 - protein, 8 aa, BORRELIA BURGDORFERI
IALKCIVK

SEQ ID NO: 147161 - protein, 8 aa, BORRELIA BURGDORFERI
ALKCIVKT

SEQ ID NO: 147162 - protein, 8 aa, BORRELIA BURGDORFERI
LKCIVKTI

SEQ ID NO: 147163 - protein, 8 aa, BORRELIA BURGDORFERI
KCIVKTIG

SEQ ID NO: 147164 - protein, 8 aa, BORRELIA BURGDORFERI
CIVKTIGD

SEQ ID NO: 147165 - protein, 8 aa, BORRELIA BURGDORFERI
IVKTIGDM

SEQ ID NO: 147166 - protein, 8 aa, BORRELIA BURGDORFERI
VKTIGDMV

SEQ ID NO: 147167 - protein, 8 aa, BORRELIA BURGDORFERI
KTIGDMVN

SEQ ID NO: 147168 - protein, 8 aa, BORRELIA BURGDORFERI
TIGDMVND

SEQ ID NO: 147169 - protein, 8 aa, BORRELIA BURGDORFERI
IGDMVNDR

SEQ ID NO: 147170 - protein, 8 aa, BORRELIA BURGDORFERI
GDMVNDRE

SEQ ID NO: 147171 - protein, 8 aa, BORRELIA BURGDORFERI
DMVNDREI

SEQ ID NO: 147172 - protein, 8 aa, BORRELIA BURGDORFERI
MVNDREIN

SEQ ID NO: 147173 - protein, 8 aa, BORRELIA BURGDORFERI
VNDREINS

SEQ ID NO: 147174 - protein, 8 aa, BORRELIA BURGDORFERI
NDREINSR

SEQ ID NO: 147175 - protein, 8 aa, BORRELIA BURGDORFERI
DREINSRS

SEQ ID NO: 147176 - protein, 8 aa, BORRELIA BURGDORFERI
REINSRSR

SEQ ID NO: 147177 - protein, 8 aa, BORRELIA BURGDORFERI
EINSRSRY

SEQ ID NO: 147178 - protein, 8 aa, BORRELIA BURGDORFERI
INSRSRYN

SEQ ID NO: 147179 - protein, 8 aa, BORRELIA BURGDORFERI
NSRSRYNN

SEQ ID NO: 147180 - protein, 8 aa, BORRELIA BURGDORFERI
SRSRYNNF

SEQ ID NO: 147181 - protein, 8 aa, BORRELIA BURGDORFERI
RSRYNNFY

SEQ ID NO: 147182 - protein, 8 aa, BORRELIA BURGDORFERI
SRYNNFYK

SEQ ID NO: 147183 - protein, 8 aa, BORRELIA BURGDORFERI
RYNNFYKK

SEQ ID NO: 147184 - protein, 8 aa, BORRELIA BURGDORFERI
YNNFYKKE

SEQ ID NO: 147185 - protein, 8 aa, BORRELIA BURGDORFERI
NNFYKKEA

SEQ ID NO: 147186 - protein, 8 aa, BORRELIA BURGDORFERI
NFYKKEAD

SEQ ID NO: 147187 - protein, 8 aa, BORRELIA BURGDORFERI
FYKKEADF

SEQ ID NO: 147188 - protein, 8 aa, BORRELIA BURGDORFERI
YKKEADFL

SEQ ID NO: 147189 - protein, 8 aa, BORRELIA BURGDORFERI
KKEADFLG

SEQ ID NO: 147190 - protein, 8 aa, BORRELIA BURGDORFERI
KEADFLGA

SEQ ID NO: 147191 - protein, 8 aa, BORRELIA BURGDORFERI
EADFLGAA

SEQ ID NO: 147192 - protein, 8 aa, BORRELIA BURGDORFERI
ADFLGAAV

SEQ ID NO: 147193 - protein, 8 aa, BORRELIA BURGDORFERI
DFLGAAVE

SEQ ID NO: 147194 - protein, 8 aa, BORRELIA BURGDORFERI
FLGAAVEL

SEQ ID NO: 147195 - protein, 8 aa, BORRELIA BURGDORFERI
LGAAVELE

SEQ ID NO: 147196 - protein, 8 aa, BORRELIA BURGDORFERI
GAAVELEG

SEQ ID NO: 147197 - protein, 8 aa, BORRELIA BURGDORFERI
AAVELEGA

SEQ ID NO: 147198 - protein, 8 aa, BORRELIA BURGDORFERI
AVELEGAY

SEQ ID NO: 147199 - protein, 8 aa, BORRELIA BURGDORFERI
VELEGAYK

SEQ ID NO: 147200 - protein, 8 aa, BORRELIA BURGDORFERI
ELEGAYKA

SEQ ID NO: 147201 - protein, 8 aa, BORRELIA BURGDORFERI
LEGAYKAI

SEQ ID NO: 147202 - protein, 8 aa, BORRELIA BURGDORFERI
EGAYKAIK

SEQ ID NO: 147203 - protein, 8 aa, BORRELIA BURGDORFERI
GAYKAIKQ

SEQ ID NO: 147204 - protein, 8 aa, BORRELIA BURGDORFERI
AYKAIKQT

SEQ ID NO: 147205 - protein, 8 aa, BORRELIA BURGDORFERI
YKAIKQTL

SEQ ID NO: 147206 - protein, 8 aa, BORRELIA BURGDORFERI
KAIKQTLL

SEQ ID NO: 147207 - protein, 9 aa, BORRELIA BURGDORFERI
MKKSFLSIY

SEQ ID NO: 147208 - protein, 9 aa, BORRELIA BURGDORFERI
KKSFLSIYM

SEQ ID NO: 147209 - protein, 9 aa, BORRELIA BURGDORFERI
KSFLSIYML

SEQ ID NO: 147210 - protein, 9 aa, BORRELIA BURGDORFERI
SFLSIYMLI

SEQ ID NO: 147211 - protein, 9 aa, BORRELIA BURGDORFERI
FLSIYMLIS

SEQ ID NO: 147212 - protein, 9 aa, BORRELIA BURGDORFERI
LSIYMLISI

SEQ ID NO: 147213 - protein, 9 aa, BORRELIA BURGDORFERI
SIYMLISIS

SEQ ID NO: 147214 - protein, 9 aa, BORRELIA BURGDORFERI
IYMLISISL

SEQ ID NO: 147215 - protein, 9 aa, BORRELIA BURGDORFERI
YMLISISLL

SEQ ID NO: 147216 - protein, 9 aa, BORRELIA BURGDORFERI
MLISISLLS

SEQ ID NO: 147217 - protein, 9 aa, BORRELIA BURGDORFERI
LISISLLSC

SEQ ID NO: 147218 - protein, 9 aa, BORRELIA BURGDORFERI
ISISLLSCD

SEQ ID NO: 147219 - protein, 9 aa, BORRELIA BURGDORFERI
SISLLSCDV

SEQ ID NO: 147220 - protein, 9 aa, BORRELIA BURGDORFERI
ISLLSCDVS

SEQ ID NO: 147221 - protein, 9 aa, BORRELIA BURGDORFERI
SLLSCDVSR

SEQ ID NO: 147222 - protein, 9 aa, BORRELIA BURGDORFERI
LLSCDVSRL

SEQ ID NO: 147223 - protein, 9 aa, BORRELIA BURGDORFERI
LSCDVSRLN

SEQ ID NO: 147224 - protein, 9 aa, BORRELIA BURGDORFERI
SCDVSRLNQ

SEQ ID NO: 147225 - protein, 9 aa, BORRELIA BURGDORFERI
CDVSRLNQR

SEQ ID NO: 147226 - protein, 9 aa, BORRELIA BURGDORFERI
DVSRLNQRN

SEQ ID NO: 147227 - protein, 9 aa, BORRELIA BURGDORFERI
VSRLNQRNI

SEQ ID NO: 147228 - protein, 9 aa, BORRELIA BURGDORFERI
SRLNQRNID

SEQ ID NO: 147229 - protein, 9 aa, BORRELIA BURGDORFERI
RLNQRNIDE

SEQ ID NO: 147230 - protein, 9 aa, BORRELIA BURGDORFERI
LNQRNIDEL

SEQ ID NO: 147231 - protein, 9 aa, BORRELIA BURGDORFERI
NQRNIDELK

SEQ ID NO: 147232 - protein, 9 aa, BORRELIA BURGDORFERI
QRNIDELKI

SEQ ID NO: 147233 - protein, 9 aa, BORRELIA BURGDORFERI
RNIDELKIF

SEQ ID NO: 147234 - protein, 9 aa, BORRELIA BURGDORFERI
NIDELKIFV

SEQ ID NO: 147235 - protein, 9 aa, BORRELIA BURGDORFERI
IDELKIFVE

SEQ ID NO: 147236 - protein, 9 aa, BORRELIA BURGDORFERI
DELKIFVEK

SEQ ID NO: 147237 - protein, 9 aa, BORRELIA BURGDORFERI
ELKIFVEKA

SEQ ID NO: 147238 - protein, 9 aa, BORRELIA BURGDORFERI
LKIFVEKAK

SEQ ID NO: 147239 - protein, 9 aa, BORRELIA BURGDORFERI
KIFVEKAKY

SEQ ID NO: 147240 - protein, 9 aa, BORRELIA BURGDORFERI
IFVEKAKYY

SEQ ID NO: 147241 - protein, 9 aa, BORRELIA BURGDORFERI
FVEKAKYYS

SEQ ID NO: 147242 - protein, 9 aa, BORRELIA BURGDORFERI
VEKAKYYSI

SEQ ID NO: 147243 - protein, 9 aa, BORRELIA BURGDORFERI
EKAKYYSIK

SEQ ID NO: 147244 - protein, 9 aa, BORRELIA BURGDORFERI
KAKYYSIKL

SEQ ID NO: 147245 - protein, 9 aa, BORRELIA BURGDORFERI
AKYYSIKLD

SEQ ID NO: 147246 - protein, 9 aa, BORRELIA BURGDORFERI
KYYSIKLDA

SEQ ID NO: 147247 - protein, 9 aa, BORRELIA BURGDORFERI
YYSIKLDAI

SEQ ID NO: 147248 - protein, 9 aa, BORRELIA BURGDORFERI
YSIKLDAIY

SEQ ID NO: 147249 - protein, 9 aa, BORRELIA BURGDORFERI
SIKLDAIYS

SEQ ID NO: 147250 - protein, 9 aa, BORRELIA BURGDORFERI
IKLDAIYSE

SEQ ID NO: 147251 - protein, 9 aa, BORRELIA BURGDORFERI
KLDAIYSEY

SEQ ID NO: 147252 - protein, 9 aa, BORRELIA BURGDORFERI
LDAIYSEYT

SEQ ID NO: 147253 - protein, 9 aa, BORRELIA BURGDORFERI
DAIYSEYTG

SEQ ID NO: 147254 - protein, 9 aa, BORRELIA BURGDORFERI
AIYSEYTGA

SEQ ID NO: 147255 - protein, 9 aa, BORRELIA BURGDORFERI
IYSEYTGAY

SEQ ID NO: 147256 - protein, 9 aa, BORRELIA BURGDORFERI
YSEYTGAYN

SEQ ID NO: 147257 - protein, 9 aa, BORRELIA BURGDORFERI
SEYTGAYND

SEQ ID NO: 147258 - protein, 9 aa, BORRELIA BURGDORFERI
EYTGAYNDI

SEQ ID NO: 147259 - protein, 9 aa, BORRELIA BURGDORFERI
YTGAYNDIM

SEQ ID NO: 147260 - protein, 9 aa, BORRELIA BURGDORFERI
TGAYNDIMT

SEQ ID NO: 147261 - protein, 9 aa, BORRELIA BURGDORFERI
GAYNDIMTY

SEQ ID NO: 147262 - protein, 9 aa, BORRELIA BURGDORFERI
AYNDIMTYI

SEQ ID NO: 147263 - protein, 9 aa, BORRELIA BURGDORFERI
YNDIMTYIM

SEQ ID NO: 147264 - protein, 9 aa, BORRELIA BURGDORFERI
NDIMTYIMT

SEQ ID NO: 147265 - protein, 9 aa, BORRELIA BURGDORFERI
DIMTYIMTY

SEQ ID NO: 147266 - protein, 9 aa, BORRELIA BURGDORFERI
IMTYIMTYS

SEQ ID NO: 147267 - protein, 9 aa, BORRELIA BURGDORFERI
MTYIMTYSE

SEQ ID NO: 147268 - protein, 9 aa, BORRELIA BURGDORFERI
TYIMTYSEG

SEQ ID NO: 147269 - protein, 9 aa, BORRELIA BURGDORFERI
YIMTYSEGT

SEQ ID NO: 147270 - protein, 9 aa, BORRELIA BURGDORFERI
IMTYSEGTS

SEQ ID NO: 147271 - protein, 9 aa, BORRELIA BURGDORFERI
MTYSEGTSS

SEQ ID NO: 147272 - protein, 9 aa, BORRELIA BURGDORFERI
TYSEGTSSD

SEQ ID NO: 147273 - protein, 9 aa, BORRELIA BURGDORFERI
YSEGTSSDK

SEQ ID NO: 147274 - protein, 9 aa, BORRELIA BURGDORFERI
SEGTSSDKS

SEQ ID NO: 147275 - protein, 9 aa, BORRELIA BURGDORFERI
EGTSSDKSK

SEQ ID NO: 147276 - protein, 9 aa, BORRELIA BURGDORFERI
GTSSDKSKV

SEQ ID NO: 147277 - protein, 9 aa, BORRELIA BURGDORFERI
TSSDKSKVN

SEQ ID NO: 147278 - protein, 9 aa, BORRELIA BURGDORFERI
SSDKSKVNQ

SEQ ID NO: 147279 - protein, 9 aa, BORRELIA BURGDORFERI
SDKSKVNQA

SEQ ID NO: 147280 - protein, 9 aa, BORRELIA BURGDORFERI
DKSKVNQAI

SEQ ID NO: 147281 - protein, 9 aa, BORRELIA BURGDORFERI
KSKVNQAIS

SEQ ID NO: 147282 - protein, 9 aa, BORRELIA BURGDORFERI
SKVNQAISI

SEQ ID NO: 147283 - protein, 9 aa, BORRELIA BURGDORFERI
KVNQAISIL

SEQ ID NO: 147284 - protein, 9 aa, BORRELIA BURGDORFERI
VNQAISILK

SEQ ID NO: 147285 - protein, 9 aa, BORRELIA BURGDORFERI
NQAISILKK

SEQ ID NO: 147286 - protein, 9 aa, BORRELIA BURGDORFERI
QAISILKKD

SEQ ID NO: 147287 - protein, 9 aa, BORRELIA BURGDORFERI
AISILKKDN

SEQ ID NO: 147288 - protein, 9 aa, BORRELIA BURGDORFERI
ISILKKDNK

SEQ ID NO: 147289 - protein, 9 aa, BORRELIA BURGDORFERI
SILKKDNKI

SEQ ID NO: 147290 - protein, 9 aa, BORRELIA BURGDORFERI
ILKKDNKIV

SEQ ID NO: 147291 - protein, 9 aa, BORRELIA BURGDORFERI
LKKDNKIVN

SEQ ID NO: 147292 - protein, 9 aa, BORRELIA BURGDORFERI
KKDNKIVNK

SEQ ID NO: 147293 - protein, 9 aa, BORRELIA BURGDORFERI
KDNKIVNKF

SEQ ID NO: 147294 - protein, 9 aa, BORRELIA BURGDORFERI
DNKIVNKFK

SEQ ID NO: 147295 - protein, 9 aa, BORRELIA BURGDORFERI
NKIVNKFKE

SEQ ID NO: 147296 - protein, 9 aa, BORRELIA BURGDORFERI
KIVNKFKEL

SEQ ID NO: 147297 - protein, 9 aa, BORRELIA BURGDORFERI
IVNKFKELE

SEQ ID NO: 147298 - protein, 9 aa, BORRELIA BURGDORFERI
VNKFKELEK

SEQ ID NO: 147299 - protein, 9 aa, BORRELIA BURGDORFERI
NKFKELEKI

SEQ ID NO: 147300 - protein, 9 aa, BORRELIA BURGDORFERI
KFKELEKII

SEQ ID NO: 147301 - protein, 9 aa, BORRELIA BURGDORFERI
FKELEKIIE

SEQ ID NO: 147302 - protein, 9 aa, BORRELIA BURGDORFERI
KELEKIIEE

SEQ ID NO: 147303 - protein, 9 aa, BORRELIA BURGDORFERI
ELEKIIEEY

SEQ ID NO: 147304 - protein, 9 aa, BORRELIA BURGDORFERI
LEKIIEEYK

SEQ ID NO: 147305 - protein, 9 aa, BORRELIA BURGDORFERI
EKIIEEYKP

SEQ ID NO: 147306 - protein, 9 aa, BORRELIA BURGDORFERI
KIIEEYKPM

SEQ ID NO: 147307 - protein, 9 aa, BORRELIA BURGDORFERI
IIEEYKPMF

SEQ ID NO: 147308 - protein, 9 aa, BORRELIA BURGDORFERI
IEEYKPMFL

SEQ ID NO: 147309 - protein, 9 aa, BORRELIA BURGDORFERI
EEYKPMFLS

SEQ ID NO: 147310 - protein, 9 aa, BORRELIA BURGDORFERI
EYKPMFLSK

SEQ ID NO: 147311 - protein, 9 aa, BORRELIA BURGDORFERI
YKPMFLSKL

SEQ ID NO: 147312 - protein, 9 aa, BORRELIA BURGDORFERI
KPMFLSKLI

SEQ ID NO: 147313 - protein, 9 aa, BORRELIA BURGDORFERI
PMFLSKLID

SEQ ID NO: 147314 - protein, 9 aa, BORRELIA BURGDORFERI
MFLSKLIDD

SEQ ID NO: 147315 - protein, 9 aa, BORRELIA BURGDORFERI
FLSKLIDDF

SEQ ID NO: 147316 - protein, 9 aa, BORRELIA BURGDORFERI
LSKLIDDFA

SEQ ID NO: 147317 - protein, 9 aa, BORRELIA BURGDORFERI
SKLIDDFAI

SEQ ID NO: 147318 - protein, 9 aa, BORRELIA BURGDORFERI
KLIDDFAIE

SEQ ID NO: 147319 - protein, 9 aa, BORRELIA BURGDORFERI
LIDDFAIEL

SEQ ID NO: 147320 - protein, 9 aa, BORRELIA BURGDORFERI
IDDFAIELD

SEQ ID NO: 147321 - protein, 9 aa, BORRELIA BURGDORFERI
DDFAIELDQ

SEQ ID NO: 147322 - protein, 9 aa, BORRELIA BURGDORFERI
DFAIELDQA

SEQ ID NO: 147323 - protein, 9 aa, BORRELIA BURGDORFERI
FAIELDQAV

SEQ ID NO: 147324 - protein, 9 aa, BORRELIA BURGDORFERI
AIELDQAVD

SEQ ID NO: 147325 - protein, 9 aa, BORRELIA BURGDORFERI
IELDQAVDN

SEQ ID NO: 147326 - protein, 9 aa, BORRELIA BURGDORFERI
ELDQAVDND

SEQ ID NO: 147327 - protein, 9 aa, BORRELIA BURGDORFERI
LDQAVDNDV

SEQ ID NO: 147328 - protein, 9 aa, BORRELIA BURGDORFERI
DQAVDNDVS

SEQ ID NO: 147329 - protein, 9 aa, BORRELIA BURGDORFERI
QAVDNDVSN

SEQ ID NO: 147330 - protein, 9 aa, BORRELIA BURGDORFERI
AVDNDVSNA

SEQ ID NO: 147331 - protein, 9 aa, BORRELIA BURGDORFERI
VDNDVSNAR

SEQ ID NO: 147332 - protein, 9 aa, BORRELIA BURGDORFERI
DNDVSNARH

SEQ ID NO: 147333 - protein, 9 aa, BORRELIA BURGDORFERI
NDVSNARHV

SEQ ID NO: 147334 - protein, 9 aa, BORRELIA BURGDORFERI
DVSNARHVA

SEQ ID NO: 147335 - protein, 9 aa, BORRELIA BURGDORFERI
VSNARHVAD

SEQ ID NO: 147336 - protein, 9 aa, BORRELIA BURGDORFERI
SNARHVADS

SEQ ID NO: 147337 - protein, 9 aa, BORRELIA BURGDORFERI
NARHVADSY

SEQ ID NO: 147338 - protein, 9 aa, BORRELIA BURGDORFERI
ARHVADSYE

SEQ ID NO: 147339 - protein, 9 aa, BORRELIA BURGDORFERI
RHVADSYEK

SEQ ID NO: 147340 - protein, 9 aa, BORRELIA BURGDORFERI
HVADSYEKL

SEQ ID NO: 147341 - protein, 9 aa, BORRELIA BURGDORFERI
VADSYEKLR

SEQ ID NO: 147342 - protein, 9 aa, BORRELIA BURGDORFERI
ADSYEKLRK

SEQ ID NO: 147343 - protein, 9 aa, BORRELIA BURGDORFERI
DSYEKLRKS

SEQ ID NO: 147344 - protein, 9 aa, BORRELIA BURGDORFERI
SYEKLRKSV

SEQ ID NO: 147345 - protein, 9 aa, BORRELIA BURGDORFERI
YEKLRKSVA

SEQ ID NO: 147346 - protein, 9 aa, BORRELIA BURGDORFERI
EKLRKSVAL

SEQ ID NO: 147347 - protein, 9 aa, BORRELIA BURGDORFERI
KLRKSVALA

SEQ ID NO: 147348 - protein, 9 aa, BORRELIA BURGDORFERI
LRKSVALAY

SEQ ID NO: 147349 - protein, 9 aa, BORRELIA BURGDORFERI
RKSVALAYI

SEQ ID NO: 147350 - protein, 9 aa, BORRELIA BURGDORFERI
KSVALAYIE

SEQ ID NO: 147351 - protein, 9 aa, BORRELIA BURGDORFERI
SVALAYIES

SEQ ID NO: 147352 - protein, 9 aa, BORRELIA BURGDORFERI
VALAYIESF

SEQ ID NO: 147353 - protein, 9 aa, BORRELIA BURGDORFERI
ALAYIESFD

SEQ ID NO: 147354 - protein, 9 aa, BORRELIA BURGDORFERI
LAYIESFDV

SEQ ID NO: 147355 - protein, 9 aa, BORRELIA BURGDORFERI
AYIESFDVI

SEQ ID NO: 147356 - protein, 9 aa, BORRELIA BURGDORFERI
YIESFDVIS

SEQ ID NO: 147357 - protein, 9 aa, BORRELIA BURGDORFERI
IESFDVISS

SEQ ID NO: 147358 - protein, 9 aa, BORRELIA BURGDORFERI
ESFDVISSK

SEQ ID NO: 147359 - protein, 9 aa, BORRELIA BURGDORFERI
SFDVISSKF

SEQ ID NO: 147360 - protein, 9 aa, BORRELIA BURGDORFERI
FDVISSKFV

SEQ ID NO: 147361 - protein, 9 aa, BORRELIA BURGDORFERI
DVISSKFVD

SEQ ID NO: 147362 - protein, 9 aa, BORRELIA BURGDORFERI
VISSKFVDS

SEQ ID NO: 147363 - protein, 9 aa, BORRELIA BURGDORFERI
ISSKFVDSK

SEQ ID NO: 147364 - protein, 9 aa, BORRELIA BURGDORFERI
SSKFVDSKF

SEQ ID NO: 147365 - protein, 9 aa, BORRELIA BURGDORFERI
SKFVDSKFV

SEQ ID NO: 147366 - protein, 9 aa, BORRELIA BURGDORFERI
KFVDSKFVE

SEQ ID NO: 147367 - protein, 9 aa, BORRELIA BURGDORFERI
FVDSKFVEA

SEQ ID NO: 147368 - protein, 9 aa, BORRELIA BURGDORFERI
VDSKFVEAS

SEQ ID NO: 147369 - protein, 9 aa, BORRELIA BURGDORFERI
DSKFVEASK

SEQ ID NO: 147370 - protein, 9 aa, BORRELIA BURGDORFERI
SKFVEASKK

SEQ ID NO: 147371 - protein, 9 aa, BORRELIA BURGDORFERI
KFVEASKKF

SEQ ID NO: 147372 - protein, 9 aa, BORRELIA BURGDORFERI
FVEASKKFV

SEQ ID NO: 147373 - protein, 9 aa, BORRELIA BURGDORFERI
VEASKKFVN

SEQ ID NO: 147374 - protein, 9 aa, BORRELIA BURGDORFERI
EASKKFVNK

SEQ ID NO: 147375 - protein, 9 aa, BORRELIA BURGDORFERI
ASKKFVNKA

SEQ ID NO: 147376 - protein, 9 aa, BORRELIA BURGDORFERI
SKKFVNKAK

SEQ ID NO: 147377 - protein, 9 aa, BORRELIA BURGDORFERI
KKFVNKAKE

SEQ ID NO: 147378 - protein, 9 aa, BORRELIA BURGDORFERI
KFVNKAKEF

SEQ ID NO: 147379 - protein, 9 aa, BORRELIA BURGDORFERI
FVNKAKEFV

SEQ ID NO: 147380 - protein, 9 aa, BORRELIA BURGDORFERI
VNKAKEFVE

SEQ ID NO: 147381 - protein, 9 aa, BORRELIA BURGDORFERI
NKAKEFVEE

SEQ ID NO: 147382 - protein, 9 aa, BORRELIA BURGDORFERI
KAKEFVEEN

SEQ ID NO: 147383 - protein, 9 aa, BORRELIA BURGDORFERI
AKEFVEEND

SEQ ID NO: 147384 - protein, 9 aa, BORRELIA BURGDORFERI
KEFVEENDL

SEQ ID NO: 147385 - protein, 9 aa, BORRELIA BURGDORFERI
EFVEENDLI

SEQ ID NO: 147386 - protein, 9 aa, BORRELIA BURGDORFERI
FVEENDLIA

SEQ ID NO: 147387 - protein, 9 aa, BORRELIA BURGDORFERI
VEENDLIAL

SEQ ID NO: 147388 - protein, 9 aa, BORRELIA BURGDORFERI
EENDLIALK

SEQ ID NO: 147389 - protein, 9 aa, BORRELIA BURGDORFERI
ENDLIALKC

SEQ ID NO: 147390 - protein, 9 aa, BORRELIA BURGDORFERI
NDLIALKCI

SEQ ID NO: 147391 - protein, 9 aa, BORRELIA BURGDORFERI
DLIALKCIV

SEQ ID NO: 147392 - protein, 9 aa, BORRELIA BURGDORFERI
LIALKCIVK

SEQ ID NO: 147393 - protein, 9 aa, BORRELIA BURGDORFERI
IALKCIVKT

SEQ ID NO: 147394 - protein, 9 aa, BORRELIA BURGDORFERI
ALKCIVKTI

SEQ ID NO: 147395 - protein, 9 aa, BORRELIA BURGDORFERI
LKCIVKTIG

SEQ ID NO: 147396 - protein, 9 aa, BORRELIA BURGDORFERI
KCIVKTIGD

SEQ ID NO: 147397 - protein, 9 aa, BORRELIA BURGDORFERI
CIVKTIGDM

SEQ ID NO: 147398 - protein, 9 aa, BORRELIA BURGDORFERI
IVKTIGDMV

SEQ ID NO: 147399 - protein, 9 aa, BORRELIA BURGDORFERI
VKTIGDMVN

SEQ ID NO: 147400 - protein, 9 aa, BORRELIA BURGDORFERI
KTIGDMVND

SEQ ID NO: 147401 - protein, 9 aa, BORRELIA BURGDORFERI
TIGDMVNDR

SEQ ID NO: 147402 - protein, 9 aa, BORRELIA BURGDORFERI
IGDMVNDRE

SEQ ID NO: 147403 - protein, 9 aa, BORRELIA BURGDORFERI
GDMVNDREI

SEQ ID NO: 147404 - protein, 9 aa, BORRELIA BURGDORFERI
DMVNDREIN

SEQ ID NO: 147405 - protein, 9 aa, BORRELIA BURGDORFERI
MVNDREINS

SEQ ID NO: 147406 - protein, 9 aa, BORRELIA BURGDORFERI
VNDREINSR

SEQ ID NO: 147407 - protein, 9 aa, BORRELIA BURGDORFERI
NDREINSRS

SEQ ID NO: 147408 - protein, 9 aa, BORRELIA BURGDORFERI
DREINSRSR

SEQ ID NO: 147409 - protein, 9 aa, BORRELIA BURGDORFERI
REINSRSRY

SEQ ID NO: 147410 - protein, 9 aa, BORRELIA BURGDORFERI
EINSRSRYN

SEQ ID NO: 147411 - protein, 9 aa, BORRELIA BURGDORFERI
INSRSRYNN

SEQ ID NO: 147412 - protein, 9 aa, BORRELIA BURGDORFERI
NSRSRYNNF

SEQ ID NO: 147413 - protein, 9 aa, BORRELIA BURGDORFERI
SRSRYNNFY

SEQ ID NO: 147414 - protein, 9 aa, BORRELIA BURGDORFERI
RSRYNNFYK

SEQ ID NO: 147415 - protein, 9 aa, BORRELIA BURGDORFERI
SRYNNFYKK

SEQ ID NO: 147416 - protein, 9 aa, BORRELIA BURGDORFERI
RYNNFYKKE

SEQ ID NO: 147417 - protein, 9 aa, BORRELIA BURGDORFERI
YNNFYKKEA

SEQ ID NO: 147418 - protein, 9 aa, BORRELIA BURGDORFERI
NNFYKKEAD

SEQ ID NO: 147419 - protein, 9 aa, BORRELIA BURGDORFERI
NFYKKEADF

SEQ ID NO: 147420 - protein, 9 aa, BORRELIA BURGDORFERI
FYKKEADFL

SEQ ID NO: 147421 - protein, 9 aa, BORRELIA BURGDORFERI
YKKEADFLG

SEQ ID NO: 147422 - protein, 9 aa, BORRELIA BURGDORFERI
KKEADFLGA

SEQ ID NO: 147423 - protein, 9 aa, BORRELIA BURGDORFERI
KEADFLGAA

SEQ ID NO: 147424 - protein, 9 aa, BORRELIA BURGDORFERI
EADFLGAAV

SEQ ID NO: 147425 - protein, 9 aa, BORRELIA BURGDORFERI
ADFLGAAVE

SEQ ID NO: 147426 - protein, 9 aa, BORRELIA BURGDORFERI
DFLGAAVEL

SEQ ID NO: 147427 - protein, 9 aa, BORRELIA BURGDORFERI
FLGAAVELE

SEQ ID NO: 147428 - protein, 9 aa, BORRELIA BURGDORFERI
LGAAVELEG

SEQ ID NO: 147429 - protein, 9 aa, BORRELIA BURGDORFERI
GAAVELEGA

SEQ ID NO: 147430 - protein, 9 aa, BORRELIA BURGDORFERI
AAVELEGAY

SEQ ID NO: 147431 - protein, 9 aa, BORRELIA BURGDORFERI
AVELEGAYK

SEQ ID NO: 147432 - protein, 9 aa, BORRELIA BURGDORFERI
VELEGAYKA

SEQ ID NO: 147433 - protein, 9 aa, BORRELIA BURGDORFERI
ELEGAYKAI

SEQ ID NO: 147434 - protein, 9 aa, BORRELIA BURGDORFERI
LEGAYKAIK

SEQ ID NO: 147435 - protein, 9 aa, BORRELIA BURGDORFERI
EGAYKAIKQ

SEQ ID NO: 147436 - protein, 9 aa, BORRELIA BURGDORFERI
GAYKAIKQT

SEQ ID NO: 147437 - protein, 9 aa, BORRELIA BURGDORFERI
AYKAIKQTL

SEQ ID NO: 147438 - protein, 9 aa, BORRELIA BURGDORFERI
YKAIKQTLL

SEQ ID NO: 147439 - protein, 10 aa, BORRELIA BURGDORFERI
MKKSFLSIYM

SEQ ID NO: 147440 - protein, 10 aa, BORRELIA BURGDORFERI
KKSFLSIYML

SEQ ID NO: 147441 - protein, 10 aa, BORRELIA BURGDORFERI
KSFLSIYMLI

SEQ ID NO: 147442 - protein, 10 aa, BORRELIA BURGDORFERI
SFLSIYMLIS

SEQ ID NO: 147443 - protein, 10 aa, BORRELIA BURGDORFERI
FLSIYMLISI

SEQ ID NO: 147444 - protein, 10 aa, BORRELIA BURGDORFERI
LSIYMLISIS

SEQ ID NO: 147445 - protein, 10 aa, BORRELIA BURGDORFERI
SIYMLISISL

SEQ ID NO: 147446 - protein, 10 aa, BORRELIA BURGDORFERI
IYMLISISLL

SEQ ID NO: 147447 - protein, 10 aa, BORRELIA BURGDORFERI
YMLISISLLS

SEQ ID NO: 147448 - protein, 10 aa, BORRELIA BURGDORFERI
MLISISLLSC

SEQ ID NO: 147449 - protein, 10 aa, BORRELIA BURGDORFERI
LISISLLSCD

SEQ ID NO: 147450 - protein, 10 aa, BORRELIA BURGDORFERI
ISISLLSCDV

SEQ ID NO: 147451 - protein, 10 aa, BORRELIA BURGDORFERI
SISLLSCDVS

SEQ ID NO: 147452 - protein, 10 aa, BORRELIA BURGDORFERI
ISLLSCDVSR

SEQ ID NO: 147453 - protein, 10 aa, BORRELIA BURGDORFERI
SLLSCDVSRL

SEQ ID NO: 147454 - protein, 10 aa, BORRELIA BURGDORFERI
LLSCDVSRLN

SEQ ID NO: 147455 - protein, 10 aa, BORRELIA BURGDORFERI
LSCDVSRLNQ

SEQ ID NO: 147456 - protein, 10 aa, BORRELIA BURGDORFERI
SCDVSRLNQR

SEQ ID NO: 147457 - protein, 10 aa, BORRELIA BURGDORFERI
CDVSRLNQRN

SEQ ID NO: 147458 - protein, 10 aa, BORRELIA BURGDORFERI
DVSRLNQRNI

SEQ ID NO: 147459 - protein, 10 aa, BORRELIA BURGDORFERI
VSRLNQRNID

SEQ ID NO: 147460 - protein, 10 aa, BORRELIA BURGDORFERI
SRLNQRNIDE

SEQ ID NO: 147461 - protein, 10 aa, BORRELIA BURGDORFERI
RLNQRNIDEL

SEQ ID NO: 147462 - protein, 10 aa, BORRELIA BURGDORFERI
LNQRNIDELK

SEQ ID NO: 147463 - protein, 10 aa, BORRELIA BURGDORFERI
NQRNIDELKI

SEQ ID NO: 147464 - protein, 10 aa, BORRELIA BURGDORFERI
QRNIDELKIF

SEQ ID NO: 147465 - protein, 10 aa, BORRELIA BURGDORFERI
RNIDELKIFV

SEQ ID NO: 147466 - protein, 10 aa, BORRELIA BURGDORFERI
NIDELKIFVE

SEQ ID NO: 147467 - protein, 10 aa, BORRELIA BURGDORFERI
IDELKIFVEK

SEQ ID NO: 147468 - protein, 10 aa, BORRELIA BURGDORFERI
DELKIFVEKA

SEQ ID NO: 147469 - protein, 10 aa, BORRELIA BURGDORFERI
ELKIFVEKAK

SEQ ID NO: 147470 - protein, 10 aa, BORRELIA BURGDORFERI
LKIFVEKAKY

SEQ ID NO: 147471 - protein, 10 aa, BORRELIA BURGDORFERI
KIFVEKAKYY

SEQ ID NO: 147472 - protein, 10 aa, BORRELIA BURGDORFERI
IFVEKAKYYS

SEQ ID NO: 147473 - protein, 10 aa, BORRELIA BURGDORFERI
FVEKAKYYSI

SEQ ID NO: 147474 - protein, 10 aa, BORRELIA BURGDORFERI
VEKAKYYSIK

SEQ ID NO: 147475 - protein, 10 aa, BORRELIA BURGDORFERI
EKAKYYSIKL

SEQ ID NO: 147476 - protein, 10 aa, BORRELIA BURGDORFERI
KAKYYSIKLD

SEQ ID NO: 147477 - protein, 10 aa, BORRELIA BURGDORFERI
AKYYSIKLDA

SEQ ID NO: 147478 - protein, 10 aa, BORRELIA BURGDORFERI
KYYSIKLDAI

SEQ ID NO: 147479 - protein, 10 aa, BORRELIA BURGDORFERI
YYSIKLDAIY

SEQ ID NO: 147480 - protein, 10 aa, BORRELIA BURGDORFERI
YSIKLDAIYS

SEQ ID NO: 147481 - protein, 10 aa, BORRELIA BURGDORFERI
SIKLDAIYSE

SEQ ID NO: 147482 - protein, 10 aa, BORRELIA BURGDORFERI
IKLDAIYSEY

SEQ ID NO: 147483 - protein, 10 aa, BORRELIA BURGDORFERI
KLDAIYSEYT

SEQ ID NO: 147484 - protein, 10 aa, BORRELIA BURGDORFERI
LDAIYSEYTG

SEQ ID NO: 147485 - protein, 10 aa, BORRELIA BURGDORFERI
DAIYSEYTGA

SEQ ID NO: 147486 - protein, 10 aa, BORRELIA BURGDORFERI
AIYSEYTGAY

SEQ ID NO: 147487 - protein, 10 aa, BORRELIA BURGDORFERI
IYSEYTGAYN

SEQ ID NO: 147488 - protein, 10 aa, BORRELIA BURGDORFERI
YSEYTGAYND

SEQ ID NO: 147489 - protein, 10 aa, BORRELIA BURGDORFERI
SEYTGAYNDI

SEQ ID NO: 147490 - protein, 10 aa, BORRELIA BURGDORFERI
EYTGAYNDIM

SEQ ID NO: 147491 - protein, 10 aa, BORRELIA BURGDORFERI
YTGAYNDIMT

SEQ ID NO: 147492 - protein, 10 aa, BORRELIA BURGDORFERI
TGAYNDIMTY

SEQ ID NO: 147493 - protein, 10 aa, BORRELIA BURGDORFERI
GAYNDIMTYI

SEQ ID NO: 147494 - protein, 10 aa, BORRELIA BURGDORFERI
AYNDIMTYIM

SEQ ID NO: 147495 - protein, 10 aa, BORRELIA BURGDORFERI
YNDIMTYIMT

SEQ ID NO: 147496 - protein, 10 aa, BORRELIA BURGDORFERI
NDIMTYIMTY

SEQ ID NO: 147497 - protein, 10 aa, BORRELIA BURGDORFERI
DIMTYIMTYS

SEQ ID NO: 147498 - protein, 10 aa, BORRELIA BURGDORFERI
IMTYIMTYSE

SEQ ID NO: 147499 - protein, 10 aa, BORRELIA BURGDORFERI
MTYIMTYSEG

SEQ ID NO: 147500 - protein, 10 aa, BORRELIA BURGDORFERI
TYIMTYSEGT

SEQ ID NO: 147501 - protein, 10 aa, BORRELIA BURGDORFERI
YIMTYSEGTS

SEQ ID NO: 147502 - protein, 10 aa, BORRELIA BURGDORFERI
IMTYSEGTSS

SEQ ID NO: 147503 - protein, 10 aa, BORRELIA BURGDORFERI
MTYSEGTSSD

SEQ ID NO: 147504 - protein, 10 aa, BORRELIA BURGDORFERI
TYSEGTSSDK

SEQ ID NO: 147505 - protein, 10 aa, BORRELIA BURGDORFERI
YSEGTSSDKS

SEQ ID NO: 147506 - protein, 10 aa, BORRELIA BURGDORFERI
SEGTSSDKSK

SEQ ID NO: 147507 - protein, 10 aa, BORRELIA BURGDORFERI
EGTSSDKSKV

SEQ ID NO: 147508 - protein, 10 aa, BORRELIA BURGDORFERI
GTSSDKSKVN

SEQ ID NO: 147509 - protein, 10 aa, BORRELIA BURGDORFERI
TSSDKSKVNQ

SEQ ID NO: 147510 - protein, 10 aa, BORRELIA BURGDORFERI
SSDKSKVNQA

SEQ ID NO: 147511 - protein, 10 aa, BORRELIA BURGDORFERI
SDKSKVNQAI

SEQ ID NO: 147512 - protein, 10 aa, BORRELIA BURGDORFERI
DKSKVNQAIS

SEQ ID NO: 147513 - protein, 10 aa, BORRELIA BURGDORFERI
KSKVNQAISI

SEQ ID NO: 147514 - protein, 10 aa, BORRELIA BURGDORFERI
SKVNQAISIL

SEQ ID NO: 147515 - protein, 10 aa, BORRELIA BURGDORFERI
KVNQAISILK

SEQ ID NO: 147516 - protein, 10 aa, BORRELIA BURGDORFERI
VNQAISILKK

SEQ ID NO: 147517 - protein, 10 aa, BORRELIA BURGDORFERI
NQAISILKKD

SEQ ID NO: 147518 - protein, 10 aa, BORRELIA BURGDORFERI
QAISILKKDN

SEQ ID NO: 147519 - protein, 10 aa, BORRELIA BURGDORFERI
AISILKKDNK

SEQ ID NO: 147520 - protein, 10 aa, BORRELIA BURGDORFERI
ISILKKDNKI

SEQ ID NO: 147521 - protein, 10 aa, BORRELIA BURGDORFERI
SILKKDNKIV

SEQ ID NO: 147522 - protein, 10 aa, BORRELIA BURGDORFERI
ILKKDNKIVN

SEQ ID NO: 147523 - protein, 10 aa, BORRELIA BURGDORFERI
LKKDNKIVNK

SEQ ID NO: 147524 - protein, 10 aa, BORRELIA BURGDORFERI
KKDNKIVNKF

SEQ ID NO: 147525 - protein, 10 aa, BORRELIA BURGDORFERI
KDNKIVNKFK

SEQ ID NO: 147526 - protein, 10 aa, BORRELIA BURGDORFERI
DNKIVNKFKE

SEQ ID NO: 147527 - protein, 10 aa, BORRELIA BURGDORFERI
NKIVNKFKEL

SEQ ID NO: 147528 - protein, 10 aa, BORRELIA BURGDORFERI
KIVNKFKELE

SEQ ID NO: 147529 - protein, 10 aa, BORRELIA BURGDORFERI
IVNKFKELEK

SEQ ID NO: 147530 - protein, 10 aa, BORRELIA BURGDORFERI
VNKFKELEKI

SEQ ID NO: 147531 - protein, 10 aa, BORRELIA BURGDORFERI
NKFKELEKII

SEQ ID NO: 147532 - protein, 10 aa, BORRELIA BURGDORFERI
KFKELEKIIE

SEQ ID NO: 147533 - protein, 10 aa, BORRELIA BURGDORFERI
FKELEKIIEE

SEQ ID NO: 147534 - protein, 10 aa, BORRELIA BURGDORFERI
KELEKIIEEY

SEQ ID NO: 147535 - protein, 10 aa, BORRELIA BURGDORFERI
ELEKIIEEYK

SEQ ID NO: 147536 - protein, 10 aa, BORRELIA BURGDORFERI
LEKIIEEYKP

SEQ ID NO: 147537 - protein, 10 aa, BORRELIA BURGDORFERI
EKIIEEYKPM

SEQ ID NO: 147538 - protein, 10 aa, BORRELIA BURGDORFERI
KIIEEYKPMF

SEQ ID NO: 147539 - protein, 10 aa, BORRELIA BURGDORFERI
IIEEYKPMFL

SEQ ID NO: 147540 - protein, 10 aa, BORRELIA BURGDORFERI
IEEYKPMFLS

SEQ ID NO: 147541 - protein, 10 aa, BORRELIA BURGDORFERI
EEYKPMFLSK

SEQ ID NO: 147542 - protein, 10 aa, BORRELIA BURGDORFERI
EYKPMFLSKL

SEQ ID NO: 147543 - protein, 10 aa, BORRELIA BURGDORFERI
YKPMFLSKLI

SEQ ID NO: 147544 - protein, 10 aa, BORRELIA BURGDORFERI
KPMFLSKLID

SEQ ID NO: 147545 - protein, 10 aa, BORRELIA BURGDORFERI
PMFLSKLIDD

SEQ ID NO: 147546 - protein, 10 aa, BORRELIA BURGDORFERI
MFLSKLIDDF

SEQ ID NO: 147547 - protein, 10 aa, BORRELIA BURGDORFERI
FLSKLIDDFA

SEQ ID NO: 147548 - protein, 10 aa, BORRELIA BURGDORFERI
LSKLIDDFAI

SEQ ID NO: 147549 - protein, 10 aa, BORRELIA BURGDORFERI
SKLIDDFAIE

SEQ ID NO: 147550 - protein, 10 aa, BORRELIA BURGDORFERI
KLIDDFAIEL

SEQ ID NO: 147551 - protein, 10 aa, BORRELIA BURGDORFERI
LIDDFAIELD

SEQ ID NO: 147552 - protein, 10 aa, BORRELIA BURGDORFERI
IDDFAIELDQ

SEQ ID NO: 147553 - protein, 10 aa, BORRELIA BURGDORFERI
DDFAIELDQA

SEQ ID NO: 147554 - protein, 10 aa, BORRELIA BURGDORFERI
DFAIELDQAV

SEQ ID NO: 147555 - protein, 10 aa, BORRELIA BURGDORFERI
FAIELDQAVD

SEQ ID NO: 147556 - protein, 10 aa, BORRELIA BURGDORFERI
AIELDQAVDN

SEQ ID NO: 147557 - protein, 10 aa, BORRELIA BURGDORFERI
IELDQAVDND

SEQ ID NO: 147558 - protein, 10 aa, BORRELIA BURGDORFERI
ELDQAVDNDV

SEQ ID NO: 147559 - protein, 10 aa, BORRELIA BURGDORFERI
LDQAVDNDVS

SEQ ID NO: 147560 - protein, 10 aa, BORRELIA BURGDORFERI
DQAVDNDVSN

SEQ ID NO: 147561 - protein, 10 aa, BORRELIA BURGDORFERI
QAVDNDVSNA

SEQ ID NO: 147562 - protein, 10 aa, BORRELIA BURGDORFERI
AVDNDVSNAR

SEQ ID NO: 147563 - protein, 10 aa, BORRELIA BURGDORFERI
VDNDVSNARH

SEQ ID NO: 147564 - protein, 10 aa, BORRELIA BURGDORFERI
DNDVSNARHV

SEQ ID NO: 147565 - protein, 10 aa, BORRELIA BURGDORFERI
NDVSNARHVA

SEQ ID NO: 147566 - protein, 10 aa, BORRELIA BURGDORFERI
DVSNARHVAD

SEQ ID NO: 147567 - protein, 10 aa, BORRELIA BURGDORFERI
VSNARHVADS

SEQ ID NO: 147568 - protein, 10 aa, BORRELIA BURGDORFERI
SNARHVADSY

SEQ ID NO: 147569 - protein, 10 aa, BORRELIA BURGDORFERI
NARHVADSYE

SEQ ID NO: 147570 - protein, 10 aa, BORRELIA BURGDORFERI
ARHVADSYEK

SEQ ID NO: 147571 - protein, 10 aa, BORRELIA BURGDORFERI
RHVADSYEKL

SEQ ID NO: 147572 - protein, 10 aa, BORRELIA BURGDORFERI
HVADSYEKLR

SEQ ID NO: 147573 - protein, 10 aa, BORRELIA BURGDORFERI
VADSYEKLRK

SEQ ID NO: 147574 - protein, 10 aa, BORRELIA BURGDORFERI
ADSYEKLRKS

SEQ ID NO: 147575 - protein, 10 aa, BORRELIA BURGDORFERI
DSYEKLRKSV

SEQ ID NO: 147576 - protein, 10 aa, BORRELIA BURGDORFERI
SYEKLRKSVA

SEQ ID NO: 147577 - protein, 10 aa, BORRELIA BURGDORFERI
YEKLRKSVAL

SEQ ID NO: 147578 - protein, 10 aa, BORRELIA BURGDORFERI
EKLRKSVALA

SEQ ID NO: 147579 - protein, 10 aa, BORRELIA BURGDORFERI
KLRKSVALAY

SEQ ID NO: 147580 - protein, 10 aa, BORRELIA BURGDORFERI
LRKSVALAYI

SEQ ID NO: 147581 - protein, 10 aa, BORRELIA BURGDORFERI
RKSVALAYIE

SEQ ID NO: 147582 - protein, 10 aa, BORRELIA BURGDORFERI
KSVALAYIES

SEQ ID NO: 147583 - protein, 10 aa, BORRELIA BURGDORFERI
SVALAYIESF

SEQ ID NO: 147584 - protein, 10 aa, BORRELIA BURGDORFERI
VALAYIESFD

SEQ ID NO: 147585 - protein, 10 aa, BORRELIA BURGDORFERI
ALAYIESFDV

SEQ ID NO: 147586 - protein, 10 aa, BORRELIA BURGDORFERI
LAYIESFDVI

SEQ ID NO: 147587 - protein, 10 aa, BORRELIA BURGDORFERI
AYIESFDVIS

SEQ ID NO: 147588 - protein, 10 aa, BORRELIA BURGDORFERI
YIESFDVISS

SEQ ID NO: 147589 - protein, 10 aa, BORRELIA BURGDORFERI
IESFDVISSK

SEQ ID NO: 147590 - protein, 10 aa, BORRELIA BURGDORFERI
ESFDVISSKF

SEQ ID NO: 147591 - protein, 10 aa, BORRELIA BURGDORFERI
SFDVISSKFV

SEQ ID NO: 147592 - protein, 10 aa, BORRELIA BURGDORFERI
FDVISSKFVD

SEQ ID NO: 147593 - protein, 10 aa, BORRELIA BURGDORFERI
DVISSKFVDS

SEQ ID NO: 147594 - protein, 10 aa, BORRELIA BURGDORFERI
VISSKFVDSK

SEQ ID NO: 147595 - protein, 10 aa, BORRELIA BURGDORFERI
ISSKFVDSKF

SEQ ID NO: 147596 - protein, 10 aa, BORRELIA BURGDORFERI
SSKFVDSKFV

SEQ ID NO: 147597 - protein, 10 aa, BORRELIA BURGDORFERI
SKFVDSKFVE

SEQ ID NO: 147598 - protein, 10 aa, BORRELIA BURGDORFERI
KFVDSKFVEA

SEQ ID NO: 147599 - protein, 10 aa, BORRELIA BURGDORFERI
FVDSKFVEAS

SEQ ID NO: 147600 - protein, 10 aa, BORRELIA BURGDORFERI
VDSKFVEASK

SEQ ID NO: 147601 - protein, 10 aa, BORRELIA BURGDORFERI
DSKFVEASKK

SEQ ID NO: 147602 - protein, 10 aa, BORRELIA BURGDORFERI
SKFVEASKKF

SEQ ID NO: 147603 - protein, 10 aa, BORRELIA BURGDORFERI
KFVEASKKFV

SEQ ID NO: 147604 - protein, 10 aa, BORRELIA BURGDORFERI
FVEASKKFVN

SEQ ID NO: 147605 - protein, 10 aa, BORRELIA BURGDORFERI
VEASKKFVNK

SEQ ID NO: 147606 - protein, 10 aa, BORRELIA BURGDORFERI
EASKKFVNKA

SEQ ID NO: 147607 - protein, 10 aa, BORRELIA BURGDORFERI
ASKKFVNKAK

SEQ ID NO: 147608 - protein, 10 aa, BORRELIA BURGDORFERI
SKKFVNKAKE

SEQ ID NO: 147609 - protein, 10 aa, BORRELIA BURGDORFERI
KKFVNKAKEF

SEQ ID NO: 147610 - protein, 10 aa, BORRELIA BURGDORFERI
KFVNKAKEFV

SEQ ID NO: 147611 - protein, 10 aa, BORRELIA BURGDORFERI
FVNKAKEFVE

SEQ ID NO: 147612 - protein, 10 aa, BORRELIA BURGDORFERI
VNKAKEFVEE

SEQ ID NO: 147613 - protein, 10 aa, BORRELIA BURGDORFERI
NKAKEFVEEN

SEQ ID NO: 147614 - protein, 10 aa, BORRELIA BURGDORFERI
KAKEFVEEND

SEQ ID NO: 147615 - protein, 10 aa, BORRELIA BURGDORFERI
AKEFVEENDL

SEQ ID NO: 147616 - protein, 10 aa, BORRELIA BURGDORFERI
KEFVEENDLI

SEQ ID NO: 147617 - protein, 10 aa, BORRELIA BURGDORFERI
EFVEENDLIA

SEQ ID NO: 147618 - protein, 10 aa, BORRELIA BURGDORFERI
FVEENDLIAL

SEQ ID NO: 147619 - protein, 10 aa, BORRELIA BURGDORFERI
VEENDLIALK

SEQ ID NO: 147620 - protein, 10 aa, BORRELIA BURGDORFERI
EENDLIALKC

SEQ ID NO: 147621 - protein, 10 aa, BORRELIA BURGDORFERI
ENDLIALKCI

SEQ ID NO: 147622 - protein, 10 aa, BORRELIA BURGDORFERI
NDLIALKCIV

SEQ ID NO: 147623 - protein, 10 aa, BORRELIA BURGDORFERI
DLIALKCIVK

SEQ ID NO: 147624 - protein, 10 aa, BORRELIA BURGDORFERI
LIALKCIVKT

SEQ ID NO: 147625 - protein, 10 aa, BORRELIA BURGDORFERI
IALKCIVKTI

SEQ ID NO: 147626 - protein, 10 aa, BORRELIA BURGDORFERI
ALKCIVKTIG

SEQ ID NO: 147627 - protein, 10 aa, BORRELIA BURGDORFERI
LKCIVKTIGD

SEQ ID NO: 147628 - protein, 10 aa, BORRELIA BURGDORFERI
KCIVKTIGDM

SEQ ID NO: 147629 - protein, 10 aa, BORRELIA BURGDORFERI
CIVKTIGDMV

SEQ ID NO: 147630 - protein, 10 aa, BORRELIA BURGDORFERI
IVKTIGDMVN

SEQ ID NO: 147631 - protein, 10 aa, BORRELIA BURGDORFERI
VKTIGDMVND

SEQ ID NO: 147632 - protein, 10 aa, BORRELIA BURGDORFERI
KTIGDMVNDR

SEQ ID NO: 147633 - protein, 10 aa, BORRELIA BURGDORFERI
TIGDMVNDRE

SEQ ID NO: 147634 - protein, 10 aa, BORRELIA BURGDORFERI
IGDMVNDREI

SEQ ID NO: 147635 - protein, 10 aa, BORRELIA BURGDORFERI
GDMVNDREIN

SEQ ID NO: 147636 - protein, 10 aa, BORRELIA BURGDORFERI
DMVNDREINS

SEQ ID NO: 147637 - protein, 10 aa, BORRELIA BURGDORFERI
MVNDREINSR

SEQ ID NO: 147638 - protein, 10 aa, BORRELIA BURGDORFERI
VNDREINSRS

SEQ ID NO: 147639 - protein, 10 aa, BORRELIA BURGDORFERI
NDREINSRSR

SEQ ID NO: 147640 - protein, 10 aa, BORRELIA BURGDORFERI
DREINSRSRY

SEQ ID NO: 147641 - protein, 10 aa, BORRELIA BURGDORFERI
REINSRSRYN

SEQ ID NO: 147642 - protein, 10 aa, BORRELIA BURGDORFERI
EINSRSRYNN

SEQ ID NO: 147643 - protein, 10 aa, BORRELIA BURGDORFERI
INSRSRYNNF

SEQ ID NO: 147644 - protein, 10 aa, BORRELIA BURGDORFERI
NSRSRYNNFY

SEQ ID NO: 147645 - protein, 10 aa, BORRELIA BURGDORFERI
SRSRYNNFYK

SEQ ID NO: 147646 - protein, 10 aa, BORRELIA BURGDORFERI
RSRYNNFYKK

SEQ ID NO: 147647 - protein, 10 aa, BORRELIA BURGDORFERI
SRYNNFYKKE

SEQ ID NO: 147648 - protein, 10 aa, BORRELIA BURGDORFERI
RYNNFYKKEA

SEQ ID NO: 147649 - protein, 10 aa, BORRELIA BURGDORFERI
YNNFYKKEAD

SEQ ID NO: 147650 - protein, 10 aa, BORRELIA BURGDORFERI
NNFYKKEADF

SEQ ID NO: 147651 - protein, 10 aa, BORRELIA BURGDORFERI
NFYKKEADFL

SEQ ID NO: 147652 - protein, 10 aa, BORRELIA BURGDORFERI
FYKKEADFLG

SEQ ID NO: 147653 - protein, 10 aa, BORRELIA BURGDORFERI
YKKEADFLGA

SEQ ID NO: 147654 - protein, 10 aa, BORRELIA BURGDORFERI
KKEADFLGAA

SEQ ID NO: 147655 - protein, 10 aa, BORRELIA BURGDORFERI
KEADFLGAAV

SEQ ID NO: 147656 - protein, 10 aa, BORRELIA BURGDORFERI
EADFLGAAVE

SEQ ID NO: 147657 - protein, 10 aa, BORRELIA BURGDORFERI
ADFLGAAVEL

SEQ ID NO: 147658 - protein, 10 aa, BORRELIA BURGDORFERI
DFLGAAVELE

SEQ ID NO: 147659 - protein, 10 aa, BORRELIA BURGDORFERI
FLGAAVELEG

SEQ ID NO: 147660 - protein, 10 aa, BORRELIA BURGDORFERI
LGAAVELEGA

SEQ ID NO: 147661 - protein, 10 aa, BORRELIA BURGDORFERI
GAAVELEGAY

SEQ ID NO: 147662 - protein, 10 aa, BORRELIA BURGDORFERI
AAVELEGAYK

SEQ ID NO: 147663 - protein, 10 aa, BORRELIA BURGDORFERI
AVELEGAYKA

SEQ ID NO: 147664 - protein, 10 aa, BORRELIA BURGDORFERI
VELEGAYKAI

SEQ ID NO: 147665 - protein, 10 aa, BORRELIA BURGDORFERI
ELEGAYKAIK

SEQ ID NO: 147666 - protein, 10 aa, BORRELIA BURGDORFERI
LEGAYKAIKQ

SEQ ID NO: 147667 - protein, 10 aa, BORRELIA BURGDORFERI
EGAYKAIKQT

SEQ ID NO: 147668 - protein, 10 aa, BORRELIA BURGDORFERI
GAYKAIKQTL

SEQ ID NO: 147669 - protein, 10 aa, BORRELIA BURGDORFERI
AYKAIKQTLL

SEQ ID NO: 147670 - protein, 11 aa, BORRELIA BURGDORFERI
MKKSFLSIYML

SEQ ID NO: 147671 - protein, 11 aa, BORRELIA BURGDORFERI
KKSFLSIYMLI

SEQ ID NO: 147672 - protein, 11 aa, BORRELIA BURGDORFERI
KSFLSIYMLIS

SEQ ID NO: 147673 - protein, 11 aa, BORRELIA BURGDORFERI
SFLSIYMLISI

SEQ ID NO: 147674 - protein, 11 aa, BORRELIA BURGDORFERI
FLSIYMLISIS

SEQ ID NO: 147675 - protein, 11 aa, BORRELIA BURGDORFERI
LSIYMLISISL

SEQ ID NO: 147676 - protein, 11 aa, BORRELIA BURGDORFERI
SIYMLISISLL

SEQ ID NO: 147677 - protein, 11 aa, BORRELIA BURGDORFERI
IYMLISISLLS

SEQ ID NO: 147678 - protein, 11 aa, BORRELIA BURGDORFERI
YMLISISLLSC

SEQ ID NO: 147679 - protein, 11 aa, BORRELIA BURGDORFERI
MLISISLLSCD

SEQ ID NO: 147680 - protein, 11 aa, BORRELIA BURGDORFERI
LISISLLSCDV

SEQ ID NO: 147681 - protein, 11 aa, BORRELIA BURGDORFERI
ISISLLSCDVS

SEQ ID NO: 147682 - protein, 11 aa, BORRELIA BURGDORFERI
SISLLSCDVSR

SEQ ID NO: 147683 - protein, 11 aa, BORRELIA BURGDORFERI
ISLLSCDVSRL

SEQ ID NO: 147684 - protein, 11 aa, BORRELIA BURGDORFERI
SLLSCDVSRLN

SEQ ID NO: 147685 - protein, 11 aa, BORRELIA BURGDORFERI
LLSCDVSRLNQ

SEQ ID NO: 147686 - protein, 11 aa, BORRELIA BURGDORFERI
LSCDVSRLNQR

SEQ ID NO: 147687 - protein, 11 aa, BORRELIA BURGDORFERI
SCDVSRLNQRN

SEQ ID NO: 147688 - protein, 11 aa, BORRELIA BURGDORFERI
CDVSRLNQRNI

SEQ ID NO: 147689 - protein, 11 aa, BORRELIA BURGDORFERI
DVSRLNQRNID

SEQ ID NO: 147690 - protein, 11 aa, BORRELIA BURGDORFERI
VSRLNQRNIDE

SEQ ID NO: 147691 - protein, 11 aa, BORRELIA BURGDORFERI
SRLNQRNIDEL

SEQ ID NO: 147692 - protein, 11 aa, BORRELIA BURGDORFERI
RLNQRNIDELK

SEQ ID NO: 147693 - protein, 11 aa, BORRELIA BURGDORFERI
LNQRNIDELKI

SEQ ID NO: 147694 - protein, 11 aa, BORRELIA BURGDORFERI
NQRNIDELKIF

SEQ ID NO: 147695 - protein, 11 aa, BORRELIA BURGDORFERI
QRNIDELKIFV

SEQ ID NO: 147696 - protein, 11 aa, BORRELIA BURGDORFERI
RNIDELKIFVE

SEQ ID NO: 147697 - protein, 11 aa, BORRELIA BURGDORFERI
NIDELKIFVEK

SEQ ID NO: 147698 - protein, 11 aa, BORRELIA BURGDORFERI
IDELKIFVEKA

SEQ ID NO: 147699 - protein, 11 aa, BORRELIA BURGDORFERI
DELKIFVEKAK

SEQ ID NO: 147700 - protein, 11 aa, BORRELIA BURGDORFERI
ELKIFVEKAKY

SEQ ID NO: 147701 - protein, 11 aa, BORRELIA BURGDORFERI
LKIFVEKAKYY

SEQ ID NO: 147702 - protein, 11 aa, BORRELIA BURGDORFERI
KIFVEKAKYYS

SEQ ID NO: 147703 - protein, 11 aa, BORRELIA BURGDORFERI
IFVEKAKYYSI

SEQ ID NO: 147704 - protein, 11 aa, BORRELIA BURGDORFERI
FVEKAKYYSIK

SEQ ID NO: 147705 - protein, 11 aa, BORRELIA BURGDORFERI
VEKAKYYSIKL

SEQ ID NO: 147706 - protein, 11 aa, BORRELIA BURGDORFERI
EKAKYYSIKLD

SEQ ID NO: 147707 - protein, 11 aa, BORRELIA BURGDORFERI
KAKYYSIKLDA

SEQ ID NO: 147708 - protein, 11 aa, BORRELIA BURGDORFERI
AKYYSIKLDAI

SEQ ID NO: 147709 - protein, 11 aa, BORRELIA BURGDORFERI
KYYSIKLDAIY

SEQ ID NO: 147710 - protein, 11 aa, BORRELIA BURGDORFERI
YYSIKLDAIYS

SEQ ID NO: 147711 - protein, 11 aa, BORRELIA BURGDORFERI
YSIKLDAIYSE

SEQ ID NO: 147712 - protein, 11 aa, BORRELIA BURGDORFERI
SIKLDAIYSEY

SEQ ID NO: 147713 - protein, 11 aa, BORRELIA BURGDORFERI
IKLDAIYSEYT

SEQ ID NO: 147714 - protein, 11 aa, BORRELIA BURGDORFERI
KLDAIYSEYTG

SEQ ID NO: 147715 - protein, 11 aa, BORRELIA BURGDORFERI
LDAIYSEYTGA

SEQ ID NO: 147716 - protein, 11 aa, BORRELIA BURGDORFERI
DAIYSEYTGAY

SEQ ID NO: 147717 - protein, 11 aa, BORRELIA BURGDORFERI
AIYSEYTGAYN

SEQ ID NO: 147718 - protein, 11 aa, BORRELIA BURGDORFERI
IYSEYTGAYND

SEQ ID NO: 147719 - protein, 11 aa, BORRELIA BURGDORFERI
YSEYTGAYNDI

SEQ ID NO: 147720 - protein, 11 aa, BORRELIA BURGDORFERI
SEYTGAYNDIM

SEQ ID NO: 147721 - protein, 11 aa, BORRELIA BURGDORFERI
EYTGAYNDIMT

SEQ ID NO: 147722 - protein, 11 aa, BORRELIA BURGDORFERI
YTGAYNDIMTY

SEQ ID NO: 147723 - protein, 11 aa, BORRELIA BURGDORFERI
TGAYNDIMTYI

SEQ ID NO: 147724 - protein, 11 aa, BORRELIA BURGDORFERI
GAYNDIMTYIM

SEQ ID NO: 147725 - protein, 11 aa, BORRELIA BURGDORFERI
AYNDIMTYIMT

SEQ ID NO: 147726 - protein, 11 aa, BORRELIA BURGDORFERI
YNDIMTYIMTY

SEQ ID NO: 147727 - protein, 11 aa, BORRELIA BURGDORFERI
NDIMTYIMTYS

SEQ ID NO: 147728 - protein, 11 aa, BORRELIA BURGDORFERI
DIMTYIMTYSE

SEQ ID NO: 147729 - protein, 11 aa, BORRELIA BURGDORFERI
IMTYIMTYSEG

SEQ ID NO: 147730 - protein, 11 aa, BORRELIA BURGDORFERI
MTYIMTYSEGT

SEQ ID NO: 147731 - protein, 11 aa, BORRELIA BURGDORFERI
TYIMTYSEGTS

SEQ ID NO: 147732 - protein, 11 aa, BORRELIA BURGDORFERI
YIMTYSEGTSS

SEQ ID NO: 147733 - protein, 11 aa, BORRELIA BURGDORFERI
IMTYSEGTSSD

SEQ ID NO: 147734 - protein, 11 aa, BORRELIA BURGDORFERI
MTYSEGTSSDK

SEQ ID NO: 147735 - protein, 11 aa, BORRELIA BURGDORFERI
TYSEGTSSDKS

SEQ ID NO: 147736 - protein, 11 aa, BORRELIA BURGDORFERI
YSEGTSSDKSK

SEQ ID NO: 147737 - protein, 11 aa, BORRELIA BURGDORFERI
SEGTSSDKSKV

SEQ ID NO: 147738 - protein, 11 aa, BORRELIA BURGDORFERI
EGTSSDKSKVN

SEQ ID NO: 147739 - protein, 11 aa, BORRELIA BURGDORFERI
GTSSDKSKVNQ

SEQ ID NO: 147740 - protein, 11 aa, BORRELIA BURGDORFERI
TSSDKSKVNQA

SEQ ID NO: 147741 - protein, 11 aa, BORRELIA BURGDORFERI
SSDKSKVNQAI

SEQ ID NO: 147742 - protein, 11 aa, BORRELIA BURGDORFERI
SDKSKVNQAIS

SEQ ID NO: 147743 - protein, 11 aa, BORRELIA BURGDORFERI
DKSKVNQAISI

SEQ ID NO: 147744 - protein, 11 aa, BORRELIA BURGDORFERI
KSKVNQAISIL

SEQ ID NO: 147745 - protein, 11 aa, BORRELIA BURGDORFERI
SKVNQAISILK

SEQ ID NO: 147746 - protein, 11 aa, BORRELIA BURGDORFERI
KVNQAISILKK

SEQ ID NO: 147747 - protein, 11 aa, BORRELIA BURGDORFERI
VNQAISILKKD

SEQ ID NO: 147748 - protein, 11 aa, BORRELIA BURGDORFERI
NQAISILKKDN

SEQ ID NO: 147749 - protein, 11 aa, BORRELIA BURGDORFERI
QAISILKKDNK

SEQ ID NO: 147750 - protein, 11 aa, BORRELIA BURGDORFERI
AISILKKDNKI

SEQ ID NO: 147751 - protein, 11 aa, BORRELIA BURGDORFERI
ISILKKDNKIV

SEQ ID NO: 147752 - protein, 11 aa, BORRELIA BURGDORFERI
SILKKDNKIVN

SEQ ID NO: 147753 - protein, 11 aa, BORRELIA BURGDORFERI
ILKKDNKIVNK

SEQ ID NO: 147754 - protein, 11 aa, BORRELIA BURGDORFERI
LKKDNKIVNKF

SEQ ID NO: 147755 - protein, 11 aa, BORRELIA BURGDORFERI
KKDNKIVNKFK

SEQ ID NO: 147756 - protein, 11 aa, BORRELIA BURGDORFERI
KDNKIVNKFKE

SEQ ID NO: 147757 - protein, 11 aa, BORRELIA BURGDORFERI
DNKIVNKFKEL

SEQ ID NO: 147758 - protein, 11 aa, BORRELIA BURGDORFERI
NKIVNKFKELE

SEQ ID NO: 147759 - protein, 11 aa, BORRELIA BURGDORFERI
KIVNKFKELEK

SEQ ID NO: 147760 - protein, 11 aa, BORRELIA BURGDORFERI
IVNKFKELEKI

SEQ ID NO: 147761 - protein, 11 aa, BORRELIA BURGDORFERI
VNKFKELEKII

SEQ ID NO: 147762 - protein, 11 aa, BORRELIA BURGDORFERI
NKFKELEKIIE

SEQ ID NO: 147763 - protein, 11 aa, BORRELIA BURGDORFERI
KFKELEKIIEE

SEQ ID NO: 147764 - protein, 11 aa, BORRELIA BURGDORFERI
FKELEKIIEEY

SEQ ID NO: 147765 - protein, 11 aa, BORRELIA BURGDORFERI
KELEKIIEEYK

SEQ ID NO: 147766 - protein, 11 aa, BORRELIA BURGDORFERI
ELEKIIEEYKP

SEQ ID NO: 147767 - protein, 11 aa, BORRELIA BURGDORFERI
LEKIIEEYKPM

SEQ ID NO: 147768 - protein, 11 aa, BORRELIA BURGDORFERI
EKIIEEYKPMF

SEQ ID NO: 147769 - protein, 11 aa, BORRELIA BURGDORFERI
KIIEEYKPMFL

SEQ ID NO: 147770 - protein, 11 aa, BORRELIA BURGDORFERI
IIEEYKPMFLS

SEQ ID NO: 147771 - protein, 11 aa, BORRELIA BURGDORFERI
IEEYKPMFLSK

SEQ ID NO: 147772 - protein, 11 aa, BORRELIA BURGDORFERI
EEYKPMFLSKL

SEQ ID NO: 147773 - protein, 11 aa, BORRELIA BURGDORFERI
EYKPMFLSKLI

SEQ ID NO: 147774 - protein, 11 aa, BORRELIA BURGDORFERI
YKPMFLSKLID

SEQ ID NO: 147775 - protein, 11 aa, BORRELIA BURGDORFERI
KPMFLSKLIDD

SEQ ID NO: 147776 - protein, 11 aa, BORRELIA BURGDORFERI
PMFLSKLIDDF

SEQ ID NO: 147777 - protein, 11 aa, BORRELIA BURGDORFERI
MFLSKLIDDFA

SEQ ID NO: 147778 - protein, 11 aa, BORRELIA BURGDORFERI
FLSKLIDDFAI

SEQ ID NO: 147779 - protein, 11 aa, BORRELIA BURGDORFERI
LSKLIDDFAIE

SEQ ID NO: 147780 - protein, 11 aa, BORRELIA BURGDORFERI
SKLIDDFAIEL

SEQ ID NO: 147781 - protein, 11 aa, BORRELIA BURGDORFERI
KLIDDFAIELD

SEQ ID NO: 147782 - protein, 11 aa, BORRELIA BURGDORFERI
LIDDFAIELDQ

SEQ ID NO: 147783 - protein, 11 aa, BORRELIA BURGDORFERI
IDDFAIELDQA

SEQ ID NO: 147784 - protein, 11 aa, BORRELIA BURGDORFERI
DDFAIELDQAV

SEQ ID NO: 147785 - protein, 11 aa, BORRELIA BURGDORFERI
DFAIELDQAVD

SEQ ID NO: 147786 - protein, 11 aa, BORRELIA BURGDORFERI
FAIELDQAVDN

SEQ ID NO: 147787 - protein, 11 aa, BORRELIA BURGDORFERI
AIELDQAVDND

SEQ ID NO: 147788 - protein, 11 aa, BORRELIA BURGDORFERI
IELDQAVDNDV

SEQ ID NO: 147789 - protein, 11 aa, BORRELIA BURGDORFERI
ELDQAVDNDVS

SEQ ID NO: 147790 - protein, 11 aa, BORRELIA BURGDORFERI
LDQAVDNDVSN

SEQ ID NO: 147791 - protein, 11 aa, BORRELIA BURGDORFERI
DQAVDNDVSNA

SEQ ID NO: 147792 - protein, 11 aa, BORRELIA BURGDORFERI
QAVDNDVSNAR

SEQ ID NO: 147793 - protein, 11 aa, BORRELIA BURGDORFERI
AVDNDVSNARH

SEQ ID NO: 147794 - protein, 11 aa, BORRELIA BURGDORFERI
VDNDVSNARHV

SEQ ID NO: 147795 - protein, 11 aa, BORRELIA BURGDORFERI
DNDVSNARHVA

SEQ ID NO: 147796 - protein, 11 aa, BORRELIA BURGDORFERI
NDVSNARHVAD

SEQ ID NO: 147797 - protein, 11 aa, BORRELIA BURGDORFERI
DVSNARHVADS

SEQ ID NO: 147798 - protein, 11 aa, BORRELIA BURGDORFERI
VSNARHVADSY

SEQ ID NO: 147799 - protein, 11 aa, BORRELIA BURGDORFERI
SNARHVADSYE

SEQ ID NO: 147800 - protein, 11 aa, BORRELIA BURGDORFERI
NARHVADSYEK

SEQ ID NO: 147801 - protein, 11 aa, BORRELIA BURGDORFERI
ARHVADSYEKL

SEQ ID NO: 147802 - protein, 11 aa, BORRELIA BURGDORFERI
RHVADSYEKLR

SEQ ID NO: 147803 - protein, 11 aa, BORRELIA BURGDORFERI
HVADSYEKLRK

SEQ ID NO: 147804 - protein, 11 aa, BORRELIA BURGDORFERI
VADSYEKLRKS

SEQ ID NO: 147805 - protein, 11 aa, BORRELIA BURGDORFERI
ADSYEKLRKSV

SEQ ID NO: 147806 - protein, 11 aa, BORRELIA BURGDORFERI
DSYEKLRKSVA

SEQ ID NO: 147807 - protein, 11 aa, BORRELIA BURGDORFERI
SYEKLRKSVAL

SEQ ID NO: 147808 - protein, 11 aa, BORRELIA BURGDORFERI
YEKLRKSVALA

SEQ ID NO: 147809 - protein, 11 aa, BORRELIA BURGDORFERI
EKLRKSVALAY

SEQ ID NO: 147810 - protein, 11 aa, BORRELIA BURGDORFERI
KLRKSVALAYI

SEQ ID NO: 147811 - protein, 11 aa, BORRELIA BURGDORFERI
LRKSVALAYIE

SEQ ID NO: 147812 - protein, 11 aa, BORRELIA BURGDORFERI
RKSVALAYIES

SEQ ID NO: 147813 - protein, 11 aa, BORRELIA BURGDORFERI
KSVALAYIESF

SEQ ID NO: 147814 - protein, 11 aa, BORRELIA BURGDORFERI
SVALAYIESFD

SEQ ID NO: 147815 - protein, 11 aa, BORRELIA BURGDORFERI
VALAYIESFDV

SEQ ID NO: 147816 - protein, 11 aa, BORRELIA BURGDORFERI
ALAYIESFDVI

SEQ ID NO: 147817 - protein, 11 aa, BORRELIA BURGDORFERI
LAYIESFDVIS

SEQ ID NO: 147818 - protein, 11 aa, BORRELIA BURGDORFERI
AYIESFDVISS

SEQ ID NO: 147819 - protein, 11 aa, BORRELIA BURGDORFERI
YIESFDVISSK

SEQ ID NO: 147820 - protein, 11 aa, BORRELIA BURGDORFERI
IESFDVISSKF

SEQ ID NO: 147821 - protein, 11 aa, BORRELIA BURGDORFERI
ESFDVISSKFV

SEQ ID NO: 147822 - protein, 11 aa, BORRELIA BURGDORFERI
SFDVISSKFVD

SEQ ID NO: 147823 - protein, 11 aa, BORRELIA BURGDORFERI
FDVISSKFVDS

SEQ ID NO: 147824 - protein, 11 aa, BORRELIA BURGDORFERI
DVISSKFVDSK

SEQ ID NO: 147825 - protein, 11 aa, BORRELIA BURGDORFERI
VISSKFVDSKF

SEQ ID NO: 147826 - protein, 11 aa, BORRELIA BURGDORFERI
ISSKFVDSKFV

SEQ ID NO: 147827 - protein, 11 aa, BORRELIA BURGDORFERI
SSKFVDSKFVE

SEQ ID NO: 147828 - protein, 11 aa, BORRELIA BURGDORFERI
SKFVDSKFVEA

SEQ ID NO: 147829 - protein, 11 aa, BORRELIA BURGDORFERI
KFVDSKFVEAS

SEQ ID NO: 147830 - protein, 11 aa, BORRELIA BURGDORFERI
FVDSKFVEASK

SEQ ID NO: 147831 - protein, 11 aa, BORRELIA BURGDORFERI
VDSKFVEASKK

SEQ ID NO: 147832 - protein, 11 aa, BORRELIA BURGDORFERI
DSKFVEASKKF

SEQ ID NO: 147833 - protein, 11 aa, BORRELIA BURGDORFERI
SKFVEASKKFV

SEQ ID NO: 147834 - protein, 11 aa, BORRELIA BURGDORFERI
KFVEASKKFVN

SEQ ID NO: 147835 - protein, 11 aa, BORRELIA BURGDORFERI
FVEASKKFVNK

SEQ ID NO: 147836 - protein, 11 aa, BORRELIA BURGDORFERI
VEASKKFVNKA

SEQ ID NO: 147837 - protein, 11 aa, BORRELIA BURGDORFERI
EASKKFVNKAK

SEQ ID NO: 147838 - protein, 11 aa, BORRELIA BURGDORFERI
ASKKFVNKAKE

SEQ ID NO: 147839 - protein, 11 aa, BORRELIA BURGDORFERI
SKKFVNKAKEF

SEQ ID NO: 147840 - protein, 11 aa, BORRELIA BURGDORFERI
KKFVNKAKEFV

SEQ ID NO: 147841 - protein, 11 aa, BORRELIA BURGDORFERI
KFVNKAKEFVE

SEQ ID NO: 147842 - protein, 11 aa, BORRELIA BURGDORFERI
FVNKAKEFVEE

SEQ ID NO: 147843 - protein, 11 aa, BORRELIA BURGDORFERI
VNKAKEFVEEN

SEQ ID NO: 147844 - protein, 11 aa, BORRELIA BURGDORFERI
NKAKEFVEEND

SEQ ID NO: 147845 - protein, 11 aa, BORRELIA BURGDORFERI
KAKEFVEENDL

SEQ ID NO: 147846 - protein, 11 aa, BORRELIA BURGDORFERI
AKEFVEENDLI

SEQ ID NO: 147847 - protein, 11 aa, BORRELIA BURGDORFERI
KEFVEENDLIA

SEQ ID NO: 147848 - protein, 11 aa, BORRELIA BURGDORFERI
EFVEENDLIAL

SEQ ID NO: 147849 - protein, 11 aa, BORRELIA BURGDORFERI
FVEENDLIALK

SEQ ID NO: 147850 - protein, 11 aa, BORRELIA BURGDORFERI
VEENDLIALKC

SEQ ID NO: 147851 - protein, 11 aa, BORRELIA BURGDORFERI
EENDLIALKCI

SEQ ID NO: 147852 - protein, 11 aa, BORRELIA BURGDORFERI
ENDLIALKCIV

SEQ ID NO: 147853 - protein, 11 aa, BORRELIA BURGDORFERI
NDLIALKCIVK

SEQ ID NO: 147854 - protein, 11 aa, BORRELIA BURGDORFERI
DLIALKCIVKT

SEQ ID NO: 147855 - protein, 11 aa, BORRELIA BURGDORFERI
LIALKCIVKTI

SEQ ID NO: 147856 - protein, 11 aa, BORRELIA BURGDORFERI
IALKCIVKTIG

SEQ ID NO: 147857 - protein, 11 aa, BORRELIA BURGDORFERI
ALKCIVKTIGD

SEQ ID NO: 147858 - protein, 11 aa, BORRELIA BURGDORFERI
LKCIVKTIGDM

SEQ ID NO: 147859 - protein, 11 aa, BORRELIA BURGDORFERI
KCIVKTIGDMV

SEQ ID NO: 147860 - protein, 11 aa, BORRELIA BURGDORFERI
CIVKTIGDMVN

SEQ ID NO: 147861 - protein, 11 aa, BORRELIA BURGDORFERI
IVKTIGDMVND

SEQ ID NO: 147862 - protein, 11 aa, BORRELIA BURGDORFERI
VKTIGDMVNDR

SEQ ID NO: 147863 - protein, 11 aa, BORRELIA BURGDORFERI
KTIGDMVNDRE

SEQ ID NO: 147864 - protein, 11 aa, BORRELIA BURGDORFERI
TIGDMVNDREI

SEQ ID NO: 147865 - protein, 11 aa, BORRELIA BURGDORFERI
IGDMVNDREIN

SEQ ID NO: 147866 - protein, 11 aa, BORRELIA BURGDORFERI
GDMVNDREINS

SEQ ID NO: 147867 - protein, 11 aa, BORRELIA BURGDORFERI
DMVNDREINSR

SEQ ID NO: 147868 - protein, 11 aa, BORRELIA BURGDORFERI
MVNDREINSRS

SEQ ID NO: 147869 - protein, 11 aa, BORRELIA BURGDORFERI
VNDREINSRSR

SEQ ID NO: 147870 - protein, 11 aa, BORRELIA BURGDORFERI
NDREINSRSRY

SEQ ID NO: 147871 - protein, 11 aa, BORRELIA BURGDORFERI
DREINSRSRYN

SEQ ID NO: 147872 - protein, 11 aa, BORRELIA BURGDORFERI
REINSRSRYNN

SEQ ID NO: 147873 - protein, 11 aa, BORRELIA BURGDORFERI
EINSRSRYNNF

SEQ ID NO: 147874 - protein, 11 aa, BORRELIA BURGDORFERI
INSRSRYNNFY

SEQ ID NO: 147875 - protein, 11 aa, BORRELIA BURGDORFERI
NSRSRYNNFYK

SEQ ID NO: 147876 - protein, 11 aa, BORRELIA BURGDORFERI
SRSRYNNFYKK

SEQ ID NO: 147877 - protein, 11 aa, BORRELIA BURGDORFERI
RSRYNNFYKKE

SEQ ID NO: 147878 - protein, 11 aa, BORRELIA BURGDORFERI
SRYNNFYKKEA

SEQ ID NO: 147879 - protein, 11 aa, BORRELIA BURGDORFERI
RYNNFYKKEAD

SEQ ID NO: 147880 - protein, 11 aa, BORRELIA BURGDORFERI
YNNFYKKEADF

SEQ ID NO: 147881 - protein, 11 aa, BORRELIA BURGDORFERI
NNFYKKEADFL

SEQ ID NO: 147882 - protein, 11 aa, BORRELIA BURGDORFERI
NFYKKEADFLG

SEQ ID NO: 147883 - protein, 11 aa, BORRELIA BURGDORFERI
FYKKEADFLGA

SEQ ID NO: 147884 - protein, 11 aa, BORRELIA BURGDORFERI
YKKEADFLGAA

SEQ ID NO: 147885 - protein, 11 aa, BORRELIA BURGDORFERI
KKEADFLGAAV

SEQ ID NO: 147886 - protein, 11 aa, BORRELIA BURGDORFERI
KEADFLGAAVE

SEQ ID NO: 147887 - protein, 11 aa, BORRELIA BURGDORFERI
EADFLGAAVEL

SEQ ID NO: 147888 - protein, 11 aa, BORRELIA BURGDORFERI
ADFLGAAVELE

SEQ ID NO: 147889 - protein, 11 aa, BORRELIA BURGDORFERI
DFLGAAVELEG

SEQ ID NO: 147890 - protein, 11 aa, BORRELIA BURGDORFERI
FLGAAVELEGA

SEQ ID NO: 147891 - protein, 11 aa, BORRELIA BURGDORFERI
LGAAVELEGAY

SEQ ID NO: 147892 - protein, 11 aa, BORRELIA BURGDORFERI
GAAVELEGAYK

SEQ ID NO: 147893 - protein, 11 aa, BORRELIA BURGDORFERI
AAVELEGAYKA

SEQ ID NO: 147894 - protein, 11 aa, BORRELIA BURGDORFERI
AVELEGAYKAI

SEQ ID NO: 147895 - protein, 11 aa, BORRELIA BURGDORFERI
VELEGAYKAIK

SEQ ID NO: 147896 - protein, 11 aa, BORRELIA BURGDORFERI
ELEGAYKAIKQ

SEQ ID NO: 147897 - protein, 11 aa, BORRELIA BURGDORFERI
LEGAYKAIKQT

SEQ ID NO: 147898 - protein, 11 aa, BORRELIA BURGDORFERI
EGAYKAIKQTL

SEQ ID NO: 147899 - protein, 11 aa, BORRELIA BURGDORFERI
GAYKAIKQTLL

SEQ ID NO: 147900 - protein, 13 aa, BORRELIA BURGDORFERI
MKKSFLSIYMLIS

SEQ ID NO: 147901 - protein, 13 aa, BORRELIA BURGDORFERI
KKSFLSIYMLISI

SEQ ID NO: 147902 - protein, 13 aa, BORRELIA BURGDORFERI
KSFLSIYMLISIS

SEQ ID NO: 147903 - protein, 13 aa, BORRELIA BURGDORFERI
SFLSIYMLISISL

SEQ ID NO: 147904 - protein, 13 aa, BORRELIA BURGDORFERI
FLSIYMLISISLL

SEQ ID NO: 147905 - protein, 13 aa, BORRELIA BURGDORFERI
LSIYMLISISLLS

SEQ ID NO: 147906 - protein, 13 aa, BORRELIA BURGDORFERI
SIYMLISISLLSC

SEQ ID NO: 147907 - protein, 13 aa, BORRELIA BURGDORFERI
IYMLISISLLSCD

SEQ ID NO: 147908 - protein, 13 aa, BORRELIA BURGDORFERI
YMLISISLLSCDV

SEQ ID NO: 147909 - protein, 13 aa, BORRELIA BURGDORFERI
MLISISLLSCDVS

SEQ ID NO: 147910 - protein, 13 aa, BORRELIA BURGDORFERI
LISISLLSCDVSR

SEQ ID NO: 147911 - protein, 13 aa, BORRELIA BURGDORFERI
ISISLLSCDVSRL

SEQ ID NO: 147912 - protein, 13 aa, BORRELIA BURGDORFERI
SISLLSCDVSRLN

SEQ ID NO: 147913 - protein, 13 aa, BORRELIA BURGDORFERI
ISLLSCDVSRLNQ

SEQ ID NO: 147914 - protein, 13 aa, BORRELIA BURGDORFERI
SLLSCDVSRLNQR

SEQ ID NO: 147915 - protein, 13 aa, BORRELIA BURGDORFERI
LLSCDVSRLNQRN

SEQ ID NO: 147916 - protein, 13 aa, BORRELIA BURGDORFERI
LSCDVSRLNQRNI

SEQ ID NO: 147917 - protein, 13 aa, BORRELIA BURGDORFERI
SCDVSRLNQRNID

SEQ ID NO: 147918 - protein, 13 aa, BORRELIA BURGDORFERI
CDVSRLNQRNIDE

SEQ ID NO: 147919 - protein, 13 aa, BORRELIA BURGDORFERI
DVSRLNQRNIDEL

SEQ ID NO: 147920 - protein, 13 aa, BORRELIA BURGDORFERI
VSRLNQRNIDELK

SEQ ID NO: 147921 - protein, 13 aa, BORRELIA BURGDORFERI
SRLNQRNIDELKI

SEQ ID NO: 147922 - protein, 13 aa, BORRELIA BURGDORFERI
RLNQRNIDELKIF

SEQ ID NO: 147923 - protein, 13 aa, BORRELIA BURGDORFERI
LNQRNIDELKIFV

SEQ ID NO: 147924 - protein, 13 aa, BORRELIA BURGDORFERI
NQRNIDELKIFVE

SEQ ID NO: 147925 - protein, 13 aa, BORRELIA BURGDORFERI
QRNIDELKIFVEK

SEQ ID NO: 147926 - protein, 13 aa, BORRELIA BURGDORFERI
RNIDELKIFVEKA

SEQ ID NO: 147927 - protein, 13 aa, BORRELIA BURGDORFERI
NIDELKIFVEKAK

SEQ ID NO: 147928 - protein, 13 aa, BORRELIA BURGDORFERI
IDELKIFVEKAKY

SEQ ID NO: 147929 - protein, 13 aa, BORRELIA BURGDORFERI
DELKIFVEKAKYY

SEQ ID NO: 147930 - protein, 13 aa, BORRELIA BURGDORFERI
ELKIFVEKAKYYS

SEQ ID NO: 147931 - protein, 13 aa, BORRELIA BURGDORFERI
LKIFVEKAKYYSI

SEQ ID NO: 147932 - protein, 13 aa, BORRELIA BURGDORFERI
KIFVEKAKYYSIK

SEQ ID NO: 147933 - protein, 13 aa, BORRELIA BURGDORFERI
IFVEKAKYYSIKL

SEQ ID NO: 147934 - protein, 13 aa, BORRELIA BURGDORFERI
FVEKAKYYSIKLD

SEQ ID NO: 147935 - protein, 13 aa, BORRELIA BURGDORFERI
VEKAKYYSIKLDA

SEQ ID NO: 147936 - protein, 13 aa, BORRELIA BURGDORFERI
EKAKYYSIKLDAI

SEQ ID NO: 147937 - protein, 13 aa, BORRELIA BURGDORFERI
KAKYYSIKLDAIY

SEQ ID NO: 147938 - protein, 13 aa, BORRELIA BURGDORFERI
AKYYSIKLDAIYS

SEQ ID NO: 147939 - protein, 13 aa, BORRELIA BURGDORFERI
KYYSIKLDAIYSE

SEQ ID NO: 147940 - protein, 13 aa, BORRELIA BURGDORFERI
YYSIKLDAIYSEY

SEQ ID NO: 147941 - protein, 13 aa, BORRELIA BURGDORFERI
YSIKLDAIYSEYT

SEQ ID NO: 147942 - protein, 13 aa, BORRELIA BURGDORFERI
SIKLDAIYSEYTG

SEQ ID NO: 147943 - protein, 13 aa, BORRELIA BURGDORFERI
IKLDAIYSEYTGA

SEQ ID NO: 147944 - protein, 13 aa, BORRELIA BURGDORFERI
KLDAIYSEYTGAY

SEQ ID NO: 147945 - protein, 13 aa, BORRELIA BURGDORFERI
LDAIYSEYTGAYN

SEQ ID NO: 147946 - protein, 13 aa, BORRELIA BURGDORFERI
DAIYSEYTGAYND

SEQ ID NO: 147947 - protein, 13 aa, BORRELIA BURGDORFERI
AIYSEYTGAYNDI

SEQ ID NO: 147948 - protein, 13 aa, BORRELIA BURGDORFERI
IYSEYTGAYNDIM

SEQ ID NO: 147949 - protein, 13 aa, BORRELIA BURGDORFERI
YSEYTGAYNDIMT

SEQ ID NO: 147950 - protein, 13 aa, BORRELIA BURGDORFERI
SEYTGAYNDIMTY

SEQ ID NO: 147951 - protein, 13 aa, BORRELIA BURGDORFERI
EYTGAYNDIMTYI

SEQ ID NO: 147952 - protein, 13 aa, BORRELIA BURGDORFERI
YTGAYNDIMTYIM

SEQ ID NO: 147953 - protein, 13 aa, BORRELIA BURGDORFERI
TGAYNDIMTYIMT

SEQ ID NO: 147954 - protein, 13 aa, BORRELIA BURGDORFERI
GAYNDIMTYIMTY

SEQ ID NO: 147955 - protein, 13 aa, BORRELIA BURGDORFERI
AYNDIMTYIMTYS

SEQ ID NO: 147956 - protein, 13 aa, BORRELIA BURGDORFERI
YNDIMTYIMTYSE

SEQ ID NO: 147957 - protein, 13 aa, BORRELIA BURGDORFERI
NDIMTYIMTYSEG

SEQ ID NO: 147958 - protein, 13 aa, BORRELIA BURGDORFERI
DIMTYIMTYSEGT

SEQ ID NO: 147959 - protein, 13 aa, BORRELIA BURGDORFERI
IMTYIMTYSEGTS

SEQ ID NO: 147960 - protein, 13 aa, BORRELIA BURGDORFERI
MTYIMTYSEGTSS

SEQ ID NO: 147961 - protein, 13 aa, BORRELIA BURGDORFERI
TYIMTYSEGTSSD

SEQ ID NO: 147962 - protein, 13 aa, BORRELIA BURGDORFERI
YIMTYSEGTSSDK

SEQ ID NO: 147963 - protein, 13 aa, BORRELIA BURGDORFERI
IMTYSEGTSSDKS

SEQ ID NO: 147964 - protein, 13 aa, BORRELIA BURGDORFERI
MTYSEGTSSDKSK

SEQ ID NO: 147965 - protein, 13 aa, BORRELIA BURGDORFERI
TYSEGTSSDKSKV

SEQ ID NO: 147966 - protein, 13 aa, BORRELIA BURGDORFERI
YSEGTSSDKSKVN

SEQ ID NO: 147967 - protein, 13 aa, BORRELIA BURGDORFERI
SEGTSSDKSKVNQ

SEQ ID NO: 147968 - protein, 13 aa, BORRELIA BURGDORFERI
EGTSSDKSKVNQA

SEQ ID NO: 147969 - protein, 13 aa, BORRELIA BURGDORFERI
GTSSDKSKVNQAI

SEQ ID NO: 147970 - protein, 13 aa, BORRELIA BURGDORFERI
TSSDKSKVNQAIS

SEQ ID NO: 147971 - protein, 13 aa, BORRELIA BURGDORFERI
SSDKSKVNQAISI

SEQ ID NO: 147972 - protein, 13 aa, BORRELIA BURGDORFERI
SDKSKVNQAISIL

SEQ ID NO: 147973 - protein, 13 aa, BORRELIA BURGDORFERI
DKSKVNQAISILK

SEQ ID NO: 147974 - protein, 13 aa, BORRELIA BURGDORFERI
KSKVNQAISILKK

SEQ ID NO: 147975 - protein, 13 aa, BORRELIA BURGDORFERI
SKVNQAISILKKD

SEQ ID NO: 147976 - protein, 13 aa, BORRELIA BURGDORFERI
KVNQAISILKKDN

SEQ ID NO: 147977 - protein, 13 aa, BORRELIA BURGDORFERI
VNQAISILKKDNK

SEQ ID NO: 147978 - protein, 13 aa, BORRELIA BURGDORFERI
NQAISILKKDNKI

SEQ ID NO: 147979 - protein, 13 aa, BORRELIA BURGDORFERI
QAISILKKDNKIV

SEQ ID NO: 147980 - protein, 13 aa, BORRELIA BURGDORFERI
AISILKKDNKIVN

SEQ ID NO: 147981 - protein, 13 aa, BORRELIA BURGDORFERI
ISILKKDNKIVNK

SEQ ID NO: 147982 - protein, 13 aa, BORRELIA BURGDORFERI
SILKKDNKIVNKF

SEQ ID NO: 147983 - protein, 13 aa, BORRELIA BURGDORFERI
ILKKDNKIVNKFK

SEQ ID NO: 147984 - protein, 13 aa, BORRELIA BURGDORFERI
LKKDNKIVNKFKE

SEQ ID NO: 147985 - protein, 13 aa, BORRELIA BURGDORFERI
KKDNKIVNKFKEL

SEQ ID NO: 147986 - protein, 13 aa, BORRELIA BURGDORFERI
KDNKIVNKFKELE

SEQ ID NO: 147987 - protein, 13 aa, BORRELIA BURGDORFERI
DNKIVNKFKELEK

SEQ ID NO: 147988 - protein, 13 aa, BORRELIA BURGDORFERI
NKIVNKFKELEKI

SEQ ID NO: 147989 - protein, 13 aa, BORRELIA BURGDORFERI
KIVNKFKELEKII

SEQ ID NO: 147990 - protein, 13 aa, BORRELIA BURGDORFERI
IVNKFKELEKIIE

SEQ ID NO: 147991 - protein, 13 aa, BORRELIA BURGDORFERI
VNKFKELEKIIEE

SEQ ID NO: 147992 - protein, 13 aa, BORRELIA BURGDORFERI
NKFKELEKIIEEY

SEQ ID NO: 147993 - protein, 13 aa, BORRELIA BURGDORFERI
KFKELEKIIEEYK

SEQ ID NO: 147994 - protein, 13 aa, BORRELIA BURGDORFERI
FKELEKIIEEYKP

SEQ ID NO: 147995 - protein, 13 aa, BORRELIA BURGDORFERI
KELEKIIEEYKPM

SEQ ID NO: 147996 - protein, 13 aa, BORRELIA BURGDORFERI
ELEKIIEEYKPMF

SEQ ID NO: 147997 - protein, 13 aa, BORRELIA BURGDORFERI
LEKIIEEYKPMFL

SEQ ID NO: 147998 - protein, 13 aa, BORRELIA BURGDORFERI
EKIIEEYKPMFLS

SEQ ID NO: 147999 - protein, 13 aa, BORRELIA BURGDORFERI
KIIEEYKPMFLSK

SEQ ID NO: 148000 - protein, 13 aa, BORRELIA BURGDORFERI
IIEEYKPMFLSKL

SEQ ID NO: 148001 - protein, 13 aa, BORRELIA BURGDORFERI
IEEYKPMFLSKLI

SEQ ID NO: 148002 - protein, 13 aa, BORRELIA BURGDORFERI
EEYKPMFLSKLID

SEQ ID NO: 148003 - protein, 13 aa, BORRELIA BURGDORFERI
EYKPMFLSKLIDD

SEQ ID NO: 148004 - protein, 13 aa, BORRELIA BURGDORFERI
YKPMFLSKLIDDF

SEQ ID NO: 148005 - protein, 13 aa, BORRELIA BURGDORFERI
KPMFLSKLIDDFA

SEQ ID NO: 148006 - protein, 13 aa, BORRELIA BURGDORFERI
PMFLSKLIDDFAI

SEQ ID NO: 148007 - protein, 13 aa, BORRELIA BURGDORFERI
MFLSKLIDDFAIE

SEQ ID NO: 148008 - protein, 13 aa, BORRELIA BURGDORFERI
FLSKLIDDFAIEL

SEQ ID NO: 148009 - protein, 13 aa, BORRELIA BURGDORFERI
LSKLIDDFAIELD

SEQ ID NO: 148010 - protein, 13 aa, BORRELIA BURGDORFERI
SKLIDDFAIELDQ

SEQ ID NO: 148011 - protein, 13 aa, BORRELIA BURGDORFERI
KLIDDFAIELDQA

SEQ ID NO: 148012 - protein, 13 aa, BORRELIA BURGDORFERI
LIDDFAIELDQAV

SEQ ID NO: 148013 - protein, 13 aa, BORRELIA BURGDORFERI
IDDFAIELDQAVD

SEQ ID NO: 148014 - protein, 13 aa, BORRELIA BURGDORFERI
DDFAIELDQAVDN

SEQ ID NO: 148015 - protein, 13 aa, BORRELIA BURGDORFERI
DFAIELDQAVDND

SEQ ID NO: 148016 - protein, 13 aa, BORRELIA BURGDORFERI
FAIELDQAVDNDV

SEQ ID NO: 148017 - protein, 13 aa, BORRELIA BURGDORFERI
AIELDQAVDNDVS

SEQ ID NO: 148018 - protein, 13 aa, BORRELIA BURGDORFERI
IELDQAVDNDVSN

SEQ ID NO: 148019 - protein, 13 aa, BORRELIA BURGDORFERI
ELDQAVDNDVSNA

SEQ ID NO: 148020 - protein, 13 aa, BORRELIA BURGDORFERI
LDQAVDNDVSNAR

SEQ ID NO: 148021 - protein, 13 aa, BORRELIA BURGDORFERI
DQAVDNDVSNARH

SEQ ID NO: 148022 - protein, 13 aa, BORRELIA BURGDORFERI
QAVDNDVSNARHV

SEQ ID NO: 148023 - protein, 13 aa, BORRELIA BURGDORFERI
AVDNDVSNARHVA

SEQ ID NO: 148024 - protein, 13 aa, BORRELIA BURGDORFERI
VDNDVSNARHVAD

SEQ ID NO: 148025 - protein, 13 aa, BORRELIA BURGDORFERI
DNDVSNARHVADS

SEQ ID NO: 148026 - protein, 13 aa, BORRELIA BURGDORFERI
NDVSNARHVADSY

SEQ ID NO: 148027 - protein, 13 aa, BORRELIA BURGDORFERI
DVSNARHVADSYE

SEQ ID NO: 148028 - protein, 13 aa, BORRELIA BURGDORFERI
VSNARHVADSYEK

SEQ ID NO: 148029 - protein, 13 aa, BORRELIA BURGDORFERI
SNARHVADSYEKL

SEQ ID NO: 148030 - protein, 13 aa, BORRELIA BURGDORFERI
NARHVADSYEKLR

SEQ ID NO: 148031 - protein, 13 aa, BORRELIA BURGDORFERI
ARHVADSYEKLRK

SEQ ID NO: 148032 - protein, 13 aa, BORRELIA BURGDORFERI
RHVADSYEKLRKS

SEQ ID NO: 148033 - protein, 13 aa, BORRELIA BURGDORFERI
HVADSYEKLRKSV

SEQ ID NO: 148034 - protein, 13 aa, BORRELIA BURGDORFERI
VADSYEKLRKSVA

SEQ ID NO: 148035 - protein, 13 aa, BORRELIA BURGDORFERI
ADSYEKLRKSVAL

SEQ ID NO: 148036 - protein, 13 aa, BORRELIA BURGDORFERI
DSYEKLRKSVALA

SEQ ID NO: 148037 - protein, 13 aa, BORRELIA BURGDORFERI
SYEKLRKSVALAY

SEQ ID NO: 148038 - protein, 13 aa, BORRELIA BURGDORFERI
YEKLRKSVALAYI

SEQ ID NO: 148039 - protein, 13 aa, BORRELIA BURGDORFERI
EKLRKSVALAYIE

SEQ ID NO: 148040 - protein, 13 aa, BORRELIA BURGDORFERI
KLRKSVALAYIES

SEQ ID NO: 148041 - protein, 13 aa, BORRELIA BURGDORFERI
LRKSVALAYIESF

SEQ ID NO: 148042 - protein, 13 aa, BORRELIA BURGDORFERI
RKSVALAYIESFD

SEQ ID NO: 148043 - protein, 13 aa, BORRELIA BURGDORFERI
KSVALAYIESFDV

SEQ ID NO: 148044 - protein, 13 aa, BORRELIA BURGDORFERI
SVALAYIESFDVI

SEQ ID NO: 148045 - protein, 13 aa, BORRELIA BURGDORFERI
VALAYIESFDVIS

SEQ ID NO: 148046 - protein, 13 aa, BORRELIA BURGDORFERI
ALAYIESFDVISS

SEQ ID NO: 148047 - protein, 13 aa, BORRELIA BURGDORFERI
LAYIESFDVISSK

SEQ ID NO: 148048 - protein, 13 aa, BORRELIA BURGDORFERI
AYIESFDVISSKF

SEQ ID NO: 148049 - protein, 13 aa, BORRELIA BURGDORFERI
YIESFDVISSKFV

SEQ ID NO: 148050 - protein, 13 aa, BORRELIA BURGDORFERI
IESFDVISSKFVD

SEQ ID NO: 148051 - protein, 13 aa, BORRELIA BURGDORFERI
ESFDVISSKFVDS

SEQ ID NO: 148052 - protein, 13 aa, BORRELIA BURGDORFERI
SFDVISSKFVDSK

SEQ ID NO: 148053 - protein, 13 aa, BORRELIA BURGDORFERI
FDVISSKFVDSKF

SEQ ID NO: 148054 - protein, 13 aa, BORRELIA BURGDORFERI
DVISSKFVDSKFV

SEQ ID NO: 148055 - protein, 13 aa, BORRELIA BURGDORFERI
VISSKFVDSKFVE

SEQ ID NO: 148056 - protein, 13 aa, BORRELIA BURGDORFERI
ISSKFVDSKFVEA

SEQ ID NO: 148057 - protein, 13 aa, BORRELIA BURGDORFERI
SSKFVDSKFVEAS

SEQ ID NO: 148058 - protein, 13 aa, BORRELIA BURGDORFERI
SKFVDSKFVEASK

SEQ ID NO: 148059 - protein, 13 aa, BORRELIA BURGDORFERI
KFVDSKFVEASKK

SEQ ID NO: 148060 - protein, 13 aa, BORRELIA BURGDORFERI
FVDSKFVEASKKF

SEQ ID NO: 148061 - protein, 13 aa, BORRELIA BURGDORFERI
VDSKFVEASKKFV

SEQ ID NO: 148062 - protein, 13 aa, BORRELIA BURGDORFERI
DSKFVEASKKFVN

SEQ ID NO: 148063 - protein, 13 aa, BORRELIA BURGDORFERI
SKFVEASKKFVNK

SEQ ID NO: 148064 - protein, 13 aa, BORRELIA BURGDORFERI
KFVEASKKFVNKA

SEQ ID NO: 148065 - protein, 13 aa, BORRELIA BURGDORFERI
FVEASKKFVNKAK

SEQ ID NO: 148066 - protein, 13 aa, BORRELIA BURGDORFERI
VEASKKFVNKAKE

SEQ ID NO: 148067 - protein, 13 aa, BORRELIA BURGDORFERI
EASKKFVNKAKEF

SEQ ID NO: 148068 - protein, 13 aa, BORRELIA BURGDORFERI
ASKKFVNKAKEFV

SEQ ID NO: 148069 - protein, 13 aa, BORRELIA BURGDORFERI
SKKFVNKAKEFVE

SEQ ID NO: 148070 - protein, 13 aa, BORRELIA BURGDORFERI
KKFVNKAKEFVEE

SEQ ID NO: 148071 - protein, 13 aa, BORRELIA BURGDORFERI
KFVNKAKEFVEEN

SEQ ID NO: 148072 - protein, 13 aa, BORRELIA BURGDORFERI
FVNKAKEFVEEND

SEQ ID NO: 148073 - protein, 13 aa, BORRELIA BURGDORFERI
VNKAKEFVEENDL

SEQ ID NO: 148074 - protein, 13 aa, BORRELIA BURGDORFERI
NKAKEFVEENDLI

SEQ ID NO: 148075 - protein, 13 aa, BORRELIA BURGDORFERI
KAKEFVEENDLIA

SEQ ID NO: 148076 - protein, 13 aa, BORRELIA BURGDORFERI
AKEFVEENDLIAL

SEQ ID NO: 148077 - protein, 13 aa, BORRELIA BURGDORFERI
KEFVEENDLIALK

SEQ ID NO: 148078 - protein, 13 aa, BORRELIA BURGDORFERI
EFVEENDLIALKC

SEQ ID NO: 148079 - protein, 13 aa, BORRELIA BURGDORFERI
FVEENDLIALKCI

SEQ ID NO: 148080 - protein, 13 aa, BORRELIA BURGDORFERI
VEENDLIALKCIV

SEQ ID NO: 148081 - protein, 13 aa, BORRELIA BURGDORFERI
EENDLIALKCIVK

SEQ ID NO: 148082 - protein, 13 aa, BORRELIA BURGDORFERI
ENDLIALKCIVKT

SEQ ID NO: 148083 - protein, 13 aa, BORRELIA BURGDORFERI
NDLIALKCIVKTI

SEQ ID NO: 148084 - protein, 13 aa, BORRELIA BURGDORFERI
DLIALKCIVKTIG

SEQ ID NO: 148085 - protein, 13 aa, BORRELIA BURGDORFERI
LIALKCIVKTIGD

SEQ ID NO: 148086 - protein, 13 aa, BORRELIA BURGDORFERI
IALKCIVKTIGDM

SEQ ID NO: 148087 - protein, 13 aa, BORRELIA BURGDORFERI
ALKCIVKTIGDMV

SEQ ID NO: 148088 - protein, 13 aa, BORRELIA BURGDORFERI
LKCIVKTIGDMVN

SEQ ID NO: 148089 - protein, 13 aa, BORRELIA BURGDORFERI
KCIVKTIGDMVND

SEQ ID NO: 148090 - protein, 13 aa, BORRELIA BURGDORFERI
CIVKTIGDMVNDR

SEQ ID NO: 148091 - protein, 13 aa, BORRELIA BURGDORFERI
IVKTIGDMVNDRE

SEQ ID NO: 148092 - protein, 13 aa, BORRELIA BURGDORFERI
VKTIGDMVNDREI

SEQ ID NO: 148093 - protein, 13 aa, BORRELIA BURGDORFERI
KTIGDMVNDREIN

SEQ ID NO: 148094 - protein, 13 aa, BORRELIA BURGDORFERI
TIGDMVNDREINS

SEQ ID NO: 148095 - protein, 13 aa, BORRELIA BURGDORFERI
IGDMVNDREINSR

SEQ ID NO: 148096 - protein, 13 aa, BORRELIA BURGDORFERI
GDMVNDREINSRS

SEQ ID NO: 148097 - protein, 13 aa, BORRELIA BURGDORFERI
DMVNDREINSRSR

SEQ ID NO: 148098 - protein, 13 aa, BORRELIA BURGDORFERI
MVNDREINSRSRY

SEQ ID NO: 148099 - protein, 13 aa, BORRELIA BURGDORFERI
VNDREINSRSRYN

SEQ ID NO: 148100 - protein, 13 aa, BORRELIA BURGDORFERI
NDREINSRSRYNN

SEQ ID NO: 148101 - protein, 13 aa, BORRELIA BURGDORFERI
DREINSRSRYNNF

SEQ ID NO: 148102 - protein, 13 aa, BORRELIA BURGDORFERI
REINSRSRYNNFY

SEQ ID NO: 148103 - protein, 13 aa, BORRELIA BURGDORFERI
EINSRSRYNNFYK

SEQ ID NO: 148104 - protein, 13 aa, BORRELIA BURGDORFERI
INSRSRYNNFYKK

SEQ ID NO: 148105 - protein, 13 aa, BORRELIA BURGDORFERI
NSRSRYNNFYKKE

SEQ ID NO: 148106 - protein, 13 aa, BORRELIA BURGDORFERI
SRSRYNNFYKKEA

SEQ ID NO: 148107 - protein, 13 aa, BORRELIA BURGDORFERI
RSRYNNFYKKEAD

SEQ ID NO: 148108 - protein, 13 aa, BORRELIA BURGDORFERI
SRYNNFYKKEADF

SEQ ID NO: 148109 - protein, 13 aa, BORRELIA BURGDORFERI
RYNNFYKKEADFL

SEQ ID NO: 148110 - protein, 13 aa, BORRELIA BURGDORFERI
YNNFYKKEADFLG

SEQ ID NO: 148111 - protein, 13 aa, BORRELIA BURGDORFERI
NNFYKKEADFLGA

SEQ ID NO: 148112 - protein, 13 aa, BORRELIA BURGDORFERI
NFYKKEADFLGAA

SEQ ID NO: 148113 - protein, 13 aa, BORRELIA BURGDORFERI
FYKKEADFLGAAV

SEQ ID NO: 148114 - protein, 13 aa, BORRELIA BURGDORFERI
YKKEADFLGAAVE

SEQ ID NO: 148115 - protein, 13 aa, BORRELIA BURGDORFERI
KKEADFLGAAVEL

SEQ ID NO: 148116 - protein, 13 aa, BORRELIA BURGDORFERI
KEADFLGAAVELE

SEQ ID NO: 148117 - protein, 13 aa, BORRELIA BURGDORFERI
EADFLGAAVELEG

SEQ ID NO: 148118 - protein, 13 aa, BORRELIA BURGDORFERI
ADFLGAAVELEGA

SEQ ID NO: 148119 - protein, 13 aa, BORRELIA BURGDORFERI
DFLGAAVELEGAY

SEQ ID NO: 148120 - protein, 13 aa, BORRELIA BURGDORFERI
FLGAAVELEGAYK

SEQ ID NO: 148121 - protein, 13 aa, BORRELIA BURGDORFERI
LGAAVELEGAYKA

SEQ ID NO: 148122 - protein, 13 aa, BORRELIA BURGDORFERI
GAAVELEGAYKAI

SEQ ID NO: 148123 - protein, 13 aa, BORRELIA BURGDORFERI
AAVELEGAYKAIK

SEQ ID NO: 148124 - protein, 13 aa, BORRELIA BURGDORFERI
AVELEGAYKAIKQ

SEQ ID NO: 148125 - protein, 13 aa, BORRELIA BURGDORFERI
VELEGAYKAIKQT

SEQ ID NO: 148126 - protein, 13 aa, BORRELIA BURGDORFERI
ELEGAYKAIKQTL

SEQ ID NO: 148127 - protein, 13 aa, BORRELIA BURGDORFERI
LEGAYKAIKQTLL

SEQ ID NO: 148128 - protein, 14 aa, BORRELIA BURGDORFERI
MKKSFLSIYMLISI

SEQ ID NO: 148129 - protein, 14 aa, BORRELIA BURGDORFERI
KKSFLSIYMLISIS

SEQ ID NO: 148130 - protein, 14 aa, BORRELIA BURGDORFERI
KSFLSIYMLISISL

SEQ ID NO: 148131 - protein, 14 aa, BORRELIA BURGDORFERI
SFLSIYMLISISLL

SEQ ID NO: 148132 - protein, 14 aa, BORRELIA BURGDORFERI
FLSIYMLISISLLS

SEQ ID NO: 148133 - protein, 14 aa, BORRELIA BURGDORFERI
LSIYMLISISLLSC

SEQ ID NO: 148134 - protein, 14 aa, BORRELIA BURGDORFERI
SIYMLISISLLSCD

SEQ ID NO: 148135 - protein, 14 aa, BORRELIA BURGDORFERI
IYMLISISLLSCDV

SEQ ID NO: 148136 - protein, 14 aa, BORRELIA BURGDORFERI
YMLISISLLSCDVS

SEQ ID NO: 148137 - protein, 14 aa, BORRELIA BURGDORFERI
MLISISLLSCDVSR

SEQ ID NO: 148138 - protein, 14 aa, BORRELIA BURGDORFERI
LISISLLSCDVSRL

SEQ ID NO: 148139 - protein, 14 aa, BORRELIA BURGDORFERI
ISISLLSCDVSRLN

SEQ ID NO: 148140 - protein, 14 aa, BORRELIA BURGDORFERI
SISLLSCDVSRLNQ

SEQ ID NO: 148141 - protein, 14 aa, BORRELIA BURGDORFERI
ISLLSCDVSRLNQR

SEQ ID NO: 148142 - protein, 14 aa, BORRELIA BURGDORFERI
SLLSCDVSRLNQRN

SEQ ID NO: 148143 - protein, 14 aa, BORRELIA BURGDORFERI
LLSCDVSRLNQRNI

SEQ ID NO: 148144 - protein, 14 aa, BORRELIA BURGDORFERI
LSCDVSRLNQRNID

SEQ ID NO: 148145 - protein, 14 aa, BORRELIA BURGDORFERI
SCDVSRLNQRNIDE

SEQ ID NO: 148146 - protein, 14 aa, BORRELIA BURGDORFERI
CDVSRLNQRNIDEL

SEQ ID NO: 148147 - protein, 14 aa, BORRELIA BURGDORFERI
DVSRLNQRNIDELK

SEQ ID NO: 148148 - protein, 14 aa, BORRELIA BURGDORFERI
VSRLNQRNIDELKI

SEQ ID NO: 148149 - protein, 14 aa, BORRELIA BURGDORFERI
SRLNQRNIDELKIF

SEQ ID NO: 148150 - protein, 14 aa, BORRELIA BURGDORFERI
RLNQRNIDELKIFV

SEQ ID NO: 148151 - protein, 14 aa, BORRELIA BURGDORFERI
LNQRNIDELKIFVE

SEQ ID NO: 148152 - protein, 14 aa, BORRELIA BURGDORFERI
NQRNIDELKIFVEK

SEQ ID NO: 148153 - protein, 14 aa, BORRELIA BURGDORFERI
QRNIDELKIFVEKA

SEQ ID NO: 148154 - protein, 14 aa, BORRELIA BURGDORFERI
RNIDELKIFVEKAK

SEQ ID NO: 148155 - protein, 14 aa, BORRELIA BURGDORFERI
NIDELKIFVEKAKY

SEQ ID NO: 148156 - protein, 14 aa, BORRELIA BURGDORFERI
IDELKIFVEKAKYY

SEQ ID NO: 148157 - protein, 14 aa, BORRELIA BURGDORFERI
DELKIFVEKAKYYS

SEQ ID NO: 148158 - protein, 14 aa, BORRELIA BURGDORFERI
ELKIFVEKAKYYSI

SEQ ID NO: 148159 - protein, 14 aa, BORRELIA BURGDORFERI
LKIFVEKAKYYSIK

SEQ ID NO: 148160 - protein, 14 aa, BORRELIA BURGDORFERI
KIFVEKAKYYSIKL

SEQ ID NO: 148161 - protein, 14 aa, BORRELIA BURGDORFERI
IFVEKAKYYSIKLD

SEQ ID NO: 148162 - protein, 14 aa, BORRELIA BURGDORFERI
FVEKAKYYSIKLDA

SEQ ID NO: 148163 - protein, 14 aa, BORRELIA BURGDORFERI
VEKAKYYSIKLDAI

SEQ ID NO: 148164 - protein, 14 aa, BORRELIA BURGDORFERI
EKAKYYSIKLDAIY

SEQ ID NO: 148165 - protein, 14 aa, BORRELIA BURGDORFERI
KAKYYSIKLDAIYS

SEQ ID NO: 148166 - protein, 14 aa, BORRELIA BURGDORFERI
AKYYSIKLDAIYSE

SEQ ID NO: 148167 - protein, 14 aa, BORRELIA BURGDORFERI
KYYSIKLDAIYSEY

SEQ ID NO: 148168 - protein, 14 aa, BORRELIA BURGDORFERI
YYSIKLDAIYSEYT

SEQ ID NO: 148169 - protein, 14 aa, BORRELIA BURGDORFERI
YSIKLDAIYSEYTG

SEQ ID NO: 148170 - protein, 14 aa, BORRELIA BURGDORFERI
SIKLDAIYSEYTGA

SEQ ID NO: 148171 - protein, 14 aa, BORRELIA BURGDORFERI
IKLDAIYSEYTGAY

SEQ ID NO: 148172 - protein, 14 aa, BORRELIA BURGDORFERI
KLDAIYSEYTGAYN

SEQ ID NO: 148173 - protein, 14 aa, BORRELIA BURGDORFERI
LDAIYSEYTGAYND

SEQ ID NO: 148174 - protein, 14 aa, BORRELIA BURGDORFERI
DAIYSEYTGAYNDI

SEQ ID NO: 148175 - protein, 14 aa, BORRELIA BURGDORFERI
AIYSEYTGAYNDIM

SEQ ID NO: 148176 - protein, 14 aa, BORRELIA BURGDORFERI
IYSEYTGAYNDIMT

SEQ ID NO: 148177 - protein, 14 aa, BORRELIA BURGDORFERI
YSEYTGAYNDIMTY

SEQ ID NO: 148178 - protein, 14 aa, BORRELIA BURGDORFERI
SEYTGAYNDIMTYI

SEQ ID NO: 148179 - protein, 14 aa, BORRELIA BURGDORFERI
EYTGAYNDIMTYIM

SEQ ID NO: 148180 - protein, 14 aa, BORRELIA BURGDORFERI
YTGAYNDIMTYIMT

SEQ ID NO: 148181 - protein, 14 aa, BORRELIA BURGDORFERI
TGAYNDIMTYIMTY

SEQ ID NO: 148182 - protein, 14 aa, BORRELIA BURGDORFERI
GAYNDIMTYIMTYS

SEQ ID NO: 148183 - protein, 14 aa, BORRELIA BURGDORFERI
AYNDIMTYIMTYSE

SEQ ID NO: 148184 - protein, 14 aa, BORRELIA BURGDORFERI
YNDIMTYIMTYSEG

SEQ ID NO: 148185 - protein, 14 aa, BORRELIA BURGDORFERI
NDIMTYIMTYSEGT

SEQ ID NO: 148186 - protein, 14 aa, BORRELIA BURGDORFERI
DIMTYIMTYSEGTS

SEQ ID NO: 148187 - protein, 14 aa, BORRELIA BURGDORFERI
IMTYIMTYSEGTSS

SEQ ID NO: 148188 - protein, 14 aa, BORRELIA BURGDORFERI
MTYIMTYSEGTSSD

SEQ ID NO: 148189 - protein, 14 aa, BORRELIA BURGDORFERI
TYIMTYSEGTSSDK

SEQ ID NO: 148190 - protein, 14 aa, BORRELIA BURGDORFERI
YIMTYSEGTSSDKS

SEQ ID NO: 148191 - protein, 14 aa, BORRELIA BURGDORFERI
IMTYSEGTSSDKSK

SEQ ID NO: 148192 - protein, 14 aa, BORRELIA BURGDORFERI
MTYSEGTSSDKSKV

SEQ ID NO: 148193 - protein, 14 aa, BORRELIA BURGDORFERI
TYSEGTSSDKSKVN

SEQ ID NO: 148194 - protein, 14 aa, BORRELIA BURGDORFERI
YSEGTSSDKSKVNQ

SEQ ID NO: 148195 - protein, 14 aa, BORRELIA BURGDORFERI
SEGTSSDKSKVNQA

SEQ ID NO: 148196 - protein, 14 aa, BORRELIA BURGDORFERI
EGTSSDKSKVNQAI

SEQ ID NO: 148197 - protein, 14 aa, BORRELIA BURGDORFERI
GTSSDKSKVNQAIS

SEQ ID NO: 148198 - protein, 14 aa, BORRELIA BURGDORFERI
TSSDKSKVNQAISI

SEQ ID NO: 148199 - protein, 14 aa, BORRELIA BURGDORFERI
SSDKSKVNQAISIL

SEQ ID NO: 148200 - protein, 14 aa, BORRELIA BURGDORFERI
SDKSKVNQAISILK

SEQ ID NO: 148201 - protein, 14 aa, BORRELIA BURGDORFERI
DKSKVNQAISILKK

SEQ ID NO: 148202 - protein, 14 aa, BORRELIA BURGDORFERI
KSKVNQAISILKKD

SEQ ID NO: 148203 - protein, 14 aa, BORRELIA BURGDORFERI
SKVNQAISILKKDN

SEQ ID NO: 148204 - protein, 14 aa, BORRELIA BURGDORFERI
KVNQAISILKKDNK

SEQ ID NO: 148205 - protein, 14 aa, BORRELIA BURGDORFERI
VNQAISILKKDNKI

SEQ ID NO: 148206 - protein, 14 aa, BORRELIA BURGDORFERI
NQAISILKKDNKIV

SEQ ID NO: 148207 - protein, 14 aa, BORRELIA BURGDORFERI
QAISILKKDNKIVN

SEQ ID NO: 148208 - protein, 14 aa, BORRELIA BURGDORFERI
AISILKKDNKIVNK

SEQ ID NO: 148209 - protein, 14 aa, BORRELIA BURGDORFERI
ISILKKDNKIVNKF

SEQ ID NO: 148210 - protein, 14 aa, BORRELIA BURGDORFERI
SILKKDNKIVNKFK

SEQ ID NO: 148211 - protein, 14 aa, BORRELIA BURGDORFERI
ILKKDNKIVNKFKE

SEQ ID NO: 148212 - protein, 14 aa, BORRELIA BURGDORFERI
LKKDNKIVNKFKEL

SEQ ID NO: 148213 - protein, 14 aa, BORRELIA BURGDORFERI
KKDNKIVNKFKELE

SEQ ID NO: 148214 - protein, 14 aa, BORRELIA BURGDORFERI
KDNKIVNKFKELEK

SEQ ID NO: 148215 - protein, 14 aa, BORRELIA BURGDORFERI
DNKIVNKFKELEKI

SEQ ID NO: 148216 - protein, 14 aa, BORRELIA BURGDORFERI
NKIVNKFKELEKII

SEQ ID NO: 148217 - protein, 14 aa, BORRELIA BURGDORFERI
KIVNKFKELEKIIE

SEQ ID NO: 148218 - protein, 14 aa, BORRELIA BURGDORFERI
IVNKFKELEKIIEE

SEQ ID NO: 148219 - protein, 14 aa, BORRELIA BURGDORFERI
VNKFKELEKIIEEY

SEQ ID NO: 148220 - protein, 14 aa, BORRELIA BURGDORFERI
NKFKELEKIIEEYK

SEQ ID NO: 148221 - protein, 14 aa, BORRELIA BURGDORFERI
KFKELEKIIEEYKP

SEQ ID NO: 148222 - protein, 14 aa, BORRELIA BURGDORFERI
FKELEKIIEEYKPM

SEQ ID NO: 148223 - protein, 14 aa, BORRELIA BURGDORFERI
KELEKIIEEYKPMF

SEQ ID NO: 148224 - protein, 14 aa, BORRELIA BURGDORFERI
ELEKIIEEYKPMFL

SEQ ID NO: 148225 - protein, 14 aa, BORRELIA BURGDORFERI
LEKIIEEYKPMFLS

SEQ ID NO: 148226 - protein, 14 aa, BORRELIA BURGDORFERI
EKIIEEYKPMFLSK

SEQ ID NO: 148227 - protein, 14 aa, BORRELIA BURGDORFERI
KIIEEYKPMFLSKL

SEQ ID NO: 148228 - protein, 14 aa, BORRELIA BURGDORFERI
IIEEYKPMFLSKLI

SEQ ID NO: 148229 - protein, 14 aa, BORRELIA BURGDORFERI
IEEYKPMFLSKLID

SEQ ID NO: 148230 - protein, 14 aa, BORRELIA BURGDORFERI
EEYKPMFLSKLIDD

SEQ ID NO: 148231 - protein, 14 aa, BORRELIA BURGDORFERI
EYKPMFLSKLIDDF

SEQ ID NO: 148232 - protein, 14 aa, BORRELIA BURGDORFERI
YKPMFLSKLIDDFA

SEQ ID NO: 148233 - protein, 14 aa, BORRELIA BURGDORFERI
KPMFLSKLIDDFAI

SEQ ID NO: 148234 - protein, 14 aa, BORRELIA BURGDORFERI
PMFLSKLIDDFAIE

SEQ ID NO: 148235 - protein, 14 aa, BORRELIA BURGDORFERI
MFLSKLIDDFAIEL

SEQ ID NO: 148236 - protein, 14 aa, BORRELIA BURGDORFERI
FLSKLIDDFAIELD

SEQ ID NO: 148237 - protein, 14 aa, BORRELIA BURGDORFERI
LSKLIDDFAIELDQ

SEQ ID NO: 148238 - protein, 14 aa, BORRELIA BURGDORFERI
SKLIDDFAIELDQA

SEQ ID NO: 148239 - protein, 14 aa, BORRELIA BURGDORFERI
KLIDDFAIELDQAV

SEQ ID NO: 148240 - protein, 14 aa, BORRELIA BURGDORFERI
LIDDFAIELDQAVD

SEQ ID NO: 148241 - protein, 14 aa, BORRELIA BURGDORFERI
IDDFAIELDQAVDN

SEQ ID NO: 148242 - protein, 14 aa, BORRELIA BURGDORFERI
DDFAIELDQAVDND

SEQ ID NO: 148243 - protein, 14 aa, BORRELIA BURGDORFERI
DFAIELDQAVDNDV

SEQ ID NO: 148244 - protein, 14 aa, BORRELIA BURGDORFERI
FAIELDQAVDNDVS

SEQ ID NO: 148245 - protein, 14 aa, BORRELIA BURGDORFERI
AIELDQAVDNDVSN

SEQ ID NO: 148246 - protein, 14 aa, BORRELIA BURGDORFERI
IELDQAVDNDVSNA

SEQ ID NO: 148247 - protein, 14 aa, BORRELIA BURGDORFERI
ELDQAVDNDVSNAR

SEQ ID NO: 148248 - protein, 14 aa, BORRELIA BURGDORFERI
LDQAVDNDVSNARH

SEQ ID NO: 148249 - protein, 14 aa, BORRELIA BURGDORFERI
DQAVDNDVSNARHV

SEQ ID NO: 148250 - protein, 14 aa, BORRELIA BURGDORFERI
QAVDNDVSNARHVA

SEQ ID NO: 148251 - protein, 14 aa, BORRELIA BURGDORFERI
AVDNDVSNARHVAD

SEQ ID NO: 148252 - protein, 14 aa, BORRELIA BURGDORFERI
VDNDVSNARHVADS

SEQ ID NO: 148253 - protein, 14 aa, BORRELIA BURGDORFERI
DNDVSNARHVADSY

SEQ ID NO: 148254 - protein, 14 aa, BORRELIA BURGDORFERI
NDVSNARHVADSYE

SEQ ID NO: 148255 - protein, 14 aa, BORRELIA BURGDORFERI
DVSNARHVADSYEK

SEQ ID NO: 148256 - protein, 14 aa, BORRELIA BURGDORFERI
VSNARHVADSYEKL

SEQ ID NO: 148257 - protein, 14 aa, BORRELIA BURGDORFERI
SNARHVADSYEKLR

SEQ ID NO: 148258 - protein, 14 aa, BORRELIA BURGDORFERI
NARHVADSYEKLRK

SEQ ID NO: 148259 - protein, 14 aa, BORRELIA BURGDORFERI
ARHVADSYEKLRKS

SEQ ID NO: 148260 - protein, 14 aa, BORRELIA BURGDORFERI
RHVADSYEKLRKSV

SEQ ID NO: 148261 - protein, 14 aa, BORRELIA BURGDORFERI
HVADSYEKLRKSVA

SEQ ID NO: 148262 - protein, 14 aa, BORRELIA BURGDORFERI
VADSYEKLRKSVAL

SEQ ID NO: 148263 - protein, 14 aa, BORRELIA BURGDORFERI
ADSYEKLRKSVALA

SEQ ID NO: 148264 - protein, 14 aa, BORRELIA BURGDORFERI
DSYEKLRKSVALAY

SEQ ID NO: 148265 - protein, 14 aa, BORRELIA BURGDORFERI
SYEKLRKSVALAYI

SEQ ID NO: 148266 - protein, 14 aa, BORRELIA BURGDORFERI
YEKLRKSVALAYIE

SEQ ID NO: 148267 - protein, 14 aa, BORRELIA BURGDORFERI
EKLRKSVALAYIES

SEQ ID NO: 148268 - protein, 14 aa, BORRELIA BURGDORFERI
KLRKSVALAYIESF

SEQ ID NO: 148269 - protein, 14 aa, BORRELIA BURGDORFERI
LRKSVALAYIESFD

SEQ ID NO: 148270 - protein, 14 aa, BORRELIA BURGDORFERI
RKSVALAYIESFDV

SEQ ID NO: 148271 - protein, 14 aa, BORRELIA BURGDORFERI
KSVALAYIESFDVI

SEQ ID NO: 148272 - protein, 14 aa, BORRELIA BURGDORFERI
SVALAYIESFDVIS

SEQ ID NO: 148273 - protein, 14 aa, BORRELIA BURGDORFERI
VALAYIESFDVISS

SEQ ID NO: 148274 - protein, 14 aa, BORRELIA BURGDORFERI
ALAYIESFDVISSK

SEQ ID NO: 148275 - protein, 14 aa, BORRELIA BURGDORFERI
LAYIESFDVISSKF

SEQ ID NO: 148276 - protein, 14 aa, BORRELIA BURGDORFERI
AYIESFDVISSKFV

SEQ ID NO: 148277 - protein, 14 aa, BORRELIA BURGDORFERI
YIESFDVISSKFVD

SEQ ID NO: 148278 - protein, 14 aa, BORRELIA BURGDORFERI
IESFDVISSKFVDS

SEQ ID NO: 148279 - protein, 14 aa, BORRELIA BURGDORFERI
ESFDVISSKFVDSK

SEQ ID NO: 148280 - protein, 14 aa, BORRELIA BURGDORFERI
SFDVISSKFVDSKF

SEQ ID NO: 148281 - protein, 14 aa, BORRELIA BURGDORFERI
FDVISSKFVDSKFV

SEQ ID NO: 148282 - protein, 14 aa, BORRELIA BURGDORFERI
DVISSKFVDSKFVE

SEQ ID NO: 148283 - protein, 14 aa, BORRELIA BURGDORFERI
VISSKFVDSKFVEA

SEQ ID NO: 148284 - protein, 14 aa, BORRELIA BURGDORFERI
ISSKFVDSKFVEAS

SEQ ID NO: 148285 - protein, 14 aa, BORRELIA BURGDORFERI
SSKFVDSKFVEASK

SEQ ID NO: 148286 - protein, 14 aa, BORRELIA BURGDORFERI
SKFVDSKFVEASKK

SEQ ID NO: 148287 - protein, 14 aa, BORRELIA BURGDORFERI
KFVDSKFVEASKKF

SEQ ID NO: 148288 - protein, 14 aa, BORRELIA BURGDORFERI
FVDSKFVEASKKFV

SEQ ID NO: 148289 - protein, 14 aa, BORRELIA BURGDORFERI
VDSKFVEASKKFVN

SEQ ID NO: 148290 - protein, 14 aa, BORRELIA BURGDORFERI
DSKFVEASKKFVNK

SEQ ID NO: 148291 - protein, 14 aa, BORRELIA BURGDORFERI
SKFVEASKKFVNKA

SEQ ID NO: 148292 - protein, 14 aa, BORRELIA BURGDORFERI
KFVEASKKFVNKAK

SEQ ID NO: 148293 - protein, 14 aa, BORRELIA BURGDORFERI
FVEASKKFVNKAKE

SEQ ID NO: 148294 - protein, 14 aa, BORRELIA BURGDORFERI
VEASKKFVNKAKEF

SEQ ID NO: 148295 - protein, 14 aa, BORRELIA BURGDORFERI
EASKKFVNKAKEFV

SEQ ID NO: 148296 - protein, 14 aa, BORRELIA BURGDORFERI
ASKKFVNKAKEFVE

SEQ ID NO: 148297 - protein, 14 aa, BORRELIA BURGDORFERI
SKKFVNKAKEFVEE

SEQ ID NO: 148298 - protein, 14 aa, BORRELIA BURGDORFERI
KKFVNKAKEFVEEN

SEQ ID NO: 148299 - protein, 14 aa, BORRELIA BURGDORFERI
KFVNKAKEFVEEND

SEQ ID NO: 148300 - protein, 14 aa, BORRELIA BURGDORFERI
FVNKAKEFVEENDL

SEQ ID NO: 148301 - protein, 14 aa, BORRELIA BURGDORFERI
VNKAKEFVEENDLI

SEQ ID NO: 148302 - protein, 14 aa, BORRELIA BURGDORFERI
NKAKEFVEENDLIA

SEQ ID NO: 148303 - protein, 14 aa, BORRELIA BURGDORFERI
KAKEFVEENDLIAL

SEQ ID NO: 148304 - protein, 14 aa, BORRELIA BURGDORFERI
AKEFVEENDLIALK

SEQ ID NO: 148305 - protein, 14 aa, BORRELIA BURGDORFERI
KEFVEENDLIALKC

SEQ ID NO: 148306 - protein, 14 aa, BORRELIA BURGDORFERI
EFVEENDLIALKCI

SEQ ID NO: 148307 - protein, 14 aa, BORRELIA BURGDORFERI
FVEENDLIALKCIV

SEQ ID NO: 148308 - protein, 14 aa, BORRELIA BURGDORFERI
VEENDLIALKCIVK

SEQ ID NO: 148309 - protein, 14 aa, BORRELIA BURGDORFERI
EENDLIALKCIVKT

SEQ ID NO: 148310 - protein, 14 aa, BORRELIA BURGDORFERI
ENDLIALKCIVKTI

SEQ ID NO: 148311 - protein, 14 aa, BORRELIA BURGDORFERI
NDLIALKCIVKTIG

SEQ ID NO: 148312 - protein, 14 aa, BORRELIA BURGDORFERI
DLIALKCIVKTIGD

SEQ ID NO: 148313 - protein, 14 aa, BORRELIA BURGDORFERI
LIALKCIVKTIGDM

SEQ ID NO: 148314 - protein, 14 aa, BORRELIA BURGDORFERI
IALKCIVKTIGDMV

SEQ ID NO: 148315 - protein, 14 aa, BORRELIA BURGDORFERI
ALKCIVKTIGDMVN

SEQ ID NO: 148316 - protein, 14 aa, BORRELIA BURGDORFERI
LKCIVKTIGDMVND

SEQ ID NO: 148317 - protein, 14 aa, BORRELIA BURGDORFERI
KCIVKTIGDMVNDR

SEQ ID NO: 148318 - protein, 14 aa, BORRELIA BURGDORFERI
CIVKTIGDMVNDRE

SEQ ID NO: 148319 - protein, 14 aa, BORRELIA BURGDORFERI
IVKTIGDMVNDREI

SEQ ID NO: 148320 - protein, 14 aa, BORRELIA BURGDORFERI
VKTIGDMVNDREIN

SEQ ID NO: 148321 - protein, 14 aa, BORRELIA BURGDORFERI
KTIGDMVNDREINS

SEQ ID NO: 148322 - protein, 14 aa, BORRELIA BURGDORFERI
TIGDMVNDREINSR

SEQ ID NO: 148323 - protein, 14 aa, BORRELIA BURGDORFERI
IGDMVNDREINSRS

SEQ ID NO: 148324 - protein, 14 aa, BORRELIA BURGDORFERI
GDMVNDREINSRSR

SEQ ID NO: 148325 - protein, 14 aa, BORRELIA BURGDORFERI
DMVNDREINSRSRY

SEQ ID NO: 148326 - protein, 14 aa, BORRELIA BURGDORFERI
MVNDREINSRSRYN

SEQ ID NO: 148327 - protein, 14 aa, BORRELIA BURGDORFERI
VNDREINSRSRYNN

SEQ ID NO: 148328 - protein, 14 aa, BORRELIA BURGDORFERI
NDREINSRSRYNNF

SEQ ID NO: 148329 - protein, 14 aa, BORRELIA BURGDORFERI
DREINSRSRYNNFY

SEQ ID NO: 148330 - protein, 14 aa, BORRELIA BURGDORFERI
REINSRSRYNNFYK

SEQ ID NO: 148331 - protein, 14 aa, BORRELIA BURGDORFERI
EINSRSRYNNFYKK

SEQ ID NO: 148332 - protein, 14 aa, BORRELIA BURGDORFERI
INSRSRYNNFYKKE

SEQ ID NO: 148333 - protein, 14 aa, BORRELIA BURGDORFERI
NSRSRYNNFYKKEA

SEQ ID NO: 148334 - protein, 14 aa, BORRELIA BURGDORFERI
SRSRYNNFYKKEAD

SEQ ID NO: 148335 - protein, 14 aa, BORRELIA BURGDORFERI
RSRYNNFYKKEADF

SEQ ID NO: 148336 - protein, 14 aa, BORRELIA BURGDORFERI
SRYNNFYKKEADFL

SEQ ID NO: 148337 - protein, 14 aa, BORRELIA BURGDORFERI
RYNNFYKKEADFLG

SEQ ID NO: 148338 - protein, 14 aa, BORRELIA BURGDORFERI
YNNFYKKEADFLGA

SEQ ID NO: 148339 - protein, 14 aa, BORRELIA BURGDORFERI
NNFYKKEADFLGAA

SEQ ID NO: 148340 - protein, 14 aa, BORRELIA BURGDORFERI
NFYKKEADFLGAAV

SEQ ID NO: 148341 - protein, 14 aa, BORRELIA BURGDORFERI
FYKKEADFLGAAVE

SEQ ID NO: 148342 - protein, 14 aa, BORRELIA BURGDORFERI
YKKEADFLGAAVEL

SEQ ID NO: 148343 - protein, 14 aa, BORRELIA BURGDORFERI
KKEADFLGAAVELE

SEQ ID NO: 148344 - protein, 14 aa, BORRELIA BURGDORFERI
KEADFLGAAVELEG

SEQ ID NO: 148345 - protein, 14 aa, BORRELIA BURGDORFERI
EADFLGAAVELEGA

SEQ ID NO: 148346 - protein, 14 aa, BORRELIA BURGDORFERI
ADFLGAAVELEGAY

SEQ ID NO: 148347 - protein, 14 aa, BORRELIA BURGDORFERI
DFLGAAVELEGAYK

SEQ ID NO: 148348 - protein, 14 aa, BORRELIA BURGDORFERI
FLGAAVELEGAYKA

SEQ ID NO: 148349 - protein, 14 aa, BORRELIA BURGDORFERI
LGAAVELEGAYKAI

SEQ ID NO: 148350 - protein, 14 aa, BORRELIA BURGDORFERI
GAAVELEGAYKAIK

SEQ ID NO: 148351 - protein, 14 aa, BORRELIA BURGDORFERI
AAVELEGAYKAIKQ

SEQ ID NO: 148352 - protein, 14 aa, BORRELIA BURGDORFERI
AVELEGAYKAIKQT

SEQ ID NO: 148353 - protein, 14 aa, BORRELIA BURGDORFERI
VELEGAYKAIKQTL

SEQ ID NO: 148354 - protein, 14 aa, BORRELIA BURGDORFERI
ELEGAYKAIKQTLL

SEQ ID NO: 148355 - protein, 15 aa, BORRELIA BURGDORFERI
MKKSFLSIYMLISIS

SEQ ID NO: 148356 - protein, 15 aa, BORRELIA BURGDORFERI
KKSFLSIYMLISISL

SEQ ID NO: 148357 - protein, 15 aa, BORRELIA BURGDORFERI
KSFLSIYMLISISLL

SEQ ID NO: 148358 - protein, 15 aa, BORRELIA BURGDORFERI
SFLSIYMLISISLLS

SEQ ID NO: 148359 - protein, 15 aa, BORRELIA BURGDORFERI
FLSIYMLISISLLSC

SEQ ID NO: 148360 - protein, 15 aa, BORRELIA BURGDORFERI
LSIYMLISISLLSCD

SEQ ID NO: 148361 - protein, 15 aa, BORRELIA BURGDORFERI
SIYMLISISLLSCDV

SEQ ID NO: 148362 - protein, 15 aa, BORRELIA BURGDORFERI
IYMLISISLLSCDVS

SEQ ID NO: 148363 - protein, 15 aa, BORRELIA BURGDORFERI
YMLISISLLSCDVSR

SEQ ID NO: 148364 - protein, 15 aa, BORRELIA BURGDORFERI
MLISISLLSCDVSRL

SEQ ID NO: 148365 - protein, 15 aa, BORRELIA BURGDORFERI
LISISLLSCDVSRLN

SEQ ID NO: 148366 - protein, 15 aa, BORRELIA BURGDORFERI
ISISLLSCDVSRLNQ

SEQ ID NO: 148367 - protein, 15 aa, BORRELIA BURGDORFERI
SISLLSCDVSRLNQR

SEQ ID NO: 148368 - protein, 15 aa, BORRELIA BURGDORFERI
ISLLSCDVSRLNQRN

SEQ ID NO: 148369 - protein, 15 aa, BORRELIA BURGDORFERI
SLLSCDVSRLNQRNI

SEQ ID NO: 148370 - protein, 15 aa, BORRELIA BURGDORFERI
LLSCDVSRLNQRNID

SEQ ID NO: 148371 - protein, 15 aa, BORRELIA BURGDORFERI
LSCDVSRLNQRNIDE

SEQ ID NO: 148372 - protein, 15 aa, BORRELIA BURGDORFERI
SCDVSRLNQRNIDEL

SEQ ID NO: 148373 - protein, 15 aa, BORRELIA BURGDORFERI
CDVSRLNQRNIDELK

SEQ ID NO: 148374 - protein, 15 aa, BORRELIA BURGDORFERI
DVSRLNQRNIDELKI

SEQ ID NO: 148375 - protein, 15 aa, BORRELIA BURGDORFERI
VSRLNQRNIDELKIF

SEQ ID NO: 148376 - protein, 15 aa, BORRELIA BURGDORFERI
SRLNQRNIDELKIFV

SEQ ID NO: 148377 - protein, 15 aa, BORRELIA BURGDORFERI
RLNQRNIDELKIFVE

SEQ ID NO: 148378 - protein, 15 aa, BORRELIA BURGDORFERI
LNQRNIDELKIFVEK

SEQ ID NO: 148379 - protein, 15 aa, BORRELIA BURGDORFERI
NQRNIDELKIFVEKA

SEQ ID NO: 148380 - protein, 15 aa, BORRELIA BURGDORFERI
QRNIDELKIFVEKAK

SEQ ID NO: 148381 - protein, 15 aa, BORRELIA BURGDORFERI
RNIDELKIFVEKAKY

SEQ ID NO: 148382 - protein, 15 aa, BORRELIA BURGDORFERI
NIDELKIFVEKAKYY

SEQ ID NO: 148383 - protein, 15 aa, BORRELIA BURGDORFERI
IDELKIFVEKAKYYS

SEQ ID NO: 148384 - protein, 15 aa, BORRELIA BURGDORFERI
DELKIFVEKAKYYSI

SEQ ID NO: 148385 - protein, 15 aa, BORRELIA BURGDORFERI
ELKIFVEKAKYYSIK

SEQ ID NO: 148386 - protein, 15 aa, BORRELIA BURGDORFERI
LKIFVEKAKYYSIKL

SEQ ID NO: 148387 - protein, 15 aa, BORRELIA BURGDORFERI
KIFVEKAKYYSIKLD

SEQ ID NO: 148388 - protein, 15 aa, BORRELIA BURGDORFERI
IFVEKAKYYSIKLDA

SEQ ID NO: 148389 - protein, 15 aa, BORRELIA BURGDORFERI
FVEKAKYYSIKLDAI

SEQ ID NO: 148390 - protein, 15 aa, BORRELIA BURGDORFERI
VEKAKYYSIKLDAIY

SEQ ID NO: 148391 - protein, 15 aa, BORRELIA BURGDORFERI
EKAKYYSIKLDAIYS

SEQ ID NO: 148392 - protein, 15 aa, BORRELIA BURGDORFERI
KAKYYSIKLDAIYSE

SEQ ID NO: 148393 - protein, 15 aa, BORRELIA BURGDORFERI
AKYYSIKLDAIYSEY

SEQ ID NO: 148394 - protein, 15 aa, BORRELIA BURGDORFERI
KYYSIKLDAIYSEYT

SEQ ID NO: 148395 - protein, 15 aa, BORRELIA BURGDORFERI
YYSIKLDAIYSEYTG

SEQ ID NO: 148396 - protein, 15 aa, BORRELIA BURGDORFERI
YSIKLDAIYSEYTGA

SEQ ID NO: 148397 - protein, 15 aa, BORRELIA BURGDORFERI
SIKLDAIYSEYTGAY

SEQ ID NO: 148398 - protein, 15 aa, BORRELIA BURGDORFERI
IKLDAIYSEYTGAYN

SEQ ID NO: 148399 - protein, 15 aa, BORRELIA BURGDORFERI
KLDAIYSEYTGAYND

SEQ ID NO: 148400 - protein, 15 aa, BORRELIA BURGDORFERI
LDAIYSEYTGAYNDI

SEQ ID NO: 148401 - protein, 15 aa, BORRELIA BURGDORFERI
DAIYSEYTGAYNDIM

SEQ ID NO: 148402 - protein, 15 aa, BORRELIA BURGDORFERI
AIYSEYTGAYNDIMT

SEQ ID NO: 148403 - protein, 15 aa, BORRELIA BURGDORFERI
IYSEYTGAYNDIMTY

SEQ ID NO: 148404 - protein, 15 aa, BORRELIA BURGDORFERI
YSEYTGAYNDIMTYI

SEQ ID NO: 148405 - protein, 15 aa, BORRELIA BURGDORFERI
SEYTGAYNDIMTYIM

SEQ ID NO: 148406 - protein, 15 aa, BORRELIA BURGDORFERI
EYTGAYNDIMTYIMT

SEQ ID NO: 148407 - protein, 15 aa, BORRELIA BURGDORFERI
YTGAYNDIMTYIMTY

SEQ ID NO: 148408 - protein, 15 aa, BORRELIA BURGDORFERI
TGAYNDIMTYIMTYS

SEQ ID NO: 148409 - protein, 15 aa, BORRELIA BURGDORFERI
GAYNDIMTYIMTYSE

SEQ ID NO: 148410 - protein, 15 aa, BORRELIA BURGDORFERI
AYNDIMTYIMTYSEG

SEQ ID NO: 148411 - protein, 15 aa, BORRELIA BURGDORFERI
YNDIMTYIMTYSEGT

SEQ ID NO: 148412 - protein, 15 aa, BORRELIA BURGDORFERI
NDIMTYIMTYSEGTS

SEQ ID NO: 148413 - protein, 15 aa, BORRELIA BURGDORFERI
DIMTYIMTYSEGTSS

SEQ ID NO: 148414 - protein, 15 aa, BORRELIA BURGDORFERI
IMTYIMTYSEGTSSD

SEQ ID NO: 148415 - protein, 15 aa, BORRELIA BURGDORFERI
MTYIMTYSEGTSSDK

SEQ ID NO: 148416 - protein, 15 aa, BORRELIA BURGDORFERI
TYIMTYSEGTSSDKS

SEQ ID NO: 148417 - protein, 15 aa, BORRELIA BURGDORFERI
YIMTYSEGTSSDKSK

SEQ ID NO: 148418 - protein, 15 aa, BORRELIA BURGDORFERI
IMTYSEGTSSDKSKV

SEQ ID NO: 148419 - protein, 15 aa, BORRELIA BURGDORFERI
MTYSEGTSSDKSKVN

SEQ ID NO: 148420 - protein, 15 aa, BORRELIA BURGDORFERI
TYSEGTSSDKSKVNQ

SEQ ID NO: 148421 - protein, 15 aa, BORRELIA BURGDORFERI
YSEGTSSDKSKVNQA

SEQ ID NO: 148422 - protein, 15 aa, BORRELIA BURGDORFERI
SEGTSSDKSKVNQAI

SEQ ID NO: 148423 - protein, 15 aa, BORRELIA BURGDORFERI
EGTSSDKSKVNQAIS

SEQ ID NO: 148424 - protein, 15 aa, BORRELIA BURGDORFERI
GTSSDKSKVNQAISI

SEQ ID NO: 148425 - protein, 15 aa, BORRELIA BURGDORFERI
TSSDKSKVNQAISIL

SEQ ID NO: 148426 - protein, 15 aa, BORRELIA BURGDORFERI
SSDKSKVNQAISILK

SEQ ID NO: 148427 - protein, 15 aa, BORRELIA BURGDORFERI
SDKSKVNQAISILKK

SEQ ID NO: 148428 - protein, 15 aa, BORRELIA BURGDORFERI
DKSKVNQAISILKKD

SEQ ID NO: 148429 - protein, 15 aa, BORRELIA BURGDORFERI
KSKVNQAISILKKDN

SEQ ID NO: 148430 - protein, 15 aa, BORRELIA BURGDORFERI
SKVNQAISILKKDNK

SEQ ID NO: 148431 - protein, 15 aa, BORRELIA BURGDORFERI
KVNQAISILKKDNKI

SEQ ID NO: 148432 - protein, 15 aa, BORRELIA BURGDORFERI
VNQAISILKKDNKIV

SEQ ID NO: 148433 - protein, 15 aa, BORRELIA BURGDORFERI
NQAISILKKDNKIVN

SEQ ID NO: 148434 - protein, 15 aa, BORRELIA BURGDORFERI
QAISILKKDNKIVNK

SEQ ID NO: 148435 - protein, 15 aa, BORRELIA BURGDORFERI
AISILKKDNKIVNKF

SEQ ID NO: 148436 - protein, 15 aa, BORRELIA BURGDORFERI
ISILKKDNKIVNKFK

SEQ ID NO: 148437 - protein, 15 aa, BORRELIA BURGDORFERI
SILKKDNKIVNKFKE

SEQ ID NO: 148438 - protein, 15 aa, BORRELIA BURGDORFERI
ILKKDNKIVNKFKEL

SEQ ID NO: 148439 - protein, 15 aa, BORRELIA BURGDORFERI
LKKDNKIVNKFKELE

SEQ ID NO: 148440 - protein, 15 aa, BORRELIA BURGDORFERI
KKDNKIVNKFKELEK

SEQ ID NO: 148441 - protein, 15 aa, BORRELIA BURGDORFERI
KDNKIVNKFKELEKI

SEQ ID NO: 148442 - protein, 15 aa, BORRELIA BURGDORFERI
DNKIVNKFKELEKII

SEQ ID NO: 148443 - protein, 15 aa, BORRELIA BURGDORFERI
NKIVNKFKELEKIIE

SEQ ID NO: 148444 - protein, 15 aa, BORRELIA BURGDORFERI
KIVNKFKELEKIIEE

SEQ ID NO: 148445 - protein, 15 aa, BORRELIA BURGDORFERI
IVNKFKELEKIIEEY

SEQ ID NO: 148446 - protein, 15 aa, BORRELIA BURGDORFERI
VNKFKELEKIIEEYK

SEQ ID NO: 148447 - protein, 15 aa, BORRELIA BURGDORFERI
NKFKELEKIIEEYKP

SEQ ID NO: 148448 - protein, 15 aa, BORRELIA BURGDORFERI
KFKELEKIIEEYKPM

SEQ ID NO: 148449 - protein, 15 aa, BORRELIA BURGDORFERI
FKELEKIIEEYKPMF

SEQ ID NO: 148450 - protein, 15 aa, BORRELIA BURGDORFERI
KELEKIIEEYKPMFL

SEQ ID NO: 148451 - protein, 15 aa, BORRELIA BURGDORFERI
ELEKIIEEYKPMFLS

SEQ ID NO: 148452 - protein, 15 aa, BORRELIA BURGDORFERI
LEKIIEEYKPMFLSK

SEQ ID NO: 148453 - protein, 15 aa, BORRELIA BURGDORFERI
EKIIEEYKPMFLSKL

SEQ ID NO: 148454 - protein, 15 aa, BORRELIA BURGDORFERI
KIIEEYKPMFLSKLI

SEQ ID NO: 148455 - protein, 15 aa, BORRELIA BURGDORFERI
IIEEYKPMFLSKLID

SEQ ID NO: 148456 - protein, 15 aa, BORRELIA BURGDORFERI
IEEYKPMFLSKLIDD

SEQ ID NO: 148457 - protein, 15 aa, BORRELIA BURGDORFERI
EEYKPMFLSKLIDDF

SEQ ID NO: 148458 - protein, 15 aa, BORRELIA BURGDORFERI
EYKPMFLSKLIDDFA

SEQ ID NO: 148459 - protein, 15 aa, BORRELIA BURGDORFERI
YKPMFLSKLIDDFAI

SEQ ID NO: 148460 - protein, 15 aa, BORRELIA BURGDORFERI
KPMFLSKLIDDFAIE

SEQ ID NO: 148461 - protein, 15 aa, BORRELIA BURGDORFERI
PMFLSKLIDDFAIEL

SEQ ID NO: 148462 - protein, 15 aa, BORRELIA BURGDORFERI
MFLSKLIDDFAIELD

SEQ ID NO: 148463 - protein, 15 aa, BORRELIA BURGDORFERI
FLSKLIDDFAIELDQ

SEQ ID NO: 148464 - protein, 15 aa, BORRELIA BURGDORFERI
LSKLIDDFAIELDQA

SEQ ID NO: 148465 - protein, 15 aa, BORRELIA BURGDORFERI
SKLIDDFAIELDQAV

SEQ ID NO: 148466 - protein, 15 aa, BORRELIA BURGDORFERI
KLIDDFAIELDQAVD

SEQ ID NO: 148467 - protein, 15 aa, BORRELIA BURGDORFERI
LIDDFAIELDQAVDN

SEQ ID NO: 148468 - protein, 15 aa, BORRELIA BURGDORFERI
IDDFAIELDQAVDND

SEQ ID NO: 148469 - protein, 15 aa, BORRELIA BURGDORFERI
DDFAIELDQAVDNDV

SEQ ID NO: 148470 - protein, 15 aa, BORRELIA BURGDORFERI
DFAIELDQAVDNDVS

SEQ ID NO: 148471 - protein, 15 aa, BORRELIA BURGDORFERI
FAIELDQAVDNDVSN

SEQ ID NO: 148472 - protein, 15 aa, BORRELIA BURGDORFERI
AIELDQAVDNDVSNA

SEQ ID NO: 148473 - protein, 15 aa, BORRELIA BURGDORFERI
IELDQAVDNDVSNAR

SEQ ID NO: 148474 - protein, 15 aa, BORRELIA BURGDORFERI
ELDQAVDNDVSNARH

SEQ ID NO: 148475 - protein, 15 aa, BORRELIA BURGDORFERI
LDQAVDNDVSNARHV

SEQ ID NO: 148476 - protein, 15 aa, BORRELIA BURGDORFERI
DQAVDNDVSNARHVA

SEQ ID NO: 148477 - protein, 15 aa, BORRELIA BURGDORFERI
QAVDNDVSNARHVAD

SEQ ID NO: 148478 - protein, 15 aa, BORRELIA BURGDORFERI
AVDNDVSNARHVADS

SEQ ID NO: 148479 - protein, 15 aa, BORRELIA BURGDORFERI
VDNDVSNARHVADSY

SEQ ID NO: 148480 - protein, 15 aa, BORRELIA BURGDORFERI
DNDVSNARHVADSYE

SEQ ID NO: 148481 - protein, 15 aa, BORRELIA BURGDORFERI
NDVSNARHVADSYEK

SEQ ID NO: 148482 - protein, 15 aa, BORRELIA BURGDORFERI
DVSNARHVADSYEKL

SEQ ID NO: 148483 - protein, 15 aa, BORRELIA BURGDORFERI
VSNARHVADSYEKLR

SEQ ID NO: 148484 - protein, 15 aa, BORRELIA BURGDORFERI
SNARHVADSYEKLRK

SEQ ID NO: 148485 - protein, 15 aa, BORRELIA BURGDORFERI
NARHVADSYEKLRKS

SEQ ID NO: 148486 - protein, 15 aa, BORRELIA BURGDORFERI
ARHVADSYEKLRKSV

SEQ ID NO: 148487 - protein, 15 aa, BORRELIA BURGDORFERI
RHVADSYEKLRKSVA

SEQ ID NO: 148488 - protein, 15 aa, BORRELIA BURGDORFERI
HVADSYEKLRKSVAL

SEQ ID NO: 148489 - protein, 15 aa, BORRELIA BURGDORFERI
VADSYEKLRKSVALA

SEQ ID NO: 148490 - protein, 15 aa, BORRELIA BURGDORFERI
ADSYEKLRKSVALAY

SEQ ID NO: 148491 - protein, 15 aa, BORRELIA BURGDORFERI
DSYEKLRKSVALAYI

SEQ ID NO: 148492 - protein, 15 aa, BORRELIA BURGDORFERI
SYEKLRKSVALAYIE

SEQ ID NO: 148493 - protein, 15 aa, BORRELIA BURGDORFERI
YEKLRKSVALAYIES

SEQ ID NO: 148494 - protein, 15 aa, BORRELIA BURGDORFERI
EKLRKSVALAYIESF

SEQ ID NO: 148495 - protein, 15 aa, BORRELIA BURGDORFERI
KLRKSVALAYIESFD

SEQ ID NO: 148496 - protein, 15 aa, BORRELIA BURGDORFERI
LRKSVALAYIESFDV

SEQ ID NO: 148497 - protein, 15 aa, BORRELIA BURGDORFERI
RKSVALAYIESFDVI

SEQ ID NO: 148498 - protein, 15 aa, BORRELIA BURGDORFERI
KSVALAYIESFDVIS

SEQ ID NO: 148499 - protein, 15 aa, BORRELIA BURGDORFERI
SVALAYIESFDVISS

SEQ ID NO: 148500 - protein, 15 aa, BORRELIA BURGDORFERI
VALAYIESFDVISSK

SEQ ID NO: 148501 - protein, 15 aa, BORRELIA BURGDORFERI
ALAYIESFDVISSKF

SEQ ID NO: 148502 - protein, 15 aa, BORRELIA BURGDORFERI
LAYIESFDVISSKFV

SEQ ID NO: 148503 - protein, 15 aa, BORRELIA BURGDORFERI
AYIESFDVISSKFVD

SEQ ID NO: 148504 - protein, 15 aa, BORRELIA BURGDORFERI
YIESFDVISSKFVDS

SEQ ID NO: 148505 - protein, 15 aa, BORRELIA BURGDORFERI
IESFDVISSKFVDSK

SEQ ID NO: 148506 - protein, 15 aa, BORRELIA BURGDORFERI
ESFDVISSKFVDSKF

SEQ ID NO: 148507 - protein, 15 aa, BORRELIA BURGDORFERI
SFDVISSKFVDSKFV

SEQ ID NO: 148508 - protein, 15 aa, BORRELIA BURGDORFERI
FDVISSKFVDSKFVE

SEQ ID NO: 148509 - protein, 15 aa, BORRELIA BURGDORFERI
DVISSKFVDSKFVEA

SEQ ID NO: 148510 - protein, 15 aa, BORRELIA BURGDORFERI
VISSKFVDSKFVEAS

SEQ ID NO: 148511 - protein, 15 aa, BORRELIA BURGDORFERI
ISSKFVDSKFVEASK

SEQ ID NO: 148512 - protein, 15 aa, BORRELIA BURGDORFERI
SSKFVDSKFVEASKK

SEQ ID NO: 148513 - protein, 15 aa, BORRELIA BURGDORFERI
SKFVDSKFVEASKKF

SEQ ID NO: 148514 - protein, 15 aa, BORRELIA BURGDORFERI
KFVDSKFVEASKKFV

SEQ ID NO: 148515 - protein, 15 aa, BORRELIA BURGDORFERI
FVDSKFVEASKKFVN

SEQ ID NO: 148516 - protein, 15 aa, BORRELIA BURGDORFERI
VDSKFVEASKKFVNK

SEQ ID NO: 148517 - protein, 15 aa, BORRELIA BURGDORFERI
DSKFVEASKKFVNKA

SEQ ID NO: 148518 - protein, 15 aa, BORRELIA BURGDORFERI
SKFVEASKKFVNKAK

SEQ ID NO: 148519 - protein, 15 aa, BORRELIA BURGDORFERI
KFVEASKKFVNKAKE

SEQ ID NO: 148520 - protein, 15 aa, BORRELIA BURGDORFERI
FVEASKKFVNKAKEF

SEQ ID NO: 148521 - protein, 15 aa, BORRELIA BURGDORFERI
VEASKKFVNKAKEFV

SEQ ID NO: 148522 - protein, 15 aa, BORRELIA BURGDORFERI
EASKKFVNKAKEFVE

SEQ ID NO: 148523 - protein, 15 aa, BORRELIA BURGDORFERI
ASKKFVNKAKEFVEE

SEQ ID NO: 148524 - protein, 15 aa, BORRELIA BURGDORFERI
SKKFVNKAKEFVEEN

SEQ ID NO: 148525 - protein, 15 aa, BORRELIA BURGDORFERI
KKFVNKAKEFVEEND

SEQ ID NO: 148526 - protein, 15 aa, BORRELIA BURGDORFERI
KFVNKAKEFVEENDL

SEQ ID NO: 148527 - protein, 15 aa, BORRELIA BURGDORFERI
FVNKAKEFVEENDLI

SEQ ID NO: 148528 - protein, 15 aa, BORRELIA BURGDORFERI
VNKAKEFVEENDLIA

SEQ ID NO: 148529 - protein, 15 aa, BORRELIA BURGDORFERI
NKAKEFVEENDLIAL

SEQ ID NO: 148530 - protein, 15 aa, BORRELIA BURGDORFERI
KAKEFVEENDLIALK

SEQ ID NO: 148531 - protein, 15 aa, BORRELIA BURGDORFERI
AKEFVEENDLIALKC

SEQ ID NO: 148532 - protein, 15 aa, BORRELIA BURGDORFERI
KEFVEENDLIALKCI

SEQ ID NO: 148533 - protein, 15 aa, BORRELIA BURGDORFERI
EFVEENDLIALKCIV

SEQ ID NO: 148534 - protein, 15 aa, BORRELIA BURGDORFERI
FVEENDLIALKCIVK

SEQ ID NO: 148535 - protein, 15 aa, BORRELIA BURGDORFERI
VEENDLIALKCIVKT

SEQ ID NO: 148536 - protein, 15 aa, BORRELIA BURGDORFERI
EENDLIALKCIVKTI

SEQ ID NO: 148537 - protein, 15 aa, BORRELIA BURGDORFERI
ENDLIALKCIVKTIG

SEQ ID NO: 148538 - protein, 15 aa, BORRELIA BURGDORFERI
NDLIALKCIVKTIGD

SEQ ID NO: 148539 - protein, 15 aa, BORRELIA BURGDORFERI
DLIALKCIVKTIGDM

SEQ ID NO: 148540 - protein, 15 aa, BORRELIA BURGDORFERI
LIALKCIVKTIGDMV

SEQ ID NO: 148541 - protein, 15 aa, BORRELIA BURGDORFERI
IALKCIVKTIGDMVN

SEQ ID NO: 148542 - protein, 15 aa, BORRELIA BURGDORFERI
ALKCIVKTIGDMVND

SEQ ID NO: 148543 - protein, 15 aa, BORRELIA BURGDORFERI
LKCIVKTIGDMVNDR

SEQ ID NO: 148544 - protein, 15 aa, BORRELIA BURGDORFERI
KCIVKTIGDMVNDRE

SEQ ID NO: 148545 - protein, 15 aa, BORRELIA BURGDORFERI
CIVKTIGDMVNDREI

SEQ ID NO: 148546 - protein, 15 aa, BORRELIA BURGDORFERI
IVKTIGDMVNDREIN

SEQ ID NO: 148547 - protein, 15 aa, BORRELIA BURGDORFERI
VKTIGDMVNDREINS

SEQ ID NO: 148548 - protein, 15 aa, BORRELIA BURGDORFERI
KTIGDMVNDREINSR

SEQ ID NO: 148549 - protein, 15 aa, BORRELIA BURGDORFERI
TIGDMVNDREINSRS

SEQ ID NO: 148550 - protein, 15 aa, BORRELIA BURGDORFERI
IGDMVNDREINSRSR

SEQ ID NO: 148551 - protein, 15 aa, BORRELIA BURGDORFERI
GDMVNDREINSRSRY

SEQ ID NO: 148552 - protein, 15 aa, BORRELIA BURGDORFERI
DMVNDREINSRSRYN

SEQ ID NO: 148553 - protein, 15 aa, BORRELIA BURGDORFERI
MVNDREINSRSRYNN

SEQ ID NO: 148554 - protein, 15 aa, BORRELIA BURGDORFERI
VNDREINSRSRYNNF

SEQ ID NO: 148555 - protein, 15 aa, BORRELIA BURGDORFERI
NDREINSRSRYNNFY

SEQ ID NO: 148556 - protein, 15 aa, BORRELIA BURGDORFERI
DREINSRSRYNNFYK

SEQ ID NO: 148557 - protein, 15 aa, BORRELIA BURGDORFERI
REINSRSRYNNFYKK

SEQ ID NO: 148558 - protein, 15 aa, BORRELIA BURGDORFERI
EINSRSRYNNFYKKE

SEQ ID NO: 148559 - protein, 15 aa, BORRELIA BURGDORFERI
INSRSRYNNFYKKEA

SEQ ID NO: 148560 - protein, 15 aa, BORRELIA BURGDORFERI
NSRSRYNNFYKKEAD

SEQ ID NO: 148561 - protein, 15 aa, BORRELIA BURGDORFERI
SRSRYNNFYKKEADF

SEQ ID NO: 148562 - protein, 15 aa, BORRELIA BURGDORFERI
RSRYNNFYKKEADFL

SEQ ID NO: 148563 - protein, 15 aa, BORRELIA BURGDORFERI
SRYNNFYKKEADFLG

SEQ ID NO: 148564 - protein, 15 aa, BORRELIA BURGDORFERI
RYNNFYKKEADFLGA

SEQ ID NO: 148565 - protein, 15 aa, BORRELIA BURGDORFERI
YNNFYKKEADFLGAA

SEQ ID NO: 148566 - protein, 15 aa, BORRELIA BURGDORFERI
NNFYKKEADFLGAAV

SEQ ID NO: 148567 - protein, 15 aa, BORRELIA BURGDORFERI
NFYKKEADFLGAAVE

SEQ ID NO: 148568 - protein, 15 aa, BORRELIA BURGDORFERI
FYKKEADFLGAAVEL

SEQ ID NO: 148569 - protein, 15 aa, BORRELIA BURGDORFERI
YKKEADFLGAAVELE

SEQ ID NO: 148570 - protein, 15 aa, BORRELIA BURGDORFERI
KKEADFLGAAVELEG

SEQ ID NO: 148571 - protein, 15 aa, BORRELIA BURGDORFERI
KEADFLGAAVELEGA

SEQ ID NO: 148572 - protein, 15 aa, BORRELIA BURGDORFERI
EADFLGAAVELEGAY

SEQ ID NO: 148573 - protein, 15 aa, BORRELIA BURGDORFERI
ADFLGAAVELEGAYK

SEQ ID NO: 148574 - protein, 15 aa, BORRELIA BURGDORFERI
DFLGAAVELEGAYKA

SEQ ID NO: 148575 - protein, 15 aa, BORRELIA BURGDORFERI
FLGAAVELEGAYKAI

SEQ ID NO: 148576 - protein, 15 aa, BORRELIA BURGDORFERI
LGAAVELEGAYKAIK

SEQ ID NO: 148577 - protein, 15 aa, BORRELIA BURGDORFERI
GAAVELEGAYKAIKQ

SEQ ID NO: 148578 - protein, 15 aa, BORRELIA BURGDORFERI
AAVELEGAYKAIKQT

SEQ ID NO: 148579 - protein, 15 aa, BORRELIA BURGDORFERI
AVELEGAYKAIKQTL

SEQ ID NO: 148580 - protein, 15 aa, BORRELIA BURGDORFERI
VELEGAYKAIKQTLL

SEQ ID NO: 148581 - protein, 16 aa, BORRELIA BURGDORFERI
MKKSFLSIYMLISISL

SEQ ID NO: 148582 - protein, 16 aa, BORRELIA BURGDORFERI
KKSFLSIYMLISISLL

SEQ ID NO: 148583 - protein, 16 aa, BORRELIA BURGDORFERI
KSFLSIYMLISISLLS

SEQ ID NO: 148584 - protein, 16 aa, BORRELIA BURGDORFERI
SFLSIYMLISISLLSC

SEQ ID NO: 148585 - protein, 16 aa, BORRELIA BURGDORFERI
FLSIYMLISISLLSCD

SEQ ID NO: 148586 - protein, 16 aa, BORRELIA BURGDORFERI
LSIYMLISISLLSCDV

SEQ ID NO: 148587 - protein, 16 aa, BORRELIA BURGDORFERI
SIYMLISISLLSCDVS

SEQ ID NO: 148588 - protein, 16 aa, BORRELIA BURGDORFERI
IYMLISISLLSCDVSR

SEQ ID NO: 148589 - protein, 16 aa, BORRELIA BURGDORFERI
YMLISISLLSCDVSRL

SEQ ID NO: 148590 - protein, 16 aa, BORRELIA BURGDORFERI
MLISISLLSCDVSRLN

SEQ ID NO: 148591 - protein, 16 aa, BORRELIA BURGDORFERI
LISISLLSCDVSRLNQ

SEQ ID NO: 148592 - protein, 16 aa, BORRELIA BURGDORFERI
ISISLLSCDVSRLNQR

SEQ ID NO: 148593 - protein, 16 aa, BORRELIA BURGDORFERI
SISLLSCDVSRLNQRN

SEQ ID NO: 148594 - protein, 16 aa, BORRELIA BURGDORFERI
ISLLSCDVSRLNQRNI

SEQ ID NO: 148595 - protein, 16 aa, BORRELIA BURGDORFERI
SLLSCDVSRLNQRNID

SEQ ID NO: 148596 - protein, 16 aa, BORRELIA BURGDORFERI
LLSCDVSRLNQRNIDE

SEQ ID NO: 148597 - protein, 16 aa, BORRELIA BURGDORFERI
LSCDVSRLNQRNIDEL

SEQ ID NO: 148598 - protein, 16 aa, BORRELIA BURGDORFERI
SCDVSRLNQRNIDELK

SEQ ID NO: 148599 - protein, 16 aa, BORRELIA BURGDORFERI
CDVSRLNQRNIDELKI

SEQ ID NO: 148600 - protein, 16 aa, BORRELIA BURGDORFERI
DVSRLNQRNIDELKIF

SEQ ID NO: 148601 - protein, 16 aa, BORRELIA BURGDORFERI
VSRLNQRNIDELKIFV

SEQ ID NO: 148602 - protein, 16 aa, BORRELIA BURGDORFERI
SRLNQRNIDELKIFVE

SEQ ID NO: 148603 - protein, 16 aa, BORRELIA BURGDORFERI
RLNQRNIDELKIFVEK

SEQ ID NO: 148604 - protein, 16 aa, BORRELIA BURGDORFERI
LNQRNIDELKIFVEKA

SEQ ID NO: 148605 - protein, 16 aa, BORRELIA BURGDORFERI
NQRNIDELKIFVEKAK

SEQ ID NO: 148606 - protein, 16 aa, BORRELIA BURGDORFERI
QRNIDELKIFVEKAKY

SEQ ID NO: 148607 - protein, 16 aa, BORRELIA BURGDORFERI
RNIDELKIFVEKAKYY

SEQ ID NO: 148608 - protein, 16 aa, BORRELIA BURGDORFERI
NIDELKIFVEKAKYYS

SEQ ID NO: 148609 - protein, 16 aa, BORRELIA BURGDORFERI
IDELKIFVEKAKYYSI

SEQ ID NO: 148610 - protein, 16 aa, BORRELIA BURGDORFERI
DELKIFVEKAKYYSIK

SEQ ID NO: 148611 - protein, 16 aa, BORRELIA BURGDORFERI
ELKIFVEKAKYYSIKL

SEQ ID NO: 148612 - protein, 16 aa, BORRELIA BURGDORFERI
LKIFVEKAKYYSIKLD

SEQ ID NO: 148613 - protein, 16 aa, BORRELIA BURGDORFERI
KIFVEKAKYYSIKLDA

SEQ ID NO: 148614 - protein, 16 aa, BORRELIA BURGDORFERI
IFVEKAKYYSIKLDAI

SEQ ID NO: 148615 - protein, 16 aa, BORRELIA BURGDORFERI
FVEKAKYYSIKLDAIY

SEQ ID NO: 148616 - protein, 16 aa, BORRELIA BURGDORFERI
VEKAKYYSIKLDAIYS

SEQ ID NO: 148617 - protein, 16 aa, BORRELIA BURGDORFERI
EKAKYYSIKLDAIYSE

SEQ ID NO: 148618 - protein, 16 aa, BORRELIA BURGDORFERI
KAKYYSIKLDAIYSEY

SEQ ID NO: 148619 - protein, 16 aa, BORRELIA BURGDORFERI
AKYYSIKLDAIYSEYT

SEQ ID NO: 148620 - protein, 16 aa, BORRELIA BURGDORFERI
KYYSIKLDAIYSEYTG

SEQ ID NO: 148621 - protein, 16 aa, BORRELIA BURGDORFERI
YYSIKLDAIYSEYTGA

SEQ ID NO: 148622 - protein, 16 aa, BORRELIA BURGDORFERI
YSIKLDAIYSEYTGAY

SEQ ID NO: 148623 - protein, 16 aa, BORRELIA BURGDORFERI
SIKLDAIYSEYTGAYN

SEQ ID NO: 148624 - protein, 16 aa, BORRELIA BURGDORFERI
IKLDAIYSEYTGAYND

SEQ ID NO: 148625 - protein, 16 aa, BORRELIA BURGDORFERI
KLDAIYSEYTGAYNDI

SEQ ID NO: 148626 - protein, 16 aa, BORRELIA BURGDORFERI
LDAIYSEYTGAYNDIM

SEQ ID NO: 148627 - protein, 16 aa, BORRELIA BURGDORFERI
DAIYSEYTGAYNDIMT

SEQ ID NO: 148628 - protein, 16 aa, BORRELIA BURGDORFERI
AIYSEYTGAYNDIMTY

SEQ ID NO: 148629 - protein, 16 aa, BORRELIA BURGDORFERI
IYSEYTGAYNDIMTYI

SEQ ID NO: 148630 - protein, 16 aa, BORRELIA BURGDORFERI
YSEYTGAYNDIMTYIM

SEQ ID NO: 148631 - protein, 16 aa, BORRELIA BURGDORFERI
SEYTGAYNDIMTYIMT

SEQ ID NO: 148632 - protein, 16 aa, BORRELIA BURGDORFERI
EYTGAYNDIMTYIMTY

SEQ ID NO: 148633 - protein, 16 aa, BORRELIA BURGDORFERI
YTGAYNDIMTYIMTYS

SEQ ID NO: 148634 - protein, 16 aa, BORRELIA BURGDORFERI
TGAYNDIMTYIMTYSE

SEQ ID NO: 148635 - protein, 16 aa, BORRELIA BURGDORFERI
GAYNDIMTYIMTYSEG

SEQ ID NO: 148636 - protein, 16 aa, BORRELIA BURGDORFERI
AYNDIMTYIMTYSEGT

SEQ ID NO: 148637 - protein, 16 aa, BORRELIA BURGDORFERI
YNDIMTYIMTYSEGTS

SEQ ID NO: 148638 - protein, 16 aa, BORRELIA BURGDORFERI
NDIMTYIMTYSEGTSS

SEQ ID NO: 148639 - protein, 16 aa, BORRELIA BURGDORFERI
DIMTYIMTYSEGTSSD

SEQ ID NO: 148640 - protein, 16 aa, BORRELIA BURGDORFERI
IMTYIMTYSEGTSSDK

SEQ ID NO: 148641 - protein, 16 aa, BORRELIA BURGDORFERI
MTYIMTYSEGTSSDKS

SEQ ID NO: 148642 - protein, 16 aa, BORRELIA BURGDORFERI
TYIMTYSEGTSSDKSK

SEQ ID NO: 148643 - protein, 16 aa, BORRELIA BURGDORFERI
YIMTYSEGTSSDKSKV

SEQ ID NO: 148644 - protein, 16 aa, BORRELIA BURGDORFERI
IMTYSEGTSSDKSKVN

SEQ ID NO: 148645 - protein, 16 aa, BORRELIA BURGDORFERI
MTYSEGTSSDKSKVNQ

SEQ ID NO: 148646 - protein, 16 aa, BORRELIA BURGDORFERI
TYSEGTSSDKSKVNQA

SEQ ID NO: 148647 - protein, 16 aa, BORRELIA BURGDORFERI
YSEGTSSDKSKVNQAI

SEQ ID NO: 148648 - protein, 16 aa, BORRELIA BURGDORFERI
SEGTSSDKSKVNQAIS

SEQ ID NO: 148649 - protein, 16 aa, BORRELIA BURGDORFERI
EGTSSDKSKVNQAISI

SEQ ID NO: 148650 - protein, 16 aa, BORRELIA BURGDORFERI
GTSSDKSKVNQAISIL

SEQ ID NO: 148651 - protein, 16 aa, BORRELIA BURGDORFERI
TSSDKSKVNQAISILK

SEQ ID NO: 148652 - protein, 16 aa, BORRELIA BURGDORFERI
SSDKSKVNQAISILKK

SEQ ID NO: 148653 - protein, 16 aa, BORRELIA BURGDORFERI
SDKSKVNQAISILKKD

SEQ ID NO: 148654 - protein, 16 aa, BORRELIA BURGDORFERI
DKSKVNQAISILKKDN

SEQ ID NO: 148655 - protein, 16 aa, BORRELIA BURGDORFERI
KSKVNQAISILKKDNK

SEQ ID NO: 148656 - protein, 16 aa, BORRELIA BURGDORFERI
SKVNQAISILKKDNKI

SEQ ID NO: 148657 - protein, 16 aa, BORRELIA BURGDORFERI
KVNQAISILKKDNKIV

SEQ ID NO: 148658 - protein, 16 aa, BORRELIA BURGDORFERI
VNQAISILKKDNKIVN

SEQ ID NO: 148659 - protein, 16 aa, BORRELIA BURGDORFERI
NQAISILKKDNKIVNK

SEQ ID NO: 148660 - protein, 16 aa, BORRELIA BURGDORFERI
QAISILKKDNKIVNKF

SEQ ID NO: 148661 - protein, 16 aa, BORRELIA BURGDORFERI
AISILKKDNKIVNKFK

SEQ ID NO: 148662 - protein, 16 aa, BORRELIA BURGDORFERI
ISILKKDNKIVNKFKE

SEQ ID NO: 148663 - protein, 16 aa, BORRELIA BURGDORFERI
SILKKDNKIVNKFKEL

SEQ ID NO: 148664 - protein, 16 aa, BORRELIA BURGDORFERI
ILKKDNKIVNKFKELE

SEQ ID NO: 148665 - protein, 16 aa, BORRELIA BURGDORFERI
LKKDNKIVNKFKELEK

SEQ ID NO: 148666 - protein, 16 aa, BORRELIA BURGDORFERI
KKDNKIVNKFKELEKI

SEQ ID NO: 148667 - protein, 16 aa, BORRELIA BURGDORFERI
KDNKIVNKFKELEKII

SEQ ID NO: 148668 - protein, 16 aa, BORRELIA BURGDORFERI
DNKIVNKFKELEKIIE

SEQ ID NO: 148669 - protein, 16 aa, BORRELIA BURGDORFERI
NKIVNKFKELEKIIEE

SEQ ID NO: 148670 - protein, 16 aa, BORRELIA BURGDORFERI
KIVNKFKELEKIIEEY

SEQ ID NO: 148671 - protein, 16 aa, BORRELIA BURGDORFERI
IVNKFKELEKIIEEYK

SEQ ID NO: 148672 - protein, 16 aa, BORRELIA BURGDORFERI
VNKFKELEKIIEEYKP

SEQ ID NO: 148673 - protein, 16 aa, BORRELIA BURGDORFERI
NKFKELEKIIEEYKPM

SEQ ID NO: 148674 - protein, 16 aa, BORRELIA BURGDORFERI
KFKELEKIIEEYKPMF

SEQ ID NO: 148675 - protein, 16 aa, BORRELIA BURGDORFERI
FKELEKIIEEYKPMFL

SEQ ID NO: 148676 - protein, 16 aa, BORRELIA BURGDORFERI
KELEKIIEEYKPMFLS

SEQ ID NO: 148677 - protein, 16 aa, BORRELIA BURGDORFERI
ELEKIIEEYKPMFLSK

SEQ ID NO: 148678 - protein, 16 aa, BORRELIA BURGDORFERI
LEKIIEEYKPMFLSKL

SEQ ID NO: 148679 - protein, 16 aa, BORRELIA BURGDORFERI
EKIIEEYKPMFLSKLI

SEQ ID NO: 148680 - protein, 16 aa, BORRELIA BURGDORFERI
KIIEEYKPMFLSKLID

SEQ ID NO: 148681 - protein, 16 aa, BORRELIA BURGDORFERI
IIEEYKPMFLSKLIDD

SEQ ID NO: 148682 - protein, 16 aa, BORRELIA BURGDORFERI
IEEYKPMFLSKLIDDF

SEQ ID NO: 148683 - protein, 16 aa, BORRELIA BURGDORFERI
EEYKPMFLSKLIDDFA

SEQ ID NO: 148684 - protein, 16 aa, BORRELIA BURGDORFERI
EYKPMFLSKLIDDFAI

SEQ ID NO: 148685 - protein, 16 aa, BORRELIA BURGDORFERI
YKPMFLSKLIDDFAIE

SEQ ID NO: 148686 - protein, 16 aa, BORRELIA BURGDORFERI
KPMFLSKLIDDFAIEL

SEQ ID NO: 148687 - protein, 16 aa, BORRELIA BURGDORFERI
PMFLSKLIDDFAIELD

SEQ ID NO: 148688 - protein, 16 aa, BORRELIA BURGDORFERI
MFLSKLIDDFAIELDQ

SEQ ID NO: 148689 - protein, 16 aa, BORRELIA BURGDORFERI
FLSKLIDDFAIELDQA

SEQ ID NO: 148690 - protein, 16 aa, BORRELIA BURGDORFERI
LSKLIDDFAIELDQAV

SEQ ID NO: 148691 - protein, 16 aa, BORRELIA BURGDORFERI
SKLIDDFAIELDQAVD

SEQ ID NO: 148692 - protein, 16 aa, BORRELIA BURGDORFERI
KLIDDFAIELDQAVDN

SEQ ID NO: 148693 - protein, 16 aa, BORRELIA BURGDORFERI
LIDDFAIELDQAVDND

SEQ ID NO: 148694 - protein, 16 aa, BORRELIA BURGDORFERI
IDDFAIELDQAVDNDV

SEQ ID NO: 148695 - protein, 16 aa, BORRELIA BURGDORFERI
DDFAIELDQAVDNDVS

SEQ ID NO: 148696 - protein, 16 aa, BORRELIA BURGDORFERI
DFAIELDQAVDNDVSN

SEQ ID NO: 148697 - protein, 16 aa, BORRELIA BURGDORFERI
FAIELDQAVDNDVSNA

SEQ ID NO: 148698 - protein, 16 aa, BORRELIA BURGDORFERI
AIELDQAVDNDVSNAR

SEQ ID NO: 148699 - protein, 16 aa, BORRELIA BURGDORFERI
IELDQAVDNDVSNARH

SEQ ID NO: 148700 - protein, 16 aa, BORRELIA BURGDORFERI
ELDQAVDNDVSNARHV

SEQ ID NO: 148701 - protein, 16 aa, BORRELIA BURGDORFERI
LDQAVDNDVSNARHVA

SEQ ID NO: 148702 - protein, 16 aa, BORRELIA BURGDORFERI
DQAVDNDVSNARHVAD

SEQ ID NO: 148703 - protein, 16 aa, BORRELIA BURGDORFERI
QAVDNDVSNARHVADS

SEQ ID NO: 148704 - protein, 16 aa, BORRELIA BURGDORFERI
AVDNDVSNARHVADSY

SEQ ID NO: 148705 - protein, 16 aa, BORRELIA BURGDORFERI
VDNDVSNARHVADSYE

SEQ ID NO: 148706 - protein, 16 aa, BORRELIA BURGDORFERI
DNDVSNARHVADSYEK

SEQ ID NO: 148707 - protein, 16 aa, BORRELIA BURGDORFERI
NDVSNARHVADSYEKL

SEQ ID NO: 148708 - protein, 16 aa, BORRELIA BURGDORFERI
DVSNARHVADSYEKLR

SEQ ID NO: 148709 - protein, 16 aa, BORRELIA BURGDORFERI
VSNARHVADSYEKLRK

SEQ ID NO: 148710 - protein, 16 aa, BORRELIA BURGDORFERI
SNARHVADSYEKLRKS

SEQ ID NO: 148711 - protein, 16 aa, BORRELIA BURGDORFERI
NARHVADSYEKLRKSV

SEQ ID NO: 148712 - protein, 16 aa, BORRELIA BURGDORFERI
ARHVADSYEKLRKSVA

SEQ ID NO: 148713 - protein, 16 aa, BORRELIA BURGDORFERI
RHVADSYEKLRKSVAL

SEQ ID NO: 148714 - protein, 16 aa, BORRELIA BURGDORFERI
HVADSYEKLRKSVALA

SEQ ID NO: 148715 - protein, 16 aa, BORRELIA BURGDORFERI
VADSYEKLRKSVALAY

SEQ ID NO: 148716 - protein, 16 aa, BORRELIA BURGDORFERI
ADSYEKLRKSVALAYI

SEQ ID NO: 148717 - protein, 16 aa, BORRELIA BURGDORFERI
DSYEKLRKSVALAYIE

SEQ ID NO: 148718 - protein, 16 aa, BORRELIA BURGDORFERI
SYEKLRKSVALAYIES

SEQ ID NO: 148719 - protein, 16 aa, BORRELIA BURGDORFERI
YEKLRKSVALAYIESF

SEQ ID NO: 148720 - protein, 16 aa, BORRELIA BURGDORFERI
EKLRKSVALAYIESFD

SEQ ID NO: 148721 - protein, 16 aa, BORRELIA BURGDORFERI
KLRKSVALAYIESFDV

SEQ ID NO: 148722 - protein, 16 aa, BORRELIA BURGDORFERI
LRKSVALAYIESFDVI

SEQ ID NO: 148723 - protein, 16 aa, BORRELIA BURGDORFERI
RKSVALAYIESFDVIS

SEQ ID NO: 148724 - protein, 16 aa, BORRELIA BURGDORFERI
KSVALAYIESFDVISS

SEQ ID NO: 148725 - protein, 16 aa, BORRELIA BURGDORFERI
SVALAYIESFDVISSK

SEQ ID NO: 148726 - protein, 16 aa, BORRELIA BURGDORFERI
VALAYIESFDVISSKF

SEQ ID NO: 148727 - protein, 16 aa, BORRELIA BURGDORFERI
ALAYIESFDVISSKFV

SEQ ID NO: 148728 - protein, 16 aa, BORRELIA BURGDORFERI
LAYIESFDVISSKFVD

SEQ ID NO: 148729 - protein, 16 aa, BORRELIA BURGDORFERI
AYIESFDVISSKFVDS

SEQ ID NO: 148730 - protein, 16 aa, BORRELIA BURGDORFERI
YIESFDVISSKFVDSK

SEQ ID NO: 148731 - protein, 16 aa, BORRELIA BURGDORFERI
IESFDVISSKFVDSKF

SEQ ID NO: 148732 - protein, 16 aa, BORRELIA BURGDORFERI
ESFDVISSKFVDSKFV

SEQ ID NO: 148733 - protein, 16 aa, BORRELIA BURGDORFERI
SFDVISSKFVDSKFVE

SEQ ID NO: 148734 - protein, 16 aa, BORRELIA BURGDORFERI
FDVISSKFVDSKFVEA

SEQ ID NO: 148735 - protein, 16 aa, BORRELIA BURGDORFERI
DVISSKFVDSKFVEAS

SEQ ID NO: 148736 - protein, 16 aa, BORRELIA BURGDORFERI
VISSKFVDSKFVEASK

SEQ ID NO: 148737 - protein, 16 aa, BORRELIA BURGDORFERI
ISSKFVDSKFVEASKK

SEQ ID NO: 148738 - protein, 16 aa, BORRELIA BURGDORFERI
SSKFVDSKFVEASKKF

SEQ ID NO: 148739 - protein, 16 aa, BORRELIA BURGDORFERI
SKFVDSKFVEASKKFV

SEQ ID NO: 148740 - protein, 16 aa, BORRELIA BURGDORFERI
KFVDSKFVEASKKFVN

SEQ ID NO: 148741 - protein, 16 aa, BORRELIA BURGDORFERI
FVDSKFVEASKKFVNK

SEQ ID NO: 148742 - protein, 16 aa, BORRELIA BURGDORFERI
VDSKFVEASKKFVNKA

SEQ ID NO: 148743 - protein, 16 aa, BORRELIA BURGDORFERI
DSKFVEASKKFVNKAK

SEQ ID NO: 148744 - protein, 16 aa, BORRELIA BURGDORFERI
SKFVEASKKFVNKAKE

SEQ ID NO: 148745 - protein, 16 aa, BORRELIA BURGDORFERI
KFVEASKKFVNKAKEF

SEQ ID NO: 148746 - protein, 16 aa, BORRELIA BURGDORFERI
FVEASKKFVNKAKEFV

SEQ ID NO: 148747 - protein, 16 aa, BORRELIA BURGDORFERI
VEASKKFVNKAKEFVE

SEQ ID NO: 148748 - protein, 16 aa, BORRELIA BURGDORFERI
EASKKFVNKAKEFVEE

SEQ ID NO: 148749 - protein, 16 aa, BORRELIA BURGDORFERI
ASKKFVNKAKEFVEEN

SEQ ID NO: 148750 - protein, 16 aa, BORRELIA BURGDORFERI
SKKFVNKAKEFVEEND

SEQ ID NO: 148751 - protein, 16 aa, BORRELIA BURGDORFERI
KKFVNKAKEFVEENDL

SEQ ID NO: 148752 - protein, 16 aa, BORRELIA BURGDORFERI
KFVNKAKEFVEENDLI

SEQ ID NO: 148753 - protein, 16 aa, BORRELIA BURGDORFERI
FVNKAKEFVEENDLIA

SEQ ID NO: 148754 - protein, 16 aa, BORRELIA BURGDORFERI
VNKAKEFVEENDLIAL

SEQ ID NO: 148755 - protein, 16 aa, BORRELIA BURGDORFERI
NKAKEFVEENDLIALK

SEQ ID NO: 148756 - protein, 16 aa, BORRELIA BURGDORFERI
KAKEFVEENDLIALKC

SEQ ID NO: 148757 - protein, 16 aa, BORRELIA BURGDORFERI
AKEFVEENDLIALKCI

SEQ ID NO: 148758 - protein, 16 aa, BORRELIA BURGDORFERI
KEFVEENDLIALKCIV

SEQ ID NO: 148759 - protein, 16 aa, BORRELIA BURGDORFERI
EFVEENDLIALKCIVK

SEQ ID NO: 148760 - protein, 16 aa, BORRELIA BURGDORFERI
FVEENDLIALKCIVKT

SEQ ID NO: 148761 - protein, 16 aa, BORRELIA BURGDORFERI
VEENDLIALKCIVKTI

SEQ ID NO: 148762 - protein, 16 aa, BORRELIA BURGDORFERI
EENDLIALKCIVKTIG

SEQ ID NO: 148763 - protein, 16 aa, BORRELIA BURGDORFERI
ENDLIALKCIVKTIGD

SEQ ID NO: 148764 - protein, 16 aa, BORRELIA BURGDORFERI
NDLIALKCIVKTIGDM

SEQ ID NO: 148765 - protein, 16 aa, BORRELIA BURGDORFERI
DLIALKCIVKTIGDMV

SEQ ID NO: 148766 - protein, 16 aa, BORRELIA BURGDORFERI
LIALKCIVKTIGDMVN

SEQ ID NO: 148767 - protein, 16 aa, BORRELIA BURGDORFERI
IALKCIVKTIGDMVND

SEQ ID NO: 148768 - protein, 16 aa, BORRELIA BURGDORFERI
ALKCIVKTIGDMVNDR

SEQ ID NO: 148769 - protein, 16 aa, BORRELIA BURGDORFERI
LKCIVKTIGDMVNDRE

SEQ ID NO: 148770 - protein, 16 aa, BORRELIA BURGDORFERI
KCIVKTIGDMVNDREI

SEQ ID NO: 148771 - protein, 16 aa, BORRELIA BURGDORFERI
CIVKTIGDMVNDREIN

SEQ ID NO: 148772 - protein, 16 aa, BORRELIA BURGDORFERI
IVKTIGDMVNDREINS

SEQ ID NO: 148773 - protein, 16 aa, BORRELIA BURGDORFERI
VKTIGDMVNDREINSR

SEQ ID NO: 148774 - protein, 16 aa, BORRELIA BURGDORFERI
KTIGDMVNDREINSRS

SEQ ID NO: 148775 - protein, 16 aa, BORRELIA BURGDORFERI
TIGDMVNDREINSRSR

SEQ ID NO: 148776 - protein, 16 aa, BORRELIA BURGDORFERI
IGDMVNDREINSRSRY

SEQ ID NO: 148777 - protein, 16 aa, BORRELIA BURGDORFERI
GDMVNDREINSRSRYN

SEQ ID NO: 148778 - protein, 16 aa, BORRELIA BURGDORFERI
DMVNDREINSRSRYNN

SEQ ID NO: 148779 - protein, 16 aa, BORRELIA BURGDORFERI
MVNDREINSRSRYNNF

SEQ ID NO: 148780 - protein, 16 aa, BORRELIA BURGDORFERI
VNDREINSRSRYNNFY

SEQ ID NO: 148781 - protein, 16 aa, BORRELIA BURGDORFERI
NDREINSRSRYNNFYK

SEQ ID NO: 148782 - protein, 16 aa, BORRELIA BURGDORFERI
DREINSRSRYNNFYKK

SEQ ID NO: 148783 - protein, 16 aa, BORRELIA BURGDORFERI
REINSRSRYNNFYKKE

SEQ ID NO: 148784 - protein, 16 aa, BORRELIA BURGDORFERI
EINSRSRYNNFYKKEA

SEQ ID NO: 148785 - protein, 16 aa, BORRELIA BURGDORFERI
INSRSRYNNFYKKEAD

SEQ ID NO: 148786 - protein, 16 aa, BORRELIA BURGDORFERI
NSRSRYNNFYKKEADF

SEQ ID NO: 148787 - protein, 16 aa, BORRELIA BURGDORFERI
SRSRYNNFYKKEADFL

SEQ ID NO: 148788 - protein, 16 aa, BORRELIA BURGDORFERI
RSRYNNFYKKEADFLG

SEQ ID NO: 148789 - protein, 16 aa, BORRELIA BURGDORFERI
SRYNNFYKKEADFLGA

SEQ ID NO: 148790 - protein, 16 aa, BORRELIA BURGDORFERI
RYNNFYKKEADFLGAA

SEQ ID NO: 148791 - protein, 16 aa, BORRELIA BURGDORFERI
YNNFYKKEADFLGAAV

SEQ ID NO: 148792 - protein, 16 aa, BORRELIA BURGDORFERI
NNFYKKEADFLGAAVE

SEQ ID NO: 148793 - protein, 16 aa, BORRELIA BURGDORFERI
NFYKKEADFLGAAVEL

SEQ ID NO: 148794 - protein, 16 aa, BORRELIA BURGDORFERI
FYKKEADFLGAAVELE

SEQ ID NO: 148795 - protein, 16 aa, BORRELIA BURGDORFERI
YKKEADFLGAAVELEG

SEQ ID NO: 148796 - protein, 16 aa, BORRELIA BURGDORFERI
KKEADFLGAAVELEGA

SEQ ID NO: 148797 - protein, 16 aa, BORRELIA BURGDORFERI
KEADFLGAAVELEGAY

SEQ ID NO: 148798 - protein, 16 aa, BORRELIA BURGDORFERI
EADFLGAAVELEGAYK

SEQ ID NO: 148799 - protein, 16 aa, BORRELIA BURGDORFERI
ADFLGAAVELEGAYKA

SEQ ID NO: 148800 - protein, 16 aa, BORRELIA BURGDORFERI
DFLGAAVELEGAYKAI

SEQ ID NO: 148801 - protein, 16 aa, BORRELIA BURGDORFERI
FLGAAVELEGAYKAIK

SEQ ID NO: 148802 - protein, 16 aa, BORRELIA BURGDORFERI
LGAAVELEGAYKAIKQ

SEQ ID NO: 148803 - protein, 16 aa, BORRELIA BURGDORFERI
GAAVELEGAYKAIKQT

SEQ ID NO: 148804 - protein, 16 aa, BORRELIA BURGDORFERI
AAVELEGAYKAIKQTL

SEQ ID NO: 148805 - protein, 16 aa, BORRELIA BURGDORFERI
AVELEGAYKAIKQTLL

SEQ ID NO: 148806 - protein, 8 aa, BORRELIA GARINII
MKKTKLNI

SEQ ID NO: 148807 - protein, 8 aa, BORRELIA GARINII
KKTKLNII

SEQ ID NO: 148808 - protein, 8 aa, BORRELIA GARINII
KTKLNIIK

SEQ ID NO: 148809 - protein, 8 aa, BORRELIA GARINII
TKLNIIKL

SEQ ID NO: 148810 - protein, 8 aa, BORRELIA GARINII
KLNIIKLN

SEQ ID NO: 148811 - protein, 8 aa, BORRELIA GARINII
LNIIKLNI

SEQ ID NO: 148812 - protein, 8 aa, BORRELIA GARINII
NIIKLNIL

SEQ ID NO: 148813 - protein, 8 aa, BORRELIA GARINII
IIKLNILT

SEQ ID NO: 148814 - protein, 8 aa, BORRELIA GARINII
IKLNILTT

SEQ ID NO: 148815 - protein, 8 aa, BORRELIA GARINII
KLNILTTI

SEQ ID NO: 148816 - protein, 8 aa, BORRELIA GARINII
LNILTTIL

SEQ ID NO: 148817 - protein, 8 aa, BORRELIA GARINII
NILTTILT

SEQ ID NO: 148818 - protein, 8 aa, BORRELIA GARINII
ILTTILTL

SEQ ID NO: 148819 - protein, 8 aa, BORRELIA GARINII
LTTILTLI

SEQ ID NO: 148820 - protein, 8 aa, BORRELIA GARINII
TTILTLIC

SEQ ID NO: 148821 - protein, 8 aa, BORRELIA GARINII
TILTLICI

SEQ ID NO: 148822 - protein, 8 aa, BORRELIA GARINII
ILTLICIS

SEQ ID NO: 148823 - protein, 8 aa, BORRELIA GARINII
LTLICISC

SEQ ID NO: 148824 - protein, 8 aa, BORRELIA GARINII
TLICISCA

SEQ ID NO: 148825 - protein, 8 aa, BORRELIA GARINII
LICISCAV

SEQ ID NO: 148826 - protein, 8 aa, BORRELIA GARINII
ICISCAVD

SEQ ID NO: 148827 - protein, 8 aa, BORRELIA GARINII
CISCAVDK

SEQ ID NO: 148828 - protein, 8 aa, BORRELIA GARINII
ISCAVDKI

SEQ ID NO: 148829 - protein, 8 aa, BORRELIA GARINII
SCAVDKID

SEQ ID NO: 148830 - protein, 8 aa, BORRELIA GARINII
CAVDKIDP

SEQ ID NO: 148831 - protein, 8 aa, BORRELIA GARINII
AVDKIDPE

SEQ ID NO: 148832 - protein, 8 aa, BORRELIA GARINII
VDKIDPES

SEQ ID NO: 148833 - protein, 8 aa, BORRELIA GARINII
DKIDPESK

SEQ ID NO: 148834 - protein, 8 aa, BORRELIA GARINII
KIDPESKS

SEQ ID NO: 148835 - protein, 8 aa, BORRELIA GARINII
IDPESKSK

SEQ ID NO: 148836 - protein, 8 aa, BORRELIA GARINII
DPESKSKT

SEQ ID NO: 148837 - protein, 8 aa, BORRELIA GARINII
PESKSKTN

SEQ ID NO: 148838 - protein, 8 aa, BORRELIA GARINII
ESKSKTNT

SEQ ID NO: 148839 - protein, 8 aa, BORRELIA GARINII
SKSKTNTK

SEQ ID NO: 148840 - protein, 8 aa, BORRELIA GARINII
KSKTNTKD

SEQ ID NO: 148841 - protein, 8 aa, BORRELIA GARINII
SKTNTKDF

SEQ ID NO: 148842 - protein, 8 aa, BORRELIA GARINII
KTNTKDFE

SEQ ID NO: 148843 - protein, 8 aa, BORRELIA GARINII
TNTKDFEN

SEQ ID NO: 148844 - protein, 8 aa, BORRELIA GARINII
NTKDFENK

SEQ ID NO: 148845 - protein, 8 aa, BORRELIA GARINII
TKDFENKS

SEQ ID NO: 148846 - protein, 8 aa, BORRELIA GARINII
KDFENKSQ

SEQ ID NO: 148847 - protein, 8 aa, BORRELIA GARINII
DFENKSQD

SEQ ID NO: 148848 - protein, 8 aa, BORRELIA GARINII
FENKSQDL

SEQ ID NO: 148849 - protein, 8 aa, BORRELIA GARINII
ENKSQDLE

SEQ ID NO: 148850 - protein, 8 aa, BORRELIA GARINII
NKSQDLEP

SEQ ID NO: 148851 - protein, 8 aa, BORRELIA GARINII
KSQDLEPS

SEQ ID NO: 148852 - protein, 8 aa, BORRELIA GARINII
SQDLEPSN

SEQ ID NO: 148853 - protein, 8 aa, BORRELIA GARINII
QDLEPSNT

SEQ ID NO: 148854 - protein, 8 aa, BORRELIA GARINII
DLEPSNTK

SEQ ID NO: 148855 - protein, 8 aa, BORRELIA GARINII
LEPSNTKN

SEQ ID NO: 148856 - protein, 8 aa, BORRELIA GARINII
EPSNTKNK

SEQ ID NO: 148857 - protein, 8 aa, BORRELIA GARINII
PSNTKNKD

SEQ ID NO: 148858 - protein, 8 aa, BORRELIA GARINII
SNTKNKDL

SEQ ID NO: 148859 - protein, 8 aa, BORRELIA GARINII
NTKNKDLE

SEQ ID NO: 148860 - protein, 8 aa, BORRELIA GARINII
TKNKDLEP

SEQ ID NO: 148861 - protein, 8 aa, BORRELIA GARINII
KNKDLEPL

SEQ ID NO: 148862 - protein, 8 aa, BORRELIA GARINII
NKDLEPLE

SEQ ID NO: 148863 - protein, 8 aa, BORRELIA GARINII
KDLEPLEK

SEQ ID NO: 148864 - protein, 8 aa, BORRELIA GARINII
DLEPLEKN

SEQ ID NO: 148865 - protein, 8 aa, BORRELIA GARINII
LEPLEKNS

SEQ ID NO: 148866 - protein, 8 aa, BORRELIA GARINII
EPLEKNSK

SEQ ID NO: 148867 - protein, 8 aa, BORRELIA GARINII
PLEKNSKE

SEQ ID NO: 148868 - protein, 8 aa, BORRELIA GARINII
LEKNSKET

SEQ ID NO: 148869 - protein, 8 aa, BORRELIA GARINII
EKNSKETI

SEQ ID NO: 148870 - protein, 8 aa, BORRELIA GARINII
KNSKETII

SEQ ID NO: 148871 - protein, 8 aa, BORRELIA GARINII
NSKETIIS

SEQ ID NO: 148872 - protein, 8 aa, BORRELIA GARINII
SKETIISK

SEQ ID NO: 148873 - protein, 8 aa, BORRELIA GARINII
KETIISKL

SEQ ID NO: 148874 - protein, 8 aa, BORRELIA GARINII
ETIISKLE

SEQ ID NO: 148875 - protein, 8 aa, BORRELIA GARINII
TIISKLEK

SEQ ID NO: 148876 - protein, 8 aa, BORRELIA GARINII
IISKLEKM

SEQ ID NO: 148877 - protein, 8 aa, BORRELIA GARINII
ISKLEKMI

SEQ ID NO: 148878 - protein, 8 aa, BORRELIA GARINII
SKLEKMIK

SEQ ID NO: 148879 - protein, 8 aa, BORRELIA GARINII
KLEKMIKD

SEQ ID NO: 148880 - protein, 8 aa, BORRELIA GARINII
LEKMIKDL

SEQ ID NO: 148881 - protein, 8 aa, BORRELIA GARINII
EKMIKDLE

SEQ ID NO: 148882 - protein, 8 aa, BORRELIA GARINII
KMIKDLED

SEQ ID NO: 148883 - protein, 8 aa, BORRELIA GARINII
MIKDLEDQ

SEQ ID NO: 148884 - protein, 8 aa, BORRELIA GARINII
IKDLEDQK

SEQ ID NO: 148885 - protein, 8 aa, BORRELIA GARINII
KDLEDQKD

SEQ ID NO: 148886 - protein, 8 aa, BORRELIA GARINII
DLEDQKDQ

SEQ ID NO: 148887 - protein, 8 aa, BORRELIA GARINII
LEDQKDQE

SEQ ID NO: 148888 - protein, 8 aa, BORRELIA GARINII
EDQKDQED

SEQ ID NO: 148889 - protein, 8 aa, BORRELIA GARINII
DQKDQEDT

SEQ ID NO: 148890 - protein, 8 aa, BORRELIA GARINII
QKDQEDTE

SEQ ID NO: 148891 - protein, 8 aa, BORRELIA GARINII
KDQEDTEI

SEQ ID NO: 148892 - protein, 8 aa, BORRELIA GARINII
DQEDTEIA

SEQ ID NO: 148893 - protein, 8 aa, BORRELIA GARINII
QEDTEIAK

SEQ ID NO: 148894 - protein, 8 aa, BORRELIA GARINII
EDTEIAKI

SEQ ID NO: 148895 - protein, 8 aa, BORRELIA GARINII
DTEIAKIT

SEQ ID NO: 148896 - protein, 8 aa, BORRELIA GARINII
TEIAKITN

SEQ ID NO: 148897 - protein, 8 aa, BORRELIA GARINII
EIAKITNT

SEQ ID NO: 148898 - protein, 8 aa, BORRELIA GARINII
IAKITNTQ

SEQ ID NO: 148899 - protein, 8 aa, BORRELIA GARINII
AKITNTQI

SEQ ID NO: 148900 - protein, 8 aa, BORRELIA GARINII
KITNTQID

SEQ ID NO: 148901 - protein, 8 aa, BORRELIA GARINII
ITNTQIDF

SEQ ID NO: 148902 - protein, 8 aa, BORRELIA GARINII
TNTQIDFL

SEQ ID NO: 148903 - protein, 8 aa, BORRELIA GARINII
NTQIDFLE

SEQ ID NO: 148904 - protein, 8 aa, BORRELIA GARINII
TQIDFLEN

SEQ ID NO: 148905 - protein, 8 aa, BORRELIA GARINII
QIDFLENF

SEQ ID NO: 148906 - protein, 8 aa, BORRELIA GARINII
IDFLENFK

SEQ ID NO: 148907 - protein, 8 aa, BORRELIA GARINII
DFLENFKS

SEQ ID NO: 148908 - protein, 8 aa, BORRELIA GARINII
FLENFKSE

SEQ ID NO: 148909 - protein, 8 aa, BORRELIA GARINII
LENFKSEP

SEQ ID NO: 148910 - protein, 8 aa, BORRELIA GARINII
ENFKSEPH

SEQ ID NO: 148911 - protein, 8 aa, BORRELIA GARINII
NFKSEPHD

SEQ ID NO: 148912 - protein, 8 aa, BORRELIA GARINII
FKSEPHDT

SEQ ID NO: 148913 - protein, 8 aa, BORRELIA GARINII
KSEPHDTI

SEQ ID NO: 148914 - protein, 8 aa, BORRELIA GARINII
SEPHDTIS

SEQ ID NO: 148915 - protein, 8 aa, BORRELIA GARINII
EPHDTISE

SEQ ID NO: 148916 - protein, 8 aa, BORRELIA GARINII
PHDTISED

SEQ ID NO: 148917 - protein, 8 aa, BORRELIA GARINII
HDTISEDI

SEQ ID NO: 148918 - protein, 8 aa, BORRELIA GARINII
DTISEDIE

SEQ ID NO: 148919 - protein, 8 aa, BORRELIA GARINII
TISEDIEM

SEQ ID NO: 148920 - protein, 8 aa, BORRELIA GARINII
ISEDIEMK

SEQ ID NO: 148921 - protein, 8 aa, BORRELIA GARINII
SEDIEMKI

SEQ ID NO: 148922 - protein, 8 aa, BORRELIA GARINII
EDIEMKIK

SEQ ID NO: 148923 - protein, 8 aa, BORRELIA GARINII
DIEMKIKR

SEQ ID NO: 148924 - protein, 8 aa, BORRELIA GARINII
IEMKIKRI

SEQ ID NO: 148925 - protein, 8 aa, BORRELIA GARINII
EMKIKRII

SEQ ID NO: 148926 - protein, 8 aa, BORRELIA GARINII
MKIKRIIY

SEQ ID NO: 148927 - protein, 8 aa, BORRELIA GARINII
KIKRIIYS

SEQ ID NO: 148928 - protein, 8 aa, BORRELIA GARINII
IKRIIYSS

SEQ ID NO: 148929 - protein, 8 aa, BORRELIA GARINII
KRIIYSSL

SEQ ID NO: 148930 - protein, 8 aa, BORRELIA GARINII
RIIYSSLN

SEQ ID NO: 148931 - protein, 8 aa, BORRELIA GARINII
IIYSSLNY

SEQ ID NO: 148932 - protein, 8 aa, BORRELIA GARINII
IYSSLNYE

SEQ ID NO: 148933 - protein, 8 aa, BORRELIA GARINII
YSSLNYEI

SEQ ID NO: 148934 - protein, 8 aa, BORRELIA GARINII
SSLNYEIE

SEQ ID NO: 148935 - protein, 8 aa, BORRELIA GARINII
SLNYEIEK

SEQ ID NO: 148936 - protein, 8 aa, BORRELIA GARINII
LNYEIEKI

SEQ ID NO: 148937 - protein, 8 aa, BORRELIA GARINII
NYEIEKIN

SEQ ID NO: 148938 - protein, 8 aa, BORRELIA GARINII
YEIEKINT

SEQ ID NO: 148939 - protein, 8 aa, BORRELIA GARINII
EIEKINTL

SEQ ID NO: 148940 - protein, 8 aa, BORRELIA GARINII
IEKINTLK

SEQ ID NO: 148941 - protein, 8 aa, BORRELIA GARINII
EKINTLKE

SEQ ID NO: 148942 - protein, 8 aa, BORRELIA GARINII
KINTLKEI

SEQ ID NO: 148943 - protein, 8 aa, BORRELIA GARINII
INTLKEIL

SEQ ID NO: 148944 - protein, 8 aa, BORRELIA GARINII
NTLKEILD

SEQ ID NO: 148945 - protein, 8 aa, BORRELIA GARINII
TLKEILDK

SEQ ID NO: 148946 - protein, 8 aa, BORRELIA GARINII
LKEILDKL

SEQ ID NO: 148947 - protein, 8 aa, BORRELIA GARINII
KEILDKLY

SEQ ID NO: 148948 - protein, 8 aa, BORRELIA GARINII
EILDKLYK

SEQ ID NO: 148949 - protein, 8 aa, BORRELIA GARINII
ILDKLYKN

SEQ ID NO: 148950 - protein, 8 aa, BORRELIA GARINII
LDKLYKNH

SEQ ID NO: 148951 - protein, 8 aa, BORRELIA GARINII
DKLYKNHK

SEQ ID NO: 148952 - protein, 8 aa, BORRELIA GARINII
KLYKNHKY

SEQ ID NO: 148953 - protein, 8 aa, BORRELIA GARINII
LYKNHKYK

SEQ ID NO: 148954 - protein, 8 aa, BORRELIA GARINII
YKNHKYKT

SEQ ID NO: 148955 - protein, 8 aa, BORRELIA GARINII
KNHKYKTT

SEQ ID NO: 148956 - protein, 8 aa, BORRELIA GARINII
NHKYKTTA

SEQ ID NO: 148957 - protein, 8 aa, BORRELIA GARINII
HKYKTTAR

SEQ ID NO: 148958 - protein, 8 aa, BORRELIA GARINII
KYKTTARN

SEQ ID NO: 148959 - protein, 8 aa, BORRELIA GARINII
YKTTARNF

SEQ ID NO: 148960 - protein, 8 aa, BORRELIA GARINII
KTTARNFI

SEQ ID NO: 148961 - protein, 8 aa, BORRELIA GARINII
TTARNFIL

SEQ ID NO: 148962 - protein, 8 aa, BORRELIA GARINII
TARNFILN

SEQ ID NO: 148963 - protein, 8 aa, BORRELIA GARINII
ARNFILNI

SEQ ID NO: 148964 - protein, 8 aa, BORRELIA GARINII
RNFILNIS

SEQ ID NO: 148965 - protein, 8 aa, BORRELIA GARINII
NFILNISI

SEQ ID NO: 148966 - protein, 8 aa, BORRELIA GARINII
FILNISIK

SEQ ID NO: 148967 - protein, 8 aa, BORRELIA GARINII
ILNISIKI

SEQ ID NO: 148968 - protein, 8 aa, BORRELIA GARINII
LNISIKIQ

SEQ ID NO: 148969 - protein, 8 aa, BORRELIA GARINII
NISIKIQF

SEQ ID NO: 148970 - protein, 8 aa, BORRELIA GARINII
ISIKIQFQ

SEQ ID NO: 148971 - protein, 8 aa, BORRELIA GARINII
SIKIQFQI

SEQ ID NO: 148972 - protein, 8 aa, BORRELIA GARINII
IKIQFQIE

SEQ ID NO: 148973 - protein, 8 aa, BORRELIA GARINII
KIQFQIEN

SEQ ID NO: 148974 - protein, 8 aa, BORRELIA GARINII
IQFQIENA

SEQ ID NO: 148975 - protein, 8 aa, BORRELIA GARINII
QFQIENAL

SEQ ID NO: 148976 - protein, 8 aa, BORRELIA GARINII
FQIENALE

SEQ ID NO: 148977 - protein, 8 aa, BORRELIA GARINII
QIENALEL

SEQ ID NO: 148978 - protein, 8 aa, BORRELIA GARINII
IENALELM

SEQ ID NO: 148979 - protein, 8 aa, BORRELIA GARINII
ENALELMK

SEQ ID NO: 148980 - protein, 8 aa, BORRELIA GARINII
NALELMKE

SEQ ID NO: 148981 - protein, 8 aa, BORRELIA GARINII
ALELMKEE

SEQ ID NO: 148982 - protein, 8 aa, BORRELIA GARINII
LELMKEEI

SEQ ID NO: 148983 - protein, 8 aa, BORRELIA GARINII
ELMKEEIE

SEQ ID NO: 148984 - protein, 8 aa, BORRELIA GARINII
LMKEEIED

SEQ ID NO: 148985 - protein, 8 aa, BORRELIA GARINII
MKEEIEDA

SEQ ID NO: 148986 - protein, 8 aa, BORRELIA GARINII
KEEIEDAS

SEQ ID NO: 148987 - protein, 8 aa, BORRELIA GARINII
EEIEDASE

SEQ ID NO: 148988 - protein, 8 aa, BORRELIA GARINII
EIEDASEI

SEQ ID NO: 148989 - protein, 8 aa, BORRELIA GARINII
IEDASEIL

SEQ ID NO: 148990 - protein, 8 aa, BORRELIA GARINII
EDASEILN

SEQ ID NO: 148991 - protein, 8 aa, BORRELIA GARINII
DASEILNQ

SEQ ID NO: 148992 - protein, 8 aa, BORRELIA GARINII
ASEILNQE

SEQ ID NO: 148993 - protein, 8 aa, BORRELIA GARINII
SEILNQER

SEQ ID NO: 148994 - protein, 8 aa, BORRELIA GARINII
EILNQERY

SEQ ID NO: 148995 - protein, 8 aa, BORRELIA GARINII
ILNQERYE

SEQ ID NO: 148996 - protein, 8 aa, BORRELIA GARINII
LNQERYEI

SEQ ID NO: 148997 - protein, 8 aa, BORRELIA GARINII
NQERYEIL

SEQ ID NO: 148998 - protein, 8 aa, BORRELIA GARINII
QERYEILL

SEQ ID NO: 148999 - protein, 8 aa, BORRELIA GARINII
ERYEILLK

SEQ ID NO: 149000 - protein, 8 aa, BORRELIA GARINII
RYEILLKH

SEQ ID NO: 149001 - protein, 8 aa, BORRELIA GARINII
YEILLKHV

SEQ ID NO: 149002 - protein, 8 aa, BORRELIA GARINII
EILLKHVE

SEQ ID NO: 149003 - protein, 8 aa, BORRELIA GARINII
ILLKHVEP

SEQ ID NO: 149004 - protein, 8 aa, BORRELIA GARINII
LLKHVEPS

SEQ ID NO: 149005 - protein, 8 aa, BORRELIA GARINII
LKHVEPSL

SEQ ID NO: 149006 - protein, 8 aa, BORRELIA GARINII
KHVEPSLN

SEQ ID NO: 149007 - protein, 8 aa, BORRELIA GARINII
HVEPSLNL

SEQ ID NO: 149008 - protein, 8 aa, BORRELIA GARINII
VEPSLNLK

SEQ ID NO: 149009 - protein, 8 aa, BORRELIA GARINII
EPSLNLKQ

SEQ ID NO: 149010 - protein, 8 aa, BORRELIA GARINII
PSLNLKQK

SEQ ID NO: 149011 - protein, 8 aa, BORRELIA GARINII
SLNLKQKF

SEQ ID NO: 149012 - protein, 8 aa, BORRELIA GARINII
LNLKQKFE

SEQ ID NO: 149013 - protein, 8 aa, BORRELIA GARINII
NLKQKFEK

SEQ ID NO: 149014 - protein, 8 aa, BORRELIA GARINII
LKQKFEKI

SEQ ID NO: 149015 - protein, 8 aa, BORRELIA GARINII
KQKFEKIL

SEQ ID NO: 149016 - protein, 8 aa, BORRELIA GARINII
QKFEKILN

SEQ ID NO: 149017 - protein, 8 aa, BORRELIA GARINII
KFEKILNE

SEQ ID NO: 149018 - protein, 8 aa, BORRELIA GARINII
FEKILNET

SEQ ID NO: 149019 - protein, 8 aa, BORRELIA GARINII
EKILNETI

SEQ ID NO: 149020 - protein, 8 aa, BORRELIA GARINII
KILNETIK

SEQ ID NO: 149021 - protein, 8 aa, BORRELIA GARINII
ILNETIKA

SEQ ID NO: 149022 - protein, 8 aa, BORRELIA GARINII
LNETIKAY

SEQ ID NO: 149023 - protein, 8 aa, BORRELIA GARINII
NETIKAYN

SEQ ID NO: 149024 - protein, 8 aa, BORRELIA GARINII
ETIKAYNQ

SEQ ID NO: 149025 - protein, 8 aa, BORRELIA GARINII
TIKAYNQD

SEQ ID NO: 149026 - protein, 8 aa, BORRELIA GARINII
IKAYNQDL

SEQ ID NO: 149027 - protein, 8 aa, BORRELIA GARINII
KAYNQDLD

SEQ ID NO: 149028 - protein, 8 aa, BORRELIA GARINII
AYNQDLDN

SEQ ID NO: 149029 - protein, 8 aa, BORRELIA GARINII
YNQDLDNI

SEQ ID NO: 149030 - protein, 8 aa, BORRELIA GARINII
NQDLDNIK

SEQ ID NO: 149031 - protein, 8 aa, BORRELIA GARINII
QDLDNIKS

SEQ ID NO: 149032 - protein, 8 aa, BORRELIA GARINII
DLDNIKSN

SEQ ID NO: 149033 - protein, 8 aa, BORRELIA GARINII
LDNIKSNE

SEQ ID NO: 149034 - protein, 8 aa, BORRELIA GARINII
DNIKSNED

SEQ ID NO: 149035 - protein, 8 aa, BORRELIA GARINII
NIKSNEDQ

SEQ ID NO: 149036 - protein, 8 aa, BORRELIA GARINII
IKSNEDQL

SEQ ID NO: 149037 - protein, 8 aa, BORRELIA GARINII
KSNEDQLA

SEQ ID NO: 149038 - protein, 8 aa, BORRELIA GARINII
SNEDQLAH

SEQ ID NO: 149039 - protein, 8 aa, BORRELIA GARINII
NEDQLAHM

SEQ ID NO: 149040 - protein, 8 aa, BORRELIA GARINII
EDQLAHMD

SEQ ID NO: 149041 - protein, 8 aa, BORRELIA GARINII
DQLAHMDE

SEQ ID NO: 149042 - protein, 8 aa, BORRELIA GARINII
QLAHMDEN

SEQ ID NO: 149043 - protein, 8 aa, BORRELIA GARINII
LAHMDENY

SEQ ID NO: 149044 - protein, 8 aa, BORRELIA GARINII
AHMDENYK

SEQ ID NO: 149045 - protein, 8 aa, BORRELIA GARINII
HMDENYKE

SEQ ID NO: 149046 - protein, 8 aa, BORRELIA GARINII
MDENYKEF

SEQ ID NO: 149047 - protein, 8 aa, BORRELIA GARINII
DENYKEFD

SEQ ID NO: 149048 - protein, 8 aa, BORRELIA GARINII
ENYKEFDP

SEQ ID NO: 149049 - protein, 8 aa, BORRELIA GARINII
NYKEFDPL

SEQ ID NO: 149050 - protein, 8 aa, BORRELIA GARINII
YKEFDPLN

SEQ ID NO: 149051 - protein, 8 aa, BORRELIA GARINII
KEFDPLNL

SEQ ID NO: 149052 - protein, 8 aa, BORRELIA GARINII
EFDPLNLD

SEQ ID NO: 149053 - protein, 8 aa, BORRELIA GARINII
FDPLNLDY

SEQ ID NO: 149054 - protein, 9 aa, BORRELIA GARINII
MKKTKLNII

SEQ ID NO: 149055 - protein, 9 aa, BORRELIA GARINII
KKTKLNIIK

SEQ ID NO: 149056 - protein, 9 aa, BORRELIA GARINII
KTKLNIIKL

SEQ ID NO: 149057 - protein, 9 aa, BORRELIA GARINII
TKLNIIKLN

SEQ ID NO: 149058 - protein, 9 aa, BORRELIA GARINII
KLNIIKLNI

SEQ ID NO: 149059 - protein, 9 aa, BORRELIA GARINII
LNIIKLNIL

SEQ ID NO: 149060 - protein, 9 aa, BORRELIA GARINII
NIIKLNILT

SEQ ID NO: 149061 - protein, 9 aa, BORRELIA GARINII
IIKLNILTT

SEQ ID NO: 149062 - protein, 9 aa, BORRELIA GARINII
IKLNILTTI

SEQ ID NO: 149063 - protein, 9 aa, BORRELIA GARINII
KLNILTTIL

SEQ ID NO: 149064 - protein, 9 aa, BORRELIA GARINII
LNILTTILT

SEQ ID NO: 149065 - protein, 9 aa, BORRELIA GARINII
NILTTILTL

SEQ ID NO: 149066 - protein, 9 aa, BORRELIA GARINII
ILTTILTLI

SEQ ID NO: 149067 - protein, 9 aa, BORRELIA GARINII
LTTILTLIC

SEQ ID NO: 149068 - protein, 9 aa, BORRELIA GARINII
TTILTLICI

SEQ ID NO: 149069 - protein, 9 aa, BORRELIA GARINII
TILTLICIS

SEQ ID NO: 149070 - protein, 9 aa, BORRELIA GARINII
ILTLICISC

SEQ ID NO: 149071 - protein, 9 aa, BORRELIA GARINII
LTLICISCA

SEQ ID NO: 149072 - protein, 9 aa, BORRELIA GARINII
TLICISCAV

SEQ ID NO: 149073 - protein, 9 aa, BORRELIA GARINII
LICISCAVD

SEQ ID NO: 149074 - protein, 9 aa, BORRELIA GARINII
ICISCAVDK

SEQ ID NO: 149075 - protein, 9 aa, BORRELIA GARINII
CISCAVDKI

SEQ ID NO: 149076 - protein, 9 aa, BORRELIA GARINII
ISCAVDKID

SEQ ID NO: 149077 - protein, 9 aa, BORRELIA GARINII
SCAVDKIDP

SEQ ID NO: 149078 - protein, 9 aa, BORRELIA GARINII
CAVDKIDPE

SEQ ID NO: 149079 - protein, 9 aa, BORRELIA GARINII
AVDKIDPES

SEQ ID NO: 149080 - protein, 9 aa, BORRELIA GARINII
VDKIDPESK

SEQ ID NO: 149081 - protein, 9 aa, BORRELIA GARINII
DKIDPESKS

SEQ ID NO: 149082 - protein, 9 aa, BORRELIA GARINII
KIDPESKSK

SEQ ID NO: 149083 - protein, 9 aa, BORRELIA GARINII
IDPESKSKT

SEQ ID NO: 149084 - protein, 9 aa, BORRELIA GARINII
DPESKSKTN

SEQ ID NO: 149085 - protein, 9 aa, BORRELIA GARINII
PESKSKTNT

SEQ ID NO: 149086 - protein, 9 aa, BORRELIA GARINII
ESKSKTNTK

SEQ ID NO: 149087 - protein, 9 aa, BORRELIA GARINII
SKSKTNTKD

SEQ ID NO: 149088 - protein, 9 aa, BORRELIA GARINII
KSKTNTKDF

SEQ ID NO: 149089 - protein, 9 aa, BORRELIA GARINII
SKTNTKDFE

SEQ ID NO: 149090 - protein, 9 aa, BORRELIA GARINII
KTNTKDFEN

SEQ ID NO: 149091 - protein, 9 aa, BORRELIA GARINII
TNTKDFENK

SEQ ID NO: 149092 - protein, 9 aa, BORRELIA GARINII
NTKDFENKS

SEQ ID NO: 149093 - protein, 9 aa, BORRELIA GARINII
TKDFENKSQ

SEQ ID NO: 149094 - protein, 9 aa, BORRELIA GARINII
KDFENKSQD

SEQ ID NO: 149095 - protein, 9 aa, BORRELIA GARINII
DFENKSQDL

SEQ ID NO: 149096 - protein, 9 aa, BORRELIA GARINII
FENKSQDLE

SEQ ID NO: 149097 - protein, 9 aa, BORRELIA GARINII
ENKSQDLEP

SEQ ID NO: 149098 - protein, 9 aa, BORRELIA GARINII
NKSQDLEPS

SEQ ID NO: 149099 - protein, 9 aa, BORRELIA GARINII
KSQDLEPSN

SEQ ID NO: 149100 - protein, 9 aa, BORRELIA GARINII
SQDLEPSNT

SEQ ID NO: 149101 - protein, 9 aa, BORRELIA GARINII
QDLEPSNTK

SEQ ID NO: 149102 - protein, 9 aa, BORRELIA GARINII
DLEPSNTKN

SEQ ID NO: 149103 - protein, 9 aa, BORRELIA GARINII
LEPSNTKNK

SEQ ID NO: 149104 - protein, 9 aa, BORRELIA GARINII
EPSNTKNKD

SEQ ID NO: 149105 - protein, 9 aa, BORRELIA GARINII
PSNTKNKDL

SEQ ID NO: 149106 - protein, 9 aa, BORRELIA GARINII
SNTKNKDLE

SEQ ID NO: 149107 - protein, 9 aa, BORRELIA GARINII
NTKNKDLEP

SEQ ID NO: 149108 - protein, 9 aa, BORRELIA GARINII
TKNKDLEPL

SEQ ID NO: 149109 - protein, 9 aa, BORRELIA GARINII
KNKDLEPLE

SEQ ID NO: 149110 - protein, 9 aa, BORRELIA GARINII
NKDLEPLEK

SEQ ID NO: 149111 - protein, 9 aa, BORRELIA GARINII
KDLEPLEKN

SEQ ID NO: 149112 - protein, 9 aa, BORRELIA GARINII
DLEPLEKNS

SEQ ID NO: 149113 - protein, 9 aa, BORRELIA GARINII
LEPLEKNSK

SEQ ID NO: 149114 - protein, 9 aa, BORRELIA GARINII
EPLEKNSKE

SEQ ID NO: 149115 - protein, 9 aa, BORRELIA GARINII
PLEKNSKET

SEQ ID NO: 149116 - protein, 9 aa, BORRELIA GARINII
LEKNSKETI

SEQ ID NO: 149117 - protein, 9 aa, BORRELIA GARINII
EKNSKETII

SEQ ID NO: 149118 - protein, 9 aa, BORRELIA GARINII
KNSKETIIS

SEQ ID NO: 149119 - protein, 9 aa, BORRELIA GARINII
NSKETIISK

SEQ ID NO: 149120 - protein, 9 aa, BORRELIA GARINII
SKETIISKL

SEQ ID NO: 149121 - protein, 9 aa, BORRELIA GARINII
KETIISKLE

SEQ ID NO: 149122 - protein, 9 aa, BORRELIA GARINII
ETIISKLEK

SEQ ID NO: 149123 - protein, 9 aa, BORRELIA GARINII
TIISKLEKM

SEQ ID NO: 149124 - protein, 9 aa, BORRELIA GARINII
IISKLEKMI

SEQ ID NO: 149125 - protein, 9 aa, BORRELIA GARINII
ISKLEKMIK

SEQ ID NO: 149126 - protein, 9 aa, BORRELIA GARINII
SKLEKMIKD

SEQ ID NO: 149127 - protein, 9 aa, BORRELIA GARINII
KLEKMIKDL

SEQ ID NO: 149128 - protein, 9 aa, BORRELIA GARINII
LEKMIKDLE

SEQ ID NO: 149129 - protein, 9 aa, BORRELIA GARINII
EKMIKDLED

SEQ ID NO: 149130 - protein, 9 aa, BORRELIA GARINII
KMIKDLEDQ

SEQ ID NO: 149131 - protein, 9 aa, BORRELIA GARINII
MIKDLEDQK

SEQ ID NO: 149132 - protein, 9 aa, BORRELIA GARINII
IKDLEDQKD

SEQ ID NO: 149133 - protein, 9 aa, BORRELIA GARINII
KDLEDQKDQ

SEQ ID NO: 149134 - protein, 9 aa, BORRELIA GARINII
DLEDQKDQE

SEQ ID NO: 149135 - protein, 9 aa, BORRELIA GARINII
LEDQKDQED

SEQ ID NO: 149136 - protein, 9 aa, BORRELIA GARINII
EDQKDQEDT

SEQ ID NO: 149137 - protein, 9 aa, BORRELIA GARINII
DQKDQEDTE

SEQ ID NO: 149138 - protein, 9 aa, BORRELIA GARINII
QKDQEDTEI

SEQ ID NO: 149139 - protein, 9 aa, BORRELIA GARINII
KDQEDTEIA

SEQ ID NO: 149140 - protein, 9 aa, BORRELIA GARINII
DQEDTEIAK

SEQ ID NO: 149141 - protein, 9 aa, BORRELIA GARINII
QEDTEIAKI

SEQ ID NO: 149142 - protein, 9 aa, BORRELIA GARINII
EDTEIAKIT

SEQ ID NO: 149143 - protein, 9 aa, BORRELIA GARINII
DTEIAKITN

SEQ ID NO: 149144 - protein, 9 aa, BORRELIA GARINII
TEIAKITNT

SEQ ID NO: 149145 - protein, 9 aa, BORRELIA GARINII
EIAKITNTQ

SEQ ID NO: 149146 - protein, 9 aa, BORRELIA GARINII
IAKITNTQI

SEQ ID NO: 149147 - protein, 9 aa, BORRELIA GARINII
AKITNTQID

SEQ ID NO: 149148 - protein, 9 aa, BORRELIA GARINII
KITNTQIDF

SEQ ID NO: 149149 - protein, 9 aa, BORRELIA GARINII
ITNTQIDFL

SEQ ID NO: 149150 - protein, 9 aa, BORRELIA GARINII
TNTQIDFLE

SEQ ID NO: 149151 - protein, 9 aa, BORRELIA GARINII
NTQIDFLEN

SEQ ID NO: 149152 - protein, 9 aa, BORRELIA GARINII
TQIDFLENF

SEQ ID NO: 149153 - protein, 9 aa, BORRELIA GARINII
QIDFLENFK

SEQ ID NO: 149154 - protein, 9 aa, BORRELIA GARINII
IDFLENFKS

SEQ ID NO: 149155 - protein, 9 aa, BORRELIA GARINII
DFLENFKSE

SEQ ID NO: 149156 - protein, 9 aa, BORRELIA GARINII
FLENFKSEP

SEQ ID NO: 149157 - protein, 9 aa, BORRELIA GARINII
LENFKSEPH

SEQ ID NO: 149158 - protein, 9 aa, BORRELIA GARINII
ENFKSEPHD

SEQ ID NO: 149159 - protein, 9 aa, BORRELIA GARINII
NFKSEPHDT

SEQ ID NO: 149160 - protein, 9 aa, BORRELIA GARINII
FKSEPHDTI

SEQ ID NO: 149161 - protein, 9 aa, BORRELIA GARINII
KSEPHDTIS

SEQ ID NO: 149162 - protein, 9 aa, BORRELIA GARINII
SEPHDTISE

SEQ ID NO: 149163 - protein, 9 aa, BORRELIA GARINII
EPHDTISED

SEQ ID NO: 149164 - protein, 9 aa, BORRELIA GARINII
PHDTISEDI

SEQ ID NO: 149165 - protein, 9 aa, BORRELIA GARINII
HDTISEDIE

SEQ ID NO: 149166 - protein, 9 aa, BORRELIA GARINII
DTISEDIEM

SEQ ID NO: 149167 - protein, 9 aa, BORRELIA GARINII
TISEDIEMK

SEQ ID NO: 149168 - protein, 9 aa, BORRELIA GARINII
ISEDIEMKI

SEQ ID NO: 149169 - protein, 9 aa, BORRELIA GARINII
SEDIEMKIK

SEQ ID NO: 149170 - protein, 9 aa, BORRELIA GARINII
EDIEMKIKR

SEQ ID NO: 149171 - protein, 9 aa, BORRELIA GARINII
DIEMKIKRI

SEQ ID NO: 149172 - protein, 9 aa, BORRELIA GARINII
IEMKIKRII

SEQ ID NO: 149173 - protein, 9 aa, BORRELIA GARINII
EMKIKRIIY

SEQ ID NO: 149174 - protein, 9 aa, BORRELIA GARINII
MKIKRIIYS

SEQ ID NO: 149175 - protein, 9 aa, BORRELIA GARINII
KIKRIIYSS

SEQ ID NO: 149176 - protein, 9 aa, BORRELIA GARINII
IKRIIYSSL

SEQ ID NO: 149177 - protein, 9 aa, BORRELIA GARINII
KRIIYSSLN

SEQ ID NO: 149178 - protein, 9 aa, BORRELIA GARINII
RIIYSSLNY

SEQ ID NO: 149179 - protein, 9 aa, BORRELIA GARINII
IIYSSLNYE

SEQ ID NO: 149180 - protein, 9 aa, BORRELIA GARINII
IYSSLNYEI

SEQ ID NO: 149181 - protein, 9 aa, BORRELIA GARINII
YSSLNYEIE

SEQ ID NO: 149182 - protein, 9 aa, BORRELIA GARINII
SSLNYEIEK

SEQ ID NO: 149183 - protein, 9 aa, BORRELIA GARINII
SLNYEIEKI

SEQ ID NO: 149184 - protein, 9 aa, BORRELIA GARINII
LNYEIEKIN

SEQ ID NO: 149185 - protein, 9 aa, BORRELIA GARINII
NYEIEKINT

SEQ ID NO: 149186 - protein, 9 aa, BORRELIA GARINII
YEIEKINTL

SEQ ID NO: 149187 - protein, 9 aa, BORRELIA GARINII
EIEKINTLK

SEQ ID NO: 149188 - protein, 9 aa, BORRELIA GARINII
IEKINTLKE

SEQ ID NO: 149189 - protein, 9 aa, BORRELIA GARINII
EKINTLKEI

SEQ ID NO: 149190 - protein, 9 aa, BORRELIA GARINII
KINTLKEIL

SEQ ID NO: 149191 - protein, 9 aa, BORRELIA GARINII
INTLKEILD

SEQ ID NO: 149192 - protein, 9 aa, BORRELIA GARINII
NTLKEILDK

SEQ ID NO: 149193 - protein, 9 aa, BORRELIA GARINII
TLKEILDKL

SEQ ID NO: 149194 - protein, 9 aa, BORRELIA GARINII
LKEILDKLY

SEQ ID NO: 149195 - protein, 9 aa, BORRELIA GARINII
KEILDKLYK

SEQ ID NO: 149196 - protein, 9 aa, BORRELIA GARINII
EILDKLYKN

SEQ ID NO: 149197 - protein, 9 aa, BORRELIA GARINII
ILDKLYKNH

SEQ ID NO: 149198 - protein, 9 aa, BORRELIA GARINII
LDKLYKNHK

SEQ ID NO: 149199 - protein, 9 aa, BORRELIA GARINII
DKLYKNHKY

SEQ ID NO: 149200 - protein, 9 aa, BORRELIA GARINII
KLYKNHKYK

SEQ ID NO: 149201 - protein, 9 aa, BORRELIA GARINII
LYKNHKYKT

SEQ ID NO: 149202 - protein, 9 aa, BORRELIA GARINII
YKNHKYKTT

SEQ ID NO: 149203 - protein, 9 aa, BORRELIA GARINII
KNHKYKTTA

SEQ ID NO: 149204 - protein, 9 aa, BORRELIA GARINII
NHKYKTTAR

SEQ ID NO: 149205 - protein, 9 aa, BORRELIA GARINII
HKYKTTARN

SEQ ID NO: 149206 - protein, 9 aa, BORRELIA GARINII
KYKTTARNF

SEQ ID NO: 149207 - protein, 9 aa, BORRELIA GARINII
YKTTARNFI

SEQ ID NO: 149208 - protein, 9 aa, BORRELIA GARINII
KTTARNFIL

SEQ ID NO: 149209 - protein, 9 aa, BORRELIA GARINII
TTARNFILN

SEQ ID NO: 149210 - protein, 9 aa, BORRELIA GARINII
TARNFILNI

SEQ ID NO: 149211 - protein, 9 aa, BORRELIA GARINII
ARNFILNIS

SEQ ID NO: 149212 - protein, 9 aa, BORRELIA GARINII
RNFILNISI

SEQ ID NO: 149213 - protein, 9 aa, BORRELIA GARINII
NFILNISIK

SEQ ID NO: 149214 - protein, 9 aa, BORRELIA GARINII
FILNISIKI

SEQ ID NO: 149215 - protein, 9 aa, BORRELIA GARINII
ILNISIKIQ

SEQ ID NO: 149216 - protein, 9 aa, BORRELIA GARINII
LNISIKIQF

SEQ ID NO: 149217 - protein, 9 aa, BORRELIA GARINII
NISIKIQFQ

SEQ ID NO: 149218 - protein, 9 aa, BORRELIA GARINII
ISIKIQFQI

SEQ ID NO: 149219 - protein, 9 aa, BORRELIA GARINII
SIKIQFQIE

SEQ ID NO: 149220 - protein, 9 aa, BORRELIA GARINII
IKIQFQIEN

SEQ ID NO: 149221 - protein, 9 aa, BORRELIA GARINII
KIQFQIENA

SEQ ID NO: 149222 - protein, 9 aa, BORRELIA GARINII
IQFQIENAL

SEQ ID NO: 149223 - protein, 9 aa, BORRELIA GARINII
QFQIENALE

SEQ ID NO: 149224 - protein, 9 aa, BORRELIA GARINII
FQIENALEL

SEQ ID NO: 149225 - protein, 9 aa, BORRELIA GARINII
QIENALELM

SEQ ID NO: 149226 - protein, 9 aa, BORRELIA GARINII
IENALELMK

SEQ ID NO: 149227 - protein, 9 aa, BORRELIA GARINII
ENALELMKE

SEQ ID NO: 149228 - protein, 9 aa, BORRELIA GARINII
NALELMKEE

SEQ ID NO: 149229 - protein, 9 aa, BORRELIA GARINII
ALELMKEEI

SEQ ID NO: 149230 - protein, 9 aa, BORRELIA GARINII
LELMKEEIE

SEQ ID NO: 149231 - protein, 9 aa, BORRELIA GARINII
ELMKEEIED

SEQ ID NO: 149232 - protein, 9 aa, BORRELIA GARINII
LMKEEIEDA

SEQ ID NO: 149233 - protein, 9 aa, BORRELIA GARINII
MKEEIEDAS

SEQ ID NO: 149234 - protein, 9 aa, BORRELIA GARINII
KEEIEDASE

SEQ ID NO: 149235 - protein, 9 aa, BORRELIA GARINII
EEIEDASEI

SEQ ID NO: 149236 - protein, 9 aa, BORRELIA GARINII
EIEDASEIL

SEQ ID NO: 149237 - protein, 9 aa, BORRELIA GARINII
IEDASEILN

SEQ ID NO: 149238 - protein, 9 aa, BORRELIA GARINII
EDASEILNQ

SEQ ID NO: 149239 - protein, 9 aa, BORRELIA GARINII
DASEILNQE

SEQ ID NO: 149240 - protein, 9 aa, BORRELIA GARINII
ASEILNQER

SEQ ID NO: 149241 - protein, 9 aa, BORRELIA GARINII
SEILNQERY

SEQ ID NO: 149242 - protein, 9 aa, BORRELIA GARINII
EILNQERYE

SEQ ID NO: 149243 - protein, 9 aa, BORRELIA GARINII
ILNQERYEI

SEQ ID NO: 149244 - protein, 9 aa, BORRELIA GARINII
LNQERYEIL

SEQ ID NO: 149245 - protein, 9 aa, BORRELIA GARINII
NQERYEILL

SEQ ID NO: 149246 - protein, 9 aa, BORRELIA GARINII
QERYEILLK

SEQ ID NO: 149247 - protein, 9 aa, BORRELIA GARINII
ERYEILLKH

SEQ ID NO: 149248 - protein, 9 aa, BORRELIA GARINII
RYEILLKHV

SEQ ID NO: 149249 - protein, 9 aa, BORRELIA GARINII
YEILLKHVE

SEQ ID NO: 149250 - protein, 9 aa, BORRELIA GARINII
EILLKHVEP

SEQ ID NO: 149251 - protein, 9 aa, BORRELIA GARINII
ILLKHVEPS

SEQ ID NO: 149252 - protein, 9 aa, BORRELIA GARINII
LLKHVEPSL

SEQ ID NO: 149253 - protein, 9 aa, BORRELIA GARINII
LKHVEPSLN

SEQ ID NO: 149254 - protein, 9 aa, BORRELIA GARINII
KHVEPSLNL

SEQ ID NO: 149255 - protein, 9 aa, BORRELIA GARINII
HVEPSLNLK

SEQ ID NO: 149256 - protein, 9 aa, BORRELIA GARINII
VEPSLNLKQ

SEQ ID NO: 149257 - protein, 9 aa, BORRELIA GARINII
EPSLNLKQK

SEQ ID NO: 149258 - protein, 9 aa, BORRELIA GARINII
PSLNLKQKF

SEQ ID NO: 149259 - protein, 9 aa, BORRELIA GARINII
SLNLKQKFE

SEQ ID NO: 149260 - protein, 9 aa, BORRELIA GARINII
LNLKQKFEK

SEQ ID NO: 149261 - protein, 9 aa, BORRELIA GARINII
NLKQKFEKI

SEQ ID NO: 149262 - protein, 9 aa, BORRELIA GARINII
LKQKFEKIL

SEQ ID NO: 149263 - protein, 9 aa, BORRELIA GARINII
KQKFEKILN

SEQ ID NO: 149264 - protein, 9 aa, BORRELIA GARINII
QKFEKILNE

SEQ ID NO: 149265 - protein, 9 aa, BORRELIA GARINII
KFEKILNET

SEQ ID NO: 149266 - protein, 9 aa, BORRELIA GARINII
FEKILNETI

SEQ ID NO: 149267 - protein, 9 aa, BORRELIA GARINII
EKILNETIK

SEQ ID NO: 149268 - protein, 9 aa, BORRELIA GARINII
KILNETIKA

SEQ ID NO: 149269 - protein, 9 aa, BORRELIA GARINII
ILNETIKAY

SEQ ID NO: 149270 - protein, 9 aa, BORRELIA GARINII
LNETIKAYN

SEQ ID NO: 149271 - protein, 9 aa, BORRELIA GARINII
NETIKAYNQ

SEQ ID NO: 149272 - protein, 9 aa, BORRELIA GARINII
ETIKAYNQD

SEQ ID NO: 149273 - protein, 9 aa, BORRELIA GARINII
TIKAYNQDL

SEQ ID NO: 149274 - protein, 9 aa, BORRELIA GARINII
IKAYNQDLD

SEQ ID NO: 149275 - protein, 9 aa, BORRELIA GARINII
KAYNQDLDN

SEQ ID NO: 149276 - protein, 9 aa, BORRELIA GARINII
AYNQDLDNI

SEQ ID NO: 149277 - protein, 9 aa, BORRELIA GARINII
YNQDLDNIK

SEQ ID NO: 149278 - protein, 9 aa, BORRELIA GARINII
NQDLDNIKS

SEQ ID NO: 149279 - protein, 9 aa, BORRELIA GARINII
QDLDNIKSN

SEQ ID NO: 149280 - protein, 9 aa, BORRELIA GARINII
DLDNIKSNE

SEQ ID NO: 149281 - protein, 9 aa, BORRELIA GARINII
LDNIKSNED

SEQ ID NO: 149282 - protein, 9 aa, BORRELIA GARINII
DNIKSNEDQ

SEQ ID NO: 149283 - protein, 9 aa, BORRELIA GARINII
NIKSNEDQL

SEQ ID NO: 149284 - protein, 9 aa, BORRELIA GARINII
IKSNEDQLA

SEQ ID NO: 149285 - protein, 9 aa, BORRELIA GARINII
KSNEDQLAH

SEQ ID NO: 149286 - protein, 9 aa, BORRELIA GARINII
SNEDQLAHM

SEQ ID NO: 149287 - protein, 9 aa, BORRELIA GARINII
NEDQLAHMD

SEQ ID NO: 149288 - protein, 9 aa, BORRELIA GARINII
EDQLAHMDE

SEQ ID NO: 149289 - protein, 9 aa, BORRELIA GARINII
DQLAHMDEN

SEQ ID NO: 149290 - protein, 9 aa, BORRELIA GARINII
QLAHMDENY

SEQ ID NO: 149291 - protein, 9 aa, BORRELIA GARINII
LAHMDENYK

SEQ ID NO: 149292 - protein, 9 aa, BORRELIA GARINII
AHMDENYKE

SEQ ID NO: 149293 - protein, 9 aa, BORRELIA GARINII
HMDENYKEF

SEQ ID NO: 149294 - protein, 9 aa, BORRELIA GARINII
MDENYKEFD

SEQ ID NO: 149295 - protein, 9 aa, BORRELIA GARINII
DENYKEFDP

SEQ ID NO: 149296 - protein, 9 aa, BORRELIA GARINII
ENYKEFDPL

SEQ ID NO: 149297 - protein, 9 aa, BORRELIA GARINII
NYKEFDPLN

SEQ ID NO: 149298 - protein, 9 aa, BORRELIA GARINII
YKEFDPLNL

SEQ ID NO: 149299 - protein, 9 aa, BORRELIA GARINII
KEFDPLNLD

SEQ ID NO: 149300 - protein, 9 aa, BORRELIA GARINII
EFDPLNLDY

SEQ ID NO: 149301 - protein, 10 aa, BORRELIA GARINII
MKKTKLNIIK

SEQ ID NO: 149302 - protein, 10 aa, BORRELIA GARINII
KKTKLNIIKL

SEQ ID NO: 149303 - protein, 10 aa, BORRELIA GARINII
KTKLNIIKLN

SEQ ID NO: 149304 - protein, 10 aa, BORRELIA GARINII
TKLNIIKLNI

SEQ ID NO: 149305 - protein, 10 aa, BORRELIA GARINII
KLNIIKLNIL

SEQ ID NO: 149306 - protein, 10 aa, BORRELIA GARINII
LNIIKLNILT

SEQ ID NO: 149307 - protein, 10 aa, BORRELIA GARINII
NIIKLNILTT

SEQ ID NO: 149308 - protein, 10 aa, BORRELIA GARINII
IIKLNILTTI

SEQ ID NO: 149309 - protein, 10 aa, BORRELIA GARINII
IKLNILTTIL

SEQ ID NO: 149310 - protein, 10 aa, BORRELIA GARINII
KLNILTTILT

SEQ ID NO: 149311 - protein, 10 aa, BORRELIA GARINII
LNILTTILTL

SEQ ID NO: 149312 - protein, 10 aa, BORRELIA GARINII
NILTTILTLI

SEQ ID NO: 149313 - protein, 10 aa, BORRELIA GARINII
ILTTILTLIC

SEQ ID NO: 149314 - protein, 10 aa, BORRELIA GARINII
LTTILTLICI

SEQ ID NO: 149315 - protein, 10 aa, BORRELIA GARINII
TTILTLICIS

SEQ ID NO: 149316 - protein, 10 aa, BORRELIA GARINII
TILTLICISC

SEQ ID NO: 149317 - protein, 10 aa, BORRELIA GARINII
ILTLICISCA

SEQ ID NO: 149318 - protein, 10 aa, BORRELIA GARINII
LTLICISCAV

SEQ ID NO: 149319 - protein, 10 aa, BORRELIA GARINII
TLICISCAVD

SEQ ID NO: 149320 - protein, 10 aa, BORRELIA GARINII
LICISCAVDK

SEQ ID NO: 149321 - protein, 10 aa, BORRELIA GARINII
ICISCAVDKI

SEQ ID NO: 149322 - protein, 10 aa, BORRELIA GARINII
CISCAVDKID

SEQ ID NO: 149323 - protein, 10 aa, BORRELIA GARINII
ISCAVDKIDP

SEQ ID NO: 149324 - protein, 10 aa, BORRELIA GARINII
SCAVDKIDPE

SEQ ID NO: 149325 - protein, 10 aa, BORRELIA GARINII
CAVDKIDPES

SEQ ID NO: 149326 - protein, 10 aa, BORRELIA GARINII
AVDKIDPESK

SEQ ID NO: 149327 - protein, 10 aa, BORRELIA GARINII
VDKIDPESKS

SEQ ID NO: 149328 - protein, 10 aa, BORRELIA GARINII
DKIDPESKSK

SEQ ID NO: 149329 - protein, 10 aa, BORRELIA GARINII
KIDPESKSKT

SEQ ID NO: 149330 - protein, 10 aa, BORRELIA GARINII
IDPESKSKTN

SEQ ID NO: 149331 - protein, 10 aa, BORRELIA GARINII
DPESKSKTNT

SEQ ID NO: 149332 - protein, 10 aa, BORRELIA GARINII
PESKSKTNTK

SEQ ID NO: 149333 - protein, 10 aa, BORRELIA GARINII
ESKSKTNTKD

SEQ ID NO: 149334 - protein, 10 aa, BORRELIA GARINII
SKSKTNTKDF

SEQ ID NO: 149335 - protein, 10 aa, BORRELIA GARINII
KSKTNTKDFE

SEQ ID NO: 149336 - protein, 10 aa, BORRELIA GARINII
SKTNTKDFEN

SEQ ID NO: 149337 - protein, 10 aa, BORRELIA GARINII
KTNTKDFENK

SEQ ID NO: 149338 - protein, 10 aa, BORRELIA GARINII
TNTKDFENKS

SEQ ID NO: 149339 - protein, 10 aa, BORRELIA GARINII
NTKDFENKSQ

SEQ ID NO: 149340 - protein, 10 aa, BORRELIA GARINII
TKDFENKSQD

SEQ ID NO: 149341 - protein, 10 aa, BORRELIA GARINII
KDFENKSQDL

SEQ ID NO: 149342 - protein, 10 aa, BORRELIA GARINII
DFENKSQDLE

SEQ ID NO: 149343 - protein, 10 aa, BORRELIA GARINII
FENKSQDLEP

SEQ ID NO: 149344 - protein, 10 aa, BORRELIA GARINII
ENKSQDLEPS

SEQ ID NO: 149345 - protein, 10 aa, BORRELIA GARINII
NKSQDLEPSN

SEQ ID NO: 149346 - protein, 10 aa, BORRELIA GARINII
KSQDLEPSNT

SEQ ID NO: 149347 - protein, 10 aa, BORRELIA GARINII
SQDLEPSNTK

SEQ ID NO: 149348 - protein, 10 aa, BORRELIA GARINII
QDLEPSNTKN

SEQ ID NO: 149349 - protein, 10 aa, BORRELIA GARINII
DLEPSNTKNK

SEQ ID NO: 149350 - protein, 10 aa, BORRELIA GARINII
LEPSNTKNKD

SEQ ID NO: 149351 - protein, 10 aa, BORRELIA GARINII
EPSNTKNKDL

SEQ ID NO: 149352 - protein, 10 aa, BORRELIA GARINII
PSNTKNKDLE

SEQ ID NO: 149353 - protein, 10 aa, BORRELIA GARINII
SNTKNKDLEP

SEQ ID NO: 149354 - protein, 10 aa, BORRELIA GARINII
NTKNKDLEPL

SEQ ID NO: 149355 - protein, 10 aa, BORRELIA GARINII
TKNKDLEPLE

SEQ ID NO: 149356 - protein, 10 aa, BORRELIA GARINII
KNKDLEPLEK

SEQ ID NO: 149357 - protein, 10 aa, BORRELIA GARINII
NKDLEPLEKN

SEQ ID NO: 149358 - protein, 10 aa, BORRELIA GARINII
KDLEPLEKNS

SEQ ID NO: 149359 - protein, 10 aa, BORRELIA GARINII
DLEPLEKNSK

SEQ ID NO: 149360 - protein, 10 aa, BORRELIA GARINII
LEPLEKNSKE

SEQ ID NO: 149361 - protein, 10 aa, BORRELIA GARINII
EPLEKNSKET

SEQ ID NO: 149362 - protein, 10 aa, BORRELIA GARINII
PLEKNSKETI

SEQ ID NO: 149363 - protein, 10 aa, BORRELIA GARINII
LEKNSKETII

SEQ ID NO: 149364 - protein, 10 aa, BORRELIA GARINII
EKNSKETIIS

SEQ ID NO: 149365 - protein, 10 aa, BORRELIA GARINII
KNSKETIISK

SEQ ID NO: 149366 - protein, 10 aa, BORRELIA GARINII
NSKETIISKL

SEQ ID NO: 149367 - protein, 10 aa, BORRELIA GARINII
SKETIISKLE

SEQ ID NO: 149368 - protein, 10 aa, BORRELIA GARINII
KETIISKLEK

SEQ ID NO: 149369 - protein, 10 aa, BORRELIA GARINII
ETIISKLEKM

SEQ ID NO: 149370 - protein, 10 aa, BORRELIA GARINII
TIISKLEKMI

SEQ ID NO: 149371 - protein, 10 aa, BORRELIA GARINII
IISKLEKMIK

SEQ ID NO: 149372 - protein, 10 aa, BORRELIA GARINII
ISKLEKMIKD

SEQ ID NO: 149373 - protein, 10 aa, BORRELIA GARINII
SKLEKMIKDL

SEQ ID NO: 149374 - protein, 10 aa, BORRELIA GARINII
KLEKMIKDLE

SEQ ID NO: 149375 - protein, 10 aa, BORRELIA GARINII
LEKMIKDLED

SEQ ID NO: 149376 - protein, 10 aa, BORRELIA GARINII
EKMIKDLEDQ

SEQ ID NO: 149377 - protein, 10 aa, BORRELIA GARINII
KMIKDLEDQK

SEQ ID NO: 149378 - protein, 10 aa, BORRELIA GARINII
MIKDLEDQKD

SEQ ID NO: 149379 - protein, 10 aa, BORRELIA GARINII
IKDLEDQKDQ

SEQ ID NO: 149380 - protein, 10 aa, BORRELIA GARINII
KDLEDQKDQE

SEQ ID NO: 149381 - protein, 10 aa, BORRELIA GARINII
DLEDQKDQED

SEQ ID NO: 149382 - protein, 10 aa, BORRELIA GARINII
LEDQKDQEDT

SEQ ID NO: 149383 - protein, 10 aa, BORRELIA GARINII
EDQKDQEDTE

SEQ ID NO: 149384 - protein, 10 aa, BORRELIA GARINII
DQKDQEDTEI

SEQ ID NO: 149385 - protein, 10 aa, BORRELIA GARINII
QKDQEDTEIA

SEQ ID NO: 149386 - protein, 10 aa, BORRELIA GARINII
KDQEDTEIAK

SEQ ID NO: 149387 - protein, 10 aa, BORRELIA GARINII
DQEDTEIAKI

SEQ ID NO: 149388 - protein, 10 aa, BORRELIA GARINII
QEDTEIAKIT

SEQ ID NO: 149389 - protein, 10 aa, BORRELIA GARINII
EDTEIAKITN

SEQ ID NO: 149390 - protein, 10 aa, BORRELIA GARINII
DTEIAKITNT

SEQ ID NO: 149391 - protein, 10 aa, BORRELIA GARINII
TEIAKITNTQ

SEQ ID NO: 149392 - protein, 10 aa, BORRELIA GARINII
EIAKITNTQI

SEQ ID NO: 149393 - protein, 10 aa, BORRELIA GARINII
IAKITNTQID

SEQ ID NO: 149394 - protein, 10 aa, BORRELIA GARINII
AKITNTQIDF

SEQ ID NO: 149395 - protein, 10 aa, BORRELIA GARINII
KITNTQIDFL

SEQ ID NO: 149396 - protein, 10 aa, BORRELIA GARINII
ITNTQIDFLE

SEQ ID NO: 149397 - protein, 10 aa, BORRELIA GARINII
TNTQIDFLEN

SEQ ID NO: 149398 - protein, 10 aa, BORRELIA GARINII
NTQIDFLENF

SEQ ID NO: 149399 - protein, 10 aa, BORRELIA GARINII
TQIDFLENFK

SEQ ID NO: 149400 - protein, 10 aa, BORRELIA GARINII
QIDFLENFKS

SEQ ID NO: 149401 - protein, 10 aa, BORRELIA GARINII
IDFLENFKSE

SEQ ID NO: 149402 - protein, 10 aa, BORRELIA GARINII
DFLENFKSEP

SEQ ID NO: 149403 - protein, 10 aa, BORRELIA GARINII
FLENFKSEPH

SEQ ID NO: 149404 - protein, 10 aa, BORRELIA GARINII
LENFKSEPHD

SEQ ID NO: 149405 - protein, 10 aa, BORRELIA GARINII
ENFKSEPHDT

SEQ ID NO: 149406 - protein, 10 aa, BORRELIA GARINII
NFKSEPHDTI

SEQ ID NO: 149407 - protein, 10 aa, BORRELIA GARINII
FKSEPHDTIS

SEQ ID NO: 149408 - protein, 10 aa, BORRELIA GARINII
KSEPHDTISE

SEQ ID NO: 149409 - protein, 10 aa, BORRELIA GARINII
SEPHDTISED

SEQ ID NO: 149410 - protein, 10 aa, BORRELIA GARINII
EPHDTISEDI

SEQ ID NO: 149411 - protein, 10 aa, BORRELIA GARINII
PHDTISEDIE

SEQ ID NO: 149412 - protein, 10 aa, BORRELIA GARINII
HDTISEDIEM

SEQ ID NO: 149413 - protein, 10 aa, BORRELIA GARINII
DTISEDIEMK

SEQ ID NO: 149414 - protein, 10 aa, BORRELIA GARINII
TISEDIEMKI

SEQ ID NO: 149415 - protein, 10 aa, BORRELIA GARINII
ISEDIEMKIK

SEQ ID NO: 149416 - protein, 10 aa, BORRELIA GARINII
SEDIEMKIKR

SEQ ID NO: 149417 - protein, 10 aa, BORRELIA GARINII
EDIEMKIKRI

SEQ ID NO: 149418 - protein, 10 aa, BORRELIA GARINII
DIEMKIKRII

SEQ ID NO: 149419 - protein, 10 aa, BORRELIA GARINII
IEMKIKRIIY

SEQ ID NO: 149420 - protein, 10 aa, BORRELIA GARINII
EMKIKRIIYS

SEQ ID NO: 149421 - protein, 10 aa, BORRELIA GARINII
MKIKRIIYSS

SEQ ID NO: 149422 - protein, 10 aa, BORRELIA GARINII
KIKRIIYSSL

SEQ ID NO: 149423 - protein, 10 aa, BORRELIA GARINII
IKRIIYSSLN

SEQ ID NO: 149424 - protein, 10 aa, BORRELIA GARINII
KRIIYSSLNY

SEQ ID NO: 149425 - protein, 10 aa, BORRELIA GARINII
RIIYSSLNYE

SEQ ID NO: 149426 - protein, 10 aa, BORRELIA GARINII
IIYSSLNYEI

SEQ ID NO: 149427 - protein, 10 aa, BORRELIA GARINII
IYSSLNYEIE

SEQ ID NO: 149428 - protein, 10 aa, BORRELIA GARINII
YSSLNYEIEK

SEQ ID NO: 149429 - protein, 10 aa, BORRELIA GARINII
SSLNYEIEKI

SEQ ID NO: 149430 - protein, 10 aa, BORRELIA GARINII
SLNYEIEKIN

SEQ ID NO: 149431 - protein, 10 aa, BORRELIA GARINII
LNYEIEKINT

SEQ ID NO: 149432 - protein, 10 aa, BORRELIA GARINII
NYEIEKINTL

SEQ ID NO: 149433 - protein, 10 aa, BORRELIA GARINII
YEIEKINTLK

SEQ ID NO: 149434 - protein, 10 aa, BORRELIA GARINII
EIEKINTLKE

SEQ ID NO: 149435 - protein, 10 aa, BORRELIA GARINII
IEKINTLKEI

SEQ ID NO: 149436 - protein, 10 aa, BORRELIA GARINII
EKINTLKEIL

SEQ ID NO: 149437 - protein, 10 aa, BORRELIA GARINII
KINTLKEILD

SEQ ID NO: 149438 - protein, 10 aa, BORRELIA GARINII
INTLKEILDK

SEQ ID NO: 149439 - protein, 10 aa, BORRELIA GARINII
NTLKEILDKL

SEQ ID NO: 149440 - protein, 10 aa, BORRELIA GARINII
TLKEILDKLY

SEQ ID NO: 149441 - protein, 10 aa, BORRELIA GARINII
LKEILDKLYK

SEQ ID NO: 149442 - protein, 10 aa, BORRELIA GARINII
KEILDKLYKN

SEQ ID NO: 149443 - protein, 10 aa, BORRELIA GARINII
EILDKLYKNH

SEQ ID NO: 149444 - protein, 10 aa, BORRELIA GARINII
ILDKLYKNHK

SEQ ID NO: 149445 - protein, 10 aa, BORRELIA GARINII
LDKLYKNHKY

SEQ ID NO: 149446 - protein, 10 aa, BORRELIA GARINII
DKLYKNHKYK

SEQ ID NO: 149447 - protein, 10 aa, BORRELIA GARINII
KLYKNHKYKT

SEQ ID NO: 149448 - protein, 10 aa, BORRELIA GARINII
LYKNHKYKTT

SEQ ID NO: 149449 - protein, 10 aa, BORRELIA GARINII
YKNHKYKTTA

SEQ ID NO: 149450 - protein, 10 aa, BORRELIA GARINII
KNHKYKTTAR

SEQ ID NO: 149451 - protein, 10 aa, BORRELIA GARINII
NHKYKTTARN

SEQ ID NO: 149452 - protein, 10 aa, BORRELIA GARINII
HKYKTTARNF

SEQ ID NO: 149453 - protein, 10 aa, BORRELIA GARINII
KYKTTARNFI

SEQ ID NO: 149454 - protein, 10 aa, BORRELIA GARINII
YKTTARNFIL

SEQ ID NO: 149455 - protein, 10 aa, BORRELIA GARINII
KTTARNFILN

SEQ ID NO: 149456 - protein, 10 aa, BORRELIA GARINII
TTARNFILNI

SEQ ID NO: 149457 - protein, 10 aa, BORRELIA GARINII
TARNFILNIS

SEQ ID NO: 149458 - protein, 10 aa, BORRELIA GARINII
ARNFILNISI

SEQ ID NO: 149459 - protein, 10 aa, BORRELIA GARINII
RNFILNISIK

SEQ ID NO: 149460 - protein, 10 aa, BORRELIA GARINII
NFILNISIKI

SEQ ID NO: 149461 - protein, 10 aa, BORRELIA GARINII
FILNISIKIQ

SEQ ID NO: 149462 - protein, 10 aa, BORRELIA GARINII
ILNISIKIQF

SEQ ID NO: 149463 - protein, 10 aa, BORRELIA GARINII
LNISIKIQFQ

SEQ ID NO: 149464 - protein, 10 aa, BORRELIA GARINII
NISIKIQFQI

SEQ ID NO: 149465 - protein, 10 aa, BORRELIA GARINII
ISIKIQFQIE

SEQ ID NO: 149466 - protein, 10 aa, BORRELIA GARINII
SIKIQFQIEN

SEQ ID NO: 149467 - protein, 10 aa, BORRELIA GARINII
IKIQFQIENA

SEQ ID NO: 149468 - protein, 10 aa, BORRELIA GARINII
KIQFQIENAL

SEQ ID NO: 149469 - protein, 10 aa, BORRELIA GARINII
IQFQIENALE

SEQ ID NO: 149470 - protein, 10 aa, BORRELIA GARINII
QFQIENALEL

SEQ ID NO: 149471 - protein, 10 aa, BORRELIA GARINII
FQIENALELM

SEQ ID NO: 149472 - protein, 10 aa, BORRELIA GARINII
QIENALELMK

SEQ ID NO: 149473 - protein, 10 aa, BORRELIA GARINII
IENALELMKE

SEQ ID NO: 149474 - protein, 10 aa, BORRELIA GARINII
ENALELMKEE

SEQ ID NO: 149475 - protein, 10 aa, BORRELIA GARINII
NALELMKEEI

SEQ ID NO: 149476 - protein, 10 aa, BORRELIA GARINII
ALELMKEEIE

SEQ ID NO: 149477 - protein, 10 aa, BORRELIA GARINII
LELMKEEIED

SEQ ID NO: 149478 - protein, 10 aa, BORRELIA GARINII
ELMKEEIEDA

SEQ ID NO: 149479 - protein, 10 aa, BORRELIA GARINII
LMKEEIEDAS

SEQ ID NO: 149480 - protein, 10 aa, BORRELIA GARINII
MKEEIEDASE

SEQ ID NO: 149481 - protein, 10 aa, BORRELIA GARINII
KEEIEDASEI

SEQ ID NO: 149482 - protein, 10 aa, BORRELIA GARINII
EEIEDASEIL

SEQ ID NO: 149483 - protein, 10 aa, BORRELIA GARINII
EIEDASEILN

SEQ ID NO: 149484 - protein, 10 aa, BORRELIA GARINII
IEDASEILNQ

SEQ ID NO: 149485 - protein, 10 aa, BORRELIA GARINII
EDASEILNQE

SEQ ID NO: 149486 - protein, 10 aa, BORRELIA GARINII
DASEILNQER

SEQ ID NO: 149487 - protein, 10 aa, BORRELIA GARINII
ASEILNQERY

SEQ ID NO: 149488 - protein, 10 aa, BORRELIA GARINII
SEILNQERYE

SEQ ID NO: 149489 - protein, 10 aa, BORRELIA GARINII
EILNQERYEI

SEQ ID NO: 149490 - protein, 10 aa, BORRELIA GARINII
ILNQERYEIL

SEQ ID NO: 149491 - protein, 10 aa, BORRELIA GARINII
LNQERYEILL

SEQ ID NO: 149492 - protein, 10 aa, BORRELIA GARINII
NQERYEILLK

SEQ ID NO: 149493 - protein, 10 aa, BORRELIA GARINII
QERYEILLKH

SEQ ID NO: 149494 - protein, 10 aa, BORRELIA GARINII
ERYEILLKHV

SEQ ID NO: 149495 - protein, 10 aa, BORRELIA GARINII
RYEILLKHVE

SEQ ID NO: 149496 - protein, 10 aa, BORRELIA GARINII
YEILLKHVEP

SEQ ID NO: 149497 - protein, 10 aa, BORRELIA GARINII
EILLKHVEPS

SEQ ID NO: 149498 - protein, 10 aa, BORRELIA GARINII
ILLKHVEPSL

SEQ ID NO: 149499 - protein, 10 aa, BORRELIA GARINII
LLKHVEPSLN

SEQ ID NO: 149500 - protein, 10 aa, BORRELIA GARINII
LKHVEPSLNL

SEQ ID NO: 149501 - protein, 10 aa, BORRELIA GARINII
KHVEPSLNLK

SEQ ID NO: 149502 - protein, 10 aa, BORRELIA GARINII
HVEPSLNLKQ

SEQ ID NO: 149503 - protein, 10 aa, BORRELIA GARINII
VEPSLNLKQK

SEQ ID NO: 149504 - protein, 10 aa, BORRELIA GARINII
EPSLNLKQKF

SEQ ID NO: 149505 - protein, 10 aa, BORRELIA GARINII
PSLNLKQKFE

SEQ ID NO: 149506 - protein, 10 aa, BORRELIA GARINII
SLNLKQKFEK

SEQ ID NO: 149507 - protein, 10 aa, BORRELIA GARINII
LNLKQKFEKI

SEQ ID NO: 149508 - protein, 10 aa, BORRELIA GARINII
NLKQKFEKIL

SEQ ID NO: 149509 - protein, 10 aa, BORRELIA GARINII
LKQKFEKILN

SEQ ID NO: 149510 - protein, 10 aa, BORRELIA GARINII
KQKFEKILNE

SEQ ID NO: 149511 - protein, 10 aa, BORRELIA GARINII
QKFEKILNET

SEQ ID NO: 149512 - protein, 10 aa, BORRELIA GARINII
KFEKILNETI

SEQ ID NO: 149513 - protein, 10 aa, BORRELIA GARINII
FEKILNETIK

SEQ ID NO: 149514 - protein, 10 aa, BORRELIA GARINII
EKILNETIKA

SEQ ID NO: 149515 - protein, 10 aa, BORRELIA GARINII
KILNETIKAY

SEQ ID NO: 149516 - protein, 10 aa, BORRELIA GARINII
ILNETIKAYN

SEQ ID NO: 149517 - protein, 10 aa, BORRELIA GARINII
LNETIKAYNQ

SEQ ID NO: 149518 - protein, 10 aa, BORRELIA GARINII
NETIKAYNQD

SEQ ID NO: 149519 - protein, 10 aa, BORRELIA GARINII
ETIKAYNQDL

SEQ ID NO: 149520 - protein, 10 aa, BORRELIA GARINII
TIKAYNQDLD

SEQ ID NO: 149521 - protein, 10 aa, BORRELIA GARINII
IKAYNQDLDN

SEQ ID NO: 149522 - protein, 10 aa, BORRELIA GARINII
KAYNQDLDNI

SEQ ID NO: 149523 - protein, 10 aa, BORRELIA GARINII
AYNQDLDNIK

SEQ ID NO: 149524 - protein, 10 aa, BORRELIA GARINII
YNQDLDNIKS

SEQ ID NO: 149525 - protein, 10 aa, BORRELIA GARINII
NQDLDNIKSN

SEQ ID NO: 149526 - protein, 10 aa, BORRELIA GARINII
QDLDNIKSNE

SEQ ID NO: 149527 - protein, 10 aa, BORRELIA GARINII
DLDNIKSNED

SEQ ID NO: 149528 - protein, 10 aa, BORRELIA GARINII
LDNIKSNEDQ

SEQ ID NO: 149529 - protein, 10 aa, BORRELIA GARINII
DNIKSNEDQL

SEQ ID NO: 149530 - protein, 10 aa, BORRELIA GARINII
NIKSNEDQLA

SEQ ID NO: 149531 - protein, 10 aa, BORRELIA GARINII
IKSNEDQLAH

SEQ ID NO: 149532 - protein, 10 aa, BORRELIA GARINII
KSNEDQLAHM

SEQ ID NO: 149533 - protein, 10 aa, BORRELIA GARINII
SNEDQLAHMD

SEQ ID NO: 149534 - protein, 10 aa, BORRELIA GARINII
NEDQLAHMDE

SEQ ID NO: 149535 - protein, 10 aa, BORRELIA GARINII
EDQLAHMDEN

SEQ ID NO: 149536 - protein, 10 aa, BORRELIA GARINII
DQLAHMDENY

SEQ ID NO: 149537 - protein, 10 aa, BORRELIA GARINII
QLAHMDENYK

SEQ ID NO: 149538 - protein, 10 aa, BORRELIA GARINII
LAHMDENYKE

SEQ ID NO: 149539 - protein, 10 aa, BORRELIA GARINII
AHMDENYKEF

SEQ ID NO: 149540 - protein, 10 aa, BORRELIA GARINII
HMDENYKEFD

SEQ ID NO: 149541 - protein, 10 aa, BORRELIA GARINII
MDENYKEFDP

SEQ ID NO: 149542 - protein, 10 aa, BORRELIA GARINII
DENYKEFDPL

SEQ ID NO: 149543 - protein, 10 aa, BORRELIA GARINII
ENYKEFDPLN

SEQ ID NO: 149544 - protein, 10 aa, BORRELIA GARINII
NYKEFDPLNL

SEQ ID NO: 149545 - protein, 10 aa, BORRELIA GARINII
YKEFDPLNLD

SEQ ID NO: 149546 - protein, 10 aa, BORRELIA GARINII
KEFDPLNLDY

SEQ ID NO: 149547 - protein, 11 aa, BORRELIA GARINII
MKKTKLNIIKL

SEQ ID NO: 149548 - protein, 11 aa, BORRELIA GARINII
KKTKLNIIKLN

SEQ ID NO: 149549 - protein, 11 aa, BORRELIA GARINII
KTKLNIIKLNI

SEQ ID NO: 149550 - protein, 11 aa, BORRELIA GARINII
TKLNIIKLNIL

SEQ ID NO: 149551 - protein, 11 aa, BORRELIA GARINII
KLNIIKLNILT

SEQ ID NO: 149552 - protein, 11 aa, BORRELIA GARINII
LNIIKLNILTT

SEQ ID NO: 149553 - protein, 11 aa, BORRELIA GARINII
NIIKLNILTTI

SEQ ID NO: 149554 - protein, 11 aa, BORRELIA GARINII
IIKLNILTTIL

SEQ ID NO: 149555 - protein, 11 aa, BORRELIA GARINII
IKLNILTTILT

SEQ ID NO: 149556 - protein, 11 aa, BORRELIA GARINII
KLNILTTILTL

SEQ ID NO: 149557 - protein, 11 aa, BORRELIA GARINII
LNILTTILTLI

SEQ ID NO: 149558 - protein, 11 aa, BORRELIA GARINII
NILTTILTLIC

SEQ ID NO: 149559 - protein, 11 aa, BORRELIA GARINII
ILTTILTLICI

SEQ ID NO: 149560 - protein, 11 aa, BORRELIA GARINII
LTTILTLICIS

SEQ ID NO: 149561 - protein, 11 aa, BORRELIA GARINII
TTILTLICISC

SEQ ID NO: 149562 - protein, 11 aa, BORRELIA GARINII
TILTLICISCA

SEQ ID NO: 149563 - protein, 11 aa, BORRELIA GARINII
ILTLICISCAV

SEQ ID NO: 149564 - protein, 11 aa, BORRELIA GARINII
LTLICISCAVD

SEQ ID NO: 149565 - protein, 11 aa, BORRELIA GARINII
TLICISCAVDK

SEQ ID NO: 149566 - protein, 11 aa, BORRELIA GARINII
LICISCAVDKI

SEQ ID NO: 149567 - protein, 11 aa, BORRELIA GARINII
ICISCAVDKID

SEQ ID NO: 149568 - protein, 11 aa, BORRELIA GARINII
CISCAVDKIDP

SEQ ID NO: 149569 - protein, 11 aa, BORRELIA GARINII
ISCAVDKIDPE

SEQ ID NO: 149570 - protein, 11 aa, BORRELIA GARINII
SCAVDKIDPES

SEQ ID NO: 149571 - protein, 11 aa, BORRELIA GARINII
CAVDKIDPESK

SEQ ID NO: 149572 - protein, 11 aa, BORRELIA GARINII
AVDKIDPESKS

SEQ ID NO: 149573 - protein, 11 aa, BORRELIA GARINII
VDKIDPESKSK

SEQ ID NO: 149574 - protein, 11 aa, BORRELIA GARINII
DKIDPESKSKT

SEQ ID NO: 149575 - protein, 11 aa, BORRELIA GARINII
KIDPESKSKTN

SEQ ID NO: 149576 - protein, 11 aa, BORRELIA GARINII
IDPESKSKTNT

SEQ ID NO: 149577 - protein, 11 aa, BORRELIA GARINII
DPESKSKTNTK

SEQ ID NO: 149578 - protein, 11 aa, BORRELIA GARINII
PESKSKTNTKD

SEQ ID NO: 149579 - protein, 11 aa, BORRELIA GARINII
ESKSKTNTKDF

SEQ ID NO: 149580 - protein, 11 aa, BORRELIA GARINII
SKSKTNTKDFE

SEQ ID NO: 149581 - protein, 11 aa, BORRELIA GARINII
KSKTNTKDFEN

SEQ ID NO: 149582 - protein, 11 aa, BORRELIA GARINII
SKTNTKDFENK

SEQ ID NO: 149583 - protein, 11 aa, BORRELIA GARINII
KTNTKDFENKS

SEQ ID NO: 149584 - protein, 11 aa, BORRELIA GARINII
TNTKDFENKSQ

SEQ ID NO: 149585 - protein, 11 aa, BORRELIA GARINII
NTKDFENKSQD

SEQ ID NO: 149586 - protein, 11 aa, BORRELIA GARINII
TKDFENKSQDL

SEQ ID NO: 149587 - protein, 11 aa, BORRELIA GARINII
KDFENKSQDLE

SEQ ID NO: 149588 - protein, 11 aa, BORRELIA GARINII
DFENKSQDLEP

SEQ ID NO: 149589 - protein, 11 aa, BORRELIA GARINII
FENKSQDLEPS

SEQ ID NO: 149590 - protein, 11 aa, BORRELIA GARINII
ENKSQDLEPSN

SEQ ID NO: 149591 - protein, 11 aa, BORRELIA GARINII
NKSQDLEPSNT

SEQ ID NO: 149592 - protein, 11 aa, BORRELIA GARINII
KSQDLEPSNTK

SEQ ID NO: 149593 - protein, 11 aa, BORRELIA GARINII
SQDLEPSNTKN

SEQ ID NO: 149594 - protein, 11 aa, BORRELIA GARINII
QDLEPSNTKNK

SEQ ID NO: 149595 - protein, 11 aa, BORRELIA GARINII
DLEPSNTKNKD

SEQ ID NO: 149596 - protein, 11 aa, BORRELIA GARINII
LEPSNTKNKDL

SEQ ID NO: 149597 - protein, 11 aa, BORRELIA GARINII
EPSNTKNKDLE

SEQ ID NO: 149598 - protein, 11 aa, BORRELIA GARINII
PSNTKNKDLEP

SEQ ID NO: 149599 - protein, 11 aa, BORRELIA GARINII
SNTKNKDLEPL

SEQ ID NO: 149600 - protein, 11 aa, BORRELIA GARINII
NTKNKDLEPLE

SEQ ID NO: 149601 - protein, 11 aa, BORRELIA GARINII
TKNKDLEPLEK

SEQ ID NO: 149602 - protein, 11 aa, BORRELIA GARINII
KNKDLEPLEKN

SEQ ID NO: 149603 - protein, 11 aa, BORRELIA GARINII
NKDLEPLEKNS

SEQ ID NO: 149604 - protein, 11 aa, BORRELIA GARINII
KDLEPLEKNSK

SEQ ID NO: 149605 - protein, 11 aa, BORRELIA GARINII
DLEPLEKNSKE

SEQ ID NO: 149606 - protein, 11 aa, BORRELIA GARINII
LEPLEKNSKET

SEQ ID NO: 149607 - protein, 11 aa, BORRELIA GARINII
EPLEKNSKETI

SEQ ID NO: 149608 - protein, 11 aa, BORRELIA GARINII
PLEKNSKETII

SEQ ID NO: 149609 - protein, 11 aa, BORRELIA GARINII
LEKNSKETIIS

SEQ ID NO: 149610 - protein, 11 aa, BORRELIA GARINII
EKNSKETIISK

SEQ ID NO: 149611 - protein, 11 aa, BORRELIA GARINII
KNSKETIISKL

SEQ ID NO: 149612 - protein, 11 aa, BORRELIA GARINII
NSKETIISKLE

SEQ ID NO: 149613 - protein, 11 aa, BORRELIA GARINII
SKETIISKLEK

SEQ ID NO: 149614 - protein, 11 aa, BORRELIA GARINII
KETIISKLEKM

SEQ ID NO: 149615 - protein, 11 aa, BORRELIA GARINII
ETIISKLEKMI

SEQ ID NO: 149616 - protein, 11 aa, BORRELIA GARINII
TIISKLEKMIK

SEQ ID NO: 149617 - protein, 11 aa, BORRELIA GARINII
IISKLEKMIKD

SEQ ID NO: 149618 - protein, 11 aa, BORRELIA GARINII
ISKLEKMIKDL

SEQ ID NO: 149619 - protein, 11 aa, BORRELIA GARINII
SKLEKMIKDLE

SEQ ID NO: 149620 - protein, 11 aa, BORRELIA GARINII
KLEKMIKDLED

SEQ ID NO: 149621 - protein, 11 aa, BORRELIA GARINII
LEKMIKDLEDQ

SEQ ID NO: 149622 - protein, 11 aa, BORRELIA GARINII
EKMIKDLEDQK

SEQ ID NO: 149623 - protein, 11 aa, BORRELIA GARINII
KMIKDLEDQKD

SEQ ID NO: 149624 - protein, 11 aa, BORRELIA GARINII
MIKDLEDQKDQ

SEQ ID NO: 149625 - protein, 11 aa, BORRELIA GARINII
IKDLEDQKDQE

SEQ ID NO: 149626 - protein, 11 aa, BORRELIA GARINII
KDLEDQKDQED

SEQ ID NO: 149627 - protein, 11 aa, BORRELIA GARINII
DLEDQKDQEDT

SEQ ID NO: 149628 - protein, 11 aa, BORRELIA GARINII
LEDQKDQEDTE

SEQ ID NO: 149629 - protein, 11 aa, BORRELIA GARINII
EDQKDQEDTEI

SEQ ID NO: 149630 - protein, 11 aa, BORRELIA GARINII
DQKDQEDTEIA

SEQ ID NO: 149631 - protein, 11 aa, BORRELIA GARINII
QKDQEDTEIAK

SEQ ID NO: 149632 - protein, 11 aa, BORRELIA GARINII
KDQEDTEIAKI

SEQ ID NO: 149633 - protein, 11 aa, BORRELIA GARINII
DQEDTEIAKIT

SEQ ID NO: 149634 - protein, 11 aa, BORRELIA GARINII
QEDTEIAKITN

SEQ ID NO: 149635 - protein, 11 aa, BORRELIA GARINII
EDTEIAKITNT

SEQ ID NO: 149636 - protein, 11 aa, BORRELIA GARINII
DTEIAKITNTQ

SEQ ID NO: 149637 - protein, 11 aa, BORRELIA GARINII
TEIAKITNTQI

SEQ ID NO: 149638 - protein, 11 aa, BORRELIA GARINII
EIAKITNTQID

SEQ ID NO: 149639 - protein, 11 aa, BORRELIA GARINII
IAKITNTQIDF

SEQ ID NO: 149640 - protein, 11 aa, BORRELIA GARINII
AKITNTQIDFL

SEQ ID NO: 149641 - protein, 11 aa, BORRELIA GARINII
KITNTQIDFLE

SEQ ID NO: 149642 - protein, 11 aa, BORRELIA GARINII
ITNTQIDFLEN

SEQ ID NO: 149643 - protein, 11 aa, BORRELIA GARINII
TNTQIDFLENF

SEQ ID NO: 149644 - protein, 11 aa, BORRELIA GARINII
NTQIDFLENFK

SEQ ID NO: 149645 - protein, 11 aa, BORRELIA GARINII
TQIDFLENFKS

SEQ ID NO: 149646 - protein, 11 aa, BORRELIA GARINII
QIDFLENFKSE

SEQ ID NO: 149647 - protein, 11 aa, BORRELIA GARINII
IDFLENFKSEP

SEQ ID NO: 149648 - protein, 11 aa, BORRELIA GARINII
DFLENFKSEPH

SEQ ID NO: 149649 - protein, 11 aa, BORRELIA GARINII
FLENFKSEPHD

SEQ ID NO: 149650 - protein, 11 aa, BORRELIA GARINII
LENFKSEPHDT

SEQ ID NO: 149651 - protein, 11 aa, BORRELIA GARINII
ENFKSEPHDTI

SEQ ID NO: 149652 - protein, 11 aa, BORRELIA GARINII
NFKSEPHDTIS

SEQ ID NO: 149653 - protein, 11 aa, BORRELIA GARINII
FKSEPHDTISE

SEQ ID NO: 149654 - protein, 11 aa, BORRELIA GARINII
KSEPHDTISED

SEQ ID NO: 149655 - protein, 11 aa, BORRELIA GARINII
SEPHDTISEDI

SEQ ID NO: 149656 - protein, 11 aa, BORRELIA GARINII
EPHDTISEDIE

SEQ ID NO: 149657 - protein, 11 aa, BORRELIA GARINII
PHDTISEDIEM

SEQ ID NO: 149658 - protein, 11 aa, BORRELIA GARINII
HDTISEDIEMK

SEQ ID NO: 149659 - protein, 11 aa, BORRELIA GARINII
DTISEDIEMKI

SEQ ID NO: 149660 - protein, 11 aa, BORRELIA GARINII
TISEDIEMKIK

SEQ ID NO: 149661 - protein, 11 aa, BORRELIA GARINII
ISEDIEMKIKR

SEQ ID NO: 149662 - protein, 11 aa, BORRELIA GARINII
SEDIEMKIKRI

SEQ ID NO: 149663 - protein, 11 aa, BORRELIA GARINII
EDIEMKIKRII

SEQ ID NO: 149664 - protein, 11 aa, BORRELIA GARINII
DIEMKIKRIIY

SEQ ID NO: 149665 - protein, 11 aa, BORRELIA GARINII
IEMKIKRIIYS

SEQ ID NO: 149666 - protein, 11 aa, BORRELIA GARINII
EMKIKRIIYSS

SEQ ID NO: 149667 - protein, 11 aa, BORRELIA GARINII
MKIKRIIYSSL

SEQ ID NO: 149668 - protein, 11 aa, BORRELIA GARINII
KIKRIIYSSLN

SEQ ID NO: 149669 - protein, 11 aa, BORRELIA GARINII
IKRIIYSSLNY

SEQ ID NO: 149670 - protein, 11 aa, BORRELIA GARINII
KRIIYSSLNYE

SEQ ID NO: 149671 - protein, 11 aa, BORRELIA GARINII
RIIYSSLNYEI

SEQ ID NO: 149672 - protein, 11 aa, BORRELIA GARINII
IIYSSLNYEIE

SEQ ID NO: 149673 - protein, 11 aa, BORRELIA GARINII
IYSSLNYEIEK

SEQ ID NO: 149674 - protein, 11 aa, BORRELIA GARINII
YSSLNYEIEKI

SEQ ID NO: 149675 - protein, 11 aa, BORRELIA GARINII
SSLNYEIEKIN

SEQ ID NO: 149676 - protein, 11 aa, BORRELIA GARINII
SLNYEIEKINT

SEQ ID NO: 149677 - protein, 11 aa, BORRELIA GARINII
LNYEIEKINTL

SEQ ID NO: 149678 - protein, 11 aa, BORRELIA GARINII
NYEIEKINTLK

SEQ ID NO: 149679 - protein, 11 aa, BORRELIA GARINII
YEIEKINTLKE

SEQ ID NO: 149680 - protein, 11 aa, BORRELIA GARINII
EIEKINTLKEI

SEQ ID NO: 149681 - protein, 11 aa, BORRELIA GARINII
IEKINTLKEIL

SEQ ID NO: 149682 - protein, 11 aa, BORRELIA GARINII
EKINTLKEILD

SEQ ID NO: 149683 - protein, 11 aa, BORRELIA GARINII
KINTLKEILDK

SEQ ID NO: 149684 - protein, 11 aa, BORRELIA GARINII
INTLKEILDKL

SEQ ID NO: 149685 - protein, 11 aa, BORRELIA GARINII
NTLKEILDKLY

SEQ ID NO: 149686 - protein, 11 aa, BORRELIA GARINII
TLKEILDKLYK

SEQ ID NO: 149687 - protein, 11 aa, BORRELIA GARINII
LKEILDKLYKN

SEQ ID NO: 149688 - protein, 11 aa, BORRELIA GARINII
KEILDKLYKNH

SEQ ID NO: 149689 - protein, 11 aa, BORRELIA GARINII
EILDKLYKNHK

SEQ ID NO: 149690 - protein, 11 aa, BORRELIA GARINII
ILDKLYKNHKY

SEQ ID NO: 149691 - protein, 11 aa, BORRELIA GARINII
LDKLYKNHKYK

SEQ ID NO: 149692 - protein, 11 aa, BORRELIA GARINII
DKLYKNHKYKT

SEQ ID NO: 149693 - protein, 11 aa, BORRELIA GARINII
KLYKNHKYKTT

SEQ ID NO: 149694 - protein, 11 aa, BORRELIA GARINII
LYKNHKYKTTA

SEQ ID NO: 149695 - protein, 11 aa, BORRELIA GARINII
YKNHKYKTTAR

SEQ ID NO: 149696 - protein, 11 aa, BORRELIA GARINII
KNHKYKTTARN

SEQ ID NO: 149697 - protein, 11 aa, BORRELIA GARINII
NHKYKTTARNF

SEQ ID NO: 149698 - protein, 11 aa, BORRELIA GARINII
HKYKTTARNFI

SEQ ID NO: 149699 - protein, 11 aa, BORRELIA GARINII
KYKTTARNFIL

SEQ ID NO: 149700 - protein, 11 aa, BORRELIA GARINII
YKTTARNFILN

SEQ ID NO: 149701 - protein, 11 aa, BORRELIA GARINII
KTTARNFILNI

SEQ ID NO: 149702 - protein, 11 aa, BORRELIA GARINII
TTARNFILNIS

SEQ ID NO: 149703 - protein, 11 aa, BORRELIA GARINII
TARNFILNISI

SEQ ID NO: 149704 - protein, 11 aa, BORRELIA GARINII
ARNFILNISIK

SEQ ID NO: 149705 - protein, 11 aa, BORRELIA GARINII
RNFILNISIKI

SEQ ID NO: 149706 - protein, 11 aa, BORRELIA GARINII
NFILNISIKIQ

SEQ ID NO: 149707 - protein, 11 aa, BORRELIA GARINII
FILNISIKIQF

SEQ ID NO: 149708 - protein, 11 aa, BORRELIA GARINII
ILNISIKIQFQ

SEQ ID NO: 149709 - protein, 11 aa, BORRELIA GARINII
LNISIKIQFQI

SEQ ID NO: 149710 - protein, 11 aa, BORRELIA GARINII
NISIKIQFQIE

SEQ ID NO: 149711 - protein, 11 aa, BORRELIA GARINII
ISIKIQFQIEN

SEQ ID NO: 149712 - protein, 11 aa, BORRELIA GARINII
SIKIQFQIENA

SEQ ID NO: 149713 - protein, 11 aa, BORRELIA GARINII
IKIQFQIENAL

SEQ ID NO: 149714 - protein, 11 aa, BORRELIA GARINII
KIQFQIENALE

SEQ ID NO: 149715 - protein, 11 aa, BORRELIA GARINII
IQFQIENALEL

SEQ ID NO: 149716 - protein, 11 aa, BORRELIA GARINII
QFQIENALELM

SEQ ID NO: 149717 - protein, 11 aa, BORRELIA GARINII
FQIENALELMK

SEQ ID NO: 149718 - protein, 11 aa, BORRELIA GARINII
QIENALELMKE

SEQ ID NO: 149719 - protein, 11 aa, BORRELIA GARINII
IENALELMKEE

SEQ ID NO: 149720 - protein, 11 aa, BORRELIA GARINII
ENALELMKEEI

SEQ ID NO: 149721 - protein, 11 aa, BORRELIA GARINII
NALELMKEEIE

SEQ ID NO: 149722 - protein, 11 aa, BORRELIA GARINII
ALELMKEEIED

SEQ ID NO: 149723 - protein, 11 aa, BORRELIA GARINII
LELMKEEIEDA

SEQ ID NO: 149724 - protein, 11 aa, BORRELIA GARINII
ELMKEEIEDAS

SEQ ID NO: 149725 - protein, 11 aa, BORRELIA GARINII
LMKEEIEDASE

SEQ ID NO: 149726 - protein, 11 aa, BORRELIA GARINII
MKEEIEDASEI

SEQ ID NO: 149727 - protein, 11 aa, BORRELIA GARINII
KEEIEDASEIL

SEQ ID NO: 149728 - protein, 11 aa, BORRELIA GARINII
EEIEDASEILN

SEQ ID NO: 149729 - protein, 11 aa, BORRELIA GARINII
EIEDASEILNQ

SEQ ID NO: 149730 - protein, 11 aa, BORRELIA GARINII
IEDASEILNQE

SEQ ID NO: 149731 - protein, 11 aa, BORRELIA GARINII
EDASEILNQER

SEQ ID NO: 149732 - protein, 11 aa, BORRELIA GARINII
DASEILNQERY

SEQ ID NO: 149733 - protein, 11 aa, BORRELIA GARINII
ASEILNQERYE

SEQ ID NO: 149734 - protein, 11 aa, BORRELIA GARINII
SEILNQERYEI

SEQ ID NO: 149735 - protein, 11 aa, BORRELIA GARINII
EILNQERYEIL

SEQ ID NO: 149736 - protein, 11 aa, BORRELIA GARINII
ILNQERYEILL

SEQ ID NO: 149737 - protein, 11 aa, BORRELIA GARINII
LNQERYEILLK

SEQ ID NO: 149738 - protein, 11 aa, BORRELIA GARINII
NQERYEILLKH

SEQ ID NO: 149739 - protein, 11 aa, BORRELIA GARINII
QERYEILLKHV

SEQ ID NO: 149740 - protein, 11 aa, BORRELIA GARINII
ERYEILLKHVE

SEQ ID NO: 149741 - protein, 11 aa, BORRELIA GARINII
RYEILLKHVEP

SEQ ID NO: 149742 - protein, 11 aa, BORRELIA GARINII
YEILLKHVEPS

SEQ ID NO: 149743 - protein, 11 aa, BORRELIA GARINII
EILLKHVEPSL

SEQ ID NO: 149744 - protein, 11 aa, BORRELIA GARINII
ILLKHVEPSLN

SEQ ID NO: 149745 - protein, 11 aa, BORRELIA GARINII
LLKHVEPSLNL

SEQ ID NO: 149746 - protein, 11 aa, BORRELIA GARINII
LKHVEPSLNLK

SEQ ID NO: 149747 - protein, 11 aa, BORRELIA GARINII
KHVEPSLNLKQ

SEQ ID NO: 149748 - protein, 11 aa, BORRELIA GARINII
HVEPSLNLKQK

SEQ ID NO: 149749 - protein, 11 aa, BORRELIA GARINII
VEPSLNLKQKF

SEQ ID NO: 149750 - protein, 11 aa, BORRELIA GARINII
EPSLNLKQKFE

SEQ ID NO: 149751 - protein, 11 aa, BORRELIA GARINII
PSLNLKQKFEK

SEQ ID NO: 149752 - protein, 11 aa, BORRELIA GARINII
SLNLKQKFEKI

SEQ ID NO: 149753 - protein, 11 aa, BORRELIA GARINII
LNLKQKFEKIL

SEQ ID NO: 149754 - protein, 11 aa, BORRELIA GARINII
NLKQKFEKILN

SEQ ID NO: 149755 - protein, 11 aa, BORRELIA GARINII
LKQKFEKILNE

SEQ ID NO: 149756 - protein, 11 aa, BORRELIA GARINII
KQKFEKILNET

SEQ ID NO: 149757 - protein, 11 aa, BORRELIA GARINII
QKFEKILNETI

SEQ ID NO: 149758 - protein, 11 aa, BORRELIA GARINII
KFEKILNETIK

SEQ ID NO: 149759 - protein, 11 aa, BORRELIA GARINII
FEKILNETIKA

SEQ ID NO: 149760 - protein, 11 aa, BORRELIA GARINII
EKILNETIKAY

SEQ ID NO: 149761 - protein, 11 aa, BORRELIA GARINII
KILNETIKAYN

SEQ ID NO: 149762 - protein, 11 aa, BORRELIA GARINII
ILNETIKAYNQ

SEQ ID NO: 149763 - protein, 11 aa, BORRELIA GARINII
LNETIKAYNQD

SEQ ID NO: 149764 - protein, 11 aa, BORRELIA GARINII
NETIKAYNQDL

SEQ ID NO: 149765 - protein, 11 aa, BORRELIA GARINII
ETIKAYNQDLD

SEQ ID NO: 149766 - protein, 11 aa, BORRELIA GARINII
TIKAYNQDLDN

SEQ ID NO: 149767 - protein, 11 aa, BORRELIA GARINII
IKAYNQDLDNI

SEQ ID NO: 149768 - protein, 11 aa, BORRELIA GARINII
KAYNQDLDNIK

SEQ ID NO: 149769 - protein, 11 aa, BORRELIA GARINII
AYNQDLDNIKS

SEQ ID NO: 149770 - protein, 11 aa, BORRELIA GARINII
YNQDLDNIKSN

SEQ ID NO: 149771 - protein, 11 aa, BORRELIA GARINII
NQDLDNIKSNE

SEQ ID NO: 149772 - protein, 11 aa, BORRELIA GARINII
QDLDNIKSNED

SEQ ID NO: 149773 - protein, 11 aa, BORRELIA GARINII
DLDNIKSNEDQ

SEQ ID NO: 149774 - protein, 11 aa, BORRELIA GARINII
LDNIKSNEDQL

SEQ ID NO: 149775 - protein, 11 aa, BORRELIA GARINII
DNIKSNEDQLA

SEQ ID NO: 149776 - protein, 11 aa, BORRELIA GARINII
NIKSNEDQLAH

SEQ ID NO: 149777 - protein, 11 aa, BORRELIA GARINII
IKSNEDQLAHM

SEQ ID NO: 149778 - protein, 11 aa, BORRELIA GARINII
KSNEDQLAHMD

SEQ ID NO: 149779 - protein, 11 aa, BORRELIA GARINII
SNEDQLAHMDE

SEQ ID NO: 149780 - protein, 11 aa, BORRELIA GARINII
NEDQLAHMDEN

SEQ ID NO: 149781 - protein, 11 aa, BORRELIA GARINII
EDQLAHMDENY

SEQ ID NO: 149782 - protein, 11 aa, BORRELIA GARINII
DQLAHMDENYK

SEQ ID NO: 149783 - protein, 11 aa, BORRELIA GARINII
QLAHMDENYKE

SEQ ID NO: 149784 - protein, 11 aa, BORRELIA GARINII
LAHMDENYKEF

SEQ ID NO: 149785 - protein, 11 aa, BORRELIA GARINII
AHMDENYKEFD

SEQ ID NO: 149786 - protein, 11 aa, BORRELIA GARINII
HMDENYKEFDP

SEQ ID NO: 149787 - protein, 11 aa, BORRELIA GARINII
MDENYKEFDPL

SEQ ID NO: 149788 - protein, 11 aa, BORRELIA GARINII
DENYKEFDPLN

SEQ ID NO: 149789 - protein, 11 aa, BORRELIA GARINII
ENYKEFDPLNL

SEQ ID NO: 149790 - protein, 11 aa, BORRELIA GARINII
NYKEFDPLNLD

SEQ ID NO: 149791 - protein, 11 aa, BORRELIA GARINII
YKEFDPLNLDY

SEQ ID NO: 149792 - protein, 13 aa, BORRELIA GARINII
MKKTKLNIIKLNI

SEQ ID NO: 149793 - protein, 13 aa, BORRELIA GARINII
KKTKLNIIKLNIL

SEQ ID NO: 149794 - protein, 13 aa, BORRELIA GARINII
KTKLNIIKLNILT

SEQ ID NO: 149795 - protein, 13 aa, BORRELIA GARINII
TKLNIIKLNILTT

SEQ ID NO: 149796 - protein, 13 aa, BORRELIA GARINII
KLNIIKLNILTTI

SEQ ID NO: 149797 - protein, 13 aa, BORRELIA GARINII
LNIIKLNILTTIL

SEQ ID NO: 149798 - protein, 13 aa, BORRELIA GARINII
NIIKLNILTTILT

SEQ ID NO: 149799 - protein, 13 aa, BORRELIA GARINII
IIKLNILTTILTL

SEQ ID NO: 149800 - protein, 13 aa, BORRELIA GARINII
IKLNILTTILTLI

SEQ ID NO: 149801 - protein, 13 aa, BORRELIA GARINII
KLNILTTILTLIC

SEQ ID NO: 149802 - protein, 13 aa, BORRELIA GARINII
LNILTTILTLICI

SEQ ID NO: 149803 - protein, 13 aa, BORRELIA GARINII
NILTTILTLICIS

SEQ ID NO: 149804 - protein, 13 aa, BORRELIA GARINII
ILTTILTLICISC

SEQ ID NO: 149805 - protein, 13 aa, BORRELIA GARINII
LTTILTLICISCA

SEQ ID NO: 149806 - protein, 13 aa, BORRELIA GARINII
TTILTLICISCAV

SEQ ID NO: 149807 - protein, 13 aa, BORRELIA GARINII
TILTLICISCAVD

SEQ ID NO: 149808 - protein, 13 aa, BORRELIA GARINII
ILTLICISCAVDK

SEQ ID NO: 149809 - protein, 13 aa, BORRELIA GARINII
LTLICISCAVDKI

SEQ ID NO: 149810 - protein, 13 aa, BORRELIA GARINII
TLICISCAVDKID

SEQ ID NO: 149811 - protein, 13 aa, BORRELIA GARINII
LICISCAVDKIDP

SEQ ID NO: 149812 - protein, 13 aa, BORRELIA GARINII
ICISCAVDKIDPE

SEQ ID NO: 149813 - protein, 13 aa, BORRELIA GARINII
CISCAVDKIDPES

SEQ ID NO: 149814 - protein, 13 aa, BORRELIA GARINII
ISCAVDKIDPESK

SEQ ID NO: 149815 - protein, 13 aa, BORRELIA GARINII
SCAVDKIDPESKS

SEQ ID NO: 149816 - protein, 13 aa, BORRELIA GARINII
CAVDKIDPESKSK

SEQ ID NO: 149817 - protein, 13 aa, BORRELIA GARINII
AVDKIDPESKSKT

SEQ ID NO: 149818 - protein, 13 aa, BORRELIA GARINII
VDKIDPESKSKTN

SEQ ID NO: 149819 - protein, 13 aa, BORRELIA GARINII
DKIDPESKSKTNT

SEQ ID NO: 149820 - protein, 13 aa, BORRELIA GARINII
KIDPESKSKTNTK

SEQ ID NO: 149821 - protein, 13 aa, BORRELIA GARINII
IDPESKSKTNTKD

SEQ ID NO: 149822 - protein, 13 aa, BORRELIA GARINII
DPESKSKTNTKDF

SEQ ID NO: 149823 - protein, 13 aa, BORRELIA GARINII
PESKSKTNTKDFE

SEQ ID NO: 149824 - protein, 13 aa, BORRELIA GARINII
ESKSKTNTKDFEN

SEQ ID NO: 149825 - protein, 13 aa, BORRELIA GARINII
SKSKTNTKDFENK

SEQ ID NO: 149826 - protein, 13 aa, BORRELIA GARINII
KSKTNTKDFENKS

SEQ ID NO: 149827 - protein, 13 aa, BORRELIA GARINII
SKTNTKDFENKSQ

SEQ ID NO: 149828 - protein, 13 aa, BORRELIA GARINII
KTNTKDFENKSQD

SEQ ID NO: 149829 - protein, 13 aa, BORRELIA GARINII
TNTKDFENKSQDL

SEQ ID NO: 149830 - protein, 13 aa, BORRELIA GARINII
NTKDFENKSQDLE

SEQ ID NO: 149831 - protein, 13 aa, BORRELIA GARINII
TKDFENKSQDLEP

SEQ ID NO: 149832 - protein, 13 aa, BORRELIA GARINII
KDFENKSQDLEPS

SEQ ID NO: 149833 - protein, 13 aa, BORRELIA GARINII
DFENKSQDLEPSN

SEQ ID NO: 149834 - protein, 13 aa, BORRELIA GARINII
FENKSQDLEPSNT

SEQ ID NO: 149835 - protein, 13 aa, BORRELIA GARINII
ENKSQDLEPSNTK

SEQ ID NO: 149836 - protein, 13 aa, BORRELIA GARINII
NKSQDLEPSNTKN

SEQ ID NO: 149837 - protein, 13 aa, BORRELIA GARINII
KSQDLEPSNTKNK

SEQ ID NO: 149838 - protein, 13 aa, BORRELIA GARINII
SQDLEPSNTKNKD

SEQ ID NO: 149839 - protein, 13 aa, BORRELIA GARINII
QDLEPSNTKNKDL

SEQ ID NO: 149840 - protein, 13 aa, BORRELIA GARINII
DLEPSNTKNKDLE

SEQ ID NO: 149841 - protein, 13 aa, BORRELIA GARINII
LEPSNTKNKDLEP

SEQ ID NO: 149842 - protein, 13 aa, BORRELIA GARINII
EPSNTKNKDLEPL

SEQ ID NO: 149843 - protein, 13 aa, BORRELIA GARINII
PSNTKNKDLEPLE

SEQ ID NO: 149844 - protein, 13 aa, BORRELIA GARINII
SNTKNKDLEPLEK

SEQ ID NO: 149845 - protein, 13 aa, BORRELIA GARINII
NTKNKDLEPLEKN

SEQ ID NO: 149846 - protein, 13 aa, BORRELIA GARINII
TKNKDLEPLEKNS

SEQ ID NO: 149847 - protein, 13 aa, BORRELIA GARINII
KNKDLEPLEKNSK

SEQ ID NO: 149848 - protein, 13 aa, BORRELIA GARINII
NKDLEPLEKNSKE

SEQ ID NO: 149849 - protein, 13 aa, BORRELIA GARINII
KDLEPLEKNSKET

SEQ ID NO: 149850 - protein, 13 aa, BORRELIA GARINII
DLEPLEKNSKETI

SEQ ID NO: 149851 - protein, 13 aa, BORRELIA GARINII
LEPLEKNSKETII

SEQ ID NO: 149852 - protein, 13 aa, BORRELIA GARINII
EPLEKNSKETIIS

SEQ ID NO: 149853 - protein, 13 aa, BORRELIA GARINII
PLEKNSKETIISK

SEQ ID NO: 149854 - protein, 13 aa, BORRELIA GARINII
LEKNSKETIISKL

SEQ ID NO: 149855 - protein, 13 aa, BORRELIA GARINII
EKNSKETIISKLE

SEQ ID NO: 149856 - protein, 13 aa, BORRELIA GARINII
KNSKETIISKLEK

SEQ ID NO: 149857 - protein, 13 aa, BORRELIA GARINII
NSKETIISKLEKM

SEQ ID NO: 149858 - protein, 13 aa, BORRELIA GARINII
SKETIISKLEKMI

SEQ ID NO: 149859 - protein, 13 aa, BORRELIA GARINII
KETIISKLEKMIK

SEQ ID NO: 149860 - protein, 13 aa, BORRELIA GARINII
ETIISKLEKMIKD

SEQ ID NO: 149861 - protein, 13 aa, BORRELIA GARINII
TIISKLEKMIKDL

SEQ ID NO: 149862 - protein, 13 aa, BORRELIA GARINII
IISKLEKMIKDLE

SEQ ID NO: 149863 - protein, 13 aa, BORRELIA GARINII
ISKLEKMIKDLED

SEQ ID NO: 149864 - protein, 13 aa, BORRELIA GARINII
SKLEKMIKDLEDQ

SEQ ID NO: 149865 - protein, 13 aa, BORRELIA GARINII
KLEKMIKDLEDQK

SEQ ID NO: 149866 - protein, 13 aa, BORRELIA GARINII
LEKMIKDLEDQKD

SEQ ID NO: 149867 - protein, 13 aa, BORRELIA GARINII
EKMIKDLEDQKDQ

SEQ ID NO: 149868 - protein, 13 aa, BORRELIA GARINII
KMIKDLEDQKDQE

SEQ ID NO: 149869 - protein, 13 aa, BORRELIA GARINII
MIKDLEDQKDQED

SEQ ID NO: 149870 - protein, 13 aa, BORRELIA GARINII
IKDLEDQKDQEDT

SEQ ID NO: 149871 - protein, 13 aa, BORRELIA GARINII
KDLEDQKDQEDTE

SEQ ID NO: 149872 - protein, 13 aa, BORRELIA GARINII
DLEDQKDQEDTEI

SEQ ID NO: 149873 - protein, 13 aa, BORRELIA GARINII
LEDQKDQEDTEIA

SEQ ID NO: 149874 - protein, 13 aa, BORRELIA GARINII
EDQKDQEDTEIAK

SEQ ID NO: 149875 - protein, 13 aa, BORRELIA GARINII
DQKDQEDTEIAKI

SEQ ID NO: 149876 - protein, 13 aa, BORRELIA GARINII
QKDQEDTEIAKIT

SEQ ID NO: 149877 - protein, 13 aa, BORRELIA GARINII
KDQEDTEIAKITN

SEQ ID NO: 149878 - protein, 13 aa, BORRELIA GARINII
DQEDTEIAKITNT

SEQ ID NO: 149879 - protein, 13 aa, BORRELIA GARINII
QEDTEIAKITNTQ

SEQ ID NO: 149880 - protein, 13 aa, BORRELIA GARINII
EDTEIAKITNTQI

SEQ ID NO: 149881 - protein, 13 aa, BORRELIA GARINII
DTEIAKITNTQID

SEQ ID NO: 149882 - protein, 13 aa, BORRELIA GARINII
TEIAKITNTQIDF

SEQ ID NO: 149883 - protein, 13 aa, BORRELIA GARINII
EIAKITNTQIDFL

SEQ ID NO: 149884 - protein, 13 aa, BORRELIA GARINII
IAKITNTQIDFLE

SEQ ID NO: 149885 - protein, 13 aa, BORRELIA GARINII
AKITNTQIDFLEN

SEQ ID NO: 149886 - protein, 13 aa, BORRELIA GARINII
KITNTQIDFLENF

SEQ ID NO: 149887 - protein, 13 aa, BORRELIA GARINII
ITNTQIDFLENFK

SEQ ID NO: 149888 - protein, 13 aa, BORRELIA GARINII
TNTQIDFLENFKS

SEQ ID NO: 149889 - protein, 13 aa, BORRELIA GARINII
NTQIDFLENFKSE

SEQ ID NO: 149890 - protein, 13 aa, BORRELIA GARINII
TQIDFLENFKSEP

SEQ ID NO: 149891 - protein, 13 aa, BORRELIA GARINII
QIDFLENFKSEPH

SEQ ID NO: 149892 - protein, 13 aa, BORRELIA GARINII
IDFLENFKSEPHD

SEQ ID NO: 149893 - protein, 13 aa, BORRELIA GARINII
DFLENFKSEPHDT

SEQ ID NO: 149894 - protein, 13 aa, BORRELIA GARINII
FLENFKSEPHDTI

SEQ ID NO: 149895 - protein, 13 aa, BORRELIA GARINII
LENFKSEPHDTIS

SEQ ID NO: 149896 - protein, 13 aa, BORRELIA GARINII
ENFKSEPHDTISE

SEQ ID NO: 149897 - protein, 13 aa, BORRELIA GARINII
NFKSEPHDTISED

SEQ ID NO: 149898 - protein, 13 aa, BORRELIA GARINII
FKSEPHDTISEDI

SEQ ID NO: 149899 - protein, 13 aa, BORRELIA GARINII
KSEPHDTISEDIE

SEQ ID NO: 149900 - protein, 13 aa, BORRELIA GARINII
SEPHDTISEDIEM

SEQ ID NO: 149901 - protein, 13 aa, BORRELIA GARINII
EPHDTISEDIEMK

SEQ ID NO: 149902 - protein, 13 aa, BORRELIA GARINII
PHDTISEDIEMKI

SEQ ID NO: 149903 - protein, 13 aa, BORRELIA GARINII
HDTISEDIEMKIK

SEQ ID NO: 149904 - protein, 13 aa, BORRELIA GARINII
DTISEDIEMKIKR

SEQ ID NO: 149905 - protein, 13 aa, BORRELIA GARINII
TISEDIEMKIKRI

SEQ ID NO: 149906 - protein, 13 aa, BORRELIA GARINII
ISEDIEMKIKRII

SEQ ID NO: 149907 - protein, 13 aa, BORRELIA GARINII
SEDIEMKIKRIIY

SEQ ID NO: 149908 - protein, 13 aa, BORRELIA GARINII
EDIEMKIKRIIYS

SEQ ID NO: 149909 - protein, 13 aa, BORRELIA GARINII
DIEMKIKRIIYSS

SEQ ID NO: 149910 - protein, 13 aa, BORRELIA GARINII
IEMKIKRIIYSSL

SEQ ID NO: 149911 - protein, 13 aa, BORRELIA GARINII
EMKIKRIIYSSLN

SEQ ID NO: 149912 - protein, 13 aa, BORRELIA GARINII
MKIKRIIYSSLNY

SEQ ID NO: 149913 - protein, 13 aa, BORRELIA GARINII
KIKRIIYSSLNYE

SEQ ID NO: 149914 - protein, 13 aa, BORRELIA GARINII
IKRIIYSSLNYEI

SEQ ID NO: 149915 - protein, 13 aa, BORRELIA GARINII
KRIIYSSLNYEIE

SEQ ID NO: 149916 - protein, 13 aa, BORRELIA GARINII
RIIYSSLNYEIEK

SEQ ID NO: 149917 - protein, 13 aa, BORRELIA GARINII
IIYSSLNYEIEKI

SEQ ID NO: 149918 - protein, 13 aa, BORRELIA GARINII
IYSSLNYEIEKIN

SEQ ID NO: 149919 - protein, 13 aa, BORRELIA GARINII
YSSLNYEIEKINT

SEQ ID NO: 149920 - protein, 13 aa, BORRELIA GARINII
SSLNYEIEKINTL

SEQ ID NO: 149921 - protein, 13 aa, BORRELIA GARINII
SLNYEIEKINTLK

SEQ ID NO: 149922 - protein, 13 aa, BORRELIA GARINII
LNYEIEKINTLKE

SEQ ID NO: 149923 - protein, 13 aa, BORRELIA GARINII
NYEIEKINTLKEI

SEQ ID NO: 149924 - protein, 13 aa, BORRELIA GARINII
YEIEKINTLKEIL

SEQ ID NO: 149925 - protein, 13 aa, BORRELIA GARINII
EIEKINTLKEILD

SEQ ID NO: 149926 - protein, 13 aa, BORRELIA GARINII
IEKINTLKEILDK

SEQ ID NO: 149927 - protein, 13 aa, BORRELIA GARINII
EKINTLKEILDKL

SEQ ID NO: 149928 - protein, 13 aa, BORRELIA GARINII
KINTLKEILDKLY

SEQ ID NO: 149929 - protein, 13 aa, BORRELIA GARINII
INTLKEILDKLYK

SEQ ID NO: 149930 - protein, 13 aa, BORRELIA GARINII
NTLKEILDKLYKN

SEQ ID NO: 149931 - protein, 13 aa, BORRELIA GARINII
TLKEILDKLYKNH

SEQ ID NO: 149932 - protein, 13 aa, BORRELIA GARINII
LKEILDKLYKNHK

SEQ ID NO: 149933 - protein, 13 aa, BORRELIA GARINII
KEILDKLYKNHKY

SEQ ID NO: 149934 - protein, 13 aa, BORRELIA GARINII
EILDKLYKNHKYK

SEQ ID NO: 149935 - protein, 13 aa, BORRELIA GARINII
ILDKLYKNHKYKT

SEQ ID NO: 149936 - protein, 13 aa, BORRELIA GARINII
LDKLYKNHKYKTT

SEQ ID NO: 149937 - protein, 13 aa, BORRELIA GARINII
DKLYKNHKYKTTA

SEQ ID NO: 149938 - protein, 13 aa, BORRELIA GARINII
KLYKNHKYKTTAR

SEQ ID NO: 149939 - protein, 13 aa, BORRELIA GARINII
LYKNHKYKTTARN

SEQ ID NO: 149940 - protein, 13 aa, BORRELIA GARINII
YKNHKYKTTARNF

SEQ ID NO: 149941 - protein, 13 aa, BORRELIA GARINII
KNHKYKTTARNFI

SEQ ID NO: 149942 - protein, 13 aa, BORRELIA GARINII
NHKYKTTARNFIL

SEQ ID NO: 149943 - protein, 13 aa, BORRELIA GARINII
HKYKTTARNFILN

SEQ ID NO: 149944 - protein, 13 aa, BORRELIA GARINII
KYKTTARNFILNI

SEQ ID NO: 149945 - protein, 13 aa, BORRELIA GARINII
YKTTARNFILNIS

SEQ ID NO: 149946 - protein, 13 aa, BORRELIA GARINII
KTTARNFILNISI

SEQ ID NO: 149947 - protein, 13 aa, BORRELIA GARINII
TTARNFILNISIK

SEQ ID NO: 149948 - protein, 13 aa, BORRELIA GARINII
TARNFILNISIKI

SEQ ID NO: 149949 - protein, 13 aa, BORRELIA GARINII
ARNFILNISIKIQ

SEQ ID NO: 149950 - protein, 13 aa, BORRELIA GARINII
RNFILNISIKIQF

SEQ ID NO: 149951 - protein, 13 aa, BORRELIA GARINII
NFILNISIKIQFQ

SEQ ID NO: 149952 - protein, 13 aa, BORRELIA GARINII
FILNISIKIQFQI

SEQ ID NO: 149953 - protein, 13 aa, BORRELIA GARINII
ILNISIKIQFQIE

SEQ ID NO: 149954 - protein, 13 aa, BORRELIA GARINII
LNISIKIQFQIEN

SEQ ID NO: 149955 - protein, 13 aa, BORRELIA GARINII
NISIKIQFQIENA

SEQ ID NO: 149956 - protein, 13 aa, BORRELIA GARINII
ISIKIQFQIENAL

SEQ ID NO: 149957 - protein, 13 aa, BORRELIA GARINII
SIKIQFQIENALE

SEQ ID NO: 149958 - protein, 13 aa, BORRELIA GARINII
IKIQFQIENALEL

SEQ ID NO: 149959 - protein, 13 aa, BORRELIA GARINII
KIQFQIENALELM

SEQ ID NO: 149960 - protein, 13 aa, BORRELIA GARINII
IQFQIENALELMK

SEQ ID NO: 149961 - protein, 13 aa, BORRELIA GARINII
QFQIENALELMKE

SEQ ID NO: 149962 - protein, 13 aa, BORRELIA GARINII
FQIENALELMKEE

SEQ ID NO: 149963 - protein, 13 aa, BORRELIA GARINII
QIENALELMKEEI

SEQ ID NO: 149964 - protein, 13 aa, BORRELIA GARINII
IENALELMKEEIE

SEQ ID NO: 149965 - protein, 13 aa, BORRELIA GARINII
ENALELMKEEIED

SEQ ID NO: 149966 - protein, 13 aa, BORRELIA GARINII
NALELMKEEIEDA

SEQ ID NO: 149967 - protein, 13 aa, BORRELIA GARINII
ALELMKEEIEDAS

SEQ ID NO: 149968 - protein, 13 aa, BORRELIA GARINII
LELMKEEIEDASE

SEQ ID NO: 149969 - protein, 13 aa, BORRELIA GARINII
ELMKEEIEDASEI

SEQ ID NO: 149970 - protein, 13 aa, BORRELIA GARINII
LMKEEIEDASEIL

SEQ ID NO: 149971 - protein, 13 aa, BORRELIA GARINII
MKEEIEDASEILN

SEQ ID NO: 149972 - protein, 13 aa, BORRELIA GARINII
KEEIEDASEILNQ

SEQ ID NO: 149973 - protein, 13 aa, BORRELIA GARINII
EEIEDASEILNQE

SEQ ID NO: 149974 - protein, 13 aa, BORRELIA GARINII
EIEDASEILNQER

SEQ ID NO: 149975 - protein, 13 aa, BORRELIA GARINII
IEDASEILNQERY

SEQ ID NO: 149976 - protein, 13 aa, BORRELIA GARINII
EDASEILNQERYE

SEQ ID NO: 149977 - protein, 13 aa, BORRELIA GARINII
DASEILNQERYEI

SEQ ID NO: 149978 - protein, 13 aa, BORRELIA GARINII
ASEILNQERYEIL

SEQ ID NO: 149979 - protein, 13 aa, BORRELIA GARINII
SEILNQERYEILL

SEQ ID NO: 149980 - protein, 13 aa, BORRELIA GARINII
EILNQERYEILLK

SEQ ID NO: 149981 - protein, 13 aa, BORRELIA GARINII
ILNQERYEILLKH

SEQ ID NO: 149982 - protein, 13 aa, BORRELIA GARINII
LNQERYEILLKHV

SEQ ID NO: 149983 - protein, 13 aa, BORRELIA GARINII
NQERYEILLKHVE

SEQ ID NO: 149984 - protein, 13 aa, BORRELIA GARINII
QERYEILLKHVEP

SEQ ID NO: 149985 - protein, 13 aa, BORRELIA GARINII
ERYEILLKHVEPS

SEQ ID NO: 149986 - protein, 13 aa, BORRELIA GARINII
RYEILLKHVEPSL

SEQ ID NO: 149987 - protein, 13 aa, BORRELIA GARINII
YEILLKHVEPSLN

SEQ ID NO: 149988 - protein, 13 aa, BORRELIA GARINII
EILLKHVEPSLNL

SEQ ID NO: 149989 - protein, 13 aa, BORRELIA GARINII
ILLKHVEPSLNLK

SEQ ID NO: 149990 - protein, 13 aa, BORRELIA GARINII
LLKHVEPSLNLKQ

SEQ ID NO: 149991 - protein, 13 aa, BORRELIA GARINII
LKHVEPSLNLKQK

SEQ ID NO: 149992 - protein, 13 aa, BORRELIA GARINII
KHVEPSLNLKQKF

SEQ ID NO: 149993 - protein, 13 aa, BORRELIA GARINII
HVEPSLNLKQKFE

SEQ ID NO: 149994 - protein, 13 aa, BORRELIA GARINII
VEPSLNLKQKFEK

SEQ ID NO: 149995 - protein, 13 aa, BORRELIA GARINII
EPSLNLKQKFEKI

SEQ ID NO: 149996 - protein, 13 aa, BORRELIA GARINII
PSLNLKQKFEKIL

SEQ ID NO: 149997 - protein, 13 aa, BORRELIA GARINII
SLNLKQKFEKILN

SEQ ID NO: 149998 - protein, 13 aa, BORRELIA GARINII
LNLKQKFEKILNE

SEQ ID NO: 149999 - protein, 13 aa, BORRELIA GARINII
NLKQKFEKILNET

SEQ ID NO: 150000 - protein, 13 aa, BORRELIA GARINII
LKQKFEKILNETI

SEQ ID NO: 150001 - protein, 13 aa, BORRELIA GARINII
KQKFEKILNETIK

SEQ ID NO: 150002 - protein, 13 aa, BORRELIA GARINII
QKFEKILNETIKA

SEQ ID NO: 150003 - protein, 13 aa, BORRELIA GARINII
KFEKILNETIKAY

SEQ ID NO: 150004 - protein, 13 aa, BORRELIA GARINII
FEKILNETIKAYN

SEQ ID NO: 150005 - protein, 13 aa, BORRELIA GARINII
EKILNETIKAYNQ

SEQ ID NO: 150006 - protein, 13 aa, BORRELIA GARINII
KILNETIKAYNQD

SEQ ID NO: 150007 - protein, 13 aa, BORRELIA GARINII
ILNETIKAYNQDL

SEQ ID NO: 150008 - protein, 13 aa, BORRELIA GARINII
LNETIKAYNQDLD

SEQ ID NO: 150009 - protein, 13 aa, BORRELIA GARINII
NETIKAYNQDLDN

SEQ ID NO: 150010 - protein, 13 aa, BORRELIA GARINII
ETIKAYNQDLDNI

SEQ ID NO: 150011 - protein, 13 aa, BORRELIA GARINII
TIKAYNQDLDNIK

SEQ ID NO: 150012 - protein, 13 aa, BORRELIA GARINII
IKAYNQDLDNIKS

SEQ ID NO: 150013 - protein, 13 aa, BORRELIA GARINII
KAYNQDLDNIKSN

SEQ ID NO: 150014 - protein, 13 aa, BORRELIA GARINII
AYNQDLDNIKSNE

SEQ ID NO: 150015 - protein, 13 aa, BORRELIA GARINII
YNQDLDNIKSNED

SEQ ID NO: 150016 - protein, 13 aa, BORRELIA GARINII
NQDLDNIKSNEDQ

SEQ ID NO: 150017 - protein, 13 aa, BORRELIA GARINII
QDLDNIKSNEDQL

SEQ ID NO: 150018 - protein, 13 aa, BORRELIA GARINII
DLDNIKSNEDQLA

SEQ ID NO: 150019 - protein, 13 aa, BORRELIA GARINII
LDNIKSNEDQLAH

SEQ ID NO: 150020 - protein, 13 aa, BORRELIA GARINII
DNIKSNEDQLAHM

SEQ ID NO: 150021 - protein, 13 aa, BORRELIA GARINII
NIKSNEDQLAHMD

SEQ ID NO: 150022 - protein, 13 aa, BORRELIA GARINII
IKSNEDQLAHMDE

SEQ ID NO: 150023 - protein, 13 aa, BORRELIA GARINII
KSNEDQLAHMDEN

SEQ ID NO: 150024 - protein, 13 aa, BORRELIA GARINII
SNEDQLAHMDENY

SEQ ID NO: 150025 - protein, 13 aa, BORRELIA GARINII
NEDQLAHMDENYK

SEQ ID NO: 150026 - protein, 13 aa, BORRELIA GARINII
EDQLAHMDENYKE

SEQ ID NO: 150027 - protein, 13 aa, BORRELIA GARINII
DQLAHMDENYKEF

SEQ ID NO: 150028 - protein, 13 aa, BORRELIA GARINII
QLAHMDENYKEFD

SEQ ID NO: 150029 - protein, 13 aa, BORRELIA GARINII
LAHMDENYKEFDP

SEQ ID NO: 150030 - protein, 13 aa, BORRELIA GARINII
AHMDENYKEFDPL

SEQ ID NO: 150031 - protein, 13 aa, BORRELIA GARINII
HMDENYKEFDPLN

SEQ ID NO: 150032 - protein, 13 aa, BORRELIA GARINII
MDENYKEFDPLNL

SEQ ID NO: 150033 - protein, 13 aa, BORRELIA GARINII
DENYKEFDPLNLD

SEQ ID NO: 150034 - protein, 13 aa, BORRELIA GARINII
ENYKEFDPLNLDY

SEQ ID NO: 150035 - protein, 14 aa, BORRELIA GARINII
MKKTKLNIIKLNIL

SEQ ID NO: 150036 - protein, 14 aa, BORRELIA GARINII
KKTKLNIIKLNILT

SEQ ID NO: 150037 - protein, 14 aa, BORRELIA GARINII
KTKLNIIKLNILTT

SEQ ID NO: 150038 - protein, 14 aa, BORRELIA GARINII
TKLNIIKLNILTTI

SEQ ID NO: 150039 - protein, 14 aa, BORRELIA GARINII
KLNIIKLNILTTIL

SEQ ID NO: 150040 - protein, 14 aa, BORRELIA GARINII
LNIIKLNILTTILT

SEQ ID NO: 150041 - protein, 14 aa, BORRELIA GARINII
NIIKLNILTTILTL

SEQ ID NO: 150042 - protein, 14 aa, BORRELIA GARINII
IIKLNILTTILTLI

SEQ ID NO: 150043 - protein, 14 aa, BORRELIA GARINII
IKLNILTTILTLIC

SEQ ID NO: 150044 - protein, 14 aa, BORRELIA GARINII
KLNILTTILTLICI

SEQ ID NO: 150045 - protein, 14 aa, BORRELIA GARINII
LNILTTILTLICIS

SEQ ID NO: 150046 - protein, 14 aa, BORRELIA GARINII
NILTTILTLICISC

SEQ ID NO: 150047 - protein, 14 aa, BORRELIA GARINII
ILTTILTLICISCA

SEQ ID NO: 150048 - protein, 14 aa, BORRELIA GARINII
LTTILTLICISCAV

SEQ ID NO: 150049 - protein, 14 aa, BORRELIA GARINII
TTILTLICISCAVD

SEQ ID NO: 150050 - protein, 14 aa, BORRELIA GARINII
TILTLICISCAVDK

SEQ ID NO: 150051 - protein, 14 aa, BORRELIA GARINII
ILTLICISCAVDKI

SEQ ID NO: 150052 - protein, 14 aa, BORRELIA GARINII
LTLICISCAVDKID

SEQ ID NO: 150053 - protein, 14 aa, BORRELIA GARINII
TLICISCAVDKIDP

SEQ ID NO: 150054 - protein, 14 aa, BORRELIA GARINII
LICISCAVDKIDPE

SEQ ID NO: 150055 - protein, 14 aa, BORRELIA GARINII
ICISCAVDKIDPES

SEQ ID NO: 150056 - protein, 14 aa, BORRELIA GARINII
CISCAVDKIDPESK

SEQ ID NO: 150057 - protein, 14 aa, BORRELIA GARINII
ISCAVDKIDPESKS

SEQ ID NO: 150058 - protein, 14 aa, BORRELIA GARINII
SCAVDKIDPESKSK

SEQ ID NO: 150059 - protein, 14 aa, BORRELIA GARINII
CAVDKIDPESKSKT

SEQ ID NO: 150060 - protein, 14 aa, BORRELIA GARINII
AVDKIDPESKSKTN

SEQ ID NO: 150061 - protein, 14 aa, BORRELIA GARINII
VDKIDPESKSKTNT

SEQ ID NO: 150062 - protein, 14 aa, BORRELIA GARINII
DKIDPESKSKTNTK

SEQ ID NO: 150063 - protein, 14 aa, BORRELIA GARINII
KIDPESKSKTNTKD

SEQ ID NO: 150064 - protein, 14 aa, BORRELIA GARINII
IDPESKSKTNTKDF

SEQ ID NO: 150065 - protein, 14 aa, BORRELIA GARINII
DPESKSKTNTKDFE

SEQ ID NO: 150066 - protein, 14 aa, BORRELIA GARINII
PESKSKTNTKDFEN

SEQ ID NO: 150067 - protein, 14 aa, BORRELIA GARINII
ESKSKTNTKDFENK

SEQ ID NO: 150068 - protein, 14 aa, BORRELIA GARINII
SKSKTNTKDFENKS

SEQ ID NO: 150069 - protein, 14 aa, BORRELIA GARINII
KSKTNTKDFENKSQ

SEQ ID NO: 150070 - protein, 14 aa, BORRELIA GARINII
SKTNTKDFENKSQD

SEQ ID NO: 150071 - protein, 14 aa, BORRELIA GARINII
KTNTKDFENKSQDL

SEQ ID NO: 150072 - protein, 14 aa, BORRELIA GARINII
TNTKDFENKSQDLE

SEQ ID NO: 150073 - protein, 14 aa, BORRELIA GARINII
NTKDFENKSQDLEP

SEQ ID NO: 150074 - protein, 14 aa, BORRELIA GARINII
TKDFENKSQDLEPS

SEQ ID NO: 150075 - protein, 14 aa, BORRELIA GARINII
KDFENKSQDLEPSN

SEQ ID NO: 150076 - protein, 14 aa, BORRELIA GARINII
DFENKSQDLEPSNT

SEQ ID NO: 150077 - protein, 14 aa, BORRELIA GARINII
FENKSQDLEPSNTK

SEQ ID NO: 150078 - protein, 14 aa, BORRELIA GARINII
ENKSQDLEPSNTKN

SEQ ID NO: 150079 - protein, 14 aa, BORRELIA GARINII
NKSQDLEPSNTKNK

SEQ ID NO: 150080 - protein, 14 aa, BORRELIA GARINII
KSQDLEPSNTKNKD

SEQ ID NO: 150081 - protein, 14 aa, BORRELIA GARINII
SQDLEPSNTKNKDL

SEQ ID NO: 150082 - protein, 14 aa, BORRELIA GARINII
QDLEPSNTKNKDLE

SEQ ID NO: 150083 - protein, 14 aa, BORRELIA GARINII
DLEPSNTKNKDLEP

SEQ ID NO: 150084 - protein, 14 aa, BORRELIA GARINII
LEPSNTKNKDLEPL

SEQ ID NO: 150085 - protein, 14 aa, BORRELIA GARINII
EPSNTKNKDLEPLE

SEQ ID NO: 150086 - protein, 14 aa, BORRELIA GARINII
PSNTKNKDLEPLEK

SEQ ID NO: 150087 - protein, 14 aa, BORRELIA GARINII
SNTKNKDLEPLEKN

SEQ ID NO: 150088 - protein, 14 aa, BORRELIA GARINII
NTKNKDLEPLEKNS

SEQ ID NO: 150089 - protein, 14 aa, BORRELIA GARINII
TKNKDLEPLEKNSK

SEQ ID NO: 150090 - protein, 14 aa, BORRELIA GARINII
KNKDLEPLEKNSKE

SEQ ID NO: 150091 - protein, 14 aa, BORRELIA GARINII
NKDLEPLEKNSKET

SEQ ID NO: 150092 - protein, 14 aa, BORRELIA GARINII
KDLEPLEKNSKETI

SEQ ID NO: 150093 - protein, 14 aa, BORRELIA GARINII
DLEPLEKNSKETII

SEQ ID NO: 150094 - protein, 14 aa, BORRELIA GARINII
LEPLEKNSKETIIS

SEQ ID NO: 150095 - protein, 14 aa, BORRELIA GARINII
EPLEKNSKETIISK

SEQ ID NO: 150096 - protein, 14 aa, BORRELIA GARINII
PLEKNSKETIISKL

SEQ ID NO: 150097 - protein, 14 aa, BORRELIA GARINII
LEKNSKETIISKLE

SEQ ID NO: 150098 - protein, 14 aa, BORRELIA GARINII
EKNSKETIISKLEK

SEQ ID NO: 150099 - protein, 14 aa, BORRELIA GARINII
KNSKETIISKLEKM

SEQ ID NO: 150100 - protein, 14 aa, BORRELIA GARINII
NSKETIISKLEKMI

SEQ ID NO: 150101 - protein, 14 aa, BORRELIA GARINII
SKETIISKLEKMIK

SEQ ID NO: 150102 - protein, 14 aa, BORRELIA GARINII
KETIISKLEKMIKD

SEQ ID NO: 150103 - protein, 14 aa, BORRELIA GARINII
ETIISKLEKMIKDL

SEQ ID NO: 150104 - protein, 14 aa, BORRELIA GARINII
TIISKLEKMIKDLE

SEQ ID NO: 150105 - protein, 14 aa, BORRELIA GARINII
IISKLEKMIKDLED

SEQ ID NO: 150106 - protein, 14 aa, BORRELIA GARINII
ISKLEKMIKDLEDQ

SEQ ID NO: 150107 - protein, 14 aa, BORRELIA GARINII
SKLEKMIKDLEDQK

SEQ ID NO: 150108 - protein, 14 aa, BORRELIA GARINII
KLEKMIKDLEDQKD

SEQ ID NO: 150109 - protein, 14 aa, BORRELIA GARINII
LEKMIKDLEDQKDQ

SEQ ID NO: 150110 - protein, 14 aa, BORRELIA GARINII
EKMIKDLEDQKDQE

SEQ ID NO: 150111 - protein, 14 aa, BORRELIA GARINII
KMIKDLEDQKDQED

SEQ ID NO: 150112 - protein, 14 aa, BORRELIA GARINII
MIKDLEDQKDQEDT

SEQ ID NO: 150113 - protein, 14 aa, BORRELIA GARINII
IKDLEDQKDQEDTE

SEQ ID NO: 150114 - protein, 14 aa, BORRELIA GARINII
KDLEDQKDQEDTEI

SEQ ID NO: 150115 - protein, 14 aa, BORRELIA GARINII
DLEDQKDQEDTEIA

SEQ ID NO: 150116 - protein, 14 aa, BORRELIA GARINII
LEDQKDQEDTEIAK

SEQ ID NO: 150117 - protein, 14 aa, BORRELIA GARINII
EDQKDQEDTEIAKI

SEQ ID NO: 150118 - protein, 14 aa, BORRELIA GARINII
DQKDQEDTEIAKIT

SEQ ID NO: 150119 - protein, 14 aa, BORRELIA GARINII
QKDQEDTEIAKITN

SEQ ID NO: 150120 - protein, 14 aa, BORRELIA GARINII
KDQEDTEIAKITNT

SEQ ID NO: 150121 - protein, 14 aa, BORRELIA GARINII
DQEDTEIAKITNTQ

SEQ ID NO: 150122 - protein, 14 aa, BORRELIA GARINII
QEDTEIAKITNTQI

SEQ ID NO: 150123 - protein, 14 aa, BORRELIA GARINII
EDTEIAKITNTQID

SEQ ID NO: 150124 - protein, 14 aa, BORRELIA GARINII
DTEIAKITNTQIDF

SEQ ID NO: 150125 - protein, 14 aa, BORRELIA GARINII
TEIAKITNTQIDFL

SEQ ID NO: 150126 - protein, 14 aa, BORRELIA GARINII
EIAKITNTQIDFLE

SEQ ID NO: 150127 - protein, 14 aa, BORRELIA GARINII
IAKITNTQIDFLEN

SEQ ID NO: 150128 - protein, 14 aa, BORRELIA GARINII
AKITNTQIDFLENF

SEQ ID NO: 150129 - protein, 14 aa, BORRELIA GARINII
KITNTQIDFLENFK

SEQ ID NO: 150130 - protein, 14 aa, BORRELIA GARINII
ITNTQIDFLENFKS

SEQ ID NO: 150131 - protein, 14 aa, BORRELIA GARINII
TNTQIDFLENFKSE

SEQ ID NO: 150132 - protein, 14 aa, BORRELIA GARINII
NTQIDFLENFKSEP

SEQ ID NO: 150133 - protein, 14 aa, BORRELIA GARINII
TQIDFLENFKSEPH

SEQ ID NO: 150134 - protein, 14 aa, BORRELIA GARINII
QIDFLENFKSEPHD

SEQ ID NO: 150135 - protein, 14 aa, BORRELIA GARINII
IDFLENFKSEPHDT

SEQ ID NO: 150136 - protein, 14 aa, BORRELIA GARINII
DFLENFKSEPHDTI

SEQ ID NO: 150137 - protein, 14 aa, BORRELIA GARINII
FLENFKSEPHDTIS

SEQ ID NO: 150138 - protein, 14 aa, BORRELIA GARINII
LENFKSEPHDTISE

SEQ ID NO: 150139 - protein, 14 aa, BORRELIA GARINII
ENFKSEPHDTISED

SEQ ID NO: 150140 - protein, 14 aa, BORRELIA GARINII
NFKSEPHDTISEDI

SEQ ID NO: 150141 - protein, 14 aa, BORRELIA GARINII
FKSEPHDTISEDIE

SEQ ID NO: 150142 - protein, 14 aa, BORRELIA GARINII
KSEPHDTISEDIEM

SEQ ID NO: 150143 - protein, 14 aa, BORRELIA GARINII
SEPHDTISEDIEMK

SEQ ID NO: 150144 - protein, 14 aa, BORRELIA GARINII
EPHDTISEDIEMKI

SEQ ID NO: 150145 - protein, 14 aa, BORRELIA GARINII
PHDTISEDIEMKIK

SEQ ID NO: 150146 - protein, 14 aa, BORRELIA GARINII
HDTISEDIEMKIKR

SEQ ID NO: 150147 - protein, 14 aa, BORRELIA GARINII
DTISEDIEMKIKRI

SEQ ID NO: 150148 - protein, 14 aa, BORRELIA GARINII
TISEDIEMKIKRII

SEQ ID NO: 150149 - protein, 14 aa, BORRELIA GARINII
ISEDIEMKIKRIIY

SEQ ID NO: 150150 - protein, 14 aa, BORRELIA GARINII
SEDIEMKIKRIIYS

SEQ ID NO: 150151 - protein, 14 aa, BORRELIA GARINII
EDIEMKIKRIIYSS

SEQ ID NO: 150152 - protein, 14 aa, BORRELIA GARINII
DIEMKIKRIIYSSL

SEQ ID NO: 150153 - protein, 14 aa, BORRELIA GARINII
IEMKIKRIIYSSLN

SEQ ID NO: 150154 - protein, 14 aa, BORRELIA GARINII
EMKIKRIIYSSLNY

SEQ ID NO: 150155 - protein, 14 aa, BORRELIA GARINII
MKIKRIIYSSLNYE

SEQ ID NO: 150156 - protein, 14 aa, BORRELIA GARINII
KIKRIIYSSLNYEI

SEQ ID NO: 150157 - protein, 14 aa, BORRELIA GARINII
IKRIIYSSLNYEIE

SEQ ID NO: 150158 - protein, 14 aa, BORRELIA GARINII
KRIIYSSLNYEIEK

SEQ ID NO: 150159 - protein, 14 aa, BORRELIA GARINII
RIIYSSLNYEIEKI

SEQ ID NO: 150160 - protein, 14 aa, BORRELIA GARINII
IIYSSLNYEIEKIN

SEQ ID NO: 150161 - protein, 14 aa, BORRELIA GARINII
IYSSLNYEIEKINT

SEQ ID NO: 150162 - protein, 14 aa, BORRELIA GARINII
YSSLNYEIEKINTL

SEQ ID NO: 150163 - protein, 14 aa, BORRELIA GARINII
SSLNYEIEKINTLK

SEQ ID NO: 150164 - protein, 14 aa, BORRELIA GARINII
SLNYEIEKINTLKE

SEQ ID NO: 150165 - protein, 14 aa, BORRELIA GARINII
LNYEIEKINTLKEI

SEQ ID NO: 150166 - protein, 14 aa, BORRELIA GARINII
NYEIEKINTLKEIL

SEQ ID NO: 150167 - protein, 14 aa, BORRELIA GARINII
YEIEKINTLKEILD

SEQ ID NO: 150168 - protein, 14 aa, BORRELIA GARINII
EIEKINTLKEILDK

SEQ ID NO: 150169 - protein, 14 aa, BORRELIA GARINII
IEKINTLKEILDKL

SEQ ID NO: 150170 - protein, 14 aa, BORRELIA GARINII
EKINTLKEILDKLY

SEQ ID NO: 150171 - protein, 14 aa, BORRELIA GARINII
KINTLKEILDKLYK

SEQ ID NO: 150172 - protein, 14 aa, BORRELIA GARINII
INTLKEILDKLYKN

SEQ ID NO: 150173 - protein, 14 aa, BORRELIA GARINII
NTLKEILDKLYKNH

SEQ ID NO: 150174 - protein, 14 aa, BORRELIA GARINII
TLKEILDKLYKNHK

SEQ ID NO: 150175 - protein, 14 aa, BORRELIA GARINII
LKEILDKLYKNHKY

SEQ ID NO: 150176 - protein, 14 aa, BORRELIA GARINII
KEILDKLYKNHKYK

SEQ ID NO: 150177 - protein, 14 aa, BORRELIA GARINII
EILDKLYKNHKYKT

SEQ ID NO: 150178 - protein, 14 aa, BORRELIA GARINII
ILDKLYKNHKYKTT

SEQ ID NO: 150179 - protein, 14 aa, BORRELIA GARINII
LDKLYKNHKYKTTA

SEQ ID NO: 150180 - protein, 14 aa, BORRELIA GARINII
DKLYKNHKYKTTAR

SEQ ID NO: 150181 - protein, 14 aa, BORRELIA GARINII
KLYKNHKYKTTARN

SEQ ID NO: 150182 - protein, 14 aa, BORRELIA GARINII
LYKNHKYKTTARNF

SEQ ID NO: 150183 - protein, 14 aa, BORRELIA GARINII
YKNHKYKTTARNFI

SEQ ID NO: 150184 - protein, 14 aa, BORRELIA GARINII
KNHKYKTTARNFIL

SEQ ID NO: 150185 - protein, 14 aa, BORRELIA GARINII
NHKYKTTARNFILN

SEQ ID NO: 150186 - protein, 14 aa, BORRELIA GARINII
HKYKTTARNFILNI

SEQ ID NO: 150187 - protein, 14 aa, BORRELIA GARINII
KYKTTARNFILNIS

SEQ ID NO: 150188 - protein, 14 aa, BORRELIA GARINII
YKTTARNFILNISI

SEQ ID NO: 150189 - protein, 14 aa, BORRELIA GARINII
KTTARNFILNISIK

SEQ ID NO: 150190 - protein, 14 aa, BORRELIA GARINII
TTARNFILNISIKI

SEQ ID NO: 150191 - protein, 14 aa, BORRELIA GARINII
TARNFILNISIKIQ

SEQ ID NO: 150192 - protein, 14 aa, BORRELIA GARINII
ARNFILNISIKIQF

SEQ ID NO: 150193 - protein, 14 aa, BORRELIA GARINII
RNFILNISIKIQFQ

SEQ ID NO: 150194 - protein, 14 aa, BORRELIA GARINII
NFILNISIKIQFQI

SEQ ID NO: 150195 - protein, 14 aa, BORRELIA GARINII
FILNISIKIQFQIE

SEQ ID NO: 150196 - protein, 14 aa, BORRELIA GARINII
ILNISIKIQFQIEN

SEQ ID NO: 150197 - protein, 14 aa, BORRELIA GARINII
LNISIKIQFQIENA

SEQ ID NO: 150198 - protein, 14 aa, BORRELIA GARINII
NISIKIQFQIENAL

SEQ ID NO: 150199 - protein, 14 aa, BORRELIA GARINII
ISIKIQFQIENALE

SEQ ID NO: 150200 - protein, 14 aa, BORRELIA GARINII
SIKIQFQIENALEL

SEQ ID NO: 150201 - protein, 14 aa, BORRELIA GARINII
IKIQFQIENALELM

SEQ ID NO: 150202 - protein, 14 aa, BORRELIA GARINII
KIQFQIENALELMK

SEQ ID NO: 150203 - protein, 14 aa, BORRELIA GARINII
IQFQIENALELMKE

SEQ ID NO: 150204 - protein, 14 aa, BORRELIA GARINII
QFQIENALELMKEE

SEQ ID NO: 150205 - protein, 14 aa, BORRELIA GARINII
FQIENALELMKEEI

SEQ ID NO: 150206 - protein, 14 aa, BORRELIA GARINII
QIENALELMKEEIE

SEQ ID NO: 150207 - protein, 14 aa, BORRELIA GARINII
IENALELMKEEIED

SEQ ID NO: 150208 - protein, 14 aa, BORRELIA GARINII
ENALELMKEEIEDA

SEQ ID NO: 150209 - protein, 14 aa, BORRELIA GARINII
NALELMKEEIEDAS

SEQ ID NO: 150210 - protein, 14 aa, BORRELIA GARINII
ALELMKEEIEDASE

SEQ ID NO: 150211 - protein, 14 aa, BORRELIA GARINII
LELMKEEIEDASEI

SEQ ID NO: 150212 - protein, 14 aa, BORRELIA GARINII
ELMKEEIEDASEIL

SEQ ID NO: 150213 - protein, 14 aa, BORRELIA GARINII
LMKEEIEDASEILN

SEQ ID NO: 150214 - protein, 14 aa, BORRELIA GARINII
MKEEIEDASEILNQ

SEQ ID NO: 150215 - protein, 14 aa, BORRELIA GARINII
KEEIEDASEILNQE

SEQ ID NO: 150216 - protein, 14 aa, BORRELIA GARINII
EEIEDASEILNQER

SEQ ID NO: 150217 - protein, 14 aa, BORRELIA GARINII
EIEDASEILNQERY

SEQ ID NO: 150218 - protein, 14 aa, BORRELIA GARINII
IEDASEILNQERYE

SEQ ID NO: 150219 - protein, 14 aa, BORRELIA GARINII
EDASEILNQERYEI

SEQ ID NO: 150220 - protein, 14 aa, BORRELIA GARINII
DASEILNQERYEIL

SEQ ID NO: 150221 - protein, 14 aa, BORRELIA GARINII
ASEILNQERYEILL

SEQ ID NO: 150222 - protein, 14 aa, BORRELIA GARINII
SEILNQERYEILLK

SEQ ID NO: 150223 - protein, 14 aa, BORRELIA GARINII
EILNQERYEILLKH

SEQ ID NO: 150224 - protein, 14 aa, BORRELIA GARINII
ILNQERYEILLKHV

SEQ ID NO: 150225 - protein, 14 aa, BORRELIA GARINII
LNQERYEILLKHVE

SEQ ID NO: 150226 - protein, 14 aa, BORRELIA GARINII
NQERYEILLKHVEP

SEQ ID NO: 150227 - protein, 14 aa, BORRELIA GARINII
QERYEILLKHVEPS

SEQ ID NO: 150228 - protein, 14 aa, BORRELIA GARINII
ERYEILLKHVEPSL

SEQ ID NO: 150229 - protein, 14 aa, BORRELIA GARINII
RYEILLKHVEPSLN

SEQ ID NO: 150230 - protein, 14 aa, BORRELIA GARINII
YEILLKHVEPSLNL

SEQ ID NO: 150231 - protein, 14 aa, BORRELIA GARINII
EILLKHVEPSLNLK

SEQ ID NO: 150232 - protein, 14 aa, BORRELIA GARINII
ILLKHVEPSLNLKQ

SEQ ID NO: 150233 - protein, 14 aa, BORRELIA GARINII
LLKHVEPSLNLKQK

SEQ ID NO: 150234 - protein, 14 aa, BORRELIA GARINII
LKHVEPSLNLKQKF

SEQ ID NO: 150235 - protein, 14 aa, BORRELIA GARINII
KHVEPSLNLKQKFE

SEQ ID NO: 150236 - protein, 14 aa, BORRELIA GARINII
HVEPSLNLKQKFEK

SEQ ID NO: 150237 - protein, 14 aa, BORRELIA GARINII
VEPSLNLKQKFEKI

SEQ ID NO: 150238 - protein, 14 aa, BORRELIA GARINII
EPSLNLKQKFEKIL

SEQ ID NO: 150239 - protein, 14 aa, BORRELIA GARINII
PSLNLKQKFEKILN

SEQ ID NO: 150240 - protein, 14 aa, BORRELIA GARINII
SLNLKQKFEKILNE

SEQ ID NO: 150241 - protein, 14 aa, BORRELIA GARINII
LNLKQKFEKILNET

SEQ ID NO: 150242 - protein, 14 aa, BORRELIA GARINII
NLKQKFEKILNETI

SEQ ID NO: 150243 - protein, 14 aa, BORRELIA GARINII
LKQKFEKILNETIK

SEQ ID NO: 150244 - protein, 14 aa, BORRELIA GARINII
KQKFEKILNETIKA

SEQ ID NO: 150245 - protein, 14 aa, BORRELIA GARINII
QKFEKILNETIKAY

SEQ ID NO: 150246 - protein, 14 aa, BORRELIA GARINII
KFEKILNETIKAYN

SEQ ID NO: 150247 - protein, 14 aa, BORRELIA GARINII
FEKILNETIKAYNQ

SEQ ID NO: 150248 - protein, 14 aa, BORRELIA GARINII
EKILNETIKAYNQD

SEQ ID NO: 150249 - protein, 14 aa, BORRELIA GARINII
KILNETIKAYNQDL

SEQ ID NO: 150250 - protein, 14 aa, BORRELIA GARINII
ILNETIKAYNQDLD

SEQ ID NO: 150251 - protein, 14 aa, BORRELIA GARINII
LNETIKAYNQDLDN

SEQ ID NO: 150252 - protein, 14 aa, BORRELIA GARINII
NETIKAYNQDLDNI

SEQ ID NO: 150253 - protein, 14 aa, BORRELIA GARINII
ETIKAYNQDLDNIK

SEQ ID NO: 150254 - protein, 14 aa, BORRELIA GARINII
TIKAYNQDLDNIKS

SEQ ID NO: 150255 - protein, 14 aa, BORRELIA GARINII
IKAYNQDLDNIKSN

SEQ ID NO: 150256 - protein, 14 aa, BORRELIA GARINII
KAYNQDLDNIKSNE

SEQ ID NO: 150257 - protein, 14 aa, BORRELIA GARINII
AYNQDLDNIKSNED

SEQ ID NO: 150258 - protein, 14 aa, BORRELIA GARINII
YNQDLDNIKSNEDQ

SEQ ID NO: 150259 - protein, 14 aa, BORRELIA GARINII
NQDLDNIKSNEDQL

SEQ ID NO: 150260 - protein, 14 aa, BORRELIA GARINII
QDLDNIKSNEDQLA

SEQ ID NO: 150261 - protein, 14 aa, BORRELIA GARINII
DLDNIKSNEDQLAH

SEQ ID NO: 150262 - protein, 14 aa, BORRELIA GARINII
LDNIKSNEDQLAHM

SEQ ID NO: 150263 - protein, 14 aa, BORRELIA GARINII
DNIKSNEDQLAHMD

SEQ ID NO: 150264 - protein, 14 aa, BORRELIA GARINII
NIKSNEDQLAHMDE

SEQ ID NO: 150265 - protein, 14 aa, BORRELIA GARINII
IKSNEDQLAHMDEN

SEQ ID NO: 150266 - protein, 14 aa, BORRELIA GARINII
KSNEDQLAHMDENY

SEQ ID NO: 150267 - protein, 14 aa, BORRELIA GARINII
SNEDQLAHMDENYK

SEQ ID NO: 150268 - protein, 14 aa, BORRELIA GARINII
NEDQLAHMDENYKE

SEQ ID NO: 150269 - protein, 14 aa, BORRELIA GARINII
EDQLAHMDENYKEF

SEQ ID NO: 150270 - protein, 14 aa, BORRELIA GARINII
DQLAHMDENYKEFD

SEQ ID NO: 150271 - protein, 14 aa, BORRELIA GARINII
QLAHMDENYKEFDP

SEQ ID NO: 150272 - protein, 14 aa, BORRELIA GARINII
LAHMDENYKEFDPL

SEQ ID NO: 150273 - protein, 14 aa, BORRELIA GARINII
AHMDENYKEFDPLN

SEQ ID NO: 150274 - protein, 14 aa, BORRELIA GARINII
HMDENYKEFDPLNL

SEQ ID NO: 150275 - protein, 14 aa, BORRELIA GARINII
MDENYKEFDPLNLD

SEQ ID NO: 150276 - protein, 14 aa, BORRELIA GARINII
DENYKEFDPLNLDY

SEQ ID NO: 150277 - protein, 15 aa, BORRELIA GARINII
MKKTKLNIIKLNILT

SEQ ID NO: 150278 - protein, 15 aa, BORRELIA GARINII
KKTKLNIIKLNILTT

SEQ ID NO: 150279 - protein, 15 aa, BORRELIA GARINII
KTKLNIIKLNILTTI

SEQ ID NO: 150280 - protein, 15 aa, BORRELIA GARINII
TKLNIIKLNILTTIL

SEQ ID NO: 150281 - protein, 15 aa, BORRELIA GARINII
KLNIIKLNILTTILT

SEQ ID NO: 150282 - protein, 15 aa, BORRELIA GARINII
LNIIKLNILTTILTL

SEQ ID NO: 150283 - protein, 15 aa, BORRELIA GARINII
NIIKLNILTTILTLI

SEQ ID NO: 150284 - protein, 15 aa, BORRELIA GARINII
IIKLNILTTILTLIC

SEQ ID NO: 150285 - protein, 15 aa, BORRELIA GARINII
IKLNILTTILTLICI

SEQ ID NO: 150286 - protein, 15 aa, BORRELIA GARINII
KLNILTTILTLICIS

SEQ ID NO: 150287 - protein, 15 aa, BORRELIA GARINII
LNILTTILTLICISC

SEQ ID NO: 150288 - protein, 15 aa, BORRELIA GARINII
NILTTILTLICISCA

SEQ ID NO: 150289 - protein, 15 aa, BORRELIA GARINII
ILTTILTLICISCAV

SEQ ID NO: 150290 - protein, 15 aa, BORRELIA GARINII
LTTILTLICISCAVD

SEQ ID NO: 150291 - protein, 15 aa, BORRELIA GARINII
TTILTLICISCAVDK

SEQ ID NO: 150292 - protein, 15 aa, BORRELIA GARINII
TILTLICISCAVDKI

SEQ ID NO: 150293 - protein, 15 aa, BORRELIA GARINII
ILTLICISCAVDKID

SEQ ID NO: 150294 - protein, 15 aa, BORRELIA GARINII
LTLICISCAVDKIDP

SEQ ID NO: 150295 - protein, 15 aa, BORRELIA GARINII
TLICISCAVDKIDPE

SEQ ID NO: 150296 - protein, 15 aa, BORRELIA GARINII
LICISCAVDKIDPES

SEQ ID NO: 150297 - protein, 15 aa, BORRELIA GARINII
ICISCAVDKIDPESK

SEQ ID NO: 150298 - protein, 15 aa, BORRELIA GARINII
CISCAVDKIDPESKS

SEQ ID NO: 150299 - protein, 15 aa, BORRELIA GARINII
ISCAVDKIDPESKSK

SEQ ID NO: 150300 - protein, 15 aa, BORRELIA GARINII
SCAVDKIDPESKSKT

SEQ ID NO: 150301 - protein, 15 aa, BORRELIA GARINII
CAVDKIDPESKSKTN

SEQ ID NO: 150302 - protein, 15 aa, BORRELIA GARINII
AVDKIDPESKSKTNT

SEQ ID NO: 150303 - protein, 15 aa, BORRELIA GARINII
VDKIDPESKSKTNTK

SEQ ID NO: 150304 - protein, 15 aa, BORRELIA GARINII
DKIDPESKSKTNTKD

SEQ ID NO: 150305 - protein, 15 aa, BORRELIA GARINII
KIDPESKSKTNTKDF

SEQ ID NO: 150306 - protein, 15 aa, BORRELIA GARINII
IDPESKSKTNTKDFE

SEQ ID NO: 150307 - protein, 15 aa, BORRELIA GARINII
DPESKSKTNTKDFEN

SEQ ID NO: 150308 - protein, 15 aa, BORRELIA GARINII
PESKSKTNTKDFENK

SEQ ID NO: 150309 - protein, 15 aa, BORRELIA GARINII
ESKSKTNTKDFENKS

SEQ ID NO: 150310 - protein, 15 aa, BORRELIA GARINII
SKSKTNTKDFENKSQ

SEQ ID NO: 150311 - protein, 15 aa, BORRELIA GARINII
KSKTNTKDFENKSQD

SEQ ID NO: 150312 - protein, 15 aa, BORRELIA GARINII
SKTNTKDFENKSQDL

SEQ ID NO: 150313 - protein, 15 aa, BORRELIA GARINII
KTNTKDFENKSQDLE

SEQ ID NO: 150314 - protein, 15 aa, BORRELIA GARINII
TNTKDFENKSQDLEP

SEQ ID NO: 150315 - protein, 15 aa, BORRELIA GARINII
NTKDFENKSQDLEPS

SEQ ID NO: 150316 - protein, 15 aa, BORRELIA GARINII
TKDFENKSQDLEPSN

SEQ ID NO: 150317 - protein, 15 aa, BORRELIA GARINII
KDFENKSQDLEPSNT

SEQ ID NO: 150318 - protein, 15 aa, BORRELIA GARINII
DFENKSQDLEPSNTK

SEQ ID NO: 150319 - protein, 15 aa, BORRELIA GARINII
FENKSQDLEPSNTKN

SEQ ID NO: 150320 - protein, 15 aa, BORRELIA GARINII
ENKSQDLEPSNTKNK

SEQ ID NO: 150321 - protein, 15 aa, BORRELIA GARINII
NKSQDLEPSNTKNKD

SEQ ID NO: 150322 - protein, 15 aa, BORRELIA GARINII
KSQDLEPSNTKNKDL

SEQ ID NO: 150323 - protein, 15 aa, BORRELIA GARINII
SQDLEPSNTKNKDLE

SEQ ID NO: 150324 - protein, 15 aa, BORRELIA GARINII
QDLEPSNTKNKDLEP

SEQ ID NO: 150325 - protein, 15 aa, BORRELIA GARINII
DLEPSNTKNKDLEPL

SEQ ID NO: 150326 - protein, 15 aa, BORRELIA GARINII
LEPSNTKNKDLEPLE

SEQ ID NO: 150327 - protein, 15 aa, BORRELIA GARINII
EPSNTKNKDLEPLEK

SEQ ID NO: 150328 - protein, 15 aa, BORRELIA GARINII
PSNTKNKDLEPLEKN

SEQ ID NO: 150329 - protein, 15 aa, BORRELIA GARINII
SNTKNKDLEPLEKNS

SEQ ID NO: 150330 - protein, 15 aa, BORRELIA GARINII
NTKNKDLEPLEKNSK

SEQ ID NO: 150331 - protein, 15 aa, BORRELIA GARINII
TKNKDLEPLEKNSKE

SEQ ID NO: 150332 - protein, 15 aa, BORRELIA GARINII
KNKDLEPLEKNSKET

SEQ ID NO: 150333 - protein, 15 aa, BORRELIA GARINII
NKDLEPLEKNSKETI

SEQ ID NO: 150334 - protein, 15 aa, BORRELIA GARINII
KDLEPLEKNSKETII

SEQ ID NO: 150335 - protein, 15 aa, BORRELIA GARINII
DLEPLEKNSKETIIS

SEQ ID NO: 150336 - protein, 15 aa, BORRELIA GARINII
LEPLEKNSKETIISK

SEQ ID NO: 150337 - protein, 15 aa, BORRELIA GARINII
EPLEKNSKETIISKL

SEQ ID NO: 150338 - protein, 15 aa, BORRELIA GARINII
PLEKNSKETIISKLE

SEQ ID NO: 150339 - protein, 15 aa, BORRELIA GARINII
LEKNSKETIISKLEK

SEQ ID NO: 150340 - protein, 15 aa, BORRELIA GARINII
EKNSKETIISKLEKM

SEQ ID NO: 150341 - protein, 15 aa, BORRELIA GARINII
KNSKETIISKLEKMI

SEQ ID NO: 150342 - protein, 15 aa, BORRELIA GARINII
NSKETIISKLEKMIK

SEQ ID NO: 150343 - protein, 15 aa, BORRELIA GARINII
SKETIISKLEKMIKD

SEQ ID NO: 150344 - protein, 15 aa, BORRELIA GARINII
KETIISKLEKMIKDL

SEQ ID NO: 150345 - protein, 15 aa, BORRELIA GARINII
ETIISKLEKMIKDLE

SEQ ID NO: 150346 - protein, 15 aa, BORRELIA GARINII
TIISKLEKMIKDLED

SEQ ID NO: 150347 - protein, 15 aa, BORRELIA GARINII
IISKLEKMIKDLEDQ

SEQ ID NO: 150348 - protein, 15 aa, BORRELIA GARINII
ISKLEKMIKDLEDQK

SEQ ID NO: 150349 - protein, 15 aa, BORRELIA GARINII
SKLEKMIKDLEDQKD

SEQ ID NO: 150350 - protein, 15 aa, BORRELIA GARINII
KLEKMIKDLEDQKDQ

SEQ ID NO: 150351 - protein, 15 aa, BORRELIA GARINII
LEKMIKDLEDQKDQE

SEQ ID NO: 150352 - protein, 15 aa, BORRELIA GARINII
EKMIKDLEDQKDQED

SEQ ID NO: 150353 - protein, 15 aa, BORRELIA GARINII
KMIKDLEDQKDQEDT

SEQ ID NO: 150354 - protein, 15 aa, BORRELIA GARINII
MIKDLEDQKDQEDTE

SEQ ID NO: 150355 - protein, 15 aa, BORRELIA GARINII
IKDLEDQKDQEDTEI

SEQ ID NO: 150356 - protein, 15 aa, BORRELIA GARINII
KDLEDQKDQEDTEIA

SEQ ID NO: 150357 - protein, 15 aa, BORRELIA GARINII
DLEDQKDQEDTEIAK

SEQ ID NO: 150358 - protein, 15 aa, BORRELIA GARINII
LEDQKDQEDTEIAKI

SEQ ID NO: 150359 - protein, 15 aa, BORRELIA GARINII
EDQKDQEDTEIAKIT

SEQ ID NO: 150360 - protein, 15 aa, BORRELIA GARINII
DQKDQEDTEIAKITN

SEQ ID NO: 150361 - protein, 15 aa, BORRELIA GARINII
QKDQEDTEIAKITNT

SEQ ID NO: 150362 - protein, 15 aa, BORRELIA GARINII
KDQEDTEIAKITNTQ

SEQ ID NO: 150363 - protein, 15 aa, BORRELIA GARINII
DQEDTEIAKITNTQI

SEQ ID NO: 150364 - protein, 15 aa, BORRELIA GARINII
QEDTEIAKITNTQID

SEQ ID NO: 150365 - protein, 15 aa, BORRELIA GARINII
EDTEIAKITNTQIDF

SEQ ID NO: 150366 - protein, 15 aa, BORRELIA GARINII
DTEIAKITNTQIDFL

SEQ ID NO: 150367 - protein, 15 aa, BORRELIA GARINII
TEIAKITNTQIDFLE

SEQ ID NO: 150368 - protein, 15 aa, BORRELIA GARINII
EIAKITNTQIDFLEN

SEQ ID NO: 150369 - protein, 15 aa, BORRELIA GARINII
IAKITNTQIDFLENF

SEQ ID NO: 150370 - protein, 15 aa, BORRELIA GARINII
AKITNTQIDFLENFK

SEQ ID NO: 150371 - protein, 15 aa, BORRELIA GARINII
KITNTQIDFLENFKS

SEQ ID NO: 150372 - protein, 15 aa, BORRELIA GARINII
ITNTQIDFLENFKSE

SEQ ID NO: 150373 - protein, 15 aa, BORRELIA GARINII
TNTQIDFLENFKSEP

SEQ ID NO: 150374 - protein, 15 aa, BORRELIA GARINII
NTQIDFLENFKSEPH

SEQ ID NO: 150375 - protein, 15 aa, BORRELIA GARINII
TQIDFLENFKSEPHD

SEQ ID NO: 150376 - protein, 15 aa, BORRELIA GARINII
QIDFLENFKSEPHDT

SEQ ID NO: 150377 - protein, 15 aa, BORRELIA GARINII
IDFLENFKSEPHDTI

SEQ ID NO: 150378 - protein, 15 aa, BORRELIA GARINII
DFLENFKSEPHDTIS

SEQ ID NO: 150379 - protein, 15 aa, BORRELIA GARINII
FLENFKSEPHDTISE

SEQ ID NO: 150380 - protein, 15 aa, BORRELIA GARINII
LENFKSEPHDTISED

SEQ ID NO: 150381 - protein, 15 aa, BORRELIA GARINII
ENFKSEPHDTISEDI

SEQ ID NO: 150382 - protein, 15 aa, BORRELIA GARINII
NFKSEPHDTISEDIE

SEQ ID NO: 150383 - protein, 15 aa, BORRELIA GARINII
FKSEPHDTISEDIEM

SEQ ID NO: 150384 - protein, 15 aa, BORRELIA GARINII
KSEPHDTISEDIEMK

SEQ ID NO: 150385 - protein, 15 aa, BORRELIA GARINII
SEPHDTISEDIEMKI

SEQ ID NO: 150386 - protein, 15 aa, BORRELIA GARINII
EPHDTISEDIEMKIK

SEQ ID NO: 150387 - protein, 15 aa, BORRELIA GARINII
PHDTISEDIEMKIKR

SEQ ID NO: 150388 - protein, 15 aa, BORRELIA GARINII
HDTISEDIEMKIKRI

SEQ ID NO: 150389 - protein, 15 aa, BORRELIA GARINII
DTISEDIEMKIKRII

SEQ ID NO: 150390 - protein, 15 aa, BORRELIA GARINII
TISEDIEMKIKRIIY

SEQ ID NO: 150391 - protein, 15 aa, BORRELIA GARINII
ISEDIEMKIKRIIYS

SEQ ID NO: 150392 - protein, 15 aa, BORRELIA GARINII
SEDIEMKIKRIIYSS

SEQ ID NO: 150393 - protein, 15 aa, BORRELIA GARINII
EDIEMKIKRIIYSSL

SEQ ID NO: 150394 - protein, 15 aa, BORRELIA GARINII
DIEMKIKRIIYSSLN

SEQ ID NO: 150395 - protein, 15 aa, BORRELIA GARINII
IEMKIKRIIYSSLNY

SEQ ID NO: 150396 - protein, 15 aa, BORRELIA GARINII
EMKIKRIIYSSLNYE

SEQ ID NO: 150397 - protein, 15 aa, BORRELIA GARINII
MKIKRIIYSSLNYEI

SEQ ID NO: 150398 - protein, 15 aa, BORRELIA GARINII
KIKRIIYSSLNYEIE

SEQ ID NO: 150399 - protein, 15 aa, BORRELIA GARINII
IKRIIYSSLNYEIEK

SEQ ID NO: 150400 - protein, 15 aa, BORRELIA GARINII
KRIIYSSLNYEIEKI

SEQ ID NO: 150401 - protein, 15 aa, BORRELIA GARINII
RIIYSSLNYEIEKIN

SEQ ID NO: 150402 - protein, 15 aa, BORRELIA GARINII
IIYSSLNYEIEKINT

SEQ ID NO: 150403 - protein, 15 aa, BORRELIA GARINII
IYSSLNYEIEKINTL

SEQ ID NO: 150404 - protein, 15 aa, BORRELIA GARINII
YSSLNYEIEKINTLK

SEQ ID NO: 150405 - protein, 15 aa, BORRELIA GARINII
SSLNYEIEKINTLKE

SEQ ID NO: 150406 - protein, 15 aa, BORRELIA GARINII
SLNYEIEKINTLKEI

SEQ ID NO: 150407 - protein, 15 aa, BORRELIA GARINII
LNYEIEKINTLKEIL

SEQ ID NO: 150408 - protein, 15 aa, BORRELIA GARINII
NYEIEKINTLKEILD

SEQ ID NO: 150409 - protein, 15 aa, BORRELIA GARINII
YEIEKINTLKEILDK

SEQ ID NO: 150410 - protein, 15 aa, BORRELIA GARINII
EIEKINTLKEILDKL

SEQ ID NO: 150411 - protein, 15 aa, BORRELIA GARINII
IEKINTLKEILDKLY

SEQ ID NO: 150412 - protein, 15 aa, BORRELIA GARINII
EKINTLKEILDKLYK

SEQ ID NO: 150413 - protein, 15 aa, BORRELIA GARINII
KINTLKEILDKLYKN

SEQ ID NO: 150414 - protein, 15 aa, BORRELIA GARINII
INTLKEILDKLYKNH

SEQ ID NO: 150415 - protein, 15 aa, BORRELIA GARINII
NTLKEILDKLYKNHK

SEQ ID NO: 150416 - protein, 15 aa, BORRELIA GARINII
TLKEILDKLYKNHKY

SEQ ID NO: 150417 - protein, 15 aa, BORRELIA GARINII
LKEILDKLYKNHKYK

SEQ ID NO: 150418 - protein, 15 aa, BORRELIA GARINII
KEILDKLYKNHKYKT

SEQ ID NO: 150419 - protein, 15 aa, BORRELIA GARINII
EILDKLYKNHKYKTT

SEQ ID NO: 150420 - protein, 15 aa, BORRELIA GARINII
ILDKLYKNHKYKTTA

SEQ ID NO: 150421 - protein, 15 aa, BORRELIA GARINII
LDKLYKNHKYKTTAR

SEQ ID NO: 150422 - protein, 15 aa, BORRELIA GARINII
DKLYKNHKYKTTARN

SEQ ID NO: 150423 - protein, 15 aa, BORRELIA GARINII
KLYKNHKYKTTARNF

SEQ ID NO: 150424 - protein, 15 aa, BORRELIA GARINII
LYKNHKYKTTARNFI

SEQ ID NO: 150425 - protein, 15 aa, BORRELIA GARINII
YKNHKYKTTARNFIL

SEQ ID NO: 150426 - protein, 15 aa, BORRELIA GARINII
KNHKYKTTARNFILN

SEQ ID NO: 150427 - protein, 15 aa, BORRELIA GARINII
NHKYKTTARNFILNI

SEQ ID NO: 150428 - protein, 15 aa, BORRELIA GARINII
HKYKTTARNFILNIS

SEQ ID NO: 150429 - protein, 15 aa, BORRELIA GARINII
KYKTTARNFILNISI

SEQ ID NO: 150430 - protein, 15 aa, BORRELIA GARINII
YKTTARNFILNISIK

SEQ ID NO: 150431 - protein, 15 aa, BORRELIA GARINII
KTTARNFILNISIKI

SEQ ID NO: 150432 - protein, 15 aa, BORRELIA GARINII
TTARNFILNISIKIQ

SEQ ID NO: 150433 - protein, 15 aa, BORRELIA GARINII
TARNFILNISIKIQF

SEQ ID NO: 150434 - protein, 15 aa, BORRELIA GARINII
ARNFILNISIKIQFQ

SEQ ID NO: 150435 - protein, 15 aa, BORRELIA GARINII
RNFILNISIKIQFQI

SEQ ID NO: 150436 - protein, 15 aa, BORRELIA GARINII
NFILNISIKIQFQIE

SEQ ID NO: 150437 - protein, 15 aa, BORRELIA GARINII
FILNISIKIQFQIEN

SEQ ID NO: 150438 - protein, 15 aa, BORRELIA GARINII
ILNISIKIQFQIENA

SEQ ID NO: 150439 - protein, 15 aa, BORRELIA GARINII
LNISIKIQFQIENAL

SEQ ID NO: 150440 - protein, 15 aa, BORRELIA GARINII
NISIKIQFQIENALE

SEQ ID NO: 150441 - protein, 15 aa, BORRELIA GARINII
ISIKIQFQIENALEL

SEQ ID NO: 150442 - protein, 15 aa, BORRELIA GARINII
SIKIQFQIENALELM

SEQ ID NO: 150443 - protein, 15 aa, BORRELIA GARINII
IKIQFQIENALELMK

SEQ ID NO: 150444 - protein, 15 aa, BORRELIA GARINII
KIQFQIENALELMKE

SEQ ID NO: 150445 - protein, 15 aa, BORRELIA GARINII
IQFQIENALELMKEE

SEQ ID NO: 150446 - protein, 15 aa, BORRELIA GARINII
QFQIENALELMKEEI

SEQ ID NO: 150447 - protein, 15 aa, BORRELIA GARINII
FQIENALELMKEEIE

SEQ ID NO: 150448 - protein, 15 aa, BORRELIA GARINII
QIENALELMKEEIED

SEQ ID NO: 150449 - protein, 15 aa, BORRELIA GARINII
IENALELMKEEIEDA

SEQ ID NO: 150450 - protein, 15 aa, BORRELIA GARINII
ENALELMKEEIEDAS

SEQ ID NO: 150451 - protein, 15 aa, BORRELIA GARINII
NALELMKEEIEDASE

SEQ ID NO: 150452 - protein, 15 aa, BORRELIA GARINII
ALELMKEEIEDASEI

SEQ ID NO: 150453 - protein, 15 aa, BORRELIA GARINII
LELMKEEIEDASEIL

SEQ ID NO: 150454 - protein, 15 aa, BORRELIA GARINII
ELMKEEIEDASEILN

SEQ ID NO: 150455 - protein, 15 aa, BORRELIA GARINII
LMKEEIEDASEILNQ

SEQ ID NO: 150456 - protein, 15 aa, BORRELIA GARINII
MKEEIEDASEILNQE

SEQ ID NO: 150457 - protein, 15 aa, BORRELIA GARINII
KEEIEDASEILNQER

SEQ ID NO: 150458 - protein, 15 aa, BORRELIA GARINII
EEIEDASEILNQERY

SEQ ID NO: 150459 - protein, 15 aa, BORRELIA GARINII
EIEDASEILNQERYE

SEQ ID NO: 150460 - protein, 15 aa, BORRELIA GARINII
IEDASEILNQERYEI

SEQ ID NO: 150461 - protein, 15 aa, BORRELIA GARINII
EDASEILNQERYEIL

SEQ ID NO: 150462 - protein, 15 aa, BORRELIA GARINII
DASEILNQERYEILL

SEQ ID NO: 150463 - protein, 15 aa, BORRELIA GARINII
ASEILNQERYEILLK

SEQ ID NO: 150464 - protein, 15 aa, BORRELIA GARINII
SEILNQERYEILLKH

SEQ ID NO: 150465 - protein, 15 aa, BORRELIA GARINII
EILNQERYEILLKHV

SEQ ID NO: 150466 - protein, 15 aa, BORRELIA GARINII
ILNQERYEILLKHVE

SEQ ID NO: 150467 - protein, 15 aa, BORRELIA GARINII
LNQERYEILLKHVEP

SEQ ID NO: 150468 - protein, 15 aa, BORRELIA GARINII
NQERYEILLKHVEPS

SEQ ID NO: 150469 - protein, 15 aa, BORRELIA GARINII
QERYEILLKHVEPSL

SEQ ID NO: 150470 - protein, 15 aa, BORRELIA GARINII
ERYEILLKHVEPSLN

SEQ ID NO: 150471 - protein, 15 aa, BORRELIA GARINII
RYEILLKHVEPSLNL

SEQ ID NO: 150472 - protein, 15 aa, BORRELIA GARINII
YEILLKHVEPSLNLK

SEQ ID NO: 150473 - protein, 15 aa, BORRELIA GARINII
EILLKHVEPSLNLKQ

SEQ ID NO: 150474 - protein, 15 aa, BORRELIA GARINII
ILLKHVEPSLNLKQK

SEQ ID NO: 150475 - protein, 15 aa, BORRELIA GARINII
LLKHVEPSLNLKQKF

SEQ ID NO: 150476 - protein, 15 aa, BORRELIA GARINII
LKHVEPSLNLKQKFE

SEQ ID NO: 150477 - protein, 15 aa, BORRELIA GARINII
KHVEPSLNLKQKFEK

SEQ ID NO: 150478 - protein, 15 aa, BORRELIA GARINII
HVEPSLNLKQKFEKI

SEQ ID NO: 150479 - protein, 15 aa, BORRELIA GARINII
VEPSLNLKQKFEKIL

SEQ ID NO: 150480 - protein, 15 aa, BORRELIA GARINII
EPSLNLKQKFEKILN

SEQ ID NO: 150481 - protein, 15 aa, BORRELIA GARINII
PSLNLKQKFEKILNE

SEQ ID NO: 150482 - protein, 15 aa, BORRELIA GARINII
SLNLKQKFEKILNET

SEQ ID NO: 150483 - protein, 15 aa, BORRELIA GARINII
LNLKQKFEKILNETI

SEQ ID NO: 150484 - protein, 15 aa, BORRELIA GARINII
NLKQKFEKILNETIK

SEQ ID NO: 150485 - protein, 15 aa, BORRELIA GARINII
LKQKFEKILNETIKA

SEQ ID NO: 150486 - protein, 15 aa, BORRELIA GARINII
KQKFEKILNETIKAY

SEQ ID NO: 150487 - protein, 15 aa, BORRELIA GARINII
QKFEKILNETIKAYN

SEQ ID NO: 150488 - protein, 15 aa, BORRELIA GARINII
KFEKILNETIKAYNQ

SEQ ID NO: 150489 - protein, 15 aa, BORRELIA GARINII
FEKILNETIKAYNQD

SEQ ID NO: 150490 - protein, 15 aa, BORRELIA GARINII
EKILNETIKAYNQDL

SEQ ID NO: 150491 - protein, 15 aa, BORRELIA GARINII
KILNETIKAYNQDLD

SEQ ID NO: 150492 - protein, 15 aa, BORRELIA GARINII
ILNETIKAYNQDLDN

SEQ ID NO: 150493 - protein, 15 aa, BORRELIA GARINII
LNETIKAYNQDLDNI

SEQ ID NO: 150494 - protein, 15 aa, BORRELIA GARINII
NETIKAYNQDLDNIK

SEQ ID NO: 150495 - protein, 15 aa, BORRELIA GARINII
ETIKAYNQDLDNIKS

SEQ ID NO: 150496 - protein, 15 aa, BORRELIA GARINII
TIKAYNQDLDNIKSN

SEQ ID NO: 150497 - protein, 15 aa, BORRELIA GARINII
IKAYNQDLDNIKSNE

SEQ ID NO: 150498 - protein, 15 aa, BORRELIA GARINII
KAYNQDLDNIKSNED

SEQ ID NO: 150499 - protein, 15 aa, BORRELIA GARINII
AYNQDLDNIKSNEDQ

SEQ ID NO: 150500 - protein, 15 aa, BORRELIA GARINII
YNQDLDNIKSNEDQL

SEQ ID NO: 150501 - protein, 15 aa, BORRELIA GARINII
NQDLDNIKSNEDQLA

SEQ ID NO: 150502 - protein, 15 aa, BORRELIA GARINII
QDLDNIKSNEDQLAH

SEQ ID NO: 150503 - protein, 15 aa, BORRELIA GARINII
DLDNIKSNEDQLAHM

SEQ ID NO: 150504 - protein, 15 aa, BORRELIA GARINII
LDNIKSNEDQLAHMD

SEQ ID NO: 150505 - protein, 15 aa, BORRELIA GARINII
DNIKSNEDQLAHMDE

SEQ ID NO: 150506 - protein, 15 aa, BORRELIA GARINII
NIKSNEDQLAHMDEN

SEQ ID NO: 150507 - protein, 15 aa, BORRELIA GARINII
IKSNEDQLAHMDENY

SEQ ID NO: 150508 - protein, 15 aa, BORRELIA GARINII
KSNEDQLAHMDENYK

SEQ ID NO: 150509 - protein, 15 aa, BORRELIA GARINII
SNEDQLAHMDENYKE

SEQ ID NO: 150510 - protein, 15 aa, BORRELIA GARINII
NEDQLAHMDENYKEF

SEQ ID NO: 150511 - protein, 15 aa, BORRELIA GARINII
EDQLAHMDENYKEFD

SEQ ID NO: 150512 - protein, 15 aa, BORRELIA GARINII
DQLAHMDENYKEFDP

SEQ ID NO: 150513 - protein, 15 aa, BORRELIA GARINII
QLAHMDENYKEFDPL

SEQ ID NO: 150514 - protein, 15 aa, BORRELIA GARINII
LAHMDENYKEFDPLN

SEQ ID NO: 150515 - protein, 15 aa, BORRELIA GARINII
AHMDENYKEFDPLNL

SEQ ID NO: 150516 - protein, 15 aa, BORRELIA GARINII
HMDENYKEFDPLNLD

SEQ ID NO: 150517 - protein, 15 aa, BORRELIA GARINII
MDENYKEFDPLNLDY

SEQ ID NO: 150518 - protein, 16 aa, BORRELIA GARINII
MKKTKLNIIKLNILTT

SEQ ID NO: 150519 - protein, 16 aa, BORRELIA GARINII
KKTKLNIIKLNILTTI

SEQ ID NO: 150520 - protein, 16 aa, BORRELIA GARINII
KTKLNIIKLNILTTIL

SEQ ID NO: 150521 - protein, 16 aa, BORRELIA GARINII
TKLNIIKLNILTTILT

SEQ ID NO: 150522 - protein, 16 aa, BORRELIA GARINII
KLNIIKLNILTTILTL

SEQ ID NO: 150523 - protein, 16 aa, BORRELIA GARINII
LNIIKLNILTTILTLI

SEQ ID NO: 150524 - protein, 16 aa, BORRELIA GARINII
NIIKLNILTTILTLIC

SEQ ID NO: 150525 - protein, 16 aa, BORRELIA GARINII
IIKLNILTTILTLICI

SEQ ID NO: 150526 - protein, 16 aa, BORRELIA GARINII
IKLNILTTILTLICIS

SEQ ID NO: 150527 - protein, 16 aa, BORRELIA GARINII
KLNILTTILTLICISC

SEQ ID NO: 150528 - protein, 16 aa, BORRELIA GARINII
LNILTTILTLICISCA

SEQ ID NO: 150529 - protein, 16 aa, BORRELIA GARINII
NILTTILTLICISCAV

SEQ ID NO: 150530 - protein, 16 aa, BORRELIA GARINII
ILTTILTLICISCAVD

SEQ ID NO: 150531 - protein, 16 aa, BORRELIA GARINII
LTTILTLICISCAVDK

SEQ ID NO: 150532 - protein, 16 aa, BORRELIA GARINII
TTILTLICISCAVDKI

SEQ ID NO: 150533 - protein, 16 aa, BORRELIA GARINII
TILTLICISCAVDKID

SEQ ID NO: 150534 - protein, 16 aa, BORRELIA GARINII
ILTLICISCAVDKIDP

SEQ ID NO: 150535 - protein, 16 aa, BORRELIA GARINII
LTLICISCAVDKIDPE

SEQ ID NO: 150536 - protein, 16 aa, BORRELIA GARINII
TLICISCAVDKIDPES

SEQ ID NO: 150537 - protein, 16 aa, BORRELIA GARINII
LICISCAVDKIDPESK

SEQ ID NO: 150538 - protein, 16 aa, BORRELIA GARINII
ICISCAVDKIDPESKS

SEQ ID NO: 150539 - protein, 16 aa, BORRELIA GARINII
CISCAVDKIDPESKSK

SEQ ID NO: 150540 - protein, 16 aa, BORRELIA GARINII
ISCAVDKIDPESKSKT

SEQ ID NO: 150541 - protein, 16 aa, BORRELIA GARINII
SCAVDKIDPESKSKTN

SEQ ID NO: 150542 - protein, 16 aa, BORRELIA GARINII
CAVDKIDPESKSKTNT

SEQ ID NO: 150543 - protein, 16 aa, BORRELIA GARINII
AVDKIDPESKSKTNTK

SEQ ID NO: 150544 - protein, 16 aa, BORRELIA GARINII
VDKIDPESKSKTNTKD

SEQ ID NO: 150545 - protein, 16 aa, BORRELIA GARINII
DKIDPESKSKTNTKDF

SEQ ID NO: 150546 - protein, 16 aa, BORRELIA GARINII
KIDPESKSKTNTKDFE

SEQ ID NO: 150547 - protein, 16 aa, BORRELIA GARINII
IDPESKSKTNTKDFEN

SEQ ID NO: 150548 - protein, 16 aa, BORRELIA GARINII
DPESKSKTNTKDFENK

SEQ ID NO: 150549 - protein, 16 aa, BORRELIA GARINII
PESKSKTNTKDFENKS

SEQ ID NO: 150550 - protein, 16 aa, BORRELIA GARINII
ESKSKTNTKDFENKSQ

SEQ ID NO: 150551 - protein, 16 aa, BORRELIA GARINII
SKSKTNTKDFENKSQD

SEQ ID NO: 150552 - protein, 16 aa, BORRELIA GARINII
KSKTNTKDFENKSQDL

SEQ ID NO: 150553 - protein, 16 aa, BORRELIA GARINII
SKTNTKDFENKSQDLE

SEQ ID NO: 150554 - protein, 16 aa, BORRELIA GARINII
KTNTKDFENKSQDLEP

SEQ ID NO: 150555 - protein, 16 aa, BORRELIA GARINII
TNTKDFENKSQDLEPS

SEQ ID NO: 150556 - protein, 16 aa, BORRELIA GARINII
NTKDFENKSQDLEPSN

SEQ ID NO: 150557 - protein, 16 aa, BORRELIA GARINII
TKDFENKSQDLEPSNT

SEQ ID NO: 150558 - protein, 16 aa, BORRELIA GARINII
KDFENKSQDLEPSNTK

SEQ ID NO: 150559 - protein, 16 aa, BORRELIA GARINII
DFENKSQDLEPSNTKN

SEQ ID NO: 150560 - protein, 16 aa, BORRELIA GARINII
FENKSQDLEPSNTKNK

SEQ ID NO: 150561 - protein, 16 aa, BORRELIA GARINII
ENKSQDLEPSNTKNKD

SEQ ID NO: 150562 - protein, 16 aa, BORRELIA GARINII
NKSQDLEPSNTKNKDL

SEQ ID NO: 150563 - protein, 16 aa, BORRELIA GARINII
KSQDLEPSNTKNKDLE

SEQ ID NO: 150564 - protein, 16 aa, BORRELIA GARINII
SQDLEPSNTKNKDLEP

SEQ ID NO: 150565 - protein, 16 aa, BORRELIA GARINII
QDLEPSNTKNKDLEPL

SEQ ID NO: 150566 - protein, 16 aa, BORRELIA GARINII
DLEPSNTKNKDLEPLE

SEQ ID NO: 150567 - protein, 16 aa, BORRELIA GARINII
LEPSNTKNKDLEPLEK

SEQ ID NO: 150568 - protein, 16 aa, BORRELIA GARINII
EPSNTKNKDLEPLEKN

SEQ ID NO: 150569 - protein, 16 aa, BORRELIA GARINII
PSNTKNKDLEPLEKNS

SEQ ID NO: 150570 - protein, 16 aa, BORRELIA GARINII
SNTKNKDLEPLEKNSK

SEQ ID NO: 150571 - protein, 16 aa, BORRELIA GARINII
NTKNKDLEPLEKNSKE

SEQ ID NO: 150572 - protein, 16 aa, BORRELIA GARINII
TKNKDLEPLEKNSKET

SEQ ID NO: 150573 - protein, 16 aa, BORRELIA GARINII
KNKDLEPLEKNSKETI

SEQ ID NO: 150574 - protein, 16 aa, BORRELIA GARINII
NKDLEPLEKNSKETII

SEQ ID NO: 150575 - protein, 16 aa, BORRELIA GARINII
KDLEPLEKNSKETIIS

SEQ ID NO: 150576 - protein, 16 aa, BORRELIA GARINII
DLEPLEKNSKETIISK

SEQ ID NO: 150577 - protein, 16 aa, BORRELIA GARINII
LEPLEKNSKETIISKL

SEQ ID NO: 150578 - protein, 16 aa, BORRELIA GARINII
EPLEKNSKETIISKLE

SEQ ID NO: 150579 - protein, 16 aa, BORRELIA GARINII
PLEKNSKETIISKLEK

SEQ ID NO: 150580 - protein, 16 aa, BORRELIA GARINII
LEKNSKETIISKLEKM

SEQ ID NO: 150581 - protein, 16 aa, BORRELIA GARINII
EKNSKETIISKLEKMI

SEQ ID NO: 150582 - protein, 16 aa, BORRELIA GARINII
KNSKETIISKLEKMIK

SEQ ID NO: 150583 - protein, 16 aa, BORRELIA GARINII
NSKETIISKLEKMIKD

SEQ ID NO: 150584 - protein, 16 aa, BORRELIA GARINII
SKETIISKLEKMIKDL

SEQ ID NO: 150585 - protein, 16 aa, BORRELIA GARINII
KETIISKLEKMIKDLE

SEQ ID NO: 150586 - protein, 16 aa, BORRELIA GARINII
ETIISKLEKMIKDLED

SEQ ID NO: 150587 - protein, 16 aa, BORRELIA GARINII
TIISKLEKMIKDLEDQ

SEQ ID NO: 150588 - protein, 16 aa, BORRELIA GARINII
IISKLEKMIKDLEDQK

SEQ ID NO: 150589 - protein, 16 aa, BORRELIA GARINII
ISKLEKMIKDLEDQKD

SEQ ID NO: 150590 - protein, 16 aa, BORRELIA GARINII
SKLEKMIKDLEDQKDQ

SEQ ID NO: 150591 - protein, 16 aa, BORRELIA GARINII
KLEKMIKDLEDQKDQE

SEQ ID NO: 150592 - protein, 16 aa, BORRELIA GARINII
LEKMIKDLEDQKDQED

SEQ ID NO: 150593 - protein, 16 aa, BORRELIA GARINII
EKMIKDLEDQKDQEDT

SEQ ID NO: 150594 - protein, 16 aa, BORRELIA GARINII
KMIKDLEDQKDQEDTE

SEQ ID NO: 150595 - protein, 16 aa, BORRELIA GARINII
MIKDLEDQKDQEDTEI

SEQ ID NO: 150596 - protein, 16 aa, BORRELIA GARINII
IKDLEDQKDQEDTEIA

SEQ ID NO: 150597 - protein, 16 aa, BORRELIA GARINII
KDLEDQKDQEDTEIAK

SEQ ID NO: 150598 - protein, 16 aa, BORRELIA GARINII
DLEDQKDQEDTEIAKI

SEQ ID NO: 150599 - protein, 16 aa, BORRELIA GARINII
LEDQKDQEDTEIAKIT

SEQ ID NO: 150600 - protein, 16 aa, BORRELIA GARINII
EDQKDQEDTEIAKITN

SEQ ID NO: 150601 - protein, 16 aa, BORRELIA GARINII
DQKDQEDTEIAKITNT

SEQ ID NO: 150602 - protein, 16 aa, BORRELIA GARINII
QKDQEDTEIAKITNTQ

SEQ ID NO: 150603 - protein, 16 aa, BORRELIA GARINII
KDQEDTEIAKITNTQI

SEQ ID NO: 150604 - protein, 16 aa, BORRELIA GARINII
DQEDTEIAKITNTQID

SEQ ID NO: 150605 - protein, 16 aa, BORRELIA GARINII
QEDTEIAKITNTQIDF

SEQ ID NO: 150606 - protein, 16 aa, BORRELIA GARINII
EDTEIAKITNTQIDFL

SEQ ID NO: 150607 - protein, 16 aa, BORRELIA GARINII
DTEIAKITNTQIDFLE

SEQ ID NO: 150608 - protein, 16 aa, BORRELIA GARINII
TEIAKITNTQIDFLEN

SEQ ID NO: 150609 - protein, 16 aa, BORRELIA GARINII
EIAKITNTQIDFLENF

SEQ ID NO: 150610 - protein, 16 aa, BORRELIA GARINII
IAKITNTQIDFLENFK

SEQ ID NO: 150611 - protein, 16 aa, BORRELIA GARINII
AKITNTQIDFLENFKS

SEQ ID NO: 150612 - protein, 16 aa, BORRELIA GARINII
KITNTQIDFLENFKSE

SEQ ID NO: 150613 - protein, 16 aa, BORRELIA GARINII
ITNTQIDFLENFKSEP

SEQ ID NO: 150614 - protein, 16 aa, BORRELIA GARINII
TNTQIDFLENFKSEPH

SEQ ID NO: 150615 - protein, 16 aa, BORRELIA GARINII
NTQIDFLENFKSEPHD

SEQ ID NO: 150616 - protein, 16 aa, BORRELIA GARINII
TQIDFLENFKSEPHDT

SEQ ID NO: 150617 - protein, 16 aa, BORRELIA GARINII
QIDFLENFKSEPHDTI

SEQ ID NO: 150618 - protein, 16 aa, BORRELIA GARINII
IDFLENFKSEPHDTIS

SEQ ID NO: 150619 - protein, 16 aa, BORRELIA GARINII
DFLENFKSEPHDTISE

SEQ ID NO: 150620 - protein, 16 aa, BORRELIA GARINII
FLENFKSEPHDTISED

SEQ ID NO: 150621 - protein, 16 aa, BORRELIA GARINII
LENFKSEPHDTISEDI

SEQ ID NO: 150622 - protein, 16 aa, BORRELIA GARINII
ENFKSEPHDTISEDIE

SEQ ID NO: 150623 - protein, 16 aa, BORRELIA GARINII
NFKSEPHDTISEDIEM

SEQ ID NO: 150624 - protein, 16 aa, BORRELIA GARINII
FKSEPHDTISEDIEMK

SEQ ID NO: 150625 - protein, 16 aa, BORRELIA GARINII
KSEPHDTISEDIEMKI

SEQ ID NO: 150626 - protein, 16 aa, BORRELIA GARINII
SEPHDTISEDIEMKIK

SEQ ID NO: 150627 - protein, 16 aa, BORRELIA GARINII
EPHDTISEDIEMKIKR

SEQ ID NO: 150628 - protein, 16 aa, BORRELIA GARINII
PHDTISEDIEMKIKRI

SEQ ID NO: 150629 - protein, 16 aa, BORRELIA GARINII
HDTISEDIEMKIKRII

SEQ ID NO: 150630 - protein, 16 aa, BORRELIA GARINII
DTISEDIEMKIKRIIY

SEQ ID NO: 150631 - protein, 16 aa, BORRELIA GARINII
TISEDIEMKIKRIIYS

SEQ ID NO: 150632 - protein, 16 aa, BORRELIA GARINII
ISEDIEMKIKRIIYSS

SEQ ID NO: 150633 - protein, 16 aa, BORRELIA GARINII
SEDIEMKIKRIIYSSL

SEQ ID NO: 150634 - protein, 16 aa, BORRELIA GARINII
EDIEMKIKRIIYSSLN

SEQ ID NO: 150635 - protein, 16 aa, BORRELIA GARINII
DIEMKIKRIIYSSLNY

SEQ ID NO: 150636 - protein, 16 aa, BORRELIA GARINII
IEMKIKRIIYSSLNYE

SEQ ID NO: 150637 - protein, 16 aa, BORRELIA GARINII
EMKIKRIIYSSLNYEI

SEQ ID NO: 150638 - protein, 16 aa, BORRELIA GARINII
MKIKRIIYSSLNYEIE

SEQ ID NO: 150639 - protein, 16 aa, BORRELIA GARINII
KIKRIIYSSLNYEIEK

SEQ ID NO: 150640 - protein, 16 aa, BORRELIA GARINII
IKRIIYSSLNYEIEKI

SEQ ID NO: 150641 - protein, 16 aa, BORRELIA GARINII
KRIIYSSLNYEIEKIN

SEQ ID NO: 150642 - protein, 16 aa, BORRELIA GARINII
RIIYSSLNYEIEKINT

SEQ ID NO: 150643 - protein, 16 aa, BORRELIA GARINII
IIYSSLNYEIEKINTL

SEQ ID NO: 150644 - protein, 16 aa, BORRELIA GARINII
IYSSLNYEIEKINTLK

SEQ ID NO: 150645 - protein, 16 aa, BORRELIA GARINII
YSSLNYEIEKINTLKE

SEQ ID NO: 150646 - protein, 16 aa, BORRELIA GARINII
SSLNYEIEKINTLKEI

SEQ ID NO: 150647 - protein, 16 aa, BORRELIA GARINII
SLNYEIEKINTLKEIL

SEQ ID NO: 150648 - protein, 16 aa, BORRELIA GARINII
LNYEIEKINTLKEILD

SEQ ID NO: 150649 - protein, 16 aa, BORRELIA GARINII
NYEIEKINTLKEILDK

SEQ ID NO: 150650 - protein, 16 aa, BORRELIA GARINII
YEIEKINTLKEILDKL

SEQ ID NO: 150651 - protein, 16 aa, BORRELIA GARINII
EIEKINTLKEILDKLY

SEQ ID NO: 150652 - protein, 16 aa, BORRELIA GARINII
IEKINTLKEILDKLYK

SEQ ID NO: 150653 - protein, 16 aa, BORRELIA GARINII
EKINTLKEILDKLYKN

SEQ ID NO: 150654 - protein, 16 aa, BORRELIA GARINII
KINTLKEILDKLYKNH

SEQ ID NO: 150655 - protein, 16 aa, BORRELIA GARINII
INTLKEILDKLYKNHK

SEQ ID NO: 150656 - protein, 16 aa, BORRELIA GARINII
NTLKEILDKLYKNHKY

SEQ ID NO: 150657 - protein, 16 aa, BORRELIA GARINII
TLKEILDKLYKNHKYK

SEQ ID NO: 150658 - protein, 16 aa, BORRELIA GARINII
LKEILDKLYKNHKYKT

SEQ ID NO: 150659 - protein, 16 aa, BORRELIA GARINII
KEILDKLYKNHKYKTT

SEQ ID NO: 150660 - protein, 16 aa, BORRELIA GARINII
EILDKLYKNHKYKTTA

SEQ ID NO: 150661 - protein, 16 aa, BORRELIA GARINII
ILDKLYKNHKYKTTAR

SEQ ID NO: 150662 - protein, 16 aa, BORRELIA GARINII
LDKLYKNHKYKTTARN

SEQ ID NO: 150663 - protein, 16 aa, BORRELIA GARINII
DKLYKNHKYKTTARNF

SEQ ID NO: 150664 - protein, 16 aa, BORRELIA GARINII
KLYKNHKYKTTARNFI

SEQ ID NO: 150665 - protein, 16 aa, BORRELIA GARINII
LYKNHKYKTTARNFIL

SEQ ID NO: 150666 - protein, 16 aa, BORRELIA GARINII
YKNHKYKTTARNFILN

SEQ ID NO: 150667 - protein, 16 aa, BORRELIA GARINII
KNHKYKTTARNFILNI

SEQ ID NO: 150668 - protein, 16 aa, BORRELIA GARINII
NHKYKTTARNFILNIS

SEQ ID NO: 150669 - protein, 16 aa, BORRELIA GARINII
HKYKTTARNFILNISI

SEQ ID NO: 150670 - protein, 16 aa, BORRELIA GARINII
KYKTTARNFILNISIK

SEQ ID NO: 150671 - protein, 16 aa, BORRELIA GARINII
YKTTARNFILNISIKI

SEQ ID NO: 150672 - protein, 16 aa, BORRELIA GARINII
KTTARNFILNISIKIQ

SEQ ID NO: 150673 - protein, 16 aa, BORRELIA GARINII
TTARNFILNISIKIQF

SEQ ID NO: 150674 - protein, 16 aa, BORRELIA GARINII
TARNFILNISIKIQFQ

SEQ ID NO: 150675 - protein, 16 aa, BORRELIA GARINII
ARNFILNISIKIQFQI

SEQ ID NO: 150676 - protein, 16 aa, BORRELIA GARINII
RNFILNISIKIQFQIE

SEQ ID NO: 150677 - protein, 16 aa, BORRELIA GARINII
NFILNISIKIQFQIEN

SEQ ID NO: 150678 - protein, 16 aa, BORRELIA GARINII
FILNISIKIQFQIENA

SEQ ID NO: 150679 - protein, 16 aa, BORRELIA GARINII
ILNISIKIQFQIENAL

SEQ ID NO: 150680 - protein, 16 aa, BORRELIA GARINII
LNISIKIQFQIENALE

SEQ ID NO: 150681 - protein, 16 aa, BORRELIA GARINII
NISIKIQFQIENALEL

SEQ ID NO: 150682 - protein, 16 aa, BORRELIA GARINII
ISIKIQFQIENALELM

SEQ ID NO: 150683 - protein, 16 aa, BORRELIA GARINII
SIKIQFQIENALELMK

SEQ ID NO: 150684 - protein, 16 aa, BORRELIA GARINII
IKIQFQIENALELMKE

SEQ ID NO: 150685 - protein, 16 aa, BORRELIA GARINII
KIQFQIENALELMKEE

SEQ ID NO: 150686 - protein, 16 aa, BORRELIA GARINII
IQFQIENALELMKEEI

SEQ ID NO: 150687 - protein, 16 aa, BORRELIA GARINII
QFQIENALELMKEEIE

SEQ ID NO: 150688 - protein, 16 aa, BORRELIA GARINII
FQIENALELMKEEIED

SEQ ID NO: 150689 - protein, 16 aa, BORRELIA GARINII
QIENALELMKEEIEDA

SEQ ID NO: 150690 - protein, 16 aa, BORRELIA GARINII
IENALELMKEEIEDAS

SEQ ID NO: 150691 - protein, 16 aa, BORRELIA GARINII
ENALELMKEEIEDASE

SEQ ID NO: 150692 - protein, 16 aa, BORRELIA GARINII
NALELMKEEIEDASEI

SEQ ID NO: 150693 - protein, 16 aa, BORRELIA GARINII
ALELMKEEIEDASEIL

SEQ ID NO: 150694 - protein, 16 aa, BORRELIA GARINII
LELMKEEIEDASEILN

SEQ ID NO: 150695 - protein, 16 aa, BORRELIA GARINII
ELMKEEIEDASEILNQ

SEQ ID NO: 150696 - protein, 16 aa, BORRELIA GARINII
LMKEEIEDASEILNQE

SEQ ID NO: 150697 - protein, 16 aa, BORRELIA GARINII
MKEEIEDASEILNQER

SEQ ID NO: 150698 - protein, 16 aa, BORRELIA GARINII
KEEIEDASEILNQERY

SEQ ID NO: 150699 - protein, 16 aa, BORRELIA GARINII
EEIEDASEILNQERYE

SEQ ID NO: 150700 - protein, 16 aa, BORRELIA GARINII
EIEDASEILNQERYEI

SEQ ID NO: 150701 - protein, 16 aa, BORRELIA GARINII
IEDASEILNQERYEIL

SEQ ID NO: 150702 - protein, 16 aa, BORRELIA GARINII
EDASEILNQERYEILL

SEQ ID NO: 150703 - protein, 16 aa, BORRELIA GARINII
DASEILNQERYEILLK

SEQ ID NO: 150704 - protein, 16 aa, BORRELIA GARINII
ASEILNQERYEILLKH

SEQ ID NO: 150705 - protein, 16 aa, BORRELIA GARINII
SEILNQERYEILLKHV

SEQ ID NO: 150706 - protein, 16 aa, BORRELIA GARINII
EILNQERYEILLKHVE

SEQ ID NO: 150707 - protein, 16 aa, BORRELIA GARINII
ILNQERYEILLKHVEP

SEQ ID NO: 150708 - protein, 16 aa, BORRELIA GARINII
LNQERYEILLKHVEPS

SEQ ID NO: 150709 - protein, 16 aa, BORRELIA GARINII
NQERYEILLKHVEPSL

SEQ ID NO: 150710 - protein, 16 aa, BORRELIA GARINII
QERYEILLKHVEPSLN

SEQ ID NO: 150711 - protein, 16 aa, BORRELIA GARINII
ERYEILLKHVEPSLNL

SEQ ID NO: 150712 - protein, 16 aa, BORRELIA GARINII
RYEILLKHVEPSLNLK

SEQ ID NO: 150713 - protein, 16 aa, BORRELIA GARINII
YEILLKHVEPSLNLKQ

SEQ ID NO: 150714 - protein, 16 aa, BORRELIA GARINII
EILLKHVEPSLNLKQK

SEQ ID NO: 150715 - protein, 16 aa, BORRELIA GARINII
ILLKHVEPSLNLKQKF

SEQ ID NO: 150716 - protein, 16 aa, BORRELIA GARINII
LLKHVEPSLNLKQKFE

SEQ ID NO: 150717 - protein, 16 aa, BORRELIA GARINII
LKHVEPSLNLKQKFEK

SEQ ID NO: 150718 - protein, 16 aa, BORRELIA GARINII
KHVEPSLNLKQKFEKI

SEQ ID NO: 150719 - protein, 16 aa, BORRELIA GARINII
HVEPSLNLKQKFEKIL

SEQ ID NO: 150720 - protein, 16 aa, BORRELIA GARINII
VEPSLNLKQKFEKILN

SEQ ID NO: 150721 - protein, 16 aa, BORRELIA GARINII
EPSLNLKQKFEKILNE

SEQ ID NO: 150722 - protein, 16 aa, BORRELIA GARINII
PSLNLKQKFEKILNET

SEQ ID NO: 150723 - protein, 16 aa, BORRELIA GARINII
SLNLKQKFEKILNETI

SEQ ID NO: 150724 - protein, 16 aa, BORRELIA GARINII
LNLKQKFEKILNETIK

SEQ ID NO: 150725 - protein, 16 aa, BORRELIA GARINII
NLKQKFEKILNETIKA

SEQ ID NO: 150726 - protein, 16 aa, BORRELIA GARINII
LKQKFEKILNETIKAY

SEQ ID NO: 150727 - protein, 16 aa, BORRELIA GARINII
KQKFEKILNETIKAYN

SEQ ID NO: 150728 - protein, 16 aa, BORRELIA GARINII
QKFEKILNETIKAYNQ

SEQ ID NO: 150729 - protein, 16 aa, BORRELIA GARINII
KFEKILNETIKAYNQD

SEQ ID NO: 150730 - protein, 16 aa, BORRELIA GARINII
FEKILNETIKAYNQDL

SEQ ID NO: 150731 - protein, 16 aa, BORRELIA GARINII
EKILNETIKAYNQDLD

SEQ ID NO: 150732 - protein, 16 aa, BORRELIA GARINII
KILNETIKAYNQDLDN

SEQ ID NO: 150733 - protein, 16 aa, BORRELIA GARINII
ILNETIKAYNQDLDNI

SEQ ID NO: 150734 - protein, 16 aa, BORRELIA GARINII
LNETIKAYNQDLDNIK

SEQ ID NO: 150735 - protein, 16 aa, BORRELIA GARINII
NETIKAYNQDLDNIKS

SEQ ID NO: 150736 - protein, 16 aa, BORRELIA GARINII
ETIKAYNQDLDNIKSN

SEQ ID NO: 150737 - protein, 16 aa, BORRELIA GARINII
TIKAYNQDLDNIKSNE

SEQ ID NO: 150738 - protein, 16 aa, BORRELIA GARINII
IKAYNQDLDNIKSNED

SEQ ID NO: 150739 - protein, 16 aa, BORRELIA GARINII
KAYNQDLDNIKSNEDQ

SEQ ID NO: 150740 - protein, 16 aa, BORRELIA GARINII
AYNQDLDNIKSNEDQL

SEQ ID NO: 150741 - protein, 16 aa, BORRELIA GARINII
YNQDLDNIKSNEDQLA

SEQ ID NO: 150742 - protein, 16 aa, BORRELIA GARINII
NQDLDNIKSNEDQLAH

SEQ ID NO: 150743 - protein, 16 aa, BORRELIA GARINII
QDLDNIKSNEDQLAHM

SEQ ID NO: 150744 - protein, 16 aa, BORRELIA GARINII
DLDNIKSNEDQLAHMD

SEQ ID NO: 150745 - protein, 16 aa, BORRELIA GARINII
LDNIKSNEDQLAHMDE

SEQ ID NO: 150746 - protein, 16 aa, BORRELIA GARINII
DNIKSNEDQLAHMDEN

SEQ ID NO: 150747 - protein, 16 aa, BORRELIA GARINII
NIKSNEDQLAHMDENY

SEQ ID NO: 150748 - protein, 16 aa, BORRELIA GARINII
IKSNEDQLAHMDENYK

SEQ ID NO: 150749 - protein, 16 aa, BORRELIA GARINII
KSNEDQLAHMDENYKE

SEQ ID NO: 150750 - protein, 16 aa, BORRELIA GARINII
SNEDQLAHMDENYKEF

SEQ ID NO: 150751 - protein, 16 aa, BORRELIA GARINII
NEDQLAHMDENYKEFD

SEQ ID NO: 150752 - protein, 16 aa, BORRELIA GARINII
EDQLAHMDENYKEFDP

SEQ ID NO: 150753 - protein, 16 aa, BORRELIA GARINII
DQLAHMDENYKEFDPL

SEQ ID NO: 150754 - protein, 16 aa, BORRELIA GARINII
QLAHMDENYKEFDPLN

SEQ ID NO: 150755 - protein, 16 aa, BORRELIA GARINII
LAHMDENYKEFDPLNL

SEQ ID NO: 150756 - protein, 16 aa, BORRELIA GARINII
AHMDENYKEFDPLNLD

SEQ ID NO: 150757 - protein, 16 aa, BORRELIA GARINII
HMDENYKEFDPLNLDY

SEQ ID NO: 150758 - protein, 8 aa, BORRELIA GARINII PBI
MKYKKIRI

SEQ ID NO: 150759 - protein, 8 aa, BORRELIA GARINII PBI
KYKKIRIN

SEQ ID NO: 150760 - protein, 8 aa, BORRELIA GARINII PBI
YKKIRINL

SEQ ID NO: 150761 - protein, 8 aa, BORRELIA GARINII PBI
KKIRINLN

SEQ ID NO: 150762 - protein, 8 aa, BORRELIA GARINII PBI
KIRINLNL

SEQ ID NO: 150763 - protein, 8 aa, BORRELIA GARINII PBI
IRINLNLK

SEQ ID NO: 150764 - protein, 8 aa, BORRELIA GARINII PBI
RINLNLKR

SEQ ID NO: 150765 - protein, 8 aa, BORRELIA GARINII PBI
INLNLKRK

SEQ ID NO: 150766 - protein, 8 aa, BORRELIA GARINII PBI
NLNLKRKS

SEQ ID NO: 150767 - protein, 8 aa, BORRELIA GARINII PBI
LNLKRKSG

SEQ ID NO: 150768 - protein, 8 aa, BORRELIA GARINII PBI
NLKRKSGI

SEQ ID NO: 150769 - protein, 8 aa, BORRELIA GARINII PBI
LKRKSGIL

SEQ ID NO: 150770 - protein, 8 aa, BORRELIA GARINII PBI
KRKSGILL

SEQ ID NO: 150771 - protein, 8 aa, BORRELIA GARINII PBI
RKSGILLN

SEQ ID NO: 150772 - protein, 8 aa, BORRELIA GARINII PBI
KSGILLNI

SEQ ID NO: 150773 - protein, 8 aa, BORRELIA GARINII PBI
SGILLNIS

SEQ ID NO: 150774 - protein, 8 aa, BORRELIA GARINII PBI
GILLNISS

SEQ ID NO: 150775 - protein, 8 aa, BORRELIA GARINII PBI
ILLNISSL

SEQ ID NO: 150776 - protein, 8 aa, BORRELIA GARINII PBI
LLNISSLP

SEQ ID NO: 150777 - protein, 8 aa, BORRELIA GARINII PBI
LNISSLPS

SEQ ID NO: 150778 - protein, 8 aa, BORRELIA GARINII PBI
NISSLPSK

SEQ ID NO: 150779 - protein, 8 aa, BORRELIA GARINII PBI
ISSLPSKY

SEQ ID NO: 150780 - protein, 8 aa, BORRELIA GARINII PBI
SSLPSKYG

SEQ ID NO: 150781 - protein, 8 aa, BORRELIA GARINII PBI
SLPSKYGI

SEQ ID NO: 150782 - protein, 8 aa, BORRELIA GARINII PBI
LPSKYGIG

SEQ ID NO: 150783 - protein, 8 aa, BORRELIA GARINII PBI
PSKYGIGD

SEQ ID NO: 150784 - protein, 8 aa, BORRELIA GARINII PBI
SKYGIGDL

SEQ ID NO: 150785 - protein, 8 aa, BORRELIA GARINII PBI
KYGIGDLG

SEQ ID NO: 150786 - protein, 8 aa, BORRELIA GARINII PBI
YGIGDLGK

SEQ ID NO: 150787 - protein, 8 aa, BORRELIA GARINII PBI
GIGDLGKG

SEQ ID NO: 150788 - protein, 8 aa, BORRELIA GARINII PBI
IGDLGKGA

SEQ ID NO: 150789 - protein, 8 aa, BORRELIA GARINII PBI
GDLGKGAY

SEQ ID NO: 150790 - protein, 8 aa, BORRELIA GARINII PBI
DLGKGAYK

SEQ ID NO: 150791 - protein, 8 aa, BORRELIA GARINII PBI
LGKGAYKF

SEQ ID NO: 150792 - protein, 8 aa, BORRELIA GARINII PBI
GKGAYKFI

SEQ ID NO: 150793 - protein, 8 aa, BORRELIA GARINII PBI
KGAYKFID

SEQ ID NO: 150794 - protein, 8 aa, BORRELIA GARINII PBI
GAYKFIDF

SEQ ID NO: 150795 - protein, 8 aa, BORRELIA GARINII PBI
AYKFIDFL

SEQ ID NO: 150796 - protein, 8 aa, BORRELIA GARINII PBI
YKFIDFLF

SEQ ID NO: 150797 - protein, 8 aa, BORRELIA GARINII PBI
KFIDFLFA

SEQ ID NO: 150798 - protein, 8 aa, BORRELIA GARINII PBI
FIDFLFAS

SEQ ID NO: 150799 - protein, 8 aa, BORRELIA GARINII PBI
IDFLFASS

SEQ ID NO: 150800 - protein, 8 aa, BORRELIA GARINII PBI
DFLFASSQ

SEQ ID NO: 150801 - protein, 8 aa, BORRELIA GARINII PBI
FLFASSQS

SEQ ID NO: 150802 - protein, 8 aa, BORRELIA GARINII PBI
LFASSQSY

SEQ ID NO: 150803 - protein, 8 aa, BORRELIA GARINII PBI
FASSQSYW

SEQ ID NO: 150804 - protein, 8 aa, BORRELIA GARINII PBI
ASSQSYWQ

SEQ ID NO: 150805 - protein, 8 aa, BORRELIA GARINII PBI
SSQSYWQM

SEQ ID NO: 150806 - protein, 8 aa, BORRELIA GARINII PBI
SQSYWQMF

SEQ ID NO: 150807 - protein, 8 aa, BORRELIA GARINII PBI
QSYWQMFA

SEQ ID NO: 150808 - protein, 8 aa, BORRELIA GARINII PBI
SYWQMFAY

SEQ ID NO: 150809 - protein, 8 aa, BORRELIA GARINII PBI
YWQMFAYS

SEQ ID NO: 150810 - protein, 8 aa, BORRELIA GARINII PBI
WQMFAYSP

SEQ ID NO: 150811 - protein, 8 aa, BORRELIA GARINII PBI
QMFAYSPI

SEQ ID NO: 150812 - protein, 8 aa, BORRELIA GARINII PBI
MFAYSPID

SEQ ID NO: 150813 - protein, 8 aa, BORRELIA GARINII PBI
FAYSPIDF

SEQ ID NO: 150814 - protein, 8 aa, BORRELIA GARINII PBI
AYSPIDFT

SEQ ID NO: 150815 - protein, 8 aa, BORRELIA GARINII PBI
YSPIDFTR

SEQ ID NO: 150816 - protein, 8 aa, BORRELIA GARINII PBI
SPIDFTRS

SEQ ID NO: 150817 - protein, 8 aa, BORRELIA GARINII PBI
PIDFTRSP

SEQ ID NO: 150818 - protein, 8 aa, BORRELIA GARINII PBI
IDFTRSPP

SEQ ID NO: 150819 - protein, 8 aa, BORRELIA GARINII PBI
DFTRSPPY

SEQ ID NO: 150820 - protein, 8 aa, BORRELIA GARINII PBI
FTRSPPYS

SEQ ID NO: 150821 - protein, 8 aa, BORRELIA GARINII PBI
TRSPPYSI

SEQ ID NO: 150822 - protein, 8 aa, BORRELIA GARINII PBI
RSPPYSIF

SEQ ID NO: 150823 - protein, 8 aa, BORRELIA GARINII PBI
SPPYSIFS

SEQ ID NO: 150824 - protein, 8 aa, BORRELIA GARINII PBI
PPYSIFSA

SEQ ID NO: 150825 - protein, 8 aa, BORRELIA GARINII PBI
PYSIFSAF

SEQ ID NO: 150826 - protein, 8 aa, BORRELIA GARINII PBI
YSIFSAFA

SEQ ID NO: 150827 - protein, 8 aa, BORRELIA GARINII PBI
SIFSAFAG

SEQ ID NO: 150828 - protein, 8 aa, BORRELIA GARINII PBI
IFSAFAGN

SEQ ID NO: 150829 - protein, 8 aa, BORRELIA GARINII PBI
FSAFAGNV

SEQ ID NO: 150830 - protein, 8 aa, BORRELIA GARINII PBI
SAFAGNVY

SEQ ID NO: 150831 - protein, 8 aa, BORRELIA GARINII PBI
AFAGNVYY

SEQ ID NO: 150832 - protein, 8 aa, BORRELIA GARINII PBI
FAGNVYYI

SEQ ID NO: 150833 - protein, 8 aa, BORRELIA GARINII PBI
AGNVYYID

SEQ ID NO: 150834 - protein, 8 aa, BORRELIA GARINII PBI
GNVYYIDL

SEQ ID NO: 150835 - protein, 8 aa, BORRELIA GARINII PBI
NVYYIDLE

SEQ ID NO: 150836 - protein, 8 aa, BORRELIA GARINII PBI
VYYIDLEA

SEQ ID NO: 150837 - protein, 8 aa, BORRELIA GARINII PBI
YYIDLEAL

SEQ ID NO: 150838 - protein, 8 aa, BORRELIA GARINII PBI
YIDLEALD

SEQ ID NO: 150839 - protein, 8 aa, BORRELIA GARINII PBI
IDLEALDK

SEQ ID NO: 150840 - protein, 8 aa, BORRELIA GARINII PBI
DLEALDKF

SEQ ID NO: 150841 - protein, 8 aa, BORRELIA GARINII PBI
LEALDKFI

SEQ ID NO: 150842 - protein, 8 aa, BORRELIA GARINII PBI
EALDKFID

SEQ ID NO: 150843 - protein, 8 aa, BORRELIA GARINII PBI
ALDKFIDS

SEQ ID NO: 150844 - protein, 8 aa, BORRELIA GARINII PBI
LDKFIDSD

SEQ ID NO: 150845 - protein, 8 aa, BORRELIA GARINII PBI
DKFIDSDL

SEQ ID NO: 150846 - protein, 8 aa, BORRELIA GARINII PBI
KFIDSDLN

SEQ ID NO: 150847 - protein, 8 aa, BORRELIA GARINII PBI
FIDSDLNL

SEQ ID NO: 150848 - protein, 8 aa, BORRELIA GARINII PBI
IDSDLNLL

SEQ ID NO: 150849 - protein, 8 aa, BORRELIA GARINII PBI
DSDLNLLK

SEQ ID NO: 150850 - protein, 8 aa, BORRELIA GARINII PBI
SDLNLLKE

SEQ ID NO: 150851 - protein, 8 aa, BORRELIA GARINII PBI
DLNLLKEN

SEQ ID NO: 150852 - protein, 8 aa, BORRELIA GARINII PBI
LNLLKENE

SEQ ID NO: 150853 - protein, 8 aa, BORRELIA GARINII PBI
NLLKENET

SEQ ID NO: 150854 - protein, 8 aa, BORRELIA GARINII PBI
LLKENETR

SEQ ID NO: 150855 - protein, 8 aa, BORRELIA GARINII PBI
LKENETRY

SEQ ID NO: 150856 - protein, 8 aa, BORRELIA GARINII PBI
KENETRYS

SEQ ID NO: 150857 - protein, 8 aa, BORRELIA GARINII PBI
ENETRYSD

SEQ ID NO: 150858 - protein, 8 aa, BORRELIA GARINII PBI
NETRYSDL

SEQ ID NO: 150859 - protein, 8 aa, BORRELIA GARINII PBI
ETRYSDLK

SEQ ID NO: 150860 - protein, 8 aa, BORRELIA GARINII PBI
TRYSDLKK

SEQ ID NO: 150861 - protein, 8 aa, BORRELIA GARINII PBI
RYSDLKKL

SEQ ID NO: 150862 - protein, 8 aa, BORRELIA GARINII PBI
YSDLKKLS

SEQ ID NO: 150863 - protein, 8 aa, BORRELIA GARINII PBI
SDLKKLSF

SEQ ID NO: 150864 - protein, 8 aa, BORRELIA GARINII PBI
DLKKLSFK

SEQ ID NO: 150865 - protein, 8 aa, BORRELIA GARINII PBI
LKKLSFKD

SEQ ID NO: 150866 - protein, 8 aa, BORRELIA GARINII PBI
KKLSFKDK

SEQ ID NO: 150867 - protein, 8 aa, BORRELIA GARINII PBI
KLSFKDKF

SEQ ID NO: 150868 - protein, 8 aa, BORRELIA GARINII PBI
LSFKDKFL

SEQ ID NO: 150869 - protein, 8 aa, BORRELIA GARINII PBI
SFKDKFLK

SEQ ID NO: 150870 - protein, 8 aa, BORRELIA GARINII PBI
FKDKFLKE

SEQ ID NO: 150871 - protein, 8 aa, BORRELIA GARINII PBI
KDKFLKEA

SEQ ID NO: 150872 - protein, 8 aa, BORRELIA GARINII PBI
DKFLKEAA

SEQ ID NO: 150873 - protein, 8 aa, BORRELIA GARINII PBI
KFLKEAAL

SEQ ID NO: 150874 - protein, 8 aa, BORRELIA GARINII PBI
FLKEAALN

SEQ ID NO: 150875 - protein, 8 aa, BORRELIA GARINII PBI
LKEAALNF

SEQ ID NO: 150876 - protein, 8 aa, BORRELIA GARINII PBI
KEAALNFI

SEQ ID NO: 150877 - protein, 8 aa, BORRELIA GARINII PBI
EAALNFIN

SEQ ID NO: 150878 - protein, 8 aa, BORRELIA GARINII PBI
AALNFINR

SEQ ID NO: 150879 - protein, 8 aa, BORRELIA GARINII PBI
ALNFINRA

SEQ ID NO: 150880 - protein, 8 aa, BORRELIA GARINII PBI
LNFINRAS

SEQ ID NO: 150881 - protein, 8 aa, BORRELIA GARINII PBI
NFINRASV

SEQ ID NO: 150882 - protein, 8 aa, BORRELIA GARINII PBI
FINRASVD

SEQ ID NO: 150883 - protein, 8 aa, BORRELIA GARINII PBI
INRASVDE

SEQ ID NO: 150884 - protein, 8 aa, BORRELIA GARINII PBI
NRASVDEV

SEQ ID NO: 150885 - protein, 8 aa, BORRELIA GARINII PBI
RASVDEVR

SEQ ID NO: 150886 - protein, 8 aa, BORRELIA GARINII PBI
ASVDEVRS

SEQ ID NO: 150887 - protein, 8 aa, BORRELIA GARINII PBI
SVDEVRSF

SEQ ID NO: 150888 - protein, 8 aa, BORRELIA GARINII PBI
VDEVRSFE

SEQ ID NO: 150889 - protein, 8 aa, BORRELIA GARINII PBI
DEVRSFEK

SEQ ID NO: 150890 - protein, 8 aa, BORRELIA GARINII PBI
EVRSFEKF

SEQ ID NO: 150891 - protein, 8 aa, BORRELIA GARINII PBI
VRSFEKFK

SEQ ID NO: 150892 - protein, 8 aa, BORRELIA GARINII PBI
RSFEKFKK

SEQ ID NO: 150893 - protein, 8 aa, BORRELIA GARINII PBI
SFEKFKKK

SEQ ID NO: 150894 - protein, 8 aa, BORRELIA GARINII PBI
FEKFKKKS

SEQ ID NO: 150895 - protein, 8 aa, BORRELIA GARINII PBI
EKFKKKSS

SEQ ID NO: 150896 - protein, 8 aa, BORRELIA GARINII PBI
KFKKKSSY

SEQ ID NO: 150897 - protein, 8 aa, BORRELIA GARINII PBI
FKKKSSYW

SEQ ID NO: 150898 - protein, 8 aa, BORRELIA GARINII PBI
KKKSSYWL

SEQ ID NO: 150899 - protein, 8 aa, BORRELIA GARINII PBI
KKSSYWLL

SEQ ID NO: 150900 - protein, 8 aa, BORRELIA GARINII PBI
KSSYWLLD

SEQ ID NO: 150901 - protein, 8 aa, BORRELIA GARINII PBI
SSYWLLDF

SEQ ID NO: 150902 - protein, 8 aa, BORRELIA GARINII PBI
SYWLLDFA

SEQ ID NO: 150903 - protein, 8 aa, BORRELIA GARINII PBI
YWLLDFAS

SEQ ID NO: 150904 - protein, 8 aa, BORRELIA GARINII PBI
WLLDFASF

SEQ ID NO: 150905 - protein, 8 aa, BORRELIA GARINII PBI
LLDFASFV

SEQ ID NO: 150906 - protein, 8 aa, BORRELIA GARINII PBI
LDFASFVA

SEQ ID NO: 150907 - protein, 8 aa, BORRELIA GARINII PBI
DFASFVAF

SEQ ID NO: 150908 - protein, 8 aa, BORRELIA GARINII PBI
FASFVAFK

SEQ ID NO: 150909 - protein, 8 aa, BORRELIA GARINII PBI
ASFVAFKE

SEQ ID NO: 150910 - protein, 8 aa, BORRELIA GARINII PBI
SFVAFKEY

SEQ ID NO: 150911 - protein, 8 aa, BORRELIA GARINII PBI
FVAFKEYF

SEQ ID NO: 150912 - protein, 8 aa, BORRELIA GARINII PBI
VAFKEYFL

SEQ ID NO: 150913 - protein, 8 aa, BORRELIA GARINII PBI
AFKEYFLK

SEQ ID NO: 150914 - protein, 8 aa, BORRELIA GARINII PBI
FKEYFLKD

SEQ ID NO: 150915 - protein, 8 aa, BORRELIA GARINII PBI
KEYFLKDS

SEQ ID NO: 150916 - protein, 8 aa, BORRELIA GARINII PBI
EYFLKDSR

SEQ ID NO: 150917 - protein, 8 aa, BORRELIA GARINII PBI
YFLKDSRD

SEQ ID NO: 150918 - protein, 8 aa, BORRELIA GARINII PBI
FLKDSRDA

SEQ ID NO: 150919 - protein, 8 aa, BORRELIA GARINII PBI
LKDSRDAF

SEQ ID NO: 150920 - protein, 8 aa, BORRELIA GARINII PBI
KDSRDAFN

SEQ ID NO: 150921 - protein, 8 aa, BORRELIA GARINII PBI
DSRDAFNV

SEQ ID NO: 150922 - protein, 8 aa, BORRELIA GARINII PBI
SRDAFNVL

SEQ ID NO: 150923 - protein, 8 aa, BORRELIA GARINII PBI
RDAFNVLF

SEQ ID NO: 150924 - protein, 8 aa, BORRELIA GARINII PBI
DAFNVLFD

SEQ ID NO: 150925 - protein, 8 aa, BORRELIA GARINII PBI
AFNVLFDR

SEQ ID NO: 150926 - protein, 8 aa, BORRELIA GARINII PBI
FNVLFDRG

SEQ ID NO: 150927 - protein, 8 aa, BORRELIA GARINII PBI
NVLFDRGI

SEQ ID NO: 150928 - protein, 8 aa, BORRELIA GARINII PBI
VLFDRGIL

SEQ ID NO: 150929 - protein, 8 aa, BORRELIA GARINII PBI
LFDRGILI

SEQ ID NO: 150930 - protein, 8 aa, BORRELIA GARINII PBI
FDRGILIR

SEQ ID NO: 150931 - protein, 8 aa, BORRELIA GARINII PBI
DRGILIRN

SEQ ID NO: 150932 - protein, 8 aa, BORRELIA GARINII PBI
RGILIRNE

SEQ ID NO: 150933 - protein, 8 aa, BORRELIA GARINII PBI
GILIRNEK

SEQ ID NO: 150934 - protein, 8 aa, BORRELIA GARINII PBI
ILIRNEKD

SEQ ID NO: 150935 - protein, 8 aa, BORRELIA GARINII PBI
LIRNEKDL

SEQ ID NO: 150936 - protein, 8 aa, BORRELIA GARINII PBI
IRNEKDLF

SEQ ID NO: 150937 - protein, 8 aa, BORRELIA GARINII PBI
RNEKDLFK

SEQ ID NO: 150938 - protein, 8 aa, BORRELIA GARINII PBI
NEKDLFKL

SEQ ID NO: 150939 - protein, 8 aa, BORRELIA GARINII PBI
EKDLFKLR

SEQ ID NO: 150940 - protein, 8 aa, BORRELIA GARINII PBI
KDLFKLRN

SEQ ID NO: 150941 - protein, 8 aa, BORRELIA GARINII PBI
DLFKLRNI

SEQ ID NO: 150942 - protein, 8 aa, BORRELIA GARINII PBI
LFKLRNIL

SEQ ID NO: 150943 - protein, 8 aa, BORRELIA GARINII PBI
FKLRNILS

SEQ ID NO: 150944 - protein, 8 aa, BORRELIA GARINII PBI
KLRNILSK

SEQ ID NO: 150945 - protein, 8 aa, BORRELIA GARINII PBI
LRNILSKE

SEQ ID NO: 150946 - protein, 8 aa, BORRELIA GARINII PBI
RNILSKEI

SEQ ID NO: 150947 - protein, 8 aa, BORRELIA GARINII PBI
NILSKEIK

SEQ ID NO: 150948 - protein, 8 aa, BORRELIA GARINII PBI
ILSKEIKV

SEQ ID NO: 150949 - protein, 8 aa, BORRELIA GARINII PBI
LSKEIKVQ

SEQ ID NO: 150950 - protein, 8 aa, BORRELIA GARINII PBI
SKEIKVQE

SEQ ID NO: 150951 - protein, 8 aa, BORRELIA GARINII PBI
KEIKVQEV

SEQ ID NO: 150952 - protein, 8 aa, BORRELIA GARINII PBI
EIKVQEVL

SEQ ID NO: 150953 - protein, 8 aa, BORRELIA GARINII PBI
IKVQEVLQ

SEQ ID NO: 150954 - protein, 8 aa, BORRELIA GARINII PBI
KVQEVLQY

SEQ ID NO: 150955 - protein, 8 aa, BORRELIA GARINII PBI
VQEVLQYF

SEQ ID NO: 150956 - protein, 8 aa, BORRELIA GARINII PBI
QEVLQYFF

SEQ ID NO: 150957 - protein, 8 aa, BORRELIA GARINII PBI
EVLQYFFF

SEQ ID NO: 150958 - protein, 8 aa, BORRELIA GARINII PBI
VLQYFFFS

SEQ ID NO: 150959 - protein, 8 aa, BORRELIA GARINII PBI
LQYFFFSQ

SEQ ID NO: 150960 - protein, 8 aa, BORRELIA GARINII PBI
QYFFFSQF

SEQ ID NO: 150961 - protein, 8 aa, BORRELIA GARINII PBI
YFFFSQFQ

SEQ ID NO: 150962 - protein, 8 aa, BORRELIA GARINII PBI
FFFSQFQA

SEQ ID NO: 150963 - protein, 8 aa, BORRELIA GARINII PBI
FFSQFQAL

SEQ ID NO: 150964 - protein, 8 aa, BORRELIA GARINII PBI
FSQFQALK

SEQ ID NO: 150965 - protein, 8 aa, BORRELIA GARINII PBI
SQFQALKR

SEQ ID NO: 150966 - protein, 8 aa, BORRELIA GARINII PBI
QFQALKRY

SEQ ID NO: 150967 - protein, 8 aa, BORRELIA GARINII PBI
FQALKRYA

SEQ ID NO: 150968 - protein, 8 aa, BORRELIA GARINII PBI
QALKRYAN

SEQ ID NO: 150969 - protein, 8 aa, BORRELIA GARINII PBI
ALKRYAND

SEQ ID NO: 150970 - protein, 8 aa, BORRELIA GARINII PBI
LKRYANDK

SEQ ID NO: 150971 - protein, 8 aa, BORRELIA GARINII PBI
KRYANDKG

SEQ ID NO: 150972 - protein, 8 aa, BORRELIA GARINII PBI
RYANDKGI

SEQ ID NO: 150973 - protein, 8 aa, BORRELIA GARINII PBI
YANDKGIE

SEQ ID NO: 150974 - protein, 8 aa, BORRELIA GARINII PBI
ANDKGIEL

SEQ ID NO: 150975 - protein, 8 aa, BORRELIA GARINII PBI
NDKGIELV

SEQ ID NO: 150976 - protein, 8 aa, BORRELIA GARINII PBI
DKGIELVM

SEQ ID NO: 150977 - protein, 8 aa, BORRELIA GARINII PBI
KGIELVMN

SEQ ID NO: 150978 - protein, 8 aa, BORRELIA GARINII PBI
GIELVMNL

SEQ ID NO: 150979 - protein, 8 aa, BORRELIA GARINII PBI
IELVMNLP

SEQ ID NO: 150980 - protein, 8 aa, BORRELIA GARINII PBI
ELVMNLPL

SEQ ID NO: 150981 - protein, 8 aa, BORRELIA GARINII PBI
LVMNLPLF

SEQ ID NO: 150982 - protein, 8 aa, BORRELIA GARINII PBI
VMNLPLFI

SEQ ID NO: 150983 - protein, 8 aa, BORRELIA GARINII PBI
MNLPLFIA

SEQ ID NO: 150984 - protein, 8 aa, BORRELIA GARINII PBI
NLPLFIAY

SEQ ID NO: 150985 - protein, 8 aa, BORRELIA GARINII PBI
LPLFIAYD

SEQ ID NO: 150986 - protein, 8 aa, BORRELIA GARINII PBI
PLFIAYDS

SEQ ID NO: 150987 - protein, 8 aa, BORRELIA GARINII PBI
LFIAYDSA

SEQ ID NO: 150988 - protein, 8 aa, BORRELIA GARINII PBI
FIAYDSAD

SEQ ID NO: 150989 - protein, 8 aa, BORRELIA GARINII PBI
IAYDSADV

SEQ ID NO: 150990 - protein, 8 aa, BORRELIA GARINII PBI
AYDSADVW

SEQ ID NO: 150991 - protein, 8 aa, BORRELIA GARINII PBI
YDSADVWA

SEQ ID NO: 150992 - protein, 8 aa, BORRELIA GARINII PBI
DSADVWAH

SEQ ID NO: 150993 - protein, 8 aa, BORRELIA GARINII PBI
SADVWAHQ

SEQ ID NO: 150994 - protein, 8 aa, BORRELIA GARINII PBI
ADVWAHQK

SEQ ID NO: 150995 - protein, 8 aa, BORRELIA GARINII PBI
DVWAHQKY

SEQ ID NO: 150996 - protein, 8 aa, BORRELIA GARINII PBI
VWAHQKYF

SEQ ID NO: 150997 - protein, 8 aa, BORRELIA GARINII PBI
WAHQKYFK

SEQ ID NO: 150998 - protein, 8 aa, BORRELIA GARINII PBI
AHQKYFKL

SEQ ID NO: 150999 - protein, 8 aa, BORRELIA GARINII PBI
HQKYFKLR

SEQ ID NO: 151000 - protein, 8 aa, BORRELIA GARINII PBI
QKYFKLRF

SEQ ID NO: 151001 - protein, 8 aa, BORRELIA GARINII PBI
KYFKLRFD

SEQ ID NO: 151002 - protein, 8 aa, BORRELIA GARINII PBI
YFKLRFDA

SEQ ID NO: 151003 - protein, 8 aa, BORRELIA GARINII PBI
FKLRFDAS

SEQ ID NO: 151004 - protein, 8 aa, BORRELIA GARINII PBI
KLRFDASK

SEQ ID NO: 151005 - protein, 8 aa, BORRELIA GARINII PBI
LRFDASKD

SEQ ID NO: 151006 - protein, 8 aa, BORRELIA GARINII PBI
RFDASKDK

SEQ ID NO: 151007 - protein, 8 aa, BORRELIA GARINII PBI
FDASKDKV

SEQ ID NO: 151008 - protein, 8 aa, BORRELIA GARINII PBI
DASKDKVA

SEQ ID NO: 151009 - protein, 8 aa, BORRELIA GARINII PBI
ASKDKVAG

SEQ ID NO: 151010 - protein, 8 aa, BORRELIA GARINII PBI
SKDKVAGI

SEQ ID NO: 151011 - protein, 8 aa, BORRELIA GARINII PBI
KDKVAGIS

SEQ ID NO: 151012 - protein, 8 aa, BORRELIA GARINII PBI
DKVAGISP

SEQ ID NO: 151013 - protein, 8 aa, BORRELIA GARINII PBI
KVAGISPD

SEQ ID NO: 151014 - protein, 8 aa, BORRELIA GARINII PBI
VAGISPDY

SEQ ID NO: 151015 - protein, 8 aa, BORRELIA GARINII PBI
AGISPDYF

SEQ ID NO: 151016 - protein, 8 aa, BORRELIA GARINII PBI
GISPDYFL

SEQ ID NO: 151017 - protein, 8 aa, BORRELIA GARINII PBI
ISPDYFLE

SEQ ID NO: 151018 - protein, 8 aa, BORRELIA GARINII PBI
SPDYFLEQ

SEQ ID NO: 151019 - protein, 8 aa, BORRELIA GARINII PBI
PDYFLEQE

SEQ ID NO: 151020 - protein, 8 aa, BORRELIA GARINII PBI
DYFLEQEQ

SEQ ID NO: 151021 - protein, 8 aa, BORRELIA GARINII PBI
YFLEQEQA

SEQ ID NO: 151022 - protein, 8 aa, BORRELIA GARINII PBI
FLEQEQAW

SEQ ID NO: 151023 - protein, 8 aa, BORRELIA GARINII PBI
LEQEQAWD

SEQ ID NO: 151024 - protein, 8 aa, BORRELIA GARINII PBI
EQEQAWDS

SEQ ID NO: 151025 - protein, 8 aa, BORRELIA GARINII PBI
QEQAWDSP

SEQ ID NO: 151026 - protein, 8 aa, BORRELIA GARINII PBI
EQAWDSPA

SEQ ID NO: 151027 - protein, 8 aa, BORRELIA GARINII PBI
QAWDSPAY

SEQ ID NO: 151028 - protein, 8 aa, BORRELIA GARINII PBI
AWDSPAYS

SEQ ID NO: 151029 - protein, 8 aa, BORRELIA GARINII PBI
WDSPAYSW

SEQ ID NO: 151030 - protein, 8 aa, BORRELIA GARINII PBI
DSPAYSWN

SEQ ID NO: 151031 - protein, 8 aa, BORRELIA GARINII PBI
SPAYSWNV

SEQ ID NO: 151032 - protein, 8 aa, BORRELIA GARINII PBI
PAYSWNVL

SEQ ID NO: 151033 - protein, 8 aa, BORRELIA GARINII PBI
AYSWNVLK

SEQ ID NO: 151034 - protein, 8 aa, BORRELIA GARINII PBI
YSWNVLKN

SEQ ID NO: 151035 - protein, 8 aa, BORRELIA GARINII PBI
SWNVLKNV

SEQ ID NO: 151036 - protein, 8 aa, BORRELIA GARINII PBI
WNVLKNVK

SEQ ID NO: 151037 - protein, 8 aa, BORRELIA GARINII PBI
NVLKNVKY

SEQ ID NO: 151038 - protein, 8 aa, BORRELIA GARINII PBI
VLKNVKYE

SEQ ID NO: 151039 - protein, 8 aa, BORRELIA GARINII PBI
LKNVKYEW

SEQ ID NO: 151040 - protein, 8 aa, BORRELIA GARINII PBI
KNVKYEWW

SEQ ID NO: 151041 - protein, 8 aa, BORRELIA GARINII PBI
NVKYEWWA

SEQ ID NO: 151042 - protein, 8 aa, BORRELIA GARINII PBI
VKYEWWAK

SEQ ID NO: 151043 - protein, 8 aa, BORRELIA GARINII PBI
KYEWWAKR

SEQ ID NO: 151044 - protein, 8 aa, BORRELIA GARINII PBI
YEWWAKRI

SEQ ID NO: 151045 - protein, 8 aa, BORRELIA GARINII PBI
EWWAKRIG

SEQ ID NO: 151046 - protein, 8 aa, BORRELIA GARINII PBI
WWAKRIGI

SEQ ID NO: 151047 - protein, 8 aa, BORRELIA GARINII PBI
WAKRIGIL

SEQ ID NO: 151048 - protein, 8 aa, BORRELIA GARINII PBI
AKRIGILR

SEQ ID NO: 151049 - protein, 8 aa, BORRELIA GARINII PBI
KRIGILRK

SEQ ID NO: 151050 - protein, 8 aa, BORRELIA GARINII PBI
RIGILRKY

SEQ ID NO: 151051 - protein, 8 aa, BORRELIA GARINII PBI
IGILRKYI

SEQ ID NO: 151052 - protein, 8 aa, BORRELIA GARINII PBI
GILRKYID

SEQ ID NO: 151053 - protein, 8 aa, BORRELIA GARINII PBI
ILRKYIDV

SEQ ID NO: 151054 - protein, 8 aa, BORRELIA GARINII PBI
LRKYIDVI

SEQ ID NO: 151055 - protein, 8 aa, BORRELIA GARINII PBI
RKYIDVIK

SEQ ID NO: 151056 - protein, 8 aa, BORRELIA GARINII PBI
KYIDVIKI

SEQ ID NO: 151057 - protein, 8 aa, BORRELIA GARINII PBI
YIDVIKID

SEQ ID NO: 151058 - protein, 8 aa, BORRELIA GARINII PBI
IDVIKIDH

SEQ ID NO: 151059 - protein, 8 aa, BORRELIA GARINII PBI
DVIKIDHF

SEQ ID NO: 151060 - protein, 8 aa, BORRELIA GARINII PBI
VIKIDHFR

SEQ ID NO: 151061 - protein, 8 aa, BORRELIA GARINII PBI
IKIDHFRG

SEQ ID NO: 151062 - protein, 8 aa, BORRELIA GARINII PBI
KIDHFRGF

SEQ ID NO: 151063 - protein, 8 aa, BORRELIA GARINII PBI
IDHFRGFV

SEQ ID NO: 151064 - protein, 8 aa, BORRELIA GARINII PBI
DHFRGFVS

SEQ ID NO: 151065 - protein, 8 aa, BORRELIA GARINII PBI
HFRGFVST

SEQ ID NO: 151066 - protein, 8 aa, BORRELIA GARINII PBI
FRGFVSTW

SEQ ID NO: 151067 - protein, 8 aa, BORRELIA GARINII PBI
RGFVSTWE

SEQ ID NO: 151068 - protein, 8 aa, BORRELIA GARINII PBI
GFVSTWEV

SEQ ID NO: 151069 - protein, 8 aa, BORRELIA GARINII PBI
FVSTWEVG

SEQ ID NO: 151070 - protein, 8 aa, BORRELIA GARINII PBI
VSTWEVGV

SEQ ID NO: 151071 - protein, 8 aa, BORRELIA GARINII PBI
STWEVGVG

SEQ ID NO: 151072 - protein, 8 aa, BORRELIA GARINII PBI
TWEVGVGE

SEQ ID NO: 151073 - protein, 8 aa, BORRELIA GARINII PBI
WEVGVGEA

SEQ ID NO: 151074 - protein, 8 aa, BORRELIA GARINII PBI
EVGVGEAY

SEQ ID NO: 151075 - protein, 8 aa, BORRELIA GARINII PBI
VGVGEAYA

SEQ ID NO: 151076 - protein, 8 aa, BORRELIA GARINII PBI
GVGEAYAF

SEQ ID NO: 151077 - protein, 8 aa, BORRELIA GARINII PBI
VGEAYAFN

SEQ ID NO: 151078 - protein, 8 aa, BORRELIA GARINII PBI
GEAYAFNG

SEQ ID NO: 151079 - protein, 8 aa, BORRELIA GARINII PBI
EAYAFNGL

SEQ ID NO: 151080 - protein, 8 aa, BORRELIA GARINII PBI
AYAFNGLW

SEQ ID NO: 151081 - protein, 8 aa, BORRELIA GARINII PBI
YAFNGLWV

SEQ ID NO: 151082 - protein, 8 aa, BORRELIA GARINII PBI
AFNGLWVK

SEQ ID NO: 151083 - protein, 8 aa, BORRELIA GARINII PBI
FNGLWVKS

SEQ ID NO: 151084 - protein, 8 aa, BORRELIA GARINII PBI
NGLWVKSP

SEQ ID NO: 151085 - protein, 8 aa, BORRELIA GARINII PBI
GLWVKSPG

SEQ ID NO: 151086 - protein, 8 aa, BORRELIA GARINII PBI
LWVKSPGR

SEQ ID NO: 151087 - protein, 8 aa, BORRELIA GARINII PBI
WVKSPGRD

SEQ ID NO: 151088 - protein, 8 aa, BORRELIA GARINII PBI
VKSPGRDF

SEQ ID NO: 151089 - protein, 8 aa, BORRELIA GARINII PBI
KSPGRDFF

SEQ ID NO: 151090 - protein, 8 aa, BORRELIA GARINII PBI
SPGRDFFN

SEQ ID NO: 151091 - protein, 8 aa, BORRELIA GARINII PBI
PGRDFFNF

SEQ ID NO: 151092 - protein, 8 aa, BORRELIA GARINII PBI
GRDFFNFI

SEQ ID NO: 151093 - protein, 8 aa, BORRELIA GARINII PBI
RDFFNFIL

SEQ ID NO: 151094 - protein, 8 aa, BORRELIA GARINII PBI
DFFNFILN

SEQ ID NO: 151095 - protein, 8 aa, BORRELIA GARINII PBI
FFNFILNE

SEQ ID NO: 151096 - protein, 8 aa, BORRELIA GARINII PBI
FNFILNEI

SEQ ID NO: 151097 - protein, 8 aa, BORRELIA GARINII PBI
NFILNEIK

SEQ ID NO: 151098 - protein, 8 aa, BORRELIA GARINII PBI
FILNEIKD

SEQ ID NO: 151099 - protein, 8 aa, BORRELIA GARINII PBI
ILNEIKDL

SEQ ID NO: 151100 - protein, 8 aa, BORRELIA GARINII PBI
LNEIKDLK

SEQ ID NO: 151101 - protein, 8 aa, BORRELIA GARINII PBI
NEIKDLKI

SEQ ID NO: 151102 - protein, 8 aa, BORRELIA GARINII PBI
EIKDLKIW

SEQ ID NO: 151103 - protein, 8 aa, BORRELIA GARINII PBI
IKDLKIWV

SEQ ID NO: 151104 - protein, 8 aa, BORRELIA GARINII PBI
KDLKIWVE

SEQ ID NO: 151105 - protein, 8 aa, BORRELIA GARINII PBI
DLKIWVED

SEQ ID NO: 151106 - protein, 8 aa, BORRELIA GARINII PBI
LKIWVEDF

SEQ ID NO: 151107 - protein, 8 aa, BORRELIA GARINII PBI
KIWVEDFE

SEQ ID NO: 151108 - protein, 8 aa, BORRELIA GARINII PBI
IWVEDFEN

SEQ ID NO: 151109 - protein, 8 aa, BORRELIA GARINII PBI
WVEDFEND

SEQ ID NO: 151110 - protein, 8 aa, BORRELIA GARINII PBI
VEDFENDL

SEQ ID NO: 151111 - protein, 8 aa, BORRELIA GARINII PBI
EDFENDLE

SEQ ID NO: 151112 - protein, 8 aa, BORRELIA GARINII PBI
DFENDLED

SEQ ID NO: 151113 - protein, 8 aa, BORRELIA GARINII PBI
FENDLEDV

SEQ ID NO: 151114 - protein, 8 aa, BORRELIA GARINII PBI
ENDLEDVS

SEQ ID NO: 151115 - protein, 8 aa, BORRELIA GARINII PBI
NDLEDVSR

SEQ ID NO: 151116 - protein, 8 aa, BORRELIA GARINII PBI
DLEDVSRL

SEQ ID NO: 151117 - protein, 8 aa, BORRELIA GARINII PBI
LEDVSRLR

SEQ ID NO: 151118 - protein, 8 aa, BORRELIA GARINII PBI
EDVSRLRD

SEQ ID NO: 151119 - protein, 8 aa, BORRELIA GARINII PBI
DVSRLRDF

SEQ ID NO: 151120 - protein, 8 aa, BORRELIA GARINII PBI
VSRLRDFF

SEQ ID NO: 151121 - protein, 8 aa, BORRELIA GARINII PBI
SRLRDFFN

SEQ ID NO: 151122 - protein, 8 aa, BORRELIA GARINII PBI
RLRDFFNF

SEQ ID NO: 151123 - protein, 8 aa, BORRELIA GARINII PBI
LRDFFNFP

SEQ ID NO: 151124 - protein, 8 aa, BORRELIA GARINII PBI
RDFFNFPG

SEQ ID NO: 151125 - protein, 8 aa, BORRELIA GARINII PBI
DFFNFPGM

SEQ ID NO: 151126 - protein, 8 aa, BORRELIA GARINII PBI
FFNFPGMR

SEQ ID NO: 151127 - protein, 8 aa, BORRELIA GARINII PBI
FNFPGMRI

SEQ ID NO: 151128 - protein, 8 aa, BORRELIA GARINII PBI
NFPGMRIM

SEQ ID NO: 151129 - protein, 8 aa, BORRELIA GARINII PBI
FPGMRIMK

SEQ ID NO: 151130 - protein, 8 aa, BORRELIA GARINII PBI
PGMRIMKL

SEQ ID NO: 151131 - protein, 8 aa, BORRELIA GARINII PBI
GMRIMKLA

SEQ ID NO: 151132 - protein, 8 aa, BORRELIA GARINII PBI
MRIMKLAF

SEQ ID NO: 151133 - protein, 8 aa, BORRELIA GARINII PBI
RIMKLAFD

SEQ ID NO: 151134 - protein, 8 aa, BORRELIA GARINII PBI
IMKLAFDF

SEQ ID NO: 151135 - protein, 8 aa, BORRELIA GARINII PBI
MKLAFDFD

SEQ ID NO: 151136 - protein, 8 aa, BORRELIA GARINII PBI
KLAFDFDS

SEQ ID NO: 151137 - protein, 8 aa, BORRELIA GARINII PBI
LAFDFDSD

SEQ ID NO: 151138 - protein, 8 aa, BORRELIA GARINII PBI
AFDFDSDN

SEQ ID NO: 151139 - protein, 8 aa, BORRELIA GARINII PBI
FDFDSDNQ

SEQ ID NO: 151140 - protein, 8 aa, BORRELIA GARINII PBI
DFDSDNQN

SEQ ID NO: 151141 - protein, 8 aa, BORRELIA GARINII PBI
FDSDNQNL

SEQ ID NO: 151142 - protein, 8 aa, BORRELIA GARINII PBI
DSDNQNLP

SEQ ID NO: 151143 - protein, 8 aa, BORRELIA GARINII PBI
SDNQNLPH

SEQ ID NO: 151144 - protein, 8 aa, BORRELIA GARINII PBI
DNQNLPHN

SEQ ID NO: 151145 - protein, 8 aa, BORRELIA GARINII PBI
NQNLPHNY

SEQ ID NO: 151146 - protein, 8 aa, BORRELIA GARINII PBI
QNLPHNYI

SEQ ID NO: 151147 - protein, 8 aa, BORRELIA GARINII PBI
NLPHNYIK

SEQ ID NO: 151148 - protein, 8 aa, BORRELIA GARINII PBI
LPHNYIKN

SEQ ID NO: 151149 - protein, 8 aa, BORRELIA GARINII PBI
PHNYIKNC

SEQ ID NO: 151150 - protein, 8 aa, BORRELIA GARINII PBI
HNYIKNCI

SEQ ID NO: 151151 - protein, 8 aa, BORRELIA GARINII PBI
NYIKNCIV

SEQ ID NO: 151152 - protein, 8 aa, BORRELIA GARINII PBI
YIKNCIVY

SEQ ID NO: 151153 - protein, 8 aa, BORRELIA GARINII PBI
IKNCIVYT

SEQ ID NO: 151154 - protein, 8 aa, BORRELIA GARINII PBI
KNCIVYTG

SEQ ID NO: 151155 - protein, 8 aa, BORRELIA GARINII PBI
NCIVYTGI

SEQ ID NO: 151156 - protein, 8 aa, BORRELIA GARINII PBI
CIVYTGIG

SEQ ID NO: 151157 - protein, 8 aa, BORRELIA GARINII PBI
IVYTGIGD

SEQ ID NO: 151158 - protein, 8 aa, BORRELIA GARINII PBI
VYTGIGDN

SEQ ID NO: 151159 - protein, 8 aa, BORRELIA GARINII PBI
YTGIGDNS

SEQ ID NO: 151160 - protein, 8 aa, BORRELIA GARINII PBI
TGIGDNST

SEQ ID NO: 151161 - protein, 8 aa, BORRELIA GARINII PBI
GIGDNSTI

SEQ ID NO: 151162 - protein, 8 aa, BORRELIA GARINII PBI
IGDNSTIR

SEQ ID NO: 151163 - protein, 8 aa, BORRELIA GARINII PBI
GDNSTIRE

SEQ ID NO: 151164 - protein, 8 aa, BORRELIA GARINII PBI
DNSTIREF

SEQ ID NO: 151165 - protein, 8 aa, BORRELIA GARINII PBI
NSTIREFV

SEQ ID NO: 151166 - protein, 8 aa, BORRELIA GARINII PBI
STIREFVN

SEQ ID NO: 151167 - protein, 8 aa, BORRELIA GARINII PBI
TIREFVNS

SEQ ID NO: 151168 - protein, 8 aa, BORRELIA GARINII PBI
IREFVNSL

SEQ ID NO: 151169 - protein, 8 aa, BORRELIA GARINII PBI
REFVNSLD

SEQ ID NO: 151170 - protein, 8 aa, BORRELIA GARINII PBI
EFVNSLDD

SEQ ID NO: 151171 - protein, 8 aa, BORRELIA GARINII PBI
FVNSLDDL

SEQ ID NO: 151172 - protein, 8 aa, BORRELIA GARINII PBI
VNSLDDLH

SEQ ID NO: 151173 - protein, 8 aa, BORRELIA GARINII PBI
NSLDDLHK

SEQ ID NO: 151174 - protein, 8 aa, BORRELIA GARINII PBI
SLDDLHKK

SEQ ID NO: 151175 - protein, 8 aa, BORRELIA GARINII PBI
LDDLHKKY

SEQ ID NO: 151176 - protein, 8 aa, BORRELIA GARINII PBI
DDLHKKYI

SEQ ID NO: 151177 - protein, 8 aa, BORRELIA GARINII PBI
DLHKKYIF

SEQ ID NO: 151178 - protein, 8 aa, BORRELIA GARINII PBI
LHKKYIFD

SEQ ID NO: 151179 - protein, 8 aa, BORRELIA GARINII PBI
HKKYIFDY

SEQ ID NO: 151180 - protein, 8 aa, BORRELIA GARINII PBI
KKYIFDYL

SEQ ID NO: 151181 - protein, 8 aa, BORRELIA GARINII PBI
KYIFDYLN

SEQ ID NO: 151182 - protein, 8 aa, BORRELIA GARINII PBI
YIFDYLNT

SEQ ID NO: 151183 - protein, 8 aa, BORRELIA GARINII PBI
IFDYLNTN

SEQ ID NO: 151184 - protein, 8 aa, BORRELIA GARINII PBI
FDYLNTNE

SEQ ID NO: 151185 - protein, 8 aa, BORRELIA GARINII PBI
DYLNTNED

SEQ ID NO: 151186 - protein, 8 aa, BORRELIA GARINII PBI
YLNTNEDF

SEQ ID NO: 151187 - protein, 8 aa, BORRELIA GARINII PBI
LNTNEDFV

SEQ ID NO: 151188 - protein, 8 aa, BORRELIA GARINII PBI
NTNEDFVV

SEQ ID NO: 151189 - protein, 8 aa, BORRELIA GARINII PBI
TNEDFVVW

SEQ ID NO: 151190 - protein, 8 aa, BORRELIA GARINII PBI
NEDFVVWD

SEQ ID NO: 151191 - protein, 8 aa, BORRELIA GARINII PBI
EDFVVWDM

SEQ ID NO: 151192 - protein, 8 aa, BORRELIA GARINII PBI
DFVVWDMI

SEQ ID NO: 151193 - protein, 8 aa, BORRELIA GARINII PBI
FVVWDMIR

SEQ ID NO: 151194 - protein, 8 aa, BORRELIA GARINII PBI
VVWDMIRS

SEQ ID NO: 151195 - protein, 8 aa, BORRELIA GARINII PBI
VWDMIRSA

SEQ ID NO: 151196 - protein, 8 aa, BORRELIA GARINII PBI
WDMIRSAM

SEQ ID NO: 151197 - protein, 8 aa, BORRELIA GARINII PBI
DMIRSAMS

SEQ ID NO: 151198 - protein, 8 aa, BORRELIA GARINII PBI
MIRSAMSS

SEQ ID NO: 151199 - protein, 8 aa, BORRELIA GARINII PBI
IRSAMSSV

SEQ ID NO: 151200 - protein, 8 aa, BORRELIA GARINII PBI
RSAMSSVS

SEQ ID NO: 151201 - protein, 8 aa, BORRELIA GARINII PBI
SAMSSVSD

SEQ ID NO: 151202 - protein, 8 aa, BORRELIA GARINII PBI
AMSSVSDS

SEQ ID NO: 151203 - protein, 8 aa, BORRELIA GARINII PBI
MSSVSDSV

SEQ ID NO: 151204 - protein, 8 aa, BORRELIA GARINII PBI
SSVSDSVI

SEQ ID NO: 151205 - protein, 8 aa, BORRELIA GARINII PBI
SVSDSVII

SEQ ID NO: 151206 - protein, 8 aa, BORRELIA GARINII PBI
VSDSVIIP

SEQ ID NO: 151207 - protein, 8 aa, BORRELIA GARINII PBI
SDSVIIPM

SEQ ID NO: 151208 - protein, 8 aa, BORRELIA GARINII PBI
DSVIIPMQ

SEQ ID NO: 151209 - protein, 8 aa, BORRELIA GARINII PBI
SVIIPMQD

SEQ ID NO: 151210 - protein, 8 aa, BORRELIA GARINII PBI
VIIPMQDY

SEQ ID NO: 151211 - protein, 8 aa, BORRELIA GARINII PBI
IIPMQDYI

SEQ ID NO: 151212 - protein, 8 aa, BORRELIA GARINII PBI
IPMQDYIN

SEQ ID NO: 151213 - protein, 8 aa, BORRELIA GARINII PBI
PMQDYINL

SEQ ID NO: 151214 - protein, 8 aa, BORRELIA GARINII PBI
MQDYINLG

SEQ ID NO: 151215 - protein, 8 aa, BORRELIA GARINII PBI
QDYINLGN

SEQ ID NO: 151216 - protein, 8 aa, BORRELIA GARINII PBI
DYINLGNE

SEQ ID NO: 151217 - protein, 8 aa, BORRELIA GARINII PBI
YINLGNEF

SEQ ID NO: 151218 - protein, 8 aa, BORRELIA GARINII PBI
INLGNEFR

SEQ ID NO: 151219 - protein, 8 aa, BORRELIA GARINII PBI
NLGNEFRA

SEQ ID NO: 151220 - protein, 8 aa, BORRELIA GARINII PBI
LGNEFRAN

SEQ ID NO: 151221 - protein, 8 aa, BORRELIA GARINII PBI
GNEFRANI

SEQ ID NO: 151222 - protein, 8 aa, BORRELIA GARINII PBI
NEFRANIP

SEQ ID NO: 151223 - protein, 8 aa, BORRELIA GARINII PBI
EFRANIPK

SEQ ID NO: 151224 - protein, 8 aa, BORRELIA GARINII PBI
FRANIPKN

SEQ ID NO: 151225 - protein, 8 aa, BORRELIA GARINII PBI
RANIPKNT

SEQ ID NO: 151226 - protein, 8 aa, BORRELIA GARINII PBI
ANIPKNTL

SEQ ID NO: 151227 - protein, 8 aa, BORRELIA GARINII PBI
NIPKNTLN

SEQ ID NO: 151228 - protein, 8 aa, BORRELIA GARINII PBI
IPKNTLNN

SEQ ID NO: 151229 - protein, 8 aa, BORRELIA GARINII PBI
PKNTLNNW

SEQ ID NO: 151230 - protein, 8 aa, BORRELIA GARINII PBI
KNTLNNWI

SEQ ID NO: 151231 - protein, 8 aa, BORRELIA GARINII PBI
NTLNNWIF

SEQ ID NO: 151232 - protein, 8 aa, BORRELIA GARINII PBI
TLNNWIFR

SEQ ID NO: 151233 - protein, 8 aa, BORRELIA GARINII PBI
LNNWIFRL

SEQ ID NO: 151234 - protein, 8 aa, BORRELIA GARINII PBI
NNWIFRLL

SEQ ID NO: 151235 - protein, 8 aa, BORRELIA GARINII PBI
NWIFRLLE

SEQ ID NO: 151236 - protein, 8 aa, BORRELIA GARINII PBI
WIFRLLES

SEQ ID NO: 151237 - protein, 8 aa, BORRELIA GARINII PBI
IFRLLESD

SEQ ID NO: 151238 - protein, 8 aa, BORRELIA GARINII PBI
FRLLESDL

SEQ ID NO: 151239 - protein, 8 aa, BORRELIA GARINII PBI
RLLESDLD

SEQ ID NO: 151240 - protein, 8 aa, BORRELIA GARINII PBI
LLESDLDA

SEQ ID NO: 151241 - protein, 8 aa, BORRELIA GARINII PBI
LESDLDAT

SEQ ID NO: 151242 - protein, 8 aa, BORRELIA GARINII PBI
ESDLDATL

SEQ ID NO: 151243 - protein, 8 aa, BORRELIA GARINII PBI
SDLDATLS

SEQ ID NO: 151244 - protein, 8 aa, BORRELIA GARINII PBI
DLDATLSK

SEQ ID NO: 151245 - protein, 8 aa, BORRELIA GARINII PBI
LDATLSKN

SEQ ID NO: 151246 - protein, 8 aa, BORRELIA GARINII PBI
DATLSKNI

SEQ ID NO: 151247 - protein, 8 aa, BORRELIA GARINII PBI
ATLSKNIS

SEQ ID NO: 151248 - protein, 8 aa, BORRELIA GARINII PBI
TLSKNISF

SEQ ID NO: 151249 - protein, 8 aa, BORRELIA GARINII PBI
LSKNISFI

SEQ ID NO: 151250 - protein, 8 aa, BORRELIA GARINII PBI
SKNISFIT

SEQ ID NO: 151251 - protein, 8 aa, BORRELIA GARINII PBI
KNISFITR

SEQ ID NO: 151252 - protein, 8 aa, BORRELIA GARINII PBI
NISFITRL

SEQ ID NO: 151253 - protein, 8 aa, BORRELIA GARINII PBI
ISFITRLY

SEQ ID NO: 151254 - protein, 8 aa, BORRELIA GARINII PBI
SFITRLYG

SEQ ID NO: 151255 - protein, 8 aa, BORRELIA GARINII PBI
FITRLYGR

SEQ ID NO: 151256 - protein, 8 aa, BORRELIA GARINII PBI
ITRLYGRT

SEQ ID NO: 151257 - protein, 9 aa, BORRELIA GARINII PBI
MKYKKIRIN

SEQ ID NO: 151258 - protein, 9 aa, BORRELIA GARINII PBI
KYKKIRINL

SEQ ID NO: 151259 - protein, 9 aa, BORRELIA GARINII PBI
YKKIRINLN

SEQ ID NO: 151260 - protein, 9 aa, BORRELIA GARINII PBI
KKIRINLNL

SEQ ID NO: 151261 - protein, 9 aa, BORRELIA GARINII PBI
KIRINLNLK

SEQ ID NO: 151262 - protein, 9 aa, BORRELIA GARINII PBI
IRINLNLKR

SEQ ID NO: 151263 - protein, 9 aa, BORRELIA GARINII PBI
RINLNLKRK

SEQ ID NO: 151264 - protein, 9 aa, BORRELIA GARINII PBI
INLNLKRKS

SEQ ID NO: 151265 - protein, 9 aa, BORRELIA GARINII PBI
NLNLKRKSG

SEQ ID NO: 151266 - protein, 9 aa, BORRELIA GARINII PBI
LNLKRKSGI

SEQ ID NO: 151267 - protein, 9 aa, BORRELIA GARINII PBI
NLKRKSGIL

SEQ ID NO: 151268 - protein, 9 aa, BORRELIA GARINII PBI
LKRKSGILL

SEQ ID NO: 151269 - protein, 9 aa, BORRELIA GARINII PBI
KRKSGILLN

SEQ ID NO: 151270 - protein, 9 aa, BORRELIA GARINII PBI
RKSGILLNI

SEQ ID NO: 151271 - protein, 9 aa, BORRELIA GARINII PBI
KSGILLNIS

SEQ ID NO: 151272 - protein, 9 aa, BORRELIA GARINII PBI
SGILLNISS

SEQ ID NO: 151273 - protein, 9 aa, BORRELIA GARINII PBI
GILLNISSL

SEQ ID NO: 151274 - protein, 9 aa, BORRELIA GARINII PBI
ILLNISSLP

SEQ ID NO: 151275 - protein, 9 aa, BORRELIA GARINII PBI
LLNISSLPS

SEQ ID NO: 151276 - protein, 9 aa, BORRELIA GARINII PBI
LNISSLPSK

SEQ ID NO: 151277 - protein, 9 aa, BORRELIA GARINII PBI
NISSLPSKY

SEQ ID NO: 151278 - protein, 9 aa, BORRELIA GARINII PBI
ISSLPSKYG

SEQ ID NO: 151279 - protein, 9 aa, BORRELIA GARINII PBI
SSLPSKYGI

SEQ ID NO: 151280 - protein, 9 aa, BORRELIA GARINII PBI
SLPSKYGIG

SEQ ID NO: 151281 - protein, 9 aa, BORRELIA GARINII PBI
LPSKYGIGD

SEQ ID NO: 151282 - protein, 9 aa, BORRELIA GARINII PBI
PSKYGIGDL

SEQ ID NO: 151283 - protein, 9 aa, BORRELIA GARINII PBI
SKYGIGDLG

SEQ ID NO: 151284 - protein, 9 aa, BORRELIA GARINII PBI
KYGIGDLGK

SEQ ID NO: 151285 - protein, 9 aa, BORRELIA GARINII PBI
YGIGDLGKG

SEQ ID NO: 151286 - protein, 9 aa, BORRELIA GARINII PBI
GIGDLGKGA

SEQ ID NO: 151287 - protein, 9 aa, BORRELIA GARINII PBI
IGDLGKGAY

SEQ ID NO: 151288 - protein, 9 aa, BORRELIA GARINII PBI
GDLGKGAYK

SEQ ID NO: 151289 - protein, 9 aa, BORRELIA GARINII PBI
DLGKGAYKF

SEQ ID NO: 151290 - protein, 9 aa, BORRELIA GARINII PBI
LGKGAYKFI

SEQ ID NO: 151291 - protein, 9 aa, BORRELIA GARINII PBI
GKGAYKFID

SEQ ID NO: 151292 - protein, 9 aa, BORRELIA GARINII PBI
KGAYKFIDF

SEQ ID NO: 151293 - protein, 9 aa, BORRELIA GARINII PBI
GAYKFIDFL

SEQ ID NO: 151294 - protein, 9 aa, BORRELIA GARINII PBI
AYKFIDFLF

SEQ ID NO: 151295 - protein, 9 aa, BORRELIA GARINII PBI
YKFIDFLFA

SEQ ID NO: 151296 - protein, 9 aa, BORRELIA GARINII PBI
KFIDFLFAS

SEQ ID NO: 151297 - protein, 9 aa, BORRELIA GARINII PBI
FIDFLFASS

SEQ ID NO: 151298 - protein, 9 aa, BORRELIA GARINII PBI
IDFLFASSQ

SEQ ID NO: 151299 - protein, 9 aa, BORRELIA GARINII PBI
DFLFASSQS

SEQ ID NO: 151300 - protein, 9 aa, BORRELIA GARINII PBI
FLFASSQSY

SEQ ID NO: 151301 - protein, 9 aa, BORRELIA GARINII PBI
LFASSQSYW

SEQ ID NO: 151302 - protein, 9 aa, BORRELIA GARINII PBI
FASSQSYWQ

SEQ ID NO: 151303 - protein, 9 aa, BORRELIA GARINII PBI
ASSQSYWQM

SEQ ID NO: 151304 - protein, 9 aa, BORRELIA GARINII PBI
SSQSYWQMF

SEQ ID NO: 151305 - protein, 9 aa, BORRELIA GARINII PBI
SQSYWQMFA

SEQ ID NO: 151306 - protein, 9 aa, BORRELIA GARINII PBI
QSYWQMFAY

SEQ ID NO: 151307 - protein, 9 aa, BORRELIA GARINII PBI
SYWQMFAYS

SEQ ID NO: 151308 - protein, 9 aa, BORRELIA GARINII PBI
YWQMFAYSP

SEQ ID NO: 151309 - protein, 9 aa, BORRELIA GARINII PBI
WQMFAYSPI

SEQ ID NO: 151310 - protein, 9 aa, BORRELIA GARINII PBI
QMFAYSPID

SEQ ID NO: 151311 - protein, 9 aa, BORRELIA GARINII PBI
MFAYSPIDF

SEQ ID NO: 151312 - protein, 9 aa, BORRELIA GARINII PBI
FAYSPIDFT

SEQ ID NO: 151313 - protein, 9 aa, BORRELIA GARINII PBI
AYSPIDFTR

SEQ ID NO: 151314 - protein, 9 aa, BORRELIA GARINII PBI
YSPIDFTRS

SEQ ID NO: 151315 - protein, 9 aa, BORRELIA GARINII PBI
SPIDFTRSP

SEQ ID NO: 151316 - protein, 9 aa, BORRELIA GARINII PBI
PIDFTRSPP

SEQ ID NO: 151317 - protein, 9 aa, BORRELIA GARINII PBI
IDFTRSPPY

SEQ ID NO: 151318 - protein, 9 aa, BORRELIA GARINII PBI
DFTRSPPYS

SEQ ID NO: 151319 - protein, 9 aa, BORRELIA GARINII PBI
FTRSPPYSI

SEQ ID NO: 151320 - protein, 9 aa, BORRELIA GARINII PBI
TRSPPYSIF

SEQ ID NO: 151321 - protein, 9 aa, BORRELIA GARINII PBI
RSPPYSIFS

SEQ ID NO: 151322 - protein, 9 aa, BORRELIA GARINII PBI
SPPYSIFSA

SEQ ID NO: 151323 - protein, 9 aa, BORRELIA GARINII PBI
PPYSIFSAF

SEQ ID NO: 151324 - protein, 9 aa, BORRELIA GARINII PBI
PYSIFSAFA

SEQ ID NO: 151325 - protein, 9 aa, BORRELIA GARINII PBI
YSIFSAFAG

SEQ ID NO: 151326 - protein, 9 aa, BORRELIA GARINII PBI
SIFSAFAGN

SEQ ID NO: 151327 - protein, 9 aa, BORRELIA GARINII PBI
IFSAFAGNV

SEQ ID NO: 151328 - protein, 9 aa, BORRELIA GARINII PBI
FSAFAGNVY

SEQ ID NO: 151329 - protein, 9 aa, BORRELIA GARINII PBI
SAFAGNVYY

SEQ ID NO: 151330 - protein, 9 aa, BORRELIA GARINII PBI
AFAGNVYYI

SEQ ID NO: 151331 - protein, 9 aa, BORRELIA GARINII PBI
FAGNVYYID

SEQ ID NO: 151332 - protein, 9 aa, BORRELIA GARINII PBI
AGNVYYIDL

SEQ ID NO: 151333 - protein, 9 aa, BORRELIA GARINII PBI
GNVYYIDLE

SEQ ID NO: 151334 - protein, 9 aa, BORRELIA GARINII PBI
NVYYIDLEA

SEQ ID NO: 151335 - protein, 9 aa, BORRELIA GARINII PBI
VYYIDLEAL

SEQ ID NO: 151336 - protein, 9 aa, BORRELIA GARINII PBI
YYIDLEALD

SEQ ID NO: 151337 - protein, 9 aa, BORRELIA GARINII PBI
YIDLEALDK

SEQ ID NO: 151338 - protein, 9 aa, BORRELIA GARINII PBI
IDLEALDKF

SEQ ID NO: 151339 - protein, 9 aa, BORRELIA GARINII PBI
DLEALDKFI

SEQ ID NO: 151340 - protein, 9 aa, BORRELIA GARINII PBI
LEALDKFID

SEQ ID NO: 151341 - protein, 9 aa, BORRELIA GARINII PBI
EALDKFIDS

SEQ ID NO: 151342 - protein, 9 aa, BORRELIA GARINII PBI
ALDKFIDSD

SEQ ID NO: 151343 - protein, 9 aa, BORRELIA GARINII PBI
LDKFIDSDL

SEQ ID NO: 151344 - protein, 9 aa, BORRELIA GARINII PBI
DKFIDSDLN

SEQ ID NO: 151345 - protein, 9 aa, BORRELIA GARINII PBI
KFIDSDLNL

SEQ ID NO: 151346 - protein, 9 aa, BORRELIA GARINII PBI
FIDSDLNLL

SEQ ID NO: 151347 - protein, 9 aa, BORRELIA GARINII PBI
IDSDLNLLK

SEQ ID NO: 151348 - protein, 9 aa, BORRELIA GARINII PBI
DSDLNLLKE

SEQ ID NO: 151349 - protein, 9 aa, BORRELIA GARINII PBI
SDLNLLKEN

SEQ ID NO: 151350 - protein, 9 aa, BORRELIA GARINII PBI
DLNLLKENE

SEQ ID NO: 151351 - protein, 9 aa, BORRELIA GARINII PBI
LNLLKENET

SEQ ID NO: 151352 - protein, 9 aa, BORRELIA GARINII PBI
NLLKENETR

SEQ ID NO: 151353 - protein, 9 aa, BORRELIA GARINII PBI
LLKENETRY

SEQ ID NO: 151354 - protein, 9 aa, BORRELIA GARINII PBI
LKENETRYS

SEQ ID NO: 151355 - protein, 9 aa, BORRELIA GARINII PBI
KENETRYSD

SEQ ID NO: 151356 - protein, 9 aa, BORRELIA GARINII PBI
ENETRYSDL

SEQ ID NO: 151357 - protein, 9 aa, BORRELIA GARINII PBI
NETRYSDLK

SEQ ID NO: 151358 - protein, 9 aa, BORRELIA GARINII PBI
ETRYSDLKK

SEQ ID NO: 151359 - protein, 9 aa, BORRELIA GARINII PBI
TRYSDLKKL

SEQ ID NO: 151360 - protein, 9 aa, BORRELIA GARINII PBI
RYSDLKKLS

SEQ ID NO: 151361 - protein, 9 aa, BORRELIA GARINII PBI
YSDLKKLSF

SEQ ID NO: 151362 - protein, 9 aa, BORRELIA GARINII PBI
SDLKKLSFK

SEQ ID NO: 151363 - protein, 9 aa, BORRELIA GARINII PBI
DLKKLSFKD

SEQ ID NO: 151364 - protein, 9 aa, BORRELIA GARINII PBI
LKKLSFKDK

SEQ ID NO: 151365 - protein, 9 aa, BORRELIA GARINII PBI
KKLSFKDKF

SEQ ID NO: 151366 - protein, 9 aa, BORRELIA GARINII PBI
KLSFKDKFL

SEQ ID NO: 151367 - protein, 9 aa, BORRELIA GARINII PBI
LSFKDKFLK

SEQ ID NO: 151368 - protein, 9 aa, BORRELIA GARINII PBI
SFKDKFLKE

SEQ ID NO: 151369 - protein, 9 aa, BORRELIA GARINII PBI
FKDKFLKEA

SEQ ID NO: 151370 - protein, 9 aa, BORRELIA GARINII PBI
KDKFLKEAA

SEQ ID NO: 151371 - protein, 9 aa, BORRELIA GARINII PBI
DKFLKEAAL

SEQ ID NO: 151372 - protein, 9 aa, BORRELIA GARINII PBI
KFLKEAALN

SEQ ID NO: 151373 - protein, 9 aa, BORRELIA GARINII PBI
FLKEAALNF

SEQ ID NO: 151374 - protein, 9 aa, BORRELIA GARINII PBI
LKEAALNFI

SEQ ID NO: 151375 - protein, 9 aa, BORRELIA GARINII PBI
KEAALNFIN

SEQ ID NO: 151376 - protein, 9 aa, BORRELIA GARINII PBI
EAALNFINR

SEQ ID NO: 151377 - protein, 9 aa, BORRELIA GARINII PBI
AALNFINRA

SEQ ID NO: 151378 - protein, 9 aa, BORRELIA GARINII PBI
ALNFINRAS

SEQ ID NO: 151379 - protein, 9 aa, BORRELIA GARINII PBI
LNFINRASV

SEQ ID NO: 151380 - protein, 9 aa, BORRELIA GARINII PBI
NFINRASVD

SEQ ID NO: 151381 - protein, 9 aa, BORRELIA GARINII PBI
FINRASVDE

SEQ ID NO: 151382 - protein, 9 aa, BORRELIA GARINII PBI
INRASVDEV

SEQ ID NO: 151383 - protein, 9 aa, BORRELIA GARINII PBI
NRASVDEVR

SEQ ID NO: 151384 - protein, 9 aa, BORRELIA GARINII PBI
RASVDEVRS

SEQ ID NO: 151385 - protein, 9 aa, BORRELIA GARINII PBI
ASVDEVRSF

SEQ ID NO: 151386 - protein, 9 aa, BORRELIA GARINII PBI
SVDEVRSFE

SEQ ID NO: 151387 - protein, 9 aa, BORRELIA GARINII PBI
VDEVRSFEK

SEQ ID NO: 151388 - protein, 9 aa, BORRELIA GARINII PBI
DEVRSFEKF

SEQ ID NO: 151389 - protein, 9 aa, BORRELIA GARINII PBI
EVRSFEKFK

SEQ ID NO: 151390 - protein, 9 aa, BORRELIA GARINII PBI
VRSFEKFKK

SEQ ID NO: 151391 - protein, 9 aa, BORRELIA GARINII PBI
RSFEKFKKK

SEQ ID NO: 151392 - protein, 9 aa, BORRELIA GARINII PBI
SFEKFKKKS

SEQ ID NO: 151393 - protein, 9 aa, BORRELIA GARINII PBI
FEKFKKKSS

SEQ ID NO: 151394 - protein, 9 aa, BORRELIA GARINII PBI
EKFKKKSSY

SEQ ID NO: 151395 - protein, 9 aa, BORRELIA GARINII PBI
KFKKKSSYW

SEQ ID NO: 151396 - protein, 9 aa, BORRELIA GARINII PBI
FKKKSSYWL

SEQ ID NO: 151397 - protein, 9 aa, BORRELIA GARINII PBI
KKKSSYWLL

SEQ ID NO: 151398 - protein, 9 aa, BORRELIA GARINII PBI
KKSSYWLLD

SEQ ID NO: 151399 - protein, 9 aa, BORRELIA GARINII PBI
KSSYWLLDF

SEQ ID NO: 151400 - protein, 9 aa, BORRELIA GARINII PBI
SSYWLLDFA

SEQ ID NO: 151401 - protein, 9 aa, BORRELIA GARINII PBI
SYWLLDFAS

SEQ ID NO: 151402 - protein, 9 aa, BORRELIA GARINII PBI
YWLLDFASF

SEQ ID NO: 151403 - protein, 9 aa, BORRELIA GARINII PBI
WLLDFASFV

SEQ ID NO: 151404 - protein, 9 aa, BORRELIA GARINII PBI
LLDFASFVA

SEQ ID NO: 151405 - protein, 9 aa, BORRELIA GARINII PBI
LDFASFVAF

SEQ ID NO: 151406 - protein, 9 aa, BORRELIA GARINII PBI
DFASFVAFK

SEQ ID NO: 151407 - protein, 9 aa, BORRELIA GARINII PBI
FASFVAFKE

SEQ ID NO: 151408 - protein, 9 aa, BORRELIA GARINII PBI
ASFVAFKEY

SEQ ID NO: 151409 - protein, 9 aa, BORRELIA GARINII PBI
SFVAFKEYF

SEQ ID NO: 151410 - protein, 9 aa, BORRELIA GARINII PBI
FVAFKEYFL

SEQ ID NO: 151411 - protein, 9 aa, BORRELIA GARINII PBI
VAFKEYFLK

SEQ ID NO: 151412 - protein, 9 aa, BORRELIA GARINII PBI
AFKEYFLKD

SEQ ID NO: 151413 - protein, 9 aa, BORRELIA GARINII PBI
FKEYFLKDS

SEQ ID NO: 151414 - protein, 9 aa, BORRELIA GARINII PBI
KEYFLKDSR

SEQ ID NO: 151415 - protein, 9 aa, BORRELIA GARINII PBI
EYFLKDSRD

SEQ ID NO: 151416 - protein, 9 aa, BORRELIA GARINII PBI
YFLKDSRDA

SEQ ID NO: 151417 - protein, 9 aa, BORRELIA GARINII PBI
FLKDSRDAF

SEQ ID NO: 151418 - protein, 9 aa, BORRELIA GARINII PBI
LKDSRDAFN

SEQ ID NO: 151419 - protein, 9 aa, BORRELIA GARINII PBI
KDSRDAFNV

SEQ ID NO: 151420 - protein, 9 aa, BORRELIA GARINII PBI
DSRDAFNVL

SEQ ID NO: 151421 - protein, 9 aa, BORRELIA GARINII PBI
SRDAFNVLF

SEQ ID NO: 151422 - protein, 9 aa, BORRELIA GARINII PBI
RDAFNVLFD

SEQ ID NO: 151423 - protein, 9 aa, BORRELIA GARINII PBI
DAFNVLFDR

SEQ ID NO: 151424 - protein, 9 aa, BORRELIA GARINII PBI
AFNVLFDRG

SEQ ID NO: 151425 - protein, 9 aa, BORRELIA GARINII PBI
FNVLFDRGI

SEQ ID NO: 151426 - protein, 9 aa, BORRELIA GARINII PBI
NVLFDRGIL

SEQ ID NO: 151427 - protein, 9 aa, BORRELIA GARINII PBI
VLFDRGILI

SEQ ID NO: 151428 - protein, 9 aa, BORRELIA GARINII PBI
LFDRGILIR

SEQ ID NO: 151429 - protein, 9 aa, BORRELIA GARINII PBI
FDRGILIRN

SEQ ID NO: 151430 - protein, 9 aa, BORRELIA GARINII PBI
DRGILIRNE

SEQ ID NO: 151431 - protein, 9 aa, BORRELIA GARINII PBI
RGILIRNEK

SEQ ID NO: 151432 - protein, 9 aa, BORRELIA GARINII PBI
GILIRNEKD

SEQ ID NO: 151433 - protein, 9 aa, BORRELIA GARINII PBI
ILIRNEKDL

SEQ ID NO: 151434 - protein, 9 aa, BORRELIA GARINII PBI
LIRNEKDLF

SEQ ID NO: 151435 - protein, 9 aa, BORRELIA GARINII PBI
IRNEKDLFK

SEQ ID NO: 151436 - protein, 9 aa, BORRELIA GARINII PBI
RNEKDLFKL

SEQ ID NO: 151437 - protein, 9 aa, BORRELIA GARINII PBI
NEKDLFKLR

SEQ ID NO: 151438 - protein, 9 aa, BORRELIA GARINII PBI
EKDLFKLRN

SEQ ID NO: 151439 - protein, 9 aa, BORRELIA GARINII PBI
KDLFKLRNI

SEQ ID NO: 151440 - protein, 9 aa, BORRELIA GARINII PBI
DLFKLRNIL

SEQ ID NO: 151441 - protein, 9 aa, BORRELIA GARINII PBI
LFKLRNILS

SEQ ID NO: 151442 - protein, 9 aa, BORRELIA GARINII PBI
FKLRNILSK

SEQ ID NO: 151443 - protein, 9 aa, BORRELIA GARINII PBI
KLRNILSKE

SEQ ID NO: 151444 - protein, 9 aa, BORRELIA GARINII PBI
LRNILSKEI

SEQ ID NO: 151445 - protein, 9 aa, BORRELIA GARINII PBI
RNILSKEIK

SEQ ID NO: 151446 - protein, 9 aa, BORRELIA GARINII PBI
NILSKEIKV

SEQ ID NO: 151447 - protein, 9 aa, BORRELIA GARINII PBI
ILSKEIKVQ

SEQ ID NO: 151448 - protein, 9 aa, BORRELIA GARINII PBI
LSKEIKVQE

SEQ ID NO: 151449 - protein, 9 aa, BORRELIA GARINII PBI
SKEIKVQEV

SEQ ID NO: 151450 - protein, 9 aa, BORRELIA GARINII PBI
KEIKVQEVL

SEQ ID NO: 151451 - protein, 9 aa, BORRELIA GARINII PBI
EIKVQEVLQ

SEQ ID NO: 151452 - protein, 9 aa, BORRELIA GARINII PBI
IKVQEVLQY

SEQ ID NO: 151453 - protein, 9 aa, BORRELIA GARINII PBI
KVQEVLQYF

SEQ ID NO: 151454 - protein, 9 aa, BORRELIA GARINII PBI
VQEVLQYFF

SEQ ID NO: 151455 - protein, 9 aa, BORRELIA GARINII PBI
QEVLQYFFF

SEQ ID NO: 151456 - protein, 9 aa, BORRELIA GARINII PBI
EVLQYFFFS

SEQ ID NO: 151457 - protein, 9 aa, BORRELIA GARINII PBI
VLQYFFFSQ

SEQ ID NO: 151458 - protein, 9 aa, BORRELIA GARINII PBI
LQYFFFSQF

SEQ ID NO: 151459 - protein, 9 aa, BORRELIA GARINII PBI
QYFFFSQFQ

SEQ ID NO: 151460 - protein, 9 aa, BORRELIA GARINII PBI
YFFFSQFQA

SEQ ID NO: 151461 - protein, 9 aa, BORRELIA GARINII PBI
FFFSQFQAL

SEQ ID NO: 151462 - protein, 9 aa, BORRELIA GARINII PBI
FFSQFQALK

SEQ ID NO: 151463 - protein, 9 aa, BORRELIA GARINII PBI
FSQFQALKR

SEQ ID NO: 151464 - protein, 9 aa, BORRELIA GARINII PBI
SQFQALKRY

SEQ ID NO: 151465 - protein, 9 aa, BORRELIA GARINII PBI
QFQALKRYA

SEQ ID NO: 151466 - protein, 9 aa, BORRELIA GARINII PBI
FQALKRYAN

SEQ ID NO: 151467 - protein, 9 aa, BORRELIA GARINII PBI
QALKRYAND

SEQ ID NO: 151468 - protein, 9 aa, BORRELIA GARINII PBI
ALKRYANDK

SEQ ID NO: 151469 - protein, 9 aa, BORRELIA GARINII PBI
LKRYANDKG

SEQ ID NO: 151470 - protein, 9 aa, BORRELIA GARINII PBI
KRYANDKGI

SEQ ID NO: 151471 - protein, 9 aa, BORRELIA GARINII PBI
RYANDKGIE

SEQ ID NO: 151472 - protein, 9 aa, BORRELIA GARINII PBI
YANDKGIEL

SEQ ID NO: 151473 - protein, 9 aa, BORRELIA GARINII PBI
ANDKGIELV

SEQ ID NO: 151474 - protein, 9 aa, BORRELIA GARINII PBI
NDKGIELVM

SEQ ID NO: 151475 - protein, 9 aa, BORRELIA GARINII PBI
DKGIELVMN

SEQ ID NO: 151476 - protein, 9 aa, BORRELIA GARINII PBI
KGIELVMNL

SEQ ID NO: 151477 - protein, 9 aa, BORRELIA GARINII PBI
GIELVMNLP

SEQ ID NO: 151478 - protein, 9 aa, BORRELIA GARINII PBI
IELVMNLPL

SEQ ID NO: 151479 - protein, 9 aa, BORRELIA GARINII PBI
ELVMNLPLF

SEQ ID NO: 151480 - protein, 9 aa, BORRELIA GARINII PBI
LVMNLPLFI

SEQ ID NO: 151481 - protein, 9 aa, BORRELIA GARINII PBI
VMNLPLFIA

SEQ ID NO: 151482 - protein, 9 aa, BORRELIA GARINII PBI
MNLPLFIAY

SEQ ID NO: 151483 - protein, 9 aa, BORRELIA GARINII PBI
NLPLFIAYD

SEQ ID NO: 151484 - protein, 9 aa, BORRELIA GARINII PBI
LPLFIAYDS

SEQ ID NO: 151485 - protein, 9 aa, BORRELIA GARINII PBI
PLFIAYDSA

SEQ ID NO: 151486 - protein, 9 aa, BORRELIA GARINII PBI
LFIAYDSAD

SEQ ID NO: 151487 - protein, 9 aa, BORRELIA GARINII PBI
FIAYDSADV

SEQ ID NO: 151488 - protein, 9 aa, BORRELIA GARINII PBI
IAYDSADVW

SEQ ID NO: 151489 - protein, 9 aa, BORRELIA GARINII PBI
AYDSADVWA

SEQ ID NO: 151490 - protein, 9 aa, BORRELIA GARINII PBI
YDSADVWAH

SEQ ID NO: 151491 - protein, 9 aa, BORRELIA GARINII PBI
DSADVWAHQ

SEQ ID NO: 151492 - protein, 9 aa, BORRELIA GARINII PBI
SADVWAHQK

SEQ ID NO: 151493 - protein, 9 aa, BORRELIA GARINII PBI
ADVWAHQKY

SEQ ID NO: 151494 - protein, 9 aa, BORRELIA GARINII PBI
DVWAHQKYF

SEQ ID NO: 151495 - protein, 9 aa, BORRELIA GARINII PBI
VWAHQKYFK

SEQ ID NO: 151496 - protein, 9 aa, BORRELIA GARINII PBI
WAHQKYFKL

SEQ ID NO: 151497 - protein, 9 aa, BORRELIA GARINII PBI
AHQKYFKLR

SEQ ID NO: 151498 - protein, 9 aa, BORRELIA GARINII PBI
HQKYFKLRF

SEQ ID NO: 151499 - protein, 9 aa, BORRELIA GARINII PBI
QKYFKLRFD

SEQ ID NO: 151500 - protein, 9 aa, BORRELIA GARINII PBI
KYFKLRFDA

SEQ ID NO: 151501 - protein, 9 aa, BORRELIA GARINII PBI
YFKLRFDAS

SEQ ID NO: 151502 - protein, 9 aa, BORRELIA GARINII PBI
FKLRFDASK

SEQ ID NO: 151503 - protein, 9 aa, BORRELIA GARINII PBI
KLRFDASKD

SEQ ID NO: 151504 - protein, 9 aa, BORRELIA GARINII PBI
LRFDASKDK

SEQ ID NO: 151505 - protein, 9 aa, BORRELIA GARINII PBI
RFDASKDKV

SEQ ID NO: 151506 - protein, 9 aa, BORRELIA GARINII PBI
FDASKDKVA

SEQ ID NO: 151507 - protein, 9 aa, BORRELIA GARINII PBI
DASKDKVAG

SEQ ID NO: 151508 - protein, 9 aa, BORRELIA GARINII PBI
ASKDKVAGI

SEQ ID NO: 151509 - protein, 9 aa, BORRELIA GARINII PBI
SKDKVAGIS

SEQ ID NO: 151510 - protein, 9 aa, BORRELIA GARINII PBI
KDKVAGISP

SEQ ID NO: 151511 - protein, 9 aa, BORRELIA GARINII PBI
DKVAGISPD

SEQ ID NO: 151512 - protein, 9 aa, BORRELIA GARINII PBI
KVAGISPDY

SEQ ID NO: 151513 - protein, 9 aa, BORRELIA GARINII PBI
VAGISPDYF

SEQ ID NO: 151514 - protein, 9 aa, BORRELIA GARINII PBI
AGISPDYFL

SEQ ID NO: 151515 - protein, 9 aa, BORRELIA GARINII PBI
GISPDYFLE

SEQ ID NO: 151516 - protein, 9 aa, BORRELIA GARINII PBI
ISPDYFLEQ

SEQ ID NO: 151517 - protein, 9 aa, BORRELIA GARINII PBI
SPDYFLEQE

SEQ ID NO: 151518 - protein, 9 aa, BORRELIA GARINII PBI
PDYFLEQEQ

SEQ ID NO: 151519 - protein, 9 aa, BORRELIA GARINII PBI
DYFLEQEQA

SEQ ID NO: 151520 - protein, 9 aa, BORRELIA GARINII PBI
YFLEQEQAW

SEQ ID NO: 151521 - protein, 9 aa, BORRELIA GARINII PBI
FLEQEQAWD

SEQ ID NO: 151522 - protein, 9 aa, BORRELIA GARINII PBI
LEQEQAWDS

SEQ ID NO: 151523 - protein, 9 aa, BORRELIA GARINII PBI
EQEQAWDSP

SEQ ID NO: 151524 - protein, 9 aa, BORRELIA GARINII PBI
QEQAWDSPA

SEQ ID NO: 151525 - protein, 9 aa, BORRELIA GARINII PBI
EQAWDSPAY

SEQ ID NO: 151526 - protein, 9 aa, BORRELIA GARINII PBI
QAWDSPAYS

SEQ ID NO: 151527 - protein, 9 aa, BORRELIA GARINII PBI
AWDSPAYSW

SEQ ID NO: 151528 - protein, 9 aa, BORRELIA GARINII PBI
WDSPAYSWN

SEQ ID NO: 151529 - protein, 9 aa, BORRELIA GARINII PBI
DSPAYSWNV

SEQ ID NO: 151530 - protein, 9 aa, BORRELIA GARINII PBI
SPAYSWNVL

SEQ ID NO: 151531 - protein, 9 aa, BORRELIA GARINII PBI
PAYSWNVLK

SEQ ID NO: 151532 - protein, 9 aa, BORRELIA GARINII PBI
AYSWNVLKN

SEQ ID NO: 151533 - protein, 9 aa, BORRELIA GARINII PBI
YSWNVLKNV

SEQ ID NO: 151534 - protein, 9 aa, BORRELIA GARINII PBI
SWNVLKNVK

SEQ ID NO: 151535 - protein, 9 aa, BORRELIA GARINII PBI
WNVLKNVKY

SEQ ID NO: 151536 - protein, 9 aa, BORRELIA GARINII PBI
NVLKNVKYE

SEQ ID NO: 151537 - protein, 9 aa, BORRELIA GARINII PBI
VLKNVKYEW

SEQ ID NO: 151538 - protein, 9 aa, BORRELIA GARINII PBI
LKNVKYEWW

SEQ ID NO: 151539 - protein, 9 aa, BORRELIA GARINII PBI
KNVKYEWWA

SEQ ID NO: 151540 - protein, 9 aa, BORRELIA GARINII PBI
NVKYEWWAK

SEQ ID NO: 151541 - protein, 9 aa, BORRELIA GARINII PBI
VKYEWWAKR

SEQ ID NO: 151542 - protein, 9 aa, BORRELIA GARINII PBI
KYEWWAKRI

SEQ ID NO: 151543 - protein, 9 aa, BORRELIA GARINII PBI
YEWWAKRIG

SEQ ID NO: 151544 - protein, 9 aa, BORRELIA GARINII PBI
EWWAKRIGI

SEQ ID NO: 151545 - protein, 9 aa, BORRELIA GARINII PBI
WWAKRIGIL

SEQ ID NO: 151546 - protein, 9 aa, BORRELIA GARINII PBI
WAKRIGILR

SEQ ID NO: 151547 - protein, 9 aa, BORRELIA GARINII PBI
AKRIGILRK

SEQ ID NO: 151548 - protein, 9 aa, BORRELIA GARINII PBI
KRIGILRKY

SEQ ID NO: 151549 - protein, 9 aa, BORRELIA GARINII PBI
RIGILRKYI

SEQ ID NO: 151550 - protein, 9 aa, BORRELIA GARINII PBI
IGILRKYID

SEQ ID NO: 151551 - protein, 9 aa, BORRELIA GARINII PBI
GILRKYIDV

SEQ ID NO: 151552 - protein, 9 aa, BORRELIA GARINII PBI
ILRKYIDVI

SEQ ID NO: 151553 - protein, 9 aa, BORRELIA GARINII PBI
LRKYIDVIK

SEQ ID NO: 151554 - protein, 9 aa, BORRELIA GARINII PBI
RKYIDVIKI

SEQ ID NO: 151555 - protein, 9 aa, BORRELIA GARINII PBI
KYIDVIKID

SEQ ID NO: 151556 - protein, 9 aa, BORRELIA GARINII PBI
YIDVIKIDH

SEQ ID NO: 151557 - protein, 9 aa, BORRELIA GARINII PBI
IDVIKIDHF

SEQ ID NO: 151558 - protein, 9 aa, BORRELIA GARINII PBI
DVIKIDHFR

SEQ ID NO: 151559 - protein, 9 aa, BORRELIA GARINII PBI
VIKIDHFRG

SEQ ID NO: 151560 - protein, 9 aa, BORRELIA GARINII PBI
IKIDHFRGF

SEQ ID NO: 151561 - protein, 9 aa, BORRELIA GARINII PBI
KIDHFRGFV

SEQ ID NO: 151562 - protein, 9 aa, BORRELIA GARINII PBI
IDHFRGFVS

SEQ ID NO: 151563 - protein, 9 aa, BORRELIA GARINII PBI
DHFRGFVST

SEQ ID NO: 151564 - protein, 9 aa, BORRELIA GARINII PBI
HFRGFVSTW

SEQ ID NO: 151565 - protein, 9 aa, BORRELIA GARINII PBI
FRGFVSTWE

SEQ ID NO: 151566 - protein, 9 aa, BORRELIA GARINII PBI
RGFVSTWEV

SEQ ID NO: 151567 - protein, 9 aa, BORRELIA GARINII PBI
GFVSTWEVG

SEQ ID NO: 151568 - protein, 9 aa, BORRELIA GARINII PBI
FVSTWEVGV

SEQ ID NO: 151569 - protein, 9 aa, BORRELIA GARINII PBI
VSTWEVGVG

SEQ ID NO: 151570 - protein, 9 aa, BORRELIA GARINII PBI
STWEVGVGE

SEQ ID NO: 151571 - protein, 9 aa, BORRELIA GARINII PBI
TWEVGVGEA

SEQ ID NO: 151572 - protein, 9 aa, BORRELIA GARINII PBI
WEVGVGEAY

SEQ ID NO: 151573 - protein, 9 aa, BORRELIA GARINII PBI
EVGVGEAYA

SEQ ID NO: 151574 - protein, 9 aa, BORRELIA GARINII PBI
VGVGEAYAF

SEQ ID NO: 151575 - protein, 9 aa, BORRELIA GARINII PBI
GVGEAYAFN

SEQ ID NO: 151576 - protein, 9 aa, BORRELIA GARINII PBI
VGEAYAFNG

SEQ ID NO: 151577 - protein, 9 aa, BORRELIA GARINII PBI
GEAYAFNGL

SEQ ID NO: 151578 - protein, 9 aa, BORRELIA GARINII PBI
EAYAFNGLW

SEQ ID NO: 151579 - protein, 9 aa, BORRELIA GARINII PBI
AYAFNGLWV

SEQ ID NO: 151580 - protein, 9 aa, BORRELIA GARINII PBI
YAFNGLWVK

SEQ ID NO: 151581 - protein, 9 aa, BORRELIA GARINII PBI
AFNGLWVKS

SEQ ID NO: 151582 - protein, 9 aa, BORRELIA GARINII PBI
FNGLWVKSP

SEQ ID NO: 151583 - protein, 9 aa, BORRELIA GARINII PBI
NGLWVKSPG

SEQ ID NO: 151584 - protein, 9 aa, BORRELIA GARINII PBI
GLWVKSPGR

SEQ ID NO: 151585 - protein, 9 aa, BORRELIA GARINII PBI
LWVKSPGRD

SEQ ID NO: 151586 - protein, 9 aa, BORRELIA GARINII PBI
WVKSPGRDF

SEQ ID NO: 151587 - protein, 9 aa, BORRELIA GARINII PBI
VKSPGRDFF

SEQ ID NO: 151588 - protein, 9 aa, BORRELIA GARINII PBI
KSPGRDFFN

SEQ ID NO: 151589 - protein, 9 aa, BORRELIA GARINII PBI
SPGRDFFNF

SEQ ID NO: 151590 - protein, 9 aa, BORRELIA GARINII PBI
PGRDFFNFI

SEQ ID NO: 151591 - protein, 9 aa, BORRELIA GARINII PBI
GRDFFNFIL

SEQ ID NO: 151592 - protein, 9 aa, BORRELIA GARINII PBI
RDFFNFILN

SEQ ID NO: 151593 - protein, 9 aa, BORRELIA GARINII PBI
DFFNFILNE

SEQ ID NO: 151594 - protein, 9 aa, BORRELIA GARINII PBI
FFNFILNEI

SEQ ID NO: 151595 - protein, 9 aa, BORRELIA GARINII PBI
FNFILNEIK

SEQ ID NO: 151596 - protein, 9 aa, BORRELIA GARINII PBI
NFILNEIKD

SEQ ID NO: 151597 - protein, 9 aa, BORRELIA GARINII PBI
FILNEIKDL

SEQ ID NO: 151598 - protein, 9 aa, BORRELIA GARINII PBI
ILNEIKDLK

SEQ ID NO: 151599 - protein, 9 aa, BORRELIA GARINII PBI
LNEIKDLKI

SEQ ID NO: 151600 - protein, 9 aa, BORRELIA GARINII PBI
NEIKDLKIW

SEQ ID NO: 151601 - protein, 9 aa, BORRELIA GARINII PBI
EIKDLKIWV

SEQ ID NO: 151602 - protein, 9 aa, BORRELIA GARINII PBI
IKDLKIWVE

SEQ ID NO: 151603 - protein, 9 aa, BORRELIA GARINII PBI
KDLKIWVED

SEQ ID NO: 151604 - protein, 9 aa, BORRELIA GARINII PBI
DLKIWVEDF

SEQ ID NO: 151605 - protein, 9 aa, BORRELIA GARINII PBI
LKIWVEDFE

SEQ ID NO: 151606 - protein, 9 aa, BORRELIA GARINII PBI
KIWVEDFEN

SEQ ID NO: 151607 - protein, 9 aa, BORRELIA GARINII PBI
IWVEDFEND

SEQ ID NO: 151608 - protein, 9 aa, BORRELIA GARINII PBI
WVEDFENDL

SEQ ID NO: 151609 - protein, 9 aa, BORRELIA GARINII PBI
VEDFENDLE

SEQ ID NO: 151610 - protein, 9 aa, BORRELIA GARINII PBI
EDFENDLED

SEQ ID NO: 151611 - protein, 9 aa, BORRELIA GARINII PBI
DFENDLEDV

SEQ ID NO: 151612 - protein, 9 aa, BORRELIA GARINII PBI
FENDLEDVS

SEQ ID NO: 151613 - protein, 9 aa, BORRELIA GARINII PBI
ENDLEDVSR

SEQ ID NO: 151614 - protein, 9 aa, BORRELIA GARINII PBI
NDLEDVSRL

SEQ ID NO: 151615 - protein, 9 aa, BORRELIA GARINII PBI
DLEDVSRLR

SEQ ID NO: 151616 - protein, 9 aa, BORRELIA GARINII PBI
LEDVSRLRD

SEQ ID NO: 151617 - protein, 9 aa, BORRELIA GARINII PBI
EDVSRLRDF

SEQ ID NO: 151618 - protein, 9 aa, BORRELIA GARINII PBI
DVSRLRDFF

SEQ ID NO: 151619 - protein, 9 aa, BORRELIA GARINII PBI
VSRLRDFFN

SEQ ID NO: 151620 - protein, 9 aa, BORRELIA GARINII PBI
SRLRDFFNF

SEQ ID NO: 151621 - protein, 9 aa, BORRELIA GARINII PBI
RLRDFFNFP

SEQ ID NO: 151622 - protein, 9 aa, BORRELIA GARINII PBI
LRDFFNFPG

SEQ ID NO: 151623 - protein, 9 aa, BORRELIA GARINII PBI
RDFFNFPGM

SEQ ID NO: 151624 - protein, 9 aa, BORRELIA GARINII PBI
DFFNFPGMR

SEQ ID NO: 151625 - protein, 9 aa, BORRELIA GARINII PBI
FFNFPGMRI

SEQ ID NO: 151626 - protein, 9 aa, BORRELIA GARINII PBI
FNFPGMRIM

SEQ ID NO: 151627 - protein, 9 aa, BORRELIA GARINII PBI
NFPGMRIMK

SEQ ID NO: 151628 - protein, 9 aa, BORRELIA GARINII PBI
FPGMRIMKL

SEQ ID NO: 151629 - protein, 9 aa, BORRELIA GARINII PBI
PGMRIMKLA

SEQ ID NO: 151630 - protein, 9 aa, BORRELIA GARINII PBI
GMRIMKLAF

SEQ ID NO: 151631 - protein, 9 aa, BORRELIA GARINII PBI
MRIMKLAFD

SEQ ID NO: 151632 - protein, 9 aa, BORRELIA GARINII PBI
RIMKLAFDF

SEQ ID NO: 151633 - protein, 9 aa, BORRELIA GARINII PBI
IMKLAFDFD

SEQ ID NO: 151634 - protein, 9 aa, BORRELIA GARINII PBI
MKLAFDFDS

SEQ ID NO: 151635 - protein, 9 aa, BORRELIA GARINII PBI
KLAFDFDSD

SEQ ID NO: 151636 - protein, 9 aa, BORRELIA GARINII PBI
LAFDFDSDN

SEQ ID NO: 151637 - protein, 9 aa, BORRELIA GARINII PBI
AFDFDSDNQ

SEQ ID NO: 151638 - protein, 9 aa, BORRELIA GARINII PBI
FDFDSDNQN

SEQ ID NO: 151639 - protein, 9 aa, BORRELIA GARINII PBI
DFDSDNQNL

SEQ ID NO: 151640 - protein, 9 aa, BORRELIA GARINII PBI
FDSDNQNLP

SEQ ID NO: 151641 - protein, 9 aa, BORRELIA GARINII PBI
DSDNQNLPH

SEQ ID NO: 151642 - protein, 9 aa, BORRELIA GARINII PBI
SDNQNLPHN

SEQ ID NO: 151643 - protein, 9 aa, BORRELIA GARINII PBI
DNQNLPHNY

SEQ ID NO: 151644 - protein, 9 aa, BORRELIA GARINII PBI
NQNLPHNYI

SEQ ID NO: 151645 - protein, 9 aa, BORRELIA GARINII PBI
QNLPHNYIK

SEQ ID NO: 151646 - protein, 9 aa, BORRELIA GARINII PBI
NLPHNYIKN

SEQ ID NO: 151647 - protein, 9 aa, BORRELIA GARINII PBI
LPHNYIKNC

SEQ ID NO: 151648 - protein, 9 aa, BORRELIA GARINII PBI
PHNYIKNCI

SEQ ID NO: 151649 - protein, 9 aa, BORRELIA GARINII PBI
HNYIKNCIV

SEQ ID NO: 151650 - protein, 9 aa, BORRELIA GARINII PBI
NYIKNCIVY

SEQ ID NO: 151651 - protein, 9 aa, BORRELIA GARINII PBI
YIKNCIVYT

SEQ ID NO: 151652 - protein, 9 aa, BORRELIA GARINII PBI
IKNCIVYTG

SEQ ID NO: 151653 - protein, 9 aa, BORRELIA GARINII PBI
KNCIVYTGI

SEQ ID NO: 151654 - protein, 9 aa, BORRELIA GARINII PBI
NCIVYTGIG

SEQ ID NO: 151655 - protein, 9 aa, BORRELIA GARINII PBI
CIVYTGIGD

SEQ ID NO: 151656 - protein, 9 aa, BORRELIA GARINII PBI
IVYTGIGDN

SEQ ID NO: 151657 - protein, 9 aa, BORRELIA GARINII PBI
VYTGIGDNS

SEQ ID NO: 151658 - protein, 9 aa, BORRELIA GARINII PBI
YTGIGDNST

SEQ ID NO: 151659 - protein, 9 aa, BORRELIA GARINII PBI
TGIGDNSTI

SEQ ID NO: 151660 - protein, 9 aa, BORRELIA GARINII PBI
GIGDNSTIR

SEQ ID NO: 151661 - protein, 9 aa, BORRELIA GARINII PBI
IGDNSTIRE

SEQ ID NO: 151662 - protein, 9 aa, BORRELIA GARINII PBI
GDNSTIREF

SEQ ID NO: 151663 - protein, 9 aa, BORRELIA GARINII PBI
DNSTIREFV

SEQ ID NO: 151664 - protein, 9 aa, BORRELIA GARINII PBI
NSTIREFVN

SEQ ID NO: 151665 - protein, 9 aa, BORRELIA GARINII PBI
STIREFVNS

SEQ ID NO: 151666 - protein, 9 aa, BORRELIA GARINII PBI
TIREFVNSL

SEQ ID NO: 151667 - protein, 9 aa, BORRELIA GARINII PBI
IREFVNSLD

SEQ ID NO: 151668 - protein, 9 aa, BORRELIA GARINII PBI
REFVNSLDD

SEQ ID NO: 151669 - protein, 9 aa, BORRELIA GARINII PBI
EFVNSLDDL

SEQ ID NO: 151670 - protein, 9 aa, BORRELIA GARINII PBI
FVNSLDDLH

SEQ ID NO: 151671 - protein, 9 aa, BORRELIA GARINII PBI
VNSLDDLHK

SEQ ID NO: 151672 - protein, 9 aa, BORRELIA GARINII PBI
NSLDDLHKK

SEQ ID NO: 151673 - protein, 9 aa, BORRELIA GARINII PBI
SLDDLHKKY

SEQ ID NO: 151674 - protein, 9 aa, BORRELIA GARINII PBI
LDDLHKKYI

SEQ ID NO: 151675 - protein, 9 aa, BORRELIA GARINII PBI
DDLHKKYIF

SEQ ID NO: 151676 - protein, 9 aa, BORRELIA GARINII PBI
DLHKKYIFD

SEQ ID NO: 151677 - protein, 9 aa, BORRELIA GARINII PBI
LHKKYIFDY

SEQ ID NO: 151678 - protein, 9 aa, BORRELIA GARINII PBI
HKKYIFDYL

SEQ ID NO: 151679 - protein, 9 aa, BORRELIA GARINII PBI
KKYIFDYLN

SEQ ID NO: 151680 - protein, 9 aa, BORRELIA GARINII PBI
KYIFDYLNT

SEQ ID NO: 151681 - protein, 9 aa, BORRELIA GARINII PBI
YIFDYLNTN

SEQ ID NO: 151682 - protein, 9 aa, BORRELIA GARINII PBI
IFDYLNTNE

SEQ ID NO: 151683 - protein, 9 aa, BORRELIA GARINII PBI
FDYLNTNED

SEQ ID NO: 151684 - protein, 9 aa, BORRELIA GARINII PBI
DYLNTNEDF

SEQ ID NO: 151685 - protein, 9 aa, BORRELIA GARINII PBI
YLNTNEDFV

SEQ ID NO: 151686 - protein, 9 aa, BORRELIA GARINII PBI
LNTNEDFVV

SEQ ID NO: 151687 - protein, 9 aa, BORRELIA GARINII PBI
NTNEDFVVW

SEQ ID NO: 151688 - protein, 9 aa, BORRELIA GARINII PBI
TNEDFVVWD

SEQ ID NO: 151689 - protein, 9 aa, BORRELIA GARINII PBI
NEDFVVWDM

SEQ ID NO: 151690 - protein, 9 aa, BORRELIA GARINII PBI
EDFVVWDMI

SEQ ID NO: 151691 - protein, 9 aa, BORRELIA GARINII PBI
DFVVWDMIR

SEQ ID NO: 151692 - protein, 9 aa, BORRELIA GARINII PBI
FVVWDMIRS

SEQ ID NO: 151693 - protein, 9 aa, BORRELIA GARINII PBI
VVWDMIRSA

SEQ ID NO: 151694 - protein, 9 aa, BORRELIA GARINII PBI
VWDMIRSAM

SEQ ID NO: 151695 - protein, 9 aa, BORRELIA GARINII PBI
WDMIRSAMS

SEQ ID NO: 151696 - protein, 9 aa, BORRELIA GARINII PBI
DMIRSAMSS

SEQ ID NO: 151697 - protein, 9 aa, BORRELIA GARINII PBI
MIRSAMSSV

SEQ ID NO: 151698 - protein, 9 aa, BORRELIA GARINII PBI
IRSAMSSVS

SEQ ID NO: 151699 - protein, 9 aa, BORRELIA GARINII PBI
RSAMSSVSD

SEQ ID NO: 151700 - protein, 9 aa, BORRELIA GARINII PBI
SAMSSVSDS

SEQ ID NO: 151701 - protein, 9 aa, BORRELIA GARINII PBI
AMSSVSDSV

SEQ ID NO: 151702 - protein, 9 aa, BORRELIA GARINII PBI
MSSVSDSVI

SEQ ID NO: 151703 - protein, 9 aa, BORRELIA GARINII PBI
SSVSDSVII

SEQ ID NO: 151704 - protein, 9 aa, BORRELIA GARINII PBI
SVSDSVIIP

SEQ ID NO: 151705 - protein, 9 aa, BORRELIA GARINII PBI
VSDSVIIPM

SEQ ID NO: 151706 - protein, 9 aa, BORRELIA GARINII PBI
SDSVIIPMQ

SEQ ID NO: 151707 - protein, 9 aa, BORRELIA GARINII PBI
DSVIIPMQD

SEQ ID NO: 151708 - protein, 9 aa, BORRELIA GARINII PBI
SVIIPMQDY

SEQ ID NO: 151709 - protein, 9 aa, BORRELIA GARINII PBI
VIIPMQDYI

SEQ ID NO: 151710 - protein, 9 aa, BORRELIA GARINII PBI
IIPMQDYIN

SEQ ID NO: 151711 - protein, 9 aa, BORRELIA GARINII PBI
IPMQDYINL

SEQ ID NO: 151712 - protein, 9 aa, BORRELIA GARINII PBI
PMQDYINLG

SEQ ID NO: 151713 - protein, 9 aa, BORRELIA GARINII PBI
MQDYINLGN

SEQ ID NO: 151714 - protein, 9 aa, BORRELIA GARINII PBI
QDYINLGNE

SEQ ID NO: 151715 - protein, 9 aa, BORRELIA GARINII PBI
DYINLGNEF

SEQ ID NO: 151716 - protein, 9 aa, BORRELIA GARINII PBI
YINLGNEFR

SEQ ID NO: 151717 - protein, 9 aa, BORRELIA GARINII PBI
INLGNEFRA

SEQ ID NO: 151718 - protein, 9 aa, BORRELIA GARINII PBI
NLGNEFRAN

SEQ ID NO: 151719 - protein, 9 aa, BORRELIA GARINII PBI
LGNEFRANI

SEQ ID NO: 151720 - protein, 9 aa, BORRELIA GARINII PBI
GNEFRANIP

SEQ ID NO: 151721 - protein, 9 aa, BORRELIA GARINII PBI
NEFRANIPK

SEQ ID NO: 151722 - protein, 9 aa, BORRELIA GARINII PBI
EFRANIPKN

SEQ ID NO: 151723 - protein, 9 aa, BORRELIA GARINII PBI
FRANIPKNT

SEQ ID NO: 151724 - protein, 9 aa, BORRELIA GARINII PBI
RANIPKNTL

SEQ ID NO: 151725 - protein, 9 aa, BORRELIA GARINII PBI
ANIPKNTLN

SEQ ID NO: 151726 - protein, 9 aa, BORRELIA GARINII PBI
NIPKNTLNN

SEQ ID NO: 151727 - protein, 9 aa, BORRELIA GARINII PBI
IPKNTLNNW

SEQ ID NO: 151728 - protein, 9 aa, BORRELIA GARINII PBI
PKNTLNNWI

SEQ ID NO: 151729 - protein, 9 aa, BORRELIA GARINII PBI
KNTLNNWIF

SEQ ID NO: 151730 - protein, 9 aa, BORRELIA GARINII PBI
NTLNNWIFR

SEQ ID NO: 151731 - protein, 9 aa, BORRELIA GARINII PBI
TLNNWIFRL

SEQ ID NO: 151732 - protein, 9 aa, BORRELIA GARINII PBI
LNNWIFRLL

SEQ ID NO: 151733 - protein, 9 aa, BORRELIA GARINII PBI
NNWIFRLLE

SEQ ID NO: 151734 - protein, 9 aa, BORRELIA GARINII PBI
NWIFRLLES

SEQ ID NO: 151735 - protein, 9 aa, BORRELIA GARINII PBI
WIFRLLESD

SEQ ID NO: 151736 - protein, 9 aa, BORRELIA GARINII PBI
IFRLLESDL

SEQ ID NO: 151737 - protein, 9 aa, BORRELIA GARINII PBI
FRLLESDLD

SEQ ID NO: 151738 - protein, 9 aa, BORRELIA GARINII PBI
RLLESDLDA

SEQ ID NO: 151739 - protein, 9 aa, BORRELIA GARINII PBI
LLESDLDAT

SEQ ID NO: 151740 - protein, 9 aa, BORRELIA GARINII PBI
LESDLDATL

SEQ ID NO: 151741 - protein, 9 aa, BORRELIA GARINII PBI
ESDLDATLS

SEQ ID NO: 151742 - protein, 9 aa, BORRELIA GARINII PBI
SDLDATLSK

SEQ ID NO: 151743 - protein, 9 aa, BORRELIA GARINII PBI
DLDATLSKN

SEQ ID NO: 151744 - protein, 9 aa, BORRELIA GARINII PBI
LDATLSKNI

SEQ ID NO: 151745 - protein, 9 aa, BORRELIA GARINII PBI
DATLSKNIS

SEQ ID NO: 151746 - protein, 9 aa, BORRELIA GARINII PBI
ATLSKNISF

SEQ ID NO: 151747 - protein, 9 aa, BORRELIA GARINII PBI
TLSKNISFI

SEQ ID NO: 151748 - protein, 9 aa, BORRELIA GARINII PBI
LSKNISFIT

SEQ ID NO: 151749 - protein, 9 aa, BORRELIA GARINII PBI
SKNISFITR

SEQ ID NO: 151750 - protein, 9 aa, BORRELIA GARINII PBI
KNISFITRL

SEQ ID NO: 151751 - protein, 9 aa, BORRELIA GARINII PBI
NISFITRLY

SEQ ID NO: 151752 - protein, 9 aa, BORRELIA GARINII PBI
ISFITRLYG

SEQ ID NO: 151753 - protein, 9 aa, BORRELIA GARINII PBI
SFITRLYGR

SEQ ID NO: 151754 - protein, 9 aa, BORRELIA GARINII PBI
FITRLYGRT

SEQ ID NO: 151755 - protein, 10 aa, BORRELIA GARINII PBI
MKYKKIRINL

SEQ ID NO: 151756 - protein, 10 aa, BORRELIA GARINII PBI
KYKKIRINLN

SEQ ID NO: 151757 - protein, 10 aa, BORRELIA GARINII PBI
YKKIRINLNL

SEQ ID NO: 151758 - protein, 10 aa, BORRELIA GARINII PBI
KKIRINLNLK

SEQ ID NO: 151759 - protein, 10 aa, BORRELIA GARINII PBI
KIRINLNLKR

SEQ ID NO: 151760 - protein, 10 aa, BORRELIA GARINII PBI
IRINLNLKRK

SEQ ID NO: 151761 - protein, 10 aa, BORRELIA GARINII PBI
RINLNLKRKS

SEQ ID NO: 151762 - protein, 10 aa, BORRELIA GARINII PBI
INLNLKRKSG

SEQ ID NO: 151763 - protein, 10 aa, BORRELIA GARINII PBI
NLNLKRKSGI

SEQ ID NO: 151764 - protein, 10 aa, BORRELIA GARINII PBI
LNLKRKSGIL

SEQ ID NO: 151765 - protein, 10 aa, BORRELIA GARINII PBI
NLKRKSGILL

SEQ ID NO: 151766 - protein, 10 aa, BORRELIA GARINII PBI
LKRKSGILLN

SEQ ID NO: 151767 - protein, 10 aa, BORRELIA GARINII PBI
KRKSGILLNI

SEQ ID NO: 151768 - protein, 10 aa, BORRELIA GARINII PBI
RKSGILLNIS

SEQ ID NO: 151769 - protein, 10 aa, BORRELIA GARINII PBI
KSGILLNISS

SEQ ID NO: 151770 - protein, 10 aa, BORRELIA GARINII PBI
SGILLNISSL

SEQ ID NO: 151771 - protein, 10 aa, BORRELIA GARINII PBI
GILLNISSLP

SEQ ID NO: 151772 - protein, 10 aa, BORRELIA GARINII PBI
ILLNISSLPS

SEQ ID NO: 151773 - protein, 10 aa, BORRELIA GARINII PBI
LLNISSLPSK

SEQ ID NO: 151774 - protein, 10 aa, BORRELIA GARINII PBI
LNISSLPSKY

SEQ ID NO: 151775 - protein, 10 aa, BORRELIA GARINII PBI
NISSLPSKYG

SEQ ID NO: 151776 - protein, 10 aa, BORRELIA GARINII PBI
ISSLPSKYGI

SEQ ID NO: 151777 - protein, 10 aa, BORRELIA GARINII PBI
SSLPSKYGIG

SEQ ID NO: 151778 - protein, 10 aa, BORRELIA GARINII PBI
SLPSKYGIGD

SEQ ID NO: 151779 - protein, 10 aa, BORRELIA GARINII PBI
LPSKYGIGDL

SEQ ID NO: 151780 - protein, 10 aa, BORRELIA GARINII PBI
PSKYGIGDLG

SEQ ID NO: 151781 - protein, 10 aa, BORRELIA GARINII PBI
SKYGIGDLGK

SEQ ID NO: 151782 - protein, 10 aa, BORRELIA GARINII PBI
KYGIGDLGKG

SEQ ID NO: 151783 - protein, 10 aa, BORRELIA GARINII PBI
YGIGDLGKGA

SEQ ID NO: 151784 - protein, 10 aa, BORRELIA GARINII PBI
GIGDLGKGAY

SEQ ID NO: 151785 - protein, 10 aa, BORRELIA GARINII PBI
IGDLGKGAYK

SEQ ID NO: 151786 - protein, 10 aa, BORRELIA GARINII PBI
GDLGKGAYKF

SEQ ID NO: 151787 - protein, 10 aa, BORRELIA GARINII PBI
DLGKGAYKFI

SEQ ID NO: 151788 - protein, 10 aa, BORRELIA GARINII PBI
LGKGAYKFID

SEQ ID NO: 151789 - protein, 10 aa, BORRELIA GARINII PBI
GKGAYKFIDF

SEQ ID NO: 151790 - protein, 10 aa, BORRELIA GARINII PBI
KGAYKFIDFL

SEQ ID NO: 151791 - protein, 10 aa, BORRELIA GARINII PBI
GAYKFIDFLF

SEQ ID NO: 151792 - protein, 10 aa, BORRELIA GARINII PBI
AYKFIDFLFA

SEQ ID NO: 151793 - protein, 10 aa, BORRELIA GARINII PBI
YKFIDFLFAS

SEQ ID NO: 151794 - protein, 10 aa, BORRELIA GARINII PBI
KFIDFLFASS

SEQ ID NO: 151795 - protein, 10 aa, BORRELIA GARINII PBI
FIDFLFASSQ

SEQ ID NO: 151796 - protein, 10 aa, BORRELIA GARINII PBI
IDFLFASSQS

SEQ ID NO: 151797 - protein, 10 aa, BORRELIA GARINII PBI
DFLFASSQSY

SEQ ID NO: 151798 - protein, 10 aa, BORRELIA GARINII PBI
FLFASSQSYW

SEQ ID NO: 151799 - protein, 10 aa, BORRELIA GARINII PBI
LFASSQSYWQ

SEQ ID NO: 151800 - protein, 10 aa, BORRELIA GARINII PBI
FASSQSYWQM

SEQ ID NO: 151801 - protein, 10 aa, BORRELIA GARINII PBI
ASSQSYWQMF

SEQ ID NO: 151802 - protein, 10 aa, BORRELIA GARINII PBI
SSQSYWQMFA

SEQ ID NO: 151803 - protein, 10 aa, BORRELIA GARINII PBI
SQSYWQMFAY

SEQ ID NO: 151804 - protein, 10 aa, BORRELIA GARINII PBI
QSYWQMFAYS

SEQ ID NO: 151805 - protein, 10 aa, BORRELIA GARINII PBI
SYWQMFAYSP

SEQ ID NO: 151806 - protein, 10 aa, BORRELIA GARINII PBI
YWQMFAYSPI

SEQ ID NO: 151807 - protein, 10 aa, BORRELIA GARINII PBI
WQMFAYSPID

SEQ ID NO: 151808 - protein, 10 aa, BORRELIA GARINII PBI
QMFAYSPIDF

SEQ ID NO: 151809 - protein, 10 aa, BORRELIA GARINII PBI
MFAYSPIDFT

SEQ ID NO: 151810 - protein, 10 aa, BORRELIA GARINII PBI
FAYSPIDFTR

SEQ ID NO: 151811 - protein, 10 aa, BORRELIA GARINII PBI
AYSPIDFTRS

SEQ ID NO: 151812 - protein, 10 aa, BORRELIA GARINII PBI
YSPIDFTRSP

SEQ ID NO: 151813 - protein, 10 aa, BORRELIA GARINII PBI
SPIDFTRSPP

SEQ ID NO: 151814 - protein, 10 aa, BORRELIA GARINII PBI
PIDFTRSPPY

SEQ ID NO: 151815 - protein, 10 aa, BORRELIA GARINII PBI
IDFTRSPPYS

SEQ ID NO: 151816 - protein, 10 aa, BORRELIA GARINII PBI
DFTRSPPYSI

SEQ ID NO: 151817 - protein, 10 aa, BORRELIA GARINII PBI
FTRSPPYSIF

SEQ ID NO: 151818 - protein, 10 aa, BORRELIA GARINII PBI
TRSPPYSIFS

SEQ ID NO: 151819 - protein, 10 aa, BORRELIA GARINII PBI
RSPPYSIFSA

SEQ ID NO: 151820 - protein, 10 aa, BORRELIA GARINII PBI
SPPYSIFSAF

SEQ ID NO: 151821 - protein, 10 aa, BORRELIA GARINII PBI
PPYSIFSAFA

SEQ ID NO: 151822 - protein, 10 aa, BORRELIA GARINII PBI
PYSIFSAFAG

SEQ ID NO: 151823 - protein, 10 aa, BORRELIA GARINII PBI
YSIFSAFAGN

SEQ ID NO: 151824 - protein, 10 aa, BORRELIA GARINII PBI
SIFSAFAGNV

SEQ ID NO: 151825 - protein, 10 aa, BORRELIA GARINII PBI
IFSAFAGNVY

SEQ ID NO: 151826 - protein, 10 aa, BORRELIA GARINII PBI
FSAFAGNVYY

SEQ ID NO: 151827 - protein, 10 aa, BORRELIA GARINII PBI
SAFAGNVYYI

SEQ ID NO: 151828 - protein, 10 aa, BORRELIA GARINII PBI
AFAGNVYYID

SEQ ID NO: 151829 - protein, 10 aa, BORRELIA GARINII PBI
FAGNVYYIDL

SEQ ID NO: 151830 - protein, 10 aa, BORRELIA GARINII PBI
AGNVYYIDLE

SEQ ID NO: 151831 - protein, 10 aa, BORRELIA GARINII PBI
GNVYYIDLEA

SEQ ID NO: 151832 - protein, 10 aa, BORRELIA GARINII PBI
NVYYIDLEAL

SEQ ID NO: 151833 - protein, 10 aa, BORRELIA GARINII PBI
VYYIDLEALD

SEQ ID NO: 151834 - protein, 10 aa, BORRELIA GARINII PBI
YYIDLEALDK

SEQ ID NO: 151835 - protein, 10 aa, BORRELIA GARINII PBI
YIDLEALDKF

SEQ ID NO: 151836 - protein, 10 aa, BORRELIA GARINII PBI
IDLEALDKFI

SEQ ID NO: 151837 - protein, 10 aa, BORRELIA GARINII PBI
DLEALDKFID

SEQ ID NO: 151838 - protein, 10 aa, BORRELIA GARINII PBI
LEALDKFIDS

SEQ ID NO: 151839 - protein, 10 aa, BORRELIA GARINII PBI
EALDKFIDSD

SEQ ID NO: 151840 - protein, 10 aa, BORRELIA GARINII PBI
ALDKFIDSDL

SEQ ID NO: 151841 - protein, 10 aa, BORRELIA GARINII PBI
LDKFIDSDLN

SEQ ID NO: 151842 - protein, 10 aa, BORRELIA GARINII PBI
DKFIDSDLNL

SEQ ID NO: 151843 - protein, 10 aa, BORRELIA GARINII PBI
KFIDSDLNLL

SEQ ID NO: 151844 - protein, 10 aa, BORRELIA GARINII PBI
FIDSDLNLLK

SEQ ID NO: 151845 - protein, 10 aa, BORRELIA GARINII PBI
IDSDLNLLKE

SEQ ID NO: 151846 - protein, 10 aa, BORRELIA GARINII PBI
DSDLNLLKEN

SEQ ID NO: 151847 - protein, 10 aa, BORRELIA GARINII PBI
SDLNLLKENE

SEQ ID NO: 151848 - protein, 10 aa, BORRELIA GARINII PBI
DLNLLKENET

SEQ ID NO: 151849 - protein, 10 aa, BORRELIA GARINII PBI
LNLLKENETR

SEQ ID NO: 151850 - protein, 10 aa, BORRELIA GARINII PBI
NLLKENETRY

SEQ ID NO: 151851 - protein, 10 aa, BORRELIA GARINII PBI
LLKENETRYS

SEQ ID NO: 151852 - protein, 10 aa, BORRELIA GARINII PBI
LKENETRYSD

SEQ ID NO: 151853 - protein, 10 aa, BORRELIA GARINII PBI
KENETRYSDL

SEQ ID NO: 151854 - protein, 10 aa, BORRELIA GARINII PBI
ENETRYSDLK

SEQ ID NO: 151855 - protein, 10 aa, BORRELIA GARINII PBI
NETRYSDLKK

SEQ ID NO: 151856 - protein, 10 aa, BORRELIA GARINII PBI
ETRYSDLKKL

SEQ ID NO: 151857 - protein, 10 aa, BORRELIA GARINII PBI
TRYSDLKKLS

SEQ ID NO: 151858 - protein, 10 aa, BORRELIA GARINII PBI
RYSDLKKLSF

SEQ ID NO: 151859 - protein, 10 aa, BORRELIA GARINII PBI
YSDLKKLSFK

SEQ ID NO: 151860 - protein, 10 aa, BORRELIA GARINII PBI
SDLKKLSFKD

SEQ ID NO: 151861 - protein, 10 aa, BORRELIA GARINII PBI
DLKKLSFKDK

SEQ ID NO: 151862 - protein, 10 aa, BORRELIA GARINII PBI
LKKLSFKDKF

SEQ ID NO: 151863 - protein, 10 aa, BORRELIA GARINII PBI
KKLSFKDKFL

SEQ ID NO: 151864 - protein, 10 aa, BORRELIA GARINII PBI
KLSFKDKFLK

SEQ ID NO: 151865 - protein, 10 aa, BORRELIA GARINII PBI
LSFKDKFLKE

SEQ ID NO: 151866 - protein, 10 aa, BORRELIA GARINII PBI
SFKDKFLKEA

SEQ ID NO: 151867 - protein, 10 aa, BORRELIA GARINII PBI
FKDKFLKEAA

SEQ ID NO: 151868 - protein, 10 aa, BORRELIA GARINII PBI
KDKFLKEAAL

SEQ ID NO: 151869 - protein, 10 aa, BORRELIA GARINII PBI
DKFLKEAALN

SEQ ID NO: 151870 - protein, 10 aa, BORRELIA GARINII PBI
KFLKEAALNF

SEQ ID NO: 151871 - protein, 10 aa, BORRELIA GARINII PBI
FLKEAALNFI

SEQ ID NO: 151872 - protein, 10 aa, BORRELIA GARINII PBI
LKEAALNFIN

SEQ ID NO: 151873 - protein, 10 aa, BORRELIA GARINII PBI
KEAALNFINR

SEQ ID NO: 151874 - protein, 10 aa, BORRELIA GARINII PBI
EAALNFINRA

SEQ ID NO: 151875 - protein, 10 aa, BORRELIA GARINII PBI
AALNFINRAS

SEQ ID NO: 151876 - protein, 10 aa, BORRELIA GARINII PBI
ALNFINRASV

SEQ ID NO: 151877 - protein, 10 aa, BORRELIA GARINII PBI
LNFINRASVD

SEQ ID NO: 151878 - protein, 10 aa, BORRELIA GARINII PBI
NFINRASVDE

SEQ ID NO: 151879 - protein, 10 aa, BORRELIA GARINII PBI
FINRASVDEV

SEQ ID NO: 151880 - protein, 10 aa, BORRELIA GARINII PBI
INRASVDEVR

SEQ ID NO: 151881 - protein, 10 aa, BORRELIA GARINII PBI
NRASVDEVRS

SEQ ID NO: 151882 - protein, 10 aa, BORRELIA GARINII PBI
RASVDEVRSF

SEQ ID NO: 151883 - protein, 10 aa, BORRELIA GARINII PBI
ASVDEVRSFE

SEQ ID NO: 151884 - protein, 10 aa, BORRELIA GARINII PBI
SVDEVRSFEK

SEQ ID NO: 151885 - protein, 10 aa, BORRELIA GARINII PBI
VDEVRSFEKF

SEQ ID NO: 151886 - protein, 10 aa, BORRELIA GARINII PBI
DEVRSFEKFK

SEQ ID NO: 151887 - protein, 10 aa, BORRELIA GARINII PBI
EVRSFEKFKK

SEQ ID NO: 151888 - protein, 10 aa, BORRELIA GARINII PBI
VRSFEKFKKK

SEQ ID NO: 151889 - protein, 10 aa, BORRELIA GARINII PBI
RSFEKFKKKS

SEQ ID NO: 151890 - protein, 10 aa, BORRELIA GARINII PBI
SFEKFKKKSS

SEQ ID NO: 151891 - protein, 10 aa, BORRELIA GARINII PBI
FEKFKKKSSY

SEQ ID NO: 151892 - protein, 10 aa, BORRELIA GARINII PBI
EKFKKKSSYW

SEQ ID NO: 151893 - protein, 10 aa, BORRELIA GARINII PBI
KFKKKSSYWL

SEQ ID NO: 151894 - protein, 10 aa, BORRELIA GARINII PBI
FKKKSSYWLL

SEQ ID NO: 151895 - protein, 10 aa, BORRELIA GARINII PBI
KKKSSYWLLD

SEQ ID NO: 151896 - protein, 10 aa, BORRELIA GARINII PBI
KKSSYWLLDF

SEQ ID NO: 151897 - protein, 10 aa, BORRELIA GARINII PBI
KSSYWLLDFA

SEQ ID NO: 151898 - protein, 10 aa, BORRELIA GARINII PBI
SSYWLLDFAS

SEQ ID NO: 151899 - protein, 10 aa, BORRELIA GARINII PBI
SYWLLDFASF

SEQ ID NO: 151900 - protein, 10 aa, BORRELIA GARINII PBI
YWLLDFASFV

SEQ ID NO: 151901 - protein, 10 aa, BORRELIA GARINII PBI
WLLDFASFVA

SEQ ID NO: 151902 - protein, 10 aa, BORRELIA GARINII PBI
LLDFASFVAF

SEQ ID NO: 151903 - protein, 10 aa, BORRELIA GARINII PBI
LDFASFVAFK

SEQ ID NO: 151904 - protein, 10 aa, BORRELIA GARINII PBI
DFASFVAFKE

SEQ ID NO: 151905 - protein, 10 aa, BORRELIA GARINII PBI
FASFVAFKEY

SEQ ID NO: 151906 - protein, 10 aa, BORRELIA GARINII PBI
ASFVAFKEYF

SEQ ID NO: 151907 - protein, 10 aa, BORRELIA GARINII PBI
SFVAFKEYFL

SEQ ID NO: 151908 - protein, 10 aa, BORRELIA GARINII PBI
FVAFKEYFLK

SEQ ID NO: 151909 - protein, 10 aa, BORRELIA GARINII PBI
VAFKEYFLKD

SEQ ID NO: 151910 - protein, 10 aa, BORRELIA GARINII PBI
AFKEYFLKDS

SEQ ID NO: 151911 - protein, 10 aa, BORRELIA GARINII PBI
FKEYFLKDSR

SEQ ID NO: 151912 - protein, 10 aa, BORRELIA GARINII PBI
KEYFLKDSRD

SEQ ID NO: 151913 - protein, 10 aa, BORRELIA GARINII PBI
EYFLKDSRDA

SEQ ID NO: 151914 - protein, 10 aa, BORRELIA GARINII PBI
YFLKDSRDAF

SEQ ID NO: 151915 - protein, 10 aa, BORRELIA GARINII PBI
FLKDSRDAFN

SEQ ID NO: 151916 - protein, 10 aa, BORRELIA GARINII PBI
LKDSRDAFNV

SEQ ID NO: 151917 - protein, 10 aa, BORRELIA GARINII PBI
KDSRDAFNVL

SEQ ID NO: 151918 - protein, 10 aa, BORRELIA GARINII PBI
DSRDAFNVLF

SEQ ID NO: 151919 - protein, 10 aa, BORRELIA GARINII PBI
SRDAFNVLFD

SEQ ID NO: 151920 - protein, 10 aa, BORRELIA GARINII PBI
RDAFNVLFDR

SEQ ID NO: 151921 - protein, 10 aa, BORRELIA GARINII PBI
DAFNVLFDRG

SEQ ID NO: 151922 - protein, 10 aa, BORRELIA GARINII PBI
AFNVLFDRGI

SEQ ID NO: 151923 - protein, 10 aa, BORRELIA GARINII PBI
FNVLFDRGIL

SEQ ID NO: 151924 - protein, 10 aa, BORRELIA GARINII PBI
NVLFDRGILI

SEQ ID NO: 151925 - protein, 10 aa, BORRELIA GARINII PBI
VLFDRGILIR

SEQ ID NO: 151926 - protein, 10 aa, BORRELIA GARINII PBI
LFDRGILIRN

SEQ ID NO: 151927 - protein, 10 aa, BORRELIA GARINII PBI
FDRGILIRNE

SEQ ID NO: 151928 - protein, 10 aa, BORRELIA GARINII PBI
DRGILIRNEK

SEQ ID NO: 151929 - protein, 10 aa, BORRELIA GARINII PBI
RGILIRNEKD

SEQ ID NO: 151930 - protein, 10 aa, BORRELIA GARINII PBI
GILIRNEKDL

SEQ ID NO: 151931 - protein, 10 aa, BORRELIA GARINII PBI
ILIRNEKDLF

SEQ ID NO: 151932 - protein, 10 aa, BORRELIA GARINII PBI
LIRNEKDLFK

SEQ ID NO: 151933 - protein, 10 aa, BORRELIA GARINII PBI
IRNEKDLFKL

SEQ ID NO: 151934 - protein, 10 aa, BORRELIA GARINII PBI
RNEKDLFKLR

SEQ ID NO: 151935 - protein, 10 aa, BORRELIA GARINII PBI
NEKDLFKLRN

SEQ ID NO: 151936 - protein, 10 aa, BORRELIA GARINII PBI
EKDLFKLRNI

SEQ ID NO: 151937 - protein, 10 aa, BORRELIA GARINII PBI
KDLFKLRNIL

SEQ ID NO: 151938 - protein, 10 aa, BORRELIA GARINII PBI
DLFKLRNILS

SEQ ID NO: 151939 - protein, 10 aa, BORRELIA GARINII PBI
LFKLRNILSK

SEQ ID NO: 151940 - protein, 10 aa, BORRELIA GARINII PBI
FKLRNILSKE

SEQ ID NO: 151941 - protein, 10 aa, BORRELIA GARINII PBI
KLRNILSKEI

SEQ ID NO: 151942 - protein, 10 aa, BORRELIA GARINII PBI
LRNILSKEIK

SEQ ID NO: 151943 - protein, 10 aa, BORRELIA GARINII PBI
RNILSKEIKV

SEQ ID NO: 151944 - protein, 10 aa, BORRELIA GARINII PBI
NILSKEIKVQ

SEQ ID NO: 151945 - protein, 10 aa, BORRELIA GARINII PBI
ILSKEIKVQE

SEQ ID NO: 151946 - protein, 10 aa, BORRELIA GARINII PBI
LSKEIKVQEV

SEQ ID NO: 151947 - protein, 10 aa, BORRELIA GARINII PBI
SKEIKVQEVL

SEQ ID NO: 151948 - protein, 10 aa, BORRELIA GARINII PBI
KEIKVQEVLQ

SEQ ID NO: 151949 - protein, 10 aa, BORRELIA GARINII PBI
EIKVQEVLQY

SEQ ID NO: 151950 - protein, 10 aa, BORRELIA GARINII PBI
IKVQEVLQYF

SEQ ID NO: 151951 - protein, 10 aa, BORRELIA GARINII PBI
KVQEVLQYFF

SEQ ID NO: 151952 - protein, 10 aa, BORRELIA GARINII PBI
VQEVLQYFFF

SEQ ID NO: 151953 - protein, 10 aa, BORRELIA GARINII PBI
QEVLQYFFFS

SEQ ID NO: 151954 - protein, 10 aa, BORRELIA GARINII PBI
EVLQYFFFSQ

SEQ ID NO: 151955 - protein, 10 aa, BORRELIA GARINII PBI
VLQYFFFSQF

SEQ ID NO: 151956 - protein, 10 aa, BORRELIA GARINII PBI
LQYFFFSQFQ

SEQ ID NO: 151957 - protein, 10 aa, BORRELIA GARINII PBI
QYFFFSQFQA

SEQ ID NO: 151958 - protein, 10 aa, BORRELIA GARINII PBI
YFFFSQFQAL

SEQ ID NO: 151959 - protein, 10 aa, BORRELIA GARINII PBI
FFFSQFQALK

SEQ ID NO: 151960 - protein, 10 aa, BORRELIA GARINII PBI
FFSQFQALKR

SEQ ID NO: 151961 - protein, 10 aa, BORRELIA GARINII PBI
FSQFQALKRY

SEQ ID NO: 151962 - protein, 10 aa, BORRELIA GARINII PBI
SQFQALKRYA

SEQ ID NO: 151963 - protein, 10 aa, BORRELIA GARINII PBI
QFQALKRYAN

SEQ ID NO: 151964 - protein, 10 aa, BORRELIA GARINII PBI
FQALKRYAND

SEQ ID NO: 151965 - protein, 10 aa, BORRELIA GARINII PBI
QALKRYANDK

SEQ ID NO: 151966 - protein, 10 aa, BORRELIA GARINII PBI
ALKRYANDKG

SEQ ID NO: 151967 - protein, 10 aa, BORRELIA GARINII PBI
LKRYANDKGI

SEQ ID NO: 151968 - protein, 10 aa, BORRELIA GARINII PBI
KRYANDKGIE

SEQ ID NO: 151969 - protein, 10 aa, BORRELIA GARINII PBI
RYANDKGIEL

SEQ ID NO: 151970 - protein, 10 aa, BORRELIA GARINII PBI
YANDKGIELV

SEQ ID NO: 151971 - protein, 10 aa, BORRELIA GARINII PBI
ANDKGIELVM

SEQ ID NO: 151972 - protein, 10 aa, BORRELIA GARINII PBI
NDKGIELVMN

SEQ ID NO: 151973 - protein, 10 aa, BORRELIA GARINII PBI
DKGIELVMNL

SEQ ID NO: 151974 - protein, 10 aa, BORRELIA GARINII PBI
KGIELVMNLP

SEQ ID NO: 151975 - protein, 10 aa, BORRELIA GARINII PBI
GIELVMNLPL

SEQ ID NO: 151976 - protein, 10 aa, BORRELIA GARINII PBI
IELVMNLPLF

SEQ ID NO: 151977 - protein, 10 aa, BORRELIA GARINII PBI
ELVMNLPLFI

SEQ ID NO: 151978 - protein, 10 aa, BORRELIA GARINII PBI
LVMNLPLFIA

SEQ ID NO: 151979 - protein, 10 aa, BORRELIA GARINII PBI
VMNLPLFIAY

SEQ ID NO: 151980 - protein, 10 aa, BORRELIA GARINII PBI
MNLPLFIAYD

SEQ ID NO: 151981 - protein, 10 aa, BORRELIA GARINII PBI
NLPLFIAYDS

SEQ ID NO: 151982 - protein, 10 aa, BORRELIA GARINII PBI
LPLFIAYDSA

SEQ ID NO: 151983 - protein, 10 aa, BORRELIA GARINII PBI
PLFIAYDSAD

SEQ ID NO: 151984 - protein, 10 aa, BORRELIA GARINII PBI
LFIAYDSADV

SEQ ID NO: 151985 - protein, 10 aa, BORRELIA GARINII PBI
FIAYDSADVW

SEQ ID NO: 151986 - protein, 10 aa, BORRELIA GARINII PBI
IAYDSADVWA

SEQ ID NO: 151987 - protein, 10 aa, BORRELIA GARINII PBI
AYDSADVWAH

SEQ ID NO: 151988 - protein, 10 aa, BORRELIA GARINII PBI
YDSADVWAHQ

SEQ ID NO: 151989 - protein, 10 aa, BORRELIA GARINII PBI
DSADVWAHQK

SEQ ID NO: 151990 - protein, 10 aa, BORRELIA GARINII PBI
SADVWAHQKY

SEQ ID NO: 151991 - protein, 10 aa, BORRELIA GARINII PBI
ADVWAHQKYF

SEQ ID NO: 151992 - protein, 10 aa, BORRELIA GARINII PBI
DVWAHQKYFK

SEQ ID NO: 151993 - protein, 10 aa, BORRELIA GARINII PBI
VWAHQKYFKL

SEQ ID NO: 151994 - protein, 10 aa, BORRELIA GARINII PBI
WAHQKYFKLR

SEQ ID NO: 151995 - protein, 10 aa, BORRELIA GARINII PBI
AHQKYFKLRF

SEQ ID NO: 151996 - protein, 10 aa, BORRELIA GARINII PBI
HQKYFKLRFD

SEQ ID NO: 151997 - protein, 10 aa, BORRELIA GARINII PBI
QKYFKLRFDA

SEQ ID NO: 151998 - protein, 10 aa, BORRELIA GARINII PBI
KYFKLRFDAS

SEQ ID NO: 151999 - protein, 10 aa, BORRELIA GARINII PBI
YFKLRFDASK

SEQ ID NO: 152000 - protein, 10 aa, BORRELIA GARINII PBI
FKLRFDASKD

SEQ ID NO: 152001 - protein, 10 aa, BORRELIA GARINII PBI
KLRFDASKDK

SEQ ID NO: 152002 - protein, 10 aa, BORRELIA GARINII PBI
LRFDASKDKV

SEQ ID NO: 152003 - protein, 10 aa, BORRELIA GARINII PBI
RFDASKDKVA

SEQ ID NO: 152004 - protein, 10 aa, BORRELIA GARINII PBI
FDASKDKVAG

SEQ ID NO: 152005 - protein, 10 aa, BORRELIA GARINII PBI
DASKDKVAGI

SEQ ID NO: 152006 - protein, 10 aa, BORRELIA GARINII PBI
ASKDKVAGIS

SEQ ID NO: 152007 - protein, 10 aa, BORRELIA GARINII PBI
SKDKVAGISP

SEQ ID NO: 152008 - protein, 10 aa, BORRELIA GARINII PBI
KDKVAGISPD

SEQ ID NO: 152009 - protein, 10 aa, BORRELIA GARINII PBI
DKVAGISPDY

SEQ ID NO: 152010 - protein, 10 aa, BORRELIA GARINII PBI
KVAGISPDYF

SEQ ID NO: 152011 - protein, 10 aa, BORRELIA GARINII PBI
VAGISPDYFL

SEQ ID NO: 152012 - protein, 10 aa, BORRELIA GARINII PBI
AGISPDYFLE

SEQ ID NO: 152013 - protein, 10 aa, BORRELIA GARINII PBI
GISPDYFLEQ

SEQ ID NO: 152014 - protein, 10 aa, BORRELIA GARINII PBI
ISPDYFLEQE

SEQ ID NO: 152015 - protein, 10 aa, BORRELIA GARINII PBI
SPDYFLEQEQ

SEQ ID NO: 152016 - protein, 10 aa, BORRELIA GARINII PBI
PDYFLEQEQA

SEQ ID NO: 152017 - protein, 10 aa, BORRELIA GARINII PBI
DYFLEQEQAW

SEQ ID NO: 152018 - protein, 10 aa, BORRELIA GARINII PBI
YFLEQEQAWD

SEQ ID NO: 152019 - protein, 10 aa, BORRELIA GARINII PBI
FLEQEQAWDS

SEQ ID NO: 152020 - protein, 10 aa, BORRELIA GARINII PBI
LEQEQAWDSP

SEQ ID NO: 152021 - protein, 10 aa, BORRELIA GARINII PBI
EQEQAWDSPA

SEQ ID NO: 152022 - protein, 10 aa, BORRELIA GARINII PBI
QEQAWDSPAY

SEQ ID NO: 152023 - protein, 10 aa, BORRELIA GARINII PBI
EQAWDSPAYS

SEQ ID NO: 152024 - protein, 10 aa, BORRELIA GARINII PBI
QAWDSPAYSW

SEQ ID NO: 152025 - protein, 10 aa, BORRELIA GARINII PBI
AWDSPAYSWN

SEQ ID NO: 152026 - protein, 10 aa, BORRELIA GARINII PBI
WDSPAYSWNV

SEQ ID NO: 152027 - protein, 10 aa, BORRELIA GARINII PBI
DSPAYSWNVL

SEQ ID NO: 152028 - protein, 10 aa, BORRELIA GARINII PBI
SPAYSWNVLK

SEQ ID NO: 152029 - protein, 10 aa, BORRELIA GARINII PBI
PAYSWNVLKN

SEQ ID NO: 152030 - protein, 10 aa, BORRELIA GARINII PBI
AYSWNVLKNV

SEQ ID NO: 152031 - protein, 10 aa, BORRELIA GARINII PBI
YSWNVLKNVK

SEQ ID NO: 152032 - protein, 10 aa, BORRELIA GARINII PBI
SWNVLKNVKY

SEQ ID NO: 152033 - protein, 10 aa, BORRELIA GARINII PBI
WNVLKNVKYE

SEQ ID NO: 152034 - protein, 10 aa, BORRELIA GARINII PBI
NVLKNVKYEW

SEQ ID NO: 152035 - protein, 10 aa, BORRELIA GARINII PBI
VLKNVKYEWW

SEQ ID NO: 152036 - protein, 10 aa, BORRELIA GARINII PBI
LKNVKYEWWA

SEQ ID NO: 152037 - protein, 10 aa, BORRELIA GARINII PBI
KNVKYEWWAK

SEQ ID NO: 152038 - protein, 10 aa, BORRELIA GARINII PBI
NVKYEWWAKR

SEQ ID NO: 152039 - protein, 10 aa, BORRELIA GARINII PBI
VKYEWWAKRI

SEQ ID NO: 152040 - protein, 10 aa, BORRELIA GARINII PBI
KYEWWAKRIG

SEQ ID NO: 152041 - protein, 10 aa, BORRELIA GARINII PBI
YEWWAKRIGI

SEQ ID NO: 152042 - protein, 10 aa, BORRELIA GARINII PBI
EWWAKRIGIL

SEQ ID NO: 152043 - protein, 10 aa, BORRELIA GARINII PBI
WWAKRIGILR

SEQ ID NO: 152044 - protein, 10 aa, BORRELIA GARINII PBI
WAKRIGILRK

SEQ ID NO: 152045 - protein, 10 aa, BORRELIA GARINII PBI
AKRIGILRKY

SEQ ID NO: 152046 - protein, 10 aa, BORRELIA GARINII PBI
KRIGILRKYI

SEQ ID NO: 152047 - protein, 10 aa, BORRELIA GARINII PBI
RIGILRKYID

SEQ ID NO: 152048 - protein, 10 aa, BORRELIA GARINII PBI
IGILRKYIDV

SEQ ID NO: 152049 - protein, 10 aa, BORRELIA GARINII PBI
GILRKYIDVI

SEQ ID NO: 152050 - protein, 10 aa, BORRELIA GARINII PBI
ILRKYIDVIK

SEQ ID NO: 152051 - protein, 10 aa, BORRELIA GARINII PBI
LRKYIDVIKI

SEQ ID NO: 152052 - protein, 10 aa, BORRELIA GARINII PBI
RKYIDVIKID

SEQ ID NO: 152053 - protein, 10 aa, BORRELIA GARINII PBI
KYIDVIKIDH

SEQ ID NO: 152054 - protein, 10 aa, BORRELIA GARINII PBI
YIDVIKIDHF

SEQ ID NO: 152055 - protein, 10 aa, BORRELIA GARINII PBI
IDVIKIDHFR

SEQ ID NO: 152056 - protein, 10 aa, BORRELIA GARINII PBI
DVIKIDHFRG

SEQ ID NO: 152057 - protein, 10 aa, BORRELIA GARINII PBI
VIKIDHFRGF

SEQ ID NO: 152058 - protein, 10 aa, BORRELIA GARINII PBI
IKIDHFRGFV

SEQ ID NO: 152059 - protein, 10 aa, BORRELIA GARINII PBI
KIDHFRGFVS

SEQ ID NO: 152060 - protein, 10 aa, BORRELIA GARINII PBI
IDHFRGFVST

SEQ ID NO: 152061 - protein, 10 aa, BORRELIA GARINII PBI
DHFRGFVSTW

SEQ ID NO: 152062 - protein, 10 aa, BORRELIA GARINII PBI
HFRGFVSTWE

SEQ ID NO: 152063 - protein, 10 aa, BORRELIA GARINII PBI
FRGFVSTWEV

SEQ ID NO: 152064 - protein, 10 aa, BORRELIA GARINII PBI
RGFVSTWEVG

SEQ ID NO: 152065 - protein, 10 aa, BORRELIA GARINII PBI
GFVSTWEVGV

SEQ ID NO: 152066 - protein, 10 aa, BORRELIA GARINII PBI
FVSTWEVGVG

SEQ ID NO: 152067 - protein, 10 aa, BORRELIA GARINII PBI
VSTWEVGVGE

SEQ ID NO: 152068 - protein, 10 aa, BORRELIA GARINII PBI
STWEVGVGEA

SEQ ID NO: 152069 - protein, 10 aa, BORRELIA GARINII PBI
TWEVGVGEAY

SEQ ID NO: 152070 - protein, 10 aa, BORRELIA GARINII PBI
WEVGVGEAYA

SEQ ID NO: 152071 - protein, 10 aa, BORRELIA GARINII PBI
EVGVGEAYAF

SEQ ID NO: 152072 - protein, 10 aa, BORRELIA GARINII PBI
VGVGEAYAFN

SEQ ID NO: 152073 - protein, 10 aa, BORRELIA GARINII PBI
GVGEAYAFNG

SEQ ID NO: 152074 - protein, 10 aa, BORRELIA GARINII PBI
VGEAYAFNGL

SEQ ID NO: 152075 - protein, 10 aa, BORRELIA GARINII PBI
GEAYAFNGLW

SEQ ID NO: 152076 - protein, 10 aa, BORRELIA GARINII PBI
EAYAFNGLWV

SEQ ID NO: 152077 - protein, 10 aa, BORRELIA GARINII PBI
AYAFNGLWVK

SEQ ID NO: 152078 - protein, 10 aa, BORRELIA GARINII PBI
YAFNGLWVKS

SEQ ID NO: 152079 - protein, 10 aa, BORRELIA GARINII PBI
AFNGLWVKSP

SEQ ID NO: 152080 - protein, 10 aa, BORRELIA GARINII PBI
FNGLWVKSPG

SEQ ID NO: 152081 - protein, 10 aa, BORRELIA GARINII PBI
NGLWVKSPGR

SEQ ID NO: 152082 - protein, 10 aa, BORRELIA GARINII PBI
GLWVKSPGRD

SEQ ID NO: 152083 - protein, 10 aa, BORRELIA GARINII PBI
LWVKSPGRDF

SEQ ID NO: 152084 - protein, 10 aa, BORRELIA GARINII PBI
WVKSPGRDFF

SEQ ID NO: 152085 - protein, 10 aa, BORRELIA GARINII PBI
VKSPGRDFFN

SEQ ID NO: 152086 - protein, 10 aa, BORRELIA GARINII PBI
KSPGRDFFNF

SEQ ID NO: 152087 - protein, 10 aa, BORRELIA GARINII PBI
SPGRDFFNFI

SEQ ID NO: 152088 - protein, 10 aa, BORRELIA GARINII PBI
PGRDFFNFIL

SEQ ID NO: 152089 - protein, 10 aa, BORRELIA GARINII PBI
GRDFFNFILN

SEQ ID NO: 152090 - protein, 10 aa, BORRELIA GARINII PBI
RDFFNFILNE

SEQ ID NO: 152091 - protein, 10 aa, BORRELIA GARINII PBI
DFFNFILNEI

SEQ ID NO: 152092 - protein, 10 aa, BORRELIA GARINII PBI
FFNFILNEIK

SEQ ID NO: 152093 - protein, 10 aa, BORRELIA GARINII PBI
FNFILNEIKD

SEQ ID NO: 152094 - protein, 10 aa, BORRELIA GARINII PBI
NFILNEIKDL

SEQ ID NO: 152095 - protein, 10 aa, BORRELIA GARINII PBI
FILNEIKDLK

SEQ ID NO: 152096 - protein, 10 aa, BORRELIA GARINII PBI
ILNEIKDLKI

SEQ ID NO: 152097 - protein, 10 aa, BORRELIA GARINII PBI
LNEIKDLKIW

SEQ ID NO: 152098 - protein, 10 aa, BORRELIA GARINII PBI
NEIKDLKIWV

SEQ ID NO: 152099 - protein, 10 aa, BORRELIA GARINII PBI
EIKDLKIWVE

SEQ ID NO: 152100 - protein, 10 aa, BORRELIA GARINII PBI
IKDLKIWVED

SEQ ID NO: 152101 - protein, 10 aa, BORRELIA GARINII PBI
KDLKIWVEDF

SEQ ID NO: 152102 - protein, 10 aa, BORRELIA GARINII PBI
DLKIWVEDFE

SEQ ID NO: 152103 - protein, 10 aa, BORRELIA GARINII PBI
LKIWVEDFEN

SEQ ID NO: 152104 - protein, 10 aa, BORRELIA GARINII PBI
KIWVEDFEND

SEQ ID NO: 152105 - protein, 10 aa, BORRELIA GARINII PBI
IWVEDFENDL

SEQ ID NO: 152106 - protein, 10 aa, BORRELIA GARINII PBI
WVEDFENDLE

SEQ ID NO: 152107 - protein, 10 aa, BORRELIA GARINII PBI
VEDFENDLED

SEQ ID NO: 152108 - protein, 10 aa, BORRELIA GARINII PBI
EDFENDLEDV

SEQ ID NO: 152109 - protein, 10 aa, BORRELIA GARINII PBI
DFENDLEDVS

SEQ ID NO: 152110 - protein, 10 aa, BORRELIA GARINII PBI
FENDLEDVSR

SEQ ID NO: 152111 - protein, 10 aa, BORRELIA GARINII PBI
ENDLEDVSRL

SEQ ID NO: 152112 - protein, 10 aa, BORRELIA GARINII PBI
NDLEDVSRLR

SEQ ID NO: 152113 - protein, 10 aa, BORRELIA GARINII PBI
DLEDVSRLRD

SEQ ID NO: 152114 - protein, 10 aa, BORRELIA GARINII PBI
LEDVSRLRDF

SEQ ID NO: 152115 - protein, 10 aa, BORRELIA GARINII PBI
EDVSRLRDFF

SEQ ID NO: 152116 - protein, 10 aa, BORRELIA GARINII PBI
DVSRLRDFFN

SEQ ID NO: 152117 - protein, 10 aa, BORRELIA GARINII PBI
VSRLRDFFNF

SEQ ID NO: 152118 - protein, 10 aa, BORRELIA GARINII PBI
SRLRDFFNFP

SEQ ID NO: 152119 - protein, 10 aa, BORRELIA GARINII PBI
RLRDFFNFPG

SEQ ID NO: 152120 - protein, 10 aa, BORRELIA GARINII PBI
LRDFFNFPGM

SEQ ID NO: 152121 - protein, 10 aa, BORRELIA GARINII PBI
RDFFNFPGMR

SEQ ID NO: 152122 - protein, 10 aa, BORRELIA GARINII PBI
DFFNFPGMRI

SEQ ID NO: 152123 - protein, 10 aa, BORRELIA GARINII PBI
FFNFPGMRIM

SEQ ID NO: 152124 - protein, 10 aa, BORRELIA GARINII PBI
FNFPGMRIMK

SEQ ID NO: 152125 - protein, 10 aa, BORRELIA GARINII PBI
NFPGMRIMKL

SEQ ID NO: 152126 - protein, 10 aa, BORRELIA GARINII PBI
FPGMRIMKLA

SEQ ID NO: 152127 - protein, 10 aa, BORRELIA GARINII PBI
PGMRIMKLAF

SEQ ID NO: 152128 - protein, 10 aa, BORRELIA GARINII PBI
GMRIMKLAFD

SEQ ID NO: 152129 - protein, 10 aa, BORRELIA GARINII PBI
MRIMKLAFDF

SEQ ID NO: 152130 - protein, 10 aa, BORRELIA GARINII PBI
RIMKLAFDFD

SEQ ID NO: 152131 - protein, 10 aa, BORRELIA GARINII PBI
IMKLAFDFDS

SEQ ID NO: 152132 - protein, 10 aa, BORRELIA GARINII PBI
MKLAFDFDSD

SEQ ID NO: 152133 - protein, 10 aa, BORRELIA GARINII PBI
KLAFDFDSDN

SEQ ID NO: 152134 - protein, 10 aa, BORRELIA GARINII PBI
LAFDFDSDNQ

SEQ ID NO: 152135 - protein, 10 aa, BORRELIA GARINII PBI
AFDFDSDNQN

SEQ ID NO: 152136 - protein, 10 aa, BORRELIA GARINII PBI
FDFDSDNQNL

SEQ ID NO: 152137 - protein, 10 aa, BORRELIA GARINII PBI
DFDSDNQNLP

SEQ ID NO: 152138 - protein, 10 aa, BORRELIA GARINII PBI
FDSDNQNLPH

SEQ ID NO: 152139 - protein, 10 aa, BORRELIA GARINII PBI
DSDNQNLPHN

SEQ ID NO: 152140 - protein, 10 aa, BORRELIA GARINII PBI
SDNQNLPHNY

SEQ ID NO: 152141 - protein, 10 aa, BORRELIA GARINII PBI
DNQNLPHNYI

SEQ ID NO: 152142 - protein, 10 aa, BORRELIA GARINII PBI
NQNLPHNYIK

SEQ ID NO: 152143 - protein, 10 aa, BORRELIA GARINII PBI
QNLPHNYIKN

SEQ ID NO: 152144 - protein, 10 aa, BORRELIA GARINII PBI
NLPHNYIKNC

SEQ ID NO: 152145 - protein, 10 aa, BORRELIA GARINII PBI
LPHNYIKNCI

SEQ ID NO: 152146 - protein, 10 aa, BORRELIA GARINII PBI
PHNYIKNCIV

SEQ ID NO: 152147 - protein, 10 aa, BORRELIA GARINII PBI
HNYIKNCIVY

SEQ ID NO: 152148 - protein, 10 aa, BORRELIA GARINII PBI
NYIKNCIVYT

SEQ ID NO: 152149 - protein, 10 aa, BORRELIA GARINII PBI
YIKNCIVYTG

SEQ ID NO: 152150 - protein, 10 aa, BORRELIA GARINII PBI
IKNCIVYTGI

SEQ ID NO: 152151 - protein, 10 aa, BORRELIA GARINII PBI
KNCIVYTGIG

SEQ ID NO: 152152 - protein, 10 aa, BORRELIA GARINII PBI
NCIVYTGIGD

SEQ ID NO: 152153 - protein, 10 aa, BORRELIA GARINII PBI
CIVYTGIGDN

SEQ ID NO: 152154 - protein, 10 aa, BORRELIA GARINII PBI
IVYTGIGDNS

SEQ ID NO: 152155 - protein, 10 aa, BORRELIA GARINII PBI
VYTGIGDNST

SEQ ID NO: 152156 - protein, 10 aa, BORRELIA GARINII PBI
YTGIGDNSTI

SEQ ID NO: 152157 - protein, 10 aa, BORRELIA GARINII PBI
TGIGDNSTIR

SEQ ID NO: 152158 - protein, 10 aa, BORRELIA GARINII PBI
GIGDNSTIRE

SEQ ID NO: 152159 - protein, 10 aa, BORRELIA GARINII PBI
IGDNSTIREF

SEQ ID NO: 152160 - protein, 10 aa, BORRELIA GARINII PBI
GDNSTIREFV

SEQ ID NO: 152161 - protein, 10 aa, BORRELIA GARINII PBI
DNSTIREFVN

SEQ ID NO: 152162 - protein, 10 aa, BORRELIA GARINII PBI
NSTIREFVNS

SEQ ID NO: 152163 - protein, 10 aa, BORRELIA GARINII PBI
STIREFVNSL

SEQ ID NO: 152164 - protein, 10 aa, BORRELIA GARINII PBI
TIREFVNSLD

SEQ ID NO: 152165 - protein, 10 aa, BORRELIA GARINII PBI
IREFVNSLDD

SEQ ID NO: 152166 - protein, 10 aa, BORRELIA GARINII PBI
REFVNSLDDL

SEQ ID NO: 152167 - protein, 10 aa, BORRELIA GARINII PBI
EFVNSLDDLH

SEQ ID NO: 152168 - protein, 10 aa, BORRELIA GARINII PBI
FVNSLDDLHK

SEQ ID NO: 152169 - protein, 10 aa, BORRELIA GARINII PBI
VNSLDDLHKK

SEQ ID NO: 152170 - protein, 10 aa, BORRELIA GARINII PBI
NSLDDLHKKY

SEQ ID NO: 152171 - protein, 10 aa, BORRELIA GARINII PBI
SLDDLHKKYI

SEQ ID NO: 152172 - protein, 10 aa, BORRELIA GARINII PBI
LDDLHKKYIF

SEQ ID NO: 152173 - protein, 10 aa, BORRELIA GARINII PBI
DDLHKKYIFD

SEQ ID NO: 152174 - protein, 10 aa, BORRELIA GARINII PBI
DLHKKYIFDY

SEQ ID NO: 152175 - protein, 10 aa, BORRELIA GARINII PBI
LHKKYIFDYL

SEQ ID NO: 152176 - protein, 10 aa, BORRELIA GARINII PBI
HKKYIFDYLN

SEQ ID NO: 152177 - protein, 10 aa, BORRELIA GARINII PBI
KKYIFDYLNT

SEQ ID NO: 152178 - protein, 10 aa, BORRELIA GARINII PBI
KYIFDYLNTN

SEQ ID NO: 152179 - protein, 10 aa, BORRELIA GARINII PBI
YIFDYLNTNE

SEQ ID NO: 152180 - protein, 10 aa, BORRELIA GARINII PBI
IFDYLNTNED

SEQ ID NO: 152181 - protein, 10 aa, BORRELIA GARINII PBI
FDYLNTNEDF

SEQ ID NO: 152182 - protein, 10 aa, BORRELIA GARINII PBI
DYLNTNEDFV

SEQ ID NO: 152183 - protein, 10 aa, BORRELIA GARINII PBI
YLNTNEDFVV

SEQ ID NO: 152184 - protein, 10 aa, BORRELIA GARINII PBI
LNTNEDFVVW

SEQ ID NO: 152185 - protein, 10 aa, BORRELIA GARINII PBI
NTNEDFVVWD

SEQ ID NO: 152186 - protein, 10 aa, BORRELIA GARINII PBI
TNEDFVVWDM

SEQ ID NO: 152187 - protein, 10 aa, BORRELIA GARINII PBI
NEDFVVWDMI

SEQ ID NO: 152188 - protein, 10 aa, BORRELIA GARINII PBI
EDFVVWDMIR

SEQ ID NO: 152189 - protein, 10 aa, BORRELIA GARINII PBI
DFVVWDMIRS

SEQ ID NO: 152190 - protein, 10 aa, BORRELIA GARINII PBI
FVVWDMIRSA

SEQ ID NO: 152191 - protein, 10 aa, BORRELIA GARINII PBI
VVWDMIRSAM

SEQ ID NO: 152192 - protein, 10 aa, BORRELIA GARINII PBI
VWDMIRSAMS

SEQ ID NO: 152193 - protein, 10 aa, BORRELIA GARINII PBI
WDMIRSAMSS

SEQ ID NO: 152194 - protein, 10 aa, BORRELIA GARINII PBI
DMIRSAMSSV

SEQ ID NO: 152195 - protein, 10 aa, BORRELIA GARINII PBI
MIRSAMSSVS

SEQ ID NO: 152196 - protein, 10 aa, BORRELIA GARINII PBI
IRSAMSSVSD

SEQ ID NO: 152197 - protein, 10 aa, BORRELIA GARINII PBI
RSAMSSVSDS

SEQ ID NO: 152198 - protein, 10 aa, BORRELIA GARINII PBI
SAMSSVSDSV

SEQ ID NO: 152199 - protein, 10 aa, BORRELIA GARINII PBI
AMSSVSDSVI

SEQ ID NO: 152200 - protein, 10 aa, BORRELIA GARINII PBI
MSSVSDSVII

SEQ ID NO: 152201 - protein, 10 aa, BORRELIA GARINII PBI
SSVSDSVIIP

SEQ ID NO: 152202 - protein, 10 aa, BORRELIA GARINII PBI
SVSDSVIIPM

SEQ ID NO: 152203 - protein, 10 aa, BORRELIA GARINII PBI
VSDSVIIPMQ

SEQ ID NO: 152204 - protein, 10 aa, BORRELIA GARINII PBI
SDSVIIPMQD

SEQ ID NO: 152205 - protein, 10 aa, BORRELIA GARINII PBI
DSVIIPMQDY

SEQ ID NO: 152206 - protein, 10 aa, BORRELIA GARINII PBI
SVIIPMQDYI

SEQ ID NO: 152207 - protein, 10 aa, BORRELIA GARINII PBI
VIIPMQDYIN

SEQ ID NO: 152208 - protein, 10 aa, BORRELIA GARINII PBI
IIPMQDYINL

SEQ ID NO: 152209 - protein, 10 aa, BORRELIA GARINII PBI
IPMQDYINLG

SEQ ID NO: 152210 - protein, 10 aa, BORRELIA GARINII PBI
PMQDYINLGN

SEQ ID NO: 152211 - protein, 10 aa, BORRELIA GARINII PBI
MQDYINLGNE

SEQ ID NO: 152212 - protein, 10 aa, BORRELIA GARINII PBI
QDYINLGNEF

SEQ ID NO: 152213 - protein, 10 aa, BORRELIA GARINII PBI
DYINLGNEFR

SEQ ID NO: 152214 - protein, 10 aa, BORRELIA GARINII PBI
YINLGNEFRA

SEQ ID NO: 152215 - protein, 10 aa, BORRELIA GARINII PBI
INLGNEFRAN

SEQ ID NO: 152216 - protein, 10 aa, BORRELIA GARINII PBI
NLGNEFRANI

SEQ ID NO: 152217 - protein, 10 aa, BORRELIA GARINII PBI
LGNEFRANIP

SEQ ID NO: 152218 - protein, 10 aa, BORRELIA GARINII PBI
GNEFRANIPK

SEQ ID NO: 152219 - protein, 10 aa, BORRELIA GARINII PBI
NEFRANIPKN

SEQ ID NO: 152220 - protein, 10 aa, BORRELIA GARINII PBI
EFRANIPKNT

SEQ ID NO: 152221 - protein, 10 aa, BORRELIA GARINII PBI
FRANIPKNTL

SEQ ID NO: 152222 - protein, 10 aa, BORRELIA GARINII PBI
RANIPKNTLN

SEQ ID NO: 152223 - protein, 10 aa, BORRELIA GARINII PBI
ANIPKNTLNN

SEQ ID NO: 152224 - protein, 10 aa, BORRELIA GARINII PBI
NIPKNTLNNW

SEQ ID NO: 152225 - protein, 10 aa, BORRELIA GARINII PBI
IPKNTLNNWI

SEQ ID NO: 152226 - protein, 10 aa, BORRELIA GARINII PBI
PKNTLNNWIF

SEQ ID NO: 152227 - protein, 10 aa, BORRELIA GARINII PBI
KNTLNNWIFR

SEQ ID NO: 152228 - protein, 10 aa, BORRELIA GARINII PBI
NTLNNWIFRL

SEQ ID NO: 152229 - protein, 10 aa, BORRELIA GARINII PBI
TLNNWIFRLL

SEQ ID NO: 152230 - protein, 10 aa, BORRELIA GARINII PBI
LNNWIFRLLE

SEQ ID NO: 152231 - protein, 10 aa, BORRELIA GARINII PBI
NNWIFRLLES

SEQ ID NO: 152232 - protein, 10 aa, BORRELIA GARINII PBI
NWIFRLLESD

SEQ ID NO: 152233 - protein, 10 aa, BORRELIA GARINII PBI
WIFRLLESDL

SEQ ID NO: 152234 - protein, 10 aa, BORRELIA GARINII PBI
IFRLLESDLD

SEQ ID NO: 152235 - protein, 10 aa, BORRELIA GARINII PBI
FRLLESDLDA

SEQ ID NO: 152236 - protein, 10 aa, BORRELIA GARINII PBI
RLLESDLDAT

SEQ ID NO: 152237 - protein, 10 aa, BORRELIA GARINII PBI
LLESDLDATL

SEQ ID NO: 152238 - protein, 10 aa, BORRELIA GARINII PBI
LESDLDATLS

SEQ ID NO: 152239 - protein, 10 aa, BORRELIA GARINII PBI
ESDLDATLSK

SEQ ID NO: 152240 - protein, 10 aa, BORRELIA GARINII PBI
SDLDATLSKN

SEQ ID NO: 152241 - protein, 10 aa, BORRELIA GARINII PBI
DLDATLSKNI

SEQ ID NO: 152242 - protein, 10 aa, BORRELIA GARINII PBI
LDATLSKNIS

SEQ ID NO: 152243 - protein, 10 aa, BORRELIA GARINII PBI
DATLSKNISF

SEQ ID NO: 152244 - protein, 10 aa, BORRELIA GARINII PBI
ATLSKNISFI

SEQ ID NO: 152245 - protein, 10 aa, BORRELIA GARINII PBI
TLSKNISFIT

SEQ ID NO: 152246 - protein, 10 aa, BORRELIA GARINII PBI
LSKNISFITR

SEQ ID NO: 152247 - protein, 10 aa, BORRELIA GARINII PBI
SKNISFITRL

SEQ ID NO: 152248 - protein, 10 aa, BORRELIA GARINII PBI
KNISFITRLY

SEQ ID NO: 152249 - protein, 10 aa, BORRELIA GARINII PBI
NISFITRLYG

SEQ ID NO: 152250 - protein, 10 aa, BORRELIA GARINII PBI
ISFITRLYGR

SEQ ID NO: 152251 - protein, 10 aa, BORRELIA GARINII PBI
SFITRLYGRT

SEQ ID NO: 152252 - protein, 11 aa, BORRELIA GARINII PBI
MKYKKIRINLN

SEQ ID NO: 152253 - protein, 11 aa, BORRELIA GARINII PBI
KYKKIRINLNL

SEQ ID NO: 152254 - protein, 11 aa, BORRELIA GARINII PBI
YKKIRINLNLK

SEQ ID NO: 152255 - protein, 11 aa, BORRELIA GARINII PBI
KKIRINLNLKR

SEQ ID NO: 152256 - protein, 11 aa, BORRELIA GARINII PBI
KIRINLNLKRK

SEQ ID NO: 152257 - protein, 11 aa, BORRELIA GARINII PBI
IRINLNLKRKS

SEQ ID NO: 152258 - protein, 11 aa, BORRELIA GARINII PBI
RINLNLKRKSG

SEQ ID NO: 152259 - protein, 11 aa, BORRELIA GARINII PBI
INLNLKRKSGI

SEQ ID NO: 152260 - protein, 11 aa, BORRELIA GARINII PBI
NLNLKRKSGIL

SEQ ID NO: 152261 - protein, 11 aa, BORRELIA GARINII PBI
LNLKRKSGILL

SEQ ID NO: 152262 - protein, 11 aa, BORRELIA GARINII PBI
NLKRKSGILLN

SEQ ID NO: 152263 - protein, 11 aa, BORRELIA GARINII PBI
LKRKSGILLNI

SEQ ID NO: 152264 - protein, 11 aa, BORRELIA GARINII PBI
KRKSGILLNIS

SEQ ID NO: 152265 - protein, 11 aa, BORRELIA GARINII PBI
RKSGILLNISS

SEQ ID NO: 152266 - protein, 11 aa, BORRELIA GARINII PBI
KSGILLNISSL

SEQ ID NO: 152267 - protein, 11 aa, BORRELIA GARINII PBI
SGILLNISSLP

SEQ ID NO: 152268 - protein, 11 aa, BORRELIA GARINII PBI
GILLNISSLPS

SEQ ID NO: 152269 - protein, 11 aa, BORRELIA GARINII PBI
ILLNISSLPSK

SEQ ID NO: 152270 - protein, 11 aa, BORRELIA GARINII PBI
LLNISSLPSKY

SEQ ID NO: 152271 - protein, 11 aa, BORRELIA GARINII PBI
LNISSLPSKYG

SEQ ID NO: 152272 - protein, 11 aa, BORRELIA GARINII PBI
NISSLPSKYGI

SEQ ID NO: 152273 - protein, 11 aa, BORRELIA GARINII PBI
ISSLPSKYGIG

SEQ ID NO: 152274 - protein, 11 aa, BORRELIA GARINII PBI
SSLPSKYGIGD

SEQ ID NO: 152275 - protein, 11 aa, BORRELIA GARINII PBI
SLPSKYGIGDL

SEQ ID NO: 152276 - protein, 11 aa, BORRELIA GARINII PBI
LPSKYGIGDLG

SEQ ID NO: 152277 - protein, 11 aa, BORRELIA GARINII PBI
PSKYGIGDLGK

SEQ ID NO: 152278 - protein, 11 aa, BORRELIA GARINII PBI
SKYGIGDLGKG

SEQ ID NO: 152279 - protein, 11 aa, BORRELIA GARINII PBI
KYGIGDLGKGA

SEQ ID NO: 152280 - protein, 11 aa, BORRELIA GARINII PBI
YGIGDLGKGAY

SEQ ID NO: 152281 - protein, 11 aa, BORRELIA GARINII PBI
GIGDLGKGAYK

SEQ ID NO: 152282 - protein, 11 aa, BORRELIA GARINII PBI
IGDLGKGAYKF

SEQ ID NO: 152283 - protein, 11 aa, BORRELIA GARINII PBI
GDLGKGAYKFI

SEQ ID NO: 152284 - protein, 11 aa, BORRELIA GARINII PBI
DLGKGAYKFID

SEQ ID NO: 152285 - protein, 11 aa, BORRELIA GARINII PBI
LGKGAYKFIDF

SEQ ID NO: 152286 - protein, 11 aa, BORRELIA GARINII PBI
GKGAYKFIDFL

SEQ ID NO: 152287 - protein, 11 aa, BORRELIA GARINII PBI
KGAYKFIDFLF

SEQ ID NO: 152288 - protein, 11 aa, BORRELIA GARINII PBI
GAYKFIDFLFA

SEQ ID NO: 152289 - protein, 11 aa, BORRELIA GARINII PBI
AYKFIDFLFAS

SEQ ID NO: 152290 - protein, 11 aa, BORRELIA GARINII PBI
YKFIDFLFASS

SEQ ID NO: 152291 - protein, 11 aa, BORRELIA GARINII PBI
KFIDFLFASSQ

SEQ ID NO: 152292 - protein, 11 aa, BORRELIA GARINII PBI
FIDFLFASSQS

SEQ ID NO: 152293 - protein, 11 aa, BORRELIA GARINII PBI
IDFLFASSQSY

SEQ ID NO: 152294 - protein, 11 aa, BORRELIA GARINII PBI
DFLFASSQSYW

SEQ ID NO: 152295 - protein, 11 aa, BORRELIA GARINII PBI
FLFASSQSYWQ

SEQ ID NO: 152296 - protein, 11 aa, BORRELIA GARINII PBI
LFASSQSYWQM

SEQ ID NO: 152297 - protein, 11 aa, BORRELIA GARINII PBI
FASSQSYWQMF

SEQ ID NO: 152298 - protein, 11 aa, BORRELIA GARINII PBI
ASSQSYWQMFA

SEQ ID NO: 152299 - protein, 11 aa, BORRELIA GARINII PBI
SSQSYWQMFAY

SEQ ID NO: 152300 - protein, 11 aa, BORRELIA GARINII PBI
SQSYWQMFAYS

SEQ ID NO: 152301 - protein, 11 aa, BORRELIA GARINII PBI
QSYWQMFAYSP

SEQ ID NO: 152302 - protein, 11 aa, BORRELIA GARINII PBI
SYWQMFAYSPI

SEQ ID NO: 152303 - protein, 11 aa, BORRELIA GARINII PBI
YWQMFAYSPID

SEQ ID NO: 152304 - protein, 11 aa, BORRELIA GARINII PBI
WQMFAYSPIDF

SEQ ID NO: 152305 - protein, 11 aa, BORRELIA GARINII PBI
QMFAYSPIDFT

SEQ ID NO: 152306 - protein, 11 aa, BORRELIA GARINII PBI
MFAYSPIDFTR

SEQ ID NO: 152307 - protein, 11 aa, BORRELIA GARINII PBI
FAYSPIDFTRS

SEQ ID NO: 152308 - protein, 11 aa, BORRELIA GARINII PBI
AYSPIDFTRSP

SEQ ID NO: 152309 - protein, 11 aa, BORRELIA GARINII PBI
YSPIDFTRSPP

SEQ ID NO: 152310 - protein, 11 aa, BORRELIA GARINII PBI
SPIDFTRSPPY

SEQ ID NO: 152311 - protein, 11 aa, BORRELIA GARINII PBI
PIDFTRSPPYS

SEQ ID NO: 152312 - protein, 11 aa, BORRELIA GARINII PBI
IDFTRSPPYSI

SEQ ID NO: 152313 - protein, 11 aa, BORRELIA GARINII PBI
DFTRSPPYSIF

SEQ ID NO: 152314 - protein, 11 aa, BORRELIA GARINII PBI
FTRSPPYSIFS

SEQ ID NO: 152315 - protein, 11 aa, BORRELIA GARINII PBI
TRSPPYSIFSA

SEQ ID NO: 152316 - protein, 11 aa, BORRELIA GARINII PBI
RSPPYSIFSAF

SEQ ID NO: 152317 - protein, 11 aa, BORRELIA GARINII PBI
SPPYSIFSAFA

SEQ ID NO: 152318 - protein, 11 aa, BORRELIA GARINII PBI
PPYSIFSAFAG

SEQ ID NO: 152319 - protein, 11 aa, BORRELIA GARINII PBI
PYSIFSAFAGN

SEQ ID NO: 152320 - protein, 11 aa, BORRELIA GARINII PBI
YSIFSAFAGNV

SEQ ID NO: 152321 - protein, 11 aa, BORRELIA GARINII PBI
SIFSAFAGNVY

SEQ ID NO: 152322 - protein, 11 aa, BORRELIA GARINII PBI
IFSAFAGNVYY

SEQ ID NO: 152323 - protein, 11 aa, BORRELIA GARINII PBI
FSAFAGNVYYI

SEQ ID NO: 152324 - protein, 11 aa, BORRELIA GARINII PBI
SAFAGNVYYID

SEQ ID NO: 152325 - protein, 11 aa, BORRELIA GARINII PBI
AFAGNVYYIDL

SEQ ID NO: 152326 - protein, 11 aa, BORRELIA GARINII PBI
FAGNVYYIDLE

SEQ ID NO: 152327 - protein, 11 aa, BORRELIA GARINII PBI
AGNVYYIDLEA

SEQ ID NO: 152328 - protein, 11 aa, BORRELIA GARINII PBI
GNVYYIDLEAL

SEQ ID NO: 152329 - protein, 11 aa, BORRELIA GARINII PBI
NVYYIDLEALD

SEQ ID NO: 152330 - protein, 11 aa, BORRELIA GARINII PBI
VYYIDLEALDK

SEQ ID NO: 152331 - protein, 11 aa, BORRELIA GARINII PBI
YYIDLEALDKF

SEQ ID NO: 152332 - protein, 11 aa, BORRELIA GARINII PBI
YIDLEALDKFI

SEQ ID NO: 152333 - protein, 11 aa, BORRELIA GARINII PBI
IDLEALDKFID

SEQ ID NO: 152334 - protein, 11 aa, BORRELIA GARINII PBI
DLEALDKFIDS

SEQ ID NO: 152335 - protein, 11 aa, BORRELIA GARINII PBI
LEALDKFIDSD

SEQ ID NO: 152336 - protein, 11 aa, BORRELIA GARINII PBI
EALDKFIDSDL

SEQ ID NO: 152337 - protein, 11 aa, BORRELIA GARINII PBI
ALDKFIDSDLN

SEQ ID NO: 152338 - protein, 11 aa, BORRELIA GARINII PBI
LDKFIDSDLNL

SEQ ID NO: 152339 - protein, 11 aa, BORRELIA GARINII PBI
DKFIDSDLNLL

SEQ ID NO: 152340 - protein, 11 aa, BORRELIA GARINII PBI
KFIDSDLNLLK

SEQ ID NO: 152341 - protein, 11 aa, BORRELIA GARINII PBI
FIDSDLNLLKE

SEQ ID NO: 152342 - protein, 11 aa, BORRELIA GARINII PBI
IDSDLNLLKEN

SEQ ID NO: 152343 - protein, 11 aa, BORRELIA GARINII PBI
DSDLNLLKENE

SEQ ID NO: 152344 - protein, 11 aa, BORRELIA GARINII PBI
SDLNLLKENET

SEQ ID NO: 152345 - protein, 11 aa, BORRELIA GARINII PBI
DLNLLKENETR

SEQ ID NO: 152346 - protein, 11 aa, BORRELIA GARINII PBI
LNLLKENETRY

SEQ ID NO: 152347 - protein, 11 aa, BORRELIA GARINII PBI
NLLKENETRYS

SEQ ID NO: 152348 - protein, 11 aa, BORRELIA GARINII PBI
LLKENETRYSD

SEQ ID NO: 152349 - protein, 11 aa, BORRELIA GARINII PBI
LKENETRYSDL

SEQ ID NO: 152350 - protein, 11 aa, BORRELIA GARINII PBI
KENETRYSDLK

SEQ ID NO: 152351 - protein, 11 aa, BORRELIA GARINII PBI
ENETRYSDLKK

SEQ ID NO: 152352 - protein, 11 aa, BORRELIA GARINII PBI
NETRYSDLKKL

SEQ ID NO: 152353 - protein, 11 aa, BORRELIA GARINII PBI
ETRYSDLKKLS

SEQ ID NO: 152354 - protein, 11 aa, BORRELIA GARINII PBI
TRYSDLKKLSF

SEQ ID NO: 152355 - protein, 11 aa, BORRELIA GARINII PBI
RYSDLKKLSFK

SEQ ID NO: 152356 - protein, 11 aa, BORRELIA GARINII PBI
YSDLKKLSFKD

SEQ ID NO: 152357 - protein, 11 aa, BORRELIA GARINII PBI
SDLKKLSFKDK

SEQ ID NO: 152358 - protein, 11 aa, BORRELIA GARINII PBI
DLKKLSFKDKF

SEQ ID NO: 152359 - protein, 11 aa, BORRELIA GARINII PBI
LKKLSFKDKFL

SEQ ID NO: 152360 - protein, 11 aa, BORRELIA GARINII PBI
KKLSFKDKFLK

SEQ ID NO: 152361 - protein, 11 aa, BORRELIA GARINII PBI
KLSFKDKFLKE

SEQ ID NO: 152362 - protein, 11 aa, BORRELIA GARINII PBI
LSFKDKFLKEA

SEQ ID NO: 152363 - protein, 11 aa, BORRELIA GARINII PBI
SFKDKFLKEAA

SEQ ID NO: 152364 - protein, 11 aa, BORRELIA GARINII PBI
FKDKFLKEAAL

SEQ ID NO: 152365 - protein, 11 aa, BORRELIA GARINII PBI
KDKFLKEAALN

SEQ ID NO: 152366 - protein, 11 aa, BORRELIA GARINII PBI
DKFLKEAALNF

SEQ ID NO: 152367 - protein, 11 aa, BORRELIA GARINII PBI
KFLKEAALNFI

SEQ ID NO: 152368 - protein, 11 aa, BORRELIA GARINII PBI
FLKEAALNFIN

SEQ ID NO: 152369 - protein, 11 aa, BORRELIA GARINII PBI
LKEAALNFINR

SEQ ID NO: 152370 - protein, 11 aa, BORRELIA GARINII PBI
KEAALNFINRA

SEQ ID NO: 152371 - protein, 11 aa, BORRELIA GARINII PBI
EAALNFINRAS

SEQ ID NO: 152372 - protein, 11 aa, BORRELIA GARINII PBI
AALNFINRASV

SEQ ID NO: 152373 - protein, 11 aa, BORRELIA GARINII PBI
ALNFINRASVD

SEQ ID NO: 152374 - protein, 11 aa, BORRELIA GARINII PBI
LNFINRASVDE

SEQ ID NO: 152375 - protein, 11 aa, BORRELIA GARINII PBI
NFINRASVDEV

SEQ ID NO: 152376 - protein, 11 aa, BORRELIA GARINII PBI
FINRASVDEVR

SEQ ID NO: 152377 - protein, 11 aa, BORRELIA GARINII PBI
INRASVDEVRS

SEQ ID NO: 152378 - protein, 11 aa, BORRELIA GARINII PBI
NRASVDEVRSF

SEQ ID NO: 152379 - protein, 11 aa, BORRELIA GARINII PBI
RASVDEVRSFE

SEQ ID NO: 152380 - protein, 11 aa, BORRELIA GARINII PBI
ASVDEVRSFEK

SEQ ID NO: 152381 - protein, 11 aa, BORRELIA GARINII PBI
SVDEVRSFEKF

SEQ ID NO: 152382 - protein, 11 aa, BORRELIA GARINII PBI
VDEVRSFEKFK

SEQ ID NO: 152383 - protein, 11 aa, BORRELIA GARINII PBI
DEVRSFEKFKK

SEQ ID NO: 152384 - protein, 11 aa, BORRELIA GARINII PBI
EVRSFEKFKKK

SEQ ID NO: 152385 - protein, 11 aa, BORRELIA GARINII PBI
VRSFEKFKKKS

SEQ ID NO: 152386 - protein, 11 aa, BORRELIA GARINII PBI
RSFEKFKKKSS

SEQ ID NO: 152387 - protein, 11 aa, BORRELIA GARINII PBI
SFEKFKKKSSY

SEQ ID NO: 152388 - protein, 11 aa, BORRELIA GARINII PBI
FEKFKKKSSYW

SEQ ID NO: 152389 - protein, 11 aa, BORRELIA GARINII PBI
EKFKKKSSYWL

SEQ ID NO: 152390 - protein, 11 aa, BORRELIA GARINII PBI
KFKKKSSYWLL

SEQ ID NO: 152391 - protein, 11 aa, BORRELIA GARINII PBI
FKKKSSYWLLD

SEQ ID NO: 152392 - protein, 11 aa, BORRELIA GARINII PBI
KKKSSYWLLDF

SEQ ID NO: 152393 - protein, 11 aa, BORRELIA GARINII PBI
KKSSYWLLDFA

SEQ ID NO: 152394 - protein, 11 aa, BORRELIA GARINII PBI
KSSYWLLDFAS

SEQ ID NO: 152395 - protein, 11 aa, BORRELIA GARINII PBI
SSYWLLDFASF

SEQ ID NO: 152396 - protein, 11 aa, BORRELIA GARINII PBI
SYWLLDFASFV

SEQ ID NO: 152397 - protein, 11 aa, BORRELIA GARINII PBI
YWLLDFASFVA

SEQ ID NO: 152398 - protein, 11 aa, BORRELIA GARINII PBI
WLLDFASFVAF

SEQ ID NO: 152399 - protein, 11 aa, BORRELIA GARINII PBI
LLDFASFVAFK

SEQ ID NO: 152400 - protein, 11 aa, BORRELIA GARINII PBI
LDFASFVAFKE

SEQ ID NO: 152401 - protein, 11 aa, BORRELIA GARINII PBI
DFASFVAFKEY

SEQ ID NO: 152402 - protein, 11 aa, BORRELIA GARINII PBI
FASFVAFKEYF

SEQ ID NO: 152403 - protein, 11 aa, BORRELIA GARINII PBI
ASFVAFKEYFL

SEQ ID NO: 152404 - protein, 11 aa, BORRELIA GARINII PBI
SFVAFKEYFLK

SEQ ID NO: 152405 - protein, 11 aa, BORRELIA GARINII PBI
FVAFKEYFLKD

SEQ ID NO: 152406 - protein, 11 aa, BORRELIA GARINII PBI
VAFKEYFLKDS

SEQ ID NO: 152407 - protein, 11 aa, BORRELIA GARINII PBI
AFKEYFLKDSR

SEQ ID NO: 152408 - protein, 11 aa, BORRELIA GARINII PBI
FKEYFLKDSRD

SEQ ID NO: 152409 - protein, 11 aa, BORRELIA GARINII PBI
KEYFLKDSRDA

SEQ ID NO: 152410 - protein, 11 aa, BORRELIA GARINII PBI
EYFLKDSRDAF

SEQ ID NO: 152411 - protein, 11 aa, BORRELIA GARINII PBI
YFLKDSRDAFN

SEQ ID NO: 152412 - protein, 11 aa, BORRELIA GARINII PBI
FLKDSRDAFNV

SEQ ID NO: 152413 - protein, 11 aa, BORRELIA GARINII PBI
LKDSRDAFNVL

SEQ ID NO: 152414 - protein, 11 aa, BORRELIA GARINII PBI
KDSRDAFNVLF

SEQ ID NO: 152415 - protein, 11 aa, BORRELIA GARINII PBI
DSRDAFNVLFD

SEQ ID NO: 152416 - protein, 11 aa, BORRELIA GARINII PBI
SRDAFNVLFDR

SEQ ID NO: 152417 - protein, 11 aa, BORRELIA GARINII PBI
RDAFNVLFDRG

SEQ ID NO: 152418 - protein, 11 aa, BORRELIA GARINII PBI
DAFNVLFDRGI

SEQ ID NO: 152419 - protein, 11 aa, BORRELIA GARINII PBI
AFNVLFDRGIL

SEQ ID NO: 152420 - protein, 11 aa, BORRELIA GARINII PBI
FNVLFDRGILI

SEQ ID NO: 152421 - protein, 11 aa, BORRELIA GARINII PBI
NVLFDRGILIR

SEQ ID NO: 152422 - protein, 11 aa, BORRELIA GARINII PBI
VLFDRGILIRN

SEQ ID NO: 152423 - protein, 11 aa, BORRELIA GARINII PBI
LFDRGILIRNE

SEQ ID NO: 152424 - protein, 11 aa, BORRELIA GARINII PBI
FDRGILIRNEK

SEQ ID NO: 152425 - protein, 11 aa, BORRELIA GARINII PBI
DRGILIRNEKD

SEQ ID NO: 152426 - protein, 11 aa, BORRELIA GARINII PBI
RGILIRNEKDL

SEQ ID NO: 152427 - protein, 11 aa, BORRELIA GARINII PBI
GILIRNEKDLF

SEQ ID NO: 152428 - protein, 11 aa, BORRELIA GARINII PBI
ILIRNEKDLFK

SEQ ID NO: 152429 - protein, 11 aa, BORRELIA GARINII PBI
LIRNEKDLFKL

SEQ ID NO: 152430 - protein, 11 aa, BORRELIA GARINII PBI
IRNEKDLFKLR

SEQ ID NO: 152431 - protein, 11 aa, BORRELIA GARINII PBI
RNEKDLFKLRN

SEQ ID NO: 152432 - protein, 11 aa, BORRELIA GARINII PBI
NEKDLFKLRNI

SEQ ID NO: 152433 - protein, 11 aa, BORRELIA GARINII PBI
EKDLFKLRNIL

SEQ ID NO: 152434 - protein, 11 aa, BORRELIA GARINII PBI
KDLFKLRNILS

SEQ ID NO: 152435 - protein, 11 aa, BORRELIA GARINII PBI
DLFKLRNILSK

SEQ ID NO: 152436 - protein, 11 aa, BORRELIA GARINII PBI
LFKLRNILSKE

SEQ ID NO: 152437 - protein, 11 aa, BORRELIA GARINII PBI
FKLRNILSKEI

SEQ ID NO: 152438 - protein, 11 aa, BORRELIA GARINII PBI
KLRNILSKEIK

SEQ ID NO: 152439 - protein, 11 aa, BORRELIA GARINII PBI
LRNILSKEIKV

SEQ ID NO: 152440 - protein, 11 aa, BORRELIA GARINII PBI
RNILSKEIKVQ

SEQ ID NO: 152441 - protein, 11 aa, BORRELIA GARINII PBI
NILSKEIKVQE

SEQ ID NO: 152442 - protein, 11 aa, BORRELIA GARINII PBI
ILSKEIKVQEV

SEQ ID NO: 152443 - protein, 11 aa, BORRELIA GARINII PBI
LSKEIKVQEVL

SEQ ID NO: 152444 - protein, 11 aa, BORRELIA GARINII PBI
SKEIKVQEVLQ

SEQ ID NO: 152445 - protein, 11 aa, BORRELIA GARINII PBI
KEIKVQEVLQY

SEQ ID NO: 152446 - protein, 11 aa, BORRELIA GARINII PBI
EIKVQEVLQYF

SEQ ID NO: 152447 - protein, 11 aa, BORRELIA GARINII PBI
IKVQEVLQYFF

SEQ ID NO: 152448 - protein, 11 aa, BORRELIA GARINII PBI
KVQEVLQYFFF

SEQ ID NO: 152449 - protein, 11 aa, BORRELIA GARINII PBI
VQEVLQYFFFS

SEQ ID NO: 152450 - protein, 11 aa, BORRELIA GARINII PBI
QEVLQYFFFSQ

SEQ ID NO: 152451 - protein, 11 aa, BORRELIA GARINII PBI
EVLQYFFFSQF

SEQ ID NO: 152452 - protein, 11 aa, BORRELIA GARINII PBI
VLQYFFFSQFQ

SEQ ID NO: 152453 - protein, 11 aa, BORRELIA GARINII PBI
LQYFFFSQFQA

SEQ ID NO: 152454 - protein, 11 aa, BORRELIA GARINII PBI
QYFFFSQFQAL

SEQ ID NO: 152455 - protein, 11 aa, BORRELIA GARINII PBI
YFFFSQFQALK

SEQ ID NO: 152456 - protein, 11 aa, BORRELIA GARINII PBI
FFFSQFQALKR

SEQ ID NO: 152457 - protein, 11 aa, BORRELIA GARINII PBI
FFSQFQALKRY

SEQ ID NO: 152458 - protein, 11 aa, BORRELIA GARINII PBI
FSQFQALKRYA

SEQ ID NO: 152459 - protein, 11 aa, BORRELIA GARINII PBI
SQFQALKRYAN

SEQ ID NO: 152460 - protein, 11 aa, BORRELIA GARINII PBI
QFQALKRYAND

SEQ ID NO: 152461 - protein, 11 aa, BORRELIA GARINII PBI
FQALKRYANDK

SEQ ID NO: 152462 - protein, 11 aa, BORRELIA GARINII PBI
QALKRYANDKG

SEQ ID NO: 152463 - protein, 11 aa, BORRELIA GARINII PBI
ALKRYANDKGI

SEQ ID NO: 152464 - protein, 11 aa, BORRELIA GARINII PBI
LKRYANDKGIE

SEQ ID NO: 152465 - protein, 11 aa, BORRELIA GARINII PBI
KRYANDKGIEL

SEQ ID NO: 152466 - protein, 11 aa, BORRELIA GARINII PBI
RYANDKGIELV

SEQ ID NO: 152467 - protein, 11 aa, BORRELIA GARINII PBI
YANDKGIELVM

SEQ ID NO: 152468 - protein, 11 aa, BORRELIA GARINII PBI
ANDKGIELVMN

SEQ ID NO: 152469 - protein, 11 aa, BORRELIA GARINII PBI
NDKGIELVMNL

SEQ ID NO: 152470 - protein, 11 aa, BORRELIA GARINII PBI
DKGIELVMNLP

SEQ ID NO: 152471 - protein, 11 aa, BORRELIA GARINII PBI
KGIELVMNLPL

SEQ ID NO: 152472 - protein, 11 aa, BORRELIA GARINII PBI
GIELVMNLPLF

SEQ ID NO: 152473 - protein, 11 aa, BORRELIA GARINII PBI
IELVMNLPLFI

SEQ ID NO: 152474 - protein, 11 aa, BORRELIA GARINII PBI
ELVMNLPLFIA

SEQ ID NO: 152475 - protein, 11 aa, BORRELIA GARINII PBI
LVMNLPLFIAY

SEQ ID NO: 152476 - protein, 11 aa, BORRELIA GARINII PBI
VMNLPLFIAYD

SEQ ID NO: 152477 - protein, 11 aa, BORRELIA GARINII PBI
MNLPLFIAYDS

SEQ ID NO: 152478 - protein, 11 aa, BORRELIA GARINII PBI
NLPLFIAYDSA

SEQ ID NO: 152479 - protein, 11 aa, BORRELIA GARINII PBI
LPLFIAYDSAD

SEQ ID NO: 152480 - protein, 11 aa, BORRELIA GARINII PBI
PLFIAYDSADV

SEQ ID NO: 152481 - protein, 11 aa, BORRELIA GARINII PBI
LFIAYDSADVW

SEQ ID NO: 152482 - protein, 11 aa, BORRELIA GARINII PBI
FIAYDSADVWA

SEQ ID NO: 152483 - protein, 11 aa, BORRELIA GARINII PBI
IAYDSADVWAH

SEQ ID NO: 152484 - protein, 11 aa, BORRELIA GARINII PBI
AYDSADVWAHQ

SEQ ID NO: 152485 - protein, 11 aa, BORRELIA GARINII PBI
YDSADVWAHQK

SEQ ID NO: 152486 - protein, 11 aa, BORRELIA GARINII PBI
DSADVWAHQKY

SEQ ID NO: 152487 - protein, 11 aa, BORRELIA GARINII PBI
SADVWAHQKYF

SEQ ID NO: 152488 - protein, 11 aa, BORRELIA GARINII PBI
ADVWAHQKYFK

SEQ ID NO: 152489 - protein, 11 aa, BORRELIA GARINII PBI
DVWAHQKYFKL

SEQ ID NO: 152490 - protein, 11 aa, BORRELIA GARINII PBI
VWAHQKYFKLR

SEQ ID NO: 152491 - protein, 11 aa, BORRELIA GARINII PBI
WAHQKYFKLRF

SEQ ID NO: 152492 - protein, 11 aa, BORRELIA GARINII PBI
AHQKYFKLRFD

SEQ ID NO: 152493 - protein, 11 aa, BORRELIA GARINII PBI
HQKYFKLRFDA

SEQ ID NO: 152494 - protein, 11 aa, BORRELIA GARINII PBI
QKYFKLRFDAS

SEQ ID NO: 152495 - protein, 11 aa, BORRELIA GARINII PBI
KYFKLRFDASK

SEQ ID NO: 152496 - protein, 11 aa, BORRELIA GARINII PBI
YFKLRFDASKD

SEQ ID NO: 152497 - protein, 11 aa, BORRELIA GARINII PBI
FKLRFDASKDK

SEQ ID NO: 152498 - protein, 11 aa, BORRELIA GARINII PBI
KLRFDASKDKV

SEQ ID NO: 152499 - protein, 11 aa, BORRELIA GARINII PBI
LRFDASKDKVA

SEQ ID NO: 152500 - protein, 11 aa, BORRELIA GARINII PBI
RFDASKDKVAG

SEQ ID NO: 152501 - protein, 11 aa, BORRELIA GARINII PBI
FDASKDKVAGI

SEQ ID NO: 152502 - protein, 11 aa, BORRELIA GARINII PBI
DASKDKVAGIS

SEQ ID NO: 152503 - protein, 11 aa, BORRELIA GARINII PBI
ASKDKVAGISP

SEQ ID NO: 152504 - protein, 11 aa, BORRELIA GARINII PBI
SKDKVAGISPD

SEQ ID NO: 152505 - protein, 11 aa, BORRELIA GARINII PBI
KDKVAGISPDY

SEQ ID NO: 152506 - protein, 11 aa, BORRELIA GARINII PBI
DKVAGISPDYF

SEQ ID NO: 152507 - protein, 11 aa, BORRELIA GARINII PBI
KVAGISPDYFL

SEQ ID NO: 152508 - protein, 11 aa, BORRELIA GARINII PBI
VAGISPDYFLE

SEQ ID NO: 152509 - protein, 11 aa, BORRELIA GARINII PBI
AGISPDYFLEQ

SEQ ID NO: 152510 - protein, 11 aa, BORRELIA GARINII PBI
GISPDYFLEQE

SEQ ID NO: 152511 - protein, 11 aa, BORRELIA GARINII PBI
ISPDYFLEQEQ

SEQ ID NO: 152512 - protein, 11 aa, BORRELIA GARINII PBI
SPDYFLEQEQA

SEQ ID NO: 152513 - protein, 11 aa, BORRELIA GARINII PBI
PDYFLEQEQAW

SEQ ID NO: 152514 - protein, 11 aa, BORRELIA GARINII PBI
DYFLEQEQAWD

SEQ ID NO: 152515 - protein, 11 aa, BORRELIA GARINII PBI
YFLEQEQAWDS

SEQ ID NO: 152516 - protein, 11 aa, BORRELIA GARINII PBI
FLEQEQAWDSP

SEQ ID NO: 152517 - protein, 11 aa, BORRELIA GARINII PBI
LEQEQAWDSPA

SEQ ID NO: 152518 - protein, 11 aa, BORRELIA GARINII PBI
EQEQAWDSPAY

SEQ ID NO: 152519 - protein, 11 aa, BORRELIA GARINII PBI
QEQAWDSPAYS

SEQ ID NO: 152520 - protein, 11 aa, BORRELIA GARINII PBI
EQAWDSPAYSW

SEQ ID NO: 152521 - protein, 11 aa, BORRELIA GARINII PBI
QAWDSPAYSWN

SEQ ID NO: 152522 - protein, 11 aa, BORRELIA GARINII PBI
AWDSPAYSWNV

SEQ ID NO: 152523 - protein, 11 aa, BORRELIA GARINII PBI
WDSPAYSWNVL

SEQ ID NO: 152524 - protein, 11 aa, BORRELIA GARINII PBI
DSPAYSWNVLK

SEQ ID NO: 152525 - protein, 11 aa, BORRELIA GARINII PBI
SPAYSWNVLKN

SEQ ID NO: 152526 - protein, 11 aa, BORRELIA GARINII PBI
PAYSWNVLKNV

SEQ ID NO: 152527 - protein, 11 aa, BORRELIA GARINII PBI
AYSWNVLKNVK

SEQ ID NO: 152528 - protein, 11 aa, BORRELIA GARINII PBI
YSWNVLKNVKY

SEQ ID NO: 152529 - protein, 11 aa, BORRELIA GARINII PBI
SWNVLKNVKYE

SEQ ID NO: 152530 - protein, 11 aa, BORRELIA GARINII PBI
WNVLKNVKYEW

SEQ ID NO: 152531 - protein, 11 aa, BORRELIA GARINII PBI
NVLKNVKYEWW

SEQ ID NO: 152532 - protein, 11 aa, BORRELIA GARINII PBI
VLKNVKYEWWA

SEQ ID NO: 152533 - protein, 11 aa, BORRELIA GARINII PBI
LKNVKYEWWAK

SEQ ID NO: 152534 - protein, 11 aa, BORRELIA GARINII PBI
KNVKYEWWAKR

SEQ ID NO: 152535 - protein, 11 aa, BORRELIA GARINII PBI
NVKYEWWAKRI

SEQ ID NO: 152536 - protein, 11 aa, BORRELIA GARINII PBI
VKYEWWAKRIG

SEQ ID NO: 152537 - protein, 11 aa, BORRELIA GARINII PBI
KYEWWAKRIGI

SEQ ID NO: 152538 - protein, 11 aa, BORRELIA GARINII PBI
YEWWAKRIGIL

SEQ ID NO: 152539 - protein, 11 aa, BORRELIA GARINII PBI
EWWAKRIGILR

SEQ ID NO: 152540 - protein, 11 aa, BORRELIA GARINII PBI
WWAKRIGILRK

SEQ ID NO: 152541 - protein, 11 aa, BORRELIA GARINII PBI
WAKRIGILRKY

SEQ ID NO: 152542 - protein, 11 aa, BORRELIA GARINII PBI
AKRIGILRKYI

SEQ ID NO: 152543 - protein, 11 aa, BORRELIA GARINII PBI
KRIGILRKYID

SEQ ID NO: 152544 - protein, 11 aa, BORRELIA GARINII PBI
RIGILRKYIDV

SEQ ID NO: 152545 - protein, 11 aa, BORRELIA GARINII PBI
IGILRKYIDVI

SEQ ID NO: 152546 - protein, 11 aa, BORRELIA GARINII PBI
GILRKYIDVIK

SEQ ID NO: 152547 - protein, 11 aa, BORRELIA GARINII PBI
ILRKYIDVIKI

SEQ ID NO: 152548 - protein, 11 aa, BORRELIA GARINII PBI
LRKYIDVIKID

SEQ ID NO: 152549 - protein, 11 aa, BORRELIA GARINII PBI
RKYIDVIKIDH

SEQ ID NO: 152550 - protein, 11 aa, BORRELIA GARINII PBI
KYIDVIKIDHF

SEQ ID NO: 152551 - protein, 11 aa, BORRELIA GARINII PBI
YIDVIKIDHFR

SEQ ID NO: 152552 - protein, 11 aa, BORRELIA GARINII PBI
IDVIKIDHFRG

SEQ ID NO: 152553 - protein, 11 aa, BORRELIA GARINII PBI
DVIKIDHFRGF

SEQ ID NO: 152554 - protein, 11 aa, BORRELIA GARINII PBI
VIKIDHFRGFV

SEQ ID NO: 152555 - protein, 11 aa, BORRELIA GARINII PBI
IKIDHFRGFVS

SEQ ID NO: 152556 - protein, 11 aa, BORRELIA GARINII PBI
KIDHFRGFVST

SEQ ID NO: 152557 - protein, 11 aa, BORRELIA GARINII PBI
IDHFRGFVSTW

SEQ ID NO: 152558 - protein, 11 aa, BORRELIA GARINII PBI
DHFRGFVSTWE

SEQ ID NO: 152559 - protein, 11 aa, BORRELIA GARINII PBI
HFRGFVSTWEV

SEQ ID NO: 152560 - protein, 11 aa, BORRELIA GARINII PBI
FRGFVSTWEVG

SEQ ID NO: 152561 - protein, 11 aa, BORRELIA GARINII PBI
RGFVSTWEVGV

SEQ ID NO: 152562 - protein, 11 aa, BORRELIA GARINII PBI
GFVSTWEVGVG

SEQ ID NO: 152563 - protein, 11 aa, BORRELIA GARINII PBI
FVSTWEVGVGE

SEQ ID NO: 152564 - protein, 11 aa, BORRELIA GARINII PBI
VSTWEVGVGEA

SEQ ID NO: 152565 - protein, 11 aa, BORRELIA GARINII PBI
STWEVGVGEAY

SEQ ID NO: 152566 - protein, 11 aa, BORRELIA GARINII PBI
TWEVGVGEAYA

SEQ ID NO: 152567 - protein, 11 aa, BORRELIA GARINII PBI
WEVGVGEAYAF

SEQ ID NO: 152568 - protein, 11 aa, BORRELIA GARINII PBI
EVGVGEAYAFN

SEQ ID NO: 152569 - protein, 11 aa, BORRELIA GARINII PBI
VGVGEAYAFNG

SEQ ID NO: 152570 - protein, 11 aa, BORRELIA GARINII PBI
GVGEAYAFNGL

SEQ ID NO: 152571 - protein, 11 aa, BORRELIA GARINII PBI
VGEAYAFNGLW

SEQ ID NO: 152572 - protein, 11 aa, BORRELIA GARINII PBI
GEAYAFNGLWV

SEQ ID NO: 152573 - protein, 11 aa, BORRELIA GARINII PBI
EAYAFNGLWVK

SEQ ID NO: 152574 - protein, 11 aa, BORRELIA GARINII PBI
AYAFNGLWVKS

SEQ ID NO: 152575 - protein, 11 aa, BORRELIA GARINII PBI
YAFNGLWVKSP

SEQ ID NO: 152576 - protein, 11 aa, BORRELIA GARINII PBI
AFNGLWVKSPG

SEQ ID NO: 152577 - protein, 11 aa, BORRELIA GARINII PBI
FNGLWVKSPGR

SEQ ID NO: 152578 - protein, 11 aa, BORRELIA GARINII PBI
NGLWVKSPGRD

SEQ ID NO: 152579 - protein, 11 aa, BORRELIA GARINII PBI
GLWVKSPGRDF

SEQ ID NO: 152580 - protein, 11 aa, BORRELIA GARINII PBI
LWVKSPGRDFF

SEQ ID NO: 152581 - protein, 11 aa, BORRELIA GARINII PBI
WVKSPGRDFFN

SEQ ID NO: 152582 - protein, 11 aa, BORRELIA GARINII PBI
VKSPGRDFFNF

SEQ ID NO: 152583 - protein, 11 aa, BORRELIA GARINII PBI
KSPGRDFFNFI

SEQ ID NO: 152584 - protein, 11 aa, BORRELIA GARINII PBI
SPGRDFFNFIL

SEQ ID NO: 152585 - protein, 11 aa, BORRELIA GARINII PBI
PGRDFFNFILN

SEQ ID NO: 152586 - protein, 11 aa, BORRELIA GARINII PBI
GRDFFNFILNE

SEQ ID NO: 152587 - protein, 11 aa, BORRELIA GARINII PBI
RDFFNFILNEI

SEQ ID NO: 152588 - protein, 11 aa, BORRELIA GARINII PBI
DFFNFILNEIK

SEQ ID NO: 152589 - protein, 11 aa, BORRELIA GARINII PBI
FFNFILNEIKD

SEQ ID NO: 152590 - protein, 11 aa, BORRELIA GARINII PBI
FNFILNEIKDL

SEQ ID NO: 152591 - protein, 11 aa, BORRELIA GARINII PBI
NFILNEIKDLK

SEQ ID NO: 152592 - protein, 11 aa, BORRELIA GARINII PBI
FILNEIKDLKI

SEQ ID NO: 152593 - protein, 11 aa, BORRELIA GARINII PBI
ILNEIKDLKIW

SEQ ID NO: 152594 - protein, 11 aa, BORRELIA GARINII PBI
LNEIKDLKIWV

SEQ ID NO: 152595 - protein, 11 aa, BORRELIA GARINII PBI
NEIKDLKIWVE

SEQ ID NO: 152596 - protein, 11 aa, BORRELIA GARINII PBI
EIKDLKIWVED

SEQ ID NO: 152597 - protein, 11 aa, BORRELIA GARINII PBI
IKDLKIWVEDF

SEQ ID NO: 152598 - protein, 11 aa, BORRELIA GARINII PBI
KDLKIWVEDFE

SEQ ID NO: 152599 - protein, 11 aa, BORRELIA GARINII PBI
DLKIWVEDFEN

SEQ ID NO: 152600 - protein, 11 aa, BORRELIA GARINII PBI
LKIWVEDFEND

SEQ ID NO: 152601 - protein, 11 aa, BORRELIA GARINII PBI
KIWVEDFENDL

SEQ ID NO: 152602 - protein, 11 aa, BORRELIA GARINII PBI
IWVEDFENDLE

SEQ ID NO: 152603 - protein, 11 aa, BORRELIA GARINII PBI
WVEDFENDLED

SEQ ID NO: 152604 - protein, 11 aa, BORRELIA GARINII PBI
VEDFENDLEDV

SEQ ID NO: 152605 - protein, 11 aa, BORRELIA GARINII PBI
EDFENDLEDVS

SEQ ID NO: 152606 - protein, 11 aa, BORRELIA GARINII PBI
DFENDLEDVSR

SEQ ID NO: 152607 - protein, 11 aa, BORRELIA GARINII PBI
FENDLEDVSRL

SEQ ID NO: 152608 - protein, 11 aa, BORRELIA GARINII PBI
ENDLEDVSRLR

SEQ ID NO: 152609 - protein, 11 aa, BORRELIA GARINII PBI
NDLEDVSRLRD

SEQ ID NO: 152610 - protein, 11 aa, BORRELIA GARINII PBI
DLEDVSRLRDF

SEQ ID NO: 152611 - protein, 11 aa, BORRELIA GARINII PBI
LEDVSRLRDFF

SEQ ID NO: 152612 - protein, 11 aa, BORRELIA GARINII PBI
EDVSRLRDFFN

SEQ ID NO: 152613 - protein, 11 aa, BORRELIA GARINII PBI
DVSRLRDFFNF

SEQ ID NO: 152614 - protein, 11 aa, BORRELIA GARINII PBI
VSRLRDFFNFP

SEQ ID NO: 152615 - protein, 11 aa, BORRELIA GARINII PBI
SRLRDFFNFPG

SEQ ID NO: 152616 - protein, 11 aa, BORRELIA GARINII PBI
RLRDFFNFPGM

SEQ ID NO: 152617 - protein, 11 aa, BORRELIA GARINII PBI
LRDFFNFPGMR

SEQ ID NO: 152618 - protein, 11 aa, BORRELIA GARINII PBI
RDFFNFPGMRI

SEQ ID NO: 152619 - protein, 11 aa, BORRELIA GARINII PBI
DFFNFPGMRIM

SEQ ID NO: 152620 - protein, 11 aa, BORRELIA GARINII PBI
FFNFPGMRIMK

SEQ ID NO: 152621 - protein, 11 aa, BORRELIA GARINII PBI
FNFPGMRIMKL

SEQ ID NO: 152622 - protein, 11 aa, BORRELIA GARINII PBI
NFPGMRIMKLA

SEQ ID NO: 152623 - protein, 11 aa, BORRELIA GARINII PBI
FPGMRIMKLAF

SEQ ID NO: 152624 - protein, 11 aa, BORRELIA GARINII PBI
PGMRIMKLAFD

SEQ ID NO: 152625 - protein, 11 aa, BORRELIA GARINII PBI
GMRIMKLAFDF

SEQ ID NO: 152626 - protein, 11 aa, BORRELIA GARINII PBI
MRIMKLAFDFD

SEQ ID NO: 152627 - protein, 11 aa, BORRELIA GARINII PBI
RIMKLAFDFDS

SEQ ID NO: 152628 - protein, 11 aa, BORRELIA GARINII PBI
IMKLAFDFDSD

SEQ ID NO: 152629 - protein, 11 aa, BORRELIA GARINII PBI
MKLAFDFDSDN

SEQ ID NO: 152630 - protein, 11 aa, BORRELIA GARINII PBI
KLAFDFDSDNQ

SEQ ID NO: 152631 - protein, 11 aa, BORRELIA GARINII PBI
LAFDFDSDNQN

SEQ ID NO: 152632 - protein, 11 aa, BORRELIA GARINII PBI
AFDFDSDNQNL

SEQ ID NO: 152633 - protein, 11 aa, BORRELIA GARINII PBI
FDFDSDNQNLP

SEQ ID NO: 152634 - protein, 11 aa, BORRELIA GARINII PBI
DFDSDNQNLPH

SEQ ID NO: 152635 - protein, 11 aa, BORRELIA GARINII PBI
FDSDNQNLPHN

SEQ ID NO: 152636 - protein, 11 aa, BORRELIA GARINII PBI
DSDNQNLPHNY

SEQ ID NO: 152637 - protein, 11 aa, BORRELIA GARINII PBI
SDNQNLPHNYI

SEQ ID NO: 152638 - protein, 11 aa, BORRELIA GARINII PBI
DNQNLPHNYIK

SEQ ID NO: 152639 - protein, 11 aa, BORRELIA GARINII PBI
NQNLPHNYIKN

SEQ ID NO: 152640 - protein, 11 aa, BORRELIA GARINII PBI
QNLPHNYIKNC

SEQ ID NO: 152641 - protein, 11 aa, BORRELIA GARINII PBI
NLPHNYIKNCI

SEQ ID NO: 152642 - protein, 11 aa, BORRELIA GARINII PBI
LPHNYIKNCIV

SEQ ID NO: 152643 - protein, 11 aa, BORRELIA GARINII PBI
PHNYIKNCIVY

SEQ ID NO: 152644 - protein, 11 aa, BORRELIA GARINII PBI
HNYIKNCIVYT

SEQ ID NO: 152645 - protein, 11 aa, BORRELIA GARINII PBI
NYIKNCIVYTG

SEQ ID NO: 152646 - protein, 11 aa, BORRELIA GARINII PBI
YIKNCIVYTGI

SEQ ID NO: 152647 - protein, 11 aa, BORRELIA GARINII PBI
IKNCIVYTGIG

SEQ ID NO: 152648 - protein, 11 aa, BORRELIA GARINII PBI
KNCIVYTGIGD

SEQ ID NO: 152649 - protein, 11 aa, BORRELIA GARINII PBI
NCIVYTGIGDN

SEQ ID NO: 152650 - protein, 11 aa, BORRELIA GARINII PBI
CIVYTGIGDNS

SEQ ID NO: 152651 - protein, 11 aa, BORRELIA GARINII PBI
IVYTGIGDNST

SEQ ID NO: 152652 - protein, 11 aa, BORRELIA GARINII PBI
VYTGIGDNSTI

SEQ ID NO: 152653 - protein, 11 aa, BORRELIA GARINII PBI
YTGIGDNSTIR

SEQ ID NO: 152654 - protein, 11 aa, BORRELIA GARINII PBI
TGIGDNSTIRE

SEQ ID NO: 152655 - protein, 11 aa, BORRELIA GARINII PBI
GIGDNSTIREF

SEQ ID NO: 152656 - protein, 11 aa, BORRELIA GARINII PBI
IGDNSTIREFV

SEQ ID NO: 152657 - protein, 11 aa, BORRELIA GARINII PBI
GDNSTIREFVN

SEQ ID NO: 152658 - protein, 11 aa, BORRELIA GARINII PBI
DNSTIREFVNS

SEQ ID NO: 152659 - protein, 11 aa, BORRELIA GARINII PBI
NSTIREFVNSL

SEQ ID NO: 152660 - protein, 11 aa, BORRELIA GARINII PBI
STIREFVNSLD

SEQ ID NO: 152661 - protein, 11 aa, BORRELIA GARINII PBI
TIREFVNSLDD

SEQ ID NO: 152662 - protein, 11 aa, BORRELIA GARINII PBI
IREFVNSLDDL

SEQ ID NO: 152663 - protein, 11 aa, BORRELIA GARINII PBI
REFVNSLDDLH

SEQ ID NO: 152664 - protein, 11 aa, BORRELIA GARINII PBI
EFVNSLDDLHK

SEQ ID NO: 152665 - protein, 11 aa, BORRELIA GARINII PBI
FVNSLDDLHKK

SEQ ID NO: 152666 - protein, 11 aa, BORRELIA GARINII PBI
VNSLDDLHKKY

SEQ ID NO: 152667 - protein, 11 aa, BORRELIA GARINII PBI
NSLDDLHKKYI

SEQ ID NO: 152668 - protein, 11 aa, BORRELIA GARINII PBI
SLDDLHKKYIF

SEQ ID NO: 152669 - protein, 11 aa, BORRELIA GARINII PBI
LDDLHKKYIFD

SEQ ID NO: 152670 - protein, 11 aa, BORRELIA GARINII PBI
DDLHKKYIFDY

SEQ ID NO: 152671 - protein, 11 aa, BORRELIA GARINII PBI
DLHKKYIFDYL

SEQ ID NO: 152672 - protein, 11 aa, BORRELIA GARINII PBI
LHKKYIFDYLN

SEQ ID NO: 152673 - protein, 11 aa, BORRELIA GARINII PBI
HKKYIFDYLNT

SEQ ID NO: 152674 - protein, 11 aa, BORRELIA GARINII PBI
KKYIFDYLNTN

SEQ ID NO: 152675 - protein, 11 aa, BORRELIA GARINII PBI
KYIFDYLNTNE

SEQ ID NO: 152676 - protein, 11 aa, BORRELIA GARINII PBI
YIFDYLNTNED

SEQ ID NO: 152677 - protein, 11 aa, BORRELIA GARINII PBI
IFDYLNTNEDF

SEQ ID NO: 152678 - protein, 11 aa, BORRELIA GARINII PBI
FDYLNTNEDFV

SEQ ID NO: 152679 - protein, 11 aa, BORRELIA GARINII PBI
DYLNTNEDFVV

SEQ ID NO: 152680 - protein, 11 aa, BORRELIA GARINII PBI
YLNTNEDFVVW

SEQ ID NO: 152681 - protein, 11 aa, BORRELIA GARINII PBI
LNTNEDFVVWD

SEQ ID NO: 152682 - protein, 11 aa, BORRELIA GARINII PBI
NTNEDFVVWDM

SEQ ID NO: 152683 - protein, 11 aa, BORRELIA GARINII PBI
TNEDFVVWDMI

SEQ ID NO: 152684 - protein, 11 aa, BORRELIA GARINII PBI
NEDFVVWDMIR

SEQ ID NO: 152685 - protein, 11 aa, BORRELIA GARINII PBI
EDFVVWDMIRS

SEQ ID NO: 152686 - protein, 11 aa, BORRELIA GARINII PBI
DFVVWDMIRSA

SEQ ID NO: 152687 - protein, 11 aa, BORRELIA GARINII PBI
FVVWDMIRSAM

SEQ ID NO: 152688 - protein, 11 aa, BORRELIA GARINII PBI
VVWDMIRSAMS

SEQ ID NO: 152689 - protein, 11 aa, BORRELIA GARINII PBI
VWDMIRSAMSS

SEQ ID NO: 152690 - protein, 11 aa, BORRELIA GARINII PBI
WDMIRSAMSSV

SEQ ID NO: 152691 - protein, 11 aa, BORRELIA GARINII PBI
DMIRSAMSSVS

SEQ ID NO: 152692 - protein, 11 aa, BORRELIA GARINII PBI
MIRSAMSSVSD

SEQ ID NO: 152693 - protein, 11 aa, BORRELIA GARINII PBI
IRSAMSSVSDS

SEQ ID NO: 152694 - protein, 11 aa, BORRELIA GARINII PBI
RSAMSSVSDSV

SEQ ID NO: 152695 - protein, 11 aa, BORRELIA GARINII PBI
SAMSSVSDSVI

SEQ ID NO: 152696 - protein, 11 aa, BORRELIA GARINII PBI
AMSSVSDSVII

SEQ ID NO: 152697 - protein, 11 aa, BORRELIA GARINII PBI
MSSVSDSVIIP

SEQ ID NO: 152698 - protein, 11 aa, BORRELIA GARINII PBI
SSVSDSVIIPM

SEQ ID NO: 152699 - protein, 11 aa, BORRELIA GARINII PBI
SVSDSVIIPMQ

SEQ ID NO: 152700 - protein, 11 aa, BORRELIA GARINII PBI
VSDSVIIPMQD

SEQ ID NO: 152701 - protein, 11 aa, BORRELIA GARINII PBI
SDSVIIPMQDY

SEQ ID NO: 152702 - protein, 11 aa, BORRELIA GARINII PBI
DSVIIPMQDYI

SEQ ID NO: 152703 - protein, 11 aa, BORRELIA GARINII PBI
SVIIPMQDYIN

SEQ ID NO: 152704 - protein, 11 aa, BORRELIA GARINII PBI
VIIPMQDYINL

SEQ ID NO: 152705 - protein, 11 aa, BORRELIA GARINII PBI
IIPMQDYINLG

SEQ ID NO: 152706 - protein, 11 aa, BORRELIA GARINII PBI
IPMQDYINLGN

SEQ ID NO: 152707 - protein, 11 aa, BORRELIA GARINII PBI
PMQDYINLGNE

SEQ ID NO: 152708 - protein, 11 aa, BORRELIA GARINII PBI
MQDYINLGNEF

SEQ ID NO: 152709 - protein, 11 aa, BORRELIA GARINII PBI
QDYINLGNEFR

SEQ ID NO: 152710 - protein, 11 aa, BORRELIA GARINII PBI
DYINLGNEFRA

SEQ ID NO: 152711 - protein, 11 aa, BORRELIA GARINII PBI
YINLGNEFRAN

SEQ ID NO: 152712 - protein, 11 aa, BORRELIA GARINII PBI
INLGNEFRANI

SEQ ID NO: 152713 - protein, 11 aa, BORRELIA GARINII PBI
NLGNEFRANIP

SEQ ID NO: 152714 - protein, 11 aa, BORRELIA GARINII PBI
LGNEFRANIPK

SEQ ID NO: 152715 - protein, 11 aa, BORRELIA GARINII PBI
GNEFRANIPKN

SEQ ID NO: 152716 - protein, 11 aa, BORRELIA GARINII PBI
NEFRANIPKNT

SEQ ID NO: 152717 - protein, 11 aa, BORRELIA GARINII PBI
EFRANIPKNTL

SEQ ID NO: 152718 - protein, 11 aa, BORRELIA GARINII PBI
FRANIPKNTLN

SEQ ID NO: 152719 - protein, 11 aa, BORRELIA GARINII PBI
RANIPKNTLNN

SEQ ID NO: 152720 - protein, 11 aa, BORRELIA GARINII PBI
ANIPKNTLNNW

SEQ ID NO: 152721 - protein, 11 aa, BORRELIA GARINII PBI
NIPKNTLNNWI

SEQ ID NO: 152722 - protein, 11 aa, BORRELIA GARINII PBI
IPKNTLNNWIF

SEQ ID NO: 152723 - protein, 11 aa, BORRELIA GARINII PBI
PKNTLNNWIFR

SEQ ID NO: 152724 - protein, 11 aa, BORRELIA GARINII PBI
KNTLNNWIFRL

SEQ ID NO: 152725 - protein, 11 aa, BORRELIA GARINII PBI
NTLNNWIFRLL

SEQ ID NO: 152726 - protein, 11 aa, BORRELIA GARINII PBI
TLNNWIFRLLE

SEQ ID NO: 152727 - protein, 11 aa, BORRELIA GARINII PBI
LNNWIFRLLES

SEQ ID NO: 152728 - protein, 11 aa, BORRELIA GARINII PBI
NNWIFRLLESD

SEQ ID NO: 152729 - protein, 11 aa, BORRELIA GARINII PBI
NWIFRLLESDL

SEQ ID NO: 152730 - protein, 11 aa, BORRELIA GARINII PBI
WIFRLLESDLD

SEQ ID NO: 152731 - protein, 11 aa, BORRELIA GARINII PBI
IFRLLESDLDA

SEQ ID NO: 152732 - protein, 11 aa, BORRELIA GARINII PBI
FRLLESDLDAT

SEQ ID NO: 152733 - protein, 11 aa, BORRELIA GARINII PBI
RLLESDLDATL

SEQ ID NO: 152734 - protein, 11 aa, BORRELIA GARINII PBI
LLESDLDATLS

SEQ ID NO: 152735 - protein, 11 aa, BORRELIA GARINII PBI
LESDLDATLSK

SEQ ID NO: 152736 - protein, 11 aa, BORRELIA GARINII PBI
ESDLDATLSKN

SEQ ID NO: 152737 - protein, 11 aa, BORRELIA GARINII PBI
SDLDATLSKNI

SEQ ID NO: 152738 - protein, 11 aa, BORRELIA GARINII PBI
DLDATLSKNIS

SEQ ID NO: 152739 - protein, 11 aa, BORRELIA GARINII PBI
LDATLSKNISF

SEQ ID NO: 152740 - protein, 11 aa, BORRELIA GARINII PBI
DATLSKNISFI

SEQ ID NO: 152741 - protein, 11 aa, BORRELIA GARINII PBI
ATLSKNISFIT

SEQ ID NO: 152742 - protein, 11 aa, BORRELIA GARINII PBI
TLSKNISFITR

SEQ ID NO: 152743 - protein, 11 aa, BORRELIA GARINII PBI
LSKNISFITRL

SEQ ID NO: 152744 - protein, 11 aa, BORRELIA GARINII PBI
SKNISFITRLY

SEQ ID NO: 152745 - protein, 11 aa, BORRELIA GARINII PBI
KNISFITRLYG

SEQ ID NO: 152746 - protein, 11 aa, BORRELIA GARINII PBI
NISFITRLYGR

SEQ ID NO: 152747 - protein, 11 aa, BORRELIA GARINII PBI
ISFITRLYGRT

SEQ ID NO: 152748 - protein, 13 aa, BORRELIA GARINII PBI
MKYKKIRINLNLK

SEQ ID NO: 152749 - protein, 13 aa, BORRELIA GARINII PBI
KYKKIRINLNLKR

SEQ ID NO: 152750 - protein, 13 aa, BORRELIA GARINII PBI
YKKIRINLNLKRK

SEQ ID NO: 152751 - protein, 13 aa, BORRELIA GARINII PBI
KKIRINLNLKRKS

SEQ ID NO: 152752 - protein, 13 aa, BORRELIA GARINII PBI
KIRINLNLKRKSG

SEQ ID NO: 152753 - protein, 13 aa, BORRELIA GARINII PBI
IRINLNLKRKSGI

SEQ ID NO: 152754 - protein, 13 aa, BORRELIA GARINII PBI
RINLNLKRKSGIL

SEQ ID NO: 152755 - protein, 13 aa, BORRELIA GARINII PBI
INLNLKRKSGILL

SEQ ID NO: 152756 - protein, 13 aa, BORRELIA GARINII PBI
NLNLKRKSGILLN

SEQ ID NO: 152757 - protein, 13 aa, BORRELIA GARINII PBI
LNLKRKSGILLNI

SEQ ID NO: 152758 - protein, 13 aa, BORRELIA GARINII PBI
NLKRKSGILLNIS

SEQ ID NO: 152759 - protein, 13 aa, BORRELIA GARINII PBI
LKRKSGILLNISS

SEQ ID NO: 152760 - protein, 13 aa, BORRELIA GARINII PBI
KRKSGILLNISSL

SEQ ID NO: 152761 - protein, 13 aa, BORRELIA GARINII PBI
RKSGILLNISSLP

SEQ ID NO: 152762 - protein, 13 aa, BORRELIA GARINII PBI
KSGILLNISSLPS

SEQ ID NO: 152763 - protein, 13 aa, BORRELIA GARINII PBI
SGILLNISSLPSK

SEQ ID NO: 152764 - protein, 13 aa, BORRELIA GARINII PBI
GILLNISSLPSKY

SEQ ID NO: 152765 - protein, 13 aa, BORRELIA GARINII PBI
ILLNISSLPSKYG

SEQ ID NO: 152766 - protein, 13 aa, BORRELIA GARINII PBI
LLNISSLPSKYGI

SEQ ID NO: 152767 - protein, 13 aa, BORRELIA GARINII PBI
LNISSLPSKYGIG

SEQ ID NO: 152768 - protein, 13 aa, BORRELIA GARINII PBI
NISSLPSKYGIGD

SEQ ID NO: 152769 - protein, 13 aa, BORRELIA GARINII PBI
ISSLPSKYGIGDL

SEQ ID NO: 152770 - protein, 13 aa, BORRELIA GARINII PBI
SSLPSKYGIGDLG

SEQ ID NO: 152771 - protein, 13 aa, BORRELIA GARINII PBI
SLPSKYGIGDLGK

SEQ ID NO: 152772 - protein, 13 aa, BORRELIA GARINII PBI
LPSKYGIGDLGKG

SEQ ID NO: 152773 - protein, 13 aa, BORRELIA GARINII PBI
PSKYGIGDLGKGA

SEQ ID NO: 152774 - protein, 13 aa, BORRELIA GARINII PBI
SKYGIGDLGKGAY

SEQ ID NO: 152775 - protein, 13 aa, BORRELIA GARINII PBI
KYGIGDLGKGAYK

SEQ ID NO: 152776 - protein, 13 aa, BORRELIA GARINII PBI
YGIGDLGKGAYKF

SEQ ID NO: 152777 - protein, 13 aa, BORRELIA GARINII PBI
GIGDLGKGAYKFI

SEQ ID NO: 152778 - protein, 13 aa, BORRELIA GARINII PBI
IGDLGKGAYKFID

SEQ ID NO: 152779 - protein, 13 aa, BORRELIA GARINII PBI
GDLGKGAYKFIDF

SEQ ID NO: 152780 - protein, 13 aa, BORRELIA GARINII PBI
DLGKGAYKFIDFL

SEQ ID NO: 152781 - protein, 13 aa, BORRELIA GARINII PBI
LGKGAYKFIDFLF

SEQ ID NO: 152782 - protein, 13 aa, BORRELIA GARINII PBI
GKGAYKFIDFLFA

SEQ ID NO: 152783 - protein, 13 aa, BORRELIA GARINII PBI
KGAYKFIDFLFAS

SEQ ID NO: 152784 - protein, 13 aa, BORRELIA GARINII PBI
GAYKFIDFLFASS

SEQ ID NO: 152785 - protein, 13 aa, BORRELIA GARINII PBI
AYKFIDFLFASSQ

SEQ ID NO: 152786 - protein, 13 aa, BORRELIA GARINII PBI
YKFIDFLFASSQS

SEQ ID NO: 152787 - protein, 13 aa, BORRELIA GARINII PBI
KFIDFLFASSQSY

SEQ ID NO: 152788 - protein, 13 aa, BORRELIA GARINII PBI
FIDFLFASSQSYW

SEQ ID NO: 152789 - protein, 13 aa, BORRELIA GARINII PBI
IDFLFASSQSYWQ

SEQ ID NO: 152790 - protein, 13 aa, BORRELIA GARINII PBI
DFLFASSQSYWQM

SEQ ID NO: 152791 - protein, 13 aa, BORRELIA GARINII PBI
FLFASSQSYWQMF

SEQ ID NO: 152792 - protein, 13 aa, BORRELIA GARINII PBI
LFASSQSYWQMFA

SEQ ID NO: 152793 - protein, 13 aa, BORRELIA GARINII PBI
FASSQSYWQMFAY

SEQ ID NO: 152794 - protein, 13 aa, BORRELIA GARINII PBI
ASSQSYWQMFAYS

SEQ ID NO: 152795 - protein, 13 aa, BORRELIA GARINII PBI
SSQSYWQMFAYSP

SEQ ID NO: 152796 - protein, 13 aa, BORRELIA GARINII PBI
SQSYWQMFAYSPI

SEQ ID NO: 152797 - protein, 13 aa, BORRELIA GARINII PBI
QSYWQMFAYSPID

SEQ ID NO: 152798 - protein, 13 aa, BORRELIA GARINII PBI
SYWQMFAYSPIDF

SEQ ID NO: 152799 - protein, 13 aa, BORRELIA GARINII PBI
YWQMFAYSPIDFT

SEQ ID NO: 152800 - protein, 13 aa, BORRELIA GARINII PBI
WQMFAYSPIDFTR

SEQ ID NO: 152801 - protein, 13 aa, BORRELIA GARINII PBI
QMFAYSPIDFTRS

SEQ ID NO: 152802 - protein, 13 aa, BORRELIA GARINII PBI
MFAYSPIDFTRSP

SEQ ID NO: 152803 - protein, 13 aa, BORRELIA GARINII PBI
FAYSPIDFTRSPP

SEQ ID NO: 152804 - protein, 13 aa, BORRELIA GARINII PBI
AYSPIDFTRSPPY

SEQ ID NO: 152805 - protein, 13 aa, BORRELIA GARINII PBI
YSPIDFTRSPPYS

SEQ ID NO: 152806 - protein, 13 aa, BORRELIA GARINII PBI
SPIDFTRSPPYSI

SEQ ID NO: 152807 - protein, 13 aa, BORRELIA GARINII PBI
PIDFTRSPPYSIF

SEQ ID NO: 152808 - protein, 13 aa, BORRELIA GARINII PBI
IDFTRSPPYSIFS

SEQ ID NO: 152809 - protein, 13 aa, BORRELIA GARINII PBI
DFTRSPPYSIFSA

SEQ ID NO: 152810 - protein, 13 aa, BORRELIA GARINII PBI
FTRSPPYSIFSAF

SEQ ID NO: 152811 - protein, 13 aa, BORRELIA GARINII PBI
TRSPPYSIFSAFA

SEQ ID NO: 152812 - protein, 13 aa, BORRELIA GARINII PBI
RSPPYSIFSAFAG

SEQ ID NO: 152813 - protein, 13 aa, BORRELIA GARINII PBI
SPPYSIFSAFAGN

SEQ ID NO: 152814 - protein, 13 aa, BORRELIA GARINII PBI
PPYSIFSAFAGNV

SEQ ID NO: 152815 - protein, 13 aa, BORRELIA GARINII PBI
PYSIFSAFAGNVY

SEQ ID NO: 152816 - protein, 13 aa, BORRELIA GARINII PBI
YSIFSAFAGNVYY

SEQ ID NO: 152817 - protein, 13 aa, BORRELIA GARINII PBI
SIFSAFAGNVYYI

SEQ ID NO: 152818 - protein, 13 aa, BORRELIA GARINII PBI
IFSAFAGNVYYID

SEQ ID NO: 152819 - protein, 13 aa, BORRELIA GARINII PBI
FSAFAGNVYYIDL

SEQ ID NO: 152820 - protein, 13 aa, BORRELIA GARINII PBI
SAFAGNVYYIDLE

SEQ ID NO: 152821 - protein, 13 aa, BORRELIA GARINII PBI
AFAGNVYYIDLEA

SEQ ID NO: 152822 - protein, 13 aa, BORRELIA GARINII PBI
FAGNVYYIDLEAL

SEQ ID NO: 152823 - protein, 13 aa, BORRELIA GARINII PBI
AGNVYYIDLEALD

SEQ ID NO: 152824 - protein, 13 aa, BORRELIA GARINII PBI
GNVYYIDLEALDK

SEQ ID NO: 152825 - protein, 13 aa, BORRELIA GARINII PBI
NVYYIDLEALDKF

SEQ ID NO: 152826 - protein, 13 aa, BORRELIA GARINII PBI
VYYIDLEALDKFI

SEQ ID NO: 152827 - protein, 13 aa, BORRELIA GARINII PBI
YYIDLEALDKFID

SEQ ID NO: 152828 - protein, 13 aa, BORRELIA GARINII PBI
YIDLEALDKFIDS

SEQ ID NO: 152829 - protein, 13 aa, BORRELIA GARINII PBI
IDLEALDKFIDSD

SEQ ID NO: 152830 - protein, 13 aa, BORRELIA GARINII PBI
DLEALDKFIDSDL

SEQ ID NO: 152831 - protein, 13 aa, BORRELIA GARINII PBI
LEALDKFIDSDLN

SEQ ID NO: 152832 - protein, 13 aa, BORRELIA GARINII PBI
EALDKFIDSDLNL

SEQ ID NO: 152833 - protein, 13 aa, BORRELIA GARINII PBI
ALDKFIDSDLNLL

SEQ ID NO: 152834 - protein, 13 aa, BORRELIA GARINII PBI
LDKFIDSDLNLLK

SEQ ID NO: 152835 - protein, 13 aa, BORRELIA GARINII PBI
DKFIDSDLNLLKE

SEQ ID NO: 152836 - protein, 13 aa, BORRELIA GARINII PBI
KFIDSDLNLLKEN

SEQ ID NO: 152837 - protein, 13 aa, BORRELIA GARINII PBI
FIDSDLNLLKENE

SEQ ID NO: 152838 - protein, 13 aa, BORRELIA GARINII PBI
IDSDLNLLKENET

SEQ ID NO: 152839 - protein, 13 aa, BORRELIA GARINII PBI
DSDLNLLKENETR

SEQ ID NO: 152840 - protein, 13 aa, BORRELIA GARINII PBI
SDLNLLKENETRY

SEQ ID NO: 152841 - protein, 13 aa, BORRELIA GARINII PBI
DLNLLKENETRYS

SEQ ID NO: 152842 - protein, 13 aa, BORRELIA GARINII PBI
LNLLKENETRYSD

SEQ ID NO: 152843 - protein, 13 aa, BORRELIA GARINII PBI
NLLKENETRYSDL

SEQ ID NO: 152844 - protein, 13 aa, BORRELIA GARINII PBI
LLKENETRYSDLK

SEQ ID NO: 152845 - protein, 13 aa, BORRELIA GARINII PBI
LKENETRYSDLKK

SEQ ID NO: 152846 - protein, 13 aa, BORRELIA GARINII PBI
KENETRYSDLKKL

SEQ ID NO: 152847 - protein, 13 aa, BORRELIA GARINII PBI
ENETRYSDLKKLS

SEQ ID NO: 152848 - protein, 13 aa, BORRELIA GARINII PBI
NETRYSDLKKLSF

SEQ ID NO: 152849 - protein, 13 aa, BORRELIA GARINII PBI
ETRYSDLKKLSFK

SEQ ID NO: 152850 - protein, 13 aa, BORRELIA GARINII PBI
TRYSDLKKLSFKD

SEQ ID NO: 152851 - protein, 13 aa, BORRELIA GARINII PBI
RYSDLKKLSFKDK

SEQ ID NO: 152852 - protein, 13 aa, BORRELIA GARINII PBI
YSDLKKLSFKDKF

SEQ ID NO: 152853 - protein, 13 aa, BORRELIA GARINII PBI
SDLKKLSFKDKFL

SEQ ID NO: 152854 - protein, 13 aa, BORRELIA GARINII PBI
DLKKLSFKDKFLK

SEQ ID NO: 152855 - protein, 13 aa, BORRELIA GARINII PBI
LKKLSFKDKFLKE

SEQ ID NO: 152856 - protein, 13 aa, BORRELIA GARINII PBI
KKLSFKDKFLKEA

SEQ ID NO: 152857 - protein, 13 aa, BORRELIA GARINII PBI
KLSFKDKFLKEAA

SEQ ID NO: 152858 - protein, 13 aa, BORRELIA GARINII PBI
LSFKDKFLKEAAL

SEQ ID NO: 152859 - protein, 13 aa, BORRELIA GARINII PBI
SFKDKFLKEAALN

SEQ ID NO: 152860 - protein, 13 aa, BORRELIA GARINII PBI
FKDKFLKEAALNF

SEQ ID NO: 152861 - protein, 13 aa, BORRELIA GARINII PBI
KDKFLKEAALNFI

SEQ ID NO: 152862 - protein, 13 aa, BORRELIA GARINII PBI
DKFLKEAALNFIN

SEQ ID NO: 152863 - protein, 13 aa, BORRELIA GARINII PBI
KFLKEAALNFINR

SEQ ID NO: 152864 - protein, 13 aa, BORRELIA GARINII PBI
FLKEAALNFINRA

SEQ ID NO: 152865 - protein, 13 aa, BORRELIA GARINII PBI
LKEAALNFINRAS

SEQ ID NO: 152866 - protein, 13 aa, BORRELIA GARINII PBI
KEAALNFINRASV

SEQ ID NO: 152867 - protein, 13 aa, BORRELIA GARINII PBI
EAALNFINRASVD

SEQ ID NO: 152868 - protein, 13 aa, BORRELIA GARINII PBI
AALNFINRASVDE

SEQ ID NO: 152869 - protein, 13 aa, BORRELIA GARINII PBI
ALNFINRASVDEV

SEQ ID NO: 152870 - protein, 13 aa, BORRELIA GARINII PBI
LNFINRASVDEVR

SEQ ID NO: 152871 - protein, 13 aa, BORRELIA GARINII PBI
NFINRASVDEVRS

SEQ ID NO: 152872 - protein, 13 aa, BORRELIA GARINII PBI
FINRASVDEVRSF

SEQ ID NO: 152873 - protein, 13 aa, BORRELIA GARINII PBI
INRASVDEVRSFE

SEQ ID NO: 152874 - protein, 13 aa, BORRELIA GARINII PBI
NRASVDEVRSFEK

SEQ ID NO: 152875 - protein, 13 aa, BORRELIA GARINII PBI
RASVDEVRSFEKF

SEQ ID NO: 152876 - protein, 13 aa, BORRELIA GARINII PBI
ASVDEVRSFEKFK

SEQ ID NO: 152877 - protein, 13 aa, BORRELIA GARINII PBI
SVDEVRSFEKFKK

SEQ ID NO: 152878 - protein, 13 aa, BORRELIA GARINII PBI
VDEVRSFEKFKKK

SEQ ID NO: 152879 - protein, 13 aa, BORRELIA GARINII PBI
DEVRSFEKFKKKS

SEQ ID NO: 152880 - protein, 13 aa, BORRELIA GARINII PBI
EVRSFEKFKKKSS

SEQ ID NO: 152881 - protein, 13 aa, BORRELIA GARINII PBI
VRSFEKFKKKSSY

SEQ ID NO: 152882 - protein, 13 aa, BORRELIA GARINII PBI
RSFEKFKKKSSYW

SEQ ID NO: 152883 - protein, 13 aa, BORRELIA GARINII PBI
SFEKFKKKSSYWL

SEQ ID NO: 152884 - protein, 13 aa, BORRELIA GARINII PBI
FEKFKKKSSYWLL

SEQ ID NO: 152885 - protein, 13 aa, BORRELIA GARINII PBI
EKFKKKSSYWLLD

SEQ ID NO: 152886 - protein, 13 aa, BORRELIA GARINII PBI
KFKKKSSYWLLDF

SEQ ID NO: 152887 - protein, 13 aa, BORRELIA GARINII PBI
FKKKSSYWLLDFA

SEQ ID NO: 152888 - protein, 13 aa, BORRELIA GARINII PBI
KKKSSYWLLDFAS

SEQ ID NO: 152889 - protein, 13 aa, BORRELIA GARINII PBI
KKSSYWLLDFASF

SEQ ID NO: 152890 - protein, 13 aa, BORRELIA GARINII PBI
KSSYWLLDFASFV

SEQ ID NO: 152891 - protein, 13 aa, BORRELIA GARINII PBI
SSYWLLDFASFVA

SEQ ID NO: 152892 - protein, 13 aa, BORRELIA GARINII PBI
SYWLLDFASFVAF

SEQ ID NO: 152893 - protein, 13 aa, BORRELIA GARINII PBI
YWLLDFASFVAFK

SEQ ID NO: 152894 - protein, 13 aa, BORRELIA GARINII PBI
WLLDFASFVAFKE

SEQ ID NO: 152895 - protein, 13 aa, BORRELIA GARINII PBI
LLDFASFVAFKEY

SEQ ID NO: 152896 - protein, 13 aa, BORRELIA GARINII PBI
LDFASFVAFKEYF

SEQ ID NO: 152897 - protein, 13 aa, BORRELIA GARINII PBI
DFASFVAFKEYFL

SEQ ID NO: 152898 - protein, 13 aa, BORRELIA GARINII PBI
FASFVAFKEYFLK

SEQ ID NO: 152899 - protein, 13 aa, BORRELIA GARINII PBI
ASFVAFKEYFLKD

SEQ ID NO: 152900 - protein, 13 aa, BORRELIA GARINII PBI
SFVAFKEYFLKDS

SEQ ID NO: 152901 - protein, 13 aa, BORRELIA GARINII PBI
FVAFKEYFLKDSR

SEQ ID NO: 152902 - protein, 13 aa, BORRELIA GARINII PBI
VAFKEYFLKDSRD

SEQ ID NO: 152903 - protein, 13 aa, BORRELIA GARINII PBI
AFKEYFLKDSRDA

SEQ ID NO: 152904 - protein, 13 aa, BORRELIA GARINII PBI
FKEYFLKDSRDAF

SEQ ID NO: 152905 - protein, 13 aa, BORRELIA GARINII PBI
KEYFLKDSRDAFN

SEQ ID NO: 152906 - protein, 13 aa, BORRELIA GARINII PBI
EYFLKDSRDAFNV

SEQ ID NO: 152907 - protein, 13 aa, BORRELIA GARINII PBI
YFLKDSRDAFNVL

SEQ ID NO: 152908 - protein, 13 aa, BORRELIA GARINII PBI
FLKDSRDAFNVLF

SEQ ID NO: 152909 - protein, 13 aa, BORRELIA GARINII PBI
LKDSRDAFNVLFD

SEQ ID NO: 152910 - protein, 13 aa, BORRELIA GARINII PBI
KDSRDAFNVLFDR

SEQ ID NO: 152911 - protein, 13 aa, BORRELIA GARINII PBI
DSRDAFNVLFDRG

SEQ ID NO: 152912 - protein, 13 aa, BORRELIA GARINII PBI
SRDAFNVLFDRGI

SEQ ID NO: 152913 - protein, 13 aa, BORRELIA GARINII PBI
RDAFNVLFDRGIL

SEQ ID NO: 152914 - protein, 13 aa, BORRELIA GARINII PBI
DAFNVLFDRGILI

SEQ ID NO: 152915 - protein, 13 aa, BORRELIA GARINII PBI
AFNVLFDRGILIR

SEQ ID NO: 152916 - protein, 13 aa, BORRELIA GARINII PBI
FNVLFDRGILIRN

SEQ ID NO: 152917 - protein, 13 aa, BORRELIA GARINII PBI
NVLFDRGILIRNE

SEQ ID NO: 152918 - protein, 13 aa, BORRELIA GARINII PBI
VLFDRGILIRNEK

SEQ ID NO: 152919 - protein, 13 aa, BORRELIA GARINII PBI
LFDRGILIRNEKD

SEQ ID NO: 152920 - protein, 13 aa, BORRELIA GARINII PBI
FDRGILIRNEKDL

SEQ ID NO: 152921 - protein, 13 aa, BORRELIA GARINII PBI
DRGILIRNEKDLF

SEQ ID NO: 152922 - protein, 13 aa, BORRELIA GARINII PBI
RGILIRNEKDLFK

SEQ ID NO: 152923 - protein, 13 aa, BORRELIA GARINII PBI
GILIRNEKDLFKL

SEQ ID NO: 152924 - protein, 13 aa, BORRELIA GARINII PBI
ILIRNEKDLFKLR

SEQ ID NO: 152925 - protein, 13 aa, BORRELIA GARINII PBI
LIRNEKDLFKLRN

SEQ ID NO: 152926 - protein, 13 aa, BORRELIA GARINII PBI
IRNEKDLFKLRNI

SEQ ID NO: 152927 - protein, 13 aa, BORRELIA GARINII PBI
RNEKDLFKLRNIL

SEQ ID NO: 152928 - protein, 13 aa, BORRELIA GARINII PBI
NEKDLFKLRNILS

SEQ ID NO: 152929 - protein, 13 aa, BORRELIA GARINII PBI
EKDLFKLRNILSK

SEQ ID NO: 152930 - protein, 13 aa, BORRELIA GARINII PBI
KDLFKLRNILSKE

SEQ ID NO: 152931 - protein, 13 aa, BORRELIA GARINII PBI
DLFKLRNILSKEI

SEQ ID NO: 152932 - protein, 13 aa, BORRELIA GARINII PBI
LFKLRNILSKEIK

SEQ ID NO: 152933 - protein, 13 aa, BORRELIA GARINII PBI
FKLRNILSKEIKV

SEQ ID NO: 152934 - protein, 13 aa, BORRELIA GARINII PBI
KLRNILSKEIKVQ

SEQ ID NO: 152935 - protein, 13 aa, BORRELIA GARINII PBI
LRNILSKEIKVQE

SEQ ID NO: 152936 - protein, 13 aa, BORRELIA GARINII PBI
RNILSKEIKVQEV

SEQ ID NO: 152937 - protein, 13 aa, BORRELIA GARINII PBI
NILSKEIKVQEVL

SEQ ID NO: 152938 - protein, 13 aa, BORRELIA GARINII PBI
ILSKEIKVQEVLQ

SEQ ID NO: 152939 - protein, 13 aa, BORRELIA GARINII PBI
LSKEIKVQEVLQY

SEQ ID NO: 152940 - protein, 13 aa, BORRELIA GARINII PBI
SKEIKVQEVLQYF

SEQ ID NO: 152941 - protein, 13 aa, BORRELIA GARINII PBI
KEIKVQEVLQYFF

SEQ ID NO: 152942 - protein, 13 aa, BORRELIA GARINII PBI
EIKVQEVLQYFFF

SEQ ID NO: 152943 - protein, 13 aa, BORRELIA GARINII PBI
IKVQEVLQYFFFS

SEQ ID NO: 152944 - protein, 13 aa, BORRELIA GARINII PBI
KVQEVLQYFFFSQ

SEQ ID NO: 152945 - protein, 13 aa, BORRELIA GARINII PBI
VQEVLQYFFFSQF

SEQ ID NO: 152946 - protein, 13 aa, BORRELIA GARINII PBI
QEVLQYFFFSQFQ

SEQ ID NO: 152947 - protein, 13 aa, BORRELIA GARINII PBI
EVLQYFFFSQFQA

SEQ ID NO: 152948 - protein, 13 aa, BORRELIA GARINII PBI
VLQYFFFSQFQAL

SEQ ID NO: 152949 - protein, 13 aa, BORRELIA GARINII PBI
LQYFFFSQFQALK

SEQ ID NO: 152950 - protein, 13 aa, BORRELIA GARINII PBI
QYFFFSQFQALKR

SEQ ID NO: 152951 - protein, 13 aa, BORRELIA GARINII PBI
YFFFSQFQALKRY

SEQ ID NO: 152952 - protein, 13 aa, BORRELIA GARINII PBI
FFFSQFQALKRYA

SEQ ID NO: 152953 - protein, 13 aa, BORRELIA GARINII PBI
FFSQFQALKRYAN

SEQ ID NO: 152954 - protein, 13 aa, BORRELIA GARINII PBI
FSQFQALKRYAND

SEQ ID NO: 152955 - protein, 13 aa, BORRELIA GARINII PBI
SQFQALKRYANDK

SEQ ID NO: 152956 - protein, 13 aa, BORRELIA GARINII PBI
QFQALKRYANDKG

SEQ ID NO: 152957 - protein, 13 aa, BORRELIA GARINII PBI
FQALKRYANDKGI

SEQ ID NO: 152958 - protein, 13 aa, BORRELIA GARINII PBI
QALKRYANDKGIE

SEQ ID NO: 152959 - protein, 13 aa, BORRELIA GARINII PBI
ALKRYANDKGIEL

SEQ ID NO: 152960 - protein, 13 aa, BORRELIA GARINII PBI
LKRYANDKGIELV

SEQ ID NO: 152961 - protein, 13 aa, BORRELIA GARINII PBI
KRYANDKGIELVM

SEQ ID NO: 152962 - protein, 13 aa, BORRELIA GARINII PBI
RYANDKGIELVMN

SEQ ID NO: 152963 - protein, 13 aa, BORRELIA GARINII PBI
YANDKGIELVMNL

SEQ ID NO: 152964 - protein, 13 aa, BORRELIA GARINII PBI
ANDKGIELVMNLP

SEQ ID NO: 152965 - protein, 13 aa, BORRELIA GARINII PBI
NDKGIELVMNLPL

SEQ ID NO: 152966 - protein, 13 aa, BORRELIA GARINII PBI
DKGIELVMNLPLF

SEQ ID NO: 152967 - protein, 13 aa, BORRELIA GARINII PBI
KGIELVMNLPLFI

SEQ ID NO: 152968 - protein, 13 aa, BORRELIA GARINII PBI
GIELVMNLPLFIA

SEQ ID NO: 152969 - protein, 13 aa, BORRELIA GARINII PBI
IELVMNLPLFIAY

SEQ ID NO: 152970 - protein, 13 aa, BORRELIA GARINII PBI
ELVMNLPLFIAYD

SEQ ID NO: 152971 - protein, 13 aa, BORRELIA GARINII PBI
LVMNLPLFIAYDS

SEQ ID NO: 152972 - protein, 13 aa, BORRELIA GARINII PBI
VMNLPLFIAYDSA

SEQ ID NO: 152973 - protein, 13 aa, BORRELIA GARINII PBI
MNLPLFIAYDSAD

SEQ ID NO: 152974 - protein, 13 aa, BORRELIA GARINII PBI
NLPLFIAYDSADV

SEQ ID NO: 152975 - protein, 13 aa, BORRELIA GARINII PBI
LPLFIAYDSADVW

SEQ ID NO: 152976 - protein, 13 aa, BORRELIA GARINII PBI
PLFIAYDSADVWA

SEQ ID NO: 152977 - protein, 13 aa, BORRELIA GARINII PBI
LFIAYDSADVWAH

SEQ ID NO: 152978 - protein, 13 aa, BORRELIA GARINII PBI
FIAYDSADVWAHQ

SEQ ID NO: 152979 - protein, 13 aa, BORRELIA GARINII PBI
IAYDSADVWAHQK

SEQ ID NO: 152980 - protein, 13 aa, BORRELIA GARINII PBI
AYDSADVWAHQKY

SEQ ID NO: 152981 - protein, 13 aa, BORRELIA GARINII PBI
YDSADVWAHQKYF

SEQ ID NO: 152982 - protein, 13 aa, BORRELIA GARINII PBI
DSADVWAHQKYFK

SEQ ID NO: 152983 - protein, 13 aa, BORRELIA GARINII PBI
SADVWAHQKYFKL

SEQ ID NO: 152984 - protein, 13 aa, BORRELIA GARINII PBI
ADVWAHQKYFKLR

SEQ ID NO: 152985 - protein, 13 aa, BORRELIA GARINII PBI
DVWAHQKYFKLRF

SEQ ID NO: 152986 - protein, 13 aa, BORRELIA GARINII PBI
VWAHQKYFKLRFD

SEQ ID NO: 152987 - protein, 13 aa, BORRELIA GARINII PBI
WAHQKYFKLRFDA

SEQ ID NO: 152988 - protein, 13 aa, BORRELIA GARINII PBI
AHQKYFKLRFDAS

SEQ ID NO: 152989 - protein, 13 aa, BORRELIA GARINII PBI
HQKYFKLRFDASK

SEQ ID NO: 152990 - protein, 13 aa, BORRELIA GARINII PBI
QKYFKLRFDASKD

SEQ ID NO: 152991 - protein, 13 aa, BORRELIA GARINII PBI
KYFKLRFDASKDK

SEQ ID NO: 152992 - protein, 13 aa, BORRELIA GARINII PBI
YFKLRFDASKDKV

SEQ ID NO: 152993 - protein, 13 aa, BORRELIA GARINII PBI
FKLRFDASKDKVA

SEQ ID NO: 152994 - protein, 13 aa, BORRELIA GARINII PBI
KLRFDASKDKVAG

SEQ ID NO: 152995 - protein, 13 aa, BORRELIA GARINII PBI
LRFDASKDKVAGI

SEQ ID NO: 152996 - protein, 13 aa, BORRELIA GARINII PBI
RFDASKDKVAGIS

SEQ ID NO: 152997 - protein, 13 aa, BORRELIA GARINII PBI
FDASKDKVAGISP

SEQ ID NO: 152998 - protein, 13 aa, BORRELIA GARINII PBI
DASKDKVAGISPD

SEQ ID NO: 152999 - protein, 13 aa, BORRELIA GARINII PBI
ASKDKVAGISPDY

SEQ ID NO: 153000 - protein, 13 aa, BORRELIA GARINII PBI
SKDKVAGISPDYF

SEQ ID NO: 153001 - protein, 13 aa, BORRELIA GARINII PBI
KDKVAGISPDYFL

SEQ ID NO: 153002 - protein, 13 aa, BORRELIA GARINII PBI
DKVAGISPDYFLE

SEQ ID NO: 153003 - protein, 13 aa, BORRELIA GARINII PBI
KVAGISPDYFLEQ

SEQ ID NO: 153004 - protein, 13 aa, BORRELIA GARINII PBI
VAGISPDYFLEQE

SEQ ID NO: 153005 - protein, 13 aa, BORRELIA GARINII PBI
AGISPDYFLEQEQ

SEQ ID NO: 153006 - protein, 13 aa, BORRELIA GARINII PBI
GISPDYFLEQEQA

SEQ ID NO: 153007 - protein, 13 aa, BORRELIA GARINII PBI
ISPDYFLEQEQAW

SEQ ID NO: 153008 - protein, 13 aa, BORRELIA GARINII PBI
SPDYFLEQEQAWD

SEQ ID NO: 153009 - protein, 13 aa, BORRELIA GARINII PBI
PDYFLEQEQAWDS

SEQ ID NO: 153010 - protein, 13 aa, BORRELIA GARINII PBI
DYFLEQEQAWDSP

SEQ ID NO: 153011 - protein, 13 aa, BORRELIA GARINII PBI
YFLEQEQAWDSPA

SEQ ID NO: 153012 - protein, 13 aa, BORRELIA GARINII PBI
FLEQEQAWDSPAY

SEQ ID NO: 153013 - protein, 13 aa, BORRELIA GARINII PBI
LEQEQAWDSPAYS

SEQ ID NO: 153014 - protein, 13 aa, BORRELIA GARINII PBI
EQEQAWDSPAYSW

SEQ ID NO: 153015 - protein, 13 aa, BORRELIA GARINII PBI
QEQAWDSPAYSWN

SEQ ID NO: 153016 - protein, 13 aa, BORRELIA GARINII PBI
EQAWDSPAYSWNV

SEQ ID NO: 153017 - protein, 13 aa, BORRELIA GARINII PBI
QAWDSPAYSWNVL

SEQ ID NO: 153018 - protein, 13 aa, BORRELIA GARINII PBI
AWDSPAYSWNVLK

SEQ ID NO: 153019 - protein, 13 aa, BORRELIA GARINII PBI
WDSPAYSWNVLKN

SEQ ID NO: 153020 - protein, 13 aa, BORRELIA GARINII PBI
DSPAYSWNVLKNV

SEQ ID NO: 153021 - protein, 13 aa, BORRELIA GARINII PBI
SPAYSWNVLKNVK

SEQ ID NO: 153022 - protein, 13 aa, BORRELIA GARINII PBI
PAYSWNVLKNVKY

SEQ ID NO: 153023 - protein, 13 aa, BORRELIA GARINII PBI
AYSWNVLKNVKYE

SEQ ID NO: 153024 - protein, 13 aa, BORRELIA GARINII PBI
YSWNVLKNVKYEW

SEQ ID NO: 153025 - protein, 13 aa, BORRELIA GARINII PBI
SWNVLKNVKYEWW

SEQ ID NO: 153026 - protein, 13 aa, BORRELIA GARINII PBI
WNVLKNVKYEWWA

SEQ ID NO: 153027 - protein, 13 aa, BORRELIA GARINII PBI
NVLKNVKYEWWAK

SEQ ID NO: 153028 - protein, 13 aa, BORRELIA GARINII PBI
VLKNVKYEWWAKR

SEQ ID NO: 153029 - protein, 13 aa, BORRELIA GARINII PBI
LKNVKYEWWAKRI

SEQ ID NO: 153030 - protein, 13 aa, BORRELIA GARINII PBI
KNVKYEWWAKRIG

SEQ ID NO: 153031 - protein, 13 aa, BORRELIA GARINII PBI
NVKYEWWAKRIGI

SEQ ID NO: 153032 - protein, 13 aa, BORRELIA GARINII PBI
VKYEWWAKRIGIL

SEQ ID NO: 153033 - protein, 13 aa, BORRELIA GARINII PBI
KYEWWAKRIGILR

SEQ ID NO: 153034 - protein, 13 aa, BORRELIA GARINII PBI
YEWWAKRIGILRK

SEQ ID NO: 153035 - protein, 13 aa, BORRELIA GARINII PBI
EWWAKRIGILRKY

SEQ ID NO: 153036 - protein, 13 aa, BORRELIA GARINII PBI
WWAKRIGILRKYI

SEQ ID NO: 153037 - protein, 13 aa, BORRELIA GARINII PBI
WAKRIGILRKYID

SEQ ID NO: 153038 - protein, 13 aa, BORRELIA GARINII PBI
AKRIGILRKYIDV

SEQ ID NO: 153039 - protein, 13 aa, BORRELIA GARINII PBI
KRIGILRKYIDVI

SEQ ID NO: 153040 - protein, 13 aa, BORRELIA GARINII PBI
RIGILRKYIDVIK

SEQ ID NO: 153041 - protein, 13 aa, BORRELIA GARINII PBI
IGILRKYIDVIKI

SEQ ID NO: 153042 - protein, 13 aa, BORRELIA GARINII PBI
GILRKYIDVIKID

SEQ ID NO: 153043 - protein, 13 aa, BORRELIA GARINII PBI
ILRKYIDVIKIDH

SEQ ID NO: 153044 - protein, 13 aa, BORRELIA GARINII PBI
LRKYIDVIKIDHF

SEQ ID NO: 153045 - protein, 13 aa, BORRELIA GARINII PBI
RKYIDVIKIDHFR

SEQ ID NO: 153046 - protein, 13 aa, BORRELIA GARINII PBI
KYIDVIKIDHFRG

SEQ ID NO: 153047 - protein, 13 aa, BORRELIA GARINII PBI
YIDVIKIDHFRGF

SEQ ID NO: 153048 - protein, 13 aa, BORRELIA GARINII PBI
IDVIKIDHFRGFV

SEQ ID NO: 153049 - protein, 13 aa, BORRELIA GARINII PBI
DVIKIDHFRGFVS

SEQ ID NO: 153050 - protein, 13 aa, BORRELIA GARINII PBI
VIKIDHFRGFVST

SEQ ID NO: 153051 - protein, 13 aa, BORRELIA GARINII PBI
IKIDHFRGFVSTW

SEQ ID NO: 153052 - protein, 13 aa, BORRELIA GARINII PBI
KIDHFRGFVSTWE

SEQ ID NO: 153053 - protein, 13 aa, BORRELIA GARINII PBI
IDHFRGFVSTWEV

SEQ ID NO: 153054 - protein, 13 aa, BORRELIA GARINII PBI
DHFRGFVSTWEVG

SEQ ID NO: 153055 - protein, 13 aa, BORRELIA GARINII PBI
HFRGFVSTWEVGV

SEQ ID NO: 153056 - protein, 13 aa, BORRELIA GARINII PBI
FRGFVSTWEVGVG

SEQ ID NO: 153057 - protein, 13 aa, BORRELIA GARINII PBI
RGFVSTWEVGVGE

SEQ ID NO: 153058 - protein, 13 aa, BORRELIA GARINII PBI
GFVSTWEVGVGEA

SEQ ID NO: 153059 - protein, 13 aa, BORRELIA GARINII PBI
FVSTWEVGVGEAY

SEQ ID NO: 153060 - protein, 13 aa, BORRELIA GARINII PBI
VSTWEVGVGEAYA

SEQ ID NO: 153061 - protein, 13 aa, BORRELIA GARINII PBI
STWEVGVGEAYAF

SEQ ID NO: 153062 - protein, 13 aa, BORRELIA GARINII PBI
TWEVGVGEAYAFN

SEQ ID NO: 153063 - protein, 13 aa, BORRELIA GARINII PBI
WEVGVGEAYAFNG

SEQ ID NO: 153064 - protein, 13 aa, BORRELIA GARINII PBI
EVGVGEAYAFNGL

SEQ ID NO: 153065 - protein, 13 aa, BORRELIA GARINII PBI
VGVGEAYAFNGLW

SEQ ID NO: 153066 - protein, 13 aa, BORRELIA GARINII PBI
GVGEAYAFNGLWV

SEQ ID NO: 153067 - protein, 13 aa, BORRELIA GARINII PBI
VGEAYAFNGLWVK

SEQ ID NO: 153068 - protein, 13 aa, BORRELIA GARINII PBI
GEAYAFNGLWVKS

SEQ ID NO: 153069 - protein, 13 aa, BORRELIA GARINII PBI
EAYAFNGLWVKSP

SEQ ID NO: 153070 - protein, 13 aa, BORRELIA GARINII PBI
AYAFNGLWVKSPG

SEQ ID NO: 153071 - protein, 13 aa, BORRELIA GARINII PBI
YAFNGLWVKSPGR

SEQ ID NO: 153072 - protein, 13 aa, BORRELIA GARINII PBI
AFNGLWVKSPGRD

SEQ ID NO: 153073 - protein, 13 aa, BORRELIA GARINII PBI
FNGLWVKSPGRDF

SEQ ID NO: 153074 - protein, 13 aa, BORRELIA GARINII PBI
NGLWVKSPGRDFF

SEQ ID NO: 153075 - protein, 13 aa, BORRELIA GARINII PBI
GLWVKSPGRDFFN

SEQ ID NO: 153076 - protein, 13 aa, BORRELIA GARINII PBI
LWVKSPGRDFFNF

SEQ ID NO: 153077 - protein, 13 aa, BORRELIA GARINII PBI
WVKSPGRDFFNFI

SEQ ID NO: 153078 - protein, 13 aa, BORRELIA GARINII PBI
VKSPGRDFFNFIL

SEQ ID NO: 153079 - protein, 13 aa, BORRELIA GARINII PBI
KSPGRDFFNFILN

SEQ ID NO: 153080 - protein, 13 aa, BORRELIA GARINII PBI
SPGRDFFNFILNE

SEQ ID NO: 153081 - protein, 13 aa, BORRELIA GARINII PBI
PGRDFFNFILNEI

SEQ ID NO: 153082 - protein, 13 aa, BORRELIA GARINII PBI
GRDFFNFILNEIK

SEQ ID NO: 153083 - protein, 13 aa, BORRELIA GARINII PBI
RDFFNFILNEIKD

SEQ ID NO: 153084 - protein, 13 aa, BORRELIA GARINII PBI
DFFNFILNEIKDL

SEQ ID NO: 153085 - protein, 13 aa, BORRELIA GARINII PBI
FFNFILNEIKDLK

SEQ ID NO: 153086 - protein, 13 aa, BORRELIA GARINII PBI
FNFILNEIKDLKI

SEQ ID NO: 153087 - protein, 13 aa, BORRELIA GARINII PBI
NFILNEIKDLKIW

SEQ ID NO: 153088 - protein, 13 aa, BORRELIA GARINII PBI
FILNEIKDLKIWV

SEQ ID NO: 153089 - protein, 13 aa, BORRELIA GARINII PBI
ILNEIKDLKIWVE

SEQ ID NO: 153090 - protein, 13 aa, BORRELIA GARINII PBI
LNEIKDLKIWVED

SEQ ID NO: 153091 - protein, 13 aa, BORRELIA GARINII PBI
NEIKDLKIWVEDF

SEQ ID NO: 153092 - protein, 13 aa, BORRELIA GARINII PBI
EIKDLKIWVEDFE

SEQ ID NO: 153093 - protein, 13 aa, BORRELIA GARINII PBI
IKDLKIWVEDFEN

SEQ ID NO: 153094 - protein, 13 aa, BORRELIA GARINII PBI
KDLKIWVEDFEND

SEQ ID NO: 153095 - protein, 13 aa, BORRELIA GARINII PBI
DLKIWVEDFENDL

SEQ ID NO: 153096 - protein, 13 aa, BORRELIA GARINII PBI
LKIWVEDFENDLE

SEQ ID NO: 153097 - protein, 13 aa, BORRELIA GARINII PBI
KIWVEDFENDLED

SEQ ID NO: 153098 - protein, 13 aa, BORRELIA GARINII PBI
IWVEDFENDLEDV

SEQ ID NO: 153099 - protein, 13 aa, BORRELIA GARINII PBI
WVEDFENDLEDVS

SEQ ID NO: 153100 - protein, 13 aa, BORRELIA GARINII PBI
VEDFENDLEDVSR

SEQ ID NO: 153101 - protein, 13 aa, BORRELIA GARINII PBI
EDFENDLEDVSRL

SEQ ID NO: 153102 - protein, 13 aa, BORRELIA GARINII PBI
DFENDLEDVSRLR

SEQ ID NO: 153103 - protein, 13 aa, BORRELIA GARINII PBI
FENDLEDVSRLRD

SEQ ID NO: 153104 - protein, 13 aa, BORRELIA GARINII PBI
ENDLEDVSRLRDF

SEQ ID NO: 153105 - protein, 13 aa, BORRELIA GARINII PBI
NDLEDVSRLRDFF

SEQ ID NO: 153106 - protein, 13 aa, BORRELIA GARINII PBI
DLEDVSRLRDFFN

SEQ ID NO: 153107 - protein, 13 aa, BORRELIA GARINII PBI
LEDVSRLRDFFNF

SEQ ID NO: 153108 - protein, 13 aa, BORRELIA GARINII PBI
EDVSRLRDFFNFP

SEQ ID NO: 153109 - protein, 13 aa, BORRELIA GARINII PBI
DVSRLRDFFNFPG

SEQ ID NO: 153110 - protein, 13 aa, BORRELIA GARINII PBI
VSRLRDFFNFPGM

SEQ ID NO: 153111 - protein, 13 aa, BORRELIA GARINII PBI
SRLRDFFNFPGMR

SEQ ID NO: 153112 - protein, 13 aa, BORRELIA GARINII PBI
RLRDFFNFPGMRI

SEQ ID NO: 153113 - protein, 13 aa, BORRELIA GARINII PBI
LRDFFNFPGMRIM

SEQ ID NO: 153114 - protein, 13 aa, BORRELIA GARINII PBI
RDFFNFPGMRIMK

SEQ ID NO: 153115 - protein, 13 aa, BORRELIA GARINII PBI
DFFNFPGMRIMKL

SEQ ID NO: 153116 - protein, 13 aa, BORRELIA GARINII PBI
FFNFPGMRIMKLA

SEQ ID NO: 153117 - protein, 13 aa, BORRELIA GARINII PBI
FNFPGMRIMKLAF

SEQ ID NO: 153118 - protein, 13 aa, BORRELIA GARINII PBI
NFPGMRIMKLAFD

SEQ ID NO: 153119 - protein, 13 aa, BORRELIA GARINII PBI
FPGMRIMKLAFDF

SEQ ID NO: 153120 - protein, 13 aa, BORRELIA GARINII PBI
PGMRIMKLAFDFD

SEQ ID NO: 153121 - protein, 13 aa, BORRELIA GARINII PBI
GMRIMKLAFDFDS

SEQ ID NO: 153122 - protein, 13 aa, BORRELIA GARINII PBI
MRIMKLAFDFDSD

SEQ ID NO: 153123 - protein, 13 aa, BORRELIA GARINII PBI
RIMKLAFDFDSDN

SEQ ID NO: 153124 - protein, 13 aa, BORRELIA GARINII PBI
IMKLAFDFDSDNQ

SEQ ID NO: 153125 - protein, 13 aa, BORRELIA GARINII PBI
MKLAFDFDSDNQN

SEQ ID NO: 153126 - protein, 13 aa, BORRELIA GARINII PBI
KLAFDFDSDNQNL

SEQ ID NO: 153127 - protein, 13 aa, BORRELIA GARINII PBI
LAFDFDSDNQNLP

SEQ ID NO: 153128 - protein, 13 aa, BORRELIA GARINII PBI
AFDFDSDNQNLPH

SEQ ID NO: 153129 - protein, 13 aa, BORRELIA GARINII PBI
FDFDSDNQNLPHN

SEQ ID NO: 153130 - protein, 13 aa, BORRELIA GARINII PBI
DFDSDNQNLPHNY

SEQ ID NO: 153131 - protein, 13 aa, BORRELIA GARINII PBI
FDSDNQNLPHNYI

SEQ ID NO: 153132 - protein, 13 aa, BORRELIA GARINII PBI
DSDNQNLPHNYIK

SEQ ID NO: 153133 - protein, 13 aa, BORRELIA GARINII PBI
SDNQNLPHNYIKN

SEQ ID NO: 153134 - protein, 13 aa, BORRELIA GARINII PBI
DNQNLPHNYIKNC

SEQ ID NO: 153135 - protein, 13 aa, BORRELIA GARINII PBI
NQNLPHNYIKNCI

SEQ ID NO: 153136 - protein, 13 aa, BORRELIA GARINII PBI
QNLPHNYIKNCIV

SEQ ID NO: 153137 - protein, 13 aa, BORRELIA GARINII PBI
NLPHNYIKNCIVY

SEQ ID NO: 153138 - protein, 13 aa, BORRELIA GARINII PBI
LPHNYIKNCIVYT

SEQ ID NO: 153139 - protein, 13 aa, BORRELIA GARINII PBI
PHNYIKNCIVYTG

SEQ ID NO: 153140 - protein, 13 aa, BORRELIA GARINII PBI
HNYIKNCIVYTGI

SEQ ID NO: 153141 - protein, 13 aa, BORRELIA GARINII PBI
NYIKNCIVYTGIG

SEQ ID NO: 153142 - protein, 13 aa, BORRELIA GARINII PBI
YIKNCIVYTGIGD

SEQ ID NO: 153143 - protein, 13 aa, BORRELIA GARINII PBI
IKNCIVYTGIGDN

SEQ ID NO: 153144 - protein, 13 aa, BORRELIA GARINII PBI
KNCIVYTGIGDNS

SEQ ID NO: 153145 - protein, 13 aa, BORRELIA GARINII PBI
NCIVYTGIGDNST

SEQ ID NO: 153146 - protein, 13 aa, BORRELIA GARINII PBI
CIVYTGIGDNSTI

SEQ ID NO: 153147 - protein, 13 aa, BORRELIA GARINII PBI
IVYTGIGDNSTIR

SEQ ID NO: 153148 - protein, 13 aa, BORRELIA GARINII PBI
VYTGIGDNSTIRE

SEQ ID NO: 153149 - protein, 13 aa, BORRELIA GARINII PBI
YTGIGDNSTIREF

SEQ ID NO: 153150 - protein, 13 aa, BORRELIA GARINII PBI
TGIGDNSTIREFV

SEQ ID NO: 153151 - protein, 13 aa, BORRELIA GARINII PBI
GIGDNSTIREFVN

SEQ ID NO: 153152 - protein, 13 aa, BORRELIA GARINII PBI
IGDNSTIREFVNS

SEQ ID NO: 153153 - protein, 13 aa, BORRELIA GARINII PBI
GDNSTIREFVNSL

SEQ ID NO: 153154 - protein, 13 aa, BORRELIA GARINII PBI
DNSTIREFVNSLD

SEQ ID NO: 153155 - protein, 13 aa, BORRELIA GARINII PBI
NSTIREFVNSLDD

SEQ ID NO: 153156 - protein, 13 aa, BORRELIA GARINII PBI
STIREFVNSLDDL

SEQ ID NO: 153157 - protein, 13 aa, BORRELIA GARINII PBI
TIREFVNSLDDLH

SEQ ID NO: 153158 - protein, 13 aa, BORRELIA GARINII PBI
IREFVNSLDDLHK

SEQ ID NO: 153159 - protein, 13 aa, BORRELIA GARINII PBI
REFVNSLDDLHKK

SEQ ID NO: 153160 - protein, 13 aa, BORRELIA GARINII PBI
EFVNSLDDLHKKY

SEQ ID NO: 153161 - protein, 13 aa, BORRELIA GARINII PBI
FVNSLDDLHKKYI

SEQ ID NO: 153162 - protein, 13 aa, BORRELIA GARINII PBI
VNSLDDLHKKYIF

SEQ ID NO: 153163 - protein, 13 aa, BORRELIA GARINII PBI
NSLDDLHKKYIFD

SEQ ID NO: 153164 - protein, 13 aa, BORRELIA GARINII PBI
SLDDLHKKYIFDY

SEQ ID NO: 153165 - protein, 13 aa, BORRELIA GARINII PBI
LDDLHKKYIFDYL

SEQ ID NO: 153166 - protein, 13 aa, BORRELIA GARINII PBI
DDLHKKYIFDYLN

SEQ ID NO: 153167 - protein, 13 aa, BORRELIA GARINII PBI
DLHKKYIFDYLNT

SEQ ID NO: 153168 - protein, 13 aa, BORRELIA GARINII PBI
LHKKYIFDYLNTN

SEQ ID NO: 153169 - protein, 13 aa, BORRELIA GARINII PBI
HKKYIFDYLNTNE

SEQ ID NO: 153170 - protein, 13 aa, BORRELIA GARINII PBI
KKYIFDYLNTNED

SEQ ID NO: 153171 - protein, 13 aa, BORRELIA GARINII PBI
KYIFDYLNTNEDF

SEQ ID NO: 153172 - protein, 13 aa, BORRELIA GARINII PBI
YIFDYLNTNEDFV

SEQ ID NO: 153173 - protein, 13 aa, BORRELIA GARINII PBI
IFDYLNTNEDFVV

SEQ ID NO: 153174 - protein, 13 aa, BORRELIA GARINII PBI
FDYLNTNEDFVVW

SEQ ID NO: 153175 - protein, 13 aa, BORRELIA GARINII PBI
DYLNTNEDFVVWD

SEQ ID NO: 153176 - protein, 13 aa, BORRELIA GARINII PBI
YLNTNEDFVVWDM

SEQ ID NO: 153177 - protein, 13 aa, BORRELIA GARINII PBI
LNTNEDFVVWDMI

SEQ ID NO: 153178 - protein, 13 aa, BORRELIA GARINII PBI
NTNEDFVVWDMIR

SEQ ID NO: 153179 - protein, 13 aa, BORRELIA GARINII PBI
TNEDFVVWDMIRS

SEQ ID NO: 153180 - protein, 13 aa, BORRELIA GARINII PBI
NEDFVVWDMIRSA

SEQ ID NO: 153181 - protein, 13 aa, BORRELIA GARINII PBI
EDFVVWDMIRSAM

SEQ ID NO: 153182 - protein, 13 aa, BORRELIA GARINII PBI
DFVVWDMIRSAMS

SEQ ID NO: 153183 - protein, 13 aa, BORRELIA GARINII PBI
FVVWDMIRSAMSS

SEQ ID NO: 153184 - protein, 13 aa, BORRELIA GARINII PBI
VVWDMIRSAMSSV

SEQ ID NO: 153185 - protein, 13 aa, BORRELIA GARINII PBI
VWDMIRSAMSSVS

SEQ ID NO: 153186 - protein, 13 aa, BORRELIA GARINII PBI
WDMIRSAMSSVSD

SEQ ID NO: 153187 - protein, 13 aa, BORRELIA GARINII PBI
DMIRSAMSSVSDS

SEQ ID NO: 153188 - protein, 13 aa, BORRELIA GARINII PBI
MIRSAMSSVSDSV

SEQ ID NO: 153189 - protein, 13 aa, BORRELIA GARINII PBI
IRSAMSSVSDSVI

SEQ ID NO: 153190 - protein, 13 aa, BORRELIA GARINII PBI
RSAMSSVSDSVII

SEQ ID NO: 153191 - protein, 13 aa, BORRELIA GARINII PBI
SAMSSVSDSVIIP

SEQ ID NO: 153192 - protein, 13 aa, BORRELIA GARINII PBI
AMSSVSDSVIIPM

SEQ ID NO: 153193 - protein, 13 aa, BORRELIA GARINII PBI
MSSVSDSVIIPMQ

SEQ ID NO: 153194 - protein, 13 aa, BORRELIA GARINII PBI
SSVSDSVIIPMQD

SEQ ID NO: 153195 - protein, 13 aa, BORRELIA GARINII PBI
SVSDSVIIPMQDY

SEQ ID NO: 153196 - protein, 13 aa, BORRELIA GARINII PBI
VSDSVIIPMQDYI

SEQ ID NO: 153197 - protein, 13 aa, BORRELIA GARINII PBI
SDSVIIPMQDYIN

SEQ ID NO: 153198 - protein, 13 aa, BORRELIA GARINII PBI
DSVIIPMQDYINL

SEQ ID NO: 153199 - protein, 13 aa, BORRELIA GARINII PBI
SVIIPMQDYINLG

SEQ ID NO: 153200 - protein, 13 aa, BORRELIA GARINII PBI
VIIPMQDYINLGN

SEQ ID NO: 153201 - protein, 13 aa, BORRELIA GARINII PBI
IIPMQDYINLGNE

SEQ ID NO: 153202 - protein, 13 aa, BORRELIA GARINII PBI
IPMQDYINLGNEF

SEQ ID NO: 153203 - protein, 13 aa, BORRELIA GARINII PBI
PMQDYINLGNEFR

SEQ ID NO: 153204 - protein, 13 aa, BORRELIA GARINII PBI
MQDYINLGNEFRA

SEQ ID NO: 153205 - protein, 13 aa, BORRELIA GARINII PBI
QDYINLGNEFRAN

SEQ ID NO: 153206 - protein, 13 aa, BORRELIA GARINII PBI
DYINLGNEFRANI

SEQ ID NO: 153207 - protein, 13 aa, BORRELIA GARINII PBI
YINLGNEFRANIP

SEQ ID NO: 153208 - protein, 13 aa, BORRELIA GARINII PBI
INLGNEFRANIPK

SEQ ID NO: 153209 - protein, 13 aa, BORRELIA GARINII PBI
NLGNEFRANIPKN

SEQ ID NO: 153210 - protein, 13 aa, BORRELIA GARINII PBI
LGNEFRANIPKNT

SEQ ID NO: 153211 - protein, 13 aa, BORRELIA GARINII PBI
GNEFRANIPKNTL

SEQ ID NO: 153212 - protein, 13 aa, BORRELIA GARINII PBI
NEFRANIPKNTLN

SEQ ID NO: 153213 - protein, 13 aa, BORRELIA GARINII PBI
EFRANIPKNTLNN

SEQ ID NO: 153214 - protein, 13 aa, BORRELIA GARINII PBI
FRANIPKNTLNNW

SEQ ID NO: 153215 - protein, 13 aa, BORRELIA GARINII PBI
RANIPKNTLNNWI

SEQ ID NO: 153216 - protein, 13 aa, BORRELIA GARINII PBI
ANIPKNTLNNWIF

SEQ ID NO: 153217 - protein, 13 aa, BORRELIA GARINII PBI
NIPKNTLNNWIFR

SEQ ID NO: 153218 - protein, 13 aa, BORRELIA GARINII PBI
IPKNTLNNWIFRL

SEQ ID NO: 153219 - protein, 13 aa, BORRELIA GARINII PBI
PKNTLNNWIFRLL

SEQ ID NO: 153220 - protein, 13 aa, BORRELIA GARINII PBI
KNTLNNWIFRLLE

SEQ ID NO: 153221 - protein, 13 aa, BORRELIA GARINII PBI
NTLNNWIFRLLES

SEQ ID NO: 153222 - protein, 13 aa, BORRELIA GARINII PBI
TLNNWIFRLLESD

SEQ ID NO: 153223 - protein, 13 aa, BORRELIA GARINII PBI
LNNWIFRLLESDL

SEQ ID NO: 153224 - protein, 13 aa, BORRELIA GARINII PBI
NNWIFRLLESDLD

SEQ ID NO: 153225 - protein, 13 aa, BORRELIA GARINII PBI
NWIFRLLESDLDA

SEQ ID NO: 153226 - protein, 13 aa, BORRELIA GARINII PBI
WIFRLLESDLDAT

SEQ ID NO: 153227 - protein, 13 aa, BORRELIA GARINII PBI
IFRLLESDLDATL

SEQ ID NO: 153228 - protein, 13 aa, BORRELIA GARINII PBI
FRLLESDLDATLS

SEQ ID NO: 153229 - protein, 13 aa, BORRELIA GARINII PBI
RLLESDLDATLSK

SEQ ID NO: 153230 - protein, 13 aa, BORRELIA GARINII PBI
LLESDLDATLSKN

SEQ ID NO: 153231 - protein, 13 aa, BORRELIA GARINII PBI
LESDLDATLSKNI

SEQ ID NO: 153232 - protein, 13 aa, BORRELIA GARINII PBI
ESDLDATLSKNIS

SEQ ID NO: 153233 - protein, 13 aa, BORRELIA GARINII PBI
SDLDATLSKNISF

SEQ ID NO: 153234 - protein, 13 aa, BORRELIA GARINII PBI
DLDATLSKNISFI

SEQ ID NO: 153235 - protein, 13 aa, BORRELIA GARINII PBI
LDATLSKNISFIT

SEQ ID NO: 153236 - protein, 13 aa, BORRELIA GARINII PBI
DATLSKNISFITR

SEQ ID NO: 153237 - protein, 13 aa, BORRELIA GARINII PBI
ATLSKNISFITRL

SEQ ID NO: 153238 - protein, 13 aa, BORRELIA GARINII PBI
TLSKNISFITRLY

SEQ ID NO: 153239 - protein, 13 aa, BORRELIA GARINII PBI
LSKNISFITRLYG

SEQ ID NO: 153240 - protein, 13 aa, BORRELIA GARINII PBI
SKNISFITRLYGR

SEQ ID NO: 153241 - protein, 13 aa, BORRELIA GARINII PBI
KNISFITRLYGRT

SEQ ID NO: 153242 - protein, 14 aa, BORRELIA GARINII PBI
MKYKKIRINLNLKR

SEQ ID NO: 153243 - protein, 14 aa, BORRELIA GARINII PBI
KYKKIRINLNLKRK

SEQ ID NO: 153244 - protein, 14 aa, BORRELIA GARINII PBI
YKKIRINLNLKRKS

SEQ ID NO: 153245 - protein, 14 aa, BORRELIA GARINII PBI
KKIRINLNLKRKSG

SEQ ID NO: 153246 - protein, 14 aa, BORRELIA GARINII PBI
KIRINLNLKRKSGI

SEQ ID NO: 153247 - protein, 14 aa, BORRELIA GARINII PBI
IRINLNLKRKSGIL

SEQ ID NO: 153248 - protein, 14 aa, BORRELIA GARINII PBI
RINLNLKRKSGILL

SEQ ID NO: 153249 - protein, 14 aa, BORRELIA GARINII PBI
INLNLKRKSGILLN

SEQ ID NO: 153250 - protein, 14 aa, BORRELIA GARINII PBI
NLNLKRKSGILLNI

SEQ ID NO: 153251 - protein, 14 aa, BORRELIA GARINII PBI
LNLKRKSGILLNIS

SEQ ID NO: 153252 - protein, 14 aa, BORRELIA GARINII PBI
NLKRKSGILLNISS

SEQ ID NO: 153253 - protein, 14 aa, BORRELIA GARINII PBI
LKRKSGILLNISSL

SEQ ID NO: 153254 - protein, 14 aa, BORRELIA GARINII PBI
KRKSGILLNISSLP

SEQ ID NO: 153255 - protein, 14 aa, BORRELIA GARINII PBI
RKSGILLNISSLPS

SEQ ID NO: 153256 - protein, 14 aa, BORRELIA GARINII PBI
KSGILLNISSLPSK

SEQ ID NO: 153257 - protein, 14 aa, BORRELIA GARINII PBI
SGILLNISSLPSKY

SEQ ID NO: 153258 - protein, 14 aa, BORRELIA GARINII PBI
GILLNISSLPSKYG

SEQ ID NO: 153259 - protein, 14 aa, BORRELIA GARINII PBI
ILLNISSLPSKYGI

SEQ ID NO: 153260 - protein, 14 aa, BORRELIA GARINII PBI
LLNISSLPSKYGIG

SEQ ID NO: 153261 - protein, 14 aa, BORRELIA GARINII PBI
LNISSLPSKYGIGD

SEQ ID NO: 153262 - protein, 14 aa, BORRELIA GARINII PBI
NISSLPSKYGIGDL

SEQ ID NO: 153263 - protein, 14 aa, BORRELIA GARINII PBI
ISSLPSKYGIGDLG

SEQ ID NO: 153264 - protein, 14 aa, BORRELIA GARINII PBI
SSLPSKYGIGDLGK

SEQ ID NO: 153265 - protein, 14 aa, BORRELIA GARINII PBI
SLPSKYGIGDLGKG

SEQ ID NO: 153266 - protein, 14 aa, BORRELIA GARINII PBI
LPSKYGIGDLGKGA

SEQ ID NO: 153267 - protein, 14 aa, BORRELIA GARINII PBI
PSKYGIGDLGKGAY

SEQ ID NO: 153268 - protein, 14 aa, BORRELIA GARINII PBI
SKYGIGDLGKGAYK

SEQ ID NO: 153269 - protein, 14 aa, BORRELIA GARINII PBI
KYGIGDLGKGAYKF

SEQ ID NO: 153270 - protein, 14 aa, BORRELIA GARINII PBI
YGIGDLGKGAYKFI

SEQ ID NO: 153271 - protein, 14 aa, BORRELIA GARINII PBI
GIGDLGKGAYKFID

SEQ ID NO: 153272 - protein, 14 aa, BORRELIA GARINII PBI
IGDLGKGAYKFIDF

SEQ ID NO: 153273 - protein, 14 aa, BORRELIA GARINII PBI
GDLGKGAYKFIDFL

SEQ ID NO: 153274 - protein, 14 aa, BORRELIA GARINII PBI
DLGKGAYKFIDFLF

SEQ ID NO: 153275 - protein, 14 aa, BORRELIA GARINII PBI
LGKGAYKFIDFLFA

SEQ ID NO: 153276 - protein, 14 aa, BORRELIA GARINII PBI
GKGAYKFIDFLFAS

SEQ ID NO: 153277 - protein, 14 aa, BORRELIA GARINII PBI
KGAYKFIDFLFASS

SEQ ID NO: 153278 - protein, 14 aa, BORRELIA GARINII PBI
GAYKFIDFLFASSQ

SEQ ID NO: 153279 - protein, 14 aa, BORRELIA GARINII PBI
AYKFIDFLFASSQS

SEQ ID NO: 153280 - protein, 14 aa, BORRELIA GARINII PBI
YKFIDFLFASSQSY

SEQ ID NO: 153281 - protein, 14 aa, BORRELIA GARINII PBI
KFIDFLFASSQSYW

SEQ ID NO: 153282 - protein, 14 aa, BORRELIA GARINII PBI
FIDFLFASSQSYWQ

SEQ ID NO: 153283 - protein, 14 aa, BORRELIA GARINII PBI
IDFLFASSQSYWQM

SEQ ID NO: 153284 - protein, 14 aa, BORRELIA GARINII PBI
DFLFASSQSYWQMF

SEQ ID NO: 153285 - protein, 14 aa, BORRELIA GARINII PBI
FLFASSQSYWQMFA

SEQ ID NO: 153286 - protein, 14 aa, BORRELIA GARINII PBI
LFASSQSYWQMFAY

SEQ ID NO: 153287 - protein, 14 aa, BORRELIA GARINII PBI
FASSQSYWQMFAYS

SEQ ID NO: 153288 - protein, 14 aa, BORRELIA GARINII PBI
ASSQSYWQMFAYSP

SEQ ID NO: 153289 - protein, 14 aa, BORRELIA GARINII PBI
SSQSYWQMFAYSPI

SEQ ID NO: 153290 - protein, 14 aa, BORRELIA GARINII PBI
SQSYWQMFAYSPID

SEQ ID NO: 153291 - protein, 14 aa, BORRELIA GARINII PBI
QSYWQMFAYSPIDF

SEQ ID NO: 153292 - protein, 14 aa, BORRELIA GARINII PBI
SYWQMFAYSPIDFT

SEQ ID NO: 153293 - protein, 14 aa, BORRELIA GARINII PBI
YWQMFAYSPIDFTR

SEQ ID NO: 153294 - protein, 14 aa, BORRELIA GARINII PBI
WQMFAYSPIDFTRS

SEQ ID NO: 153295 - protein, 14 aa, BORRELIA GARINII PBI
QMFAYSPIDFTRSP

SEQ ID NO: 153296 - protein, 14 aa, BORRELIA GARINII PBI
MFAYSPIDFTRSPP

SEQ ID NO: 153297 - protein, 14 aa, BORRELIA GARINII PBI
FAYSPIDFTRSPPY

SEQ ID NO: 153298 - protein, 14 aa, BORRELIA GARINII PBI
AYSPIDFTRSPPYS

SEQ ID NO: 153299 - protein, 14 aa, BORRELIA GARINII PBI
YSPIDFTRSPPYSI

SEQ ID NO: 153300 - protein, 14 aa, BORRELIA GARINII PBI
SPIDFTRSPPYSIF

SEQ ID NO: 153301 - protein, 14 aa, BORRELIA GARINII PBI
PIDFTRSPPYSIFS

SEQ ID NO: 153302 - protein, 14 aa, BORRELIA GARINII PBI
IDFTRSPPYSIFSA

SEQ ID NO: 153303 - protein, 14 aa, BORRELIA GARINII PBI
DFTRSPPYSIFSAF

SEQ ID NO: 153304 - protein, 14 aa, BORRELIA GARINII PBI
FTRSPPYSIFSAFA

SEQ ID NO: 153305 - protein, 14 aa, BORRELIA GARINII PBI
TRSPPYSIFSAFAG

SEQ ID NO: 153306 - protein, 14 aa, BORRELIA GARINII PBI
RSPPYSIFSAFAGN

SEQ ID NO: 153307 - protein, 14 aa, BORRELIA GARINII PBI
SPPYSIFSAFAGNV

SEQ ID NO: 153308 - protein, 14 aa, BORRELIA GARINII PBI
PPYSIFSAFAGNVY

SEQ ID NO: 153309 - protein, 14 aa, BORRELIA GARINII PBI
PYSIFSAFAGNVYY

SEQ ID NO: 153310 - protein, 14 aa, BORRELIA GARINII PBI
YSIFSAFAGNVYYI

SEQ ID NO: 153311 - protein, 14 aa, BORRELIA GARINII PBI
SIFSAFAGNVYYID

SEQ ID NO: 153312 - protein, 14 aa, BORRELIA GARINII PBI
IFSAFAGNVYYIDL

SEQ ID NO: 153313 - protein, 14 aa, BORRELIA GARINII PBI
FSAFAGNVYYIDLE

SEQ ID NO: 153314 - protein, 14 aa, BORRELIA GARINII PBI
SAFAGNVYYIDLEA

SEQ ID NO: 153315 - protein, 14 aa, BORRELIA GARINII PBI
AFAGNVYYIDLEAL

SEQ ID NO: 153316 - protein, 14 aa, BORRELIA GARINII PBI
FAGNVYYIDLEALD

SEQ ID NO: 153317 - protein, 14 aa, BORRELIA GARINII PBI
AGNVYYIDLEALDK

SEQ ID NO: 153318 - protein, 14 aa, BORRELIA GARINII PBI
GNVYYIDLEALDKF

SEQ ID NO: 153319 - protein, 14 aa, BORRELIA GARINII PBI
NVYYIDLEALDKFI

SEQ ID NO: 153320 - protein, 14 aa, BORRELIA GARINII PBI
VYYIDLEALDKFID

SEQ ID NO: 153321 - protein, 14 aa, BORRELIA GARINII PBI
YYIDLEALDKFIDS

SEQ ID NO: 153322 - protein, 14 aa, BORRELIA GARINII PBI
YIDLEALDKFIDSD

SEQ ID NO: 153323 - protein, 14 aa, BORRELIA GARINII PBI
IDLEALDKFIDSDL

SEQ ID NO: 153324 - protein, 14 aa, BORRELIA GARINII PBI
DLEALDKFIDSDLN

SEQ ID NO: 153325 - protein, 14 aa, BORRELIA GARINII PBI
LEALDKFIDSDLNL

SEQ ID NO: 153326 - protein, 14 aa, BORRELIA GARINII PBI
EALDKFIDSDLNLL

SEQ ID NO: 153327 - protein, 14 aa, BORRELIA GARINII PBI
ALDKFIDSDLNLLK

SEQ ID NO: 153328 - protein, 14 aa, BORRELIA GARINII PBI
LDKFIDSDLNLLKE

SEQ ID NO: 153329 - protein, 14 aa, BORRELIA GARINII PBI
DKFIDSDLNLLKEN

SEQ ID NO: 153330 - protein, 14 aa, BORRELIA GARINII PBI
KFIDSDLNLLKENE

SEQ ID NO: 153331 - protein, 14 aa, BORRELIA GARINII PBI
FIDSDLNLLKENET

SEQ ID NO: 153332 - protein, 14 aa, BORRELIA GARINII PBI
IDSDLNLLKENETR

SEQ ID NO: 153333 - protein, 14 aa, BORRELIA GARINII PBI
DSDLNLLKENETRY

SEQ ID NO: 153334 - protein, 14 aa, BORRELIA GARINII PBI
SDLNLLKENETRYS

SEQ ID NO: 153335 - protein, 14 aa, BORRELIA GARINII PBI
DLNLLKENETRYSD

SEQ ID NO: 153336 - protein, 14 aa, BORRELIA GARINII PBI
LNLLKENETRYSDL

SEQ ID NO: 153337 - protein, 14 aa, BORRELIA GARINII PBI
NLLKENETRYSDLK

SEQ ID NO: 153338 - protein, 14 aa, BORRELIA GARINII PBI
LLKENETRYSDLKK

SEQ ID NO: 153339 - protein, 14 aa, BORRELIA GARINII PBI
LKENETRYSDLKKL

SEQ ID NO: 153340 - protein, 14 aa, BORRELIA GARINII PBI
KENETRYSDLKKLS

SEQ ID NO: 153341 - protein, 14 aa, BORRELIA GARINII PBI
ENETRYSDLKKLSF

SEQ ID NO: 153342 - protein, 14 aa, BORRELIA GARINII PBI
NETRYSDLKKLSFK

SEQ ID NO: 153343 - protein, 14 aa, BORRELIA GARINII PBI
ETRYSDLKKLSFKD

SEQ ID NO: 153344 - protein, 14 aa, BORRELIA GARINII PBI
TRYSDLKKLSFKDK

SEQ ID NO: 153345 - protein, 14 aa, BORRELIA GARINII PBI
RYSDLKKLSFKDKF

SEQ ID NO: 153346 - protein, 14 aa, BORRELIA GARINII PBI
YSDLKKLSFKDKFL

SEQ ID NO: 153347 - protein, 14 aa, BORRELIA GARINII PBI
SDLKKLSFKDKFLK

SEQ ID NO: 153348 - protein, 14 aa, BORRELIA GARINII PBI
DLKKLSFKDKFLKE

SEQ ID NO: 153349 - protein, 14 aa, BORRELIA GARINII PBI
LKKLSFKDKFLKEA

SEQ ID NO: 153350 - protein, 14 aa, BORRELIA GARINII PBI
KKLSFKDKFLKEAA

SEQ ID NO: 153351 - protein, 14 aa, BORRELIA GARINII PBI
KLSFKDKFLKEAAL

SEQ ID NO: 153352 - protein, 14 aa, BORRELIA GARINII PBI
LSFKDKFLKEAALN

SEQ ID NO: 153353 - protein, 14 aa, BORRELIA GARINII PBI
SFKDKFLKEAALNF

SEQ ID NO: 153354 - protein, 14 aa, BORRELIA GARINII PBI
FKDKFLKEAALNFI

SEQ ID NO: 153355 - protein, 14 aa, BORRELIA GARINII PBI
KDKFLKEAALNFIN

SEQ ID NO: 153356 - protein, 14 aa, BORRELIA GARINII PBI
DKFLKEAALNFINR

SEQ ID NO: 153357 - protein, 14 aa, BORRELIA GARINII PBI
KFLKEAALNFINRA

SEQ ID NO: 153358 - protein, 14 aa, BORRELIA GARINII PBI
FLKEAALNFINRAS

SEQ ID NO: 153359 - protein, 14 aa, BORRELIA GARINII PBI
LKEAALNFINRASV

SEQ ID NO: 153360 - protein, 14 aa, BORRELIA GARINII PBI
KEAALNFINRASVD

SEQ ID NO: 153361 - protein, 14 aa, BORRELIA GARINII PBI
EAALNFINRASVDE

SEQ ID NO: 153362 - protein, 14 aa, BORRELIA GARINII PBI
AALNFINRASVDEV

SEQ ID NO: 153363 - protein, 14 aa, BORRELIA GARINII PBI
ALNFINRASVDEVR

SEQ ID NO: 153364 - protein, 14 aa, BORRELIA GARINII PBI
LNFINRASVDEVRS

SEQ ID NO: 153365 - protein, 14 aa, BORRELIA GARINII PBI
NFINRASVDEVRSF

SEQ ID NO: 153366 - protein, 14 aa, BORRELIA GARINII PBI
FINRASVDEVRSFE

SEQ ID NO: 153367 - protein, 14 aa, BORRELIA GARINII PBI
INRASVDEVRSFEK

SEQ ID NO: 153368 - protein, 14 aa, BORRELIA GARINII PBI
NRASVDEVRSFEKF

SEQ ID NO: 153369 - protein, 14 aa, BORRELIA GARINII PBI
RASVDEVRSFEKFK

SEQ ID NO: 153370 - protein, 14 aa, BORRELIA GARINII PBI
ASVDEVRSFEKFKK

SEQ ID NO: 153371 - protein, 14 aa, BORRELIA GARINII PBI
SVDEVRSFEKFKKK

SEQ ID NO: 153372 - protein, 14 aa, BORRELIA GARINII PBI
VDEVRSFEKFKKKS

SEQ ID NO: 153373 - protein, 14 aa, BORRELIA GARINII PBI
DEVRSFEKFKKKSS

SEQ ID NO: 153374 - protein, 14 aa, BORRELIA GARINII PBI
EVRSFEKFKKKSSY

SEQ ID NO: 153375 - protein, 14 aa, BORRELIA GARINII PBI
VRSFEKFKKKSSYW

SEQ ID NO: 153376 - protein, 14 aa, BORRELIA GARINII PBI
RSFEKFKKKSSYWL

SEQ ID NO: 153377 - protein, 14 aa, BORRELIA GARINII PBI
SFEKFKKKSSYWLL

SEQ ID NO: 153378 - protein, 14 aa, BORRELIA GARINII PBI
FEKFKKKSSYWLLD

SEQ ID NO: 153379 - protein, 14 aa, BORRELIA GARINII PBI
EKFKKKSSYWLLDF

SEQ ID NO: 153380 - protein, 14 aa, BORRELIA GARINII PBI
KFKKKSSYWLLDFA

SEQ ID NO: 153381 - protein, 14 aa, BORRELIA GARINII PBI
FKKKSSYWLLDFAS

SEQ ID NO: 153382 - protein, 14 aa, BORRELIA GARINII PBI
KKKSSYWLLDFASF

SEQ ID NO: 153383 - protein, 14 aa, BORRELIA GARINII PBI
KKSSYWLLDFASFV

SEQ ID NO: 153384 - protein, 14 aa, BORRELIA GARINII PBI
KSSYWLLDFASFVA

SEQ ID NO: 153385 - protein, 14 aa, BORRELIA GARINII PBI
SSYWLLDFASFVAF

SEQ ID NO: 153386 - protein, 14 aa, BORRELIA GARINII PBI
SYWLLDFASFVAFK

SEQ ID NO: 153387 - protein, 14 aa, BORRELIA GARINII PBI
YWLLDFASFVAFKE

SEQ ID NO: 153388 - protein, 14 aa, BORRELIA GARINII PBI
WLLDFASFVAFKEY

SEQ ID NO: 153389 - protein, 14 aa, BORRELIA GARINII PBI
LLDFASFVAFKEYF

SEQ ID NO: 153390 - protein, 14 aa, BORRELIA GARINII PBI
LDFASFVAFKEYFL

SEQ ID NO: 153391 - protein, 14 aa, BORRELIA GARINII PBI
DFASFVAFKEYFLK

SEQ ID NO: 153392 - protein, 14 aa, BORRELIA GARINII PBI
FASFVAFKEYFLKD

SEQ ID NO: 153393 - protein, 14 aa, BORRELIA GARINII PBI
ASFVAFKEYFLKDS

SEQ ID NO: 153394 - protein, 14 aa, BORRELIA GARINII PBI
SFVAFKEYFLKDSR

SEQ ID NO: 153395 - protein, 14 aa, BORRELIA GARINII PBI
FVAFKEYFLKDSRD

SEQ ID NO: 153396 - protein, 14 aa, BORRELIA GARINII PBI
VAFKEYFLKDSRDA

SEQ ID NO: 153397 - protein, 14 aa, BORRELIA GARINII PBI
AFKEYFLKDSRDAF

SEQ ID NO: 153398 - protein, 14 aa, BORRELIA GARINII PBI
FKEYFLKDSRDAFN

SEQ ID NO: 153399 - protein, 14 aa, BORRELIA GARINII PBI
KEYFLKDSRDAFNV

SEQ ID NO: 153400 - protein, 14 aa, BORRELIA GARINII PBI
EYFLKDSRDAFNVL

SEQ ID NO: 153401 - protein, 14 aa, BORRELIA GARINII PBI
YFLKDSRDAFNVLF

SEQ ID NO: 153402 - protein, 14 aa, BORRELIA GARINII PBI
FLKDSRDAFNVLFD

SEQ ID NO: 153403 - protein, 14 aa, BORRELIA GARINII PBI
LKDSRDAFNVLFDR

SEQ ID NO: 153404 - protein, 14 aa, BORRELIA GARINII PBI
KDSRDAFNVLFDRG

SEQ ID NO: 153405 - protein, 14 aa, BORRELIA GARINII PBI
DSRDAFNVLFDRGI

SEQ ID NO: 153406 - protein, 14 aa, BORRELIA GARINII PBI
SRDAFNVLFDRGIL

SEQ ID NO: 153407 - protein, 14 aa, BORRELIA GARINII PBI
RDAFNVLFDRGILI

SEQ ID NO: 153408 - protein, 14 aa, BORRELIA GARINII PBI
DAFNVLFDRGILIR

SEQ ID NO: 153409 - protein, 14 aa, BORRELIA GARINII PBI
AFNVLFDRGILIRN

SEQ ID NO: 153410 - protein, 14 aa, BORRELIA GARINII PBI
FNVLFDRGILIRNE

SEQ ID NO: 153411 - protein, 14 aa, BORRELIA GARINII PBI
NVLFDRGILIRNEK

SEQ ID NO: 153412 - protein, 14 aa, BORRELIA GARINII PBI
VLFDRGILIRNEKD

SEQ ID NO: 153413 - protein, 14 aa, BORRELIA GARINII PBI
LFDRGILIRNEKDL

SEQ ID NO: 153414 - protein, 14 aa, BORRELIA GARINII PBI
FDRGILIRNEKDLF

SEQ ID NO: 153415 - protein, 14 aa, BORRELIA GARINII PBI
DRGILIRNEKDLFK

SEQ ID NO: 153416 - protein, 14 aa, BORRELIA GARINII PBI
RGILIRNEKDLFKL

SEQ ID NO: 153417 - protein, 14 aa, BORRELIA GARINII PBI
GILIRNEKDLFKLR

SEQ ID NO: 153418 - protein, 14 aa, BORRELIA GARINII PBI
ILIRNEKDLFKLRN

SEQ ID NO: 153419 - protein, 14 aa, BORRELIA GARINII PBI
LIRNEKDLFKLRNI

SEQ ID NO: 153420 - protein, 14 aa, BORRELIA GARINII PBI
IRNEKDLFKLRNIL

SEQ ID NO: 153421 - protein, 14 aa, BORRELIA GARINII PBI
RNEKDLFKLRNILS

SEQ ID NO: 153422 - protein, 14 aa, BORRELIA GARINII PBI
NEKDLFKLRNILSK

SEQ ID NO: 153423 - protein, 14 aa, BORRELIA GARINII PBI
EKDLFKLRNILSKE

SEQ ID NO: 153424 - protein, 14 aa, BORRELIA GARINII PBI
KDLFKLRNILSKEI

SEQ ID NO: 153425 - protein, 14 aa, BORRELIA GARINII PBI
DLFKLRNILSKEIK

SEQ ID NO: 153426 - protein, 14 aa, BORRELIA GARINII PBI
LFKLRNILSKEIKV

SEQ ID NO: 153427 - protein, 14 aa, BORRELIA GARINII PBI
FKLRNILSKEIKVQ

SEQ ID NO: 153428 - protein, 14 aa, BORRELIA GARINII PBI
KLRNILSKEIKVQE

SEQ ID NO: 153429 - protein, 14 aa, BORRELIA GARINII PBI
LRNILSKEIKVQEV

SEQ ID NO: 153430 - protein, 14 aa, BORRELIA GARINII PBI
RNILSKEIKVQEVL

SEQ ID NO: 153431 - protein, 14 aa, BORRELIA GARINII PBI
NILSKEIKVQEVLQ

SEQ ID NO: 153432 - protein, 14 aa, BORRELIA GARINII PBI
ILSKEIKVQEVLQY

SEQ ID NO: 153433 - protein, 14 aa, BORRELIA GARINII PBI
LSKEIKVQEVLQYF

SEQ ID NO: 153434 - protein, 14 aa, BORRELIA GARINII PBI
SKEIKVQEVLQYFF

SEQ ID NO: 153435 - protein, 14 aa, BORRELIA GARINII PBI
KEIKVQEVLQYFFF

SEQ ID NO: 153436 - protein, 14 aa, BORRELIA GARINII PBI
EIKVQEVLQYFFFS

SEQ ID NO: 153437 - protein, 14 aa, BORRELIA GARINII PBI
IKVQEVLQYFFFSQ

SEQ ID NO: 153438 - protein, 14 aa, BORRELIA GARINII PBI
KVQEVLQYFFFSQF

SEQ ID NO: 153439 - protein, 14 aa, BORRELIA GARINII PBI
VQEVLQYFFFSQFQ

SEQ ID NO: 153440 - protein, 14 aa, BORRELIA GARINII PBI
QEVLQYFFFSQFQA

SEQ ID NO: 153441 - protein, 14 aa, BORRELIA GARINII PBI
EVLQYFFFSQFQAL

SEQ ID NO: 153442 - protein, 14 aa, BORRELIA GARINII PBI
VLQYFFFSQFQALK

SEQ ID NO: 153443 - protein, 14 aa, BORRELIA GARINII PBI
LQYFFFSQFQALKR

SEQ ID NO: 153444 - protein, 14 aa, BORRELIA GARINII PBI
QYFFFSQFQALKRY

SEQ ID NO: 153445 - protein, 14 aa, BORRELIA GARINII PBI
YFFFSQFQALKRYA

SEQ ID NO: 153446 - protein, 14 aa, BORRELIA GARINII PBI
FFFSQFQALKRYAN

SEQ ID NO: 153447 - protein, 14 aa, BORRELIA GARINII PBI
FFSQFQALKRYAND

SEQ ID NO: 153448 - protein, 14 aa, BORRELIA GARINII PBI
FSQFQALKRYANDK

SEQ ID NO: 153449 - protein, 14 aa, BORRELIA GARINII PBI
SQFQALKRYANDKG

SEQ ID NO: 153450 - protein, 14 aa, BORRELIA GARINII PBI
QFQALKRYANDKGI

SEQ ID NO: 153451 - protein, 14 aa, BORRELIA GARINII PBI
FQALKRYANDKGIE

SEQ ID NO: 153452 - protein, 14 aa, BORRELIA GARINII PBI
QALKRYANDKGIEL

SEQ ID NO: 153453 - protein, 14 aa, BORRELIA GARINII PBI
ALKRYANDKGIELV

SEQ ID NO: 153454 - protein, 14 aa, BORRELIA GARINII PBI
LKRYANDKGIELVM

SEQ ID NO: 153455 - protein, 14 aa, BORRELIA GARINII PBI
KRYANDKGIELVMN

SEQ ID NO: 153456 - protein, 14 aa, BORRELIA GARINII PBI
RYANDKGIELVMNL

SEQ ID NO: 153457 - protein, 14 aa, BORRELIA GARINII PBI
YANDKGIELVMNLP

SEQ ID NO: 153458 - protein, 14 aa, BORRELIA GARINII PBI
ANDKGIELVMNLPL

SEQ ID NO: 153459 - protein, 14 aa, BORRELIA GARINII PBI
NDKGIELVMNLPLF

SEQ ID NO: 153460 - protein, 14 aa, BORRELIA GARINII PBI
DKGIELVMNLPLFI

SEQ ID NO: 153461 - protein, 14 aa, BORRELIA GARINII PBI
KGIELVMNLPLFIA

SEQ ID NO: 153462 - protein, 14 aa, BORRELIA GARINII PBI
GIELVMNLPLFIAY

SEQ ID NO: 153463 - protein, 14 aa, BORRELIA GARINII PBI
IELVMNLPLFIAYD

SEQ ID NO: 153464 - protein, 14 aa, BORRELIA GARINII PBI
ELVMNLPLFIAYDS

SEQ ID NO: 153465 - protein, 14 aa, BORRELIA GARINII PBI
LVMNLPLFIAYDSA

SEQ ID NO: 153466 - protein, 14 aa, BORRELIA GARINII PBI
VMNLPLFIAYDSAD

SEQ ID NO: 153467 - protein, 14 aa, BORRELIA GARINII PBI
MNLPLFIAYDSADV

SEQ ID NO: 153468 - protein, 14 aa, BORRELIA GARINII PBI
NLPLFIAYDSADVW

SEQ ID NO: 153469 - protein, 14 aa, BORRELIA GARINII PBI
LPLFIAYDSADVWA

SEQ ID NO: 153470 - protein, 14 aa, BORRELIA GARINII PBI
PLFIAYDSADVWAH

SEQ ID NO: 153471 - protein, 14 aa, BORRELIA GARINII PBI
LFIAYDSADVWAHQ

SEQ ID NO: 153472 - protein, 14 aa, BORRELIA GARINII PBI
FIAYDSADVWAHQK

SEQ ID NO: 153473 - protein, 14 aa, BORRELIA GARINII PBI
IAYDSADVWAHQKY

SEQ ID NO: 153474 - protein, 14 aa, BORRELIA GARINII PBI
AYDSADVWAHQKYF

SEQ ID NO: 153475 - protein, 14 aa, BORRELIA GARINII PBI
YDSADVWAHQKYFK

SEQ ID NO: 153476 - protein, 14 aa, BORRELIA GARINII PBI
DSADVWAHQKYFKL

SEQ ID NO: 153477 - protein, 14 aa, BORRELIA GARINII PBI
SADVWAHQKYFKLR

SEQ ID NO: 153478 - protein, 14 aa, BORRELIA GARINII PBI
ADVWAHQKYFKLRF

SEQ ID NO: 153479 - protein, 14 aa, BORRELIA GARINII PBI
DVWAHQKYFKLRFD

SEQ ID NO: 153480 - protein, 14 aa, BORRELIA GARINII PBI
VWAHQKYFKLRFDA

SEQ ID NO: 153481 - protein, 14 aa, BORRELIA GARINII PBI
WAHQKYFKLRFDAS

SEQ ID NO: 153482 - protein, 14 aa, BORRELIA GARINII PBI
AHQKYFKLRFDASK

SEQ ID NO: 153483 - protein, 14 aa, BORRELIA GARINII PBI
HQKYFKLRFDASKD

SEQ ID NO: 153484 - protein, 14 aa, BORRELIA GARINII PBI
QKYFKLRFDASKDK

SEQ ID NO: 153485 - protein, 14 aa, BORRELIA GARINII PBI
KYFKLRFDASKDKV

SEQ ID NO: 153486 - protein, 14 aa, BORRELIA GARINII PBI
YFKLRFDASKDKVA

SEQ ID NO: 153487 - protein, 14 aa, BORRELIA GARINII PBI
FKLRFDASKDKVAG

SEQ ID NO: 153488 - protein, 14 aa, BORRELIA GARINII PBI
KLRFDASKDKVAGI

SEQ ID NO: 153489 - protein, 14 aa, BORRELIA GARINII PBI
LRFDASKDKVAGIS

SEQ ID NO: 153490 - protein, 14 aa, BORRELIA GARINII PBI
RFDASKDKVAGISP

SEQ ID NO: 153491 - protein, 14 aa, BORRELIA GARINII PBI
FDASKDKVAGISPD

SEQ ID NO: 153492 - protein, 14 aa, BORRELIA GARINII PBI
DASKDKVAGISPDY

SEQ ID NO: 153493 - protein, 14 aa, BORRELIA GARINII PBI
ASKDKVAGISPDYF

SEQ ID NO: 153494 - protein, 14 aa, BORRELIA GARINII PBI
SKDKVAGISPDYFL

SEQ ID NO: 153495 - protein, 14 aa, BORRELIA GARINII PBI
KDKVAGISPDYFLE

SEQ ID NO: 153496 - protein, 14 aa, BORRELIA GARINII PBI
DKVAGISPDYFLEQ

SEQ ID NO: 153497 - protein, 14 aa, BORRELIA GARINII PBI
KVAGISPDYFLEQE

SEQ ID NO: 153498 - protein, 14 aa, BORRELIA GARINII PBI
VAGISPDYFLEQEQ

SEQ ID NO: 153499 - protein, 14 aa, BORRELIA GARINII PBI
AGISPDYFLEQEQA

SEQ ID NO: 153500 - protein, 14 aa, BORRELIA GARINII PBI
GISPDYFLEQEQAW

SEQ ID NO: 153501 - protein, 14 aa, BORRELIA GARINII PBI
ISPDYFLEQEQAWD

SEQ ID NO: 153502 - protein, 14 aa, BORRELIA GARINII PBI
SPDYFLEQEQAWDS

SEQ ID NO: 153503 - protein, 14 aa, BORRELIA GARINII PBI
PDYFLEQEQAWDSP

SEQ ID NO: 153504 - protein, 14 aa, BORRELIA GARINII PBI
DYFLEQEQAWDSPA

SEQ ID NO: 153505 - protein, 14 aa, BORRELIA GARINII PBI
YFLEQEQAWDSPAY

SEQ ID NO: 153506 - protein, 14 aa, BORRELIA GARINII PBI
FLEQEQAWDSPAYS

SEQ ID NO: 153507 - protein, 14 aa, BORRELIA GARINII PBI
LEQEQAWDSPAYSW

SEQ ID NO: 153508 - protein, 14 aa, BORRELIA GARINII PBI
EQEQAWDSPAYSWN

SEQ ID NO: 153509 - protein, 14 aa, BORRELIA GARINII PBI
QEQAWDSPAYSWNV

SEQ ID NO: 153510 - protein, 14 aa, BORRELIA GARINII PBI
EQAWDSPAYSWNVL

SEQ ID NO: 153511 - protein, 14 aa, BORRELIA GARINII PBI
QAWDSPAYSWNVLK

SEQ ID NO: 153512 - protein, 14 aa, BORRELIA GARINII PBI
AWDSPAYSWNVLKN

SEQ ID NO: 153513 - protein, 14 aa, BORRELIA GARINII PBI
WDSPAYSWNVLKNV

SEQ ID NO: 153514 - protein, 14 aa, BORRELIA GARINII PBI
DSPAYSWNVLKNVK

SEQ ID NO: 153515 - protein, 14 aa, BORRELIA GARINII PBI
SPAYSWNVLKNVKY

SEQ ID NO: 153516 - protein, 14 aa, BORRELIA GARINII PBI
PAYSWNVLKNVKYE

SEQ ID NO: 153517 - protein, 14 aa, BORRELIA GARINII PBI
AYSWNVLKNVKYEW

SEQ ID NO: 153518 - protein, 14 aa, BORRELIA GARINII PBI
YSWNVLKNVKYEWW

SEQ ID NO: 153519 - protein, 14 aa, BORRELIA GARINII PBI
SWNVLKNVKYEWWA

SEQ ID NO: 153520 - protein, 14 aa, BORRELIA GARINII PBI
WNVLKNVKYEWWAK

SEQ ID NO: 153521 - protein, 14 aa, BORRELIA GARINII PBI
NVLKNVKYEWWAKR

SEQ ID NO: 153522 - protein, 14 aa, BORRELIA GARINII PBI
VLKNVKYEWWAKRI

SEQ ID NO: 153523 - protein, 14 aa, BORRELIA GARINII PBI
LKNVKYEWWAKRIG

SEQ ID NO: 153524 - protein, 14 aa, BORRELIA GARINII PBI
KNVKYEWWAKRIGI

SEQ ID NO: 153525 - protein, 14 aa, BORRELIA GARINII PBI
NVKYEWWAKRIGIL

SEQ ID NO: 153526 - protein, 14 aa, BORRELIA GARINII PBI
VKYEWWAKRIGILR

SEQ ID NO: 153527 - protein, 14 aa, BORRELIA GARINII PBI
KYEWWAKRIGILRK

SEQ ID NO: 153528 - protein, 14 aa, BORRELIA GARINII PBI
YEWWAKRIGILRKY

SEQ ID NO: 153529 - protein, 14 aa, BORRELIA GARINII PBI
EWWAKRIGILRKYI

SEQ ID NO: 153530 - protein, 14 aa, BORRELIA GARINII PBI
WWAKRIGILRKYID

SEQ ID NO: 153531 - protein, 14 aa, BORRELIA GARINII PBI
WAKRIGILRKYIDV

SEQ ID NO: 153532 - protein, 14 aa, BORRELIA GARINII PBI
AKRIGILRKYIDVI

SEQ ID NO: 153533 - protein, 14 aa, BORRELIA GARINII PBI
KRIGILRKYIDVIK

SEQ ID NO: 153534 - protein, 14 aa, BORRELIA GARINII PBI
RIGILRKYIDVIKI

SEQ ID NO: 153535 - protein, 14 aa, BORRELIA GARINII PBI
IGILRKYIDVIKID

SEQ ID NO: 153536 - protein, 14 aa, BORRELIA GARINII PBI
GILRKYIDVIKIDH

SEQ ID NO: 153537 - protein, 14 aa, BORRELIA GARINII PBI
ILRKYIDVIKIDHF

SEQ ID NO: 153538 - protein, 14 aa, BORRELIA GARINII PBI
LRKYIDVIKIDHFR

SEQ ID NO: 153539 - protein, 14 aa, BORRELIA GARINII PBI
RKYIDVIKIDHFRG

SEQ ID NO: 153540 - protein, 14 aa, BORRELIA GARINII PBI
KYIDVIKIDHFRGF

SEQ ID NO: 153541 - protein, 14 aa, BORRELIA GARINII PBI
YIDVIKIDHFRGFV

SEQ ID NO: 153542 - protein, 14 aa, BORRELIA GARINII PBI
IDVIKIDHFRGFVS

SEQ ID NO: 153543 - protein, 14 aa, BORRELIA GARINII PBI
DVIKIDHFRGFVST

SEQ ID NO: 153544 - protein, 14 aa, BORRELIA GARINII PBI
VIKIDHFRGFVSTW

SEQ ID NO: 153545 - protein, 14 aa, BORRELIA GARINII PBI
IKIDHFRGFVSTWE

SEQ ID NO: 153546 - protein, 14 aa, BORRELIA GARINII PBI
KIDHFRGFVSTWEV

SEQ ID NO: 153547 - protein, 14 aa, BORRELIA GARINII PBI
IDHFRGFVSTWEVG

SEQ ID NO: 153548 - protein, 14 aa, BORRELIA GARINII PBI
DHFRGFVSTWEVGV

SEQ ID NO: 153549 - protein, 14 aa, BORRELIA GARINII PBI
HFRGFVSTWEVGVG

SEQ ID NO: 153550 - protein, 14 aa, BORRELIA GARINII PBI
FRGFVSTWEVGVGE

SEQ ID NO: 153551 - protein, 14 aa, BORRELIA GARINII PBI
RGFVSTWEVGVGEA

SEQ ID NO: 153552 - protein, 14 aa, BORRELIA GARINII PBI
GFVSTWEVGVGEAY

SEQ ID NO: 153553 - protein, 14 aa, BORRELIA GARINII PBI
FVSTWEVGVGEAYA

SEQ ID NO: 153554 - protein, 14 aa, BORRELIA GARINII PBI
VSTWEVGVGEAYAF

SEQ ID NO: 153555 - protein, 14 aa, BORRELIA GARINII PBI
STWEVGVGEAYAFN

SEQ ID NO: 153556 - protein, 14 aa, BORRELIA GARINII PBI
TWEVGVGEAYAFNG

SEQ ID NO: 153557 - protein, 14 aa, BORRELIA GARINII PBI
WEVGVGEAYAFNGL

SEQ ID NO: 153558 - protein, 14 aa, BORRELIA GARINII PBI
EVGVGEAYAFNGLW

SEQ ID NO: 153559 - protein, 14 aa, BORRELIA GARINII PBI
VGVGEAYAFNGLWV

SEQ ID NO: 153560 - protein, 14 aa, BORRELIA GARINII PBI
GVGEAYAFNGLWVK

SEQ ID NO: 153561 - protein, 14 aa, BORRELIA GARINII PBI
VGEAYAFNGLWVKS

SEQ ID NO: 153562 - protein, 14 aa, BORRELIA GARINII PBI
GEAYAFNGLWVKSP

SEQ ID NO: 153563 - protein, 14 aa, BORRELIA GARINII PBI
EAYAFNGLWVKSPG

SEQ ID NO: 153564 - protein, 14 aa, BORRELIA GARINII PBI
AYAFNGLWVKSPGR

SEQ ID NO: 153565 - protein, 14 aa, BORRELIA GARINII PBI
YAFNGLWVKSPGRD

SEQ ID NO: 153566 - protein, 14 aa, BORRELIA GARINII PBI
AFNGLWVKSPGRDF

SEQ ID NO: 153567 - protein, 14 aa, BORRELIA GARINII PBI
FNGLWVKSPGRDFF

SEQ ID NO: 153568 - protein, 14 aa, BORRELIA GARINII PBI
NGLWVKSPGRDFFN

SEQ ID NO: 153569 - protein, 14 aa, BORRELIA GARINII PBI
GLWVKSPGRDFFNF

SEQ ID NO: 153570 - protein, 14 aa, BORRELIA GARINII PBI
LWVKSPGRDFFNFI

SEQ ID NO: 153571 - protein, 14 aa, BORRELIA GARINII PBI
WVKSPGRDFFNFIL

SEQ ID NO: 153572 - protein, 14 aa, BORRELIA GARINII PBI
VKSPGRDFFNFILN

SEQ ID NO: 153573 - protein, 14 aa, BORRELIA GARINII PBI
KSPGRDFFNFILNE

SEQ ID NO: 153574 - protein, 14 aa, BORRELIA GARINII PBI
SPGRDFFNFILNEI

SEQ ID NO: 153575 - protein, 14 aa, BORRELIA GARINII PBI
PGRDFFNFILNEIK

SEQ ID NO: 153576 - protein, 14 aa, BORRELIA GARINII PBI
GRDFFNFILNEIKD

SEQ ID NO: 153577 - protein, 14 aa, BORRELIA GARINII PBI
RDFFNFILNEIKDL

SEQ ID NO: 153578 - protein, 14 aa, BORRELIA GARINII PBI
DFFNFILNEIKDLK

SEQ ID NO: 153579 - protein, 14 aa, BORRELIA GARINII PBI
FFNFILNEIKDLKI

SEQ ID NO: 153580 - protein, 14 aa, BORRELIA GARINII PBI
FNFILNEIKDLKIW

SEQ ID NO: 153581 - protein, 14 aa, BORRELIA GARINII PBI
NFILNEIKDLKIWV

SEQ ID NO: 153582 - protein, 14 aa, BORRELIA GARINII PBI
FILNEIKDLKIWVE

SEQ ID NO: 153583 - protein, 14 aa, BORRELIA GARINII PBI
ILNEIKDLKIWVED

SEQ ID NO: 153584 - protein, 14 aa, BORRELIA GARINII PBI
LNEIKDLKIWVEDF

SEQ ID NO: 153585 - protein, 14 aa, BORRELIA GARINII PBI
NEIKDLKIWVEDFE

SEQ ID NO: 153586 - protein, 14 aa, BORRELIA GARINII PBI
EIKDLKIWVEDFEN

SEQ ID NO: 153587 - protein, 14 aa, BORRELIA GARINII PBI
IKDLKIWVEDFEND

SEQ ID NO: 153588 - protein, 14 aa, BORRELIA GARINII PBI
KDLKIWVEDFENDL

SEQ ID NO: 153589 - protein, 14 aa, BORRELIA GARINII PBI
DLKIWVEDFENDLE

SEQ ID NO: 153590 - protein, 14 aa, BORRELIA GARINII PBI
LKIWVEDFENDLED

SEQ ID NO: 153591 - protein, 14 aa, BORRELIA GARINII PBI
KIWVEDFENDLEDV

SEQ ID NO: 153592 - protein, 14 aa, BORRELIA GARINII PBI
IWVEDFENDLEDVS

SEQ ID NO: 153593 - protein, 14 aa, BORRELIA GARINII PBI
WVEDFENDLEDVSR

SEQ ID NO: 153594 - protein, 14 aa, BORRELIA GARINII PBI
VEDFENDLEDVSRL

SEQ ID NO: 153595 - protein, 14 aa, BORRELIA GARINII PBI
EDFENDLEDVSRLR

SEQ ID NO: 153596 - protein, 14 aa, BORRELIA GARINII PBI
DFENDLEDVSRLRD

SEQ ID NO: 153597 - protein, 14 aa, BORRELIA GARINII PBI
FENDLEDVSRLRDF

SEQ ID NO: 153598 - protein, 14 aa, BORRELIA GARINII PBI
ENDLEDVSRLRDFF

SEQ ID NO: 153599 - protein, 14 aa, BORRELIA GARINII PBI
NDLEDVSRLRDFFN

SEQ ID NO: 153600 - protein, 14 aa, BORRELIA GARINII PBI
DLEDVSRLRDFFNF

SEQ ID NO: 153601 - protein, 14 aa, BORRELIA GARINII PBI
LEDVSRLRDFFNFP

SEQ ID NO: 153602 - protein, 14 aa, BORRELIA GARINII PBI
EDVSRLRDFFNFPG

SEQ ID NO: 153603 - protein, 14 aa, BORRELIA GARINII PBI
DVSRLRDFFNFPGM

SEQ ID NO: 153604 - protein, 14 aa, BORRELIA GARINII PBI
VSRLRDFFNFPGMR

SEQ ID NO: 153605 - protein, 14 aa, BORRELIA GARINII PBI
SRLRDFFNFPGMRI

SEQ ID NO: 153606 - protein, 14 aa, BORRELIA GARINII PBI
RLRDFFNFPGMRIM

SEQ ID NO: 153607 - protein, 14 aa, BORRELIA GARINII PBI
LRDFFNFPGMRIMK

SEQ ID NO: 153608 - protein, 14 aa, BORRELIA GARINII PBI
RDFFNFPGMRIMKL

SEQ ID NO: 153609 - protein, 14 aa, BORRELIA GARINII PBI
DFFNFPGMRIMKLA

SEQ ID NO: 153610 - protein, 14 aa, BORRELIA GARINII PBI
FFNFPGMRIMKLAF

SEQ ID NO: 153611 - protein, 14 aa, BORRELIA GARINII PBI
FNFPGMRIMKLAFD

SEQ ID NO: 153612 - protein, 14 aa, BORRELIA GARINII PBI
NFPGMRIMKLAFDF

SEQ ID NO: 153613 - protein, 14 aa, BORRELIA GARINII PBI
FPGMRIMKLAFDFD

SEQ ID NO: 153614 - protein, 14 aa, BORRELIA GARINII PBI
PGMRIMKLAFDFDS

SEQ ID NO: 153615 - protein, 14 aa, BORRELIA GARINII PBI
GMRIMKLAFDFDSD

SEQ ID NO: 153616 - protein, 14 aa, BORRELIA GARINII PBI
MRIMKLAFDFDSDN

SEQ ID NO: 153617 - protein, 14 aa, BORRELIA GARINII PBI
RIMKLAFDFDSDNQ

SEQ ID NO: 153618 - protein, 14 aa, BORRELIA GARINII PBI
IMKLAFDFDSDNQN

SEQ ID NO: 153619 - protein, 14 aa, BORRELIA GARINII PBI
MKLAFDFDSDNQNL

SEQ ID NO: 153620 - protein, 14 aa, BORRELIA GARINII PBI
KLAFDFDSDNQNLP

SEQ ID NO: 153621 - protein, 14 aa, BORRELIA GARINII PBI
LAFDFDSDNQNLPH

SEQ ID NO: 153622 - protein, 14 aa, BORRELIA GARINII PBI
AFDFDSDNQNLPHN

SEQ ID NO: 153623 - protein, 14 aa, BORRELIA GARINII PBI
FDFDSDNQNLPHNY

SEQ ID NO: 153624 - protein, 14 aa, BORRELIA GARINII PBI
DFDSDNQNLPHNYI

SEQ ID NO: 153625 - protein, 14 aa, BORRELIA GARINII PBI
FDSDNQNLPHNYIK

SEQ ID NO: 153626 - protein, 14 aa, BORRELIA GARINII PBI
DSDNQNLPHNYIKN

SEQ ID NO: 153627 - protein, 14 aa, BORRELIA GARINII PBI
SDNQNLPHNYIKNC

SEQ ID NO: 153628 - protein, 14 aa, BORRELIA GARINII PBI
DNQNLPHNYIKNCI

SEQ ID NO: 153629 - protein, 14 aa, BORRELIA GARINII PBI
NQNLPHNYIKNCIV

SEQ ID NO: 153630 - protein, 14 aa, BORRELIA GARINII PBI
QNLPHNYIKNCIVY

SEQ ID NO: 153631 - protein, 14 aa, BORRELIA GARINII PBI
NLPHNYIKNCIVYT

SEQ ID NO: 153632 - protein, 14 aa, BORRELIA GARINII PBI
LPHNYIKNCIVYTG

SEQ ID NO: 153633 - protein, 14 aa, BORRELIA GARINII PBI
PHNYIKNCIVYTGI

SEQ ID NO: 153634 - protein, 14 aa, BORRELIA GARINII PBI
HNYIKNCIVYTGIG

SEQ ID NO: 153635 - protein, 14 aa, BORRELIA GARINII PBI
NYIKNCIVYTGIGD

SEQ ID NO: 153636 - protein, 14 aa, BORRELIA GARINII PBI
YIKNCIVYTGIGDN

SEQ ID NO: 153637 - protein, 14 aa, BORRELIA GARINII PBI
IKNCIVYTGIGDNS

SEQ ID NO: 153638 - protein, 14 aa, BORRELIA GARINII PBI
KNCIVYTGIGDNST

SEQ ID NO: 153639 - protein, 14 aa, BORRELIA GARINII PBI
NCIVYTGIGDNSTI

SEQ ID NO: 153640 - protein, 14 aa, BORRELIA GARINII PBI
CIVYTGIGDNSTIR

SEQ ID NO: 153641 - protein, 14 aa, BORRELIA GARINII PBI
IVYTGIGDNSTIRE

SEQ ID NO: 153642 - protein, 14 aa, BORRELIA GARINII PBI
VYTGIGDNSTIREF

SEQ ID NO: 153643 - protein, 14 aa, BORRELIA GARINII PBI
YTGIGDNSTIREFV

SEQ ID NO: 153644 - protein, 14 aa, BORRELIA GARINII PBI
TGIGDNSTIREFVN

SEQ ID NO: 153645 - protein, 14 aa, BORRELIA GARINII PBI
GIGDNSTIREFVNS

SEQ ID NO: 153646 - protein, 14 aa, BORRELIA GARINII PBI
IGDNSTIREFVNSL

SEQ ID NO: 153647 - protein, 14 aa, BORRELIA GARINII PBI
GDNSTIREFVNSLD

SEQ ID NO: 153648 - protein, 14 aa, BORRELIA GARINII PBI
DNSTIREFVNSLDD

SEQ ID NO: 153649 - protein, 14 aa, BORRELIA GARINII PBI
NSTIREFVNSLDDL

SEQ ID NO: 153650 - protein, 14 aa, BORRELIA GARINII PBI
STIREFVNSLDDLH

SEQ ID NO: 153651 - protein, 14 aa, BORRELIA GARINII PBI
TIREFVNSLDDLHK

SEQ ID NO: 153652 - protein, 14 aa, BORRELIA GARINII PBI
IREFVNSLDDLHKK

SEQ ID NO: 153653 - protein, 14 aa, BORRELIA GARINII PBI
REFVNSLDDLHKKY

SEQ ID NO: 153654 - protein, 14 aa, BORRELIA GARINII PBI
EFVNSLDDLHKKYI

SEQ ID NO: 153655 - protein, 14 aa, BORRELIA GARINII PBI
FVNSLDDLHKKYIF

SEQ ID NO: 153656 - protein, 14 aa, BORRELIA GARINII PBI
VNSLDDLHKKYIFD

SEQ ID NO: 153657 - protein, 14 aa, BORRELIA GARINII PBI
NSLDDLHKKYIFDY

SEQ ID NO: 153658 - protein, 14 aa, BORRELIA GARINII PBI
SLDDLHKKYIFDYL

SEQ ID NO: 153659 - protein, 14 aa, BORRELIA GARINII PBI
LDDLHKKYIFDYLN

SEQ ID NO: 153660 - protein, 14 aa, BORRELIA GARINII PBI
DDLHKKYIFDYLNT

SEQ ID NO: 153661 - protein, 14 aa, BORRELIA GARINII PBI
DLHKKYIFDYLNTN

SEQ ID NO: 153662 - protein, 14 aa, BORRELIA GARINII PBI
LHKKYIFDYLNTNE

SEQ ID NO: 153663 - protein, 14 aa, BORRELIA GARINII PBI
HKKYIFDYLNTNED

SEQ ID NO: 153664 - protein, 14 aa, BORRELIA GARINII PBI
KKYIFDYLNTNEDF

SEQ ID NO: 153665 - protein, 14 aa, BORRELIA GARINII PBI
KYIFDYLNTNEDFV

SEQ ID NO: 153666 - protein, 14 aa, BORRELIA GARINII PBI
YIFDYLNTNEDFVV

SEQ ID NO: 153667 - protein, 14 aa, BORRELIA GARINII PBI
IFDYLNTNEDFVVW

SEQ ID NO: 153668 - protein, 14 aa, BORRELIA GARINII PBI
FDYLNTNEDFVVWD

SEQ ID NO: 153669 - protein, 14 aa, BORRELIA GARINII PBI
DYLNTNEDFVVWDM

SEQ ID NO: 153670 - protein, 14 aa, BORRELIA GARINII PBI
YLNTNEDFVVWDMI

SEQ ID NO: 153671 - protein, 14 aa, BORRELIA GARINII PBI
LNTNEDFVVWDMIR

SEQ ID NO: 153672 - protein, 14 aa, BORRELIA GARINII PBI
NTNEDFVVWDMIRS

SEQ ID NO: 153673 - protein, 14 aa, BORRELIA GARINII PBI
TNEDFVVWDMIRSA

SEQ ID NO: 153674 - protein, 14 aa, BORRELIA GARINII PBI
NEDFVVWDMIRSAM

SEQ ID NO: 153675 - protein, 14 aa, BORRELIA GARINII PBI
EDFVVWDMIRSAMS

SEQ ID NO: 153676 - protein, 14 aa, BORRELIA GARINII PBI
DFVVWDMIRSAMSS

SEQ ID NO: 153677 - protein, 14 aa, BORRELIA GARINII PBI
FVVWDMIRSAMSSV

SEQ ID NO: 153678 - protein, 14 aa, BORRELIA GARINII PBI
VVWDMIRSAMSSVS

SEQ ID NO: 153679 - protein, 14 aa, BORRELIA GARINII PBI
VWDMIRSAMSSVSD

SEQ ID NO: 153680 - protein, 14 aa, BORRELIA GARINII PBI
WDMIRSAMSSVSDS

SEQ ID NO: 153681 - protein, 14 aa, BORRELIA GARINII PBI
DMIRSAMSSVSDSV

SEQ ID NO: 153682 - protein, 14 aa, BORRELIA GARINII PBI
MIRSAMSSVSDSVI

SEQ ID NO: 153683 - protein, 14 aa, BORRELIA GARINII PBI
IRSAMSSVSDSVII

SEQ ID NO: 153684 - protein, 14 aa, BORRELIA GARINII PBI
RSAMSSVSDSVIIP

SEQ ID NO: 153685 - protein, 14 aa, BORRELIA GARINII PBI
SAMSSVSDSVIIPM

SEQ ID NO: 153686 - protein, 14 aa, BORRELIA GARINII PBI
AMSSVSDSVIIPMQ

SEQ ID NO: 153687 - protein, 14 aa, BORRELIA GARINII PBI
MSSVSDSVIIPMQD

SEQ ID NO: 153688 - protein, 14 aa, BORRELIA GARINII PBI
SSVSDSVIIPMQDY

SEQ ID NO: 153689 - protein, 14 aa, BORRELIA GARINII PBI
SVSDSVIIPMQDYI

SEQ ID NO: 153690 - protein, 14 aa, BORRELIA GARINII PBI
VSDSVIIPMQDYIN

SEQ ID NO: 153691 - protein, 14 aa, BORRELIA GARINII PBI
SDSVIIPMQDYINL

SEQ ID NO: 153692 - protein, 14 aa, BORRELIA GARINII PBI
DSVIIPMQDYINLG

SEQ ID NO: 153693 - protein, 14 aa, BORRELIA GARINII PBI
SVIIPMQDYINLGN

SEQ ID NO: 153694 - protein, 14 aa, BORRELIA GARINII PBI
VIIPMQDYINLGNE

SEQ ID NO: 153695 - protein, 14 aa, BORRELIA GARINII PBI
IIPMQDYINLGNEF

SEQ ID NO: 153696 - protein, 14 aa, BORRELIA GARINII PBI
IPMQDYINLGNEFR

SEQ ID NO: 153697 - protein, 14 aa, BORRELIA GARINII PBI
PMQDYINLGNEFRA

SEQ ID NO: 153698 - protein, 14 aa, BORRELIA GARINII PBI
MQDYINLGNEFRAN

SEQ ID NO: 153699 - protein, 14 aa, BORRELIA GARINII PBI
QDYINLGNEFRANI

SEQ ID NO: 153700 - protein, 14 aa, BORRELIA GARINII PBI
DYINLGNEFRANIP

SEQ ID NO: 153701 - protein, 14 aa, BORRELIA GARINII PBI
YINLGNEFRANIPK

SEQ ID NO: 153702 - protein, 14 aa, BORRELIA GARINII PBI
INLGNEFRANIPKN

SEQ ID NO: 153703 - protein, 14 aa, BORRELIA GARINII PBI
NLGNEFRANIPKNT

SEQ ID NO: 153704 - protein, 14 aa, BORRELIA GARINII PBI
LGNEFRANIPKNTL

SEQ ID NO: 153705 - protein, 14 aa, BORRELIA GARINII PBI
GNEFRANIPKNTLN

SEQ ID NO: 153706 - protein, 14 aa, BORRELIA GARINII PBI
NEFRANIPKNTLNN

SEQ ID NO: 153707 - protein, 14 aa, BORRELIA GARINII PBI
EFRANIPKNTLNNW

SEQ ID NO: 153708 - protein, 14 aa, BORRELIA GARINII PBI
FRANIPKNTLNNWI

SEQ ID NO: 153709 - protein, 14 aa, BORRELIA GARINII PBI
RANIPKNTLNNWIF

SEQ ID NO: 153710 - protein, 14 aa, BORRELIA GARINII PBI
ANIPKNTLNNWIFR

SEQ ID NO: 153711 - protein, 14 aa, BORRELIA GARINII PBI
NIPKNTLNNWIFRL

SEQ ID NO: 153712 - protein, 14 aa, BORRELIA GARINII PBI
IPKNTLNNWIFRLL

SEQ ID NO: 153713 - protein, 14 aa, BORRELIA GARINII PBI
PKNTLNNWIFRLLE

SEQ ID NO: 153714 - protein, 14 aa, BORRELIA GARINII PBI
KNTLNNWIFRLLES

SEQ ID NO: 153715 - protein, 14 aa, BORRELIA GARINII PBI
NTLNNWIFRLLESD

SEQ ID NO: 153716 - protein, 14 aa, BORRELIA GARINII PBI
TLNNWIFRLLESDL

SEQ ID NO: 153717 - protein, 14 aa, BORRELIA GARINII PBI
LNNWIFRLLESDLD

SEQ ID NO: 153718 - protein, 14 aa, BORRELIA GARINII PBI
NNWIFRLLESDLDA

SEQ ID NO: 153719 - protein, 14 aa, BORRELIA GARINII PBI
NWIFRLLESDLDAT

SEQ ID NO: 153720 - protein, 14 aa, BORRELIA GARINII PBI
WIFRLLESDLDATL

SEQ ID NO: 153721 - protein, 14 aa, BORRELIA GARINII PBI
IFRLLESDLDATLS

SEQ ID NO: 153722 - protein, 14 aa, BORRELIA GARINII PBI
FRLLESDLDATLSK

SEQ ID NO: 153723 - protein, 14 aa, BORRELIA GARINII PBI
RLLESDLDATLSKN

SEQ ID NO: 153724 - protein, 14 aa, BORRELIA GARINII PBI
LLESDLDATLSKNI

SEQ ID NO: 153725 - protein, 14 aa, BORRELIA GARINII PBI
LESDLDATLSKNIS

SEQ ID NO: 153726 - protein, 14 aa, BORRELIA GARINII PBI
ESDLDATLSKNISF

SEQ ID NO: 153727 - protein, 14 aa, BORRELIA GARINII PBI
SDLDATLSKNISFI

SEQ ID NO: 153728 - protein, 14 aa, BORRELIA GARINII PBI
DLDATLSKNISFIT

SEQ ID NO: 153729 - protein, 14 aa, BORRELIA GARINII PBI
LDATLSKNISFITR

SEQ ID NO: 153730 - protein, 14 aa, BORRELIA GARINII PBI
DATLSKNISFITRL

SEQ ID NO: 153731 - protein, 14 aa, BORRELIA GARINII PBI
ATLSKNISFITRLY

SEQ ID NO: 153732 - protein, 14 aa, BORRELIA GARINII PBI
TLSKNISFITRLYG

SEQ ID NO: 153733 - protein, 14 aa, BORRELIA GARINII PBI
LSKNISFITRLYGR

SEQ ID NO: 153734 - protein, 14 aa, BORRELIA GARINII PBI
SKNISFITRLYGRT

SEQ ID NO: 153735 - protein, 15 aa, BORRELIA GARINII PBI
MKYKKIRINLNLKRK

SEQ ID NO: 153736 - protein, 15 aa, BORRELIA GARINII PBI
KYKKIRINLNLKRKS

SEQ ID NO: 153737 - protein, 15 aa, BORRELIA GARINII PBI
YKKIRINLNLKRKSG

SEQ ID NO: 153738 - protein, 15 aa, BORRELIA GARINII PBI
KKIRINLNLKRKSGI

SEQ ID NO: 153739 - protein, 15 aa, BORRELIA GARINII PBI
KIRINLNLKRKSGIL

SEQ ID NO: 153740 - protein, 15 aa, BORRELIA GARINII PBI
IRINLNLKRKSGILL

SEQ ID NO: 153741 - protein, 15 aa, BORRELIA GARINII PBI
RINLNLKRKSGILLN

SEQ ID NO: 153742 - protein, 15 aa, BORRELIA GARINII PBI
INLNLKRKSGILLNI

SEQ ID NO: 153743 - protein, 15 aa, BORRELIA GARINII PBI
NLNLKRKSGILLNIS

SEQ ID NO: 153744 - protein, 15 aa, BORRELIA GARINII PBI
LNLKRKSGILLNISS

SEQ ID NO: 153745 - protein, 15 aa, BORRELIA GARINII PBI
NLKRKSGILLNISSL

SEQ ID NO: 153746 - protein, 15 aa, BORRELIA GARINII PBI
LKRKSGILLNISSLP

SEQ ID NO: 153747 - protein, 15 aa, BORRELIA GARINII PBI
KRKSGILLNISSLPS

SEQ ID NO: 153748 - protein, 15 aa, BORRELIA GARINII PBI
RKSGILLNISSLPSK

SEQ ID NO: 153749 - protein, 15 aa, BORRELIA GARINII PBI
KSGILLNISSLPSKY

SEQ ID NO: 153750 - protein, 15 aa, BORRELIA GARINII PBI
SGILLNISSLPSKYG

SEQ ID NO: 153751 - protein, 15 aa, BORRELIA GARINII PBI
GILLNISSLPSKYGI

SEQ ID NO: 153752 - protein, 15 aa, BORRELIA GARINII PBI
ILLNISSLPSKYGIG

SEQ ID NO: 153753 - protein, 15 aa, BORRELIA GARINII PBI
LLNISSLPSKYGIGD

SEQ ID NO: 153754 - protein, 15 aa, BORRELIA GARINII PBI
LNISSLPSKYGIGDL

SEQ ID NO: 153755 - protein, 15 aa, BORRELIA GARINII PBI
NISSLPSKYGIGDLG

SEQ ID NO: 153756 - protein, 15 aa, BORRELIA GARINII PBI
ISSLPSKYGIGDLGK

SEQ ID NO: 153757 - protein, 15 aa, BORRELIA GARINII PBI
SSLPSKYGIGDLGKG

SEQ ID NO: 153758 - protein, 15 aa, BORRELIA GARINII PBI
SLPSKYGIGDLGKGA

SEQ ID NO: 153759 - protein, 15 aa, BORRELIA GARINII PBI
LPSKYGIGDLGKGAY

SEQ ID NO: 153760 - protein, 15 aa, BORRELIA GARINII PBI
PSKYGIGDLGKGAYK

SEQ ID NO: 153761 - protein, 15 aa, BORRELIA GARINII PBI
SKYGIGDLGKGAYKF

SEQ ID NO: 153762 - protein, 15 aa, BORRELIA GARINII PBI
KYGIGDLGKGAYKFI

SEQ ID NO: 153763 - protein, 15 aa, BORRELIA GARINII PBI
YGIGDLGKGAYKFID

SEQ ID NO: 153764 - protein, 15 aa, BORRELIA GARINII PBI
GIGDLGKGAYKFIDF

SEQ ID NO: 153765 - protein, 15 aa, BORRELIA GARINII PBI
IGDLGKGAYKFIDFL

SEQ ID NO: 153766 - protein, 15 aa, BORRELIA GARINII PBI
GDLGKGAYKFIDFLF

SEQ ID NO: 153767 - protein, 15 aa, BORRELIA GARINII PBI
DLGKGAYKFIDFLFA

SEQ ID NO: 153768 - protein, 15 aa, BORRELIA GARINII PBI
LGKGAYKFIDFLFAS

SEQ ID NO: 153769 - protein, 15 aa, BORRELIA GARINII PBI
GKGAYKFIDFLFASS

SEQ ID NO: 153770 - protein, 15 aa, BORRELIA GARINII PBI
KGAYKFIDFLFASSQ

SEQ ID NO: 153771 - protein, 15 aa, BORRELIA GARINII PBI
GAYKFIDFLFASSQS

SEQ ID NO: 153772 - protein, 15 aa, BORRELIA GARINII PBI
AYKFIDFLFASSQSY

SEQ ID NO: 153773 - protein, 15 aa, BORRELIA GARINII PBI
YKFIDFLFASSQSYW

SEQ ID NO: 153774 - protein, 15 aa, BORRELIA GARINII PBI
KFIDFLFASSQSYWQ

SEQ ID NO: 153775 - protein, 15 aa, BORRELIA GARINII PBI
FIDFLFASSQSYWQM

SEQ ID NO: 153776 - protein, 15 aa, BORRELIA GARINII PBI
IDFLFASSQSYWQMF

SEQ ID NO: 153777 - protein, 15 aa, BORRELIA GARINII PBI
DFLFASSQSYWQMFA

SEQ ID NO: 153778 - protein, 15 aa, BORRELIA GARINII PBI
FLFASSQSYWQMFAY

SEQ ID NO: 153779 - protein, 15 aa, BORRELIA GARINII PBI
LFASSQSYWQMFAYS

SEQ ID NO: 153780 - protein, 15 aa, BORRELIA GARINII PBI
FASSQSYWQMFAYSP

SEQ ID NO: 153781 - protein, 15 aa, BORRELIA GARINII PBI
ASSQSYWQMFAYSPI

SEQ ID NO: 153782 - protein, 15 aa, BORRELIA GARINII PBI
SSQSYWQMFAYSPID

SEQ ID NO: 153783 - protein, 15 aa, BORRELIA GARINII PBI
SQSYWQMFAYSPIDF

SEQ ID NO: 153784 - protein, 15 aa, BORRELIA GARINII PBI
QSYWQMFAYSPIDFT

SEQ ID NO: 153785 - protein, 15 aa, BORRELIA GARINII PBI
SYWQMFAYSPIDFTR

SEQ ID NO: 153786 - protein, 15 aa, BORRELIA GARINII PBI
YWQMFAYSPIDFTRS

SEQ ID NO: 153787 - protein, 15 aa, BORRELIA GARINII PBI
WQMFAYSPIDFTRSP

SEQ ID NO: 153788 - protein, 15 aa, BORRELIA GARINII PBI
QMFAYSPIDFTRSPP

SEQ ID NO: 153789 - protein, 15 aa, BORRELIA GARINII PBI
MFAYSPIDFTRSPPY

SEQ ID NO: 153790 - protein, 15 aa, BORRELIA GARINII PBI
FAYSPIDFTRSPPYS

SEQ ID NO: 153791 - protein, 15 aa, BORRELIA GARINII PBI
AYSPIDFTRSPPYSI

SEQ ID NO: 153792 - protein, 15 aa, BORRELIA GARINII PBI
YSPIDFTRSPPYSIF

SEQ ID NO: 153793 - protein, 15 aa, BORRELIA GARINII PBI
SPIDFTRSPPYSIFS

SEQ ID NO: 153794 - protein, 15 aa, BORRELIA GARINII PBI
PIDFTRSPPYSIFSA

SEQ ID NO: 153795 - protein, 15 aa, BORRELIA GARINII PBI
IDFTRSPPYSIFSAF

SEQ ID NO: 153796 - protein, 15 aa, BORRELIA GARINII PBI
DFTRSPPYSIFSAFA

SEQ ID NO: 153797 - protein, 15 aa, BORRELIA GARINII PBI
FTRSPPYSIFSAFAG

SEQ ID NO: 153798 - protein, 15 aa, BORRELIA GARINII PBI
TRSPPYSIFSAFAGN

SEQ ID NO: 153799 - protein, 15 aa, BORRELIA GARINII PBI
RSPPYSIFSAFAGNV

SEQ ID NO: 153800 - protein, 15 aa, BORRELIA GARINII PBI
SPPYSIFSAFAGNVY

SEQ ID NO: 153801 - protein, 15 aa, BORRELIA GARINII PBI
PPYSIFSAFAGNVYY

SEQ ID NO: 153802 - protein, 15 aa, BORRELIA GARINII PBI
PYSIFSAFAGNVYYI

SEQ ID NO: 153803 - protein, 15 aa, BORRELIA GARINII PBI
YSIFSAFAGNVYYID

SEQ ID NO: 153804 - protein, 15 aa, BORRELIA GARINII PBI
SIFSAFAGNVYYIDL

SEQ ID NO: 153805 - protein, 15 aa, BORRELIA GARINII PBI
IFSAFAGNVYYIDLE

SEQ ID NO: 153806 - protein, 15 aa, BORRELIA GARINII PBI
FSAFAGNVYYIDLEA

SEQ ID NO: 153807 - protein, 15 aa, BORRELIA GARINII PBI
SAFAGNVYYIDLEAL

SEQ ID NO: 153808 - protein, 15 aa, BORRELIA GARINII PBI
AFAGNVYYIDLEALD

SEQ ID NO: 153809 - protein, 15 aa, BORRELIA GARINII PBI
FAGNVYYIDLEALDK

SEQ ID NO: 153810 - protein, 15 aa, BORRELIA GARINII PBI
AGNVYYIDLEALDKF

SEQ ID NO: 153811 - protein, 15 aa, BORRELIA GARINII PBI
GNVYYIDLEALDKFI

SEQ ID NO: 153812 - protein, 15 aa, BORRELIA GARINII PBI
NVYYIDLEALDKFID

SEQ ID NO: 153813 - protein, 15 aa, BORRELIA GARINII PBI
VYYIDLEALDKFIDS

SEQ ID NO: 153814 - protein, 15 aa, BORRELIA GARINII PBI
YYIDLEALDKFIDSD

SEQ ID NO: 153815 - protein, 15 aa, BORRELIA GARINII PBI
YIDLEALDKFIDSDL

SEQ ID NO: 153816 - protein, 15 aa, BORRELIA GARINII PBI
IDLEALDKFIDSDLN

SEQ ID NO: 153817 - protein, 15 aa, BORRELIA GARINII PBI
DLEALDKFIDSDLNL

SEQ ID NO: 153818 - protein, 15 aa, BORRELIA GARINII PBI
LEALDKFIDSDLNLL

SEQ ID NO: 153819 - protein, 15 aa, BORRELIA GARINII PBI
EALDKFIDSDLNLLK

SEQ ID NO: 153820 - protein, 15 aa, BORRELIA GARINII PBI
ALDKFIDSDLNLLKE

SEQ ID NO: 153821 - protein, 15 aa, BORRELIA GARINII PBI
LDKFIDSDLNLLKEN

SEQ ID NO: 153822 - protein, 15 aa, BORRELIA GARINII PBI
DKFIDSDLNLLKENE

SEQ ID NO: 153823 - protein, 15 aa, BORRELIA GARINII PBI
KFIDSDLNLLKENET

SEQ ID NO: 153824 - protein, 15 aa, BORRELIA GARINII PBI
FIDSDLNLLKENETR

SEQ ID NO: 153825 - protein, 15 aa, BORRELIA GARINII PBI
IDSDLNLLKENETRY

SEQ ID NO: 153826 - protein, 15 aa, BORRELIA GARINII PBI
DSDLNLLKENETRYS

SEQ ID NO: 153827 - protein, 15 aa, BORRELIA GARINII PBI
SDLNLLKENETRYSD

SEQ ID NO: 153828 - protein, 15 aa, BORRELIA GARINII PBI
DLNLLKENETRYSDL

SEQ ID NO: 153829 - protein, 15 aa, BORRELIA GARINII PBI
LNLLKENETRYSDLK

SEQ ID NO: 153830 - protein, 15 aa, BORRELIA GARINII PBI
NLLKENETRYSDLKK

SEQ ID NO: 153831 - protein, 15 aa, BORRELIA GARINII PBI
LLKENETRYSDLKKL

SEQ ID NO: 153832 - protein, 15 aa, BORRELIA GARINII PBI
LKENETRYSDLKKLS

SEQ ID NO: 153833 - protein, 15 aa, BORRELIA GARINII PBI
KENETRYSDLKKLSF

SEQ ID NO: 153834 - protein, 15 aa, BORRELIA GARINII PBI
ENETRYSDLKKLSFK

SEQ ID NO: 153835 - protein, 15 aa, BORRELIA GARINII PBI
NETRYSDLKKLSFKD

SEQ ID NO: 153836 - protein, 15 aa, BORRELIA GARINII PBI
ETRYSDLKKLSFKDK

SEQ ID NO: 153837 - protein, 15 aa, BORRELIA GARINII PBI
TRYSDLKKLSFKDKF

SEQ ID NO: 153838 - protein, 15 aa, BORRELIA GARINII PBI
RYSDLKKLSFKDKFL

SEQ ID NO: 153839 - protein, 15 aa, BORRELIA GARINII PBI
YSDLKKLSFKDKFLK

SEQ ID NO: 153840 - protein, 15 aa, BORRELIA GARINII PBI
SDLKKLSFKDKFLKE

SEQ ID NO: 153841 - protein, 15 aa, BORRELIA GARINII PBI
DLKKLSFKDKFLKEA

SEQ ID NO: 153842 - protein, 15 aa, BORRELIA GARINII PBI
LKKLSFKDKFLKEAA

SEQ ID NO: 153843 - protein, 15 aa, BORRELIA GARINII PBI
KKLSFKDKFLKEAAL

SEQ ID NO: 153844 - protein, 15 aa, BORRELIA GARINII PBI
KLSFKDKFLKEAALN

SEQ ID NO: 153845 - protein, 15 aa, BORRELIA GARINII PBI
LSFKDKFLKEAALNF

SEQ ID NO: 153846 - protein, 15 aa, BORRELIA GARINII PBI
SFKDKFLKEAALNFI

SEQ ID NO: 153847 - protein, 15 aa, BORRELIA GARINII PBI
FKDKFLKEAALNFIN

SEQ ID NO: 153848 - protein, 15 aa, BORRELIA GARINII PBI
KDKFLKEAALNFINR

SEQ ID NO: 153849 - protein, 15 aa, BORRELIA GARINII PBI
DKFLKEAALNFINRA

SEQ ID NO: 153850 - protein, 15 aa, BORRELIA GARINII PBI
KFLKEAALNFINRAS

SEQ ID NO: 153851 - protein, 15 aa, BORRELIA GARINII PBI
FLKEAALNFINRASV

SEQ ID NO: 153852 - protein, 15 aa, BORRELIA GARINII PBI
LKEAALNFINRASVD

SEQ ID NO: 153853 - protein, 15 aa, BORRELIA GARINII PBI
KEAALNFINRASVDE

SEQ ID NO: 153854 - protein, 15 aa, BORRELIA GARINII PBI
EAALNFINRASVDEV

SEQ ID NO: 153855 - protein, 15 aa, BORRELIA GARINII PBI
AALNFINRASVDEVR

SEQ ID NO: 153856 - protein, 15 aa, BORRELIA GARINII PBI
ALNFINRASVDEVRS

SEQ ID NO: 153857 - protein, 15 aa, BORRELIA GARINII PBI
LNFINRASVDEVRSF

SEQ ID NO: 153858 - protein, 15 aa, BORRELIA GARINII PBI
NFINRASVDEVRSFE

SEQ ID NO: 153859 - protein, 15 aa, BORRELIA GARINII PBI
FINRASVDEVRSFEK

SEQ ID NO: 153860 - protein, 15 aa, BORRELIA GARINII PBI
INRASVDEVRSFEKF

SEQ ID NO: 153861 - protein, 15 aa, BORRELIA GARINII PBI
NRASVDEVRSFEKFK

SEQ ID NO: 153862 - protein, 15 aa, BORRELIA GARINII PBI
RASVDEVRSFEKFKK

SEQ ID NO: 153863 - protein, 15 aa, BORRELIA GARINII PBI
ASVDEVRSFEKFKKK

SEQ ID NO: 153864 - protein, 15 aa, BORRELIA GARINII PBI
SVDEVRSFEKFKKKS

SEQ ID NO: 153865 - protein, 15 aa, BORRELIA GARINII PBI
VDEVRSFEKFKKKSS

SEQ ID NO: 153866 - protein, 15 aa, BORRELIA GARINII PBI
DEVRSFEKFKKKSSY

SEQ ID NO: 153867 - protein, 15 aa, BORRELIA GARINII PBI
EVRSFEKFKKKSSYW

SEQ ID NO: 153868 - protein, 15 aa, BORRELIA GARINII PBI
VRSFEKFKKKSSYWL

SEQ ID NO: 153869 - protein, 15 aa, BORRELIA GARINII PBI
RSFEKFKKKSSYWLL

SEQ ID NO: 153870 - protein, 15 aa, BORRELIA GARINII PBI
SFEKFKKKSSYWLLD

SEQ ID NO: 153871 - protein, 15 aa, BORRELIA GARINII PBI
FEKFKKKSSYWLLDF

SEQ ID NO: 153872 - protein, 15 aa, BORRELIA GARINII PBI
EKFKKKSSYWLLDFA

SEQ ID NO: 153873 - protein, 15 aa, BORRELIA GARINII PBI
KFKKKSSYWLLDFAS

SEQ ID NO: 153874 - protein, 15 aa, BORRELIA GARINII PBI
FKKKSSYWLLDFASF

SEQ ID NO: 153875 - protein, 15 aa, BORRELIA GARINII PBI
KKKSSYWLLDFASFV

SEQ ID NO: 153876 - protein, 15 aa, BORRELIA GARINII PBI
KKSSYWLLDFASFVA

SEQ ID NO: 153877 - protein, 15 aa, BORRELIA GARINII PBI
KSSYWLLDFASFVAF

SEQ ID NO: 153878 - protein, 15 aa, BORRELIA GARINII PBI
SSYWLLDFASFVAFK

SEQ ID NO: 153879 - protein, 15 aa, BORRELIA GARINII PBI
SYWLLDFASFVAFKE

SEQ ID NO: 153880 - protein, 15 aa, BORRELIA GARINII PBI
YWLLDFASFVAFKEY

SEQ ID NO: 153881 - protein, 15 aa, BORRELIA GARINII PBI
WLLDFASFVAFKEYF

SEQ ID NO: 153882 - protein, 15 aa, BORRELIA GARINII PBI
LLDFASFVAFKEYFL

SEQ ID NO: 153883 - protein, 15 aa, BORRELIA GARINII PBI
LDFASFVAFKEYFLK

SEQ ID NO: 153884 - protein, 15 aa, BORRELIA GARINII PBI
DFASFVAFKEYFLKD

SEQ ID NO: 153885 - protein, 15 aa, BORRELIA GARINII PBI
FASFVAFKEYFLKDS

SEQ ID NO: 153886 - protein, 15 aa, BORRELIA GARINII PBI
ASFVAFKEYFLKDSR

SEQ ID NO: 153887 - protein, 15 aa, BORRELIA GARINII PBI
SFVAFKEYFLKDSRD

SEQ ID NO: 153888 - protein, 15 aa, BORRELIA GARINII PBI
FVAFKEYFLKDSRDA

SEQ ID NO: 153889 - protein, 15 aa, BORRELIA GARINII PBI
VAFKEYFLKDSRDAF

SEQ ID NO: 153890 - protein, 15 aa, BORRELIA GARINII PBI
AFKEYFLKDSRDAFN

SEQ ID NO: 153891 - protein, 15 aa, BORRELIA GARINII PBI
FKEYFLKDSRDAFNV

SEQ ID NO: 153892 - protein, 15 aa, BORRELIA GARINII PBI
KEYFLKDSRDAFNVL

SEQ ID NO: 153893 - protein, 15 aa, BORRELIA GARINII PBI
EYFLKDSRDAFNVLF

SEQ ID NO: 153894 - protein, 15 aa, BORRELIA GARINII PBI
YFLKDSRDAFNVLFD

SEQ ID NO: 153895 - protein, 15 aa, BORRELIA GARINII PBI
FLKDSRDAFNVLFDR

SEQ ID NO: 153896 - protein, 15 aa, BORRELIA GARINII PBI
LKDSRDAFNVLFDRG

SEQ ID NO: 153897 - protein, 15 aa, BORRELIA GARINII PBI
KDSRDAFNVLFDRGI

SEQ ID NO: 153898 - protein, 15 aa, BORRELIA GARINII PBI
DSRDAFNVLFDRGIL

SEQ ID NO: 153899 - protein, 15 aa, BORRELIA GARINII PBI
SRDAFNVLFDRGILI

SEQ ID NO: 153900 - protein, 15 aa, BORRELIA GARINII PBI
RDAFNVLFDRGILIR

SEQ ID NO: 153901 - protein, 15 aa, BORRELIA GARINII PBI
DAFNVLFDRGILIRN

SEQ ID NO: 153902 - protein, 15 aa, BORRELIA GARINII PBI
AFNVLFDRGILIRNE

SEQ ID NO: 153903 - protein, 15 aa, BORRELIA GARINII PBI
FNVLFDRGILIRNEK

SEQ ID NO: 153904 - protein, 15 aa, BORRELIA GARINII PBI
NVLFDRGILIRNEKD

SEQ ID NO: 153905 - protein, 15 aa, BORRELIA GARINII PBI
VLFDRGILIRNEKDL

SEQ ID NO: 153906 - protein, 15 aa, BORRELIA GARINII PBI
LFDRGILIRNEKDLF

SEQ ID NO: 153907 - protein, 15 aa, BORRELIA GARINII PBI
FDRGILIRNEKDLFK

SEQ ID NO: 153908 - protein, 15 aa, BORRELIA GARINII PBI
DRGILIRNEKDLFKL

SEQ ID NO: 153909 - protein, 15 aa, BORRELIA GARINII PBI
RGILIRNEKDLFKLR

SEQ ID NO: 153910 - protein, 15 aa, BORRELIA GARINII PBI
GILIRNEKDLFKLRN

SEQ ID NO: 153911 - protein, 15 aa, BORRELIA GARINII PBI
ILIRNEKDLFKLRNI

SEQ ID NO: 153912 - protein, 15 aa, BORRELIA GARINII PBI
LIRNEKDLFKLRNIL

SEQ ID NO: 153913 - protein, 15 aa, BORRELIA GARINII PBI
IRNEKDLFKLRNILS

SEQ ID NO: 153914 - protein, 15 aa, BORRELIA GARINII PBI
RNEKDLFKLRNILSK

SEQ ID NO: 153915 - protein, 15 aa, BORRELIA GARINII PBI
NEKDLFKLRNILSKE

SEQ ID NO: 153916 - protein, 15 aa, BORRELIA GARINII PBI
EKDLFKLRNILSKEI

SEQ ID NO: 153917 - protein, 15 aa, BORRELIA GARINII PBI
KDLFKLRNILSKEIK

SEQ ID NO: 153918 - protein, 15 aa, BORRELIA GARINII PBI
DLFKLRNILSKEIKV

SEQ ID NO: 153919 - protein, 15 aa, BORRELIA GARINII PBI
LFKLRNILSKEIKVQ

SEQ ID NO: 153920 - protein, 15 aa, BORRELIA GARINII PBI
FKLRNILSKEIKVQE

SEQ ID NO: 153921 - protein, 15 aa, BORRELIA GARINII PBI
KLRNILSKEIKVQEV

SEQ ID NO: 153922 - protein, 15 aa, BORRELIA GARINII PBI
LRNILSKEIKVQEVL

SEQ ID NO: 153923 - protein, 15 aa, BORRELIA GARINII PBI
RNILSKEIKVQEVLQ

SEQ ID NO: 153924 - protein, 15 aa, BORRELIA GARINII PBI
NILSKEIKVQEVLQY

SEQ ID NO: 153925 - protein, 15 aa, BORRELIA GARINII PBI
ILSKEIKVQEVLQYF

SEQ ID NO: 153926 - protein, 15 aa, BORRELIA GARINII PBI
LSKEIKVQEVLQYFF

SEQ ID NO: 153927 - protein, 15 aa, BORRELIA GARINII PBI
SKEIKVQEVLQYFFF

SEQ ID NO: 153928 - protein, 15 aa, BORRELIA GARINII PBI
KEIKVQEVLQYFFFS

SEQ ID NO: 153929 - protein, 15 aa, BORRELIA GARINII PBI
EIKVQEVLQYFFFSQ

SEQ ID NO: 153930 - protein, 15 aa, BORRELIA GARINII PBI
IKVQEVLQYFFFSQF

SEQ ID NO: 153931 - protein, 15 aa, BORRELIA GARINII PBI
KVQEVLQYFFFSQFQ

SEQ ID NO: 153932 - protein, 15 aa, BORRELIA GARINII PBI
VQEVLQYFFFSQFQA

SEQ ID NO: 153933 - protein, 15 aa, BORRELIA GARINII PBI
QEVLQYFFFSQFQAL

SEQ ID NO: 153934 - protein, 15 aa, BORRELIA GARINII PBI
EVLQYFFFSQFQALK

SEQ ID NO: 153935 - protein, 15 aa, BORRELIA GARINII PBI
VLQYFFFSQFQALKR

SEQ ID NO: 153936 - protein, 15 aa, BORRELIA GARINII PBI
LQYFFFSQFQALKRY

SEQ ID NO: 153937 - protein, 15 aa, BORRELIA GARINII PBI
QYFFFSQFQALKRYA

SEQ ID NO: 153938 - protein, 15 aa, BORRELIA GARINII PBI
YFFFSQFQALKRYAN

SEQ ID NO: 153939 - protein, 15 aa, BORRELIA GARINII PBI
FFFSQFQALKRYAND

SEQ ID NO: 153940 - protein, 15 aa, BORRELIA GARINII PBI
FFSQFQALKRYANDK

SEQ ID NO: 153941 - protein, 15 aa, BORRELIA GARINII PBI
FSQFQALKRYANDKG

SEQ ID NO: 153942 - protein, 15 aa, BORRELIA GARINII PBI
SQFQALKRYANDKGI

SEQ ID NO: 153943 - protein, 15 aa, BORRELIA GARINII PBI
QFQALKRYANDKGIE

SEQ ID NO: 153944 - protein, 15 aa, BORRELIA GARINII PBI
FQALKRYANDKGIEL

SEQ ID NO: 153945 - protein, 15 aa, BORRELIA GARINII PBI
QALKRYANDKGIELV

SEQ ID NO: 153946 - protein, 15 aa, BORRELIA GARINII PBI
ALKRYANDKGIELVM

SEQ ID NO: 153947 - protein, 15 aa, BORRELIA GARINII PBI
LKRYANDKGIELVMN

SEQ ID NO: 153948 - protein, 15 aa, BORRELIA GARINII PBI
KRYANDKGIELVMNL

SEQ ID NO: 153949 - protein, 15 aa, BORRELIA GARINII PBI
RYANDKGIELVMNLP

SEQ ID NO: 153950 - protein, 15 aa, BORRELIA GARINII PBI
YANDKGIELVMNLPL

SEQ ID NO: 153951 - protein, 15 aa, BORRELIA GARINII PBI
ANDKGIELVMNLPLF

SEQ ID NO: 153952 - protein, 15 aa, BORRELIA GARINII PBI
NDKGIELVMNLPLFI

SEQ ID NO: 153953 - protein, 15 aa, BORRELIA GARINII PBI
DKGIELVMNLPLFIA

SEQ ID NO: 153954 - protein, 15 aa, BORRELIA GARINII PBI
KGIELVMNLPLFIAY

SEQ ID NO: 153955 - protein, 15 aa, BORRELIA GARINII PBI
GIELVMNLPLFIAYD

SEQ ID NO: 153956 - protein, 15 aa, BORRELIA GARINII PBI
IELVMNLPLFIAYDS

SEQ ID NO: 153957 - protein, 15 aa, BORRELIA GARINII PBI
ELVMNLPLFIAYDSA

SEQ ID NO: 153958 - protein, 15 aa, BORRELIA GARINII PBI
LVMNLPLFIAYDSAD

SEQ ID NO: 153959 - protein, 15 aa, BORRELIA GARINII PBI
VMNLPLFIAYDSADV

SEQ ID NO: 153960 - protein, 15 aa, BORRELIA GARINII PBI
MNLPLFIAYDSADVW

SEQ ID NO: 153961 - protein, 15 aa, BORRELIA GARINII PBI
NLPLFIAYDSADVWA

SEQ ID NO: 153962 - protein, 15 aa, BORRELIA GARINII PBI
LPLFIAYDSADVWAH

SEQ ID NO: 153963 - protein, 15 aa, BORRELIA GARINII PBI
PLFIAYDSADVWAHQ

SEQ ID NO: 153964 - protein, 15 aa, BORRELIA GARINII PBI
LFIAYDSADVWAHQK

SEQ ID NO: 153965 - protein, 15 aa, BORRELIA GARINII PBI
FIAYDSADVWAHQKY

SEQ ID NO: 153966 - protein, 15 aa, BORRELIA GARINII PBI
IAYDSADVWAHQKYF

SEQ ID NO: 153967 - protein, 15 aa, BORRELIA GARINII PBI
AYDSADVWAHQKYFK

SEQ ID NO: 153968 - protein, 15 aa, BORRELIA GARINII PBI
YDSADVWAHQKYFKL

SEQ ID NO: 153969 - protein, 15 aa, BORRELIA GARINII PBI
DSADVWAHQKYFKLR

SEQ ID NO: 153970 - protein, 15 aa, BORRELIA GARINII PBI
SADVWAHQKYFKLRF

SEQ ID NO: 153971 - protein, 15 aa, BORRELIA GARINII PBI
ADVWAHQKYFKLRFD

SEQ ID NO: 153972 - protein, 15 aa, BORRELIA GARINII PBI
DVWAHQKYFKLRFDA

SEQ ID NO: 153973 - protein, 15 aa, BORRELIA GARINII PBI
VWAHQKYFKLRFDAS

SEQ ID NO: 153974 - protein, 15 aa, BORRELIA GARINII PBI
WAHQKYFKLRFDASK

SEQ ID NO: 153975 - protein, 15 aa, BORRELIA GARINII PBI
AHQKYFKLRFDASKD

SEQ ID NO: 153976 - protein, 15 aa, BORRELIA GARINII PBI
HQKYFKLRFDASKDK

SEQ ID NO: 153977 - protein, 15 aa, BORRELIA GARINII PBI
QKYFKLRFDASKDKV

SEQ ID NO: 153978 - protein, 15 aa, BORRELIA GARINII PBI
KYFKLRFDASKDKVA

SEQ ID NO: 153979 - protein, 15 aa, BORRELIA GARINII PBI
YFKLRFDASKDKVAG

SEQ ID NO: 153980 - protein, 15 aa, BORRELIA GARINII PBI
FKLRFDASKDKVAGI

SEQ ID NO: 153981 - protein, 15 aa, BORRELIA GARINII PBI
KLRFDASKDKVAGIS

SEQ ID NO: 153982 - protein, 15 aa, BORRELIA GARINII PBI
LRFDASKDKVAGISP

SEQ ID NO: 153983 - protein, 15 aa, BORRELIA GARINII PBI
RFDASKDKVAGISPD

SEQ ID NO: 153984 - protein, 15 aa, BORRELIA GARINII PBI
FDASKDKVAGISPDY

SEQ ID NO: 153985 - protein, 15 aa, BORRELIA GARINII PBI
DASKDKVAGISPDYF

SEQ ID NO: 153986 - protein, 15 aa, BORRELIA GARINII PBI
ASKDKVAGISPDYFL

SEQ ID NO: 153987 - protein, 15 aa, BORRELIA GARINII PBI
SKDKVAGISPDYFLE

SEQ ID NO: 153988 - protein, 15 aa, BORRELIA GARINII PBI
KDKVAGISPDYFLEQ

SEQ ID NO: 153989 - protein, 15 aa, BORRELIA GARINII PBI
DKVAGISPDYFLEQE

SEQ ID NO: 153990 - protein, 15 aa, BORRELIA GARINII PBI
KVAGISPDYFLEQEQ

SEQ ID NO: 153991 - protein, 15 aa, BORRELIA GARINII PBI
VAGISPDYFLEQEQA

SEQ ID NO: 153992 - protein, 15 aa, BORRELIA GARINII PBI
AGISPDYFLEQEQAW

SEQ ID NO: 153993 - protein, 15 aa, BORRELIA GARINII PBI
GISPDYFLEQEQAWD

SEQ ID NO: 153994 - protein, 15 aa, BORRELIA GARINII PBI
ISPDYFLEQEQAWDS

SEQ ID NO: 153995 - protein, 15 aa, BORRELIA GARINII PBI
SPDYFLEQEQAWDSP

SEQ ID NO: 153996 - protein, 15 aa, BORRELIA GARINII PBI
PDYFLEQEQAWDSPA

SEQ ID NO: 153997 - protein, 15 aa, BORRELIA GARINII PBI
DYFLEQEQAWDSPAY

SEQ ID NO: 153998 - protein, 15 aa, BORRELIA GARINII PBI
YFLEQEQAWDSPAYS

SEQ ID NO: 153999 - protein, 15 aa, BORRELIA GARINII PBI
FLEQEQAWDSPAYSW

SEQ ID NO: 154000 - protein, 15 aa, BORRELIA GARINII PBI
LEQEQAWDSPAYSWN

SEQ ID NO: 154001 - protein, 15 aa, BORRELIA GARINII PBI
EQEQAWDSPAYSWNV

SEQ ID NO: 154002 - protein, 15 aa, BORRELIA GARINII PBI
QEQAWDSPAYSWNVL

SEQ ID NO: 154003 - protein, 15 aa, BORRELIA GARINII PBI
EQAWDSPAYSWNVLK

SEQ ID NO: 154004 - protein, 15 aa, BORRELIA GARINII PBI
QAWDSPAYSWNVLKN

SEQ ID NO: 154005 - protein, 15 aa, BORRELIA GARINII PBI
AWDSPAYSWNVLKNV

SEQ ID NO: 154006 - protein, 15 aa, BORRELIA GARINII PBI
WDSPAYSWNVLKNVK

SEQ ID NO: 154007 - protein, 15 aa, BORRELIA GARINII PBI
DSPAYSWNVLKNVKY

SEQ ID NO: 154008 - protein, 15 aa, BORRELIA GARINII PBI
SPAYSWNVLKNVKYE

SEQ ID NO: 154009 - protein, 15 aa, BORRELIA GARINII PBI
PAYSWNVLKNVKYEW

SEQ ID NO: 154010 - protein, 15 aa, BORRELIA GARINII PBI
AYSWNVLKNVKYEWW

SEQ ID NO: 154011 - protein, 15 aa, BORRELIA GARINII PBI
YSWNVLKNVKYEWWA

SEQ ID NO: 154012 - protein, 15 aa, BORRELIA GARINII PBI
SWNVLKNVKYEWWAK

SEQ ID NO: 154013 - protein, 15 aa, BORRELIA GARINII PBI
WNVLKNVKYEWWAKR

SEQ ID NO: 154014 - protein, 15 aa, BORRELIA GARINII PBI
NVLKNVKYEWWAKRI

SEQ ID NO: 154015 - protein, 15 aa, BORRELIA GARINII PBI
VLKNVKYEWWAKRIG

SEQ ID NO: 154016 - protein, 15 aa, BORRELIA GARINII PBI
LKNVKYEWWAKRIGI

SEQ ID NO: 154017 - protein, 15 aa, BORRELIA GARINII PBI
KNVKYEWWAKRIGIL

SEQ ID NO: 154018 - protein, 15 aa, BORRELIA GARINII PBI
NVKYEWWAKRIGILR

SEQ ID NO: 154019 - protein, 15 aa, BORRELIA GARINII PBI
VKYEWWAKRIGILRK

SEQ ID NO: 154020 - protein, 15 aa, BORRELIA GARINII PBI
KYEWWAKRIGILRKY

SEQ ID NO: 154021 - protein, 15 aa, BORRELIA GARINII PBI
YEWWAKRIGILRKYI

SEQ ID NO: 154022 - protein, 15 aa, BORRELIA GARINII PBI
EWWAKRIGILRKYID

SEQ ID NO: 154023 - protein, 15 aa, BORRELIA GARINII PBI
WWAKRIGILRKYIDV

SEQ ID NO: 154024 - protein, 15 aa, BORRELIA GARINII PBI
WAKRIGILRKYIDVI

SEQ ID NO: 154025 - protein, 15 aa, BORRELIA GARINII PBI
AKRIGILRKYIDVIK

SEQ ID NO: 154026 - protein, 15 aa, BORRELIA GARINII PBI
KRIGILRKYIDVIKI

SEQ ID NO: 154027 - protein, 15 aa, BORRELIA GARINII PBI
RIGILRKYIDVIKID

SEQ ID NO: 154028 - protein, 15 aa, BORRELIA GARINII PBI
IGILRKYIDVIKIDH

SEQ ID NO: 154029 - protein, 15 aa, BORRELIA GARINII PBI
GILRKYIDVIKIDHF

SEQ ID NO: 154030 - protein, 15 aa, BORRELIA GARINII PBI
ILRKYIDVIKIDHFR

SEQ ID NO: 154031 - protein, 15 aa, BORRELIA GARINII PBI
LRKYIDVIKIDHFRG

SEQ ID NO: 154032 - protein, 15 aa, BORRELIA GARINII PBI
RKYIDVIKIDHFRGF

SEQ ID NO: 154033 - protein, 15 aa, BORRELIA GARINII PBI
KYIDVIKIDHFRGFV

SEQ ID NO: 154034 - protein, 15 aa, BORRELIA GARINII PBI
YIDVIKIDHFRGFVS

SEQ ID NO: 154035 - protein, 15 aa, BORRELIA GARINII PBI
IDVIKIDHFRGFVST

SEQ ID NO: 154036 - protein, 15 aa, BORRELIA GARINII PBI
DVIKIDHFRGFVSTW

SEQ ID NO: 154037 - protein, 15 aa, BORRELIA GARINII PBI
VIKIDHFRGFVSTWE

SEQ ID NO: 154038 - protein, 15 aa, BORRELIA GARINII PBI
IKIDHFRGFVSTWEV

SEQ ID NO: 154039 - protein, 15 aa, BORRELIA GARINII PBI
KIDHFRGFVSTWEVG

SEQ ID NO: 154040 - protein, 15 aa, BORRELIA GARINII PBI
IDHFRGFVSTWEVGV

SEQ ID NO: 154041 - protein, 15 aa, BORRELIA GARINII PBI
DHFRGFVSTWEVGVG

SEQ ID NO: 154042 - protein, 15 aa, BORRELIA GARINII PBI
HFRGFVSTWEVGVGE

SEQ ID NO: 154043 - protein, 15 aa, BORRELIA GARINII PBI
FRGFVSTWEVGVGEA

SEQ ID NO: 154044 - protein, 15 aa, BORRELIA GARINII PBI
RGFVSTWEVGVGEAY

SEQ ID NO: 154045 - protein, 15 aa, BORRELIA GARINII PBI
GFVSTWEVGVGEAYA

SEQ ID NO: 154046 - protein, 15 aa, BORRELIA GARINII PBI
FVSTWEVGVGEAYAF

SEQ ID NO: 154047 - protein, 15 aa, BORRELIA GARINII PBI
VSTWEVGVGEAYAFN

SEQ ID NO: 154048 - protein, 15 aa, BORRELIA GARINII PBI
STWEVGVGEAYAFNG

SEQ ID NO: 154049 - protein, 15 aa, BORRELIA GARINII PBI
TWEVGVGEAYAFNGL

SEQ ID NO: 154050 - protein, 15 aa, BORRELIA GARINII PBI
WEVGVGEAYAFNGLW

SEQ ID NO: 154051 - protein, 15 aa, BORRELIA GARINII PBI
EVGVGEAYAFNGLWV

SEQ ID NO: 154052 - protein, 15 aa, BORRELIA GARINII PBI
VGVGEAYAFNGLWVK

SEQ ID NO: 154053 - protein, 15 aa, BORRELIA GARINII PBI
GVGEAYAFNGLWVKS

SEQ ID NO: 154054 - protein, 15 aa, BORRELIA GARINII PBI
VGEAYAFNGLWVKSP

SEQ ID NO: 154055 - protein, 15 aa, BORRELIA GARINII PBI
GEAYAFNGLWVKSPG

SEQ ID NO: 154056 - protein, 15 aa, BORRELIA GARINII PBI
EAYAFNGLWVKSPGR

SEQ ID NO: 154057 - protein, 15 aa, BORRELIA GARINII PBI
AYAFNGLWVKSPGRD

SEQ ID NO: 154058 - protein, 15 aa, BORRELIA GARINII PBI
YAFNGLWVKSPGRDF

SEQ ID NO: 154059 - protein, 15 aa, BORRELIA GARINII PBI
AFNGLWVKSPGRDFF

SEQ ID NO: 154060 - protein, 15 aa, BORRELIA GARINII PBI
FNGLWVKSPGRDFFN

SEQ ID NO: 154061 - protein, 15 aa, BORRELIA GARINII PBI
NGLWVKSPGRDFFNF

SEQ ID NO: 154062 - protein, 15 aa, BORRELIA GARINII PBI
GLWVKSPGRDFFNFI

SEQ ID NO: 154063 - protein, 15 aa, BORRELIA GARINII PBI
LWVKSPGRDFFNFIL

SEQ ID NO: 154064 - protein, 15 aa, BORRELIA GARINII PBI
WVKSPGRDFFNFILN

SEQ ID NO: 154065 - protein, 15 aa, BORRELIA GARINII PBI
VKSPGRDFFNFILNE

SEQ ID NO: 154066 - protein, 15 aa, BORRELIA GARINII PBI
KSPGRDFFNFILNEI

SEQ ID NO: 154067 - protein, 15 aa, BORRELIA GARINII PBI
SPGRDFFNFILNEIK

SEQ ID NO: 154068 - protein, 15 aa, BORRELIA GARINII PBI
PGRDFFNFILNEIKD

SEQ ID NO: 154069 - protein, 15 aa, BORRELIA GARINII PBI
GRDFFNFILNEIKDL

SEQ ID NO: 154070 - protein, 15 aa, BORRELIA GARINII PBI
RDFFNFILNEIKDLK

SEQ ID NO: 154071 - protein, 15 aa, BORRELIA GARINII PBI
DFFNFILNEIKDLKI

SEQ ID NO: 154072 - protein, 15 aa, BORRELIA GARINII PBI
FFNFILNEIKDLKIW

SEQ ID NO: 154073 - protein, 15 aa, BORRELIA GARINII PBI
FNFILNEIKDLKIWV

SEQ ID NO: 154074 - protein, 15 aa, BORRELIA GARINII PBI
NFILNEIKDLKIWVE

SEQ ID NO: 154075 - protein, 15 aa, BORRELIA GARINII PBI
FILNEIKDLKIWVED

SEQ ID NO: 154076 - protein, 15 aa, BORRELIA GARINII PBI
ILNEIKDLKIWVEDF

SEQ ID NO: 154077 - protein, 15 aa, BORRELIA GARINII PBI
LNEIKDLKIWVEDFE

SEQ ID NO: 154078 - protein, 15 aa, BORRELIA GARINII PBI
NEIKDLKIWVEDFEN

SEQ ID NO: 154079 - protein, 15 aa, BORRELIA GARINII PBI
EIKDLKIWVEDFEND

SEQ ID NO: 154080 - protein, 15 aa, BORRELIA GARINII PBI
IKDLKIWVEDFENDL

SEQ ID NO: 154081 - protein, 15 aa, BORRELIA GARINII PBI
KDLKIWVEDFENDLE

SEQ ID NO: 154082 - protein, 15 aa, BORRELIA GARINII PBI
DLKIWVEDFENDLED

SEQ ID NO: 154083 - protein, 15 aa, BORRELIA GARINII PBI
LKIWVEDFENDLEDV

SEQ ID NO: 154084 - protein, 15 aa, BORRELIA GARINII PBI
KIWVEDFENDLEDVS

SEQ ID NO: 154085 - protein, 15 aa, BORRELIA GARINII PBI
IWVEDFENDLEDVSR

SEQ ID NO: 154086 - protein, 15 aa, BORRELIA GARINII PBI
WVEDFENDLEDVSRL

SEQ ID NO: 154087 - protein, 15 aa, BORRELIA GARINII PBI
VEDFENDLEDVSRLR

SEQ ID NO: 154088 - protein, 15 aa, BORRELIA GARINII PBI
EDFENDLEDVSRLRD

SEQ ID NO: 154089 - protein, 15 aa, BORRELIA GARINII PBI
DFENDLEDVSRLRDF

SEQ ID NO: 154090 - protein, 15 aa, BORRELIA GARINII PBI
FENDLEDVSRLRDFF

SEQ ID NO: 154091 - protein, 15 aa, BORRELIA GARINII PBI
ENDLEDVSRLRDFFN

SEQ ID NO: 154092 - protein, 15 aa, BORRELIA GARINII PBI
NDLEDVSRLRDFFNF

SEQ ID NO: 154093 - protein, 15 aa, BORRELIA GARINII PBI
DLEDVSRLRDFFNFP

SEQ ID NO: 154094 - protein, 15 aa, BORRELIA GARINII PBI
LEDVSRLRDFFNFPG

SEQ ID NO: 154095 - protein, 15 aa, BORRELIA GARINII PBI
EDVSRLRDFFNFPGM

SEQ ID NO: 154096 - protein, 15 aa, BORRELIA GARINII PBI
DVSRLRDFFNFPGMR

SEQ ID NO: 154097 - protein, 15 aa, BORRELIA GARINII PBI
VSRLRDFFNFPGMRI

SEQ ID NO: 154098 - protein, 15 aa, BORRELIA GARINII PBI
SRLRDFFNFPGMRIM

SEQ ID NO: 154099 - protein, 15 aa, BORRELIA GARINII PBI
RLRDFFNFPGMRIMK

SEQ ID NO: 154100 - protein, 15 aa, BORRELIA GARINII PBI
LRDFFNFPGMRIMKL

SEQ ID NO: 154101 - protein, 15 aa, BORRELIA GARINII PBI
RDFFNFPGMRIMKLA

SEQ ID NO: 154102 - protein, 15 aa, BORRELIA GARINII PBI
DFFNFPGMRIMKLAF

SEQ ID NO: 154103 - protein, 15 aa, BORRELIA GARINII PBI
FFNFPGMRIMKLAFD

SEQ ID NO: 154104 - protein, 15 aa, BORRELIA GARINII PBI
FNFPGMRIMKLAFDF

SEQ ID NO: 154105 - protein, 15 aa, BORRELIA GARINII PBI
NFPGMRIMKLAFDFD

SEQ ID NO: 154106 - protein, 15 aa, BORRELIA GARINII PBI
FPGMRIMKLAFDFDS

SEQ ID NO: 154107 - protein, 15 aa, BORRELIA GARINII PBI
PGMRIMKLAFDFDSD

SEQ ID NO: 154108 - protein, 15 aa, BORRELIA GARINII PBI
GMRIMKLAFDFDSDN

SEQ ID NO: 154109 - protein, 15 aa, BORRELIA GARINII PBI
MRIMKLAFDFDSDNQ

SEQ ID NO: 154110 - protein, 15 aa, BORRELIA GARINII PBI
RIMKLAFDFDSDNQN

SEQ ID NO: 154111 - protein, 15 aa, BORRELIA GARINII PBI
IMKLAFDFDSDNQNL

SEQ ID NO: 154112 - protein, 15 aa, BORRELIA GARINII PBI
MKLAFDFDSDNQNLP

SEQ ID NO: 154113 - protein, 15 aa, BORRELIA GARINII PBI
KLAFDFDSDNQNLPH

SEQ ID NO: 154114 - protein, 15 aa, BORRELIA GARINII PBI
LAFDFDSDNQNLPHN

SEQ ID NO: 154115 - protein, 15 aa, BORRELIA GARINII PBI
AFDFDSDNQNLPHNY

SEQ ID NO: 154116 - protein, 15 aa, BORRELIA GARINII PBI
FDFDSDNQNLPHNYI

SEQ ID NO: 154117 - protein, 15 aa, BORRELIA GARINII PBI
DFDSDNQNLPHNYIK

SEQ ID NO: 154118 - protein, 15 aa, BORRELIA GARINII PBI
FDSDNQNLPHNYIKN

SEQ ID NO: 154119 - protein, 15 aa, BORRELIA GARINII PBI
DSDNQNLPHNYIKNC

SEQ ID NO: 154120 - protein, 15 aa, BORRELIA GARINII PBI
SDNQNLPHNYIKNCI

SEQ ID NO: 154121 - protein, 15 aa, BORRELIA GARINII PBI
DNQNLPHNYIKNCIV

SEQ ID NO: 154122 - protein, 15 aa, BORRELIA GARINII PBI
NQNLPHNYIKNCIVY

SEQ ID NO: 154123 - protein, 15 aa, BORRELIA GARINII PBI
QNLPHNYIKNCIVYT

SEQ ID NO: 154124 - protein, 15 aa, BORRELIA GARINII PBI
NLPHNYIKNCIVYTG

SEQ ID NO: 154125 - protein, 15 aa, BORRELIA GARINII PBI
LPHNYIKNCIVYTGI

SEQ ID NO: 154126 - protein, 15 aa, BORRELIA GARINII PBI
PHNYIKNCIVYTGIG

SEQ ID NO: 154127 - protein, 15 aa, BORRELIA GARINII PBI
HNYIKNCIVYTGIGD

SEQ ID NO: 154128 - protein, 15 aa, BORRELIA GARINII PBI
NYIKNCIVYTGIGDN

SEQ ID NO: 154129 - protein, 15 aa, BORRELIA GARINII PBI
YIKNCIVYTGIGDNS

SEQ ID NO: 154130 - protein, 15 aa, BORRELIA GARINII PBI
IKNCIVYTGIGDNST

SEQ ID NO: 154131 - protein, 15 aa, BORRELIA GARINII PBI
KNCIVYTGIGDNSTI

SEQ ID NO: 154132 - protein, 15 aa, BORRELIA GARINII PBI
NCIVYTGIGDNSTIR

SEQ ID NO: 154133 - protein, 15 aa, BORRELIA GARINII PBI
CIVYTGIGDNSTIRE

SEQ ID NO: 154134 - protein, 15 aa, BORRELIA GARINII PBI
IVYTGIGDNSTIREF

SEQ ID NO: 154135 - protein, 15 aa, BORRELIA GARINII PBI
VYTGIGDNSTIREFV

SEQ ID NO: 154136 - protein, 15 aa, BORRELIA GARINII PBI
YTGIGDNSTIREFVN

SEQ ID NO: 154137 - protein, 15 aa, BORRELIA GARINII PBI
TGIGDNSTIREFVNS

SEQ ID NO: 154138 - protein, 15 aa, BORRELIA GARINII PBI
GIGDNSTIREFVNSL

SEQ ID NO: 154139 - protein, 15 aa, BORRELIA GARINII PBI
IGDNSTIREFVNSLD

SEQ ID NO: 154140 - protein, 15 aa, BORRELIA GARINII PBI
GDNSTIREFVNSLDD

SEQ ID NO: 154141 - protein, 15 aa, BORRELIA GARINII PBI
DNSTIREFVNSLDDL

SEQ ID NO: 154142 - protein, 15 aa, BORRELIA GARINII PBI
NSTIREFVNSLDDLH

SEQ ID NO: 154143 - protein, 15 aa, BORRELIA GARINII PBI
STIREFVNSLDDLHK

SEQ ID NO: 154144 - protein, 15 aa, BORRELIA GARINII PBI
TIREFVNSLDDLHKK

SEQ ID NO: 154145 - protein, 15 aa, BORRELIA GARINII PBI
IREFVNSLDDLHKKY

SEQ ID NO: 154146 - protein, 15 aa, BORRELIA GARINII PBI
REFVNSLDDLHKKYI

SEQ ID NO: 154147 - protein, 15 aa, BORRELIA GARINII PBI
EFVNSLDDLHKKYIF

SEQ ID NO: 154148 - protein, 15 aa, BORRELIA GARINII PBI
FVNSLDDLHKKYIFD

SEQ ID NO: 154149 - protein, 15 aa, BORRELIA GARINII PBI
VNSLDDLHKKYIFDY

SEQ ID NO: 154150 - protein, 15 aa, BORRELIA GARINII PBI
NSLDDLHKKYIFDYL

SEQ ID NO: 154151 - protein, 15 aa, BORRELIA GARINII PBI
SLDDLHKKYIFDYLN

SEQ ID NO: 154152 - protein, 15 aa, BORRELIA GARINII PBI
LDDLHKKYIFDYLNT

SEQ ID NO: 154153 - protein, 15 aa, BORRELIA GARINII PBI
DDLHKKYIFDYLNTN

SEQ ID NO: 154154 - protein, 15 aa, BORRELIA GARINII PBI
DLHKKYIFDYLNTNE

SEQ ID NO: 154155 - protein, 15 aa, BORRELIA GARINII PBI
LHKKYIFDYLNTNED

SEQ ID NO: 154156 - protein, 15 aa, BORRELIA GARINII PBI
HKKYIFDYLNTNEDF

SEQ ID NO: 154157 - protein, 15 aa, BORRELIA GARINII PBI
KKYIFDYLNTNEDFV

SEQ ID NO: 154158 - protein, 15 aa, BORRELIA GARINII PBI
KYIFDYLNTNEDFVV

SEQ ID NO: 154159 - protein, 15 aa, BORRELIA GARINII PBI
YIFDYLNTNEDFVVW

SEQ ID NO: 154160 - protein, 15 aa, BORRELIA GARINII PBI
IFDYLNTNEDFVVWD

SEQ ID NO: 154161 - protein, 15 aa, BORRELIA GARINII PBI
FDYLNTNEDFVVWDM

SEQ ID NO: 154162 - protein, 15 aa, BORRELIA GARINII PBI
DYLNTNEDFVVWDMI

SEQ ID NO: 154163 - protein, 15 aa, BORRELIA GARINII PBI
YLNTNEDFVVWDMIR

SEQ ID NO: 154164 - protein, 15 aa, BORRELIA GARINII PBI
LNTNEDFVVWDMIRS

SEQ ID NO: 154165 - protein, 15 aa, BORRELIA GARINII PBI
NTNEDFVVWDMIRSA

SEQ ID NO: 154166 - protein, 15 aa, BORRELIA GARINII PBI
TNEDFVVWDMIRSAM

SEQ ID NO: 154167 - protein, 15 aa, BORRELIA GARINII PBI
NEDFVVWDMIRSAMS

SEQ ID NO: 154168 - protein, 15 aa, BORRELIA GARINII PBI
EDFVVWDMIRSAMSS

SEQ ID NO: 154169 - protein, 15 aa, BORRELIA GARINII PBI
DFVVWDMIRSAMSSV

SEQ ID NO: 154170 - protein, 15 aa, BORRELIA GARINII PBI
FVVWDMIRSAMSSVS

SEQ ID NO: 154171 - protein, 15 aa, BORRELIA GARINII PBI
VVWDMIRSAMSSVSD

SEQ ID NO: 154172 - protein, 15 aa, BORRELIA GARINII PBI
VWDMIRSAMSSVSDS

SEQ ID NO: 154173 - protein, 15 aa, BORRELIA GARINII PBI
WDMIRSAMSSVSDSV

SEQ ID NO: 154174 - protein, 15 aa, BORRELIA GARINII PBI
DMIRSAMSSVSDSVI

SEQ ID NO: 154175 - protein, 15 aa, BORRELIA GARINII PBI
MIRSAMSSVSDSVII

SEQ ID NO: 154176 - protein, 15 aa, BORRELIA GARINII PBI
IRSAMSSVSDSVIIP

SEQ ID NO: 154177 - protein, 15 aa, BORRELIA GARINII PBI
RSAMSSVSDSVIIPM

SEQ ID NO: 154178 - protein, 15 aa, BORRELIA GARINII PBI
SAMSSVSDSVIIPMQ

SEQ ID NO: 154179 - protein, 15 aa, BORRELIA GARINII PBI
AMSSVSDSVIIPMQD

SEQ ID NO: 154180 - protein, 15 aa, BORRELIA GARINII PBI
MSSVSDSVIIPMQDY

SEQ ID NO: 154181 - protein, 15 aa, BORRELIA GARINII PBI
SSVSDSVIIPMQDYI

SEQ ID NO: 154182 - protein, 15 aa, BORRELIA GARINII PBI
SVSDSVIIPMQDYIN

SEQ ID NO: 154183 - protein, 15 aa, BORRELIA GARINII PBI
VSDSVIIPMQDYINL

SEQ ID NO: 154184 - protein, 15 aa, BORRELIA GARINII PBI
SDSVIIPMQDYINLG

SEQ ID NO: 154185 - protein, 15 aa, BORRELIA GARINII PBI
DSVIIPMQDYINLGN

SEQ ID NO: 154186 - protein, 15 aa, BORRELIA GARINII PBI
SVIIPMQDYINLGNE

SEQ ID NO: 154187 - protein, 15 aa, BORRELIA GARINII PBI
VIIPMQDYINLGNEF

SEQ ID NO: 154188 - protein, 15 aa, BORRELIA GARINII PBI
IIPMQDYINLGNEFR

SEQ ID NO: 154189 - protein, 15 aa, BORRELIA GARINII PBI
IPMQDYINLGNEFRA

SEQ ID NO: 154190 - protein, 15 aa, BORRELIA GARINII PBI
PMQDYINLGNEFRAN

SEQ ID NO: 154191 - protein, 15 aa, BORRELIA GARINII PBI
MQDYINLGNEFRANI

SEQ ID NO: 154192 - protein, 15 aa, BORRELIA GARINII PBI
QDYINLGNEFRANIP

SEQ ID NO: 154193 - protein, 15 aa, BORRELIA GARINII PBI
DYINLGNEFRANIPK

SEQ ID NO: 154194 - protein, 15 aa, BORRELIA GARINII PBI
YINLGNEFRANIPKN

SEQ ID NO: 154195 - protein, 15 aa, BORRELIA GARINII PBI
INLGNEFRANIPKNT

SEQ ID NO: 154196 - protein, 15 aa, BORRELIA GARINII PBI
NLGNEFRANIPKNTL

SEQ ID NO: 154197 - protein, 15 aa, BORRELIA GARINII PBI
LGNEFRANIPKNTLN

SEQ ID NO: 154198 - protein, 15 aa, BORRELIA GARINII PBI
GNEFRANIPKNTLNN

SEQ ID NO: 154199 - protein, 15 aa, BORRELIA GARINII PBI
NEFRANIPKNTLNNW

SEQ ID NO: 154200 - protein, 15 aa, BORRELIA GARINII PBI
EFRANIPKNTLNNWI

SEQ ID NO: 154201 - protein, 15 aa, BORRELIA GARINII PBI
FRANIPKNTLNNWIF

SEQ ID NO: 154202 - protein, 15 aa, BORRELIA GARINII PBI
RANIPKNTLNNWIFR

SEQ ID NO: 154203 - protein, 15 aa, BORRELIA GARINII PBI
ANIPKNTLNNWIFRL

SEQ ID NO: 154204 - protein, 15 aa, BORRELIA GARINII PBI
NIPKNTLNNWIFRLL

SEQ ID NO: 154205 - protein, 15 aa, BORRELIA GARINII PBI
IPKNTLNNWIFRLLE

SEQ ID NO: 154206 - protein, 15 aa, BORRELIA GARINII PBI
PKNTLNNWIFRLLES

SEQ ID NO: 154207 - protein, 15 aa, BORRELIA GARINII PBI
KNTLNNWIFRLLESD

SEQ ID NO: 154208 - protein, 15 aa, BORRELIA GARINII PBI
NTLNNWIFRLLESDL

SEQ ID NO: 154209 - protein, 15 aa, BORRELIA GARINII PBI
TLNNWIFRLLESDLD

SEQ ID NO: 154210 - protein, 15 aa, BORRELIA GARINII PBI
LNNWIFRLLESDLDA

SEQ ID NO: 154211 - protein, 15 aa, BORRELIA GARINII PBI
NNWIFRLLESDLDAT

SEQ ID NO: 154212 - protein, 15 aa, BORRELIA GARINII PBI
NWIFRLLESDLDATL

SEQ ID NO: 154213 - protein, 15 aa, BORRELIA GARINII PBI
WIFRLLESDLDATLS

SEQ ID NO: 154214 - protein, 15 aa, BORRELIA GARINII PBI
IFRLLESDLDATLSK

SEQ ID NO: 154215 - protein, 15 aa, BORRELIA GARINII PBI
FRLLESDLDATLSKN

SEQ ID NO: 154216 - protein, 15 aa, BORRELIA GARINII PBI
RLLESDLDATLSKNI

SEQ ID NO: 154217 - protein, 15 aa, BORRELIA GARINII PBI
LLESDLDATLSKNIS

SEQ ID NO: 154218 - protein, 15 aa, BORRELIA GARINII PBI
LESDLDATLSKNISF

SEQ ID NO: 154219 - protein, 15 aa, BORRELIA GARINII PBI
ESDLDATLSKNISFI

SEQ ID NO: 154220 - protein, 15 aa, BORRELIA GARINII PBI
SDLDATLSKNISFIT

SEQ ID NO: 154221 - protein, 15 aa, BORRELIA GARINII PBI
DLDATLSKNISFITR

SEQ ID NO: 154222 - protein, 15 aa, BORRELIA GARINII PBI
LDATLSKNISFITRL

SEQ ID NO: 154223 - protein, 15 aa, BORRELIA GARINII PBI
DATLSKNISFITRLY

SEQ ID NO: 154224 - protein, 15 aa, BORRELIA GARINII PBI
ATLSKNISFITRLYG

SEQ ID NO: 154225 - protein, 15 aa, BORRELIA GARINII PBI
TLSKNISFITRLYGR

SEQ ID NO: 154226 - protein, 15 aa, BORRELIA GARINII PBI
LSKNISFITRLYGRT

SEQ ID NO: 154227 - protein, 16 aa, BORRELIA GARINII PBI
MKYKKIRINLNLKRKS

SEQ ID NO: 154228 - protein, 16 aa, BORRELIA GARINII PBI
KYKKIRINLNLKRKSG

SEQ ID NO: 154229 - protein, 16 aa, BORRELIA GARINII PBI
YKKIRINLNLKRKSGI

SEQ ID NO: 154230 - protein, 16 aa, BORRELIA GARINII PBI
KKIRINLNLKRKSGIL

SEQ ID NO: 154231 - protein, 16 aa, BORRELIA GARINII PBI
KIRINLNLKRKSGILL

SEQ ID NO: 154232 - protein, 16 aa, BORRELIA GARINII PBI
IRINLNLKRKSGILLN

SEQ ID NO: 154233 - protein, 16 aa, BORRELIA GARINII PBI
RINLNLKRKSGILLNI

SEQ ID NO: 154234 - protein, 16 aa, BORRELIA GARINII PBI
INLNLKRKSGILLNIS

SEQ ID NO: 154235 - protein, 16 aa, BORRELIA GARINII PBI
NLNLKRKSGILLNISS

SEQ ID NO: 154236 - protein, 16 aa, BORRELIA GARINII PBI
LNLKRKSGILLNISSL

SEQ ID NO: 154237 - protein, 16 aa, BORRELIA GARINII PBI
NLKRKSGILLNISSLP

SEQ ID NO: 154238 - protein, 16 aa, BORRELIA GARINII PBI
LKRKSGILLNISSLPS

SEQ ID NO: 154239 - protein, 16 aa, BORRELIA GARINII PBI
KRKSGILLNISSLPSK

SEQ ID NO: 154240 - protein, 16 aa, BORRELIA GARINII PBI
RKSGILLNISSLPSKY

SEQ ID NO: 154241 - protein, 16 aa, BORRELIA GARINII PBI
KSGILLNISSLPSKYG

SEQ ID NO: 154242 - protein, 16 aa, BORRELIA GARINII PBI
SGILLNISSLPSKYGI

SEQ ID NO: 154243 - protein, 16 aa, BORRELIA GARINII PBI
GILLNISSLPSKYGIG

SEQ ID NO: 154244 - protein, 16 aa, BORRELIA GARINII PBI
ILLNISSLPSKYGIGD

SEQ ID NO: 154245 - protein, 16 aa, BORRELIA GARINII PBI
LLNISSLPSKYGIGDL

SEQ ID NO: 154246 - protein, 16 aa, BORRELIA GARINII PBI
LNISSLPSKYGIGDLG

SEQ ID NO: 154247 - protein, 16 aa, BORRELIA GARINII PBI
NISSLPSKYGIGDLGK

SEQ ID NO: 154248 - protein, 16 aa, BORRELIA GARINII PBI
ISSLPSKYGIGDLGKG

SEQ ID NO: 154249 - protein, 16 aa, BORRELIA GARINII PBI
SSLPSKYGIGDLGKGA

SEQ ID NO: 154250 - protein, 16 aa, BORRELIA GARINII PBI
SLPSKYGIGDLGKGAY

SEQ ID NO: 154251 - protein, 16 aa, BORRELIA GARINII PBI
LPSKYGIGDLGKGAYK

SEQ ID NO: 154252 - protein, 16 aa, BORRELIA GARINII PBI
PSKYGIGDLGKGAYKF

SEQ ID NO: 154253 - protein, 16 aa, BORRELIA GARINII PBI
SKYGIGDLGKGAYKFI

SEQ ID NO: 154254 - protein, 16 aa, BORRELIA GARINII PBI
KYGIGDLGKGAYKFID

SEQ ID NO: 154255 - protein, 16 aa, BORRELIA GARINII PBI
YGIGDLGKGAYKFIDF

SEQ ID NO: 154256 - protein, 16 aa, BORRELIA GARINII PBI
GIGDLGKGAYKFIDFL

SEQ ID NO: 154257 - protein, 16 aa, BORRELIA GARINII PBI
IGDLGKGAYKFIDFLF

SEQ ID NO: 154258 - protein, 16 aa, BORRELIA GARINII PBI
GDLGKGAYKFIDFLFA

SEQ ID NO: 154259 - protein, 16 aa, BORRELIA GARINII PBI
DLGKGAYKFIDFLFAS

SEQ ID NO: 154260 - protein, 16 aa, BORRELIA GARINII PBI
LGKGAYKFIDFLFASS

SEQ ID NO: 154261 - protein, 16 aa, BORRELIA GARINII PBI
GKGAYKFIDFLFASSQ

SEQ ID NO: 154262 - protein, 16 aa, BORRELIA GARINII PBI
KGAYKFIDFLFASSQS

SEQ ID NO: 154263 - protein, 16 aa, BORRELIA GARINII PBI
GAYKFIDFLFASSQSY

SEQ ID NO: 154264 - protein, 16 aa, BORRELIA GARINII PBI
AYKFIDFLFASSQSYW

SEQ ID NO: 154265 - protein, 16 aa, BORRELIA GARINII PBI
YKFIDFLFASSQSYWQ

SEQ ID NO: 154266 - protein, 16 aa, BORRELIA GARINII PBI
KFIDFLFASSQSYWQM

SEQ ID NO: 154267 - protein, 16 aa, BORRELIA GARINII PBI
FIDFLFASSQSYWQMF

SEQ ID NO: 154268 - protein, 16 aa, BORRELIA GARINII PBI
IDFLFASSQSYWQMFA

SEQ ID NO: 154269 - protein, 16 aa, BORRELIA GARINII PBI
DFLFASSQSYWQMFAY

SEQ ID NO: 154270 - protein, 16 aa, BORRELIA GARINII PBI
FLFASSQSYWQMFAYS

SEQ ID NO: 154271 - protein, 16 aa, BORRELIA GARINII PBI
LFASSQSYWQMFAYSP

SEQ ID NO: 154272 - protein, 16 aa, BORRELIA GARINII PBI
FASSQSYWQMFAYSPI

SEQ ID NO: 154273 - protein, 16 aa, BORRELIA GARINII PBI
ASSQSYWQMFAYSPID

SEQ ID NO: 154274 - protein, 16 aa, BORRELIA GARINII PBI
SSQSYWQMFAYSPIDF

SEQ ID NO: 154275 - protein, 16 aa, BORRELIA GARINII PBI
SQSYWQMFAYSPIDFT

SEQ ID NO: 154276 - protein, 16 aa, BORRELIA GARINII PBI
QSYWQMFAYSPIDFTR

SEQ ID NO: 154277 - protein, 16 aa, BORRELIA GARINII PBI
SYWQMFAYSPIDFTRS

SEQ ID NO: 154278 - protein, 16 aa, BORRELIA GARINII PBI
YWQMFAYSPIDFTRSP

SEQ ID NO: 154279 - protein, 16 aa, BORRELIA GARINII PBI
WQMFAYSPIDFTRSPP

SEQ ID NO: 154280 - protein, 16 aa, BORRELIA GARINII PBI
QMFAYSPIDFTRSPPY

SEQ ID NO: 154281 - protein, 16 aa, BORRELIA GARINII PBI
MFAYSPIDFTRSPPYS

SEQ ID NO: 154282 - protein, 16 aa, BORRELIA GARINII PBI
FAYSPIDFTRSPPYSI

SEQ ID NO: 154283 - protein, 16 aa, BORRELIA GARINII PBI
AYSPIDFTRSPPYSIF

SEQ ID NO: 154284 - protein, 16 aa, BORRELIA GARINII PBI
YSPIDFTRSPPYSIFS

SEQ ID NO: 154285 - protein, 16 aa, BORRELIA GARINII PBI
SPIDFTRSPPYSIFSA

SEQ ID NO: 154286 - protein, 16 aa, BORRELIA GARINII PBI
PIDFTRSPPYSIFSAF

SEQ ID NO: 154287 - protein, 16 aa, BORRELIA GARINII PBI
IDFTRSPPYSIFSAFA

SEQ ID NO: 154288 - protein, 16 aa, BORRELIA GARINII PBI
DFTRSPPYSIFSAFAG

SEQ ID NO: 154289 - protein, 16 aa, BORRELIA GARINII PBI
FTRSPPYSIFSAFAGN

SEQ ID NO: 154290 - protein, 16 aa, BORRELIA GARINII PBI
TRSPPYSIFSAFAGNV

SEQ ID NO: 154291 - protein, 16 aa, BORRELIA GARINII PBI
RSPPYSIFSAFAGNVY

SEQ ID NO: 154292 - protein, 16 aa, BORRELIA GARINII PBI
SPPYSIFSAFAGNVYY

SEQ ID NO: 154293 - protein, 16 aa, BORRELIA GARINII PBI
PPYSIFSAFAGNVYYI

SEQ ID NO: 154294 - protein, 16 aa, BORRELIA GARINII PBI
PYSIFSAFAGNVYYID

SEQ ID NO: 154295 - protein, 16 aa, BORRELIA GARINII PBI
YSIFSAFAGNVYYIDL

SEQ ID NO: 154296 - protein, 16 aa, BORRELIA GARINII PBI
SIFSAFAGNVYYIDLE

SEQ ID NO: 154297 - protein, 16 aa, BORRELIA GARINII PBI
IFSAFAGNVYYIDLEA

SEQ ID NO: 154298 - protein, 16 aa, BORRELIA GARINII PBI
FSAFAGNVYYIDLEAL

SEQ ID NO: 154299 - protein, 16 aa, BORRELIA GARINII PBI
SAFAGNVYYIDLEALD

SEQ ID NO: 154300 - protein, 16 aa, BORRELIA GARINII PBI
AFAGNVYYIDLEALDK

SEQ ID NO: 154301 - protein, 16 aa, BORRELIA GARINII PBI
FAGNVYYIDLEALDKF

SEQ ID NO: 154302 - protein, 16 aa, BORRELIA GARINII PBI
AGNVYYIDLEALDKFI

SEQ ID NO: 154303 - protein, 16 aa, BORRELIA GARINII PBI
GNVYYIDLEALDKFID

SEQ ID NO: 154304 - protein, 16 aa, BORRELIA GARINII PBI
NVYYIDLEALDKFIDS

SEQ ID NO: 154305 - protein, 16 aa, BORRELIA GARINII PBI
VYYIDLEALDKFIDSD

SEQ ID NO: 154306 - protein, 16 aa, BORRELIA GARINII PBI
YYIDLEALDKFIDSDL

SEQ ID NO: 154307 - protein, 16 aa, BORRELIA GARINII PBI
YIDLEALDKFIDSDLN

SEQ ID NO: 154308 - protein, 16 aa, BORRELIA GARINII PBI
IDLEALDKFIDSDLNL

SEQ ID NO: 154309 - protein, 16 aa, BORRELIA GARINII PBI
DLEALDKFIDSDLNLL

SEQ ID NO: 154310 - protein, 16 aa, BORRELIA GARINII PBI
LEALDKFIDSDLNLLK

SEQ ID NO: 154311 - protein, 16 aa, BORRELIA GARINII PBI
EALDKFIDSDLNLLKE

SEQ ID NO: 154312 - protein, 16 aa, BORRELIA GARINII PBI
ALDKFIDSDLNLLKEN

SEQ ID NO: 154313 - protein, 16 aa, BORRELIA GARINII PBI
LDKFIDSDLNLLKENE

SEQ ID NO: 154314 - protein, 16 aa, BORRELIA GARINII PBI
DKFIDSDLNLLKENET

SEQ ID NO: 154315 - protein, 16 aa, BORRELIA GARINII PBI
KFIDSDLNLLKENETR

SEQ ID NO: 154316 - protein, 16 aa, BORRELIA GARINII PBI
FIDSDLNLLKENETRY

SEQ ID NO: 154317 - protein, 16 aa, BORRELIA GARINII PBI
IDSDLNLLKENETRYS

SEQ ID NO: 154318 - protein, 16 aa, BORRELIA GARINII PBI
DSDLNLLKENETRYSD

SEQ ID NO: 154319 - protein, 16 aa, BORRELIA GARINII PBI
SDLNLLKENETRYSDL

SEQ ID NO: 154320 - protein, 16 aa, BORRELIA GARINII PBI
DLNLLKENETRYSDLK

SEQ ID NO: 154321 - protein, 16 aa, BORRELIA GARINII PBI
LNLLKENETRYSDLKK

SEQ ID NO: 154322 - protein, 16 aa, BORRELIA GARINII PBI
NLLKENETRYSDLKKL

SEQ ID NO: 154323 - protein, 16 aa, BORRELIA GARINII PBI
LLKENETRYSDLKKLS

SEQ ID NO: 154324 - protein, 16 aa, BORRELIA GARINII PBI
LKENETRYSDLKKLSF

SEQ ID NO: 154325 - protein, 16 aa, BORRELIA GARINII PBI
KENETRYSDLKKLSFK

SEQ ID NO: 154326 - protein, 16 aa, BORRELIA GARINII PBI
ENETRYSDLKKLSFKD

SEQ ID NO: 154327 - protein, 16 aa, BORRELIA GARINII PBI
NETRYSDLKKLSFKDK

SEQ ID NO: 154328 - protein, 16 aa, BORRELIA GARINII PBI
ETRYSDLKKLSFKDKF

SEQ ID NO: 154329 - protein, 16 aa, BORRELIA GARINII PBI
TRYSDLKKLSFKDKFL

SEQ ID NO: 154330 - protein, 16 aa, BORRELIA GARINII PBI
RYSDLKKLSFKDKFLK

SEQ ID NO: 154331 - protein, 16 aa, BORRELIA GARINII PBI
YSDLKKLSFKDKFLKE

SEQ ID NO: 154332 - protein, 16 aa, BORRELIA GARINII PBI
SDLKKLSFKDKFLKEA

SEQ ID NO: 154333 - protein, 16 aa, BORRELIA GARINII PBI
DLKKLSFKDKFLKEAA

SEQ ID NO: 154334 - protein, 16 aa, BORRELIA GARINII PBI
LKKLSFKDKFLKEAAL

SEQ ID NO: 154335 - protein, 16 aa, BORRELIA GARINII PBI
KKLSFKDKFLKEAALN

SEQ ID NO: 154336 - protein, 16 aa, BORRELIA GARINII PBI
KLSFKDKFLKEAALNF

SEQ ID NO: 154337 - protein, 16 aa, BORRELIA GARINII PBI
LSFKDKFLKEAALNFI

SEQ ID NO: 154338 - protein, 16 aa, BORRELIA GARINII PBI
SFKDKFLKEAALNFIN

SEQ ID NO: 154339 - protein, 16 aa, BORRELIA GARINII PBI
FKDKFLKEAALNFINR

SEQ ID NO: 154340 - protein, 16 aa, BORRELIA GARINII PBI
KDKFLKEAALNFINRA

SEQ ID NO: 154341 - protein, 16 aa, BORRELIA GARINII PBI
DKFLKEAALNFINRAS

SEQ ID NO: 154342 - protein, 16 aa, BORRELIA GARINII PBI
KFLKEAALNFINRASV

SEQ ID NO: 154343 - protein, 16 aa, BORRELIA GARINII PBI
FLKEAALNFINRASVD

SEQ ID NO: 154344 - protein, 16 aa, BORRELIA GARINII PBI
LKEAALNFINRASVDE

SEQ ID NO: 154345 - protein, 16 aa, BORRELIA GARINII PBI
KEAALNFINRASVDEV

SEQ ID NO: 154346 - protein, 16 aa, BORRELIA GARINII PBI
EAALNFINRASVDEVR

SEQ ID NO: 154347 - protein, 16 aa, BORRELIA GARINII PBI
AALNFINRASVDEVRS

SEQ ID NO: 154348 - protein, 16 aa, BORRELIA GARINII PBI
ALNFINRASVDEVRSF

SEQ ID NO: 154349 - protein, 16 aa, BORRELIA GARINII PBI
LNFINRASVDEVRSFE

SEQ ID NO: 154350 - protein, 16 aa, BORRELIA GARINII PBI
NFINRASVDEVRSFEK

SEQ ID NO: 154351 - protein, 16 aa, BORRELIA GARINII PBI
FINRASVDEVRSFEKF

SEQ ID NO: 154352 - protein, 16 aa, BORRELIA GARINII PBI
INRASVDEVRSFEKFK

SEQ ID NO: 154353 - protein, 16 aa, BORRELIA GARINII PBI
NRASVDEVRSFEKFKK

SEQ ID NO: 154354 - protein, 16 aa, BORRELIA GARINII PBI
RASVDEVRSFEKFKKK

SEQ ID NO: 154355 - protein, 16 aa, BORRELIA GARINII PBI
ASVDEVRSFEKFKKKS

SEQ ID NO: 154356 - protein, 16 aa, BORRELIA GARINII PBI
SVDEVRSFEKFKKKSS

SEQ ID NO: 154357 - protein, 16 aa, BORRELIA GARINII PBI
VDEVRSFEKFKKKSSY

SEQ ID NO: 154358 - protein, 16 aa, BORRELIA GARINII PBI
DEVRSFEKFKKKSSYW

SEQ ID NO: 154359 - protein, 16 aa, BORRELIA GARINII PBI
EVRSFEKFKKKSSYWL

SEQ ID NO: 154360 - protein, 16 aa, BORRELIA GARINII PBI
VRSFEKFKKKSSYWLL

SEQ ID NO: 154361 - protein, 16 aa, BORRELIA GARINII PBI
RSFEKFKKKSSYWLLD

SEQ ID NO: 154362 - protein, 16 aa, BORRELIA GARINII PBI
SFEKFKKKSSYWLLDF

SEQ ID NO: 154363 - protein, 16 aa, BORRELIA GARINII PBI
FEKFKKKSSYWLLDFA

SEQ ID NO: 154364 - protein, 16 aa, BORRELIA GARINII PBI
EKFKKKSSYWLLDFAS

SEQ ID NO: 154365 - protein, 16 aa, BORRELIA GARINII PBI
KFKKKSSYWLLDFASF

SEQ ID NO: 154366 - protein, 16 aa, BORRELIA GARINII PBI
FKKKSSYWLLDFASFV

SEQ ID NO: 154367 - protein, 16 aa, BORRELIA GARINII PBI
KKKSSYWLLDFASFVA

SEQ ID NO: 154368 - protein, 16 aa, BORRELIA GARINII PBI
KKSSYWLLDFASFVAF

SEQ ID NO: 154369 - protein, 16 aa, BORRELIA GARINII PBI
KSSYWLLDFASFVAFK

SEQ ID NO: 154370 - protein, 16 aa, BORRELIA GARINII PBI
SSYWLLDFASFVAFKE

SEQ ID NO: 154371 - protein, 16 aa, BORRELIA GARINII PBI
SYWLLDFASFVAFKEY

SEQ ID NO: 154372 - protein, 16 aa, BORRELIA GARINII PBI
YWLLDFASFVAFKEYF

SEQ ID NO: 154373 - protein, 16 aa, BORRELIA GARINII PBI
WLLDFASFVAFKEYFL

SEQ ID NO: 154374 - protein, 16 aa, BORRELIA GARINII PBI
LLDFASFVAFKEYFLK

SEQ ID NO: 154375 - protein, 16 aa, BORRELIA GARINII PBI
LDFASFVAFKEYFLKD

SEQ ID NO: 154376 - protein, 16 aa, BORRELIA GARINII PBI
DFASFVAFKEYFLKDS

SEQ ID NO: 154377 - protein, 16 aa, BORRELIA GARINII PBI
FASFVAFKEYFLKDSR

SEQ ID NO: 154378 - protein, 16 aa, BORRELIA GARINII PBI
ASFVAFKEYFLKDSRD

SEQ ID NO: 154379 - protein, 16 aa, BORRELIA GARINII PBI
SFVAFKEYFLKDSRDA

SEQ ID NO: 154380 - protein, 16 aa, BORRELIA GARINII PBI
FVAFKEYFLKDSRDAF

SEQ ID NO: 154381 - protein, 16 aa, BORRELIA GARINII PBI
VAFKEYFLKDSRDAFN

SEQ ID NO: 154382 - protein, 16 aa, BORRELIA GARINII PBI
AFKEYFLKDSRDAFNV

SEQ ID NO: 154383 - protein, 16 aa, BORRELIA GARINII PBI
FKEYFLKDSRDAFNVL

SEQ ID NO: 154384 - protein, 16 aa, BORRELIA GARINII PBI
KEYFLKDSRDAFNVLF

SEQ ID NO: 154385 - protein, 16 aa, BORRELIA GARINII PBI
EYFLKDSRDAFNVLFD

SEQ ID NO: 154386 - protein, 16 aa, BORRELIA GARINII PBI
YFLKDSRDAFNVLFDR

SEQ ID NO: 154387 - protein, 16 aa, BORRELIA GARINII PBI
FLKDSRDAFNVLFDRG

SEQ ID NO: 154388 - protein, 16 aa, BORRELIA GARINII PBI
LKDSRDAFNVLFDRGI

SEQ ID NO: 154389 - protein, 16 aa, BORRELIA GARINII PBI
KDSRDAFNVLFDRGIL

SEQ ID NO: 154390 - protein, 16 aa, BORRELIA GARINII PBI
DSRDAFNVLFDRGILI

SEQ ID NO: 154391 - protein, 16 aa, BORRELIA GARINII PBI
SRDAFNVLFDRGILIR

SEQ ID NO: 154392 - protein, 16 aa, BORRELIA GARINII PBI
RDAFNVLFDRGILIRN

SEQ ID NO: 154393 - protein, 16 aa, BORRELIA GARINII PBI
DAFNVLFDRGILIRNE

SEQ ID NO: 154394 - protein, 16 aa, BORRELIA GARINII PBI
AFNVLFDRGILIRNEK

SEQ ID NO: 154395 - protein, 16 aa, BORRELIA GARINII PBI
FNVLFDRGILIRNEKD

SEQ ID NO: 154396 - protein, 16 aa, BORRELIA GARINII PBI
NVLFDRGILIRNEKDL

SEQ ID NO: 154397 - protein, 16 aa, BORRELIA GARINII PBI
VLFDRGILIRNEKDLF

SEQ ID NO: 154398 - protein, 16 aa, BORRELIA GARINII PBI
LFDRGILIRNEKDLFK

SEQ ID NO: 154399 - protein, 16 aa, BORRELIA GARINII PBI
FDRGILIRNEKDLFKL

SEQ ID NO: 154400 - protein, 16 aa, BORRELIA GARINII PBI
DRGILIRNEKDLFKLR

SEQ ID NO: 154401 - protein, 16 aa, BORRELIA GARINII PBI
RGILIRNEKDLFKLRN

SEQ ID NO: 154402 - protein, 16 aa, BORRELIA GARINII PBI
GILIRNEKDLFKLRNI

SEQ ID NO: 154403 - protein, 16 aa, BORRELIA GARINII PBI
ILIRNEKDLFKLRNIL

SEQ ID NO: 154404 - protein, 16 aa, BORRELIA GARINII PBI
LIRNEKDLFKLRNILS

SEQ ID NO: 154405 - protein, 16 aa, BORRELIA GARINII PBI
IRNEKDLFKLRNILSK

SEQ ID NO: 154406 - protein, 16 aa, BORRELIA GARINII PBI
RNEKDLFKLRNILSKE

SEQ ID NO: 154407 - protein, 16 aa, BORRELIA GARINII PBI
NEKDLFKLRNILSKEI

SEQ ID NO: 154408 - protein, 16 aa, BORRELIA GARINII PBI
EKDLFKLRNILSKEIK

SEQ ID NO: 154409 - protein, 16 aa, BORRELIA GARINII PBI
KDLFKLRNILSKEIKV

SEQ ID NO: 154410 - protein, 16 aa, BORRELIA GARINII PBI
DLFKLRNILSKEIKVQ

SEQ ID NO: 154411 - protein, 16 aa, BORRELIA GARINII PBI
LFKLRNILSKEIKVQE

SEQ ID NO: 154412 - protein, 16 aa, BORRELIA GARINII PBI
FKLRNILSKEIKVQEV

SEQ ID NO: 154413 - protein, 16 aa, BORRELIA GARINII PBI
KLRNILSKEIKVQEVL

SEQ ID NO: 154414 - protein, 16 aa, BORRELIA GARINII PBI
LRNILSKEIKVQEVLQ

SEQ ID NO: 154415 - protein, 16 aa, BORRELIA GARINII PBI
RNILSKEIKVQEVLQY

SEQ ID NO: 154416 - protein, 16 aa, BORRELIA GARINII PBI
NILSKEIKVQEVLQYF

SEQ ID NO: 154417 - protein, 16 aa, BORRELIA GARINII PBI
ILSKEIKVQEVLQYFF

SEQ ID NO: 154418 - protein, 16 aa, BORRELIA GARINII PBI
LSKEIKVQEVLQYFFF

SEQ ID NO: 154419 - protein, 16 aa, BORRELIA GARINII PBI
SKEIKVQEVLQYFFFS

SEQ ID NO: 154420 - protein, 16 aa, BORRELIA GARINII PBI
KEIKVQEVLQYFFFSQ

SEQ ID NO: 154421 - protein, 16 aa, BORRELIA GARINII PBI
EIKVQEVLQYFFFSQF

SEQ ID NO: 154422 - protein, 16 aa, BORRELIA GARINII PBI
IKVQEVLQYFFFSQFQ

SEQ ID NO: 154423 - protein, 16 aa, BORRELIA GARINII PBI
KVQEVLQYFFFSQFQA

SEQ ID NO: 154424 - protein, 16 aa, BORRELIA GARINII PBI
VQEVLQYFFFSQFQAL

SEQ ID NO: 154425 - protein, 16 aa, BORRELIA GARINII PBI
QEVLQYFFFSQFQALK

SEQ ID NO: 154426 - protein, 16 aa, BORRELIA GARINII PBI
EVLQYFFFSQFQALKR

SEQ ID NO: 154427 - protein, 16 aa, BORRELIA GARINII PBI
VLQYFFFSQFQALKRY

SEQ ID NO: 154428 - protein, 16 aa, BORRELIA GARINII PBI
LQYFFFSQFQALKRYA

SEQ ID NO: 154429 - protein, 16 aa, BORRELIA GARINII PBI
QYFFFSQFQALKRYAN

SEQ ID NO: 154430 - protein, 16 aa, BORRELIA GARINII PBI
YFFFSQFQALKRYAND

SEQ ID NO: 154431 - protein, 16 aa, BORRELIA GARINII PBI
FFFSQFQALKRYANDK

SEQ ID NO: 154432 - protein, 16 aa, BORRELIA GARINII PBI
FFSQFQALKRYANDKG

SEQ ID NO: 154433 - protein, 16 aa, BORRELIA GARINII PBI
FSQFQALKRYANDKGI

SEQ ID NO: 154434 - protein, 16 aa, BORRELIA GARINII PBI
SQFQALKRYANDKGIE

SEQ ID NO: 154435 - protein, 16 aa, BORRELIA GARINII PBI
QFQALKRYANDKGIEL

SEQ ID NO: 154436 - protein, 16 aa, BORRELIA GARINII PBI
FQALKRYANDKGIELV

SEQ ID NO: 154437 - protein, 16 aa, BORRELIA GARINII PBI
QALKRYANDKGIELVM

SEQ ID NO: 154438 - protein, 16 aa, BORRELIA GARINII PBI
ALKRYANDKGIELVMN

SEQ ID NO: 154439 - protein, 16 aa, BORRELIA GARINII PBI
LKRYANDKGIELVMNL

SEQ ID NO: 154440 - protein, 16 aa, BORRELIA GARINII PBI
KRYANDKGIELVMNLP

SEQ ID NO: 154441 - protein, 16 aa, BORRELIA GARINII PBI
RYANDKGIELVMNLPL

SEQ ID NO: 154442 - protein, 16 aa, BORRELIA GARINII PBI
YANDKGIELVMNLPLF

SEQ ID NO: 154443 - protein, 16 aa, BORRELIA GARINII PBI
ANDKGIELVMNLPLFI

SEQ ID NO: 154444 - protein, 16 aa, BORRELIA GARINII PBI
NDKGIELVMNLPLFIA

SEQ ID NO: 154445 - protein, 16 aa, BORRELIA GARINII PBI
DKGIELVMNLPLFIAY

SEQ ID NO: 154446 - protein, 16 aa, BORRELIA GARINII PBI
KGIELVMNLPLFIAYD

SEQ ID NO: 154447 - protein, 16 aa, BORRELIA GARINII PBI
GIELVMNLPLFIAYDS

SEQ ID NO: 154448 - protein, 16 aa, BORRELIA GARINII PBI
IELVMNLPLFIAYDSA

SEQ ID NO: 154449 - protein, 16 aa, BORRELIA GARINII PBI
ELVMNLPLFIAYDSAD

SEQ ID NO: 154450 - protein, 16 aa, BORRELIA GARINII PBI
LVMNLPLFIAYDSADV

SEQ ID NO: 154451 - protein, 16 aa, BORRELIA GARINII PBI
VMNLPLFIAYDSADVW

SEQ ID NO: 154452 - protein, 16 aa, BORRELIA GARINII PBI
MNLPLFIAYDSADVWA

SEQ ID NO: 154453 - protein, 16 aa, BORRELIA GARINII PBI
NLPLFIAYDSADVWAH

SEQ ID NO: 154454 - protein, 16 aa, BORRELIA GARINII PBI
LPLFIAYDSADVWAHQ

SEQ ID NO: 154455 - protein, 16 aa, BORRELIA GARINII PBI
PLFIAYDSADVWAHQK

SEQ ID NO: 154456 - protein, 16 aa, BORRELIA GARINII PBI
LFIAYDSADVWAHQKY

SEQ ID NO: 154457 - protein, 16 aa, BORRELIA GARINII PBI
FIAYDSADVWAHQKYF

SEQ ID NO: 154458 - protein, 16 aa, BORRELIA GARINII PBI
IAYDSADVWAHQKYFK

SEQ ID NO: 154459 - protein, 16 aa, BORRELIA GARINII PBI
AYDSADVWAHQKYFKL

SEQ ID NO: 154460 - protein, 16 aa, BORRELIA GARINII PBI
YDSADVWAHQKYFKLR

SEQ ID NO: 154461 - protein, 16 aa, BORRELIA GARINII PBI
DSADVWAHQKYFKLRF

SEQ ID NO: 154462 - protein, 16 aa, BORRELIA GARINII PBI
SADVWAHQKYFKLRFD

SEQ ID NO: 154463 - protein, 16 aa, BORRELIA GARINII PBI
ADVWAHQKYFKLRFDA

SEQ ID NO: 154464 - protein, 16 aa, BORRELIA GARINII PBI
DVWAHQKYFKLRFDAS

SEQ ID NO: 154465 - protein, 16 aa, BORRELIA GARINII PBI
VWAHQKYFKLRFDASK

SEQ ID NO: 154466 - protein, 16 aa, BORRELIA GARINII PBI
WAHQKYFKLRFDASKD

SEQ ID NO: 154467 - protein, 16 aa, BORRELIA GARINII PBI
AHQKYFKLRFDASKDK

SEQ ID NO: 154468 - protein, 16 aa, BORRELIA GARINII PBI
HQKYFKLRFDASKDKV

SEQ ID NO: 154469 - protein, 16 aa, BORRELIA GARINII PBI
QKYFKLRFDASKDKVA

SEQ ID NO: 154470 - protein, 16 aa, BORRELIA GARINII PBI
KYFKLRFDASKDKVAG

SEQ ID NO: 154471 - protein, 16 aa, BORRELIA GARINII PBI
YFKLRFDASKDKVAGI

SEQ ID NO: 154472 - protein, 16 aa, BORRELIA GARINII PBI
FKLRFDASKDKVAGIS

SEQ ID NO: 154473 - protein, 16 aa, BORRELIA GARINII PBI
KLRFDASKDKVAGISP

SEQ ID NO: 154474 - protein, 16 aa, BORRELIA GARINII PBI
LRFDASKDKVAGISPD

SEQ ID NO: 154475 - protein, 16 aa, BORRELIA GARINII PBI
RFDASKDKVAGISPDY

SEQ ID NO: 154476 - protein, 16 aa, BORRELIA GARINII PBI
FDASKDKVAGISPDYF

SEQ ID NO: 154477 - protein, 16 aa, BORRELIA GARINII PBI
DASKDKVAGISPDYFL

SEQ ID NO: 154478 - protein, 16 aa, BORRELIA GARINII PBI
ASKDKVAGISPDYFLE

SEQ ID NO: 154479 - protein, 16 aa, BORRELIA GARINII PBI
SKDKVAGISPDYFLEQ

SEQ ID NO: 154480 - protein, 16 aa, BORRELIA GARINII PBI
KDKVAGISPDYFLEQE

SEQ ID NO: 154481 - protein, 16 aa, BORRELIA GARINII PBI
DKVAGISPDYFLEQEQ

SEQ ID NO: 154482 - protein, 16 aa, BORRELIA GARINII PBI
KVAGISPDYFLEQEQA

SEQ ID NO: 154483 - protein, 16 aa, BORRELIA GARINII PBI
VAGISPDYFLEQEQAW

SEQ ID NO: 154484 - protein, 16 aa, BORRELIA GARINII PBI
AGISPDYFLEQEQAWD

SEQ ID NO: 154485 - protein, 16 aa, BORRELIA GARINII PBI
GISPDYFLEQEQAWDS

SEQ ID NO: 154486 - protein, 16 aa, BORRELIA GARINII PBI
ISPDYFLEQEQAWDSP

SEQ ID NO: 154487 - protein, 16 aa, BORRELIA GARINII PBI
SPDYFLEQEQAWDSPA

SEQ ID NO: 154488 - protein, 16 aa, BORRELIA GARINII PBI
PDYFLEQEQAWDSPAY

SEQ ID NO: 154489 - protein, 16 aa, BORRELIA GARINII PBI
DYFLEQEQAWDSPAYS

SEQ ID NO: 154490 - protein, 16 aa, BORRELIA GARINII PBI
YFLEQEQAWDSPAYSW

SEQ ID NO: 154491 - protein, 16 aa, BORRELIA GARINII PBI
FLEQEQAWDSPAYSWN

SEQ ID NO: 154492 - protein, 16 aa, BORRELIA GARINII PBI
LEQEQAWDSPAYSWNV

SEQ ID NO: 154493 - protein, 16 aa, BORRELIA GARINII PBI
EQEQAWDSPAYSWNVL

SEQ ID NO: 154494 - protein, 16 aa, BORRELIA GARINII PBI
QEQAWDSPAYSWNVLK

SEQ ID NO: 154495 - protein, 16 aa, BORRELIA GARINII PBI
EQAWDSPAYSWNVLKN

SEQ ID NO: 154496 - protein, 16 aa, BORRELIA GARINII PBI
QAWDSPAYSWNVLKNV

SEQ ID NO: 154497 - protein, 16 aa, BORRELIA GARINII PBI
AWDSPAYSWNVLKNVK

SEQ ID NO: 154498 - protein, 16 aa, BORRELIA GARINII PBI
WDSPAYSWNVLKNVKY

SEQ ID NO: 154499 - protein, 16 aa, BORRELIA GARINII PBI
DSPAYSWNVLKNVKYE

SEQ ID NO: 154500 - protein, 16 aa, BORRELIA GARINII PBI
SPAYSWNVLKNVKYEW

SEQ ID NO: 154501 - protein, 16 aa, BORRELIA GARINII PBI
PAYSWNVLKNVKYEWW

SEQ ID NO: 154502 - protein, 16 aa, BORRELIA GARINII PBI
AYSWNVLKNVKYEWWA

SEQ ID NO: 154503 - protein, 16 aa, BORRELIA GARINII PBI
YSWNVLKNVKYEWWAK

SEQ ID NO: 154504 - protein, 16 aa, BORRELIA GARINII PBI
SWNVLKNVKYEWWAKR

SEQ ID NO: 154505 - protein, 16 aa, BORRELIA GARINII PBI
WNVLKNVKYEWWAKRI

SEQ ID NO: 154506 - protein, 16 aa, BORRELIA GARINII PBI
NVLKNVKYEWWAKRIG

SEQ ID NO: 154507 - protein, 16 aa, BORRELIA GARINII PBI
VLKNVKYEWWAKRIGI

SEQ ID NO: 154508 - protein, 16 aa, BORRELIA GARINII PBI
LKNVKYEWWAKRIGIL

SEQ ID NO: 154509 - protein, 16 aa, BORRELIA GARINII PBI
KNVKYEWWAKRIGILR

SEQ ID NO: 154510 - protein, 16 aa, BORRELIA GARINII PBI
NVKYEWWAKRIGILRK

SEQ ID NO: 154511 - protein, 16 aa, BORRELIA GARINII PBI
VKYEWWAKRIGILRKY

SEQ ID NO: 154512 - protein, 16 aa, BORRELIA GARINII PBI
KYEWWAKRIGILRKYI

SEQ ID NO: 154513 - protein, 16 aa, BORRELIA GARINII PBI
YEWWAKRIGILRKYID

SEQ ID NO: 154514 - protein, 16 aa, BORRELIA GARINII PBI
EWWAKRIGILRKYIDV

SEQ ID NO: 154515 - protein, 16 aa, BORRELIA GARINII PBI
WWAKRIGILRKYIDVI

SEQ ID NO: 154516 - protein, 16 aa, BORRELIA GARINII PBI
WAKRIGILRKYIDVIK

SEQ ID NO: 154517 - protein, 16 aa, BORRELIA GARINII PBI
AKRIGILRKYIDVIKI

SEQ ID NO: 154518 - protein, 16 aa, BORRELIA GARINII PBI
KRIGILRKYIDVIKID

SEQ ID NO: 154519 - protein, 16 aa, BORRELIA GARINII PBI
RIGILRKYIDVIKIDH

SEQ ID NO: 154520 - protein, 16 aa, BORRELIA GARINII PBI
IGILRKYIDVIKIDHF

SEQ ID NO: 154521 - protein, 16 aa, BORRELIA GARINII PBI
GILRKYIDVIKIDHFR

SEQ ID NO: 154522 - protein, 16 aa, BORRELIA GARINII PBI
ILRKYIDVIKIDHFRG

SEQ ID NO: 154523 - protein, 16 aa, BORRELIA GARINII PBI
LRKYIDVIKIDHFRGF

SEQ ID NO: 154524 - protein, 16 aa, BORRELIA GARINII PBI
RKYIDVIKIDHFRGFV

SEQ ID NO: 154525 - protein, 16 aa, BORRELIA GARINII PBI
KYIDVIKIDHFRGFVS

SEQ ID NO: 154526 - protein, 16 aa, BORRELIA GARINII PBI
YIDVIKIDHFRGFVST

SEQ ID NO: 154527 - protein, 16 aa, BORRELIA GARINII PBI
IDVIKIDHFRGFVSTW

SEQ ID NO: 154528 - protein, 16 aa, BORRELIA GARINII PBI
DVIKIDHFRGFVSTWE

SEQ ID NO: 154529 - protein, 16 aa, BORRELIA GARINII PBI
VIKIDHFRGFVSTWEV

SEQ ID NO: 154530 - protein, 16 aa, BORRELIA GARINII PBI
IKIDHFRGFVSTWEVG

SEQ ID NO: 154531 - protein, 16 aa, BORRELIA GARINII PBI
KIDHFRGFVSTWEVGV

SEQ ID NO: 154532 - protein, 16 aa, BORRELIA GARINII PBI
IDHFRGFVSTWEVGVG

SEQ ID NO: 154533 - protein, 16 aa, BORRELIA GARINII PBI
DHFRGFVSTWEVGVGE

SEQ ID NO: 154534 - protein, 16 aa, BORRELIA GARINII PBI
HFRGFVSTWEVGVGEA

SEQ ID NO: 154535 - protein, 16 aa, BORRELIA GARINII PBI
FRGFVSTWEVGVGEAY

SEQ ID NO: 154536 - protein, 16 aa, BORRELIA GARINII PBI
RGFVSTWEVGVGEAYA

SEQ ID NO: 154537 - protein, 16 aa, BORRELIA GARINII PBI
GFVSTWEVGVGEAYAF

SEQ ID NO: 154538 - protein, 16 aa, BORRELIA GARINII PBI
FVSTWEVGVGEAYAFN

SEQ ID NO: 154539 - protein, 16 aa, BORRELIA GARINII PBI
VSTWEVGVGEAYAFNG

SEQ ID NO: 154540 - protein, 16 aa, BORRELIA GARINII PBI
STWEVGVGEAYAFNGL

SEQ ID NO: 154541 - protein, 16 aa, BORRELIA GARINII PBI
TWEVGVGEAYAFNGLW

SEQ ID NO: 154542 - protein, 16 aa, BORRELIA GARINII PBI
WEVGVGEAYAFNGLWV

SEQ ID NO: 154543 - protein, 16 aa, BORRELIA GARINII PBI
EVGVGEAYAFNGLWVK

SEQ ID NO: 154544 - protein, 16 aa, BORRELIA GARINII PBI
VGVGEAYAFNGLWVKS

SEQ ID NO: 154545 - protein, 16 aa, BORRELIA GARINII PBI
GVGEAYAFNGLWVKSP

SEQ ID NO: 154546 - protein, 16 aa, BORRELIA GARINII PBI
VGEAYAFNGLWVKSPG

SEQ ID NO: 154547 - protein, 16 aa, BORRELIA GARINII PBI
GEAYAFNGLWVKSPGR

SEQ ID NO: 154548 - protein, 16 aa, BORRELIA GARINII PBI
EAYAFNGLWVKSPGRD

SEQ ID NO: 154549 - protein, 16 aa, BORRELIA GARINII PBI
AYAFNGLWVKSPGRDF

SEQ ID NO: 154550 - protein, 16 aa, BORRELIA GARINII PBI
YAFNGLWVKSPGRDFF

SEQ ID NO: 154551 - protein, 16 aa, BORRELIA GARINII PBI
AFNGLWVKSPGRDFFN

SEQ ID NO: 154552 - protein, 16 aa, BORRELIA GARINII PBI
FNGLWVKSPGRDFFNF

SEQ ID NO: 154553 - protein, 16 aa, BORRELIA GARINII PBI
NGLWVKSPGRDFFNFI

SEQ ID NO: 154554 - protein, 16 aa, BORRELIA GARINII PBI
GLWVKSPGRDFFNFIL

SEQ ID NO: 154555 - protein, 16 aa, BORRELIA GARINII PBI
LWVKSPGRDFFNFILN

SEQ ID NO: 154556 - protein, 16 aa, BORRELIA GARINII PBI
WVKSPGRDFFNFILNE

SEQ ID NO: 154557 - protein, 16 aa, BORRELIA GARINII PBI
VKSPGRDFFNFILNEI

SEQ ID NO: 154558 - protein, 16 aa, BORRELIA GARINII PBI
KSPGRDFFNFILNEIK

SEQ ID NO: 154559 - protein, 16 aa, BORRELIA GARINII PBI
SPGRDFFNFILNEIKD

SEQ ID NO: 154560 - protein, 16 aa, BORRELIA GARINII PBI
PGRDFFNFILNEIKDL

SEQ ID NO: 154561 - protein, 16 aa, BORRELIA GARINII PBI
GRDFFNFILNEIKDLK

SEQ ID NO: 154562 - protein, 16 aa, BORRELIA GARINII PBI
RDFFNFILNEIKDLKI

SEQ ID NO: 154563 - protein, 16 aa, BORRELIA GARINII PBI
DFFNFILNEIKDLKIW

SEQ ID NO: 154564 - protein, 16 aa, BORRELIA GARINII PBI
FFNFILNEIKDLKIWV

SEQ ID NO: 154565 - protein, 16 aa, BORRELIA GARINII PBI
FNFILNEIKDLKIWVE

SEQ ID NO: 154566 - protein, 16 aa, BORRELIA GARINII PBI
NFILNEIKDLKIWVED

SEQ ID NO: 154567 - protein, 16 aa, BORRELIA GARINII PBI
FILNEIKDLKIWVEDF

SEQ ID NO: 154568 - protein, 16 aa, BORRELIA GARINII PBI
ILNEIKDLKIWVEDFE

SEQ ID NO: 154569 - protein, 16 aa, BORRELIA GARINII PBI
LNEIKDLKIWVEDFEN

SEQ ID NO: 154570 - protein, 16 aa, BORRELIA GARINII PBI
NEIKDLKIWVEDFEND

SEQ ID NO: 154571 - protein, 16 aa, BORRELIA GARINII PBI
EIKDLKIWVEDFENDL

SEQ ID NO: 154572 - protein, 16 aa, BORRELIA GARINII PBI
IKDLKIWVEDFENDLE

SEQ ID NO: 154573 - protein, 16 aa, BORRELIA GARINII PBI
KDLKIWVEDFENDLED

SEQ ID NO: 154574 - protein, 16 aa, BORRELIA GARINII PBI
DLKIWVEDFENDLEDV

SEQ ID NO: 154575 - protein, 16 aa, BORRELIA GARINII PBI
LKIWVEDFENDLEDVS

SEQ ID NO: 154576 - protein, 16 aa, BORRELIA GARINII PBI
KIWVEDFENDLEDVSR

SEQ ID NO: 154577 - protein, 16 aa, BORRELIA GARINII PBI
IWVEDFENDLEDVSRL

SEQ ID NO: 154578 - protein, 16 aa, BORRELIA GARINII PBI
WVEDFENDLEDVSRLR

SEQ ID NO: 154579 - protein, 16 aa, BORRELIA GARINII PBI
VEDFENDLEDVSRLRD

SEQ ID NO: 154580 - protein, 16 aa, BORRELIA GARINII PBI
EDFENDLEDVSRLRDF

SEQ ID NO: 154581 - protein, 16 aa, BORRELIA GARINII PBI
DFENDLEDVSRLRDFF

SEQ ID NO: 154582 - protein, 16 aa, BORRELIA GARINII PBI
FENDLEDVSRLRDFFN

SEQ ID NO: 154583 - protein, 16 aa, BORRELIA GARINII PBI
ENDLEDVSRLRDFFNF

SEQ ID NO: 154584 - protein, 16 aa, BORRELIA GARINII PBI
NDLEDVSRLRDFFNFP

SEQ ID NO: 154585 - protein, 16 aa, BORRELIA GARINII PBI
DLEDVSRLRDFFNFPG

SEQ ID NO: 154586 - protein, 16 aa, BORRELIA GARINII PBI
LEDVSRLRDFFNFPGM

SEQ ID NO: 154587 - protein, 16 aa, BORRELIA GARINII PBI
EDVSRLRDFFNFPGMR

SEQ ID NO: 154588 - protein, 16 aa, BORRELIA GARINII PBI
DVSRLRDFFNFPGMRI

SEQ ID NO: 154589 - protein, 16 aa, BORRELIA GARINII PBI
VSRLRDFFNFPGMRIM

SEQ ID NO: 154590 - protein, 16 aa, BORRELIA GARINII PBI
SRLRDFFNFPGMRIMK

SEQ ID NO: 154591 - protein, 16 aa, BORRELIA GARINII PBI
RLRDFFNFPGMRIMKL

SEQ ID NO: 154592 - protein, 16 aa, BORRELIA GARINII PBI
LRDFFNFPGMRIMKLA

SEQ ID NO: 154593 - protein, 16 aa, BORRELIA GARINII PBI
RDFFNFPGMRIMKLAF

SEQ ID NO: 154594 - protein, 16 aa, BORRELIA GARINII PBI
DFFNFPGMRIMKLAFD

SEQ ID NO: 154595 - protein, 16 aa, BORRELIA GARINII PBI
FFNFPGMRIMKLAFDF

SEQ ID NO: 154596 - protein, 16 aa, BORRELIA GARINII PBI
FNFPGMRIMKLAFDFD

SEQ ID NO: 154597 - protein, 16 aa, BORRELIA GARINII PBI
NFPGMRIMKLAFDFDS

SEQ ID NO: 154598 - protein, 16 aa, BORRELIA GARINII PBI
FPGMRIMKLAFDFDSD

SEQ ID NO: 154599 - protein, 16 aa, BORRELIA GARINII PBI
PGMRIMKLAFDFDSDN

SEQ ID NO: 154600 - protein, 16 aa, BORRELIA GARINII PBI
GMRIMKLAFDFDSDNQ

SEQ ID NO: 154601 - protein, 16 aa, BORRELIA GARINII PBI
MRIMKLAFDFDSDNQN

SEQ ID NO: 154602 - protein, 16 aa, BORRELIA GARINII PBI
RIMKLAFDFDSDNQNL

SEQ ID NO: 154603 - protein, 16 aa, BORRELIA GARINII PBI
IMKLAFDFDSDNQNLP

SEQ ID NO: 154604 - protein, 16 aa, BORRELIA GARINII PBI
MKLAFDFDSDNQNLPH

SEQ ID NO: 154605 - protein, 16 aa, BORRELIA GARINII PBI
KLAFDFDSDNQNLPHN

SEQ ID NO: 154606 - protein, 16 aa, BORRELIA GARINII PBI
LAFDFDSDNQNLPHNY

SEQ ID NO: 154607 - protein, 16 aa, BORRELIA GARINII PBI
AFDFDSDNQNLPHNYI

SEQ ID NO: 154608 - protein, 16 aa, BORRELIA GARINII PBI
FDFDSDNQNLPHNYIK

SEQ ID NO: 154609 - protein, 16 aa, BORRELIA GARINII PBI
DFDSDNQNLPHNYIKN

SEQ ID NO: 154610 - protein, 16 aa, BORRELIA GARINII PBI
FDSDNQNLPHNYIKNC

SEQ ID NO: 154611 - protein, 16 aa, BORRELIA GARINII PBI
DSDNQNLPHNYIKNCI

SEQ ID NO: 154612 - protein, 16 aa, BORRELIA GARINII PBI
SDNQNLPHNYIKNCIV

SEQ ID NO: 154613 - protein, 16 aa, BORRELIA GARINII PBI
DNQNLPHNYIKNCIVY

SEQ ID NO: 154614 - protein, 16 aa, BORRELIA GARINII PBI
NQNLPHNYIKNCIVYT

SEQ ID NO: 154615 - protein, 16 aa, BORRELIA GARINII PBI
QNLPHNYIKNCIVYTG

SEQ ID NO: 154616 - protein, 16 aa, BORRELIA GARINII PBI
NLPHNYIKNCIVYTGI

SEQ ID NO: 154617 - protein, 16 aa, BORRELIA GARINII PBI
LPHNYIKNCIVYTGIG

SEQ ID NO: 154618 - protein, 16 aa, BORRELIA GARINII PBI
PHNYIKNCIVYTGIGD

SEQ ID NO: 154619 - protein, 16 aa, BORRELIA GARINII PBI
HNYIKNCIVYTGIGDN

SEQ ID NO: 154620 - protein, 16 aa, BORRELIA GARINII PBI
NYIKNCIVYTGIGDNS

SEQ ID NO: 154621 - protein, 16 aa, BORRELIA GARINII PBI
YIKNCIVYTGIGDNST

SEQ ID NO: 154622 - protein, 16 aa, BORRELIA GARINII PBI
IKNCIVYTGIGDNSTI

SEQ ID NO: 154623 - protein, 16 aa, BORRELIA GARINII PBI
KNCIVYTGIGDNSTIR

SEQ ID NO: 154624 - protein, 16 aa, BORRELIA GARINII PBI
NCIVYTGIGDNSTIRE

SEQ ID NO: 154625 - protein, 16 aa, BORRELIA GARINII PBI
CIVYTGIGDNSTIREF

SEQ ID NO: 154626 - protein, 16 aa, BORRELIA GARINII PBI
IVYTGIGDNSTIREFV

SEQ ID NO: 154627 - protein, 16 aa, BORRELIA GARINII PBI
VYTGIGDNSTIREFVN

SEQ ID NO: 154628 - protein, 16 aa, BORRELIA GARINII PBI
YTGIGDNSTIREFVNS

SEQ ID NO: 154629 - protein, 16 aa, BORRELIA GARINII PBI
TGIGDNSTIREFVNSL

SEQ ID NO: 154630 - protein, 16 aa, BORRELIA GARINII PBI
GIGDNSTIREFVNSLD

SEQ ID NO: 154631 - protein, 16 aa, BORRELIA GARINII PBI
IGDNSTIREFVNSLDD

SEQ ID NO: 154632 - protein, 16 aa, BORRELIA GARINII PBI
GDNSTIREFVNSLDDL

SEQ ID NO: 154633 - protein, 16 aa, BORRELIA GARINII PBI
DNSTIREFVNSLDDLH

SEQ ID NO: 154634 - protein, 16 aa, BORRELIA GARINII PBI
NSTIREFVNSLDDLHK

SEQ ID NO: 154635 - protein, 16 aa, BORRELIA GARINII PBI
STIREFVNSLDDLHKK

SEQ ID NO: 154636 - protein, 16 aa, BORRELIA GARINII PBI
TIREFVNSLDDLHKKY

SEQ ID NO: 154637 - protein, 16 aa, BORRELIA GARINII PBI
IREFVNSLDDLHKKYI

SEQ ID NO: 154638 - protein, 16 aa, BORRELIA GARINII PBI
REFVNSLDDLHKKYIF

SEQ ID NO: 154639 - protein, 16 aa, BORRELIA GARINII PBI
EFVNSLDDLHKKYIFD

SEQ ID NO: 154640 - protein, 16 aa, BORRELIA GARINII PBI
FVNSLDDLHKKYIFDY

SEQ ID NO: 154641 - protein, 16 aa, BORRELIA GARINII PBI
VNSLDDLHKKYIFDYL

SEQ ID NO: 154642 - protein, 16 aa, BORRELIA GARINII PBI
NSLDDLHKKYIFDYLN

SEQ ID NO: 154643 - protein, 16 aa, BORRELIA GARINII PBI
SLDDLHKKYIFDYLNT

SEQ ID NO: 154644 - protein, 16 aa, BORRELIA GARINII PBI
LDDLHKKYIFDYLNTN

SEQ ID NO: 154645 - protein, 16 aa, BORRELIA GARINII PBI
DDLHKKYIFDYLNTNE

SEQ ID NO: 154646 - protein, 16 aa, BORRELIA GARINII PBI
DLHKKYIFDYLNTNED

SEQ ID NO: 154647 - protein, 16 aa, BORRELIA GARINII PBI
LHKKYIFDYLNTNEDF

SEQ ID NO: 154648 - protein, 16 aa, BORRELIA GARINII PBI
HKKYIFDYLNTNEDFV

SEQ ID NO: 154649 - protein, 16 aa, BORRELIA GARINII PBI
KKYIFDYLNTNEDFVV

SEQ ID NO: 154650 - protein, 16 aa, BORRELIA GARINII PBI
KYIFDYLNTNEDFVVW

SEQ ID NO: 154651 - protein, 16 aa, BORRELIA GARINII PBI
YIFDYLNTNEDFVVWD

SEQ ID NO: 154652 - protein, 16 aa, BORRELIA GARINII PBI
IFDYLNTNEDFVVWDM

SEQ ID NO: 154653 - protein, 16 aa, BORRELIA GARINII PBI
FDYLNTNEDFVVWDMI

SEQ ID NO: 154654 - protein, 16 aa, BORRELIA GARINII PBI
DYLNTNEDFVVWDMIR

SEQ ID NO: 154655 - protein, 16 aa, BORRELIA GARINII PBI
YLNTNEDFVVWDMIRS

SEQ ID NO: 154656 - protein, 16 aa, BORRELIA GARINII PBI
LNTNEDFVVWDMIRSA

SEQ ID NO: 154657 - protein, 16 aa, BORRELIA GARINII PBI
NTNEDFVVWDMIRSAM

SEQ ID NO: 154658 - protein, 16 aa, BORRELIA GARINII PBI
TNEDFVVWDMIRSAMS

SEQ ID NO: 154659 - protein, 16 aa, BORRELIA GARINII PBI
NEDFVVWDMIRSAMSS

SEQ ID NO: 154660 - protein, 16 aa, BORRELIA GARINII PBI
EDFVVWDMIRSAMSSV

SEQ ID NO: 154661 - protein, 16 aa, BORRELIA GARINII PBI
DFVVWDMIRSAMSSVS

SEQ ID NO: 154662 - protein, 16 aa, BORRELIA GARINII PBI
FVVWDMIRSAMSSVSD

SEQ ID NO: 154663 - protein, 16 aa, BORRELIA GARINII PBI
VVWDMIRSAMSSVSDS

SEQ ID NO: 154664 - protein, 16 aa, BORRELIA GARINII PBI
VWDMIRSAMSSVSDSV

SEQ ID NO: 154665 - protein, 16 aa, BORRELIA GARINII PBI
WDMIRSAMSSVSDSVI

SEQ ID NO: 154666 - protein, 16 aa, BORRELIA GARINII PBI
DMIRSAMSSVSDSVII

SEQ ID NO: 154667 - protein, 16 aa, BORRELIA GARINII PBI
MIRSAMSSVSDSVIIP

SEQ ID NO: 154668 - protein, 16 aa, BORRELIA GARINII PBI
IRSAMSSVSDSVIIPM

SEQ ID NO: 154669 - protein, 16 aa, BORRELIA GARINII PBI
RSAMSSVSDSVIIPMQ

SEQ ID NO: 154670 - protein, 16 aa, BORRELIA GARINII PBI
SAMSSVSDSVIIPMQD

SEQ ID NO: 154671 - protein, 16 aa, BORRELIA GARINII PBI
AMSSVSDSVIIPMQDY

SEQ ID NO: 154672 - protein, 16 aa, BORRELIA GARINII PBI
MSSVSDSVIIPMQDYI

SEQ ID NO: 154673 - protein, 16 aa, BORRELIA GARINII PBI
SSVSDSVIIPMQDYIN

SEQ ID NO: 154674 - protein, 16 aa, BORRELIA GARINII PBI
SVSDSVIIPMQDYINL

SEQ ID NO: 154675 - protein, 16 aa, BORRELIA GARINII PBI
VSDSVIIPMQDYINLG

SEQ ID NO: 154676 - protein, 16 aa, BORRELIA GARINII PBI
SDSVIIPMQDYINLGN

SEQ ID NO: 154677 - protein, 16 aa, BORRELIA GARINII PBI
DSVIIPMQDYINLGNE

SEQ ID NO: 154678 - protein, 16 aa, BORRELIA GARINII PBI
SVIIPMQDYINLGNEF

SEQ ID NO: 154679 - protein, 16 aa, BORRELIA GARINII PBI
VIIPMQDYINLGNEFR

SEQ ID NO: 154680 - protein, 16 aa, BORRELIA GARINII PBI
IIPMQDYINLGNEFRA

SEQ ID NO: 154681 - protein, 16 aa, BORRELIA GARINII PBI
IPMQDYINLGNEFRAN

SEQ ID NO: 154682 - protein, 16 aa, BORRELIA GARINII PBI
PMQDYINLGNEFRANI

SEQ ID NO: 154683 - protein, 16 aa, BORRELIA GARINII PBI
MQDYINLGNEFRANIP

SEQ ID NO: 154684 - protein, 16 aa, BORRELIA GARINII PBI
QDYINLGNEFRANIPK

SEQ ID NO: 154685 - protein, 16 aa, BORRELIA GARINII PBI
DYINLGNEFRANIPKN

SEQ ID NO: 154686 - protein, 16 aa, BORRELIA GARINII PBI
YINLGNEFRANIPKNT

SEQ ID NO: 154687 - protein, 16 aa, BORRELIA GARINII PBI
INLGNEFRANIPKNTL

SEQ ID NO: 154688 - protein, 16 aa, BORRELIA GARINII PBI
NLGNEFRANIPKNTLN

SEQ ID NO: 154689 - protein, 16 aa, BORRELIA GARINII PBI
LGNEFRANIPKNTLNN

SEQ ID NO: 154690 - protein, 16 aa, BORRELIA GARINII PBI
GNEFRANIPKNTLNNW

SEQ ID NO: 154691 - protein, 16 aa, BORRELIA GARINII PBI
NEFRANIPKNTLNNWI

SEQ ID NO: 154692 - protein, 16 aa, BORRELIA GARINII PBI
EFRANIPKNTLNNWIF

SEQ ID NO: 154693 - protein, 16 aa, BORRELIA GARINII PBI
FRANIPKNTLNNWIFR

SEQ ID NO: 154694 - protein, 16 aa, BORRELIA GARINII PBI
RANIPKNTLNNWIFRL

SEQ ID NO: 154695 - protein, 16 aa, BORRELIA GARINII PBI
ANIPKNTLNNWIFRLL

SEQ ID NO: 154696 - protein, 16 aa, BORRELIA GARINII PBI
NIPKNTLNNWIFRLLE

SEQ ID NO: 154697 - protein, 16 aa, BORRELIA GARINII PBI
IPKNTLNNWIFRLLES

SEQ ID NO: 154698 - protein, 16 aa, BORRELIA GARINII PBI
PKNTLNNWIFRLLESD

SEQ ID NO: 154699 - protein, 16 aa, BORRELIA GARINII PBI
KNTLNNWIFRLLESDL

SEQ ID NO: 154700 - protein, 16 aa, BORRELIA GARINII PBI
NTLNNWIFRLLESDLD

SEQ ID NO: 154701 - protein, 16 aa, BORRELIA GARINII PBI
TLNNWIFRLLESDLDA

SEQ ID NO: 154702 - protein, 16 aa, BORRELIA GARINII PBI
LNNWIFRLLESDLDAT

SEQ ID NO: 154703 - protein, 16 aa, BORRELIA GARINII PBI
NNWIFRLLESDLDATL

SEQ ID NO: 154704 - protein, 16 aa, BORRELIA GARINII PBI
NWIFRLLESDLDATLS

SEQ ID NO: 154705 - protein, 16 aa, BORRELIA GARINII PBI
WIFRLLESDLDATLSK

SEQ ID NO: 154706 - protein, 16 aa, BORRELIA GARINII PBI
IFRLLESDLDATLSKN

SEQ ID NO: 154707 - protein, 16 aa, BORRELIA GARINII PBI
FRLLESDLDATLSKNI

SEQ ID NO: 154708 - protein, 16 aa, BORRELIA GARINII PBI
RLLESDLDATLSKNIS

SEQ ID NO: 154709 - protein, 16 aa, BORRELIA GARINII PBI
LLESDLDATLSKNISF

SEQ ID NO: 154710 - protein, 16 aa, BORRELIA GARINII PBI
LESDLDATLSKNISFI

SEQ ID NO: 154711 - protein, 16 aa, BORRELIA GARINII PBI
ESDLDATLSKNISFIT

SEQ ID NO: 154712 - protein, 16 aa, BORRELIA GARINII PBI
SDLDATLSKNISFITR

SEQ ID NO: 154713 - protein, 16 aa, BORRELIA GARINII PBI
DLDATLSKNISFITRL

SEQ ID NO: 154714 - protein, 16 aa, BORRELIA GARINII PBI
LDATLSKNISFITRLY

SEQ ID NO: 154715 - protein, 16 aa, BORRELIA GARINII PBI
DATLSKNISFITRLYG

SEQ ID NO: 154716 - protein, 16 aa, BORRELIA GARINII PBI
ATLSKNISFITRLYGR

SEQ ID NO: 154717 - protein, 16 aa, BORRELIA GARINII PBI
TLSKNISFITRLYGRT

SEQ ID NO: 154718 - protein, 8 aa, BORRELIA GARINII
MKKYLLGI

SEQ ID NO: 154719 - protein, 8 aa, BORRELIA GARINII
KKYLLGIG

SEQ ID NO: 154720 - protein, 8 aa, BORRELIA GARINII
KYLLGIGL

SEQ ID NO: 154721 - protein, 8 aa, BORRELIA GARINII
YLLGIGLI

SEQ ID NO: 154722 - protein, 8 aa, BORRELIA GARINII
LLGIGLIL

SEQ ID NO: 154723 - protein, 8 aa, BORRELIA GARINII
LGIGLILA

SEQ ID NO: 154724 - protein, 8 aa, BORRELIA GARINII
GIGLILAL

SEQ ID NO: 154725 - protein, 8 aa, BORRELIA GARINII
IGLILALI

SEQ ID NO: 154726 - protein, 8 aa, BORRELIA GARINII
GLILALIA

SEQ ID NO: 154727 - protein, 8 aa, BORRELIA GARINII
LILALIAC

SEQ ID NO: 154728 - protein, 8 aa, BORRELIA GARINII
ILALIACK

SEQ ID NO: 154729 - protein, 8 aa, BORRELIA GARINII
LALIACKQ

SEQ ID NO: 154730 - protein, 8 aa, BORRELIA GARINII
ALIACKQN

SEQ ID NO: 154731 - protein, 8 aa, BORRELIA GARINII
LIACKQNV

SEQ ID NO: 154732 - protein, 8 aa, BORRELIA GARINII
IACKQNVS

SEQ ID NO: 154733 - protein, 8 aa, BORRELIA GARINII
ACKQNVSS

SEQ ID NO: 154734 - protein, 8 aa, BORRELIA GARINII
CKQNVSSL

SEQ ID NO: 154735 - protein, 8 aa, BORRELIA GARINII
KQNVSSLD

SEQ ID NO: 154736 - protein, 8 aa, BORRELIA GARINII
QNVSSLDE

SEQ ID NO: 154737 - protein, 8 aa, BORRELIA GARINII
NVSSLDEK

SEQ ID NO: 154738 - protein, 8 aa, BORRELIA GARINII
VSSLDEKN

SEQ ID NO: 154739 - protein, 8 aa, BORRELIA GARINII
SSLDEKNS

SEQ ID NO: 154740 - protein, 8 aa, BORRELIA GARINII
SLDEKNSV

SEQ ID NO: 154741 - protein, 8 aa, BORRELIA GARINII
LDEKNSVS

SEQ ID NO: 154742 - protein, 8 aa, BORRELIA GARINII
DEKNSVSV

SEQ ID NO: 154743 - protein, 8 aa, BORRELIA GARINII
EKNSVSVD

SEQ ID NO: 154744 - protein, 8 aa, BORRELIA GARINII
KNSVSVDL

SEQ ID NO: 154745 - protein, 8 aa, BORRELIA GARINII
NSVSVDLP

SEQ ID NO: 154746 - protein, 8 aa, BORRELIA GARINII
SVSVDLPG

SEQ ID NO: 154747 - protein, 8 aa, BORRELIA GARINII
VSVDLPGG

SEQ ID NO: 154748 - protein, 8 aa, BORRELIA GARINII
SVDLPGGM

SEQ ID NO: 154749 - protein, 8 aa, BORRELIA GARINII
VDLPGGMK

SEQ ID NO: 154750 - protein, 8 aa, BORRELIA GARINII
DLPGGMKV

SEQ ID NO: 154751 - protein, 8 aa, BORRELIA GARINII
LPGGMKVL

SEQ ID NO: 154752 - protein, 8 aa, BORRELIA GARINII
PGGMKVLV

SEQ ID NO: 154753 - protein, 8 aa, BORRELIA GARINII
GGMKVLVS

SEQ ID NO: 154754 - protein, 8 aa, BORRELIA GARINII
GMKVLVSK

SEQ ID NO: 154755 - protein, 8 aa, BORRELIA GARINII
MKVLVSKE

SEQ ID NO: 154756 - protein, 8 aa, BORRELIA GARINII
KVLVSKEK

SEQ ID NO: 154757 - protein, 8 aa, BORRELIA GARINII
VLVSKEKD

SEQ ID NO: 154758 - protein, 8 aa, BORRELIA GARINII
LVSKEKDK

SEQ ID NO: 154759 - protein, 8 aa, BORRELIA GARINII
VSKEKDKD

SEQ ID NO: 154760 - protein, 8 aa, BORRELIA GARINII
SKEKDKDG

SEQ ID NO: 154761 - protein, 8 aa, BORRELIA GARINII
KEKDKDGK

SEQ ID NO: 154762 - protein, 8 aa, BORRELIA GARINII
EKDKDGKY

SEQ ID NO: 154763 - protein, 8 aa, BORRELIA GARINII
KDKDGKYS

SEQ ID NO: 154764 - protein, 8 aa, BORRELIA GARINII
DKDGKYSL

SEQ ID NO: 154765 - protein, 8 aa, BORRELIA GARINII
KDGKYSLM

SEQ ID NO: 154766 - protein, 8 aa, BORRELIA GARINII
DGKYSLMA

SEQ ID NO: 154767 - protein, 8 aa, BORRELIA GARINII
GKYSLMAT

SEQ ID NO: 154768 - protein, 8 aa, BORRELIA GARINII
KYSLMATV

SEQ ID NO: 154769 - protein, 8 aa, BORRELIA GARINII
YSLMATVE

SEQ ID NO: 154770 - protein, 8 aa, BORRELIA GARINII
SLMATVEK

SEQ ID NO: 154771 - protein, 8 aa, BORRELIA GARINII
LMATVEKL

SEQ ID NO: 154772 - protein, 8 aa, BORRELIA GARINII
MATVEKLE

SEQ ID NO: 154773 - protein, 8 aa, BORRELIA GARINII
ATVEKLEL

SEQ ID NO: 154774 - protein, 8 aa, BORRELIA GARINII
TVEKLELK

SEQ ID NO: 154775 - protein, 8 aa, BORRELIA GARINII
VEKLELKG

SEQ ID NO: 154776 - protein, 8 aa, BORRELIA GARINII
EKLELKGT

SEQ ID NO: 154777 - protein, 8 aa, BORRELIA GARINII
KLELKGTS

SEQ ID NO: 154778 - protein, 8 aa, BORRELIA GARINII
LELKGTSD

SEQ ID NO: 154779 - protein, 8 aa, BORRELIA GARINII
ELKGTSDK

SEQ ID NO: 154780 - protein, 8 aa, BORRELIA GARINII
LKGTSDKN

SEQ ID NO: 154781 - protein, 8 aa, BORRELIA GARINII
KGTSDKNN

SEQ ID NO: 154782 - protein, 8 aa, BORRELIA GARINII
GTSDKNNG

SEQ ID NO: 154783 - protein, 8 aa, BORRELIA GARINII
TSDKNNGS

SEQ ID NO: 154784 - protein, 8 aa, BORRELIA GARINII
SDKNNGSG

SEQ ID NO: 154785 - protein, 8 aa, BORRELIA GARINII
DKNNGSGT

SEQ ID NO: 154786 - protein, 8 aa, BORRELIA GARINII
KNNGSGTL

SEQ ID NO: 154787 - protein, 8 aa, BORRELIA GARINII
NNGSGTLE

SEQ ID NO: 154788 - protein, 8 aa, BORRELIA GARINII
NGSGTLEG

SEQ ID NO: 154789 - protein, 8 aa, BORRELIA GARINII
GSGTLEGE

SEQ ID NO: 154790 - protein, 8 aa, BORRELIA GARINII
SGTLEGEK

SEQ ID NO: 154791 - protein, 8 aa, BORRELIA GARINII
GTLEGEKT

SEQ ID NO: 154792 - protein, 8 aa, BORRELIA GARINII
TLEGEKTD

SEQ ID NO: 154793 - protein, 8 aa, BORRELIA GARINII
LEGEKTDK

SEQ ID NO: 154794 - protein, 8 aa, BORRELIA GARINII
EGEKTDKS

SEQ ID NO: 154795 - protein, 8 aa, BORRELIA GARINII
GEKTDKSK

SEQ ID NO: 154796 - protein, 8 aa, BORRELIA GARINII
EKTDKSKV

SEQ ID NO: 154797 - protein, 8 aa, BORRELIA GARINII
KTDKSKVK

SEQ ID NO: 154798 - protein, 8 aa, BORRELIA GARINII
TDKSKVKL

SEQ ID NO: 154799 - protein, 8 aa, BORRELIA GARINII
DKSKVKLT

SEQ ID NO: 154800 - protein, 8 aa, BORRELIA GARINII
KSKVKLTI

SEQ ID NO: 154801 - protein, 8 aa, BORRELIA GARINII
SKVKLTIA

SEQ ID NO: 154802 - protein, 8 aa, BORRELIA GARINII
KVKLTIAE

SEQ ID NO: 154803 - protein, 8 aa, BORRELIA GARINII
VKLTIAED

SEQ ID NO: 154804 - protein, 8 aa, BORRELIA GARINII
KLTIAEDL

SEQ ID NO: 154805 - protein, 8 aa, BORRELIA GARINII
LTIAEDLS

SEQ ID NO: 154806 - protein, 8 aa, BORRELIA GARINII
TIAEDLSK

SEQ ID NO: 154807 - protein, 8 aa, BORRELIA GARINII
IAEDLSKT

SEQ ID NO: 154808 - protein, 8 aa, BORRELIA GARINII
AEDLSKTT

SEQ ID NO: 154809 - protein, 8 aa, BORRELIA GARINII
EDLSKTTF

SEQ ID NO: 154810 - protein, 8 aa, BORRELIA GARINII
DLSKTTFE

SEQ ID NO: 154811 - protein, 8 aa, BORRELIA GARINII
LSKTTFEI

SEQ ID NO: 154812 - protein, 8 aa, BORRELIA GARINII
SKTTFEIF

SEQ ID NO: 154813 - protein, 8 aa, BORRELIA GARINII
KTTFEIFK

SEQ ID NO: 154814 - protein, 8 aa, BORRELIA GARINII
TTFEIFKE

SEQ ID NO: 154815 - protein, 8 aa, BORRELIA GARINII
TFEIFKED

SEQ ID NO: 154816 - protein, 8 aa, BORRELIA GARINII
FEIFKEDG

SEQ ID NO: 154817 - protein, 8 aa, BORRELIA GARINII
EIFKEDGK

SEQ ID NO: 154818 - protein, 8 aa, BORRELIA GARINII
IFKEDGKT

SEQ ID NO: 154819 - protein, 8 aa, BORRELIA GARINII
FKEDGKTL

SEQ ID NO: 154820 - protein, 8 aa, BORRELIA GARINII
KEDGKTLV

SEQ ID NO: 154821 - protein, 8 aa, BORRELIA GARINII
EDGKTLVS

SEQ ID NO: 154822 - protein, 8 aa, BORRELIA GARINII
DGKTLVSK

SEQ ID NO: 154823 - protein, 8 aa, BORRELIA GARINII
GKTLVSKK

SEQ ID NO: 154824 - protein, 8 aa, BORRELIA GARINII
KTLVSKKV

SEQ ID NO: 154825 - protein, 8 aa, BORRELIA GARINII
TLVSKKVT

SEQ ID NO: 154826 - protein, 8 aa, BORRELIA GARINII
LVSKKVTL

SEQ ID NO: 154827 - protein, 8 aa, BORRELIA GARINII
VSKKVTLK

SEQ ID NO: 154828 - protein, 8 aa, BORRELIA GARINII
SKKVTLKD

SEQ ID NO: 154829 - protein, 8 aa, BORRELIA GARINII
KKVTLKDK

SEQ ID NO: 154830 - protein, 8 aa, BORRELIA GARINII
KVTLKDKS

SEQ ID NO: 154831 - protein, 8 aa, BORRELIA GARINII
VTLKDKSS

SEQ ID NO: 154832 - protein, 8 aa, BORRELIA GARINII
TLKDKSST

SEQ ID NO: 154833 - protein, 8 aa, BORRELIA GARINII
LKDKSSTE

SEQ ID NO: 154834 - protein, 8 aa, BORRELIA GARINII
KDKSSTEE

SEQ ID NO: 154835 - protein, 8 aa, BORRELIA GARINII
DKSSTEEK

SEQ ID NO: 154836 - protein, 8 aa, BORRELIA GARINII
KSSTEEKF

SEQ ID NO: 154837 - protein, 8 aa, BORRELIA GARINII
SSTEEKFN

SEQ ID NO: 154838 - protein, 8 aa, BORRELIA GARINII
STEEKFNE

SEQ ID NO: 154839 - protein, 8 aa, BORRELIA GARINII
TEEKFNEK

SEQ ID NO: 154840 - protein, 8 aa, BORRELIA GARINII
EEKFNEKG

SEQ ID NO: 154841 - protein, 8 aa, BORRELIA GARINII
EKFNEKGE

SEQ ID NO: 154842 - protein, 8 aa, BORRELIA GARINII
KFNEKGEI

SEQ ID NO: 154843 - protein, 8 aa, BORRELIA GARINII
FNEKGEIS

SEQ ID NO: 154844 - protein, 8 aa, BORRELIA GARINII
NEKGEISE

SEQ ID NO: 154845 - protein, 8 aa, BORRELIA GARINII
EKGEISEK

SEQ ID NO: 154846 - protein, 8 aa, BORRELIA GARINII
KGEISEKT

SEQ ID NO: 154847 - protein, 8 aa, BORRELIA GARINII
GEISEKTI

SEQ ID NO: 154848 - protein, 8 aa, BORRELIA GARINII
EISEKTIV

SEQ ID NO: 154849 - protein, 8 aa, BORRELIA GARINII
ISEKTIVR

SEQ ID NO: 154850 - protein, 8 aa, BORRELIA GARINII
SEKTIVRA

SEQ ID NO: 154851 - protein, 8 aa, BORRELIA GARINII
EKTIVRAN

SEQ ID NO: 154852 - protein, 8 aa, BORRELIA GARINII
KTIVRANG

SEQ ID NO: 154853 - protein, 8 aa, BORRELIA GARINII
TIVRANGT

SEQ ID NO: 154854 - protein, 8 aa, BORRELIA GARINII
IVRANGTR

SEQ ID NO: 154855 - protein, 8 aa, BORRELIA GARINII
VRANGTRL

SEQ ID NO: 154856 - protein, 8 aa, BORRELIA GARINII
RANGTRLE

SEQ ID NO: 154857 - protein, 8 aa, BORRELIA GARINII
ANGTRLEY

SEQ ID NO: 154858 - protein, 8 aa, BORRELIA GARINII
NGTRLEYT

SEQ ID NO: 154859 - protein, 8 aa, BORRELIA GARINII
GTRLEYTD

SEQ ID NO: 154860 - protein, 8 aa, BORRELIA GARINII
TRLEYTDI

SEQ ID NO: 154861 - protein, 8 aa, BORRELIA GARINII
RLEYTDIK

SEQ ID NO: 154862 - protein, 8 aa, BORRELIA GARINII
LEYTDIKS

SEQ ID NO: 154863 - protein, 8 aa, BORRELIA GARINII
EYTDIKSD

SEQ ID NO: 154864 - protein, 8 aa, BORRELIA GARINII
YTDIKSDG

SEQ ID NO: 154865 - protein, 8 aa, BORRELIA GARINII
TDIKSDGS

SEQ ID NO: 154866 - protein, 8 aa, BORRELIA GARINII
DIKSDGSG

SEQ ID NO: 154867 - protein, 8 aa, BORRELIA GARINII
IKSDGSGK

SEQ ID NO: 154868 - protein, 8 aa, BORRELIA GARINII
KSDGSGKA

SEQ ID NO: 154869 - protein, 8 aa, BORRELIA GARINII
SDGSGKAK

SEQ ID NO: 154870 - protein, 8 aa, BORRELIA GARINII
DGSGKAKE

SEQ ID NO: 154871 - protein, 8 aa, BORRELIA GARINII
GSGKAKEV

SEQ ID NO: 154872 - protein, 8 aa, BORRELIA GARINII
SGKAKEVL

SEQ ID NO: 154873 - protein, 8 aa, BORRELIA GARINII
GKAKEVLK

SEQ ID NO: 154874 - protein, 8 aa, BORRELIA GARINII
KAKEVLKD

SEQ ID NO: 154875 - protein, 8 aa, BORRELIA GARINII
AKEVLKDF

SEQ ID NO: 154876 - protein, 8 aa, BORRELIA GARINII
KEVLKDFT

SEQ ID NO: 154877 - protein, 8 aa, BORRELIA GARINII
EVLKDFTL

SEQ ID NO: 154878 - protein, 8 aa, BORRELIA GARINII
VLKDFTLE

SEQ ID NO: 154879 - protein, 8 aa, BORRELIA GARINII
LKDFTLEG

SEQ ID NO: 154880 - protein, 8 aa, BORRELIA GARINII
KDFTLEGT

SEQ ID NO: 154881 - protein, 8 aa, BORRELIA GARINII
DFTLEGTL

SEQ ID NO: 154882 - protein, 8 aa, BORRELIA GARINII
FTLEGTLA

SEQ ID NO: 154883 - protein, 8 aa, BORRELIA GARINII
TLEGTLAA

SEQ ID NO: 154884 - protein, 8 aa, BORRELIA GARINII
LEGTLAAD

SEQ ID NO: 154885 - protein, 8 aa, BORRELIA GARINII
EGTLAADG

SEQ ID NO: 154886 - protein, 8 aa, BORRELIA GARINII
GTLAADGK

SEQ ID NO: 154887 - protein, 8 aa, BORRELIA GARINII
TLAADGKT

SEQ ID NO: 154888 - protein, 8 aa, BORRELIA GARINII
LAADGKTT

SEQ ID NO: 154889 - protein, 8 aa, BORRELIA GARINII
AADGKTTL

SEQ ID NO: 154890 - protein, 8 aa, BORRELIA GARINII
ADGKTTLK

SEQ ID NO: 154891 - protein, 8 aa, BORRELIA GARINII
DGKTTLKV

SEQ ID NO: 154892 - protein, 8 aa, BORRELIA GARINII
GKTTLKVT

SEQ ID NO: 154893 - protein, 8 aa, BORRELIA GARINII
KTTLKVTE

SEQ ID NO: 154894 - protein, 8 aa, BORRELIA GARINII
TTLKVTEG

SEQ ID NO: 154895 - protein, 8 aa, BORRELIA GARINII
TLKVTEGT

SEQ ID NO: 154896 - protein, 8 aa, BORRELIA GARINII
LKVTEGTV

SEQ ID NO: 154897 - protein, 8 aa, BORRELIA GARINII
KVTEGTVV

SEQ ID NO: 154898 - protein, 8 aa, BORRELIA GARINII
VTEGTVVL

SEQ ID NO: 154899 - protein, 8 aa, BORRELIA GARINII
TEGTVVLS

SEQ ID NO: 154900 - protein, 8 aa, BORRELIA GARINII
EGTVVLSK

SEQ ID NO: 154901 - protein, 8 aa, BORRELIA GARINII
GTVVLSKN

SEQ ID NO: 154902 - protein, 8 aa, BORRELIA GARINII
TVVLSKNI

SEQ ID NO: 154903 - protein, 8 aa, BORRELIA GARINII
VVLSKNIL

SEQ ID NO: 154904 - protein, 8 aa, BORRELIA GARINII
VLSKNILK

SEQ ID NO: 154905 - protein, 8 aa, BORRELIA GARINII
LSKNILKS

SEQ ID NO: 154906 - protein, 8 aa, BORRELIA GARINII
SKNILKSG

SEQ ID NO: 154907 - protein, 8 aa, BORRELIA GARINII
KNILKSGE

SEQ ID NO: 154908 - protein, 8 aa, BORRELIA GARINII
NILKSGEI

SEQ ID NO: 154909 - protein, 8 aa, BORRELIA GARINII
ILKSGEIT

SEQ ID NO: 154910 - protein, 8 aa, BORRELIA GARINII
LKSGEITV

SEQ ID NO: 154911 - protein, 8 aa, BORRELIA GARINII
KSGEITVA

SEQ ID NO: 154912 - protein, 8 aa, BORRELIA GARINII
SGEITVAL

SEQ ID NO: 154913 - protein, 8 aa, BORRELIA GARINII
GEITVALD

SEQ ID NO: 154914 - protein, 8 aa, BORRELIA GARINII
EITVALDD

SEQ ID NO: 154915 - protein, 8 aa, BORRELIA GARINII
ITVALDDS

SEQ ID NO: 154916 - protein, 8 aa, BORRELIA GARINII
TVALDDSD

SEQ ID NO: 154917 - protein, 8 aa, BORRELIA GARINII
VALDDSDT

SEQ ID NO: 154918 - protein, 8 aa, BORRELIA GARINII
ALDDSDTT

SEQ ID NO: 154919 - protein, 8 aa, BORRELIA GARINII
LDDSDTTQ

SEQ ID NO: 154920 - protein, 8 aa, BORRELIA GARINII
DDSDTTQA

SEQ ID NO: 154921 - protein, 8 aa, BORRELIA GARINII
DSDTTQAT

SEQ ID NO: 154922 - protein, 8 aa, BORRELIA GARINII
SDTTQATK

SEQ ID NO: 154923 - protein, 8 aa, BORRELIA GARINII
DTTQATKK

SEQ ID NO: 154924 - protein, 8 aa, BORRELIA GARINII
TTQATKKT

SEQ ID NO: 154925 - protein, 8 aa, BORRELIA GARINII
TQATKKTG

SEQ ID NO: 154926 - protein, 8 aa, BORRELIA GARINII
QATKKTGK

SEQ ID NO: 154927 - protein, 8 aa, BORRELIA GARINII
ATKKTGKW

SEQ ID NO: 154928 - protein, 8 aa, BORRELIA GARINII
TKKTGKWD

SEQ ID NO: 154929 - protein, 8 aa, BORRELIA GARINII
KKTGKWDS

SEQ ID NO: 154930 - protein, 8 aa, BORRELIA GARINII
KTGKWDSK

SEQ ID NO: 154931 - protein, 8 aa, BORRELIA GARINII
TGKWDSKT

SEQ ID NO: 154932 - protein, 8 aa, BORRELIA GARINII
GKWDSKTS

SEQ ID NO: 154933 - protein, 8 aa, BORRELIA GARINII
KWDSKTST

SEQ ID NO: 154934 - protein, 8 aa, BORRELIA GARINII
WDSKTSTL

SEQ ID NO: 154935 - protein, 8 aa, BORRELIA GARINII
DSKTSTLT

SEQ ID NO: 154936 - protein, 8 aa, BORRELIA GARINII
SKTSTLTI

SEQ ID NO: 154937 - protein, 8 aa, BORRELIA GARINII
KTSTLTIS

SEQ ID NO: 154938 - protein, 8 aa, BORRELIA GARINII
TSTLTISV

SEQ ID NO: 154939 - protein, 8 aa, BORRELIA GARINII
STLTISVN

SEQ ID NO: 154940 - protein, 8 aa, BORRELIA GARINII
TLTISVNS

SEQ ID NO: 154941 - protein, 8 aa, BORRELIA GARINII
LTISVNSQ

SEQ ID NO: 154942 - protein, 8 aa, BORRELIA GARINII
TISVNSQK

SEQ ID NO: 154943 - protein, 8 aa, BORRELIA GARINII
ISVNSQKT

SEQ ID NO: 154944 - protein, 8 aa, BORRELIA GARINII
SVNSQKTK

SEQ ID NO: 154945 - protein, 8 aa, BORRELIA GARINII
VNSQKTKN

SEQ ID NO: 154946 - protein, 8 aa, BORRELIA GARINII
NSQKTKNL

SEQ ID NO: 154947 - protein, 8 aa, BORRELIA GARINII
SQKTKNLV

SEQ ID NO: 154948 - protein, 8 aa, BORRELIA GARINII
QKTKNLVF

SEQ ID NO: 154949 - protein, 8 aa, BORRELIA GARINII
KTKNLVFT

SEQ ID NO: 154950 - protein, 8 aa, BORRELIA GARINII
TKNLVFTK

SEQ ID NO: 154951 - protein, 8 aa, BORRELIA GARINII
KNLVFTKE

SEQ ID NO: 154952 - protein, 8 aa, BORRELIA GARINII
NLVFTKED

SEQ ID NO: 154953 - protein, 8 aa, BORRELIA GARINII
LVFTKEDT

SEQ ID NO: 154954 - protein, 8 aa, BORRELIA GARINII
VFTKEDTI

SEQ ID NO: 154955 - protein, 8 aa, BORRELIA GARINII
FTKEDTIT

SEQ ID NO: 154956 - protein, 8 aa, BORRELIA GARINII
TKEDTITV

SEQ ID NO: 154957 - protein, 8 aa, BORRELIA GARINII
KEDTITVQ

SEQ ID NO: 154958 - protein, 8 aa, BORRELIA GARINII
EDTITVQK

SEQ ID NO: 154959 - protein, 8 aa, BORRELIA GARINII
DTITVQKY

SEQ ID NO: 154960 - protein, 8 aa, BORRELIA GARINII
TITVQKYD

SEQ ID NO: 154961 - protein, 8 aa, BORRELIA GARINII
ITVQKYDS

SEQ ID NO: 154962 - protein, 8 aa, BORRELIA GARINII
TVQKYDSA

SEQ ID NO: 154963 - protein, 8 aa, BORRELIA GARINII
VQKYDSAG

SEQ ID NO: 154964 - protein, 8 aa, BORRELIA GARINII
QKYDSAGT

SEQ ID NO: 154965 - protein, 8 aa, BORRELIA GARINII
KYDSAGTN

SEQ ID NO: 154966 - protein, 8 aa, BORRELIA GARINII
YDSAGTNL

SEQ ID NO: 154967 - protein, 8 aa, BORRELIA GARINII
DSAGTNLE

SEQ ID NO: 154968 - protein, 8 aa, BORRELIA GARINII
SAGTNLEG

SEQ ID NO: 154969 - protein, 8 aa, BORRELIA GARINII
AGTNLEGK

SEQ ID NO: 154970 - protein, 8 aa, BORRELIA GARINII
GTNLEGKA

SEQ ID NO: 154971 - protein, 8 aa, BORRELIA GARINII
TNLEGKAV

SEQ ID NO: 154972 - protein, 8 aa, BORRELIA GARINII
NLEGKAVE

SEQ ID NO: 154973 - protein, 8 aa, BORRELIA GARINII
LEGKAVEI

SEQ ID NO: 154974 - protein, 8 aa, BORRELIA GARINII
EGKAVEIT

SEQ ID NO: 154975 - protein, 8 aa, BORRELIA GARINII
GKAVEITT

SEQ ID NO: 154976 - protein, 8 aa, BORRELIA GARINII
KAVEITTL

SEQ ID NO: 154977 - protein, 8 aa, BORRELIA GARINII
AVEITTLE

SEQ ID NO: 154978 - protein, 8 aa, BORRELIA GARINII
VEITTLEK

SEQ ID NO: 154979 - protein, 8 aa, BORRELIA GARINII
EITTLEKL

SEQ ID NO: 154980 - protein, 8 aa, BORRELIA GARINII
ITTLEKLK

SEQ ID NO: 154981 - protein, 8 aa, BORRELIA GARINII
TTLEKLKD

SEQ ID NO: 154982 - protein, 8 aa, BORRELIA GARINII
TLEKLKDA

SEQ ID NO: 154983 - protein, 8 aa, BORRELIA GARINII
LEKLKDAL

SEQ ID NO: 154984 - protein, 8 aa, BORRELIA GARINII
EKLKDALK

SEQ ID NO: 154985 - protein, 9 aa, BORRELIA GARINII
MKKYLLGIG

SEQ ID NO: 154986 - protein, 9 aa, BORRELIA GARINII
KKYLLGIGL

SEQ ID NO: 154987 - protein, 9 aa, BORRELIA GARINII
KYLLGIGLI

SEQ ID NO: 154988 - protein, 9 aa, BORRELIA GARINII
YLLGIGLIL

SEQ ID NO: 154989 - protein, 9 aa, BORRELIA GARINII
LLGIGLILA

SEQ ID NO: 154990 - protein, 9 aa, BORRELIA GARINII
LGIGLILAL

SEQ ID NO: 154991 - protein, 9 aa, BORRELIA GARINII
GIGLILALI

SEQ ID NO: 154992 - protein, 9 aa, BORRELIA GARINII
IGLILALIA

SEQ ID NO: 154993 - protein, 9 aa, BORRELIA GARINII
GLILALIAC

SEQ ID NO: 154994 - protein, 9 aa, BORRELIA GARINII
LILALIACK

SEQ ID NO: 154995 - protein, 9 aa, BORRELIA GARINII
ILALIACKQ

SEQ ID NO: 154996 - protein, 9 aa, BORRELIA GARINII
LALIACKQN

SEQ ID NO: 154997 - protein, 9 aa, BORRELIA GARINII
ALIACKQNV

SEQ ID NO: 154998 - protein, 9 aa, BORRELIA GARINII
LIACKQNVS

SEQ ID NO: 154999 - protein, 9 aa, BORRELIA GARINII
IACKQNVSS

SEQ ID NO: 155000 - protein, 9 aa, BORRELIA GARINII
ACKQNVSSL

SEQ ID NO: 155001 - protein, 9 aa, BORRELIA GARINII
CKQNVSSLD

SEQ ID NO: 155002 - protein, 9 aa, BORRELIA GARINII
KQNVSSLDE

SEQ ID NO: 155003 - protein, 9 aa, BORRELIA GARINII
QNVSSLDEK

SEQ ID NO: 155004 - protein, 9 aa, BORRELIA GARINII
NVSSLDEKN

SEQ ID NO: 155005 - protein, 9 aa, BORRELIA GARINII
VSSLDEKNS

SEQ ID NO: 155006 - protein, 9 aa, BORRELIA GARINII
SSLDEKNSV

SEQ ID NO: 155007 - protein, 9 aa, BORRELIA GARINII
SLDEKNSVS

SEQ ID NO: 155008 - protein, 9 aa, BORRELIA GARINII
LDEKNSVSV

SEQ ID NO: 155009 - protein, 9 aa, BORRELIA GARINII
DEKNSVSVD

SEQ ID NO: 155010 - protein, 9 aa, BORRELIA GARINII
EKNSVSVDL

SEQ ID NO: 155011 - protein, 9 aa, BORRELIA GARINII
KNSVSVDLP

SEQ ID NO: 155012 - protein, 9 aa, BORRELIA GARINII
NSVSVDLPG

SEQ ID NO: 155013 - protein, 9 aa, BORRELIA GARINII
SVSVDLPGG

SEQ ID NO: 155014 - protein, 9 aa, BORRELIA GARINII
VSVDLPGGM

SEQ ID NO: 155015 - protein, 9 aa, BORRELIA GARINII
SVDLPGGMK

SEQ ID NO: 155016 - protein, 9 aa, BORRELIA GARINII
VDLPGGMKV

SEQ ID NO: 155017 - protein, 9 aa, BORRELIA GARINII
DLPGGMKVL

SEQ ID NO: 155018 - protein, 9 aa, BORRELIA GARINII
LPGGMKVLV

SEQ ID NO: 155019 - protein, 9 aa, BORRELIA GARINII
PGGMKVLVS

SEQ ID NO: 155020 - protein, 9 aa, BORRELIA GARINII
GGMKVLVSK

SEQ ID NO: 155021 - protein, 9 aa, BORRELIA GARINII
GMKVLVSKE

SEQ ID NO: 155022 - protein, 9 aa, BORRELIA GARINII
MKVLVSKEK

SEQ ID NO: 155023 - protein, 9 aa, BORRELIA GARINII
KVLVSKEKD

SEQ ID NO: 155024 - protein, 9 aa, BORRELIA GARINII
VLVSKEKDK

SEQ ID NO: 155025 - protein, 9 aa, BORRELIA GARINII
LVSKEKDKD

SEQ ID NO: 155026 - protein, 9 aa, BORRELIA GARINII
VSKEKDKDG

SEQ ID NO: 155027 - protein, 9 aa, BORRELIA GARINII
SKEKDKDGK

SEQ ID NO: 155028 - protein, 9 aa, BORRELIA GARINII
KEKDKDGKY

SEQ ID NO: 155029 - protein, 9 aa, BORRELIA GARINII
EKDKDGKYS

SEQ ID NO: 155030 - protein, 9 aa, BORRELIA GARINII
KDKDGKYSL

SEQ ID NO: 155031 - protein, 9 aa, BORRELIA GARINII
DKDGKYSLM

SEQ ID NO: 155032 - protein, 9 aa, BORRELIA GARINII
KDGKYSLMA

SEQ ID NO: 155033 - protein, 9 aa, BORRELIA GARINII
DGKYSLMAT

SEQ ID NO: 155034 - protein, 9 aa, BORRELIA GARINII
GKYSLMATV

SEQ ID NO: 155035 - protein, 9 aa, BORRELIA GARINII
KYSLMATVE

SEQ ID NO: 155036 - protein, 9 aa, BORRELIA GARINII
YSLMATVEK

SEQ ID NO: 155037 - protein, 9 aa, BORRELIA GARINII
SLMATVEKL

SEQ ID NO: 155038 - protein, 9 aa, BORRELIA GARINII
LMATVEKLE

SEQ ID NO: 155039 - protein, 9 aa, BORRELIA GARINII
MATVEKLEL

SEQ ID NO: 155040 - protein, 9 aa, BORRELIA GARINII
ATVEKLELK

SEQ ID NO: 155041 - protein, 9 aa, BORRELIA GARINII
TVEKLELKG

SEQ ID NO: 155042 - protein, 9 aa, BORRELIA GARINII
VEKLELKGT

SEQ ID NO: 155043 - protein, 9 aa, BORRELIA GARINII
EKLELKGTS

SEQ ID NO: 155044 - protein, 9 aa, BORRELIA GARINII
KLELKGTSD

SEQ ID NO: 155045 - protein, 9 aa, BORRELIA GARINII
LELKGTSDK

SEQ ID NO: 155046 - protein, 9 aa, BORRELIA GARINII
ELKGTSDKN

SEQ ID NO: 155047 - protein, 9 aa, BORRELIA GARINII
LKGTSDKNN

SEQ ID NO: 155048 - protein, 9 aa, BORRELIA GARINII
KGTSDKNNG

SEQ ID NO: 155049 - protein, 9 aa, BORRELIA GARINII
GTSDKNNGS

SEQ ID NO: 155050 - protein, 9 aa, BORRELIA GARINII
TSDKNNGSG

SEQ ID NO: 155051 - protein, 9 aa, BORRELIA GARINII
SDKNNGSGT

SEQ ID NO: 155052 - protein, 9 aa, BORRELIA GARINII
DKNNGSGTL

SEQ ID NO: 155053 - protein, 9 aa, BORRELIA GARINII
KNNGSGTLE

SEQ ID NO: 155054 - protein, 9 aa, BORRELIA GARINII
NNGSGTLEG

SEQ ID NO: 155055 - protein, 9 aa, BORRELIA GARINII
NGSGTLEGE

SEQ ID NO: 155056 - protein, 9 aa, BORRELIA GARINII
GSGTLEGEK

SEQ ID NO: 155057 - protein, 9 aa, BORRELIA GARINII
SGTLEGEKT

SEQ ID NO: 155058 - protein, 9 aa, BORRELIA GARINII
GTLEGEKTD

SEQ ID NO: 155059 - protein, 9 aa, BORRELIA GARINII
TLEGEKTDK

SEQ ID NO: 155060 - protein, 9 aa, BORRELIA GARINII
LEGEKTDKS

SEQ ID NO: 155061 - protein, 9 aa, BORRELIA GARINII
EGEKTDKSK

SEQ ID NO: 155062 - protein, 9 aa, BORRELIA GARINII
GEKTDKSKV

SEQ ID NO: 155063 - protein, 9 aa, BORRELIA GARINII
EKTDKSKVK

SEQ ID NO: 155064 - protein, 9 aa, BORRELIA GARINII
KTDKSKVKL

SEQ ID NO: 155065 - protein, 9 aa, BORRELIA GARINII
TDKSKVKLT

SEQ ID NO: 155066 - protein, 9 aa, BORRELIA GARINII
DKSKVKLTI

SEQ ID NO: 155067 - protein, 9 aa, BORRELIA GARINII
KSKVKLTIA

SEQ ID NO: 155068 - protein, 9 aa, BORRELIA GARINII
SKVKLTIAE

SEQ ID NO: 155069 - protein, 9 aa, BORRELIA GARINII
KVKLTIAED

SEQ ID NO: 155070 - protein, 9 aa, BORRELIA GARINII
VKLTIAEDL

SEQ ID NO: 155071 - protein, 9 aa, BORRELIA GARINII
KLTIAEDLS

SEQ ID NO: 155072 - protein, 9 aa, BORRELIA GARINII
LTIAEDLSK

SEQ ID NO: 155073 - protein, 9 aa, BORRELIA GARINII
TIAEDLSKT

SEQ ID NO: 155074 - protein, 9 aa, BORRELIA GARINII
IAEDLSKTT

SEQ ID NO: 155075 - protein, 9 aa, BORRELIA GARINII
AEDLSKTTF

SEQ ID NO: 155076 - protein, 9 aa, BORRELIA GARINII
EDLSKTTFE

SEQ ID NO: 155077 - protein, 9 aa, BORRELIA GARINII
DLSKTTFEI

SEQ ID NO: 155078 - protein, 9 aa, BORRELIA GARINII
LSKTTFEIF

SEQ ID NO: 155079 - protein, 9 aa, BORRELIA GARINII
SKTTFEIFK

SEQ ID NO: 155080 - protein, 9 aa, BORRELIA GARINII
KTTFEIFKE

SEQ ID NO: 155081 - protein, 9 aa, BORRELIA GARINII
TTFEIFKED

SEQ ID NO: 155082 - protein, 9 aa, BORRELIA GARINII
TFEIFKEDG

SEQ ID NO: 155083 - protein, 9 aa, BORRELIA GARINII
FEIFKEDGK

SEQ ID NO: 155084 - protein, 9 aa, BORRELIA GARINII
EIFKEDGKT

SEQ ID NO: 155085 - protein, 9 aa, BORRELIA GARINII
IFKEDGKTL

SEQ ID NO: 155086 - protein, 9 aa, BORRELIA GARINII
FKEDGKTLV

SEQ ID NO: 155087 - protein, 9 aa, BORRELIA GARINII
KEDGKTLVS

SEQ ID NO: 155088 - protein, 9 aa, BORRELIA GARINII
EDGKTLVSK

SEQ ID NO: 155089 - protein, 9 aa, BORRELIA GARINII
DGKTLVSKK

SEQ ID NO: 155090 - protein, 9 aa, BORRELIA GARINII
GKTLVSKKV

SEQ ID NO: 155091 - protein, 9 aa, BORRELIA GARINII
KTLVSKKVT

SEQ ID NO: 155092 - protein, 9 aa, BORRELIA GARINII
TLVSKKVTL

SEQ ID NO: 155093 - protein, 9 aa, BORRELIA GARINII
LVSKKVTLK

SEQ ID NO: 155094 - protein, 9 aa, BORRELIA GARINII
VSKKVTLKD

SEQ ID NO: 155095 - protein, 9 aa, BORRELIA GARINII
SKKVTLKDK

SEQ ID NO: 155096 - protein, 9 aa, BORRELIA GARINII
KKVTLKDKS

SEQ ID NO: 155097 - protein, 9 aa, BORRELIA GARINII
KVTLKDKSS

SEQ ID NO: 155098 - protein, 9 aa, BORRELIA GARINII
VTLKDKSST

SEQ ID NO: 155099 - protein, 9 aa, BORRELIA GARINII
TLKDKSSTE

SEQ ID NO: 155100 - protein, 9 aa, BORRELIA GARINII
LKDKSSTEE

SEQ ID NO: 155101 - protein, 9 aa, BORRELIA GARINII
KDKSSTEEK

SEQ ID NO: 155102 - protein, 9 aa, BORRELIA GARINII
DKSSTEEKF

SEQ ID NO: 155103 - protein, 9 aa, BORRELIA GARINII
KSSTEEKFN

SEQ ID NO: 155104 - protein, 9 aa, BORRELIA GARINII
SSTEEKFNE

SEQ ID NO: 155105 - protein, 9 aa, BORRELIA GARINII
STEEKFNEK

SEQ ID NO: 155106 - protein, 9 aa, BORRELIA GARINII
TEEKFNEKG

SEQ ID NO: 155107 - protein, 9 aa, BORRELIA GARINII
EEKFNEKGE

SEQ ID NO: 155108 - protein, 9 aa, BORRELIA GARINII
EKFNEKGEI

SEQ ID NO: 155109 - protein, 9 aa, BORRELIA GARINII
KFNEKGEIS

SEQ ID NO: 155110 - protein, 9 aa, BORRELIA GARINII
FNEKGEISE

SEQ ID NO: 155111 - protein, 9 aa, BORRELIA GARINII
NEKGEISEK

SEQ ID NO: 155112 - protein, 9 aa, BORRELIA GARINII
EKGEISEKT

SEQ ID NO: 155113 - protein, 9 aa, BORRELIA GARINII
KGEISEKTI

SEQ ID NO: 155114 - protein, 9 aa, BORRELIA GARINII
GEISEKTIV

SEQ ID NO: 155115 - protein, 9 aa, BORRELIA GARINII
EISEKTIVR

SEQ ID NO: 155116 - protein, 9 aa, BORRELIA GARINII
ISEKTIVRA

SEQ ID NO: 155117 - protein, 9 aa, BORRELIA GARINII
SEKTIVRAN

SEQ ID NO: 155118 - protein, 9 aa, BORRELIA GARINII
EKTIVRANG

SEQ ID NO: 155119 - protein, 9 aa, BORRELIA GARINII
KTIVRANGT

SEQ ID NO: 155120 - protein, 9 aa, BORRELIA GARINII
TIVRANGTR

SEQ ID NO: 155121 - protein, 9 aa, BORRELIA GARINII
IVRANGTRL

SEQ ID NO: 155122 - protein, 9 aa, BORRELIA GARINII
VRANGTRLE

SEQ ID NO: 155123 - protein, 9 aa, BORRELIA GARINII
RANGTRLEY

SEQ ID NO: 155124 - protein, 9 aa, BORRELIA GARINII
ANGTRLEYT

SEQ ID NO: 155125 - protein, 9 aa, BORRELIA GARINII
NGTRLEYTD

SEQ ID NO: 155126 - protein, 9 aa, BORRELIA GARINII
GTRLEYTDI

SEQ ID NO: 155127 - protein, 9 aa, BORRELIA GARINII
TRLEYTDIK

SEQ ID NO: 155128 - protein, 9 aa, BORRELIA GARINII
RLEYTDIKS

SEQ ID NO: 155129 - protein, 9 aa, BORRELIA GARINII
LEYTDIKSD

SEQ ID NO: 155130 - protein, 9 aa, BORRELIA GARINII
EYTDIKSDG

SEQ ID NO: 155131 - protein, 9 aa, BORRELIA GARINII
YTDIKSDGS

SEQ ID NO: 155132 - protein, 9 aa, BORRELIA GARINII
TDIKSDGSG

SEQ ID NO: 155133 - protein, 9 aa, BORRELIA GARINII
DIKSDGSGK

SEQ ID NO: 155134 - protein, 9 aa, BORRELIA GARINII
IKSDGSGKA

SEQ ID NO: 155135 - protein, 9 aa, BORRELIA GARINII
KSDGSGKAK

SEQ ID NO: 155136 - protein, 9 aa, BORRELIA GARINII
SDGSGKAKE

SEQ ID NO: 155137 - protein, 9 aa, BORRELIA GARINII
DGSGKAKEV

SEQ ID NO: 155138 - protein, 9 aa, BORRELIA GARINII
GSGKAKEVL

SEQ ID NO: 155139 - protein, 9 aa, BORRELIA GARINII
SGKAKEVLK

SEQ ID NO: 155140 - protein, 9 aa, BORRELIA GARINII
GKAKEVLKD

SEQ ID NO: 155141 - protein, 9 aa, BORRELIA GARINII
KAKEVLKDF

SEQ ID NO: 155142 - protein, 9 aa, BORRELIA GARINII
AKEVLKDFT

SEQ ID NO: 155143 - protein, 9 aa, BORRELIA GARINII
KEVLKDFTL

SEQ ID NO: 155144 - protein, 9 aa, BORRELIA GARINII
EVLKDFTLE

SEQ ID NO: 155145 - protein, 9 aa, BORRELIA GARINII
VLKDFTLEG

SEQ ID NO: 155146 - protein, 9 aa, BORRELIA GARINII
LKDFTLEGT

SEQ ID NO: 155147 - protein, 9 aa, BORRELIA GARINII
KDFTLEGTL

SEQ ID NO: 155148 - protein, 9 aa, BORRELIA GARINII
DFTLEGTLA

SEQ ID NO: 155149 - protein, 9 aa, BORRELIA GARINII
FTLEGTLAA

SEQ ID NO: 155150 - protein, 9 aa, BORRELIA GARINII
TLEGTLAAD

SEQ ID NO: 155151 - protein, 9 aa, BORRELIA GARINII
LEGTLAADG

SEQ ID NO: 155152 - protein, 9 aa, BORRELIA GARINII
EGTLAADGK

SEQ ID NO: 155153 - protein, 9 aa, BORRELIA GARINII
GTLAADGKT

SEQ ID NO: 155154 - protein, 9 aa, BORRELIA GARINII
TLAADGKTT

SEQ ID NO: 155155 - protein, 9 aa, BORRELIA GARINII
LAADGKTTL

SEQ ID NO: 155156 - protein, 9 aa, BORRELIA GARINII
AADGKTTLK

SEQ ID NO: 155157 - protein, 9 aa, BORRELIA GARINII
ADGKTTLKV

SEQ ID NO: 155158 - protein, 9 aa, BORRELIA GARINII
DGKTTLKVT

SEQ ID NO: 155159 - protein, 9 aa, BORRELIA GARINII
GKTTLKVTE

SEQ ID NO: 155160 - protein, 9 aa, BORRELIA GARINII
KTTLKVTEG

SEQ ID NO: 155161 - protein, 9 aa, BORRELIA GARINII
TTLKVTEGT

SEQ ID NO: 155162 - protein, 9 aa, BORRELIA GARINII
TLKVTEGTV

SEQ ID NO: 155163 - protein, 9 aa, BORRELIA GARINII
LKVTEGTVV

SEQ ID NO: 155164 - protein, 9 aa, BORRELIA GARINII
KVTEGTVVL

SEQ ID NO: 155165 - protein, 9 aa, BORRELIA GARINII
VTEGTVVLS

SEQ ID NO: 155166 - protein, 9 aa, BORRELIA GARINII
TEGTVVLSK

SEQ ID NO: 155167 - protein, 9 aa, BORRELIA GARINII
EGTVVLSKN

SEQ ID NO: 155168 - protein, 9 aa, BORRELIA GARINII
GTVVLSKNI

SEQ ID NO: 155169 - protein, 9 aa, BORRELIA GARINII
TVVLSKNIL

SEQ ID NO: 155170 - protein, 9 aa, BORRELIA GARINII
VVLSKNILK

SEQ ID NO: 155171 - protein, 9 aa, BORRELIA GARINII
VLSKNILKS

SEQ ID NO: 155172 - protein, 9 aa, BORRELIA GARINII
LSKNILKSG

SEQ ID NO: 155173 - protein, 9 aa, BORRELIA GARINII
SKNILKSGE

SEQ ID NO: 155174 - protein, 9 aa, BORRELIA GARINII
KNILKSGEI

SEQ ID NO: 155175 - protein, 9 aa, BORRELIA GARINII
NILKSGEIT

SEQ ID NO: 155176 - protein, 9 aa, BORRELIA GARINII
ILKSGEITV

SEQ ID NO: 155177 - protein, 9 aa, BORRELIA GARINII
LKSGEITVA

SEQ ID NO: 155178 - protein, 9 aa, BORRELIA GARINII
KSGEITVAL

SEQ ID NO: 155179 - protein, 9 aa, BORRELIA GARINII
SGEITVALD

SEQ ID NO: 155180 - protein, 9 aa, BORRELIA GARINII
GEITVALDD

SEQ ID NO: 155181 - protein, 9 aa, BORRELIA GARINII
EITVALDDS

SEQ ID NO: 155182 - protein, 9 aa, BORRELIA GARINII
ITVALDDSD

SEQ ID NO: 155183 - protein, 9 aa, BORRELIA GARINII
TVALDDSDT

SEQ ID NO: 155184 - protein, 9 aa, BORRELIA GARINII
VALDDSDTT

SEQ ID NO: 155185 - protein, 9 aa, BORRELIA GARINII
ALDDSDTTQ

SEQ ID NO: 155186 - protein, 9 aa, BORRELIA GARINII
LDDSDTTQA

SEQ ID NO: 155187 - protein, 9 aa, BORRELIA GARINII
DDSDTTQAT

SEQ ID NO: 155188 - protein, 9 aa, BORRELIA GARINII
DSDTTQATK

SEQ ID NO: 155189 - protein, 9 aa, BORRELIA GARINII
SDTTQATKK

SEQ ID NO: 155190 - protein, 9 aa, BORRELIA GARINII
DTTQATKKT

SEQ ID NO: 155191 - protein, 9 aa, BORRELIA GARINII
TTQATKKTG

SEQ ID NO: 155192 - protein, 9 aa, BORRELIA GARINII
TQATKKTGK

SEQ ID NO: 155193 - protein, 9 aa, BORRELIA GARINII
QATKKTGKW

SEQ ID NO: 155194 - protein, 9 aa, BORRELIA GARINII
ATKKTGKWD

SEQ ID NO: 155195 - protein, 9 aa, BORRELIA GARINII
TKKTGKWDS

SEQ ID NO: 155196 - protein, 9 aa, BORRELIA GARINII
KKTGKWDSK

SEQ ID NO: 155197 - protein, 9 aa, BORRELIA GARINII
KTGKWDSKT

SEQ ID NO: 155198 - protein, 9 aa, BORRELIA GARINII
TGKWDSKTS

SEQ ID NO: 155199 - protein, 9 aa, BORRELIA GARINII
GKWDSKTST

SEQ ID NO: 155200 - protein, 9 aa, BORRELIA GARINII
KWDSKTSTL

SEQ ID NO: 155201 - protein, 9 aa, BORRELIA GARINII
WDSKTSTLT

SEQ ID NO: 155202 - protein, 9 aa, BORRELIA GARINII
DSKTSTLTI

SEQ ID NO: 155203 - protein, 9 aa, BORRELIA GARINII
SKTSTLTIS

SEQ ID NO: 155204 - protein, 9 aa, BORRELIA GARINII
KTSTLTISV

SEQ ID NO: 155205 - protein, 9 aa, BORRELIA GARINII
TSTLTISVN

SEQ ID NO: 155206 - protein, 9 aa, BORRELIA GARINII
STLTISVNS

SEQ ID NO: 155207 - protein, 9 aa, BORRELIA GARINII
TLTISVNSQ

SEQ ID NO: 155208 - protein, 9 aa, BORRELIA GARINII
LTISVNSQK

SEQ ID NO: 155209 - protein, 9 aa, BORRELIA GARINII
TISVNSQKT

SEQ ID NO: 155210 - protein, 9 aa, BORRELIA GARINII
ISVNSQKTK

SEQ ID NO: 155211 - protein, 9 aa, BORRELIA GARINII
SVNSQKTKN

SEQ ID NO: 155212 - protein, 9 aa, BORRELIA GARINII
VNSQKTKNL

SEQ ID NO: 155213 - protein, 9 aa, BORRELIA GARINII
NSQKTKNLV

SEQ ID NO: 155214 - protein, 9 aa, BORRELIA GARINII
SQKTKNLVF

SEQ ID NO: 155215 - protein, 9 aa, BORRELIA GARINII
QKTKNLVFT

SEQ ID NO: 155216 - protein, 9 aa, BORRELIA GARINII
KTKNLVFTK

SEQ ID NO: 155217 - protein, 9 aa, BORRELIA GARINII
TKNLVFTKE

SEQ ID NO: 155218 - protein, 9 aa, BORRELIA GARINII
KNLVFTKED

SEQ ID NO: 155219 - protein, 9 aa, BORRELIA GARINII
NLVFTKEDT

SEQ ID NO: 155220 - protein, 9 aa, BORRELIA GARINII
LVFTKEDTI

SEQ ID NO: 155221 - protein, 9 aa, BORRELIA GARINII
VFTKEDTIT

SEQ ID NO: 155222 - protein, 9 aa, BORRELIA GARINII
FTKEDTITV

SEQ ID NO: 155223 - protein, 9 aa, BORRELIA GARINII
TKEDTITVQ

SEQ ID NO: 155224 - protein, 9 aa, BORRELIA GARINII
KEDTITVQK

SEQ ID NO: 155225 - protein, 9 aa, BORRELIA GARINII
EDTITVQKY

SEQ ID NO: 155226 - protein, 9 aa, BORRELIA GARINII
DTITVQKYD

SEQ ID NO: 155227 - protein, 9 aa, BORRELIA GARINII
TITVQKYDS

SEQ ID NO: 155228 - protein, 9 aa, BORRELIA GARINII
ITVQKYDSA

SEQ ID NO: 155229 - protein, 9 aa, BORRELIA GARINII
TVQKYDSAG

SEQ ID NO: 155230 - protein, 9 aa, BORRELIA GARINII
VQKYDSAGT

SEQ ID NO: 155231 - protein, 9 aa, BORRELIA GARINII
QKYDSAGTN

SEQ ID NO: 155232 - protein, 9 aa, BORRELIA GARINII
KYDSAGTNL

SEQ ID NO: 155233 - protein, 9 aa, BORRELIA GARINII
YDSAGTNLE

SEQ ID NO: 155234 - protein, 9 aa, BORRELIA GARINII
DSAGTNLEG

SEQ ID NO: 155235 - protein, 9 aa, BORRELIA GARINII
SAGTNLEGK

SEQ ID NO: 155236 - protein, 9 aa, BORRELIA GARINII
AGTNLEGKA

SEQ ID NO: 155237 - protein, 9 aa, BORRELIA GARINII
GTNLEGKAV

SEQ ID NO: 155238 - protein, 9 aa, BORRELIA GARINII
TNLEGKAVE

SEQ ID NO: 155239 - protein, 9 aa, BORRELIA GARINII
NLEGKAVEI

SEQ ID NO: 155240 - protein, 9 aa, BORRELIA GARINII
LEGKAVEIT

SEQ ID NO: 155241 - protein, 9 aa, BORRELIA GARINII
EGKAVEITT

SEQ ID NO: 155242 - protein, 9 aa, BORRELIA GARINII
GKAVEITTL

SEQ ID NO: 155243 - protein, 9 aa, BORRELIA GARINII
KAVEITTLE

SEQ ID NO: 155244 - protein, 9 aa, BORRELIA GARINII
AVEITTLEK

SEQ ID NO: 155245 - protein, 9 aa, BORRELIA GARINII
VEITTLEKL

SEQ ID NO: 155246 - protein, 9 aa, BORRELIA GARINII
EITTLEKLK

SEQ ID NO: 155247 - protein, 9 aa, BORRELIA GARINII
ITTLEKLKD

SEQ ID NO: 155248 - protein, 9 aa, BORRELIA GARINII
TTLEKLKDA

SEQ ID NO: 155249 - protein, 9 aa, BORRELIA GARINII
TLEKLKDAL

SEQ ID NO: 155250 - protein, 9 aa, BORRELIA GARINII
LEKLKDALK

SEQ ID NO: 155251 - protein, 10 aa, BORRELIA GARINII
MKKYLLGIGL

SEQ ID NO: 155252 - protein, 10 aa, BORRELIA GARINII
KKYLLGIGLI

SEQ ID NO: 155253 - protein, 10 aa, BORRELIA GARINII
KYLLGIGLIL

SEQ ID NO: 155254 - protein, 10 aa, BORRELIA GARINII
YLLGIGLILA

SEQ ID NO: 155255 - protein, 10 aa, BORRELIA GARINII
LLGIGLILAL

SEQ ID NO: 155256 - protein, 10 aa, BORRELIA GARINII
LGIGLILALI

SEQ ID NO: 155257 - protein, 10 aa, BORRELIA GARINII
GIGLILALIA

SEQ ID NO: 155258 - protein, 10 aa, BORRELIA GARINII
IGLILALIAC

SEQ ID NO: 155259 - protein, 10 aa, BORRELIA GARINII
GLILALIACK

SEQ ID NO: 155260 - protein, 10 aa, BORRELIA GARINII
LILALIACKQ

SEQ ID NO: 155261 - protein, 10 aa, BORRELIA GARINII
ILALIACKQN

SEQ ID NO: 155262 - protein, 10 aa, BORRELIA GARINII
LALIACKQNV

SEQ ID NO: 155263 - protein, 10 aa, BORRELIA GARINII
ALIACKQNVS

SEQ ID NO: 155264 - protein, 10 aa, BORRELIA GARINII
LIACKQNVSS

SEQ ID NO: 155265 - protein, 10 aa, BORRELIA GARINII
IACKQNVSSL

SEQ ID NO: 155266 - protein, 10 aa, BORRELIA GARINII
ACKQNVSSLD

SEQ ID NO: 155267 - protein, 10 aa, BORRELIA GARINII
CKQNVSSLDE

SEQ ID NO: 155268 - protein, 10 aa, BORRELIA GARINII
KQNVSSLDEK

SEQ ID NO: 155269 - protein, 10 aa, BORRELIA GARINII
QNVSSLDEKN

SEQ ID NO: 155270 - protein, 10 aa, BORRELIA GARINII
NVSSLDEKNS

SEQ ID NO: 155271 - protein, 10 aa, BORRELIA GARINII
VSSLDEKNSV

SEQ ID NO: 155272 - protein, 10 aa, BORRELIA GARINII
SSLDEKNSVS

SEQ ID NO: 155273 - protein, 10 aa, BORRELIA GARINII
SLDEKNSVSV

SEQ ID NO: 155274 - protein, 10 aa, BORRELIA GARINII
LDEKNSVSVD

SEQ ID NO: 155275 - protein, 10 aa, BORRELIA GARINII
DEKNSVSVDL

SEQ ID NO: 155276 - protein, 10 aa, BORRELIA GARINII
EKNSVSVDLP

SEQ ID NO: 155277 - protein, 10 aa, BORRELIA GARINII
KNSVSVDLPG

SEQ ID NO: 155278 - protein, 10 aa, BORRELIA GARINII
NSVSVDLPGG

SEQ ID NO: 155279 - protein, 10 aa, BORRELIA GARINII
SVSVDLPGGM

SEQ ID NO: 155280 - protein, 10 aa, BORRELIA GARINII
VSVDLPGGMK

SEQ ID NO: 155281 - protein, 10 aa, BORRELIA GARINII
SVDLPGGMKV

SEQ ID NO: 155282 - protein, 10 aa, BORRELIA GARINII
VDLPGGMKVL

SEQ ID NO: 155283 - protein, 10 aa, BORRELIA GARINII
DLPGGMKVLV

SEQ ID NO: 155284 - protein, 10 aa, BORRELIA GARINII
LPGGMKVLVS

SEQ ID NO: 155285 - protein, 10 aa, BORRELIA GARINII
PGGMKVLVSK

SEQ ID NO: 155286 - protein, 10 aa, BORRELIA GARINII
GGMKVLVSKE

SEQ ID NO: 155287 - protein, 10 aa, BORRELIA GARINII
GMKVLVSKEK

SEQ ID NO: 155288 - protein, 10 aa, BORRELIA GARINII
MKVLVSKEKD

SEQ ID NO: 155289 - protein, 10 aa, BORRELIA GARINII
KVLVSKEKDK

SEQ ID NO: 155290 - protein, 10 aa, BORRELIA GARINII
VLVSKEKDKD

SEQ ID NO: 155291 - protein, 10 aa, BORRELIA GARINII
LVSKEKDKDG

SEQ ID NO: 155292 - protein, 10 aa, BORRELIA GARINII
VSKEKDKDGK

SEQ ID NO: 155293 - protein, 10 aa, BORRELIA GARINII
SKEKDKDGKY

SEQ ID NO: 155294 - protein, 10 aa, BORRELIA GARINII
KEKDKDGKYS

SEQ ID NO: 155295 - protein, 10 aa, BORRELIA GARINII
EKDKDGKYSL

SEQ ID NO: 155296 - protein, 10 aa, BORRELIA GARINII
KDKDGKYSLM

SEQ ID NO: 155297 - protein, 10 aa, BORRELIA GARINII
DKDGKYSLMA

SEQ ID NO: 155298 - protein, 10 aa, BORRELIA GARINII
KDGKYSLMAT

SEQ ID NO: 155299 - protein, 10 aa, BORRELIA GARINII
DGKYSLMATV

SEQ ID NO: 155300 - protein, 10 aa, BORRELIA GARINII
GKYSLMATVE

SEQ ID NO: 155301 - protein, 10 aa, BORRELIA GARINII
KYSLMATVEK

SEQ ID NO: 155302 - protein, 10 aa, BORRELIA GARINII
YSLMATVEKL

SEQ ID NO: 155303 - protein, 10 aa, BORRELIA GARINII
SLMATVEKLE

SEQ ID NO: 155304 - protein, 10 aa, BORRELIA GARINII
LMATVEKLEL

SEQ ID NO: 155305 - protein, 10 aa, BORRELIA GARINII
MATVEKLELK

SEQ ID NO: 155306 - protein, 10 aa, BORRELIA GARINII
ATVEKLELKG

SEQ ID NO: 155307 - protein, 10 aa, BORRELIA GARINII
TVEKLELKGT

SEQ ID NO: 155308 - protein, 10 aa, BORRELIA GARINII
VEKLELKGTS

SEQ ID NO: 155309 - protein, 10 aa, BORRELIA GARINII
EKLELKGTSD

SEQ ID NO: 155310 - protein, 10 aa, BORRELIA GARINII
KLELKGTSDK

SEQ ID NO: 155311 - protein, 10 aa, BORRELIA GARINII
LELKGTSDKN

SEQ ID NO: 155312 - protein, 10 aa, BORRELIA GARINII
ELKGTSDKNN

SEQ ID NO: 155313 - protein, 10 aa, BORRELIA GARINII
LKGTSDKNNG

SEQ ID NO: 155314 - protein, 10 aa, BORRELIA GARINII
KGTSDKNNGS

SEQ ID NO: 155315 - protein, 10 aa, BORRELIA GARINII
GTSDKNNGSG

SEQ ID NO: 155316 - protein, 10 aa, BORRELIA GARINII
TSDKNNGSGT

SEQ ID NO: 155317 - protein, 10 aa, BORRELIA GARINII
SDKNNGSGTL

SEQ ID NO: 155318 - protein, 10 aa, BORRELIA GARINII
DKNNGSGTLE

SEQ ID NO: 155319 - protein, 10 aa, BORRELIA GARINII
KNNGSGTLEG

SEQ ID NO: 155320 - protein, 10 aa, BORRELIA GARINII
NNGSGTLEGE

SEQ ID NO: 155321 - protein, 10 aa, BORRELIA GARINII
NGSGTLEGEK

SEQ ID NO: 155322 - protein, 10 aa, BORRELIA GARINII
GSGTLEGEKT

SEQ ID NO: 155323 - protein, 10 aa, BORRELIA GARINII
SGTLEGEKTD

SEQ ID NO: 155324 - protein, 10 aa, BORRELIA GARINII
GTLEGEKTDK

SEQ ID NO: 155325 - protein, 10 aa, BORRELIA GARINII
TLEGEKTDKS

SEQ ID NO: 155326 - protein, 10 aa, BORRELIA GARINII
LEGEKTDKSK

SEQ ID NO: 155327 - protein, 10 aa, BORRELIA GARINII
EGEKTDKSKV

SEQ ID NO: 155328 - protein, 10 aa, BORRELIA GARINII
GEKTDKSKVK

SEQ ID NO: 155329 - protein, 10 aa, BORRELIA GARINII
EKTDKSKVKL

SEQ ID NO: 155330 - protein, 10 aa, BORRELIA GARINII
KTDKSKVKLT

SEQ ID NO: 155331 - protein, 10 aa, BORRELIA GARINII
TDKSKVKLTI

SEQ ID NO: 155332 - protein, 10 aa, BORRELIA GARINII
DKSKVKLTIA

SEQ ID NO: 155333 - protein, 10 aa, BORRELIA GARINII
KSKVKLTIAE

SEQ ID NO: 155334 - protein, 10 aa, BORRELIA GARINII
SKVKLTIAED

SEQ ID NO: 155335 - protein, 10 aa, BORRELIA GARINII
KVKLTIAEDL

SEQ ID NO: 155336 - protein, 10 aa, BORRELIA GARINII
VKLTIAEDLS

SEQ ID NO: 155337 - protein, 10 aa, BORRELIA GARINII
KLTIAEDLSK

SEQ ID NO: 155338 - protein, 10 aa, BORRELIA GARINII
LTIAEDLSKT

SEQ ID NO: 155339 - protein, 10 aa, BORRELIA GARINII
TIAEDLSKTT

SEQ ID NO: 155340 - protein, 10 aa, BORRELIA GARINII
IAEDLSKTTF

SEQ ID NO: 155341 - protein, 10 aa, BORRELIA GARINII
AEDLSKTTFE

SEQ ID NO: 155342 - protein, 10 aa, BORRELIA GARINII
EDLSKTTFEI

SEQ ID NO: 155343 - protein, 10 aa, BORRELIA GARINII
DLSKTTFEIF

SEQ ID NO: 155344 - protein, 10 aa, BORRELIA GARINII
LSKTTFEIFK

SEQ ID NO: 155345 - protein, 10 aa, BORRELIA GARINII
SKTTFEIFKE

SEQ ID NO: 155346 - protein, 10 aa, BORRELIA GARINII
KTTFEIFKED

SEQ ID NO: 155347 - protein, 10 aa, BORRELIA GARINII
TTFEIFKEDG

SEQ ID NO: 155348 - protein, 10 aa, BORRELIA GARINII
TFEIFKEDGK

SEQ ID NO: 155349 - protein, 10 aa, BORRELIA GARINII
FEIFKEDGKT

SEQ ID NO: 155350 - protein, 10 aa, BORRELIA GARINII
EIFKEDGKTL

SEQ ID NO: 155351 - protein, 10 aa, BORRELIA GARINII
IFKEDGKTLV

SEQ ID NO: 155352 - protein, 10 aa, BORRELIA GARINII
FKEDGKTLVS

SEQ ID NO: 155353 - protein, 10 aa, BORRELIA GARINII
KEDGKTLVSK

SEQ ID NO: 155354 - protein, 10 aa, BORRELIA GARINII
EDGKTLVSKK

SEQ ID NO: 155355 - protein, 10 aa, BORRELIA GARINII
DGKTLVSKKV

SEQ ID NO: 155356 - protein, 10 aa, BORRELIA GARINII
GKTLVSKKVT

SEQ ID NO: 155357 - protein, 10 aa, BORRELIA GARINII
KTLVSKKVTL

SEQ ID NO: 155358 - protein, 10 aa, BORRELIA GARINII
TLVSKKVTLK

SEQ ID NO: 155359 - protein, 10 aa, BORRELIA GARINII
LVSKKVTLKD

SEQ ID NO: 155360 - protein, 10 aa, BORRELIA GARINII
VSKKVTLKDK

SEQ ID NO: 155361 - protein, 10 aa, BORRELIA GARINII
SKKVTLKDKS

SEQ ID NO: 155362 - protein, 10 aa, BORRELIA GARINII
KKVTLKDKSS

SEQ ID NO: 155363 - protein, 10 aa, BORRELIA GARINII
KVTLKDKSST

SEQ ID NO: 155364 - protein, 10 aa, BORRELIA GARINII
VTLKDKSSTE

SEQ ID NO: 155365 - protein, 10 aa, BORRELIA GARINII
TLKDKSSTEE

SEQ ID NO: 155366 - protein, 10 aa, BORRELIA GARINII
LKDKSSTEEK

SEQ ID NO: 155367 - protein, 10 aa, BORRELIA GARINII
KDKSSTEEKF

SEQ ID NO: 155368 - protein, 10 aa, BORRELIA GARINII
DKSSTEEKFN

SEQ ID NO: 155369 - protein, 10 aa, BORRELIA GARINII
KSSTEEKFNE

SEQ ID NO: 155370 - protein, 10 aa, BORRELIA GARINII
SSTEEKFNEK

SEQ ID NO: 155371 - protein, 10 aa, BORRELIA GARINII
STEEKFNEKG

SEQ ID NO: 155372 - protein, 10 aa, BORRELIA GARINII
TEEKFNEKGE

SEQ ID NO: 155373 - protein, 10 aa, BORRELIA GARINII
EEKFNEKGEI

SEQ ID NO: 155374 - protein, 10 aa, BORRELIA GARINII
EKFNEKGEIS

SEQ ID NO: 155375 - protein, 10 aa, BORRELIA GARINII
KFNEKGEISE

SEQ ID NO: 155376 - protein, 10 aa, BORRELIA GARINII
FNEKGEISEK

SEQ ID NO: 155377 - protein, 10 aa, BORRELIA GARINII
NEKGEISEKT

SEQ ID NO: 155378 - protein, 10 aa, BORRELIA GARINII
EKGEISEKTI

SEQ ID NO: 155379 - protein, 10 aa, BORRELIA GARINII
KGEISEKTIV

SEQ ID NO: 155380 - protein, 10 aa, BORRELIA GARINII
GEISEKTIVR

SEQ ID NO: 155381 - protein, 10 aa, BORRELIA GARINII
EISEKTIVRA

SEQ ID NO: 155382 - protein, 10 aa, BORRELIA GARINII
ISEKTIVRAN

SEQ ID NO: 155383 - protein, 10 aa, BORRELIA GARINII
SEKTIVRANG

SEQ ID NO: 155384 - protein, 10 aa, BORRELIA GARINII
EKTIVRANGT

SEQ ID NO: 155385 - protein, 10 aa, BORRELIA GARINII
KTIVRANGTR

SEQ ID NO: 155386 - protein, 10 aa, BORRELIA GARINII
TIVRANGTRL

SEQ ID NO: 155387 - protein, 10 aa, BORRELIA GARINII
IVRANGTRLE

SEQ ID NO: 155388 - protein, 10 aa, BORRELIA GARINII
VRANGTRLEY

SEQ ID NO: 155389 - protein, 10 aa, BORRELIA GARINII
RANGTRLEYT

SEQ ID NO: 155390 - protein, 10 aa, BORRELIA GARINII
ANGTRLEYTD

SEQ ID NO: 155391 - protein, 10 aa, BORRELIA GARINII
NGTRLEYTDI

SEQ ID NO: 155392 - protein, 10 aa, BORRELIA GARINII
GTRLEYTDIK

SEQ ID NO: 155393 - protein, 10 aa, BORRELIA GARINII
TRLEYTDIKS

SEQ ID NO: 155394 - protein, 10 aa, BORRELIA GARINII
RLEYTDIKSD

SEQ ID NO: 155395 - protein, 10 aa, BORRELIA GARINII
LEYTDIKSDG

SEQ ID NO: 155396 - protein, 10 aa, BORRELIA GARINII
EYTDIKSDGS

SEQ ID NO: 155397 - protein, 10 aa, BORRELIA GARINII
YTDIKSDGSG

SEQ ID NO: 155398 - protein, 10 aa, BORRELIA GARINII
TDIKSDGSGK

SEQ ID NO: 155399 - protein, 10 aa, BORRELIA GARINII
DIKSDGSGKA

SEQ ID NO: 155400 - protein, 10 aa, BORRELIA GARINII
IKSDGSGKAK

SEQ ID NO: 155401 - protein, 10 aa, BORRELIA GARINII
KSDGSGKAKE

SEQ ID NO: 155402 - protein, 10 aa, BORRELIA GARINII
SDGSGKAKEV

SEQ ID NO: 155403 - protein, 10 aa, BORRELIA GARINII
DGSGKAKEVL

SEQ ID NO: 155404 - protein, 10 aa, BORRELIA GARINII
GSGKAKEVLK

SEQ ID NO: 155405 - protein, 10 aa, BORRELIA GARINII
SGKAKEVLKD

SEQ ID NO: 155406 - protein, 10 aa, BORRELIA GARINII
GKAKEVLKDF

SEQ ID NO: 155407 - protein, 10 aa, BORRELIA GARINII
KAKEVLKDFT

SEQ ID NO: 155408 - protein, 10 aa, BORRELIA GARINII
AKEVLKDFTL

SEQ ID NO: 155409 - protein, 10 aa, BORRELIA GARINII
KEVLKDFTLE

SEQ ID NO: 155410 - protein, 10 aa, BORRELIA GARINII
EVLKDFTLEG

SEQ ID NO: 155411 - protein, 10 aa, BORRELIA GARINII
VLKDFTLEGT

SEQ ID NO: 155412 - protein, 10 aa, BORRELIA GARINII
LKDFTLEGTL

SEQ ID NO: 155413 - protein, 10 aa, BORRELIA GARINII
KDFTLEGTLA

SEQ ID NO: 155414 - protein, 10 aa, BORRELIA GARINII
DFTLEGTLAA

SEQ ID NO: 155415 - protein, 10 aa, BORRELIA GARINII
FTLEGTLAAD

SEQ ID NO: 155416 - protein, 10 aa, BORRELIA GARINII
TLEGTLAADG

SEQ ID NO: 155417 - protein, 10 aa, BORRELIA GARINII
LEGTLAADGK

SEQ ID NO: 155418 - protein, 10 aa, BORRELIA GARINII
EGTLAADGKT

SEQ ID NO: 155419 - protein, 10 aa, BORRELIA GARINII
GTLAADGKTT

SEQ ID NO: 155420 - protein, 10 aa, BORRELIA GARINII
TLAADGKTTL

SEQ ID NO: 155421 - protein, 10 aa, BORRELIA GARINII
LAADGKTTLK

SEQ ID NO: 155422 - protein, 10 aa, BORRELIA GARINII
AADGKTTLKV

SEQ ID NO: 155423 - protein, 10 aa, BORRELIA GARINII
ADGKTTLKVT

SEQ ID NO: 155424 - protein, 10 aa, BORRELIA GARINII
DGKTTLKVTE

SEQ ID NO: 155425 - protein, 10 aa, BORRELIA GARINII
GKTTLKVTEG

SEQ ID NO: 155426 - protein, 10 aa, BORRELIA GARINII
KTTLKVTEGT

SEQ ID NO: 155427 - protein, 10 aa, BORRELIA GARINII
TTLKVTEGTV

SEQ ID NO: 155428 - protein, 10 aa, BORRELIA GARINII
TLKVTEGTVV

SEQ ID NO: 155429 - protein, 10 aa, BORRELIA GARINII
LKVTEGTVVL

SEQ ID NO: 155430 - protein, 10 aa, BORRELIA GARINII
KVTEGTVVLS

SEQ ID NO: 155431 - protein, 10 aa, BORRELIA GARINII
VTEGTVVLSK

SEQ ID NO: 155432 - protein, 10 aa, BORRELIA GARINII
TEGTVVLSKN

SEQ ID NO: 155433 - protein, 10 aa, BORRELIA GARINII
EGTVVLSKNI

SEQ ID NO: 155434 - protein, 10 aa, BORRELIA GARINII
GTVVLSKNIL

SEQ ID NO: 155435 - protein, 10 aa, BORRELIA GARINII
TVVLSKNILK

SEQ ID NO: 155436 - protein, 10 aa, BORRELIA GARINII
VVLSKNILKS

SEQ ID NO: 155437 - protein, 10 aa, BORRELIA GARINII
VLSKNILKSG

SEQ ID NO: 155438 - protein, 10 aa, BORRELIA GARINII
LSKNILKSGE

SEQ ID NO: 155439 - protein, 10 aa, BORRELIA GARINII
SKNILKSGEI

SEQ ID NO: 155440 - protein, 10 aa, BORRELIA GARINII
KNILKSGEIT

SEQ ID NO: 155441 - protein, 10 aa, BORRELIA GARINII
NILKSGEITV

SEQ ID NO: 155442 - protein, 10 aa, BORRELIA GARINII
ILKSGEITVA

SEQ ID NO: 155443 - protein, 10 aa, BORRELIA GARINII
LKSGEITVAL

SEQ ID NO: 155444 - protein, 10 aa, BORRELIA GARINII
KSGEITVALD

SEQ ID NO: 155445 - protein, 10 aa, BORRELIA GARINII
SGEITVALDD

SEQ ID NO: 155446 - protein, 10 aa, BORRELIA GARINII
GEITVALDDS

SEQ ID NO: 155447 - protein, 10 aa, BORRELIA GARINII
EITVALDDSD

SEQ ID NO: 155448 - protein, 10 aa, BORRELIA GARINII
ITVALDDSDT

SEQ ID NO: 155449 - protein, 10 aa, BORRELIA GARINII
TVALDDSDTT

SEQ ID NO: 155450 - protein, 10 aa, BORRELIA GARINII
VALDDSDTTQ

SEQ ID NO: 155451 - protein, 10 aa, BORRELIA GARINII
ALDDSDTTQA

SEQ ID NO: 155452 - protein, 10 aa, BORRELIA GARINII
LDDSDTTQAT

SEQ ID NO: 155453 - protein, 10 aa, BORRELIA GARINII
DDSDTTQATK

SEQ ID NO: 155454 - protein, 10 aa, BORRELIA GARINII
DSDTTQATKK

SEQ ID NO: 155455 - protein, 10 aa, BORRELIA GARINII
SDTTQATKKT

SEQ ID NO: 155456 - protein, 10 aa, BORRELIA GARINII
DTTQATKKTG

SEQ ID NO: 155457 - protein, 10 aa, BORRELIA GARINII
TTQATKKTGK

SEQ ID NO: 155458 - protein, 10 aa, BORRELIA GARINII
TQATKKTGKW

SEQ ID NO: 155459 - protein, 10 aa, BORRELIA GARINII
QATKKTGKWD

SEQ ID NO: 155460 - protein, 10 aa, BORRELIA GARINII
ATKKTGKWDS

SEQ ID NO: 155461 - protein, 10 aa, BORRELIA GARINII
TKKTGKWDSK

SEQ ID NO: 155462 - protein, 10 aa, BORRELIA GARINII
KKTGKWDSKT

SEQ ID NO: 155463 - protein, 10 aa, BORRELIA GARINII
KTGKWDSKTS

SEQ ID NO: 155464 - protein, 10 aa, BORRELIA GARINII
TGKWDSKTST

SEQ ID NO: 155465 - protein, 10 aa, BORRELIA GARINII
GKWDSKTSTL

SEQ ID NO: 155466 - protein, 10 aa, BORRELIA GARINII
KWDSKTSTLT

SEQ ID NO: 155467 - protein, 10 aa, BORRELIA GARINII
WDSKTSTLTI

SEQ ID NO: 155468 - protein, 10 aa, BORRELIA GARINII
DSKTSTLTIS

SEQ ID NO: 155469 - protein, 10 aa, BORRELIA GARINII
SKTSTLTISV

SEQ ID NO: 155470 - protein, 10 aa, BORRELIA GARINII
KTSTLTISVN

SEQ ID NO: 155471 - protein, 10 aa, BORRELIA GARINII
TSTLTISVNS

SEQ ID NO: 155472 - protein, 10 aa, BORRELIA GARINII
STLTISVNSQ

SEQ ID NO: 155473 - protein, 10 aa, BORRELIA GARINII
TLTISVNSQK

SEQ ID NO: 155474 - protein, 10 aa, BORRELIA GARINII
LTISVNSQKT

SEQ ID NO: 155475 - protein, 10 aa, BORRELIA GARINII
TISVNSQKTK

SEQ ID NO: 155476 - protein, 10 aa, BORRELIA GARINII
ISVNSQKTKN

SEQ ID NO: 155477 - protein, 10 aa, BORRELIA GARINII
SVNSQKTKNL

SEQ ID NO: 155478 - protein, 10 aa, BORRELIA GARINII
VNSQKTKNLV

SEQ ID NO: 155479 - protein, 10 aa, BORRELIA GARINII
NSQKTKNLVF

SEQ ID NO: 155480 - protein, 10 aa, BORRELIA GARINII
SQKTKNLVFT

SEQ ID NO: 155481 - protein, 10 aa, BORRELIA GARINII
QKTKNLVFTK

SEQ ID NO: 155482 - protein, 10 aa, BORRELIA GARINII
KTKNLVFTKE

SEQ ID NO: 155483 - protein, 10 aa, BORRELIA GARINII
TKNLVFTKED

SEQ ID NO: 155484 - protein, 10 aa, BORRELIA GARINII
KNLVFTKEDT

SEQ ID NO: 155485 - protein, 10 aa, BORRELIA GARINII
NLVFTKEDTI

SEQ ID NO: 155486 - protein, 10 aa, BORRELIA GARINII
LVFTKEDTIT

SEQ ID NO: 155487 - protein, 10 aa, BORRELIA GARINII
VFTKEDTITV

SEQ ID NO: 155488 - protein, 10 aa, BORRELIA GARINII
FTKEDTITVQ

SEQ ID NO: 155489 - protein, 10 aa, BORRELIA GARINII
TKEDTITVQK

SEQ ID NO: 155490 - protein, 10 aa, BORRELIA GARINII
KEDTITVQKY

SEQ ID NO: 155491 - protein, 10 aa, BORRELIA GARINII
EDTITVQKYD

SEQ ID NO: 155492 - protein, 10 aa, BORRELIA GARINII
DTITVQKYDS

SEQ ID NO: 155493 - protein, 10 aa, BORRELIA GARINII
TITVQKYDSA

SEQ ID NO: 155494 - protein, 10 aa, BORRELIA GARINII
ITVQKYDSAG

SEQ ID NO: 155495 - protein, 10 aa, BORRELIA GARINII
TVQKYDSAGT

SEQ ID NO: 155496 - protein, 10 aa, BORRELIA GARINII
VQKYDSAGTN

SEQ ID NO: 155497 - protein, 10 aa, BORRELIA GARINII
QKYDSAGTNL

SEQ ID NO: 155498 - protein, 10 aa, BORRELIA GARINII
KYDSAGTNLE

SEQ ID NO: 155499 - protein, 10 aa, BORRELIA GARINII
YDSAGTNLEG

SEQ ID NO: 155500 - protein, 10 aa, BORRELIA GARINII
DSAGTNLEGK

SEQ ID NO: 155501 - protein, 10 aa, BORRELIA GARINII
SAGTNLEGKA

SEQ ID NO: 155502 - protein, 10 aa, BORRELIA GARINII
AGTNLEGKAV

SEQ ID NO: 155503 - protein, 10 aa, BORRELIA GARINII
GTNLEGKAVE

SEQ ID NO: 155504 - protein, 10 aa, BORRELIA GARINII
TNLEGKAVEI

SEQ ID NO: 155505 - protein, 10 aa, BORRELIA GARINII
NLEGKAVEIT

SEQ ID NO: 155506 - protein, 10 aa, BORRELIA GARINII
LEGKAVEITT

SEQ ID NO: 155507 - protein, 10 aa, BORRELIA GARINII
EGKAVEITTL

SEQ ID NO: 155508 - protein, 10 aa, BORRELIA GARINII
GKAVEITTLE

SEQ ID NO: 155509 - protein, 10 aa, BORRELIA GARINII
KAVEITTLEK

SEQ ID NO: 155510 - protein, 10 aa, BORRELIA GARINII
AVEITTLEKL

SEQ ID NO: 155511 - protein, 10 aa, BORRELIA GARINII
VEITTLEKLK

SEQ ID NO: 155512 - protein, 10 aa, BORRELIA GARINII
EITTLEKLKD

SEQ ID NO: 155513 - protein, 10 aa, BORRELIA GARINII
ITTLEKLKDA

SEQ ID NO: 155514 - protein, 10 aa, BORRELIA GARINII
TTLEKLKDAL

SEQ ID NO: 155515 - protein, 10 aa, BORRELIA GARINII
TLEKLKDALK

SEQ ID NO: 155516 - protein, 11 aa, BORRELIA GARINII
MKKYLLGIGLI

SEQ ID NO: 155517 - protein, 11 aa, BORRELIA GARINII
KKYLLGIGLIL

SEQ ID NO: 155518 - protein, 11 aa, BORRELIA GARINII
KYLLGIGLILA

SEQ ID NO: 155519 - protein, 11 aa, BORRELIA GARINII
YLLGIGLILAL

SEQ ID NO: 155520 - protein, 11 aa, BORRELIA GARINII
LLGIGLILALI

SEQ ID NO: 155521 - protein, 11 aa, BORRELIA GARINII
LGIGLILALIA

SEQ ID NO: 155522 - protein, 11 aa, BORRELIA GARINII
GIGLILALIAC

SEQ ID NO: 155523 - protein, 11 aa, BORRELIA GARINII
IGLILALIACK

SEQ ID NO: 155524 - protein, 11 aa, BORRELIA GARINII
GLILALIACKQ

SEQ ID NO: 155525 - protein, 11 aa, BORRELIA GARINII
LILALIACKQN

SEQ ID NO: 155526 - protein, 11 aa, BORRELIA GARINII
ILALIACKQNV

SEQ ID NO: 155527 - protein, 11 aa, BORRELIA GARINII
LALIACKQNVS

SEQ ID NO: 155528 - protein, 11 aa, BORRELIA GARINII
ALIACKQNVSS

SEQ ID NO: 155529 - protein, 11 aa, BORRELIA GARINII
LIACKQNVSSL

SEQ ID NO: 155530 - protein, 11 aa, BORRELIA GARINII
IACKQNVSSLD

SEQ ID NO: 155531 - protein, 11 aa, BORRELIA GARINII
ACKQNVSSLDE

SEQ ID NO: 155532 - protein, 11 aa, BORRELIA GARINII
CKQNVSSLDEK

SEQ ID NO: 155533 - protein, 11 aa, BORRELIA GARINII
KQNVSSLDEKN

SEQ ID NO: 155534 - protein, 11 aa, BORRELIA GARINII
QNVSSLDEKNS

SEQ ID NO: 155535 - protein, 11 aa, BORRELIA GARINII
NVSSLDEKNSV

SEQ ID NO: 155536 - protein, 11 aa, BORRELIA GARINII
VSSLDEKNSVS

SEQ ID NO: 155537 - protein, 11 aa, BORRELIA GARINII
SSLDEKNSVSV

SEQ ID NO: 155538 - protein, 11 aa, BORRELIA GARINII
SLDEKNSVSVD

SEQ ID NO: 155539 - protein, 11 aa, BORRELIA GARINII
LDEKNSVSVDL

SEQ ID NO: 155540 - protein, 11 aa, BORRELIA GARINII
DEKNSVSVDLP

SEQ ID NO: 155541 - protein, 11 aa, BORRELIA GARINII
EKNSVSVDLPG

SEQ ID NO: 155542 - protein, 11 aa, BORRELIA GARINII
KNSVSVDLPGG

SEQ ID NO: 155543 - protein, 11 aa, BORRELIA GARINII
NSVSVDLPGGM

SEQ ID NO: 155544 - protein, 11 aa, BORRELIA GARINII
SVSVDLPGGMK

SEQ ID NO: 155545 - protein, 11 aa, BORRELIA GARINII
VSVDLPGGMKV

SEQ ID NO: 155546 - protein, 11 aa, BORRELIA GARINII
SVDLPGGMKVL

SEQ ID NO: 155547 - protein, 11 aa, BORRELIA GARINII
VDLPGGMKVLV

SEQ ID NO: 155548 - protein, 11 aa, BORRELIA GARINII
DLPGGMKVLVS

SEQ ID NO: 155549 - protein, 11 aa, BORRELIA GARINII
LPGGMKVLVSK

SEQ ID NO: 155550 - protein, 11 aa, BORRELIA GARINII
PGGMKVLVSKE

SEQ ID NO: 155551 - protein, 11 aa, BORRELIA GARINII
GGMKVLVSKEK

SEQ ID NO: 155552 - protein, 11 aa, BORRELIA GARINII
GMKVLVSKEKD

SEQ ID NO: 155553 - protein, 11 aa, BORRELIA GARINII
MKVLVSKEKDK

SEQ ID NO: 155554 - protein, 11 aa, BORRELIA GARINII
KVLVSKEKDKD

SEQ ID NO: 155555 - protein, 11 aa, BORRELIA GARINII
VLVSKEKDKDG

SEQ ID NO: 155556 - protein, 11 aa, BORRELIA GARINII
LVSKEKDKDGK

SEQ ID NO: 155557 - protein, 11 aa, BORRELIA GARINII
VSKEKDKDGKY

SEQ ID NO: 155558 - protein, 11 aa, BORRELIA GARINII
SKEKDKDGKYS

SEQ ID NO: 155559 - protein, 11 aa, BORRELIA GARINII
KEKDKDGKYSL

SEQ ID NO: 155560 - protein, 11 aa, BORRELIA GARINII
EKDKDGKYSLM

SEQ ID NO: 155561 - protein, 11 aa, BORRELIA GARINII
KDKDGKYSLMA

SEQ ID NO: 155562 - protein, 11 aa, BORRELIA GARINII
DKDGKYSLMAT

SEQ ID NO: 155563 - protein, 11 aa, BORRELIA GARINII
KDGKYSLMATV

SEQ ID NO: 155564 - protein, 11 aa, BORRELIA GARINII
DGKYSLMATVE

SEQ ID NO: 155565 - protein, 11 aa, BORRELIA GARINII
GKYSLMATVEK

SEQ ID NO: 155566 - protein, 11 aa, BORRELIA GARINII
KYSLMATVEKL

SEQ ID NO: 155567 - protein, 11 aa, BORRELIA GARINII
YSLMATVEKLE

SEQ ID NO: 155568 - protein, 11 aa, BORRELIA GARINII
SLMATVEKLEL

SEQ ID NO: 155569 - protein, 11 aa, BORRELIA GARINII
LMATVEKLELK

SEQ ID NO: 155570 - protein, 11 aa, BORRELIA GARINII
MATVEKLELKG

SEQ ID NO: 155571 - protein, 11 aa, BORRELIA GARINII
ATVEKLELKGT

SEQ ID NO: 155572 - protein, 11 aa, BORRELIA GARINII
TVEKLELKGTS

SEQ ID NO: 155573 - protein, 11 aa, BORRELIA GARINII
VEKLELKGTSD

SEQ ID NO: 155574 - protein, 11 aa, BORRELIA GARINII
EKLELKGTSDK

SEQ ID NO: 155575 - protein, 11 aa, BORRELIA GARINII
KLELKGTSDKN

SEQ ID NO: 155576 - protein, 11 aa, BORRELIA GARINII
LELKGTSDKNN

SEQ ID NO: 155577 - protein, 11 aa, BORRELIA GARINII
ELKGTSDKNNG

SEQ ID NO: 155578 - protein, 11 aa, BORRELIA GARINII
LKGTSDKNNGS

SEQ ID NO: 155579 - protein, 11 aa, BORRELIA GARINII
KGTSDKNNGSG

SEQ ID NO: 155580 - protein, 11 aa, BORRELIA GARINII
GTSDKNNGSGT

SEQ ID NO: 155581 - protein, 11 aa, BORRELIA GARINII
TSDKNNGSGTL

SEQ ID NO: 155582 - protein, 11 aa, BORRELIA GARINII
SDKNNGSGTLE

SEQ ID NO: 155583 - protein, 11 aa, BORRELIA GARINII
DKNNGSGTLEG

SEQ ID NO: 155584 - protein, 11 aa, BORRELIA GARINII
KNNGSGTLEGE

SEQ ID NO: 155585 - protein, 11 aa, BORRELIA GARINII
NNGSGTLEGEK

SEQ ID NO: 155586 - protein, 11 aa, BORRELIA GARINII
NGSGTLEGEKT

SEQ ID NO: 155587 - protein, 11 aa, BORRELIA GARINII
GSGTLEGEKTD

SEQ ID NO: 155588 - protein, 11 aa, BORRELIA GARINII
SGTLEGEKTDK

SEQ ID NO: 155589 - protein, 11 aa, BORRELIA GARINII
GTLEGEKTDKS

SEQ ID NO: 155590 - protein, 11 aa, BORRELIA GARINII
TLEGEKTDKSK

SEQ ID NO: 155591 - protein, 11 aa, BORRELIA GARINII
LEGEKTDKSKV

SEQ ID NO: 155592 - protein, 11 aa, BORRELIA GARINII
EGEKTDKSKVK

SEQ ID NO: 155593 - protein, 11 aa, BORRELIA GARINII
GEKTDKSKVKL

SEQ ID NO: 155594 - protein, 11 aa, BORRELIA GARINII
EKTDKSKVKLT

SEQ ID NO: 155595 - protein, 11 aa, BORRELIA GARINII
KTDKSKVKLTI

SEQ ID NO: 155596 - protein, 11 aa, BORRELIA GARINII
TDKSKVKLTIA

SEQ ID NO: 155597 - protein, 11 aa, BORRELIA GARINII
DKSKVKLTIAE

SEQ ID NO: 155598 - protein, 11 aa, BORRELIA GARINII
KSKVKLTIAED

SEQ ID NO: 155599 - protein, 11 aa, BORRELIA GARINII
SKVKLTIAEDL

SEQ ID NO: 155600 - protein, 11 aa, BORRELIA GARINII
KVKLTIAEDLS

SEQ ID NO: 155601 - protein, 11 aa, BORRELIA GARINII
VKLTIAEDLSK

SEQ ID NO: 155602 - protein, 11 aa, BORRELIA GARINII
KLTIAEDLSKT

SEQ ID NO: 155603 - protein, 11 aa, BORRELIA GARINII
LTIAEDLSKTT

SEQ ID NO: 155604 - protein, 11 aa, BORRELIA GARINII
TIAEDLSKTTF

SEQ ID NO: 155605 - protein, 11 aa, BORRELIA GARINII
IAEDLSKTTFE

SEQ ID NO: 155606 - protein, 11 aa, BORRELIA GARINII
AEDLSKTTFEI

SEQ ID NO: 155607 - protein, 11 aa, BORRELIA GARINII
EDLSKTTFEIF

SEQ ID NO: 155608 - protein, 11 aa, BORRELIA GARINII
DLSKTTFEIFK

SEQ ID NO: 155609 - protein, 11 aa, BORRELIA GARINII
LSKTTFEIFKE

SEQ ID NO: 155610 - protein, 11 aa, BORRELIA GARINII
SKTTFEIFKED

SEQ ID NO: 155611 - protein, 11 aa, BORRELIA GARINII
KTTFEIFKEDG

SEQ ID NO: 155612 - protein, 11 aa, BORRELIA GARINII
TTFEIFKEDGK

SEQ ID NO: 155613 - protein, 11 aa, BORRELIA GARINII
TFEIFKEDGKT

SEQ ID NO: 155614 - protein, 11 aa, BORRELIA GARINII
FEIFKEDGKTL

SEQ ID NO: 155615 - protein, 11 aa, BORRELIA GARINII
EIFKEDGKTLV

SEQ ID NO: 155616 - protein, 11 aa, BORRELIA GARINII
IFKEDGKTLVS

SEQ ID NO: 155617 - protein, 11 aa, BORRELIA GARINII
FKEDGKTLVSK

SEQ ID NO: 155618 - protein, 11 aa, BORRELIA GARINII
KEDGKTLVSKK

SEQ ID NO: 155619 - protein, 11 aa, BORRELIA GARINII
EDGKTLVSKKV

SEQ ID NO: 155620 - protein, 11 aa, BORRELIA GARINII
DGKTLVSKKVT

SEQ ID NO: 155621 - protein, 11 aa, BORRELIA GARINII
GKTLVSKKVTL

SEQ ID NO: 155622 - protein, 11 aa, BORRELIA GARINII
KTLVSKKVTLK

SEQ ID NO: 155623 - protein, 11 aa, BORRELIA GARINII
TLVSKKVTLKD

SEQ ID NO: 155624 - protein, 11 aa, BORRELIA GARINII
LVSKKVTLKDK

SEQ ID NO: 155625 - protein, 11 aa, BORRELIA GARINII
VSKKVTLKDKS

SEQ ID NO: 155626 - protein, 11 aa, BORRELIA GARINII
SKKVTLKDKSS

SEQ ID NO: 155627 - protein, 11 aa, BORRELIA GARINII
KKVTLKDKSST

SEQ ID NO: 155628 - protein, 11 aa, BORRELIA GARINII
KVTLKDKSSTE

SEQ ID NO: 155629 - protein, 11 aa, BORRELIA GARINII
VTLKDKSSTEE

SEQ ID NO: 155630 - protein, 11 aa, BORRELIA GARINII
TLKDKSSTEEK

SEQ ID NO: 155631 - protein, 11 aa, BORRELIA GARINII
LKDKSSTEEKF

SEQ ID NO: 155632 - protein, 11 aa, BORRELIA GARINII
KDKSSTEEKFN

SEQ ID NO: 155633 - protein, 11 aa, BORRELIA GARINII
DKSSTEEKFNE

SEQ ID NO: 155634 - protein, 11 aa, BORRELIA GARINII
KSSTEEKFNEK

SEQ ID NO: 155635 - protein, 11 aa, BORRELIA GARINII
SSTEEKFNEKG

SEQ ID NO: 155636 - protein, 11 aa, BORRELIA GARINII
STEEKFNEKGE

SEQ ID NO: 155637 - protein, 11 aa, BORRELIA GARINII
TEEKFNEKGEI

SEQ ID NO: 155638 - protein, 11 aa, BORRELIA GARINII
EEKFNEKGEIS

SEQ ID NO: 155639 - protein, 11 aa, BORRELIA GARINII
EKFNEKGEISE

SEQ ID NO: 155640 - protein, 11 aa, BORRELIA GARINII
KFNEKGEISEK

SEQ ID NO: 155641 - protein, 11 aa, BORRELIA GARINII
FNEKGEISEKT

SEQ ID NO: 155642 - protein, 11 aa, BORRELIA GARINII
NEKGEISEKTI

SEQ ID NO: 155643 - protein, 11 aa, BORRELIA GARINII
EKGEISEKTIV

SEQ ID NO: 155644 - protein, 11 aa, BORRELIA GARINII
KGEISEKTIVR

SEQ ID NO: 155645 - protein, 11 aa, BORRELIA GARINII
GEISEKTIVRA

SEQ ID NO: 155646 - protein, 11 aa, BORRELIA GARINII
EISEKTIVRAN

SEQ ID NO: 155647 - protein, 11 aa, BORRELIA GARINII
ISEKTIVRANG

SEQ ID NO: 155648 - protein, 11 aa, BORRELIA GARINII
SEKTIVRANGT

SEQ ID NO: 155649 - protein, 11 aa, BORRELIA GARINII
EKTIVRANGTR

SEQ ID NO: 155650 - protein, 11 aa, BORRELIA GARINII
KTIVRANGTRL

SEQ ID NO: 155651 - protein, 11 aa, BORRELIA GARINII
TIVRANGTRLE

SEQ ID NO: 155652 - protein, 11 aa, BORRELIA GARINII
IVRANGTRLEY

SEQ ID NO: 155653 - protein, 11 aa, BORRELIA GARINII
VRANGTRLEYT

SEQ ID NO: 155654 - protein, 11 aa, BORRELIA GARINII
RANGTRLEYTD

SEQ ID NO: 155655 - protein, 11 aa, BORRELIA GARINII
ANGTRLEYTDI

SEQ ID NO: 155656 - protein, 11 aa, BORRELIA GARINII
NGTRLEYTDIK

SEQ ID NO: 155657 - protein, 11 aa, BORRELIA GARINII
GTRLEYTDIKS

SEQ ID NO: 155658 - protein, 11 aa, BORRELIA GARINII
TRLEYTDIKSD

SEQ ID NO: 155659 - protein, 11 aa, BORRELIA GARINII
RLEYTDIKSDG

SEQ ID NO: 155660 - protein, 11 aa, BORRELIA GARINII
LEYTDIKSDGS

SEQ ID NO: 155661 - protein, 11 aa, BORRELIA GARINII
EYTDIKSDGSG

SEQ ID NO: 155662 - protein, 11 aa, BORRELIA GARINII
YTDIKSDGSGK

SEQ ID NO: 155663 - protein, 11 aa, BORRELIA GARINII
TDIKSDGSGKA

SEQ ID NO: 155664 - protein, 11 aa, BORRELIA GARINII
DIKSDGSGKAK

SEQ ID NO: 155665 - protein, 11 aa, BORRELIA GARINII
IKSDGSGKAKE

SEQ ID NO: 155666 - protein, 11 aa, BORRELIA GARINII
KSDGSGKAKEV

SEQ ID NO: 155667 - protein, 11 aa, BORRELIA GARINII
SDGSGKAKEVL

SEQ ID NO: 155668 - protein, 11 aa, BORRELIA GARINII
DGSGKAKEVLK

SEQ ID NO: 155669 - protein, 11 aa, BORRELIA GARINII
GSGKAKEVLKD

SEQ ID NO: 155670 - protein, 11 aa, BORRELIA GARINII
SGKAKEVLKDF

SEQ ID NO: 155671 - protein, 11 aa, BORRELIA GARINII
GKAKEVLKDFT

SEQ ID NO: 155672 - protein, 11 aa, BORRELIA GARINII
KAKEVLKDFTL

SEQ ID NO: 155673 - protein, 11 aa, BORRELIA GARINII
AKEVLKDFTLE

SEQ ID NO: 155674 - protein, 11 aa, BORRELIA GARINII
KEVLKDFTLEG

SEQ ID NO: 155675 - protein, 11 aa, BORRELIA GARINII
EVLKDFTLEGT

SEQ ID NO: 155676 - protein, 11 aa, BORRELIA GARINII
VLKDFTLEGTL

SEQ ID NO: 155677 - protein, 11 aa, BORRELIA GARINII
LKDFTLEGTLA

SEQ ID NO: 155678 - protein, 11 aa, BORRELIA GARINII
KDFTLEGTLAA

SEQ ID NO: 155679 - protein, 11 aa, BORRELIA GARINII
DFTLEGTLAAD

SEQ ID NO: 155680 - protein, 11 aa, BORRELIA GARINII
FTLEGTLAADG

SEQ ID NO: 155681 - protein, 11 aa, BORRELIA GARINII
TLEGTLAADGK

SEQ ID NO: 155682 - protein, 11 aa, BORRELIA GARINII
LEGTLAADGKT

SEQ ID NO: 155683 - protein, 11 aa, BORRELIA GARINII
EGTLAADGKTT

SEQ ID NO: 155684 - protein, 11 aa, BORRELIA GARINII
GTLAADGKTTL

SEQ ID NO: 155685 - protein, 11 aa, BORRELIA GARINII
TLAADGKTTLK

SEQ ID NO: 155686 - protein, 11 aa, BORRELIA GARINII
LAADGKTTLKV

SEQ ID NO: 155687 - protein, 11 aa, BORRELIA GARINII
AADGKTTLKVT

SEQ ID NO: 155688 - protein, 11 aa, BORRELIA GARINII
ADGKTTLKVTE

SEQ ID NO: 155689 - protein, 11 aa, BORRELIA GARINII
DGKTTLKVTEG

SEQ ID NO: 155690 - protein, 11 aa, BORRELIA GARINII
GKTTLKVTEGT

SEQ ID NO: 155691 - protein, 11 aa, BORRELIA GARINII
KTTLKVTEGTV

SEQ ID NO: 155692 - protein, 11 aa, BORRELIA GARINII
TTLKVTEGTVV

SEQ ID NO: 155693 - protein, 11 aa, BORRELIA GARINII
TLKVTEGTVVL

SEQ ID NO: 155694 - protein, 11 aa, BORRELIA GARINII
LKVTEGTVVLS

SEQ ID NO: 155695 - protein, 11 aa, BORRELIA GARINII
KVTEGTVVLSK

SEQ ID NO: 155696 - protein, 11 aa, BORRELIA GARINII
VTEGTVVLSKN

SEQ ID NO: 155697 - protein, 11 aa, BORRELIA GARINII
TEGTVVLSKNI

SEQ ID NO: 155698 - protein, 11 aa, BORRELIA GARINII
EGTVVLSKNIL

SEQ ID NO: 155699 - protein, 11 aa, BORRELIA GARINII
GTVVLSKNILK

SEQ ID NO: 155700 - protein, 11 aa, BORRELIA GARINII
TVVLSKNILKS

SEQ ID NO: 155701 - protein, 11 aa, BORRELIA GARINII
VVLSKNILKSG

SEQ ID NO: 155702 - protein, 11 aa, BORRELIA GARINII
VLSKNILKSGE

SEQ ID NO: 155703 - protein, 11 aa, BORRELIA GARINII
LSKNILKSGEI

SEQ ID NO: 155704 - protein, 11 aa, BORRELIA GARINII
SKNILKSGEIT

SEQ ID NO: 155705 - protein, 11 aa, BORRELIA GARINII
KNILKSGEITV

SEQ ID NO: 155706 - protein, 11 aa, BORRELIA GARINII
NILKSGEITVA

SEQ ID NO: 155707 - protein, 11 aa, BORRELIA GARINII
ILKSGEITVAL

SEQ ID NO: 155708 - protein, 11 aa, BORRELIA GARINII
LKSGEITVALD

SEQ ID NO: 155709 - protein, 11 aa, BORRELIA GARINII
KSGEITVALDD

SEQ ID NO: 155710 - protein, 11 aa, BORRELIA GARINII
SGEITVALDDS

SEQ ID NO: 155711 - protein, 11 aa, BORRELIA GARINII
GEITVALDDSD

SEQ ID NO: 155712 - protein, 11 aa, BORRELIA GARINII
EITVALDDSDT

SEQ ID NO: 155713 - protein, 11 aa, BORRELIA GARINII
ITVALDDSDTT

SEQ ID NO: 155714 - protein, 11 aa, BORRELIA GARINII
TVALDDSDTTQ

SEQ ID NO: 155715 - protein, 11 aa, BORRELIA GARINII
VALDDSDTTQA

SEQ ID NO: 155716 - protein, 11 aa, BORRELIA GARINII
ALDDSDTTQAT

SEQ ID NO: 155717 - protein, 11 aa, BORRELIA GARINII
LDDSDTTQATK

SEQ ID NO: 155718 - protein, 11 aa, BORRELIA GARINII
DDSDTTQATKK

SEQ ID NO: 155719 - protein, 11 aa, BORRELIA GARINII
DSDTTQATKKT

SEQ ID NO: 155720 - protein, 11 aa, BORRELIA GARINII
SDTTQATKKTG

SEQ ID NO: 155721 - protein, 11 aa, BORRELIA GARINII
DTTQATKKTGK

SEQ ID NO: 155722 - protein, 11 aa, BORRELIA GARINII
TTQATKKTGKW

SEQ ID NO: 155723 - protein, 11 aa, BORRELIA GARINII
TQATKKTGKWD

SEQ ID NO: 155724 - protein, 11 aa, BORRELIA GARINII
QATKKTGKWDS

SEQ ID NO: 155725 - protein, 11 aa, BORRELIA GARINII
ATKKTGKWDSK

SEQ ID NO: 155726 - protein, 11 aa, BORRELIA GARINII
TKKTGKWDSKT

SEQ ID NO: 155727 - protein, 11 aa, BORRELIA GARINII
KKTGKWDSKTS

SEQ ID NO: 155728 - protein, 11 aa, BORRELIA GARINII
KTGKWDSKTST

SEQ ID NO: 155729 - protein, 11 aa, BORRELIA GARINII
TGKWDSKTSTL

SEQ ID NO: 155730 - protein, 11 aa, BORRELIA GARINII
GKWDSKTSTLT

SEQ ID NO: 155731 - protein, 11 aa, BORRELIA GARINII
KWDSKTSTLTI

SEQ ID NO: 155732 - protein, 11 aa, BORRELIA GARINII
WDSKTSTLTIS

SEQ ID NO: 155733 - protein, 11 aa, BORRELIA GARINII
DSKTSTLTISV

SEQ ID NO: 155734 - protein, 11 aa, BORRELIA GARINII
SKTSTLTISVN

SEQ ID NO: 155735 - protein, 11 aa, BORRELIA GARINII
KTSTLTISVNS

SEQ ID NO: 155736 - protein, 11 aa, BORRELIA GARINII
TSTLTISVNSQ

SEQ ID NO: 155737 - protein, 11 aa, BORRELIA GARINII
STLTISVNSQK

SEQ ID NO: 155738 - protein, 11 aa, BORRELIA GARINII
TLTISVNSQKT

SEQ ID NO: 155739 - protein, 11 aa, BORRELIA GARINII
LTISVNSQKTK

SEQ ID NO: 155740 - protein, 11 aa, BORRELIA GARINII
TISVNSQKTKN

SEQ ID NO: 155741 - protein, 11 aa, BORRELIA GARINII
ISVNSQKTKNL

SEQ ID NO: 155742 - protein, 11 aa, BORRELIA GARINII
SVNSQKTKNLV

SEQ ID NO: 155743 - protein, 11 aa, BORRELIA GARINII
VNSQKTKNLVF

SEQ ID NO: 155744 - protein, 11 aa, BORRELIA GARINII
NSQKTKNLVFT

SEQ ID NO: 155745 - protein, 11 aa, BORRELIA GARINII
SQKTKNLVFTK

SEQ ID NO: 155746 - protein, 11 aa, BORRELIA GARINII
QKTKNLVFTKE

SEQ ID NO: 155747 - protein, 11 aa, BORRELIA GARINII
KTKNLVFTKED

SEQ ID NO: 155748 - protein, 11 aa, BORRELIA GARINII
TKNLVFTKEDT

SEQ ID NO: 155749 - protein, 11 aa, BORRELIA GARINII
KNLVFTKEDTI

SEQ ID NO: 155750 - protein, 11 aa, BORRELIA GARINII
NLVFTKEDTIT

SEQ ID NO: 155751 - protein, 11 aa, BORRELIA GARINII
LVFTKEDTITV

SEQ ID NO: 155752 - protein, 11 aa, BORRELIA GARINII
VFTKEDTITVQ

SEQ ID NO: 155753 - protein, 11 aa, BORRELIA GARINII
FTKEDTITVQK

SEQ ID NO: 155754 - protein, 11 aa, BORRELIA GARINII
TKEDTITVQKY

SEQ ID NO: 155755 - protein, 11 aa, BORRELIA GARINII
KEDTITVQKYD

SEQ ID NO: 155756 - protein, 11 aa, BORRELIA GARINII
EDTITVQKYDS

SEQ ID NO: 155757 - protein, 11 aa, BORRELIA GARINII
DTITVQKYDSA

SEQ ID NO: 155758 - protein, 11 aa, BORRELIA GARINII
TITVQKYDSAG

SEQ ID NO: 155759 - protein, 11 aa, BORRELIA GARINII
ITVQKYDSAGT

SEQ ID NO: 155760 - protein, 11 aa, BORRELIA GARINII
TVQKYDSAGTN

SEQ ID NO: 155761 - protein, 11 aa, BORRELIA GARINII
VQKYDSAGTNL

SEQ ID NO: 155762 - protein, 11 aa, BORRELIA GARINII
QKYDSAGTNLE

SEQ ID NO: 155763 - protein, 11 aa, BORRELIA GARINII
KYDSAGTNLEG

SEQ ID NO: 155764 - protein, 11 aa, BORRELIA GARINII
YDSAGTNLEGK

SEQ ID NO: 155765 - protein, 11 aa, BORRELIA GARINII
DSAGTNLEGKA

SEQ ID NO: 155766 - protein, 11 aa, BORRELIA GARINII
SAGTNLEGKAV

SEQ ID NO: 155767 - protein, 11 aa, BORRELIA GARINII
AGTNLEGKAVE

SEQ ID NO: 155768 - protein, 11 aa, BORRELIA GARINII
GTNLEGKAVEI

SEQ ID NO: 155769 - protein, 11 aa, BORRELIA GARINII
TNLEGKAVEIT

SEQ ID NO: 155770 - protein, 11 aa, BORRELIA GARINII
NLEGKAVEITT

SEQ ID NO: 155771 - protein, 11 aa, BORRELIA GARINII
LEGKAVEITTL

SEQ ID NO: 155772 - protein, 11 aa, BORRELIA GARINII
EGKAVEITTLE

SEQ ID NO: 155773 - protein, 11 aa, BORRELIA GARINII
GKAVEITTLEK

SEQ ID NO: 155774 - protein, 11 aa, BORRELIA GARINII
KAVEITTLEKL

SEQ ID NO: 155775 - protein, 11 aa, BORRELIA GARINII
AVEITTLEKLK

SEQ ID NO: 155776 - protein, 11 aa, BORRELIA GARINII
VEITTLEKLKD

SEQ ID NO: 155777 - protein, 11 aa, BORRELIA GARINII
EITTLEKLKDA

SEQ ID NO: 155778 - protein, 11 aa, BORRELIA GARINII
ITTLEKLKDAL

SEQ ID NO: 155779 - protein, 11 aa, BORRELIA GARINII
TTLEKLKDALK

SEQ ID NO: 155780 - protein, 13 aa, BORRELIA GARINII
MKKYLLGIGLILA

SEQ ID NO: 155781 - protein, 13 aa, BORRELIA GARINII
KKYLLGIGLILAL

SEQ ID NO: 155782 - protein, 13 aa, BORRELIA GARINII
KYLLGIGLILALI

SEQ ID NO: 155783 - protein, 13 aa, BORRELIA GARINII
YLLGIGLILALIA

SEQ ID NO: 155784 - protein, 13 aa, BORRELIA GARINII
LLGIGLILALIAC

SEQ ID NO: 155785 - protein, 13 aa, BORRELIA GARINII
LGIGLILALIACK

SEQ ID NO: 155786 - protein, 13 aa, BORRELIA GARINII
GIGLILALIACKQ

SEQ ID NO: 155787 - protein, 13 aa, BORRELIA GARINII
IGLILALIACKQN

SEQ ID NO: 155788 - protein, 13 aa, BORRELIA GARINII
GLILALIACKQNV

SEQ ID NO: 155789 - protein, 13 aa, BORRELIA GARINII
LILALIACKQNVS

SEQ ID NO: 155790 - protein, 13 aa, BORRELIA GARINII
ILALIACKQNVSS

SEQ ID NO: 155791 - protein, 13 aa, BORRELIA GARINII
LALIACKQNVSSL

SEQ ID NO: 155792 - protein, 13 aa, BORRELIA GARINII
ALIACKQNVSSLD

SEQ ID NO: 155793 - protein, 13 aa, BORRELIA GARINII
LIACKQNVSSLDE

SEQ ID NO: 155794 - protein, 13 aa, BORRELIA GARINII
IACKQNVSSLDEK

SEQ ID NO: 155795 - protein, 13 aa, BORRELIA GARINII
ACKQNVSSLDEKN

SEQ ID NO: 155796 - protein, 13 aa, BORRELIA GARINII
CKQNVSSLDEKNS

SEQ ID NO: 155797 - protein, 13 aa, BORRELIA GARINII
KQNVSSLDEKNSV

SEQ ID NO: 155798 - protein, 13 aa, BORRELIA GARINII
QNVSSLDEKNSVS

SEQ ID NO: 155799 - protein, 13 aa, BORRELIA GARINII
NVSSLDEKNSVSV

SEQ ID NO: 155800 - protein, 13 aa, BORRELIA GARINII
VSSLDEKNSVSVD

SEQ ID NO: 155801 - protein, 13 aa, BORRELIA GARINII
SSLDEKNSVSVDL

SEQ ID NO: 155802 - protein, 13 aa, BORRELIA GARINII
SLDEKNSVSVDLP

SEQ ID NO: 155803 - protein, 13 aa, BORRELIA GARINII
LDEKNSVSVDLPG

SEQ ID NO: 155804 - protein, 13 aa, BORRELIA GARINII
DEKNSVSVDLPGG

SEQ ID NO: 155805 - protein, 13 aa, BORRELIA GARINII
EKNSVSVDLPGGM

SEQ ID NO: 155806 - protein, 13 aa, BORRELIA GARINII
KNSVSVDLPGGMK

SEQ ID NO: 155807 - protein, 13 aa, BORRELIA GARINII
NSVSVDLPGGMKV

SEQ ID NO: 155808 - protein, 13 aa, BORRELIA GARINII
SVSVDLPGGMKVL

SEQ ID NO: 155809 - protein, 13 aa, BORRELIA GARINII
VSVDLPGGMKVLV

SEQ ID NO: 155810 - protein, 13 aa, BORRELIA GARINII
SVDLPGGMKVLVS

SEQ ID NO: 155811 - protein, 13 aa, BORRELIA GARINII
VDLPGGMKVLVSK

SEQ ID NO: 155812 - protein, 13 aa, BORRELIA GARINII
DLPGGMKVLVSKE

SEQ ID NO: 155813 - protein, 13 aa, BORRELIA GARINII
LPGGMKVLVSKEK

SEQ ID NO: 155814 - protein, 13 aa, BORRELIA GARINII
PGGMKVLVSKEKD

SEQ ID NO: 155815 - protein, 13 aa, BORRELIA GARINII
GGMKVLVSKEKDK

SEQ ID NO: 155816 - protein, 13 aa, BORRELIA GARINII
GMKVLVSKEKDKD

SEQ ID NO: 155817 - protein, 13 aa, BORRELIA GARINII
MKVLVSKEKDKDG

SEQ ID NO: 155818 - protein, 13 aa, BORRELIA GARINII
KVLVSKEKDKDGK

SEQ ID NO: 155819 - protein, 13 aa, BORRELIA GARINII
VLVSKEKDKDGKY

SEQ ID NO: 155820 - protein, 13 aa, BORRELIA GARINII
LVSKEKDKDGKYS

SEQ ID NO: 155821 - protein, 13 aa, BORRELIA GARINII
VSKEKDKDGKYSL

SEQ ID NO: 155822 - protein, 13 aa, BORRELIA GARINII
SKEKDKDGKYSLM

SEQ ID NO: 155823 - protein, 13 aa, BORRELIA GARINII
KEKDKDGKYSLMA

SEQ ID NO: 155824 - protein, 13 aa, BORRELIA GARINII
EKDKDGKYSLMAT

SEQ ID NO: 155825 - protein, 13 aa, BORRELIA GARINII
KDKDGKYSLMATV

SEQ ID NO: 155826 - protein, 13 aa, BORRELIA GARINII
DKDGKYSLMATVE

SEQ ID NO: 155827 - protein, 13 aa, BORRELIA GARINII
KDGKYSLMATVEK

SEQ ID NO: 155828 - protein, 13 aa, BORRELIA GARINII
DGKYSLMATVEKL

SEQ ID NO: 155829 - protein, 13 aa, BORRELIA GARINII
GKYSLMATVEKLE

SEQ ID NO: 155830 - protein, 13 aa, BORRELIA GARINII
KYSLMATVEKLEL

SEQ ID NO: 155831 - protein, 13 aa, BORRELIA GARINII
YSLMATVEKLELK

SEQ ID NO: 155832 - protein, 13 aa, BORRELIA GARINII
SLMATVEKLELKG

SEQ ID NO: 155833 - protein, 13 aa, BORRELIA GARINII
LMATVEKLELKGT

SEQ ID NO: 155834 - protein, 13 aa, BORRELIA GARINII
MATVEKLELKGTS

SEQ ID NO: 155835 - protein, 13 aa, BORRELIA GARINII
ATVEKLELKGTSD

SEQ ID NO: 155836 - protein, 13 aa, BORRELIA GARINII
TVEKLELKGTSDK

SEQ ID NO: 155837 - protein, 13 aa, BORRELIA GARINII
VEKLELKGTSDKN

SEQ ID NO: 155838 - protein, 13 aa, BORRELIA GARINII
EKLELKGTSDKNN

SEQ ID NO: 155839 - protein, 13 aa, BORRELIA GARINII
KLELKGTSDKNNG

SEQ ID NO: 155840 - protein, 13 aa, BORRELIA GARINII
LELKGTSDKNNGS

SEQ ID NO: 155841 - protein, 13 aa, BORRELIA GARINII
ELKGTSDKNNGSG

SEQ ID NO: 155842 - protein, 13 aa, BORRELIA GARINII
LKGTSDKNNGSGT

SEQ ID NO: 155843 - protein, 13 aa, BORRELIA GARINII
KGTSDKNNGSGTL

SEQ ID NO: 155844 - protein, 13 aa, BORRELIA GARINII
GTSDKNNGSGTLE

SEQ ID NO: 155845 - protein, 13 aa, BORRELIA GARINII
TSDKNNGSGTLEG

SEQ ID NO: 155846 - protein, 13 aa, BORRELIA GARINII
SDKNNGSGTLEGE

SEQ ID NO: 155847 - protein, 13 aa, BORRELIA GARINII
DKNNGSGTLEGEK

SEQ ID NO: 155848 - protein, 13 aa, BORRELIA GARINII
KNNGSGTLEGEKT

SEQ ID NO: 155849 - protein, 13 aa, BORRELIA GARINII
NNGSGTLEGEKTD

SEQ ID NO: 155850 - protein, 13 aa, BORRELIA GARINII
NGSGTLEGEKTDK

SEQ ID NO: 155851 - protein, 13 aa, BORRELIA GARINII
GSGTLEGEKTDKS

SEQ ID NO: 155852 - protein, 13 aa, BORRELIA GARINII
SGTLEGEKTDKSK

SEQ ID NO: 155853 - protein, 13 aa, BORRELIA GARINII
GTLEGEKTDKSKV

SEQ ID NO: 155854 - protein, 13 aa, BORRELIA GARINII
TLEGEKTDKSKVK

SEQ ID NO: 155855 - protein, 13 aa, BORRELIA GARINII
LEGEKTDKSKVKL

SEQ ID NO: 155856 - protein, 13 aa, BORRELIA GARINII
EGEKTDKSKVKLT

SEQ ID NO: 155857 - protein, 13 aa, BORRELIA GARINII
GEKTDKSKVKLTI

SEQ ID NO: 155858 - protein, 13 aa, BORRELIA GARINII
EKTDKSKVKLTIA

SEQ ID NO: 155859 - protein, 13 aa, BORRELIA GARINII
KTDKSKVKLTIAE

SEQ ID NO: 155860 - protein, 13 aa, BORRELIA GARINII
TDKSKVKLTIAED

SEQ ID NO: 155861 - protein, 13 aa, BORRELIA GARINII
DKSKVKLTIAEDL

SEQ ID NO: 155862 - protein, 13 aa, BORRELIA GARINII
KSKVKLTIAEDLS

SEQ ID NO: 155863 - protein, 13 aa, BORRELIA GARINII
SKVKLTIAEDLSK

SEQ ID NO: 155864 - protein, 13 aa, BORRELIA GARINII
KVKLTIAEDLSKT

SEQ ID NO: 155865 - protein, 13 aa, BORRELIA GARINII
VKLTIAEDLSKTT

SEQ ID NO: 155866 - protein, 13 aa, BORRELIA GARINII
KLTIAEDLSKTTF

SEQ ID NO: 155867 - protein, 13 aa, BORRELIA GARINII
LTIAEDLSKTTFE

SEQ ID NO: 155868 - protein, 13 aa, BORRELIA GARINII
TIAEDLSKTTFEI

SEQ ID NO: 155869 - protein, 13 aa, BORRELIA GARINII
IAEDLSKTTFEIF

SEQ ID NO: 155870 - protein, 13 aa, BORRELIA GARINII
AEDLSKTTFEIFK

SEQ ID NO: 155871 - protein, 13 aa, BORRELIA GARINII
EDLSKTTFEIFKE

SEQ ID NO: 155872 - protein, 13 aa, BORRELIA GARINII
DLSKTTFEIFKED

SEQ ID NO: 155873 - protein, 13 aa, BORRELIA GARINII
LSKTTFEIFKEDG

SEQ ID NO: 155874 - protein, 13 aa, BORRELIA GARINII
SKTTFEIFKEDGK

SEQ ID NO: 155875 - protein, 13 aa, BORRELIA GARINII
KTTFEIFKEDGKT

SEQ ID NO: 155876 - protein, 13 aa, BORRELIA GARINII
TTFEIFKEDGKTL

SEQ ID NO: 155877 - protein, 13 aa, BORRELIA GARINII
TFEIFKEDGKTLV

SEQ ID NO: 155878 - protein, 13 aa, BORRELIA GARINII
FEIFKEDGKTLVS

SEQ ID NO: 155879 - protein, 13 aa, BORRELIA GARINII
EIFKEDGKTLVSK

SEQ ID NO: 155880 - protein, 13 aa, BORRELIA GARINII
IFKEDGKTLVSKK

SEQ ID NO: 155881 - protein, 13 aa, BORRELIA GARINII
FKEDGKTLVSKKV

SEQ ID NO: 155882 - protein, 13 aa, BORRELIA GARINII
KEDGKTLVSKKVT

SEQ ID NO: 155883 - protein, 13 aa, BORRELIA GARINII
EDGKTLVSKKVTL

SEQ ID NO: 155884 - protein, 13 aa, BORRELIA GARINII
DGKTLVSKKVTLK

SEQ ID NO: 155885 - protein, 13 aa, BORRELIA GARINII
GKTLVSKKVTLKD

SEQ ID NO: 155886 - protein, 13 aa, BORRELIA GARINII
KTLVSKKVTLKDK

SEQ ID NO: 155887 - protein, 13 aa, BORRELIA GARINII
TLVSKKVTLKDKS

SEQ ID NO: 155888 - protein, 13 aa, BORRELIA GARINII
LVSKKVTLKDKSS

SEQ ID NO: 155889 - protein, 13 aa, BORRELIA GARINII
VSKKVTLKDKSST

SEQ ID NO: 155890 - protein, 13 aa, BORRELIA GARINII
SKKVTLKDKSSTE

SEQ ID NO: 155891 - protein, 13 aa, BORRELIA GARINII
KKVTLKDKSSTEE

SEQ ID NO: 155892 - protein, 13 aa, BORRELIA GARINII
KVTLKDKSSTEEK

SEQ ID NO: 155893 - protein, 13 aa, BORRELIA GARINII
VTLKDKSSTEEKF

SEQ ID NO: 155894 - protein, 13 aa, BORRELIA GARINII
TLKDKSSTEEKFN

SEQ ID NO: 155895 - protein, 13 aa, BORRELIA GARINII
LKDKSSTEEKFNE

SEQ ID NO: 155896 - protein, 13 aa, BORRELIA GARINII
KDKSSTEEKFNEK

SEQ ID NO: 155897 - protein, 13 aa, BORRELIA GARINII
DKSSTEEKFNEKG

SEQ ID NO: 155898 - protein, 13 aa, BORRELIA GARINII
KSSTEEKFNEKGE

SEQ ID NO: 155899 - protein, 13 aa, BORRELIA GARINII
SSTEEKFNEKGEI

SEQ ID NO: 155900 - protein, 13 aa, BORRELIA GARINII
STEEKFNEKGEIS

SEQ ID NO: 155901 - protein, 13 aa, BORRELIA GARINII
TEEKFNEKGEISE

SEQ ID NO: 155902 - protein, 13 aa, BORRELIA GARINII
EEKFNEKGEISEK

SEQ ID NO: 155903 - protein, 13 aa, BORRELIA GARINII
EKFNEKGEISEKT

SEQ ID NO: 155904 - protein, 13 aa, BORRELIA GARINII
KFNEKGEISEKTI

SEQ ID NO: 155905 - protein, 13 aa, BORRELIA GARINII
FNEKGEISEKTIV

SEQ ID NO: 155906 - protein, 13 aa, BORRELIA GARINII
NEKGEISEKTIVR

SEQ ID NO: 155907 - protein, 13 aa, BORRELIA GARINII
EKGEISEKTIVRA

SEQ ID NO: 155908 - protein, 13 aa, BORRELIA GARINII
KGEISEKTIVRAN

SEQ ID NO: 155909 - protein, 13 aa, BORRELIA GARINII
GEISEKTIVRANG

SEQ ID NO: 155910 - protein, 13 aa, BORRELIA GARINII
EISEKTIVRANGT

SEQ ID NO: 155911 - protein, 13 aa, BORRELIA GARINII
ISEKTIVRANGTR

SEQ ID NO: 155912 - protein, 13 aa, BORRELIA GARINII
SEKTIVRANGTRL

SEQ ID NO: 155913 - protein, 13 aa, BORRELIA GARINII
EKTIVRANGTRLE

SEQ ID NO: 155914 - protein, 13 aa, BORRELIA GARINII
KTIVRANGTRLEY

SEQ ID NO: 155915 - protein, 13 aa, BORRELIA GARINII
TIVRANGTRLEYT

SEQ ID NO: 155916 - protein, 13 aa, BORRELIA GARINII
IVRANGTRLEYTD

SEQ ID NO: 155917 - protein, 13 aa, BORRELIA GARINII
VRANGTRLEYTDI

SEQ ID NO: 155918 - protein, 13 aa, BORRELIA GARINII
RANGTRLEYTDIK

SEQ ID NO: 155919 - protein, 13 aa, BORRELIA GARINII
ANGTRLEYTDIKS

SEQ ID NO: 155920 - protein, 13 aa, BORRELIA GARINII
NGTRLEYTDIKSD

SEQ ID NO: 155921 - protein, 13 aa, BORRELIA GARINII
GTRLEYTDIKSDG

SEQ ID NO: 155922 - protein, 13 aa, BORRELIA GARINII
TRLEYTDIKSDGS

SEQ ID NO: 155923 - protein, 13 aa, BORRELIA GARINII
RLEYTDIKSDGSG

SEQ ID NO: 155924 - protein, 13 aa, BORRELIA GARINII
LEYTDIKSDGSGK

SEQ ID NO: 155925 - protein, 13 aa, BORRELIA GARINII
EYTDIKSDGSGKA

SEQ ID NO: 155926 - protein, 13 aa, BORRELIA GARINII
YTDIKSDGSGKAK

SEQ ID NO: 155927 - protein, 13 aa, BORRELIA GARINII
TDIKSDGSGKAKE

SEQ ID NO: 155928 - protein, 13 aa, BORRELIA GARINII
DIKSDGSGKAKEV

SEQ ID NO: 155929 - protein, 13 aa, BORRELIA GARINII
IKSDGSGKAKEVL

SEQ ID NO: 155930 - protein, 13 aa, BORRELIA GARINII
KSDGSGKAKEVLK

SEQ ID NO: 155931 - protein, 13 aa, BORRELIA GARINII
SDGSGKAKEVLKD

SEQ ID NO: 155932 - protein, 13 aa, BORRELIA GARINII
DGSGKAKEVLKDF

SEQ ID NO: 155933 - protein, 13 aa, BORRELIA GARINII
GSGKAKEVLKDFT

SEQ ID NO: 155934 - protein, 13 aa, BORRELIA GARINII
SGKAKEVLKDFTL

SEQ ID NO: 155935 - protein, 13 aa, BORRELIA GARINII
GKAKEVLKDFTLE

SEQ ID NO: 155936 - protein, 13 aa, BORRELIA GARINII
KAKEVLKDFTLEG

SEQ ID NO: 155937 - protein, 13 aa, BORRELIA GARINII
AKEVLKDFTLEGT

SEQ ID NO: 155938 - protein, 13 aa, BORRELIA GARINII
KEVLKDFTLEGTL

SEQ ID NO: 155939 - protein, 13 aa, BORRELIA GARINII
EVLKDFTLEGTLA

SEQ ID NO: 155940 - protein, 13 aa, BORRELIA GARINII
VLKDFTLEGTLAA

SEQ ID NO: 155941 - protein, 13 aa, BORRELIA GARINII
LKDFTLEGTLAAD

SEQ ID NO: 155942 - protein, 13 aa, BORRELIA GARINII
KDFTLEGTLAADG

SEQ ID NO: 155943 - protein, 13 aa, BORRELIA GARINII
DFTLEGTLAADGK

SEQ ID NO: 155944 - protein, 13 aa, BORRELIA GARINII
FTLEGTLAADGKT

SEQ ID NO: 155945 - protein, 13 aa, BORRELIA GARINII
TLEGTLAADGKTT

SEQ ID NO: 155946 - protein, 13 aa, BORRELIA GARINII
LEGTLAADGKTTL

SEQ ID NO: 155947 - protein, 13 aa, BORRELIA GARINII
EGTLAADGKTTLK

SEQ ID NO: 155948 - protein, 13 aa, BORRELIA GARINII
GTLAADGKTTLKV

SEQ ID NO: 155949 - protein, 13 aa, BORRELIA GARINII
TLAADGKTTLKVT

SEQ ID NO: 155950 - protein, 13 aa, BORRELIA GARINII
LAADGKTTLKVTE

SEQ ID NO: 155951 - protein, 13 aa, BORRELIA GARINII
AADGKTTLKVTEG

SEQ ID NO: 155952 - protein, 13 aa, BORRELIA GARINII
ADGKTTLKVTEGT

SEQ ID NO: 155953 - protein, 13 aa, BORRELIA GARINII
DGKTTLKVTEGTV

SEQ ID NO: 155954 - protein, 13 aa, BORRELIA GARINII
GKTTLKVTEGTVV

SEQ ID NO: 155955 - protein, 13 aa, BORRELIA GARINII
KTTLKVTEGTVVL

SEQ ID NO: 155956 - protein, 13 aa, BORRELIA GARINII
TTLKVTEGTVVLS

SEQ ID NO: 155957 - protein, 13 aa, BORRELIA GARINII
TLKVTEGTVVLSK

SEQ ID NO: 155958 - protein, 13 aa, BORRELIA GARINII
LKVTEGTVVLSKN

SEQ ID NO: 155959 - protein, 13 aa, BORRELIA GARINII
KVTEGTVVLSKNI

SEQ ID NO: 155960 - protein, 13 aa, BORRELIA GARINII
VTEGTVVLSKNIL

SEQ ID NO: 155961 - protein, 13 aa, BORRELIA GARINII
TEGTVVLSKNILK

SEQ ID NO: 155962 - protein, 13 aa, BORRELIA GARINII
EGTVVLSKNILKS

SEQ ID NO: 155963 - protein, 13 aa, BORRELIA GARINII
GTVVLSKNILKSG

SEQ ID NO: 155964 - protein, 13 aa, BORRELIA GARINII
TVVLSKNILKSGE

SEQ ID NO: 155965 - protein, 13 aa, BORRELIA GARINII
VVLSKNILKSGEI

SEQ ID NO: 155966 - protein, 13 aa, BORRELIA GARINII
VLSKNILKSGEIT

SEQ ID NO: 155967 - protein, 13 aa, BORRELIA GARINII
LSKNILKSGEITV

SEQ ID NO: 155968 - protein, 13 aa, BORRELIA GARINII
SKNILKSGEITVA

SEQ ID NO: 155969 - protein, 13 aa, BORRELIA GARINII
KNILKSGEITVAL

SEQ ID NO: 155970 - protein, 13 aa, BORRELIA GARINII
NILKSGEITVALD

SEQ ID NO: 155971 - protein, 13 aa, BORRELIA GARINII
ILKSGEITVALDD

SEQ ID NO: 155972 - protein, 13 aa, BORRELIA GARINII
LKSGEITVALDDS

SEQ ID NO: 155973 - protein, 13 aa, BORRELIA GARINII
KSGEITVALDDSD

SEQ ID NO: 155974 - protein, 13 aa, BORRELIA GARINII
SGEITVALDDSDT

SEQ ID NO: 155975 - protein, 13 aa, BORRELIA GARINII
GEITVALDDSDTT

SEQ ID NO: 155976 - protein, 13 aa, BORRELIA GARINII
EITVALDDSDTTQ

SEQ ID NO: 155977 - protein, 13 aa, BORRELIA GARINII
ITVALDDSDTTQA

SEQ ID NO: 155978 - protein, 13 aa, BORRELIA GARINII
TVALDDSDTTQAT

SEQ ID NO: 155979 - protein, 13 aa, BORRELIA GARINII
VALDDSDTTQATK

SEQ ID NO: 155980 - protein, 13 aa, BORRELIA GARINII
ALDDSDTTQATKK

SEQ ID NO: 155981 - protein, 13 aa, BORRELIA GARINII
LDDSDTTQATKKT

SEQ ID NO: 155982 - protein, 13 aa, BORRELIA GARINII
DDSDTTQATKKTG

SEQ ID NO: 155983 - protein, 13 aa, BORRELIA GARINII
DSDTTQATKKTGK

SEQ ID NO: 155984 - protein, 13 aa, BORRELIA GARINII
SDTTQATKKTGKW

SEQ ID NO: 155985 - protein, 13 aa, BORRELIA GARINII
DTTQATKKTGKWD

SEQ ID NO: 155986 - protein, 13 aa, BORRELIA GARINII
TTQATKKTGKWDS

SEQ ID NO: 155987 - protein, 13 aa, BORRELIA GARINII
TQATKKTGKWDSK

SEQ ID NO: 155988 - protein, 13 aa, BORRELIA GARINII
QATKKTGKWDSKT

SEQ ID NO: 155989 - protein, 13 aa, BORRELIA GARINII
ATKKTGKWDSKTS

SEQ ID NO: 155990 - protein, 13 aa, BORRELIA GARINII
TKKTGKWDSKTST

SEQ ID NO: 155991 - protein, 13 aa, BORRELIA GARINII
KKTGKWDSKTSTL

SEQ ID NO: 155992 - protein, 13 aa, BORRELIA GARINII
KTGKWDSKTSTLT

SEQ ID NO: 155993 - protein, 13 aa, BORRELIA GARINII
TGKWDSKTSTLTI

SEQ ID NO: 155994 - protein, 13 aa, BORRELIA GARINII
GKWDSKTSTLTIS

SEQ ID NO: 155995 - protein, 13 aa, BORRELIA GARINII
KWDSKTSTLTISV

SEQ ID NO: 155996 - protein, 13 aa, BORRELIA GARINII
WDSKTSTLTISVN

SEQ ID NO: 155997 - protein, 13 aa, BORRELIA GARINII
DSKTSTLTISVNS

SEQ ID NO: 155998 - protein, 13 aa, BORRELIA GARINII
SKTSTLTISVNSQ

SEQ ID NO: 155999 - protein, 13 aa, BORRELIA GARINII
KTSTLTISVNSQK

SEQ ID NO: 156000 - protein, 13 aa, BORRELIA GARINII
TSTLTISVNSQKT

SEQ ID NO: 156001 - protein, 13 aa, BORRELIA GARINII
STLTISVNSQKTK

SEQ ID NO: 156002 - protein, 13 aa, BORRELIA GARINII
TLTISVNSQKTKN

SEQ ID NO: 156003 - protein, 13 aa, BORRELIA GARINII
LTISVNSQKTKNL

SEQ ID NO: 156004 - protein, 13 aa, BORRELIA GARINII
TISVNSQKTKNLV

SEQ ID NO: 156005 - protein, 13 aa, BORRELIA GARINII
ISVNSQKTKNLVF

SEQ ID NO: 156006 - protein, 13 aa, BORRELIA GARINII
SVNSQKTKNLVFT

SEQ ID NO: 156007 - protein, 13 aa, BORRELIA GARINII
VNSQKTKNLVFTK

SEQ ID NO: 156008 - protein, 13 aa, BORRELIA GARINII
NSQKTKNLVFTKE

SEQ ID NO: 156009 - protein, 13 aa, BORRELIA GARINII
SQKTKNLVFTKED

SEQ ID NO: 156010 - protein, 13 aa, BORRELIA GARINII
QKTKNLVFTKEDT

SEQ ID NO: 156011 - protein, 13 aa, BORRELIA GARINII
KTKNLVFTKEDTI

SEQ ID NO: 156012 - protein, 13 aa, BORRELIA GARINII
TKNLVFTKEDTIT

SEQ ID NO: 156013 - protein, 13 aa, BORRELIA GARINII
KNLVFTKEDTITV

SEQ ID NO: 156014 - protein, 13 aa, BORRELIA GARINII
NLVFTKEDTITVQ

SEQ ID NO: 156015 - protein, 13 aa, BORRELIA GARINII
LVFTKEDTITVQK

SEQ ID NO: 156016 - protein, 13 aa, BORRELIA GARINII
VFTKEDTITVQKY

SEQ ID NO: 156017 - protein, 13 aa, BORRELIA GARINII
FTKEDTITVQKYD

SEQ ID NO: 156018 - protein, 13 aa, BORRELIA GARINII
TKEDTITVQKYDS

SEQ ID NO: 156019 - protein, 13 aa, BORRELIA GARINII
KEDTITVQKYDSA

SEQ ID NO: 156020 - protein, 13 aa, BORRELIA GARINII
EDTITVQKYDSAG

SEQ ID NO: 156021 - protein, 13 aa, BORRELIA GARINII
DTITVQKYDSAGT

SEQ ID NO: 156022 - protein, 13 aa, BORRELIA GARINII
TITVQKYDSAGTN

SEQ ID NO: 156023 - protein, 13 aa, BORRELIA GARINII
ITVQKYDSAGTNL

SEQ ID NO: 156024 - protein, 13 aa, BORRELIA GARINII
TVQKYDSAGTNLE

SEQ ID NO: 156025 - protein, 13 aa, BORRELIA GARINII
VQKYDSAGTNLEG

SEQ ID NO: 156026 - protein, 13 aa, BORRELIA GARINII
QKYDSAGTNLEGK

SEQ ID NO: 156027 - protein, 13 aa, BORRELIA GARINII
KYDSAGTNLEGKA

SEQ ID NO: 156028 - protein, 13 aa, BORRELIA GARINII
YDSAGTNLEGKAV

SEQ ID NO: 156029 - protein, 13 aa, BORRELIA GARINII
DSAGTNLEGKAVE

SEQ ID NO: 156030 - protein, 13 aa, BORRELIA GARINII
SAGTNLEGKAVEI

SEQ ID NO: 156031 - protein, 13 aa, BORRELIA GARINII
AGTNLEGKAVEIT

SEQ ID NO: 156032 - protein, 13 aa, BORRELIA GARINII
GTNLEGKAVEITT

SEQ ID NO: 156033 - protein, 13 aa, BORRELIA GARINII
TNLEGKAVEITTL

SEQ ID NO: 156034 - protein, 13 aa, BORRELIA GARINII
NLEGKAVEITTLE

SEQ ID NO: 156035 - protein, 13 aa, BORRELIA GARINII
LEGKAVEITTLEK

SEQ ID NO: 156036 - protein, 13 aa, BORRELIA GARINII
EGKAVEITTLEKL

SEQ ID NO: 156037 - protein, 13 aa, BORRELIA GARINII
GKAVEITTLEKLK

SEQ ID NO: 156038 - protein, 13 aa, BORRELIA GARINII
KAVEITTLEKLKD

SEQ ID NO: 156039 - protein, 13 aa, BORRELIA GARINII
AVEITTLEKLKDA

SEQ ID NO: 156040 - protein, 13 aa, BORRELIA GARINII
VEITTLEKLKDAL

SEQ ID NO: 156041 - protein, 13 aa, BORRELIA GARINII
EITTLEKLKDALK

SEQ ID NO: 156042 - protein, 14 aa, BORRELIA GARINII
MKKYLLGIGLILAL

SEQ ID NO: 156043 - protein, 14 aa, BORRELIA GARINII
KKYLLGIGLILALI

SEQ ID NO: 156044 - protein, 14 aa, BORRELIA GARINII
KYLLGIGLILALIA

SEQ ID NO: 156045 - protein, 14 aa, BORRELIA GARINII
YLLGIGLILALIAC

SEQ ID NO: 156046 - protein, 14 aa, BORRELIA GARINII
LLGIGLILALIACK

SEQ ID NO: 156047 - protein, 14 aa, BORRELIA GARINII
LGIGLILALIACKQ

SEQ ID NO: 156048 - protein, 14 aa, BORRELIA GARINII
GIGLILALIACKQN

SEQ ID NO: 156049 - protein, 14 aa, BORRELIA GARINII
IGLILALIACKQNV

SEQ ID NO: 156050 - protein, 14 aa, BORRELIA GARINII
GLILALIACKQNVS

SEQ ID NO: 156051 - protein, 14 aa, BORRELIA GARINII
LILALIACKQNVSS

SEQ ID NO: 156052 - protein, 14 aa, BORRELIA GARINII
ILALIACKQNVSSL

SEQ ID NO: 156053 - protein, 14 aa, BORRELIA GARINII
LALIACKQNVSSLD

SEQ ID NO: 156054 - protein, 14 aa, BORRELIA GARINII
ALIACKQNVSSLDE

SEQ ID NO: 156055 - protein, 14 aa, BORRELIA GARINII
LIACKQNVSSLDEK

SEQ ID NO: 156056 - protein, 14 aa, BORRELIA GARINII
IACKQNVSSLDEKN

SEQ ID NO: 156057 - protein, 14 aa, BORRELIA GARINII
ACKQNVSSLDEKNS

SEQ ID NO: 156058 - protein, 14 aa, BORRELIA GARINII
CKQNVSSLDEKNSV

SEQ ID NO: 156059 - protein, 14 aa, BORRELIA GARINII
KQNVSSLDEKNSVS

SEQ ID NO: 156060 - protein, 14 aa, BORRELIA GARINII
QNVSSLDEKNSVSV

SEQ ID NO: 156061 - protein, 14 aa, BORRELIA GARINII
NVSSLDEKNSVSVD

SEQ ID NO: 156062 - protein, 14 aa, BORRELIA GARINII
VSSLDEKNSVSVDL

SEQ ID NO: 156063 - protein, 14 aa, BORRELIA GARINII
SSLDEKNSVSVDLP

SEQ ID NO: 156064 - protein, 14 aa, BORRELIA GARINII
SLDEKNSVSVDLPG

SEQ ID NO: 156065 - protein, 14 aa, BORRELIA GARINII
LDEKNSVSVDLPGG

SEQ ID NO: 156066 - protein, 14 aa, BORRELIA GARINII
DEKNSVSVDLPGGM

SEQ ID NO: 156067 - protein, 14 aa, BORRELIA GARINII
EKNSVSVDLPGGMK

SEQ ID NO: 156068 - protein, 14 aa, BORRELIA GARINII
KNSVSVDLPGGMKV

SEQ ID NO: 156069 - protein, 14 aa, BORRELIA GARINII
NSVSVDLPGGMKVL

SEQ ID NO: 156070 - protein, 14 aa, BORRELIA GARINII
SVSVDLPGGMKVLV

SEQ ID NO: 156071 - protein, 14 aa, BORRELIA GARINII
VSVDLPGGMKVLVS

SEQ ID NO: 156072 - protein, 14 aa, BORRELIA GARINII
SVDLPGGMKVLVSK

SEQ ID NO: 156073 - protein, 14 aa, BORRELIA GARINII
VDLPGGMKVLVSKE

SEQ ID NO: 156074 - protein, 14 aa, BORRELIA GARINII
DLPGGMKVLVSKEK

SEQ ID NO: 156075 - protein, 14 aa, BORRELIA GARINII
LPGGMKVLVSKEKD

SEQ ID NO: 156076 - protein, 14 aa, BORRELIA GARINII
PGGMKVLVSKEKDK

SEQ ID NO: 156077 - protein, 14 aa, BORRELIA GARINII
GGMKVLVSKEKDKD

SEQ ID NO: 156078 - protein, 14 aa, BORRELIA GARINII
GMKVLVSKEKDKDG

SEQ ID NO: 156079 - protein, 14 aa, BORRELIA GARINII
MKVLVSKEKDKDGK

SEQ ID NO: 156080 - protein, 14 aa, BORRELIA GARINII
KVLVSKEKDKDGKY

SEQ ID NO: 156081 - protein, 14 aa, BORRELIA GARINII
VLVSKEKDKDGKYS

SEQ ID NO: 156082 - protein, 14 aa, BORRELIA GARINII
LVSKEKDKDGKYSL

SEQ ID NO: 156083 - protein, 14 aa, BORRELIA GARINII
VSKEKDKDGKYSLM

SEQ ID NO: 156084 - protein, 14 aa, BORRELIA GARINII
SKEKDKDGKYSLMA

SEQ ID NO: 156085 - protein, 14 aa, BORRELIA GARINII
KEKDKDGKYSLMAT

SEQ ID NO: 156086 - protein, 14 aa, BORRELIA GARINII
EKDKDGKYSLMATV

SEQ ID NO: 156087 - protein, 14 aa, BORRELIA GARINII
KDKDGKYSLMATVE

SEQ ID NO: 156088 - protein, 14 aa, BORRELIA GARINII
DKDGKYSLMATVEK

SEQ ID NO: 156089 - protein, 14 aa, BORRELIA GARINII
KDGKYSLMATVEKL

SEQ ID NO: 156090 - protein, 14 aa, BORRELIA GARINII
DGKYSLMATVEKLE

SEQ ID NO: 156091 - protein, 14 aa, BORRELIA GARINII
GKYSLMATVEKLEL

SEQ ID NO: 156092 - protein, 14 aa, BORRELIA GARINII
KYSLMATVEKLELK

SEQ ID NO: 156093 - protein, 14 aa, BORRELIA GARINII
YSLMATVEKLELKG

SEQ ID NO: 156094 - protein, 14 aa, BORRELIA GARINII
SLMATVEKLELKGT

SEQ ID NO: 156095 - protein, 14 aa, BORRELIA GARINII
LMATVEKLELKGTS

SEQ ID NO: 156096 - protein, 14 aa, BORRELIA GARINII
MATVEKLELKGTSD

SEQ ID NO: 156097 - protein, 14 aa, BORRELIA GARINII
ATVEKLELKGTSDK

SEQ ID NO: 156098 - protein, 14 aa, BORRELIA GARINII
TVEKLELKGTSDKN

SEQ ID NO: 156099 - protein, 14 aa, BORRELIA GARINII
VEKLELKGTSDKNN

SEQ ID NO: 156100 - protein, 14 aa, BORRELIA GARINII
EKLELKGTSDKNNG

SEQ ID NO: 156101 - protein, 14 aa, BORRELIA GARINII
KLELKGTSDKNNGS

SEQ ID NO: 156102 - protein, 14 aa, BORRELIA GARINII
LELKGTSDKNNGSG

SEQ ID NO: 156103 - protein, 14 aa, BORRELIA GARINII
ELKGTSDKNNGSGT

SEQ ID NO: 156104 - protein, 14 aa, BORRELIA GARINII
LKGTSDKNNGSGTL

SEQ ID NO: 156105 - protein, 14 aa, BORRELIA GARINII
KGTSDKNNGSGTLE

SEQ ID NO: 156106 - protein, 14 aa, BORRELIA GARINII
GTSDKNNGSGTLEG

SEQ ID NO: 156107 - protein, 14 aa, BORRELIA GARINII
TSDKNNGSGTLEGE

SEQ ID NO: 156108 - protein, 14 aa, BORRELIA GARINII
SDKNNGSGTLEGEK

SEQ ID NO: 156109 - protein, 14 aa, BORRELIA GARINII
DKNNGSGTLEGEKT

SEQ ID NO: 156110 - protein, 14 aa, BORRELIA GARINII
KNNGSGTLEGEKTD

SEQ ID NO: 156111 - protein, 14 aa, BORRELIA GARINII
NNGSGTLEGEKTDK

SEQ ID NO: 156112 - protein, 14 aa, BORRELIA GARINII
NGSGTLEGEKTDKS

SEQ ID NO: 156113 - protein, 14 aa, BORRELIA GARINII
GSGTLEGEKTDKSK

SEQ ID NO: 156114 - protein, 14 aa, BORRELIA GARINII
SGTLEGEKTDKSKV

SEQ ID NO: 156115 - protein, 14 aa, BORRELIA GARINII
GTLEGEKTDKSKVK

SEQ ID NO: 156116 - protein, 14 aa, BORRELIA GARINII
TLEGEKTDKSKVKL

SEQ ID NO: 156117 - protein, 14 aa, BORRELIA GARINII
LEGEKTDKSKVKLT

SEQ ID NO: 156118 - protein, 14 aa, BORRELIA GARINII
EGEKTDKSKVKLTI

SEQ ID NO: 156119 - protein, 14 aa, BORRELIA GARINII
GEKTDKSKVKLTIA

SEQ ID NO: 156120 - protein, 14 aa, BORRELIA GARINII
EKTDKSKVKLTIAE

SEQ ID NO: 156121 - protein, 14 aa, BORRELIA GARINII
KTDKSKVKLTIAED

SEQ ID NO: 156122 - protein, 14 aa, BORRELIA GARINII
TDKSKVKLTIAEDL

SEQ ID NO: 156123 - protein, 14 aa, BORRELIA GARINII
DKSKVKLTIAEDLS

SEQ ID NO: 156124 - protein, 14 aa, BORRELIA GARINII
KSKVKLTIAEDLSK

SEQ ID NO: 156125 - protein, 14 aa, BORRELIA GARINII
SKVKLTIAEDLSKT

SEQ ID NO: 156126 - protein, 14 aa, BORRELIA GARINII
KVKLTIAEDLSKTT

SEQ ID NO: 156127 - protein, 14 aa, BORRELIA GARINII
VKLTIAEDLSKTTF

SEQ ID NO: 156128 - protein, 14 aa, BORRELIA GARINII
KLTIAEDLSKTTFE

SEQ ID NO: 156129 - protein, 14 aa, BORRELIA GARINII
LTIAEDLSKTTFEI

SEQ ID NO: 156130 - protein, 14 aa, BORRELIA GARINII
TIAEDLSKTTFEIF

SEQ ID NO: 156131 - protein, 14 aa, BORRELIA GARINII
IAEDLSKTTFEIFK

SEQ ID NO: 156132 - protein, 14 aa, BORRELIA GARINII
AEDLSKTTFEIFKE

SEQ ID NO: 156133 - protein, 14 aa, BORRELIA GARINII
EDLSKTTFEIFKED

SEQ ID NO: 156134 - protein, 14 aa, BORRELIA GARINII
DLSKTTFEIFKEDG

SEQ ID NO: 156135 - protein, 14 aa, BORRELIA GARINII
LSKTTFEIFKEDGK

SEQ ID NO: 156136 - protein, 14 aa, BORRELIA GARINII
SKTTFEIFKEDGKT

SEQ ID NO: 156137 - protein, 14 aa, BORRELIA GARINII
KTTFEIFKEDGKTL

SEQ ID NO: 156138 - protein, 14 aa, BORRELIA GARINII
TTFEIFKEDGKTLV

SEQ ID NO: 156139 - protein, 14 aa, BORRELIA GARINII
TFEIFKEDGKTLVS

SEQ ID NO: 156140 - protein, 14 aa, BORRELIA GARINII
FEIFKEDGKTLVSK

SEQ ID NO: 156141 - protein, 14 aa, BORRELIA GARINII
EIFKEDGKTLVSKK

SEQ ID NO: 156142 - protein, 14 aa, BORRELIA GARINII
IFKEDGKTLVSKKV

SEQ ID NO: 156143 - protein, 14 aa, BORRELIA GARINII
FKEDGKTLVSKKVT

SEQ ID NO: 156144 - protein, 14 aa, BORRELIA GARINII
KEDGKTLVSKKVTL

SEQ ID NO: 156145 - protein, 14 aa, BORRELIA GARINII
EDGKTLVSKKVTLK

SEQ ID NO: 156146 - protein, 14 aa, BORRELIA GARINII
DGKTLVSKKVTLKD

SEQ ID NO: 156147 - protein, 14 aa, BORRELIA GARINII
GKTLVSKKVTLKDK

SEQ ID NO: 156148 - protein, 14 aa, BORRELIA GARINII
KTLVSKKVTLKDKS

SEQ ID NO: 156149 - protein, 14 aa, BORRELIA GARINII
TLVSKKVTLKDKSS

SEQ ID NO: 156150 - protein, 14 aa, BORRELIA GARINII
LVSKKVTLKDKSST

SEQ ID NO: 156151 - protein, 14 aa, BORRELIA GARINII
VSKKVTLKDKSSTE

SEQ ID NO: 156152 - protein, 14 aa, BORRELIA GARINII
SKKVTLKDKSSTEE

SEQ ID NO: 156153 - protein, 14 aa, BORRELIA GARINII
KKVTLKDKSSTEEK

SEQ ID NO: 156154 - protein, 14 aa, BORRELIA GARINII
KVTLKDKSSTEEKF

SEQ ID NO: 156155 - protein, 14 aa, BORRELIA GARINII
VTLKDKSSTEEKFN

SEQ ID NO: 156156 - protein, 14 aa, BORRELIA GARINII
TLKDKSSTEEKFNE

SEQ ID NO: 156157 - protein, 14 aa, BORRELIA GARINII
LKDKSSTEEKFNEK

SEQ ID NO: 156158 - protein, 14 aa, BORRELIA GARINII
KDKSSTEEKFNEKG

SEQ ID NO: 156159 - protein, 14 aa, BORRELIA GARINII
DKSSTEEKFNEKGE

SEQ ID NO: 156160 - protein, 14 aa, BORRELIA GARINII
KSSTEEKFNEKGEI

SEQ ID NO: 156161 - protein, 14 aa, BORRELIA GARINII
SSTEEKFNEKGEIS

SEQ ID NO: 156162 - protein, 14 aa, BORRELIA GARINII
STEEKFNEKGEISE

SEQ ID NO: 156163 - protein, 14 aa, BORRELIA GARINII
TEEKFNEKGEISEK

SEQ ID NO: 156164 - protein, 14 aa, BORRELIA GARINII
EEKFNEKGEISEKT

SEQ ID NO: 156165 - protein, 14 aa, BORRELIA GARINII
EKFNEKGEISEKTI

SEQ ID NO: 156166 - protein, 14 aa, BORRELIA GARINII
KFNEKGEISEKTIV

SEQ ID NO: 156167 - protein, 14 aa, BORRELIA GARINII
FNEKGEISEKTIVR

SEQ ID NO: 156168 - protein, 14 aa, BORRELIA GARINII
NEKGEISEKTIVRA

SEQ ID NO: 156169 - protein, 14 aa, BORRELIA GARINII
EKGEISEKTIVRAN

SEQ ID NO: 156170 - protein, 14 aa, BORRELIA GARINII
KGEISEKTIVRANG

SEQ ID NO: 156171 - protein, 14 aa, BORRELIA GARINII
GEISEKTIVRANGT

SEQ ID NO: 156172 - protein, 14 aa, BORRELIA GARINII
EISEKTIVRANGTR

SEQ ID NO: 156173 - protein, 14 aa, BORRELIA GARINII
ISEKTIVRANGTRL

SEQ ID NO: 156174 - protein, 14 aa, BORRELIA GARINII
SEKTIVRANGTRLE

SEQ ID NO: 156175 - protein, 14 aa, BORRELIA GARINII
EKTIVRANGTRLEY

SEQ ID NO: 156176 - protein, 14 aa, BORRELIA GARINII
KTIVRANGTRLEYT

SEQ ID NO: 156177 - protein, 14 aa, BORRELIA GARINII
TIVRANGTRLEYTD

SEQ ID NO: 156178 - protein, 14 aa, BORRELIA GARINII
IVRANGTRLEYTDI

SEQ ID NO: 156179 - protein, 14 aa, BORRELIA GARINII
VRANGTRLEYTDIK

SEQ ID NO: 156180 - protein, 14 aa, BORRELIA GARINII
RANGTRLEYTDIKS

SEQ ID NO: 156181 - protein, 14 aa, BORRELIA GARINII
ANGTRLEYTDIKSD

SEQ ID NO: 156182 - protein, 14 aa, BORRELIA GARINII
NGTRLEYTDIKSDG

SEQ ID NO: 156183 - protein, 14 aa, BORRELIA GARINII
GTRLEYTDIKSDGS

SEQ ID NO: 156184 - protein, 14 aa, BORRELIA GARINII
TRLEYTDIKSDGSG

SEQ ID NO: 156185 - protein, 14 aa, BORRELIA GARINII
RLEYTDIKSDGSGK

SEQ ID NO: 156186 - protein, 14 aa, BORRELIA GARINII
LEYTDIKSDGSGKA

SEQ ID NO: 156187 - protein, 14 aa, BORRELIA GARINII
EYTDIKSDGSGKAK

SEQ ID NO: 156188 - protein, 14 aa, BORRELIA GARINII
YTDIKSDGSGKAKE

SEQ ID NO: 156189 - protein, 14 aa, BORRELIA GARINII
TDIKSDGSGKAKEV

SEQ ID NO: 156190 - protein, 14 aa, BORRELIA GARINII
DIKSDGSGKAKEVL

SEQ ID NO: 156191 - protein, 14 aa, BORRELIA GARINII
IKSDGSGKAKEVLK

SEQ ID NO: 156192 - protein, 14 aa, BORRELIA GARINII
KSDGSGKAKEVLKD

SEQ ID NO: 156193 - protein, 14 aa, BORRELIA GARINII
SDGSGKAKEVLKDF

SEQ ID NO: 156194 - protein, 14 aa, BORRELIA GARINII
DGSGKAKEVLKDFT

SEQ ID NO: 156195 - protein, 14 aa, BORRELIA GARINII
GSGKAKEVLKDFTL

SEQ ID NO: 156196 - protein, 14 aa, BORRELIA GARINII
SGKAKEVLKDFTLE

SEQ ID NO: 156197 - protein, 14 aa, BORRELIA GARINII
GKAKEVLKDFTLEG

SEQ ID NO: 156198 - protein, 14 aa, BORRELIA GARINII
KAKEVLKDFTLEGT

SEQ ID NO: 156199 - protein, 14 aa, BORRELIA GARINII
AKEVLKDFTLEGTL

SEQ ID NO: 156200 - protein, 14 aa, BORRELIA GARINII
KEVLKDFTLEGTLA

SEQ ID NO: 156201 - protein, 14 aa, BORRELIA GARINII
EVLKDFTLEGTLAA

SEQ ID NO: 156202 - protein, 14 aa, BORRELIA GARINII
VLKDFTLEGTLAAD

SEQ ID NO: 156203 - protein, 14 aa, BORRELIA GARINII
LKDFTLEGTLAADG

SEQ ID NO: 156204 - protein, 14 aa, BORRELIA GARINII
KDFTLEGTLAADGK

SEQ ID NO: 156205 - protein, 14 aa, BORRELIA GARINII
DFTLEGTLAADGKT

SEQ ID NO: 156206 - protein, 14 aa, BORRELIA GARINII
FTLEGTLAADGKTT

SEQ ID NO: 156207 - protein, 14 aa, BORRELIA GARINII
TLEGTLAADGKTTL

SEQ ID NO: 156208 - protein, 14 aa, BORRELIA GARINII
LEGTLAADGKTTLK

SEQ ID NO: 156209 - protein, 14 aa, BORRELIA GARINII
EGTLAADGKTTLKV

SEQ ID NO: 156210 - protein, 14 aa, BORRELIA GARINII
GTLAADGKTTLKVT

SEQ ID NO: 156211 - protein, 14 aa, BORRELIA GARINII
TLAADGKTTLKVTE

SEQ ID NO: 156212 - protein, 14 aa, BORRELIA GARINII
LAADGKTTLKVTEG

SEQ ID NO: 156213 - protein, 14 aa, BORRELIA GARINII
AADGKTTLKVTEGT

SEQ ID NO: 156214 - protein, 14 aa, BORRELIA GARINII
ADGKTTLKVTEGTV

SEQ ID NO: 156215 - protein, 14 aa, BORRELIA GARINII
DGKTTLKVTEGTVV

SEQ ID NO: 156216 - protein, 14 aa, BORRELIA GARINII
GKTTLKVTEGTVVL

SEQ ID NO: 156217 - protein, 14 aa, BORRELIA GARINII
KTTLKVTEGTVVLS

SEQ ID NO: 156218 - protein, 14 aa, BORRELIA GARINII
TTLKVTEGTVVLSK

SEQ ID NO: 156219 - protein, 14 aa, BORRELIA GARINII
TLKVTEGTVVLSKN

SEQ ID NO: 156220 - protein, 14 aa, BORRELIA GARINII
LKVTEGTVVLSKNI

SEQ ID NO: 156221 - protein, 14 aa, BORRELIA GARINII
KVTEGTVVLSKNIL

SEQ ID NO: 156222 - protein, 14 aa, BORRELIA GARINII
VTEGTVVLSKNILK

SEQ ID NO: 156223 - protein, 14 aa, BORRELIA GARINII
TEGTVVLSKNILKS

SEQ ID NO: 156224 - protein, 14 aa, BORRELIA GARINII
EGTVVLSKNILKSG

SEQ ID NO: 156225 - protein, 14 aa, BORRELIA GARINII
GTVVLSKNILKSGE

SEQ ID NO: 156226 - protein, 14 aa, BORRELIA GARINII
TVVLSKNILKSGEI

SEQ ID NO: 156227 - protein, 14 aa, BORRELIA GARINII
VVLSKNILKSGEIT

SEQ ID NO: 156228 - protein, 14 aa, BORRELIA GARINII
VLSKNILKSGEITV

SEQ ID NO: 156229 - protein, 14 aa, BORRELIA GARINII
LSKNILKSGEITVA

SEQ ID NO: 156230 - protein, 14 aa, BORRELIA GARINII
SKNILKSGEITVAL

SEQ ID NO: 156231 - protein, 14 aa, BORRELIA GARINII
KNILKSGEITVALD

SEQ ID NO: 156232 - protein, 14 aa, BORRELIA GARINII
NILKSGEITVALDD

SEQ ID NO: 156233 - protein, 14 aa, BORRELIA GARINII
ILKSGEITVALDDS

SEQ ID NO: 156234 - protein, 14 aa, BORRELIA GARINII
LKSGEITVALDDSD

SEQ ID NO: 156235 - protein, 14 aa, BORRELIA GARINII
KSGEITVALDDSDT

SEQ ID NO: 156236 - protein, 14 aa, BORRELIA GARINII
SGEITVALDDSDTT

SEQ ID NO: 156237 - protein, 14 aa, BORRELIA GARINII
GEITVALDDSDTTQ

SEQ ID NO: 156238 - protein, 14 aa, BORRELIA GARINII
EITVALDDSDTTQA

SEQ ID NO: 156239 - protein, 14 aa, BORRELIA GARINII
ITVALDDSDTTQAT

SEQ ID NO: 156240 - protein, 14 aa, BORRELIA GARINII
TVALDDSDTTQATK

SEQ ID NO: 156241 - protein, 14 aa, BORRELIA GARINII
VALDDSDTTQATKK

SEQ ID NO: 156242 - protein, 14 aa, BORRELIA GARINII
ALDDSDTTQATKKT

SEQ ID NO: 156243 - protein, 14 aa, BORRELIA GARINII
LDDSDTTQATKKTG

SEQ ID NO: 156244 - protein, 14 aa, BORRELIA GARINII
DDSDTTQATKKTGK

SEQ ID NO: 156245 - protein, 14 aa, BORRELIA GARINII
DSDTTQATKKTGKW

SEQ ID NO: 156246 - protein, 14 aa, BORRELIA GARINII
SDTTQATKKTGKWD

SEQ ID NO: 156247 - protein, 14 aa, BORRELIA GARINII
DTTQATKKTGKWDS

SEQ ID NO: 156248 - protein, 14 aa, BORRELIA GARINII
TTQATKKTGKWDSK

SEQ ID NO: 156249 - protein, 14 aa, BORRELIA GARINII
TQATKKTGKWDSKT

SEQ ID NO: 156250 - protein, 14 aa, BORRELIA GARINII
QATKKTGKWDSKTS

SEQ ID NO: 156251 - protein, 14 aa, BORRELIA GARINII
ATKKTGKWDSKTST

SEQ ID NO: 156252 - protein, 14 aa, BORRELIA GARINII
TKKTGKWDSKTSTL

SEQ ID NO: 156253 - protein, 14 aa, BORRELIA GARINII
KKTGKWDSKTSTLT

SEQ ID NO: 156254 - protein, 14 aa, BORRELIA GARINII
KTGKWDSKTSTLTI

SEQ ID NO: 156255 - protein, 14 aa, BORRELIA GARINII
TGKWDSKTSTLTIS

SEQ ID NO: 156256 - protein, 14 aa, BORRELIA GARINII
GKWDSKTSTLTISV

SEQ ID NO: 156257 - protein, 14 aa, BORRELIA GARINII
KWDSKTSTLTISVN

SEQ ID NO: 156258 - protein, 14 aa, BORRELIA GARINII
WDSKTSTLTISVNS

SEQ ID NO: 156259 - protein, 14 aa, BORRELIA GARINII
DSKTSTLTISVNSQ

SEQ ID NO: 156260 - protein, 14 aa, BORRELIA GARINII
SKTSTLTISVNSQK

SEQ ID NO: 156261 - protein, 14 aa, BORRELIA GARINII
KTSTLTISVNSQKT

SEQ ID NO: 156262 - protein, 14 aa, BORRELIA GARINII
TSTLTISVNSQKTK

SEQ ID NO: 156263 - protein, 14 aa, BORRELIA GARINII
STLTISVNSQKTKN

SEQ ID NO: 156264 - protein, 14 aa, BORRELIA GARINII
TLTISVNSQKTKNL

SEQ ID NO: 156265 - protein, 14 aa, BORRELIA GARINII
LTISVNSQKTKNLV

SEQ ID NO: 156266 - protein, 14 aa, BORRELIA GARINII
TISVNSQKTKNLVF

SEQ ID NO: 156267 - protein, 14 aa, BORRELIA GARINII
ISVNSQKTKNLVFT

SEQ ID NO: 156268 - protein, 14 aa, BORRELIA GARINII
SVNSQKTKNLVFTK

SEQ ID NO: 156269 - protein, 14 aa, BORRELIA GARINII
VNSQKTKNLVFTKE

SEQ ID NO: 156270 - protein, 14 aa, BORRELIA GARINII
NSQKTKNLVFTKED

SEQ ID NO: 156271 - protein, 14 aa, BORRELIA GARINII
SQKTKNLVFTKEDT

SEQ ID NO: 156272 - protein, 14 aa, BORRELIA GARINII
QKTKNLVFTKEDTI

SEQ ID NO: 156273 - protein, 14 aa, BORRELIA GARINII
KTKNLVFTKEDTIT

SEQ ID NO: 156274 - protein, 14 aa, BORRELIA GARINII
TKNLVFTKEDTITV

SEQ ID NO: 156275 - protein, 14 aa, BORRELIA GARINII
KNLVFTKEDTITVQ

SEQ ID NO: 156276 - protein, 14 aa, BORRELIA GARINII
NLVFTKEDTITVQK

SEQ ID NO: 156277 - protein, 14 aa, BORRELIA GARINII
LVFTKEDTITVQKY

SEQ ID NO: 156278 - protein, 14 aa, BORRELIA GARINII
VFTKEDTITVQKYD

SEQ ID NO: 156279 - protein, 14 aa, BORRELIA GARINII
FTKEDTITVQKYDS

SEQ ID NO: 156280 - protein, 14 aa, BORRELIA GARINII
TKEDTITVQKYDSA

SEQ ID NO: 156281 - protein, 14 aa, BORRELIA GARINII
KEDTITVQKYDSAG

SEQ ID NO: 156282 - protein, 14 aa, BORRELIA GARINII
EDTITVQKYDSAGT

SEQ ID NO: 156283 - protein, 14 aa, BORRELIA GARINII
DTITVQKYDSAGTN

SEQ ID NO: 156284 - protein, 14 aa, BORRELIA GARINII
TITVQKYDSAGTNL

SEQ ID NO: 156285 - protein, 14 aa, BORRELIA GARINII
ITVQKYDSAGTNLE

SEQ ID NO: 156286 - protein, 14 aa, BORRELIA GARINII
TVQKYDSAGTNLEG

SEQ ID NO: 156287 - protein, 14 aa, BORRELIA GARINII
VQKYDSAGTNLEGK

SEQ ID NO: 156288 - protein, 14 aa, BORRELIA GARINII
QKYDSAGTNLEGKA

SEQ ID NO: 156289 - protein, 14 aa, BORRELIA GARINII
KYDSAGTNLEGKAV

SEQ ID NO: 156290 - protein, 14 aa, BORRELIA GARINII
YDSAGTNLEGKAVE

SEQ ID NO: 156291 - protein, 14 aa, BORRELIA GARINII
DSAGTNLEGKAVEI

SEQ ID NO: 156292 - protein, 14 aa, BORRELIA GARINII
SAGTNLEGKAVEIT

SEQ ID NO: 156293 - protein, 14 aa, BORRELIA GARINII
AGTNLEGKAVEITT

SEQ ID NO: 156294 - protein, 14 aa, BORRELIA GARINII
GTNLEGKAVEITTL

SEQ ID NO: 156295 - protein, 14 aa, BORRELIA GARINII
TNLEGKAVEITTLE

SEQ ID NO: 156296 - protein, 14 aa, BORRELIA GARINII
NLEGKAVEITTLEK

SEQ ID NO: 156297 - protein, 14 aa, BORRELIA GARINII
LEGKAVEITTLEKL

SEQ ID NO: 156298 - protein, 14 aa, BORRELIA GARINII
EGKAVEITTLEKLK

SEQ ID NO: 156299 - protein, 14 aa, BORRELIA GARINII
GKAVEITTLEKLKD

SEQ ID NO: 156300 - protein, 14 aa, BORRELIA GARINII
KAVEITTLEKLKDA

SEQ ID NO: 156301 - protein, 14 aa, BORRELIA GARINII
AVEITTLEKLKDAL

SEQ ID NO: 156302 - protein, 14 aa, BORRELIA GARINII
VEITTLEKLKDALK

SEQ ID NO: 156303 - protein, 15 aa, BORRELIA GARINII
MKKYLLGIGLILALI

SEQ ID NO: 156304 - protein, 15 aa, BORRELIA GARINII
KKYLLGIGLILALIA

SEQ ID NO: 156305 - protein, 15 aa, BORRELIA GARINII
KYLLGIGLILALIAC

SEQ ID NO: 156306 - protein, 15 aa, BORRELIA GARINII
YLLGIGLILALIACK

SEQ ID NO: 156307 - protein, 15 aa, BORRELIA GARINII
LLGIGLILALIACKQ

SEQ ID NO: 156308 - protein, 15 aa, BORRELIA GARINII
LGIGLILALIACKQN

SEQ ID NO: 156309 - protein, 15 aa, BORRELIA GARINII
GIGLILALIACKQNV

SEQ ID NO: 156310 - protein, 15 aa, BORRELIA GARINII
IGLILALIACKQNVS

SEQ ID NO: 156311 - protein, 15 aa, BORRELIA GARINII
GLILALIACKQNVSS

SEQ ID NO: 156312 - protein, 15 aa, BORRELIA GARINII
LILALIACKQNVSSL

SEQ ID NO: 156313 - protein, 15 aa, BORRELIA GARINII
ILALIACKQNVSSLD

SEQ ID NO: 156314 - protein, 15 aa, BORRELIA GARINII
LALIACKQNVSSLDE

SEQ ID NO: 156315 - protein, 15 aa, BORRELIA GARINII
ALIACKQNVSSLDEK

SEQ ID NO: 156316 - protein, 15 aa, BORRELIA GARINII
LIACKQNVSSLDEKN

SEQ ID NO: 156317 - protein, 15 aa, BORRELIA GARINII
IACKQNVSSLDEKNS

SEQ ID NO: 156318 - protein, 15 aa, BORRELIA GARINII
ACKQNVSSLDEKNSV

SEQ ID NO: 156319 - protein, 15 aa, BORRELIA GARINII
CKQNVSSLDEKNSVS

SEQ ID NO: 156320 - protein, 15 aa, BORRELIA GARINII
KQNVSSLDEKNSVSV

SEQ ID NO: 156321 - protein, 15 aa, BORRELIA GARINII
QNVSSLDEKNSVSVD

SEQ ID NO: 156322 - protein, 15 aa, BORRELIA GARINII
NVSSLDEKNSVSVDL

SEQ ID NO: 156323 - protein, 15 aa, BORRELIA GARINII
VSSLDEKNSVSVDLP

SEQ ID NO: 156324 - protein, 15 aa, BORRELIA GARINII
SSLDEKNSVSVDLPG

SEQ ID NO: 156325 - protein, 15 aa, BORRELIA GARINII
SLDEKNSVSVDLPGG

SEQ ID NO: 156326 - protein, 15 aa, BORRELIA GARINII
LDEKNSVSVDLPGGM

SEQ ID NO: 156327 - protein, 15 aa, BORRELIA GARINII
DEKNSVSVDLPGGMK

SEQ ID NO: 156328 - protein, 15 aa, BORRELIA GARINII
EKNSVSVDLPGGMKV

SEQ ID NO: 156329 - protein, 15 aa, BORRELIA GARINII
KNSVSVDLPGGMKVL

SEQ ID NO: 156330 - protein, 15 aa, BORRELIA GARINII
NSVSVDLPGGMKVLV

SEQ ID NO: 156331 - protein, 15 aa, BORRELIA GARINII
SVSVDLPGGMKVLVS

SEQ ID NO: 156332 - protein, 15 aa, BORRELIA GARINII
VSVDLPGGMKVLVSK

SEQ ID NO: 156333 - protein, 15 aa, BORRELIA GARINII
SVDLPGGMKVLVSKE

SEQ ID NO: 156334 - protein, 15 aa, BORRELIA GARINII
VDLPGGMKVLVSKEK

SEQ ID NO: 156335 - protein, 15 aa, BORRELIA GARINII
DLPGGMKVLVSKEKD

SEQ ID NO: 156336 - protein, 15 aa, BORRELIA GARINII
LPGGMKVLVSKEKDK

SEQ ID NO: 156337 - protein, 15 aa, BORRELIA GARINII
PGGMKVLVSKEKDKD

SEQ ID NO: 156338 - protein, 15 aa, BORRELIA GARINII
GGMKVLVSKEKDKDG

SEQ ID NO: 156339 - protein, 15 aa, BORRELIA GARINII
GMKVLVSKEKDKDGK

SEQ ID NO: 156340 - protein, 15 aa, BORRELIA GARINII
MKVLVSKEKDKDGKY

SEQ ID NO: 156341 - protein, 15 aa, BORRELIA GARINII
KVLVSKEKDKDGKYS

SEQ ID NO: 156342 - protein, 15 aa, BORRELIA GARINII
VLVSKEKDKDGKYSL

SEQ ID NO: 156343 - protein, 15 aa, BORRELIA GARINII
LVSKEKDKDGKYSLM

SEQ ID NO: 156344 - protein, 15 aa, BORRELIA GARINII
VSKEKDKDGKYSLMA

SEQ ID NO: 156345 - protein, 15 aa, BORRELIA GARINII
SKEKDKDGKYSLMAT

SEQ ID NO: 156346 - protein, 15 aa, BORRELIA GARINII
KEKDKDGKYSLMATV

SEQ ID NO: 156347 - protein, 15 aa, BORRELIA GARINII
EKDKDGKYSLMATVE

SEQ ID NO: 156348 - protein, 15 aa, BORRELIA GARINII
KDKDGKYSLMATVEK

SEQ ID NO: 156349 - protein, 15 aa, BORRELIA GARINII
DKDGKYSLMATVEKL

SEQ ID NO: 156350 - protein, 15 aa, BORRELIA GARINII
KDGKYSLMATVEKLE

SEQ ID NO: 156351 - protein, 15 aa, BORRELIA GARINII
DGKYSLMATVEKLEL

SEQ ID NO: 156352 - protein, 15 aa, BORRELIA GARINII
GKYSLMATVEKLELK

SEQ ID NO: 156353 - protein, 15 aa, BORRELIA GARINII
KYSLMATVEKLELKG

SEQ ID NO: 156354 - protein, 15 aa, BORRELIA GARINII
YSLMATVEKLELKGT

SEQ ID NO: 156355 - protein, 15 aa, BORRELIA GARINII
SLMATVEKLELKGTS

SEQ ID NO: 156356 - protein, 15 aa, BORRELIA GARINII
LMATVEKLELKGTSD

SEQ ID NO: 156357 - protein, 15 aa, BORRELIA GARINII
MATVEKLELKGTSDK

SEQ ID NO: 156358 - protein, 15 aa, BORRELIA GARINII
ATVEKLELKGTSDKN

SEQ ID NO: 156359 - protein, 15 aa, BORRELIA GARINII
TVEKLELKGTSDKNN

SEQ ID NO: 156360 - protein, 15 aa, BORRELIA GARINII
VEKLELKGTSDKNNG

SEQ ID NO: 156361 - protein, 15 aa, BORRELIA GARINII
EKLELKGTSDKNNGS

SEQ ID NO: 156362 - protein, 15 aa, BORRELIA GARINII
KLELKGTSDKNNGSG

SEQ ID NO: 156363 - protein, 15 aa, BORRELIA GARINII
LELKGTSDKNNGSGT

SEQ ID NO: 156364 - protein, 15 aa, BORRELIA GARINII
ELKGTSDKNNGSGTL

SEQ ID NO: 156365 - protein, 15 aa, BORRELIA GARINII
LKGTSDKNNGSGTLE

SEQ ID NO: 156366 - protein, 15 aa, BORRELIA GARINII
KGTSDKNNGSGTLEG

SEQ ID NO: 156367 - protein, 15 aa, BORRELIA GARINII
GTSDKNNGSGTLEGE

SEQ ID NO: 156368 - protein, 15 aa, BORRELIA GARINII
TSDKNNGSGTLEGEK

SEQ ID NO: 156369 - protein, 15 aa, BORRELIA GARINII
SDKNNGSGTLEGEKT

SEQ ID NO: 156370 - protein, 15 aa, BORRELIA GARINII
DKNNGSGTLEGEKTD

SEQ ID NO: 156371 - protein, 15 aa, BORRELIA GARINII
KNNGSGTLEGEKTDK

SEQ ID NO: 156372 - protein, 15 aa, BORRELIA GARINII
NNGSGTLEGEKTDKS

SEQ ID NO: 156373 - protein, 15 aa, BORRELIA GARINII
NGSGTLEGEKTDKSK

SEQ ID NO: 156374 - protein, 15 aa, BORRELIA GARINII
GSGTLEGEKTDKSKV

SEQ ID NO: 156375 - protein, 15 aa, BORRELIA GARINII
SGTLEGEKTDKSKVK

SEQ ID NO: 156376 - protein, 15 aa, BORRELIA GARINII
GTLEGEKTDKSKVKL

SEQ ID NO: 156377 - protein, 15 aa, BORRELIA GARINII
TLEGEKTDKSKVKLT

SEQ ID NO: 156378 - protein, 15 aa, BORRELIA GARINII
LEGEKTDKSKVKLTI

SEQ ID NO: 156379 - protein, 15 aa, BORRELIA GARINII
EGEKTDKSKVKLTIA

SEQ ID NO: 156380 - protein, 15 aa, BORRELIA GARINII
GEKTDKSKVKLTIAE

SEQ ID NO: 156381 - protein, 15 aa, BORRELIA GARINII
EKTDKSKVKLTIAED

SEQ ID NO: 156382 - protein, 15 aa, BORRELIA GARINII
KTDKSKVKLTIAEDL

SEQ ID NO: 156383 - protein, 15 aa, BORRELIA GARINII
TDKSKVKLTIAEDLS

SEQ ID NO: 156384 - protein, 15 aa, BORRELIA GARINII
DKSKVKLTIAEDLSK

SEQ ID NO: 156385 - protein, 15 aa, BORRELIA GARINII
KSKVKLTIAEDLSKT

SEQ ID NO: 156386 - protein, 15 aa, BORRELIA GARINII
SKVKLTIAEDLSKTT

SEQ ID NO: 156387 - protein, 15 aa, BORRELIA GARINII
KVKLTIAEDLSKTTF

SEQ ID NO: 156388 - protein, 15 aa, BORRELIA GARINII
VKLTIAEDLSKTTFE

SEQ ID NO: 156389 - protein, 15 aa, BORRELIA GARINII
KLTIAEDLSKTTFEI

SEQ ID NO: 156390 - protein, 15 aa, BORRELIA GARINII
LTIAEDLSKTTFEIF

SEQ ID NO: 156391 - protein, 15 aa, BORRELIA GARINII
TIAEDLSKTTFEIFK

SEQ ID NO: 156392 - protein, 15 aa, BORRELIA GARINII
IAEDLSKTTFEIFKE

SEQ ID NO: 156393 - protein, 15 aa, BORRELIA GARINII
AEDLSKTTFEIFKED

SEQ ID NO: 156394 - protein, 15 aa, BORRELIA GARINII
EDLSKTTFEIFKEDG

SEQ ID NO: 156395 - protein, 15 aa, BORRELIA GARINII
DLSKTTFEIFKEDGK

SEQ ID NO: 156396 - protein, 15 aa, BORRELIA GARINII
LSKTTFEIFKEDGKT

SEQ ID NO: 156397 - protein, 15 aa, BORRELIA GARINII
SKTTFEIFKEDGKTL

SEQ ID NO: 156398 - protein, 15 aa, BORRELIA GARINII
KTTFEIFKEDGKTLV

SEQ ID NO: 156399 - protein, 15 aa, BORRELIA GARINII
TTFEIFKEDGKTLVS

SEQ ID NO: 156400 - protein, 15 aa, BORRELIA GARINII
TFEIFKEDGKTLVSK

SEQ ID NO: 156401 - protein, 15 aa, BORRELIA GARINII
FEIFKEDGKTLVSKK

SEQ ID NO: 156402 - protein, 15 aa, BORRELIA GARINII
EIFKEDGKTLVSKKV

SEQ ID NO: 156403 - protein, 15 aa, BORRELIA GARINII
IFKEDGKTLVSKKVT

SEQ ID NO: 156404 - protein, 15 aa, BORRELIA GARINII
FKEDGKTLVSKKVTL

SEQ ID NO: 156405 - protein, 15 aa, BORRELIA GARINII
KEDGKTLVSKKVTLK

SEQ ID NO: 156406 - protein, 15 aa, BORRELIA GARINII
EDGKTLVSKKVTLKD

SEQ ID NO: 156407 - protein, 15 aa, BORRELIA GARINII
DGKTLVSKKVTLKDK

SEQ ID NO: 156408 - protein, 15 aa, BORRELIA GARINII
GKTLVSKKVTLKDKS

SEQ ID NO: 156409 - protein, 15 aa, BORRELIA GARINII
KTLVSKKVTLKDKSS

SEQ ID NO: 156410 - protein, 15 aa, BORRELIA GARINII
TLVSKKVTLKDKSST

SEQ ID NO: 156411 - protein, 15 aa, BORRELIA GARINII
LVSKKVTLKDKSSTE

SEQ ID NO: 156412 - protein, 15 aa, BORRELIA GARINII
VSKKVTLKDKSSTEE

SEQ ID NO: 156413 - protein, 15 aa, BORRELIA GARINII
SKKVTLKDKSSTEEK

SEQ ID NO: 156414 - protein, 15 aa, BORRELIA GARINII
KKVTLKDKSSTEEKF

SEQ ID NO: 156415 - protein, 15 aa, BORRELIA GARINII
KVTLKDKSSTEEKFN

SEQ ID NO: 156416 - protein, 15 aa, BORRELIA GARINII
VTLKDKSSTEEKFNE

SEQ ID NO: 156417 - protein, 15 aa, BORRELIA GARINII
TLKDKSSTEEKFNEK

SEQ ID NO: 156418 - protein, 15 aa, BORRELIA GARINII
LKDKSSTEEKFNEKG

SEQ ID NO: 156419 - protein, 15 aa, BORRELIA GARINII
KDKSSTEEKFNEKGE

SEQ ID NO: 156420 - protein, 15 aa, BORRELIA GARINII
DKSSTEEKFNEKGEI

SEQ ID NO: 156421 - protein, 15 aa, BORRELIA GARINII
KSSTEEKFNEKGEIS

SEQ ID NO: 156422 - protein, 15 aa, BORRELIA GARINII
SSTEEKFNEKGEISE

SEQ ID NO: 156423 - protein, 15 aa, BORRELIA GARINII
STEEKFNEKGEISEK

SEQ ID NO: 156424 - protein, 15 aa, BORRELIA GARINII
TEEKFNEKGEISEKT

SEQ ID NO: 156425 - protein, 15 aa, BORRELIA GARINII
EEKFNEKGEISEKTI

SEQ ID NO: 156426 - protein, 15 aa, BORRELIA GARINII
EKFNEKGEISEKTIV

SEQ ID NO: 156427 - protein, 15 aa, BORRELIA GARINII
KFNEKGEISEKTIVR

SEQ ID NO: 156428 - protein, 15 aa, BORRELIA GARINII
FNEKGEISEKTIVRA

SEQ ID NO: 156429 - protein, 15 aa, BORRELIA GARINII
NEKGEISEKTIVRAN

SEQ ID NO: 156430 - protein, 15 aa, BORRELIA GARINII
EKGEISEKTIVRANG

SEQ ID NO: 156431 - protein, 15 aa, BORRELIA GARINII
KGEISEKTIVRANGT

SEQ ID NO: 156432 - protein, 15 aa, BORRELIA GARINII
GEISEKTIVRANGTR

SEQ ID NO: 156433 - protein, 15 aa, BORRELIA GARINII
EISEKTIVRANGTRL

SEQ ID NO: 156434 - protein, 15 aa, BORRELIA GARINII
ISEKTIVRANGTRLE

SEQ ID NO: 156435 - protein, 15 aa, BORRELIA GARINII
SEKTIVRANGTRLEY

SEQ ID NO: 156436 - protein, 15 aa, BORRELIA GARINII
EKTIVRANGTRLEYT

SEQ ID NO: 156437 - protein, 15 aa, BORRELIA GARINII
KTIVRANGTRLEYTD

SEQ ID NO: 156438 - protein, 15 aa, BORRELIA GARINII
TIVRANGTRLEYTDI

SEQ ID NO: 156439 - protein, 15 aa, BORRELIA GARINII
IVRANGTRLEYTDIK

SEQ ID NO: 156440 - protein, 15 aa, BORRELIA GARINII
VRANGTRLEYTDIKS

SEQ ID NO: 156441 - protein, 15 aa, BORRELIA GARINII
RANGTRLEYTDIKSD

SEQ ID NO: 156442 - protein, 15 aa, BORRELIA GARINII
ANGTRLEYTDIKSDG

SEQ ID NO: 156443 - protein, 15 aa, BORRELIA GARINII
NGTRLEYTDIKSDGS

SEQ ID NO: 156444 - protein, 15 aa, BORRELIA GARINII
GTRLEYTDIKSDGSG

SEQ ID NO: 156445 - protein, 15 aa, BORRELIA GARINII
TRLEYTDIKSDGSGK

SEQ ID NO: 156446 - protein, 15 aa, BORRELIA GARINII
RLEYTDIKSDGSGKA

SEQ ID NO: 156447 - protein, 15 aa, BORRELIA GARINII
LEYTDIKSDGSGKAK

SEQ ID NO: 156448 - protein, 15 aa, BORRELIA GARINII
EYTDIKSDGSGKAKE

SEQ ID NO: 156449 - protein, 15 aa, BORRELIA GARINII
YTDIKSDGSGKAKEV

SEQ ID NO: 156450 - protein, 15 aa, BORRELIA GARINII
TDIKSDGSGKAKEVL

SEQ ID NO: 156451 - protein, 15 aa, BORRELIA GARINII
DIKSDGSGKAKEVLK

SEQ ID NO: 156452 - protein, 15 aa, BORRELIA GARINII
IKSDGSGKAKEVLKD

SEQ ID NO: 156453 - protein, 15 aa, BORRELIA GARINII
KSDGSGKAKEVLKDF

SEQ ID NO: 156454 - protein, 15 aa, BORRELIA GARINII
SDGSGKAKEVLKDFT

SEQ ID NO: 156455 - protein, 15 aa, BORRELIA GARINII
DGSGKAKEVLKDFTL

SEQ ID NO: 156456 - protein, 15 aa, BORRELIA GARINII
GSGKAKEVLKDFTLE

SEQ ID NO: 156457 - protein, 15 aa, BORRELIA GARINII
SGKAKEVLKDFTLEG

SEQ ID NO: 156458 - protein, 15 aa, BORRELIA GARINII
GKAKEVLKDFTLEGT

SEQ ID NO: 156459 - protein, 15 aa, BORRELIA GARINII
KAKEVLKDFTLEGTL

SEQ ID NO: 156460 - protein, 15 aa, BORRELIA GARINII
AKEVLKDFTLEGTLA

SEQ ID NO: 156461 - protein, 15 aa, BORRELIA GARINII
KEVLKDFTLEGTLAA

SEQ ID NO: 156462 - protein, 15 aa, BORRELIA GARINII
EVLKDFTLEGTLAAD

SEQ ID NO: 156463 - protein, 15 aa, BORRELIA GARINII
VLKDFTLEGTLAADG

SEQ ID NO: 156464 - protein, 15 aa, BORRELIA GARINII
LKDFTLEGTLAADGK

SEQ ID NO: 156465 - protein, 15 aa, BORRELIA GARINII
KDFTLEGTLAADGKT

SEQ ID NO: 156466 - protein, 15 aa, BORRELIA GARINII
DFTLEGTLAADGKTT

SEQ ID NO: 156467 - protein, 15 aa, BORRELIA GARINII
FTLEGTLAADGKTTL

SEQ ID NO: 156468 - protein, 15 aa, BORRELIA GARINII
TLEGTLAADGKTTLK

SEQ ID NO: 156469 - protein, 15 aa, BORRELIA GARINII
LEGTLAADGKTTLKV

SEQ ID NO: 156470 - protein, 15 aa, BORRELIA GARINII
EGTLAADGKTTLKVT

SEQ ID NO: 156471 - protein, 15 aa, BORRELIA GARINII
GTLAADGKTTLKVTE

SEQ ID NO: 156472 - protein, 15 aa, BORRELIA GARINII
TLAADGKTTLKVTEG

SEQ ID NO: 156473 - protein, 15 aa, BORRELIA GARINII
LAADGKTTLKVTEGT

SEQ ID NO: 156474 - protein, 15 aa, BORRELIA GARINII
AADGKTTLKVTEGTV

SEQ ID NO: 156475 - protein, 15 aa, BORRELIA GARINII
ADGKTTLKVTEGTVV

SEQ ID NO: 156476 - protein, 15 aa, BORRELIA GARINII
DGKTTLKVTEGTVVL

SEQ ID NO: 156477 - protein, 15 aa, BORRELIA GARINII
GKTTLKVTEGTVVLS

SEQ ID NO: 156478 - protein, 15 aa, BORRELIA GARINII
KTTLKVTEGTVVLSK

SEQ ID NO: 156479 - protein, 15 aa, BORRELIA GARINII
TTLKVTEGTVVLSKN

SEQ ID NO: 156480 - protein, 15 aa, BORRELIA GARINII
TLKVTEGTVVLSKNI

SEQ ID NO: 156481 - protein, 15 aa, BORRELIA GARINII
LKVTEGTVVLSKNIL

SEQ ID NO: 156482 - protein, 15 aa, BORRELIA GARINII
KVTEGTVVLSKNILK

SEQ ID NO: 156483 - protein, 15 aa, BORRELIA GARINII
VTEGTVVLSKNILKS

SEQ ID NO: 156484 - protein, 15 aa, BORRELIA GARINII
TEGTVVLSKNILKSG

SEQ ID NO: 156485 - protein, 15 aa, BORRELIA GARINII
EGTVVLSKNILKSGE

SEQ ID NO: 156486 - protein, 15 aa, BORRELIA GARINII
GTVVLSKNILKSGEI

SEQ ID NO: 156487 - protein, 15 aa, BORRELIA GARINII
TVVLSKNILKSGEIT

SEQ ID NO: 156488 - protein, 15 aa, BORRELIA GARINII
VVLSKNILKSGEITV

SEQ ID NO: 156489 - protein, 15 aa, BORRELIA GARINII
VLSKNILKSGEITVA

SEQ ID NO: 156490 - protein, 15 aa, BORRELIA GARINII
LSKNILKSGEITVAL

SEQ ID NO: 156491 - protein, 15 aa, BORRELIA GARINII
SKNILKSGEITVALD

SEQ ID NO: 156492 - protein, 15 aa, BORRELIA GARINII
KNILKSGEITVALDD

SEQ ID NO: 156493 - protein, 15 aa, BORRELIA GARINII
NILKSGEITVALDDS

SEQ ID NO: 156494 - protein, 15 aa, BORRELIA GARINII
ILKSGEITVALDDSD

SEQ ID NO: 156495 - protein, 15 aa, BORRELIA GARINII
LKSGEITVALDDSDT

SEQ ID NO: 156496 - protein, 15 aa, BORRELIA GARINII
KSGEITVALDDSDTT

SEQ ID NO: 156497 - protein, 15 aa, BORRELIA GARINII
SGEITVALDDSDTTQ

SEQ ID NO: 156498 - protein, 15 aa, BORRELIA GARINII
GEITVALDDSDTTQA

SEQ ID NO: 156499 - protein, 15 aa, BORRELIA GARINII
EITVALDDSDTTQAT

SEQ ID NO: 156500 - protein, 15 aa, BORRELIA GARINII
ITVALDDSDTTQATK

SEQ ID NO: 156501 - protein, 15 aa, BORRELIA GARINII
TVALDDSDTTQATKK

SEQ ID NO: 156502 - protein, 15 aa, BORRELIA GARINII
VALDDSDTTQATKKT

SEQ ID NO: 156503 - protein, 15 aa, BORRELIA GARINII
ALDDSDTTQATKKTG

SEQ ID NO: 156504 - protein, 15 aa, BORRELIA GARINII
LDDSDTTQATKKTGK

SEQ ID NO: 156505 - protein, 15 aa, BORRELIA GARINII
DDSDTTQATKKTGKW

SEQ ID NO: 156506 - protein, 15 aa, BORRELIA GARINII
DSDTTQATKKTGKWD

SEQ ID NO: 156507 - protein, 15 aa, BORRELIA GARINII
SDTTQATKKTGKWDS

SEQ ID NO: 156508 - protein, 15 aa, BORRELIA GARINII
DTTQATKKTGKWDSK

SEQ ID NO: 156509 - protein, 15 aa, BORRELIA GARINII
TTQATKKTGKWDSKT

SEQ ID NO: 156510 - protein, 15 aa, BORRELIA GARINII
TQATKKTGKWDSKTS

SEQ ID NO: 156511 - protein, 15 aa, BORRELIA GARINII
QATKKTGKWDSKTST

SEQ ID NO: 156512 - protein, 15 aa, BORRELIA GARINII
ATKKTGKWDSKTSTL

SEQ ID NO: 156513 - protein, 15 aa, BORRELIA GARINII
TKKTGKWDSKTSTLT

SEQ ID NO: 156514 - protein, 15 aa, BORRELIA GARINII
KKTGKWDSKTSTLTI

SEQ ID NO: 156515 - protein, 15 aa, BORRELIA GARINII
KTGKWDSKTSTLTIS

SEQ ID NO: 156516 - protein, 15 aa, BORRELIA GARINII
TGKWDSKTSTLTISV

SEQ ID NO: 156517 - protein, 15 aa, BORRELIA GARINII
GKWDSKTSTLTISVN

SEQ ID NO: 156518 - protein, 15 aa, BORRELIA GARINII
KWDSKTSTLTISVNS

SEQ ID NO: 156519 - protein, 15 aa, BORRELIA GARINII
WDSKTSTLTISVNSQ

SEQ ID NO: 156520 - protein, 15 aa, BORRELIA GARINII
DSKTSTLTISVNSQK

SEQ ID NO: 156521 - protein, 15 aa, BORRELIA GARINII
SKTSTLTISVNSQKT

SEQ ID NO: 156522 - protein, 15 aa, BORRELIA GARINII
KTSTLTISVNSQKTK

SEQ ID NO: 156523 - protein, 15 aa, BORRELIA GARINII
TSTLTISVNSQKTKN

SEQ ID NO: 156524 - protein, 15 aa, BORRELIA GARINII
STLTISVNSQKTKNL

SEQ ID NO: 156525 - protein, 15 aa, BORRELIA GARINII
TLTISVNSQKTKNLV

SEQ ID NO: 156526 - protein, 15 aa, BORRELIA GARINII
LTISVNSQKTKNLVF

SEQ ID NO: 156527 - protein, 15 aa, BORRELIA GARINII
TISVNSQKTKNLVFT

SEQ ID NO: 156528 - protein, 15 aa, BORRELIA GARINII
ISVNSQKTKNLVFTK

SEQ ID NO: 156529 - protein, 15 aa, BORRELIA GARINII
SVNSQKTKNLVFTKE

SEQ ID NO: 156530 - protein, 15 aa, BORRELIA GARINII
VNSQKTKNLVFTKED

SEQ ID NO: 156531 - protein, 15 aa, BORRELIA GARINII
NSQKTKNLVFTKEDT

SEQ ID NO: 156532 - protein, 15 aa, BORRELIA GARINII
SQKTKNLVFTKEDTI

SEQ ID NO: 156533 - protein, 15 aa, BORRELIA GARINII
QKTKNLVFTKEDTIT

SEQ ID NO: 156534 - protein, 15 aa, BORRELIA GARINII
KTKNLVFTKEDTITV

SEQ ID NO: 156535 - protein, 15 aa, BORRELIA GARINII
TKNLVFTKEDTITVQ

SEQ ID NO: 156536 - protein, 15 aa, BORRELIA GARINII
KNLVFTKEDTITVQK

SEQ ID NO: 156537 - protein, 15 aa, BORRELIA GARINII
NLVFTKEDTITVQKY

SEQ ID NO: 156538 - protein, 15 aa, BORRELIA GARINII
LVFTKEDTITVQKYD

SEQ ID NO: 156539 - protein, 15 aa, BORRELIA GARINII
VFTKEDTITVQKYDS

SEQ ID NO: 156540 - protein, 15 aa, BORRELIA GARINII
FTKEDTITVQKYDSA

SEQ ID NO: 156541 - protein, 15 aa, BORRELIA GARINII
TKEDTITVQKYDSAG

SEQ ID NO: 156542 - protein, 15 aa, BORRELIA GARINII
KEDTITVQKYDSAGT

SEQ ID NO: 156543 - protein, 15 aa, BORRELIA GARINII
EDTITVQKYDSAGTN

SEQ ID NO: 156544 - protein, 15 aa, BORRELIA GARINII
DTITVQKYDSAGTNL

SEQ ID NO: 156545 - protein, 15 aa, BORRELIA GARINII
TITVQKYDSAGTNLE

SEQ ID NO: 156546 - protein, 15 aa, BORRELIA GARINII
ITVQKYDSAGTNLEG

SEQ ID NO: 156547 - protein, 15 aa, BORRELIA GARINII
TVQKYDSAGTNLEGK

SEQ ID NO: 156548 - protein, 15 aa, BORRELIA GARINII
VQKYDSAGTNLEGKA

SEQ ID NO: 156549 - protein, 15 aa, BORRELIA GARINII
QKYDSAGTNLEGKAV

SEQ ID NO: 156550 - protein, 15 aa, BORRELIA GARINII
KYDSAGTNLEGKAVE

SEQ ID NO: 156551 - protein, 15 aa, BORRELIA GARINII
YDSAGTNLEGKAVEI

SEQ ID NO: 156552 - protein, 15 aa, BORRELIA GARINII
DSAGTNLEGKAVEIT

SEQ ID NO: 156553 - protein, 15 aa, BORRELIA GARINII
SAGTNLEGKAVEITT

SEQ ID NO: 156554 - protein, 15 aa, BORRELIA GARINII
AGTNLEGKAVEITTL

SEQ ID NO: 156555 - protein, 15 aa, BORRELIA GARINII
GTNLEGKAVEITTLE

SEQ ID NO: 156556 - protein, 15 aa, BORRELIA GARINII
TNLEGKAVEITTLEK

SEQ ID NO: 156557 - protein, 15 aa, BORRELIA GARINII
NLEGKAVEITTLEKL

SEQ ID NO: 156558 - protein, 15 aa, BORRELIA GARINII
LEGKAVEITTLEKLK

SEQ ID NO: 156559 - protein, 15 aa, BORRELIA GARINII
EGKAVEITTLEKLKD

SEQ ID NO: 156560 - protein, 15 aa, BORRELIA GARINII
GKAVEITTLEKLKDA

SEQ ID NO: 156561 - protein, 15 aa, BORRELIA GARINII
KAVEITTLEKLKDAL

SEQ ID NO: 156562 - protein, 15 aa, BORRELIA GARINII
AVEITTLEKLKDALK

SEQ ID NO: 156563 - protein, 16 aa, BORRELIA GARINII
MKKYLLGIGLILALIA

SEQ ID NO: 156564 - protein, 16 aa, BORRELIA GARINII
KKYLLGIGLILALIAC

SEQ ID NO: 156565 - protein, 16 aa, BORRELIA GARINII
KYLLGIGLILALIACK

SEQ ID NO: 156566 - protein, 16 aa, BORRELIA GARINII
YLLGIGLILALIACKQ

SEQ ID NO: 156567 - protein, 16 aa, BORRELIA GARINII
LLGIGLILALIACKQN

SEQ ID NO: 156568 - protein, 16 aa, BORRELIA GARINII
LGIGLILALIACKQNV

SEQ ID NO: 156569 - protein, 16 aa, BORRELIA GARINII
GIGLILALIACKQNVS

SEQ ID NO: 156570 - protein, 16 aa, BORRELIA GARINII
IGLILALIACKQNVSS

SEQ ID NO: 156571 - protein, 16 aa, BORRELIA GARINII
GLILALIACKQNVSSL

SEQ ID NO: 156572 - protein, 16 aa, BORRELIA GARINII
LILALIACKQNVSSLD

SEQ ID NO: 156573 - protein, 16 aa, BORRELIA GARINII
ILALIACKQNVSSLDE

SEQ ID NO: 156574 - protein, 16 aa, BORRELIA GARINII
LALIACKQNVSSLDEK

SEQ ID NO: 156575 - protein, 16 aa, BORRELIA GARINII
ALIACKQNVSSLDEKN

SEQ ID NO: 156576 - protein, 16 aa, BORRELIA GARINII
LIACKQNVSSLDEKNS

SEQ ID NO: 156577 - protein, 16 aa, BORRELIA GARINII
IACKQNVSSLDEKNSV

SEQ ID NO: 156578 - protein, 16 aa, BORRELIA GARINII
ACKQNVSSLDEKNSVS

SEQ ID NO: 156579 - protein, 16 aa, BORRELIA GARINII
CKQNVSSLDEKNSVSV

SEQ ID NO: 156580 - protein, 16 aa, BORRELIA GARINII
KQNVSSLDEKNSVSVD

SEQ ID NO: 156581 - protein, 16 aa, BORRELIA GARINII
QNVSSLDEKNSVSVDL

SEQ ID NO: 156582 - protein, 16 aa, BORRELIA GARINII
NVSSLDEKNSVSVDLP

SEQ ID NO: 156583 - protein, 16 aa, BORRELIA GARINII
VSSLDEKNSVSVDLPG

SEQ ID NO: 156584 - protein, 16 aa, BORRELIA GARINII
SSLDEKNSVSVDLPGG

SEQ ID NO: 156585 - protein, 16 aa, BORRELIA GARINII
SLDEKNSVSVDLPGGM

SEQ ID NO: 156586 - protein, 16 aa, BORRELIA GARINII
LDEKNSVSVDLPGGMK

SEQ ID NO: 156587 - protein, 16 aa, BORRELIA GARINII
DEKNSVSVDLPGGMKV

SEQ ID NO: 156588 - protein, 16 aa, BORRELIA GARINII
EKNSVSVDLPGGMKVL

SEQ ID NO: 156589 - protein, 16 aa, BORRELIA GARINII
KNSVSVDLPGGMKVLV

SEQ ID NO: 156590 - protein, 16 aa, BORRELIA GARINII
NSVSVDLPGGMKVLVS

SEQ ID NO: 156591 - protein, 16 aa, BORRELIA GARINII
SVSVDLPGGMKVLVSK

SEQ ID NO: 156592 - protein, 16 aa, BORRELIA GARINII
VSVDLPGGMKVLVSKE

SEQ ID NO: 156593 - protein, 16 aa, BORRELIA GARINII
SVDLPGGMKVLVSKEK

SEQ ID NO: 156594 - protein, 16 aa, BORRELIA GARINII
VDLPGGMKVLVSKEKD

SEQ ID NO: 156595 - protein, 16 aa, BORRELIA GARINII
DLPGGMKVLVSKEKDK

SEQ ID NO: 156596 - protein, 16 aa, BORRELIA GARINII
LPGGMKVLVSKEKDKD

SEQ ID NO: 156597 - protein, 16 aa, BORRELIA GARINII
PGGMKVLVSKEKDKDG

SEQ ID NO: 156598 - protein, 16 aa, BORRELIA GARINII
GGMKVLVSKEKDKDGK

SEQ ID NO: 156599 - protein, 16 aa, BORRELIA GARINII
GMKVLVSKEKDKDGKY

SEQ ID NO: 156600 - protein, 16 aa, BORRELIA GARINII
MKVLVSKEKDKDGKYS

SEQ ID NO: 156601 - protein, 16 aa, BORRELIA GARINII
KVLVSKEKDKDGKYSL

SEQ ID NO: 156602 - protein, 16 aa, BORRELIA GARINII
VLVSKEKDKDGKYSLM

SEQ ID NO: 156603 - protein, 16 aa, BORRELIA GARINII
LVSKEKDKDGKYSLMA

SEQ ID NO: 156604 - protein, 16 aa, BORRELIA GARINII
VSKEKDKDGKYSLMAT

SEQ ID NO: 156605 - protein, 16 aa, BORRELIA GARINII
SKEKDKDGKYSLMATV

SEQ ID NO: 156606 - protein, 16 aa, BORRELIA GARINII
KEKDKDGKYSLMATVE

SEQ ID NO: 156607 - protein, 16 aa, BORRELIA GARINII
EKDKDGKYSLMATVEK

SEQ ID NO: 156608 - protein, 16 aa, BORRELIA GARINII
KDKDGKYSLMATVEKL

SEQ ID NO: 156609 - protein, 16 aa, BORRELIA GARINII
DKDGKYSLMATVEKLE

SEQ ID NO: 156610 - protein, 16 aa, BORRELIA GARINII
KDGKYSLMATVEKLEL

SEQ ID NO: 156611 - protein, 16 aa, BORRELIA GARINII
DGKYSLMATVEKLELK

SEQ ID NO: 156612 - protein, 16 aa, BORRELIA GARINII
GKYSLMATVEKLELKG

SEQ ID NO: 156613 - protein, 16 aa, BORRELIA GARINII
KYSLMATVEKLELKGT

SEQ ID NO: 156614 - protein, 16 aa, BORRELIA GARINII
YSLMATVEKLELKGTS

SEQ ID NO: 156615 - protein, 16 aa, BORRELIA GARINII
SLMATVEKLELKGTSD

SEQ ID NO: 156616 - protein, 16 aa, BORRELIA GARINII
LMATVEKLELKGTSDK

SEQ ID NO: 156617 - protein, 16 aa, BORRELIA GARINII
MATVEKLELKGTSDKN

SEQ ID NO: 156618 - protein, 16 aa, BORRELIA GARINII
ATVEKLELKGTSDKNN

SEQ ID NO: 156619 - protein, 16 aa, BORRELIA GARINII
TVEKLELKGTSDKNNG

SEQ ID NO: 156620 - protein, 16 aa, BORRELIA GARINII
VEKLELKGTSDKNNGS

SEQ ID NO: 156621 - protein, 16 aa, BORRELIA GARINII
EKLELKGTSDKNNGSG

SEQ ID NO: 156622 - protein, 16 aa, BORRELIA GARINII
KLELKGTSDKNNGSGT

SEQ ID NO: 156623 - protein, 16 aa, BORRELIA GARINII
LELKGTSDKNNGSGTL

SEQ ID NO: 156624 - protein, 16 aa, BORRELIA GARINII
ELKGTSDKNNGSGTLE

SEQ ID NO: 156625 - protein, 16 aa, BORRELIA GARINII
LKGTSDKNNGSGTLEG

SEQ ID NO: 156626 - protein, 16 aa, BORRELIA GARINII
KGTSDKNNGSGTLEGE

SEQ ID NO: 156627 - protein, 16 aa, BORRELIA GARINII
GTSDKNNGSGTLEGEK

SEQ ID NO: 156628 - protein, 16 aa, BORRELIA GARINII
TSDKNNGSGTLEGEKT

SEQ ID NO: 156629 - protein, 16 aa, BORRELIA GARINII
SDKNNGSGTLEGEKTD

SEQ ID NO: 156630 - protein, 16 aa, BORRELIA GARINII
DKNNGSGTLEGEKTDK

SEQ ID NO: 156631 - protein, 16 aa, BORRELIA GARINII
KNNGSGTLEGEKTDKS

SEQ ID NO: 156632 - protein, 16 aa, BORRELIA GARINII
NNGSGTLEGEKTDKSK

SEQ ID NO: 156633 - protein, 16 aa, BORRELIA GARINII
NGSGTLEGEKTDKSKV

SEQ ID NO: 156634 - protein, 16 aa, BORRELIA GARINII
GSGTLEGEKTDKSKVK

SEQ ID NO: 156635 - protein, 16 aa, BORRELIA GARINII
SGTLEGEKTDKSKVKL

SEQ ID NO: 156636 - protein, 16 aa, BORRELIA GARINII
GTLEGEKTDKSKVKLT

SEQ ID NO: 156637 - protein, 16 aa, BORRELIA GARINII
TLEGEKTDKSKVKLTI

SEQ ID NO: 156638 - protein, 16 aa, BORRELIA GARINII
LEGEKTDKSKVKLTIA

SEQ ID NO: 156639 - protein, 16 aa, BORRELIA GARINII
EGEKTDKSKVKLTIAE

SEQ ID NO: 156640 - protein, 16 aa, BORRELIA GARINII
GEKTDKSKVKLTIAED

SEQ ID NO: 156641 - protein, 16 aa, BORRELIA GARINII
EKTDKSKVKLTIAEDL

SEQ ID NO: 156642 - protein, 16 aa, BORRELIA GARINII
KTDKSKVKLTIAEDLS

SEQ ID NO: 156643 - protein, 16 aa, BORRELIA GARINII
TDKSKVKLTIAEDLSK

SEQ ID NO: 156644 - protein, 16 aa, BORRELIA GARINII
DKSKVKLTIAEDLSKT

SEQ ID NO: 156645 - protein, 16 aa, BORRELIA GARINII
KSKVKLTIAEDLSKTT

SEQ ID NO: 156646 - protein, 16 aa, BORRELIA GARINII
SKVKLTIAEDLSKTTF

SEQ ID NO: 156647 - protein, 16 aa, BORRELIA GARINII
KVKLTIAEDLSKTTFE

SEQ ID NO: 156648 - protein, 16 aa, BORRELIA GARINII
VKLTIAEDLSKTTFEI

SEQ ID NO: 156649 - protein, 16 aa, BORRELIA GARINII
KLTIAEDLSKTTFEIF

SEQ ID NO: 156650 - protein, 16 aa, BORRELIA GARINII
LTIAEDLSKTTFEIFK

SEQ ID NO: 156651 - protein, 16 aa, BORRELIA GARINII
TIAEDLSKTTFEIFKE

SEQ ID NO: 156652 - protein, 16 aa, BORRELIA GARINII
IAEDLSKTTFEIFKED

SEQ ID NO: 156653 - protein, 16 aa, BORRELIA GARINII
AEDLSKTTFEIFKEDG

SEQ ID NO: 156654 - protein, 16 aa, BORRELIA GARINII
EDLSKTTFEIFKEDGK

SEQ ID NO: 156655 - protein, 16 aa, BORRELIA GARINII
DLSKTTFEIFKEDGKT

SEQ ID NO: 156656 - protein, 16 aa, BORRELIA GARINII
LSKTTFEIFKEDGKTL

SEQ ID NO: 156657 - protein, 16 aa, BORRELIA GARINII
SKTTFEIFKEDGKTLV

SEQ ID NO: 156658 - protein, 16 aa, BORRELIA GARINII
KTTFEIFKEDGKTLVS

SEQ ID NO: 156659 - protein, 16 aa, BORRELIA GARINII
TTFEIFKEDGKTLVSK

SEQ ID NO: 156660 - protein, 16 aa, BORRELIA GARINII
TFEIFKEDGKTLVSKK

SEQ ID NO: 156661 - protein, 16 aa, BORRELIA GARINII
FEIFKEDGKTLVSKKV

SEQ ID NO: 156662 - protein, 16 aa, BORRELIA GARINII
EIFKEDGKTLVSKKVT

SEQ ID NO: 156663 - protein, 16 aa, BORRELIA GARINII
IFKEDGKTLVSKKVTL

SEQ ID NO: 156664 - protein, 16 aa, BORRELIA GARINII
FKEDGKTLVSKKVTLK

SEQ ID NO: 156665 - protein, 16 aa, BORRELIA GARINII
KEDGKTLVSKKVTLKD

SEQ ID NO: 156666 - protein, 16 aa, BORRELIA GARINII
EDGKTLVSKKVTLKDK

SEQ ID NO: 156667 - protein, 16 aa, BORRELIA GARINII
DGKTLVSKKVTLKDKS

SEQ ID NO: 156668 - protein, 16 aa, BORRELIA GARINII
GKTLVSKKVTLKDKSS

SEQ ID NO: 156669 - protein, 16 aa, BORRELIA GARINII
KTLVSKKVTLKDKSST

SEQ ID NO: 156670 - protein, 16 aa, BORRELIA GARINII
TLVSKKVTLKDKSSTE

SEQ ID NO: 156671 - protein, 16 aa, BORRELIA GARINII
LVSKKVTLKDKSSTEE

SEQ ID NO: 156672 - protein, 16 aa, BORRELIA GARINII
VSKKVTLKDKSSTEEK

SEQ ID NO: 156673 - protein, 16 aa, BORRELIA GARINII
SKKVTLKDKSSTEEKF

SEQ ID NO: 156674 - protein, 16 aa, BORRELIA GARINII
KKVTLKDKSSTEEKFN

SEQ ID NO: 156675 - protein, 16 aa, BORRELIA GARINII
KVTLKDKSSTEEKFNE

SEQ ID NO: 156676 - protein, 16 aa, BORRELIA GARINII
VTLKDKSSTEEKFNEK

SEQ ID NO: 156677 - protein, 16 aa, BORRELIA GARINII
TLKDKSSTEEKFNEKG

SEQ ID NO: 156678 - protein, 16 aa, BORRELIA GARINII
LKDKSSTEEKFNEKGE

SEQ ID NO: 156679 - protein, 16 aa, BORRELIA GARINII
KDKSSTEEKFNEKGEI

SEQ ID NO: 156680 - protein, 16 aa, BORRELIA GARINII
DKSSTEEKFNEKGEIS

SEQ ID NO: 156681 - protein, 16 aa, BORRELIA GARINII
KSSTEEKFNEKGEISE

SEQ ID NO: 156682 - protein, 16 aa, BORRELIA GARINII
SSTEEKFNEKGEISEK

SEQ ID NO: 156683 - protein, 16 aa, BORRELIA GARINII
STEEKFNEKGEISEKT

SEQ ID NO: 156684 - protein, 16 aa, BORRELIA GARINII
TEEKFNEKGEISEKTI

SEQ ID NO: 156685 - protein, 16 aa, BORRELIA GARINII
EEKFNEKGEISEKTIV

SEQ ID NO: 156686 - protein, 16 aa, BORRELIA GARINII
EKFNEKGEISEKTIVR

SEQ ID NO: 156687 - protein, 16 aa, BORRELIA GARINII
KFNEKGEISEKTIVRA

SEQ ID NO: 156688 - protein, 16 aa, BORRELIA GARINII
FNEKGEISEKTIVRAN

SEQ ID NO: 156689 - protein, 16 aa, BORRELIA GARINII
NEKGEISEKTIVRANG

SEQ ID NO: 156690 - protein, 16 aa, BORRELIA GARINII
EKGEISEKTIVRANGT

SEQ ID NO: 156691 - protein, 16 aa, BORRELIA GARINII
KGEISEKTIVRANGTR

SEQ ID NO: 156692 - protein, 16 aa, BORRELIA GARINII
GEISEKTIVRANGTRL

SEQ ID NO: 156693 - protein, 16 aa, BORRELIA GARINII
EISEKTIVRANGTRLE

SEQ ID NO: 156694 - protein, 16 aa, BORRELIA GARINII
ISEKTIVRANGTRLEY

SEQ ID NO: 156695 - protein, 16 aa, BORRELIA GARINII
SEKTIVRANGTRLEYT

SEQ ID NO: 156696 - protein, 16 aa, BORRELIA GARINII
EKTIVRANGTRLEYTD

SEQ ID NO: 156697 - protein, 16 aa, BORRELIA GARINII
KTIVRANGTRLEYTDI

SEQ ID NO: 156698 - protein, 16 aa, BORRELIA GARINII
TIVRANGTRLEYTDIK

SEQ ID NO: 156699 - protein, 16 aa, BORRELIA GARINII
IVRANGTRLEYTDIKS

SEQ ID NO: 156700 - protein, 16 aa, BORRELIA GARINII
VRANGTRLEYTDIKSD

SEQ ID NO: 156701 - protein, 16 aa, BORRELIA GARINII
RANGTRLEYTDIKSDG

SEQ ID NO: 156702 - protein, 16 aa, BORRELIA GARINII
ANGTRLEYTDIKSDGS

SEQ ID NO: 156703 - protein, 16 aa, BORRELIA GARINII
NGTRLEYTDIKSDGSG

SEQ ID NO: 156704 - protein, 16 aa, BORRELIA GARINII
GTRLEYTDIKSDGSGK

SEQ ID NO: 156705 - protein, 16 aa, BORRELIA GARINII
TRLEYTDIKSDGSGKA

SEQ ID NO: 156706 - protein, 16 aa, BORRELIA GARINII
RLEYTDIKSDGSGKAK

SEQ ID NO: 156707 - protein, 16 aa, BORRELIA GARINII
LEYTDIKSDGSGKAKE

SEQ ID NO: 156708 - protein, 16 aa, BORRELIA GARINII
EYTDIKSDGSGKAKEV

SEQ ID NO: 156709 - protein, 16 aa, BORRELIA GARINII
YTDIKSDGSGKAKEVL

SEQ ID NO: 156710 - protein, 16 aa, BORRELIA GARINII
TDIKSDGSGKAKEVLK

SEQ ID NO: 156711 - protein, 16 aa, BORRELIA GARINII
DIKSDGSGKAKEVLKD

SEQ ID NO: 156712 - protein, 16 aa, BORRELIA GARINII
IKSDGSGKAKEVLKDF

SEQ ID NO: 156713 - protein, 16 aa, BORRELIA GARINII
KSDGSGKAKEVLKDFT

SEQ ID NO: 156714 - protein, 16 aa, BORRELIA GARINII
SDGSGKAKEVLKDFTL

SEQ ID NO: 156715 - protein, 16 aa, BORRELIA GARINII
DGSGKAKEVLKDFTLE

SEQ ID NO: 156716 - protein, 16 aa, BORRELIA GARINII
GSGKAKEVLKDFTLEG

SEQ ID NO: 156717 - protein, 16 aa, BORRELIA GARINII
SGKAKEVLKDFTLEGT

SEQ ID NO: 156718 - protein, 16 aa, BORRELIA GARINII
GKAKEVLKDFTLEGTL

SEQ ID NO: 156719 - protein, 16 aa, BORRELIA GARINII
KAKEVLKDFTLEGTLA

SEQ ID NO: 156720 - protein, 16 aa, BORRELIA GARINII
AKEVLKDFTLEGTLAA

SEQ ID NO: 156721 - protein, 16 aa, BORRELIA GARINII
KEVLKDFTLEGTLAAD

SEQ ID NO: 156722 - protein, 16 aa, BORRELIA GARINII
EVLKDFTLEGTLAADG

SEQ ID NO: 156723 - protein, 16 aa, BORRELIA GARINII
VLKDFTLEGTLAADGK

SEQ ID NO: 156724 - protein, 16 aa, BORRELIA GARINII
LKDFTLEGTLAADGKT

SEQ ID NO: 156725 - protein, 16 aa, BORRELIA GARINII
KDFTLEGTLAADGKTT

SEQ ID NO: 156726 - protein, 16 aa, BORRELIA GARINII
DFTLEGTLAADGKTTL

SEQ ID NO: 156727 - protein, 16 aa, BORRELIA GARINII
FTLEGTLAADGKTTLK

SEQ ID NO: 156728 - protein, 16 aa, BORRELIA GARINII
TLEGTLAADGKTTLKV

SEQ ID NO: 156729 - protein, 16 aa, BORRELIA GARINII
LEGTLAADGKTTLKVT

SEQ ID NO: 156730 - protein, 16 aa, BORRELIA GARINII
EGTLAADGKTTLKVTE

SEQ ID NO: 156731 - protein, 16 aa, BORRELIA GARINII
GTLAADGKTTLKVTEG

SEQ ID NO: 156732 - protein, 16 aa, BORRELIA GARINII
TLAADGKTTLKVTEGT

SEQ ID NO: 156733 - protein, 16 aa, BORRELIA GARINII
LAADGKTTLKVTEGTV

SEQ ID NO: 156734 - protein, 16 aa, BORRELIA GARINII
AADGKTTLKVTEGTVV

SEQ ID NO: 156735 - protein, 16 aa, BORRELIA GARINII
ADGKTTLKVTEGTVVL

SEQ ID NO: 156736 - protein, 16 aa, BORRELIA GARINII
DGKTTLKVTEGTVVLS

SEQ ID NO: 156737 - protein, 16 aa, BORRELIA GARINII
GKTTLKVTEGTVVLSK

SEQ ID NO: 156738 - protein, 16 aa, BORRELIA GARINII
KTTLKVTEGTVVLSKN

SEQ ID NO: 156739 - protein, 16 aa, BORRELIA GARINII
TTLKVTEGTVVLSKNI

SEQ ID NO: 156740 - protein, 16 aa, BORRELIA GARINII
TLKVTEGTVVLSKNIL

SEQ ID NO: 156741 - protein, 16 aa, BORRELIA GARINII
LKVTEGTVVLSKNILK

SEQ ID NO: 156742 - protein, 16 aa, BORRELIA GARINII
KVTEGTVVLSKNILKS

SEQ ID NO: 156743 - protein, 16 aa, BORRELIA GARINII
VTEGTVVLSKNILKSG

SEQ ID NO: 156744 - protein, 16 aa, BORRELIA GARINII
TEGTVVLSKNILKSGE

SEQ ID NO: 156745 - protein, 16 aa, BORRELIA GARINII
EGTVVLSKNILKSGEI

SEQ ID NO: 156746 - protein, 16 aa, BORRELIA GARINII
GTVVLSKNILKSGEIT

SEQ ID NO: 156747 - protein, 16 aa, BORRELIA GARINII
TVVLSKNILKSGEITV

SEQ ID NO: 156748 - protein, 16 aa, BORRELIA GARINII
VVLSKNILKSGEITVA

SEQ ID NO: 156749 - protein, 16 aa, BORRELIA GARINII
VLSKNILKSGEITVAL

SEQ ID NO: 156750 - protein, 16 aa, BORRELIA GARINII
LSKNILKSGEITVALD

SEQ ID NO: 156751 - protein, 16 aa, BORRELIA GARINII
SKNILKSGEITVALDD

SEQ ID NO: 156752 - protein, 16 aa, BORRELIA GARINII
KNILKSGEITVALDDS

SEQ ID NO: 156753 - protein, 16 aa, BORRELIA GARINII
NILKSGEITVALDDSD

SEQ ID NO: 156754 - protein, 16 aa, BORRELIA GARINII
ILKSGEITVALDDSDT

SEQ ID NO: 156755 - protein, 16 aa, BORRELIA GARINII
LKSGEITVALDDSDTT

SEQ ID NO: 156756 - protein, 16 aa, BORRELIA GARINII
KSGEITVALDDSDTTQ

SEQ ID NO: 156757 - protein, 16 aa, BORRELIA GARINII
SGEITVALDDSDTTQA

SEQ ID NO: 156758 - protein, 16 aa, BORRELIA GARINII
GEITVALDDSDTTQAT

SEQ ID NO: 156759 - protein, 16 aa, BORRELIA GARINII
EITVALDDSDTTQATK

SEQ ID NO: 156760 - protein, 16 aa, BORRELIA GARINII
ITVALDDSDTTQATKK

SEQ ID NO: 156761 - protein, 16 aa, BORRELIA GARINII
TVALDDSDTTQATKKT

SEQ ID NO: 156762 - protein, 16 aa, BORRELIA GARINII
VALDDSDTTQATKKTG

SEQ ID NO: 156763 - protein, 16 aa, BORRELIA GARINII
ALDDSDTTQATKKTGK

SEQ ID NO: 156764 - protein, 16 aa, BORRELIA GARINII
LDDSDTTQATKKTGKW

SEQ ID NO: 156765 - protein, 16 aa, BORRELIA GARINII
DDSDTTQATKKTGKWD

SEQ ID NO: 156766 - protein, 16 aa, BORRELIA GARINII
DSDTTQATKKTGKWDS

SEQ ID NO: 156767 - protein, 16 aa, BORRELIA GARINII
SDTTQATKKTGKWDSK

SEQ ID NO: 156768 - protein, 16 aa, BORRELIA GARINII
DTTQATKKTGKWDSKT

SEQ ID NO: 156769 - protein, 16 aa, BORRELIA GARINII
TTQATKKTGKWDSKTS

SEQ ID NO: 156770 - protein, 16 aa, BORRELIA GARINII
TQATKKTGKWDSKTST

SEQ ID NO: 156771 - protein, 16 aa, BORRELIA GARINII
QATKKTGKWDSKTSTL

SEQ ID NO: 156772 - protein, 16 aa, BORRELIA GARINII
ATKKTGKWDSKTSTLT

SEQ ID NO: 156773 - protein, 16 aa, BORRELIA GARINII
TKKTGKWDSKTSTLTI

SEQ ID NO: 156774 - protein, 16 aa, BORRELIA GARINII
KKTGKWDSKTSTLTIS

SEQ ID NO: 156775 - protein, 16 aa, BORRELIA GARINII
KTGKWDSKTSTLTISV

SEQ ID NO: 156776 - protein, 16 aa, BORRELIA GARINII
TGKWDSKTSTLTISVN

SEQ ID NO: 156777 - protein, 16 aa, BORRELIA GARINII
GKWDSKTSTLTISVNS

SEQ ID NO: 156778 - protein, 16 aa, BORRELIA GARINII
KWDSKTSTLTISVNSQ

SEQ ID NO: 156779 - protein, 16 aa, BORRELIA GARINII
WDSKTSTLTISVNSQK

SEQ ID NO: 156780 - protein, 16 aa, BORRELIA GARINII
DSKTSTLTISVNSQKT

SEQ ID NO: 156781 - protein, 16 aa, BORRELIA GARINII
SKTSTLTISVNSQKTK

SEQ ID NO: 156782 - protein, 16 aa, BORRELIA GARINII
KTSTLTISVNSQKTKN

SEQ ID NO: 156783 - protein, 16 aa, BORRELIA GARINII
TSTLTISVNSQKTKNL

SEQ ID NO: 156784 - protein, 16 aa, BORRELIA GARINII
STLTISVNSQKTKNLV

SEQ ID NO: 156785 - protein, 16 aa, BORRELIA GARINII
TLTISVNSQKTKNLVF

SEQ ID NO: 156786 - protein, 16 aa, BORRELIA GARINII
LTISVNSQKTKNLVFT

SEQ ID NO: 156787 - protein, 16 aa, BORRELIA GARINII
TISVNSQKTKNLVFTK

SEQ ID NO: 156788 - protein, 16 aa, BORRELIA GARINII
ISVNSQKTKNLVFTKE

SEQ ID NO: 156789 - protein, 16 aa, BORRELIA GARINII
SVNSQKTKNLVFTKED

SEQ ID NO: 156790 - protein, 16 aa, BORRELIA GARINII
VNSQKTKNLVFTKEDT

SEQ ID NO: 156791 - protein, 16 aa, BORRELIA GARINII
NSQKTKNLVFTKEDTI

SEQ ID NO: 156792 - protein, 16 aa, BORRELIA GARINII
SQKTKNLVFTKEDTIT

SEQ ID NO: 156793 - protein, 16 aa, BORRELIA GARINII
QKTKNLVFTKEDTITV

SEQ ID NO: 156794 - protein, 16 aa, BORRELIA GARINII
KTKNLVFTKEDTITVQ

SEQ ID NO: 156795 - protein, 16 aa, BORRELIA GARINII
TKNLVFTKEDTITVQK

SEQ ID NO: 156796 - protein, 16 aa, BORRELIA GARINII
KNLVFTKEDTITVQKY

SEQ ID NO: 156797 - protein, 16 aa, BORRELIA GARINII
NLVFTKEDTITVQKYD

SEQ ID NO: 156798 - protein, 16 aa, BORRELIA GARINII
LVFTKEDTITVQKYDS

SEQ ID NO: 156799 - protein, 16 aa, BORRELIA GARINII
VFTKEDTITVQKYDSA

SEQ ID NO: 156800 - protein, 16 aa, BORRELIA GARINII
FTKEDTITVQKYDSAG

SEQ ID NO: 156801 - protein, 16 aa, BORRELIA GARINII
TKEDTITVQKYDSAGT

SEQ ID NO: 156802 - protein, 16 aa, BORRELIA GARINII
KEDTITVQKYDSAGTN

SEQ ID NO: 156803 - protein, 16 aa, BORRELIA GARINII
EDTITVQKYDSAGTNL

SEQ ID NO: 156804 - protein, 16 aa, BORRELIA GARINII
DTITVQKYDSAGTNLE

SEQ ID NO: 156805 - protein, 16 aa, BORRELIA GARINII
TITVQKYDSAGTNLEG

SEQ ID NO: 156806 - protein, 16 aa, BORRELIA GARINII
ITVQKYDSAGTNLEGK

SEQ ID NO: 156807 - protein, 16 aa, BORRELIA GARINII
TVQKYDSAGTNLEGKA

SEQ ID NO: 156808 - protein, 16 aa, BORRELIA GARINII
VQKYDSAGTNLEGKAV

SEQ ID NO: 156809 - protein, 16 aa, BORRELIA GARINII
QKYDSAGTNLEGKAVE

SEQ ID NO: 156810 - protein, 16 aa, BORRELIA GARINII
KYDSAGTNLEGKAVEI

SEQ ID NO: 156811 - protein, 16 aa, BORRELIA GARINII
YDSAGTNLEGKAVEIT

SEQ ID NO: 156812 - protein, 16 aa, BORRELIA GARINII
DSAGTNLEGKAVEITT

SEQ ID NO: 156813 - protein, 16 aa, BORRELIA GARINII
SAGTNLEGKAVEITTL

SEQ ID NO: 156814 - protein, 16 aa, BORRELIA GARINII
AGTNLEGKAVEITTLE

SEQ ID NO: 156815 - protein, 16 aa, BORRELIA GARINII
GTNLEGKAVEITTLEK

SEQ ID NO: 156816 - protein, 16 aa, BORRELIA GARINII
TNLEGKAVEITTLEKL

SEQ ID NO: 156817 - protein, 16 aa, BORRELIA GARINII
NLEGKAVEITTLEKLK

SEQ ID NO: 156818 - protein, 16 aa, BORRELIA GARINII
LEGKAVEITTLEKLKD

SEQ ID NO: 156819 - protein, 16 aa, BORRELIA GARINII
EGKAVEITTLEKLKDA

SEQ ID NO: 156820 - protein, 16 aa, BORRELIA GARINII
GKAVEITTLEKLKDAL

SEQ ID NO: 156821 - protein, 16 aa, BORRELIA GARINII
KAVEITTLEKLKDALK

SEQ ID NO: 156822 - protein, 8 aa, Borrelia afzelii
MKKYLLGI

SEQ ID NO: 156823 - protein, 8 aa, Borrelia afzelii
KKYLLGIG

SEQ ID NO: 156824 - protein, 8 aa, Borrelia afzelii
KYLLGIGL

SEQ ID NO: 156825 - protein, 8 aa, Borrelia afzelii
YLLGIGLI

SEQ ID NO: 156826 - protein, 8 aa, Borrelia afzelii
LLGIGLIL

SEQ ID NO: 156827 - protein, 8 aa, Borrelia afzelii
LGIGLILA

SEQ ID NO: 156828 - protein, 8 aa, Borrelia afzelii
GIGLILAL

SEQ ID NO: 156829 - protein, 8 aa, Borrelia afzelii
IGLILALI

SEQ ID NO: 156830 - protein, 8 aa, Borrelia afzelii
GLILALIA

SEQ ID NO: 156831 - protein, 8 aa, Borrelia afzelii
LILALIAC

SEQ ID NO: 156832 - protein, 8 aa, Borrelia afzelii
ILALIACK

SEQ ID NO: 156833 - protein, 8 aa, Borrelia afzelii
LALIACKQ

SEQ ID NO: 156834 - protein, 8 aa, Borrelia afzelii
ALIACKQN

SEQ ID NO: 156835 - protein, 8 aa, Borrelia afzelii
LIACKQNV

SEQ ID NO: 156836 - protein, 8 aa, Borrelia afzelii
IACKQNVS

SEQ ID NO: 156837 - protein, 8 aa, Borrelia afzelii
ACKQNVSS

SEQ ID NO: 156838 - protein, 8 aa, Borrelia afzelii
CKQNVSSL

SEQ ID NO: 156839 - protein, 8 aa, Borrelia afzelii
KQNVSSLD

SEQ ID NO: 156840 - protein, 8 aa, Borrelia afzelii
QNVSSLDE

SEQ ID NO: 156841 - protein, 8 aa, Borrelia afzelii
NVSSLDEK

SEQ ID NO: 156842 - protein, 8 aa, Borrelia afzelii
VSSLDEKN

SEQ ID NO: 156843 - protein, 8 aa, Borrelia afzelii
SSLDEKNS

SEQ ID NO: 156844 - protein, 8 aa, Borrelia afzelii
SLDEKNSA

SEQ ID NO: 156845 - protein, 8 aa, Borrelia afzelii
LDEKNSAS

SEQ ID NO: 156846 - protein, 8 aa, Borrelia afzelii
DEKNSASV

SEQ ID NO: 156847 - protein, 8 aa, Borrelia afzelii
EKNSASVD

SEQ ID NO: 156848 - protein, 8 aa, Borrelia afzelii
KNSASVDL

SEQ ID NO: 156849 - protein, 8 aa, Borrelia afzelii
NSASVDLP

SEQ ID NO: 156850 - protein, 8 aa, Borrelia afzelii
SASVDLPG

SEQ ID NO: 156851 - protein, 8 aa, Borrelia afzelii
ASVDLPGE

SEQ ID NO: 156852 - protein, 8 aa, Borrelia afzelii
SVDLPGEM

SEQ ID NO: 156853 - protein, 8 aa, Borrelia afzelii
VDLPGEMK

SEQ ID NO: 156854 - protein, 8 aa, Borrelia afzelii
DLPGEMKV

SEQ ID NO: 156855 - protein, 8 aa, Borrelia afzelii
LPGEMKVL

SEQ ID NO: 156856 - protein, 8 aa, Borrelia afzelii
PGEMKVLV

SEQ ID NO: 156857 - protein, 8 aa, Borrelia afzelii
GEMKVLVS

SEQ ID NO: 156858 - protein, 8 aa, Borrelia afzelii
EMKVLVSK

SEQ ID NO: 156859 - protein, 8 aa, Borrelia afzelii
MKVLVSKE

SEQ ID NO: 156860 - protein, 8 aa, Borrelia afzelii
KVLVSKEK

SEQ ID NO: 156861 - protein, 8 aa, Borrelia afzelii
VLVSKEKD

SEQ ID NO: 156862 - protein, 8 aa, Borrelia afzelii
LVSKEKDK

SEQ ID NO: 156863 - protein, 8 aa, Borrelia afzelii
VSKEKDKD

SEQ ID NO: 156864 - protein, 8 aa, Borrelia afzelii
SKEKDKDG

SEQ ID NO: 156865 - protein, 8 aa, Borrelia afzelii
KEKDKDGK

SEQ ID NO: 156866 - protein, 8 aa, Borrelia afzelii
EKDKDGKY

SEQ ID NO: 156867 - protein, 8 aa, Borrelia afzelii
KDKDGKYS

SEQ ID NO: 156868 - protein, 8 aa, Borrelia afzelii
DKDGKYSL

SEQ ID NO: 156869 - protein, 8 aa, Borrelia afzelii
KDGKYSLK

SEQ ID NO: 156870 - protein, 8 aa, Borrelia afzelii
DGKYSLKA

SEQ ID NO: 156871 - protein, 8 aa, Borrelia afzelii
GKYSLKAT

SEQ ID NO: 156872 - protein, 8 aa, Borrelia afzelii
KYSLKATV

SEQ ID NO: 156873 - protein, 8 aa, Borrelia afzelii
YSLKATVD

SEQ ID NO: 156874 - protein, 8 aa, Borrelia afzelii
SLKATVDK

SEQ ID NO: 156875 - protein, 8 aa, Borrelia afzelii
LKATVDKI

SEQ ID NO: 156876 - protein, 8 aa, Borrelia afzelii
KATVDKIE

SEQ ID NO: 156877 - protein, 8 aa, Borrelia afzelii
ATVDKIEL

SEQ ID NO: 156878 - protein, 8 aa, Borrelia afzelii
TVDKIELK

SEQ ID NO: 156879 - protein, 8 aa, Borrelia afzelii
VDKIELKG

SEQ ID NO: 156880 - protein, 8 aa, Borrelia afzelii
DKIELKGT

SEQ ID NO: 156881 - protein, 8 aa, Borrelia afzelii
KIELKGTS

SEQ ID NO: 156882 - protein, 8 aa, Borrelia afzelii
IELKGTSD

SEQ ID NO: 156883 - protein, 8 aa, Borrelia afzelii
ELKGTSDK

SEQ ID NO: 156884 - protein, 8 aa, Borrelia afzelii
LKGTSDKD

SEQ ID NO: 156885 - protein, 8 aa, Borrelia afzelii
KGTSDKDN

SEQ ID NO: 156886 - protein, 8 aa, Borrelia afzelii
GTSDKDNG

SEQ ID NO: 156887 - protein, 8 aa, Borrelia afzelii
TSDKDNGS

SEQ ID NO: 156888 - protein, 8 aa, Borrelia afzelii
SDKDNGSG

SEQ ID NO: 156889 - protein, 8 aa, Borrelia afzelii
DKDNGSGV

SEQ ID NO: 156890 - protein, 8 aa, Borrelia afzelii
KDNGSGVL

SEQ ID NO: 156891 - protein, 8 aa, Borrelia afzelii
DNGSGVLE

SEQ ID NO: 156892 - protein, 8 aa, Borrelia afzelii
NGSGVLEG

SEQ ID NO: 156893 - protein, 8 aa, Borrelia afzelii
GSGVLEGT

SEQ ID NO: 156894 - protein, 8 aa, Borrelia afzelii
SGVLEGTK

SEQ ID NO: 156895 - protein, 8 aa, Borrelia afzelii
GVLEGTKD

SEQ ID NO: 156896 - protein, 8 aa, Borrelia afzelii
VLEGTKDD

SEQ ID NO: 156897 - protein, 8 aa, Borrelia afzelii
LEGTKDDK

SEQ ID NO: 156898 - protein, 8 aa, Borrelia afzelii
EGTKDDKS

SEQ ID NO: 156899 - protein, 8 aa, Borrelia afzelii
GTKDDKSK

SEQ ID NO: 156900 - protein, 8 aa, Borrelia afzelii
TKDDKSKA

SEQ ID NO: 156901 - protein, 8 aa, Borrelia afzelii
KDDKSKAK

SEQ ID NO: 156902 - protein, 8 aa, Borrelia afzelii
DDKSKAKL

SEQ ID NO: 156903 - protein, 8 aa, Borrelia afzelii
DKSKAKLT

SEQ ID NO: 156904 - protein, 8 aa, Borrelia afzelii
KSKAKLTI

SEQ ID NO: 156905 - protein, 8 aa, Borrelia afzelii
SKAKLTIA

SEQ ID NO: 156906 - protein, 8 aa, Borrelia afzelii
KAKLTIAD

SEQ ID NO: 156907 - protein, 8 aa, Borrelia afzelii
AKLTIADD

SEQ ID NO: 156908 - protein, 8 aa, Borrelia afzelii
KLTIADDL

SEQ ID NO: 156909 - protein, 8 aa, Borrelia afzelii
LTIADDLS

SEQ ID NO: 156910 - protein, 8 aa, Borrelia afzelii
TIADDLSK

SEQ ID NO: 156911 - protein, 8 aa, Borrelia afzelii
IADDLSKT

SEQ ID NO: 156912 - protein, 8 aa, Borrelia afzelii
ADDLSKTT

SEQ ID NO: 156913 - protein, 8 aa, Borrelia afzelii
DDLSKTTF

SEQ ID NO: 156914 - protein, 8 aa, Borrelia afzelii
DLSKTTFE

SEQ ID NO: 156915 - protein, 8 aa, Borrelia afzelii
LSKTTFEL

SEQ ID NO: 156916 - protein, 8 aa, Borrelia afzelii
SKTTFELF

SEQ ID NO: 156917 - protein, 8 aa, Borrelia afzelii
KTTFELFK

SEQ ID NO: 156918 - protein, 8 aa, Borrelia afzelii
TTFELFKE

SEQ ID NO: 156919 - protein, 8 aa, Borrelia afzelii
TFELFKED

SEQ ID NO: 156920 - protein, 8 aa, Borrelia afzelii
FELFKEDG

SEQ ID NO: 156921 - protein, 8 aa, Borrelia afzelii
ELFKEDGK

SEQ ID NO: 156922 - protein, 8 aa, Borrelia afzelii
LFKEDGKT

SEQ ID NO: 156923 - protein, 8 aa, Borrelia afzelii
FKEDGKTL

SEQ ID NO: 156924 - protein, 8 aa, Borrelia afzelii
KEDGKTLV

SEQ ID NO: 156925 - protein, 8 aa, Borrelia afzelii
EDGKTLVS

SEQ ID NO: 156926 - protein, 8 aa, Borrelia afzelii
DGKTLVSR

SEQ ID NO: 156927 - protein, 8 aa, Borrelia afzelii
GKTLVSRK

SEQ ID NO: 156928 - protein, 8 aa, Borrelia afzelii
KTLVSRKV

SEQ ID NO: 156929 - protein, 8 aa, Borrelia afzelii
TLVSRKVS

SEQ ID NO: 156930 - protein, 8 aa, Borrelia afzelii
LVSRKVSS

SEQ ID NO: 156931 - protein, 8 aa, Borrelia afzelii
VSRKVSSK

SEQ ID NO: 156932 - protein, 8 aa, Borrelia afzelii
SRKVSSKD

SEQ ID NO: 156933 - protein, 8 aa, Borrelia afzelii
RKVSSKDK

SEQ ID NO: 156934 - protein, 8 aa, Borrelia afzelii
KVSSKDKT

SEQ ID NO: 156935 - protein, 8 aa, Borrelia afzelii
VSSKDKTS

SEQ ID NO: 156936 - protein, 8 aa, Borrelia afzelii
SSKDKTST

SEQ ID NO: 156937 - protein, 8 aa, Borrelia afzelii
SKDKTSTD

SEQ ID NO: 156938 - protein, 8 aa, Borrelia afzelii
KDKTSTDE

SEQ ID NO: 156939 - protein, 8 aa, Borrelia afzelii
DKTSTDEM

SEQ ID NO: 156940 - protein, 8 aa, Borrelia afzelii
KTSTDEMF

SEQ ID NO: 156941 - protein, 8 aa, Borrelia afzelii
TSTDEMFN

SEQ ID NO: 156942 - protein, 8 aa, Borrelia afzelii
STDEMFNE

SEQ ID NO: 156943 - protein, 8 aa, Borrelia afzelii
TDEMFNEK

SEQ ID NO: 156944 - protein, 8 aa, Borrelia afzelii
DEMFNEKG

SEQ ID NO: 156945 - protein, 8 aa, Borrelia afzelii
EMFNEKGE

SEQ ID NO: 156946 - protein, 8 aa, Borrelia afzelii
MFNEKGEL

SEQ ID NO: 156947 - protein, 8 aa, Borrelia afzelii
FNEKGELS

SEQ ID NO: 156948 - protein, 8 aa, Borrelia afzelii
NEKGELSA

SEQ ID NO: 156949 - protein, 8 aa, Borrelia afzelii
EKGELSAK

SEQ ID NO: 156950 - protein, 8 aa, Borrelia afzelii
KGELSAKT

SEQ ID NO: 156951 - protein, 8 aa, Borrelia afzelii
GELSAKTM

SEQ ID NO: 156952 - protein, 8 aa, Borrelia afzelii
ELSAKTMT

SEQ ID NO: 156953 - protein, 8 aa, Borrelia afzelii
LSAKTMTR

SEQ ID NO: 156954 - protein, 8 aa, Borrelia afzelii
SAKTMTRE

SEQ ID NO: 156955 - protein, 8 aa, Borrelia afzelii
AKTMTREN

SEQ ID NO: 156956 - protein, 8 aa, Borrelia afzelii
KTMTRENG

SEQ ID NO: 156957 - protein, 8 aa, Borrelia afzelii
TMTRENGT

SEQ ID NO: 156958 - protein, 8 aa, Borrelia afzelii
MTRENGTK

SEQ ID NO: 156959 - protein, 8 aa, Borrelia afzelii
TRENGTKL

SEQ ID NO: 156960 - protein, 8 aa, Borrelia afzelii
RENGTKLE

SEQ ID NO: 156961 - protein, 8 aa, Borrelia afzelii
ENGTKLEY

SEQ ID NO: 156962 - protein, 8 aa, Borrelia afzelii
NGTKLEYT

SEQ ID NO: 156963 - protein, 8 aa, Borrelia afzelii
GTKLEYTE

SEQ ID NO: 156964 - protein, 8 aa, Borrelia afzelii
TKLEYTEM

SEQ ID NO: 156965 - protein, 8 aa, Borrelia afzelii
KLEYTEMK

SEQ ID NO: 156966 - protein, 8 aa, Borrelia afzelii
LEYTEMKS

SEQ ID NO: 156967 - protein, 8 aa, Borrelia afzelii
EYTEMKSD

SEQ ID NO: 156968 - protein, 8 aa, Borrelia afzelii
YTEMKSDG

SEQ ID NO: 156969 - protein, 8 aa, Borrelia afzelii
TEMKSDGT

SEQ ID NO: 156970 - protein, 8 aa, Borrelia afzelii
EMKSDGTG

SEQ ID NO: 156971 - protein, 8 aa, Borrelia afzelii
MKSDGTGK

SEQ ID NO: 156972 - protein, 8 aa, Borrelia afzelii
KSDGTGKA

SEQ ID NO: 156973 - protein, 8 aa, Borrelia afzelii
SDGTGKAK

SEQ ID NO: 156974 - protein, 8 aa, Borrelia afzelii
DGTGKAKE

SEQ ID NO: 156975 - protein, 8 aa, Borrelia afzelii
GTGKAKEV

SEQ ID NO: 156976 - protein, 8 aa, Borrelia afzelii
TGKAKEVL

SEQ ID NO: 156977 - protein, 8 aa, Borrelia afzelii
GKAKEVLK

SEQ ID NO: 156978 - protein, 8 aa, Borrelia afzelii
KAKEVLKN

SEQ ID NO: 156979 - protein, 8 aa, Borrelia afzelii
AKEVLKNF

SEQ ID NO: 156980 - protein, 8 aa, Borrelia afzelii
KEVLKNFT

SEQ ID NO: 156981 - protein, 8 aa, Borrelia afzelii
EVLKNFTL

SEQ ID NO: 156982 - protein, 8 aa, Borrelia afzelii
VLKNFTLE

SEQ ID NO: 156983 - protein, 8 aa, Borrelia afzelii
LKNFTLEG

SEQ ID NO: 156984 - protein, 8 aa, Borrelia afzelii
KNFTLEGK

SEQ ID NO: 156985 - protein, 8 aa, Borrelia afzelii
NFTLEGKV

SEQ ID NO: 156986 - protein, 8 aa, Borrelia afzelii
FTLEGKVA

SEQ ID NO: 156987 - protein, 8 aa, Borrelia afzelii
TLEGKVAN

SEQ ID NO: 156988 - protein, 8 aa, Borrelia afzelii
LEGKVAND

SEQ ID NO: 156989 - protein, 8 aa, Borrelia afzelii
EGKVANDK

SEQ ID NO: 156990 - protein, 8 aa, Borrelia afzelii
GKVANDKV

SEQ ID NO: 156991 - protein, 8 aa, Borrelia afzelii
KVANDKVT

SEQ ID NO: 156992 - protein, 8 aa, Borrelia afzelii
VANDKVTL

SEQ ID NO: 156993 - protein, 8 aa, Borrelia afzelii
ANDKVTLE

SEQ ID NO: 156994 - protein, 8 aa, Borrelia afzelii
NDKVTLEV

SEQ ID NO: 156995 - protein, 8 aa, Borrelia afzelii
DKVTLEVK

SEQ ID NO: 156996 - protein, 8 aa, Borrelia afzelii
KVTLEVKE

SEQ ID NO: 156997 - protein, 8 aa, Borrelia afzelii
VTLEVKEG

SEQ ID NO: 156998 - protein, 8 aa, Borrelia afzelii
TLEVKEGT

SEQ ID NO: 156999 - protein, 8 aa, Borrelia afzelii
LEVKEGTV

SEQ ID NO: 157000 - protein, 8 aa, Borrelia afzelii
EVKEGTVT

SEQ ID NO: 157001 - protein, 8 aa, Borrelia afzelii
VKEGTVTL

SEQ ID NO: 157002 - protein, 8 aa, Borrelia afzelii
KEGTVTLS

SEQ ID NO: 157003 - protein, 8 aa, Borrelia afzelii
EGTVTLSK

SEQ ID NO: 157004 - protein, 8 aa, Borrelia afzelii
GTVTLSKE

SEQ ID NO: 157005 - protein, 8 aa, Borrelia afzelii
TVTLSKEI

SEQ ID NO: 157006 - protein, 8 aa, Borrelia afzelii
VTLSKEIA

SEQ ID NO: 157007 - protein, 8 aa, Borrelia afzelii
TLSKEIAK

SEQ ID NO: 157008 - protein, 8 aa, Borrelia afzelii
LSKEIAKS

SEQ ID NO: 157009 - protein, 8 aa, Borrelia afzelii
SKEIAKSG

SEQ ID NO: 157010 - protein, 8 aa, Borrelia afzelii
KEIAKSGE

SEQ ID NO: 157011 - protein, 8 aa, Borrelia afzelii
EIAKSGEV

SEQ ID NO: 157012 - protein, 8 aa, Borrelia afzelii
IAKSGEVT

SEQ ID NO: 157013 - protein, 8 aa, Borrelia afzelii
AKSGEVTV

SEQ ID NO: 157014 - protein, 8 aa, Borrelia afzelii
KSGEVTVA

SEQ ID NO: 157015 - protein, 8 aa, Borrelia afzelii
SGEVTVAL

SEQ ID NO: 157016 - protein, 8 aa, Borrelia afzelii
GEVTVALN

SEQ ID NO: 157017 - protein, 8 aa, Borrelia afzelii
EVTVALND

SEQ ID NO: 157018 - protein, 8 aa, Borrelia afzelii
VTVALNDT

SEQ ID NO: 157019 - protein, 8 aa, Borrelia afzelii
TVALNDTN

SEQ ID NO: 157020 - protein, 8 aa, Borrelia afzelii
VALNDTNT

SEQ ID NO: 157021 - protein, 8 aa, Borrelia afzelii
ALNDTNTT

SEQ ID NO: 157022 - protein, 8 aa, Borrelia afzelii
LNDTNTTQ

SEQ ID NO: 157023 - protein, 8 aa, Borrelia afzelii
NDTNTTQA

SEQ ID NO: 157024 - protein, 8 aa, Borrelia afzelii
DTNTTQAT

SEQ ID NO: 157025 - protein, 8 aa, Borrelia afzelii
TNTTQATK

SEQ ID NO: 157026 - protein, 8 aa, Borrelia afzelii
NTTQATKK

SEQ ID NO: 157027 - protein, 8 aa, Borrelia afzelii
TTQATKKT

SEQ ID NO: 157028 - protein, 8 aa, Borrelia afzelii
TQATKKTG

SEQ ID NO: 157029 - protein, 8 aa, Borrelia afzelii
QATKKTGA

SEQ ID NO: 157030 - protein, 8 aa, Borrelia afzelii
ATKKTGAW

SEQ ID NO: 157031 - protein, 8 aa, Borrelia afzelii
TKKTGAWD

SEQ ID NO: 157032 - protein, 8 aa, Borrelia afzelii
KKTGAWDS

SEQ ID NO: 157033 - protein, 8 aa, Borrelia afzelii
KTGAWDSK

SEQ ID NO: 157034 - protein, 8 aa, Borrelia afzelii
TGAWDSKT

SEQ ID NO: 157035 - protein, 8 aa, Borrelia afzelii
GAWDSKTS

SEQ ID NO: 157036 - protein, 8 aa, Borrelia afzelii
AWDSKTST

SEQ ID NO: 157037 - protein, 8 aa, Borrelia afzelii
WDSKTSTL

SEQ ID NO: 157038 - protein, 8 aa, Borrelia afzelii
DSKTSTLT

SEQ ID NO: 157039 - protein, 8 aa, Borrelia afzelii
SKTSTLTI

SEQ ID NO: 157040 - protein, 8 aa, Borrelia afzelii
KTSTLTIS

SEQ ID NO: 157041 - protein, 8 aa, Borrelia afzelii
TSTLTISV

SEQ ID NO: 157042 - protein, 8 aa, Borrelia afzelii
STLTISVN

SEQ ID NO: 157043 - protein, 8 aa, Borrelia afzelii
TLTISVNS

SEQ ID NO: 157044 - protein, 8 aa, Borrelia afzelii
LTISVNSK

SEQ ID NO: 157045 - protein, 8 aa, Borrelia afzelii
TISVNSKK

SEQ ID NO: 157046 - protein, 8 aa, Borrelia afzelii
ISVNSKKT

SEQ ID NO: 157047 - protein, 8 aa, Borrelia afzelii
SVNSKKTT

SEQ ID NO: 157048 - protein, 8 aa, Borrelia afzelii
VNSKKTTQ

SEQ ID NO: 157049 - protein, 8 aa, Borrelia afzelii
NSKKTTQL

SEQ ID NO: 157050 - protein, 8 aa, Borrelia afzelii
SKKTTQLV

SEQ ID NO: 157051 - protein, 8 aa, Borrelia afzelii
KKTTQLVF

SEQ ID NO: 157052 - protein, 8 aa, Borrelia afzelii
KTTQLVFT

SEQ ID NO: 157053 - protein, 8 aa, Borrelia afzelii
TTQLVFTK

SEQ ID NO: 157054 - protein, 8 aa, Borrelia afzelii
TQLVFTKQ

SEQ ID NO: 157055 - protein, 8 aa, Borrelia afzelii
QLVFTKQD

SEQ ID NO: 157056 - protein, 8 aa, Borrelia afzelii
LVFTKQDT

SEQ ID NO: 157057 - protein, 8 aa, Borrelia afzelii
VFTKQDTI

SEQ ID NO: 157058 - protein, 8 aa, Borrelia afzelii
FTKQDTIT

SEQ ID NO: 157059 - protein, 8 aa, Borrelia afzelii
TKQDTITV

SEQ ID NO: 157060 - protein, 8 aa, Borrelia afzelii
KQDTITVQ

SEQ ID NO: 157061 - protein, 8 aa, Borrelia afzelii
QDTITVQK

SEQ ID NO: 157062 - protein, 8 aa, Borrelia afzelii
DTITVQKY

SEQ ID NO: 157063 - protein, 8 aa, Borrelia afzelii
TITVQKYD

SEQ ID NO: 157064 - protein, 8 aa, Borrelia afzelii
ITVQKYDS

SEQ ID NO: 157065 - protein, 8 aa, Borrelia afzelii
TVQKYDSA

SEQ ID NO: 157066 - protein, 8 aa, Borrelia afzelii
VQKYDSAG

SEQ ID NO: 157067 - protein, 8 aa, Borrelia afzelii
QKYDSAGT

SEQ ID NO: 157068 - protein, 8 aa, Borrelia afzelii
KYDSAGTN

SEQ ID NO: 157069 - protein, 8 aa, Borrelia afzelii
YDSAGTNL

SEQ ID NO: 157070 - protein, 8 aa, Borrelia afzelii
DSAGTNLE

SEQ ID NO: 157071 - protein, 8 aa, Borrelia afzelii
SAGTNLEG

SEQ ID NO: 157072 - protein, 8 aa, Borrelia afzelii
AGTNLEGT

SEQ ID NO: 157073 - protein, 8 aa, Borrelia afzelii
GTNLEGTA

SEQ ID NO: 157074 - protein, 8 aa, Borrelia afzelii
TNLEGTAV

SEQ ID NO: 157075 - protein, 8 aa, Borrelia afzelii
NLEGTAVE

SEQ ID NO: 157076 - protein, 8 aa, Borrelia afzelii
LEGTAVEI

SEQ ID NO: 157077 - protein, 8 aa, Borrelia afzelii
EGTAVEIK

SEQ ID NO: 157078 - protein, 8 aa, Borrelia afzelii
GTAVEIKT

SEQ ID NO: 157079 - protein, 8 aa, Borrelia afzelii
TAVEIKTL

SEQ ID NO: 157080 - protein, 8 aa, Borrelia afzelii
AVEIKTLD

SEQ ID NO: 157081 - protein, 8 aa, Borrelia afzelii
VEIKTLDE

SEQ ID NO: 157082 - protein, 8 aa, Borrelia afzelii
EIKTLDEL

SEQ ID NO: 157083 - protein, 8 aa, Borrelia afzelii
IKTLDELK

SEQ ID NO: 157084 - protein, 8 aa, Borrelia afzelii
KTLDELKN

SEQ ID NO: 157085 - protein, 8 aa, Borrelia afzelii
TLDELKNA

SEQ ID NO: 157086 - protein, 8 aa, Borrelia afzelii
LDELKNAL

SEQ ID NO: 157087 - protein, 8 aa, Borrelia afzelii
DELKNALK

SEQ ID NO: 157088 - protein, 9 aa, Borrelia afzelii
MKKYLLGIG

SEQ ID NO: 157089 - protein, 9 aa, Borrelia afzelii
KKYLLGIGL

SEQ ID NO: 157090 - protein, 9 aa, Borrelia afzelii
KYLLGIGLI

SEQ ID NO: 157091 - protein, 9 aa, Borrelia afzelii
YLLGIGLIL

SEQ ID NO: 157092 - protein, 9 aa, Borrelia afzelii
LLGIGLILA

SEQ ID NO: 157093 - protein, 9 aa, Borrelia afzelii
LGIGLILAL

SEQ ID NO: 157094 - protein, 9 aa, Borrelia afzelii
GIGLILALI

SEQ ID NO: 157095 - protein, 9 aa, Borrelia afzelii
IGLILALIA

SEQ ID NO: 157096 - protein, 9 aa, Borrelia afzelii
GLILALIAC

SEQ ID NO: 157097 - protein, 9 aa, Borrelia afzelii
LILALIACK

SEQ ID NO: 157098 - protein, 9 aa, Borrelia afzelii
ILALIACKQ

SEQ ID NO: 157099 - protein, 9 aa, Borrelia afzelii
LALIACKQN

SEQ ID NO: 157100 - protein, 9 aa, Borrelia afzelii
ALIACKQNV

SEQ ID NO: 157101 - protein, 9 aa, Borrelia afzelii
LIACKQNVS

SEQ ID NO: 157102 - protein, 9 aa, Borrelia afzelii
IACKQNVSS

SEQ ID NO: 157103 - protein, 9 aa, Borrelia afzelii
ACKQNVSSL

SEQ ID NO: 157104 - protein, 9 aa, Borrelia afzelii
CKQNVSSLD

SEQ ID NO: 157105 - protein, 9 aa, Borrelia afzelii
KQNVSSLDE

SEQ ID NO: 157106 - protein, 9 aa, Borrelia afzelii
QNVSSLDEK

SEQ ID NO: 157107 - protein, 9 aa, Borrelia afzelii
NVSSLDEKN

SEQ ID NO: 157108 - protein, 9 aa, Borrelia afzelii
VSSLDEKNS

SEQ ID NO: 157109 - protein, 9 aa, Borrelia afzelii
SSLDEKNSA

SEQ ID NO: 157110 - protein, 9 aa, Borrelia afzelii
SLDEKNSAS

SEQ ID NO: 157111 - protein, 9 aa, Borrelia afzelii
LDEKNSASV

SEQ ID NO: 157112 - protein, 9 aa, Borrelia afzelii
DEKNSASVD

SEQ ID NO: 157113 - protein, 9 aa, Borrelia afzelii
EKNSASVDL

SEQ ID NO: 157114 - protein, 9 aa, Borrelia afzelii
KNSASVDLP

SEQ ID NO: 157115 - protein, 9 aa, Borrelia afzelii
NSASVDLPG

SEQ ID NO: 157116 - protein, 9 aa, Borrelia afzelii
SASVDLPGE

SEQ ID NO: 157117 - protein, 9 aa, Borrelia afzelii
ASVDLPGEM

SEQ ID NO: 157118 - protein, 9 aa, Borrelia afzelii
SVDLPGEMK

SEQ ID NO: 157119 - protein, 9 aa, Borrelia afzelii
VDLPGEMKV

SEQ ID NO: 157120 - protein, 9 aa, Borrelia afzelii
DLPGEMKVL

SEQ ID NO: 157121 - protein, 9 aa, Borrelia afzelii
LPGEMKVLV

SEQ ID NO: 157122 - protein, 9 aa, Borrelia afzelii
PGEMKVLVS

SEQ ID NO: 157123 - protein, 9 aa, Borrelia afzelii
GEMKVLVSK

SEQ ID NO: 157124 - protein, 9 aa, Borrelia afzelii
EMKVLVSKE

SEQ ID NO: 157125 - protein, 9 aa, Borrelia afzelii
MKVLVSKEK

SEQ ID NO: 157126 - protein, 9 aa, Borrelia afzelii
KVLVSKEKD

SEQ ID NO: 157127 - protein, 9 aa, Borrelia afzelii
VLVSKEKDK

SEQ ID NO: 157128 - protein, 9 aa, Borrelia afzelii
LVSKEKDKD

SEQ ID NO: 157129 - protein, 9 aa, Borrelia afzelii
VSKEKDKDG

SEQ ID NO: 157130 - protein, 9 aa, Borrelia afzelii
SKEKDKDGK

SEQ ID NO: 157131 - protein, 9 aa, Borrelia afzelii
KEKDKDGKY

SEQ ID NO: 157132 - protein, 9 aa, Borrelia afzelii
EKDKDGKYS

SEQ ID NO: 157133 - protein, 9 aa, Borrelia afzelii
KDKDGKYSL

SEQ ID NO: 157134 - protein, 9 aa, Borrelia afzelii
DKDGKYSLK

SEQ ID NO: 157135 - protein, 9 aa, Borrelia afzelii
KDGKYSLKA

SEQ ID NO: 157136 - protein, 9 aa, Borrelia afzelii
DGKYSLKAT

SEQ ID NO: 157137 - protein, 9 aa, Borrelia afzelii
GKYSLKATV

SEQ ID NO: 157138 - protein, 9 aa, Borrelia afzelii
KYSLKATVD

SEQ ID NO: 157139 - protein, 9 aa, Borrelia afzelii
YSLKATVDK

SEQ ID NO: 157140 - protein, 9 aa, Borrelia afzelii
SLKATVDKI

SEQ ID NO: 157141 - protein, 9 aa, Borrelia afzelii
LKATVDKIE

SEQ ID NO: 157142 - protein, 9 aa, Borrelia afzelii
KATVDKIEL

SEQ ID NO: 157143 - protein, 9 aa, Borrelia afzelii
ATVDKIELK

SEQ ID NO: 157144 - protein, 9 aa, Borrelia afzelii
TVDKIELKG

SEQ ID NO: 157145 - protein, 9 aa, Borrelia afzelii
VDKIELKGT

SEQ ID NO: 157146 - protein, 9 aa, Borrelia afzelii
DKIELKGTS

SEQ ID NO: 157147 - protein, 9 aa, Borrelia afzelii
KIELKGTSD

SEQ ID NO: 157148 - protein, 9 aa, Borrelia afzelii
IELKGTSDK

SEQ ID NO: 157149 - protein, 9 aa, Borrelia afzelii
ELKGTSDKD

SEQ ID NO: 157150 - protein, 9 aa, Borrelia afzelii
LKGTSDKDN

SEQ ID NO: 157151 - protein, 9 aa, Borrelia afzelii
KGTSDKDNG

SEQ ID NO: 157152 - protein, 9 aa, Borrelia afzelii
GTSDKDNGS

SEQ ID NO: 157153 - protein, 9 aa, Borrelia afzelii
TSDKDNGSG

SEQ ID NO: 157154 - protein, 9 aa, Borrelia afzelii
SDKDNGSGV

SEQ ID NO: 157155 - protein, 9 aa, Borrelia afzelii
DKDNGSGVL

SEQ ID NO: 157156 - protein, 9 aa, Borrelia afzelii
KDNGSGVLE

SEQ ID NO: 157157 - protein, 9 aa, Borrelia afzelii
DNGSGVLEG

SEQ ID NO: 157158 - protein, 9 aa, Borrelia afzelii
NGSGVLEGT

SEQ ID NO: 157159 - protein, 9 aa, Borrelia afzelii
GSGVLEGTK

SEQ ID NO: 157160 - protein, 9 aa, Borrelia afzelii
SGVLEGTKD

SEQ ID NO: 157161 - protein, 9 aa, Borrelia afzelii
GVLEGTKDD

SEQ ID NO: 157162 - protein, 9 aa, Borrelia afzelii
VLEGTKDDK

SEQ ID NO: 157163 - protein, 9 aa, Borrelia afzelii
LEGTKDDKS

SEQ ID NO: 157164 - protein, 9 aa, Borrelia afzelii
EGTKDDKSK

SEQ ID NO: 157165 - protein, 9 aa, Borrelia afzelii
GTKDDKSKA

SEQ ID NO: 157166 - protein, 9 aa, Borrelia afzelii
TKDDKSKAK

SEQ ID NO: 157167 - protein, 9 aa, Borrelia afzelii
KDDKSKAKL

SEQ ID NO: 157168 - protein, 9 aa, Borrelia afzelii
DDKSKAKLT

SEQ ID NO: 157169 - protein, 9 aa, Borrelia afzelii
DKSKAKLTI

SEQ ID NO: 157170 - protein, 9 aa, Borrelia afzelii
KSKAKLTIA

SEQ ID NO: 157171 - protein, 9 aa, Borrelia afzelii
SKAKLTIAD

SEQ ID NO: 157172 - protein, 9 aa, Borrelia afzelii
KAKLTIADD

SEQ ID NO: 157173 - protein, 9 aa, Borrelia afzelii
AKLTIADDL

SEQ ID NO: 157174 - protein, 9 aa, Borrelia afzelii
KLTIADDLS

SEQ ID NO: 157175 - protein, 9 aa, Borrelia afzelii
LTIADDLSK

SEQ ID NO: 157176 - protein, 9 aa, Borrelia afzelii
TIADDLSKT

SEQ ID NO: 157177 - protein, 9 aa, Borrelia afzelii
IADDLSKTT

SEQ ID NO: 157178 - protein, 9 aa, Borrelia afzelii
ADDLSKTTF

SEQ ID NO: 157179 - protein, 9 aa, Borrelia afzelii
DDLSKTTFE

SEQ ID NO: 157180 - protein, 9 aa, Borrelia afzelii
DLSKTTFEL

SEQ ID NO: 157181 - protein, 9 aa, Borrelia afzelii
LSKTTFELF

SEQ ID NO: 157182 - protein, 9 aa, Borrelia afzelii
SKTTFELFK

SEQ ID NO: 157183 - protein, 9 aa, Borrelia afzelii
KTTFELFKE

SEQ ID NO: 157184 - protein, 9 aa, Borrelia afzelii
TTFELFKED

SEQ ID NO: 157185 - protein, 9 aa, Borrelia afzelii
TFELFKEDG

SEQ ID NO: 157186 - protein, 9 aa, Borrelia afzelii
FELFKEDGK

SEQ ID NO: 157187 - protein, 9 aa, Borrelia afzelii
ELFKEDGKT

SEQ ID NO: 157188 - protein, 9 aa, Borrelia afzelii
LFKEDGKTL

SEQ ID NO: 157189 - protein, 9 aa, Borrelia afzelii
FKEDGKTLV

SEQ ID NO: 157190 - protein, 9 aa, Borrelia afzelii
KEDGKTLVS

SEQ ID NO: 157191 - protein, 9 aa, Borrelia afzelii
EDGKTLVSR

SEQ ID NO: 157192 - protein, 9 aa, Borrelia afzelii
DGKTLVSRK

SEQ ID NO: 157193 - protein, 9 aa, Borrelia afzelii
GKTLVSRKV

SEQ ID NO: 157194 - protein, 9 aa, Borrelia afzelii
KTLVSRKVS

SEQ ID NO: 157195 - protein, 9 aa, Borrelia afzelii
TLVSRKVSS

SEQ ID NO: 157196 - protein, 9 aa, Borrelia afzelii
LVSRKVSSK

SEQ ID NO: 157197 - protein, 9 aa, Borrelia afzelii
VSRKVSSKD

SEQ ID NO: 157198 - protein, 9 aa, Borrelia afzelii
SRKVSSKDK

SEQ ID NO: 157199 - protein, 9 aa, Borrelia afzelii
RKVSSKDKT

SEQ ID NO: 157200 - protein, 9 aa, Borrelia afzelii
KVSSKDKTS

SEQ ID NO: 157201 - protein, 9 aa, Borrelia afzelii
VSSKDKTST

SEQ ID NO: 157202 - protein, 9 aa, Borrelia afzelii
SSKDKTSTD

SEQ ID NO: 157203 - protein, 9 aa, Borrelia afzelii
SKDKTSTDE

SEQ ID NO: 157204 - protein, 9 aa, Borrelia afzelii
KDKTSTDEM

SEQ ID NO: 157205 - protein, 9 aa, Borrelia afzelii
DKTSTDEMF

SEQ ID NO: 157206 - protein, 9 aa, Borrelia afzelii
KTSTDEMFN

SEQ ID NO: 157207 - protein, 9 aa, Borrelia afzelii
TSTDEMFNE

SEQ ID NO: 157208 - protein, 9 aa, Borrelia afzelii
STDEMFNEK

SEQ ID NO: 157209 - protein, 9 aa, Borrelia afzelii
TDEMFNEKG

SEQ ID NO: 157210 - protein, 9 aa, Borrelia afzelii
DEMFNEKGE

SEQ ID NO: 157211 - protein, 9 aa, Borrelia afzelii
EMFNEKGEL

SEQ ID NO: 157212 - protein, 9 aa, Borrelia afzelii
MFNEKGELS

SEQ ID NO: 157213 - protein, 9 aa, Borrelia afzelii
FNEKGELSA

SEQ ID NO: 157214 - protein, 9 aa, Borrelia afzelii
NEKGELSAK

SEQ ID NO: 157215 - protein, 9 aa, Borrelia afzelii
EKGELSAKT

SEQ ID NO: 157216 - protein, 9 aa, Borrelia afzelii
KGELSAKTM

SEQ ID NO: 157217 - protein, 9 aa, Borrelia afzelii
GELSAKTMT

SEQ ID NO: 157218 - protein, 9 aa, Borrelia afzelii
ELSAKTMTR

SEQ ID NO: 157219 - protein, 9 aa, Borrelia afzelii
LSAKTMTRE

SEQ ID NO: 157220 - protein, 9 aa, Borrelia afzelii
SAKTMTREN

SEQ ID NO: 157221 - protein, 9 aa, Borrelia afzelii
AKTMTRENG

SEQ ID NO: 157222 - protein, 9 aa, Borrelia afzelii
KTMTRENGT

SEQ ID NO: 157223 - protein, 9 aa, Borrelia afzelii
TMTRENGTK

SEQ ID NO: 157224 - protein, 9 aa, Borrelia afzelii
MTRENGTKL

SEQ ID NO: 157225 - protein, 9 aa, Borrelia afzelii
TRENGTKLE

SEQ ID NO: 157226 - protein, 9 aa, Borrelia afzelii
RENGTKLEY

SEQ ID NO: 157227 - protein, 9 aa, Borrelia afzelii
ENGTKLEYT

SEQ ID NO: 157228 - protein, 9 aa, Borrelia afzelii
NGTKLEYTE

SEQ ID NO: 157229 - protein, 9 aa, Borrelia afzelii
GTKLEYTEM

SEQ ID NO: 157230 - protein, 9 aa, Borrelia afzelii
TKLEYTEMK

SEQ ID NO: 157231 - protein, 9 aa, Borrelia afzelii
KLEYTEMKS

SEQ ID NO: 157232 - protein, 9 aa, Borrelia afzelii
LEYTEMKSD

SEQ ID NO: 157233 - protein, 9 aa, Borrelia afzelii
EYTEMKSDG

SEQ ID NO: 157234 - protein, 9 aa, Borrelia afzelii
YTEMKSDGT

SEQ ID NO: 157235 - protein, 9 aa, Borrelia afzelii
TEMKSDGTG

SEQ ID NO: 157236 - protein, 9 aa, Borrelia afzelii
EMKSDGTGK

SEQ ID NO: 157237 - protein, 9 aa, Borrelia afzelii
MKSDGTGKA

SEQ ID NO: 157238 - protein, 9 aa, Borrelia afzelii
KSDGTGKAK

SEQ ID NO: 157239 - protein, 9 aa, Borrelia afzelii
SDGTGKAKE

SEQ ID NO: 157240 - protein, 9 aa, Borrelia afzelii
DGTGKAKEV

SEQ ID NO: 157241 - protein, 9 aa, Borrelia afzelii
GTGKAKEVL

SEQ ID NO: 157242 - protein, 9 aa, Borrelia afzelii
TGKAKEVLK

SEQ ID NO: 157243 - protein, 9 aa, Borrelia afzelii
GKAKEVLKN

SEQ ID NO: 157244 - protein, 9 aa, Borrelia afzelii
KAKEVLKNF

SEQ ID NO: 157245 - protein, 9 aa, Borrelia afzelii
AKEVLKNFT

SEQ ID NO: 157246 - protein, 9 aa, Borrelia afzelii
KEVLKNFTL

SEQ ID NO: 157247 - protein, 9 aa, Borrelia afzelii
EVLKNFTLE

SEQ ID NO: 157248 - protein, 9 aa, Borrelia afzelii
VLKNFTLEG

SEQ ID NO: 157249 - protein, 9 aa, Borrelia afzelii
LKNFTLEGK

SEQ ID NO: 157250 - protein, 9 aa, Borrelia afzelii
KNFTLEGKV

SEQ ID NO: 157251 - protein, 9 aa, Borrelia afzelii
NFTLEGKVA

SEQ ID NO: 157252 - protein, 9 aa, Borrelia afzelii
FTLEGKVAN

SEQ ID NO: 157253 - protein, 9 aa, Borrelia afzelii
TLEGKVAND

SEQ ID NO: 157254 - protein, 9 aa, Borrelia afzelii
LEGKVANDK

SEQ ID NO: 157255 - protein, 9 aa, Borrelia afzelii
EGKVANDKV

SEQ ID NO: 157256 - protein, 9 aa, Borrelia afzelii
GKVANDKVT

SEQ ID NO: 157257 - protein, 9 aa, Borrelia afzelii
KVANDKVTL

SEQ ID NO: 157258 - protein, 9 aa, Borrelia afzelii
VANDKVTLE

SEQ ID NO: 157259 - protein, 9 aa, Borrelia afzelii
ANDKVTLEV

SEQ ID NO: 157260 - protein, 9 aa, Borrelia afzelii
NDKVTLEVK

SEQ ID NO: 157261 - protein, 9 aa, Borrelia afzelii
DKVTLEVKE

SEQ ID NO: 157262 - protein, 9 aa, Borrelia afzelii
KVTLEVKEG

SEQ ID NO: 157263 - protein, 9 aa, Borrelia afzelii
VTLEVKEGT

SEQ ID NO: 157264 - protein, 9 aa, Borrelia afzelii
TLEVKEGTV

SEQ ID NO: 157265 - protein, 9 aa, Borrelia afzelii
LEVKEGTVT

SEQ ID NO: 157266 - protein, 9 aa, Borrelia afzelii
EVKEGTVTL

SEQ ID NO: 157267 - protein, 9 aa, Borrelia afzelii
VKEGTVTLS

SEQ ID NO: 157268 - protein, 9 aa, Borrelia afzelii
KEGTVTLSK

SEQ ID NO: 157269 - protein, 9 aa, Borrelia afzelii
EGTVTLSKE

SEQ ID NO: 157270 - protein, 9 aa, Borrelia afzelii
GTVTLSKEI

SEQ ID NO: 157271 - protein, 9 aa, Borrelia afzelii
TVTLSKEIA

SEQ ID NO: 157272 - protein, 9 aa, Borrelia afzelii
VTLSKEIAK

SEQ ID NO: 157273 - protein, 9 aa, Borrelia afzelii
TLSKEIAKS

SEQ ID NO: 157274 - protein, 9 aa, Borrelia afzelii
LSKEIAKSG

SEQ ID NO: 157275 - protein, 9 aa, Borrelia afzelii
SKEIAKSGE

SEQ ID NO: 157276 - protein, 9 aa, Borrelia afzelii
KEIAKSGEV

SEQ ID NO: 157277 - protein, 9 aa, Borrelia afzelii
EIAKSGEVT

SEQ ID NO: 157278 - protein, 9 aa, Borrelia afzelii
IAKSGEVTV

SEQ ID NO: 157279 - protein, 9 aa, Borrelia afzelii
AKSGEVTVA

SEQ ID NO: 157280 - protein, 9 aa, Borrelia afzelii
KSGEVTVAL

SEQ ID NO: 157281 - protein, 9 aa, Borrelia afzelii
SGEVTVALN

SEQ ID NO: 157282 - protein, 9 aa, Borrelia afzelii
GEVTVALND

SEQ ID NO: 157283 - protein, 9 aa, Borrelia afzelii
EVTVALNDT

SEQ ID NO: 157284 - protein, 9 aa, Borrelia afzelii
VTVALNDTN

SEQ ID NO: 157285 - protein, 9 aa, Borrelia afzelii
TVALNDTNT

SEQ ID NO: 157286 - protein, 9 aa, Borrelia afzelii
VALNDTNTT

SEQ ID NO: 157287 - protein, 9 aa, Borrelia afzelii
ALNDTNTTQ

SEQ ID NO: 157288 - protein, 9 aa, Borrelia afzelii
LNDTNTTQA

SEQ ID NO: 157289 - protein, 9 aa, Borrelia afzelii
NDTNTTQAT

SEQ ID NO: 157290 - protein, 9 aa, Borrelia afzelii
DTNTTQATK

SEQ ID NO: 157291 - protein, 9 aa, Borrelia afzelii
TNTTQATKK

SEQ ID NO: 157292 - protein, 9 aa, Borrelia afzelii
NTTQATKKT

SEQ ID NO: 157293 - protein, 9 aa, Borrelia afzelii
TTQATKKTG

SEQ ID NO: 157294 - protein, 9 aa, Borrelia afzelii
TQATKKTGA

SEQ ID NO: 157295 - protein, 9 aa, Borrelia afzelii
QATKKTGAW

SEQ ID NO: 157296 - protein, 9 aa, Borrelia afzelii
ATKKTGAWD

SEQ ID NO: 157297 - protein, 9 aa, Borrelia afzelii
TKKTGAWDS

SEQ ID NO: 157298 - protein, 9 aa, Borrelia afzelii
KKTGAWDSK

SEQ ID NO: 157299 - protein, 9 aa, Borrelia afzelii
KTGAWDSKT

SEQ ID NO: 157300 - protein, 9 aa, Borrelia afzelii
TGAWDSKTS

SEQ ID NO: 157301 - protein, 9 aa, Borrelia afzelii
GAWDSKTST

SEQ ID NO: 157302 - protein, 9 aa, Borrelia afzelii
AWDSKTSTL

SEQ ID NO: 157303 - protein, 9 aa, Borrelia afzelii
WDSKTSTLT

SEQ ID NO: 157304 - protein, 9 aa, Borrelia afzelii
DSKTSTLTI

SEQ ID NO: 157305 - protein, 9 aa, Borrelia afzelii
SKTSTLTIS

SEQ ID NO: 157306 - protein, 9 aa, Borrelia afzelii
KTSTLTISV

SEQ ID NO: 157307 - protein, 9 aa, Borrelia afzelii
TSTLTISVN

SEQ ID NO: 157308 - protein, 9 aa, Borrelia afzelii
STLTISVNS

SEQ ID NO: 157309 - protein, 9 aa, Borrelia afzelii
TLTISVNSK

SEQ ID NO: 157310 - protein, 9 aa, Borrelia afzelii
LTISVNSKK

SEQ ID NO: 157311 - protein, 9 aa, Borrelia afzelii
TISVNSKKT

SEQ ID NO: 157312 - protein, 9 aa, Borrelia afzelii
ISVNSKKTT

SEQ ID NO: 157313 - protein, 9 aa, Borrelia afzelii
SVNSKKTTQ

SEQ ID NO: 157314 - protein, 9 aa, Borrelia afzelii
VNSKKTTQL

SEQ ID NO: 157315 - protein, 9 aa, Borrelia afzelii
NSKKTTQLV

SEQ ID NO: 157316 - protein, 9 aa, Borrelia afzelii
SKKTTQLVF

SEQ ID NO: 157317 - protein, 9 aa, Borrelia afzelii
KKTTQLVFT

SEQ ID NO: 157318 - protein, 9 aa, Borrelia afzelii
KTTQLVFTK

SEQ ID NO: 157319 - protein, 9 aa, Borrelia afzelii
TTQLVFTKQ

SEQ ID NO: 157320 - protein, 9 aa, Borrelia afzelii
TQLVFTKQD

SEQ ID NO: 157321 - protein, 9 aa, Borrelia afzelii
QLVFTKQDT

SEQ ID NO: 157322 - protein, 9 aa, Borrelia afzelii
LVFTKQDTI

SEQ ID NO: 157323 - protein, 9 aa, Borrelia afzelii
VFTKQDTIT

SEQ ID NO: 157324 - protein, 9 aa, Borrelia afzelii
FTKQDTITV

SEQ ID NO: 157325 - protein, 9 aa, Borrelia afzelii
TKQDTITVQ

SEQ ID NO: 157326 - protein, 9 aa, Borrelia afzelii
KQDTITVQK

SEQ ID NO: 157327 - protein, 9 aa, Borrelia afzelii
QDTITVQKY

SEQ ID NO: 157328 - protein, 9 aa, Borrelia afzelii
DTITVQKYD

SEQ ID NO: 157329 - protein, 9 aa, Borrelia afzelii
TITVQKYDS

SEQ ID NO: 157330 - protein, 9 aa, Borrelia afzelii
ITVQKYDSA

SEQ ID NO: 157331 - protein, 9 aa, Borrelia afzelii
TVQKYDSAG

SEQ ID NO: 157332 - protein, 9 aa, Borrelia afzelii
VQKYDSAGT

SEQ ID NO: 157333 - protein, 9 aa, Borrelia afzelii
QKYDSAGTN

SEQ ID NO: 157334 - protein, 9 aa, Borrelia afzelii
KYDSAGTNL

SEQ ID NO: 157335 - protein, 9 aa, Borrelia afzelii
YDSAGTNLE

SEQ ID NO: 157336 - protein, 9 aa, Borrelia afzelii
DSAGTNLEG

SEQ ID NO: 157337 - protein, 9 aa, Borrelia afzelii
SAGTNLEGT

SEQ ID NO: 157338 - protein, 9 aa, Borrelia afzelii
AGTNLEGTA

SEQ ID NO: 157339 - protein, 9 aa, Borrelia afzelii
GTNLEGTAV

SEQ ID NO: 157340 - protein, 9 aa, Borrelia afzelii
TNLEGTAVE

SEQ ID NO: 157341 - protein, 9 aa, Borrelia afzelii
NLEGTAVEI

SEQ ID NO: 157342 - protein, 9 aa, Borrelia afzelii
LEGTAVEIK

SEQ ID NO: 157343 - protein, 9 aa, Borrelia afzelii
EGTAVEIKT

SEQ ID NO: 157344 - protein, 9 aa, Borrelia afzelii
GTAVEIKTL

SEQ ID NO: 157345 - protein, 9 aa, Borrelia afzelii
TAVEIKTLD

SEQ ID NO: 157346 - protein, 9 aa, Borrelia afzelii
AVEIKTLDE

SEQ ID NO: 157347 - protein, 9 aa, Borrelia afzelii
VEIKTLDEL

SEQ ID NO: 157348 - protein, 9 aa, Borrelia afzelii
EIKTLDELK

SEQ ID NO: 157349 - protein, 9 aa, Borrelia afzelii
IKTLDELKN

SEQ ID NO: 157350 - protein, 9 aa, Borrelia afzelii
KTLDELKNA

SEQ ID NO: 157351 - protein, 9 aa, Borrelia afzelii
TLDELKNAL

SEQ ID NO: 157352 - protein, 9 aa, Borrelia afzelii
LDELKNALK

SEQ ID NO: 157353 - protein, 10 aa, Borrelia afzelii
MKKYLLGIGL

SEQ ID NO: 157354 - protein, 10 aa, Borrelia afzelii
KKYLLGIGLI

SEQ ID NO: 157355 - protein, 10 aa, Borrelia afzelii
KYLLGIGLIL

SEQ ID NO: 157356 - protein, 10 aa, Borrelia afzelii
YLLGIGLILA

SEQ ID NO: 157357 - protein, 10 aa, Borrelia afzelii
LLGIGLILAL

SEQ ID NO: 157358 - protein, 10 aa, Borrelia afzelii
LGIGLILALI

SEQ ID NO: 157359 - protein, 10 aa, Borrelia afzelii
GIGLILALIA

SEQ ID NO: 157360 - protein, 10 aa, Borrelia afzelii
IGLILALIAC

SEQ ID NO: 157361 - protein, 10 aa, Borrelia afzelii
GLILALIACK

SEQ ID NO: 157362 - protein, 10 aa, Borrelia afzelii
LILALIACKQ

SEQ ID NO: 157363 - protein, 10 aa, Borrelia afzelii
ILALIACKQN

SEQ ID NO: 157364 - protein, 10 aa, Borrelia afzelii
LALIACKQNV

SEQ ID NO: 157365 - protein, 10 aa, Borrelia afzelii
ALIACKQNVS

SEQ ID NO: 157366 - protein, 10 aa, Borrelia afzelii
LIACKQNVSS

SEQ ID NO: 157367 - protein, 10 aa, Borrelia afzelii
IACKQNVSSL

SEQ ID NO: 157368 - protein, 10 aa, Borrelia afzelii
ACKQNVSSLD

SEQ ID NO: 157369 - protein, 10 aa, Borrelia afzelii
CKQNVSSLDE

SEQ ID NO: 157370 - protein, 10 aa, Borrelia afzelii
KQNVSSLDEK

SEQ ID NO: 157371 - protein, 10 aa, Borrelia afzelii
QNVSSLDEKN

SEQ ID NO: 157372 - protein, 10 aa, Borrelia afzelii
NVSSLDEKNS

SEQ ID NO: 157373 - protein, 10 aa, Borrelia afzelii
VSSLDEKNSA

SEQ ID NO: 157374 - protein, 10 aa, Borrelia afzelii
SSLDEKNSAS

SEQ ID NO: 157375 - protein, 10 aa, Borrelia afzelii
SLDEKNSASV

SEQ ID NO: 157376 - protein, 10 aa, Borrelia afzelii
LDEKNSASVD

SEQ ID NO: 157377 - protein, 10 aa, Borrelia afzelii
DEKNSASVDL

SEQ ID NO: 157378 - protein, 10 aa, Borrelia afzelii
EKNSASVDLP

SEQ ID NO: 157379 - protein, 10 aa, Borrelia afzelii
KNSASVDLPG

SEQ ID NO: 157380 - protein, 10 aa, Borrelia afzelii
NSASVDLPGE

SEQ ID NO: 157381 - protein, 10 aa, Borrelia afzelii
SASVDLPGEM

SEQ ID NO: 157382 - protein, 10 aa, Borrelia afzelii
ASVDLPGEMK

SEQ ID NO: 157383 - protein, 10 aa, Borrelia afzelii
SVDLPGEMKV

SEQ ID NO: 157384 - protein, 10 aa, Borrelia afzelii
VDLPGEMKVL

SEQ ID NO: 157385 - protein, 10 aa, Borrelia afzelii
DLPGEMKVLV

SEQ ID NO: 157386 - protein, 10 aa, Borrelia afzelii
LPGEMKVLVS

SEQ ID NO: 157387 - protein, 10 aa, Borrelia afzelii
PGEMKVLVSK

SEQ ID NO: 157388 - protein, 10 aa, Borrelia afzelii
GEMKVLVSKE

SEQ ID NO: 157389 - protein, 10 aa, Borrelia afzelii
EMKVLVSKEK

SEQ ID NO: 157390 - protein, 10 aa, Borrelia afzelii
MKVLVSKEKD

SEQ ID NO: 157391 - protein, 10 aa, Borrelia afzelii
KVLVSKEKDK

SEQ ID NO: 157392 - protein, 10 aa, Borrelia afzelii
VLVSKEKDKD

SEQ ID NO: 157393 - protein, 10 aa, Borrelia afzelii
LVSKEKDKDG

SEQ ID NO: 157394 - protein, 10 aa, Borrelia afzelii
VSKEKDKDGK

SEQ ID NO: 157395 - protein, 10 aa, Borrelia afzelii
SKEKDKDGKY

SEQ ID NO: 157396 - protein, 10 aa, Borrelia afzelii
KEKDKDGKYS

SEQ ID NO: 157397 - protein, 10 aa, Borrelia afzelii
EKDKDGKYSL

SEQ ID NO: 157398 - protein, 10 aa, Borrelia afzelii
KDKDGKYSLK

SEQ ID NO: 157399 - protein, 10 aa, Borrelia afzelii
DKDGKYSLKA

SEQ ID NO: 157400 - protein, 10 aa, Borrelia afzelii
KDGKYSLKAT

SEQ ID NO: 157401 - protein, 10 aa, Borrelia afzelii
DGKYSLKATV

SEQ ID NO: 157402 - protein, 10 aa, Borrelia afzelii
GKYSLKATVD

SEQ ID NO: 157403 - protein, 10 aa, Borrelia afzelii
KYSLKATVDK

SEQ ID NO: 157404 - protein, 10 aa, Borrelia afzelii
YSLKATVDKI

SEQ ID NO: 157405 - protein, 10 aa, Borrelia afzelii
SLKATVDKIE

SEQ ID NO: 157406 - protein, 10 aa, Borrelia afzelii
LKATVDKIEL

SEQ ID NO: 157407 - protein, 10 aa, Borrelia afzelii
KATVDKIELK

SEQ ID NO: 157408 - protein, 10 aa, Borrelia afzelii
ATVDKIELKG

SEQ ID NO: 157409 - protein, 10 aa, Borrelia afzelii
TVDKIELKGT

SEQ ID NO: 157410 - protein, 10 aa, Borrelia afzelii
VDKIELKGTS

SEQ ID NO: 157411 - protein, 10 aa, Borrelia afzelii
DKIELKGTSD

SEQ ID NO: 157412 - protein, 10 aa, Borrelia afzelii
KIELKGTSDK

SEQ ID NO: 157413 - protein, 10 aa, Borrelia afzelii
IELKGTSDKD

SEQ ID NO: 157414 - protein, 10 aa, Borrelia afzelii
ELKGTSDKDN

SEQ ID NO: 157415 - protein, 10 aa, Borrelia afzelii
LKGTSDKDNG

SEQ ID NO: 157416 - protein, 10 aa, Borrelia afzelii
KGTSDKDNGS

SEQ ID NO: 157417 - protein, 10 aa, Borrelia afzelii
GTSDKDNGSG

SEQ ID NO: 157418 - protein, 10 aa, Borrelia afzelii
TSDKDNGSGV

SEQ ID NO: 157419 - protein, 10 aa, Borrelia afzelii
SDKDNGSGVL

SEQ ID NO: 157420 - protein, 10 aa, Borrelia afzelii
DKDNGSGVLE

SEQ ID NO: 157421 - protein, 10 aa, Borrelia afzelii
KDNGSGVLEG

SEQ ID NO: 157422 - protein, 10 aa, Borrelia afzelii
DNGSGVLEGT

SEQ ID NO: 157423 - protein, 10 aa, Borrelia afzelii
NGSGVLEGTK

SEQ ID NO: 157424 - protein, 10 aa, Borrelia afzelii
GSGVLEGTKD

SEQ ID NO: 157425 - protein, 10 aa, Borrelia afzelii
SGVLEGTKDD

SEQ ID NO: 157426 - protein, 10 aa, Borrelia afzelii
GVLEGTKDDK

SEQ ID NO: 157427 - protein, 10 aa, Borrelia afzelii
VLEGTKDDKS

SEQ ID NO: 157428 - protein, 10 aa, Borrelia afzelii
LEGTKDDKSK

SEQ ID NO: 157429 - protein, 10 aa, Borrelia afzelii
EGTKDDKSKA

SEQ ID NO: 157430 - protein, 10 aa, Borrelia afzelii
GTKDDKSKAK

SEQ ID NO: 157431 - protein, 10 aa, Borrelia afzelii
TKDDKSKAKL

SEQ ID NO: 157432 - protein, 10 aa, Borrelia afzelii
KDDKSKAKLT

SEQ ID NO: 157433 - protein, 10 aa, Borrelia afzelii
DDKSKAKLTI

SEQ ID NO: 157434 - protein, 10 aa, Borrelia afzelii
DKSKAKLTIA

SEQ ID NO: 157435 - protein, 10 aa, Borrelia afzelii
KSKAKLTIAD

SEQ ID NO: 157436 - protein, 10 aa, Borrelia afzelii
SKAKLTIADD

SEQ ID NO: 157437 - protein, 10 aa, Borrelia afzelii
KAKLTIADDL

SEQ ID NO: 157438 - protein, 10 aa, Borrelia afzelii
AKLTIADDLS

SEQ ID NO: 157439 - protein, 10 aa, Borrelia afzelii
KLTIADDLSK

SEQ ID NO: 157440 - protein, 10 aa, Borrelia afzelii
LTIADDLSKT

SEQ ID NO: 157441 - protein, 10 aa, Borrelia afzelii
TIADDLSKTT

SEQ ID NO: 157442 - protein, 10 aa, Borrelia afzelii
IADDLSKTTF

SEQ ID NO: 157443 - protein, 10 aa, Borrelia afzelii
ADDLSKTTFE

SEQ ID NO: 157444 - protein, 10 aa, Borrelia afzelii
DDLSKTTFEL

SEQ ID NO: 157445 - protein, 10 aa, Borrelia afzelii
DLSKTTFELF

SEQ ID NO: 157446 - protein, 10 aa, Borrelia afzelii
LSKTTFELFK

SEQ ID NO: 157447 - protein, 10 aa, Borrelia afzelii
SKTTFELFKE

SEQ ID NO: 157448 - protein, 10 aa, Borrelia afzelii
KTTFELFKED

SEQ ID NO: 157449 - protein, 10 aa, Borrelia afzelii
TTFELFKEDG

SEQ ID NO: 157450 - protein, 10 aa, Borrelia afzelii
TFELFKEDGK

SEQ ID NO: 157451 - protein, 10 aa, Borrelia afzelii
FELFKEDGKT

SEQ ID NO: 157452 - protein, 10 aa, Borrelia afzelii
ELFKEDGKTL

SEQ ID NO: 157453 - protein, 10 aa, Borrelia afzelii
LFKEDGKTLV

SEQ ID NO: 157454 - protein, 10 aa, Borrelia afzelii
FKEDGKTLVS

SEQ ID NO: 157455 - protein, 10 aa, Borrelia afzelii
KEDGKTLVSR

SEQ ID NO: 157456 - protein, 10 aa, Borrelia afzelii
EDGKTLVSRK

SEQ ID NO: 157457 - protein, 10 aa, Borrelia afzelii
DGKTLVSRKV

SEQ ID NO: 157458 - protein, 10 aa, Borrelia afzelii
GKTLVSRKVS

SEQ ID NO: 157459 - protein, 10 aa, Borrelia afzelii
KTLVSRKVSS

SEQ ID NO: 157460 - protein, 10 aa, Borrelia afzelii
TLVSRKVSSK

SEQ ID NO: 157461 - protein, 10 aa, Borrelia afzelii
LVSRKVSSKD

SEQ ID NO: 157462 - protein, 10 aa, Borrelia afzelii
VSRKVSSKDK

SEQ ID NO: 157463 - protein, 10 aa, Borrelia afzelii
SRKVSSKDKT

SEQ ID NO: 157464 - protein, 10 aa, Borrelia afzelii
RKVSSKDKTS

SEQ ID NO: 157465 - protein, 10 aa, Borrelia afzelii
KVSSKDKTST

SEQ ID NO: 157466 - protein, 10 aa, Borrelia afzelii
VSSKDKTSTD

SEQ ID NO: 157467 - protein, 10 aa, Borrelia afzelii
SSKDKTSTDE

SEQ ID NO: 157468 - protein, 10 aa, Borrelia afzelii
SKDKTSTDEM

SEQ ID NO: 157469 - protein, 10 aa, Borrelia afzelii
KDKTSTDEMF

SEQ ID NO: 157470 - protein, 10 aa, Borrelia afzelii
DKTSTDEMFN

SEQ ID NO: 157471 - protein, 10 aa, Borrelia afzelii
KTSTDEMFNE

SEQ ID NO: 157472 - protein, 10 aa, Borrelia afzelii
TSTDEMFNEK

SEQ ID NO: 157473 - protein, 10 aa, Borrelia afzelii
STDEMFNEKG

SEQ ID NO: 157474 - protein, 10 aa, Borrelia afzelii
TDEMFNEKGE

SEQ ID NO: 157475 - protein, 10 aa, Borrelia afzelii
DEMFNEKGEL

SEQ ID NO: 157476 - protein, 10 aa, Borrelia afzelii
EMFNEKGELS

SEQ ID NO: 157477 - protein, 10 aa, Borrelia afzelii
MFNEKGELSA

SEQ ID NO: 157478 - protein, 10 aa, Borrelia afzelii
FNEKGELSAK

SEQ ID NO: 157479 - protein, 10 aa, Borrelia afzelii
NEKGELSAKT

SEQ ID NO: 157480 - protein, 10 aa, Borrelia afzelii
EKGELSAKTM

SEQ ID NO: 157481 - protein, 10 aa, Borrelia afzelii
KGELSAKTMT

SEQ ID NO: 157482 - protein, 10 aa, Borrelia afzelii
GELSAKTMTR

SEQ ID NO: 157483 - protein, 10 aa, Borrelia afzelii
ELSAKTMTRE

SEQ ID NO: 157484 - protein, 10 aa, Borrelia afzelii
LSAKTMTREN

SEQ ID NO: 157485 - protein, 10 aa, Borrelia afzelii
SAKTMTRENG

SEQ ID NO: 157486 - protein, 10 aa, Borrelia afzelii
AKTMTRENGT

SEQ ID NO: 157487 - protein, 10 aa, Borrelia afzelii
KTMTRENGTK

SEQ ID NO: 157488 - protein, 10 aa, Borrelia afzelii
TMTRENGTKL

SEQ ID NO: 157489 - protein, 10 aa, Borrelia afzelii
MTRENGTKLE

SEQ ID NO: 157490 - protein, 10 aa, Borrelia afzelii
TRENGTKLEY

SEQ ID NO: 157491 - protein, 10 aa, Borrelia afzelii
RENGTKLEYT

SEQ ID NO: 157492 - protein, 10 aa, Borrelia afzelii
ENGTKLEYTE

SEQ ID NO: 157493 - protein, 10 aa, Borrelia afzelii
NGTKLEYTEM

SEQ ID NO: 157494 - protein, 10 aa, Borrelia afzelii
GTKLEYTEMK

SEQ ID NO: 157495 - protein, 10 aa, Borrelia afzelii
TKLEYTEMKS

SEQ ID NO: 157496 - protein, 10 aa, Borrelia afzelii
KLEYTEMKSD

SEQ ID NO: 157497 - protein, 10 aa, Borrelia afzelii
LEYTEMKSDG

SEQ ID NO: 157498 - protein, 10 aa, Borrelia afzelii
EYTEMKSDGT

SEQ ID NO: 157499 - protein, 10 aa, Borrelia afzelii
YTEMKSDGTG

SEQ ID NO: 157500 - protein, 10 aa, Borrelia afzelii
TEMKSDGTGK

SEQ ID NO: 157501 - protein, 10 aa, Borrelia afzelii
EMKSDGTGKA

SEQ ID NO: 157502 - protein, 10 aa, Borrelia afzelii
MKSDGTGKAK

SEQ ID NO: 157503 - protein, 10 aa, Borrelia afzelii
KSDGTGKAKE

SEQ ID NO: 157504 - protein, 10 aa, Borrelia afzelii
SDGTGKAKEV

SEQ ID NO: 157505 - protein, 10 aa, Borrelia afzelii
DGTGKAKEVL

SEQ ID NO: 157506 - protein, 10 aa, Borrelia afzelii
GTGKAKEVLK

SEQ ID NO: 157507 - protein, 10 aa, Borrelia afzelii
TGKAKEVLKN

SEQ ID NO: 157508 - protein, 10 aa, Borrelia afzelii
GKAKEVLKNF

SEQ ID NO: 157509 - protein, 10 aa, Borrelia afzelii
KAKEVLKNFT

SEQ ID NO: 157510 - protein, 10 aa, Borrelia afzelii
AKEVLKNFTL

SEQ ID NO: 157511 - protein, 10 aa, Borrelia afzelii
KEVLKNFTLE

SEQ ID NO: 157512 - protein, 10 aa, Borrelia afzelii
EVLKNFTLEG

SEQ ID NO: 157513 - protein, 10 aa, Borrelia afzelii
VLKNFTLEGK

SEQ ID NO: 157514 - protein, 10 aa, Borrelia afzelii
LKNFTLEGKV

SEQ ID NO: 157515 - protein, 10 aa, Borrelia afzelii
KNFTLEGKVA

SEQ ID NO: 157516 - protein, 10 aa, Borrelia afzelii
NFTLEGKVAN

SEQ ID NO: 157517 - protein, 10 aa, Borrelia afzelii
FTLEGKVAND

SEQ ID NO: 157518 - protein, 10 aa, Borrelia afzelii
TLEGKVANDK

SEQ ID NO: 157519 - protein, 10 aa, Borrelia afzelii
LEGKVANDKV

SEQ ID NO: 157520 - protein, 10 aa, Borrelia afzelii
EGKVANDKVT

SEQ ID NO: 157521 - protein, 10 aa, Borrelia afzelii
GKVANDKVTL

SEQ ID NO: 157522 - protein, 10 aa, Borrelia afzelii
KVANDKVTLE

SEQ ID NO: 157523 - protein, 10 aa, Borrelia afzelii
VANDKVTLEV

SEQ ID NO: 157524 - protein, 10 aa, Borrelia afzelii
ANDKVTLEVK

SEQ ID NO: 157525 - protein, 10 aa, Borrelia afzelii
NDKVTLEVKE

SEQ ID NO: 157526 - protein, 10 aa, Borrelia afzelii
DKVTLEVKEG

SEQ ID NO: 157527 - protein, 10 aa, Borrelia afzelii
KVTLEVKEGT

SEQ ID NO: 157528 - protein, 10 aa, Borrelia afzelii
VTLEVKEGTV

SEQ ID NO: 157529 - protein, 10 aa, Borrelia afzelii
TLEVKEGTVT

SEQ ID NO: 157530 - protein, 10 aa, Borrelia afzelii
LEVKEGTVTL

SEQ ID NO: 157531 - protein, 10 aa, Borrelia afzelii
EVKEGTVTLS

SEQ ID NO: 157532 - protein, 10 aa, Borrelia afzelii
VKEGTVTLSK

SEQ ID NO: 157533 - protein, 10 aa, Borrelia afzelii
KEGTVTLSKE

SEQ ID NO: 157534 - protein, 10 aa, Borrelia afzelii
EGTVTLSKEI

SEQ ID NO: 157535 - protein, 10 aa, Borrelia afzelii
GTVTLSKEIA

SEQ ID NO: 157536 - protein, 10 aa, Borrelia afzelii
TVTLSKEIAK

SEQ ID NO: 157537 - protein, 10 aa, Borrelia afzelii
VTLSKEIAKS

SEQ ID NO: 157538 - protein, 10 aa, Borrelia afzelii
TLSKEIAKSG

SEQ ID NO: 157539 - protein, 10 aa, Borrelia afzelii
LSKEIAKSGE

SEQ ID NO: 157540 - protein, 10 aa, Borrelia afzelii
SKEIAKSGEV

SEQ ID NO: 157541 - protein, 10 aa, Borrelia afzelii
KEIAKSGEVT

SEQ ID NO: 157542 - protein, 10 aa, Borrelia afzelii
EIAKSGEVTV

SEQ ID NO: 157543 - protein, 10 aa, Borrelia afzelii
IAKSGEVTVA

SEQ ID NO: 157544 - protein, 10 aa, Borrelia afzelii
AKSGEVTVAL

SEQ ID NO: 157545 - protein, 10 aa, Borrelia afzelii
KSGEVTVALN

SEQ ID NO: 157546 - protein, 10 aa, Borrelia afzelii
SGEVTVALND

SEQ ID NO: 157547 - protein, 10 aa, Borrelia afzelii
GEVTVALNDT

SEQ ID NO: 157548 - protein, 10 aa, Borrelia afzelii
EVTVALNDTN

SEQ ID NO: 157549 - protein, 10 aa, Borrelia afzelii
VTVALNDTNT

SEQ ID NO: 157550 - protein, 10 aa, Borrelia afzelii
TVALNDTNTT

SEQ ID NO: 157551 - protein, 10 aa, Borrelia afzelii
VALNDTNTTQ

SEQ ID NO: 157552 - protein, 10 aa, Borrelia afzelii
ALNDTNTTQA

SEQ ID NO: 157553 - protein, 10 aa, Borrelia afzelii
LNDTNTTQAT

SEQ ID NO: 157554 - protein, 10 aa, Borrelia afzelii
NDTNTTQATK

SEQ ID NO: 157555 - protein, 10 aa, Borrelia afzelii
DTNTTQATKK

SEQ ID NO: 157556 - protein, 10 aa, Borrelia afzelii
TNTTQATKKT

SEQ ID NO: 157557 - protein, 10 aa, Borrelia afzelii
NTTQATKKTG

SEQ ID NO: 157558 - protein, 10 aa, Borrelia afzelii
TTQATKKTGA

SEQ ID NO: 157559 - protein, 10 aa, Borrelia afzelii
TQATKKTGAW

SEQ ID NO: 157560 - protein, 10 aa, Borrelia afzelii
QATKKTGAWD

SEQ ID NO: 157561 - protein, 10 aa, Borrelia afzelii
ATKKTGAWDS

SEQ ID NO: 157562 - protein, 10 aa, Borrelia afzelii
TKKTGAWDSK

SEQ ID NO: 157563 - protein, 10 aa, Borrelia afzelii
KKTGAWDSKT

SEQ ID NO: 157564 - protein, 10 aa, Borrelia afzelii
KTGAWDSKTS

SEQ ID NO: 157565 - protein, 10 aa, Borrelia afzelii
TGAWDSKTST

SEQ ID NO: 157566 - protein, 10 aa, Borrelia afzelii
GAWDSKTSTL

SEQ ID NO: 157567 - protein, 10 aa, Borrelia afzelii
AWDSKTSTLT

SEQ ID NO: 157568 - protein, 10 aa, Borrelia afzelii
WDSKTSTLTI

SEQ ID NO: 157569 - protein, 10 aa, Borrelia afzelii
DSKTSTLTIS

SEQ ID NO: 157570 - protein, 10 aa, Borrelia afzelii
SKTSTLTISV

SEQ ID NO: 157571 - protein, 10 aa, Borrelia afzelii
KTSTLTISVN

SEQ ID NO: 157572 - protein, 10 aa, Borrelia afzelii
TSTLTISVNS

SEQ ID NO: 157573 - protein, 10 aa, Borrelia afzelii
STLTISVNSK

SEQ ID NO: 157574 - protein, 10 aa, Borrelia afzelii
TLTISVNSKK

SEQ ID NO: 157575 - protein, 10 aa, Borrelia afzelii
LTISVNSKKT

SEQ ID NO: 157576 - protein, 10 aa, Borrelia afzelii
TISVNSKKTT

SEQ ID NO: 157577 - protein, 10 aa, Borrelia afzelii
ISVNSKKTTQ

SEQ ID NO: 157578 - protein, 10 aa, Borrelia afzelii
SVNSKKTTQL

SEQ ID NO: 157579 - protein, 10 aa, Borrelia afzelii
VNSKKTTQLV

SEQ ID NO: 157580 - protein, 10 aa, Borrelia afzelii
NSKKTTQLVF

SEQ ID NO: 157581 - protein, 10 aa, Borrelia afzelii
SKKTTQLVFT

SEQ ID NO: 157582 - protein, 10 aa, Borrelia afzelii
KKTTQLVFTK

SEQ ID NO: 157583 - protein, 10 aa, Borrelia afzelii
KTTQLVFTKQ

SEQ ID NO: 157584 - protein, 10 aa, Borrelia afzelii
TTQLVFTKQD

SEQ ID NO: 157585 - protein, 10 aa, Borrelia afzelii
TQLVFTKQDT

SEQ ID NO: 157586 - protein, 10 aa, Borrelia afzelii
QLVFTKQDTI

SEQ ID NO: 157587 - protein, 10 aa, Borrelia afzelii
LVFTKQDTIT

SEQ ID NO: 157588 - protein, 10 aa, Borrelia afzelii
VFTKQDTITV

SEQ ID NO: 157589 - protein, 10 aa, Borrelia afzelii
FTKQDTITVQ

SEQ ID NO: 157590 - protein, 10 aa, Borrelia afzelii
TKQDTITVQK

SEQ ID NO: 157591 - protein, 10 aa, Borrelia afzelii
KQDTITVQKY

SEQ ID NO: 157592 - protein, 10 aa, Borrelia afzelii
QDTITVQKYD

SEQ ID NO: 157593 - protein, 10 aa, Borrelia afzelii
DTITVQKYDS

SEQ ID NO: 157594 - protein, 10 aa, Borrelia afzelii
TITVQKYDSA

SEQ ID NO: 157595 - protein, 10 aa, Borrelia afzelii
ITVQKYDSAG

SEQ ID NO: 157596 - protein, 10 aa, Borrelia afzelii
TVQKYDSAGT

SEQ ID NO: 157597 - protein, 10 aa, Borrelia afzelii
VQKYDSAGTN

SEQ ID NO: 157598 - protein, 10 aa, Borrelia afzelii
QKYDSAGTNL

SEQ ID NO: 157599 - protein, 10 aa, Borrelia afzelii
KYDSAGTNLE

SEQ ID NO: 157600 - protein, 10 aa, Borrelia afzelii
YDSAGTNLEG

SEQ ID NO: 157601 - protein, 10 aa, Borrelia afzelii
DSAGTNLEGT

SEQ ID NO: 157602 - protein, 10 aa, Borrelia afzelii
SAGTNLEGTA

SEQ ID NO: 157603 - protein, 10 aa, Borrelia afzelii
AGTNLEGTAV

SEQ ID NO: 157604 - protein, 10 aa, Borrelia afzelii
GTNLEGTAVE

SEQ ID NO: 157605 - protein, 10 aa, Borrelia afzelii
TNLEGTAVEI

SEQ ID NO: 157606 - protein, 10 aa, Borrelia afzelii
NLEGTAVEIK

SEQ ID NO: 157607 - protein, 10 aa, Borrelia afzelii
LEGTAVEIKT

SEQ ID NO: 157608 - protein, 10 aa, Borrelia afzelii
EGTAVEIKTL

SEQ ID NO: 157609 - protein, 10 aa, Borrelia afzelii
GTAVEIKTLD

SEQ ID NO: 157610 - protein, 10 aa, Borrelia afzelii
TAVEIKTLDE

SEQ ID NO: 157611 - protein, 10 aa, Borrelia afzelii
AVEIKTLDEL

SEQ ID NO: 157612 - protein, 10 aa, Borrelia afzelii
VEIKTLDELK

SEQ ID NO: 157613 - protein, 10 aa, Borrelia afzelii
EIKTLDELKN

SEQ ID NO: 157614 - protein, 10 aa, Borrelia afzelii
IKTLDELKNA

SEQ ID NO: 157615 - protein, 10 aa, Borrelia afzelii
KTLDELKNAL

SEQ ID NO: 157616 - protein, 10 aa, Borrelia afzelii
TLDELKNALK

SEQ ID NO: 157617 - protein, 11 aa, Borrelia afzelii
MKKYLLGIGLI

SEQ ID NO: 157618 - protein, 11 aa, Borrelia afzelii
KKYLLGIGLIL

SEQ ID NO: 157619 - protein, 11 aa, Borrelia afzelii
KYLLGIGLILA

SEQ ID NO: 157620 - protein, 11 aa, Borrelia afzelii
YLLGIGLILAL

SEQ ID NO: 157621 - protein, 11 aa, Borrelia afzelii
LLGIGLILALI

SEQ ID NO: 157622 - protein, 11 aa, Borrelia afzelii
LGIGLILALIA

SEQ ID NO: 157623 - protein, 11 aa, Borrelia afzelii
GIGLILALIAC

SEQ ID NO: 157624 - protein, 11 aa, Borrelia afzelii
IGLILALIACK

SEQ ID NO: 157625 - protein, 11 aa, Borrelia afzelii
GLILALIACKQ

SEQ ID NO: 157626 - protein, 11 aa, Borrelia afzelii
LILALIACKQN

SEQ ID NO: 157627 - protein, 11 aa, Borrelia afzelii
ILALIACKQNV

SEQ ID NO: 157628 - protein, 11 aa, Borrelia afzelii
LALIACKQNVS

SEQ ID NO: 157629 - protein, 11 aa, Borrelia afzelii
ALIACKQNVSS

SEQ ID NO: 157630 - protein, 11 aa, Borrelia afzelii
LIACKQNVSSL

SEQ ID NO: 157631 - protein, 11 aa, Borrelia afzelii
IACKQNVSSLD

SEQ ID NO: 157632 - protein, 11 aa, Borrelia afzelii
ACKQNVSSLDE

SEQ ID NO: 157633 - protein, 11 aa, Borrelia afzelii
CKQNVSSLDEK

SEQ ID NO: 157634 - protein, 11 aa, Borrelia afzelii
KQNVSSLDEKN

SEQ ID NO: 157635 - protein, 11 aa, Borrelia afzelii
QNVSSLDEKNS

SEQ ID NO: 157636 - protein, 11 aa, Borrelia afzelii
NVSSLDEKNSA

SEQ ID NO: 157637 - protein, 11 aa, Borrelia afzelii
VSSLDEKNSAS

SEQ ID NO: 157638 - protein, 11 aa, Borrelia afzelii
SSLDEKNSASV

SEQ ID NO: 157639 - protein, 11 aa, Borrelia afzelii
SLDEKNSASVD

SEQ ID NO: 157640 - protein, 11 aa, Borrelia afzelii
LDEKNSASVDL

SEQ ID NO: 157641 - protein, 11 aa, Borrelia afzelii
DEKNSASVDLP

SEQ ID NO: 157642 - protein, 11 aa, Borrelia afzelii
EKNSASVDLPG

SEQ ID NO: 157643 - protein, 11 aa, Borrelia afzelii
KNSASVDLPGE

SEQ ID NO: 157644 - protein, 11 aa, Borrelia afzelii
NSASVDLPGEM

SEQ ID NO: 157645 - protein, 11 aa, Borrelia afzelii
SASVDLPGEMK

SEQ ID NO: 157646 - protein, 11 aa, Borrelia afzelii
ASVDLPGEMKV

SEQ ID NO: 157647 - protein, 11 aa, Borrelia afzelii
SVDLPGEMKVL

SEQ ID NO: 157648 - protein, 11 aa, Borrelia afzelii
VDLPGEMKVLV

SEQ ID NO: 157649 - protein, 11 aa, Borrelia afzelii
DLPGEMKVLVS

SEQ ID NO: 157650 - protein, 11 aa, Borrelia afzelii
LPGEMKVLVSK

SEQ ID NO: 157651 - protein, 11 aa, Borrelia afzelii
PGEMKVLVSKE

SEQ ID NO: 157652 - protein, 11 aa, Borrelia afzelii
GEMKVLVSKEK

SEQ ID NO: 157653 - protein, 11 aa, Borrelia afzelii
EMKVLVSKEKD

SEQ ID NO: 157654 - protein, 11 aa, Borrelia afzelii
MKVLVSKEKDK

SEQ ID NO: 157655 - protein, 11 aa, Borrelia afzelii
KVLVSKEKDKD

SEQ ID NO: 157656 - protein, 11 aa, Borrelia afzelii
VLVSKEKDKDG

SEQ ID NO: 157657 - protein, 11 aa, Borrelia afzelii
LVSKEKDKDGK

SEQ ID NO: 157658 - protein, 11 aa, Borrelia afzelii
VSKEKDKDGKY

SEQ ID NO: 157659 - protein, 11 aa, Borrelia afzelii
SKEKDKDGKYS

SEQ ID NO: 157660 - protein, 11 aa, Borrelia afzelii
KEKDKDGKYSL

SEQ ID NO: 157661 - protein, 11 aa, Borrelia afzelii
EKDKDGKYSLK

SEQ ID NO: 157662 - protein, 11 aa, Borrelia afzelii
KDKDGKYSLKA

SEQ ID NO: 157663 - protein, 11 aa, Borrelia afzelii
DKDGKYSLKAT

SEQ ID NO: 157664 - protein, 11 aa, Borrelia afzelii
KDGKYSLKATV

SEQ ID NO: 157665 - protein, 11 aa, Borrelia afzelii
DGKYSLKATVD

SEQ ID NO: 157666 - protein, 11 aa, Borrelia afzelii
GKYSLKATVDK

SEQ ID NO: 157667 - protein, 11 aa, Borrelia afzelii
KYSLKATVDKI

SEQ ID NO: 157668 - protein, 11 aa, Borrelia afzelii
YSLKATVDKIE

SEQ ID NO: 157669 - protein, 11 aa, Borrelia afzelii
SLKATVDKIEL

SEQ ID NO: 157670 - protein, 11 aa, Borrelia afzelii
LKATVDKIELK

SEQ ID NO: 157671 - protein, 11 aa, Borrelia afzelii
KATVDKIELKG

SEQ ID NO: 157672 - protein, 11 aa, Borrelia afzelii
ATVDKIELKGT

SEQ ID NO: 157673 - protein, 11 aa, Borrelia afzelii
TVDKIELKGTS

SEQ ID NO: 157674 - protein, 11 aa, Borrelia afzelii
VDKIELKGTSD

SEQ ID NO: 157675 - protein, 11 aa, Borrelia afzelii
DKIELKGTSDK

SEQ ID NO: 157676 - protein, 11 aa, Borrelia afzelii
KIELKGTSDKD

SEQ ID NO: 157677 - protein, 11 aa, Borrelia afzelii
IELKGTSDKDN

SEQ ID NO: 157678 - protein, 11 aa, Borrelia afzelii
ELKGTSDKDNG

SEQ ID NO: 157679 - protein, 11 aa, Borrelia afzelii
LKGTSDKDNGS

SEQ ID NO: 157680 - protein, 11 aa, Borrelia afzelii
KGTSDKDNGSG

SEQ ID NO: 157681 - protein, 11 aa, Borrelia afzelii
GTSDKDNGSGV

SEQ ID NO: 157682 - protein, 11 aa, Borrelia afzelii
TSDKDNGSGVL

SEQ ID NO: 157683 - protein, 11 aa, Borrelia afzelii
SDKDNGSGVLE

SEQ ID NO: 157684 - protein, 11 aa, Borrelia afzelii
DKDNGSGVLEG

SEQ ID NO: 157685 - protein, 11 aa, Borrelia afzelii
KDNGSGVLEGT

SEQ ID NO: 157686 - protein, 11 aa, Borrelia afzelii
DNGSGVLEGTK

SEQ ID NO: 157687 - protein, 11 aa, Borrelia afzelii
NGSGVLEGTKD

SEQ ID NO: 157688 - protein, 11 aa, Borrelia afzelii
GSGVLEGTKDD

SEQ ID NO: 157689 - protein, 11 aa, Borrelia afzelii
SGVLEGTKDDK

SEQ ID NO: 157690 - protein, 11 aa, Borrelia afzelii
GVLEGTKDDKS

SEQ ID NO: 157691 - protein, 11 aa, Borrelia afzelii
VLEGTKDDKSK

SEQ ID NO: 157692 - protein, 11 aa, Borrelia afzelii
LEGTKDDKSKA

SEQ ID NO: 157693 - protein, 11 aa, Borrelia afzelii
EGTKDDKSKAK

SEQ ID NO: 157694 - protein, 11 aa, Borrelia afzelii
GTKDDKSKAKL

SEQ ID NO: 157695 - protein, 11 aa, Borrelia afzelii
TKDDKSKAKLT

SEQ ID NO: 157696 - protein, 11 aa, Borrelia afzelii
KDDKSKAKLTI

SEQ ID NO: 157697 - protein, 11 aa, Borrelia afzelii
DDKSKAKLTIA

SEQ ID NO: 157698 - protein, 11 aa, Borrelia afzelii
DKSKAKLTIAD

SEQ ID NO: 157699 - protein, 11 aa, Borrelia afzelii
KSKAKLTIADD

SEQ ID NO: 157700 - protein, 11 aa, Borrelia afzelii
SKAKLTIADDL

SEQ ID NO: 157701 - protein, 11 aa, Borrelia afzelii
KAKLTIADDLS

SEQ ID NO: 157702 - protein, 11 aa, Borrelia afzelii
AKLTIADDLSK

SEQ ID NO: 157703 - protein, 11 aa, Borrelia afzelii
KLTIADDLSKT

SEQ ID NO: 157704 - protein, 11 aa, Borrelia afzelii
LTIADDLSKTT

SEQ ID NO: 157705 - protein, 11 aa, Borrelia afzelii
TIADDLSKTTF

SEQ ID NO: 157706 - protein, 11 aa, Borrelia afzelii
IADDLSKTTFE

SEQ ID NO: 157707 - protein, 11 aa, Borrelia afzelii
ADDLSKTTFEL

SEQ ID NO: 157708 - protein, 11 aa, Borrelia afzelii
DDLSKTTFELF

SEQ ID NO: 157709 - protein, 11 aa, Borrelia afzelii
DLSKTTFELFK

SEQ ID NO: 157710 - protein, 11 aa, Borrelia afzelii
LSKTTFELFKE

SEQ ID NO: 157711 - protein, 11 aa, Borrelia afzelii
SKTTFELFKED

SEQ ID NO: 157712 - protein, 11 aa, Borrelia afzelii
KTTFELFKEDG

SEQ ID NO: 157713 - protein, 11 aa, Borrelia afzelii
TTFELFKEDGK

SEQ ID NO: 157714 - protein, 11 aa, Borrelia afzelii
TFELFKEDGKT

SEQ ID NO: 157715 - protein, 11 aa, Borrelia afzelii
FELFKEDGKTL

SEQ ID NO: 157716 - protein, 11 aa, Borrelia afzelii
ELFKEDGKTLV

SEQ ID NO: 157717 - protein, 11 aa, Borrelia afzelii
LFKEDGKTLVS

SEQ ID NO: 157718 - protein, 11 aa, Borrelia afzelii
FKEDGKTLVSR

SEQ ID NO: 157719 - protein, 11 aa, Borrelia afzelii
KEDGKTLVSRK

SEQ ID NO: 157720 - protein, 11 aa, Borrelia afzelii
EDGKTLVSRKV

SEQ ID NO: 157721 - protein, 11 aa, Borrelia afzelii
DGKTLVSRKVS

SEQ ID NO: 157722 - protein, 11 aa, Borrelia afzelii
GKTLVSRKVSS

SEQ ID NO: 157723 - protein, 11 aa, Borrelia afzelii
KTLVSRKVSSK

SEQ ID NO: 157724 - protein, 11 aa, Borrelia afzelii
TLVSRKVSSKD

SEQ ID NO: 157725 - protein, 11 aa, Borrelia afzelii
LVSRKVSSKDK

SEQ ID NO: 157726 - protein, 11 aa, Borrelia afzelii
VSRKVSSKDKT

SEQ ID NO: 157727 - protein, 11 aa, Borrelia afzelii
SRKVSSKDKTS

SEQ ID NO: 157728 - protein, 11 aa, Borrelia afzelii
RKVSSKDKTST

SEQ ID NO: 157729 - protein, 11 aa, Borrelia afzelii
KVSSKDKTSTD

SEQ ID NO: 157730 - protein, 11 aa, Borrelia afzelii
VSSKDKTSTDE

SEQ ID NO: 157731 - protein, 11 aa, Borrelia afzelii
SSKDKTSTDEM

SEQ ID NO: 157732 - protein, 11 aa, Borrelia afzelii
SKDKTSTDEMF

SEQ ID NO: 157733 - protein, 11 aa, Borrelia afzelii
KDKTSTDEMFN

SEQ ID NO: 157734 - protein, 11 aa, Borrelia afzelii
DKTSTDEMFNE

SEQ ID NO: 157735 - protein, 11 aa, Borrelia afzelii
KTSTDEMFNEK

SEQ ID NO: 157736 - protein, 11 aa, Borrelia afzelii
TSTDEMFNEKG

SEQ ID NO: 157737 - protein, 11 aa, Borrelia afzelii
STDEMFNEKGE

SEQ ID NO: 157738 - protein, 11 aa, Borrelia afzelii
TDEMFNEKGEL

SEQ ID NO: 157739 - protein, 11 aa, Borrelia afzelii
DEMFNEKGELS

SEQ ID NO: 157740 - protein, 11 aa, Borrelia afzelii
EMFNEKGELSA

SEQ ID NO: 157741 - protein, 11 aa, Borrelia afzelii
MFNEKGELSAK

SEQ ID NO: 157742 - protein, 11 aa, Borrelia afzelii
FNEKGELSAKT

SEQ ID NO: 157743 - protein, 11 aa, Borrelia afzelii
NEKGELSAKTM

SEQ ID NO: 157744 - protein, 11 aa, Borrelia afzelii
EKGELSAKTMT

SEQ ID NO: 157745 - protein, 11 aa, Borrelia afzelii
KGELSAKTMTR

SEQ ID NO: 157746 - protein, 11 aa, Borrelia afzelii
GELSAKTMTRE

SEQ ID NO: 157747 - protein, 11 aa, Borrelia afzelii
ELSAKTMTREN

SEQ ID NO: 157748 - protein, 11 aa, Borrelia afzelii
LSAKTMTRENG

SEQ ID NO: 157749 - protein, 11 aa, Borrelia afzelii
SAKTMTRENGT

SEQ ID NO: 157750 - protein, 11 aa, Borrelia afzelii
AKTMTRENGTK

SEQ ID NO: 157751 - protein, 11 aa, Borrelia afzelii
KTMTRENGTKL

SEQ ID NO: 157752 - protein, 11 aa, Borrelia afzelii
TMTRENGTKLE

SEQ ID NO: 157753 - protein, 11 aa, Borrelia afzelii
MTRENGTKLEY

SEQ ID NO: 157754 - protein, 11 aa, Borrelia afzelii
TRENGTKLEYT

SEQ ID NO: 157755 - protein, 11 aa, Borrelia afzelii
RENGTKLEYTE

SEQ ID NO: 157756 - protein, 11 aa, Borrelia afzelii
ENGTKLEYTEM

SEQ ID NO: 157757 - protein, 11 aa, Borrelia afzelii
NGTKLEYTEMK

SEQ ID NO: 157758 - protein, 11 aa, Borrelia afzelii
GTKLEYTEMKS

SEQ ID NO: 157759 - protein, 11 aa, Borrelia afzelii
TKLEYTEMKSD

SEQ ID NO: 157760 - protein, 11 aa, Borrelia afzelii
KLEYTEMKSDG

SEQ ID NO: 157761 - protein, 11 aa, Borrelia afzelii
LEYTEMKSDGT

SEQ ID NO: 157762 - protein, 11 aa, Borrelia afzelii
EYTEMKSDGTG

SEQ ID NO: 157763 - protein, 11 aa, Borrelia afzelii
YTEMKSDGTGK

SEQ ID NO: 157764 - protein, 11 aa, Borrelia afzelii
TEMKSDGTGKA

SEQ ID NO: 157765 - protein, 11 aa, Borrelia afzelii
EMKSDGTGKAK

SEQ ID NO: 157766 - protein, 11 aa, Borrelia afzelii
MKSDGTGKAKE

SEQ ID NO: 157767 - protein, 11 aa, Borrelia afzelii
KSDGTGKAKEV

SEQ ID NO: 157768 - protein, 11 aa, Borrelia afzelii
SDGTGKAKEVL

SEQ ID NO: 157769 - protein, 11 aa, Borrelia afzelii
DGTGKAKEVLK

SEQ ID NO: 157770 - protein, 11 aa, Borrelia afzelii
GTGKAKEVLKN

SEQ ID NO: 157771 - protein, 11 aa, Borrelia afzelii
TGKAKEVLKNF

SEQ ID NO: 157772 - protein, 11 aa, Borrelia afzelii
GKAKEVLKNFT

SEQ ID NO: 157773 - protein, 11 aa, Borrelia afzelii
KAKEVLKNFTL

SEQ ID NO: 157774 - protein, 11 aa, Borrelia afzelii
AKEVLKNFTLE

SEQ ID NO: 157775 - protein, 11 aa, Borrelia afzelii
KEVLKNFTLEG

SEQ ID NO: 157776 - protein, 11 aa, Borrelia afzelii
EVLKNFTLEGK

SEQ ID NO: 157777 - protein, 11 aa, Borrelia afzelii
VLKNFTLEGKV

SEQ ID NO: 157778 - protein, 11 aa, Borrelia afzelii
LKNFTLEGKVA

SEQ ID NO: 157779 - protein, 11 aa, Borrelia afzelii
KNFTLEGKVAN

SEQ ID NO: 157780 - protein, 11 aa, Borrelia afzelii
NFTLEGKVAND

SEQ ID NO: 157781 - protein, 11 aa, Borrelia afzelii
FTLEGKVANDK

SEQ ID NO: 157782 - protein, 11 aa, Borrelia afzelii
TLEGKVANDKV

SEQ ID NO: 157783 - protein, 11 aa, Borrelia afzelii
LEGKVANDKVT

SEQ ID NO: 157784 - protein, 11 aa, Borrelia afzelii
EGKVANDKVTL

SEQ ID NO: 157785 - protein, 11 aa, Borrelia afzelii
GKVANDKVTLE

SEQ ID NO: 157786 - protein, 11 aa, Borrelia afzelii
KVANDKVTLEV

SEQ ID NO: 157787 - protein, 11 aa, Borrelia afzelii
VANDKVTLEVK

SEQ ID NO: 157788 - protein, 11 aa, Borrelia afzelii
ANDKVTLEVKE

SEQ ID NO: 157789 - protein, 11 aa, Borrelia afzelii
NDKVTLEVKEG

SEQ ID NO: 157790 - protein, 11 aa, Borrelia afzelii
DKVTLEVKEGT

SEQ ID NO: 157791 - protein, 11 aa, Borrelia afzelii
KVTLEVKEGTV

SEQ ID NO: 157792 - protein, 11 aa, Borrelia afzelii
VTLEVKEGTVT

SEQ ID NO: 157793 - protein, 11 aa, Borrelia afzelii
TLEVKEGTVTL

SEQ ID NO: 157794 - protein, 11 aa, Borrelia afzelii
LEVKEGTVTLS

SEQ ID NO: 157795 - protein, 11 aa, Borrelia afzelii
EVKEGTVTLSK

SEQ ID NO: 157796 - protein, 11 aa, Borrelia afzelii
VKEGTVTLSKE

SEQ ID NO: 157797 - protein, 11 aa, Borrelia afzelii
KEGTVTLSKEI

SEQ ID NO: 157798 - protein, 11 aa, Borrelia afzelii
EGTVTLSKEIA

SEQ ID NO: 157799 - protein, 11 aa, Borrelia afzelii
GTVTLSKEIAK

SEQ ID NO: 157800 - protein, 11 aa, Borrelia afzelii
TVTLSKEIAKS

SEQ ID NO: 157801 - protein, 11 aa, Borrelia afzelii
VTLSKEIAKSG

SEQ ID NO: 157802 - protein, 11 aa, Borrelia afzelii
TLSKEIAKSGE

SEQ ID NO: 157803 - protein, 11 aa, Borrelia afzelii
LSKEIAKSGEV

SEQ ID NO: 157804 - protein, 11 aa, Borrelia afzelii
SKEIAKSGEVT

SEQ ID NO: 157805 - protein, 11 aa, Borrelia afzelii
KEIAKSGEVTV

SEQ ID NO: 157806 - protein, 11 aa, Borrelia afzelii
EIAKSGEVTVA

SEQ ID NO: 157807 - protein, 11 aa, Borrelia afzelii
IAKSGEVTVAL

SEQ ID NO: 157808 - protein, 11 aa, Borrelia afzelii
AKSGEVTVALN

SEQ ID NO: 157809 - protein, 11 aa, Borrelia afzelii
KSGEVTVALND

SEQ ID NO: 157810 - protein, 11 aa, Borrelia afzelii
SGEVTVALNDT

SEQ ID NO: 157811 - protein, 11 aa, Borrelia afzelii
GEVTVALNDTN

SEQ ID NO: 157812 - protein, 11 aa, Borrelia afzelii
EVTVALNDTNT

SEQ ID NO: 157813 - protein, 11 aa, Borrelia afzelii
VTVALNDTNTT

SEQ ID NO: 157814 - protein, 11 aa, Borrelia afzelii
TVALNDTNTTQ

SEQ ID NO: 157815 - protein, 11 aa, Borrelia afzelii
VALNDTNTTQA

SEQ ID NO: 157816 - protein, 11 aa, Borrelia afzelii
ALNDTNTTQAT

SEQ ID NO: 157817 - protein, 11 aa, Borrelia afzelii
LNDTNTTQATK

SEQ ID NO: 157818 - protein, 11 aa, Borrelia afzelii
NDTNTTQATKK

SEQ ID NO: 157819 - protein, 11 aa, Borrelia afzelii
DTNTTQATKKT

SEQ ID NO: 157820 - protein, 11 aa, Borrelia afzelii
TNTTQATKKTG

SEQ ID NO: 157821 - protein, 11 aa, Borrelia afzelii
NTTQATKKTGA

SEQ ID NO: 157822 - protein, 11 aa, Borrelia afzelii
TTQATKKTGAW

SEQ ID NO: 157823 - protein, 11 aa, Borrelia afzelii
TQATKKTGAWD

SEQ ID NO: 157824 - protein, 11 aa, Borrelia afzelii
QATKKTGAWDS

SEQ ID NO: 157825 - protein, 11 aa, Borrelia afzelii
ATKKTGAWDSK

SEQ ID NO: 157826 - protein, 11 aa, Borrelia afzelii
TKKTGAWDSKT

SEQ ID NO: 157827 - protein, 11 aa, Borrelia afzelii
KKTGAWDSKTS

SEQ ID NO: 157828 - protein, 11 aa, Borrelia afzelii
KTGAWDSKTST

SEQ ID NO: 157829 - protein, 11 aa, Borrelia afzelii
TGAWDSKTSTL

SEQ ID NO: 157830 - protein, 11 aa, Borrelia afzelii
GAWDSKTSTLT

SEQ ID NO: 157831 - protein, 11 aa, Borrelia afzelii
AWDSKTSTLTI

SEQ ID NO: 157832 - protein, 11 aa, Borrelia afzelii
WDSKTSTLTIS

SEQ ID NO: 157833 - protein, 11 aa, Borrelia afzelii
DSKTSTLTISV

SEQ ID NO: 157834 - protein, 11 aa, Borrelia afzelii
SKTSTLTISVN

SEQ ID NO: 157835 - protein, 11 aa, Borrelia afzelii
KTSTLTISVNS

SEQ ID NO: 157836 - protein, 11 aa, Borrelia afzelii
TSTLTISVNSK

SEQ ID NO: 157837 - protein, 11 aa, Borrelia afzelii
STLTISVNSKK

SEQ ID NO: 157838 - protein, 11 aa, Borrelia afzelii
TLTISVNSKKT

SEQ ID NO: 157839 - protein, 11 aa, Borrelia afzelii
LTISVNSKKTT

SEQ ID NO: 157840 - protein, 11 aa, Borrelia afzelii
TISVNSKKTTQ

SEQ ID NO: 157841 - protein, 11 aa, Borrelia afzelii
ISVNSKKTTQL

SEQ ID NO: 157842 - protein, 11 aa, Borrelia afzelii
SVNSKKTTQLV

SEQ ID NO: 157843 - protein, 11 aa, Borrelia afzelii
VNSKKTTQLVF

SEQ ID NO: 157844 - protein, 11 aa, Borrelia afzelii
NSKKTTQLVFT

SEQ ID NO: 157845 - protein, 11 aa, Borrelia afzelii
SKKTTQLVFTK

SEQ ID NO: 157846 - protein, 11 aa, Borrelia afzelii
KKTTQLVFTKQ

SEQ ID NO: 157847 - protein, 11 aa, Borrelia afzelii
KTTQLVFTKQD

SEQ ID NO: 157848 - protein, 11 aa, Borrelia afzelii
TTQLVFTKQDT

SEQ ID NO: 157849 - protein, 11 aa, Borrelia afzelii
TQLVFTKQDTI

SEQ ID NO: 157850 - protein, 11 aa, Borrelia afzelii
QLVFTKQDTIT

SEQ ID NO: 157851 - protein, 11 aa, Borrelia afzelii
LVFTKQDTITV

SEQ ID NO: 157852 - protein, 11 aa, Borrelia afzelii
VFTKQDTITVQ

SEQ ID NO: 157853 - protein, 11 aa, Borrelia afzelii
FTKQDTITVQK

SEQ ID NO: 157854 - protein, 11 aa, Borrelia afzelii
TKQDTITVQKY

SEQ ID NO: 157855 - protein, 11 aa, Borrelia afzelii
KQDTITVQKYD

SEQ ID NO: 157856 - protein, 11 aa, Borrelia afzelii
QDTITVQKYDS

SEQ ID NO: 157857 - protein, 11 aa, Borrelia afzelii
DTITVQKYDSA

SEQ ID NO: 157858 - protein, 11 aa, Borrelia afzelii
TITVQKYDSAG

SEQ ID NO: 157859 - protein, 11 aa, Borrelia afzelii
ITVQKYDSAGT

SEQ ID NO: 157860 - protein, 11 aa, Borrelia afzelii
TVQKYDSAGTN

SEQ ID NO: 157861 - protein, 11 aa, Borrelia afzelii
VQKYDSAGTNL

SEQ ID NO: 157862 - protein, 11 aa, Borrelia afzelii
QKYDSAGTNLE

SEQ ID NO: 157863 - protein, 11 aa, Borrelia afzelii
KYDSAGTNLEG

SEQ ID NO: 157864 - protein, 11 aa, Borrelia afzelii
YDSAGTNLEGT

SEQ ID NO: 157865 - protein, 11 aa, Borrelia afzelii
DSAGTNLEGTA

SEQ ID NO: 157866 - protein, 11 aa, Borrelia afzelii
SAGTNLEGTAV

SEQ ID NO: 157867 - protein, 11 aa, Borrelia afzelii
AGTNLEGTAVE

SEQ ID NO: 157868 - protein, 11 aa, Borrelia afzelii
GTNLEGTAVEI

SEQ ID NO: 157869 - protein, 11 aa, Borrelia afzelii
TNLEGTAVEIK

SEQ ID NO: 157870 - protein, 11 aa, Borrelia afzelii
NLEGTAVEIKT

SEQ ID NO: 157871 - protein, 11 aa, Borrelia afzelii
LEGTAVEIKTL

SEQ ID NO: 157872 - protein, 11 aa, Borrelia afzelii
EGTAVEIKTLD

SEQ ID NO: 157873 - protein, 11 aa, Borrelia afzelii
GTAVEIKTLDE

SEQ ID NO: 157874 - protein, 11 aa, Borrelia afzelii
TAVEIKTLDEL

SEQ ID NO: 157875 - protein, 11 aa, Borrelia afzelii
AVEIKTLDELK

SEQ ID NO: 157876 - protein, 11 aa, Borrelia afzelii
VEIKTLDELKN

SEQ ID NO: 157877 - protein, 11 aa, Borrelia afzelii
EIKTLDELKNA

SEQ ID NO: 157878 - protein, 11 aa, Borrelia afzelii
IKTLDELKNAL

SEQ ID NO: 157879 - protein, 11 aa, Borrelia afzelii
KTLDELKNALK

SEQ ID NO: 157880 - protein, 13 aa, Borrelia afzelii
MKKYLLGIGLILA

SEQ ID NO: 157881 - protein, 13 aa, Borrelia afzelii
KKYLLGIGLILAL

SEQ ID NO: 157882 - protein, 13 aa, Borrelia afzelii
KYLLGIGLILALI

SEQ ID NO: 157883 - protein, 13 aa, Borrelia afzelii
YLLGIGLILALIA

SEQ ID NO: 157884 - protein, 13 aa, Borrelia afzelii
LLGIGLILALIAC

SEQ ID NO: 157885 - protein, 13 aa, Borrelia afzelii
LGIGLILALIACK

SEQ ID NO: 157886 - protein, 13 aa, Borrelia afzelii
GIGLILALIACKQ

SEQ ID NO: 157887 - protein, 13 aa, Borrelia afzelii
IGLILALIACKQN

SEQ ID NO: 157888 - protein, 13 aa, Borrelia afzelii
GLILALIACKQNV

SEQ ID NO: 157889 - protein, 13 aa, Borrelia afzelii
LILALIACKQNVS

SEQ ID NO: 157890 - protein, 13 aa, Borrelia afzelii
ILALIACKQNVSS

SEQ ID NO: 157891 - protein, 13 aa, Borrelia afzelii
LALIACKQNVSSL

SEQ ID NO: 157892 - protein, 13 aa, Borrelia afzelii
ALIACKQNVSSLD

SEQ ID NO: 157893 - protein, 13 aa, Borrelia afzelii
LIACKQNVSSLDE

SEQ ID NO: 157894 - protein, 13 aa, Borrelia afzelii
IACKQNVSSLDEK

SEQ ID NO: 157895 - protein, 13 aa, Borrelia afzelii
ACKQNVSSLDEKN

SEQ ID NO: 157896 - protein, 13 aa, Borrelia afzelii
CKQNVSSLDEKNS

SEQ ID NO: 157897 - protein, 13 aa, Borrelia afzelii
KQNVSSLDEKNSA

SEQ ID NO: 157898 - protein, 13 aa, Borrelia afzelii
QNVSSLDEKNSAS

SEQ ID NO: 157899 - protein, 13 aa, Borrelia afzelii
NVSSLDEKNSASV

SEQ ID NO: 157900 - protein, 13 aa, Borrelia afzelii
VSSLDEKNSASVD

SEQ ID NO: 157901 - protein, 13 aa, Borrelia afzelii
SSLDEKNSASVDL

SEQ ID NO: 157902 - protein, 13 aa, Borrelia afzelii
SLDEKNSASVDLP

SEQ ID NO: 157903 - protein, 13 aa, Borrelia afzelii
LDEKNSASVDLPG

SEQ ID NO: 157904 - protein, 13 aa, Borrelia afzelii
DEKNSASVDLPGE

SEQ ID NO: 157905 - protein, 13 aa, Borrelia afzelii
EKNSASVDLPGEM

SEQ ID NO: 157906 - protein, 13 aa, Borrelia afzelii
KNSASVDLPGEMK

SEQ ID NO: 157907 - protein, 13 aa, Borrelia afzelii
NSASVDLPGEMKV

SEQ ID NO: 157908 - protein, 13 aa, Borrelia afzelii
SASVDLPGEMKVL

SEQ ID NO: 157909 - protein, 13 aa, Borrelia afzelii
ASVDLPGEMKVLV

SEQ ID NO: 157910 - protein, 13 aa, Borrelia afzelii
SVDLPGEMKVLVS

SEQ ID NO: 157911 - protein, 13 aa, Borrelia afzelii
VDLPGEMKVLVSK

SEQ ID NO: 157912 - protein, 13 aa, Borrelia afzelii
DLPGEMKVLVSKE

SEQ ID NO: 157913 - protein, 13 aa, Borrelia afzelii
LPGEMKVLVSKEK

SEQ ID NO: 157914 - protein, 13 aa, Borrelia afzelii
PGEMKVLVSKEKD

SEQ ID NO: 157915 - protein, 13 aa, Borrelia afzelii
GEMKVLVSKEKDK

SEQ ID NO: 157916 - protein, 13 aa, Borrelia afzelii
EMKVLVSKEKDKD

SEQ ID NO: 157917 - protein, 13 aa, Borrelia afzelii
MKVLVSKEKDKDG

SEQ ID NO: 157918 - protein, 13 aa, Borrelia afzelii
KVLVSKEKDKDGK

SEQ ID NO: 157919 - protein, 13 aa, Borrelia afzelii
VLVSKEKDKDGKY

SEQ ID NO: 157920 - protein, 13 aa, Borrelia afzelii
LVSKEKDKDGKYS

SEQ ID NO: 157921 - protein, 13 aa, Borrelia afzelii
VSKEKDKDGKYSL

SEQ ID NO: 157922 - protein, 13 aa, Borrelia afzelii
SKEKDKDGKYSLK

SEQ ID NO: 157923 - protein, 13 aa, Borrelia afzelii
KEKDKDGKYSLKA

SEQ ID NO: 157924 - protein, 13 aa, Borrelia afzelii
EKDKDGKYSLKAT

SEQ ID NO: 157925 - protein, 13 aa, Borrelia afzelii
KDKDGKYSLKATV

SEQ ID NO: 157926 - protein, 13 aa, Borrelia afzelii
DKDGKYSLKATVD

SEQ ID NO: 157927 - protein, 13 aa, Borrelia afzelii
KDGKYSLKATVDK

SEQ ID NO: 157928 - protein, 13 aa, Borrelia afzelii
DGKYSLKATVDKI

SEQ ID NO: 157929 - protein, 13 aa, Borrelia afzelii
GKYSLKATVDKIE

SEQ ID NO: 157930 - protein, 13 aa, Borrelia afzelii
KYSLKATVDKIEL

SEQ ID NO: 157931 - protein, 13 aa, Borrelia afzelii
YSLKATVDKIELK

SEQ ID NO: 157932 - protein, 13 aa, Borrelia afzelii
SLKATVDKIELKG

SEQ ID NO: 157933 - protein, 13 aa, Borrelia afzelii
LKATVDKIELKGT

SEQ ID NO: 157934 - protein, 13 aa, Borrelia afzelii
KATVDKIELKGTS

SEQ ID NO: 157935 - protein, 13 aa, Borrelia afzelii
ATVDKIELKGTSD

SEQ ID NO: 157936 - protein, 13 aa, Borrelia afzelii
TVDKIELKGTSDK

SEQ ID NO: 157937 - protein, 13 aa, Borrelia afzelii
VDKIELKGTSDKD

SEQ ID NO: 157938 - protein, 13 aa, Borrelia afzelii
DKIELKGTSDKDN

SEQ ID NO: 157939 - protein, 13 aa, Borrelia afzelii
KIELKGTSDKDNG

SEQ ID NO: 157940 - protein, 13 aa, Borrelia afzelii
IELKGTSDKDNGS

SEQ ID NO: 157941 - protein, 13 aa, Borrelia afzelii
ELKGTSDKDNGSG

SEQ ID NO: 157942 - protein, 13 aa, Borrelia afzelii
LKGTSDKDNGSGV

SEQ ID NO: 157943 - protein, 13 aa, Borrelia afzelii
KGTSDKDNGSGVL

SEQ ID NO: 157944 - protein, 13 aa, Borrelia afzelii
GTSDKDNGSGVLE

SEQ ID NO: 157945 - protein, 13 aa, Borrelia afzelii
TSDKDNGSGVLEG

SEQ ID NO: 157946 - protein, 13 aa, Borrelia afzelii
SDKDNGSGVLEGT

SEQ ID NO: 157947 - protein, 13 aa, Borrelia afzelii
DKDNGSGVLEGTK

SEQ ID NO: 157948 - protein, 13 aa, Borrelia afzelii
KDNGSGVLEGTKD

SEQ ID NO: 157949 - protein, 13 aa, Borrelia afzelii
DNGSGVLEGTKDD

SEQ ID NO: 157950 - protein, 13 aa, Borrelia afzelii
NGSGVLEGTKDDK

SEQ ID NO: 157951 - protein, 13 aa, Borrelia afzelii
GSGVLEGTKDDKS

SEQ ID NO: 157952 - protein, 13 aa, Borrelia afzelii
SGVLEGTKDDKSK

SEQ ID NO: 157953 - protein, 13 aa, Borrelia afzelii
GVLEGTKDDKSKA

SEQ ID NO: 157954 - protein, 13 aa, Borrelia afzelii
VLEGTKDDKSKAK

SEQ ID NO: 157955 - protein, 13 aa, Borrelia afzelii
LEGTKDDKSKAKL

SEQ ID NO: 157956 - protein, 13 aa, Borrelia afzelii
EGTKDDKSKAKLT

SEQ ID NO: 157957 - protein, 13 aa, Borrelia afzelii
GTKDDKSKAKLTI

SEQ ID NO: 157958 - protein, 13 aa, Borrelia afzelii
TKDDKSKAKLTIA

SEQ ID NO: 157959 - protein, 13 aa, Borrelia afzelii
KDDKSKAKLTIAD

SEQ ID NO: 157960 - protein, 13 aa, Borrelia afzelii
DDKSKAKLTIADD

SEQ ID NO: 157961 - protein, 13 aa, Borrelia afzelii
DKSKAKLTIADDL

SEQ ID NO: 157962 - protein, 13 aa, Borrelia afzelii
KSKAKLTIADDLS

SEQ ID NO: 157963 - protein, 13 aa, Borrelia afzelii
SKAKLTIADDLSK

SEQ ID NO: 157964 - protein, 13 aa, Borrelia afzelii
KAKLTIADDLSKT

SEQ ID NO: 157965 - protein, 13 aa, Borrelia afzelii
AKLTIADDLSKTT

SEQ ID NO: 157966 - protein, 13 aa, Borrelia afzelii
KLTIADDLSKTTF

SEQ ID NO: 157967 - protein, 13 aa, Borrelia afzelii
LTIADDLSKTTFE

SEQ ID NO: 157968 - protein, 13 aa, Borrelia afzelii
TIADDLSKTTFEL

SEQ ID NO: 157969 - protein, 13 aa, Borrelia afzelii
IADDLSKTTFELF

SEQ ID NO: 157970 - protein, 13 aa, Borrelia afzelii
ADDLSKTTFELFK

SEQ ID NO: 157971 - protein, 13 aa, Borrelia afzelii
DDLSKTTFELFKE

SEQ ID NO: 157972 - protein, 13 aa, Borrelia afzelii
DLSKTTFELFKED

SEQ ID NO: 157973 - protein, 13 aa, Borrelia afzelii
LSKTTFELFKEDG

SEQ ID NO: 157974 - protein, 13 aa, Borrelia afzelii
SKTTFELFKEDGK

SEQ ID NO: 157975 - protein, 13 aa, Borrelia afzelii
KTTFELFKEDGKT

SEQ ID NO: 157976 - protein, 13 aa, Borrelia afzelii
TTFELFKEDGKTL

SEQ ID NO: 157977 - protein, 13 aa, Borrelia afzelii
TFELFKEDGKTLV

SEQ ID NO: 157978 - protein, 13 aa, Borrelia afzelii
FELFKEDGKTLVS

SEQ ID NO: 157979 - protein, 13 aa, Borrelia afzelii
ELFKEDGKTLVSR

SEQ ID NO: 157980 - protein, 13 aa, Borrelia afzelii
LFKEDGKTLVSRK

SEQ ID NO: 157981 - protein, 13 aa, Borrelia afzelii
FKEDGKTLVSRKV

SEQ ID NO: 157982 - protein, 13 aa, Borrelia afzelii
KEDGKTLVSRKVS

SEQ ID NO: 157983 - protein, 13 aa, Borrelia afzelii
EDGKTLVSRKVSS

SEQ ID NO: 157984 - protein, 13 aa, Borrelia afzelii
DGKTLVSRKVSSK

SEQ ID NO: 157985 - protein, 13 aa, Borrelia afzelii
GKTLVSRKVSSKD

SEQ ID NO: 157986 - protein, 13 aa, Borrelia afzelii
KTLVSRKVSSKDK

SEQ ID NO: 157987 - protein, 13 aa, Borrelia afzelii
TLVSRKVSSKDKT

SEQ ID NO: 157988 - protein, 13 aa, Borrelia afzelii
LVSRKVSSKDKTS

SEQ ID NO: 157989 - protein, 13 aa, Borrelia afzelii
VSRKVSSKDKTST

SEQ ID NO: 157990 - protein, 13 aa, Borrelia afzelii
SRKVSSKDKTSTD

SEQ ID NO: 157991 - protein, 13 aa, Borrelia afzelii
RKVSSKDKTSTDE

SEQ ID NO: 157992 - protein, 13 aa, Borrelia afzelii
KVSSKDKTSTDEM

SEQ ID NO: 157993 - protein, 13 aa, Borrelia afzelii
VSSKDKTSTDEMF

SEQ ID NO: 157994 - protein, 13 aa, Borrelia afzelii
SSKDKTSTDEMFN

SEQ ID NO: 157995 - protein, 13 aa, Borrelia afzelii
SKDKTSTDEMFNE

SEQ ID NO: 157996 - protein, 13 aa, Borrelia afzelii
KDKTSTDEMFNEK

SEQ ID NO: 157997 - protein, 13 aa, Borrelia afzelii
DKTSTDEMFNEKG

SEQ ID NO: 157998 - protein, 13 aa, Borrelia afzelii
KTSTDEMFNEKGE

SEQ ID NO: 157999 - protein, 13 aa, Borrelia afzelii
TSTDEMFNEKGEL

SEQ ID NO: 158000 - protein, 13 aa, Borrelia afzelii
STDEMFNEKGELS

SEQ ID NO: 158001 - protein, 13 aa, Borrelia afzelii
TDEMFNEKGELSA

SEQ ID NO: 158002 - protein, 13 aa, Borrelia afzelii
DEMFNEKGELSAK

SEQ ID NO: 158003 - protein, 13 aa, Borrelia afzelii
EMFNEKGELSAKT

SEQ ID NO: 158004 - protein, 13 aa, Borrelia afzelii
MFNEKGELSAKTM

SEQ ID NO: 158005 - protein, 13 aa, Borrelia afzelii
FNEKGELSAKTMT

SEQ ID NO: 158006 - protein, 13 aa, Borrelia afzelii
NEKGELSAKTMTR

SEQ ID NO: 158007 - protein, 13 aa, Borrelia afzelii
EKGELSAKTMTRE

SEQ ID NO: 158008 - protein, 13 aa, Borrelia afzelii
KGELSAKTMTREN

SEQ ID NO: 158009 - protein, 13 aa, Borrelia afzelii
GELSAKTMTRENG

SEQ ID NO: 158010 - protein, 13 aa, Borrelia afzelii
ELSAKTMTRENGT

SEQ ID NO: 158011 - protein, 13 aa, Borrelia afzelii
LSAKTMTRENGTK

SEQ ID NO: 158012 - protein, 13 aa, Borrelia afzelii
SAKTMTRENGTKL

SEQ ID NO: 158013 - protein, 13 aa, Borrelia afzelii
AKTMTRENGTKLE

SEQ ID NO: 158014 - protein, 13 aa, Borrelia afzelii
KTMTRENGTKLEY

SEQ ID NO: 158015 - protein, 13 aa, Borrelia afzelii
TMTRENGTKLEYT

SEQ ID NO: 158016 - protein, 13 aa, Borrelia afzelii
MTRENGTKLEYTE

SEQ ID NO: 158017 - protein, 13 aa, Borrelia afzelii
TRENGTKLEYTEM

SEQ ID NO: 158018 - protein, 13 aa, Borrelia afzelii
RENGTKLEYTEMK

SEQ ID NO: 158019 - protein, 13 aa, Borrelia afzelii
ENGTKLEYTEMKS

SEQ ID NO: 158020 - protein, 13 aa, Borrelia afzelii
NGTKLEYTEMKSD

SEQ ID NO: 158021 - protein, 13 aa, Borrelia afzelii
GTKLEYTEMKSDG

SEQ ID NO: 158022 - protein, 13 aa, Borrelia afzelii
TKLEYTEMKSDGT

SEQ ID NO: 158023 - protein, 13 aa, Borrelia afzelii
KLEYTEMKSDGTG

SEQ ID NO: 158024 - protein, 13 aa, Borrelia afzelii
LEYTEMKSDGTGK

SEQ ID NO: 158025 - protein, 13 aa, Borrelia afzelii
EYTEMKSDGTGKA

SEQ ID NO: 158026 - protein, 13 aa, Borrelia afzelii
YTEMKSDGTGKAK

SEQ ID NO: 158027 - protein, 13 aa, Borrelia afzelii
TEMKSDGTGKAKE

SEQ ID NO: 158028 - protein, 13 aa, Borrelia afzelii
EMKSDGTGKAKEV

SEQ ID NO: 158029 - protein, 13 aa, Borrelia afzelii
MKSDGTGKAKEVL

SEQ ID NO: 158030 - protein, 13 aa, Borrelia afzelii
KSDGTGKAKEVLK

SEQ ID NO: 158031 - protein, 13 aa, Borrelia afzelii
SDGTGKAKEVLKN

SEQ ID NO: 158032 - protein, 13 aa, Borrelia afzelii
DGTGKAKEVLKNF

SEQ ID NO: 158033 - protein, 13 aa, Borrelia afzelii
GTGKAKEVLKNFT

SEQ ID NO: 158034 - protein, 13 aa, Borrelia afzelii
TGKAKEVLKNFTL

SEQ ID NO: 158035 - protein, 13 aa, Borrelia afzelii
GKAKEVLKNFTLE

SEQ ID NO: 158036 - protein, 13 aa, Borrelia afzelii
KAKEVLKNFTLEG

SEQ ID NO: 158037 - protein, 13 aa, Borrelia afzelii
AKEVLKNFTLEGK

SEQ ID NO: 158038 - protein, 13 aa, Borrelia afzelii
KEVLKNFTLEGKV

SEQ ID NO: 158039 - protein, 13 aa, Borrelia afzelii
EVLKNFTLEGKVA

SEQ ID NO: 158040 - protein, 13 aa, Borrelia afzelii
VLKNFTLEGKVAN

SEQ ID NO: 158041 - protein, 13 aa, Borrelia afzelii
LKNFTLEGKVAND

SEQ ID NO: 158042 - protein, 13 aa, Borrelia afzelii
KNFTLEGKVANDK

SEQ ID NO: 158043 - protein, 13 aa, Borrelia afzelii
NFTLEGKVANDKV

SEQ ID NO: 158044 - protein, 13 aa, Borrelia afzelii
FTLEGKVANDKVT

SEQ ID NO: 158045 - protein, 13 aa, Borrelia afzelii
TLEGKVANDKVTL

SEQ ID NO: 158046 - protein, 13 aa, Borrelia afzelii
LEGKVANDKVTLE

SEQ ID NO: 158047 - protein, 13 aa, Borrelia afzelii
EGKVANDKVTLEV

SEQ ID NO: 158048 - protein, 13 aa, Borrelia afzelii
GKVANDKVTLEVK

SEQ ID NO: 158049 - protein, 13 aa, Borrelia afzelii
KVANDKVTLEVKE

SEQ ID NO: 158050 - protein, 13 aa, Borrelia afzelii
VANDKVTLEVKEG

SEQ ID NO: 158051 - protein, 13 aa, Borrelia afzelii
ANDKVTLEVKEGT

SEQ ID NO: 158052 - protein, 13 aa, Borrelia afzelii
NDKVTLEVKEGTV

SEQ ID NO: 158053 - protein, 13 aa, Borrelia afzelii
DKVTLEVKEGTVT

SEQ ID NO: 158054 - protein, 13 aa, Borrelia afzelii
KVTLEVKEGTVTL

SEQ ID NO: 158055 - protein, 13 aa, Borrelia afzelii
VTLEVKEGTVTLS

SEQ ID NO: 158056 - protein, 13 aa, Borrelia afzelii
TLEVKEGTVTLSK

SEQ ID NO: 158057 - protein, 13 aa, Borrelia afzelii
LEVKEGTVTLSKE

SEQ ID NO: 158058 - protein, 13 aa, Borrelia afzelii
EVKEGTVTLSKEI

SEQ ID NO: 158059 - protein, 13 aa, Borrelia afzelii
VKEGTVTLSKEIA

SEQ ID NO: 158060 - protein, 13 aa, Borrelia afzelii
KEGTVTLSKEIAK

SEQ ID NO: 158061 - protein, 13 aa, Borrelia afzelii
EGTVTLSKEIAKS

SEQ ID NO: 158062 - protein, 13 aa, Borrelia afzelii
GTVTLSKEIAKSG

SEQ ID NO: 158063 - protein, 13 aa, Borrelia afzelii
TVTLSKEIAKSGE

SEQ ID NO: 158064 - protein, 13 aa, Borrelia afzelii
VTLSKEIAKSGEV

SEQ ID NO: 158065 - protein, 13 aa, Borrelia afzelii
TLSKEIAKSGEVT

SEQ ID NO: 158066 - protein, 13 aa, Borrelia afzelii
LSKEIAKSGEVTV

SEQ ID NO: 158067 - protein, 13 aa, Borrelia afzelii
SKEIAKSGEVTVA

SEQ ID NO: 158068 - protein, 13 aa, Borrelia afzelii
KEIAKSGEVTVAL

SEQ ID NO: 158069 - protein, 13 aa, Borrelia afzelii
EIAKSGEVTVALN

SEQ ID NO: 158070 - protein, 13 aa, Borrelia afzelii
IAKSGEVTVALND

SEQ ID NO: 158071 - protein, 13 aa, Borrelia afzelii
AKSGEVTVALNDT

SEQ ID NO: 158072 - protein, 13 aa, Borrelia afzelii
KSGEVTVALNDTN

SEQ ID NO: 158073 - protein, 13 aa, Borrelia afzelii
SGEVTVALNDTNT

SEQ ID NO: 158074 - protein, 13 aa, Borrelia afzelii
GEVTVALNDTNTT

SEQ ID NO: 158075 - protein, 13 aa, Borrelia afzelii
EVTVALNDTNTTQ

SEQ ID NO: 158076 - protein, 13 aa, Borrelia afzelii
VTVALNDTNTTQA

SEQ ID NO: 158077 - protein, 13 aa, Borrelia afzelii
TVALNDTNTTQAT

SEQ ID NO: 158078 - protein, 13 aa, Borrelia afzelii
VALNDTNTTQATK

SEQ ID NO: 158079 - protein, 13 aa, Borrelia afzelii
ALNDTNTTQATKK

SEQ ID NO: 158080 - protein, 13 aa, Borrelia afzelii
LNDTNTTQATKKT

SEQ ID NO: 158081 - protein, 13 aa, Borrelia afzelii
NDTNTTQATKKTG

SEQ ID NO: 158082 - protein, 13 aa, Borrelia afzelii
DTNTTQATKKTGA

SEQ ID NO: 158083 - protein, 13 aa, Borrelia afzelii
TNTTQATKKTGAW

SEQ ID NO: 158084 - protein, 13 aa, Borrelia afzelii
NTTQATKKTGAWD

SEQ ID NO: 158085 - protein, 13 aa, Borrelia afzelii
TTQATKKTGAWDS

SEQ ID NO: 158086 - protein, 13 aa, Borrelia afzelii
TQATKKTGAWDSK

SEQ ID NO: 158087 - protein, 13 aa, Borrelia afzelii
QATKKTGAWDSKT

SEQ ID NO: 158088 - protein, 13 aa, Borrelia afzelii
ATKKTGAWDSKTS

SEQ ID NO: 158089 - protein, 13 aa, Borrelia afzelii
TKKTGAWDSKTST

SEQ ID NO: 158090 - protein, 13 aa, Borrelia afzelii
KKTGAWDSKTSTL

SEQ ID NO: 158091 - protein, 13 aa, Borrelia afzelii
KTGAWDSKTSTLT

SEQ ID NO: 158092 - protein, 13 aa, Borrelia afzelii
TGAWDSKTSTLTI

SEQ ID NO: 158093 - protein, 13 aa, Borrelia afzelii
GAWDSKTSTLTIS

SEQ ID NO: 158094 - protein, 13 aa, Borrelia afzelii
AWDSKTSTLTISV

SEQ ID NO: 158095 - protein, 13 aa, Borrelia afzelii
WDSKTSTLTISVN

SEQ ID NO: 158096 - protein, 13 aa, Borrelia afzelii
DSKTSTLTISVNS

SEQ ID NO: 158097 - protein, 13 aa, Borrelia afzelii
SKTSTLTISVNSK

SEQ ID NO: 158098 - protein, 13 aa, Borrelia afzelii
KTSTLTISVNSKK

SEQ ID NO: 158099 - protein, 13 aa, Borrelia afzelii
TSTLTISVNSKKT

SEQ ID NO: 158100 - protein, 13 aa, Borrelia afzelii
STLTISVNSKKTT

SEQ ID NO: 158101 - protein, 13 aa, Borrelia afzelii
TLTISVNSKKTTQ

SEQ ID NO: 158102 - protein, 13 aa, Borrelia afzelii
LTISVNSKKTTQL

SEQ ID NO: 158103 - protein, 13 aa, Borrelia afzelii
TISVNSKKTTQLV

SEQ ID NO: 158104 - protein, 13 aa, Borrelia afzelii
ISVNSKKTTQLVF

SEQ ID NO: 158105 - protein, 13 aa, Borrelia afzelii
SVNSKKTTQLVFT

SEQ ID NO: 158106 - protein, 13 aa, Borrelia afzelii
VNSKKTTQLVFTK

SEQ ID NO: 158107 - protein, 13 aa, Borrelia afzelii
NSKKTTQLVFTKQ

SEQ ID NO: 158108 - protein, 13 aa, Borrelia afzelii
SKKTTQLVFTKQD

SEQ ID NO: 158109 - protein, 13 aa, Borrelia afzelii
KKTTQLVFTKQDT

SEQ ID NO: 158110 - protein, 13 aa, Borrelia afzelii
KTTQLVFTKQDTI

SEQ ID NO: 158111 - protein, 13 aa, Borrelia afzelii
TTQLVFTKQDTIT

SEQ ID NO: 158112 - protein, 13 aa, Borrelia afzelii
TQLVFTKQDTITV

SEQ ID NO: 158113 - protein, 13 aa, Borrelia afzelii
QLVFTKQDTITVQ

SEQ ID NO: 158114 - protein, 13 aa, Borrelia afzelii
LVFTKQDTITVQK

SEQ ID NO: 158115 - protein, 13 aa, Borrelia afzelii
VFTKQDTITVQKY

SEQ ID NO: 158116 - protein, 13 aa, Borrelia afzelii
FTKQDTITVQKYD

SEQ ID NO: 158117 - protein, 13 aa, Borrelia afzelii
TKQDTITVQKYDS

SEQ ID NO: 158118 - protein, 13 aa, Borrelia afzelii
KQDTITVQKYDSA

SEQ ID NO: 158119 - protein, 13 aa, Borrelia afzelii
QDTITVQKYDSAG

SEQ ID NO: 158120 - protein, 13 aa, Borrelia afzelii
DTITVQKYDSAGT

SEQ ID NO: 158121 - protein, 13 aa, Borrelia afzelii
TITVQKYDSAGTN

SEQ ID NO: 158122 - protein, 13 aa, Borrelia afzelii
ITVQKYDSAGTNL

SEQ ID NO: 158123 - protein, 13 aa, Borrelia afzelii
TVQKYDSAGTNLE

SEQ ID NO: 158124 - protein, 13 aa, Borrelia afzelii
VQKYDSAGTNLEG

SEQ ID NO: 158125 - protein, 13 aa, Borrelia afzelii
QKYDSAGTNLEGT

SEQ ID NO: 158126 - protein, 13 aa, Borrelia afzelii
KYDSAGTNLEGTA

SEQ ID NO: 158127 - protein, 13 aa, Borrelia afzelii
YDSAGTNLEGTAV

SEQ ID NO: 158128 - protein, 13 aa, Borrelia afzelii
DSAGTNLEGTAVE

SEQ ID NO: 158129 - protein, 13 aa, Borrelia afzelii
SAGTNLEGTAVEI

SEQ ID NO: 158130 - protein, 13 aa, Borrelia afzelii
AGTNLEGTAVEIK

SEQ ID NO: 158131 - protein, 13 aa, Borrelia afzelii
GTNLEGTAVEIKT

SEQ ID NO: 158132 - protein, 13 aa, Borrelia afzelii
TNLEGTAVEIKTL

SEQ ID NO: 158133 - protein, 13 aa, Borrelia afzelii
NLEGTAVEIKTLD

SEQ ID NO: 158134 - protein, 13 aa, Borrelia afzelii
LEGTAVEIKTLDE

SEQ ID NO: 158135 - protein, 13 aa, Borrelia afzelii
EGTAVEIKTLDEL

SEQ ID NO: 158136 - protein, 13 aa, Borrelia afzelii
GTAVEIKTLDELK

SEQ ID NO: 158137 - protein, 13 aa, Borrelia afzelii
TAVEIKTLDELKN

SEQ ID NO: 158138 - protein, 13 aa, Borrelia afzelii
AVEIKTLDELKNA

SEQ ID NO: 158139 - protein, 13 aa, Borrelia afzelii
VEIKTLDELKNAL

SEQ ID NO: 158140 - protein, 13 aa, Borrelia afzelii
EIKTLDELKNALK

SEQ ID NO: 158141 - protein, 14 aa, Borrelia afzelii
MKKYLLGIGLILAL

SEQ ID NO: 158142 - protein, 14 aa, Borrelia afzelii
KKYLLGIGLILALI

SEQ ID NO: 158143 - protein, 14 aa, Borrelia afzelii
KYLLGIGLILALIA

SEQ ID NO: 158144 - protein, 14 aa, Borrelia afzelii
YLLGIGLILALIAC

SEQ ID NO: 158145 - protein, 14 aa, Borrelia afzelii
LLGIGLILALIACK

SEQ ID NO: 158146 - protein, 14 aa, Borrelia afzelii
LGIGLILALIACKQ

SEQ ID NO: 158147 - protein, 14 aa, Borrelia afzelii
GIGLILALIACKQN

SEQ ID NO: 158148 - protein, 14 aa, Borrelia afzelii
IGLILALIACKQNV

SEQ ID NO: 158149 - protein, 14 aa, Borrelia afzelii
GLILALIACKQNVS

SEQ ID NO: 158150 - protein, 14 aa, Borrelia afzelii
LILALIACKQNVSS

SEQ ID NO: 158151 - protein, 14 aa, Borrelia afzelii
ILALIACKQNVSSL

SEQ ID NO: 158152 - protein, 14 aa, Borrelia afzelii
LALIACKQNVSSLD

SEQ ID NO: 158153 - protein, 14 aa, Borrelia afzelii
ALIACKQNVSSLDE

SEQ ID NO: 158154 - protein, 14 aa, Borrelia afzelii
LIACKQNVSSLDEK

SEQ ID NO: 158155 - protein, 14 aa, Borrelia afzelii
IACKQNVSSLDEKN

SEQ ID NO: 158156 - protein, 14 aa, Borrelia afzelii
ACKQNVSSLDEKNS

SEQ ID NO: 158157 - protein, 14 aa, Borrelia afzelii
CKQNVSSLDEKNSA

SEQ ID NO: 158158 - protein, 14 aa, Borrelia afzelii
KQNVSSLDEKNSAS

SEQ ID NO: 158159 - protein, 14 aa, Borrelia afzelii
QNVSSLDEKNSASV

SEQ ID NO: 158160 - protein, 14 aa, Borrelia afzelii
NVSSLDEKNSASVD

SEQ ID NO: 158161 - protein, 14 aa, Borrelia afzelii
VSSLDEKNSASVDL

SEQ ID NO: 158162 - protein, 14 aa, Borrelia afzelii
SSLDEKNSASVDLP

SEQ ID NO: 158163 - protein, 14 aa, Borrelia afzelii
SLDEKNSASVDLPG

SEQ ID NO: 158164 - protein, 14 aa, Borrelia afzelii
LDEKNSASVDLPGE

SEQ ID NO: 158165 - protein, 14 aa, Borrelia afzelii
DEKNSASVDLPGEM

SEQ ID NO: 158166 - protein, 14 aa, Borrelia afzelii
EKNSASVDLPGEMK

SEQ ID NO: 158167 - protein, 14 aa, Borrelia afzelii
KNSASVDLPGEMKV

SEQ ID NO: 158168 - protein, 14 aa, Borrelia afzelii
NSASVDLPGEMKVL

SEQ ID NO: 158169 - protein, 14 aa, Borrelia afzelii
SASVDLPGEMKVLV

SEQ ID NO: 158170 - protein, 14 aa, Borrelia afzelii
ASVDLPGEMKVLVS

SEQ ID NO: 158171 - protein, 14 aa, Borrelia afzelii
SVDLPGEMKVLVSK

SEQ ID NO: 158172 - protein, 14 aa, Borrelia afzelii
VDLPGEMKVLVSKE

SEQ ID NO: 158173 - protein, 14 aa, Borrelia afzelii
DLPGEMKVLVSKEK

SEQ ID NO: 158174 - protein, 14 aa, Borrelia afzelii
LPGEMKVLVSKEKD

SEQ ID NO: 158175 - protein, 14 aa, Borrelia afzelii
PGEMKVLVSKEKDK

SEQ ID NO: 158176 - protein, 14 aa, Borrelia afzelii
GEMKVLVSKEKDKD

SEQ ID NO: 158177 - protein, 14 aa, Borrelia afzelii
EMKVLVSKEKDKDG

SEQ ID NO: 158178 - protein, 14 aa, Borrelia afzelii
MKVLVSKEKDKDGK

SEQ ID NO: 158179 - protein, 14 aa, Borrelia afzelii
KVLVSKEKDKDGKY

SEQ ID NO: 158180 - protein, 14 aa, Borrelia afzelii
VLVSKEKDKDGKYS

SEQ ID NO: 158181 - protein, 14 aa, Borrelia afzelii
LVSKEKDKDGKYSL

SEQ ID NO: 158182 - protein, 14 aa, Borrelia afzelii
VSKEKDKDGKYSLK

SEQ ID NO: 158183 - protein, 14 aa, Borrelia afzelii
SKEKDKDGKYSLKA

SEQ ID NO: 158184 - protein, 14 aa, Borrelia afzelii
KEKDKDGKYSLKAT

SEQ ID NO: 158185 - protein, 14 aa, Borrelia afzelii
EKDKDGKYSLKATV

SEQ ID NO: 158186 - protein, 14 aa, Borrelia afzelii
KDKDGKYSLKATVD

SEQ ID NO: 158187 - protein, 14 aa, Borrelia afzelii
DKDGKYSLKATVDK

SEQ ID NO: 158188 - protein, 14 aa, Borrelia afzelii
KDGKYSLKATVDKI

SEQ ID NO: 158189 - protein, 14 aa, Borrelia afzelii
DGKYSLKATVDKIE

SEQ ID NO: 158190 - protein, 14 aa, Borrelia afzelii
GKYSLKATVDKIEL

SEQ ID NO: 158191 - protein, 14 aa, Borrelia afzelii
KYSLKATVDKIELK

SEQ ID NO: 158192 - protein, 14 aa, Borrelia afzelii
YSLKATVDKIELKG

SEQ ID NO: 158193 - protein, 14 aa, Borrelia afzelii
SLKATVDKIELKGT

SEQ ID NO: 158194 - protein, 14 aa, Borrelia afzelii
LKATVDKIELKGTS

SEQ ID NO: 158195 - protein, 14 aa, Borrelia afzelii
KATVDKIELKGTSD

SEQ ID NO: 158196 - protein, 14 aa, Borrelia afzelii
ATVDKIELKGTSDK

SEQ ID NO: 158197 - protein, 14 aa, Borrelia afzelii
TVDKIELKGTSDKD

SEQ ID NO: 158198 - protein, 14 aa, Borrelia afzelii
VDKIELKGTSDKDN

SEQ ID NO: 158199 - protein, 14 aa, Borrelia afzelii
DKIELKGTSDKDNG

SEQ ID NO: 158200 - protein, 14 aa, Borrelia afzelii
KIELKGTSDKDNGS

SEQ ID NO: 158201 - protein, 14 aa, Borrelia afzelii
IELKGTSDKDNGSG

SEQ ID NO: 158202 - protein, 14 aa, Borrelia afzelii
ELKGTSDKDNGSGV

SEQ ID NO: 158203 - protein, 14 aa, Borrelia afzelii
LKGTSDKDNGSGVL

SEQ ID NO: 158204 - protein, 14 aa, Borrelia afzelii
KGTSDKDNGSGVLE

SEQ ID NO: 158205 - protein, 14 aa, Borrelia afzelii
GTSDKDNGSGVLEG

SEQ ID NO: 158206 - protein, 14 aa, Borrelia afzelii
TSDKDNGSGVLEGT

SEQ ID NO: 158207 - protein, 14 aa, Borrelia afzelii
SDKDNGSGVLEGTK

SEQ ID NO: 158208 - protein, 14 aa, Borrelia afzelii
DKDNGSGVLEGTKD

SEQ ID NO: 158209 - protein, 14 aa, Borrelia afzelii
KDNGSGVLEGTKDD

SEQ ID NO: 158210 - protein, 14 aa, Borrelia afzelii
DNGSGVLEGTKDDK

SEQ ID NO: 158211 - protein, 14 aa, Borrelia afzelii
NGSGVLEGTKDDKS

SEQ ID NO: 158212 - protein, 14 aa, Borrelia afzelii
GSGVLEGTKDDKSK

SEQ ID NO: 158213 - protein, 14 aa, Borrelia afzelii
SGVLEGTKDDKSKA

SEQ ID NO: 158214 - protein, 14 aa, Borrelia afzelii
GVLEGTKDDKSKAK

SEQ ID NO: 158215 - protein, 14 aa, Borrelia afzelii
VLEGTKDDKSKAKL

SEQ ID NO: 158216 - protein, 14 aa, Borrelia afzelii
LEGTKDDKSKAKLT

SEQ ID NO: 158217 - protein, 14 aa, Borrelia afzelii
EGTKDDKSKAKLTI

SEQ ID NO: 158218 - protein, 14 aa, Borrelia afzelii
GTKDDKSKAKLTIA

SEQ ID NO: 158219 - protein, 14 aa, Borrelia afzelii
TKDDKSKAKLTIAD

SEQ ID NO: 158220 - protein, 14 aa, Borrelia afzelii
KDDKSKAKLTIADD

SEQ ID NO: 158221 - protein, 14 aa, Borrelia afzelii
DDKSKAKLTIADDL

SEQ ID NO: 158222 - protein, 14 aa, Borrelia afzelii
DKSKAKLTIADDLS

SEQ ID NO: 158223 - protein, 14 aa, Borrelia afzelii
KSKAKLTIADDLSK

SEQ ID NO: 158224 - protein, 14 aa, Borrelia afzelii
SKAKLTIADDLSKT

SEQ ID NO: 158225 - protein, 14 aa, Borrelia afzelii
KAKLTIADDLSKTT

SEQ ID NO: 158226 - protein, 14 aa, Borrelia afzelii
AKLTIADDLSKTTF

SEQ ID NO: 158227 - protein, 14 aa, Borrelia afzelii
KLTIADDLSKTTFE

SEQ ID NO: 158228 - protein, 14 aa, Borrelia afzelii
LTIADDLSKTTFEL

SEQ ID NO: 158229 - protein, 14 aa, Borrelia afzelii
TIADDLSKTTFELF

SEQ ID NO: 158230 - protein, 14 aa, Borrelia afzelii
IADDLSKTTFELFK

SEQ ID NO: 158231 - protein, 14 aa, Borrelia afzelii
ADDLSKTTFELFKE

SEQ ID NO: 158232 - protein, 14 aa, Borrelia afzelii
DDLSKTTFELFKED

SEQ ID NO: 158233 - protein, 14 aa, Borrelia afzelii
DLSKTTFELFKEDG

SEQ ID NO: 158234 - protein, 14 aa, Borrelia afzelii
LSKTTFELFKEDGK

SEQ ID NO: 158235 - protein, 14 aa, Borrelia afzelii
SKTTFELFKEDGKT

SEQ ID NO: 158236 - protein, 14 aa, Borrelia afzelii
KTTFELFKEDGKTL

SEQ ID NO: 158237 - protein, 14 aa, Borrelia afzelii
TTFELFKEDGKTLV

SEQ ID NO: 158238 - protein, 14 aa, Borrelia afzelii
TFELFKEDGKTLVS

SEQ ID NO: 158239 - protein, 14 aa, Borrelia afzelii
FELFKEDGKTLVSR

SEQ ID NO: 158240 - protein, 14 aa, Borrelia afzelii
ELFKEDGKTLVSRK

SEQ ID NO: 158241 - protein, 14 aa, Borrelia afzelii
LFKEDGKTLVSRKV

SEQ ID NO: 158242 - protein, 14 aa, Borrelia afzelii
FKEDGKTLVSRKVS

SEQ ID NO: 158243 - protein, 14 aa, Borrelia afzelii
KEDGKTLVSRKVSS

SEQ ID NO: 158244 - protein, 14 aa, Borrelia afzelii
EDGKTLVSRKVSSK

SEQ ID NO: 158245 - protein, 14 aa, Borrelia afzelii
DGKTLVSRKVSSKD

SEQ ID NO: 158246 - protein, 14 aa, Borrelia afzelii
GKTLVSRKVSSKDK

SEQ ID NO: 158247 - protein, 14 aa, Borrelia afzelii
KTLVSRKVSSKDKT

SEQ ID NO: 158248 - protein, 14 aa, Borrelia afzelii
TLVSRKVSSKDKTS

SEQ ID NO: 158249 - protein, 14 aa, Borrelia afzelii
LVSRKVSSKDKTST

SEQ ID NO: 158250 - protein, 14 aa, Borrelia afzelii
VSRKVSSKDKTSTD

SEQ ID NO: 158251 - protein, 14 aa, Borrelia afzelii
SRKVSSKDKTSTDE

SEQ ID NO: 158252 - protein, 14 aa, Borrelia afzelii
RKVSSKDKTSTDEM

SEQ ID NO: 158253 - protein, 14 aa, Borrelia afzelii
KVSSKDKTSTDEMF

SEQ ID NO: 158254 - protein, 14 aa, Borrelia afzelii
VSSKDKTSTDEMFN

SEQ ID NO: 158255 - protein, 14 aa, Borrelia afzelii
SSKDKTSTDEMFNE

SEQ ID NO: 158256 - protein, 14 aa, Borrelia afzelii
SKDKTSTDEMFNEK

SEQ ID NO: 158257 - protein, 14 aa, Borrelia afzelii
KDKTSTDEMFNEKG

SEQ ID NO: 158258 - protein, 14 aa, Borrelia afzelii
DKTSTDEMFNEKGE

SEQ ID NO: 158259 - protein, 14 aa, Borrelia afzelii
KTSTDEMFNEKGEL

SEQ ID NO: 158260 - protein, 14 aa, Borrelia afzelii
TSTDEMFNEKGELS

SEQ ID NO: 158261 - protein, 14 aa, Borrelia afzelii
STDEMFNEKGELSA

SEQ ID NO: 158262 - protein, 14 aa, Borrelia afzelii
TDEMFNEKGELSAK

SEQ ID NO: 158263 - protein, 14 aa, Borrelia afzelii
DEMFNEKGELSAKT

SEQ ID NO: 158264 - protein, 14 aa, Borrelia afzelii
EMFNEKGELSAKTM

SEQ ID NO: 158265 - protein, 14 aa, Borrelia afzelii
MFNEKGELSAKTMT

SEQ ID NO: 158266 - protein, 14 aa, Borrelia afzelii
FNEKGELSAKTMTR

SEQ ID NO: 158267 - protein, 14 aa, Borrelia afzelii
NEKGELSAKTMTRE

SEQ ID NO: 158268 - protein, 14 aa, Borrelia afzelii
EKGELSAKTMTREN

SEQ ID NO: 158269 - protein, 14 aa, Borrelia afzelii
KGELSAKTMTRENG

SEQ ID NO: 158270 - protein, 14 aa, Borrelia afzelii
GELSAKTMTRENGT

SEQ ID NO: 158271 - protein, 14 aa, Borrelia afzelii
ELSAKTMTRENGTK

SEQ ID NO: 158272 - protein, 14 aa, Borrelia afzelii
LSAKTMTRENGTKL

SEQ ID NO: 158273 - protein, 14 aa, Borrelia afzelii
SAKTMTRENGTKLE

SEQ ID NO: 158274 - protein, 14 aa, Borrelia afzelii
AKTMTRENGTKLEY

SEQ ID NO: 158275 - protein, 14 aa, Borrelia afzelii
KTMTRENGTKLEYT

SEQ ID NO: 158276 - protein, 14 aa, Borrelia afzelii
TMTRENGTKLEYTE

SEQ ID NO: 158277 - protein, 14 aa, Borrelia afzelii
MTRENGTKLEYTEM

SEQ ID NO: 158278 - protein, 14 aa, Borrelia afzelii
TRENGTKLEYTEMK

SEQ ID NO: 158279 - protein, 14 aa, Borrelia afzelii
RENGTKLEYTEMKS

SEQ ID NO: 158280 - protein, 14 aa, Borrelia afzelii
ENGTKLEYTEMKSD

SEQ ID NO: 158281 - protein, 14 aa, Borrelia afzelii
NGTKLEYTEMKSDG

SEQ ID NO: 158282 - protein, 14 aa, Borrelia afzelii
GTKLEYTEMKSDGT

SEQ ID NO: 158283 - protein, 14 aa, Borrelia afzelii
TKLEYTEMKSDGTG

SEQ ID NO: 158284 - protein, 14 aa, Borrelia afzelii
KLEYTEMKSDGTGK

SEQ ID NO: 158285 - protein, 14 aa, Borrelia afzelii
LEYTEMKSDGTGKA

SEQ ID NO: 158286 - protein, 14 aa, Borrelia afzelii
EYTEMKSDGTGKAK

SEQ ID NO: 158287 - protein, 14 aa, Borrelia afzelii
YTEMKSDGTGKAKE

SEQ ID NO: 158288 - protein, 14 aa, Borrelia afzelii
TEMKSDGTGKAKEV

SEQ ID NO: 158289 - protein, 14 aa, Borrelia afzelii
EMKSDGTGKAKEVL

SEQ ID NO: 158290 - protein, 14 aa, Borrelia afzelii
MKSDGTGKAKEVLK

SEQ ID NO: 158291 - protein, 14 aa, Borrelia afzelii
KSDGTGKAKEVLKN

SEQ ID NO: 158292 - protein, 14 aa, Borrelia afzelii
SDGTGKAKEVLKNF

SEQ ID NO: 158293 - protein, 14 aa, Borrelia afzelii
DGTGKAKEVLKNFT

SEQ ID NO: 158294 - protein, 14 aa, Borrelia afzelii
GTGKAKEVLKNFTL

SEQ ID NO: 158295 - protein, 14 aa, Borrelia afzelii
TGKAKEVLKNFTLE

SEQ ID NO: 158296 - protein, 14 aa, Borrelia afzelii
GKAKEVLKNFTLEG

SEQ ID NO: 158297 - protein, 14 aa, Borrelia afzelii
KAKEVLKNFTLEGK

SEQ ID NO: 158298 - protein, 14 aa, Borrelia afzelii
AKEVLKNFTLEGKV

SEQ ID NO: 158299 - protein, 14 aa, Borrelia afzelii
KEVLKNFTLEGKVA

SEQ ID NO: 158300 - protein, 14 aa, Borrelia afzelii
EVLKNFTLEGKVAN

SEQ ID NO: 158301 - protein, 14 aa, Borrelia afzelii
VLKNFTLEGKVAND

SEQ ID NO: 158302 - protein, 14 aa, Borrelia afzelii
LKNFTLEGKVANDK

SEQ ID NO: 158303 - protein, 14 aa, Borrelia afzelii
KNFTLEGKVANDKV

SEQ ID NO: 158304 - protein, 14 aa, Borrelia afzelii
NFTLEGKVANDKVT

SEQ ID NO: 158305 - protein, 14 aa, Borrelia afzelii
FTLEGKVANDKVTL

SEQ ID NO: 158306 - protein, 14 aa, Borrelia afzelii
TLEGKVANDKVTLE

SEQ ID NO: 158307 - protein, 14 aa, Borrelia afzelii
LEGKVANDKVTLEV

SEQ ID NO: 158308 - protein, 14 aa, Borrelia afzelii
EGKVANDKVTLEVK

SEQ ID NO: 158309 - protein, 14 aa, Borrelia afzelii
GKVANDKVTLEVKE

SEQ ID NO: 158310 - protein, 14 aa, Borrelia afzelii
KVANDKVTLEVKEG

SEQ ID NO: 158311 - protein, 14 aa, Borrelia afzelii
VANDKVTLEVKEGT

SEQ ID NO: 158312 - protein, 14 aa, Borrelia afzelii
ANDKVTLEVKEGTV

SEQ ID NO: 158313 - protein, 14 aa, Borrelia afzelii
NDKVTLEVKEGTVT

SEQ ID NO: 158314 - protein, 14 aa, Borrelia afzelii
DKVTLEVKEGTVTL

SEQ ID NO: 158315 - protein, 14 aa, Borrelia afzelii
KVTLEVKEGTVTLS

SEQ ID NO: 158316 - protein, 14 aa, Borrelia afzelii
VTLEVKEGTVTLSK

SEQ ID NO: 158317 - protein, 14 aa, Borrelia afzelii
TLEVKEGTVTLSKE

SEQ ID NO: 158318 - protein, 14 aa, Borrelia afzelii
LEVKEGTVTLSKEI

SEQ ID NO: 158319 - protein, 14 aa, Borrelia afzelii
EVKEGTVTLSKEIA

SEQ ID NO: 158320 - protein, 14 aa, Borrelia afzelii
VKEGTVTLSKEIAK

SEQ ID NO: 158321 - protein, 14 aa, Borrelia afzelii
KEGTVTLSKEIAKS

SEQ ID NO: 158322 - protein, 14 aa, Borrelia afzelii
EGTVTLSKEIAKSG

SEQ ID NO: 158323 - protein, 14 aa, Borrelia afzelii
GTVTLSKEIAKSGE

SEQ ID NO: 158324 - protein, 14 aa, Borrelia afzelii
TVTLSKEIAKSGEV

SEQ ID NO: 158325 - protein, 14 aa, Borrelia afzelii
VTLSKEIAKSGEVT

SEQ ID NO: 158326 - protein, 14 aa, Borrelia afzelii
TLSKEIAKSGEVTV

SEQ ID NO: 158327 - protein, 14 aa, Borrelia afzelii
LSKEIAKSGEVTVA

SEQ ID NO: 158328 - protein, 14 aa, Borrelia afzelii
SKEIAKSGEVTVAL

SEQ ID NO: 158329 - protein, 14 aa, Borrelia afzelii
KEIAKSGEVTVALN

SEQ ID NO: 158330 - protein, 14 aa, Borrelia afzelii
EIAKSGEVTVALND

SEQ ID NO: 158331 - protein, 14 aa, Borrelia afzelii
IAKSGEVTVALNDT

SEQ ID NO: 158332 - protein, 14 aa, Borrelia afzelii
AKSGEVTVALNDTN

SEQ ID NO: 158333 - protein, 14 aa, Borrelia afzelii
KSGEVTVALNDTNT

SEQ ID NO: 158334 - protein, 14 aa, Borrelia afzelii
SGEVTVALNDTNTT

SEQ ID NO: 158335 - protein, 14 aa, Borrelia afzelii
GEVTVALNDTNTTQ

SEQ ID NO: 158336 - protein, 14 aa, Borrelia afzelii
EVTVALNDTNTTQA

SEQ ID NO: 158337 - protein, 14 aa, Borrelia afzelii
VTVALNDTNTTQAT

SEQ ID NO: 158338 - protein, 14 aa, Borrelia afzelii
TVALNDTNTTQATK

SEQ ID NO: 158339 - protein, 14 aa, Borrelia afzelii
VALNDTNTTQATKK

SEQ ID NO: 158340 - protein, 14 aa, Borrelia afzelii
ALNDTNTTQATKKT

SEQ ID NO: 158341 - protein, 14 aa, Borrelia afzelii
LNDTNTTQATKKTG

SEQ ID NO: 158342 - protein, 14 aa, Borrelia afzelii
NDTNTTQATKKTGA

SEQ ID NO: 158343 - protein, 14 aa, Borrelia afzelii
DTNTTQATKKTGAW

SEQ ID NO: 158344 - protein, 14 aa, Borrelia afzelii
TNTTQATKKTGAWD

SEQ ID NO: 158345 - protein, 14 aa, Borrelia afzelii
NTTQATKKTGAWDS

SEQ ID NO: 158346 - protein, 14 aa, Borrelia afzelii
TTQATKKTGAWDSK

SEQ ID NO: 158347 - protein, 14 aa, Borrelia afzelii
TQATKKTGAWDSKT

SEQ ID NO: 158348 - protein, 14 aa, Borrelia afzelii
QATKKTGAWDSKTS

SEQ ID NO: 158349 - protein, 14 aa, Borrelia afzelii
ATKKTGAWDSKTST

SEQ ID NO: 158350 - protein, 14 aa, Borrelia afzelii
TKKTGAWDSKTSTL

SEQ ID NO: 158351 - protein, 14 aa, Borrelia afzelii
KKTGAWDSKTSTLT

SEQ ID NO: 158352 - protein, 14 aa, Borrelia afzelii
KTGAWDSKTSTLTI

SEQ ID NO: 158353 - protein, 14 aa, Borrelia afzelii
TGAWDSKTSTLTIS

SEQ ID NO: 158354 - protein, 14 aa, Borrelia afzelii
GAWDSKTSTLTISV

SEQ ID NO: 158355 - protein, 14 aa, Borrelia afzelii
AWDSKTSTLTISVN

SEQ ID NO: 158356 - protein, 14 aa, Borrelia afzelii
WDSKTSTLTISVNS

SEQ ID NO: 158357 - protein, 14 aa, Borrelia afzelii
DSKTSTLTISVNSK

SEQ ID NO: 158358 - protein, 14 aa, Borrelia afzelii
SKTSTLTISVNSKK

SEQ ID NO: 158359 - protein, 14 aa, Borrelia afzelii
KTSTLTISVNSKKT

SEQ ID NO: 158360 - protein, 14 aa, Borrelia afzelii
TSTLTISVNSKKTT

SEQ ID NO: 158361 - protein, 14 aa, Borrelia afzelii
STLTISVNSKKTTQ

SEQ ID NO: 158362 - protein, 14 aa, Borrelia afzelii
TLTISVNSKKTTQL

SEQ ID NO: 158363 - protein, 14 aa, Borrelia afzelii
LTISVNSKKTTQLV

SEQ ID NO: 158364 - protein, 14 aa, Borrelia afzelii
TISVNSKKTTQLVF

SEQ ID NO: 158365 - protein, 14 aa, Borrelia afzelii
ISVNSKKTTQLVFT

SEQ ID NO: 158366 - protein, 14 aa, Borrelia afzelii
SVNSKKTTQLVFTK

SEQ ID NO: 158367 - protein, 14 aa, Borrelia afzelii
VNSKKTTQLVFTKQ

SEQ ID NO: 158368 - protein, 14 aa, Borrelia afzelii
NSKKTTQLVFTKQD

SEQ ID NO: 158369 - protein, 14 aa, Borrelia afzelii
SKKTTQLVFTKQDT

SEQ ID NO: 158370 - protein, 14 aa, Borrelia afzelii
KKTTQLVFTKQDTI

SEQ ID NO: 158371 - protein, 14 aa, Borrelia afzelii
KTTQLVFTKQDTIT

SEQ ID NO: 158372 - protein, 14 aa, Borrelia afzelii
TTQLVFTKQDTITV

SEQ ID NO: 158373 - protein, 14 aa, Borrelia afzelii
TQLVFTKQDTITVQ

SEQ ID NO: 158374 - protein, 14 aa, Borrelia afzelii
QLVFTKQDTITVQK

SEQ ID NO: 158375 - protein, 14 aa, Borrelia afzelii
LVFTKQDTITVQKY

SEQ ID NO: 158376 - protein, 14 aa, Borrelia afzelii
VFTKQDTITVQKYD

SEQ ID NO: 158377 - protein, 14 aa, Borrelia afzelii
FTKQDTITVQKYDS

SEQ ID NO: 158378 - protein, 14 aa, Borrelia afzelii
TKQDTITVQKYDSA

SEQ ID NO: 158379 - protein, 14 aa, Borrelia afzelii
KQDTITVQKYDSAG

SEQ ID NO: 158380 - protein, 14 aa, Borrelia afzelii
QDTITVQKYDSAGT

SEQ ID NO: 158381 - protein, 14 aa, Borrelia afzelii
DTITVQKYDSAGTN

SEQ ID NO: 158382 - protein, 14 aa, Borrelia afzelii
TITVQKYDSAGTNL

SEQ ID NO: 158383 - protein, 14 aa, Borrelia afzelii
ITVQKYDSAGTNLE

SEQ ID NO: 158384 - protein, 14 aa, Borrelia afzelii
TVQKYDSAGTNLEG

SEQ ID NO: 158385 - protein, 14 aa, Borrelia afzelii
VQKYDSAGTNLEGT

SEQ ID NO: 158386 - protein, 14 aa, Borrelia afzelii
QKYDSAGTNLEGTA

SEQ ID NO: 158387 - protein, 14 aa, Borrelia afzelii
KYDSAGTNLEGTAV

SEQ ID NO: 158388 - protein, 14 aa, Borrelia afzelii
YDSAGTNLEGTAVE

SEQ ID NO: 158389 - protein, 14 aa, Borrelia afzelii
DSAGTNLEGTAVEI

SEQ ID NO: 158390 - protein, 14 aa, Borrelia afzelii
SAGTNLEGTAVEIK

SEQ ID NO: 158391 - protein, 14 aa, Borrelia afzelii
AGTNLEGTAVEIKT

SEQ ID NO: 158392 - protein, 14 aa, Borrelia afzelii
GTNLEGTAVEIKTL

SEQ ID NO: 158393 - protein, 14 aa, Borrelia afzelii
TNLEGTAVEIKTLD

SEQ ID NO: 158394 - protein, 14 aa, Borrelia afzelii
NLEGTAVEIKTLDE

SEQ ID NO: 158395 - protein, 14 aa, Borrelia afzelii
LEGTAVEIKTLDEL

SEQ ID NO: 158396 - protein, 14 aa, Borrelia afzelii
EGTAVEIKTLDELK

SEQ ID NO: 158397 - protein, 14 aa, Borrelia afzelii
GTAVEIKTLDELKN

SEQ ID NO: 158398 - protein, 14 aa, Borrelia afzelii
TAVEIKTLDELKNA

SEQ ID NO: 158399 - protein, 14 aa, Borrelia afzelii
AVEIKTLDELKNAL

SEQ ID NO: 158400 - protein, 14 aa, Borrelia afzelii
VEIKTLDELKNALK

SEQ ID NO: 158401 - protein, 15 aa, Borrelia afzelii
MKKYLLGIGLILALI

SEQ ID NO: 158402 - protein, 15 aa, Borrelia afzelii
KKYLLGIGLILALIA

SEQ ID NO: 158403 - protein, 15 aa, Borrelia afzelii
KYLLGIGLILALIAC

SEQ ID NO: 158404 - protein, 15 aa, Borrelia afzelii
YLLGIGLILALIACK

SEQ ID NO: 158405 - protein, 15 aa, Borrelia afzelii
LLGIGLILALIACKQ

SEQ ID NO: 158406 - protein, 15 aa, Borrelia afzelii
LGIGLILALIACKQN

SEQ ID NO: 158407 - protein, 15 aa, Borrelia afzelii
GIGLILALIACKQNV

SEQ ID NO: 158408 - protein, 15 aa, Borrelia afzelii
IGLILALIACKQNVS

SEQ ID NO: 158409 - protein, 15 aa, Borrelia afzelii
GLILALIACKQNVSS

SEQ ID NO: 158410 - protein, 15 aa, Borrelia afzelii
LILALIACKQNVSSL

SEQ ID NO: 158411 - protein, 15 aa, Borrelia afzelii
ILALIACKQNVSSLD

SEQ ID NO: 158412 - protein, 15 aa, Borrelia afzelii
LALIACKQNVSSLDE

SEQ ID NO: 158413 - protein, 15 aa, Borrelia afzelii
ALIACKQNVSSLDEK

SEQ ID NO: 158414 - protein, 15 aa, Borrelia afzelii
LIACKQNVSSLDEKN

SEQ ID NO: 158415 - protein, 15 aa, Borrelia afzelii
IACKQNVSSLDEKNS

SEQ ID NO: 158416 - protein, 15 aa, Borrelia afzelii
ACKQNVSSLDEKNSA

SEQ ID NO: 158417 - protein, 15 aa, Borrelia afzelii
CKQNVSSLDEKNSAS

SEQ ID NO: 158418 - protein, 15 aa, Borrelia afzelii
KQNVSSLDEKNSASV

SEQ ID NO: 158419 - protein, 15 aa, Borrelia afzelii
QNVSSLDEKNSASVD

SEQ ID NO: 158420 - protein, 15 aa, Borrelia afzelii
NVSSLDEKNSASVDL

SEQ ID NO: 158421 - protein, 15 aa, Borrelia afzelii
VSSLDEKNSASVDLP

SEQ ID NO: 158422 - protein, 15 aa, Borrelia afzelii
SSLDEKNSASVDLPG

SEQ ID NO: 158423 - protein, 15 aa, Borrelia afzelii
SLDEKNSASVDLPGE

SEQ ID NO: 158424 - protein, 15 aa, Borrelia afzelii
LDEKNSASVDLPGEM

SEQ ID NO: 158425 - protein, 15 aa, Borrelia afzelii
DEKNSASVDLPGEMK

SEQ ID NO: 158426 - protein, 15 aa, Borrelia afzelii
EKNSASVDLPGEMKV

SEQ ID NO: 158427 - protein, 15 aa, Borrelia afzelii
KNSASVDLPGEMKVL

SEQ ID NO: 158428 - protein, 15 aa, Borrelia afzelii
NSASVDLPGEMKVLV

SEQ ID NO: 158429 - protein, 15 aa, Borrelia afzelii
SASVDLPGEMKVLVS

SEQ ID NO: 158430 - protein, 15 aa, Borrelia afzelii
ASVDLPGEMKVLVSK

SEQ ID NO: 158431 - protein, 15 aa, Borrelia afzelii
SVDLPGEMKVLVSKE

SEQ ID NO: 158432 - protein, 15 aa, Borrelia afzelii
VDLPGEMKVLVSKEK

SEQ ID NO: 158433 - protein, 15 aa, Borrelia afzelii
DLPGEMKVLVSKEKD

SEQ ID NO: 158434 - protein, 15 aa, Borrelia afzelii
LPGEMKVLVSKEKDK

SEQ ID NO: 158435 - protein, 15 aa, Borrelia afzelii
PGEMKVLVSKEKDKD

SEQ ID NO: 158436 - protein, 15 aa, Borrelia afzelii
GEMKVLVSKEKDKDG

SEQ ID NO: 158437 - protein, 15 aa, Borrelia afzelii
EMKVLVSKEKDKDGK

SEQ ID NO: 158438 - protein, 15 aa, Borrelia afzelii
MKVLVSKEKDKDGKY

SEQ ID NO: 158439 - protein, 15 aa, Borrelia afzelii
KVLVSKEKDKDGKYS

SEQ ID NO: 158440 - protein, 15 aa, Borrelia afzelii
VLVSKEKDKDGKYSL

SEQ ID NO: 158441 - protein, 15 aa, Borrelia afzelii
LVSKEKDKDGKYSLK

SEQ ID NO: 158442 - protein, 15 aa, Borrelia afzelii
VSKEKDKDGKYSLKA

SEQ ID NO: 158443 - protein, 15 aa, Borrelia afzelii
SKEKDKDGKYSLKAT

SEQ ID NO: 158444 - protein, 15 aa, Borrelia afzelii
KEKDKDGKYSLKATV

SEQ ID NO: 158445 - protein, 15 aa, Borrelia afzelii
EKDKDGKYSLKATVD

SEQ ID NO: 158446 - protein, 15 aa, Borrelia afzelii
KDKDGKYSLKATVDK

SEQ ID NO: 158447 - protein, 15 aa, Borrelia afzelii
DKDGKYSLKATVDKI

SEQ ID NO: 158448 - protein, 15 aa, Borrelia afzelii
KDGKYSLKATVDKIE

SEQ ID NO: 158449 - protein, 15 aa, Borrelia afzelii
DGKYSLKATVDKIEL

SEQ ID NO: 158450 - protein, 15 aa, Borrelia afzelii
GKYSLKATVDKIELK

SEQ ID NO: 158451 - protein, 15 aa, Borrelia afzelii
KYSLKATVDKIELKG

SEQ ID NO: 158452 - protein, 15 aa, Borrelia afzelii
YSLKATVDKIELKGT

SEQ ID NO: 158453 - protein, 15 aa, Borrelia afzelii
SLKATVDKIELKGTS

SEQ ID NO: 158454 - protein, 15 aa, Borrelia afzelii
LKATVDKIELKGTSD

SEQ ID NO: 158455 - protein, 15 aa, Borrelia afzelii
KATVDKIELKGTSDK

SEQ ID NO: 158456 - protein, 15 aa, Borrelia afzelii
ATVDKIELKGTSDKD

SEQ ID NO: 158457 - protein, 15 aa, Borrelia afzelii
TVDKIELKGTSDKDN

SEQ ID NO: 158458 - protein, 15 aa, Borrelia afzelii
VDKIELKGTSDKDNG

SEQ ID NO: 158459 - protein, 15 aa, Borrelia afzelii
DKIELKGTSDKDNGS

SEQ ID NO: 158460 - protein, 15 aa, Borrelia afzelii
KIELKGTSDKDNGSG

SEQ ID NO: 158461 - protein, 15 aa, Borrelia afzelii
IELKGTSDKDNGSGV

SEQ ID NO: 158462 - protein, 15 aa, Borrelia afzelii
ELKGTSDKDNGSGVL

SEQ ID NO: 158463 - protein, 15 aa, Borrelia afzelii
LKGTSDKDNGSGVLE

SEQ ID NO: 158464 - protein, 15 aa, Borrelia afzelii
KGTSDKDNGSGVLEG

SEQ ID NO: 158465 - protein, 15 aa, Borrelia afzelii
GTSDKDNGSGVLEGT

SEQ ID NO: 158466 - protein, 15 aa, Borrelia afzelii
TSDKDNGSGVLEGTK

SEQ ID NO: 158467 - protein, 15 aa, Borrelia afzelii
SDKDNGSGVLEGTKD

SEQ ID NO: 158468 - protein, 15 aa, Borrelia afzelii
DKDNGSGVLEGTKDD

SEQ ID NO: 158469 - protein, 15 aa, Borrelia afzelii
KDNGSGVLEGTKDDK

SEQ ID NO: 158470 - protein, 15 aa, Borrelia afzelii
DNGSGVLEGTKDDKS

SEQ ID NO: 158471 - protein, 15 aa, Borrelia afzelii
NGSGVLEGTKDDKSK

SEQ ID NO: 158472 - protein, 15 aa, Borrelia afzelii
GSGVLEGTKDDKSKA

SEQ ID NO: 158473 - protein, 15 aa, Borrelia afzelii
SGVLEGTKDDKSKAK

SEQ ID NO: 158474 - protein, 15 aa, Borrelia afzelii
GVLEGTKDDKSKAKL

SEQ ID NO: 158475 - protein, 15 aa, Borrelia afzelii
VLEGTKDDKSKAKLT

SEQ ID NO: 158476 - protein, 15 aa, Borrelia afzelii
LEGTKDDKSKAKLTI

SEQ ID NO: 158477 - protein, 15 aa, Borrelia afzelii
EGTKDDKSKAKLTIA

SEQ ID NO: 158478 - protein, 15 aa, Borrelia afzelii
GTKDDKSKAKLTIAD

SEQ ID NO: 158479 - protein, 15 aa, Borrelia afzelii
TKDDKSKAKLTIADD

SEQ ID NO: 158480 - protein, 15 aa, Borrelia afzelii
KDDKSKAKLTIADDL

SEQ ID NO: 158481 - protein, 15 aa, Borrelia afzelii
DDKSKAKLTIADDLS

SEQ ID NO: 158482 - protein, 15 aa, Borrelia afzelii
DKSKAKLTIADDLSK

SEQ ID NO: 158483 - protein, 15 aa, Borrelia afzelii
KSKAKLTIADDLSKT

SEQ ID NO: 158484 - protein, 15 aa, Borrelia afzelii
SKAKLTIADDLSKTT

SEQ ID NO: 158485 - protein, 15 aa, Borrelia afzelii
KAKLTIADDLSKTTF

SEQ ID NO: 158486 - protein, 15 aa, Borrelia afzelii
AKLTIADDLSKTTFE

SEQ ID NO: 158487 - protein, 15 aa, Borrelia afzelii
KLTIADDLSKTTFEL

SEQ ID NO: 158488 - protein, 15 aa, Borrelia afzelii
LTIADDLSKTTFELF

SEQ ID NO: 158489 - protein, 15 aa, Borrelia afzelii
TIADDLSKTTFELFK

SEQ ID NO: 158490 - protein, 15 aa, Borrelia afzelii
IADDLSKTTFELFKE

SEQ ID NO: 158491 - protein, 15 aa, Borrelia afzelii
ADDLSKTTFELFKED

SEQ ID NO: 158492 - protein, 15 aa, Borrelia afzelii
DDLSKTTFELFKEDG

SEQ ID NO: 158493 - protein, 15 aa, Borrelia afzelii
DLSKTTFELFKEDGK

SEQ ID NO: 158494 - protein, 15 aa, Borrelia afzelii
LSKTTFELFKEDGKT

SEQ ID NO: 158495 - protein, 15 aa, Borrelia afzelii
SKTTFELFKEDGKTL

SEQ ID NO: 158496 - protein, 15 aa, Borrelia afzelii
KTTFELFKEDGKTLV

SEQ ID NO: 158497 - protein, 15 aa, Borrelia afzelii
TTFELFKEDGKTLVS

SEQ ID NO: 158498 - protein, 15 aa, Borrelia afzelii
TFELFKEDGKTLVSR

SEQ ID NO: 158499 - protein, 15 aa, Borrelia afzelii
FELFKEDGKTLVSRK

SEQ ID NO: 158500 - protein, 15 aa, Borrelia afzelii
ELFKEDGKTLVSRKV

SEQ ID NO: 158501 - protein, 15 aa, Borrelia afzelii
LFKEDGKTLVSRKVS

SEQ ID NO: 158502 - protein, 15 aa, Borrelia afzelii
FKEDGKTLVSRKVSS

SEQ ID NO: 158503 - protein, 15 aa, Borrelia afzelii
KEDGKTLVSRKVSSK

SEQ ID NO: 158504 - protein, 15 aa, Borrelia afzelii
EDGKTLVSRKVSSKD

SEQ ID NO: 158505 - protein, 15 aa, Borrelia afzelii
DGKTLVSRKVSSKDK

SEQ ID NO: 158506 - protein, 15 aa, Borrelia afzelii
GKTLVSRKVSSKDKT

SEQ ID NO: 158507 - protein, 15 aa, Borrelia afzelii
KTLVSRKVSSKDKTS

SEQ ID NO: 158508 - protein, 15 aa, Borrelia afzelii
TLVSRKVSSKDKTST

SEQ ID NO: 158509 - protein, 15 aa, Borrelia afzelii
LVSRKVSSKDKTSTD

SEQ ID NO: 158510 - protein, 15 aa, Borrelia afzelii
VSRKVSSKDKTSTDE

SEQ ID NO: 158511 - protein, 15 aa, Borrelia afzelii
SRKVSSKDKTSTDEM

SEQ ID NO: 158512 - protein, 15 aa, Borrelia afzelii
RKVSSKDKTSTDEMF

SEQ ID NO: 158513 - protein, 15 aa, Borrelia afzelii
KVSSKDKTSTDEMFN

SEQ ID NO: 158514 - protein, 15 aa, Borrelia afzelii
VSSKDKTSTDEMFNE

SEQ ID NO: 158515 - protein, 15 aa, Borrelia afzelii
SSKDKTSTDEMFNEK

SEQ ID NO: 158516 - protein, 15 aa, Borrelia afzelii
SKDKTSTDEMFNEKG

SEQ ID NO: 158517 - protein, 15 aa, Borrelia afzelii
KDKTSTDEMFNEKGE

SEQ ID NO: 158518 - protein, 15 aa, Borrelia afzelii
DKTSTDEMFNEKGEL

SEQ ID NO: 158519 - protein, 15 aa, Borrelia afzelii
KTSTDEMFNEKGELS

SEQ ID NO: 158520 - protein, 15 aa, Borrelia afzelii
TSTDEMFNEKGELSA

SEQ ID NO: 158521 - protein, 15 aa, Borrelia afzelii
STDEMFNEKGELSAK

SEQ ID NO: 158522 - protein, 15 aa, Borrelia afzelii
TDEMFNEKGELSAKT

SEQ ID NO: 158523 - protein, 15 aa, Borrelia afzelii
DEMFNEKGELSAKTM

SEQ ID NO: 158524 - protein, 15 aa, Borrelia afzelii
EMFNEKGELSAKTMT

SEQ ID NO: 158525 - protein, 15 aa, Borrelia afzelii
MFNEKGELSAKTMTR

SEQ ID NO: 158526 - protein, 15 aa, Borrelia afzelii
FNEKGELSAKTMTRE

SEQ ID NO: 158527 - protein, 15 aa, Borrelia afzelii
NEKGELSAKTMTREN

SEQ ID NO: 158528 - protein, 15 aa, Borrelia afzelii
EKGELSAKTMTRENG

SEQ ID NO: 158529 - protein, 15 aa, Borrelia afzelii
KGELSAKTMTRENGT

SEQ ID NO: 158530 - protein, 15 aa, Borrelia afzelii
GELSAKTMTRENGTK

SEQ ID NO: 158531 - protein, 15 aa, Borrelia afzelii
ELSAKTMTRENGTKL

SEQ ID NO: 158532 - protein, 15 aa, Borrelia afzelii
LSAKTMTRENGTKLE

SEQ ID NO: 158533 - protein, 15 aa, Borrelia afzelii
SAKTMTRENGTKLEY

SEQ ID NO: 158534 - protein, 15 aa, Borrelia afzelii
AKTMTRENGTKLEYT

SEQ ID NO: 158535 - protein, 15 aa, Borrelia afzelii
KTMTRENGTKLEYTE

SEQ ID NO: 158536 - protein, 15 aa, Borrelia afzelii
TMTRENGTKLEYTEM

SEQ ID NO: 158537 - protein, 15 aa, Borrelia afzelii
MTRENGTKLEYTEMK

SEQ ID NO: 158538 - protein, 15 aa, Borrelia afzelii
TRENGTKLEYTEMKS

SEQ ID NO: 158539 - protein, 15 aa, Borrelia afzelii
RENGTKLEYTEMKSD

SEQ ID NO: 158540 - protein, 15 aa, Borrelia afzelii
ENGTKLEYTEMKSDG

SEQ ID NO: 158541 - protein, 15 aa, Borrelia afzelii
NGTKLEYTEMKSDGT

SEQ ID NO: 158542 - protein, 15 aa, Borrelia afzelii
GTKLEYTEMKSDGTG

SEQ ID NO: 158543 - protein, 15 aa, Borrelia afzelii
TKLEYTEMKSDGTGK

SEQ ID NO: 158544 - protein, 15 aa, Borrelia afzelii
KLEYTEMKSDGTGKA

SEQ ID NO: 158545 - protein, 15 aa, Borrelia afzelii
LEYTEMKSDGTGKAK

SEQ ID NO: 158546 - protein, 15 aa, Borrelia afzelii
EYTEMKSDGTGKAKE

SEQ ID NO: 158547 - protein, 15 aa, Borrelia afzelii
YTEMKSDGTGKAKEV

SEQ ID NO: 158548 - protein, 15 aa, Borrelia afzelii
TEMKSDGTGKAKEVL

SEQ ID NO: 158549 - protein, 15 aa, Borrelia afzelii
EMKSDGTGKAKEVLK

SEQ ID NO: 158550 - protein, 15 aa, Borrelia afzelii
MKSDGTGKAKEVLKN

SEQ ID NO: 158551 - protein, 15 aa, Borrelia afzelii
KSDGTGKAKEVLKNF

SEQ ID NO: 158552 - protein, 15 aa, Borrelia afzelii
SDGTGKAKEVLKNFT

SEQ ID NO: 158553 - protein, 15 aa, Borrelia afzelii
DGTGKAKEVLKNFTL

SEQ ID NO: 158554 - protein, 15 aa, Borrelia afzelii
GTGKAKEVLKNFTLE

SEQ ID NO: 158555 - protein, 15 aa, Borrelia afzelii
TGKAKEVLKNFTLEG

SEQ ID NO: 158556 - protein, 15 aa, Borrelia afzelii
GKAKEVLKNFTLEGK

SEQ ID NO: 158557 - protein, 15 aa, Borrelia afzelii
KAKEVLKNFTLEGKV

SEQ ID NO: 158558 - protein, 15 aa, Borrelia afzelii
AKEVLKNFTLEGKVA

SEQ ID NO: 158559 - protein, 15 aa, Borrelia afzelii
KEVLKNFTLEGKVAN

SEQ ID NO: 158560 - protein, 15 aa, Borrelia afzelii
EVLKNFTLEGKVAND

SEQ ID NO: 158561 - protein, 15 aa, Borrelia afzelii
VLKNFTLEGKVANDK

SEQ ID NO: 158562 - protein, 15 aa, Borrelia afzelii
LKNFTLEGKVANDKV

SEQ ID NO: 158563 - protein, 15 aa, Borrelia afzelii
KNFTLEGKVANDKVT

SEQ ID NO: 158564 - protein, 15 aa, Borrelia afzelii
NFTLEGKVANDKVTL

SEQ ID NO: 158565 - protein, 15 aa, Borrelia afzelii
FTLEGKVANDKVTLE

SEQ ID NO: 158566 - protein, 15 aa, Borrelia afzelii
TLEGKVANDKVTLEV

SEQ ID NO: 158567 - protein, 15 aa, Borrelia afzelii
LEGKVANDKVTLEVK

SEQ ID NO: 158568 - protein, 15 aa, Borrelia afzelii
EGKVANDKVTLEVKE

SEQ ID NO: 158569 - protein, 15 aa, Borrelia afzelii
GKVANDKVTLEVKEG

SEQ ID NO: 158570 - protein, 15 aa, Borrelia afzelii
KVANDKVTLEVKEGT

SEQ ID NO: 158571 - protein, 15 aa, Borrelia afzelii
VANDKVTLEVKEGTV

SEQ ID NO: 158572 - protein, 15 aa, Borrelia afzelii
ANDKVTLEVKEGTVT

SEQ ID NO: 158573 - protein, 15 aa, Borrelia afzelii
NDKVTLEVKEGTVTL

SEQ ID NO: 158574 - protein, 15 aa, Borrelia afzelii
DKVTLEVKEGTVTLS

SEQ ID NO: 158575 - protein, 15 aa, Borrelia afzelii
KVTLEVKEGTVTLSK

SEQ ID NO: 158576 - protein, 15 aa, Borrelia afzelii
VTLEVKEGTVTLSKE

SEQ ID NO: 158577 - protein, 15 aa, Borrelia afzelii
TLEVKEGTVTLSKEI

SEQ ID NO: 158578 - protein, 15 aa, Borrelia afzelii
LEVKEGTVTLSKEIA

SEQ ID NO: 158579 - protein, 15 aa, Borrelia afzelii
EVKEGTVTLSKEIAK

SEQ ID NO: 158580 - protein, 15 aa, Borrelia afzelii
VKEGTVTLSKEIAKS

SEQ ID NO: 158581 - protein, 15 aa, Borrelia afzelii
KEGTVTLSKEIAKSG

SEQ ID NO: 158582 - protein, 15 aa, Borrelia afzelii
EGTVTLSKEIAKSGE

SEQ ID NO: 158583 - protein, 15 aa, Borrelia afzelii
GTVTLSKEIAKSGEV

SEQ ID NO: 158584 - protein, 15 aa, Borrelia afzelii
TVTLSKEIAKSGEVT

SEQ ID NO: 158585 - protein, 15 aa, Borrelia afzelii
VTLSKEIAKSGEVTV

SEQ ID NO: 158586 - protein, 15 aa, Borrelia afzelii
TLSKEIAKSGEVTVA

SEQ ID NO: 158587 - protein, 15 aa, Borrelia afzelii
LSKEIAKSGEVTVAL

SEQ ID NO: 158588 - protein, 15 aa, Borrelia afzelii
SKEIAKSGEVTVALN

SEQ ID NO: 158589 - protein, 15 aa, Borrelia afzelii
KEIAKSGEVTVALND

SEQ ID NO: 158590 - protein, 15 aa, Borrelia afzelii
EIAKSGEVTVALNDT

SEQ ID NO: 158591 - protein, 15 aa, Borrelia afzelii
IAKSGEVTVALNDTN

SEQ ID NO: 158592 - protein, 15 aa, Borrelia afzelii
AKSGEVTVALNDTNT

SEQ ID NO: 158593 - protein, 15 aa, Borrelia afzelii
KSGEVTVALNDTNTT

SEQ ID NO: 158594 - protein, 15 aa, Borrelia afzelii
SGEVTVALNDTNTTQ

SEQ ID NO: 158595 - protein, 15 aa, Borrelia afzelii
GEVTVALNDTNTTQA

SEQ ID NO: 158596 - protein, 15 aa, Borrelia afzelii
EVTVALNDTNTTQAT

SEQ ID NO: 158597 - protein, 15 aa, Borrelia afzelii
VTVALNDTNTTQATK

SEQ ID NO: 158598 - protein, 15 aa, Borrelia afzelii
TVALNDTNTTQATKK

SEQ ID NO: 158599 - protein, 15 aa, Borrelia afzelii
VALNDTNTTQATKKT

SEQ ID NO: 158600 - protein, 15 aa, Borrelia afzelii
ALNDTNTTQATKKTG

SEQ ID NO: 158601 - protein, 15 aa, Borrelia afzelii
LNDTNTTQATKKTGA

SEQ ID NO: 158602 - protein, 15 aa, Borrelia afzelii
NDTNTTQATKKTGAW

SEQ ID NO: 158603 - protein, 15 aa, Borrelia afzelii
DTNTTQATKKTGAWD

SEQ ID NO: 158604 - protein, 15 aa, Borrelia afzelii
TNTTQATKKTGAWDS

SEQ ID NO: 158605 - protein, 15 aa, Borrelia afzelii
NTTQATKKTGAWDSK

SEQ ID NO: 158606 - protein, 15 aa, Borrelia afzelii
TTQATKKTGAWDSKT

SEQ ID NO: 158607 - protein, 15 aa, Borrelia afzelii
TQATKKTGAWDSKTS

SEQ ID NO: 158608 - protein, 15 aa, Borrelia afzelii
QATKKTGAWDSKTST

SEQ ID NO: 158609 - protein, 15 aa, Borrelia afzelii
ATKKTGAWDSKTSTL

SEQ ID NO: 158610 - protein, 15 aa, Borrelia afzelii
TKKTGAWDSKTSTLT

SEQ ID NO: 158611 - protein, 15 aa, Borrelia afzelii
KKTGAWDSKTSTLTI

SEQ ID NO: 158612 - protein, 15 aa, Borrelia afzelii
KTGAWDSKTSTLTIS

SEQ ID NO: 158613 - protein, 15 aa, Borrelia afzelii
TGAWDSKTSTLTISV

SEQ ID NO: 158614 - protein, 15 aa, Borrelia afzelii
GAWDSKTSTLTISVN

SEQ ID NO: 158615 - protein, 15 aa, Borrelia afzelii
AWDSKTSTLTISVNS

SEQ ID NO: 158616 - protein, 15 aa, Borrelia afzelii
WDSKTSTLTISVNSK

SEQ ID NO: 158617 - protein, 15 aa, Borrelia afzelii
DSKTSTLTISVNSKK

SEQ ID NO: 158618 - protein, 15 aa, Borrelia afzelii
SKTSTLTISVNSKKT

SEQ ID NO: 158619 - protein, 15 aa, Borrelia afzelii
KTSTLTISVNSKKTT

SEQ ID NO: 158620 - protein, 15 aa, Borrelia afzelii
TSTLTISVNSKKTTQ

SEQ ID NO: 158621 - protein, 15 aa, Borrelia afzelii
STLTISVNSKKTTQL

SEQ ID NO: 158622 - protein, 15 aa, Borrelia afzelii
TLTISVNSKKTTQLV

SEQ ID NO: 158623 - protein, 15 aa, Borrelia afzelii
LTISVNSKKTTQLVF

SEQ ID NO: 158624 - protein, 15 aa, Borrelia afzelii
TISVNSKKTTQLVFT

SEQ ID NO: 158625 - protein, 15 aa, Borrelia afzelii
ISVNSKKTTQLVFTK

SEQ ID NO: 158626 - protein, 15 aa, Borrelia afzelii
SVNSKKTTQLVFTKQ

SEQ ID NO: 158627 - protein, 15 aa, Borrelia afzelii
VNSKKTTQLVFTKQD

SEQ ID NO: 158628 - protein, 15 aa, Borrelia afzelii
NSKKTTQLVFTKQDT

SEQ ID NO: 158629 - protein, 15 aa, Borrelia afzelii
SKKTTQLVFTKQDTI

SEQ ID NO: 158630 - protein, 15 aa, Borrelia afzelii
KKTTQLVFTKQDTIT

SEQ ID NO: 158631 - protein, 15 aa, Borrelia afzelii
KTTQLVFTKQDTITV

SEQ ID NO: 158632 - protein, 15 aa, Borrelia afzelii
TTQLVFTKQDTITVQ

SEQ ID NO: 158633 - protein, 15 aa, Borrelia afzelii
TQLVFTKQDTITVQK

SEQ ID NO: 158634 - protein, 15 aa, Borrelia afzelii
QLVFTKQDTITVQKY

SEQ ID NO: 158635 - protein, 15 aa, Borrelia afzelii
LVFTKQDTITVQKYD

SEQ ID NO: 158636 - protein, 15 aa, Borrelia afzelii
VFTKQDTITVQKYDS

SEQ ID NO: 158637 - protein, 15 aa, Borrelia afzelii
FTKQDTITVQKYDSA

SEQ ID NO: 158638 - protein, 15 aa, Borrelia afzelii
TKQDTITVQKYDSAG

SEQ ID NO: 158639 - protein, 15 aa, Borrelia afzelii
KQDTITVQKYDSAGT

SEQ ID NO: 158640 - protein, 15 aa, Borrelia afzelii
QDTITVQKYDSAGTN

SEQ ID NO: 158641 - protein, 15 aa, Borrelia afzelii
DTITVQKYDSAGTNL

SEQ ID NO: 158642 - protein, 15 aa, Borrelia afzelii
TITVQKYDSAGTNLE

SEQ ID NO: 158643 - protein, 15 aa, Borrelia afzelii
ITVQKYDSAGTNLEG

SEQ ID NO: 158644 - protein, 15 aa, Borrelia afzelii
TVQKYDSAGTNLEGT

SEQ ID NO: 158645 - protein, 15 aa, Borrelia afzelii
VQKYDSAGTNLEGTA

SEQ ID NO: 158646 - protein, 15 aa, Borrelia afzelii
QKYDSAGTNLEGTAV

SEQ ID NO: 158647 - protein, 15 aa, Borrelia afzelii
KYDSAGTNLEGTAVE

SEQ ID NO: 158648 - protein, 15 aa, Borrelia afzelii
YDSAGTNLEGTAVEI

SEQ ID NO: 158649 - protein, 15 aa, Borrelia afzelii
DSAGTNLEGTAVEIK

SEQ ID NO: 158650 - protein, 15 aa, Borrelia afzelii
SAGTNLEGTAVEIKT

SEQ ID NO: 158651 - protein, 15 aa, Borrelia afzelii
AGTNLEGTAVEIKTL

SEQ ID NO: 158652 - protein, 15 aa, Borrelia afzelii
GTNLEGTAVEIKTLD

SEQ ID NO: 158653 - protein, 15 aa, Borrelia afzelii
TNLEGTAVEIKTLDE

SEQ ID NO: 158654 - protein, 15 aa, Borrelia afzelii
NLEGTAVEIKTLDEL

SEQ ID NO: 158655 - protein, 15 aa, Borrelia afzelii
LEGTAVEIKTLDELK

SEQ ID NO: 158656 - protein, 15 aa, Borrelia afzelii
EGTAVEIKTLDELKN

SEQ ID NO: 158657 - protein, 15 aa, Borrelia afzelii
GTAVEIKTLDELKNA

SEQ ID NO: 158658 - protein, 15 aa, Borrelia afzelii
TAVEIKTLDELKNAL

SEQ ID NO: 158659 - protein, 15 aa, Borrelia afzelii
AVEIKTLDELKNALK

SEQ ID NO: 158660 - protein, 16 aa, Borrelia afzelii
MKKYLLGIGLILALIA

SEQ ID NO: 158661 - protein, 16 aa, Borrelia afzelii
KKYLLGIGLILALIAC

SEQ ID NO: 158662 - protein, 16 aa, Borrelia afzelii
KYLLGIGLILALIACK

SEQ ID NO: 158663 - protein, 16 aa, Borrelia afzelii
YLLGIGLILALIACKQ

SEQ ID NO: 158664 - protein, 16 aa, Borrelia afzelii
LLGIGLILALIACKQN

SEQ ID NO: 158665 - protein, 16 aa, Borrelia afzelii
LGIGLILALIACKQNV

SEQ ID NO: 158666 - protein, 16 aa, Borrelia afzelii
GIGLILALIACKQNVS

SEQ ID NO: 158667 - protein, 16 aa, Borrelia afzelii
IGLILALIACKQNVSS

SEQ ID NO: 158668 - protein, 16 aa, Borrelia afzelii
GLILALIACKQNVSSL

SEQ ID NO: 158669 - protein, 16 aa, Borrelia afzelii
LILALIACKQNVSSLD

SEQ ID NO: 158670 - protein, 16 aa, Borrelia afzelii
ILALIACKQNVSSLDE

SEQ ID NO: 158671 - protein, 16 aa, Borrelia afzelii
LALIACKQNVSSLDEK

SEQ ID NO: 158672 - protein, 16 aa, Borrelia afzelii
ALIACKQNVSSLDEKN

SEQ ID NO: 158673 - protein, 16 aa, Borrelia afzelii
LIACKQNVSSLDEKNS

SEQ ID NO: 158674 - protein, 16 aa, Borrelia afzelii
IACKQNVSSLDEKNSA

SEQ ID NO: 158675 - protein, 16 aa, Borrelia afzelii
ACKQNVSSLDEKNSAS

SEQ ID NO: 158676 - protein, 16 aa, Borrelia afzelii
CKQNVSSLDEKNSASV

SEQ ID NO: 158677 - protein, 16 aa, Borrelia afzelii
KQNVSSLDEKNSASVD

SEQ ID NO: 158678 - protein, 16 aa, Borrelia afzelii
QNVSSLDEKNSASVDL

SEQ ID NO: 158679 - protein, 16 aa, Borrelia afzelii
NVSSLDEKNSASVDLP

SEQ ID NO: 158680 - protein, 16 aa, Borrelia afzelii
VSSLDEKNSASVDLPG

SEQ ID NO: 158681 - protein, 16 aa, Borrelia afzelii
SSLDEKNSASVDLPGE

SEQ ID NO: 158682 - protein, 16 aa, Borrelia afzelii
SLDEKNSASVDLPGEM

SEQ ID NO: 158683 - protein, 16 aa, Borrelia afzelii
LDEKNSASVDLPGEMK

SEQ ID NO: 158684 - protein, 16 aa, Borrelia afzelii
DEKNSASVDLPGEMKV

SEQ ID NO: 158685 - protein, 16 aa, Borrelia afzelii
EKNSASVDLPGEMKVL

SEQ ID NO: 158686 - protein, 16 aa, Borrelia afzelii
KNSASVDLPGEMKVLV

SEQ ID NO: 158687 - protein, 16 aa, Borrelia afzelii
NSASVDLPGEMKVLVS

SEQ ID NO: 158688 - protein, 16 aa, Borrelia afzelii
SASVDLPGEMKVLVSK

SEQ ID NO: 158689 - protein, 16 aa, Borrelia afzelii
ASVDLPGEMKVLVSKE

SEQ ID NO: 158690 - protein, 16 aa, Borrelia afzelii
SVDLPGEMKVLVSKEK

SEQ ID NO: 158691 - protein, 16 aa, Borrelia afzelii
VDLPGEMKVLVSKEKD

SEQ ID NO: 158692 - protein, 16 aa, Borrelia afzelii
DLPGEMKVLVSKEKDK

SEQ ID NO: 158693 - protein, 16 aa, Borrelia afzelii
LPGEMKVLVSKEKDKD

SEQ ID NO: 158694 - protein, 16 aa, Borrelia afzelii
PGEMKVLVSKEKDKDG

SEQ ID NO: 158695 - protein, 16 aa, Borrelia afzelii
GEMKVLVSKEKDKDGK

SEQ ID NO: 158696 - protein, 16 aa, Borrelia afzelii
EMKVLVSKEKDKDGKY

SEQ ID NO: 158697 - protein, 16 aa, Borrelia afzelii
MKVLVSKEKDKDGKYS

SEQ ID NO: 158698 - protein, 16 aa, Borrelia afzelii
KVLVSKEKDKDGKYSL

SEQ ID NO: 158699 - protein, 16 aa, Borrelia afzelii
VLVSKEKDKDGKYSLK

SEQ ID NO: 158700 - protein, 16 aa, Borrelia afzelii
LVSKEKDKDGKYSLKA

SEQ ID NO: 158701 - protein, 16 aa, Borrelia afzelii
VSKEKDKDGKYSLKAT

SEQ ID NO: 158702 - protein, 16 aa, Borrelia afzelii
SKEKDKDGKYSLKATV

SEQ ID NO: 158703 - protein, 16 aa, Borrelia afzelii
KEKDKDGKYSLKATVD

SEQ ID NO: 158704 - protein, 16 aa, Borrelia afzelii
EKDKDGKYSLKATVDK

SEQ ID NO: 158705 - protein, 16 aa, Borrelia afzelii
KDKDGKYSLKATVDKI

SEQ ID NO: 158706 - protein, 16 aa, Borrelia afzelii
DKDGKYSLKATVDKIE

SEQ ID NO: 158707 - protein, 16 aa, Borrelia afzelii
KDGKYSLKATVDKIEL

SEQ ID NO: 158708 - protein, 16 aa, Borrelia afzelii
DGKYSLKATVDKIELK

SEQ ID NO: 158709 - protein, 16 aa, Borrelia afzelii
GKYSLKATVDKIELKG

SEQ ID NO: 158710 - protein, 16 aa, Borrelia afzelii
KYSLKATVDKIELKGT

SEQ ID NO: 158711 - protein, 16 aa, Borrelia afzelii
YSLKATVDKIELKGTS

SEQ ID NO: 158712 - protein, 16 aa, Borrelia afzelii
SLKATVDKIELKGTSD

SEQ ID NO: 158713 - protein, 16 aa, Borrelia afzelii
LKATVDKIELKGTSDK

SEQ ID NO: 158714 - protein, 16 aa, Borrelia afzelii
KATVDKIELKGTSDKD

SEQ ID NO: 158715 - protein, 16 aa, Borrelia afzelii
ATVDKIELKGTSDKDN

SEQ ID NO: 158716 - protein, 16 aa, Borrelia afzelii
TVDKIELKGTSDKDNG

SEQ ID NO: 158717 - protein, 16 aa, Borrelia afzelii
VDKIELKGTSDKDNGS

SEQ ID NO: 158718 - protein, 16 aa, Borrelia afzelii
DKIELKGTSDKDNGSG

SEQ ID NO: 158719 - protein, 16 aa, Borrelia afzelii
KIELKGTSDKDNGSGV

SEQ ID NO: 158720 - protein, 16 aa, Borrelia afzelii
IELKGTSDKDNGSGVL

SEQ ID NO: 158721 - protein, 16 aa, Borrelia afzelii
ELKGTSDKDNGSGVLE

SEQ ID NO: 158722 - protein, 16 aa, Borrelia afzelii
LKGTSDKDNGSGVLEG

SEQ ID NO: 158723 - protein, 16 aa, Borrelia afzelii
KGTSDKDNGSGVLEGT

SEQ ID NO: 158724 - protein, 16 aa, Borrelia afzelii
GTSDKDNGSGVLEGTK

SEQ ID NO: 158725 - protein, 16 aa, Borrelia afzelii
TSDKDNGSGVLEGTKD

SEQ ID NO: 158726 - protein, 16 aa, Borrelia afzelii
SDKDNGSGVLEGTKDD

SEQ ID NO: 158727 - protein, 16 aa, Borrelia afzelii
DKDNGSGVLEGTKDDK

SEQ ID NO: 158728 - protein, 16 aa, Borrelia afzelii
KDNGSGVLEGTKDDKS

SEQ ID NO: 158729 - protein, 16 aa, Borrelia afzelii
DNGSGVLEGTKDDKSK

SEQ ID NO: 158730 - protein, 16 aa, Borrelia afzelii
NGSGVLEGTKDDKSKA

SEQ ID NO: 158731 - protein, 16 aa, Borrelia afzelii
GSGVLEGTKDDKSKAK

SEQ ID NO: 158732 - protein, 16 aa, Borrelia afzelii
SGVLEGTKDDKSKAKL

SEQ ID NO: 158733 - protein, 16 aa, Borrelia afzelii
GVLEGTKDDKSKAKLT

SEQ ID NO: 158734 - protein, 16 aa, Borrelia afzelii
VLEGTKDDKSKAKLTI

SEQ ID NO: 158735 - protein, 16 aa, Borrelia afzelii
LEGTKDDKSKAKLTIA

SEQ ID NO: 158736 - protein, 16 aa, Borrelia afzelii
EGTKDDKSKAKLTIAD

SEQ ID NO: 158737 - protein, 16 aa, Borrelia afzelii
GTKDDKSKAKLTIADD

SEQ ID NO: 158738 - protein, 16 aa, Borrelia afzelii
TKDDKSKAKLTIADDL

SEQ ID NO: 158739 - protein, 16 aa, Borrelia afzelii
KDDKSKAKLTIADDLS

SEQ ID NO: 158740 - protein, 16 aa, Borrelia afzelii
DDKSKAKLTIADDLSK

SEQ ID NO: 158741 - protein, 16 aa, Borrelia afzelii
DKSKAKLTIADDLSKT

SEQ ID NO: 158742 - protein, 16 aa, Borrelia afzelii
KSKAKLTIADDLSKTT

SEQ ID NO: 158743 - protein, 16 aa, Borrelia afzelii
SKAKLTIADDLSKTTF

SEQ ID NO: 158744 - protein, 16 aa, Borrelia afzelii
KAKLTIADDLSKTTFE

SEQ ID NO: 158745 - protein, 16 aa, Borrelia afzelii
AKLTIADDLSKTTFEL

SEQ ID NO: 158746 - protein, 16 aa, Borrelia afzelii
KLTIADDLSKTTFELF

SEQ ID NO: 158747 - protein, 16 aa, Borrelia afzelii
LTIADDLSKTTFELFK

SEQ ID NO: 158748 - protein, 16 aa, Borrelia afzelii
TIADDLSKTTFELFKE

SEQ ID NO: 158749 - protein, 16 aa, Borrelia afzelii
IADDLSKTTFELFKED

SEQ ID NO: 158750 - protein, 16 aa, Borrelia afzelii
ADDLSKTTFELFKEDG

SEQ ID NO: 158751 - protein, 16 aa, Borrelia afzelii
DDLSKTTFELFKEDGK

SEQ ID NO: 158752 - protein, 16 aa, Borrelia afzelii
DLSKTTFELFKEDGKT

SEQ ID NO: 158753 - protein, 16 aa, Borrelia afzelii
LSKTTFELFKEDGKTL

SEQ ID NO: 158754 - protein, 16 aa, Borrelia afzelii
SKTTFELFKEDGKTLV

SEQ ID NO: 158755 - protein, 16 aa, Borrelia afzelii
KTTFELFKEDGKTLVS

SEQ ID NO: 158756 - protein, 16 aa, Borrelia afzelii
TTFELFKEDGKTLVSR

SEQ ID NO: 158757 - protein, 16 aa, Borrelia afzelii
TFELFKEDGKTLVSRK

SEQ ID NO: 158758 - protein, 16 aa, Borrelia afzelii
FELFKEDGKTLVSRKV

SEQ ID NO: 158759 - protein, 16 aa, Borrelia afzelii
ELFKEDGKTLVSRKVS

SEQ ID NO: 158760 - protein, 16 aa, Borrelia afzelii
LFKEDGKTLVSRKVSS

SEQ ID NO: 158761 - protein, 16 aa, Borrelia afzelii
FKEDGKTLVSRKVSSK

SEQ ID NO: 158762 - protein, 16 aa, Borrelia afzelii
KEDGKTLVSRKVSSKD

SEQ ID NO: 158763 - protein, 16 aa, Borrelia afzelii
EDGKTLVSRKVSSKDK

SEQ ID NO: 158764 - protein, 16 aa, Borrelia afzelii
DGKTLVSRKVSSKDKT

SEQ ID NO: 158765 - protein, 16 aa, Borrelia afzelii
GKTLVSRKVSSKDKTS

SEQ ID NO: 158766 - protein, 16 aa, Borrelia afzelii
KTLVSRKVSSKDKTST

SEQ ID NO: 158767 - protein, 16 aa, Borrelia afzelii
TLVSRKVSSKDKTSTD

SEQ ID NO: 158768 - protein, 16 aa, Borrelia afzelii
LVSRKVSSKDKTSTDE

SEQ ID NO: 158769 - protein, 16 aa, Borrelia afzelii
VSRKVSSKDKTSTDEM

SEQ ID NO: 158770 - protein, 16 aa, Borrelia afzelii
SRKVSSKDKTSTDEMF

SEQ ID NO: 158771 - protein, 16 aa, Borrelia afzelii
RKVSSKDKTSTDEMFN

SEQ ID NO: 158772 - protein, 16 aa, Borrelia afzelii
KVSSKDKTSTDEMFNE

SEQ ID NO: 158773 - protein, 16 aa, Borrelia afzelii
VSSKDKTSTDEMFNEK

SEQ ID NO: 158774 - protein, 16 aa, Borrelia afzelii
SSKDKTSTDEMFNEKG

SEQ ID NO: 158775 - protein, 16 aa, Borrelia afzelii
SKDKTSTDEMFNEKGE

SEQ ID NO: 158776 - protein, 16 aa, Borrelia afzelii
KDKTSTDEMFNEKGEL

SEQ ID NO: 158777 - protein, 16 aa, Borrelia afzelii
DKTSTDEMFNEKGELS

SEQ ID NO: 158778 - protein, 16 aa, Borrelia afzelii
KTSTDEMFNEKGELSA

SEQ ID NO: 158779 - protein, 16 aa, Borrelia afzelii
TSTDEMFNEKGELSAK

SEQ ID NO: 158780 - protein, 16 aa, Borrelia afzelii
STDEMFNEKGELSAKT

SEQ ID NO: 158781 - protein, 16 aa, Borrelia afzelii
TDEMFNEKGELSAKTM

SEQ ID NO: 158782 - protein, 16 aa, Borrelia afzelii
DEMFNEKGELSAKTMT

SEQ ID NO: 158783 - protein, 16 aa, Borrelia afzelii
EMFNEKGELSAKTMTR

SEQ ID NO: 158784 - protein, 16 aa, Borrelia afzelii
MFNEKGELSAKTMTRE

SEQ ID NO: 158785 - protein, 16 aa, Borrelia afzelii
FNEKGELSAKTMTREN

SEQ ID NO: 158786 - protein, 16 aa, Borrelia afzelii
NEKGELSAKTMTRENG

SEQ ID NO: 158787 - protein, 16 aa, Borrelia afzelii
EKGELSAKTMTRENGT

SEQ ID NO: 158788 - protein, 16 aa, Borrelia afzelii
KGELSAKTMTRENGTK

SEQ ID NO: 158789 - protein, 16 aa, Borrelia afzelii
GELSAKTMTRENGTKL

SEQ ID NO: 158790 - protein, 16 aa, Borrelia afzelii
ELSAKTMTRENGTKLE

SEQ ID NO: 158791 - protein, 16 aa, Borrelia afzelii
LSAKTMTRENGTKLEY

SEQ ID NO: 158792 - protein, 16 aa, Borrelia afzelii
SAKTMTRENGTKLEYT

SEQ ID NO: 158793 - protein, 16 aa, Borrelia afzelii
AKTMTRENGTKLEYTE

SEQ ID NO: 158794 - protein, 16 aa, Borrelia afzelii
KTMTRENGTKLEYTEM

SEQ ID NO: 158795 - protein, 16 aa, Borrelia afzelii
TMTRENGTKLEYTEMK

SEQ ID NO: 158796 - protein, 16 aa, Borrelia afzelii
MTRENGTKLEYTEMKS

SEQ ID NO: 158797 - protein, 16 aa, Borrelia afzelii
TRENGTKLEYTEMKSD

SEQ ID NO: 158798 - protein, 16 aa, Borrelia afzelii
RENGTKLEYTEMKSDG

SEQ ID NO: 158799 - protein, 16 aa, Borrelia afzelii
ENGTKLEYTEMKSDGT

SEQ ID NO: 158800 - protein, 16 aa, Borrelia afzelii
NGTKLEYTEMKSDGTG

SEQ ID NO: 158801 - protein, 16 aa, Borrelia afzelii
GTKLEYTEMKSDGTGK

SEQ ID NO: 158802 - protein, 16 aa, Borrelia afzelii
TKLEYTEMKSDGTGKA

SEQ ID NO: 158803 - protein, 16 aa, Borrelia afzelii
KLEYTEMKSDGTGKAK

SEQ ID NO: 158804 - protein, 16 aa, Borrelia afzelii
LEYTEMKSDGTGKAKE

SEQ ID NO: 158805 - protein, 16 aa, Borrelia afzelii
EYTEMKSDGTGKAKEV

SEQ ID NO: 158806 - protein, 16 aa, Borrelia afzelii
YTEMKSDGTGKAKEVL

SEQ ID NO: 158807 - protein, 16 aa, Borrelia afzelii
TEMKSDGTGKAKEVLK

SEQ ID NO: 158808 - protein, 16 aa, Borrelia afzelii
EMKSDGTGKAKEVLKN

SEQ ID NO: 158809 - protein, 16 aa, Borrelia afzelii
MKSDGTGKAKEVLKNF

SEQ ID NO: 158810 - protein, 16 aa, Borrelia afzelii
KSDGTGKAKEVLKNFT

SEQ ID NO: 158811 - protein, 16 aa, Borrelia afzelii
SDGTGKAKEVLKNFTL

SEQ ID NO: 158812 - protein, 16 aa, Borrelia afzelii
DGTGKAKEVLKNFTLE

SEQ ID NO: 158813 - protein, 16 aa, Borrelia afzelii
GTGKAKEVLKNFTLEG

SEQ ID NO: 158814 - protein, 16 aa, Borrelia afzelii
TGKAKEVLKNFTLEGK

SEQ ID NO: 158815 - protein, 16 aa, Borrelia afzelii
GKAKEVLKNFTLEGKV

SEQ ID NO: 158816 - protein, 16 aa, Borrelia afzelii
KAKEVLKNFTLEGKVA

SEQ ID NO: 158817 - protein, 16 aa, Borrelia afzelii
AKEVLKNFTLEGKVAN

SEQ ID NO: 158818 - protein, 16 aa, Borrelia afzelii
KEVLKNFTLEGKVAND

SEQ ID NO: 158819 - protein, 16 aa, Borrelia afzelii
EVLKNFTLEGKVANDK

SEQ ID NO: 158820 - protein, 16 aa, Borrelia afzelii
VLKNFTLEGKVANDKV

SEQ ID NO: 158821 - protein, 16 aa, Borrelia afzelii
LKNFTLEGKVANDKVT

SEQ ID NO: 158822 - protein, 16 aa, Borrelia afzelii
KNFTLEGKVANDKVTL

SEQ ID NO: 158823 - protein, 16 aa, Borrelia afzelii
NFTLEGKVANDKVTLE

SEQ ID NO: 158824 - protein, 16 aa, Borrelia afzelii
FTLEGKVANDKVTLEV

SEQ ID NO: 158825 - protein, 16 aa, Borrelia afzelii
TLEGKVANDKVTLEVK

SEQ ID NO: 158826 - protein, 16 aa, Borrelia afzelii
LEGKVANDKVTLEVKE

SEQ ID NO: 158827 - protein, 16 aa, Borrelia afzelii
EGKVANDKVTLEVKEG

SEQ ID NO: 158828 - protein, 16 aa, Borrelia afzelii
GKVANDKVTLEVKEGT

SEQ ID NO: 158829 - protein, 16 aa, Borrelia afzelii
KVANDKVTLEVKEGTV

SEQ ID NO: 158830 - protein, 16 aa, Borrelia afzelii
VANDKVTLEVKEGTVT

SEQ ID NO: 158831 - protein, 16 aa, Borrelia afzelii
ANDKVTLEVKEGTVTL

SEQ ID NO: 158832 - protein, 16 aa, Borrelia afzelii
NDKVTLEVKEGTVTLS

SEQ ID NO: 158833 - protein, 16 aa, Borrelia afzelii
DKVTLEVKEGTVTLSK

SEQ ID NO: 158834 - protein, 16 aa, Borrelia afzelii
KVTLEVKEGTVTLSKE

SEQ ID NO: 158835 - protein, 16 aa, Borrelia afzelii
VTLEVKEGTVTLSKEI

SEQ ID NO: 158836 - protein, 16 aa, Borrelia afzelii
TLEVKEGTVTLSKEIA

SEQ ID NO: 158837 - protein, 16 aa, Borrelia afzelii
LEVKEGTVTLSKEIAK

SEQ ID NO: 158838 - protein, 16 aa, Borrelia afzelii
EVKEGTVTLSKEIAKS

SEQ ID NO: 158839 - protein, 16 aa, Borrelia afzelii
VKEGTVTLSKEIAKSG

SEQ ID NO: 158840 - protein, 16 aa, Borrelia afzelii
KEGTVTLSKEIAKSGE

SEQ ID NO: 158841 - protein, 16 aa, Borrelia afzelii
EGTVTLSKEIAKSGEV

SEQ ID NO: 158842 - protein, 16 aa, Borrelia afzelii
GTVTLSKEIAKSGEVT

SEQ ID NO: 158843 - protein, 16 aa, Borrelia afzelii
TVTLSKEIAKSGEVTV

SEQ ID NO: 158844 - protein, 16 aa, Borrelia afzelii
VTLSKEIAKSGEVTVA

SEQ ID NO: 158845 - protein, 16 aa, Borrelia afzelii
TLSKEIAKSGEVTVAL

SEQ ID NO: 158846 - protein, 16 aa, Borrelia afzelii
LSKEIAKSGEVTVALN

SEQ ID NO: 158847 - protein, 16 aa, Borrelia afzelii
SKEIAKSGEVTVALND

SEQ ID NO: 158848 - protein, 16 aa, Borrelia afzelii
KEIAKSGEVTVALNDT

SEQ ID NO: 158849 - protein, 16 aa, Borrelia afzelii
EIAKSGEVTVALNDTN

SEQ ID NO: 158850 - protein, 16 aa, Borrelia afzelii
IAKSGEVTVALNDTNT

SEQ ID NO: 158851 - protein, 16 aa, Borrelia afzelii
AKSGEVTVALNDTNTT

SEQ ID NO: 158852 - protein, 16 aa, Borrelia afzelii
KSGEVTVALNDTNTTQ

SEQ ID NO: 158853 - protein, 16 aa, Borrelia afzelii
SGEVTVALNDTNTTQA

SEQ ID NO: 158854 - protein, 16 aa, Borrelia afzelii
GEVTVALNDTNTTQAT

SEQ ID NO: 158855 - protein, 16 aa, Borrelia afzelii
EVTVALNDTNTTQATK

SEQ ID NO: 158856 - protein, 16 aa, Borrelia afzelii
VTVALNDTNTTQATKK

SEQ ID NO: 158857 - protein, 16 aa, Borrelia afzelii
TVALNDTNTTQATKKT

SEQ ID NO: 158858 - protein, 16 aa, Borrelia afzelii
VALNDTNTTQATKKTG

SEQ ID NO: 158859 - protein, 16 aa, Borrelia afzelii
ALNDTNTTQATKKTGA

SEQ ID NO: 158860 - protein, 16 aa, Borrelia afzelii
LNDTNTTQATKKTGAW

SEQ ID NO: 158861 - protein, 16 aa, Borrelia afzelii
NDTNTTQATKKTGAWD

SEQ ID NO: 158862 - protein, 16 aa, Borrelia afzelii
DTNTTQATKKTGAWDS

SEQ ID NO: 158863 - protein, 16 aa, Borrelia afzelii
TNTTQATKKTGAWDSK

SEQ ID NO: 158864 - protein, 16 aa, Borrelia afzelii
NTTQATKKTGAWDSKT

SEQ ID NO: 158865 - protein, 16 aa, Borrelia afzelii
TTQATKKTGAWDSKTS

SEQ ID NO: 158866 - protein, 16 aa, Borrelia afzelii
TQATKKTGAWDSKTST

SEQ ID NO: 158867 - protein, 16 aa, Borrelia afzelii
QATKKTGAWDSKTSTL

SEQ ID NO: 158868 - protein, 16 aa, Borrelia afzelii
ATKKTGAWDSKTSTLT

SEQ ID NO: 158869 - protein, 16 aa, Borrelia afzelii
TKKTGAWDSKTSTLTI

SEQ ID NO: 158870 - protein, 16 aa, Borrelia afzelii
KKTGAWDSKTSTLTIS

SEQ ID NO: 158871 - protein, 16 aa, Borrelia afzelii
KTGAWDSKTSTLTISV

SEQ ID NO: 158872 - protein, 16 aa, Borrelia afzelii
TGAWDSKTSTLTISVN

SEQ ID NO: 158873 - protein, 16 aa, Borrelia afzelii
GAWDSKTSTLTISVNS

SEQ ID NO: 158874 - protein, 16 aa, Borrelia afzelii
AWDSKTSTLTISVNSK

SEQ ID NO: 158875 - protein, 16 aa, Borrelia afzelii
WDSKTSTLTISVNSKK

SEQ ID NO: 158876 - protein, 16 aa, Borrelia afzelii
DSKTSTLTISVNSKKT

SEQ ID NO: 158877 - protein, 16 aa, Borrelia afzelii
SKTSTLTISVNSKKTT

SEQ ID NO: 158878 - protein, 16 aa, Borrelia afzelii
KTSTLTISVNSKKTTQ

SEQ ID NO: 158879 - protein, 16 aa, Borrelia afzelii
TSTLTISVNSKKTTQL

SEQ ID NO: 158880 - protein, 16 aa, Borrelia afzelii
STLTISVNSKKTTQLV

SEQ ID NO: 158881 - protein, 16 aa, Borrelia afzelii
TLTISVNSKKTTQLVF

SEQ ID NO: 158882 - protein, 16 aa, Borrelia afzelii
LTISVNSKKTTQLVFT

SEQ ID NO: 158883 - protein, 16 aa, Borrelia afzelii
TISVNSKKTTQLVFTK

SEQ ID NO: 158884 - protein, 16 aa, Borrelia afzelii
ISVNSKKTTQLVFTKQ

SEQ ID NO: 158885 - protein, 16 aa, Borrelia afzelii
SVNSKKTTQLVFTKQD

SEQ ID NO: 158886 - protein, 16 aa, Borrelia afzelii
VNSKKTTQLVFTKQDT

SEQ ID NO: 158887 - protein, 16 aa, Borrelia afzelii
NSKKTTQLVFTKQDTI

SEQ ID NO: 158888 - protein, 16 aa, Borrelia afzelii
SKKTTQLVFTKQDTIT

SEQ ID NO: 158889 - protein, 16 aa, Borrelia afzelii
KKTTQLVFTKQDTITV

SEQ ID NO: 158890 - protein, 16 aa, Borrelia afzelii
KTTQLVFTKQDTITVQ

SEQ ID NO: 158891 - protein, 16 aa, Borrelia afzelii
TTQLVFTKQDTITVQK

SEQ ID NO: 158892 - protein, 16 aa, Borrelia afzelii
TQLVFTKQDTITVQKY

SEQ ID NO: 158893 - protein, 16 aa, Borrelia afzelii
QLVFTKQDTITVQKYD

SEQ ID NO: 158894 - protein, 16 aa, Borrelia afzelii
LVFTKQDTITVQKYDS

SEQ ID NO: 158895 - protein, 16 aa, Borrelia afzelii
VFTKQDTITVQKYDSA

SEQ ID NO: 158896 - protein, 16 aa, Borrelia afzelii
FTKQDTITVQKYDSAG

SEQ ID NO: 158897 - protein, 16 aa, Borrelia afzelii
TKQDTITVQKYDSAGT

SEQ ID NO: 158898 - protein, 16 aa, Borrelia afzelii
KQDTITVQKYDSAGTN

SEQ ID NO: 158899 - protein, 16 aa, Borrelia afzelii
QDTITVQKYDSAGTNL

SEQ ID NO: 158900 - protein, 16 aa, Borrelia afzelii
DTITVQKYDSAGTNLE

SEQ ID NO: 158901 - protein, 16 aa, Borrelia afzelii
TITVQKYDSAGTNLEG

SEQ ID NO: 158902 - protein, 16 aa, Borrelia afzelii
ITVQKYDSAGTNLEGT

SEQ ID NO: 158903 - protein, 16 aa, Borrelia afzelii
TVQKYDSAGTNLEGTA

SEQ ID NO: 158904 - protein, 16 aa, Borrelia afzelii
VQKYDSAGTNLEGTAV

SEQ ID NO: 158905 - protein, 16 aa, Borrelia afzelii
QKYDSAGTNLEGTAVE

SEQ ID NO: 158906 - protein, 16 aa, Borrelia afzelii
KYDSAGTNLEGTAVEI

SEQ ID NO: 158907 - protein, 16 aa, Borrelia afzelii
YDSAGTNLEGTAVEIK

SEQ ID NO: 158908 - protein, 16 aa, Borrelia afzelii
DSAGTNLEGTAVEIKT

SEQ ID NO: 158909 - protein, 16 aa, Borrelia afzelii
SAGTNLEGTAVEIKTL

SEQ ID NO: 158910 - protein, 16 aa, Borrelia afzelii
AGTNLEGTAVEIKTLD

SEQ ID NO: 158911 - protein, 16 aa, Borrelia afzelii
GTNLEGTAVEIKTLDE

SEQ ID NO: 158912 - protein, 16 aa, Borrelia afzelii
TNLEGTAVEIKTLDEL

SEQ ID NO: 158913 - protein, 16 aa, Borrelia afzelii
NLEGTAVEIKTLDELK

SEQ ID NO: 158914 - protein, 16 aa, Borrelia afzelii
LEGTAVEIKTLDELKN

SEQ ID NO: 158915 - protein, 16 aa, Borrelia afzelii
EGTAVEIKTLDELKNA

SEQ ID NO: 158916 - protein, 16 aa, Borrelia afzelii
GTAVEIKTLDELKNAL

SEQ ID NO: 158917 - protein, 16 aa, Borrelia afzelii
TAVEIKTLDELKNALK

SEQ ID NO: 158918 - protein, 8 aa, Borrelia afzelii PKo
MKQYLLVF

SEQ ID NO: 158919 - protein, 8 aa, Borrelia afzelii PKo
KQYLLVFA

SEQ ID NO: 158920 - protein, 8 aa, Borrelia afzelii PKo
QYLLVFAL

SEQ ID NO: 158921 - protein, 8 aa, Borrelia afzelii PKo
YLLVFALV

SEQ ID NO: 158922 - protein, 8 aa, Borrelia afzelii PKo
LLVFALVL

SEQ ID NO: 158923 - protein, 8 aa, Borrelia afzelii PKo
LVFALVLA

SEQ ID NO: 158924 - protein, 8 aa, Borrelia afzelii PKo
VFALVLAL

SEQ ID NO: 158925 - protein, 8 aa, Borrelia afzelii PKo
FALVLALI

SEQ ID NO: 158926 - protein, 8 aa, Borrelia afzelii PKo
ALVLALIA

SEQ ID NO: 158927 - protein, 8 aa, Borrelia afzelii PKo
LVLALIAC

SEQ ID NO: 158928 - protein, 8 aa, Borrelia afzelii PKo
VLALIACS

SEQ ID NO: 158929 - protein, 8 aa, Borrelia afzelii PKo
LALIACSQ

SEQ ID NO: 158930 - protein, 8 aa, Borrelia afzelii PKo
ALIACSQK

SEQ ID NO: 158931 - protein, 8 aa, Borrelia afzelii PKo
LIACSQKG

SEQ ID NO: 158932 - protein, 8 aa, Borrelia afzelii PKo
IACSQKGT

SEQ ID NO: 158933 - protein, 8 aa, Borrelia afzelii PKo
ACSQKGTE

SEQ ID NO: 158934 - protein, 8 aa, Borrelia afzelii PKo
CSQKGTEP

SEQ ID NO: 158935 - protein, 8 aa, Borrelia afzelii PKo
SQKGTEPK

SEQ ID NO: 158936 - protein, 8 aa, Borrelia afzelii PKo
QKGTEPKS

SEQ ID NO: 158937 - protein, 8 aa, Borrelia afzelii PKo
KGTEPKST

SEQ ID NO: 158938 - protein, 8 aa, Borrelia afzelii PKo
GTEPKSTS

SEQ ID NO: 158939 - protein, 8 aa, Borrelia afzelii PKo
TEPKSTSQ

SEQ ID NO: 158940 - protein, 8 aa, Borrelia afzelii PKo
EPKSTSQD

SEQ ID NO: 158941 - protein, 8 aa, Borrelia afzelii PKo
PKSTSQDH

SEQ ID NO: 158942 - protein, 8 aa, Borrelia afzelii PKo
KSTSQDHN

SEQ ID NO: 158943 - protein, 8 aa, Borrelia afzelii PKo
STSQDHND

SEQ ID NO: 158944 - protein, 8 aa, Borrelia afzelii PKo
TSQDHNDQ

SEQ ID NO: 158945 - protein, 8 aa, Borrelia afzelii PKo
SQDHNDQE

SEQ ID NO: 158946 - protein, 8 aa, Borrelia afzelii PKo
QDHNDQEI

SEQ ID NO: 158947 - protein, 8 aa, Borrelia afzelii PKo
DHNDQEII

SEQ ID NO: 158948 - protein, 8 aa, Borrelia afzelii PKo
HNDQEIIN

SEQ ID NO: 158949 - protein, 8 aa, Borrelia afzelii PKo
NDQEIINS

SEQ ID NO: 158950 - protein, 8 aa, Borrelia afzelii PKo
DQEIINSD

SEQ ID NO: 158951 - protein, 8 aa, Borrelia afzelii PKo
QEIINSDN

SEQ ID NO: 158952 - protein, 8 aa, Borrelia afzelii PKo
EIINSDNT

SEQ ID NO: 158953 - protein, 8 aa, Borrelia afzelii PKo
IINSDNTP

SEQ ID NO: 158954 - protein, 8 aa, Borrelia afzelii PKo
INSDNTPK

SEQ ID NO: 158955 - protein, 8 aa, Borrelia afzelii PKo
NSDNTPKD

SEQ ID NO: 158956 - protein, 8 aa, Borrelia afzelii PKo
SDNTPKDS

SEQ ID NO: 158957 - protein, 8 aa, Borrelia afzelii PKo
DNTPKDSK

SEQ ID NO: 158958 - protein, 8 aa, Borrelia afzelii PKo
NTPKDSKK

SEQ ID NO: 158959 - protein, 8 aa, Borrelia afzelii PKo
TPKDSKKD

SEQ ID NO: 158960 - protein, 8 aa, Borrelia afzelii PKo
PKDSKKDL

SEQ ID NO: 158961 - protein, 8 aa, Borrelia afzelii PKo
KDSKKDLT

SEQ ID NO: 158962 - protein, 8 aa, Borrelia afzelii PKo
DSKKDLTV

SEQ ID NO: 158963 - protein, 8 aa, Borrelia afzelii PKo
SKKDLTVL

SEQ ID NO: 158964 - protein, 8 aa, Borrelia afzelii PKo
KKDLTVLA

SEQ ID NO: 158965 - protein, 8 aa, Borrelia afzelii PKo
KDLTVLAE

SEQ ID NO: 158966 - protein, 8 aa, Borrelia afzelii PKo
DLTVLAEE

SEQ ID NO: 158967 - protein, 8 aa, Borrelia afzelii PKo
LTVLAEEN

SEQ ID NO: 158968 - protein, 8 aa, Borrelia afzelii PKo
TVLAEENS

SEQ ID NO: 158969 - protein, 8 aa, Borrelia afzelii PKo
VLAEENSV

SEQ ID NO: 158970 - protein, 8 aa, Borrelia afzelii PKo
LAEENSVP

SEQ ID NO: 158971 - protein, 8 aa, Borrelia afzelii PKo
AEENSVPL

SEQ ID NO: 158972 - protein, 8 aa, Borrelia afzelii PKo
EENSVPLF

SEQ ID NO: 158973 - protein, 8 aa, Borrelia afzelii PKo
ENSVPLFN

SEQ ID NO: 158974 - protein, 8 aa, Borrelia afzelii PKo
NSVPLFNG

SEQ ID NO: 158975 - protein, 8 aa, Borrelia afzelii PKo
SVPLFNGN

SEQ ID NO: 158976 - protein, 8 aa, Borrelia afzelii PKo
VPLFNGNK

SEQ ID NO: 158977 - protein, 8 aa, Borrelia afzelii PKo
PLFNGNKI

SEQ ID NO: 158978 - protein, 8 aa, Borrelia afzelii PKo
LFNGNKIF

SEQ ID NO: 158979 - protein, 8 aa, Borrelia afzelii PKo
FNGNKIFV

SEQ ID NO: 158980 - protein, 8 aa, Borrelia afzelii PKo
NGNKIFVS

SEQ ID NO: 158981 - protein, 8 aa, Borrelia afzelii PKo
GNKIFVSK

SEQ ID NO: 158982 - protein, 8 aa, Borrelia afzelii PKo
NKIFVSKE

SEQ ID NO: 158983 - protein, 8 aa, Borrelia afzelii PKo
KIFVSKEK

SEQ ID NO: 158984 - protein, 8 aa, Borrelia afzelii PKo
IFVSKEKN

SEQ ID NO: 158985 - protein, 8 aa, Borrelia afzelii PKo
FVSKEKNS

SEQ ID NO: 158986 - protein, 8 aa, Borrelia afzelii PKo
VSKEKNSA

SEQ ID NO: 158987 - protein, 8 aa, Borrelia afzelii PKo
SKEKNSAG

SEQ ID NO: 158988 - protein, 8 aa, Borrelia afzelii PKo
KEKNSAGK

SEQ ID NO: 158989 - protein, 8 aa, Borrelia afzelii PKo
EKNSAGKY

SEQ ID NO: 158990 - protein, 8 aa, Borrelia afzelii PKo
KNSAGKYE

SEQ ID NO: 158991 - protein, 8 aa, Borrelia afzelii PKo
NSAGKYEL

SEQ ID NO: 158992 - protein, 8 aa, Borrelia afzelii PKo
SAGKYELR

SEQ ID NO: 158993 - protein, 8 aa, Borrelia afzelii PKo
AGKYELRA

SEQ ID NO: 158994 - protein, 8 aa, Borrelia afzelii PKo
GKYELRAT

SEQ ID NO: 158995 - protein, 8 aa, Borrelia afzelii PKo
KYELRATV

SEQ ID NO: 158996 - protein, 8 aa, Borrelia afzelii PKo
YELRATVD

SEQ ID NO: 158997 - protein, 8 aa, Borrelia afzelii PKo
ELRATVDT

SEQ ID NO: 158998 - protein, 8 aa, Borrelia afzelii PKo
LRATVDTV

SEQ ID NO: 158999 - protein, 8 aa, Borrelia afzelii PKo
RATVDTVE

SEQ ID NO: 159000 - protein, 8 aa, Borrelia afzelii PKo
ATVDTVEL

SEQ ID NO: 159001 - protein, 8 aa, Borrelia afzelii PKo
TVDTVELK

SEQ ID NO: 159002 - protein, 8 aa, Borrelia afzelii PKo
VDTVELKG

SEQ ID NO: 159003 - protein, 8 aa, Borrelia afzelii PKo
DTVELKGV

SEQ ID NO: 159004 - protein, 8 aa, Borrelia afzelii PKo
TVELKGVS

SEQ ID NO: 159005 - protein, 8 aa, Borrelia afzelii PKo
VELKGVSD

SEQ ID NO: 159006 - protein, 8 aa, Borrelia afzelii PKo
ELKGVSDK

SEQ ID NO: 159007 - protein, 8 aa, Borrelia afzelii PKo
LKGVSDKN

SEQ ID NO: 159008 - protein, 8 aa, Borrelia afzelii PKo
KGVSDKNN

SEQ ID NO: 159009 - protein, 8 aa, Borrelia afzelii PKo
GVSDKNNG

SEQ ID NO: 159010 - protein, 8 aa, Borrelia afzelii PKo
VSDKNNGS

SEQ ID NO: 159011 - protein, 8 aa, Borrelia afzelii PKo
SDKNNGSG

SEQ ID NO: 159012 - protein, 8 aa, Borrelia afzelii PKo
DKNNGSGK

SEQ ID NO: 159013 - protein, 8 aa, Borrelia afzelii PKo
KNNGSGKL

SEQ ID NO: 159014 - protein, 8 aa, Borrelia afzelii PKo
NNGSGKLE

SEQ ID NO: 159015 - protein, 8 aa, Borrelia afzelii PKo
NGSGKLEG

SEQ ID NO: 159016 - protein, 8 aa, Borrelia afzelii PKo
GSGKLEGT

SEQ ID NO: 159017 - protein, 8 aa, Borrelia afzelii PKo
SGKLEGTK

SEQ ID NO: 159018 - protein, 8 aa, Borrelia afzelii PKo
GKLEGTKA

SEQ ID NO: 159019 - protein, 8 aa, Borrelia afzelii PKo
KLEGTKAD

SEQ ID NO: 159020 - protein, 8 aa, Borrelia afzelii PKo
LEGTKADK

SEQ ID NO: 159021 - protein, 8 aa, Borrelia afzelii PKo
EGTKADKT

SEQ ID NO: 159022 - protein, 8 aa, Borrelia afzelii PKo
GTKADKTK

SEQ ID NO: 159023 - protein, 8 aa, Borrelia afzelii PKo
TKADKTKV

SEQ ID NO: 159024 - protein, 8 aa, Borrelia afzelii PKo
KADKTKVA

SEQ ID NO: 159025 - protein, 8 aa, Borrelia afzelii PKo
ADKTKVAM

SEQ ID NO: 159026 - protein, 8 aa, Borrelia afzelii PKo
DKTKVAMT

SEQ ID NO: 159027 - protein, 8 aa, Borrelia afzelii PKo
KTKVAMTI

SEQ ID NO: 159028 - protein, 8 aa, Borrelia afzelii PKo
TKVAMTIA

SEQ ID NO: 159029 - protein, 8 aa, Borrelia afzelii PKo
KVAMTIAD

SEQ ID NO: 159030 - protein, 8 aa, Borrelia afzelii PKo
VAMTIADD

SEQ ID NO: 159031 - protein, 8 aa, Borrelia afzelii PKo
AMTIADDL

SEQ ID NO: 159032 - protein, 8 aa, Borrelia afzelii PKo
MTIADDLN

SEQ ID NO: 159033 - protein, 8 aa, Borrelia afzelii PKo
TIADDLNT

SEQ ID NO: 159034 - protein, 8 aa, Borrelia afzelii PKo
IADDLNTI

SEQ ID NO: 159035 - protein, 8 aa, Borrelia afzelii PKo
ADDLNTIT

SEQ ID NO: 159036 - protein, 8 aa, Borrelia afzelii PKo
DDLNTITV

SEQ ID NO: 159037 - protein, 8 aa, Borrelia afzelii PKo
DLNTITVE

SEQ ID NO: 159038 - protein, 8 aa, Borrelia afzelii PKo
LNTITVET

SEQ ID NO: 159039 - protein, 8 aa, Borrelia afzelii PKo
NTITVETY

SEQ ID NO: 159040 - protein, 8 aa, Borrelia afzelii PKo
TITVETYD

SEQ ID NO: 159041 - protein, 8 aa, Borrelia afzelii PKo
ITVETYDA

SEQ ID NO: 159042 - protein, 8 aa, Borrelia afzelii PKo
TVETYDAS

SEQ ID NO: 159043 - protein, 8 aa, Borrelia afzelii PKo
VETYDASN

SEQ ID NO: 159044 - protein, 8 aa, Borrelia afzelii PKo
ETYDASNK

SEQ ID NO: 159045 - protein, 8 aa, Borrelia afzelii PKo
TYDASNKK

SEQ ID NO: 159046 - protein, 8 aa, Borrelia afzelii PKo
YDASNKKT

SEQ ID NO: 159047 - protein, 8 aa, Borrelia afzelii PKo
DASNKKTG

SEQ ID NO: 159048 - protein, 8 aa, Borrelia afzelii PKo
ASNKKTGS

SEQ ID NO: 159049 - protein, 8 aa, Borrelia afzelii PKo
SNKKTGSE

SEQ ID NO: 159050 - protein, 8 aa, Borrelia afzelii PKo
NKKTGSEV

SEQ ID NO: 159051 - protein, 8 aa, Borrelia afzelii PKo
KKTGSEVV

SEQ ID NO: 159052 - protein, 8 aa, Borrelia afzelii PKo
KTGSEVVK

SEQ ID NO: 159053 - protein, 8 aa, Borrelia afzelii PKo
TGSEVVKK

SEQ ID NO: 159054 - protein, 8 aa, Borrelia afzelii PKo
GSEVVKKQ

SEQ ID NO: 159055 - protein, 8 aa, Borrelia afzelii PKo
SEVVKKQG

SEQ ID NO: 159056 - protein, 8 aa, Borrelia afzelii PKo
EVVKKQGS

SEQ ID NO: 159057 - protein, 8 aa, Borrelia afzelii PKo
VVKKQGSV

SEQ ID NO: 159058 - protein, 8 aa, Borrelia afzelii PKo
VKKQGSVI

SEQ ID NO: 159059 - protein, 8 aa, Borrelia afzelii PKo
KKQGSVIK

SEQ ID NO: 159060 - protein, 8 aa, Borrelia afzelii PKo
KQGSVIKE

SEQ ID NO: 159061 - protein, 8 aa, Borrelia afzelii PKo
QGSVIKES

SEQ ID NO: 159062 - protein, 8 aa, Borrelia afzelii PKo
GSVIKESY

SEQ ID NO: 159063 - protein, 8 aa, Borrelia afzelii PKo
SVIKESYK

SEQ ID NO: 159064 - protein, 8 aa, Borrelia afzelii PKo
VIKESYKA

SEQ ID NO: 159065 - protein, 8 aa, Borrelia afzelii PKo
IKESYKAN

SEQ ID NO: 159066 - protein, 8 aa, Borrelia afzelii PKo
KESYKANK

SEQ ID NO: 159067 - protein, 8 aa, Borrelia afzelii PKo
ESYKANKL

SEQ ID NO: 159068 - protein, 8 aa, Borrelia afzelii PKo
SYKANKLD

SEQ ID NO: 159069 - protein, 8 aa, Borrelia afzelii PKo
YKANKLDS

SEQ ID NO: 159070 - protein, 8 aa, Borrelia afzelii PKo
KANKLDSK

SEQ ID NO: 159071 - protein, 8 aa, Borrelia afzelii PKo
ANKLDSKK

SEQ ID NO: 159072 - protein, 8 aa, Borrelia afzelii PKo
NKLDSKKI

SEQ ID NO: 159073 - protein, 8 aa, Borrelia afzelii PKo
KLDSKKIT

SEQ ID NO: 159074 - protein, 8 aa, Borrelia afzelii PKo
LDSKKITR

SEQ ID NO: 159075 - protein, 8 aa, Borrelia afzelii PKo
DSKKITRE

SEQ ID NO: 159076 - protein, 8 aa, Borrelia afzelii PKo
SKKITREN

SEQ ID NO: 159077 - protein, 8 aa, Borrelia afzelii PKo
KKITRENE

SEQ ID NO: 159078 - protein, 8 aa, Borrelia afzelii PKo
KITRENET

SEQ ID NO: 159079 - protein, 8 aa, Borrelia afzelii PKo
ITRENETT

SEQ ID NO: 159080 - protein, 8 aa, Borrelia afzelii PKo
TRENETTL

SEQ ID NO: 159081 - protein, 8 aa, Borrelia afzelii PKo
RENETTLE

SEQ ID NO: 159082 - protein, 8 aa, Borrelia afzelii PKo
ENETTLEY

SEQ ID NO: 159083 - protein, 8 aa, Borrelia afzelii PKo
NETTLEYS

SEQ ID NO: 159084 - protein, 8 aa, Borrelia afzelii PKo
ETTLEYSE

SEQ ID NO: 159085 - protein, 8 aa, Borrelia afzelii PKo
TTLEYSEM

SEQ ID NO: 159086 - protein, 8 aa, Borrelia afzelii PKo
TLEYSEMT

SEQ ID NO: 159087 - protein, 8 aa, Borrelia afzelii PKo
LEYSEMTD

SEQ ID NO: 159088 - protein, 8 aa, Borrelia afzelii PKo
EYSEMTDS

SEQ ID NO: 159089 - protein, 8 aa, Borrelia afzelii PKo
YSEMTDSS

SEQ ID NO: 159090 - protein, 8 aa, Borrelia afzelii PKo
SEMTDSSN

SEQ ID NO: 159091 - protein, 8 aa, Borrelia afzelii PKo
EMTDSSNA

SEQ ID NO: 159092 - protein, 8 aa, Borrelia afzelii PKo
MTDSSNAT

SEQ ID NO: 159093 - protein, 8 aa, Borrelia afzelii PKo
TDSSNATK

SEQ ID NO: 159094 - protein, 8 aa, Borrelia afzelii PKo
DSSNATKA

SEQ ID NO: 159095 - protein, 8 aa, Borrelia afzelii PKo
SSNATKAV

SEQ ID NO: 159096 - protein, 8 aa, Borrelia afzelii PKo
SNATKAVE

SEQ ID NO: 159097 - protein, 8 aa, Borrelia afzelii PKo
NATKAVET

SEQ ID NO: 159098 - protein, 8 aa, Borrelia afzelii PKo
ATKAVETL

SEQ ID NO: 159099 - protein, 8 aa, Borrelia afzelii PKo
TKAVETLK

SEQ ID NO: 159100 - protein, 8 aa, Borrelia afzelii PKo
KAVETLKN

SEQ ID NO: 159101 - protein, 8 aa, Borrelia afzelii PKo
AVETLKNG

SEQ ID NO: 159102 - protein, 8 aa, Borrelia afzelii PKo
VETLKNGI

SEQ ID NO: 159103 - protein, 8 aa, Borrelia afzelii PKo
ETLKNGIK

SEQ ID NO: 159104 - protein, 8 aa, Borrelia afzelii PKo
TLKNGIKL

SEQ ID NO: 159105 - protein, 8 aa, Borrelia afzelii PKo
LKNGIKLE

SEQ ID NO: 159106 - protein, 8 aa, Borrelia afzelii PKo
KNGIKLEG

SEQ ID NO: 159107 - protein, 8 aa, Borrelia afzelii PKo
NGIKLEGS

SEQ ID NO: 159108 - protein, 8 aa, Borrelia afzelii PKo
GIKLEGSL

SEQ ID NO: 159109 - protein, 8 aa, Borrelia afzelii PKo
IKLEGSLV

SEQ ID NO: 159110 - protein, 8 aa, Borrelia afzelii PKo
KLEGSLVG

SEQ ID NO: 159111 - protein, 8 aa, Borrelia afzelii PKo
LEGSLVGG

SEQ ID NO: 159112 - protein, 8 aa, Borrelia afzelii PKo
EGSLVGGK

SEQ ID NO: 159113 - protein, 8 aa, Borrelia afzelii PKo
GSLVGGKT

SEQ ID NO: 159114 - protein, 8 aa, Borrelia afzelii PKo
SLVGGKTT

SEQ ID NO: 159115 - protein, 8 aa, Borrelia afzelii PKo
LVGGKTTV

SEQ ID NO: 159116 - protein, 8 aa, Borrelia afzelii PKo
VGGKTTVK

SEQ ID NO: 159117 - protein, 8 aa, Borrelia afzelii PKo
GGKTTVKL

SEQ ID NO: 159118 - protein, 8 aa, Borrelia afzelii PKo
GKTTVKLT

SEQ ID NO: 159119 - protein, 8 aa, Borrelia afzelii PKo
KTTVKLTE

SEQ ID NO: 159120 - protein, 8 aa, Borrelia afzelii PKo
TTVKLTEG

SEQ ID NO: 159121 - protein, 8 aa, Borrelia afzelii PKo
TVKLTEGT

SEQ ID NO: 159122 - protein, 8 aa, Borrelia afzelii PKo
VKLTEGTI

SEQ ID NO: 159123 - protein, 8 aa, Borrelia afzelii PKo
KLTEGTIT

SEQ ID NO: 159124 - protein, 8 aa, Borrelia afzelii PKo
LTEGTITL

SEQ ID NO: 159125 - protein, 8 aa, Borrelia afzelii PKo
TEGTITLT

SEQ ID NO: 159126 - protein, 8 aa, Borrelia afzelii PKo
EGTITLTR

SEQ ID NO: 159127 - protein, 8 aa, Borrelia afzelii PKo
GTITLTRE

SEQ ID NO: 159128 - protein, 8 aa, Borrelia afzelii PKo
TITLTREI

SEQ ID NO: 159129 - protein, 8 aa, Borrelia afzelii PKo
ITLTREIE

SEQ ID NO: 159130 - protein, 8 aa, Borrelia afzelii PKo
TLTREIEQ

SEQ ID NO: 159131 - protein, 8 aa, Borrelia afzelii PKo
LTREIEQD

SEQ ID NO: 159132 - protein, 8 aa, Borrelia afzelii PKo
TREIEQDG

SEQ ID NO: 159133 - protein, 8 aa, Borrelia afzelii PKo
REIEQDGK

SEQ ID NO: 159134 - protein, 8 aa, Borrelia afzelii PKo
EIEQDGKV

SEQ ID NO: 159135 - protein, 8 aa, Borrelia afzelii PKo
IEQDGKVK

SEQ ID NO: 159136 - protein, 8 aa, Borrelia afzelii PKo
EQDGKVKI

SEQ ID NO: 159137 - protein, 8 aa, Borrelia afzelii PKo
QDGKVKIY

SEQ ID NO: 159138 - protein, 8 aa, Borrelia afzelii PKo
DGKVKIYL

SEQ ID NO: 159139 - protein, 8 aa, Borrelia afzelii PKo
GKVKIYLN

SEQ ID NO: 159140 - protein, 8 aa, Borrelia afzelii PKo
KVKIYLND

SEQ ID NO: 159141 - protein, 8 aa, Borrelia afzelii PKo
VKIYLNDT

SEQ ID NO: 159142 - protein, 8 aa, Borrelia afzelii PKo
KIYLNDTT

SEQ ID NO: 159143 - protein, 8 aa, Borrelia afzelii PKo
IYLNDTTS

SEQ ID NO: 159144 - protein, 8 aa, Borrelia afzelii PKo
YLNDTTSG

SEQ ID NO: 159145 - protein, 8 aa, Borrelia afzelii PKo
LNDTTSGS

SEQ ID NO: 159146 - protein, 8 aa, Borrelia afzelii PKo
NDTTSGST

SEQ ID NO: 159147 - protein, 8 aa, Borrelia afzelii PKo
DTTSGSTK

SEQ ID NO: 159148 - protein, 8 aa, Borrelia afzelii PKo
TTSGSTKK

SEQ ID NO: 159149 - protein, 8 aa, Borrelia afzelii PKo
TSGSTKKT

SEQ ID NO: 159150 - protein, 8 aa, Borrelia afzelii PKo
SGSTKKTA

SEQ ID NO: 159151 - protein, 8 aa, Borrelia afzelii PKo
GSTKKTAT

SEQ ID NO: 159152 - protein, 8 aa, Borrelia afzelii PKo
STKKTATW

SEQ ID NO: 159153 - protein, 8 aa, Borrelia afzelii PKo
TKKTATWN

SEQ ID NO: 159154 - protein, 8 aa, Borrelia afzelii PKo
KKTATWNE

SEQ ID NO: 159155 - protein, 8 aa, Borrelia afzelii PKo
KTATWNET

SEQ ID NO: 159156 - protein, 8 aa, Borrelia afzelii PKo
TATWNETT

SEQ ID NO: 159157 - protein, 8 aa, Borrelia afzelii PKo
ATWNETTN

SEQ ID NO: 159158 - protein, 8 aa, Borrelia afzelii PKo
TWNETTNT

SEQ ID NO: 159159 - protein, 8 aa, Borrelia afzelii PKo
WNETTNTL

SEQ ID NO: 159160 - protein, 8 aa, Borrelia afzelii PKo
NETTNTLT

SEQ ID NO: 159161 - protein, 8 aa, Borrelia afzelii PKo
ETTNTLTI

SEQ ID NO: 159162 - protein, 8 aa, Borrelia afzelii PKo
TTNTLTIS

SEQ ID NO: 159163 - protein, 8 aa, Borrelia afzelii PKo
TNTLTISA

SEQ ID NO: 159164 - protein, 8 aa, Borrelia afzelii PKo
NTLTISAD

SEQ ID NO: 159165 - protein, 8 aa, Borrelia afzelii PKo
TLTISADS

SEQ ID NO: 159166 - protein, 8 aa, Borrelia afzelii PKo
LTISADSK

SEQ ID NO: 159167 - protein, 8 aa, Borrelia afzelii PKo
TISADSKK

SEQ ID NO: 159168 - protein, 8 aa, Borrelia afzelii PKo
ISADSKKT

SEQ ID NO: 159169 - protein, 8 aa, Borrelia afzelii PKo
SADSKKTK

SEQ ID NO: 159170 - protein, 8 aa, Borrelia afzelii PKo
ADSKKTKD

SEQ ID NO: 159171 - protein, 8 aa, Borrelia afzelii PKo
DSKKTKDF

SEQ ID NO: 159172 - protein, 8 aa, Borrelia afzelii PKo
SKKTKDFV

SEQ ID NO: 159173 - protein, 8 aa, Borrelia afzelii PKo
KKTKDFVF

SEQ ID NO: 159174 - protein, 8 aa, Borrelia afzelii PKo
KTKDFVFL

SEQ ID NO: 159175 - protein, 8 aa, Borrelia afzelii PKo
TKDFVFLT

SEQ ID NO: 159176 - protein, 8 aa, Borrelia afzelii PKo
KDFVFLTD

SEQ ID NO: 159177 - protein, 8 aa, Borrelia afzelii PKo
DFVFLTDG

SEQ ID NO: 159178 - protein, 8 aa, Borrelia afzelii PKo
FVFLTDGT

SEQ ID NO: 159179 - protein, 8 aa, Borrelia afzelii PKo
VFLTDGTI

SEQ ID NO: 159180 - protein, 8 aa, Borrelia afzelii PKo
FLTDGTIT

SEQ ID NO: 159181 - protein, 8 aa, Borrelia afzelii PKo
LTDGTITV

SEQ ID NO: 159182 - protein, 8 aa, Borrelia afzelii PKo
TDGTITVQ

SEQ ID NO: 159183 - protein, 8 aa, Borrelia afzelii PKo
DGTITVQA

SEQ ID NO: 159184 - protein, 8 aa, Borrelia afzelii PKo
GTITVQAY

SEQ ID NO: 159185 - protein, 8 aa, Borrelia afzelii PKo
TITVQAYD

SEQ ID NO: 159186 - protein, 8 aa, Borrelia afzelii PKo
ITVQAYDT

SEQ ID NO: 159187 - protein, 8 aa, Borrelia afzelii PKo
TVQAYDTA

SEQ ID NO: 159188 - protein, 8 aa, Borrelia afzelii PKo
VQAYDTAG

SEQ ID NO: 159189 - protein, 8 aa, Borrelia afzelii PKo
QAYDTAGT

SEQ ID NO: 159190 - protein, 8 aa, Borrelia afzelii PKo
AYDTAGTK

SEQ ID NO: 159191 - protein, 8 aa, Borrelia afzelii PKo
YDTAGTKL

SEQ ID NO: 159192 - protein, 8 aa, Borrelia afzelii PKo
DTAGTKLE

SEQ ID NO: 159193 - protein, 8 aa, Borrelia afzelii PKo
TAGTKLEG

SEQ ID NO: 159194 - protein, 8 aa, Borrelia afzelii PKo
AGTKLEGN

SEQ ID NO: 159195 - protein, 8 aa, Borrelia afzelii PKo
GTKLEGNS

SEQ ID NO: 159196 - protein, 8 aa, Borrelia afzelii PKo
TKLEGNSS

SEQ ID NO: 159197 - protein, 8 aa, Borrelia afzelii PKo
KLEGNSSE

SEQ ID NO: 159198 - protein, 8 aa, Borrelia afzelii PKo
LEGNSSEI

SEQ ID NO: 159199 - protein, 8 aa, Borrelia afzelii PKo
EGNSSEIK

SEQ ID NO: 159200 - protein, 8 aa, Borrelia afzelii PKo
GNSSEIKD

SEQ ID NO: 159201 - protein, 8 aa, Borrelia afzelii PKo
NSSEIKDL

SEQ ID NO: 159202 - protein, 8 aa, Borrelia afzelii PKo
SSEIKDLA

SEQ ID NO: 159203 - protein, 8 aa, Borrelia afzelii PKo
SEIKDLAA

SEQ ID NO: 159204 - protein, 8 aa, Borrelia afzelii PKo
EIKDLAAL

SEQ ID NO: 159205 - protein, 8 aa, Borrelia afzelii PKo
IKDLAALK

SEQ ID NO: 159206 - protein, 8 aa, Borrelia afzelii PKo
KDLAALKA

SEQ ID NO: 159207 - protein, 8 aa, Borrelia afzelii PKo
DLAALKAA

SEQ ID NO: 159208 - protein, 8 aa, Borrelia afzelii PKo
LAALKAAL

SEQ ID NO: 159209 - protein, 8 aa, Borrelia afzelii PKo
AALKAALK

SEQ ID NO: 159210 - protein, 9 aa, Borrelia afzelii PKo
MKQYLLVFA

SEQ ID NO: 159211 - protein, 9 aa, Borrelia afzelii PKo
KQYLLVFAL

SEQ ID NO: 159212 - protein, 9 aa, Borrelia afzelii PKo
QYLLVFALV

SEQ ID NO: 159213 - protein, 9 aa, Borrelia afzelii PKo
YLLVFALVL

SEQ ID NO: 159214 - protein, 9 aa, Borrelia afzelii PKo
LLVFALVLA

SEQ ID NO: 159215 - protein, 9 aa, Borrelia afzelii PKo
LVFALVLAL

SEQ ID NO: 159216 - protein, 9 aa, Borrelia afzelii PKo
VFALVLALI

SEQ ID NO: 159217 - protein, 9 aa, Borrelia afzelii PKo
FALVLALIA

SEQ ID NO: 159218 - protein, 9 aa, Borrelia afzelii PKo
ALVLALIAC

SEQ ID NO: 159219 - protein, 9 aa, Borrelia afzelii PKo
LVLALIACS

SEQ ID NO: 159220 - protein, 9 aa, Borrelia afzelii PKo
VLALIACSQ

SEQ ID NO: 159221 - protein, 9 aa, Borrelia afzelii PKo
LALIACSQK

SEQ ID NO: 159222 - protein, 9 aa, Borrelia afzelii PKo
ALIACSQKG

SEQ ID NO: 159223 - protein, 9 aa, Borrelia afzelii PKo
LIACSQKGT

SEQ ID NO: 159224 - protein, 9 aa, Borrelia afzelii PKo
IACSQKGTE

SEQ ID NO: 159225 - protein, 9 aa, Borrelia afzelii PKo
ACSQKGTEP

SEQ ID NO: 159226 - protein, 9 aa, Borrelia afzelii PKo
CSQKGTEPK

SEQ ID NO: 159227 - protein, 9 aa, Borrelia afzelii PKo
SQKGTEPKS

SEQ ID NO: 159228 - protein, 9 aa, Borrelia afzelii PKo
QKGTEPKST

SEQ ID NO: 159229 - protein, 9 aa, Borrelia afzelii PKo
KGTEPKSTS

SEQ ID NO: 159230 - protein, 9 aa, Borrelia afzelii PKo
GTEPKSTSQ

SEQ ID NO: 159231 - protein, 9 aa, Borrelia afzelii PKo
TEPKSTSQD

SEQ ID NO: 159232 - protein, 9 aa, Borrelia afzelii PKo
EPKSTSQDH

SEQ ID NO: 159233 - protein, 9 aa, Borrelia afzelii PKo
PKSTSQDHN

SEQ ID NO: 159234 - protein, 9 aa, Borrelia afzelii PKo
KSTSQDHND

SEQ ID NO: 159235 - protein, 9 aa, Borrelia afzelii PKo
STSQDHNDQ

SEQ ID NO: 159236 - protein, 9 aa, Borrelia afzelii PKo
TSQDHNDQE

SEQ ID NO: 159237 - protein, 9 aa, Borrelia afzelii PKo
SQDHNDQEI

SEQ ID NO: 159238 - protein, 9 aa, Borrelia afzelii PKo
QDHNDQEII

SEQ ID NO: 159239 - protein, 9 aa, Borrelia afzelii PKo
DHNDQEIIN

SEQ ID NO: 159240 - protein, 9 aa, Borrelia afzelii PKo
HNDQEIINS

SEQ ID NO: 159241 - protein, 9 aa, Borrelia afzelii PKo
NDQEIINSD

SEQ ID NO: 159242 - protein, 9 aa, Borrelia afzelii PKo
DQEIINSDN

SEQ ID NO: 159243 - protein, 9 aa, Borrelia afzelii PKo
QEIINSDNT

SEQ ID NO: 159244 - protein, 9 aa, Borrelia afzelii PKo
EIINSDNTP

SEQ ID NO: 159245 - protein, 9 aa, Borrelia afzelii PKo
IINSDNTPK

SEQ ID NO: 159246 - protein, 9 aa, Borrelia afzelii PKo
INSDNTPKD

SEQ ID NO: 159247 - protein, 9 aa, Borrelia afzelii PKo
NSDNTPKDS

SEQ ID NO: 159248 - protein, 9 aa, Borrelia afzelii PKo
SDNTPKDSK

SEQ ID NO: 159249 - protein, 9 aa, Borrelia afzelii PKo
DNTPKDSKK

SEQ ID NO: 159250 - protein, 9 aa, Borrelia afzelii PKo
NTPKDSKKD

SEQ ID NO: 159251 - protein, 9 aa, Borrelia afzelii PKo
TPKDSKKDL

SEQ ID NO: 159252 - protein, 9 aa, Borrelia afzelii PKo
PKDSKKDLT

SEQ ID NO: 159253 - protein, 9 aa, Borrelia afzelii PKo
KDSKKDLTV

SEQ ID NO: 159254 - protein, 9 aa, Borrelia afzelii PKo
DSKKDLTVL

SEQ ID NO: 159255 - protein, 9 aa, Borrelia afzelii PKo
SKKDLTVLA

SEQ ID NO: 159256 - protein, 9 aa, Borrelia afzelii PKo
KKDLTVLAE

SEQ ID NO: 159257 - protein, 9 aa, Borrelia afzelii PKo
KDLTVLAEE

SEQ ID NO: 159258 - protein, 9 aa, Borrelia afzelii PKo
DLTVLAEEN

SEQ ID NO: 159259 - protein, 9 aa, Borrelia afzelii PKo
LTVLAEENS

SEQ ID NO: 159260 - protein, 9 aa, Borrelia afzelii PKo
TVLAEENSV

SEQ ID NO: 159261 - protein, 9 aa, Borrelia afzelii PKo
VLAEENSVP

SEQ ID NO: 159262 - protein, 9 aa, Borrelia afzelii PKo
LAEENSVPL

SEQ ID NO: 159263 - protein, 9 aa, Borrelia afzelii PKo
AEENSVPLF

SEQ ID NO: 159264 - protein, 9 aa, Borrelia afzelii PKo
EENSVPLFN

SEQ ID NO: 159265 - protein, 9 aa, Borrelia afzelii PKo
ENSVPLFNG

SEQ ID NO: 159266 - protein, 9 aa, Borrelia afzelii PKo
NSVPLFNGN

SEQ ID NO: 159267 - protein, 9 aa, Borrelia afzelii PKo
SVPLFNGNK

SEQ ID NO: 159268 - protein, 9 aa, Borrelia afzelii PKo
VPLFNGNKI

SEQ ID NO: 159269 - protein, 9 aa, Borrelia afzelii PKo
PLFNGNKIF

SEQ ID NO: 159270 - protein, 9 aa, Borrelia afzelii PKo
LFNGNKIFV

SEQ ID NO: 159271 - protein, 9 aa, Borrelia afzelii PKo
FNGNKIFVS

SEQ ID NO: 159272 - protein, 9 aa, Borrelia afzelii PKo
NGNKIFVSK

SEQ ID NO: 159273 - protein, 9 aa, Borrelia afzelii PKo
GNKIFVSKE

SEQ ID NO: 159274 - protein, 9 aa, Borrelia afzelii PKo
NKIFVSKEK

SEQ ID NO: 159275 - protein, 9 aa, Borrelia afzelii PKo
KIFVSKEKN

SEQ ID NO: 159276 - protein, 9 aa, Borrelia afzelii PKo
IFVSKEKNS

SEQ ID NO: 159277 - protein, 9 aa, Borrelia afzelii PKo
FVSKEKNSA

SEQ ID NO: 159278 - protein, 9 aa, Borrelia afzelii PKo
VSKEKNSAG

SEQ ID NO: 159279 - protein, 9 aa, Borrelia afzelii PKo
SKEKNSAGK

SEQ ID NO: 159280 - protein, 9 aa, Borrelia afzelii PKo
KEKNSAGKY

SEQ ID NO: 159281 - protein, 9 aa, Borrelia afzelii PKo
EKNSAGKYE

SEQ ID NO: 159282 - protein, 9 aa, Borrelia afzelii PKo
KNSAGKYEL

SEQ ID NO: 159283 - protein, 9 aa, Borrelia afzelii PKo
NSAGKYELR

SEQ ID NO: 159284 - protein, 9 aa, Borrelia afzelii PKo
SAGKYELRA

SEQ ID NO: 159285 - protein, 9 aa, Borrelia afzelii PKo
AGKYELRAT

SEQ ID NO: 159286 - protein, 9 aa, Borrelia afzelii PKo
GKYELRATV

SEQ ID NO: 159287 - protein, 9 aa, Borrelia afzelii PKo
KYELRATVD

SEQ ID NO: 159288 - protein, 9 aa, Borrelia afzelii PKo
YELRATVDT

SEQ ID NO: 159289 - protein, 9 aa, Borrelia afzelii PKo
ELRATVDTV

SEQ ID NO: 159290 - protein, 9 aa, Borrelia afzelii PKo
LRATVDTVE

SEQ ID NO: 159291 - protein, 9 aa, Borrelia afzelii PKo
RATVDTVEL

SEQ ID NO: 159292 - protein, 9 aa, Borrelia afzelii PKo
ATVDTVELK

SEQ ID NO: 159293 - protein, 9 aa, Borrelia afzelii PKo
TVDTVELKG

SEQ ID NO: 159294 - protein, 9 aa, Borrelia afzelii PKo
VDTVELKGV

SEQ ID NO: 159295 - protein, 9 aa, Borrelia afzelii PKo
DTVELKGVS

SEQ ID NO: 159296 - protein, 9 aa, Borrelia afzelii PKo
TVELKGVSD

SEQ ID NO: 159297 - protein, 9 aa, Borrelia afzelii PKo
VELKGVSDK

SEQ ID NO: 159298 - protein, 9 aa, Borrelia afzelii PKo
ELKGVSDKN

SEQ ID NO: 159299 - protein, 9 aa, Borrelia afzelii PKo
LKGVSDKNN

SEQ ID NO: 159300 - protein, 9 aa, Borrelia afzelii PKo
KGVSDKNNG

SEQ ID NO: 159301 - protein, 9 aa, Borrelia afzelii PKo
GVSDKNNGS

SEQ ID NO: 159302 - protein, 9 aa, Borrelia afzelii PKo
VSDKNNGSG

SEQ ID NO: 159303 - protein, 9 aa, Borrelia afzelii PKo
SDKNNGSGK

SEQ ID NO: 159304 - protein, 9 aa, Borrelia afzelii PKo
DKNNGSGKL

SEQ ID NO: 159305 - protein, 9 aa, Borrelia afzelii PKo
KNNGSGKLE

SEQ ID NO: 159306 - protein, 9 aa, Borrelia afzelii PKo
NNGSGKLEG

SEQ ID NO: 159307 - protein, 9 aa, Borrelia afzelii PKo
NGSGKLEGT

SEQ ID NO: 159308 - protein, 9 aa, Borrelia afzelii PKo
GSGKLEGTK

SEQ ID NO: 159309 - protein, 9 aa, Borrelia afzelii PKo
SGKLEGTKA

SEQ ID NO: 159310 - protein, 9 aa, Borrelia afzelii PKo
GKLEGTKAD

SEQ ID NO: 159311 - protein, 9 aa, Borrelia afzelii PKo
KLEGTKADK

SEQ ID NO: 159312 - protein, 9 aa, Borrelia afzelii PKo
LEGTKADKT

SEQ ID NO: 159313 - protein, 9 aa, Borrelia afzelii PKo
EGTKADKTK

SEQ ID NO: 159314 - protein, 9 aa, Borrelia afzelii PKo
GTKADKTKV

SEQ ID NO: 159315 - protein, 9 aa, Borrelia afzelii PKo
TKADKTKVA

SEQ ID NO: 159316 - protein, 9 aa, Borrelia afzelii PKo
KADKTKVAM

SEQ ID NO: 159317 - protein, 9 aa, Borrelia afzelii PKo
ADKTKVAMT

SEQ ID NO: 159318 - protein, 9 aa, Borrelia afzelii PKo
DKTKVAMTI

SEQ ID NO: 159319 - protein, 9 aa, Borrelia afzelii PKo
KTKVAMTIA

SEQ ID NO: 159320 - protein, 9 aa, Borrelia afzelii PKo
TKVAMTIAD

SEQ ID NO: 159321 - protein, 9 aa, Borrelia afzelii PKo
KVAMTIADD

SEQ ID NO: 159322 - protein, 9 aa, Borrelia afzelii PKo
VAMTIADDL

SEQ ID NO: 159323 - protein, 9 aa, Borrelia afzelii PKo
AMTIADDLN

SEQ ID NO: 159324 - protein, 9 aa, Borrelia afzelii PKo
MTIADDLNT

SEQ ID NO: 159325 - protein, 9 aa, Borrelia afzelii PKo
TIADDLNTI

SEQ ID NO: 159326 - protein, 9 aa, Borrelia afzelii PKo
IADDLNTIT

SEQ ID NO: 159327 - protein, 9 aa, Borrelia afzelii PKo
ADDLNTITV

SEQ ID NO: 159328 - protein, 9 aa, Borrelia afzelii PKo
DDLNTITVE

SEQ ID NO: 159329 - protein, 9 aa, Borrelia afzelii PKo
DLNTITVET

SEQ ID NO: 159330 - protein, 9 aa, Borrelia afzelii PKo
LNTITVETY

SEQ ID NO: 159331 - protein, 9 aa, Borrelia afzelii PKo
NTITVETYD

SEQ ID NO: 159332 - protein, 9 aa, Borrelia afzelii PKo
TITVETYDA

SEQ ID NO: 159333 - protein, 9 aa, Borrelia afzelii PKo
ITVETYDAS

SEQ ID NO: 159334 - protein, 9 aa, Borrelia afzelii PKo
TVETYDASN

SEQ ID NO: 159335 - protein, 9 aa, Borrelia afzelii PKo
VETYDASNK

SEQ ID NO: 159336 - protein, 9 aa, Borrelia afzelii PKo
ETYDASNKK

SEQ ID NO: 159337 - protein, 9 aa, Borrelia afzelii PKo
TYDASNKKT

SEQ ID NO: 159338 - protein, 9 aa, Borrelia afzelii PKo
YDASNKKTG

SEQ ID NO: 159339 - protein, 9 aa, Borrelia afzelii PKo
DASNKKTGS

SEQ ID NO: 159340 - protein, 9 aa, Borrelia afzelii PKo
ASNKKTGSE

SEQ ID NO: 159341 - protein, 9 aa, Borrelia afzelii PKo
SNKKTGSEV

SEQ ID NO: 159342 - protein, 9 aa, Borrelia afzelii PKo
NKKTGSEVV

SEQ ID NO: 159343 - protein, 9 aa, Borrelia afzelii PKo
KKTGSEVVK

SEQ ID NO: 159344 - protein, 9 aa, Borrelia afzelii PKo
KTGSEVVKK

SEQ ID NO: 159345 - protein, 9 aa, Borrelia afzelii PKo
TGSEVVKKQ

SEQ ID NO: 159346 - protein, 9 aa, Borrelia afzelii PKo
GSEVVKKQG

SEQ ID NO: 159347 - protein, 9 aa, Borrelia afzelii PKo
SEVVKKQGS

SEQ ID NO: 159348 - protein, 9 aa, Borrelia afzelii PKo
EVVKKQGSV

SEQ ID NO: 159349 - protein, 9 aa, Borrelia afzelii PKo
VVKKQGSVI

SEQ ID NO: 159350 - protein, 9 aa, Borrelia afzelii PKo
VKKQGSVIK

SEQ ID NO: 159351 - protein, 9 aa, Borrelia afzelii PKo
KKQGSVIKE

SEQ ID NO: 159352 - protein, 9 aa, Borrelia afzelii PKo
KQGSVIKES

SEQ ID NO: 159353 - protein, 9 aa, Borrelia afzelii PKo
QGSVIKESY

SEQ ID NO: 159354 - protein, 9 aa, Borrelia afzelii PKo
GSVIKESYK

SEQ ID NO: 159355 - protein, 9 aa, Borrelia afzelii PKo
SVIKESYKA

SEQ ID NO: 159356 - protein, 9 aa, Borrelia afzelii PKo
VIKESYKAN

SEQ ID NO: 159357 - protein, 9 aa, Borrelia afzelii PKo
IKESYKANK

SEQ ID NO: 159358 - protein, 9 aa, Borrelia afzelii PKo
KESYKANKL

SEQ ID NO: 159359 - protein, 9 aa, Borrelia afzelii PKo
ESYKANKLD

SEQ ID NO: 159360 - protein, 9 aa, Borrelia afzelii PKo
SYKANKLDS

SEQ ID NO: 159361 - protein, 9 aa, Borrelia afzelii PKo
YKANKLDSK

SEQ ID NO: 159362 - protein, 9 aa, Borrelia afzelii PKo
KANKLDSKK

SEQ ID NO: 159363 - protein, 9 aa, Borrelia afzelii PKo
ANKLDSKKI

SEQ ID NO: 159364 - protein, 9 aa, Borrelia afzelii PKo
NKLDSKKIT

SEQ ID NO: 159365 - protein, 9 aa, Borrelia afzelii PKo
KLDSKKITR

SEQ ID NO: 159366 - protein, 9 aa, Borrelia afzelii PKo
LDSKKITRE

SEQ ID NO: 159367 - protein, 9 aa, Borrelia afzelii PKo
DSKKITREN

SEQ ID NO: 159368 - protein, 9 aa, Borrelia afzelii PKo
SKKITRENE

SEQ ID NO: 159369 - protein, 9 aa, Borrelia afzelii PKo
KKITRENET

SEQ ID NO: 159370 - protein, 9 aa, Borrelia afzelii PKo
KITRENETT

SEQ ID NO: 159371 - protein, 9 aa, Borrelia afzelii PKo
ITRENETTL

SEQ ID NO: 159372 - protein, 9 aa, Borrelia afzelii PKo
TRENETTLE

SEQ ID NO: 159373 - protein, 9 aa, Borrelia afzelii PKo
RENETTLEY

SEQ ID NO: 159374 - protein, 9 aa, Borrelia afzelii PKo
ENETTLEYS

SEQ ID NO: 159375 - protein, 9 aa, Borrelia afzelii PKo
NETTLEYSE

SEQ ID NO: 159376 - protein, 9 aa, Borrelia afzelii PKo
ETTLEYSEM

SEQ ID NO: 159377 - protein, 9 aa, Borrelia afzelii PKo
TTLEYSEMT

SEQ ID NO: 159378 - protein, 9 aa, Borrelia afzelii PKo
TLEYSEMTD

SEQ ID NO: 159379 - protein, 9 aa, Borrelia afzelii PKo
LEYSEMTDS

SEQ ID NO: 159380 - protein, 9 aa, Borrelia afzelii PKo
EYSEMTDSS

SEQ ID NO: 159381 - protein, 9 aa, Borrelia afzelii PKo
YSEMTDSSN

SEQ ID NO: 159382 - protein, 9 aa, Borrelia afzelii PKo
SEMTDSSNA

SEQ ID NO: 159383 - protein, 9 aa, Borrelia afzelii PKo
EMTDSSNAT

SEQ ID NO: 159384 - protein, 9 aa, Borrelia afzelii PKo
MTDSSNATK

SEQ ID NO: 159385 - protein, 9 aa, Borrelia afzelii PKo
TDSSNATKA

SEQ ID NO: 159386 - protein, 9 aa, Borrelia afzelii PKo
DSSNATKAV

SEQ ID NO: 159387 - protein, 9 aa, Borrelia afzelii PKo
SSNATKAVE

SEQ ID NO: 159388 - protein, 9 aa, Borrelia afzelii PKo
SNATKAVET

SEQ ID NO: 159389 - protein, 9 aa, Borrelia afzelii PKo
NATKAVETL

SEQ ID NO: 159390 - protein, 9 aa, Borrelia afzelii PKo
ATKAVETLK

SEQ ID NO: 159391 - protein, 9 aa, Borrelia afzelii PKo
TKAVETLKN

SEQ ID NO: 159392 - protein, 9 aa, Borrelia afzelii PKo
KAVETLKNG

SEQ ID NO: 159393 - protein, 9 aa, Borrelia afzelii PKo
AVETLKNGI

SEQ ID NO: 159394 - protein, 9 aa, Borrelia afzelii PKo
VETLKNGIK

SEQ ID NO: 159395 - protein, 9 aa, Borrelia afzelii PKo
ETLKNGIKL

SEQ ID NO: 159396 - protein, 9 aa, Borrelia afzelii PKo
TLKNGIKLE

SEQ ID NO: 159397 - protein, 9 aa, Borrelia afzelii PKo
LKNGIKLEG

SEQ ID NO: 159398 - protein, 9 aa, Borrelia afzelii PKo
KNGIKLEGS

SEQ ID NO: 159399 - protein, 9 aa, Borrelia afzelii PKo
NGIKLEGSL

SEQ ID NO: 159400 - protein, 9 aa, Borrelia afzelii PKo
GIKLEGSLV

SEQ ID NO: 159401 - protein, 9 aa, Borrelia afzelii PKo
IKLEGSLVG

SEQ ID NO: 159402 - protein, 9 aa, Borrelia afzelii PKo
KLEGSLVGG

SEQ ID NO: 159403 - protein, 9 aa, Borrelia afzelii PKo
LEGSLVGGK

SEQ ID NO: 159404 - protein, 9 aa, Borrelia afzelii PKo
EGSLVGGKT

SEQ ID NO: 159405 - protein, 9 aa, Borrelia afzelii PKo
GSLVGGKTT

SEQ ID NO: 159406 - protein, 9 aa, Borrelia afzelii PKo
SLVGGKTTV

SEQ ID NO: 159407 - protein, 9 aa, Borrelia afzelii PKo
LVGGKTTVK

SEQ ID NO: 159408 - protein, 9 aa, Borrelia afzelii PKo
VGGKTTVKL

SEQ ID NO: 159409 - protein, 9 aa, Borrelia afzelii PKo
GGKTTVKLT

SEQ ID NO: 159410 - protein, 9 aa, Borrelia afzelii PKo
GKTTVKLTE

SEQ ID NO: 159411 - protein, 9 aa, Borrelia afzelii PKo
KTTVKLTEG

SEQ ID NO: 159412 - protein, 9 aa, Borrelia afzelii PKo
TTVKLTEGT

SEQ ID NO: 159413 - protein, 9 aa, Borrelia afzelii PKo
TVKLTEGTI

SEQ ID NO: 159414 - protein, 9 aa, Borrelia afzelii PKo
VKLTEGTIT

SEQ ID NO: 159415 - protein, 9 aa, Borrelia afzelii PKo
KLTEGTITL

SEQ ID NO: 159416 - protein, 9 aa, Borrelia afzelii PKo
LTEGTITLT

SEQ ID NO: 159417 - protein, 9 aa, Borrelia afzelii PKo
TEGTITLTR

SEQ ID NO: 159418 - protein, 9 aa, Borrelia afzelii PKo
EGTITLTRE

SEQ ID NO: 159419 - protein, 9 aa, Borrelia afzelii PKo
GTITLTREI

SEQ ID NO: 159420 - protein, 9 aa, Borrelia afzelii PKo
TITLTREIE

SEQ ID NO: 159421 - protein, 9 aa, Borrelia afzelii PKo
ITLTREIEQ

SEQ ID NO: 159422 - protein, 9 aa, Borrelia afzelii PKo
TLTREIEQD

SEQ ID NO: 159423 - protein, 9 aa, Borrelia afzelii PKo
LTREIEQDG

SEQ ID NO: 159424 - protein, 9 aa, Borrelia afzelii PKo
TREIEQDGK

SEQ ID NO: 159425 - protein, 9 aa, Borrelia afzelii PKo
REIEQDGKV

SEQ ID NO: 159426 - protein, 9 aa, Borrelia afzelii PKo
EIEQDGKVK

SEQ ID NO: 159427 - protein, 9 aa, Borrelia afzelii PKo
IEQDGKVKI

SEQ ID NO: 159428 - protein, 9 aa, Borrelia afzelii PKo
EQDGKVKIY

SEQ ID NO: 159429 - protein, 9 aa, Borrelia afzelii PKo
QDGKVKIYL

SEQ ID NO: 159430 - protein, 9 aa, Borrelia afzelii PKo
DGKVKIYLN

SEQ ID NO: 159431 - protein, 9 aa, Borrelia afzelii PKo
GKVKIYLND

SEQ ID NO: 159432 - protein, 9 aa, Borrelia afzelii PKo
KVKIYLNDT

SEQ ID NO: 159433 - protein, 9 aa, Borrelia afzelii PKo
VKIYLNDTT

SEQ ID NO: 159434 - protein, 9 aa, Borrelia afzelii PKo
KIYLNDTTS

SEQ ID NO: 159435 - protein, 9 aa, Borrelia afzelii PKo
IYLNDTTSG

SEQ ID NO: 159436 - protein, 9 aa, Borrelia afzelii PKo
YLNDTTSGS

SEQ ID NO: 159437 - protein, 9 aa, Borrelia afzelii PKo
LNDTTSGST

SEQ ID NO: 159438 - protein, 9 aa, Borrelia afzelii PKo
NDTTSGSTK

SEQ ID NO: 159439 - protein, 9 aa, Borrelia afzelii PKo
DTTSGSTKK

SEQ ID NO: 159440 - protein, 9 aa, Borrelia afzelii PKo
TTSGSTKKT

SEQ ID NO: 159441 - protein, 9 aa, Borrelia afzelii PKo
TSGSTKKTA

SEQ ID NO: 159442 - protein, 9 aa, Borrelia afzelii PKo
SGSTKKTAT

SEQ ID NO: 159443 - protein, 9 aa, Borrelia afzelii PKo
GSTKKTATW

SEQ ID NO: 159444 - protein, 9 aa, Borrelia afzelii PKo
STKKTATWN

SEQ ID NO: 159445 - protein, 9 aa, Borrelia afzelii PKo
TKKTATWNE

SEQ ID NO: 159446 - protein, 9 aa, Borrelia afzelii PKo
KKTATWNET

SEQ ID NO: 159447 - protein, 9 aa, Borrelia afzelii PKo
KTATWNETT

SEQ ID NO: 159448 - protein, 9 aa, Borrelia afzelii PKo
TATWNETTN

SEQ ID NO: 159449 - protein, 9 aa, Borrelia afzelii PKo
ATWNETTNT

SEQ ID NO: 159450 - protein, 9 aa, Borrelia afzelii PKo
TWNETTNTL

SEQ ID NO: 159451 - protein, 9 aa, Borrelia afzelii PKo
WNETTNTLT

SEQ ID NO: 159452 - protein, 9 aa, Borrelia afzelii PKo
NETTNTLTI

SEQ ID NO: 159453 - protein, 9 aa, Borrelia afzelii PKo
ETTNTLTIS

SEQ ID NO: 159454 - protein, 9 aa, Borrelia afzelii PKo
TTNTLTISA

SEQ ID NO: 159455 - protein, 9 aa, Borrelia afzelii PKo
TNTLTISAD

SEQ ID NO: 159456 - protein, 9 aa, Borrelia afzelii PKo
NTLTISADS

SEQ ID NO: 159457 - protein, 9 aa, Borrelia afzelii PKo
TLTISADSK

SEQ ID NO: 159458 - protein, 9 aa, Borrelia afzelii PKo
LTISADSKK

SEQ ID NO: 159459 - protein, 9 aa, Borrelia afzelii PKo
TISADSKKT

SEQ ID NO: 159460 - protein, 9 aa, Borrelia afzelii PKo
ISADSKKTK

SEQ ID NO: 159461 - protein, 9 aa, Borrelia afzelii PKo
SADSKKTKD

SEQ ID NO: 159462 - protein, 9 aa, Borrelia afzelii PKo
ADSKKTKDF

SEQ ID NO: 159463 - protein, 9 aa, Borrelia afzelii PKo
DSKKTKDFV

SEQ ID NO: 159464 - protein, 9 aa, Borrelia afzelii PKo
SKKTKDFVF

SEQ ID NO: 159465 - protein, 9 aa, Borrelia afzelii PKo
KKTKDFVFL

SEQ ID NO: 159466 - protein, 9 aa, Borrelia afzelii PKo
KTKDFVFLT

SEQ ID NO: 159467 - protein, 9 aa, Borrelia afzelii PKo
TKDFVFLTD

SEQ ID NO: 159468 - protein, 9 aa, Borrelia afzelii PKo
KDFVFLTDG

SEQ ID NO: 159469 - protein, 9 aa, Borrelia afzelii PKo
DFVFLTDGT

SEQ ID NO: 159470 - protein, 9 aa, Borrelia afzelii PKo
FVFLTDGTI

SEQ ID NO: 159471 - protein, 9 aa, Borrelia afzelii PKo
VFLTDGTIT

SEQ ID NO: 159472 - protein, 9 aa, Borrelia afzelii PKo
FLTDGTITV

SEQ ID NO: 159473 - protein, 9 aa, Borrelia afzelii PKo
LTDGTITVQ

SEQ ID NO: 159474 - protein, 9 aa, Borrelia afzelii PKo
TDGTITVQA

SEQ ID NO: 159475 - protein, 9 aa, Borrelia afzelii PKo
DGTITVQAY

SEQ ID NO: 159476 - protein, 9 aa, Borrelia afzelii PKo
GTITVQAYD

SEQ ID NO: 159477 - protein, 9 aa, Borrelia afzelii PKo
TITVQAYDT

SEQ ID NO: 159478 - protein, 9 aa, Borrelia afzelii PKo
ITVQAYDTA

SEQ ID NO: 159479 - protein, 9 aa, Borrelia afzelii PKo
TVQAYDTAG

SEQ ID NO: 159480 - protein, 9 aa, Borrelia afzelii PKo
VQAYDTAGT

SEQ ID NO: 159481 - protein, 9 aa, Borrelia afzelii PKo
QAYDTAGTK

SEQ ID NO: 159482 - protein, 9 aa, Borrelia afzelii PKo
AYDTAGTKL

SEQ ID NO: 159483 - protein, 9 aa, Borrelia afzelii PKo
YDTAGTKLE

SEQ ID NO: 159484 - protein, 9 aa, Borrelia afzelii PKo
DTAGTKLEG

SEQ ID NO: 159485 - protein, 9 aa, Borrelia afzelii PKo
TAGTKLEGN

SEQ ID NO: 159486 - protein, 9 aa, Borrelia afzelii PKo
AGTKLEGNS

SEQ ID NO: 159487 - protein, 9 aa, Borrelia afzelii PKo
GTKLEGNSS

SEQ ID NO: 159488 - protein, 9 aa, Borrelia afzelii PKo
TKLEGNSSE

SEQ ID NO: 159489 - protein, 9 aa, Borrelia afzelii PKo
KLEGNSSEI

SEQ ID NO: 159490 - protein, 9 aa, Borrelia afzelii PKo
LEGNSSEIK

SEQ ID NO: 159491 - protein, 9 aa, Borrelia afzelii PKo
EGNSSEIKD

SEQ ID NO: 159492 - protein, 9 aa, Borrelia afzelii PKo
GNSSEIKDL

SEQ ID NO: 159493 - protein, 9 aa, Borrelia afzelii PKo
NSSEIKDLA

SEQ ID NO: 159494 - protein, 9 aa, Borrelia afzelii PKo
SSEIKDLAA

SEQ ID NO: 159495 - protein, 9 aa, Borrelia afzelii PKo
SEIKDLAAL

SEQ ID NO: 159496 - protein, 9 aa, Borrelia afzelii PKo
EIKDLAALK

SEQ ID NO: 159497 - protein, 9 aa, Borrelia afzelii PKo
IKDLAALKA

SEQ ID NO: 159498 - protein, 9 aa, Borrelia afzelii PKo
KDLAALKAA

SEQ ID NO: 159499 - protein, 9 aa, Borrelia afzelii PKo
DLAALKAAL

SEQ ID NO: 159500 - protein, 9 aa, Borrelia afzelii PKo
LAALKAALK

SEQ ID NO: 159501 - protein, 10 aa, Borrelia afzelii PKo
MKQYLLVFAL

SEQ ID NO: 159502 - protein, 10 aa, Borrelia afzelii PKo
KQYLLVFALV

SEQ ID NO: 159503 - protein, 10 aa, Borrelia afzelii PKo
QYLLVFALVL

SEQ ID NO: 159504 - protein, 10 aa, Borrelia afzelii PKo
YLLVFALVLA

SEQ ID NO: 159505 - protein, 10 aa, Borrelia afzelii PKo
LLVFALVLAL

SEQ ID NO: 159506 - protein, 10 aa, Borrelia afzelii PKo
LVFALVLALI

SEQ ID NO: 159507 - protein, 10 aa, Borrelia afzelii PKo
VFALVLALIA

SEQ ID NO: 159508 - protein, 10 aa, Borrelia afzelii PKo
FALVLALIAC

SEQ ID NO: 159509 - protein, 10 aa, Borrelia afzelii PKo
ALVLALIACS

SEQ ID NO: 159510 - protein, 10 aa, Borrelia afzelii PKo
LVLALIACSQ

SEQ ID NO: 159511 - protein, 10 aa, Borrelia afzelii PKo
VLALIACSQK

SEQ ID NO: 159512 - protein, 10 aa, Borrelia afzelii PKo
LALIACSQKG

SEQ ID NO: 159513 - protein, 10 aa, Borrelia afzelii PKo
ALIACSQKGT

SEQ ID NO: 159514 - protein, 10 aa, Borrelia afzelii PKo
LIACSQKGTE

SEQ ID NO: 159515 - protein, 10 aa, Borrelia afzelii PKo
IACSQKGTEP

SEQ ID NO: 159516 - protein, 10 aa, Borrelia afzelii PKo
ACSQKGTEPK

SEQ ID NO: 159517 - protein, 10 aa, Borrelia afzelii PKo
CSQKGTEPKS

SEQ ID NO: 159518 - protein, 10 aa, Borrelia afzelii PKo
SQKGTEPKST

SEQ ID NO: 159519 - protein, 10 aa, Borrelia afzelii PKo
QKGTEPKSTS

SEQ ID NO: 159520 - protein, 10 aa, Borrelia afzelii PKo
KGTEPKSTSQ

SEQ ID NO: 159521 - protein, 10 aa, Borrelia afzelii PKo
GTEPKSTSQD

SEQ ID NO: 159522 - protein, 10 aa, Borrelia afzelii PKo
TEPKSTSQDH

SEQ ID NO: 159523 - protein, 10 aa, Borrelia afzelii PKo
EPKSTSQDHN

SEQ ID NO: 159524 - protein, 10 aa, Borrelia afzelii PKo
PKSTSQDHND

SEQ ID NO: 159525 - protein, 10 aa, Borrelia afzelii PKo
KSTSQDHNDQ

SEQ ID NO: 159526 - protein, 10 aa, Borrelia afzelii PKo
STSQDHNDQE

SEQ ID NO: 159527 - protein, 10 aa, Borrelia afzelii PKo
TSQDHNDQEI

SEQ ID NO: 159528 - protein, 10 aa, Borrelia afzelii PKo
SQDHNDQEII

SEQ ID NO: 159529 - protein, 10 aa, Borrelia afzelii PKo
QDHNDQEIIN

SEQ ID NO: 159530 - protein, 10 aa, Borrelia afzelii PKo
DHNDQEIINS

SEQ ID NO: 159531 - protein, 10 aa, Borrelia afzelii PKo
HNDQEIINSD

SEQ ID NO: 159532 - protein, 10 aa, Borrelia afzelii PKo
NDQEIINSDN

SEQ ID NO: 159533 - protein, 10 aa, Borrelia afzelii PKo
DQEIINSDNT

SEQ ID NO: 159534 - protein, 10 aa, Borrelia afzelii PKo
QEIINSDNTP

SEQ ID NO: 159535 - protein, 10 aa, Borrelia afzelii PKo
EIINSDNTPK

SEQ ID NO: 159536 - protein, 10 aa, Borrelia afzelii PKo
IINSDNTPKD

SEQ ID NO: 159537 - protein, 10 aa, Borrelia afzelii PKo
INSDNTPKDS

SEQ ID NO: 159538 - protein, 10 aa, Borrelia afzelii PKo
NSDNTPKDSK

SEQ ID NO: 159539 - protein, 10 aa, Borrelia afzelii PKo
SDNTPKDSKK

SEQ ID NO: 159540 - protein, 10 aa, Borrelia afzelii PKo
DNTPKDSKKD

SEQ ID NO: 159541 - protein, 10 aa, Borrelia afzelii PKo
NTPKDSKKDL

SEQ ID NO: 159542 - protein, 10 aa, Borrelia afzelii PKo
TPKDSKKDLT

SEQ ID NO: 159543 - protein, 10 aa, Borrelia afzelii PKo
PKDSKKDLTV

SEQ ID NO: 159544 - protein, 10 aa, Borrelia afzelii PKo
KDSKKDLTVL

SEQ ID NO: 159545 - protein, 10 aa, Borrelia afzelii PKo
DSKKDLTVLA

SEQ ID NO: 159546 - protein, 10 aa, Borrelia afzelii PKo
SKKDLTVLAE

SEQ ID NO: 159547 - protein, 10 aa, Borrelia afzelii PKo
KKDLTVLAEE

SEQ ID NO: 159548 - protein, 10 aa, Borrelia afzelii PKo
KDLTVLAEEN

SEQ ID NO: 159549 - protein, 10 aa, Borrelia afzelii PKo
DLTVLAEENS

SEQ ID NO: 159550 - protein, 10 aa, Borrelia afzelii PKo
LTVLAEENSV

SEQ ID NO: 159551 - protein, 10 aa, Borrelia afzelii PKo
TVLAEENSVP

SEQ ID NO: 159552 - protein, 10 aa, Borrelia afzelii PKo
VLAEENSVPL

SEQ ID NO: 159553 - protein, 10 aa, Borrelia afzelii PKo
LAEENSVPLF

SEQ ID NO: 159554 - protein, 10 aa, Borrelia afzelii PKo
AEENSVPLFN

SEQ ID NO: 159555 - protein, 10 aa, Borrelia afzelii PKo
EENSVPLFNG

SEQ ID NO: 159556 - protein, 10 aa, Borrelia afzelii PKo
ENSVPLFNGN

SEQ ID NO: 159557 - protein, 10 aa, Borrelia afzelii PKo
NSVPLFNGNK

SEQ ID NO: 159558 - protein, 10 aa, Borrelia afzelii PKo
SVPLFNGNKI

SEQ ID NO: 159559 - protein, 10 aa, Borrelia afzelii PKo
VPLFNGNKIF

SEQ ID NO: 159560 - protein, 10 aa, Borrelia afzelii PKo
PLFNGNKIFV

SEQ ID NO: 159561 - protein, 10 aa, Borrelia afzelii PKo
LFNGNKIFVS

SEQ ID NO: 159562 - protein, 10 aa, Borrelia afzelii PKo
FNGNKIFVSK

SEQ ID NO: 159563 - protein, 10 aa, Borrelia afzelii PKo
NGNKIFVSKE

SEQ ID NO: 159564 - protein, 10 aa, Borrelia afzelii PKo
GNKIFVSKEK

SEQ ID NO: 159565 - protein, 10 aa, Borrelia afzelii PKo
NKIFVSKEKN

SEQ ID NO: 159566 - protein, 10 aa, Borrelia afzelii PKo
KIFVSKEKNS

SEQ ID NO: 159567 - protein, 10 aa, Borrelia afzelii PKo
IFVSKEKNSA

SEQ ID NO: 159568 - protein, 10 aa, Borrelia afzelii PKo
FVSKEKNSAG

SEQ ID NO: 159569 - protein, 10 aa, Borrelia afzelii PKo
VSKEKNSAGK

SEQ ID NO: 159570 - protein, 10 aa, Borrelia afzelii PKo
SKEKNSAGKY

SEQ ID NO: 159571 - protein, 10 aa, Borrelia afzelii PKo
KEKNSAGKYE

SEQ ID NO: 159572 - protein, 10 aa, Borrelia afzelii PKo
EKNSAGKYEL

SEQ ID NO: 159573 - protein, 10 aa, Borrelia afzelii PKo
KNSAGKYELR

SEQ ID NO: 159574 - protein, 10 aa, Borrelia afzelii PKo
NSAGKYELRA

SEQ ID NO: 159575 - protein, 10 aa, Borrelia afzelii PKo
SAGKYELRAT

SEQ ID NO: 159576 - protein, 10 aa, Borrelia afzelii PKo
AGKYELRATV

SEQ ID NO: 159577 - protein, 10 aa, Borrelia afzelii PKo
GKYELRATVD

SEQ ID NO: 159578 - protein, 10 aa, Borrelia afzelii PKo
KYELRATVDT

SEQ ID NO: 159579 - protein, 10 aa, Borrelia afzelii PKo
YELRATVDTV

SEQ ID NO: 159580 - protein, 10 aa, Borrelia afzelii PKo
ELRATVDTVE

SEQ ID NO: 159581 - protein, 10 aa, Borrelia afzelii PKo
LRATVDTVEL

SEQ ID NO: 159582 - protein, 10 aa, Borrelia afzelii PKo
RATVDTVELK

SEQ ID NO: 159583 - protein, 10 aa, Borrelia afzelii PKo
ATVDTVELKG

SEQ ID NO: 159584 - protein, 10 aa, Borrelia afzelii PKo
TVDTVELKGV

SEQ ID NO: 159585 - protein, 10 aa, Borrelia afzelii PKo
VDTVELKGVS

SEQ ID NO: 159586 - protein, 10 aa, Borrelia afzelii PKo
DTVELKGVSD

SEQ ID NO: 159587 - protein, 10 aa, Borrelia afzelii PKo
TVELKGVSDK

SEQ ID NO: 159588 - protein, 10 aa, Borrelia afzelii PKo
VELKGVSDKN

SEQ ID NO: 159589 - protein, 10 aa, Borrelia afzelii PKo
ELKGVSDKNN

SEQ ID NO: 159590 - protein, 10 aa, Borrelia afzelii PKo
LKGVSDKNNG

SEQ ID NO: 159591 - protein, 10 aa, Borrelia afzelii PKo
KGVSDKNNGS

SEQ ID NO: 159592 - protein, 10 aa, Borrelia afzelii PKo
GVSDKNNGSG

SEQ ID NO: 159593 - protein, 10 aa, Borrelia afzelii PKo
VSDKNNGSGK

SEQ ID NO: 159594 - protein, 10 aa, Borrelia afzelii PKo
SDKNNGSGKL

SEQ ID NO: 159595 - protein, 10 aa, Borrelia afzelii PKo
DKNNGSGKLE

SEQ ID NO: 159596 - protein, 10 aa, Borrelia afzelii PKo
KNNGSGKLEG

SEQ ID NO: 159597 - protein, 10 aa, Borrelia afzelii PKo
NNGSGKLEGT

SEQ ID NO: 159598 - protein, 10 aa, Borrelia afzelii PKo
NGSGKLEGTK

SEQ ID NO: 159599 - protein, 10 aa, Borrelia afzelii PKo
GSGKLEGTKA

SEQ ID NO: 159600 - protein, 10 aa, Borrelia afzelii PKo
SGKLEGTKAD

SEQ ID NO: 159601 - protein, 10 aa, Borrelia afzelii PKo
GKLEGTKADK

SEQ ID NO: 159602 - protein, 10 aa, Borrelia afzelii PKo
KLEGTKADKT

SEQ ID NO: 159603 - protein, 10 aa, Borrelia afzelii PKo
LEGTKADKTK

SEQ ID NO: 159604 - protein, 10 aa, Borrelia afzelii PKo
EGTKADKTKV

SEQ ID NO: 159605 - protein, 10 aa, Borrelia afzelii PKo
GTKADKTKVA

SEQ ID NO: 159606 - protein, 10 aa, Borrelia afzelii PKo
TKADKTKVAM

SEQ ID NO: 159607 - protein, 10 aa, Borrelia afzelii PKo
KADKTKVAMT

SEQ ID NO: 159608 - protein, 10 aa, Borrelia afzelii PKo
ADKTKVAMTI

SEQ ID NO: 159609 - protein, 10 aa, Borrelia afzelii PKo
DKTKVAMTIA

SEQ ID NO: 159610 - protein, 10 aa, Borrelia afzelii PKo
KTKVAMTIAD

SEQ ID NO: 159611 - protein, 10 aa, Borrelia afzelii PKo
TKVAMTIADD

SEQ ID NO: 159612 - protein, 10 aa, Borrelia afzelii PKo
KVAMTIADDL

SEQ ID NO: 159613 - protein, 10 aa, Borrelia afzelii PKo
VAMTIADDLN

SEQ ID NO: 159614 - protein, 10 aa, Borrelia afzelii PKo
AMTIADDLNT

SEQ ID NO: 159615 - protein, 10 aa, Borrelia afzelii PKo
MTIADDLNTI

SEQ ID NO: 159616 - protein, 10 aa, Borrelia afzelii PKo
TIADDLNTIT

SEQ ID NO: 159617 - protein, 10 aa, Borrelia afzelii PKo
IADDLNTITV

SEQ ID NO: 159618 - protein, 10 aa, Borrelia afzelii PKo
ADDLNTITVE

SEQ ID NO: 159619 - protein, 10 aa, Borrelia afzelii PKo
DDLNTITVET

SEQ ID NO: 159620 - protein, 10 aa, Borrelia afzelii PKo
DLNTITVETY

SEQ ID NO: 159621 - protein, 10 aa, Borrelia afzelii PKo
LNTITVETYD

SEQ ID NO: 159622 - protein, 10 aa, Borrelia afzelii PKo
NTITVETYDA

SEQ ID NO: 159623 - protein, 10 aa, Borrelia afzelii PKo
TITVETYDAS

SEQ ID NO: 159624 - protein, 10 aa, Borrelia afzelii PKo
ITVETYDASN

SEQ ID NO: 159625 - protein, 10 aa, Borrelia afzelii PKo
TVETYDASNK

SEQ ID NO: 159626 - protein, 10 aa, Borrelia afzelii PKo
VETYDASNKK

SEQ ID NO: 159627 - protein, 10 aa, Borrelia afzelii PKo
ETYDASNKKT

SEQ ID NO: 159628 - protein, 10 aa, Borrelia afzelii PKo
TYDASNKKTG

SEQ ID NO: 159629 - protein, 10 aa, Borrelia afzelii PKo
YDASNKKTGS

SEQ ID NO: 159630 - protein, 10 aa, Borrelia afzelii PKo
DASNKKTGSE

SEQ ID NO: 159631 - protein, 10 aa, Borrelia afzelii PKo
ASNKKTGSEV

SEQ ID NO: 159632 - protein, 10 aa, Borrelia afzelii PKo
SNKKTGSEVV

SEQ ID NO: 159633 - protein, 10 aa, Borrelia afzelii PKo
NKKTGSEVVK

SEQ ID NO: 159634 - protein, 10 aa, Borrelia afzelii PKo
KKTGSEVVKK

SEQ ID NO: 159635 - protein, 10 aa, Borrelia afzelii PKo
KTGSEVVKKQ

SEQ ID NO: 159636 - protein, 10 aa, Borrelia afzelii PKo
TGSEVVKKQG

SEQ ID NO: 159637 - protein, 10 aa, Borrelia afzelii PKo
GSEVVKKQGS

SEQ ID NO: 159638 - protein, 10 aa, Borrelia afzelii PKo
SEVVKKQGSV

SEQ ID NO: 159639 - protein, 10 aa, Borrelia afzelii PKo
EVVKKQGSVI

SEQ ID NO: 159640 - protein, 10 aa, Borrelia afzelii PKo
VVKKQGSVIK

SEQ ID NO: 159641 - protein, 10 aa, Borrelia afzelii PKo
VKKQGSVIKE

SEQ ID NO: 159642 - protein, 10 aa, Borrelia afzelii PKo
KKQGSVIKES

SEQ ID NO: 159643 - protein, 10 aa, Borrelia afzelii PKo
KQGSVIKESY

SEQ ID NO: 159644 - protein, 10 aa, Borrelia afzelii PKo
QGSVIKESYK

SEQ ID NO: 159645 - protein, 10 aa, Borrelia afzelii PKo
GSVIKESYKA

SEQ ID NO: 159646 - protein, 10 aa, Borrelia afzelii PKo
SVIKESYKAN

SEQ ID NO: 159647 - protein, 10 aa, Borrelia afzelii PKo
VIKESYKANK

SEQ ID NO: 159648 - protein, 10 aa, Borrelia afzelii PKo
IKESYKANKL

SEQ ID NO: 159649 - protein, 10 aa, Borrelia afzelii PKo
KESYKANKLD

SEQ ID NO: 159650 - protein, 10 aa, Borrelia afzelii PKo
ESYKANKLDS

SEQ ID NO: 159651 - protein, 10 aa, Borrelia afzelii PKo
SYKANKLDSK

SEQ ID NO: 159652 - protein, 10 aa, Borrelia afzelii PKo
YKANKLDSKK

SEQ ID NO: 159653 - protein, 10 aa, Borrelia afzelii PKo
KANKLDSKKI

SEQ ID NO: 159654 - protein, 10 aa, Borrelia afzelii PKo
ANKLDSKKIT

SEQ ID NO: 159655 - protein, 10 aa, Borrelia afzelii PKo
NKLDSKKITR

SEQ ID NO: 159656 - protein, 10 aa, Borrelia afzelii PKo
KLDSKKITRE

SEQ ID NO: 159657 - protein, 10 aa, Borrelia afzelii PKo
LDSKKITREN

SEQ ID NO: 159658 - protein, 10 aa, Borrelia afzelii PKo
DSKKITRENE

SEQ ID NO: 159659 - protein, 10 aa, Borrelia afzelii PKo
SKKITRENET

SEQ ID NO: 159660 - protein, 10 aa, Borrelia afzelii PKo
KKITRENETT

SEQ ID NO: 159661 - protein, 10 aa, Borrelia afzelii PKo
KITRENETTL

SEQ ID NO: 159662 - protein, 10 aa, Borrelia afzelii PKo
ITRENETTLE

SEQ ID NO: 159663 - protein, 10 aa, Borrelia afzelii PKo
TRENETTLEY

SEQ ID NO: 159664 - protein, 10 aa, Borrelia afzelii PKo
RENETTLEYS

SEQ ID NO: 159665 - protein, 10 aa, Borrelia afzelii PKo
ENETTLEYSE

SEQ ID NO: 159666 - protein, 10 aa, Borrelia afzelii PKo
NETTLEYSEM

SEQ ID NO: 159667 - protein, 10 aa, Borrelia afzelii PKo
ETTLEYSEMT

SEQ ID NO: 159668 - protein, 10 aa, Borrelia afzelii PKo
TTLEYSEMTD

SEQ ID NO: 159669 - protein, 10 aa, Borrelia afzelii PKo
TLEYSEMTDS

SEQ ID NO: 159670 - protein, 10 aa, Borrelia afzelii PKo
LEYSEMTDSS

SEQ ID NO: 159671 - protein, 10 aa, Borrelia afzelii PKo
EYSEMTDSSN

SEQ ID NO: 159672 - protein, 10 aa, Borrelia afzelii PKo
YSEMTDSSNA

SEQ ID NO: 159673 - protein, 10 aa, Borrelia afzelii PKo
SEMTDSSNAT

SEQ ID NO: 159674 - protein, 10 aa, Borrelia afzelii PKo
EMTDSSNATK

SEQ ID NO: 159675 - protein, 10 aa, Borrelia afzelii PKo
MTDSSNATKA

SEQ ID NO: 159676 - protein, 10 aa, Borrelia afzelii PKo
TDSSNATKAV

SEQ ID NO: 159677 - protein, 10 aa, Borrelia afzelii PKo
DSSNATKAVE

SEQ ID NO: 159678 - protein, 10 aa, Borrelia afzelii PKo
SSNATKAVET

SEQ ID NO: 159679 - protein, 10 aa, Borrelia afzelii PKo
SNATKAVETL

SEQ ID NO: 159680 - protein, 10 aa, Borrelia afzelii PKo
NATKAVETLK

SEQ ID NO: 159681 - protein, 10 aa, Borrelia afzelii PKo
ATKAVETLKN

SEQ ID NO: 159682 - protein, 10 aa, Borrelia afzelii PKo
TKAVETLKNG

SEQ ID NO: 159683 - protein, 10 aa, Borrelia afzelii PKo
KAVETLKNGI

SEQ ID NO: 159684 - protein, 10 aa, Borrelia afzelii PKo
AVETLKNGIK

SEQ ID NO: 159685 - protein, 10 aa, Borrelia afzelii PKo
VETLKNGIKL

SEQ ID NO: 159686 - protein, 10 aa, Borrelia afzelii PKo
ETLKNGIKLE

SEQ ID NO: 159687 - protein, 10 aa, Borrelia afzelii PKo
TLKNGIKLEG

SEQ ID NO: 159688 - protein, 10 aa, Borrelia afzelii PKo
LKNGIKLEGS

SEQ ID NO: 159689 - protein, 10 aa, Borrelia afzelii PKo
KNGIKLEGSL

SEQ ID NO: 159690 - protein, 10 aa, Borrelia afzelii PKo
NGIKLEGSLV

SEQ ID NO: 159691 - protein, 10 aa, Borrelia afzelii PKo
GIKLEGSLVG

SEQ ID NO: 159692 - protein, 10 aa, Borrelia afzelii PKo
IKLEGSLVGG

SEQ ID NO: 159693 - protein, 10 aa, Borrelia afzelii PKo
KLEGSLVGGK

SEQ ID NO: 159694 - protein, 10 aa, Borrelia afzelii PKo
LEGSLVGGKT

SEQ ID NO: 159695 - protein, 10 aa, Borrelia afzelii PKo
EGSLVGGKTT

SEQ ID NO: 159696 - protein, 10 aa, Borrelia afzelii PKo
GSLVGGKTTV

SEQ ID NO: 159697 - protein, 10 aa, Borrelia afzelii PKo
SLVGGKTTVK

SEQ ID NO: 159698 - protein, 10 aa, Borrelia afzelii PKo
LVGGKTTVKL

SEQ ID NO: 159699 - protein, 10 aa, Borrelia afzelii PKo
VGGKTTVKLT

SEQ ID NO: 159700 - protein, 10 aa, Borrelia afzelii PKo
GGKTTVKLTE

SEQ ID NO: 159701 - protein, 10 aa, Borrelia afzelii PKo
GKTTVKLTEG

SEQ ID NO: 159702 - protein, 10 aa, Borrelia afzelii PKo
KTTVKLTEGT

SEQ ID NO: 159703 - protein, 10 aa, Borrelia afzelii PKo
TTVKLTEGTI

SEQ ID NO: 159704 - protein, 10 aa, Borrelia afzelii PKo
TVKLTEGTIT

SEQ ID NO: 159705 - protein, 10 aa, Borrelia afzelii PKo
VKLTEGTITL

SEQ ID NO: 159706 - protein, 10 aa, Borrelia afzelii PKo
KLTEGTITLT

SEQ ID NO: 159707 - protein, 10 aa, Borrelia afzelii PKo
LTEGTITLTR

SEQ ID NO: 159708 - protein, 10 aa, Borrelia afzelii PKo
TEGTITLTRE

SEQ ID NO: 159709 - protein, 10 aa, Borrelia afzelii PKo
EGTITLTREI

SEQ ID NO: 159710 - protein, 10 aa, Borrelia afzelii PKo
GTITLTREIE

SEQ ID NO: 159711 - protein, 10 aa, Borrelia afzelii PKo
TITLTREIEQ

SEQ ID NO: 159712 - protein, 10 aa, Borrelia afzelii PKo
ITLTREIEQD

SEQ ID NO: 159713 - protein, 10 aa, Borrelia afzelii PKo
TLTREIEQDG

SEQ ID NO: 159714 - protein, 10 aa, Borrelia afzelii PKo
LTREIEQDGK

SEQ ID NO: 159715 - protein, 10 aa, Borrelia afzelii PKo
TREIEQDGKV

SEQ ID NO: 159716 - protein, 10 aa, Borrelia afzelii PKo
REIEQDGKVK

SEQ ID NO: 159717 - protein, 10 aa, Borrelia afzelii PKo
EIEQDGKVKI

SEQ ID NO: 159718 - protein, 10 aa, Borrelia afzelii PKo
IEQDGKVKIY

SEQ ID NO: 159719 - protein, 10 aa, Borrelia afzelii PKo
EQDGKVKIYL

SEQ ID NO: 159720 - protein, 10 aa, Borrelia afzelii PKo
QDGKVKIYLN

SEQ ID NO: 159721 - protein, 10 aa, Borrelia afzelii PKo
DGKVKIYLND

SEQ ID NO: 159722 - protein, 10 aa, Borrelia afzelii PKo
GKVKIYLNDT

SEQ ID NO: 159723 - protein, 10 aa, Borrelia afzelii PKo
KVKIYLNDTT

SEQ ID NO: 159724 - protein, 10 aa, Borrelia afzelii PKo
VKIYLNDTTS

SEQ ID NO: 159725 - protein, 10 aa, Borrelia afzelii PKo
KIYLNDTTSG

SEQ ID NO: 159726 - protein, 10 aa, Borrelia afzelii PKo
IYLNDTTSGS

SEQ ID NO: 159727 - protein, 10 aa, Borrelia afzelii PKo
YLNDTTSGST

SEQ ID NO: 159728 - protein, 10 aa, Borrelia afzelii PKo
LNDTTSGSTK

SEQ ID NO: 159729 - protein, 10 aa, Borrelia afzelii PKo
NDTTSGSTKK

SEQ ID NO: 159730 - protein, 10 aa, Borrelia afzelii PKo
DTTSGSTKKT

SEQ ID NO: 159731 - protein, 10 aa, Borrelia afzelii PKo
TTSGSTKKTA

SEQ ID NO: 159732 - protein, 10 aa, Borrelia afzelii PKo
TSGSTKKTAT

SEQ ID NO: 159733 - protein, 10 aa, Borrelia afzelii PKo
SGSTKKTATW

SEQ ID NO: 159734 - protein, 10 aa, Borrelia afzelii PKo
GSTKKTATWN

SEQ ID NO: 159735 - protein, 10 aa, Borrelia afzelii PKo
STKKTATWNE

SEQ ID NO: 159736 - protein, 10 aa, Borrelia afzelii PKo
TKKTATWNET

SEQ ID NO: 159737 - protein, 10 aa, Borrelia afzelii PKo
KKTATWNETT

SEQ ID NO: 159738 - protein, 10 aa, Borrelia afzelii PKo
KTATWNETTN

SEQ ID NO: 159739 - protein, 10 aa, Borrelia afzelii PKo
TATWNETTNT

SEQ ID NO: 159740 - protein, 10 aa, Borrelia afzelii PKo
ATWNETTNTL

SEQ ID NO: 159741 - protein, 10 aa, Borrelia afzelii PKo
TWNETTNTLT

SEQ ID NO: 159742 - protein, 10 aa, Borrelia afzelii PKo
WNETTNTLTI

SEQ ID NO: 159743 - protein, 10 aa, Borrelia afzelii PKo
NETTNTLTIS

SEQ ID NO: 159744 - protein, 10 aa, Borrelia afzelii PKo
ETTNTLTISA

SEQ ID NO: 159745 - protein, 10 aa, Borrelia afzelii PKo
TTNTLTISAD

SEQ ID NO: 159746 - protein, 10 aa, Borrelia afzelii PKo
TNTLTISADS

SEQ ID NO: 159747 - protein, 10 aa, Borrelia afzelii PKo
NTLTISADSK

SEQ ID NO: 159748 - protein, 10 aa, Borrelia afzelii PKo
TLTISADSKK

SEQ ID NO: 159749 - protein, 10 aa, Borrelia afzelii PKo
LTISADSKKT

SEQ ID NO: 159750 - protein, 10 aa, Borrelia afzelii PKo
TISADSKKTK

SEQ ID NO: 159751 - protein, 10 aa, Borrelia afzelii PKo
ISADSKKTKD

SEQ ID NO: 159752 - protein, 10 aa, Borrelia afzelii PKo
SADSKKTKDF

SEQ ID NO: 159753 - protein, 10 aa, Borrelia afzelii PKo
ADSKKTKDFV

SEQ ID NO: 159754 - protein, 10 aa, Borrelia afzelii PKo
DSKKTKDFVF

SEQ ID NO: 159755 - protein, 10 aa, Borrelia afzelii PKo
SKKTKDFVFL

SEQ ID NO: 159756 - protein, 10 aa, Borrelia afzelii PKo
KKTKDFVFLT

SEQ ID NO: 159757 - protein, 10 aa, Borrelia afzelii PKo
KTKDFVFLTD

SEQ ID NO: 159758 - protein, 10 aa, Borrelia afzelii PKo
TKDFVFLTDG

SEQ ID NO: 159759 - protein, 10 aa, Borrelia afzelii PKo
KDFVFLTDGT

SEQ ID NO: 159760 - protein, 10 aa, Borrelia afzelii PKo
DFVFLTDGTI

SEQ ID NO: 159761 - protein, 10 aa, Borrelia afzelii PKo
FVFLTDGTIT

SEQ ID NO: 159762 - protein, 10 aa, Borrelia afzelii PKo
VFLTDGTITV

SEQ ID NO: 159763 - protein, 10 aa, Borrelia afzelii PKo
FLTDGTITVQ

SEQ ID NO: 159764 - protein, 10 aa, Borrelia afzelii PKo
LTDGTITVQA

SEQ ID NO: 159765 - protein, 10 aa, Borrelia afzelii PKo
TDGTITVQAY

SEQ ID NO: 159766 - protein, 10 aa, Borrelia afzelii PKo
DGTITVQAYD

SEQ ID NO: 159767 - protein, 10 aa, Borrelia afzelii PKo
GTITVQAYDT

SEQ ID NO: 159768 - protein, 10 aa, Borrelia afzelii PKo
TITVQAYDTA

SEQ ID NO: 159769 - protein, 10 aa, Borrelia afzelii PKo
ITVQAYDTAG

SEQ ID NO: 159770 - protein, 10 aa, Borrelia afzelii PKo
TVQAYDTAGT

SEQ ID NO: 159771 - protein, 10 aa, Borrelia afzelii PKo
VQAYDTAGTK

SEQ ID NO: 159772 - protein, 10 aa, Borrelia afzelii PKo
QAYDTAGTKL

SEQ ID NO: 159773 - protein, 10 aa, Borrelia afzelii PKo
AYDTAGTKLE

SEQ ID NO: 159774 - protein, 10 aa, Borrelia afzelii PKo
YDTAGTKLEG

SEQ ID NO: 159775 - protein, 10 aa, Borrelia afzelii PKo
DTAGTKLEGN

SEQ ID NO: 159776 - protein, 10 aa, Borrelia afzelii PKo
TAGTKLEGNS

SEQ ID NO: 159777 - protein, 10 aa, Borrelia afzelii PKo
AGTKLEGNSS

SEQ ID NO: 159778 - protein, 10 aa, Borrelia afzelii PKo
GTKLEGNSSE

SEQ ID NO: 159779 - protein, 10 aa, Borrelia afzelii PKo
TKLEGNSSEI

SEQ ID NO: 159780 - protein, 10 aa, Borrelia afzelii PKo
KLEGNSSEIK

SEQ ID NO: 159781 - protein, 10 aa, Borrelia afzelii PKo
LEGNSSEIKD

SEQ ID NO: 159782 - protein, 10 aa, Borrelia afzelii PKo
EGNSSEIKDL

SEQ ID NO: 159783 - protein, 10 aa, Borrelia afzelii PKo
GNSSEIKDLA

SEQ ID NO: 159784 - protein, 10 aa, Borrelia afzelii PKo
NSSEIKDLAA

SEQ ID NO: 159785 - protein, 10 aa, Borrelia afzelii PKo
SSEIKDLAAL

SEQ ID NO: 159786 - protein, 10 aa, Borrelia afzelii PKo
SEIKDLAALK

SEQ ID NO: 159787 - protein, 10 aa, Borrelia afzelii PKo
EIKDLAALKA

SEQ ID NO: 159788 - protein, 10 aa, Borrelia afzelii PKo
IKDLAALKAA

SEQ ID NO: 159789 - protein, 10 aa, Borrelia afzelii PKo
KDLAALKAAL

SEQ ID NO: 159790 - protein, 10 aa, Borrelia afzelii PKo
DLAALKAALK

SEQ ID NO: 159791 - protein, 11 aa, Borrelia afzelii PKo
MKQYLLVFALV

SEQ ID NO: 159792 - protein, 11 aa, Borrelia afzelii PKo
KQYLLVFALVL

SEQ ID NO: 159793 - protein, 11 aa, Borrelia afzelii PKo
QYLLVFALVLA

SEQ ID NO: 159794 - protein, 11 aa, Borrelia afzelii PKo
YLLVFALVLAL

SEQ ID NO: 159795 - protein, 11 aa, Borrelia afzelii PKo
LLVFALVLALI

SEQ ID NO: 159796 - protein, 11 aa, Borrelia afzelii PKo
LVFALVLALIA

SEQ ID NO: 159797 - protein, 11 aa, Borrelia afzelii PKo
VFALVLALIAC

SEQ ID NO: 159798 - protein, 11 aa, Borrelia afzelii PKo
FALVLALIACS

SEQ ID NO: 159799 - protein, 11 aa, Borrelia afzelii PKo
ALVLALIACSQ

SEQ ID NO: 159800 - protein, 11 aa, Borrelia afzelii PKo
LVLALIACSQK

SEQ ID NO: 159801 - protein, 11 aa, Borrelia afzelii PKo
VLALIACSQKG

SEQ ID NO: 159802 - protein, 11 aa, Borrelia afzelii PKo
LALIACSQKGT

SEQ ID NO: 159803 - protein, 11 aa, Borrelia afzelii PKo
ALIACSQKGTE

SEQ ID NO: 159804 - protein, 11 aa, Borrelia afzelii PKo
LIACSQKGTEP

SEQ ID NO: 159805 - protein, 11 aa, Borrelia afzelii PKo
IACSQKGTEPK

SEQ ID NO: 159806 - protein, 11 aa, Borrelia afzelii PKo
ACSQKGTEPKS

SEQ ID NO: 159807 - protein, 11 aa, Borrelia afzelii PKo
CSQKGTEPKST

SEQ ID NO: 159808 - protein, 11 aa, Borrelia afzelii PKo
SQKGTEPKSTS

SEQ ID NO: 159809 - protein, 11 aa, Borrelia afzelii PKo
QKGTEPKSTSQ

SEQ ID NO: 159810 - protein, 11 aa, Borrelia afzelii PKo
KGTEPKSTSQD

SEQ ID NO: 159811 - protein, 11 aa, Borrelia afzelii PKo
GTEPKSTSQDH

SEQ ID NO: 159812 - protein, 11 aa, Borrelia afzelii PKo
TEPKSTSQDHN

SEQ ID NO: 159813 - protein, 11 aa, Borrelia afzelii PKo
EPKSTSQDHND

SEQ ID NO: 159814 - protein, 11 aa, Borrelia afzelii PKo
PKSTSQDHNDQ

SEQ ID NO: 159815 - protein, 11 aa, Borrelia afzelii PKo
KSTSQDHNDQE

SEQ ID NO: 159816 - protein, 11 aa, Borrelia afzelii PKo
STSQDHNDQEI

SEQ ID NO: 159817 - protein, 11 aa, Borrelia afzelii PKo
TSQDHNDQEII

SEQ ID NO: 159818 - protein, 11 aa, Borrelia afzelii PKo
SQDHNDQEIIN

SEQ ID NO: 159819 - protein, 11 aa, Borrelia afzelii PKo
QDHNDQEIINS

SEQ ID NO: 159820 - protein, 11 aa, Borrelia afzelii PKo
DHNDQEIINSD

SEQ ID NO: 159821 - protein, 11 aa, Borrelia afzelii PKo
HNDQEIINSDN

SEQ ID NO: 159822 - protein, 11 aa, Borrelia afzelii PKo
NDQEIINSDNT

SEQ ID NO: 159823 - protein, 11 aa, Borrelia afzelii PKo
DQEIINSDNTP

SEQ ID NO: 159824 - protein, 11 aa, Borrelia afzelii PKo
QEIINSDNTPK

SEQ ID NO: 159825 - protein, 11 aa, Borrelia afzelii PKo
EIINSDNTPKD

SEQ ID NO: 159826 - protein, 11 aa, Borrelia afzelii PKo
IINSDNTPKDS

SEQ ID NO: 159827 - protein, 11 aa, Borrelia afzelii PKo
INSDNTPKDSK

SEQ ID NO: 159828 - protein, 11 aa, Borrelia afzelii PKo
NSDNTPKDSKK

SEQ ID NO: 159829 - protein, 11 aa, Borrelia afzelii PKo
SDNTPKDSKKD

SEQ ID NO: 159830 - protein, 11 aa, Borrelia afzelii PKo
DNTPKDSKKDL

SEQ ID NO: 159831 - protein, 11 aa, Borrelia afzelii PKo
NTPKDSKKDLT

SEQ ID NO: 159832 - protein, 11 aa, Borrelia afzelii PKo
TPKDSKKDLTV

SEQ ID NO: 159833 - protein, 11 aa, Borrelia afzelii PKo
PKDSKKDLTVL

SEQ ID NO: 159834 - protein, 11 aa, Borrelia afzelii PKo
KDSKKDLTVLA

SEQ ID NO: 159835 - protein, 11 aa, Borrelia afzelii PKo
DSKKDLTVLAE

SEQ ID NO: 159836 - protein, 11 aa, Borrelia afzelii PKo
SKKDLTVLAEE

SEQ ID NO: 159837 - protein, 11 aa, Borrelia afzelii PKo
KKDLTVLAEEN

SEQ ID NO: 159838 - protein, 11 aa, Borrelia afzelii PKo
KDLTVLAEENS

SEQ ID NO: 159839 - protein, 11 aa, Borrelia afzelii PKo
DLTVLAEENSV

SEQ ID NO: 159840 - protein, 11 aa, Borrelia afzelii PKo
LTVLAEENSVP

SEQ ID NO: 159841 - protein, 11 aa, Borrelia afzelii PKo
TVLAEENSVPL

SEQ ID NO: 159842 - protein, 11 aa, Borrelia afzelii PKo
VLAEENSVPLF

SEQ ID NO: 159843 - protein, 11 aa, Borrelia afzelii PKo
LAEENSVPLFN

SEQ ID NO: 159844 - protein, 11 aa, Borrelia afzelii PKo
AEENSVPLFNG

SEQ ID NO: 159845 - protein, 11 aa, Borrelia afzelii PKo
EENSVPLFNGN

SEQ ID NO: 159846 - protein, 11 aa, Borrelia afzelii PKo
ENSVPLFNGNK

SEQ ID NO: 159847 - protein, 11 aa, Borrelia afzelii PKo
NSVPLFNGNKI

SEQ ID NO: 159848 - protein, 11 aa, Borrelia afzelii PKo
SVPLFNGNKIF

SEQ ID NO: 159849 - protein, 11 aa, Borrelia afzelii PKo
VPLFNGNKIFV

SEQ ID NO: 159850 - protein, 11 aa, Borrelia afzelii PKo
PLFNGNKIFVS

SEQ ID NO: 159851 - protein, 11 aa, Borrelia afzelii PKo
LFNGNKIFVSK

SEQ ID NO: 159852 - protein, 11 aa, Borrelia afzelii PKo
FNGNKIFVSKE

SEQ ID NO: 159853 - protein, 11 aa, Borrelia afzelii PKo
NGNKIFVSKEK

SEQ ID NO: 159854 - protein, 11 aa, Borrelia afzelii PKo
GNKIFVSKEKN

SEQ ID NO: 159855 - protein, 11 aa, Borrelia afzelii PKo
NKIFVSKEKNS

SEQ ID NO: 159856 - protein, 11 aa, Borrelia afzelii PKo
KIFVSKEKNSA

SEQ ID NO: 159857 - protein, 11 aa, Borrelia afzelii PKo
IFVSKEKNSAG

SEQ ID NO: 159858 - protein, 11 aa, Borrelia afzelii PKo
FVSKEKNSAGK

SEQ ID NO: 159859 - protein, 11 aa, Borrelia afzelii PKo
VSKEKNSAGKY

SEQ ID NO: 159860 - protein, 11 aa, Borrelia afzelii PKo
SKEKNSAGKYE

SEQ ID NO: 159861 - protein, 11 aa, Borrelia afzelii PKo
KEKNSAGKYEL

SEQ ID NO: 159862 - protein, 11 aa, Borrelia afzelii PKo
EKNSAGKYELR

SEQ ID NO: 159863 - protein, 11 aa, Borrelia afzelii PKo
KNSAGKYELRA

SEQ ID NO: 159864 - protein, 11 aa, Borrelia afzelii PKo
NSAGKYELRAT

SEQ ID NO: 159865 - protein, 11 aa, Borrelia afzelii PKo
SAGKYELRATV

SEQ ID NO: 159866 - protein, 11 aa, Borrelia afzelii PKo
AGKYELRATVD

SEQ ID NO: 159867 - protein, 11 aa, Borrelia afzelii PKo
GKYELRATVDT

SEQ ID NO: 159868 - protein, 11 aa, Borrelia afzelii PKo
KYELRATVDTV

SEQ ID NO: 159869 - protein, 11 aa, Borrelia afzelii PKo
YELRATVDTVE

SEQ ID NO: 159870 - protein, 11 aa, Borrelia afzelii PKo
ELRATVDTVEL

SEQ ID NO: 159871 - protein, 11 aa, Borrelia afzelii PKo
LRATVDTVELK

SEQ ID NO: 159872 - protein, 11 aa, Borrelia afzelii PKo
RATVDTVELKG

SEQ ID NO: 159873 - protein, 11 aa, Borrelia afzelii PKo
ATVDTVELKGV

SEQ ID NO: 159874 - protein, 11 aa, Borrelia afzelii PKo
TVDTVELKGVS

SEQ ID NO: 159875 - protein, 11 aa, Borrelia afzelii PKo
VDTVELKGVSD

SEQ ID NO: 159876 - protein, 11 aa, Borrelia afzelii PKo
DTVELKGVSDK

SEQ ID NO: 159877 - protein, 11 aa, Borrelia afzelii PKo
TVELKGVSDKN

SEQ ID NO: 159878 - protein, 11 aa, Borrelia afzelii PKo
VELKGVSDKNN

SEQ ID NO: 159879 - protein, 11 aa, Borrelia afzelii PKo
ELKGVSDKNNG

SEQ ID NO: 159880 - protein, 11 aa, Borrelia afzelii PKo
LKGVSDKNNGS

SEQ ID NO: 159881 - protein, 11 aa, Borrelia afzelii PKo
KGVSDKNNGSG

SEQ ID NO: 159882 - protein, 11 aa, Borrelia afzelii PKo
GVSDKNNGSGK

SEQ ID NO: 159883 - protein, 11 aa, Borrelia afzelii PKo
VSDKNNGSGKL

SEQ ID NO: 159884 - protein, 11 aa, Borrelia afzelii PKo
SDKNNGSGKLE

SEQ ID NO: 159885 - protein, 11 aa, Borrelia afzelii PKo
DKNNGSGKLEG

SEQ ID NO: 159886 - protein, 11 aa, Borrelia afzelii PKo
KNNGSGKLEGT

SEQ ID NO: 159887 - protein, 11 aa, Borrelia afzelii PKo
NNGSGKLEGTK

SEQ ID NO: 159888 - protein, 11 aa, Borrelia afzelii PKo
NGSGKLEGTKA

SEQ ID NO: 159889 - protein, 11 aa, Borrelia afzelii PKo
GSGKLEGTKAD

SEQ ID NO: 159890 - protein, 11 aa, Borrelia afzelii PKo
SGKLEGTKADK

SEQ ID NO: 159891 - protein, 11 aa, Borrelia afzelii PKo
GKLEGTKADKT

SEQ ID NO: 159892 - protein, 11 aa, Borrelia afzelii PKo
KLEGTKADKTK

SEQ ID NO: 159893 - protein, 11 aa, Borrelia afzelii PKo
LEGTKADKTKV

SEQ ID NO: 159894 - protein, 11 aa, Borrelia afzelii PKo
EGTKADKTKVA

SEQ ID NO: 159895 - protein, 11 aa, Borrelia afzelii PKo
GTKADKTKVAM

SEQ ID NO: 159896 - protein, 11 aa, Borrelia afzelii PKo
TKADKTKVAMT

SEQ ID NO: 159897 - protein, 11 aa, Borrelia afzelii PKo
KADKTKVAMTI

SEQ ID NO: 159898 - protein, 11 aa, Borrelia afzelii PKo
ADKTKVAMTIA

SEQ ID NO: 159899 - protein, 11 aa, Borrelia afzelii PKo
DKTKVAMTIAD

SEQ ID NO: 159900 - protein, 11 aa, Borrelia afzelii PKo
KTKVAMTIADD

SEQ ID NO: 159901 - protein, 11 aa, Borrelia afzelii PKo
TKVAMTIADDL

SEQ ID NO: 159902 - protein, 11 aa, Borrelia afzelii PKo
KVAMTIADDLN

SEQ ID NO: 159903 - protein, 11 aa, Borrelia afzelii PKo
VAMTIADDLNT

SEQ ID NO: 159904 - protein, 11 aa, Borrelia afzelii PKo
AMTIADDLNTI

SEQ ID NO: 159905 - protein, 11 aa, Borrelia afzelii PKo
MTIADDLNTIT

SEQ ID NO: 159906 - protein, 11 aa, Borrelia afzelii PKo
TIADDLNTITV

SEQ ID NO: 159907 - protein, 11 aa, Borrelia afzelii PKo
IADDLNTITVE

SEQ ID NO: 159908 - protein, 11 aa, Borrelia afzelii PKo
ADDLNTITVET

SEQ ID NO: 159909 - protein, 11 aa, Borrelia afzelii PKo
DDLNTITVETY

SEQ ID NO: 159910 - protein, 11 aa, Borrelia afzelii PKo
DLNTITVETYD

SEQ ID NO: 159911 - protein, 11 aa, Borrelia afzelii PKo
LNTITVETYDA

SEQ ID NO: 159912 - protein, 11 aa, Borrelia afzelii PKo
NTITVETYDAS

SEQ ID NO: 159913 - protein, 11 aa, Borrelia afzelii PKo
TITVETYDASN

SEQ ID NO: 159914 - protein, 11 aa, Borrelia afzelii PKo
ITVETYDASNK

SEQ ID NO: 159915 - protein, 11 aa, Borrelia afzelii PKo
TVETYDASNKK

SEQ ID NO: 159916 - protein, 11 aa, Borrelia afzelii PKo
VETYDASNKKT

SEQ ID NO: 159917 - protein, 11 aa, Borrelia afzelii PKo
ETYDASNKKTG

SEQ ID NO: 159918 - protein, 11 aa, Borrelia afzelii PKo
TYDASNKKTGS

SEQ ID NO: 159919 - protein, 11 aa, Borrelia afzelii PKo
YDASNKKTGSE

SEQ ID NO: 159920 - protein, 11 aa, Borrelia afzelii PKo
DASNKKTGSEV

SEQ ID NO: 159921 - protein, 11 aa, Borrelia afzelii PKo
ASNKKTGSEVV

SEQ ID NO: 159922 - protein, 11 aa, Borrelia afzelii PKo
SNKKTGSEVVK

SEQ ID NO: 159923 - protein, 11 aa, Borrelia afzelii PKo
NKKTGSEVVKK

SEQ ID NO: 159924 - protein, 11 aa, Borrelia afzelii PKo
KKTGSEVVKKQ

SEQ ID NO: 159925 - protein, 11 aa, Borrelia afzelii PKo
KTGSEVVKKQG

SEQ ID NO: 159926 - protein, 11 aa, Borrelia afzelii PKo
TGSEVVKKQGS

SEQ ID NO: 159927 - protein, 11 aa, Borrelia afzelii PKo
GSEVVKKQGSV

SEQ ID NO: 159928 - protein, 11 aa, Borrelia afzelii PKo
SEVVKKQGSVI

SEQ ID NO: 159929 - protein, 11 aa, Borrelia afzelii PKo
EVVKKQGSVIK

SEQ ID NO: 159930 - protein, 11 aa, Borrelia afzelii PKo
VVKKQGSVIKE

SEQ ID NO: 159931 - protein, 11 aa, Borrelia afzelii PKo
VKKQGSVIKES

SEQ ID NO: 159932 - protein, 11 aa, Borrelia afzelii PKo
KKQGSVIKESY

SEQ ID NO: 159933 - protein, 11 aa, Borrelia afzelii PKo
KQGSVIKESYK

SEQ ID NO: 159934 - protein, 11 aa, Borrelia afzelii PKo
QGSVIKESYKA

SEQ ID NO: 159935 - protein, 11 aa, Borrelia afzelii PKo
GSVIKESYKAN

SEQ ID NO: 159936 - protein, 11 aa, Borrelia afzelii PKo
SVIKESYKANK

SEQ ID NO: 159937 - protein, 11 aa, Borrelia afzelii PKo
VIKESYKANKL

SEQ ID NO: 159938 - protein, 11 aa, Borrelia afzelii PKo
IKESYKANKLD

SEQ ID NO: 159939 - protein, 11 aa, Borrelia afzelii PKo
KESYKANKLDS

SEQ ID NO: 159940 - protein, 11 aa, Borrelia afzelii PKo
ESYKANKLDSK

SEQ ID NO: 159941 - protein, 11 aa, Borrelia afzelii PKo
SYKANKLDSKK

SEQ ID NO: 159942 - protein, 11 aa, Borrelia afzelii PKo
YKANKLDSKKI

SEQ ID NO: 159943 - protein, 11 aa, Borrelia afzelii PKo
KANKLDSKKIT

SEQ ID NO: 159944 - protein, 11 aa, Borrelia afzelii PKo
ANKLDSKKITR

SEQ ID NO: 159945 - protein, 11 aa, Borrelia afzelii PKo
NKLDSKKITRE

SEQ ID NO: 159946 - protein, 11 aa, Borrelia afzelii PKo
KLDSKKITREN

SEQ ID NO: 159947 - protein, 11 aa, Borrelia afzelii PKo
LDSKKITRENE

SEQ ID NO: 159948 - protein, 11 aa, Borrelia afzelii PKo
DSKKITRENET

SEQ ID NO: 159949 - protein, 11 aa, Borrelia afzelii PKo
SKKITRENETT

SEQ ID NO: 159950 - protein, 11 aa, Borrelia afzelii PKo
KKITRENETTL

SEQ ID NO: 159951 - protein, 11 aa, Borrelia afzelii PKo
KITRENETTLE

SEQ ID NO: 159952 - protein, 11 aa, Borrelia afzelii PKo
ITRENETTLEY

SEQ ID NO: 159953 - protein, 11 aa, Borrelia afzelii PKo
TRENETTLEYS

SEQ ID NO: 159954 - protein, 11 aa, Borrelia afzelii PKo
RENETTLEYSE

SEQ ID NO: 159955 - protein, 11 aa, Borrelia afzelii PKo
ENETTLEYSEM

SEQ ID NO: 159956 - protein, 11 aa, Borrelia afzelii PKo
NETTLEYSEMT

SEQ ID NO: 159957 - protein, 11 aa, Borrelia afzelii PKo
ETTLEYSEMTD

SEQ ID NO: 159958 - protein, 11 aa, Borrelia afzelii PKo
TTLEYSEMTDS

SEQ ID NO: 159959 - protein, 11 aa, Borrelia afzelii PKo
TLEYSEMTDSS

SEQ ID NO: 159960 - protein, 11 aa, Borrelia afzelii PKo
LEYSEMTDSSN

SEQ ID NO: 159961 - protein, 11 aa, Borrelia afzelii PKo
EYSEMTDSSNA

SEQ ID NO: 159962 - protein, 11 aa, Borrelia afzelii PKo
YSEMTDSSNAT

SEQ ID NO: 159963 - protein, 11 aa, Borrelia afzelii PKo
SEMTDSSNATK

SEQ ID NO: 159964 - protein, 11 aa, Borrelia afzelii PKo
EMTDSSNATKA

SEQ ID NO: 159965 - protein, 11 aa, Borrelia afzelii PKo
MTDSSNATKAV

SEQ ID NO: 159966 - protein, 11 aa, Borrelia afzelii PKo
TDSSNATKAVE

SEQ ID NO: 159967 - protein, 11 aa, Borrelia afzelii PKo
DSSNATKAVET

SEQ ID NO: 159968 - protein, 11 aa, Borrelia afzelii PKo
SSNATKAVETL

SEQ ID NO: 159969 - protein, 11 aa, Borrelia afzelii PKo
SNATKAVETLK

SEQ ID NO: 159970 - protein, 11 aa, Borrelia afzelii PKo
NATKAVETLKN

SEQ ID NO: 159971 - protein, 11 aa, Borrelia afzelii PKo
ATKAVETLKNG

SEQ ID NO: 159972 - protein, 11 aa, Borrelia afzelii PKo
TKAVETLKNGI

SEQ ID NO: 159973 - protein, 11 aa, Borrelia afzelii PKo
KAVETLKNGIK

SEQ ID NO: 159974 - protein, 11 aa, Borrelia afzelii PKo
AVETLKNGIKL

SEQ ID NO: 159975 - protein, 11 aa, Borrelia afzelii PKo
VETLKNGIKLE

SEQ ID NO: 159976 - protein, 11 aa, Borrelia afzelii PKo
ETLKNGIKLEG

SEQ ID NO: 159977 - protein, 11 aa, Borrelia afzelii PKo
TLKNGIKLEGS

SEQ ID NO: 159978 - protein, 11 aa, Borrelia afzelii PKo
LKNGIKLEGSL

SEQ ID NO: 159979 - protein, 11 aa, Borrelia afzelii PKo
KNGIKLEGSLV

SEQ ID NO: 159980 - protein, 11 aa, Borrelia afzelii PKo
NGIKLEGSLVG

SEQ ID NO: 159981 - protein, 11 aa, Borrelia afzelii PKo
GIKLEGSLVGG

SEQ ID NO: 159982 - protein, 11 aa, Borrelia afzelii PKo
IKLEGSLVGGK

SEQ ID NO: 159983 - protein, 11 aa, Borrelia afzelii PKo
KLEGSLVGGKT

SEQ ID NO: 159984 - protein, 11 aa, Borrelia afzelii PKo
LEGSLVGGKTT

SEQ ID NO: 159985 - protein, 11 aa, Borrelia afzelii PKo
EGSLVGGKTTV

SEQ ID NO: 159986 - protein, 11 aa, Borrelia afzelii PKo
GSLVGGKTTVK

SEQ ID NO: 159987 - protein, 11 aa, Borrelia afzelii PKo
SLVGGKTTVKL

SEQ ID NO: 159988 - protein, 11 aa, Borrelia afzelii PKo
LVGGKTTVKLT

SEQ ID NO: 159989 - protein, 11 aa, Borrelia afzelii PKo
VGGKTTVKLTE

SEQ ID NO: 159990 - protein, 11 aa, Borrelia afzelii PKo
GGKTTVKLTEG

SEQ ID NO: 159991 - protein, 11 aa, Borrelia afzelii PKo
GKTTVKLTEGT

SEQ ID NO: 159992 - protein, 11 aa, Borrelia afzelii PKo
KTTVKLTEGTI

SEQ ID NO: 159993 - protein, 11 aa, Borrelia afzelii PKo
TTVKLTEGTIT

SEQ ID NO: 159994 - protein, 11 aa, Borrelia afzelii PKo
TVKLTEGTITL

SEQ ID NO: 159995 - protein, 11 aa, Borrelia afzelii PKo
VKLTEGTITLT

SEQ ID NO: 159996 - protein, 11 aa, Borrelia afzelii PKo
KLTEGTITLTR

SEQ ID NO: 159997 - protein, 11 aa, Borrelia afzelii PKo
LTEGTITLTRE

SEQ ID NO: 159998 - protein, 11 aa, Borrelia afzelii PKo
TEGTITLTREI

SEQ ID NO: 159999 - protein, 11 aa, Borrelia afzelii PKo
EGTITLTREIE

SEQ ID NO: 160000 - protein, 11 aa, Borrelia afzelii PKo
GTITLTREIEQ

SEQ ID NO: 160001 - protein, 11 aa, Borrelia afzelii PKo
TITLTREIEQD

SEQ ID NO: 160002 - protein, 11 aa, Borrelia afzelii PKo
ITLTREIEQDG

SEQ ID NO: 160003 - protein, 11 aa, Borrelia afzelii PKo
TLTREIEQDGK

SEQ ID NO: 160004 - protein, 11 aa, Borrelia afzelii PKo
LTREIEQDGKV

SEQ ID NO: 160005 - protein, 11 aa, Borrelia afzelii PKo
TREIEQDGKVK

SEQ ID NO: 160006 - protein, 11 aa, Borrelia afzelii PKo
REIEQDGKVKI

SEQ ID NO: 160007 - protein, 11 aa, Borrelia afzelii PKo
EIEQDGKVKIY

SEQ ID NO: 160008 - protein, 11 aa, Borrelia afzelii PKo
IEQDGKVKIYL

SEQ ID NO: 160009 - protein, 11 aa, Borrelia afzelii PKo
EQDGKVKIYLN

SEQ ID NO: 160010 - protein, 11 aa, Borrelia afzelii PKo
QDGKVKIYLND

SEQ ID NO: 160011 - protein, 11 aa, Borrelia afzelii PKo
DGKVKIYLNDT

SEQ ID NO: 160012 - protein, 11 aa, Borrelia afzelii PKo
GKVKIYLNDTT

SEQ ID NO: 160013 - protein, 11 aa, Borrelia afzelii PKo
KVKIYLNDTTS

SEQ ID NO: 160014 - protein, 11 aa, Borrelia afzelii PKo
VKIYLNDTTSG

SEQ ID NO: 160015 - protein, 11 aa, Borrelia afzelii PKo
KIYLNDTTSGS

SEQ ID NO: 160016 - protein, 11 aa, Borrelia afzelii PKo
IYLNDTTSGST

SEQ ID NO: 160017 - protein, 11 aa, Borrelia afzelii PKo
YLNDTTSGSTK

SEQ ID NO: 160018 - protein, 11 aa, Borrelia afzelii PKo
LNDTTSGSTKK

SEQ ID NO: 160019 - protein, 11 aa, Borrelia afzelii PKo
NDTTSGSTKKT

SEQ ID NO: 160020 - protein, 11 aa, Borrelia afzelii PKo
DTTSGSTKKTA

SEQ ID NO: 160021 - protein, 11 aa, Borrelia afzelii PKo
TTSGSTKKTAT

SEQ ID NO: 160022 - protein, 11 aa, Borrelia afzelii PKo
TSGSTKKTATW

SEQ ID NO: 160023 - protein, 11 aa, Borrelia afzelii PKo
SGSTKKTATWN

SEQ ID NO: 160024 - protein, 11 aa, Borrelia afzelii PKo
GSTKKTATWNE

SEQ ID NO: 160025 - protein, 11 aa, Borrelia afzelii PKo
STKKTATWNET

SEQ ID NO: 160026 - protein, 11 aa, Borrelia afzelii PKo
TKKTATWNETT

SEQ ID NO: 160027 - protein, 11 aa, Borrelia afzelii PKo
KKTATWNETTN

SEQ ID NO: 160028 - protein, 11 aa, Borrelia afzelii PKo
KTATWNETTNT

SEQ ID NO: 160029 - protein, 11 aa, Borrelia afzelii PKo
TATWNETTNTL

SEQ ID NO: 160030 - protein, 11 aa, Borrelia afzelii PKo
ATWNETTNTLT

SEQ ID NO: 160031 - protein, 11 aa, Borrelia afzelii PKo
TWNETTNTLTI

SEQ ID NO: 160032 - protein, 11 aa, Borrelia afzelii PKo
WNETTNTLTIS

SEQ ID NO: 160033 - protein, 11 aa, Borrelia afzelii PKo
NETTNTLTISA

SEQ ID NO: 160034 - protein, 11 aa, Borrelia afzelii PKo
ETTNTLTISAD

SEQ ID NO: 160035 - protein, 11 aa, Borrelia afzelii PKo
TTNTLTISADS

SEQ ID NO: 160036 - protein, 11 aa, Borrelia afzelii PKo
TNTLTISADSK

SEQ ID NO: 160037 - protein, 11 aa, Borrelia afzelii PKo
NTLTISADSKK

SEQ ID NO: 160038 - protein, 11 aa, Borrelia afzelii PKo
TLTISADSKKT

SEQ ID NO: 160039 - protein, 11 aa, Borrelia afzelii PKo
LTISADSKKTK

SEQ ID NO: 160040 - protein, 11 aa, Borrelia afzelii PKo
TISADSKKTKD

SEQ ID NO: 160041 - protein, 11 aa, Borrelia afzelii PKo
ISADSKKTKDF

SEQ ID NO: 160042 - protein, 11 aa, Borrelia afzelii PKo
SADSKKTKDFV

SEQ ID NO: 160043 - protein, 11 aa, Borrelia afzelii PKo
ADSKKTKDFVF

SEQ ID NO: 160044 - protein, 11 aa, Borrelia afzelii PKo
DSKKTKDFVFL

SEQ ID NO: 160045 - protein, 11 aa, Borrelia afzelii PKo
SKKTKDFVFLT

SEQ ID NO: 160046 - protein, 11 aa, Borrelia afzelii PKo
KKTKDFVFLTD

SEQ ID NO: 160047 - protein, 11 aa, Borrelia afzelii PKo
KTKDFVFLTDG

SEQ ID NO: 160048 - protein, 11 aa, Borrelia afzelii PKo
TKDFVFLTDGT

SEQ ID NO: 160049 - protein, 11 aa, Borrelia afzelii PKo
KDFVFLTDGTI

SEQ ID NO: 160050 - protein, 11 aa, Borrelia afzelii PKo
DFVFLTDGTIT

SEQ ID NO: 160051 - protein, 11 aa, Borrelia afzelii PKo
FVFLTDGTITV

SEQ ID NO: 160052 - protein, 11 aa, Borrelia afzelii PKo
VFLTDGTITVQ

SEQ ID NO: 160053 - protein, 11 aa, Borrelia afzelii PKo
FLTDGTITVQA

SEQ ID NO: 160054 - protein, 11 aa, Borrelia afzelii PKo
LTDGTITVQAY

SEQ ID NO: 160055 - protein, 11 aa, Borrelia afzelii PKo
TDGTITVQAYD

SEQ ID NO: 160056 - protein, 11 aa, Borrelia afzelii PKo
DGTITVQAYDT

SEQ ID NO: 160057 - protein, 11 aa, Borrelia afzelii PKo
GTITVQAYDTA

SEQ ID NO: 160058 - protein, 11 aa, Borrelia afzelii PKo
TITVQAYDTAG

SEQ ID NO: 160059 - protein, 11 aa, Borrelia afzelii PKo
ITVQAYDTAGT

SEQ ID NO: 160060 - protein, 11 aa, Borrelia afzelii PKo
TVQAYDTAGTK

SEQ ID NO: 160061 - protein, 11 aa, Borrelia afzelii PKo
VQAYDTAGTKL

SEQ ID NO: 160062 - protein, 11 aa, Borrelia afzelii PKo
QAYDTAGTKLE

SEQ ID NO: 160063 - protein, 11 aa, Borrelia afzelii PKo
AYDTAGTKLEG

SEQ ID NO: 160064 - protein, 11 aa, Borrelia afzelii PKo
YDTAGTKLEGN

SEQ ID NO: 160065 - protein, 11 aa, Borrelia afzelii PKo
DTAGTKLEGNS

SEQ ID NO: 160066 - protein, 11 aa, Borrelia afzelii PKo
TAGTKLEGNSS

SEQ ID NO: 160067 - protein, 11 aa, Borrelia afzelii PKo
AGTKLEGNSSE

SEQ ID NO: 160068 - protein, 11 aa, Borrelia afzelii PKo
GTKLEGNSSEI

SEQ ID NO: 160069 - protein, 11 aa, Borrelia afzelii PKo
TKLEGNSSEIK

SEQ ID NO: 160070 - protein, 11 aa, Borrelia afzelii PKo
KLEGNSSEIKD

SEQ ID NO: 160071 - protein, 11 aa, Borrelia afzelii PKo
LEGNSSEIKDL

SEQ ID NO: 160072 - protein, 11 aa, Borrelia afzelii PKo
EGNSSEIKDLA

SEQ ID NO: 160073 - protein, 11 aa, Borrelia afzelii PKo
GNSSEIKDLAA

SEQ ID NO: 160074 - protein, 11 aa, Borrelia afzelii PKo
NSSEIKDLAAL

SEQ ID NO: 160075 - protein, 11 aa, Borrelia afzelii PKo
SSEIKDLAALK

SEQ ID NO: 160076 - protein, 11 aa, Borrelia afzelii PKo
SEIKDLAALKA

SEQ ID NO: 160077 - protein, 11 aa, Borrelia afzelii PKo
EIKDLAALKAA

SEQ ID NO: 160078 - protein, 11 aa, Borrelia afzelii PKo
IKDLAALKAAL

SEQ ID NO: 160079 - protein, 11 aa, Borrelia afzelii PKo
KDLAALKAALK

SEQ ID NO: 160080 - protein, 13 aa, Borrelia afzelii PKo
MKQYLLVFALVLA

SEQ ID NO: 160081 - protein, 13 aa, Borrelia afzelii PKo
KQYLLVFALVLAL

SEQ ID NO: 160082 - protein, 13 aa, Borrelia afzelii PKo
QYLLVFALVLALI

SEQ ID NO: 160083 - protein, 13 aa, Borrelia afzelii PKo
YLLVFALVLALIA

SEQ ID NO: 160084 - protein, 13 aa, Borrelia afzelii PKo
LLVFALVLALIAC

SEQ ID NO: 160085 - protein, 13 aa, Borrelia afzelii PKo
LVFALVLALIACS

SEQ ID NO: 160086 - protein, 13 aa, Borrelia afzelii PKo
VFALVLALIACSQ

SEQ ID NO: 160087 - protein, 13 aa, Borrelia afzelii PKo
FALVLALIACSQK

SEQ ID NO: 160088 - protein, 13 aa, Borrelia afzelii PKo
ALVLALIACSQKG

SEQ ID NO: 160089 - protein, 13 aa, Borrelia afzelii PKo
LVLALIACSQKGT

SEQ ID NO: 160090 - protein, 13 aa, Borrelia afzelii PKo
VLALIACSQKGTE

SEQ ID NO: 160091 - protein, 13 aa, Borrelia afzelii PKo
LALIACSQKGTEP

SEQ ID NO: 160092 - protein, 13 aa, Borrelia afzelii PKo
ALIACSQKGTEPK

SEQ ID NO: 160093 - protein, 13 aa, Borrelia afzelii PKo
LIACSQKGTEPKS

SEQ ID NO: 160094 - protein, 13 aa, Borrelia afzelii PKo
IACSQKGTEPKST

SEQ ID NO: 160095 - protein, 13 aa, Borrelia afzelii PKo
ACSQKGTEPKSTS

SEQ ID NO: 160096 - protein, 13 aa, Borrelia afzelii PKo
CSQKGTEPKSTSQ

SEQ ID NO: 160097 - protein, 13 aa, Borrelia afzelii PKo
SQKGTEPKSTSQD

SEQ ID NO: 160098 - protein, 13 aa, Borrelia afzelii PKo
QKGTEPKSTSQDH

SEQ ID NO: 160099 - protein, 13 aa, Borrelia afzelii PKo
KGTEPKSTSQDHN

SEQ ID NO: 160100 - protein, 13 aa, Borrelia afzelii PKo
GTEPKSTSQDHND

SEQ ID NO: 160101 - protein, 13 aa, Borrelia afzelii PKo
TEPKSTSQDHNDQ

SEQ ID NO: 160102 - protein, 13 aa, Borrelia afzelii PKo
EPKSTSQDHNDQE

SEQ ID NO: 160103 - protein, 13 aa, Borrelia afzelii PKo
PKSTSQDHNDQEI

SEQ ID NO: 160104 - protein, 13 aa, Borrelia afzelii PKo
KSTSQDHNDQEII

SEQ ID NO: 160105 - protein, 13 aa, Borrelia afzelii PKo
STSQDHNDQEIIN

SEQ ID NO: 160106 - protein, 13 aa, Borrelia afzelii PKo
TSQDHNDQEIINS

SEQ ID NO: 160107 - protein, 13 aa, Borrelia afzelii PKo
SQDHNDQEIINSD

SEQ ID NO: 160108 - protein, 13 aa, Borrelia afzelii PKo
QDHNDQEIINSDN

SEQ ID NO: 160109 - protein, 13 aa, Borrelia afzelii PKo
DHNDQEIINSDNT

SEQ ID NO: 160110 - protein, 13 aa, Borrelia afzelii PKo
HNDQEIINSDNTP

SEQ ID NO: 160111 - protein, 13 aa, Borrelia afzelii PKo
NDQEIINSDNTPK

SEQ ID NO: 160112 - protein, 13 aa, Borrelia afzelii PKo
DQEIINSDNTPKD

SEQ ID NO: 160113 - protein, 13 aa, Borrelia afzelii PKo
QEIINSDNTPKDS

SEQ ID NO: 160114 - protein, 13 aa, Borrelia afzelii PKo
EIINSDNTPKDSK

SEQ ID NO: 160115 - protein, 13 aa, Borrelia afzelii PKo
IINSDNTPKDSKK

SEQ ID NO: 160116 - protein, 13 aa, Borrelia afzelii PKo
INSDNTPKDSKKD

SEQ ID NO: 160117 - protein, 13 aa, Borrelia afzelii PKo
NSDNTPKDSKKDL

SEQ ID NO: 160118 - protein, 13 aa, Borrelia afzelii PKo
SDNTPKDSKKDLT

SEQ ID NO: 160119 - protein, 13 aa, Borrelia afzelii PKo
DNTPKDSKKDLTV

SEQ ID NO: 160120 - protein, 13 aa, Borrelia afzelii PKo
NTPKDSKKDLTVL

SEQ ID NO: 160121 - protein, 13 aa, Borrelia afzelii PKo
TPKDSKKDLTVLA

SEQ ID NO: 160122 - protein, 13 aa, Borrelia afzelii PKo
PKDSKKDLTVLAE

SEQ ID NO: 160123 - protein, 13 aa, Borrelia afzelii PKo
KDSKKDLTVLAEE

SEQ ID NO: 160124 - protein, 13 aa, Borrelia afzelii PKo
DSKKDLTVLAEEN

SEQ ID NO: 160125 - protein, 13 aa, Borrelia afzelii PKo
SKKDLTVLAEENS

SEQ ID NO: 160126 - protein, 13 aa, Borrelia afzelii PKo
KKDLTVLAEENSV

SEQ ID NO: 160127 - protein, 13 aa, Borrelia afzelii PKo
KDLTVLAEENSVP

SEQ ID NO: 160128 - protein, 13 aa, Borrelia afzelii PKo
DLTVLAEENSVPL

SEQ ID NO: 160129 - protein, 13 aa, Borrelia afzelii PKo
LTVLAEENSVPLF

SEQ ID NO: 160130 - protein, 13 aa, Borrelia afzelii PKo
TVLAEENSVPLFN

SEQ ID NO: 160131 - protein, 13 aa, Borrelia afzelii PKo
VLAEENSVPLFNG

SEQ ID NO: 160132 - protein, 13 aa, Borrelia afzelii PKo
LAEENSVPLFNGN

SEQ ID NO: 160133 - protein, 13 aa, Borrelia afzelii PKo
AEENSVPLFNGNK

SEQ ID NO: 160134 - protein, 13 aa, Borrelia afzelii PKo
EENSVPLFNGNKI

SEQ ID NO: 160135 - protein, 13 aa, Borrelia afzelii PKo
ENSVPLFNGNKIF

SEQ ID NO: 160136 - protein, 13 aa, Borrelia afzelii PKo
NSVPLFNGNKIFV

SEQ ID NO: 160137 - protein, 13 aa, Borrelia afzelii PKo
SVPLFNGNKIFVS

SEQ ID NO: 160138 - protein, 13 aa, Borrelia afzelii PKo
VPLFNGNKIFVSK

SEQ ID NO: 160139 - protein, 13 aa, Borrelia afzelii PKo
PLFNGNKIFVSKE

SEQ ID NO: 160140 - protein, 13 aa, Borrelia afzelii PKo
LFNGNKIFVSKEK

SEQ ID NO: 160141 - protein, 13 aa, Borrelia afzelii PKo
FNGNKIFVSKEKN

SEQ ID NO: 160142 - protein, 13 aa, Borrelia afzelii PKo
NGNKIFVSKEKNS

SEQ ID NO: 160143 - protein, 13 aa, Borrelia afzelii PKo
GNKIFVSKEKNSA

SEQ ID NO: 160144 - protein, 13 aa, Borrelia afzelii PKo
NKIFVSKEKNSAG

SEQ ID NO: 160145 - protein, 13 aa, Borrelia afzelii PKo
KIFVSKEKNSAGK

SEQ ID NO: 160146 - protein, 13 aa, Borrelia afzelii PKo
IFVSKEKNSAGKY

SEQ ID NO: 160147 - protein, 13 aa, Borrelia afzelii PKo
FVSKEKNSAGKYE

SEQ ID NO: 160148 - protein, 13 aa, Borrelia afzelii PKo
VSKEKNSAGKYEL

SEQ ID NO: 160149 - protein, 13 aa, Borrelia afzelii PKo
SKEKNSAGKYELR

SEQ ID NO: 160150 - protein, 13 aa, Borrelia afzelii PKo
KEKNSAGKYELRA

SEQ ID NO: 160151 - protein, 13 aa, Borrelia afzelii PKo
EKNSAGKYELRAT

SEQ ID NO: 160152 - protein, 13 aa, Borrelia afzelii PKo
KNSAGKYELRATV

SEQ ID NO: 160153 - protein, 13 aa, Borrelia afzelii PKo
NSAGKYELRATVD

SEQ ID NO: 160154 - protein, 13 aa, Borrelia afzelii PKo
SAGKYELRATVDT

SEQ ID NO: 160155 - protein, 13 aa, Borrelia afzelii PKo
AGKYELRATVDTV

SEQ ID NO: 160156 - protein, 13 aa, Borrelia afzelii PKo
GKYELRATVDTVE

SEQ ID NO: 160157 - protein, 13 aa, Borrelia afzelii PKo
KYELRATVDTVEL

SEQ ID NO: 160158 - protein, 13 aa, Borrelia afzelii PKo
YELRATVDTVELK

SEQ ID NO: 160159 - protein, 13 aa, Borrelia afzelii PKo
ELRATVDTVELKG

SEQ ID NO: 160160 - protein, 13 aa, Borrelia afzelii PKo
LRATVDTVELKGV

SEQ ID NO: 160161 - protein, 13 aa, Borrelia afzelii PKo
RATVDTVELKGVS

SEQ ID NO: 160162 - protein, 13 aa, Borrelia afzelii PKo
ATVDTVELKGVSD

SEQ ID NO: 160163 - protein, 13 aa, Borrelia afzelii PKo
TVDTVELKGVSDK

SEQ ID NO: 160164 - protein, 13 aa, Borrelia afzelii PKo
VDTVELKGVSDKN

SEQ ID NO: 160165 - protein, 13 aa, Borrelia afzelii PKo
DTVELKGVSDKNN

SEQ ID NO: 160166 - protein, 13 aa, Borrelia afzelii PKo
TVELKGVSDKNNG

SEQ ID NO: 160167 - protein, 13 aa, Borrelia afzelii PKo
VELKGVSDKNNGS

SEQ ID NO: 160168 - protein, 13 aa, Borrelia afzelii PKo
ELKGVSDKNNGSG

SEQ ID NO: 160169 - protein, 13 aa, Borrelia afzelii PKo
LKGVSDKNNGSGK

SEQ ID NO: 160170 - protein, 13 aa, Borrelia afzelii PKo
KGVSDKNNGSGKL

SEQ ID NO: 160171 - protein, 13 aa, Borrelia afzelii PKo
GVSDKNNGSGKLE

SEQ ID NO: 160172 - protein, 13 aa, Borrelia afzelii PKo
VSDKNNGSGKLEG

SEQ ID NO: 160173 - protein, 13 aa, Borrelia afzelii PKo
SDKNNGSGKLEGT

SEQ ID NO: 160174 - protein, 13 aa, Borrelia afzelii PKo
DKNNGSGKLEGTK

SEQ ID NO: 160175 - protein, 13 aa, Borrelia afzelii PKo
KNNGSGKLEGTKA

SEQ ID NO: 160176 - protein, 13 aa, Borrelia afzelii PKo
NNGSGKLEGTKAD

SEQ ID NO: 160177 - protein, 13 aa, Borrelia afzelii PKo
NGSGKLEGTKADK

SEQ ID NO: 160178 - protein, 13 aa, Borrelia afzelii PKo
GSGKLEGTKADKT

SEQ ID NO: 160179 - protein, 13 aa, Borrelia afzelii PKo
SGKLEGTKADKTK

SEQ ID NO: 160180 - protein, 13 aa, Borrelia afzelii PKo
GKLEGTKADKTKV

SEQ ID NO: 160181 - protein, 13 aa, Borrelia afzelii PKo
KLEGTKADKTKVA

SEQ ID NO: 160182 - protein, 13 aa, Borrelia afzelii PKo
LEGTKADKTKVAM

SEQ ID NO: 160183 - protein, 13 aa, Borrelia afzelii PKo
EGTKADKTKVAMT

SEQ ID NO: 160184 - protein, 13 aa, Borrelia afzelii PKo
GTKADKTKVAMTI

SEQ ID NO: 160185 - protein, 13 aa, Borrelia afzelii PKo
TKADKTKVAMTIA

SEQ ID NO: 160186 - protein, 13 aa, Borrelia afzelii PKo
KADKTKVAMTIAD

SEQ ID NO: 160187 - protein, 13 aa, Borrelia afzelii PKo
ADKTKVAMTIADD

SEQ ID NO: 160188 - protein, 13 aa, Borrelia afzelii PKo
DKTKVAMTIADDL

SEQ ID NO: 160189 - protein, 13 aa, Borrelia afzelii PKo
KTKVAMTIADDLN

SEQ ID NO: 160190 - protein, 13 aa, Borrelia afzelii PKo
TKVAMTIADDLNT

SEQ ID NO: 160191 - protein, 13 aa, Borrelia afzelii PKo
KVAMTIADDLNTI

SEQ ID NO: 160192 - protein, 13 aa, Borrelia afzelii PKo
VAMTIADDLNTIT

SEQ ID NO: 160193 - protein, 13 aa, Borrelia afzelii PKo
AMTIADDLNTITV

SEQ ID NO: 160194 - protein, 13 aa, Borrelia afzelii PKo
MTIADDLNTITVE

SEQ ID NO: 160195 - protein, 13 aa, Borrelia afzelii PKo
TIADDLNTITVET

SEQ ID NO: 160196 - protein, 13 aa, Borrelia afzelii PKo
IADDLNTITVETY

SEQ ID NO: 160197 - protein, 13 aa, Borrelia afzelii PKo
ADDLNTITVETYD

SEQ ID NO: 160198 - protein, 13 aa, Borrelia afzelii PKo
DDLNTITVETYDA

SEQ ID NO: 160199 - protein, 13 aa, Borrelia afzelii PKo
DLNTITVETYDAS

SEQ ID NO: 160200 - protein, 13 aa, Borrelia afzelii PKo
LNTITVETYDASN

SEQ ID NO: 160201 - protein, 13 aa, Borrelia afzelii PKo
NTITVETYDASNK

SEQ ID NO: 160202 - protein, 13 aa, Borrelia afzelii PKo
TITVETYDASNKK

SEQ ID NO: 160203 - protein, 13 aa, Borrelia afzelii PKo
ITVETYDASNKKT

SEQ ID NO: 160204 - protein, 13 aa, Borrelia afzelii PKo
TVETYDASNKKTG

SEQ ID NO: 160205 - protein, 13 aa, Borrelia afzelii PKo
VETYDASNKKTGS

SEQ ID NO: 160206 - protein, 13 aa, Borrelia afzelii PKo
ETYDASNKKTGSE

SEQ ID NO: 160207 - protein, 13 aa, Borrelia afzelii PKo
TYDASNKKTGSEV

SEQ ID NO: 160208 - protein, 13 aa, Borrelia afzelii PKo
YDASNKKTGSEVV

SEQ ID NO: 160209 - protein, 13 aa, Borrelia afzelii PKo
DASNKKTGSEVVK

SEQ ID NO: 160210 - protein, 13 aa, Borrelia afzelii PKo
ASNKKTGSEVVKK

SEQ ID NO: 160211 - protein, 13 aa, Borrelia afzelii PKo
SNKKTGSEVVKKQ

SEQ ID NO: 160212 - protein, 13 aa, Borrelia afzelii PKo
NKKTGSEVVKKQG

SEQ ID NO: 160213 - protein, 13 aa, Borrelia afzelii PKo
KKTGSEVVKKQGS

SEQ ID NO: 160214 - protein, 13 aa, Borrelia afzelii PKo
KTGSEVVKKQGSV

SEQ ID NO: 160215 - protein, 13 aa, Borrelia afzelii PKo
TGSEVVKKQGSVI

SEQ ID NO: 160216 - protein, 13 aa, Borrelia afzelii PKo
GSEVVKKQGSVIK

SEQ ID NO: 160217 - protein, 13 aa, Borrelia afzelii PKo
SEVVKKQGSVIKE

SEQ ID NO: 160218 - protein, 13 aa, Borrelia afzelii PKo
EVVKKQGSVIKES

SEQ ID NO: 160219 - protein, 13 aa, Borrelia afzelii PKo
VVKKQGSVIKESY

SEQ ID NO: 160220 - protein, 13 aa, Borrelia afzelii PKo
VKKQGSVIKESYK

SEQ ID NO: 160221 - protein, 13 aa, Borrelia afzelii PKo
KKQGSVIKESYKA

SEQ ID NO: 160222 - protein, 13 aa, Borrelia afzelii PKo
KQGSVIKESYKAN

SEQ ID NO: 160223 - protein, 13 aa, Borrelia afzelii PKo
QGSVIKESYKANK

SEQ ID NO: 160224 - protein, 13 aa, Borrelia afzelii PKo
GSVIKESYKANKL

SEQ ID NO: 160225 - protein, 13 aa, Borrelia afzelii PKo
SVIKESYKANKLD

SEQ ID NO: 160226 - protein, 13 aa, Borrelia afzelii PKo
VIKESYKANKLDS

SEQ ID NO: 160227 - protein, 13 aa, Borrelia afzelii PKo
IKESYKANKLDSK

SEQ ID NO: 160228 - protein, 13 aa, Borrelia afzelii PKo
KESYKANKLDSKK

SEQ ID NO: 160229 - protein, 13 aa, Borrelia afzelii PKo
ESYKANKLDSKKI

SEQ ID NO: 160230 - protein, 13 aa, Borrelia afzelii PKo
SYKANKLDSKKIT

SEQ ID NO: 160231 - protein, 13 aa, Borrelia afzelii PKo
YKANKLDSKKITR

SEQ ID NO: 160232 - protein, 13 aa, Borrelia afzelii PKo
KANKLDSKKITRE

SEQ ID NO: 160233 - protein, 13 aa, Borrelia afzelii PKo
ANKLDSKKITREN

SEQ ID NO: 160234 - protein, 13 aa, Borrelia afzelii PKo
NKLDSKKITRENE

SEQ ID NO: 160235 - protein, 13 aa, Borrelia afzelii PKo
KLDSKKITRENET

SEQ ID NO: 160236 - protein, 13 aa, Borrelia afzelii PKo
LDSKKITRENETT

SEQ ID NO: 160237 - protein, 13 aa, Borrelia afzelii PKo
DSKKITRENETTL

SEQ ID NO: 160238 - protein, 13 aa, Borrelia afzelii PKo
SKKITRENETTLE

SEQ ID NO: 160239 - protein, 13 aa, Borrelia afzelii PKo
KKITRENETTLEY

SEQ ID NO: 160240 - protein, 13 aa, Borrelia afzelii PKo
KITRENETTLEYS

SEQ ID NO: 160241 - protein, 13 aa, Borrelia afzelii PKo
ITRENETTLEYSE

SEQ ID NO: 160242 - protein, 13 aa, Borrelia afzelii PKo
TRENETTLEYSEM

SEQ ID NO: 160243 - protein, 13 aa, Borrelia afzelii PKo
RENETTLEYSEMT

SEQ ID NO: 160244 - protein, 13 aa, Borrelia afzelii PKo
ENETTLEYSEMTD

SEQ ID NO: 160245 - protein, 13 aa, Borrelia afzelii PKo
NETTLEYSEMTDS

SEQ ID NO: 160246 - protein, 13 aa, Borrelia afzelii PKo
ETTLEYSEMTDSS

SEQ ID NO: 160247 - protein, 13 aa, Borrelia afzelii PKo
TTLEYSEMTDSSN

SEQ ID NO: 160248 - protein, 13 aa, Borrelia afzelii PKo
TLEYSEMTDSSNA

SEQ ID NO: 160249 - protein, 13 aa, Borrelia afzelii PKo
LEYSEMTDSSNAT

SEQ ID NO: 160250 - protein, 13 aa, Borrelia afzelii PKo
EYSEMTDSSNATK

SEQ ID NO: 160251 - protein, 13 aa, Borrelia afzelii PKo
YSEMTDSSNATKA

SEQ ID NO: 160252 - protein, 13 aa, Borrelia afzelii PKo
SEMTDSSNATKAV

SEQ ID NO: 160253 - protein, 13 aa, Borrelia afzelii PKo
EMTDSSNATKAVE

SEQ ID NO: 160254 - protein, 13 aa, Borrelia afzelii PKo
MTDSSNATKAVET

SEQ ID NO: 160255 - protein, 13 aa, Borrelia afzelii PKo
TDSSNATKAVETL

SEQ ID NO: 160256 - protein, 13 aa, Borrelia afzelii PKo
DSSNATKAVETLK

SEQ ID NO: 160257 - protein, 13 aa, Borrelia afzelii PKo
SSNATKAVETLKN

SEQ ID NO: 160258 - protein, 13 aa, Borrelia afzelii PKo
SNATKAVETLKNG

SEQ ID NO: 160259 - protein, 13 aa, Borrelia afzelii PKo
NATKAVETLKNGI

SEQ ID NO: 160260 - protein, 13 aa, Borrelia afzelii PKo
ATKAVETLKNGIK

SEQ ID NO: 160261 - protein, 13 aa, Borrelia afzelii PKo
TKAVETLKNGIKL

SEQ ID NO: 160262 - protein, 13 aa, Borrelia afzelii PKo
KAVETLKNGIKLE

SEQ ID NO: 160263 - protein, 13 aa, Borrelia afzelii PKo
AVETLKNGIKLEG

SEQ ID NO: 160264 - protein, 13 aa, Borrelia afzelii PKo
VETLKNGIKLEGS

SEQ ID NO: 160265 - protein, 13 aa, Borrelia afzelii PKo
ETLKNGIKLEGSL

SEQ ID NO: 160266 - protein, 13 aa, Borrelia afzelii PKo
TLKNGIKLEGSLV

SEQ ID NO: 160267 - protein, 13 aa, Borrelia afzelii PKo
LKNGIKLEGSLVG

SEQ ID NO: 160268 - protein, 13 aa, Borrelia afzelii PKo
KNGIKLEGSLVGG

SEQ ID NO: 160269 - protein, 13 aa, Borrelia afzelii PKo
NGIKLEGSLVGGK

SEQ ID NO: 160270 - protein, 13 aa, Borrelia afzelii PKo
GIKLEGSLVGGKT

SEQ ID NO: 160271 - protein, 13 aa, Borrelia afzelii PKo
IKLEGSLVGGKTT

SEQ ID NO: 160272 - protein, 13 aa, Borrelia afzelii PKo
KLEGSLVGGKTTV

SEQ ID NO: 160273 - protein, 13 aa, Borrelia afzelii PKo
LEGSLVGGKTTVK

SEQ ID NO: 160274 - protein, 13 aa, Borrelia afzelii PKo
EGSLVGGKTTVKL

SEQ ID NO: 160275 - protein, 13 aa, Borrelia afzelii PKo
GSLVGGKTTVKLT

SEQ ID NO: 160276 - protein, 13 aa, Borrelia afzelii PKo
SLVGGKTTVKLTE

SEQ ID NO: 160277 - protein, 13 aa, Borrelia afzelii PKo
LVGGKTTVKLTEG

SEQ ID NO: 160278 - protein, 13 aa, Borrelia afzelii PKo
VGGKTTVKLTEGT

SEQ ID NO: 160279 - protein, 13 aa, Borrelia afzelii PKo
GGKTTVKLTEGTI

SEQ ID NO: 160280 - protein, 13 aa, Borrelia afzelii PKo
GKTTVKLTEGTIT

SEQ ID NO: 160281 - protein, 13 aa, Borrelia afzelii PKo
KTTVKLTEGTITL

SEQ ID NO: 160282 - protein, 13 aa, Borrelia afzelii PKo
TTVKLTEGTITLT

SEQ ID NO: 160283 - protein, 13 aa, Borrelia afzelii PKo
TVKLTEGTITLTR

SEQ ID NO: 160284 - protein, 13 aa, Borrelia afzelii PKo
VKLTEGTITLTRE

SEQ ID NO: 160285 - protein, 13 aa, Borrelia afzelii PKo
KLTEGTITLTREI

SEQ ID NO: 160286 - protein, 13 aa, Borrelia afzelii PKo
LTEGTITLTREIE

SEQ ID NO: 160287 - protein, 13 aa, Borrelia afzelii PKo
TEGTITLTREIEQ

SEQ ID NO: 160288 - protein, 13 aa, Borrelia afzelii PKo
EGTITLTREIEQD

SEQ ID NO: 160289 - protein, 13 aa, Borrelia afzelii PKo
GTITLTREIEQDG

SEQ ID NO: 160290 - protein, 13 aa, Borrelia afzelii PKo
TITLTREIEQDGK

SEQ ID NO: 160291 - protein, 13 aa, Borrelia afzelii PKo
ITLTREIEQDGKV

SEQ ID NO: 160292 - protein, 13 aa, Borrelia afzelii PKo
TLTREIEQDGKVK

SEQ ID NO: 160293 - protein, 13 aa, Borrelia afzelii PKo
LTREIEQDGKVKI

SEQ ID NO: 160294 - protein, 13 aa, Borrelia afzelii PKo
TREIEQDGKVKIY

SEQ ID NO: 160295 - protein, 13 aa, Borrelia afzelii PKo
REIEQDGKVKIYL

SEQ ID NO: 160296 - protein, 13 aa, Borrelia afzelii PKo
EIEQDGKVKIYLN

SEQ ID NO: 160297 - protein, 13 aa, Borrelia afzelii PKo
IEQDGKVKIYLND

SEQ ID NO: 160298 - protein, 13 aa, Borrelia afzelii PKo
EQDGKVKIYLNDT

SEQ ID NO: 160299 - protein, 13 aa, Borrelia afzelii PKo
QDGKVKIYLNDTT

SEQ ID NO: 160300 - protein, 13 aa, Borrelia afzelii PKo
DGKVKIYLNDTTS

SEQ ID NO: 160301 - protein, 13 aa, Borrelia afzelii PKo
GKVKIYLNDTTSG

SEQ ID NO: 160302 - protein, 13 aa, Borrelia afzelii PKo
KVKIYLNDTTSGS

SEQ ID NO: 160303 - protein, 13 aa, Borrelia afzelii PKo
VKIYLNDTTSGST

SEQ ID NO: 160304 - protein, 13 aa, Borrelia afzelii PKo
KIYLNDTTSGSTK

SEQ ID NO: 160305 - protein, 13 aa, Borrelia afzelii PKo
IYLNDTTSGSTKK

SEQ ID NO: 160306 - protein, 13 aa, Borrelia afzelii PKo
YLNDTTSGSTKKT

SEQ ID NO: 160307 - protein, 13 aa, Borrelia afzelii PKo
LNDTTSGSTKKTA

SEQ ID NO: 160308 - protein, 13 aa, Borrelia afzelii PKo
NDTTSGSTKKTAT

SEQ ID NO: 160309 - protein, 13 aa, Borrelia afzelii PKo
DTTSGSTKKTATW

SEQ ID NO: 160310 - protein, 13 aa, Borrelia afzelii PKo
TTSGSTKKTATWN

SEQ ID NO: 160311 - protein, 13 aa, Borrelia afzelii PKo
TSGSTKKTATWNE

SEQ ID NO: 160312 - protein, 13 aa, Borrelia afzelii PKo
SGSTKKTATWNET

SEQ ID NO: 160313 - protein, 13 aa, Borrelia afzelii PKo
GSTKKTATWNETT

SEQ ID NO: 160314 - protein, 13 aa, Borrelia afzelii PKo
STKKTATWNETTN

SEQ ID NO: 160315 - protein, 13 aa, Borrelia afzelii PKo
TKKTATWNETTNT

SEQ ID NO: 160316 - protein, 13 aa, Borrelia afzelii PKo
KKTATWNETTNTL

SEQ ID NO: 160317 - protein, 13 aa, Borrelia afzelii PKo
KTATWNETTNTLT

SEQ ID NO: 160318 - protein, 13 aa, Borrelia afzelii PKo
TATWNETTNTLTI

SEQ ID NO: 160319 - protein, 13 aa, Borrelia afzelii PKo
ATWNETTNTLTIS

SEQ ID NO: 160320 - protein, 13 aa, Borrelia afzelii PKo
TWNETTNTLTISA

SEQ ID NO: 160321 - protein, 13 aa, Borrelia afzelii PKo
WNETTNTLTISAD

SEQ ID NO: 160322 - protein, 13 aa, Borrelia afzelii PKo
NETTNTLTISADS

SEQ ID NO: 160323 - protein, 13 aa, Borrelia afzelii PKo
ETTNTLTISADSK

SEQ ID NO: 160324 - protein, 13 aa, Borrelia afzelii PKo
TTNTLTISADSKK

SEQ ID NO: 160325 - protein, 13 aa, Borrelia afzelii PKo
TNTLTISADSKKT

SEQ ID NO: 160326 - protein, 13 aa, Borrelia afzelii PKo
NTLTISADSKKTK

SEQ ID NO: 160327 - protein, 13 aa, Borrelia afzelii PKo
TLTISADSKKTKD

SEQ ID NO: 160328 - protein, 13 aa, Borrelia afzelii PKo
LTISADSKKTKDF

SEQ ID NO: 160329 - protein, 13 aa, Borrelia afzelii PKo
TISADSKKTKDFV

SEQ ID NO: 160330 - protein, 13 aa, Borrelia afzelii PKo
ISADSKKTKDFVF

SEQ ID NO: 160331 - protein, 13 aa, Borrelia afzelii PKo
SADSKKTKDFVFL

SEQ ID NO: 160332 - protein, 13 aa, Borrelia afzelii PKo
ADSKKTKDFVFLT

SEQ ID NO: 160333 - protein, 13 aa, Borrelia afzelii PKo
DSKKTKDFVFLTD

SEQ ID NO: 160334 - protein, 13 aa, Borrelia afzelii PKo
SKKTKDFVFLTDG

SEQ ID NO: 160335 - protein, 13 aa, Borrelia afzelii PKo
KKTKDFVFLTDGT

SEQ ID NO: 160336 - protein, 13 aa, Borrelia afzelii PKo
KTKDFVFLTDGTI

SEQ ID NO: 160337 - protein, 13 aa, Borrelia afzelii PKo
TKDFVFLTDGTIT

SEQ ID NO: 160338 - protein, 13 aa, Borrelia afzelii PKo
KDFVFLTDGTITV

SEQ ID NO: 160339 - protein, 13 aa, Borrelia afzelii PKo
DFVFLTDGTITVQ

SEQ ID NO: 160340 - protein, 13 aa, Borrelia afzelii PKo
FVFLTDGTITVQA

SEQ ID NO: 160341 - protein, 13 aa, Borrelia afzelii PKo
VFLTDGTITVQAY

SEQ ID NO: 160342 - protein, 13 aa, Borrelia afzelii PKo
FLTDGTITVQAYD

SEQ ID NO: 160343 - protein, 13 aa, Borrelia afzelii PKo
LTDGTITVQAYDT

SEQ ID NO: 160344 - protein, 13 aa, Borrelia afzelii PKo
TDGTITVQAYDTA

SEQ ID NO: 160345 - protein, 13 aa, Borrelia afzelii PKo
DGTITVQAYDTAG

SEQ ID NO: 160346 - protein, 13 aa, Borrelia afzelii PKo
GTITVQAYDTAGT

SEQ ID NO: 160347 - protein, 13 aa, Borrelia afzelii PKo
TITVQAYDTAGTK

SEQ ID NO: 160348 - protein, 13 aa, Borrelia afzelii PKo
ITVQAYDTAGTKL

SEQ ID NO: 160349 - protein, 13 aa, Borrelia afzelii PKo
TVQAYDTAGTKLE

SEQ ID NO: 160350 - protein, 13 aa, Borrelia afzelii PKo
VQAYDTAGTKLEG

SEQ ID NO: 160351 - protein, 13 aa, Borrelia afzelii PKo
QAYDTAGTKLEGN

SEQ ID NO: 160352 - protein, 13 aa, Borrelia afzelii PKo
AYDTAGTKLEGNS

SEQ ID NO: 160353 - protein, 13 aa, Borrelia afzelii PKo
YDTAGTKLEGNSS

SEQ ID NO: 160354 - protein, 13 aa, Borrelia afzelii PKo
DTAGTKLEGNSSE

SEQ ID NO: 160355 - protein, 13 aa, Borrelia afzelii PKo
TAGTKLEGNSSEI

SEQ ID NO: 160356 - protein, 13 aa, Borrelia afzelii PKo
AGTKLEGNSSEIK

SEQ ID NO: 160357 - protein, 13 aa, Borrelia afzelii PKo
GTKLEGNSSEIKD

SEQ ID NO: 160358 - protein, 13 aa, Borrelia afzelii PKo
TKLEGNSSEIKDL

SEQ ID NO: 160359 - protein, 13 aa, Borrelia afzelii PKo
KLEGNSSEIKDLA

SEQ ID NO: 160360 - protein, 13 aa, Borrelia afzelii PKo
LEGNSSEIKDLAA

SEQ ID NO: 160361 - protein, 13 aa, Borrelia afzelii PKo
EGNSSEIKDLAAL

SEQ ID NO: 160362 - protein, 13 aa, Borrelia afzelii PKo
GNSSEIKDLAALK

SEQ ID NO: 160363 - protein, 13 aa, Borrelia afzelii PKo
NSSEIKDLAALKA

SEQ ID NO: 160364 - protein, 13 aa, Borrelia afzelii PKo
SSEIKDLAALKAA

SEQ ID NO: 160365 - protein, 13 aa, Borrelia afzelii PKo
SEIKDLAALKAAL

SEQ ID NO: 160366 - protein, 13 aa, Borrelia afzelii PKo
EIKDLAALKAALK

SEQ ID NO: 160367 - protein, 14 aa, Borrelia afzelii PKo
MKQYLLVFALVLAL

SEQ ID NO: 160368 - protein, 14 aa, Borrelia afzelii PKo
KQYLLVFALVLALI

SEQ ID NO: 160369 - protein, 14 aa, Borrelia afzelii PKo
QYLLVFALVLALIA

SEQ ID NO: 160370 - protein, 14 aa, Borrelia afzelii PKo
YLLVFALVLALIAC

SEQ ID NO: 160371 - protein, 14 aa, Borrelia afzelii PKo
LLVFALVLALIACS

SEQ ID NO: 160372 - protein, 14 aa, Borrelia afzelii PKo
LVFALVLALIACSQ

SEQ ID NO: 160373 - protein, 14 aa, Borrelia afzelii PKo
VFALVLALIACSQK

SEQ ID NO: 160374 - protein, 14 aa, Borrelia afzelii PKo
FALVLALIACSQKG

SEQ ID NO: 160375 - protein, 14 aa, Borrelia afzelii PKo
ALVLALIACSQKGT

SEQ ID NO: 160376 - protein, 14 aa, Borrelia afzelii PKo
LVLALIACSQKGTE

SEQ ID NO: 160377 - protein, 14 aa, Borrelia afzelii PKo
VLALIACSQKGTEP

SEQ ID NO: 160378 - protein, 14 aa, Borrelia afzelii PKo
LALIACSQKGTEPK

SEQ ID NO: 160379 - protein, 14 aa, Borrelia afzelii PKo
ALIACSQKGTEPKS

SEQ ID NO: 160380 - protein, 14 aa, Borrelia afzelii PKo
LIACSQKGTEPKST

SEQ ID NO: 160381 - protein, 14 aa, Borrelia afzelii PKo
IACSQKGTEPKSTS

SEQ ID NO: 160382 - protein, 14 aa, Borrelia afzelii PKo
ACSQKGTEPKSTSQ

SEQ ID NO: 160383 - protein, 14 aa, Borrelia afzelii PKo
CSQKGTEPKSTSQD

SEQ ID NO: 160384 - protein, 14 aa, Borrelia afzelii PKo
SQKGTEPKSTSQDH

SEQ ID NO: 160385 - protein, 14 aa, Borrelia afzelii PKo
QKGTEPKSTSQDHN

SEQ ID NO: 160386 - protein, 14 aa, Borrelia afzelii PKo
KGTEPKSTSQDHND

SEQ ID NO: 160387 - protein, 14 aa, Borrelia afzelii PKo
GTEPKSTSQDHNDQ

SEQ ID NO: 160388 - protein, 14 aa, Borrelia afzelii PKo
TEPKSTSQDHNDQE

SEQ ID NO: 160389 - protein, 14 aa, Borrelia afzelii PKo
EPKSTSQDHNDQEI

SEQ ID NO: 160390 - protein, 14 aa, Borrelia afzelii PKo
PKSTSQDHNDQEII

SEQ ID NO: 160391 - protein, 14 aa, Borrelia afzelii PKo
KSTSQDHNDQEIIN

SEQ ID NO: 160392 - protein, 14 aa, Borrelia afzelii PKo
STSQDHNDQEIINS

SEQ ID NO: 160393 - protein, 14 aa, Borrelia afzelii PKo
TSQDHNDQEIINSD

SEQ ID NO: 160394 - protein, 14 aa, Borrelia afzelii PKo
SQDHNDQEIINSDN

SEQ ID NO: 160395 - protein, 14 aa, Borrelia afzelii PKo
QDHNDQEIINSDNT

SEQ ID NO: 160396 - protein, 14 aa, Borrelia afzelii PKo
DHNDQEIINSDNTP

SEQ ID NO: 160397 - protein, 14 aa, Borrelia afzelii PKo
HNDQEIINSDNTPK

SEQ ID NO: 160398 - protein, 14 aa, Borrelia afzelii PKo
NDQEIINSDNTPKD

SEQ ID NO: 160399 - protein, 14 aa, Borrelia afzelii PKo
DQEIINSDNTPKDS

SEQ ID NO: 160400 - protein, 14 aa, Borrelia afzelii PKo
QEIINSDNTPKDSK

SEQ ID NO: 160401 - protein, 14 aa, Borrelia afzelii PKo
EIINSDNTPKDSKK

SEQ ID NO: 160402 - protein, 14 aa, Borrelia afzelii PKo
IINSDNTPKDSKKD

SEQ ID NO: 160403 - protein, 14 aa, Borrelia afzelii PKo
INSDNTPKDSKKDL

SEQ ID NO: 160404 - protein, 14 aa, Borrelia afzelii PKo
NSDNTPKDSKKDLT

SEQ ID NO: 160405 - protein, 14 aa, Borrelia afzelii PKo
SDNTPKDSKKDLTV

SEQ ID NO: 160406 - protein, 14 aa, Borrelia afzelii PKo
DNTPKDSKKDLTVL

SEQ ID NO: 160407 - protein, 14 aa, Borrelia afzelii PKo
NTPKDSKKDLTVLA

SEQ ID NO: 160408 - protein, 14 aa, Borrelia afzelii PKo
TPKDSKKDLTVLAE

SEQ ID NO: 160409 - protein, 14 aa, Borrelia afzelii PKo
PKDSKKDLTVLAEE

SEQ ID NO: 160410 - protein, 14 aa, Borrelia afzelii PKo
KDSKKDLTVLAEEN

SEQ ID NO: 160411 - protein, 14 aa, Borrelia afzelii PKo
DSKKDLTVLAEENS

SEQ ID NO: 160412 - protein, 14 aa, Borrelia afzelii PKo
SKKDLTVLAEENSV

SEQ ID NO: 160413 - protein, 14 aa, Borrelia afzelii PKo
KKDLTVLAEENSVP

SEQ ID NO: 160414 - protein, 14 aa, Borrelia afzelii PKo
KDLTVLAEENSVPL

SEQ ID NO: 160415 - protein, 14 aa, Borrelia afzelii PKo
DLTVLAEENSVPLF

SEQ ID NO: 160416 - protein, 14 aa, Borrelia afzelii PKo
LTVLAEENSVPLFN

SEQ ID NO: 160417 - protein, 14 aa, Borrelia afzelii PKo
TVLAEENSVPLFNG

SEQ ID NO: 160418 - protein, 14 aa, Borrelia afzelii PKo
VLAEENSVPLFNGN

SEQ ID NO: 160419 - protein, 14 aa, Borrelia afzelii PKo
LAEENSVPLFNGNK

SEQ ID NO: 160420 - protein, 14 aa, Borrelia afzelii PKo
AEENSVPLFNGNKI

SEQ ID NO: 160421 - protein, 14 aa, Borrelia afzelii PKo
EENSVPLFNGNKIF

SEQ ID NO: 160422 - protein, 14 aa, Borrelia afzelii PKo
ENSVPLFNGNKIFV

SEQ ID NO: 160423 - protein, 14 aa, Borrelia afzelii PKo
NSVPLFNGNKIFVS

SEQ ID NO: 160424 - protein, 14 aa, Borrelia afzelii PKo
SVPLFNGNKIFVSK

SEQ ID NO: 160425 - protein, 14 aa, Borrelia afzelii PKo
VPLFNGNKIFVSKE

SEQ ID NO: 160426 - protein, 14 aa, Borrelia afzelii PKo
PLFNGNKIFVSKEK

SEQ ID NO: 160427 - protein, 14 aa, Borrelia afzelii PKo
LFNGNKIFVSKEKN

SEQ ID NO: 160428 - protein, 14 aa, Borrelia afzelii PKo
FNGNKIFVSKEKNS

SEQ ID NO: 160429 - protein, 14 aa, Borrelia afzelii PKo
NGNKIFVSKEKNSA

SEQ ID NO: 160430 - protein, 14 aa, Borrelia afzelii PKo
GNKIFVSKEKNSAG

SEQ ID NO: 160431 - protein, 14 aa, Borrelia afzelii PKo
NKIFVSKEKNSAGK

SEQ ID NO: 160432 - protein, 14 aa, Borrelia afzelii PKo
KIFVSKEKNSAGKY

SEQ ID NO: 160433 - protein, 14 aa, Borrelia afzelii PKo
IFVSKEKNSAGKYE

SEQ ID NO: 160434 - protein, 14 aa, Borrelia afzelii PKo
FVSKEKNSAGKYEL

SEQ ID NO: 160435 - protein, 14 aa, Borrelia afzelii PKo
VSKEKNSAGKYELR

SEQ ID NO: 160436 - protein, 14 aa, Borrelia afzelii PKo
SKEKNSAGKYELRA

SEQ ID NO: 160437 - protein, 14 aa, Borrelia afzelii PKo
KEKNSAGKYELRAT

SEQ ID NO: 160438 - protein, 14 aa, Borrelia afzelii PKo
EKNSAGKYELRATV

SEQ ID NO: 160439 - protein, 14 aa, Borrelia afzelii PKo
KNSAGKYELRATVD

SEQ ID NO: 160440 - protein, 14 aa, Borrelia afzelii PKo
NSAGKYELRATVDT

SEQ ID NO: 160441 - protein, 14 aa, Borrelia afzelii PKo
SAGKYELRATVDTV

SEQ ID NO: 160442 - protein, 14 aa, Borrelia afzelii PKo
AGKYELRATVDTVE

SEQ ID NO: 160443 - protein, 14 aa, Borrelia afzelii PKo
GKYELRATVDTVEL

SEQ ID NO: 160444 - protein, 14 aa, Borrelia afzelii PKo
KYELRATVDTVELK

SEQ ID NO: 160445 - protein, 14 aa, Borrelia afzelii PKo
YELRATVDTVELKG

SEQ ID NO: 160446 - protein, 14 aa, Borrelia afzelii PKo
ELRATVDTVELKGV

SEQ ID NO: 160447 - protein, 14 aa, Borrelia afzelii PKo
LRATVDTVELKGVS

SEQ ID NO: 160448 - protein, 14 aa, Borrelia afzelii PKo
RATVDTVELKGVSD

SEQ ID NO: 160449 - protein, 14 aa, Borrelia afzelii PKo
ATVDTVELKGVSDK

SEQ ID NO: 160450 - protein, 14 aa, Borrelia afzelii PKo
TVDTVELKGVSDKN

SEQ ID NO: 160451 - protein, 14 aa, Borrelia afzelii PKo
VDTVELKGVSDKNN

SEQ ID NO: 160452 - protein, 14 aa, Borrelia afzelii PKo
DTVELKGVSDKNNG

SEQ ID NO: 160453 - protein, 14 aa, Borrelia afzelii PKo
TVELKGVSDKNNGS

SEQ ID NO: 160454 - protein, 14 aa, Borrelia afzelii PKo
VELKGVSDKNNGSG

SEQ ID NO: 160455 - protein, 14 aa, Borrelia afzelii PKo
ELKGVSDKNNGSGK

SEQ ID NO: 160456 - protein, 14 aa, Borrelia afzelii PKo
LKGVSDKNNGSGKL

SEQ ID NO: 160457 - protein, 14 aa, Borrelia afzelii PKo
KGVSDKNNGSGKLE

SEQ ID NO: 160458 - protein, 14 aa, Borrelia afzelii PKo
GVSDKNNGSGKLEG

SEQ ID NO: 160459 - protein, 14 aa, Borrelia afzelii PKo
VSDKNNGSGKLEGT

SEQ ID NO: 160460 - protein, 14 aa, Borrelia afzelii PKo
SDKNNGSGKLEGTK

SEQ ID NO: 160461 - protein, 14 aa, Borrelia afzelii PKo
DKNNGSGKLEGTKA

SEQ ID NO: 160462 - protein, 14 aa, Borrelia afzelii PKo
KNNGSGKLEGTKAD

SEQ ID NO: 160463 - protein, 14 aa, Borrelia afzelii PKo
NNGSGKLEGTKADK

SEQ ID NO: 160464 - protein, 14 aa, Borrelia afzelii PKo
NGSGKLEGTKADKT

SEQ ID NO: 160465 - protein, 14 aa, Borrelia afzelii PKo
GSGKLEGTKADKTK

SEQ ID NO: 160466 - protein, 14 aa, Borrelia afzelii PKo
SGKLEGTKADKTKV

SEQ ID NO: 160467 - protein, 14 aa, Borrelia afzelii PKo
GKLEGTKADKTKVA

SEQ ID NO: 160468 - protein, 14 aa, Borrelia afzelii PKo
KLEGTKADKTKVAM

SEQ ID NO: 160469 - protein, 14 aa, Borrelia afzelii PKo
LEGTKADKTKVAMT

SEQ ID NO: 160470 - protein, 14 aa, Borrelia afzelii PKo
EGTKADKTKVAMTI

SEQ ID NO: 160471 - protein, 14 aa, Borrelia afzelii PKo
GTKADKTKVAMTIA

SEQ ID NO: 160472 - protein, 14 aa, Borrelia afzelii PKo
TKADKTKVAMTIAD

SEQ ID NO: 160473 - protein, 14 aa, Borrelia afzelii PKo
KADKTKVAMTIADD

SEQ ID NO: 160474 - protein, 14 aa, Borrelia afzelii PKo
ADKTKVAMTIADDL

SEQ ID NO: 160475 - protein, 14 aa, Borrelia afzelii PKo
DKTKVAMTIADDLN

SEQ ID NO: 160476 - protein, 14 aa, Borrelia afzelii PKo
KTKVAMTIADDLNT

SEQ ID NO: 160477 - protein, 14 aa, Borrelia afzelii PKo
TKVAMTIADDLNTI

SEQ ID NO: 160478 - protein, 14 aa, Borrelia afzelii PKo
KVAMTIADDLNTIT

SEQ ID NO: 160479 - protein, 14 aa, Borrelia afzelii PKo
VAMTIADDLNTITV

SEQ ID NO: 160480 - protein, 14 aa, Borrelia afzelii PKo
AMTIADDLNTITVE

SEQ ID NO: 160481 - protein, 14 aa, Borrelia afzelii PKo
MTIADDLNTITVET

SEQ ID NO: 160482 - protein, 14 aa, Borrelia afzelii PKo
TIADDLNTITVETY

SEQ ID NO: 160483 - protein, 14 aa, Borrelia afzelii PKo
IADDLNTITVETYD

SEQ ID NO: 160484 - protein, 14 aa, Borrelia afzelii PKo
ADDLNTITVETYDA

SEQ ID NO: 160485 - protein, 14 aa, Borrelia afzelii PKo
DDLNTITVETYDAS

SEQ ID NO: 160486 - protein, 14 aa, Borrelia afzelii PKo
DLNTITVETYDASN

SEQ ID NO: 160487 - protein, 14 aa, Borrelia afzelii PKo
LNTITVETYDASNK

SEQ ID NO: 160488 - protein, 14 aa, Borrelia afzelii PKo
NTITVETYDASNKK

SEQ ID NO: 160489 - protein, 14 aa, Borrelia afzelii PKo
TITVETYDASNKKT

SEQ ID NO: 160490 - protein, 14 aa, Borrelia afzelii PKo
ITVETYDASNKKTG

SEQ ID NO: 160491 - protein, 14 aa, Borrelia afzelii PKo
TVETYDASNKKTGS

SEQ ID NO: 160492 - protein, 14 aa, Borrelia afzelii PKo
VETYDASNKKTGSE

SEQ ID NO: 160493 - protein, 14 aa, Borrelia afzelii PKo
ETYDASNKKTGSEV

SEQ ID NO: 160494 - protein, 14 aa, Borrelia afzelii PKo
TYDASNKKTGSEVV

SEQ ID NO: 160495 - protein, 14 aa, Borrelia afzelii PKo
YDASNKKTGSEVVK

SEQ ID NO: 160496 - protein, 14 aa, Borrelia afzelii PKo
DASNKKTGSEVVKK

SEQ ID NO: 160497 - protein, 14 aa, Borrelia afzelii PKo
ASNKKTGSEVVKKQ

SEQ ID NO: 160498 - protein, 14 aa, Borrelia afzelii PKo
SNKKTGSEVVKKQG

SEQ ID NO: 160499 - protein, 14 aa, Borrelia afzelii PKo
NKKTGSEVVKKQGS

SEQ ID NO: 160500 - protein, 14 aa, Borrelia afzelii PKo
KKTGSEVVKKQGSV

SEQ ID NO: 160501 - protein, 14 aa, Borrelia afzelii PKo
KTGSEVVKKQGSVI

SEQ ID NO: 160502 - protein, 14 aa, Borrelia afzelii PKo
TGSEVVKKQGSVIK

SEQ ID NO: 160503 - protein, 14 aa, Borrelia afzelii PKo
GSEVVKKQGSVIKE

SEQ ID NO: 160504 - protein, 14 aa, Borrelia afzelii PKo
SEVVKKQGSVIKES

SEQ ID NO: 160505 - protein, 14 aa, Borrelia afzelii PKo
EVVKKQGSVIKESY

SEQ ID NO: 160506 - protein, 14 aa, Borrelia afzelii PKo
VVKKQGSVIKESYK

SEQ ID NO: 160507 - protein, 14 aa, Borrelia afzelii PKo
VKKQGSVIKESYKA

SEQ ID NO: 160508 - protein, 14 aa, Borrelia afzelii PKo
KKQGSVIKESYKAN

SEQ ID NO: 160509 - protein, 14 aa, Borrelia afzelii PKo
KQGSVIKESYKANK

SEQ ID NO: 160510 - protein, 14 aa, Borrelia afzelii PKo
QGSVIKESYKANKL

SEQ ID NO: 160511 - protein, 14 aa, Borrelia afzelii PKo
GSVIKESYKANKLD

SEQ ID NO: 160512 - protein, 14 aa, Borrelia afzelii PKo
SVIKESYKANKLDS

SEQ ID NO: 160513 - protein, 14 aa, Borrelia afzelii PKo
VIKESYKANKLDSK

SEQ ID NO: 160514 - protein, 14 aa, Borrelia afzelii PKo
IKESYKANKLDSKK

SEQ ID NO: 160515 - protein, 14 aa, Borrelia afzelii PKo
KESYKANKLDSKKI

SEQ ID NO: 160516 - protein, 14 aa, Borrelia afzelii PKo
ESYKANKLDSKKIT

SEQ ID NO: 160517 - protein, 14 aa, Borrelia afzelii PKo
SYKANKLDSKKITR

SEQ ID NO: 160518 - protein, 14 aa, Borrelia afzelii PKo
YKANKLDSKKITRE

SEQ ID NO: 160519 - protein, 14 aa, Borrelia afzelii PKo
KANKLDSKKITREN

SEQ ID NO: 160520 - protein, 14 aa, Borrelia afzelii PKo
ANKLDSKKITRENE

SEQ ID NO: 160521 - protein, 14 aa, Borrelia afzelii PKo
NKLDSKKITRENET

SEQ ID NO: 160522 - protein, 14 aa, Borrelia afzelii PKo
KLDSKKITRENETT

SEQ ID NO: 160523 - protein, 14 aa, Borrelia afzelii PKo
LDSKKITRENETTL

SEQ ID NO: 160524 - protein, 14 aa, Borrelia afzelii PKo
DSKKITRENETTLE

SEQ ID NO: 160525 - protein, 14 aa, Borrelia afzelii PKo
SKKITRENETTLEY

SEQ ID NO: 160526 - protein, 14 aa, Borrelia afzelii PKo
KKITRENETTLEYS

SEQ ID NO: 160527 - protein, 14 aa, Borrelia afzelii PKo
KITRENETTLEYSE

SEQ ID NO: 160528 - protein, 14 aa, Borrelia afzelii PKo
ITRENETTLEYSEM

SEQ ID NO: 160529 - protein, 14 aa, Borrelia afzelii PKo
TRENETTLEYSEMT

SEQ ID NO: 160530 - protein, 14 aa, Borrelia afzelii PKo
RENETTLEYSEMTD

SEQ ID NO: 160531 - protein, 14 aa, Borrelia afzelii PKo
ENETTLEYSEMTDS

SEQ ID NO: 160532 - protein, 14 aa, Borrelia afzelii PKo
NETTLEYSEMTDSS

SEQ ID NO: 160533 - protein, 14 aa, Borrelia afzelii PKo
ETTLEYSEMTDSSN

SEQ ID NO: 160534 - protein, 14 aa, Borrelia afzelii PKo
TTLEYSEMTDSSNA

SEQ ID NO: 160535 - protein, 14 aa, Borrelia afzelii PKo
TLEYSEMTDSSNAT

SEQ ID NO: 160536 - protein, 14 aa, Borrelia afzelii PKo
LEYSEMTDSSNATK

SEQ ID NO: 160537 - protein, 14 aa, Borrelia afzelii PKo
EYSEMTDSSNATKA

SEQ ID NO: 160538 - protein, 14 aa, Borrelia afzelii PKo
YSEMTDSSNATKAV

SEQ ID NO: 160539 - protein, 14 aa, Borrelia afzelii PKo
SEMTDSSNATKAVE

SEQ ID NO: 160540 - protein, 14 aa, Borrelia afzelii PKo
EMTDSSNATKAVET

SEQ ID NO: 160541 - protein, 14 aa, Borrelia afzelii PKo
MTDSSNATKAVETL

SEQ ID NO: 160542 - protein, 14 aa, Borrelia afzelii PKo
TDSSNATKAVETLK

SEQ ID NO: 160543 - protein, 14 aa, Borrelia afzelii PKo
DSSNATKAVETLKN

SEQ ID NO: 160544 - protein, 14 aa, Borrelia afzelii PKo
SSNATKAVETLKNG

SEQ ID NO: 160545 - protein, 14 aa, Borrelia afzelii PKo
SNATKAVETLKNGI

SEQ ID NO: 160546 - protein, 14 aa, Borrelia afzelii PKo
NATKAVETLKNGIK

SEQ ID NO: 160547 - protein, 14 aa, Borrelia afzelii PKo
ATKAVETLKNGIKL

SEQ ID NO: 160548 - protein, 14 aa, Borrelia afzelii PKo
TKAVETLKNGIKLE

SEQ ID NO: 160549 - protein, 14 aa, Borrelia afzelii PKo
KAVETLKNGIKLEG

SEQ ID NO: 160550 - protein, 14 aa, Borrelia afzelii PKo
AVETLKNGIKLEGS

SEQ ID NO: 160551 - protein, 14 aa, Borrelia afzelii PKo
VETLKNGIKLEGSL

SEQ ID NO: 160552 - protein, 14 aa, Borrelia afzelii PKo
ETLKNGIKLEGSLV

SEQ ID NO: 160553 - protein, 14 aa, Borrelia afzelii PKo
TLKNGIKLEGSLVG

SEQ ID NO: 160554 - protein, 14 aa, Borrelia afzelii PKo
LKNGIKLEGSLVGG

SEQ ID NO: 160555 - protein, 14 aa, Borrelia afzelii PKo
KNGIKLEGSLVGGK

SEQ ID NO: 160556 - protein, 14 aa, Borrelia afzelii PKo
NGIKLEGSLVGGKT

SEQ ID NO: 160557 - protein, 14 aa, Borrelia afzelii PKo
GIKLEGSLVGGKTT

SEQ ID NO: 160558 - protein, 14 aa, Borrelia afzelii PKo
IKLEGSLVGGKTTV

SEQ ID NO: 160559 - protein, 14 aa, Borrelia afzelii PKo
KLEGSLVGGKTTVK

SEQ ID NO: 160560 - protein, 14 aa, Borrelia afzelii PKo
LEGSLVGGKTTVKL

SEQ ID NO: 160561 - protein, 14 aa, Borrelia afzelii PKo
EGSLVGGKTTVKLT

SEQ ID NO: 160562 - protein, 14 aa, Borrelia afzelii PKo
GSLVGGKTTVKLTE

SEQ ID NO: 160563 - protein, 14 aa, Borrelia afzelii PKo
SLVGGKTTVKLTEG

SEQ ID NO: 160564 - protein, 14 aa, Borrelia afzelii PKo
LVGGKTTVKLTEGT

SEQ ID NO: 160565 - protein, 14 aa, Borrelia afzelii PKo
VGGKTTVKLTEGTI

SEQ ID NO: 160566 - protein, 14 aa, Borrelia afzelii PKo
GGKTTVKLTEGTIT

SEQ ID NO: 160567 - protein, 14 aa, Borrelia afzelii PKo
GKTTVKLTEGTITL

SEQ ID NO: 160568 - protein, 14 aa, Borrelia afzelii PKo
KTTVKLTEGTITLT

SEQ ID NO: 160569 - protein, 14 aa, Borrelia afzelii PKo
TTVKLTEGTITLTR

SEQ ID NO: 160570 - protein, 14 aa, Borrelia afzelii PKo
TVKLTEGTITLTRE

SEQ ID NO: 160571 - protein, 14 aa, Borrelia afzelii PKo
VKLTEGTITLTREI

SEQ ID NO: 160572 - protein, 14 aa, Borrelia afzelii PKo
KLTEGTITLTREIE

SEQ ID NO: 160573 - protein, 14 aa, Borrelia afzelii PKo
LTEGTITLTREIEQ

SEQ ID NO: 160574 - protein, 14 aa, Borrelia afzelii PKo
TEGTITLTREIEQD

SEQ ID NO: 160575 - protein, 14 aa, Borrelia afzelii PKo
EGTITLTREIEQDG

SEQ ID NO: 160576 - protein, 14 aa, Borrelia afzelii PKo
GTITLTREIEQDGK

SEQ ID NO: 160577 - protein, 14 aa, Borrelia afzelii PKo
TITLTREIEQDGKV

SEQ ID NO: 160578 - protein, 14 aa, Borrelia afzelii PKo
ITLTREIEQDGKVK

SEQ ID NO: 160579 - protein, 14 aa, Borrelia afzelii PKo
TLTREIEQDGKVKI

SEQ ID NO: 160580 - protein, 14 aa, Borrelia afzelii PKo
LTREIEQDGKVKIY

SEQ ID NO: 160581 - protein, 14 aa, Borrelia afzelii PKo
TREIEQDGKVKIYL

SEQ ID NO: 160582 - protein, 14 aa, Borrelia afzelii PKo
REIEQDGKVKIYLN

SEQ ID NO: 160583 - protein, 14 aa, Borrelia afzelii PKo
EIEQDGKVKIYLND

SEQ ID NO: 160584 - protein, 14 aa, Borrelia afzelii PKo
IEQDGKVKIYLNDT

SEQ ID NO: 160585 - protein, 14 aa, Borrelia afzelii PKo
EQDGKVKIYLNDTT

SEQ ID NO: 160586 - protein, 14 aa, Borrelia afzelii PKo
QDGKVKIYLNDTTS

SEQ ID NO: 160587 - protein, 14 aa, Borrelia afzelii PKo
DGKVKIYLNDTTSG

SEQ ID NO: 160588 - protein, 14 aa, Borrelia afzelii PKo
GKVKIYLNDTTSGS

SEQ ID NO: 160589 - protein, 14 aa, Borrelia afzelii PKo
KVKIYLNDTTSGST

SEQ ID NO: 160590 - protein, 14 aa, Borrelia afzelii PKo
VKIYLNDTTSGSTK

SEQ ID NO: 160591 - protein, 14 aa, Borrelia afzelii PKo
KIYLNDTTSGSTKK

SEQ ID NO: 160592 - protein, 14 aa, Borrelia afzelii PKo
IYLNDTTSGSTKKT

SEQ ID NO: 160593 - protein, 14 aa, Borrelia afzelii PKo
YLNDTTSGSTKKTA

SEQ ID NO: 160594 - protein, 14 aa, Borrelia afzelii PKo
LNDTTSGSTKKTAT

SEQ ID NO: 160595 - protein, 14 aa, Borrelia afzelii PKo
NDTTSGSTKKTATW

SEQ ID NO: 160596 - protein, 14 aa, Borrelia afzelii PKo
DTTSGSTKKTATWN

SEQ ID NO: 160597 - protein, 14 aa, Borrelia afzelii PKo
TTSGSTKKTATWNE

SEQ ID NO: 160598 - protein, 14 aa, Borrelia afzelii PKo
TSGSTKKTATWNET

SEQ ID NO: 160599 - protein, 14 aa, Borrelia afzelii PKo
SGSTKKTATWNETT

SEQ ID NO: 160600 - protein, 14 aa, Borrelia afzelii PKo
GSTKKTATWNETTN

SEQ ID NO: 160601 - protein, 14 aa, Borrelia afzelii PKo
STKKTATWNETTNT

SEQ ID NO: 160602 - protein, 14 aa, Borrelia afzelii PKo
TKKTATWNETTNTL

SEQ ID NO: 160603 - protein, 14 aa, Borrelia afzelii PKo
KKTATWNETTNTLT

SEQ ID NO: 160604 - protein, 14 aa, Borrelia afzelii PKo
KTATWNETTNTLTI

SEQ ID NO: 160605 - protein, 14 aa, Borrelia afzelii PKo
TATWNETTNTLTIS

SEQ ID NO: 160606 - protein, 14 aa, Borrelia afzelii PKo
ATWNETTNTLTISA

SEQ ID NO: 160607 - protein, 14 aa, Borrelia afzelii PKo
TWNETTNTLTISAD

SEQ ID NO: 160608 - protein, 14 aa, Borrelia afzelii PKo
WNETTNTLTISADS

SEQ ID NO: 160609 - protein, 14 aa, Borrelia afzelii PKo
NETTNTLTISADSK

SEQ ID NO: 160610 - protein, 14 aa, Borrelia afzelii PKo
ETTNTLTISADSKK

SEQ ID NO: 160611 - protein, 14 aa, Borrelia afzelii PKo
TTNTLTISADSKKT

SEQ ID NO: 160612 - protein, 14 aa, Borrelia afzelii PKo
TNTLTISADSKKTK

SEQ ID NO: 160613 - protein, 14 aa, Borrelia afzelii PKo
NTLTISADSKKTKD

SEQ ID NO: 160614 - protein, 14 aa, Borrelia afzelii PKo
TLTISADSKKTKDF

SEQ ID NO: 160615 - protein, 14 aa, Borrelia afzelii PKo
LTISADSKKTKDFV

SEQ ID NO: 160616 - protein, 14 aa, Borrelia afzelii PKo
TISADSKKTKDFVF

SEQ ID NO: 160617 - protein, 14 aa, Borrelia afzelii PKo
ISADSKKTKDFVFL

SEQ ID NO: 160618 - protein, 14 aa, Borrelia afzelii PKo
SADSKKTKDFVFLT

SEQ ID NO: 160619 - protein, 14 aa, Borrelia afzelii PKo
ADSKKTKDFVFLTD

SEQ ID NO: 160620 - protein, 14 aa, Borrelia afzelii PKo
DSKKTKDFVFLTDG

SEQ ID NO: 160621 - protein, 14 aa, Borrelia afzelii PKo
SKKTKDFVFLTDGT

SEQ ID NO: 160622 - protein, 14 aa, Borrelia afzelii PKo
KKTKDFVFLTDGTI

SEQ ID NO: 160623 - protein, 14 aa, Borrelia afzelii PKo
KTKDFVFLTDGTIT

SEQ ID NO: 160624 - protein, 14 aa, Borrelia afzelii PKo
TKDFVFLTDGTITV

SEQ ID NO: 160625 - protein, 14 aa, Borrelia afzelii PKo
KDFVFLTDGTITVQ

SEQ ID NO: 160626 - protein, 14 aa, Borrelia afzelii PKo
DFVFLTDGTITVQA

SEQ ID NO: 160627 - protein, 14 aa, Borrelia afzelii PKo
FVFLTDGTITVQAY

SEQ ID NO: 160628 - protein, 14 aa, Borrelia afzelii PKo
VFLTDGTITVQAYD

SEQ ID NO: 160629 - protein, 14 aa, Borrelia afzelii PKo
FLTDGTITVQAYDT

SEQ ID NO: 160630 - protein, 14 aa, Borrelia afzelii PKo
LTDGTITVQAYDTA

SEQ ID NO: 160631 - protein, 14 aa, Borrelia afzelii PKo
TDGTITVQAYDTAG

SEQ ID NO: 160632 - protein, 14 aa, Borrelia afzelii PKo
DGTITVQAYDTAGT

SEQ ID NO: 160633 - protein, 14 aa, Borrelia afzelii PKo
GTITVQAYDTAGTK

SEQ ID NO: 160634 - protein, 14 aa, Borrelia afzelii PKo
TITVQAYDTAGTKL

SEQ ID NO: 160635 - protein, 14 aa, Borrelia afzelii PKo
ITVQAYDTAGTKLE

SEQ ID NO: 160636 - protein, 14 aa, Borrelia afzelii PKo
TVQAYDTAGTKLEG

SEQ ID NO: 160637 - protein, 14 aa, Borrelia afzelii PKo
VQAYDTAGTKLEGN

SEQ ID NO: 160638 - protein, 14 aa, Borrelia afzelii PKo
QAYDTAGTKLEGNS

SEQ ID NO: 160639 - protein, 14 aa, Borrelia afzelii PKo
AYDTAGTKLEGNSS

SEQ ID NO: 160640 - protein, 14 aa, Borrelia afzelii PKo
YDTAGTKLEGNSSE

SEQ ID NO: 160641 - protein, 14 aa, Borrelia afzelii PKo
DTAGTKLEGNSSEI

SEQ ID NO: 160642 - protein, 14 aa, Borrelia afzelii PKo
TAGTKLEGNSSEIK

SEQ ID NO: 160643 - protein, 14 aa, Borrelia afzelii PKo
AGTKLEGNSSEIKD

SEQ ID NO: 160644 - protein, 14 aa, Borrelia afzelii PKo
GTKLEGNSSEIKDL

SEQ ID NO: 160645 - protein, 14 aa, Borrelia afzelii PKo
TKLEGNSSEIKDLA

SEQ ID NO: 160646 - protein, 14 aa, Borrelia afzelii PKo
KLEGNSSEIKDLAA

SEQ ID NO: 160647 - protein, 14 aa, Borrelia afzelii PKo
LEGNSSEIKDLAAL

SEQ ID NO: 160648 - protein, 14 aa, Borrelia afzelii PKo
EGNSSEIKDLAALK

SEQ ID NO: 160649 - protein, 14 aa, Borrelia afzelii PKo
GNSSEIKDLAALKA

SEQ ID NO: 160650 - protein, 14 aa, Borrelia afzelii PKo
NSSEIKDLAALKAA

SEQ ID NO: 160651 - protein, 14 aa, Borrelia afzelii PKo
SSEIKDLAALKAAL

SEQ ID NO: 160652 - protein, 14 aa, Borrelia afzelii PKo
SEIKDLAALKAALK

SEQ ID NO: 160653 - protein, 15 aa, Borrelia afzelii PKo
MKQYLLVFALVLALI

SEQ ID NO: 160654 - protein, 15 aa, Borrelia afzelii PKo
KQYLLVFALVLALIA

SEQ ID NO: 160655 - protein, 15 aa, Borrelia afzelii PKo
QYLLVFALVLALIAC

SEQ ID NO: 160656 - protein, 15 aa, Borrelia afzelii PKo
YLLVFALVLALIACS

SEQ ID NO: 160657 - protein, 15 aa, Borrelia afzelii PKo
LLVFALVLALIACSQ

SEQ ID NO: 160658 - protein, 15 aa, Borrelia afzelii PKo
LVFALVLALIACSQK

SEQ ID NO: 160659 - protein, 15 aa, Borrelia afzelii PKo
VFALVLALIACSQKG

SEQ ID NO: 160660 - protein, 15 aa, Borrelia afzelii PKo
FALVLALIACSQKGT

SEQ ID NO: 160661 - protein, 15 aa, Borrelia afzelii PKo
ALVLALIACSQKGTE

SEQ ID NO: 160662 - protein, 15 aa, Borrelia afzelii PKo
LVLALIACSQKGTEP

SEQ ID NO: 160663 - protein, 15 aa, Borrelia afzelii PKo
VLALIACSQKGTEPK

SEQ ID NO: 160664 - protein, 15 aa, Borrelia afzelii PKo
LALIACSQKGTEPKS

SEQ ID NO: 160665 - protein, 15 aa, Borrelia afzelii PKo
ALIACSQKGTEPKST

SEQ ID NO: 160666 - protein, 15 aa, Borrelia afzelii PKo
LIACSQKGTEPKSTS

SEQ ID NO: 160667 - protein, 15 aa, Borrelia afzelii PKo
IACSQKGTEPKSTSQ

SEQ ID NO: 160668 - protein, 15 aa, Borrelia afzelii PKo
ACSQKGTEPKSTSQD

SEQ ID NO: 160669 - protein, 15 aa, Borrelia afzelii PKo
CSQKGTEPKSTSQDH

SEQ ID NO: 160670 - protein, 15 aa, Borrelia afzelii PKo
SQKGTEPKSTSQDHN

SEQ ID NO: 160671 - protein, 15 aa, Borrelia afzelii PKo
QKGTEPKSTSQDHND

SEQ ID NO: 160672 - protein, 15 aa, Borrelia afzelii PKo
KGTEPKSTSQDHNDQ

SEQ ID NO: 160673 - protein, 15 aa, Borrelia afzelii PKo
GTEPKSTSQDHNDQE

SEQ ID NO: 160674 - protein, 15 aa, Borrelia afzelii PKo
TEPKSTSQDHNDQEI

SEQ ID NO: 160675 - protein, 15 aa, Borrelia afzelii PKo
EPKSTSQDHNDQEII

SEQ ID NO: 160676 - protein, 15 aa, Borrelia afzelii PKo
PKSTSQDHNDQEIIN

SEQ ID NO: 160677 - protein, 15 aa, Borrelia afzelii PKo
KSTSQDHNDQEIINS

SEQ ID NO: 160678 - protein, 15 aa, Borrelia afzelii PKo
STSQDHNDQEIINSD

SEQ ID NO: 160679 - protein, 15 aa, Borrelia afzelii PKo
TSQDHNDQEIINSDN

SEQ ID NO: 160680 - protein, 15 aa, Borrelia afzelii PKo
SQDHNDQEIINSDNT

SEQ ID NO: 160681 - protein, 15 aa, Borrelia afzelii PKo
QDHNDQEIINSDNTP

SEQ ID NO: 160682 - protein, 15 aa, Borrelia afzelii PKo
DHNDQEIINSDNTPK

SEQ ID NO: 160683 - protein, 15 aa, Borrelia afzelii PKo
HNDQEIINSDNTPKD

SEQ ID NO: 160684 - protein, 15 aa, Borrelia afzelii PKo
NDQEIINSDNTPKDS

SEQ ID NO: 160685 - protein, 15 aa, Borrelia afzelii PKo
DQEIINSDNTPKDSK

SEQ ID NO: 160686 - protein, 15 aa, Borrelia afzelii PKo
QEIINSDNTPKDSKK

SEQ ID NO: 160687 - protein, 15 aa, Borrelia afzelii PKo
EIINSDNTPKDSKKD

SEQ ID NO: 160688 - protein, 15 aa, Borrelia afzelii PKo
IINSDNTPKDSKKDL

SEQ ID NO: 160689 - protein, 15 aa, Borrelia afzelii PKo
INSDNTPKDSKKDLT

SEQ ID NO: 160690 - protein, 15 aa, Borrelia afzelii PKo
NSDNTPKDSKKDLTV

SEQ ID NO: 160691 - protein, 15 aa, Borrelia afzelii PKo
SDNTPKDSKKDLTVL

SEQ ID NO: 160692 - protein, 15 aa, Borrelia afzelii PKo
DNTPKDSKKDLTVLA

SEQ ID NO: 160693 - protein, 15 aa, Borrelia afzelii PKo
NTPKDSKKDLTVLAE

SEQ ID NO: 160694 - protein, 15 aa, Borrelia afzelii PKo
TPKDSKKDLTVLAEE

SEQ ID NO: 160695 - protein, 15 aa, Borrelia afzelii PKo
PKDSKKDLTVLAEEN

SEQ ID NO: 160696 - protein, 15 aa, Borrelia afzelii PKo
KDSKKDLTVLAEENS

SEQ ID NO: 160697 - protein, 15 aa, Borrelia afzelii PKo
DSKKDLTVLAEENSV

SEQ ID NO: 160698 - protein, 15 aa, Borrelia afzelii PKo
SKKDLTVLAEENSVP

SEQ ID NO: 160699 - protein, 15 aa, Borrelia afzelii PKo
KKDLTVLAEENSVPL

SEQ ID NO: 160700 - protein, 15 aa, Borrelia afzelii PKo
KDLTVLAEENSVPLF

SEQ ID NO: 160701 - protein, 15 aa, Borrelia afzelii PKo
DLTVLAEENSVPLFN

SEQ ID NO: 160702 - protein, 15 aa, Borrelia afzelii PKo
LTVLAEENSVPLFNG

SEQ ID NO: 160703 - protein, 15 aa, Borrelia afzelii PKo
TVLAEENSVPLFNGN

SEQ ID NO: 160704 - protein, 15 aa, Borrelia afzelii PKo
VLAEENSVPLFNGNK

SEQ ID NO: 160705 - protein, 15 aa, Borrelia afzelii PKo
LAEENSVPLFNGNKI

SEQ ID NO: 160706 - protein, 15 aa, Borrelia afzelii PKo
AEENSVPLFNGNKIF

SEQ ID NO: 160707 - protein, 15 aa, Borrelia afzelii PKo
EENSVPLFNGNKIFV

SEQ ID NO: 160708 - protein, 15 aa, Borrelia afzelii PKo
ENSVPLFNGNKIFVS

SEQ ID NO: 160709 - protein, 15 aa, Borrelia afzelii PKo
NSVPLFNGNKIFVSK

SEQ ID NO: 160710 - protein, 15 aa, Borrelia afzelii PKo
SVPLFNGNKIFVSKE

SEQ ID NO: 160711 - protein, 15 aa, Borrelia afzelii PKo
VPLFNGNKIFVSKEK

SEQ ID NO: 160712 - protein, 15 aa, Borrelia afzelii PKo
PLFNGNKIFVSKEKN

SEQ ID NO: 160713 - protein, 15 aa, Borrelia afzelii PKo
LFNGNKIFVSKEKNS

SEQ ID NO: 160714 - protein, 15 aa, Borrelia afzelii PKo
FNGNKIFVSKEKNSA

SEQ ID NO: 160715 - protein, 15 aa, Borrelia afzelii PKo
NGNKIFVSKEKNSAG

SEQ ID NO: 160716 - protein, 15 aa, Borrelia afzelii PKo
GNKIFVSKEKNSAGK

SEQ ID NO: 160717 - protein, 15 aa, Borrelia afzelii PKo
NKIFVSKEKNSAGKY

SEQ ID NO: 160718 - protein, 15 aa, Borrelia afzelii PKo
KIFVSKEKNSAGKYE

SEQ ID NO: 160719 - protein, 15 aa, Borrelia afzelii PKo
IFVSKEKNSAGKYEL

SEQ ID NO: 160720 - protein, 15 aa, Borrelia afzelii PKo
FVSKEKNSAGKYELR

SEQ ID NO: 160721 - protein, 15 aa, Borrelia afzelii PKo
VSKEKNSAGKYELRA

SEQ ID NO: 160722 - protein, 15 aa, Borrelia afzelii PKo
SKEKNSAGKYELRAT

SEQ ID NO: 160723 - protein, 15 aa, Borrelia afzelii PKo
KEKNSAGKYELRATV

SEQ ID NO: 160724 - protein, 15 aa, Borrelia afzelii PKo
EKNSAGKYELRATVD

SEQ ID NO: 160725 - protein, 15 aa, Borrelia afzelii PKo
KNSAGKYELRATVDT

SEQ ID NO: 160726 - protein, 15 aa, Borrelia afzelii PKo
NSAGKYELRATVDTV

SEQ ID NO: 160727 - protein, 15 aa, Borrelia afzelii PKo
SAGKYELRATVDTVE

SEQ ID NO: 160728 - protein, 15 aa, Borrelia afzelii PKo
AGKYELRATVDTVEL

SEQ ID NO: 160729 - protein, 15 aa, Borrelia afzelii PKo
GKYELRATVDTVELK

SEQ ID NO: 160730 - protein, 15 aa, Borrelia afzelii PKo
KYELRATVDTVELKG

SEQ ID NO: 160731 - protein, 15 aa, Borrelia afzelii PKo
YELRATVDTVELKGV

SEQ ID NO: 160732 - protein, 15 aa, Borrelia afzelii PKo
ELRATVDTVELKGVS

SEQ ID NO: 160733 - protein, 15 aa, Borrelia afzelii PKo
LRATVDTVELKGVSD

SEQ ID NO: 160734 - protein, 15 aa, Borrelia afzelii PKo
RATVDTVELKGVSDK

SEQ ID NO: 160735 - protein, 15 aa, Borrelia afzelii PKo
ATVDTVELKGVSDKN

SEQ ID NO: 160736 - protein, 15 aa, Borrelia afzelii PKo
TVDTVELKGVSDKNN

SEQ ID NO: 160737 - protein, 15 aa, Borrelia afzelii PKo
VDTVELKGVSDKNNG

SEQ ID NO: 160738 - protein, 15 aa, Borrelia afzelii PKo
DTVELKGVSDKNNGS

SEQ ID NO: 160739 - protein, 15 aa, Borrelia afzelii PKo
TVELKGVSDKNNGSG

SEQ ID NO: 160740 - protein, 15 aa, Borrelia afzelii PKo
VELKGVSDKNNGSGK

SEQ ID NO: 160741 - protein, 15 aa, Borrelia afzelii PKo
ELKGVSDKNNGSGKL

SEQ ID NO: 160742 - protein, 15 aa, Borrelia afzelii PKo
LKGVSDKNNGSGKLE

SEQ ID NO: 160743 - protein, 15 aa, Borrelia afzelii PKo
KGVSDKNNGSGKLEG

SEQ ID NO: 160744 - protein, 15 aa, Borrelia afzelii PKo
GVSDKNNGSGKLEGT

SEQ ID NO: 160745 - protein, 15 aa, Borrelia afzelii PKo
VSDKNNGSGKLEGTK

SEQ ID NO: 160746 - protein, 15 aa, Borrelia afzelii PKo
SDKNNGSGKLEGTKA

SEQ ID NO: 160747 - protein, 15 aa, Borrelia afzelii PKo
DKNNGSGKLEGTKAD

SEQ ID NO: 160748 - protein, 15 aa, Borrelia afzelii PKo
KNNGSGKLEGTKADK

SEQ ID NO: 160749 - protein, 15 aa, Borrelia afzelii PKo
NNGSGKLEGTKADKT

SEQ ID NO: 160750 - protein, 15 aa, Borrelia afzelii PKo
NGSGKLEGTKADKTK

SEQ ID NO: 160751 - protein, 15 aa, Borrelia afzelii PKo
GSGKLEGTKADKTKV

SEQ ID NO: 160752 - protein, 15 aa, Borrelia afzelii PKo
SGKLEGTKADKTKVA

SEQ ID NO: 160753 - protein, 15 aa, Borrelia afzelii PKo
GKLEGTKADKTKVAM

SEQ ID NO: 160754 - protein, 15 aa, Borrelia afzelii PKo
KLEGTKADKTKVAMT

SEQ ID NO: 160755 - protein, 15 aa, Borrelia afzelii PKo
LEGTKADKTKVAMTI

SEQ ID NO: 160756 - protein, 15 aa, Borrelia afzelii PKo
EGTKADKTKVAMTIA

SEQ ID NO: 160757 - protein, 15 aa, Borrelia afzelii PKo
GTKADKTKVAMTIAD

SEQ ID NO: 160758 - protein, 15 aa, Borrelia afzelii PKo
TKADKTKVAMTIADD

SEQ ID NO: 160759 - protein, 15 aa, Borrelia afzelii PKo
KADKTKVAMTIADDL

SEQ ID NO: 160760 - protein, 15 aa, Borrelia afzelii PKo
ADKTKVAMTIADDLN

SEQ ID NO: 160761 - protein, 15 aa, Borrelia afzelii PKo
DKTKVAMTIADDLNT

SEQ ID NO: 160762 - protein, 15 aa, Borrelia afzelii PKo
KTKVAMTIADDLNTI

SEQ ID NO: 160763 - protein, 15 aa, Borrelia afzelii PKo
TKVAMTIADDLNTIT

SEQ ID NO: 160764 - protein, 15 aa, Borrelia afzelii PKo
KVAMTIADDLNTITV

SEQ ID NO: 160765 - protein, 15 aa, Borrelia afzelii PKo
VAMTIADDLNTITVE

SEQ ID NO: 160766 - protein, 15 aa, Borrelia afzelii PKo
AMTIADDLNTITVET

SEQ ID NO: 160767 - protein, 15 aa, Borrelia afzelii PKo
MTIADDLNTITVETY

SEQ ID NO: 160768 - protein, 15 aa, Borrelia afzelii PKo
TIADDLNTITVETYD

SEQ ID NO: 160769 - protein, 15 aa, Borrelia afzelii PKo
IADDLNTITVETYDA

SEQ ID NO: 160770 - protein, 15 aa, Borrelia afzelii PKo
ADDLNTITVETYDAS

SEQ ID NO: 160771 - protein, 15 aa, Borrelia afzelii PKo
DDLNTITVETYDASN

SEQ ID NO: 160772 - protein, 15 aa, Borrelia afzelii PKo
DLNTITVETYDASNK

SEQ ID NO: 160773 - protein, 15 aa, Borrelia afzelii PKo
LNTITVETYDASNKK

SEQ ID NO: 160774 - protein, 15 aa, Borrelia afzelii PKo
NTITVETYDASNKKT

SEQ ID NO: 160775 - protein, 15 aa, Borrelia afzelii PKo
TITVETYDASNKKTG

SEQ ID NO: 160776 - protein, 15 aa, Borrelia afzelii PKo
ITVETYDASNKKTGS

SEQ ID NO: 160777 - protein, 15 aa, Borrelia afzelii PKo
TVETYDASNKKTGSE

SEQ ID NO: 160778 - protein, 15 aa, Borrelia afzelii PKo
VETYDASNKKTGSEV

SEQ ID NO: 160779 - protein, 15 aa, Borrelia afzelii PKo
ETYDASNKKTGSEVV

SEQ ID NO: 160780 - protein, 15 aa, Borrelia afzelii PKo
TYDASNKKTGSEVVK

SEQ ID NO: 160781 - protein, 15 aa, Borrelia afzelii PKo
YDASNKKTGSEVVKK

SEQ ID NO: 160782 - protein, 15 aa, Borrelia afzelii PKo
DASNKKTGSEVVKKQ

SEQ ID NO: 160783 - protein, 15 aa, Borrelia afzelii PKo
ASNKKTGSEVVKKQG

SEQ ID NO: 160784 - protein, 15 aa, Borrelia afzelii PKo
SNKKTGSEVVKKQGS

SEQ ID NO: 160785 - protein, 15 aa, Borrelia afzelii PKo
NKKTGSEVVKKQGSV

SEQ ID NO: 160786 - protein, 15 aa, Borrelia afzelii PKo
KKTGSEVVKKQGSVI

SEQ ID NO: 160787 - protein, 15 aa, Borrelia afzelii PKo
KTGSEVVKKQGSVIK

SEQ ID NO: 160788 - protein, 15 aa, Borrelia afzelii PKo
TGSEVVKKQGSVIKE

SEQ ID NO: 160789 - protein, 15 aa, Borrelia afzelii PKo
GSEVVKKQGSVIKES

SEQ ID NO: 160790 - protein, 15 aa, Borrelia afzelii PKo
SEVVKKQGSVIKESY

SEQ ID NO: 160791 - protein, 15 aa, Borrelia afzelii PKo
EVVKKQGSVIKESYK

SEQ ID NO: 160792 - protein, 15 aa, Borrelia afzelii PKo
VVKKQGSVIKESYKA

SEQ ID NO: 160793 - protein, 15 aa, Borrelia afzelii PKo
VKKQGSVIKESYKAN

SEQ ID NO: 160794 - protein, 15 aa, Borrelia afzelii PKo
KKQGSVIKESYKANK

SEQ ID NO: 160795 - protein, 15 aa, Borrelia afzelii PKo
KQGSVIKESYKANKL

SEQ ID NO: 160796 - protein, 15 aa, Borrelia afzelii PKo
QGSVIKESYKANKLD

SEQ ID NO: 160797 - protein, 15 aa, Borrelia afzelii PKo
GSVIKESYKANKLDS

SEQ ID NO: 160798 - protein, 15 aa, Borrelia afzelii PKo
SVIKESYKANKLDSK

SEQ ID NO: 160799 - protein, 15 aa, Borrelia afzelii PKo
VIKESYKANKLDSKK

SEQ ID NO: 160800 - protein, 15 aa, Borrelia afzelii PKo
IKESYKANKLDSKKI

SEQ ID NO: 160801 - protein, 15 aa, Borrelia afzelii PKo
KESYKANKLDSKKIT

SEQ ID NO: 160802 - protein, 15 aa, Borrelia afzelii PKo
ESYKANKLDSKKITR

SEQ ID NO: 160803 - protein, 15 aa, Borrelia afzelii PKo
SYKANKLDSKKITRE

SEQ ID NO: 160804 - protein, 15 aa, Borrelia afzelii PKo
YKANKLDSKKITREN

SEQ ID NO: 160805 - protein, 15 aa, Borrelia afzelii PKo
KANKLDSKKITRENE

SEQ ID NO: 160806 - protein, 15 aa, Borrelia afzelii PKo
ANKLDSKKITRENET

SEQ ID NO: 160807 - protein, 15 aa, Borrelia afzelii PKo
NKLDSKKITRENETT

SEQ ID NO: 160808 - protein, 15 aa, Borrelia afzelii PKo
KLDSKKITRENETTL

SEQ ID NO: 160809 - protein, 15 aa, Borrelia afzelii PKo
LDSKKITRENETTLE

SEQ ID NO: 160810 - protein, 15 aa, Borrelia afzelii PKo
DSKKITRENETTLEY

SEQ ID NO: 160811 - protein, 15 aa, Borrelia afzelii PKo
SKKITRENETTLEYS

SEQ ID NO: 160812 - protein, 15 aa, Borrelia afzelii PKo
KKITRENETTLEYSE

SEQ ID NO: 160813 - protein, 15 aa, Borrelia afzelii PKo
KITRENETTLEYSEM

SEQ ID NO: 160814 - protein, 15 aa, Borrelia afzelii PKo
ITRENETTLEYSEMT

SEQ ID NO: 160815 - protein, 15 aa, Borrelia afzelii PKo
TRENETTLEYSEMTD

SEQ ID NO: 160816 - protein, 15 aa, Borrelia afzelii PKo
RENETTLEYSEMTDS

SEQ ID NO: 160817 - protein, 15 aa, Borrelia afzelii PKo
ENETTLEYSEMTDSS

SEQ ID NO: 160818 - protein, 15 aa, Borrelia afzelii PKo
NETTLEYSEMTDSSN

SEQ ID NO: 160819 - protein, 15 aa, Borrelia afzelii PKo
ETTLEYSEMTDSSNA

SEQ ID NO: 160820 - protein, 15 aa, Borrelia afzelii PKo
TTLEYSEMTDSSNAT

SEQ ID NO: 160821 - protein, 15 aa, Borrelia afzelii PKo
TLEYSEMTDSSNATK

SEQ ID NO: 160822 - protein, 15 aa, Borrelia afzelii PKo
LEYSEMTDSSNATKA

SEQ ID NO: 160823 - protein, 15 aa, Borrelia afzelii PKo
EYSEMTDSSNATKAV

SEQ ID NO: 160824 - protein, 15 aa, Borrelia afzelii PKo
YSEMTDSSNATKAVE

SEQ ID NO: 160825 - protein, 15 aa, Borrelia afzelii PKo
SEMTDSSNATKAVET

SEQ ID NO: 160826 - protein, 15 aa, Borrelia afzelii PKo
EMTDSSNATKAVETL

SEQ ID NO: 160827 - protein, 15 aa, Borrelia afzelii PKo
MTDSSNATKAVETLK

SEQ ID NO: 160828 - protein, 15 aa, Borrelia afzelii PKo
TDSSNATKAVETLKN

SEQ ID NO: 160829 - protein, 15 aa, Borrelia afzelii PKo
DSSNATKAVETLKNG

SEQ ID NO: 160830 - protein, 15 aa, Borrelia afzelii PKo
SSNATKAVETLKNGI

SEQ ID NO: 160831 - protein, 15 aa, Borrelia afzelii PKo
SNATKAVETLKNGIK

SEQ ID NO: 160832 - protein, 15 aa, Borrelia afzelii PKo
NATKAVETLKNGIKL

SEQ ID NO: 160833 - protein, 15 aa, Borrelia afzelii PKo
ATKAVETLKNGIKLE

SEQ ID NO: 160834 - protein, 15 aa, Borrelia afzelii PKo
TKAVETLKNGIKLEG

SEQ ID NO: 160835 - protein, 15 aa, Borrelia afzelii PKo
KAVETLKNGIKLEGS

SEQ ID NO: 160836 - protein, 15 aa, Borrelia afzelii PKo
AVETLKNGIKLEGSL

SEQ ID NO: 160837 - protein, 15 aa, Borrelia afzelii PKo
VETLKNGIKLEGSLV

SEQ ID NO: 160838 - protein, 15 aa, Borrelia afzelii PKo
ETLKNGIKLEGSLVG

SEQ ID NO: 160839 - protein, 15 aa, Borrelia afzelii PKo
TLKNGIKLEGSLVGG

SEQ ID NO: 160840 - protein, 15 aa, Borrelia afzelii PKo
LKNGIKLEGSLVGGK

SEQ ID NO: 160841 - protein, 15 aa, Borrelia afzelii PKo
KNGIKLEGSLVGGKT

SEQ ID NO: 160842 - protein, 15 aa, Borrelia afzelii PKo
NGIKLEGSLVGGKTT

SEQ ID NO: 160843 - protein, 15 aa, Borrelia afzelii PKo
GIKLEGSLVGGKTTV

SEQ ID NO: 160844 - protein, 15 aa, Borrelia afzelii PKo
IKLEGSLVGGKTTVK

SEQ ID NO: 160845 - protein, 15 aa, Borrelia afzelii PKo
KLEGSLVGGKTTVKL

SEQ ID NO: 160846 - protein, 15 aa, Borrelia afzelii PKo
LEGSLVGGKTTVKLT

SEQ ID NO: 160847 - protein, 15 aa, Borrelia afzelii PKo
EGSLVGGKTTVKLTE

SEQ ID NO: 160848 - protein, 15 aa, Borrelia afzelii PKo
GSLVGGKTTVKLTEG

SEQ ID NO: 160849 - protein, 15 aa, Borrelia afzelii PKo
SLVGGKTTVKLTEGT

SEQ ID NO: 160850 - protein, 15 aa, Borrelia afzelii PKo
LVGGKTTVKLTEGTI

SEQ ID NO: 160851 - protein, 15 aa, Borrelia afzelii PKo
VGGKTTVKLTEGTIT

SEQ ID NO: 160852 - protein, 15 aa, Borrelia afzelii PKo
GGKTTVKLTEGTITL

SEQ ID NO: 160853 - protein, 15 aa, Borrelia afzelii PKo
GKTTVKLTEGTITLT

SEQ ID NO: 160854 - protein, 15 aa, Borrelia afzelii PKo
KTTVKLTEGTITLTR

SEQ ID NO: 160855 - protein, 15 aa, Borrelia afzelii PKo
TTVKLTEGTITLTRE

SEQ ID NO: 160856 - protein, 15 aa, Borrelia afzelii PKo
TVKLTEGTITLTREI

SEQ ID NO: 160857 - protein, 15 aa, Borrelia afzelii PKo
VKLTEGTITLTREIE

SEQ ID NO: 160858 - protein, 15 aa, Borrelia afzelii PKo
KLTEGTITLTREIEQ

SEQ ID NO: 160859 - protein, 15 aa, Borrelia afzelii PKo
LTEGTITLTREIEQD

SEQ ID NO: 160860 - protein, 15 aa, Borrelia afzelii PKo
TEGTITLTREIEQDG

SEQ ID NO: 160861 - protein, 15 aa, Borrelia afzelii PKo
EGTITLTREIEQDGK

SEQ ID NO: 160862 - protein, 15 aa, Borrelia afzelii PKo
GTITLTREIEQDGKV

SEQ ID NO: 160863 - protein, 15 aa, Borrelia afzelii PKo
TITLTREIEQDGKVK

SEQ ID NO: 160864 - protein, 15 aa, Borrelia afzelii PKo
ITLTREIEQDGKVKI

SEQ ID NO: 160865 - protein, 15 aa, Borrelia afzelii PKo
TLTREIEQDGKVKIY

SEQ ID NO: 160866 - protein, 15 aa, Borrelia afzelii PKo
LTREIEQDGKVKIYL

SEQ ID NO: 160867 - protein, 15 aa, Borrelia afzelii PKo
TREIEQDGKVKIYLN

SEQ ID NO: 160868 - protein, 15 aa, Borrelia afzelii PKo
REIEQDGKVKIYLND

SEQ ID NO: 160869 - protein, 15 aa, Borrelia afzelii PKo
EIEQDGKVKIYLNDT

SEQ ID NO: 160870 - protein, 15 aa, Borrelia afzelii PKo
IEQDGKVKIYLNDTT

SEQ ID NO: 160871 - protein, 15 aa, Borrelia afzelii PKo
EQDGKVKIYLNDTTS

SEQ ID NO: 160872 - protein, 15 aa, Borrelia afzelii PKo
QDGKVKIYLNDTTSG

SEQ ID NO: 160873 - protein, 15 aa, Borrelia afzelii PKo
DGKVKIYLNDTTSGS

SEQ ID NO: 160874 - protein, 15 aa, Borrelia afzelii PKo
GKVKIYLNDTTSGST

SEQ ID NO: 160875 - protein, 15 aa, Borrelia afzelii PKo
KVKIYLNDTTSGSTK

SEQ ID NO: 160876 - protein, 15 aa, Borrelia afzelii PKo
VKIYLNDTTSGSTKK

SEQ ID NO: 160877 - protein, 15 aa, Borrelia afzelii PKo
KIYLNDTTSGSTKKT

SEQ ID NO: 160878 - protein, 15 aa, Borrelia afzelii PKo
IYLNDTTSGSTKKTA

SEQ ID NO: 160879 - protein, 15 aa, Borrelia afzelii PKo
YLNDTTSGSTKKTAT

SEQ ID NO: 160880 - protein, 15 aa, Borrelia afzelii PKo
LNDTTSGSTKKTATW

SEQ ID NO: 160881 - protein, 15 aa, Borrelia afzelii PKo
NDTTSGSTKKTATWN

SEQ ID NO: 160882 - protein, 15 aa, Borrelia afzelii PKo
DTTSGSTKKTATWNE

SEQ ID NO: 160883 - protein, 15 aa, Borrelia afzelii PKo
TTSGSTKKTATWNET

SEQ ID NO: 160884 - protein, 15 aa, Borrelia afzelii PKo
TSGSTKKTATWNETT

SEQ ID NO: 160885 - protein, 15 aa, Borrelia afzelii PKo
SGSTKKTATWNETTN

SEQ ID NO: 160886 - protein, 15 aa, Borrelia afzelii PKo
GSTKKTATWNETTNT

SEQ ID NO: 160887 - protein, 15 aa, Borrelia afzelii PKo
STKKTATWNETTNTL

SEQ ID NO: 160888 - protein, 15 aa, Borrelia afzelii PKo
TKKTATWNETTNTLT

SEQ ID NO: 160889 - protein, 15 aa, Borrelia afzelii PKo
KKTATWNETTNTLTI

SEQ ID NO: 160890 - protein, 15 aa, Borrelia afzelii PKo
KTATWNETTNTLTIS

SEQ ID NO: 160891 - protein, 15 aa, Borrelia afzelii PKo
TATWNETTNTLTISA

SEQ ID NO: 160892 - protein, 15 aa, Borrelia afzelii PKo
ATWNETTNTLTISAD

SEQ ID NO: 160893 - protein, 15 aa, Borrelia afzelii PKo
TWNETTNTLTISADS

SEQ ID NO: 160894 - protein, 15 aa, Borrelia afzelii PKo
WNETTNTLTISADSK

SEQ ID NO: 160895 - protein, 15 aa, Borrelia afzelii PKo
NETTNTLTISADSKK

SEQ ID NO: 160896 - protein, 15 aa, Borrelia afzelii PKo
ETTNTLTISADSKKT

SEQ ID NO: 160897 - protein, 15 aa, Borrelia afzelii PKo
TTNTLTISADSKKTK

SEQ ID NO: 160898 - protein, 15 aa, Borrelia afzelii PKo
TNTLTISADSKKTKD

SEQ ID NO: 160899 - protein, 15 aa, Borrelia afzelii PKo
NTLTISADSKKTKDF

SEQ ID NO: 160900 - protein, 15 aa, Borrelia afzelii PKo
TLTISADSKKTKDFV

SEQ ID NO: 160901 - protein, 15 aa, Borrelia afzelii PKo
LTISADSKKTKDFVF

SEQ ID NO: 160902 - protein, 15 aa, Borrelia afzelii PKo
TISADSKKTKDFVFL

SEQ ID NO: 160903 - protein, 15 aa, Borrelia afzelii PKo
ISADSKKTKDFVFLT

SEQ ID NO: 160904 - protein, 15 aa, Borrelia afzelii PKo
SADSKKTKDFVFLTD

SEQ ID NO: 160905 - protein, 15 aa, Borrelia afzelii PKo
ADSKKTKDFVFLTDG

SEQ ID NO: 160906 - protein, 15 aa, Borrelia afzelii PKo
DSKKTKDFVFLTDGT

SEQ ID NO: 160907 - protein, 15 aa, Borrelia afzelii PKo
SKKTKDFVFLTDGTI

SEQ ID NO: 160908 - protein, 15 aa, Borrelia afzelii PKo
KKTKDFVFLTDGTIT

SEQ ID NO: 160909 - protein, 15 aa, Borrelia afzelii PKo
KTKDFVFLTDGTITV

SEQ ID NO: 160910 - protein, 15 aa, Borrelia afzelii PKo
TKDFVFLTDGTITVQ

SEQ ID NO: 160911 - protein, 15 aa, Borrelia afzelii PKo
KDFVFLTDGTITVQA

SEQ ID NO: 160912 - protein, 15 aa, Borrelia afzelii PKo
DFVFLTDGTITVQAY

SEQ ID NO: 160913 - protein, 15 aa, Borrelia afzelii PKo
FVFLTDGTITVQAYD

SEQ ID NO: 160914 - protein, 15 aa, Borrelia afzelii PKo
VFLTDGTITVQAYDT

SEQ ID NO: 160915 - protein, 15 aa, Borrelia afzelii PKo
FLTDGTITVQAYDTA

SEQ ID NO: 160916 - protein, 15 aa, Borrelia afzelii PKo
LTDGTITVQAYDTAG

SEQ ID NO: 160917 - protein, 15 aa, Borrelia afzelii PKo
TDGTITVQAYDTAGT

SEQ ID NO: 160918 - protein, 15 aa, Borrelia afzelii PKo
DGTITVQAYDTAGTK

SEQ ID NO: 160919 - protein, 15 aa, Borrelia afzelii PKo
GTITVQAYDTAGTKL

SEQ ID NO: 160920 - protein, 15 aa, Borrelia afzelii PKo
TITVQAYDTAGTKLE

SEQ ID NO: 160921 - protein, 15 aa, Borrelia afzelii PKo
ITVQAYDTAGTKLEG

SEQ ID NO: 160922 - protein, 15 aa, Borrelia afzelii PKo
TVQAYDTAGTKLEGN

SEQ ID NO: 160923 - protein, 15 aa, Borrelia afzelii PKo
VQAYDTAGTKLEGNS

SEQ ID NO: 160924 - protein, 15 aa, Borrelia afzelii PKo
QAYDTAGTKLEGNSS

SEQ ID NO: 160925 - protein, 15 aa, Borrelia afzelii PKo
AYDTAGTKLEGNSSE

SEQ ID NO: 160926 - protein, 15 aa, Borrelia afzelii PKo
YDTAGTKLEGNSSEI

SEQ ID NO: 160927 - protein, 15 aa, Borrelia afzelii PKo
DTAGTKLEGNSSEIK

SEQ ID NO: 160928 - protein, 15 aa, Borrelia afzelii PKo
TAGTKLEGNSSEIKD

SEQ ID NO: 160929 - protein, 15 aa, Borrelia afzelii PKo
AGTKLEGNSSEIKDL

SEQ ID NO: 160930 - protein, 15 aa, Borrelia afzelii PKo
GTKLEGNSSEIKDLA

SEQ ID NO: 160931 - protein, 15 aa, Borrelia afzelii PKo
TKLEGNSSEIKDLAA

SEQ ID NO: 160932 - protein, 15 aa, Borrelia afzelii PKo
KLEGNSSEIKDLAAL

SEQ ID NO: 160933 - protein, 15 aa, Borrelia afzelii PKo
LEGNSSEIKDLAALK

SEQ ID NO: 160934 - protein, 15 aa, Borrelia afzelii PKo
EGNSSEIKDLAALKA

SEQ ID NO: 160935 - protein, 15 aa, Borrelia afzelii PKo
GNSSEIKDLAALKAA

SEQ ID NO: 160936 - protein, 15 aa, Borrelia afzelii PKo
NSSEIKDLAALKAAL

SEQ ID NO: 160937 - protein, 15 aa, Borrelia afzelii PKo
SSEIKDLAALKAALK

SEQ ID NO: 160938 - protein, 16 aa, Borrelia afzelii PKo
MKQYLLVFALVLALIA

SEQ ID NO: 160939 - protein, 16 aa, Borrelia afzelii PKo
KQYLLVFALVLALIAC

SEQ ID NO: 160940 - protein, 16 aa, Borrelia afzelii PKo
QYLLVFALVLALIACS

SEQ ID NO: 160941 - protein, 16 aa, Borrelia afzelii PKo
YLLVFALVLALIACSQ

SEQ ID NO: 160942 - protein, 16 aa, Borrelia afzelii PKo
LLVFALVLALIACSQK

SEQ ID NO: 160943 - protein, 16 aa, Borrelia afzelii PKo
LVFALVLALIACSQKG

SEQ ID NO: 160944 - protein, 16 aa, Borrelia afzelii PKo
VFALVLALIACSQKGT

SEQ ID NO: 160945 - protein, 16 aa, Borrelia afzelii PKo
FALVLALIACSQKGTE

SEQ ID NO: 160946 - protein, 16 aa, Borrelia afzelii PKo
ALVLALIACSQKGTEP

SEQ ID NO: 160947 - protein, 16 aa, Borrelia afzelii PKo
LVLALIACSQKGTEPK

SEQ ID NO: 160948 - protein, 16 aa, Borrelia afzelii PKo
VLALIACSQKGTEPKS

SEQ ID NO: 160949 - protein, 16 aa, Borrelia afzelii PKo
LALIACSQKGTEPKST

SEQ ID NO: 160950 - protein, 16 aa, Borrelia afzelii PKo
ALIACSQKGTEPKSTS

SEQ ID NO: 160951 - protein, 16 aa, Borrelia afzelii PKo
LIACSQKGTEPKSTSQ

SEQ ID NO: 160952 - protein, 16 aa, Borrelia afzelii PKo
IACSQKGTEPKSTSQD

SEQ ID NO: 160953 - protein, 16 aa, Borrelia afzelii PKo
ACSQKGTEPKSTSQDH

SEQ ID NO: 160954 - protein, 16 aa, Borrelia afzelii PKo
CSQKGTEPKSTSQDHN

SEQ ID NO: 160955 - protein, 16 aa, Borrelia afzelii PKo
SQKGTEPKSTSQDHND

SEQ ID NO: 160956 - protein, 16 aa, Borrelia afzelii PKo
QKGTEPKSTSQDHNDQ

SEQ ID NO: 160957 - protein, 16 aa, Borrelia afzelii PKo
KGTEPKSTSQDHNDQE

SEQ ID NO: 160958 - protein, 16 aa, Borrelia afzelii PKo
GTEPKSTSQDHNDQEI

SEQ ID NO: 160959 - protein, 16 aa, Borrelia afzelii PKo
TEPKSTSQDHNDQEII

SEQ ID NO: 160960 - protein, 16 aa, Borrelia afzelii PKo
EPKSTSQDHNDQEIIN

SEQ ID NO: 160961 - protein, 16 aa, Borrelia afzelii PKo
PKSTSQDHNDQEIINS

SEQ ID NO: 160962 - protein, 16 aa, Borrelia afzelii PKo
KSTSQDHNDQEIINSD

SEQ ID NO: 160963 - protein, 16 aa, Borrelia afzelii PKo
STSQDHNDQEIINSDN

SEQ ID NO: 160964 - protein, 16 aa, Borrelia afzelii PKo
TSQDHNDQEIINSDNT

SEQ ID NO: 160965 - protein, 16 aa, Borrelia afzelii PKo
SQDHNDQEIINSDNTP

SEQ ID NO: 160966 - protein, 16 aa, Borrelia afzelii PKo
QDHNDQEIINSDNTPK

SEQ ID NO: 160967 - protein, 16 aa, Borrelia afzelii PKo
DHNDQEIINSDNTPKD

SEQ ID NO: 160968 - protein, 16 aa, Borrelia afzelii PKo
HNDQEIINSDNTPKDS

SEQ ID NO: 160969 - protein, 16 aa, Borrelia afzelii PKo
NDQEIINSDNTPKDSK

SEQ ID NO: 160970 - protein, 16 aa, Borrelia afzelii PKo
DQEIINSDNTPKDSKK

SEQ ID NO: 160971 - protein, 16 aa, Borrelia afzelii PKo
QEIINSDNTPKDSKKD

SEQ ID NO: 160972 - protein, 16 aa, Borrelia afzelii PKo
EIINSDNTPKDSKKDL

SEQ ID NO: 160973 - protein, 16 aa, Borrelia afzelii PKo
IINSDNTPKDSKKDLT

SEQ ID NO: 160974 - protein, 16 aa, Borrelia afzelii PKo
INSDNTPKDSKKDLTV

SEQ ID NO: 160975 - protein, 16 aa, Borrelia afzelii PKo
NSDNTPKDSKKDLTVL

SEQ ID NO: 160976 - protein, 16 aa, Borrelia afzelii PKo
SDNTPKDSKKDLTVLA

SEQ ID NO: 160977 - protein, 16 aa, Borrelia afzelii PKo
DNTPKDSKKDLTVLAE

SEQ ID NO: 160978 - protein, 16 aa, Borrelia afzelii PKo
NTPKDSKKDLTVLAEE

SEQ ID NO: 160979 - protein, 16 aa, Borrelia afzelii PKo
TPKDSKKDLTVLAEEN

SEQ ID NO: 160980 - protein, 16 aa, Borrelia afzelii PKo
PKDSKKDLTVLAEENS

SEQ ID NO: 160981 - protein, 16 aa, Borrelia afzelii PKo
KDSKKDLTVLAEENSV

SEQ ID NO: 160982 - protein, 16 aa, Borrelia afzelii PKo
DSKKDLTVLAEENSVP

SEQ ID NO: 160983 - protein, 16 aa, Borrelia afzelii PKo
SKKDLTVLAEENSVPL

SEQ ID NO: 160984 - protein, 16 aa, Borrelia afzelii PKo
KKDLTVLAEENSVPLF

SEQ ID NO: 160985 - protein, 16 aa, Borrelia afzelii PKo
KDLTVLAEENSVPLFN

SEQ ID NO: 160986 - protein, 16 aa, Borrelia afzelii PKo
DLTVLAEENSVPLFNG

SEQ ID NO: 160987 - protein, 16 aa, Borrelia afzelii PKo
LTVLAEENSVPLFNGN

SEQ ID NO: 160988 - protein, 16 aa, Borrelia afzelii PKo
TVLAEENSVPLFNGNK

SEQ ID NO: 160989 - protein, 16 aa, Borrelia afzelii PKo
VLAEENSVPLFNGNKI

SEQ ID NO: 160990 - protein, 16 aa, Borrelia afzelii PKo
LAEENSVPLFNGNKIF

SEQ ID NO: 160991 - protein, 16 aa, Borrelia afzelii PKo
AEENSVPLFNGNKIFV

SEQ ID NO: 160992 - protein, 16 aa, Borrelia afzelii PKo
EENSVPLFNGNKIFVS

SEQ ID NO: 160993 - protein, 16 aa, Borrelia afzelii PKo
ENSVPLFNGNKIFVSK

SEQ ID NO: 160994 - protein, 16 aa, Borrelia afzelii PKo
NSVPLFNGNKIFVSKE

SEQ ID NO: 160995 - protein, 16 aa, Borrelia afzelii PKo
SVPLFNGNKIFVSKEK

SEQ ID NO: 160996 - protein, 16 aa, Borrelia afzelii PKo
VPLFNGNKIFVSKEKN

SEQ ID NO: 160997 - protein, 16 aa, Borrelia afzelii PKo
PLFNGNKIFVSKEKNS

SEQ ID NO: 160998 - protein, 16 aa, Borrelia afzelii PKo
LFNGNKIFVSKEKNSA

SEQ ID NO: 160999 - protein, 16 aa, Borrelia afzelii PKo
FNGNKIFVSKEKNSAG

SEQ ID NO: 161000 - protein, 16 aa, Borrelia afzelii PKo
NGNKIFVSKEKNSAGK

SEQ ID NO: 161001 - protein, 16 aa, Borrelia afzelii PKo
GNKIFVSKEKNSAGKY

SEQ ID NO: 161002 - protein, 16 aa, Borrelia afzelii PKo
NKIFVSKEKNSAGKYE

SEQ ID NO: 161003 - protein, 16 aa, Borrelia afzelii PKo
KIFVSKEKNSAGKYEL

SEQ ID NO: 161004 - protein, 16 aa, Borrelia afzelii PKo
IFVSKEKNSAGKYELR

SEQ ID NO: 161005 - protein, 16 aa, Borrelia afzelii PKo
FVSKEKNSAGKYELRA

SEQ ID NO: 161006 - protein, 16 aa, Borrelia afzelii PKo
VSKEKNSAGKYELRAT

SEQ ID NO: 161007 - protein, 16 aa, Borrelia afzelii PKo
SKEKNSAGKYELRATV

SEQ ID NO: 161008 - protein, 16 aa, Borrelia afzelii PKo
KEKNSAGKYELRATVD

SEQ ID NO: 161009 - protein, 16 aa, Borrelia afzelii PKo
EKNSAGKYELRATVDT

SEQ ID NO: 161010 - protein, 16 aa, Borrelia afzelii PKo
KNSAGKYELRATVDTV

SEQ ID NO: 161011 - protein, 16 aa, Borrelia afzelii PKo
NSAGKYELRATVDTVE

SEQ ID NO: 161012 - protein, 16 aa, Borrelia afzelii PKo
SAGKYELRATVDTVEL

SEQ ID NO: 161013 - protein, 16 aa, Borrelia afzelii PKo
AGKYELRATVDTVELK

SEQ ID NO: 161014 - protein, 16 aa, Borrelia afzelii PKo
GKYELRATVDTVELKG

SEQ ID NO: 161015 - protein, 16 aa, Borrelia afzelii PKo
KYELRATVDTVELKGV

SEQ ID NO: 161016 - protein, 16 aa, Borrelia afzelii PKo
YELRATVDTVELKGVS

SEQ ID NO: 161017 - protein, 16 aa, Borrelia afzelii PKo
ELRATVDTVELKGVSD

SEQ ID NO: 161018 - protein, 16 aa, Borrelia afzelii PKo
LRATVDTVELKGVSDK

SEQ ID NO: 161019 - protein, 16 aa, Borrelia afzelii PKo
RATVDTVELKGVSDKN

SEQ ID NO: 161020 - protein, 16 aa, Borrelia afzelii PKo
ATVDTVELKGVSDKNN

SEQ ID NO: 161021 - protein, 16 aa, Borrelia afzelii PKo
TVDTVELKGVSDKNNG

SEQ ID NO: 161022 - protein, 16 aa, Borrelia afzelii PKo
VDTVELKGVSDKNNGS

SEQ ID NO: 161023 - protein, 16 aa, Borrelia afzelii PKo
DTVELKGVSDKNNGSG

SEQ ID NO: 161024 - protein, 16 aa, Borrelia afzelii PKo
TVELKGVSDKNNGSGK

SEQ ID NO: 161025 - protein, 16 aa, Borrelia afzelii PKo
VELKGVSDKNNGSGKL

SEQ ID NO: 161026 - protein, 16 aa, Borrelia afzelii PKo
ELKGVSDKNNGSGKLE

SEQ ID NO: 161027 - protein, 16 aa, Borrelia afzelii PKo
LKGVSDKNNGSGKLEG

SEQ ID NO: 161028 - protein, 16 aa, Borrelia afzelii PKo
KGVSDKNNGSGKLEGT

SEQ ID NO: 161029 - protein, 16 aa, Borrelia afzelii PKo
GVSDKNNGSGKLEGTK

SEQ ID NO: 161030 - protein, 16 aa, Borrelia afzelii PKo
VSDKNNGSGKLEGTKA

SEQ ID NO: 161031 - protein, 16 aa, Borrelia afzelii PKo
SDKNNGSGKLEGTKAD

SEQ ID NO: 161032 - protein, 16 aa, Borrelia afzelii PKo
DKNNGSGKLEGTKADK

SEQ ID NO: 161033 - protein, 16 aa, Borrelia afzelii PKo
KNNGSGKLEGTKADKT

SEQ ID NO: 161034 - protein, 16 aa, Borrelia afzelii PKo
NNGSGKLEGTKADKTK

SEQ ID NO: 161035 - protein, 16 aa, Borrelia afzelii PKo
NGSGKLEGTKADKTKV

SEQ ID NO: 161036 - protein, 16 aa, Borrelia afzelii PKo
GSGKLEGTKADKTKVA

SEQ ID NO: 161037 - protein, 16 aa, Borrelia afzelii PKo
SGKLEGTKADKTKVAM

SEQ ID NO: 161038 - protein, 16 aa, Borrelia afzelii PKo
GKLEGTKADKTKVAMT

SEQ ID NO: 161039 - protein, 16 aa, Borrelia afzelii PKo
KLEGTKADKTKVAMTI

SEQ ID NO: 161040 - protein, 16 aa, Borrelia afzelii PKo
LEGTKADKTKVAMTIA

SEQ ID NO: 161041 - protein, 16 aa, Borrelia afzelii PKo
EGTKADKTKVAMTIAD

SEQ ID NO: 161042 - protein, 16 aa, Borrelia afzelii PKo
GTKADKTKVAMTIADD

SEQ ID NO: 161043 - protein, 16 aa, Borrelia afzelii PKo
TKADKTKVAMTIADDL

SEQ ID NO: 161044 - protein, 16 aa, Borrelia afzelii PKo
KADKTKVAMTIADDLN

SEQ ID NO: 161045 - protein, 16 aa, Borrelia afzelii PKo
ADKTKVAMTIADDLNT

SEQ ID NO: 161046 - protein, 16 aa, Borrelia afzelii PKo
DKTKVAMTIADDLNTI

SEQ ID NO: 161047 - protein, 16 aa, Borrelia afzelii PKo
KTKVAMTIADDLNTIT

SEQ ID NO: 161048 - protein, 16 aa, Borrelia afzelii PKo
TKVAMTIADDLNTITV

SEQ ID NO: 161049 - protein, 16 aa, Borrelia afzelii PKo
KVAMTIADDLNTITVE

SEQ ID NO: 161050 - protein, 16 aa, Borrelia afzelii PKo
VAMTIADDLNTITVET

SEQ ID NO: 161051 - protein, 16 aa, Borrelia afzelii PKo
AMTIADDLNTITVETY

SEQ ID NO: 161052 - protein, 16 aa, Borrelia afzelii PKo
MTIADDLNTITVETYD

SEQ ID NO: 161053 - protein, 16 aa, Borrelia afzelii PKo
TIADDLNTITVETYDA

SEQ ID NO: 161054 - protein, 16 aa, Borrelia afzelii PKo
IADDLNTITVETYDAS

SEQ ID NO: 161055 - protein, 16 aa, Borrelia afzelii PKo
ADDLNTITVETYDASN

SEQ ID NO: 161056 - protein, 16 aa, Borrelia afzelii PKo
DDLNTITVETYDASNK

SEQ ID NO: 161057 - protein, 16 aa, Borrelia afzelii PKo
DLNTITVETYDASNKK

SEQ ID NO: 161058 - protein, 16 aa, Borrelia afzelii PKo
LNTITVETYDASNKKT

SEQ ID NO: 161059 - protein, 16 aa, Borrelia afzelii PKo
NTITVETYDASNKKTG

SEQ ID NO: 161060 - protein, 16 aa, Borrelia afzelii PKo
TITVETYDASNKKTGS

SEQ ID NO: 161061 - protein, 16 aa, Borrelia afzelii PKo
ITVETYDASNKKTGSE

SEQ ID NO: 161062 - protein, 16 aa, Borrelia afzelii PKo
TVETYDASNKKTGSEV

SEQ ID NO: 161063 - protein, 16 aa, Borrelia afzelii PKo
VETYDASNKKTGSEVV

SEQ ID NO: 161064 - protein, 16 aa, Borrelia afzelii PKo
ETYDASNKKTGSEVVK

SEQ ID NO: 161065 - protein, 16 aa, Borrelia afzelii PKo
TYDASNKKTGSEVVKK

SEQ ID NO: 161066 - protein, 16 aa, Borrelia afzelii PKo
YDASNKKTGSEVVKKQ

SEQ ID NO: 161067 - protein, 16 aa, Borrelia afzelii PKo
DASNKKTGSEVVKKQG

SEQ ID NO: 161068 - protein, 16 aa, Borrelia afzelii PKo
ASNKKTGSEVVKKQGS

SEQ ID NO: 161069 - protein, 16 aa, Borrelia afzelii PKo
SNKKTGSEVVKKQGSV

SEQ ID NO: 161070 - protein, 16 aa, Borrelia afzelii PKo
NKKTGSEVVKKQGSVI

SEQ ID NO: 161071 - protein, 16 aa, Borrelia afzelii PKo
KKTGSEVVKKQGSVIK

SEQ ID NO: 161072 - protein, 16 aa, Borrelia afzelii PKo
KTGSEVVKKQGSVIKE

SEQ ID NO: 161073 - protein, 16 aa, Borrelia afzelii PKo
TGSEVVKKQGSVIKES

SEQ ID NO: 161074 - protein, 16 aa, Borrelia afzelii PKo
GSEVVKKQGSVIKESY

SEQ ID NO: 161075 - protein, 16 aa, Borrelia afzelii PKo
SEVVKKQGSVIKESYK

SEQ ID NO: 161076 - protein, 16 aa, Borrelia afzelii PKo
EVVKKQGSVIKESYKA

SEQ ID NO: 161077 - protein, 16 aa, Borrelia afzelii PKo
VVKKQGSVIKESYKAN

SEQ ID NO: 161078 - protein, 16 aa, Borrelia afzelii PKo
VKKQGSVIKESYKANK

SEQ ID NO: 161079 - protein, 16 aa, Borrelia afzelii PKo
KKQGSVIKESYKANKL

SEQ ID NO: 161080 - protein, 16 aa, Borrelia afzelii PKo
KQGSVIKESYKANKLD

SEQ ID NO: 161081 - protein, 16 aa, Borrelia afzelii PKo
QGSVIKESYKANKLDS

SEQ ID NO: 161082 - protein, 16 aa, Borrelia afzelii PKo
GSVIKESYKANKLDSK

SEQ ID NO: 161083 - protein, 16 aa, Borrelia afzelii PKo
SVIKESYKANKLDSKK

SEQ ID NO: 161084 - protein, 16 aa, Borrelia afzelii PKo
VIKESYKANKLDSKKI

SEQ ID NO: 161085 - protein, 16 aa, Borrelia afzelii PKo
IKESYKANKLDSKKIT

SEQ ID NO: 161086 - protein, 16 aa, Borrelia afzelii PKo
KESYKANKLDSKKITR

SEQ ID NO: 161087 - protein, 16 aa, Borrelia afzelii PKo
ESYKANKLDSKKITRE

SEQ ID NO: 161088 - protein, 16 aa, Borrelia afzelii PKo
SYKANKLDSKKITREN

SEQ ID NO: 161089 - protein, 16 aa, Borrelia afzelii PKo
YKANKLDSKKITRENE

SEQ ID NO: 161090 - protein, 16 aa, Borrelia afzelii PKo
KANKLDSKKITRENET

SEQ ID NO: 161091 - protein, 16 aa, Borrelia afzelii PKo
ANKLDSKKITRENETT

SEQ ID NO: 161092 - protein, 16 aa, Borrelia afzelii PKo
NKLDSKKITRENETTL

SEQ ID NO: 161093 - protein, 16 aa, Borrelia afzelii PKo
KLDSKKITRENETTLE

SEQ ID NO: 161094 - protein, 16 aa, Borrelia afzelii PKo
LDSKKITRENETTLEY

SEQ ID NO: 161095 - protein, 16 aa, Borrelia afzelii PKo
DSKKITRENETTLEYS

SEQ ID NO: 161096 - protein, 16 aa, Borrelia afzelii PKo
SKKITRENETTLEYSE

SEQ ID NO: 161097 - protein, 16 aa, Borrelia afzelii PKo
KKITRENETTLEYSEM

SEQ ID NO: 161098 - protein, 16 aa, Borrelia afzelii PKo
KITRENETTLEYSEMT

SEQ ID NO: 161099 - protein, 16 aa, Borrelia afzelii PKo
ITRENETTLEYSEMTD

SEQ ID NO: 161100 - protein, 16 aa, Borrelia afzelii PKo
TRENETTLEYSEMTDS

SEQ ID NO: 161101 - protein, 16 aa, Borrelia afzelii PKo
RENETTLEYSEMTDSS

SEQ ID NO: 161102 - protein, 16 aa, Borrelia afzelii PKo
ENETTLEYSEMTDSSN

SEQ ID NO: 161103 - protein, 16 aa, Borrelia afzelii PKo
NETTLEYSEMTDSSNA

SEQ ID NO: 161104 - protein, 16 aa, Borrelia afzelii PKo
ETTLEYSEMTDSSNAT

SEQ ID NO: 161105 - protein, 16 aa, Borrelia afzelii PKo
TTLEYSEMTDSSNATK

SEQ ID NO: 161106 - protein, 16 aa, Borrelia afzelii PKo
TLEYSEMTDSSNATKA

SEQ ID NO: 161107 - protein, 16 aa, Borrelia afzelii PKo
LEYSEMTDSSNATKAV

SEQ ID NO: 161108 - protein, 16 aa, Borrelia afzelii PKo
EYSEMTDSSNATKAVE

SEQ ID NO: 161109 - protein, 16 aa, Borrelia afzelii PKo
YSEMTDSSNATKAVET

SEQ ID NO: 161110 - protein, 16 aa, Borrelia afzelii PKo
SEMTDSSNATKAVETL

SEQ ID NO: 161111 - protein, 16 aa, Borrelia afzelii PKo
EMTDSSNATKAVETLK

SEQ ID NO: 161112 - protein, 16 aa, Borrelia afzelii PKo
MTDSSNATKAVETLKN

SEQ ID NO: 161113 - protein, 16 aa, Borrelia afzelii PKo
TDSSNATKAVETLKNG

SEQ ID NO: 161114 - protein, 16 aa, Borrelia afzelii PKo
DSSNATKAVETLKNGI

SEQ ID NO: 161115 - protein, 16 aa, Borrelia afzelii PKo
SSNATKAVETLKNGIK

SEQ ID NO: 161116 - protein, 16 aa, Borrelia afzelii PKo
SNATKAVETLKNGIKL

SEQ ID NO: 161117 - protein, 16 aa, Borrelia afzelii PKo
NATKAVETLKNGIKLE

SEQ ID NO: 161118 - protein, 16 aa, Borrelia afzelii PKo
ATKAVETLKNGIKLEG

SEQ ID NO: 161119 - protein, 16 aa, Borrelia afzelii PKo
TKAVETLKNGIKLEGS

SEQ ID NO: 161120 - protein, 16 aa, Borrelia afzelii PKo
KAVETLKNGIKLEGSL

SEQ ID NO: 161121 - protein, 16 aa, Borrelia afzelii PKo
AVETLKNGIKLEGSLV

SEQ ID NO: 161122 - protein, 16 aa, Borrelia afzelii PKo
VETLKNGIKLEGSLVG

SEQ ID NO: 161123 - protein, 16 aa, Borrelia afzelii PKo
ETLKNGIKLEGSLVGG

SEQ ID NO: 161124 - protein, 16 aa, Borrelia afzelii PKo
TLKNGIKLEGSLVGGK

SEQ ID NO: 161125 - protein, 16 aa, Borrelia afzelii PKo
LKNGIKLEGSLVGGKT

SEQ ID NO: 161126 - protein, 16 aa, Borrelia afzelii PKo
KNGIKLEGSLVGGKTT

SEQ ID NO: 161127 - protein, 16 aa, Borrelia afzelii PKo
NGIKLEGSLVGGKTTV

SEQ ID NO: 161128 - protein, 16 aa, Borrelia afzelii PKo
GIKLEGSLVGGKTTVK

SEQ ID NO: 161129 - protein, 16 aa, Borrelia afzelii PKo
IKLEGSLVGGKTTVKL

SEQ ID NO: 161130 - protein, 16 aa, Borrelia afzelii PKo
KLEGSLVGGKTTVKLT

SEQ ID NO: 161131 - protein, 16 aa, Borrelia afzelii PKo
LEGSLVGGKTTVKLTE

SEQ ID NO: 161132 - protein, 16 aa, Borrelia afzelii PKo
EGSLVGGKTTVKLTEG

SEQ ID NO: 161133 - protein, 16 aa, Borrelia afzelii PKo
GSLVGGKTTVKLTEGT

SEQ ID NO: 161134 - protein, 16 aa, Borrelia afzelii PKo
SLVGGKTTVKLTEGTI

SEQ ID NO: 161135 - protein, 16 aa, Borrelia afzelii PKo
LVGGKTTVKLTEGTIT

SEQ ID NO: 161136 - protein, 16 aa, Borrelia afzelii PKo
VGGKTTVKLTEGTITL

SEQ ID NO: 161137 - protein, 16 aa, Borrelia afzelii PKo
GGKTTVKLTEGTITLT

SEQ ID NO: 161138 - protein, 16 aa, Borrelia afzelii PKo
GKTTVKLTEGTITLTR

SEQ ID NO: 161139 - protein, 16 aa, Borrelia afzelii PKo
KTTVKLTEGTITLTRE

SEQ ID NO: 161140 - protein, 16 aa, Borrelia afzelii PKo
TTVKLTEGTITLTREI

SEQ ID NO: 161141 - protein, 16 aa, Borrelia afzelii PKo
TVKLTEGTITLTREIE

SEQ ID NO: 161142 - protein, 16 aa, Borrelia afzelii PKo
VKLTEGTITLTREIEQ

SEQ ID NO: 161143 - protein, 16 aa, Borrelia afzelii PKo
KLTEGTITLTREIEQD

SEQ ID NO: 161144 - protein, 16 aa, Borrelia afzelii PKo
LTEGTITLTREIEQDG

SEQ ID NO: 161145 - protein, 16 aa, Borrelia afzelii PKo
TEGTITLTREIEQDGK

SEQ ID NO: 161146 - protein, 16 aa, Borrelia afzelii PKo
EGTITLTREIEQDGKV

SEQ ID NO: 161147 - protein, 16 aa, Borrelia afzelii PKo
GTITLTREIEQDGKVK

SEQ ID NO: 161148 - protein, 16 aa, Borrelia afzelii PKo
TITLTREIEQDGKVKI

SEQ ID NO: 161149 - protein, 16 aa, Borrelia afzelii PKo
ITLTREIEQDGKVKIY

SEQ ID NO: 161150 - protein, 16 aa, Borrelia afzelii PKo
TLTREIEQDGKVKIYL

SEQ ID NO: 161151 - protein, 16 aa, Borrelia afzelii PKo
LTREIEQDGKVKIYLN

SEQ ID NO: 161152 - protein, 16 aa, Borrelia afzelii PKo
TREIEQDGKVKIYLND

SEQ ID NO: 161153 - protein, 16 aa, Borrelia afzelii PKo
REIEQDGKVKIYLNDT

SEQ ID NO: 161154 - protein, 16 aa, Borrelia afzelii PKo
EIEQDGKVKIYLNDTT

SEQ ID NO: 161155 - protein, 16 aa, Borrelia afzelii PKo
IEQDGKVKIYLNDTTS

SEQ ID NO: 161156 - protein, 16 aa, Borrelia afzelii PKo
EQDGKVKIYLNDTTSG

SEQ ID NO: 161157 - protein, 16 aa, Borrelia afzelii PKo
QDGKVKIYLNDTTSGS

SEQ ID NO: 161158 - protein, 16 aa, Borrelia afzelii PKo
DGKVKIYLNDTTSGST

SEQ ID NO: 161159 - protein, 16 aa, Borrelia afzelii PKo
GKVKIYLNDTTSGSTK

SEQ ID NO: 161160 - protein, 16 aa, Borrelia afzelii PKo
KVKIYLNDTTSGSTKK

SEQ ID NO: 161161 - protein, 16 aa, Borrelia afzelii PKo
VKIYLNDTTSGSTKKT

SEQ ID NO: 161162 - protein, 16 aa, Borrelia afzelii PKo
KIYLNDTTSGSTKKTA

SEQ ID NO: 161163 - protein, 16 aa, Borrelia afzelii PKo
IYLNDTTSGSTKKTAT

SEQ ID NO: 161164 - protein, 16 aa, Borrelia afzelii PKo
YLNDTTSGSTKKTATW

SEQ ID NO: 161165 - protein, 16 aa, Borrelia afzelii PKo
LNDTTSGSTKKTATWN

SEQ ID NO: 161166 - protein, 16 aa, Borrelia afzelii PKo
NDTTSGSTKKTATWNE

SEQ ID NO: 161167 - protein, 16 aa, Borrelia afzelii PKo
DTTSGSTKKTATWNET

SEQ ID NO: 161168 - protein, 16 aa, Borrelia afzelii PKo
TTSGSTKKTATWNETT

SEQ ID NO: 161169 - protein, 16 aa, Borrelia afzelii PKo
TSGSTKKTATWNETTN

SEQ ID NO: 161170 - protein, 16 aa, Borrelia afzelii PKo
SGSTKKTATWNETTNT

SEQ ID NO: 161171 - protein, 16 aa, Borrelia afzelii PKo
GSTKKTATWNETTNTL

SEQ ID NO: 161172 - protein, 16 aa, Borrelia afzelii PKo
STKKTATWNETTNTLT

SEQ ID NO: 161173 - protein, 16 aa, Borrelia afzelii PKo
TKKTATWNETTNTLTI

SEQ ID NO: 161174 - protein, 16 aa, Borrelia afzelii PKo
KKTATWNETTNTLTIS

SEQ ID NO: 161175 - protein, 16 aa, Borrelia afzelii PKo
KTATWNETTNTLTISA

SEQ ID NO: 161176 - protein, 16 aa, Borrelia afzelii PKo
TATWNETTNTLTISAD

SEQ ID NO: 161177 - protein, 16 aa, Borrelia afzelii PKo
ATWNETTNTLTISADS

SEQ ID NO: 161178 - protein, 16 aa, Borrelia afzelii PKo
TWNETTNTLTISADSK

SEQ ID NO: 161179 - protein, 16 aa, Borrelia afzelii PKo
WNETTNTLTISADSKK

SEQ ID NO: 161180 - protein, 16 aa, Borrelia afzelii PKo
NETTNTLTISADSKKT

SEQ ID NO: 161181 - protein, 16 aa, Borrelia afzelii PKo
ETTNTLTISADSKKTK

SEQ ID NO: 161182 - protein, 16 aa, Borrelia afzelii PKo
TTNTLTISADSKKTKD

SEQ ID NO: 161183 - protein, 16 aa, Borrelia afzelii PKo
TNTLTISADSKKTKDF

SEQ ID NO: 161184 - protein, 16 aa, Borrelia afzelii PKo
NTLTISADSKKTKDFV

SEQ ID NO: 161185 - protein, 16 aa, Borrelia afzelii PKo
TLTISADSKKTKDFVF

SEQ ID NO: 161186 - protein, 16 aa, Borrelia afzelii PKo
LTISADSKKTKDFVFL

SEQ ID NO: 161187 - protein, 16 aa, Borrelia afzelii PKo
TISADSKKTKDFVFLT

SEQ ID NO: 161188 - protein, 16 aa, Borrelia afzelii PKo
ISADSKKTKDFVFLTD

SEQ ID NO: 161189 - protein, 16 aa, Borrelia afzelii PKo
SADSKKTKDFVFLTDG

SEQ ID NO: 161190 - protein, 16 aa, Borrelia afzelii PKo
ADSKKTKDFVFLTDGT

SEQ ID NO: 161191 - protein, 16 aa, Borrelia afzelii PKo
DSKKTKDFVFLTDGTI

SEQ ID NO: 161192 - protein, 16 aa, Borrelia afzelii PKo
SKKTKDFVFLTDGTIT

SEQ ID NO: 161193 - protein, 16 aa, Borrelia afzelii PKo
KKTKDFVFLTDGTITV

SEQ ID NO: 161194 - protein, 16 aa, Borrelia afzelii PKo
KTKDFVFLTDGTITVQ

SEQ ID NO: 161195 - protein, 16 aa, Borrelia afzelii PKo
TKDFVFLTDGTITVQA

SEQ ID NO: 161196 - protein, 16 aa, Borrelia afzelii PKo
KDFVFLTDGTITVQAY

SEQ ID NO: 161197 - protein, 16 aa, Borrelia afzelii PKo
DFVFLTDGTITVQAYD

SEQ ID NO: 161198 - protein, 16 aa, Borrelia afzelii PKo
FVFLTDGTITVQAYDT

SEQ ID NO: 161199 - protein, 16 aa, Borrelia afzelii PKo
VFLTDGTITVQAYDTA

SEQ ID NO: 161200 - protein, 16 aa, Borrelia afzelii PKo
FLTDGTITVQAYDTAG

SEQ ID NO: 161201 - protein, 16 aa, Borrelia afzelii PKo
LTDGTITVQAYDTAGT

SEQ ID NO: 161202 - protein, 16 aa, Borrelia afzelii PKo
TDGTITVQAYDTAGTK

SEQ ID NO: 161203 - protein, 16 aa, Borrelia afzelii PKo
DGTITVQAYDTAGTKL

SEQ ID NO: 161204 - protein, 16 aa, Borrelia afzelii PKo
GTITVQAYDTAGTKLE

SEQ ID NO: 161205 - protein, 16 aa, Borrelia afzelii PKo
TITVQAYDTAGTKLEG

SEQ ID NO: 161206 - protein, 16 aa, Borrelia afzelii PKo
ITVQAYDTAGTKLEGN

SEQ ID NO: 161207 - protein, 16 aa, Borrelia afzelii PKo
TVQAYDTAGTKLEGNS

SEQ ID NO: 161208 - protein, 16 aa, Borrelia afzelii PKo
VQAYDTAGTKLEGNSS

SEQ ID NO: 161209 - protein, 16 aa, Borrelia afzelii PKo
QAYDTAGTKLEGNSSE

SEQ ID NO: 161210 - protein, 16 aa, Borrelia afzelii PKo
AYDTAGTKLEGNSSEI

SEQ ID NO: 161211 - protein, 16 aa, Borrelia afzelii PKo
YDTAGTKLEGNSSEIK

SEQ ID NO: 161212 - protein, 16 aa, Borrelia afzelii PKo
DTAGTKLEGNSSEIKD

SEQ ID NO: 161213 - protein, 16 aa, Borrelia afzelii PKo
TAGTKLEGNSSEIKDL

SEQ ID NO: 161214 - protein, 16 aa, Borrelia afzelii PKo
AGTKLEGNSSEIKDLA

SEQ ID NO: 161215 - protein, 16 aa, Borrelia afzelii PKo
GTKLEGNSSEIKDLAA

SEQ ID NO: 161216 - protein, 16 aa, Borrelia afzelii PKo
TKLEGNSSEIKDLAAL

SEQ ID NO: 161217 - protein, 16 aa, Borrelia afzelii PKo
KLEGNSSEIKDLAALK

SEQ ID NO: 161218 - protein, 16 aa, Borrelia afzelii PKo
LEGNSSEIKDLAALKA

SEQ ID NO: 161219 - protein, 16 aa, Borrelia afzelii PKo
EGNSSEIKDLAALKAA

SEQ ID NO: 161220 - protein, 16 aa, Borrelia afzelii PKo
GNSSEIKDLAALKAAL

SEQ ID NO: 161221 - protein, 16 aa, Borrelia afzelii PKo
NSSEIKDLAALKAALK

SEQ ID NO: 161222 - protein, 8 aa, Borrelia burgdorferi B31
MRLLIGFA

SEQ ID NO: 161223 - protein, 8 aa, Borrelia burgdorferi B31
RLLIGFAL

SEQ ID NO: 161224 - protein, 8 aa, Borrelia burgdorferi B31
LLIGFALA

SEQ ID NO: 161225 - protein, 8 aa, Borrelia burgdorferi B31
LIGFALAL

SEQ ID NO: 161226 - protein, 8 aa, Borrelia burgdorferi B31
IGFALALA

SEQ ID NO: 161227 - protein, 8 aa, Borrelia burgdorferi B31
GFALALAL

SEQ ID NO: 161228 - protein, 8 aa, Borrelia burgdorferi B31
FALALALI

SEQ ID NO: 161229 - protein, 8 aa, Borrelia burgdorferi B31
ALALALIG

SEQ ID NO: 161230 - protein, 8 aa, Borrelia burgdorferi B31
LALALIGC

SEQ ID NO: 161231 - protein, 8 aa, Borrelia burgdorferi B31
ALALIGCA

SEQ ID NO: 161232 - protein, 8 aa, Borrelia burgdorferi B31
LALIGCAQ

SEQ ID NO: 161233 - protein, 8 aa, Borrelia burgdorferi B31
ALIGCAQK

SEQ ID NO: 161234 - protein, 8 aa, Borrelia burgdorferi B31
LIGCAQKG

SEQ ID NO: 161235 - protein, 8 aa, Borrelia burgdorferi B31
IGCAQKGA

SEQ ID NO: 161236 - protein, 8 aa, Borrelia burgdorferi B31
GCAQKGAE

SEQ ID NO: 161237 - protein, 8 aa, Borrelia burgdorferi B31
CAQKGAES

SEQ ID NO: 161238 - protein, 8 aa, Borrelia burgdorferi B31
AQKGAESI

SEQ ID NO: 161239 - protein, 8 aa, Borrelia burgdorferi B31
QKGAESIG

SEQ ID NO: 161240 - protein, 8 aa, Borrelia burgdorferi B31
KGAESIGS

SEQ ID NO: 161241 - protein, 8 aa, Borrelia burgdorferi B31
GAESIGSQ

SEQ ID NO: 161242 - protein, 8 aa, Borrelia burgdorferi B31
AESIGSQK

SEQ ID NO: 161243 - protein, 8 aa, Borrelia burgdorferi B31
ESIGSQKE

SEQ ID NO: 161244 - protein, 8 aa, Borrelia burgdorferi B31
SIGSQKEN

SEQ ID NO: 161245 - protein, 8 aa, Borrelia burgdorferi B31
IGSQKEND

SEQ ID NO: 161246 - protein, 8 aa, Borrelia burgdorferi B31
GSQKENDL

SEQ ID NO: 161247 - protein, 8 aa, Borrelia burgdorferi B31
SQKENDLN

SEQ ID NO: 161248 - protein, 8 aa, Borrelia burgdorferi B31
QKENDLNL

SEQ ID NO: 161249 - protein, 8 aa, Borrelia burgdorferi B31
KENDLNLE

SEQ ID NO: 161250 - protein, 8 aa, Borrelia burgdorferi B31
ENDLNLED

SEQ ID NO: 161251 - protein, 8 aa, Borrelia burgdorferi B31
NDLNLEDS

SEQ ID NO: 161252 - protein, 8 aa, Borrelia burgdorferi B31
DLNLEDSS

SEQ ID NO: 161253 - protein, 8 aa, Borrelia burgdorferi B31
LNLEDSSK

SEQ ID NO: 161254 - protein, 8 aa, Borrelia burgdorferi B31
NLEDSSKK

SEQ ID NO: 161255 - protein, 8 aa, Borrelia burgdorferi B31
LEDSSKKS

SEQ ID NO: 161256 - protein, 8 aa, Borrelia burgdorferi B31
EDSSKKSH

SEQ ID NO: 161257 - protein, 8 aa, Borrelia burgdorferi B31
DSSKKSHQ

SEQ ID NO: 161258 - protein, 8 aa, Borrelia burgdorferi B31
SSKKSHQN

SEQ ID NO: 161259 - protein, 8 aa, Borrelia burgdorferi B31
SKKSHQNA

SEQ ID NO: 161260 - protein, 8 aa, Borrelia burgdorferi B31
KKSHQNAK

SEQ ID NO: 161261 - protein, 8 aa, Borrelia burgdorferi B31
KSHQNAKQ

SEQ ID NO: 161262 - protein, 8 aa, Borrelia burgdorferi B31
SHQNAKQD

SEQ ID NO: 161263 - protein, 8 aa, Borrelia burgdorferi B31
HQNAKQDL

SEQ ID NO: 161264 - protein, 8 aa, Borrelia burgdorferi B31
QNAKQDLP

SEQ ID NO: 161265 - protein, 8 aa, Borrelia burgdorferi B31
NAKQDLPA

SEQ ID NO: 161266 - protein, 8 aa, Borrelia burgdorferi B31
AKQDLPAV

SEQ ID NO: 161267 - protein, 8 aa, Borrelia burgdorferi B31
KQDLPAVT

SEQ ID NO: 161268 - protein, 8 aa, Borrelia burgdorferi B31
QDLPAVTE

SEQ ID NO: 161269 - protein, 8 aa, Borrelia burgdorferi B31
DLPAVTED

SEQ ID NO: 161270 - protein, 8 aa, Borrelia burgdorferi B31
LPAVTEDS

SEQ ID NO: 161271 - protein, 8 aa, Borrelia burgdorferi B31
PAVTEDSV

SEQ ID NO: 161272 - protein, 8 aa, Borrelia burgdorferi B31
AVTEDSVS

SEQ ID NO: 161273 - protein, 8 aa, Borrelia burgdorferi B31
VTEDSVSL

SEQ ID NO: 161274 - protein, 8 aa, Borrelia burgdorferi B31
TEDSVSLF

SEQ ID NO: 161275 - protein, 8 aa, Borrelia burgdorferi B31
EDSVSLFN

SEQ ID NO: 161276 - protein, 8 aa, Borrelia burgdorferi B31
DSVSLFNG

SEQ ID NO: 161277 - protein, 8 aa, Borrelia burgdorferi B31
SVSLFNGN

SEQ ID NO: 161278 - protein, 8 aa, Borrelia burgdorferi B31
VSLFNGNK

SEQ ID NO: 161279 - protein, 8 aa, Borrelia burgdorferi B31
SLFNGNKI

SEQ ID NO: 161280 - protein, 8 aa, Borrelia burgdorferi B31
LFNGNKIF

SEQ ID NO: 161281 - protein, 8 aa, Borrelia burgdorferi B31
FNGNKIFV

SEQ ID NO: 161282 - protein, 8 aa, Borrelia burgdorferi B31
NGNKIFVS

SEQ ID NO: 161283 - protein, 8 aa, Borrelia burgdorferi B31
GNKIFVSK

SEQ ID NO: 161284 - protein, 8 aa, Borrelia burgdorferi B31
NKIFVSKE

SEQ ID NO: 161285 - protein, 8 aa, Borrelia burgdorferi B31
KIFVSKEK

SEQ ID NO: 161286 - protein, 8 aa, Borrelia burgdorferi B31
IFVSKEKN

SEQ ID NO: 161287 - protein, 8 aa, Borrelia burgdorferi B31
FVSKEKNS

SEQ ID NO: 161288 - protein, 8 aa, Borrelia burgdorferi B31
VSKEKNSS

SEQ ID NO: 161289 - protein, 8 aa, Borrelia burgdorferi B31
SKEKNSSG

SEQ ID NO: 161290 - protein, 8 aa, Borrelia burgdorferi B31
KEKNSSGK

SEQ ID NO: 161291 - protein, 8 aa, Borrelia burgdorferi B31
EKNSSGKY

SEQ ID NO: 161292 - protein, 8 aa, Borrelia burgdorferi B31
KNSSGKYD

SEQ ID NO: 161293 - protein, 8 aa, Borrelia burgdorferi B31
NSSGKYDL

SEQ ID NO: 161294 - protein, 8 aa, Borrelia burgdorferi B31
SSGKYDLR

SEQ ID NO: 161295 - protein, 8 aa, Borrelia burgdorferi B31
SGKYDLRA

SEQ ID NO: 161296 - protein, 8 aa, Borrelia burgdorferi B31
GKYDLRAT

SEQ ID NO: 161297 - protein, 8 aa, Borrelia burgdorferi B31
KYDLRATI

SEQ ID NO: 161298 - protein, 8 aa, Borrelia burgdorferi B31
YDLRATID

SEQ ID NO: 161299 - protein, 8 aa, Borrelia burgdorferi B31
DLRATIDQ

SEQ ID NO: 161300 - protein, 8 aa, Borrelia burgdorferi B31
LRATIDQV

SEQ ID NO: 161301 - protein, 8 aa, Borrelia burgdorferi B31
RATIDQVE

SEQ ID NO: 161302 - protein, 8 aa, Borrelia burgdorferi B31
ATIDQVEL

SEQ ID NO: 161303 - protein, 8 aa, Borrelia burgdorferi B31
TIDQVELK

SEQ ID NO: 161304 - protein, 8 aa, Borrelia burgdorferi B31
IDQVELKG

SEQ ID NO: 161305 - protein, 8 aa, Borrelia burgdorferi B31
DQVELKGT

SEQ ID NO: 161306 - protein, 8 aa, Borrelia burgdorferi B31
QVELKGTS

SEQ ID NO: 161307 - protein, 8 aa, Borrelia burgdorferi B31
VELKGTSD

SEQ ID NO: 161308 - protein, 8 aa, Borrelia burgdorferi B31
ELKGTSDK

SEQ ID NO: 161309 - protein, 8 aa, Borrelia burgdorferi B31
LKGTSDKN

SEQ ID NO: 161310 - protein, 8 aa, Borrelia burgdorferi B31
KGTSDKNN

SEQ ID NO: 161311 - protein, 8 aa, Borrelia burgdorferi B31
GTSDKNNG

SEQ ID NO: 161312 - protein, 8 aa, Borrelia burgdorferi B31
TSDKNNGS

SEQ ID NO: 161313 - protein, 8 aa, Borrelia burgdorferi B31
SDKNNGSG

SEQ ID NO: 161314 - protein, 8 aa, Borrelia burgdorferi B31
DKNNGSGT

SEQ ID NO: 161315 - protein, 8 aa, Borrelia burgdorferi B31
KNNGSGTL

SEQ ID NO: 161316 - protein, 8 aa, Borrelia burgdorferi B31
NNGSGTLE

SEQ ID NO: 161317 - protein, 8 aa, Borrelia burgdorferi B31
NGSGTLEG

SEQ ID NO: 161318 - protein, 8 aa, Borrelia burgdorferi B31
GSGTLEGS

SEQ ID NO: 161319 - protein, 8 aa, Borrelia burgdorferi B31
SGTLEGSK

SEQ ID NO: 161320 - protein, 8 aa, Borrelia burgdorferi B31
GTLEGSKP

SEQ ID NO: 161321 - protein, 8 aa, Borrelia burgdorferi B31
TLEGSKPD

SEQ ID NO: 161322 - protein, 8 aa, Borrelia burgdorferi B31
LEGSKPDK

SEQ ID NO: 161323 - protein, 8 aa, Borrelia burgdorferi B31
EGSKPDKS

SEQ ID NO: 161324 - protein, 8 aa, Borrelia burgdorferi B31
GSKPDKSK

SEQ ID NO: 161325 - protein, 8 aa, Borrelia burgdorferi B31
SKPDKSKV

SEQ ID NO: 161326 - protein, 8 aa, Borrelia burgdorferi B31
KPDKSKVK

SEQ ID NO: 161327 - protein, 8 aa, Borrelia burgdorferi B31
PDKSKVKL

SEQ ID NO: 161328 - protein, 8 aa, Borrelia burgdorferi B31
DKSKVKLT

SEQ ID NO: 161329 - protein, 8 aa, Borrelia burgdorferi B31
KSKVKLTV

SEQ ID NO: 161330 - protein, 8 aa, Borrelia burgdorferi B31
SKVKLTVS

SEQ ID NO: 161331 - protein, 8 aa, Borrelia burgdorferi B31
KVKLTVSA

SEQ ID NO: 161332 - protein, 8 aa, Borrelia burgdorferi B31
VKLTVSAD

SEQ ID NO: 161333 - protein, 8 aa, Borrelia burgdorferi B31
KLTVSADL

SEQ ID NO: 161334 - protein, 8 aa, Borrelia burgdorferi B31
LTVSADLN

SEQ ID NO: 161335 - protein, 8 aa, Borrelia burgdorferi B31
TVSADLNT

SEQ ID NO: 161336 - protein, 8 aa, Borrelia burgdorferi B31
VSADLNTV

SEQ ID NO: 161337 - protein, 8 aa, Borrelia burgdorferi B31
SADLNTVT

SEQ ID NO: 161338 - protein, 8 aa, Borrelia burgdorferi B31
ADLNTVTL

SEQ ID NO: 161339 - protein, 8 aa, Borrelia burgdorferi B31
DLNTVTLE

SEQ ID NO: 161340 - protein, 8 aa, Borrelia burgdorferi B31
LNTVTLEA

SEQ ID NO: 161341 - protein, 8 aa, Borrelia burgdorferi B31
NTVTLEAF

SEQ ID NO: 161342 - protein, 8 aa, Borrelia burgdorferi B31
TVTLEAFD

SEQ ID NO: 161343 - protein, 8 aa, Borrelia burgdorferi B31
VTLEAFDA

SEQ ID NO: 161344 - protein, 8 aa, Borrelia burgdorferi B31
TLEAFDAS

SEQ ID NO: 161345 - protein, 8 aa, Borrelia burgdorferi B31
LEAFDASN

SEQ ID NO: 161346 - protein, 8 aa, Borrelia burgdorferi B31
EAFDASNQ

SEQ ID NO: 161347 - protein, 8 aa, Borrelia burgdorferi B31
AFDASNQK

SEQ ID NO: 161348 - protein, 8 aa, Borrelia burgdorferi B31
FDASNQKI

SEQ ID NO: 161349 - protein, 8 aa, Borrelia burgdorferi B31
DASNQKIS

SEQ ID NO: 161350 - protein, 8 aa, Borrelia burgdorferi B31
ASNQKISS

SEQ ID NO: 161351 - protein, 8 aa, Borrelia burgdorferi B31
SNQKISSK

SEQ ID NO: 161352 - protein, 8 aa, Borrelia burgdorferi B31
NQKISSKV

SEQ ID NO: 161353 - protein, 8 aa, Borrelia burgdorferi B31
QKISSKVT

SEQ ID NO: 161354 - protein, 8 aa, Borrelia burgdorferi B31
KISSKVTK

SEQ ID NO: 161355 - protein, 8 aa, Borrelia burgdorferi B31
ISSKVTKK

SEQ ID NO: 161356 - protein, 8 aa, Borrelia burgdorferi B31
SSKVTKKQ

SEQ ID NO: 161357 - protein, 8 aa, Borrelia burgdorferi B31
SKVTKKQG

SEQ ID NO: 161358 - protein, 8 aa, Borrelia burgdorferi B31
KVTKKQGS

SEQ ID NO: 161359 - protein, 8 aa, Borrelia burgdorferi B31
VTKKQGSI

SEQ ID NO: 161360 - protein, 8 aa, Borrelia burgdorferi B31
TKKQGSIT

SEQ ID NO: 161361 - protein, 8 aa, Borrelia burgdorferi B31
  Xaa can be any naturally occurring amino acid
  VARIANT 8: Xaa = Any Amino Acid
KKQGSITX

SEQ ID NO: 161362 - protein, 8 aa, Borrelia burgdorferi B31
  Xaa can be any naturally occurring amino acid
  VARIANT 7: Xaa = Any Amino Acid
KQGSITXE

SEQ ID NO: 161363 - protein, 8 aa, Borrelia burgdorferi B31
  Xaa can be any naturally occurring amino acid
  VARIANT 6: Xaa = Any Amino Acid
QGSITXET

SEQ ID NO: 161364 - protein, 8 aa, Borrelia burgdorferi B31
  Xaa can be any naturally occurring amino acid
  VARIANT 5: Xaa = Any Amino Acid
GSITXETL

SEQ ID NO: 161365 - protein, 8 aa, Borrelia burgdorferi B31
  Xaa can be any naturally occurring amino acid
  VARIANT 4: Xaa = Any Amino Acid
SITXETLK

SEQ ID NO: 161366 - protein, 8 aa, Borrelia burgdorferi B31
  Xaa can be any naturally occurring amino acid
  VARIANT 3: Xaa = Any Amino Acid
ITXETLKA

SEQ ID NO: 161367 - protein, 8 aa, Borrelia burgdorferi B31
  Xaa can be any naturally occurring amino acid
  VARIANT 2: Xaa = Any Amino Acid
TXETLKAN

SEQ ID NO: 161368 - protein, 8 aa, Borrelia burgdorferi B31
  Xaa can be any naturally occurring amino acid
  VARIANT 1: Xaa = Any Amino Acid
XETLKANK

SEQ ID NO: 161369 - protein, 8 aa, Borrelia burgdorferi B31
ETLKANKL

SEQ ID NO: 161370 - protein, 8 aa, Borrelia burgdorferi B31
TLKANKLD

SEQ ID NO: 161371 - protein, 8 aa, Borrelia burgdorferi B31
LKANKLDS

SEQ ID NO: 161372 - protein, 8 aa, Borrelia burgdorferi B31
KANKLDSK

SEQ ID NO: 161373 - protein, 8 aa, Borrelia burgdorferi B31
ANKLDSKK

SEQ ID NO: 161374 - protein, 8 aa, Borrelia burgdorferi B31
NKLDSKKL

SEQ ID NO: 161375 - protein, 8 aa, Borrelia burgdorferi B31
KLDSKKLT

SEQ ID NO: 161376 - protein, 8 aa, Borrelia burgdorferi B31
LDSKKLTR

SEQ ID NO: 161377 - protein, 8 aa, Borrelia burgdorferi B31
DSKKLTRS

SEQ ID NO: 161378 - protein, 8 aa, Borrelia burgdorferi B31
SKKLTRSN

SEQ ID NO: 161379 - protein, 8 aa, Borrelia burgdorferi B31
KKLTRSNG

SEQ ID NO: 161380 - protein, 8 aa, Borrelia burgdorferi B31
KLTRSNGT

SEQ ID NO: 161381 - protein, 8 aa, Borrelia burgdorferi B31
LTRSNGTT

SEQ ID NO: 161382 - protein, 8 aa, Borrelia burgdorferi B31
TRSNGTTL

SEQ ID NO: 161383 - protein, 8 aa, Borrelia burgdorferi B31
RSNGTTLE

SEQ ID NO: 161384 - protein, 8 aa, Borrelia burgdorferi B31
SNGTTLEY

SEQ ID NO: 161385 - protein, 8 aa, Borrelia burgdorferi B31
NGTTLEYS

SEQ ID NO: 161386 - protein, 8 aa, Borrelia burgdorferi B31
GTTLEYSQ

SEQ ID NO: 161387 - protein, 8 aa, Borrelia burgdorferi B31
TTLEYSQI

SEQ ID NO: 161388 - protein, 8 aa, Borrelia burgdorferi B31
TLEYSQIT

SEQ ID NO: 161389 - protein, 8 aa, Borrelia burgdorferi B31
LEYSQITD

SEQ ID NO: 161390 - protein, 8 aa, Borrelia burgdorferi B31
EYSQITDA

SEQ ID NO: 161391 - protein, 8 aa, Borrelia burgdorferi B31
YSQITDAD

SEQ ID NO: 161392 - protein, 8 aa, Borrelia burgdorferi B31
SQITDADN

SEQ ID NO: 161393 - protein, 8 aa, Borrelia burgdorferi B31
QITDADNA

SEQ ID NO: 161394 - protein, 8 aa, Borrelia burgdorferi B31
ITDADNAT

SEQ ID NO: 161395 - protein, 8 aa, Borrelia burgdorferi B31
TDADNATK

SEQ ID NO: 161396 - protein, 8 aa, Borrelia burgdorferi B31
DADNATKA

SEQ ID NO: 161397 - protein, 8 aa, Borrelia burgdorferi B31
ADNATKAV

SEQ ID NO: 161398 - protein, 8 aa, Borrelia burgdorferi B31
DNATKAVE

SEQ ID NO: 161399 - protein, 8 aa, Borrelia burgdorferi B31
NATKAVET

SEQ ID NO: 161400 - protein, 8 aa, Borrelia burgdorferi B31
ATKAVETL

SEQ ID NO: 161401 - protein, 8 aa, Borrelia burgdorferi B31
TKAVETLK

SEQ ID NO: 161402 - protein, 8 aa, Borrelia burgdorferi B31
KAVETLKN

SEQ ID NO: 161403 - protein, 8 aa, Borrelia burgdorferi B31
AVETLKNS

SEQ ID NO: 161404 - protein, 8 aa, Borrelia burgdorferi B31
VETLKNSI

SEQ ID NO: 161405 - protein, 8 aa, Borrelia burgdorferi B31
ETLKNSIK

SEQ ID NO: 161406 - protein, 8 aa, Borrelia burgdorferi B31
TLKNSIKL

SEQ ID NO: 161407 - protein, 8 aa, Borrelia burgdorferi B31
LKNSIKLE

SEQ ID NO: 161408 - protein, 8 aa, Borrelia burgdorferi B31
KNSIKLEG

SEQ ID NO: 161409 - protein, 8 aa, Borrelia burgdorferi B31
NSIKLEGS

SEQ ID NO: 161410 - protein, 8 aa, Borrelia burgdorferi B31
SIKLEGSL

SEQ ID NO: 161411 - protein, 8 aa, Borrelia burgdorferi B31
IKLEGSLV

SEQ ID NO: 161412 - protein, 8 aa, Borrelia burgdorferi B31
KLEGSLVG

SEQ ID NO: 161413 - protein, 8 aa, Borrelia burgdorferi B31
LEGSLVGG

SEQ ID NO: 161414 - protein, 8 aa, Borrelia burgdorferi B31
EGSLVGGK

SEQ ID NO: 161415 - protein, 8 aa, Borrelia burgdorferi B31
GSLVGGKT

SEQ ID NO: 161416 - protein, 8 aa, Borrelia burgdorferi B31
SLVGGKTT

SEQ ID NO: 161417 - protein, 8 aa, Borrelia burgdorferi B31
LVGGKTTV

SEQ ID NO: 161418 - protein, 8 aa, Borrelia burgdorferi B31
VGGKTTVE

SEQ ID NO: 161419 - protein, 8 aa, Borrelia burgdorferi B31
GGKTTVEI

SEQ ID NO: 161420 - protein, 8 aa, Borrelia burgdorferi B31
GKTTVEIK

SEQ ID NO: 161421 - protein, 8 aa, Borrelia burgdorferi B31
KTTVEIKE

SEQ ID NO: 161422 - protein, 8 aa, Borrelia burgdorferi B31
TTVEIKEG

SEQ ID NO: 161423 - protein, 8 aa, Borrelia burgdorferi B31
TVEIKEGT

SEQ ID NO: 161424 - protein, 8 aa, Borrelia burgdorferi B31
VEIKEGTV

SEQ ID NO: 161425 - protein, 8 aa, Borrelia burgdorferi B31
EIKEGTVT

SEQ ID NO: 161426 - protein, 8 aa, Borrelia burgdorferi B31
IKEGTVTL

SEQ ID NO: 161427 - protein, 8 aa, Borrelia burgdorferi B31
KEGTVTLK

SEQ ID NO: 161428 - protein, 8 aa, Borrelia burgdorferi B31
EGTVTLKR

SEQ ID NO: 161429 - protein, 8 aa, Borrelia burgdorferi B31
GTVTLKRE

SEQ ID NO: 161430 - protein, 8 aa, Borrelia burgdorferi B31
TVTLKREI

SEQ ID NO: 161431 - protein, 8 aa, Borrelia burgdorferi B31
VTLKREIE

SEQ ID NO: 161432 - protein, 8 aa, Borrelia burgdorferi B31
TLKREIEK

SEQ ID NO: 161433 - protein, 8 aa, Borrelia burgdorferi B31
LKREIEKD

SEQ ID NO: 161434 - protein, 8 aa, Borrelia burgdorferi B31
KREIEKDG

SEQ ID NO: 161435 - protein, 8 aa, Borrelia burgdorferi B31
REIEKDGK

SEQ ID NO: 161436 - protein, 8 aa, Borrelia burgdorferi B31
EIEKDGKV

SEQ ID NO: 161437 - protein, 8 aa, Borrelia burgdorferi B31
IEKDGKVK

SEQ ID NO: 161438 - protein, 8 aa, Borrelia burgdorferi B31
EKDGKVKV

SEQ ID NO: 161439 - protein, 8 aa, Borrelia burgdorferi B31
KDGKVKVF

SEQ ID NO: 161440 - protein, 8 aa, Borrelia burgdorferi B31
DGKVKVFL

SEQ ID NO: 161441 - protein, 8 aa, Borrelia burgdorferi B31
GKVKVFLN

SEQ ID NO: 161442 - protein, 8 aa, Borrelia burgdorferi B31
KVKVFLND

SEQ ID NO: 161443 - protein, 8 aa, Borrelia burgdorferi B31
VKVFLNDT

SEQ ID NO: 161444 - protein, 8 aa, Borrelia burgdorferi B31
KVFLNDTA

SEQ ID NO: 161445 - protein, 8 aa, Borrelia burgdorferi B31
VFLNDTAG

SEQ ID NO: 161446 - protein, 8 aa, Borrelia burgdorferi B31
FLNDTAGS

SEQ ID NO: 161447 - protein, 8 aa, Borrelia burgdorferi B31
LNDTAGSN

SEQ ID NO: 161448 - protein, 8 aa, Borrelia burgdorferi B31
NDTAGSNK

SEQ ID NO: 161449 - protein, 8 aa, Borrelia burgdorferi B31
DTAGSNKK

SEQ ID NO: 161450 - protein, 8 aa, Borrelia burgdorferi B31
TAGSNKKT

SEQ ID NO: 161451 - protein, 8 aa, Borrelia burgdorferi B31
AGSNKKTG

SEQ ID NO: 161452 - protein, 8 aa, Borrelia burgdorferi B31
GSNKKTGK

SEQ ID NO: 161453 - protein, 8 aa, Borrelia burgdorferi B31
SNKKTGKW

SEQ ID NO: 161454 - protein, 8 aa, Borrelia burgdorferi B31
NKKTGKWE

SEQ ID NO: 161455 - protein, 8 aa, Borrelia burgdorferi B31
KKTGKWED

SEQ ID NO: 161456 - protein, 8 aa, Borrelia burgdorferi B31
KTGKWEDS

SEQ ID NO: 161457 - protein, 8 aa, Borrelia burgdorferi B31
TGKWEDST

SEQ ID NO: 161458 - protein, 8 aa, Borrelia burgdorferi B31
GKWEDSTS

SEQ ID NO: 161459 - protein, 8 aa, Borrelia burgdorferi B31
KWEDSTST

SEQ ID NO: 161460 - protein, 8 aa, Borrelia burgdorferi B31
WEDSTSTL

SEQ ID NO: 161461 - protein, 8 aa, Borrelia burgdorferi B31
EDSTSTLT

SEQ ID NO: 161462 - protein, 8 aa, Borrelia burgdorferi B31
DSTSTLTI

SEQ ID NO: 161463 - protein, 8 aa, Borrelia burgdorferi B31
STSTLTIS

SEQ ID NO: 161464 - protein, 8 aa, Borrelia burgdorferi B31
TSTLTISA

SEQ ID NO: 161465 - protein, 8 aa, Borrelia burgdorferi B31
STLTISAD

SEQ ID NO: 161466 - protein, 8 aa, Borrelia burgdorferi B31
TLTISADS

SEQ ID NO: 161467 - protein, 8 aa, Borrelia burgdorferi B31
LTISADSK

SEQ ID NO: 161468 - protein, 8 aa, Borrelia burgdorferi B31
TISADSKK

SEQ ID NO: 161469 - protein, 8 aa, Borrelia burgdorferi B31
ISADSKKT

SEQ ID NO: 161470 - protein, 8 aa, Borrelia burgdorferi B31
SADSKKTK

SEQ ID NO: 161471 - protein, 8 aa, Borrelia burgdorferi B31
ADSKKTKD

SEQ ID NO: 161472 - protein, 8 aa, Borrelia burgdorferi B31
DSKKTKDL

SEQ ID NO: 161473 - protein, 8 aa, Borrelia burgdorferi B31
SKKTKDLV

SEQ ID NO: 161474 - protein, 8 aa, Borrelia burgdorferi B31
KKTKDLVF

SEQ ID NO: 161475 - protein, 8 aa, Borrelia burgdorferi B31
KTKDLVFL

SEQ ID NO: 161476 - protein, 8 aa, Borrelia burgdorferi B31
TKDLVFLT

SEQ ID NO: 161477 - protein, 8 aa, Borrelia burgdorferi B31
KDLVFLTD

SEQ ID NO: 161478 - protein, 8 aa, Borrelia burgdorferi B31
DLVFLTDG

SEQ ID NO: 161479 - protein, 8 aa, Borrelia burgdorferi B31
LVFLTDGT

SEQ ID NO: 161480 - protein, 8 aa, Borrelia burgdorferi B31
VFLTDGTI

SEQ ID NO: 161481 - protein, 8 aa, Borrelia burgdorferi B31
FLTDGTIT

SEQ ID NO: 161482 - protein, 8 aa, Borrelia burgdorferi B31
LTDGTITV

SEQ ID NO: 161483 - protein, 8 aa, Borrelia burgdorferi B31
TDGTITVQ

SEQ ID NO: 161484 - protein, 8 aa, Borrelia burgdorferi B31
DGTITVQQ

SEQ ID NO: 161485 - protein, 8 aa, Borrelia burgdorferi B31
GTITVQQY

SEQ ID NO: 161486 - protein, 8 aa, Borrelia burgdorferi B31
TITVQQYN

SEQ ID NO: 161487 - protein, 8 aa, Borrelia burgdorferi B31
ITVQQYNT

SEQ ID NO: 161488 - protein, 8 aa, Borrelia burgdorferi B31
TVQQYNTA

SEQ ID NO: 161489 - protein, 8 aa, Borrelia burgdorferi B31
VQQYNTAG

SEQ ID NO: 161490 - protein, 8 aa, Borrelia burgdorferi B31
QQYNTAGT

SEQ ID NO: 161491 - protein, 8 aa, Borrelia burgdorferi B31
QYNTAGTS

SEQ ID NO: 161492 - protein, 8 aa, Borrelia burgdorferi B31
YNTAGTSL

SEQ ID NO: 161493 - protein, 8 aa, Borrelia burgdorferi B31
NTAGTSLE

SEQ ID NO: 161494 - protein, 8 aa, Borrelia burgdorferi B31
TAGTSLEG

SEQ ID NO: 161495 - protein, 8 aa, Borrelia burgdorferi B31
AGTSLEGS

SEQ ID NO: 161496 - protein, 8 aa, Borrelia burgdorferi B31
GTSLEGSA

SEQ ID NO: 161497 - protein, 8 aa, Borrelia burgdorferi B31
TSLEGSAS

SEQ ID NO: 161498 - protein, 8 aa, Borrelia burgdorferi B31
SLEGSASE

SEQ ID NO: 161499 - protein, 8 aa, Borrelia burgdorferi B31
LEGSASEI

SEQ ID NO: 161500 - protein, 8 aa, Borrelia burgdorferi B31
EGSASEIK

SEQ ID NO: 161501 - protein, 8 aa, Borrelia burgdorferi B31
GSASEIKN

SEQ ID NO: 161502 - protein, 8 aa, Borrelia burgdorferi B31
SASEIKNL

SEQ ID NO: 161503 - protein, 8 aa, Borrelia burgdorferi B31
ASEIKNLS

SEQ ID NO: 161504 - protein, 8 aa, Borrelia burgdorferi B31
SEIKNLSE

SEQ ID NO: 161505 - protein, 8 aa, Borrelia burgdorferi B31
EIKNLSEL

SEQ ID NO: 161506 - protein, 8 aa, Borrelia burgdorferi B31
IKNLSELK

SEQ ID NO: 161507 - protein, 8 aa, Borrelia burgdorferi B31
KNLSELKN

SEQ ID NO: 161508 - protein, 8 aa, Borrelia burgdorferi B31
NLSELKNA

SEQ ID NO: 161509 - protein, 8 aa, Borrelia burgdorferi B31
LSELKNAL

SEQ ID NO: 161510 - protein, 8 aa, Borrelia burgdorferi B31
SELKNALK

SEQ ID NO: 161511 - protein, 9 aa, Borrelia burgdorferi B31
MRLLIGFAL

SEQ ID NO: 161512 - protein, 9 aa, Borrelia burgdorferi B31
RLLIGFALA

SEQ ID NO: 161513 - protein, 9 aa, Borrelia burgdorferi B31
LLIGFALAL

SEQ ID NO: 161514 - protein, 9 aa, Borrelia burgdorferi B31
LIGFALALA

SEQ ID NO: 161515 - protein, 9 aa, Borrelia burgdorferi B31
IGFALALAL

SEQ ID NO: 161516 - protein, 9 aa, Borrelia burgdorferi B31
GFALALALI

SEQ ID NO: 161517 - protein, 9 aa, Borrelia burgdorferi B31
FALALALIG

SEQ ID NO: 161518 - protein, 9 aa, Borrelia burgdorferi B31
ALALALIGC

SEQ ID NO: 161519 - protein, 9 aa, Borrelia burgdorferi B31
LALALIGCA

SEQ ID NO: 161520 - protein, 9 aa, Borrelia burgdorferi B31
ALALIGCAQ

SEQ ID NO: 161521 - protein, 9 aa, Borrelia burgdorferi B31
LALIGCAQK

SEQ ID NO: 161522 - protein, 9 aa, Borrelia burgdorferi B31
ALIGCAQKG

SEQ ID NO: 161523 - protein, 9 aa, Borrelia burgdorferi B31
LIGCAQKGA

SEQ ID NO: 161524 - protein, 9 aa, Borrelia burgdorferi B31
IGCAQKGAE

SEQ ID NO: 161525 - protein, 9 aa, Borrelia burgdorferi B31
GCAQKGAES

SEQ ID NO: 161526 - protein, 9 aa, Borrelia burgdorferi B31
CAQKGAESI

SEQ ID NO: 161527 - protein, 9 aa, Borrelia burgdorferi B31
AQKGAESIG

SEQ ID NO: 161528 - protein, 9 aa, Borrelia burgdorferi B31
QKGAESIGS

SEQ ID NO: 161529 - protein, 9 aa, Borrelia burgdorferi B31
KGAESIGSQ

SEQ ID NO: 161530 - protein, 9 aa, Borrelia burgdorferi B31
GAESIGSQK

SEQ ID NO: 161531 - protein, 9 aa, Borrelia burgdorferi B31
AESIGSQKE

SEQ ID NO: 161532 - protein, 9 aa, Borrelia burgdorferi B31
ESIGSQKEN

SEQ ID NO: 161533 - protein, 9 aa, Borrelia burgdorferi B31
SIGSQKEND

SEQ ID NO: 161534 - protein, 9 aa, Borrelia burgdorferi B31
IGSQKENDL

SEQ ID NO: 161535 - protein, 9 aa, Borrelia burgdorferi B31
GSQKENDLN

SEQ ID NO: 161536 - protein, 9 aa, Borrelia burgdorferi B31
SQKENDLNL

SEQ ID NO: 161537 - protein, 9 aa, Borrelia burgdorferi B31
QKENDLNLE

SEQ ID NO: 161538 - protein, 9 aa, Borrelia burgdorferi B31
KENDLNLED

SEQ ID NO: 161539 - protein, 9 aa, Borrelia burgdorferi B31
ENDLNLEDS

SEQ ID NO: 161540 - protein, 9 aa, Borrelia burgdorferi B31
NDLNLEDSS

SEQ ID NO: 161541 - protein, 9 aa, Borrelia burgdorferi B31
DLNLEDSSK

SEQ ID NO: 161542 - protein, 9 aa, Borrelia burgdorferi B31
LNLEDSSKK

SEQ ID NO: 161543 - protein, 9 aa, Borrelia burgdorferi B31
NLEDSSKKS

SEQ ID NO: 161544 - protein, 9 aa, Borrelia burgdorferi B31
LEDSSKKSH

SEQ ID NO: 161545 - protein, 9 aa, Borrelia burgdorferi B31
EDSSKKSHQ

SEQ ID NO: 161546 - protein, 9 aa, Borrelia burgdorferi B31
DSSKKSHQN

SEQ ID NO: 161547 - protein, 9 aa, Borrelia burgdorferi B31
SSKKSHQNA

SEQ ID NO: 161548 - protein, 9 aa, Borrelia burgdorferi B31
SKKSHQNAK

SEQ ID NO: 161549 - protein, 9 aa, Borrelia burgdorferi B31
KKSHQNAKQ

SEQ ID NO: 161550 - protein, 9 aa, Borrelia burgdorferi B31
KSHQNAKQD

SEQ ID NO: 161551 - protein, 9 aa, Borrelia burgdorferi B31
SHQNAKQDL

SEQ ID NO: 161552 - protein, 9 aa, Borrelia burgdorferi B31
HQNAKQDLP

SEQ ID NO: 161553 - protein, 9 aa, Borrelia burgdorferi B31
QNAKQDLPA

SEQ ID NO: 161554 - protein, 9 aa, Borrelia burgdorferi B31
NAKQDLPAV

SEQ ID NO: 161555 - protein, 9 aa, Borrelia burgdorferi B31
AKQDLPAVT

SEQ ID NO: 161556 - protein, 9 aa, Borrelia burgdorferi B31
KQDLPAVTE

SEQ ID NO: 161557 - protein, 9 aa, Borrelia burgdorferi B31
QDLPAVTED

SEQ ID NO: 161558 - protein, 9 aa, Borrelia burgdorferi B31
DLPAVTEDS

SEQ ID NO: 161559 - protein, 9 aa, Borrelia burgdorferi B31
LPAVTEDSV

SEQ ID NO: 161560 - protein, 9 aa, Borrelia burgdorferi B31
PAVTEDSVS

SEQ ID NO: 161561 - protein, 9 aa, Borrelia burgdorferi B31
AVTEDSVSL

SEQ ID NO: 161562 - protein, 9 aa, Borrelia burgdorferi B31
VTEDSVSLF

SEQ ID NO: 161563 - protein, 9 aa, Borrelia burgdorferi B31
TEDSVSLFN

SEQ ID NO: 161564 - protein, 9 aa, Borrelia burgdorferi B31
EDSVSLFNG

SEQ ID NO: 161565 - protein, 9 aa, Borrelia burgdorferi B31
DSVSLFNGN

SEQ ID NO: 161566 - protein, 9 aa, Borrelia burgdorferi B31
SVSLFNGNK

SEQ ID NO: 161567 - protein, 9 aa, Borrelia burgdorferi B31
VSLFNGNKI

SEQ ID NO: 161568 - protein, 9 aa, Borrelia burgdorferi B31
SLFNGNKIF

SEQ ID NO: 161569 - protein, 9 aa, Borrelia burgdorferi B31
LFNGNKIFV

SEQ ID NO: 161570 - protein, 9 aa, Borrelia burgdorferi B31
FNGNKIFVS

SEQ ID NO: 161571 - protein, 9 aa, Borrelia burgdorferi B31
NGNKIFVSK

SEQ ID NO: 161572 - protein, 9 aa, Borrelia burgdorferi B31
GNKIFVSKE

SEQ ID NO: 161573 - protein, 9 aa, Borrelia burgdorferi B31
NKIFVSKEK

SEQ ID NO: 161574 - protein, 9 aa, Borrelia burgdorferi B31
KIFVSKEKN

SEQ ID NO: 161575 - protein, 9 aa, Borrelia burgdorferi B31
IFVSKEKNS

SEQ ID NO: 161576 - protein, 9 aa, Borrelia burgdorferi B31
FVSKEKNSS

SEQ ID NO: 161577 - protein, 9 aa, Borrelia burgdorferi B31
VSKEKNSSG

SEQ ID NO: 161578 - protein, 9 aa, Borrelia burgdorferi B31
SKEKNSSGK

SEQ ID NO: 161579 - protein, 9 aa, Borrelia burgdorferi B31
KEKNSSGKY

SEQ ID NO: 161580 - protein, 9 aa, Borrelia burgdorferi B31
EKNSSGKYD

SEQ ID NO: 161581 - protein, 9 aa, Borrelia burgdorferi B31
KNSSGKYDL

SEQ ID NO: 161582 - protein, 9 aa, Borrelia burgdorferi B31
NSSGKYDLR

SEQ ID NO: 161583 - protein, 9 aa, Borrelia burgdorferi B31
SSGKYDLRA

SEQ ID NO: 161584 - protein, 9 aa, Borrelia burgdorferi B31
SGKYDLRAT

SEQ ID NO: 161585 - protein, 9 aa, Borrelia burgdorferi B31
GKYDLRATI

SEQ ID NO: 161586 - protein, 9 aa, Borrelia burgdorferi B31
KYDLRATID

SEQ ID NO: 161587 - protein, 9 aa, Borrelia burgdorferi B31
YDLRATIDQ

SEQ ID NO: 161588 - protein, 9 aa, Borrelia burgdorferi B31
DLRATIDQV

SEQ ID NO: 161589 - protein, 9 aa, Borrelia burgdorferi B31
LRATIDQVE

SEQ ID NO: 161590 - protein, 9 aa, Borrelia burgdorferi B31
RATIDQVEL

SEQ ID NO: 161591 - protein, 9 aa, Borrelia burgdorferi B31
ATIDQVELK

SEQ ID NO: 161592 - protein, 9 aa, Borrelia burgdorferi B31
TIDQVELKG

SEQ ID NO: 161593 - protein, 9 aa, Borrelia burgdorferi B31
IDQVELKGT

SEQ ID NO: 161594 - protein, 9 aa, Borrelia burgdorferi B31
DQVELKGTS

SEQ ID NO: 161595 - protein, 9 aa, Borrelia burgdorferi B31
QVELKGTSD

SEQ ID NO: 161596 - protein, 9 aa, Borrelia burgdorferi B31
VELKGTSDK

SEQ ID NO: 161597 - protein, 9 aa, Borrelia burgdorferi B31
ELKGTSDKN

SEQ ID NO: 161598 - protein, 9 aa, Borrelia burgdorferi B31
LKGTSDKNN

SEQ ID NO: 161599 - protein, 9 aa, Borrelia burgdorferi B31
KGTSDKNNG

SEQ ID NO: 161600 - protein, 9 aa, Borrelia burgdorferi B31
GTSDKNNGS

SEQ ID NO: 161601 - protein, 9 aa, Borrelia burgdorferi B31
TSDKNNGSG

SEQ ID NO: 161602 - protein, 9 aa, Borrelia burgdorferi B31
SDKNNGSGT

SEQ ID NO: 161603 - protein, 9 aa, Borrelia burgdorferi B31
DKNNGSGTL

SEQ ID NO: 161604 - protein, 9 aa, Borrelia burgdorferi B31
KNNGSGTLE

SEQ ID NO: 161605 - protein, 9 aa, Borrelia burgdorferi B31
NNGSGTLEG

SEQ ID NO: 161606 - protein, 9 aa, Borrelia burgdorferi B31
NGSGTLEGS

SEQ ID NO: 161607 - protein, 9 aa, Borrelia burgdorferi B31
GSGTLEGSK

SEQ ID NO: 161608 - protein, 9 aa, Borrelia burgdorferi B31
SGTLEGSKP

SEQ ID NO: 161609 - protein, 9 aa, Borrelia burgdorferi B31
GTLEGSKPD

SEQ ID NO: 161610 - protein, 9 aa, Borrelia burgdorferi B31
TLEGSKPDK

SEQ ID NO: 161611 - protein, 9 aa, Borrelia burgdorferi B31
LEGSKPDKS

SEQ ID NO: 161612 - protein, 9 aa, Borrelia burgdorferi B31
EGSKPDKSK

SEQ ID NO: 161613 - protein, 9 aa, Borrelia burgdorferi B31
GSKPDKSKV

SEQ ID NO: 161614 - protein, 9 aa, Borrelia burgdorferi B31
SKPDKSKVK

SEQ ID NO: 161615 - protein, 9 aa, Borrelia burgdorferi B31
KPDKSKVKL

SEQ ID NO: 161616 - protein, 9 aa, Borrelia burgdorferi B31
PDKSKVKLT

SEQ ID NO: 161617 - protein, 9 aa, Borrelia burgdorferi B31
DKSKVKLTV

SEQ ID NO: 161618 - protein, 9 aa, Borrelia burgdorferi B31
KSKVKLTVS

SEQ ID NO: 161619 - protein, 9 aa, Borrelia burgdorferi B31
SKVKLTVSA

SEQ ID NO: 161620 - protein, 9 aa, Borrelia burgdorferi B31
KVKLTVSAD

SEQ ID NO: 161621 - protein, 9 aa, Borrelia burgdorferi B31
VKLTVSADL

SEQ ID NO: 161622 - protein, 9 aa, Borrelia burgdorferi B31
KLTVSADLN

SEQ ID NO: 161623 - protein, 9 aa, Borrelia burgdorferi B31
LTVSADLNT

SEQ ID NO: 161624 - protein, 9 aa, Borrelia burgdorferi B31
TVSADLNTV

SEQ ID NO: 161625 - protein, 9 aa, Borrelia burgdorferi B31
VSADLNTVT

SEQ ID NO: 161626 - protein, 9 aa, Borrelia burgdorferi B31
SADLNTVTL

SEQ ID NO: 161627 - protein, 9 aa, Borrelia burgdorferi B31
ADLNTVTLE

SEQ ID NO: 161628 - protein, 9 aa, Borrelia burgdorferi B31
DLNTVTLEA

SEQ ID NO: 161629 - protein, 9 aa, Borrelia burgdorferi B31
LNTVTLEAF

SEQ ID NO: 161630 - protein, 9 aa, Borrelia burgdorferi B31
NTVTLEAFD

SEQ ID NO: 161631 - protein, 9 aa, Borrelia burgdorferi B31
TVTLEAFDA

SEQ ID NO: 161632 - protein, 9 aa, Borrelia burgdorferi B31
VTLEAFDAS

SEQ ID NO: 161633 - protein, 9 aa, Borrelia burgdorferi B31
TLEAFDASN

SEQ ID NO: 161634 - protein, 9 aa, Borrelia burgdorferi B31
LEAFDASNQ

SEQ ID NO: 161635 - protein, 9 aa, Borrelia burgdorferi B31
EAFDASNQK

SEQ ID NO: 161636 - protein, 9 aa, Borrelia burgdorferi B31
AFDASNQKI

SEQ ID NO: 161637 - protein, 9 aa, Borrelia burgdorferi B31
FDASNQKIS

SEQ ID NO: 161638 - protein, 9 aa, Borrelia burgdorferi B31
DASNQKISS

SEQ ID NO: 161639 - protein, 9 aa, Borrelia burgdorferi B31
ASNQKISSK

SEQ ID NO: 161640 - protein, 9 aa, Borrelia burgdorferi B31
SNQKISSKV

SEQ ID NO: 161641 - protein, 9 aa, Borrelia burgdorferi B31
NQKISSKVT

SEQ ID NO: 161642 - protein, 9 aa, Borrelia burgdorferi B31
QKISSKVTK

SEQ ID NO: 161643 - protein, 9 aa, Borrelia burgdorferi B31
KISSKVTKK

SEQ ID NO: 161644 - protein, 9 aa, Borrelia burgdorferi B31
ISSKVTKKQ

SEQ ID NO: 161645 - protein, 9 aa, Borrelia burgdorferi B31
SSKVTKKQG

SEQ ID NO: 161646 - protein, 9 aa, Borrelia burgdorferi B31
SKVTKKQGS

SEQ ID NO: 161647 - protein, 9 aa, Borrelia burgdorferi B31
KVTKKQGSI

SEQ ID NO: 161648 - protein, 9 aa, Borrelia burgdorferi B31
VTKKQGSIT

SEQ ID NO: 161649 - protein, 9 aa, Borrelia burgdorferi B31
  Xaa can be any naturally occurring amino acid
  VARIANT 9: Xaa = Any Amino Acid
TKKQGSITX

SEQ ID NO: 161650 - protein, 9 aa, Borrelia burgdorferi B31
  Xaa can be any naturally occurring amino acid
  VARIANT 8: Xaa = Any Amino Acid
KKQGSITXE

SEQ ID NO: 161651 - protein, 9 aa, Borrelia burgdorferi B31
  Xaa can be any naturally occurring amino acid
  VARIANT 7: Xaa = Any Amino Acid
KQGSITXET

SEQ ID NO: 161652 - protein, 9 aa, Borrelia burgdorferi B31
  Xaa can be any naturally occurring amino acid
  VARIANT 6: Xaa = Any Amino Acid
QGSITXETL

SEQ ID NO: 161653 - protein, 9 aa, Borrelia burgdorferi B31
  Xaa can be any naturally occurring amino acid
  VARIANT 5: Xaa = Any Amino Acid
GSITXETLK

SEQ ID NO: 161654 - protein, 9 aa, Borrelia burgdorferi B31
  Xaa can be any naturally occurring amino acid
  VARIANT 4: Xaa = Any Amino Acid
SITXETLKA

SEQ ID NO: 161655 - protein, 9 aa, Borrelia burgdorferi B31
  Xaa can be any naturally occurring amino acid
  VARIANT 3: Xaa = Any Amino Acid
ITXETLKAN

SEQ ID NO: 161656 - protein, 9 aa, Borrelia burgdorferi B31
  Xaa can be any naturally occurring amino acid
  VARIANT 2: Xaa = Any Amino Acid
TXETLKANK

SEQ ID NO: 161657 - protein, 9 aa, Borrelia burgdorferi B31
  Xaa can be any naturally occurring amino acid
  VARIANT 1: Xaa = Any Amino Acid
XETLKANKL

SEQ ID NO: 161658 - protein, 9 aa, Borrelia burgdorferi B31
ETLKANKLD

SEQ ID NO: 161659 - protein, 9 aa, Borrelia burgdorferi B31
TLKANKLDS

SEQ ID NO: 161660 - protein, 9 aa, Borrelia burgdorferi B31
LKANKLDSK

SEQ ID NO: 161661 - protein, 9 aa, Borrelia burgdorferi B31
KANKLDSKK

SEQ ID NO: 161662 - protein, 9 aa, Borrelia burgdorferi B31
ANKLDSKKL

SEQ ID NO: 161663 - protein, 9 aa, Borrelia burgdorferi B31
NKLDSKKLT

SEQ ID NO: 161664 - protein, 9 aa, Borrelia burgdorferi B31
KLDSKKLTR

SEQ ID NO: 161665 - protein, 9 aa, Borrelia burgdorferi B31
LDSKKLTRS

SEQ ID NO: 161666 - protein, 9 aa, Borrelia burgdorferi B31
DSKKLTRSN

SEQ ID NO: 161667 - protein, 9 aa, Borrelia burgdorferi B31
SKKLTRSNG

SEQ ID NO: 161668 - protein, 9 aa, Borrelia burgdorferi B31
KKLTRSNGT

SEQ ID NO: 161669 - protein, 9 aa, Borrelia burgdorferi B31
KLTRSNGTT

SEQ ID NO: 161670 - protein, 9 aa, Borrelia burgdorferi B31
LTRSNGTTL

SEQ ID NO: 161671 - protein, 9 aa, Borrelia burgdorferi B31
TRSNGTTLE

SEQ ID NO: 161672 - protein, 9 aa, Borrelia burgdorferi B31
RSNGTTLEY

SEQ ID NO: 161673 - protein, 9 aa, Borrelia burgdorferi B31
SNGTTLEYS

SEQ ID NO: 161674 - protein, 9 aa, Borrelia burgdorferi B31
NGTTLEYSQ

SEQ ID NO: 161675 - protein, 9 aa, Borrelia burgdorferi B31
GTTLEYSQI

SEQ ID NO: 161676 - protein, 9 aa, Borrelia burgdorferi B31
TTLEYSQIT

SEQ ID NO: 161677 - protein, 9 aa, Borrelia burgdorferi B31
TLEYSQITD

SEQ ID NO: 161678 - protein, 9 aa, Borrelia burgdorferi B31
LEYSQITDA

SEQ ID NO: 161679 - protein, 9 aa, Borrelia burgdorferi B31
EYSQITDAD

SEQ ID NO: 161680 - protein, 9 aa, Borrelia burgdorferi B31
YSQITDADN

SEQ ID NO: 161681 - protein, 9 aa, Borrelia burgdorferi B31
SQITDADNA

SEQ ID NO: 161682 - protein, 9 aa, Borrelia burgdorferi B31
QITDADNAT

SEQ ID NO: 161683 - protein, 9 aa, Borrelia burgdorferi B31
ITDADNATK

SEQ ID NO: 161684 - protein, 9 aa, Borrelia burgdorferi B31
TDADNATKA

SEQ ID NO: 161685 - protein, 9 aa, Borrelia burgdorferi B31
DADNATKAV

SEQ ID NO: 161686 - protein, 9 aa, Borrelia burgdorferi B31
ADNATKAVE

SEQ ID NO: 161687 - protein, 9 aa, Borrelia burgdorferi B31
DNATKAVET

SEQ ID NO: 161688 - protein, 9 aa, Borrelia burgdorferi B31
NATKAVETL

SEQ ID NO: 161689 - protein, 9 aa, Borrelia burgdorferi B31
ATKAVETLK

SEQ ID NO: 161690 - protein, 9 aa, Borrelia burgdorferi B31
TKAVETLKN

SEQ ID NO: 161691 - protein, 9 aa, Borrelia burgdorferi B31
KAVETLKNS

SEQ ID NO: 161692 - protein, 9 aa, Borrelia burgdorferi B31
AVETLKNSI

SEQ ID NO: 161693 - protein, 9 aa, Borrelia burgdorferi B31
VETLKNSIK

SEQ ID NO: 161694 - protein, 9 aa, Borrelia burgdorferi B31
ETLKNSIKL

SEQ ID NO: 161695 - protein, 9 aa, Borrelia burgdorferi B31
TLKNSIKLE

SEQ ID NO: 161696 - protein, 9 aa, Borrelia burgdorferi B31
LKNSIKLEG

SEQ ID NO: 161697 - protein, 9 aa, Borrelia burgdorferi B31
KNSIKLEGS

SEQ ID NO: 161698 - protein, 9 aa, Borrelia burgdorferi B31
NSIKLEGSL

SEQ ID NO: 161699 - protein, 9 aa, Borrelia burgdorferi B31
SIKLEGSLV

SEQ ID NO: 161700 - protein, 9 aa, Borrelia burgdorferi B31
IKLEGSLVG

SEQ ID NO: 161701 - protein, 9 aa, Borrelia burgdorferi B31
KLEGSLVGG

SEQ ID NO: 161702 - protein, 9 aa, Borrelia burgdorferi B31
LEGSLVGGK

SEQ ID NO: 161703 - protein, 9 aa, Borrelia burgdorferi B31
EGSLVGGKT

SEQ ID NO: 161704 - protein, 9 aa, Borrelia burgdorferi B31
GSLVGGKTT

SEQ ID NO: 161705 - protein, 9 aa, Borrelia burgdorferi B31
SLVGGKTTV

SEQ ID NO: 161706 - protein, 9 aa, Borrelia burgdorferi B31
LVGGKTTVE

SEQ ID NO: 161707 - protein, 9 aa, Borrelia burgdorferi B31
VGGKTTVEI

SEQ ID NO: 161708 - protein, 9 aa, Borrelia burgdorferi B31
GGKTTVEIK

SEQ ID NO: 161709 - protein, 9 aa, Borrelia burgdorferi B31
GKTTVEIKE

SEQ ID NO: 161710 - protein, 9 aa, Borrelia burgdorferi B31
KTTVEIKEG

SEQ ID NO: 161711 - protein, 9 aa, Borrelia burgdorferi B31
TTVEIKEGT

SEQ ID NO: 161712 - protein, 9 aa, Borrelia burgdorferi B31
TVEIKEGTV

SEQ ID NO: 161713 - protein, 9 aa, Borrelia burgdorferi B31
VEIKEGTVT

SEQ ID NO: 161714 - protein, 9 aa, Borrelia burgdorferi B31
EIKEGTVTL

SEQ ID NO: 161715 - protein, 9 aa, Borrelia burgdorferi B31
IKEGTVTLK

SEQ ID NO: 161716 - protein, 9 aa, Borrelia burgdorferi B31
KEGTVTLKR

SEQ ID NO: 161717 - protein, 9 aa, Borrelia burgdorferi B31
EGTVTLKRE

SEQ ID NO: 161718 - protein, 9 aa, Borrelia burgdorferi B31
GTVTLKREI

SEQ ID NO: 161719 - protein, 9 aa, Borrelia burgdorferi B31
TVTLKREIE

SEQ ID NO: 161720 - protein, 9 aa, Borrelia burgdorferi B31
VTLKREIEK

SEQ ID NO: 161721 - protein, 9 aa, Borrelia burgdorferi B31
TLKREIEKD

SEQ ID NO: 161722 - protein, 9 aa, Borrelia burgdorferi B31
LKREIEKDG

SEQ ID NO: 161723 - protein, 9 aa, Borrelia burgdorferi B31
KREIEKDGK

SEQ ID NO: 161724 - protein, 9 aa, Borrelia burgdorferi B31
REIEKDGKV

SEQ ID NO: 161725 - protein, 9 aa, Borrelia burgdorferi B31
EIEKDGKVK

SEQ ID NO: 161726 - protein, 9 aa, Borrelia burgdorferi B31
IEKDGKVKV

SEQ ID NO: 161727 - protein, 9 aa, Borrelia burgdorferi B31
EKDGKVKVF

SEQ ID NO: 161728 - protein, 9 aa, Borrelia burgdorferi B31
KDGKVKVFL

SEQ ID NO: 161729 - protein, 9 aa, Borrelia burgdorferi B31
DGKVKVFLN

SEQ ID NO: 161730 - protein, 9 aa, Borrelia burgdorferi B31
GKVKVFLND

SEQ ID NO: 161731 - protein, 9 aa, Borrelia burgdorferi B31
KVKVFLNDT

SEQ ID NO: 161732 - protein, 9 aa, Borrelia burgdorferi B31
VKVFLNDTA

SEQ ID NO: 161733 - protein, 9 aa, Borrelia burgdorferi B31
KVFLNDTAG

SEQ ID NO: 161734 - protein, 9 aa, Borrelia burgdorferi B31
VFLNDTAGS

SEQ ID NO: 161735 - protein, 9 aa, Borrelia burgdorferi B31
FLNDTAGSN

SEQ ID NO: 161736 - protein, 9 aa, Borrelia burgdorferi B31
LNDTAGSNK

SEQ ID NO: 161737 - protein, 9 aa, Borrelia burgdorferi B31
NDTAGSNKK

SEQ ID NO: 161738 - protein, 9 aa, Borrelia burgdorferi B31
DTAGSNKKT

SEQ ID NO: 161739 - protein, 9 aa, Borrelia burgdorferi B31
TAGSNKKTG

SEQ ID NO: 161740 - protein, 9 aa, Borrelia burgdorferi B31
AGSNKKTGK

SEQ ID NO: 161741 - protein, 9 aa, Borrelia burgdorferi B31
GSNKKTGKW

SEQ ID NO: 161742 - protein, 9 aa, Borrelia burgdorferi B31
SNKKTGKWE

SEQ ID NO: 161743 - protein, 9 aa, Borrelia burgdorferi B31
NKKTGKWED

SEQ ID NO: 161744 - protein, 9 aa, Borrelia burgdorferi B31
KKTGKWEDS

SEQ ID NO: 161745 - protein, 9 aa, Borrelia burgdorferi B31
KTGKWEDST

SEQ ID NO: 161746 - protein, 9 aa, Borrelia burgdorferi B31
TGKWEDSTS

SEQ ID NO: 161747 - protein, 9 aa, Borrelia burgdorferi B31
GKWEDSTST

SEQ ID NO: 161748 - protein, 9 aa, Borrelia burgdorferi B31
KWEDSTSTL

SEQ ID NO: 161749 - protein, 9 aa, Borrelia burgdorferi B31
WEDSTSTLT

SEQ ID NO: 161750 - protein, 9 aa, Borrelia burgdorferi B31
EDSTSTLTI

SEQ ID NO: 161751 - protein, 9 aa, Borrelia burgdorferi B31
DSTSTLTIS

SEQ ID NO: 161752 - protein, 9 aa, Borrelia burgdorferi B31
STSTLTISA

SEQ ID NO: 161753 - protein, 9 aa, Borrelia burgdorferi B31
TSTLTISAD

SEQ ID NO: 161754 - protein, 9 aa, Borrelia burgdorferi B31
STLTISADS

SEQ ID NO: 161755 - protein, 9 aa, Borrelia burgdorferi B31
TLTISADSK

SEQ ID NO: 161756 - protein, 9 aa, Borrelia burgdorferi B31
LTISADSKK

SEQ ID NO: 161757 - protein, 9 aa, Borrelia burgdorferi B31
TISADSKKT

SEQ ID NO: 161758 - protein, 9 aa, Borrelia burgdorferi B31
ISADSKKTK

SEQ ID NO: 161759 - protein, 9 aa, Borrelia burgdorferi B31
SADSKKTKD

SEQ ID NO: 161760 - protein, 9 aa, Borrelia burgdorferi B31
ADSKKTKDL

SEQ ID NO: 161761 - protein, 9 aa, Borrelia burgdorferi B31
DSKKTKDLV

SEQ ID NO: 161762 - protein, 9 aa, Borrelia burgdorferi B31
SKKTKDLVF

SEQ ID NO: 161763 - protein, 9 aa, Borrelia burgdorferi B31
KKTKDLVFL

SEQ ID NO: 161764 - protein, 9 aa, Borrelia burgdorferi B31
KTKDLVFLT

SEQ ID NO: 161765 - protein, 9 aa, Borrelia burgdorferi B31
TKDLVFLTD

SEQ ID NO: 161766 - protein, 9 aa, Borrelia burgdorferi B31
KDLVFLTDG

SEQ ID NO: 161767 - protein, 9 aa, Borrelia burgdorferi B31
DLVFLTDGT

SEQ ID NO: 161768 - protein, 9 aa, Borrelia burgdorferi B31
LVFLTDGTI

SEQ ID NO: 161769 - protein, 9 aa, Borrelia burgdorferi B31
VFLTDGTIT

SEQ ID NO: 161770 - protein, 9 aa, Borrelia burgdorferi B31
FLTDGTITV

SEQ ID NO: 161771 - protein, 9 aa, Borrelia burgdorferi B31
LTDGTITVQ

SEQ ID NO: 161772 - protein, 9 aa, Borrelia burgdorferi B31
TDGTITVQQ

SEQ ID NO: 161773 - protein, 9 aa, Borrelia burgdorferi B31
DGTITVQQY

SEQ ID NO: 161774 - protein, 9 aa, Borrelia burgdorferi B31
GTITVQQYN

SEQ ID NO: 161775 - protein, 9 aa, Borrelia burgdorferi B31
TITVQQYNT

SEQ ID NO: 161776 - protein, 9 aa, Borrelia burgdorferi B31
ITVQQYNTA

SEQ ID NO: 161777 - protein, 9 aa, Borrelia burgdorferi B31
TVQQYNTAG

SEQ ID NO: 161778 - protein, 9 aa, Borrelia burgdorferi B31
VQQYNTAGT

SEQ ID NO: 161779 - protein, 9 aa, Borrelia burgdorferi B31
QQYNTAGTS

SEQ ID NO: 161780 - protein, 9 aa, Borrelia burgdorferi B31
QYNTAGTSL

SEQ ID NO: 161781 - protein, 9 aa, Borrelia burgdorferi B31
YNTAGTSLE

SEQ ID NO: 161782 - protein, 9 aa, Borrelia burgdorferi B31
NTAGTSLEG

SEQ ID NO: 161783 - protein, 9 aa, Borrelia burgdorferi B31
TAGTSLEGS

SEQ ID NO: 161784 - protein, 9 aa, Borrelia burgdorferi B31
AGTSLEGSA

SEQ ID NO: 161785 - protein, 9 aa, Borrelia burgdorferi B31
GTSLEGSAS

SEQ ID NO: 161786 - protein, 9 aa, Borrelia burgdorferi B31
TSLEGSASE

SEQ ID NO: 161787 - protein, 9 aa, Borrelia burgdorferi B31
SLEGSASEI

SEQ ID NO: 161788 - protein, 9 aa, Borrelia burgdorferi B31
LEGSASEIK

SEQ ID NO: 161789 - protein, 9 aa, Borrelia burgdorferi B31
EGSASEIKN

SEQ ID NO: 161790 - protein, 9 aa, Borrelia burgdorferi B31
GSASEIKNL

SEQ ID NO: 161791 - protein, 9 aa, Borrelia burgdorferi B31
SASEIKNLS

SEQ ID NO: 161792 - protein, 9 aa, Borrelia burgdorferi B31
ASEIKNLSE

SEQ ID NO: 161793 - protein, 9 aa, Borrelia burgdorferi B31
SEIKNLSEL

SEQ ID NO: 161794 - protein, 9 aa, Borrelia burgdorferi B31
EIKNLSELK

SEQ ID NO: 161795 - protein, 9 aa, Borrelia burgdorferi B31
IKNLSELKN

SEQ ID NO: 161796 - protein, 9 aa, Borrelia burgdorferi B31
KNLSELKNA

SEQ ID NO: 161797 - protein, 9 aa, Borrelia burgdorferi B31
NLSELKNAL

SEQ ID NO: 161798 - protein, 9 aa, Borrelia burgdorferi B31
LSELKNALK

SEQ ID NO: 161799 - protein, 10 aa, Borrelia burgdorferi B31
MRLLIGFALA

SEQ ID NO: 161800 - protein, 10 aa, Borrelia burgdorferi B31
RLLIGFALAL

SEQ ID NO: 161801 - protein, 10 aa, Borrelia burgdorferi B31
LLIGFALALA

SEQ ID NO: 161802 - protein, 10 aa, Borrelia burgdorferi B31
LIGFALALAL

SEQ ID NO: 161803 - protein, 10 aa, Borrelia burgdorferi B31
IGFALALALI

SEQ ID NO: 161804 - protein, 10 aa, Borrelia burgdorferi B31
GFALALALIG

SEQ ID NO: 161805 - protein, 10 aa, Borrelia burgdorferi B31
FALALALIGC

SEQ ID NO: 161806 - protein, 10 aa, Borrelia burgdorferi B31
ALALALIGCA

SEQ ID NO: 161807 - protein, 10 aa, Borrelia burgdorferi B31
LALALIGCAQ

SEQ ID NO: 161808 - protein, 10 aa, Borrelia burgdorferi B31
ALALIGCAQK

SEQ ID NO: 161809 - protein, 10 aa, Borrelia burgdorferi B31
LALIGCAQKG

SEQ ID NO: 161810 - protein, 10 aa, Borrelia burgdorferi B31
ALIGCAQKGA

SEQ ID NO: 161811 - protein, 10 aa, Borrelia burgdorferi B31
LIGCAQKGAE

SEQ ID NO: 161812 - protein, 10 aa, Borrelia burgdorferi B31
IGCAQKGAES

SEQ ID NO: 161813 - protein, 10 aa, Borrelia burgdorferi B31
GCAQKGAESI

SEQ ID NO: 161814 - protein, 10 aa, Borrelia burgdorferi B31
CAQKGAESIG

SEQ ID NO: 161815 - protein, 10 aa, Borrelia burgdorferi B31
AQKGAESIGS

SEQ ID NO: 161816 - protein, 10 aa, Borrelia burgdorferi B31
QKGAESIGSQ

SEQ ID NO: 161817 - protein, 10 aa, Borrelia burgdorferi B31
KGAESIGSQK

SEQ ID NO: 161818 - protein, 10 aa, Borrelia burgdorferi B31
GAESIGSQKE

SEQ ID NO: 161819 - protein, 10 aa, Borrelia burgdorferi B31
AESIGSQKEN

SEQ ID NO: 161820 - protein, 10 aa, Borrelia burgdorferi B31
ESIGSQKEND

SEQ ID NO: 161821 - protein, 10 aa, Borrelia burgdorferi B31
SIGSQKENDL

SEQ ID NO: 161822 - protein, 10 aa, Borrelia burgdorferi B31
IGSQKENDLN

SEQ ID NO: 161823 - protein, 10 aa, Borrelia burgdorferi B31
GSQKENDLNL

SEQ ID NO: 161824 - protein, 10 aa, Borrelia burgdorferi B31
SQKENDLNLE

SEQ ID NO: 161825 - protein, 10 aa, Borrelia burgdorferi B31
QKENDLNLED

SEQ ID NO: 161826 - protein, 10 aa, Borrelia burgdorferi B31
KENDLNLEDS

SEQ ID NO: 161827 - protein, 10 aa, Borrelia burgdorferi B31
ENDLNLEDSS

SEQ ID NO: 161828 - protein, 10 aa, Borrelia burgdorferi B31
NDLNLEDSSK

SEQ ID NO: 161829 - protein, 10 aa, Borrelia burgdorferi B31
DLNLEDSSKK

SEQ ID NO: 161830 - protein, 10 aa, Borrelia burgdorferi B31
LNLEDSSKKS

SEQ ID NO: 161831 - protein, 10 aa, Borrelia burgdorferi B31
NLEDSSKKSH

SEQ ID NO: 161832 - protein, 10 aa, Borrelia burgdorferi B31
LEDSSKKSHQ

SEQ ID NO: 161833 - protein, 10 aa, Borrelia burgdorferi B31
EDSSKKSHQN

SEQ ID NO: 161834 - protein, 10 aa, Borrelia burgdorferi B31
DSSKKSHQNA

SEQ ID NO: 161835 - protein, 10 aa, Borrelia burgdorferi B31
SSKKSHQNAK

SEQ ID NO: 161836 - protein, 10 aa, Borrelia burgdorferi B31
SKKSHQNAKQ

SEQ ID NO: 161837 - protein, 10 aa, Borrelia burgdorferi B31
KKSHQNAKQD

SEQ ID NO: 161838 - protein, 10 aa, Borrelia burgdorferi B31
KSHQNAKQDL

SEQ ID NO: 161839 - protein, 10 aa, Borrelia burgdorferi B31
SHQNAKQDLP

SEQ ID NO: 161840 - protein, 10 aa, Borrelia burgdorferi B31
HQNAKQDLPA

SEQ ID NO: 161841 - protein, 10 aa, Borrelia burgdorferi B31
QNAKQDLPAV

SEQ ID NO: 161842 - protein, 10 aa, Borrelia burgdorferi B31
NAKQDLPAVT

SEQ ID NO: 161843 - protein, 10 aa, Borrelia burgdorferi B31
AKQDLPAVTE

SEQ ID NO: 161844 - protein, 10 aa, Borrelia burgdorferi B31
KQDLPAVTED

SEQ ID NO: 161845 - protein, 10 aa, Borrelia burgdorferi B31
QDLPAVTEDS

SEQ ID NO: 161846 - protein, 10 aa, Borrelia burgdorferi B31
DLPAVTEDSV

SEQ ID NO: 161847 - protein, 10 aa, Borrelia burgdorferi B31
LPAVTEDSVS

SEQ ID NO: 161848 - protein, 10 aa, Borrelia burgdorferi B31
PAVTEDSVSL

SEQ ID NO: 161849 - protein, 10 aa, Borrelia burgdorferi B31
AVTEDSVSLF

SEQ ID NO: 161850 - protein, 10 aa, Borrelia burgdorferi B31
VTEDSVSLFN

SEQ ID NO: 161851 - protein, 10 aa, Borrelia burgdorferi B31
TEDSVSLFNG

SEQ ID NO: 161852 - protein, 10 aa, Borrelia burgdorferi B31
EDSVSLFNGN

SEQ ID NO: 161853 - protein, 10 aa, Borrelia burgdorferi B31
DSVSLFNGNK

SEQ ID NO: 161854 - protein, 10 aa, Borrelia burgdorferi B31
SVSLFNGNKI

SEQ ID NO: 161855 - protein, 10 aa, Borrelia burgdorferi B31
VSLFNGNKIF

SEQ ID NO: 161856 - protein, 10 aa, Borrelia burgdorferi B31
SLFNGNKIFV

SEQ ID NO: 161857 - protein, 10 aa, Borrelia burgdorferi B31
LFNGNKIFVS

SEQ ID NO: 161858 - protein, 10 aa, Borrelia burgdorferi B31
FNGNKIFVSK

SEQ ID NO: 161859 - protein, 10 aa, Borrelia burgdorferi B31
NGNKIFVSKE

SEQ ID NO: 161860 - protein, 10 aa, Borrelia burgdorferi B31
GNKIFVSKEK

SEQ ID NO: 161861 - protein, 10 aa, Borrelia burgdorferi B31
NKIFVSKEKN

SEQ ID NO: 161862 - protein, 10 aa, Borrelia burgdorferi B31
KIFVSKEKNS

SEQ ID NO: 161863 - protein, 10 aa, Borrelia burgdorferi B31
IFVSKEKNSS

SEQ ID NO: 161864 - protein, 10 aa, Borrelia burgdorferi B31
FVSKEKNSSG

SEQ ID NO: 161865 - protein, 10 aa, Borrelia burgdorferi B31
VSKEKNSSGK

SEQ ID NO: 161866 - protein, 10 aa, Borrelia burgdorferi B31
SKEKNSSGKY

SEQ ID NO: 161867 - protein, 10 aa, Borrelia burgdorferi B31
KEKNSSGKYD

SEQ ID NO: 161868 - protein, 10 aa, Borrelia burgdorferi B31
EKNSSGKYDL

SEQ ID NO: 161869 - protein, 10 aa, Borrelia burgdorferi B31
KNSSGKYDLR

SEQ ID NO: 161870 - protein, 10 aa, Borrelia burgdorferi B31
NSSGKYDLRA

SEQ ID NO: 161871 - protein, 10 aa, Borrelia burgdorferi B31
SSGKYDLRAT

SEQ ID NO: 161872 - protein, 10 aa, Borrelia burgdorferi B31
SGKYDLRATI

SEQ ID NO: 161873 - protein, 10 aa, Borrelia burgdorferi B31
GKYDLRATID

SEQ ID NO: 161874 - protein, 10 aa, Borrelia burgdorferi B31
KYDLRATIDQ

SEQ ID NO: 161875 - protein, 10 aa, Borrelia burgdorferi B31
YDLRATIDQV

SEQ ID NO: 161876 - protein, 10 aa, Borrelia burgdorferi B31
DLRATIDQVE

SEQ ID NO: 161877 - protein, 10 aa, Borrelia burgdorferi B31
LRATIDQVEL

SEQ ID NO: 161878 - protein, 10 aa, Borrelia burgdorferi B31
RATIDQVELK

SEQ ID NO: 161879 - protein, 10 aa, Borrelia burgdorferi B31
ATIDQVELKG

SEQ ID NO: 161880 - protein, 10 aa, Borrelia burgdorferi B31
TIDQVELKGT

SEQ ID NO: 161881 - protein, 10 aa, Borrelia burgdorferi B31
IDQVELKGTS

SEQ ID NO: 161882 - protein, 10 aa, Borrelia burgdorferi B31
DQVELKGTSD

SEQ ID NO: 161883 - protein, 10 aa, Borrelia burgdorferi B31
QVELKGTSDK

SEQ ID NO: 161884 - protein, 10 aa, Borrelia burgdorferi B31
VELKGTSDKN

SEQ ID NO: 161885 - protein, 10 aa, Borrelia burgdorferi B31
ELKGTSDKNN

SEQ ID NO: 161886 - protein, 10 aa, Borrelia burgdorferi B31
LKGTSDKNNG

SEQ ID NO: 161887 - protein, 10 aa, Borrelia burgdorferi B31
KGTSDKNNGS

SEQ ID NO: 161888 - protein, 10 aa, Borrelia burgdorferi B31
GTSDKNNGSG

SEQ ID NO: 161889 - protein, 10 aa, Borrelia burgdorferi B31
TSDKNNGSGT

SEQ ID NO: 161890 - protein, 10 aa, Borrelia burgdorferi B31
SDKNNGSGTL

SEQ ID NO: 161891 - protein, 10 aa, Borrelia burgdorferi B31
DKNNGSGTLE

SEQ ID NO: 161892 - protein, 10 aa, Borrelia burgdorferi B31
KNNGSGTLEG

SEQ ID NO: 161893 - protein, 10 aa, Borrelia burgdorferi B31
NNGSGTLEGS

SEQ ID NO: 161894 - protein, 10 aa, Borrelia burgdorferi B31
NGSGTLEGSK

SEQ ID NO: 161895 - protein, 10 aa, Borrelia burgdorferi B31
GSGTLEGSKP

SEQ ID NO: 161896 - protein, 10 aa, Borrelia burgdorferi B31
SGTLEGSKPD

SEQ ID NO: 161897 - protein, 10 aa, Borrelia burgdorferi B31
GTLEGSKPDK

SEQ ID NO: 161898 - protein, 10 aa, Borrelia burgdorferi B31
TLEGSKPDKS

SEQ ID NO: 161899 - protein, 10 aa, Borrelia burgdorferi B31
LEGSKPDKSK

SEQ ID NO: 161900 - protein, 10 aa, Borrelia burgdorferi B31
EGSKPDKSKV

SEQ ID NO: 161901 - protein, 10 aa, Borrelia burgdorferi B31
GSKPDKSKVK

SEQ ID NO: 161902 - protein, 10 aa, Borrelia burgdorferi B31
SKPDKSKVKL

SEQ ID NO: 161903 - protein, 10 aa, Borrelia burgdorferi B31
KPDKSKVKLT

SEQ ID NO: 161904 - protein, 10 aa, Borrelia burgdorferi B31
PDKSKVKLTV

SEQ ID NO: 161905 - protein, 10 aa, Borrelia burgdorferi B31
DKSKVKLTVS

SEQ ID NO: 161906 - protein, 10 aa, Borrelia burgdorferi B31
KSKVKLTVSA

SEQ ID NO: 161907 - protein, 10 aa, Borrelia burgdorferi B31
SKVKLTVSAD

SEQ ID NO: 161908 - protein, 10 aa, Borrelia burgdorferi B31
KVKLTVSADL

SEQ ID NO: 161909 - protein, 10 aa, Borrelia burgdorferi B31
VKLTVSADLN

SEQ ID NO: 161910 - protein, 10 aa, Borrelia burgdorferi B31
KLTVSADLNT

SEQ ID NO: 161911 - protein, 10 aa, Borrelia burgdorferi B31
LTVSADLNTV

SEQ ID NO: 161912 - protein, 10 aa, Borrelia burgdorferi B31
TVSADLNTVT

SEQ ID NO: 161913 - protein, 10 aa, Borrelia burgdorferi B31
VSADLNTVTL

SEQ ID NO: 161914 - protein, 10 aa, Borrelia burgdorferi B31
SADLNTVTLE

SEQ ID NO: 161915 - protein, 10 aa, Borrelia burgdorferi B31
ADLNTVTLEA

SEQ ID NO: 161916 - protein, 10 aa, Borrelia burgdorferi B31
DLNTVTLEAF

SEQ ID NO: 161917 - protein, 10 aa, Borrelia burgdorferi B31
LNTVTLEAFD

SEQ ID NO: 161918 - protein, 10 aa, Borrelia burgdorferi B31
NTVTLEAFDA

SEQ ID NO: 161919 - protein, 10 aa, Borrelia burgdorferi B31
TVTLEAFDAS

SEQ ID NO: 161920 - protein, 10 aa, Borrelia burgdorferi B31
VTLEAFDASN

SEQ ID NO: 161921 - protein, 10 aa, Borrelia burgdorferi B31
TLEAFDASNQ

SEQ ID NO: 161922 - protein, 10 aa, Borrelia burgdorferi B31
LEAFDASNQK

SEQ ID NO: 161923 - protein, 10 aa, Borrelia burgdorferi B31
EAFDASNQKI

SEQ ID NO: 161924 - protein, 10 aa, Borrelia burgdorferi B31
AFDASNQKIS

SEQ ID NO: 161925 - protein, 10 aa, Borrelia burgdorferi B31
FDASNQKISS

SEQ ID NO: 161926 - protein, 10 aa, Borrelia burgdorferi B31
DASNQKISSK

SEQ ID NO: 161927 - protein, 10 aa, Borrelia burgdorferi B31
ASNQKISSKV

SEQ ID NO: 161928 - protein, 10 aa, Borrelia burgdorferi B31
SNQKISSKVT

SEQ ID NO: 161929 - protein, 10 aa, Borrelia burgdorferi B31
NQKISSKVTK

SEQ ID NO: 161930 - protein, 10 aa, Borrelia burgdorferi B31
QKISSKVTKK

SEQ ID NO: 161931 - protein, 10 aa, Borrelia burgdorferi B31
KISSKVTKKQ

SEQ ID NO: 161932 - protein, 10 aa, Borrelia burgdorferi B31
ISSKVTKKQG

SEQ ID NO: 161933 - protein, 10 aa, Borrelia burgdorferi B31
SSKVTKKQGS

SEQ ID NO: 161934 - protein, 10 aa, Borrelia burgdorferi B31
SKVTKKQGSI

SEQ ID NO: 161935 - protein, 10 aa, Borrelia burgdorferi B31
KVTKKQGSIT

SEQ ID NO: 161936 - protein, 10 aa, Borrelia burgdorferi B31
  Xaa can be any naturally occurring amino acid
  VARIANT 10: Xaa = Any Amino Acid
VTKKQGSITX

SEQ ID NO: 161937 - protein, 10 aa, Borrelia burgdorferi B31
  Xaa can be any naturally occurring amino acid
  VARIANT 9: Xaa = Any Amino Acid
TKKQGSITXE

SEQ ID NO: 161938 - protein, 10 aa, Borrelia burgdorferi B31
  Xaa can be any naturally occurring amino acid
  VARIANT 8: Xaa = Any Amino Acid
KKQGSITXET

SEQ ID NO: 161939 - protein, 10 aa, Borrelia burgdorferi B31
  Xaa can be any naturally occurring amino acid
  VARIANT 7: Xaa = Any Amino Acid
KQGSITXETL

SEQ ID NO: 161940 - protein, 10 aa, Borrelia burgdorferi B31
  Xaa can be any naturally occurring amino acid
  VARIANT 6: Xaa = Any Amino Acid
QGSITXETLK

SEQ ID NO: 161941 - protein, 10 aa, Borrelia burgdorferi B31
  Xaa can be any naturally occurring amino acid
  VARIANT 5: Xaa = Any Amino Acid
GSITXETLKA

SEQ ID NO: 161942 - protein, 10 aa, Borrelia burgdorferi B31
  Xaa can be any naturally occurring amino acid
  VARIANT 4: Xaa = Any Amino Acid
SITXETLKAN

SEQ ID NO: 161943 - protein, 10 aa, Borrelia burgdorferi B31
  Xaa can be any naturally occurring amino acid
  VARIANT 3: Xaa = Any Amino Acid
ITXETLKANK

SEQ ID NO: 161944 - protein, 10 aa, Borrelia burgdorferi B31
  Xaa can be any naturally occurring amino acid
  VARIANT 2: Xaa = Any Amino Acid
TXETLKANKL

SEQ ID NO: 161945 - protein, 10 aa, Borrelia burgdorferi B31
  Xaa can be any naturally occurring amino acid
  VARIANT 1: Xaa = Any Amino Acid
XETLKANKLD

SEQ ID NO: 161946 - protein, 10 aa, Borrelia burgdorferi B31
ETLKANKLDS

SEQ ID NO: 161947 - protein, 10 aa, Borrelia burgdorferi B31
TLKANKLDSK

SEQ ID NO: 161948 - protein, 10 aa, Borrelia burgdorferi B31
LKANKLDSKK

SEQ ID NO: 161949 - protein, 10 aa, Borrelia burgdorferi B31
KANKLDSKKL

SEQ ID NO: 161950 - protein, 10 aa, Borrelia burgdorferi B31
ANKLDSKKLT

SEQ ID NO: 161951 - protein, 10 aa, Borrelia burgdorferi B31
NKLDSKKLTR

SEQ ID NO: 161952 - protein, 10 aa, Borrelia burgdorferi B31
KLDSKKLTRS

SEQ ID NO: 161953 - protein, 10 aa, Borrelia burgdorferi B31
LDSKKLTRSN

SEQ ID NO: 161954 - protein, 10 aa, Borrelia burgdorferi B31
DSKKLTRSNG

SEQ ID NO: 161955 - protein, 10 aa, Borrelia burgdorferi B31
SKKLTRSNGT

SEQ ID NO: 161956 - protein, 10 aa, Borrelia burgdorferi B31
KKLTRSNGTT

SEQ ID NO: 161957 - protein, 10 aa, Borrelia burgdorferi B31
KLTRSNGTTL

SEQ ID NO: 161958 - protein, 10 aa, Borrelia burgdorferi B31
LTRSNGTTLE

SEQ ID NO: 161959 - protein, 10 aa, Borrelia burgdorferi B31
TRSNGTTLEY

SEQ ID NO: 161960 - protein, 10 aa, Borrelia burgdorferi B31
RSNGTTLEYS

SEQ ID NO: 161961 - protein, 10 aa, Borrelia burgdorferi B31
SNGTTLEYSQ

SEQ ID NO: 161962 - protein, 10 aa, Borrelia burgdorferi B31
NGTTLEYSQI

SEQ ID NO: 161963 - protein, 10 aa, Borrelia burgdorferi B31
GTTLEYSQIT

SEQ ID NO: 161964 - protein, 10 aa, Borrelia burgdorferi B31
TTLEYSQITD

SEQ ID NO: 161965 - protein, 10 aa, Borrelia burgdorferi B31
TLEYSQITDA

SEQ ID NO: 161966 - protein, 10 aa, Borrelia burgdorferi B31
LEYSQITDAD

SEQ ID NO: 161967 - protein, 10 aa, Borrelia burgdorferi B31
EYSQITDADN

SEQ ID NO: 161968 - protein, 10 aa, Borrelia burgdorferi B31
YSQITDADNA

SEQ ID NO: 161969 - protein, 10 aa, Borrelia burgdorferi B31
SQITDADNAT

SEQ ID NO: 161970 - protein, 10 aa, Borrelia burgdorferi B31
QITDADNATK

SEQ ID NO: 161971 - protein, 10 aa, Borrelia burgdorferi B31
ITDADNATKA

SEQ ID NO: 161972 - protein, 10 aa, Borrelia burgdorferi B31
TDADNATKAV

SEQ ID NO: 161973 - protein, 10 aa, Borrelia burgdorferi B31
DADNATKAVE

SEQ ID NO: 161974 - protein, 10 aa, Borrelia burgdorferi B31
ADNATKAVET

SEQ ID NO: 161975 - protein, 10 aa, Borrelia burgdorferi B31
DNATKAVETL

SEQ ID NO: 161976 - protein, 10 aa, Borrelia burgdorferi B31
NATKAVETLK

SEQ ID NO: 161977 - protein, 10 aa, Borrelia burgdorferi B31
ATKAVETLKN

SEQ ID NO: 161978 - protein, 10 aa, Borrelia burgdorferi B31
TKAVETLKNS

SEQ ID NO: 161979 - protein, 10 aa, Borrelia burgdorferi B31
KAVETLKNSI

SEQ ID NO: 161980 - protein, 10 aa, Borrelia burgdorferi B31
AVETLKNSIK

SEQ ID NO: 161981 - protein, 10 aa, Borrelia burgdorferi B31
VETLKNSIKL

SEQ ID NO: 161982 - protein, 10 aa, Borrelia burgdorferi B31
ETLKNSIKLE

SEQ ID NO: 161983 - protein, 10 aa, Borrelia burgdorferi B31
TLKNSIKLEG

SEQ ID NO: 161984 - protein, 10 aa, Borrelia burgdorferi B31
LKNSIKLEGS

SEQ ID NO: 161985 - protein, 10 aa, Borrelia burgdorferi B31
KNSIKLEGSL

SEQ ID NO: 161986 - protein, 10 aa, Borrelia burgdorferi B31
NSIKLEGSLV

SEQ ID NO: 161987 - protein, 10 aa, Borrelia burgdorferi B31
SIKLEGSLVG

SEQ ID NO: 161988 - protein, 10 aa, Borrelia burgdorferi B31
IKLEGSLVGG

SEQ ID NO: 161989 - protein, 10 aa, Borrelia burgdorferi B31
KLEGSLVGGK

SEQ ID NO: 161990 - protein, 10 aa, Borrelia burgdorferi B31
LEGSLVGGKT

SEQ ID NO: 161991 - protein, 10 aa, Borrelia burgdorferi B31
EGSLVGGKTT

SEQ ID NO: 161992 - protein, 10 aa, Borrelia burgdorferi B31
GSLVGGKTTV

SEQ ID NO: 161993 - protein, 10 aa, Borrelia burgdorferi B31
SLVGGKTTVE

SEQ ID NO: 161994 - protein, 10 aa, Borrelia burgdorferi B31
LVGGKTTVEI

SEQ ID NO: 161995 - protein, 10 aa, Borrelia burgdorferi B31
VGGKTTVEIK

SEQ ID NO: 161996 - protein, 10 aa, Borrelia burgdorferi B31
GGKTTVEIKE

SEQ ID NO: 161997 - protein, 10 aa, Borrelia burgdorferi B31
GKTTVEIKEG

SEQ ID NO: 161998 - protein, 10 aa, Borrelia burgdorferi B31
KTTVEIKEGT

SEQ ID NO: 161999 - protein, 10 aa, Borrelia burgdorferi B31
TTVEIKEGTV

SEQ ID NO: 162000 - protein, 10 aa, Borrelia burgdorferi B31
TVEIKEGTVT

SEQ ID NO: 162001 - protein, 10 aa, Borrelia burgdorferi B31
VEIKEGTVTL

SEQ ID NO: 162002 - protein, 10 aa, Borrelia burgdorferi B31
EIKEGTVTLK

SEQ ID NO: 162003 - protein, 10 aa, Borrelia burgdorferi B31
IKEGTVTLKR

SEQ ID NO: 162004 - protein, 10 aa, Borrelia burgdorferi B31
KEGTVTLKRE

SEQ ID NO: 162005 - protein, 10 aa, Borrelia burgdorferi B31
EGTVTLKREI

SEQ ID NO: 162006 - protein, 10 aa, Borrelia burgdorferi B31
GTVTLKREIE

SEQ ID NO: 162007 - protein, 10 aa, Borrelia burgdorferi B31
TVTLKREIEK

SEQ ID NO: 162008 - protein, 10 aa, Borrelia burgdorferi B31
VTLKREIEKD

SEQ ID NO: 162009 - protein, 10 aa, Borrelia burgdorferi B31
TLKREIEKDG

SEQ ID NO: 162010 - protein, 10 aa, Borrelia burgdorferi B31
LKREIEKDGK

SEQ ID NO: 162011 - protein, 10 aa, Borrelia burgdorferi B31
KREIEKDGKV

SEQ ID NO: 162012 - protein, 10 aa, Borrelia burgdorferi B31
REIEKDGKVK

SEQ ID NO: 162013 - protein, 10 aa, Borrelia burgdorferi B31
EIEKDGKVKV

SEQ ID NO: 162014 - protein, 10 aa, Borrelia burgdorferi B31
IEKDGKVKVF

SEQ ID NO: 162015 - protein, 10 aa, Borrelia burgdorferi B31
EKDGKVKVFL

SEQ ID NO: 162016 - protein, 10 aa, Borrelia burgdorferi B31
KDGKVKVFLN

SEQ ID NO: 162017 - protein, 10 aa, Borrelia burgdorferi B31
DGKVKVFLND

SEQ ID NO: 162018 - protein, 10 aa, Borrelia burgdorferi B31
GKVKVFLNDT

SEQ ID NO: 162019 - protein, 10 aa, Borrelia burgdorferi B31
KVKVFLNDTA

SEQ ID NO: 162020 - protein, 10 aa, Borrelia burgdorferi B31
VKVFLNDTAG

SEQ ID NO: 162021 - protein, 10 aa, Borrelia burgdorferi B31
KVFLNDTAGS

SEQ ID NO: 162022 - protein, 10 aa, Borrelia burgdorferi B31
VFLNDTAGSN

SEQ ID NO: 162023 - protein, 10 aa, Borrelia burgdorferi B31
FLNDTAGSNK

SEQ ID NO: 162024 - protein, 10 aa, Borrelia burgdorferi B31
LNDTAGSNKK

SEQ ID NO: 162025 - protein, 10 aa, Borrelia burgdorferi B31
NDTAGSNKKT

SEQ ID NO: 162026 - protein, 10 aa, Borrelia burgdorferi B31
DTAGSNKKTG

SEQ ID NO: 162027 - protein, 10 aa, Borrelia burgdorferi B31
TAGSNKKTGK

SEQ ID NO: 162028 - protein, 10 aa, Borrelia burgdorferi B31
AGSNKKTGKW

SEQ ID NO: 162029 - protein, 10 aa, Borrelia burgdorferi B31
GSNKKTGKWE

SEQ ID NO: 162030 - protein, 10 aa, Borrelia burgdorferi B31
SNKKTGKWED

SEQ ID NO: 162031 - protein, 10 aa, Borrelia burgdorferi B31
NKKTGKWEDS

SEQ ID NO: 162032 - protein, 10 aa, Borrelia burgdorferi B31
KKTGKWEDST

SEQ ID NO: 162033 - protein, 10 aa, Borrelia burgdorferi B31
KTGKWEDSTS

SEQ ID NO: 162034 - protein, 10 aa, Borrelia burgdorferi B31
TGKWEDSTST

SEQ ID NO: 162035 - protein, 10 aa, Borrelia burgdorferi B31
GKWEDSTSTL

SEQ ID NO: 162036 - protein, 10 aa, Borrelia burgdorferi B31
KWEDSTSTLT

SEQ ID NO: 162037 - protein, 10 aa, Borrelia burgdorferi B31
WEDSTSTLTI

SEQ ID NO: 162038 - protein, 10 aa, Borrelia burgdorferi B31
EDSTSTLTIS

SEQ ID NO: 162039 - protein, 10 aa, Borrelia burgdorferi B31
DSTSTLTISA

SEQ ID NO: 162040 - protein, 10 aa, Borrelia burgdorferi B31
STSTLTISAD

SEQ ID NO: 162041 - protein, 10 aa, Borrelia burgdorferi B31
TSTLTISADS

SEQ ID NO: 162042 - protein, 10 aa, Borrelia burgdorferi B31
STLTISADSK

SEQ ID NO: 162043 - protein, 10 aa, Borrelia burgdorferi B31
TLTISADSKK

SEQ ID NO: 162044 - protein, 10 aa, Borrelia burgdorferi B31
LTISADSKKT

SEQ ID NO: 162045 - protein, 10 aa, Borrelia burgdorferi B31
TISADSKKTK

SEQ ID NO: 162046 - protein, 10 aa, Borrelia burgdorferi B31
ISADSKKTKD

SEQ ID NO: 162047 - protein, 10 aa, Borrelia burgdorferi B31
SADSKKTKDL

SEQ ID NO: 162048 - protein, 10 aa, Borrelia burgdorferi B31
ADSKKTKDLV

SEQ ID NO: 162049 - protein, 10 aa, Borrelia burgdorferi B31
DSKKTKDLVF

SEQ ID NO: 162050 - protein, 10 aa, Borrelia burgdorferi B31
SKKTKDLVFL

SEQ ID NO: 162051 - protein, 10 aa, Borrelia burgdorferi B31
KKTKDLVFLT

SEQ ID NO: 162052 - protein, 10 aa, Borrelia burgdorferi B31
KTKDLVFLTD

SEQ ID NO: 162053 - protein, 10 aa, Borrelia burgdorferi B31
TKDLVFLTDG

SEQ ID NO: 162054 - protein, 10 aa, Borrelia burgdorferi B31
KDLVFLTDGT

SEQ ID NO: 162055 - protein, 10 aa, Borrelia burgdorferi B31
DLVFLTDGTI

SEQ ID NO: 162056 - protein, 10 aa, Borrelia burgdorferi B31
LVFLTDGTIT

SEQ ID NO: 162057 - protein, 10 aa, Borrelia burgdorferi B31
VFLTDGTITV

SEQ ID NO: 162058 - protein, 10 aa, Borrelia burgdorferi B31
FLTDGTITVQ

SEQ ID NO: 162059 - protein, 10 aa, Borrelia burgdorferi B31
LTDGTITVQQ

SEQ ID NO: 162060 - protein, 10 aa, Borrelia burgdorferi B31
TDGTITVQQY

SEQ ID NO: 162061 - protein, 10 aa, Borrelia burgdorferi B31
DGTITVQQYN

SEQ ID NO: 162062 - protein, 10 aa, Borrelia burgdorferi B31
GTITVQQYNT

SEQ ID NO: 162063 - protein, 10 aa, Borrelia burgdorferi B31
TITVQQYNTA

SEQ ID NO: 162064 - protein, 10 aa, Borrelia burgdorferi B31
ITVQQYNTAG

SEQ ID NO: 162065 - protein, 10 aa, Borrelia burgdorferi B31
TVQQYNTAGT

SEQ ID NO: 162066 - protein, 10 aa, Borrelia burgdorferi B31
VQQYNTAGTS

SEQ ID NO: 162067 - protein, 10 aa, Borrelia burgdorferi B31
QQYNTAGTSL

SEQ ID NO: 162068 - protein, 10 aa, Borrelia burgdorferi B31
QYNTAGTSLE

SEQ ID NO: 162069 - protein, 10 aa, Borrelia burgdorferi B31
YNTAGTSLEG

SEQ ID NO: 162070 - protein, 10 aa, Borrelia burgdorferi B31
NTAGTSLEGS

SEQ ID NO: 162071 - protein, 10 aa, Borrelia burgdorferi B31
TAGTSLEGSA

SEQ ID NO: 162072 - protein, 10 aa, Borrelia burgdorferi B31
AGTSLEGSAS

SEQ ID NO: 162073 - protein, 10 aa, Borrelia burgdorferi B31
GTSLEGSASE

SEQ ID NO: 162074 - protein, 10 aa, Borrelia burgdorferi B31
TSLEGSASEI

SEQ ID NO: 162075 - protein, 10 aa, Borrelia burgdorferi B31
SLEGSASEIK

SEQ ID NO: 162076 - protein, 10 aa, Borrelia burgdorferi B31
LEGSASEIKN

SEQ ID NO: 162077 - protein, 10 aa, Borrelia burgdorferi B31
EGSASEIKNL

SEQ ID NO: 162078 - protein, 10 aa, Borrelia burgdorferi B31
GSASEIKNLS

SEQ ID NO: 162079 - protein, 10 aa, Borrelia burgdorferi B31
SASEIKNLSE

SEQ ID NO: 162080 - protein, 10 aa, Borrelia burgdorferi B31
ASEIKNLSEL

SEQ ID NO: 162081 - protein, 10 aa, Borrelia burgdorferi B31
SEIKNLSELK

SEQ ID NO: 162082 - protein, 10 aa, Borrelia burgdorferi B31
EIKNLSELKN

SEQ ID NO: 162083 - protein, 10 aa, Borrelia burgdorferi B31
IKNLSELKNA

SEQ ID NO: 162084 - protein, 10 aa, Borrelia burgdorferi B31
KNLSELKNAL

SEQ ID NO: 162085 - protein, 10 aa, Borrelia burgdorferi B31
NLSELKNALK

SEQ ID NO: 162086 - protein, 11 aa, Borrelia burgdorferi B31
MRLLIGFALAL

SEQ ID NO: 162087 - protein, 11 aa, Borrelia burgdorferi B31
RLLIGFALALA

SEQ ID NO: 162088 - protein, 11 aa, Borrelia burgdorferi B31
LLIGFALALAL

SEQ ID NO: 162089 - protein, 11 aa, Borrelia burgdorferi B31
LIGFALALALI

SEQ ID NO: 162090 - protein, 11 aa, Borrelia burgdorferi B31
IGFALALALIG

SEQ ID NO: 162091 - protein, 11 aa, Borrelia burgdorferi B31
GFALALALIGC

SEQ ID NO: 162092 - protein, 11 aa, Borrelia burgdorferi B31
FALALALIGCA

SEQ ID NO: 162093 - protein, 11 aa, Borrelia burgdorferi B31
ALALALIGCAQ

SEQ ID NO: 162094 - protein, 11 aa, Borrelia burgdorferi B31
LALALIGCAQK

SEQ ID NO: 162095 - protein, 11 aa, Borrelia burgdorferi B31
ALALIGCAQKG

SEQ ID NO: 162096 - protein, 11 aa, Borrelia burgdorferi B31
LALIGCAQKGA

SEQ ID NO: 162097 - protein, 11 aa, Borrelia burgdorferi B31
ALIGCAQKGAE

SEQ ID NO: 162098 - protein, 11 aa, Borrelia burgdorferi B31
LIGCAQKGAES

SEQ ID NO: 162099 - protein, 11 aa, Borrelia burgdorferi B31
IGCAQKGAESI

SEQ ID NO: 162100 - protein, 11 aa, Borrelia burgdorferi B31
GCAQKGAESIG

SEQ ID NO: 162101 - protein, 11 aa, Borrelia burgdorferi B31
CAQKGAESIGS

SEQ ID NO: 162102 - protein, 11 aa, Borrelia burgdorferi B31
AQKGAESIGSQ

SEQ ID NO: 162103 - protein, 11 aa, Borrelia burgdorferi B31
QKGAESIGSQK

SEQ ID NO: 162104 - protein, 11 aa, Borrelia burgdorferi B31
KGAESIGSQKE

SEQ ID NO: 162105 - protein, 11 aa, Borrelia burgdorferi B31
GAESIGSQKEN

SEQ ID NO: 162106 - protein, 11 aa, Borrelia burgdorferi B31
AESIGSQKEND

SEQ ID NO: 162107 - protein, 11 aa, Borrelia burgdorferi B31
ESIGSQKENDL

SEQ ID NO: 162108 - protein, 11 aa, Borrelia burgdorferi B31
SIGSQKENDLN

SEQ ID NO: 162109 - protein, 11 aa, Borrelia burgdorferi B31
IGSQKENDLNL

SEQ ID NO: 162110 - protein, 11 aa, Borrelia burgdorferi B31
GSQKENDLNLE

SEQ ID NO: 162111 - protein, 11 aa, Borrelia burgdorferi B31
SQKENDLNLED

SEQ ID NO: 162112 - protein, 11 aa, Borrelia burgdorferi B31
QKENDLNLEDS

SEQ ID NO: 162113 - protein, 11 aa, Borrelia burgdorferi B31
KENDLNLEDSS

SEQ ID NO: 162114 - protein, 11 aa, Borrelia burgdorferi B31
ENDLNLEDSSK

SEQ ID NO: 162115 - protein, 11 aa, Borrelia burgdorferi B31
NDLNLEDSSKK

SEQ ID NO: 162116 - protein, 11 aa, Borrelia burgdorferi B31
DLNLEDSSKKS

SEQ ID NO: 162117 - protein, 11 aa, Borrelia burgdorferi B31
LNLEDSSKKSH

SEQ ID NO: 162118 - protein, 11 aa, Borrelia burgdorferi B31
NLEDSSKKSHQ

SEQ ID NO: 162119 - protein, 11 aa, Borrelia burgdorferi B31
LEDSSKKSHQN

SEQ ID NO: 162120 - protein, 11 aa, Borrelia burgdorferi B31
EDSSKKSHQNA

SEQ ID NO: 162121 - protein, 11 aa, Borrelia burgdorferi B31
DSSKKSHQNAK

SEQ ID NO: 162122 - protein, 11 aa, Borrelia burgdorferi B31
SSKKSHQNAKQ

SEQ ID NO: 162123 - protein, 11 aa, Borrelia burgdorferi B31
SKKSHQNAKQD

SEQ ID NO: 162124 - protein, 11 aa, Borrelia burgdorferi B31
KKSHQNAKQDL

SEQ ID NO: 162125 - protein, 11 aa, Borrelia burgdorferi B31
KSHQNAKQDLP

SEQ ID NO: 162126 - protein, 11 aa, Borrelia burgdorferi B31
SHQNAKQDLPA

SEQ ID NO: 162127 - protein, 11 aa, Borrelia burgdorferi B31
HQNAKQDLPAV

SEQ ID NO: 162128 - protein, 11 aa, Borrelia burgdorferi B31
QNAKQDLPAVT

SEQ ID NO: 162129 - protein, 11 aa, Borrelia burgdorferi B31
NAKQDLPAVTE

SEQ ID NO: 162130 - protein, 11 aa, Borrelia burgdorferi B31
AKQDLPAVTED

SEQ ID NO: 162131 - protein, 11 aa, Borrelia burgdorferi B31
KQDLPAVTEDS

SEQ ID NO: 162132 - protein, 11 aa, Borrelia burgdorferi B31
QDLPAVTEDSV

SEQ ID NO: 162133 - protein, 11 aa, Borrelia burgdorferi B31
DLPAVTEDSVS

SEQ ID NO: 162134 - protein, 11 aa, Borrelia burgdorferi B31
LPAVTEDSVSL

SEQ ID NO: 162135 - protein, 11 aa, Borrelia burgdorferi B31
PAVTEDSVSLF

SEQ ID NO: 162136 - protein, 11 aa, Borrelia burgdorferi B31
AVTEDSVSLFN

SEQ ID NO: 162137 - protein, 11 aa, Borrelia burgdorferi B31
VTEDSVSLFNG

SEQ ID NO: 162138 - protein, 11 aa, Borrelia burgdorferi B31
TEDSVSLFNGN

SEQ ID NO: 162139 - protein, 11 aa, Borrelia burgdorferi B31
EDSVSLFNGNK

SEQ ID NO: 162140 - protein, 11 aa, Borrelia burgdorferi B31
DSVSLFNGNKI

SEQ ID NO: 162141 - protein, 11 aa, Borrelia burgdorferi B31
SVSLFNGNKIF

SEQ ID NO: 162142 - protein, 11 aa, Borrelia burgdorferi B31
VSLFNGNKIFV

SEQ ID NO: 162143 - protein, 11 aa, Borrelia burgdorferi B31
SLFNGNKIFVS

SEQ ID NO: 162144 - protein, 11 aa, Borrelia burgdorferi B31
LFNGNKIFVSK

SEQ ID NO: 162145 - protein, 11 aa, Borrelia burgdorferi B31
FNGNKIFVSKE

SEQ ID NO: 162146 - protein, 11 aa, Borrelia burgdorferi B31
NGNKIFVSKEK

SEQ ID NO: 162147 - protein, 11 aa, Borrelia burgdorferi B31
GNKIFVSKEKN

SEQ ID NO: 162148 - protein, 11 aa, Borrelia burgdorferi B31
NKIFVSKEKNS

SEQ ID NO: 162149 - protein, 11 aa, Borrelia burgdorferi B31
KIFVSKEKNSS

SEQ ID NO: 162150 - protein, 11 aa, Borrelia burgdorferi B31
IFVSKEKNSSG

SEQ ID NO: 162151 - protein, 11 aa, Borrelia burgdorferi B31
FVSKEKNSSGK

SEQ ID NO: 162152 - protein, 11 aa, Borrelia burgdorferi B31
VSKEKNSSGKY

SEQ ID NO: 162153 - protein, 11 aa, Borrelia burgdorferi B31
SKEKNSSGKYD

SEQ ID NO: 162154 - protein, 11 aa, Borrelia burgdorferi B31
KEKNSSGKYDL

SEQ ID NO: 162155 - protein, 11 aa, Borrelia burgdorferi B31
EKNSSGKYDLR

SEQ ID NO: 162156 - protein, 11 aa, Borrelia burgdorferi B31
KNSSGKYDLRA

SEQ ID NO: 162157 - protein, 11 aa, Borrelia burgdorferi B31
NSSGKYDLRAT

SEQ ID NO: 162158 - protein, 11 aa, Borrelia burgdorferi B31
SSGKYDLRATI

SEQ ID NO: 162159 - protein, 11 aa, Borrelia burgdorferi B31
SGKYDLRATID

SEQ ID NO: 162160 - protein, 11 aa, Borrelia burgdorferi B31
GKYDLRATIDQ

SEQ ID NO: 162161 - protein, 11 aa, Borrelia burgdorferi B31
KYDLRATIDQV

SEQ ID NO: 162162 - protein, 11 aa, Borrelia burgdorferi B31
YDLRATIDQVE

SEQ ID NO: 162163 - protein, 11 aa, Borrelia burgdorferi B31
DLRATIDQVEL

SEQ ID NO: 162164 - protein, 11 aa, Borrelia burgdorferi B31
LRATIDQVELK

SEQ ID NO: 162165 - protein, 11 aa, Borrelia burgdorferi B31
RATIDQVELKG

SEQ ID NO: 162166 - protein, 11 aa, Borrelia burgdorferi B31
ATIDQVELKGT

SEQ ID NO: 162167 - protein, 11 aa, Borrelia burgdorferi B31
TIDQVELKGTS

SEQ ID NO: 162168 - protein, 11 aa, Borrelia burgdorferi B31
IDQVELKGTSD

SEQ ID NO: 162169 - protein, 11 aa, Borrelia burgdorferi B31
DQVELKGTSDK

SEQ ID NO: 162170 - protein, 11 aa, Borrelia burgdorferi B31
QVELKGTSDKN

SEQ ID NO: 162171 - protein, 11 aa, Borrelia burgdorferi B31
VELKGTSDKNN

SEQ ID NO: 162172 - protein, 11 aa, Borrelia burgdorferi B31
ELKGTSDKNNG

SEQ ID NO: 162173 - protein, 11 aa, Borrelia burgdorferi B31
LKGTSDKNNGS

SEQ ID NO: 162174 - protein, 11 aa, Borrelia burgdorferi B31
KGTSDKNNGSG

SEQ ID NO: 162175 - protein, 11 aa, Borrelia burgdorferi B31
GTSDKNNGSGT

SEQ ID NO: 162176 - protein, 11 aa, Borrelia burgdorferi B31
TSDKNNGSGTL

SEQ ID NO: 162177 - protein, 11 aa, Borrelia burgdorferi B31
SDKNNGSGTLE

SEQ ID NO: 162178 - protein, 11 aa, Borrelia burgdorferi B31
DKNNGSGTLEG

SEQ ID NO: 162179 - protein, 11 aa, Borrelia burgdorferi B31
KNNGSGTLEGS

SEQ ID NO: 162180 - protein, 11 aa, Borrelia burgdorferi B31
NNGSGTLEGSK

SEQ ID NO: 162181 - protein, 11 aa, Borrelia burgdorferi B31
NGSGTLEGSKP

SEQ ID NO: 162182 - protein, 11 aa, Borrelia burgdorferi B31
GSGTLEGSKPD

SEQ ID NO: 162183 - protein, 11 aa, Borrelia burgdorferi B31
SGTLEGSKPDK

SEQ ID NO: 162184 - protein, 11 aa, Borrelia burgdorferi B31
GTLEGSKPDKS

SEQ ID NO: 162185 - protein, 11 aa, Borrelia burgdorferi B31
TLEGSKPDKSK

SEQ ID NO: 162186 - protein, 11 aa, Borrelia burgdorferi B31
LEGSKPDKSKV

SEQ ID NO: 162187 - protein, 11 aa, Borrelia burgdorferi B31
EGSKPDKSKVK

SEQ ID NO: 162188 - protein, 11 aa, Borrelia burgdorferi B31
GSKPDKSKVKL

SEQ ID NO: 162189 - protein, 11 aa, Borrelia burgdorferi B31
SKPDKSKVKLT

SEQ ID NO: 162190 - protein, 11 aa, Borrelia burgdorferi B31
KPDKSKVKLTV

SEQ ID NO: 162191 - protein, 11 aa, Borrelia burgdorferi B31
PDKSKVKLTVS

SEQ ID NO: 162192 - protein, 11 aa, Borrelia burgdorferi B31
DKSKVKLTVSA

SEQ ID NO: 162193 - protein, 11 aa, Borrelia burgdorferi B31
KSKVKLTVSAD

SEQ ID NO: 162194 - protein, 11 aa, Borrelia burgdorferi B31
SKVKLTVSADL

SEQ ID NO: 162195 - protein, 11 aa, Borrelia burgdorferi B31
KVKLTVSADLN

SEQ ID NO: 162196 - protein, 11 aa, Borrelia burgdorferi B31
VKLTVSADLNT

SEQ ID NO: 162197 - protein, 11 aa, Borrelia burgdorferi B31
KLTVSADLNTV

SEQ ID NO: 162198 - protein, 11 aa, Borrelia burgdorferi B31
LTVSADLNTVT

SEQ ID NO: 162199 - protein, 11 aa, Borrelia burgdorferi B31
TVSADLNTVTL

SEQ ID NO: 162200 - protein, 11 aa, Borrelia burgdorferi B31
VSADLNTVTLE

SEQ ID NO: 162201 - protein, 11 aa, Borrelia burgdorferi B31
SADLNTVTLEA

SEQ ID NO: 162202 - protein, 11 aa, Borrelia burgdorferi B31
ADLNTVTLEAF

SEQ ID NO: 162203 - protein, 11 aa, Borrelia burgdorferi B31
DLNTVTLEAFD

SEQ ID NO: 162204 - protein, 11 aa, Borrelia burgdorferi B31
LNTVTLEAFDA

SEQ ID NO: 162205 - protein, 11 aa, Borrelia burgdorferi B31
NTVTLEAFDAS

SEQ ID NO: 162206 - protein, 11 aa, Borrelia burgdorferi B31
TVTLEAFDASN

SEQ ID NO: 162207 - protein, 11 aa, Borrelia burgdorferi B31
VTLEAFDASNQ

SEQ ID NO: 162208 - protein, 11 aa, Borrelia burgdorferi B31
TLEAFDASNQK

SEQ ID NO: 162209 - protein, 11 aa, Borrelia burgdorferi B31
LEAFDASNQKI

SEQ ID NO: 162210 - protein, 11 aa, Borrelia burgdorferi B31
EAFDASNQKIS

SEQ ID NO: 162211 - protein, 11 aa, Borrelia burgdorferi B31
AFDASNQKISS

SEQ ID NO: 162212 - protein, 11 aa, Borrelia burgdorferi B31
FDASNQKISSK

SEQ ID NO: 162213 - protein, 11 aa, Borrelia burgdorferi B31
DASNQKISSKV

SEQ ID NO: 162214 - protein, 11 aa, Borrelia burgdorferi B31
ASNQKISSKVT

SEQ ID NO: 162215 - protein, 11 aa, Borrelia burgdorferi B31
SNQKISSKVTK

SEQ ID NO: 162216 - protein, 11 aa, Borrelia burgdorferi B31
NQKISSKVTKK

SEQ ID NO: 162217 - protein, 11 aa, Borrelia burgdorferi B31
QKISSKVTKKQ

SEQ ID NO: 162218 - protein, 11 aa, Borrelia burgdorferi B31
KISSKVTKKQG

SEQ ID NO: 162219 - protein, 11 aa, Borrelia burgdorferi B31
ISSKVTKKQGS

SEQ ID NO: 162220 - protein, 11 aa, Borrelia burgdorferi B31
SSKVTKKQGSI

SEQ ID NO: 162221 - protein, 11 aa, Borrelia burgdorferi B31
SKVTKKQGSIT

SEQ ID NO: 162222 - protein, 11 aa, Borrelia burgdorferi B31
  Xaa can be any naturally occurring amino acid
  VARIANT 11: Xaa = Any Amino Acid
KVTKKQGSITX

SEQ ID NO: 162223 - protein, 11 aa, Borrelia burgdorferi B31
  Xaa can be any naturally occurring amino acid
  VARIANT 10: Xaa = Any Amino Acid
VTKKQGSITXE

SEQ ID NO: 162224 - protein, 11 aa, Borrelia burgdorferi B31
  Xaa can be any naturally occurring amino acid
  VARIANT 9: Xaa = Any Amino Acid
TKKQGSITXET

SEQ ID NO: 162225 - protein, 11 aa, Borrelia burgdorferi B31
  Xaa can be any naturally occurring amino acid
  VARIANT 8: Xaa = Any Amino Acid
KKQGSITXETL

SEQ ID NO: 162226 - protein, 11 aa, Borrelia burgdorferi B31
  Xaa can be any naturally occurring amino acid
  VARIANT 7: Xaa = Any Amino Acid
KQGSITXETLK

SEQ ID NO: 162227 - protein, 11 aa, Borrelia burgdorferi B31
  Xaa can be any naturally occurring amino acid
  VARIANT 6: Xaa = Any Amino Acid
QGSITXETLKA

SEQ ID NO: 162228 - protein, 11 aa, Borrelia burgdorferi B31
  Xaa can be any naturally occurring amino acid
  VARIANT 5: Xaa = Any Amino Acid
GSITXETLKAN

SEQ ID NO: 162229 - protein, 11 aa, Borrelia burgdorferi B31
  Xaa can be any naturally occurring amino acid
  VARIANT 4: Xaa = Any Amino Acid
SITXETLKANK

SEQ ID NO: 162230 - protein, 11 aa, Borrelia burgdorferi B31
  Xaa can be any naturally occurring amino acid
  VARIANT 3: Xaa = Any Amino Acid
ITXETLKANKL

SEQ ID NO: 162231 - protein, 11 aa, Borrelia burgdorferi B31
  Xaa can be any naturally occurring amino acid
  VARIANT 2: Xaa = Any Amino Acid
TXETLKANKLD

SEQ ID NO: 162232 - protein, 11 aa, Borrelia burgdorferi B31
  Xaa can be any naturally occurring amino acid
  VARIANT 1: Xaa = Any Amino Acid
XETLKANKLDS

SEQ ID NO: 162233 - protein, 11 aa, Borrelia burgdorferi B31
ETLKANKLDSK

SEQ ID NO: 162234 - protein, 11 aa, Borrelia burgdorferi B31
TLKANKLDSKK

SEQ ID NO: 162235 - protein, 11 aa, Borrelia burgdorferi B31
LKANKLDSKKL

SEQ ID NO: 162236 - protein, 11 aa, Borrelia burgdorferi B31
KANKLDSKKLT

SEQ ID NO: 162237 - protein, 11 aa, Borrelia burgdorferi B31
ANKLDSKKLTR

SEQ ID NO: 162238 - protein, 11 aa, Borrelia burgdorferi B31
NKLDSKKLTRS

SEQ ID NO: 162239 - protein, 11 aa, Borrelia burgdorferi B31
KLDSKKLTRSN

SEQ ID NO: 162240 - protein, 11 aa, Borrelia burgdorferi B31
LDSKKLTRSNG

SEQ ID NO: 162241 - protein, 11 aa, Borrelia burgdorferi B31
DSKKLTRSNGT

SEQ ID NO: 162242 - protein, 11 aa, Borrelia burgdorferi B31
SKKLTRSNGTT

SEQ ID NO: 162243 - protein, 11 aa, Borrelia burgdorferi B31
KKLTRSNGTTL

SEQ ID NO: 162244 - protein, 11 aa, Borrelia burgdorferi B31
KLTRSNGTTLE

SEQ ID NO: 162245 - protein, 11 aa, Borrelia burgdorferi B31
LTRSNGTTLEY

SEQ ID NO: 162246 - protein, 11 aa, Borrelia burgdorferi B31
TRSNGTTLEYS

SEQ ID NO: 162247 - protein, 11 aa, Borrelia burgdorferi B31
RSNGTTLEYSQ

SEQ ID NO: 162248 - protein, 11 aa, Borrelia burgdorferi B31
SNGTTLEYSQI

SEQ ID NO: 162249 - protein, 11 aa, Borrelia burgdorferi B31
NGTTLEYSQIT

SEQ ID NO: 162250 - protein, 11 aa, Borrelia burgdorferi B31
GTTLEYSQITD

SEQ ID NO: 162251 - protein, 11 aa, Borrelia burgdorferi B31
TTLEYSQITDA

SEQ ID NO: 162252 - protein, 11 aa, Borrelia burgdorferi B31
TLEYSQITDAD

SEQ ID NO: 162253 - protein, 11 aa, Borrelia burgdorferi B31
LEYSQITDADN

SEQ ID NO: 162254 - protein, 11 aa, Borrelia burgdorferi B31
EYSQITDADNA

SEQ ID NO: 162255 - protein, 11 aa, Borrelia burgdorferi B31
YSQITDADNAT

SEQ ID NO: 162256 - protein, 11 aa, Borrelia burgdorferi B31
SQITDADNATK

SEQ ID NO: 162257 - protein, 11 aa, Borrelia burgdorferi B31
QITDADNATKA

SEQ ID NO: 162258 - protein, 11 aa, Borrelia burgdorferi B31
ITDADNATKAV

SEQ ID NO: 162259 - protein, 11 aa, Borrelia burgdorferi B31
TDADNATKAVE

SEQ ID NO: 162260 - protein, 11 aa, Borrelia burgdorferi B31
DADNATKAVET

SEQ ID NO: 162261 - protein, 11 aa, Borrelia burgdorferi B31
ADNATKAVETL

SEQ ID NO: 162262 - protein, 11 aa, Borrelia burgdorferi B31
DNATKAVETLK

SEQ ID NO: 162263 - protein, 11 aa, Borrelia burgdorferi B31
NATKAVETLKN

SEQ ID NO: 162264 - protein, 11 aa, Borrelia burgdorferi B31
ATKAVETLKNS

SEQ ID NO: 162265 - protein, 11 aa, Borrelia burgdorferi B31
TKAVETLKNSI

SEQ ID NO: 162266 - protein, 11 aa, Borrelia burgdorferi B31
KAVETLKNSIK

SEQ ID NO: 162267 - protein, 11 aa, Borrelia burgdorferi B31
AVETLKNSIKL

SEQ ID NO: 162268 - protein, 11 aa, Borrelia burgdorferi B31
VETLKNSIKLE

SEQ ID NO: 162269 - protein, 11 aa, Borrelia burgdorferi B31
ETLKNSIKLEG

SEQ ID NO: 162270 - protein, 11 aa, Borrelia burgdorferi B31
TLKNSIKLEGS

SEQ ID NO: 162271 - protein, 11 aa, Borrelia burgdorferi B31
LKNSIKLEGSL

SEQ ID NO: 162272 - protein, 11 aa, Borrelia burgdorferi B31
KNSIKLEGSLV

SEQ ID NO: 162273 - protein, 11 aa, Borrelia burgdorferi B31
NSIKLEGSLVG

SEQ ID NO: 162274 - protein, 11 aa, Borrelia burgdorferi B31
SIKLEGSLVGG

SEQ ID NO: 162275 - protein, 11 aa, Borrelia burgdorferi B31
IKLEGSLVGGK

SEQ ID NO: 162276 - protein, 11 aa, Borrelia burgdorferi B31
KLEGSLVGGKT

SEQ ID NO: 162277 - protein, 11 aa, Borrelia burgdorferi B31
LEGSLVGGKTT

SEQ ID NO: 162278 - protein, 11 aa, Borrelia burgdorferi B31
EGSLVGGKTTV

SEQ ID NO: 162279 - protein, 11 aa, Borrelia burgdorferi B31
GSLVGGKTTVE

SEQ ID NO: 162280 - protein, 11 aa, Borrelia burgdorferi B31
SLVGGKTTVEI

SEQ ID NO: 162281 - protein, 11 aa, Borrelia burgdorferi B31
LVGGKTTVEIK

SEQ ID NO: 162282 - protein, 11 aa, Borrelia burgdorferi B31
VGGKTTVEIKE

SEQ ID NO: 162283 - protein, 11 aa, Borrelia burgdorferi B31
GGKTTVEIKEG

SEQ ID NO: 162284 - protein, 11 aa, Borrelia burgdorferi B31
GKTTVEIKEGT

SEQ ID NO: 162285 - protein, 11 aa, Borrelia burgdorferi B31
KTTVEIKEGTV

SEQ ID NO: 162286 - protein, 11 aa, Borrelia burgdorferi B31
TTVEIKEGTVT

SEQ ID NO: 162287 - protein, 11 aa, Borrelia burgdorferi B31
TVEIKEGTVTL

SEQ ID NO: 162288 - protein, 11 aa, Borrelia burgdorferi B31
VEIKEGTVTLK

SEQ ID NO: 162289 - protein, 11 aa, Borrelia burgdorferi B31
EIKEGTVTLKR

SEQ ID NO: 162290 - protein, 11 aa, Borrelia burgdorferi B31
IKEGTVTLKRE

SEQ ID NO: 162291 - protein, 11 aa, Borrelia burgdorferi B31
KEGTVTLKREI

SEQ ID NO: 162292 - protein, 11 aa, Borrelia burgdorferi B31
EGTVTLKREIE

SEQ ID NO: 162293 - protein, 11 aa, Borrelia burgdorferi B31
GTVTLKREIEK

SEQ ID NO: 162294 - protein, 11 aa, Borrelia burgdorferi B31
TVTLKREIEKD

SEQ ID NO: 162295 - protein, 11 aa, Borrelia burgdorferi B31
VTLKREIEKDG

SEQ ID NO: 162296 - protein, 11 aa, Borrelia burgdorferi B31
TLKREIEKDGK

SEQ ID NO: 162297 - protein, 11 aa, Borrelia burgdorferi B31
LKREIEKDGKV

SEQ ID NO: 162298 - protein, 11 aa, Borrelia burgdorferi B31
KREIEKDGKVK

SEQ ID NO: 162299 - protein, 11 aa, Borrelia burgdorferi B31
REIEKDGKVKV

SEQ ID NO: 162300 - protein, 11 aa, Borrelia burgdorferi B31
EIEKDGKVKVF

SEQ ID NO: 162301 - protein, 11 aa, Borrelia burgdorferi B31
IEKDGKVKVFL

SEQ ID NO: 162302 - protein, 11 aa, Borrelia burgdorferi B31
EKDGKVKVFLN

SEQ ID NO: 162303 - protein, 11 aa, Borrelia burgdorferi B31
KDGKVKVFLND

SEQ ID NO: 162304 - protein, 11 aa, Borrelia burgdorferi B31
DGKVKVFLNDT

SEQ ID NO: 162305 - protein, 11 aa, Borrelia burgdorferi B31
GKVKVFLNDTA

SEQ ID NO: 162306 - protein, 11 aa, Borrelia burgdorferi B31
KVKVFLNDTAG

SEQ ID NO: 162307 - protein, 11 aa, Borrelia burgdorferi B31
VKVFLNDTAGS

SEQ ID NO: 162308 - protein, 11 aa, Borrelia burgdorferi B31
KVFLNDTAGSN

SEQ ID NO: 162309 - protein, 11 aa, Borrelia burgdorferi B31
VFLNDTAGSNK

SEQ ID NO: 162310 - protein, 11 aa, Borrelia burgdorferi B31
FLNDTAGSNKK

SEQ ID NO: 162311 - protein, 11 aa, Borrelia burgdorferi B31
LNDTAGSNKKT

SEQ ID NO: 162312 - protein, 11 aa, Borrelia burgdorferi B31
NDTAGSNKKTG

SEQ ID NO: 162313 - protein, 11 aa, Borrelia burgdorferi B31
DTAGSNKKTGK

SEQ ID NO: 162314 - protein, 11 aa, Borrelia burgdorferi B31
TAGSNKKTGKW

SEQ ID NO: 162315 - protein, 11 aa, Borrelia burgdorferi B31
AGSNKKTGKWE

SEQ ID NO: 162316 - protein, 11 aa, Borrelia burgdorferi B31
GSNKKTGKWED

SEQ ID NO: 162317 - protein, 11 aa, Borrelia burgdorferi B31
SNKKTGKWEDS

SEQ ID NO: 162318 - protein, 11 aa, Borrelia burgdorferi B31
NKKTGKWEDST

SEQ ID NO: 162319 - protein, 11 aa, Borrelia burgdorferi B31
KKTGKWEDSTS

SEQ ID NO: 162320 - protein, 11 aa, Borrelia burgdorferi B31
KTGKWEDSTST

SEQ ID NO: 162321 - protein, 11 aa, Borrelia burgdorferi B31
TGKWEDSTSTL

SEQ ID NO: 162322 - protein, 11 aa, Borrelia burgdorferi B31
GKWEDSTSTLT

SEQ ID NO: 162323 - protein, 11 aa, Borrelia burgdorferi B31
KWEDSTSTLTI

SEQ ID NO: 162324 - protein, 11 aa, Borrelia burgdorferi B31
WEDSTSTLTIS

SEQ ID NO: 162325 - protein, 11 aa, Borrelia burgdorferi B31
EDSTSTLTISA

SEQ ID NO: 162326 - protein, 11 aa, Borrelia burgdorferi B31
DSTSTLTISAD

SEQ ID NO: 162327 - protein, 11 aa, Borrelia burgdorferi B31
STSTLTISADS

SEQ ID NO: 162328 - protein, 11 aa, Borrelia burgdorferi B31
TSTLTISADSK

SEQ ID NO: 162329 - protein, 11 aa, Borrelia burgdorferi B31
STLTISADSKK

SEQ ID NO: 162330 - protein, 11 aa, Borrelia burgdorferi B31
TLTISADSKKT

SEQ ID NO: 162331 - protein, 11 aa, Borrelia burgdorferi B31
LTISADSKKTK

SEQ ID NO: 162332 - protein, 11 aa, Borrelia burgdorferi B31
TISADSKKTKD

SEQ ID NO: 162333 - protein, 11 aa, Borrelia burgdorferi B31
ISADSKKTKDL

SEQ ID NO: 162334 - protein, 11 aa, Borrelia burgdorferi B31
SADSKKTKDLV

SEQ ID NO: 162335 - protein, 11 aa, Borrelia burgdorferi B31
ADSKKTKDLVF

SEQ ID NO: 162336 - protein, 11 aa, Borrelia burgdorferi B31
DSKKTKDLVFL

SEQ ID NO: 162337 - protein, 11 aa, Borrelia burgdorferi B31
SKKTKDLVFLT

SEQ ID NO: 162338 - protein, 11 aa, Borrelia burgdorferi B31
KKTKDLVFLTD

SEQ ID NO: 162339 - protein, 11 aa, Borrelia burgdorferi B31
KTKDLVFLTDG

SEQ ID NO: 162340 - protein, 11 aa, Borrelia burgdorferi B31
TKDLVFLTDGT

SEQ ID NO: 162341 - protein, 11 aa, Borrelia burgdorferi B31
KDLVFLTDGTI

SEQ ID NO: 162342 - protein, 11 aa, Borrelia burgdorferi B31
DLVFLTDGTIT

SEQ ID NO: 162343 - protein, 11 aa, Borrelia burgdorferi B31
LVFLTDGTITV

SEQ ID NO: 162344 - protein, 11 aa, Borrelia burgdorferi B31
VFLTDGTITVQ

SEQ ID NO: 162345 - protein, 11 aa, Borrelia burgdorferi B31
FLTDGTITVQQ

SEQ ID NO: 162346 - protein, 11 aa, Borrelia burgdorferi B31
LTDGTITVQQY

SEQ ID NO: 162347 - protein, 11 aa, Borrelia burgdorferi B31
TDGTITVQQYN

SEQ ID NO: 162348 - protein, 11 aa, Borrelia burgdorferi B31
DGTITVQQYNT

SEQ ID NO: 162349 - protein, 11 aa, Borrelia burgdorferi B31
GTITVQQYNTA

SEQ ID NO: 162350 - protein, 11 aa, Borrelia burgdorferi B31
TITVQQYNTAG

SEQ ID NO: 162351 - protein, 11 aa, Borrelia burgdorferi B31
ITVQQYNTAGT

SEQ ID NO: 162352 - protein, 11 aa, Borrelia burgdorferi B31
TVQQYNTAGTS

SEQ ID NO: 162353 - protein, 11 aa, Borrelia burgdorferi B31
VQQYNTAGTSL

SEQ ID NO: 162354 - protein, 11 aa, Borrelia burgdorferi B31
QQYNTAGTSLE

SEQ ID NO: 162355 - protein, 11 aa, Borrelia burgdorferi B31
QYNTAGTSLEG

SEQ ID NO: 162356 - protein, 11 aa, Borrelia burgdorferi B31
YNTAGTSLEGS

SEQ ID NO: 162357 - protein, 11 aa, Borrelia burgdorferi B31
NTAGTSLEGSA

SEQ ID NO: 162358 - protein, 11 aa, Borrelia burgdorferi B31
TAGTSLEGSAS

SEQ ID NO: 162359 - protein, 11 aa, Borrelia burgdorferi B31
AGTSLEGSASE

SEQ ID NO: 162360 - protein, 11 aa, Borrelia burgdorferi B31
GTSLEGSASEI

SEQ ID NO: 162361 - protein, 11 aa, Borrelia burgdorferi B31
TSLEGSASEIK

SEQ ID NO: 162362 - protein, 11 aa, Borrelia burgdorferi B31
SLEGSASEIKN

SEQ ID NO: 162363 - protein, 11 aa, Borrelia burgdorferi B31
LEGSASEIKNL

SEQ ID NO: 162364 - protein, 11 aa, Borrelia burgdorferi B31
EGSASEIKNLS

SEQ ID NO: 162365 - protein, 11 aa, Borrelia burgdorferi B31
GSASEIKNLSE

SEQ ID NO: 162366 - protein, 11 aa, Borrelia burgdorferi B31
SASEIKNLSEL

SEQ ID NO: 162367 - protein, 11 aa, Borrelia burgdorferi B31
ASEIKNLSELK

SEQ ID NO: 162368 - protein, 11 aa, Borrelia burgdorferi B31
SEIKNLSELKN

SEQ ID NO: 162369 - protein, 11 aa, Borrelia burgdorferi B31
EIKNLSELKNA

SEQ ID NO: 162370 - protein, 11 aa, Borrelia burgdorferi B31
IKNLSELKNAL

SEQ ID NO: 162371 - protein, 11 aa, Borrelia burgdorferi B31
KNLSELKNALK

SEQ ID NO: 162372 - protein, 13 aa, Borrelia burgdorferi B31
MRLLIGFALALAL

SEQ ID NO: 162373 - protein, 13 aa, Borrelia burgdorferi B31
RLLIGFALALALI

SEQ ID NO: 162374 - protein, 13 aa, Borrelia burgdorferi B31
LLIGFALALALIG

SEQ ID NO: 162375 - protein, 13 aa, Borrelia burgdorferi B31
LIGFALALALIGC

SEQ ID NO: 162376 - protein, 13 aa, Borrelia burgdorferi B31
IGFALALALIGCA

SEQ ID NO: 162377 - protein, 13 aa, Borrelia burgdorferi B31
GFALALALIGCAQ

SEQ ID NO: 162378 - protein, 13 aa, Borrelia burgdorferi B31
FALALALIGCAQK

SEQ ID NO: 162379 - protein, 13 aa, Borrelia burgdorferi B31
ALALALIGCAQKG

SEQ ID NO: 162380 - protein, 13 aa, Borrelia burgdorferi B31
LALALIGCAQKGA

SEQ ID NO: 162381 - protein, 13 aa, Borrelia burgdorferi B31
ALALIGCAQKGAE

SEQ ID NO: 162382 - protein, 13 aa, Borrelia burgdorferi B31
LALIGCAQKGAES

SEQ ID NO: 162383 - protein, 13 aa, Borrelia burgdorferi B31
ALIGCAQKGAESI

SEQ ID NO: 162384 - protein, 13 aa, Borrelia burgdorferi B31
LIGCAQKGAESIG

SEQ ID NO: 162385 - protein, 13 aa, Borrelia burgdorferi B31
IGCAQKGAESIGS

SEQ ID NO: 162386 - protein, 13 aa, Borrelia burgdorferi B31
GCAQKGAESIGSQ

SEQ ID NO: 162387 - protein, 13 aa, Borrelia burgdorferi B31
CAQKGAESIGSQK

SEQ ID NO: 162388 - protein, 13 aa, Borrelia burgdorferi B31
AQKGAESIGSQKE

SEQ ID NO: 162389 - protein, 13 aa, Borrelia burgdorferi B31
QKGAESIGSQKEN

SEQ ID NO: 162390 - protein, 13 aa, Borrelia burgdorferi B31
KGAESIGSQKEND

SEQ ID NO: 162391 - protein, 13 aa, Borrelia burgdorferi B31
GAESIGSQKENDL

SEQ ID NO: 162392 - protein, 13 aa, Borrelia burgdorferi B31
AESIGSQKENDLN

SEQ ID NO: 162393 - protein, 13 aa, Borrelia burgdorferi B31
ESIGSQKENDLNL

SEQ ID NO: 162394 - protein, 13 aa, Borrelia burgdorferi B31
SIGSQKENDLNLE

SEQ ID NO: 162395 - protein, 13 aa, Borrelia burgdorferi B31
IGSQKENDLNLED

SEQ ID NO: 162396 - protein, 13 aa, Borrelia burgdorferi B31
GSQKENDLNLEDS

SEQ ID NO: 162397 - protein, 13 aa, Borrelia burgdorferi B31
SQKENDLNLEDSS

SEQ ID NO: 162398 - protein, 13 aa, Borrelia burgdorferi B31
QKENDLNLEDSSK

SEQ ID NO: 162399 - protein, 13 aa, Borrelia burgdorferi B31
KENDLNLEDSSKK

SEQ ID NO: 162400 - protein, 13 aa, Borrelia burgdorferi B31
ENDLNLEDSSKKS

SEQ ID NO: 162401 - protein, 13 aa, Borrelia burgdorferi B31
NDLNLEDSSKKSH

SEQ ID NO: 162402 - protein, 13 aa, Borrelia burgdorferi B31
DLNLEDSSKKSHQ

SEQ ID NO: 162403 - protein, 13 aa, Borrelia burgdorferi B31
LNLEDSSKKSHQN

SEQ ID NO: 162404 - protein, 13 aa, Borrelia burgdorferi B31
NLEDSSKKSHQNA

SEQ ID NO: 162405 - protein, 13 aa, Borrelia burgdorferi B31
LEDSSKKSHQNAK

SEQ ID NO: 162406 - protein, 13 aa, Borrelia burgdorferi B31
EDSSKKSHQNAKQ

SEQ ID NO: 162407 - protein, 13 aa, Borrelia burgdorferi B31
DSSKKSHQNAKQD

SEQ ID NO: 162408 - protein, 13 aa, Borrelia burgdorferi B31
SSKKSHQNAKQDL

SEQ ID NO: 162409 - protein, 13 aa, Borrelia burgdorferi B31
SKKSHQNAKQDLP

SEQ ID NO: 162410 - protein, 13 aa, Borrelia burgdorferi B31
KKSHQNAKQDLPA

SEQ ID NO: 162411 - protein, 13 aa, Borrelia burgdorferi B31
KSHQNAKQDLPAV

SEQ ID NO: 162412 - protein, 13 aa, Borrelia burgdorferi B31
SHQNAKQDLPAVT

SEQ ID NO: 162413 - protein, 13 aa, Borrelia burgdorferi B31
HQNAKQDLPAVTE

SEQ ID NO: 162414 - protein, 13 aa, Borrelia burgdorferi B31
QNAKQDLPAVTED

SEQ ID NO: 162415 - protein, 13 aa, Borrelia burgdorferi B31
NAKQDLPAVTEDS

SEQ ID NO: 162416 - protein, 13 aa, Borrelia burgdorferi B31
AKQDLPAVTEDSV

SEQ ID NO: 162417 - protein, 13 aa, Borrelia burgdorferi B31
KQDLPAVTEDSVS

SEQ ID NO: 162418 - protein, 13 aa, Borrelia burgdorferi B31
QDLPAVTEDSVSL

SEQ ID NO: 162419 - protein, 13 aa, Borrelia burgdorferi B31
DLPAVTEDSVSLF

SEQ ID NO: 162420 - protein, 13 aa, Borrelia burgdorferi B31
LPAVTEDSVSLFN

SEQ ID NO: 162421 - protein, 13 aa, Borrelia burgdorferi B31
PAVTEDSVSLFNG

SEQ ID NO: 162422 - protein, 13 aa, Borrelia burgdorferi B31
AVTEDSVSLFNGN

SEQ ID NO: 162423 - protein, 13 aa, Borrelia burgdorferi B31
VTEDSVSLFNGNK

SEQ ID NO: 162424 - protein, 13 aa, Borrelia burgdorferi B31
TEDSVSLFNGNKI

SEQ ID NO: 162425 - protein, 13 aa, Borrelia burgdorferi B31
EDSVSLFNGNKIF

SEQ ID NO: 162426 - protein, 13 aa, Borrelia burgdorferi B31
DSVSLFNGNKIFV

SEQ ID NO: 162427 - protein, 13 aa, Borrelia burgdorferi B31
SVSLFNGNKIFVS

SEQ ID NO: 162428 - protein, 13 aa, Borrelia burgdorferi B31
VSLFNGNKIFVSK

SEQ ID NO: 162429 - protein, 13 aa, Borrelia burgdorferi B31
SLFNGNKIFVSKE

SEQ ID NO: 162430 - protein, 13 aa, Borrelia burgdorferi B31
LFNGNKIFVSKEK

SEQ ID NO: 162431 - protein, 13 aa, Borrelia burgdorferi B31
FNGNKIFVSKEKN

SEQ ID NO: 162432 - protein, 13 aa, Borrelia burgdorferi B31
NGNKIFVSKEKNS

SEQ ID NO: 162433 - protein, 13 aa, Borrelia burgdorferi B31
GNKIFVSKEKNSS

SEQ ID NO: 162434 - protein, 13 aa, Borrelia burgdorferi B31
NKIFVSKEKNSSG

SEQ ID NO: 162435 - protein, 13 aa, Borrelia burgdorferi B31
KIFVSKEKNSSGK

SEQ ID NO: 162436 - protein, 13 aa, Borrelia burgdorferi B31
IFVSKEKNSSGKY

SEQ ID NO: 162437 - protein, 13 aa, Borrelia burgdorferi B31
FVSKEKNSSGKYD

SEQ ID NO: 162438 - protein, 13 aa, Borrelia burgdorferi B31
VSKEKNSSGKYDL

SEQ ID NO: 162439 - protein, 13 aa, Borrelia burgdorferi B31
SKEKNSSGKYDLR

SEQ ID NO: 162440 - protein, 13 aa, Borrelia burgdorferi B31
KEKNSSGKYDLRA

SEQ ID NO: 162441 - protein, 13 aa, Borrelia burgdorferi B31
EKNSSGKYDLRAT

SEQ ID NO: 162442 - protein, 13 aa, Borrelia burgdorferi B31
KNSSGKYDLRATI

SEQ ID NO: 162443 - protein, 13 aa, Borrelia burgdorferi B31
NSSGKYDLRATID

SEQ ID NO: 162444 - protein, 13 aa, Borrelia burgdorferi B31
SSGKYDLRATIDQ

SEQ ID NO: 162445 - protein, 13 aa, Borrelia burgdorferi B31
SGKYDLRATIDQV

SEQ ID NO: 162446 - protein, 13 aa, Borrelia burgdorferi B31
GKYDLRATIDQVE

SEQ ID NO: 162447 - protein, 13 aa, Borrelia burgdorferi B31
KYDLRATIDQVEL

SEQ ID NO: 162448 - protein, 13 aa, Borrelia burgdorferi B31
YDLRATIDQVELK

SEQ ID NO: 162449 - protein, 13 aa, Borrelia burgdorferi B31
DLRATIDQVELKG

SEQ ID NO: 162450 - protein, 13 aa, Borrelia burgdorferi B31
LRATIDQVELKGT

SEQ ID NO: 162451 - protein, 13 aa, Borrelia burgdorferi B31
RATIDQVELKGTS

SEQ ID NO: 162452 - protein, 13 aa, Borrelia burgdorferi B31
ATIDQVELKGTSD

SEQ ID NO: 162453 - protein, 13 aa, Borrelia burgdorferi B31
TIDQVELKGTSDK

SEQ ID NO: 162454 - protein, 13 aa, Borrelia burgdorferi B31
IDQVELKGTSDKN

SEQ ID NO: 162455 - protein, 13 aa, Borrelia burgdorferi B31
DQVELKGTSDKNN

SEQ ID NO: 162456 - protein, 13 aa, Borrelia burgdorferi B31
QVELKGTSDKNNG

SEQ ID NO: 162457 - protein, 13 aa, Borrelia burgdorferi B31
VELKGTSDKNNGS

SEQ ID NO: 162458 - protein, 13 aa, Borrelia burgdorferi B31
ELKGTSDKNNGSG

SEQ ID NO: 162459 - protein, 13 aa, Borrelia burgdorferi B31
LKGTSDKNNGSGT

SEQ ID NO: 162460 - protein, 13 aa, Borrelia burgdorferi B31
KGTSDKNNGSGTL

SEQ ID NO: 162461 - protein, 13 aa, Borrelia burgdorferi B31
GTSDKNNGSGTLE

SEQ ID NO: 162462 - protein, 13 aa, Borrelia burgdorferi B31
TSDKNNGSGTLEG

SEQ ID NO: 162463 - protein, 13 aa, Borrelia burgdorferi B31
SDKNNGSGTLEGS

SEQ ID NO: 162464 - protein, 13 aa, Borrelia burgdorferi B31
DKNNGSGTLEGSK

SEQ ID NO: 162465 - protein, 13 aa, Borrelia burgdorferi B31
KNNGSGTLEGSKP

SEQ ID NO: 162466 - protein, 13 aa, Borrelia burgdorferi B31
NNGSGTLEGSKPD

SEQ ID NO: 162467 - protein, 13 aa, Borrelia burgdorferi B31
NGSGTLEGSKPDK

SEQ ID NO: 162468 - protein, 13 aa, Borrelia burgdorferi B31
GSGTLEGSKPDKS

SEQ ID NO: 162469 - protein, 13 aa, Borrelia burgdorferi B31
SGTLEGSKPDKSK

SEQ ID NO: 162470 - protein, 13 aa, Borrelia burgdorferi B31
GTLEGSKPDKSKV

SEQ ID NO: 162471 - protein, 13 aa, Borrelia burgdorferi B31
TLEGSKPDKSKVK

SEQ ID NO: 162472 - protein, 13 aa, Borrelia burgdorferi B31
LEGSKPDKSKVKL

SEQ ID NO: 162473 - protein, 13 aa, Borrelia burgdorferi B31
EGSKPDKSKVKLT

SEQ ID NO: 162474 - protein, 13 aa, Borrelia burgdorferi B31
GSKPDKSKVKLTV

SEQ ID NO: 162475 - protein, 13 aa, Borrelia burgdorferi B31
SKPDKSKVKLTVS

SEQ ID NO: 162476 - protein, 13 aa, Borrelia burgdorferi B31
KPDKSKVKLTVSA

SEQ ID NO: 162477 - protein, 13 aa, Borrelia burgdorferi B31
PDKSKVKLTVSAD

SEQ ID NO: 162478 - protein, 13 aa, Borrelia burgdorferi B31
DKSKVKLTVSADL

SEQ ID NO: 162479 - protein, 13 aa, Borrelia burgdorferi B31
KSKVKLTVSADLN

SEQ ID NO: 162480 - protein, 13 aa, Borrelia burgdorferi B31
SKVKLTVSADLNT

SEQ ID NO: 162481 - protein, 13 aa, Borrelia burgdorferi B31
KVKLTVSADLNTV

SEQ ID NO: 162482 - protein, 13 aa, Borrelia burgdorferi B31
VKLTVSADLNTVT

SEQ ID NO: 162483 - protein, 13 aa, Borrelia burgdorferi B31
KLTVSADLNTVTL

SEQ ID NO: 162484 - protein, 13 aa, Borrelia burgdorferi B31
LTVSADLNTVTLE

SEQ ID NO: 162485 - protein, 13 aa, Borrelia burgdorferi B31
TVSADLNTVTLEA

SEQ ID NO: 162486 - protein, 13 aa, Borrelia burgdorferi B31
VSADLNTVTLEAF

SEQ ID NO: 162487 - protein, 13 aa, Borrelia burgdorferi B31
SADLNTVTLEAFD

SEQ ID NO: 162488 - protein, 13 aa, Borrelia burgdorferi B31
ADLNTVTLEAFDA

SEQ ID NO: 162489 - protein, 13 aa, Borrelia burgdorferi B31
DLNTVTLEAFDAS

SEQ ID NO: 162490 - protein, 13 aa, Borrelia burgdorferi B31
LNTVTLEAFDASN

SEQ ID NO: 162491 - protein, 13 aa, Borrelia burgdorferi B31
NTVTLEAFDASNQ

SEQ ID NO: 162492 - protein, 13 aa, Borrelia burgdorferi B31
TVTLEAFDASNQK

SEQ ID NO: 162493 - protein, 13 aa, Borrelia burgdorferi B31
VTLEAFDASNQKI

SEQ ID NO: 162494 - protein, 13 aa, Borrelia burgdorferi B31
TLEAFDASNQKIS

SEQ ID NO: 162495 - protein, 13 aa, Borrelia burgdorferi B31
LEAFDASNQKISS

SEQ ID NO: 162496 - protein, 13 aa, Borrelia burgdorferi B31
EAFDASNQKISSK

SEQ ID NO: 162497 - protein, 13 aa, Borrelia burgdorferi B31
AFDASNQKISSKV

SEQ ID NO: 162498 - protein, 13 aa, Borrelia burgdorferi B31
FDASNQKISSKVT

SEQ ID NO: 162499 - protein, 13 aa, Borrelia burgdorferi B31
DASNQKISSKVTK

SEQ ID NO: 162500 - protein, 13 aa, Borrelia burgdorferi B31
ASNQKISSKVTKK

SEQ ID NO: 162501 - protein, 13 aa, Borrelia burgdorferi B31
SNQKISSKVTKKQ

SEQ ID NO: 162502 - protein, 13 aa, Borrelia burgdorferi B31
NQKISSKVTKKQG

SEQ ID NO: 162503 - protein, 13 aa, Borrelia burgdorferi B31
QKISSKVTKKQGS

SEQ ID NO: 162504 - protein, 13 aa, Borrelia burgdorferi B31
KISSKVTKKQGSI

SEQ ID NO: 162505 - protein, 13 aa, Borrelia burgdorferi B31
ISSKVTKKQGSIT

SEQ ID NO: 162506 - protein, 13 aa, Borrelia burgdorferi B31
  Xaa can be any naturally occurring amino acid
  VARIANT 13: Xaa = Any Amino Acid
SSKVTKKQGSITX

SEQ ID NO: 162507 - protein, 13 aa, Borrelia burgdorferi B31
  Xaa can be any naturally occurring amino acid
  VARIANT 12: Xaa = Any Amino Acid
SKVTKKQGSITXE

SEQ ID NO: 162508 - protein, 13 aa, Borrelia burgdorferi B31
  Xaa can be any naturally occurring amino acid
  VARIANT 11: Xaa = Any Amino Acid
KVTKKQGSITXET

SEQ ID NO: 162509 - protein, 13 aa, Borrelia burgdorferi B31
  Xaa can be any naturally occurring amino acid
  VARIANT 10: Xaa = Any Amino Acid
VTKKQGSITXETL

SEQ ID NO: 162510 - protein, 13 aa, Borrelia burgdorferi B31
  Xaa can be any naturally occurring amino acid
  VARIANT 9: Xaa = Any Amino Acid
TKKQGSITXETLK

SEQ ID NO: 162511 - protein, 13 aa, Borrelia burgdorferi B31
  Xaa can be any naturally occurring amino acid
  VARIANT 8: Xaa = Any Amino Acid
KKQGSITXETLKA

SEQ ID NO: 162512 - protein, 13 aa, Borrelia burgdorferi B31
  Xaa can be any naturally occurring amino acid
  VARIANT 7: Xaa = Any Amino Acid
KQGSITXETLKAN

SEQ ID NO: 162513 - protein, 13 aa, Borrelia burgdorferi B31
  Xaa can be any naturally occurring amino acid
  VARIANT 6: Xaa = Any Amino Acid
QGSITXETLKANK

SEQ ID NO: 162514 - protein, 13 aa, Borrelia burgdorferi B31
  Xaa can be any naturally occurring amino acid
  VARIANT 5: Xaa = Any Amino Acid
GSITXETLKANKL

SEQ ID NO: 162515 - protein, 13 aa, Borrelia burgdorferi B31
  Xaa can be any naturally occurring amino acid
  VARIANT 4: Xaa = Any Amino Acid
SITXETLKANKLD

SEQ ID NO: 162516 - protein, 13 aa, Borrelia burgdorferi B31
  Xaa can be any naturally occurring amino acid
  VARIANT 3: Xaa = Any Amino Acid
ITXETLKANKLDS

SEQ ID NO: 162517 - protein, 13 aa, Borrelia burgdorferi B31
  Xaa can be any naturally occurring amino acid
  VARIANT 2: Xaa = Any Amino Acid
TXETLKANKLDSK

SEQ ID NO: 162518 - protein, 13 aa, Borrelia burgdorferi B31
  Xaa can be any naturally occurring amino acid
  VARIANT 1: Xaa = Any Amino Acid
XETLKANKLDSKK

SEQ ID NO: 162519 - protein, 13 aa, Borrelia burgdorferi B31
ETLKANKLDSKKL

SEQ ID NO: 162520 - protein, 13 aa, Borrelia burgdorferi B31
TLKANKLDSKKLT

SEQ ID NO: 162521 - protein, 13 aa, Borrelia burgdorferi B31
LKANKLDSKKLTR

SEQ ID NO: 162522 - protein, 13 aa, Borrelia burgdorferi B31
KANKLDSKKLTRS

SEQ ID NO: 162523 - protein, 13 aa, Borrelia burgdorferi B31
ANKLDSKKLTRSN

SEQ ID NO: 162524 - protein, 13 aa, Borrelia burgdorferi B31
NKLDSKKLTRSNG

SEQ ID NO: 162525 - protein, 13 aa, Borrelia burgdorferi B31
KLDSKKLTRSNGT

SEQ ID NO: 162526 - protein, 13 aa, Borrelia burgdorferi B31
LDSKKLTRSNGTT

SEQ ID NO: 162527 - protein, 13 aa, Borrelia burgdorferi B31
DSKKLTRSNGTTL

SEQ ID NO: 162528 - protein, 13 aa, Borrelia burgdorferi B31
SKKLTRSNGTTLE

SEQ ID NO: 162529 - protein, 13 aa, Borrelia burgdorferi B31
KKLTRSNGTTLEY

SEQ ID NO: 162530 - protein, 13 aa, Borrelia burgdorferi B31
KLTRSNGTTLEYS

SEQ ID NO: 162531 - protein, 13 aa, Borrelia burgdorferi B31
LTRSNGTTLEYSQ

SEQ ID NO: 162532 - protein, 13 aa, Borrelia burgdorferi B31
TRSNGTTLEYSQI

SEQ ID NO: 162533 - protein, 13 aa, Borrelia burgdorferi B31
RSNGTTLEYSQIT

SEQ ID NO: 162534 - protein, 13 aa, Borrelia burgdorferi B31
SNGTTLEYSQITD

SEQ ID NO: 162535 - protein, 13 aa, Borrelia burgdorferi B31
NGTTLEYSQITDA

SEQ ID NO: 162536 - protein, 13 aa, Borrelia burgdorferi B31
GTTLEYSQITDAD

SEQ ID NO: 162537 - protein, 13 aa, Borrelia burgdorferi B31
TTLEYSQITDADN

SEQ ID NO: 162538 - protein, 13 aa, Borrelia burgdorferi B31
TLEYSQITDADNA

SEQ ID NO: 162539 - protein, 13 aa, Borrelia burgdorferi B31
LEYSQITDADNAT

SEQ ID NO: 162540 - protein, 13 aa, Borrelia burgdorferi B31
EYSQITDADNATK

SEQ ID NO: 162541 - protein, 13 aa, Borrelia burgdorferi B31
YSQITDADNATKA

SEQ ID NO: 162542 - protein, 13 aa, Borrelia burgdorferi B31
SQITDADNATKAV

SEQ ID NO: 162543 - protein, 13 aa, Borrelia burgdorferi B31
QITDADNATKAVE

SEQ ID NO: 162544 - protein, 13 aa, Borrelia burgdorferi B31
ITDADNATKAVET

SEQ ID NO: 162545 - protein, 13 aa, Borrelia burgdorferi B31
TDADNATKAVETL

SEQ ID NO: 162546 - protein, 13 aa, Borrelia burgdorferi B31
DADNATKAVETLK

SEQ ID NO: 162547 - protein, 13 aa, Borrelia burgdorferi B31
ADNATKAVETLKN

SEQ ID NO: 162548 - protein, 13 aa, Borrelia burgdorferi B31
DNATKAVETLKNS

SEQ ID NO: 162549 - protein, 13 aa, Borrelia burgdorferi B31
NATKAVETLKNSI

SEQ ID NO: 162550 - protein, 13 aa, Borrelia burgdorferi B31
ATKAVETLKNSIK

SEQ ID NO: 162551 - protein, 13 aa, Borrelia burgdorferi B31
TKAVETLKNSIKL

SEQ ID NO: 162552 - protein, 13 aa, Borrelia burgdorferi B31
KAVETLKNSIKLE

SEQ ID NO: 162553 - protein, 13 aa, Borrelia burgdorferi B31
AVETLKNSIKLEG

SEQ ID NO: 162554 - protein, 13 aa, Borrelia burgdorferi B31
VETLKNSIKLEGS

SEQ ID NO: 162555 - protein, 13 aa, Borrelia burgdorferi B31
ETLKNSIKLEGSL

SEQ ID NO: 162556 - protein, 13 aa, Borrelia burgdorferi B31
TLKNSIKLEGSLV

SEQ ID NO: 162557 - protein, 13 aa, Borrelia burgdorferi B31
LKNSIKLEGSLVG

SEQ ID NO: 162558 - protein, 13 aa, Borrelia burgdorferi B31
KNSIKLEGSLVGG

SEQ ID NO: 162559 - protein, 13 aa, Borrelia burgdorferi B31
NSIKLEGSLVGGK

SEQ ID NO: 162560 - protein, 13 aa, Borrelia burgdorferi B31
SIKLEGSLVGGKT

SEQ ID NO: 162561 - protein, 13 aa, Borrelia burgdorferi B31
IKLEGSLVGGKTT

SEQ ID NO: 162562 - protein, 13 aa, Borrelia burgdorferi B31
KLEGSLVGGKTTV

SEQ ID NO: 162563 - protein, 13 aa, Borrelia burgdorferi B31
LEGSLVGGKTTVE

SEQ ID NO: 162564 - protein, 13 aa, Borrelia burgdorferi B31
EGSLVGGKTTVEI

SEQ ID NO: 162565 - protein, 13 aa, Borrelia burgdorferi B31
GSLVGGKTTVEIK

SEQ ID NO: 162566 - protein, 13 aa, Borrelia burgdorferi B31
SLVGGKTTVEIKE

SEQ ID NO: 162567 - protein, 13 aa, Borrelia burgdorferi B31
LVGGKTTVEIKEG

SEQ ID NO: 162568 - protein, 13 aa, Borrelia burgdorferi B31
VGGKTTVEIKEGT

SEQ ID NO: 162569 - protein, 13 aa, Borrelia burgdorferi B31
GGKTTVEIKEGTV

SEQ ID NO: 162570 - protein, 13 aa, Borrelia burgdorferi B31
GKTTVEIKEGTVT

SEQ ID NO: 162571 - protein, 13 aa, Borrelia burgdorferi B31
KTTVEIKEGTVTL

SEQ ID NO: 162572 - protein, 13 aa, Borrelia burgdorferi B31
TTVEIKEGTVTLK

SEQ ID NO: 162573 - protein, 13 aa, Borrelia burgdorferi B31
TVEIKEGTVTLKR

SEQ ID NO: 162574 - protein, 13 aa, Borrelia burgdorferi B31
VEIKEGTVTLKRE

SEQ ID NO: 162575 - protein, 13 aa, Borrelia burgdorferi B31
EIKEGTVTLKREI

SEQ ID NO: 162576 - protein, 13 aa, Borrelia burgdorferi B31
IKEGTVTLKREIE

SEQ ID NO: 162577 - protein, 13 aa, Borrelia burgdorferi B31
KEGTVTLKREIEK

SEQ ID NO: 162578 - protein, 13 aa, Borrelia burgdorferi B31
EGTVTLKREIEKD

SEQ ID NO: 162579 - protein, 13 aa, Borrelia burgdorferi B31
GTVTLKREIEKDG

SEQ ID NO: 162580 - protein, 13 aa, Borrelia burgdorferi B31
TVTLKREIEKDGK

SEQ ID NO: 162581 - protein, 13 aa, Borrelia burgdorferi B31
VTLKREIEKDGKV

SEQ ID NO: 162582 - protein, 13 aa, Borrelia burgdorferi B31
TLKREIEKDGKVK

SEQ ID NO: 162583 - protein, 13 aa, Borrelia burgdorferi B31
LKREIEKDGKVKV

SEQ ID NO: 162584 - protein, 13 aa, Borrelia burgdorferi B31
KREIEKDGKVKVF

SEQ ID NO: 162585 - protein, 13 aa, Borrelia burgdorferi B31
REIEKDGKVKVFL

SEQ ID NO: 162586 - protein, 13 aa, Borrelia burgdorferi B31
EIEKDGKVKVFLN

SEQ ID NO: 162587 - protein, 13 aa, Borrelia burgdorferi B31
IEKDGKVKVFLND

SEQ ID NO: 162588 - protein, 13 aa, Borrelia burgdorferi B31
EKDGKVKVFLNDT

SEQ ID NO: 162589 - protein, 13 aa, Borrelia burgdorferi B31
KDGKVKVFLNDTA

SEQ ID NO: 162590 - protein, 13 aa, Borrelia burgdorferi B31
DGKVKVFLNDTAG

SEQ ID NO: 162591 - protein, 13 aa, Borrelia burgdorferi B31
GKVKVFLNDTAGS

SEQ ID NO: 162592 - protein, 13 aa, Borrelia burgdorferi B31
KVKVFLNDTAGSN

SEQ ID NO: 162593 - protein, 13 aa, Borrelia burgdorferi B31
VKVFLNDTAGSNK

SEQ ID NO: 162594 - protein, 13 aa, Borrelia burgdorferi B31
KVFLNDTAGSNKK

SEQ ID NO: 162595 - protein, 13 aa, Borrelia burgdorferi B31
VFLNDTAGSNKKT

SEQ ID NO: 162596 - protein, 13 aa, Borrelia burgdorferi B31
FLNDTAGSNKKTG

SEQ ID NO: 162597 - protein, 13 aa, Borrelia burgdorferi B31
LNDTAGSNKKTGK

SEQ ID NO: 162598 - protein, 13 aa, Borrelia burgdorferi B31
NDTAGSNKKTGKW

SEQ ID NO: 162599 - protein, 13 aa, Borrelia burgdorferi B31
DTAGSNKKTGKWE

SEQ ID NO: 162600 - protein, 13 aa, Borrelia burgdorferi B31
TAGSNKKTGKWED

SEQ ID NO: 162601 - protein, 13 aa, Borrelia burgdorferi B31
AGSNKKTGKWEDS

SEQ ID NO: 162602 - protein, 13 aa, Borrelia burgdorferi B31
GSNKKTGKWEDST

SEQ ID NO: 162603 - protein, 13 aa, Borrelia burgdorferi B31
SNKKTGKWEDSTS

SEQ ID NO: 162604 - protein, 13 aa, Borrelia burgdorferi B31
NKKTGKWEDSTST

SEQ ID NO: 162605 - protein, 13 aa, Borrelia burgdorferi B31
KKTGKWEDSTSTL

SEQ ID NO: 162606 - protein, 13 aa, Borrelia burgdorferi B31
KTGKWEDSTSTLT

SEQ ID NO: 162607 - protein, 13 aa, Borrelia burgdorferi B31
TGKWEDSTSTLTI

SEQ ID NO: 162608 - protein, 13 aa, Borrelia burgdorferi B31
GKWEDSTSTLTIS

SEQ ID NO: 162609 - protein, 13 aa, Borrelia burgdorferi B31
KWEDSTSTLTISA

SEQ ID NO: 162610 - protein, 13 aa, Borrelia burgdorferi B31
WEDSTSTLTISAD

SEQ ID NO: 162611 - protein, 13 aa, Borrelia burgdorferi B31
EDSTSTLTISADS

SEQ ID NO: 162612 - protein, 13 aa, Borrelia burgdorferi B31
DSTSTLTISADSK

SEQ ID NO: 162613 - protein, 13 aa, Borrelia burgdorferi B31
STSTLTISADSKK

SEQ ID NO: 162614 - protein, 13 aa, Borrelia burgdorferi B31
TSTLTISADSKKT

SEQ ID NO: 162615 - protein, 13 aa, Borrelia burgdorferi B31
STLTISADSKKTK

SEQ ID NO: 162616 - protein, 13 aa, Borrelia burgdorferi B31
TLTISADSKKTKD

SEQ ID NO: 162617 - protein, 13 aa, Borrelia burgdorferi B31
LTISADSKKTKDL

SEQ ID NO: 162618 - protein, 13 aa, Borrelia burgdorferi B31
TISADSKKTKDLV

SEQ ID NO: 162619 - protein, 13 aa, Borrelia burgdorferi B31
ISADSKKTKDLVF

SEQ ID NO: 162620 - protein, 13 aa, Borrelia burgdorferi B31
SADSKKTKDLVFL

SEQ ID NO: 162621 - protein, 13 aa, Borrelia burgdorferi B31
ADSKKTKDLVFLT

SEQ ID NO: 162622 - protein, 13 aa, Borrelia burgdorferi B31
DSKKTKDLVFLTD

SEQ ID NO: 162623 - protein, 13 aa, Borrelia burgdorferi B31
SKKTKDLVFLTDG

SEQ ID NO: 162624 - protein, 13 aa, Borrelia burgdorferi B31
KKTKDLVFLTDGT

SEQ ID NO: 162625 - protein, 13 aa, Borrelia burgdorferi B31
KTKDLVFLTDGTI

SEQ ID NO: 162626 - protein, 13 aa, Borrelia burgdorferi B31
TKDLVFLTDGTIT

SEQ ID NO: 162627 - protein, 13 aa, Borrelia burgdorferi B31
KDLVFLTDGTITV

SEQ ID NO: 162628 - protein, 13 aa, Borrelia burgdorferi B31
DLVFLTDGTITVQ

SEQ ID NO: 162629 - protein, 13 aa, Borrelia burgdorferi B31
LVFLTDGTITVQQ

SEQ ID NO: 162630 - protein, 13 aa, Borrelia burgdorferi B31
VFLTDGTITVQQY

SEQ ID NO: 162631 - protein, 13 aa, Borrelia burgdorferi B31
FLTDGTITVQQYN

SEQ ID NO: 162632 - protein, 13 aa, Borrelia burgdorferi B31
LTDGTITVQQYNT

SEQ ID NO: 162633 - protein, 13 aa, Borrelia burgdorferi B31
TDGTITVQQYNTA

SEQ ID NO: 162634 - protein, 13 aa, Borrelia burgdorferi B31
DGTITVQQYNTAG

SEQ ID NO: 162635 - protein, 13 aa, Borrelia burgdorferi B31
GTITVQQYNTAGT

SEQ ID NO: 162636 - protein, 13 aa, Borrelia burgdorferi B31
TITVQQYNTAGTS

SEQ ID NO: 162637 - protein, 13 aa, Borrelia burgdorferi B31
ITVQQYNTAGTSL

SEQ ID NO: 162638 - protein, 13 aa, Borrelia burgdorferi B31
TVQQYNTAGTSLE

SEQ ID NO: 162639 - protein, 13 aa, Borrelia burgdorferi B31
VQQYNTAGTSLEG

SEQ ID NO: 162640 - protein, 13 aa, Borrelia burgdorferi B31
QQYNTAGTSLEGS

SEQ ID NO: 162641 - protein, 13 aa, Borrelia burgdorferi B31
QYNTAGTSLEGSA

SEQ ID NO: 162642 - protein, 13 aa, Borrelia burgdorferi B31
YNTAGTSLEGSAS

SEQ ID NO: 162643 - protein, 13 aa, Borrelia burgdorferi B31
NTAGTSLEGSASE

SEQ ID NO: 162644 - protein, 13 aa, Borrelia burgdorferi B31
TAGTSLEGSASEI

SEQ ID NO: 162645 - protein, 13 aa, Borrelia burgdorferi B31
AGTSLEGSASEIK

SEQ ID NO: 162646 - protein, 13 aa, Borrelia burgdorferi B31
GTSLEGSASEIKN

SEQ ID NO: 162647 - protein, 13 aa, Borrelia burgdorferi B31
TSLEGSASEIKNL

SEQ ID NO: 162648 - protein, 13 aa, Borrelia burgdorferi B31
SLEGSASEIKNLS

SEQ ID NO: 162649 - protein, 13 aa, Borrelia burgdorferi B31
LEGSASEIKNLSE

SEQ ID NO: 162650 - protein, 13 aa, Borrelia burgdorferi B31
EGSASEIKNLSEL

SEQ ID NO: 162651 - protein, 13 aa, Borrelia burgdorferi B31
GSASEIKNLSELK

SEQ ID NO: 162652 - protein, 13 aa, Borrelia burgdorferi B31
SASEIKNLSELKN

SEQ ID NO: 162653 - protein, 13 aa, Borrelia burgdorferi B31
ASEIKNLSELKNA

SEQ ID NO: 162654 - protein, 13 aa, Borrelia burgdorferi B31
SEIKNLSELKNAL

SEQ ID NO: 162655 - protein, 13 aa, Borrelia burgdorferi B31
EIKNLSELKNALK

SEQ ID NO: 162656 - protein, 14 aa, Borrelia burgdorferi B31
MRLLIGFALALALI

SEQ ID NO: 162657 - protein, 14 aa, Borrelia burgdorferi B31
RLLIGFALALALIG

SEQ ID NO: 162658 - protein, 14 aa, Borrelia burgdorferi B31
LLIGFALALALIGC

SEQ ID NO: 162659 - protein, 14 aa, Borrelia burgdorferi B31
LIGFALALALIGCA

SEQ ID NO: 162660 - protein, 14 aa, Borrelia burgdorferi B31
IGFALALALIGCAQ

SEQ ID NO: 162661 - protein, 14 aa, Borrelia burgdorferi B31
GFALALALIGCAQK

SEQ ID NO: 162662 - protein, 14 aa, Borrelia burgdorferi B31
FALALALIGCAQKG

SEQ ID NO: 162663 - protein, 14 aa, Borrelia burgdorferi B31
ALALALIGCAQKGA

SEQ ID NO: 162664 - protein, 14 aa, Borrelia burgdorferi B31
LALALIGCAQKGAE

SEQ ID NO: 162665 - protein, 14 aa, Borrelia burgdorferi B31
ALALIGCAQKGAES

SEQ ID NO: 162666 - protein, 14 aa, Borrelia burgdorferi B31
LALIGCAQKGAESI

SEQ ID NO: 162667 - protein, 14 aa, Borrelia burgdorferi B31
ALIGCAQKGAESIG

SEQ ID NO: 162668 - protein, 14 aa, Borrelia burgdorferi B31
LIGCAQKGAESIGS

SEQ ID NO: 162669 - protein, 14 aa, Borrelia burgdorferi B31
IGCAQKGAESIGSQ

SEQ ID NO: 162670 - protein, 14 aa, Borrelia burgdorferi B31
GCAQKGAESIGSQK

SEQ ID NO: 162671 - protein, 14 aa, Borrelia burgdorferi B31
CAQKGAESIGSQKE

SEQ ID NO: 162672 - protein, 14 aa, Borrelia burgdorferi B31
AQKGAESIGSQKEN

SEQ ID NO: 162673 - protein, 14 aa, Borrelia burgdorferi B31
QKGAESIGSQKEND

SEQ ID NO: 162674 - protein, 14 aa, Borrelia burgdorferi B31
KGAESIGSQKENDL

SEQ ID NO: 162675 - protein, 14 aa, Borrelia burgdorferi B31
GAESIGSQKENDLN

SEQ ID NO: 162676 - protein, 14 aa, Borrelia burgdorferi B31
AESIGSQKENDLNL

SEQ ID NO: 162677 - protein, 14 aa, Borrelia burgdorferi B31
ESIGSQKENDLNLE

SEQ ID NO: 162678 - protein, 14 aa, Borrelia burgdorferi B31
SIGSQKENDLNLED

SEQ ID NO: 162679 - protein, 14 aa, Borrelia burgdorferi B31
IGSQKENDLNLEDS

SEQ ID NO: 162680 - protein, 14 aa, Borrelia burgdorferi B31
GSQKENDLNLEDSS

SEQ ID NO: 162681 - protein, 14 aa, Borrelia burgdorferi B31
SQKENDLNLEDSSK

SEQ ID NO: 162682 - protein, 14 aa, Borrelia burgdorferi B31
QKENDLNLEDSSKK

SEQ ID NO: 162683 - protein, 14 aa, Borrelia burgdorferi B31
KENDLNLEDSSKKS

SEQ ID NO: 162684 - protein, 14 aa, Borrelia burgdorferi B31
ENDLNLEDSSKKSH

SEQ ID NO: 162685 - protein, 14 aa, Borrelia burgdorferi B31
NDLNLEDSSKKSHQ

SEQ ID NO: 162686 - protein, 14 aa, Borrelia burgdorferi B31
DLNLEDSSKKSHQN

SEQ ID NO: 162687 - protein, 14 aa, Borrelia burgdorferi B31
LNLEDSSKKSHQNA

SEQ ID NO: 162688 - protein, 14 aa, Borrelia burgdorferi B31
NLEDSSKKSHQNAK

SEQ ID NO: 162689 - protein, 14 aa, Borrelia burgdorferi B31
LEDSSKKSHQNAKQ

SEQ ID NO: 162690 - protein, 14 aa, Borrelia burgdorferi B31
EDSSKKSHQNAKQD

SEQ ID NO: 162691 - protein, 14 aa, Borrelia burgdorferi B31
DSSKKSHQNAKQDL

SEQ ID NO: 162692 - protein, 14 aa, Borrelia burgdorferi B31
SSKKSHQNAKQDLP

SEQ ID NO: 162693 - protein, 14 aa, Borrelia burgdorferi B31
SKKSHQNAKQDLPA

SEQ ID NO: 162694 - protein, 14 aa, Borrelia burgdorferi B31
KKSHQNAKQDLPAV

SEQ ID NO: 162695 - protein, 14 aa, Borrelia burgdorferi B31
KSHQNAKQDLPAVT

SEQ ID NO: 162696 - protein, 14 aa, Borrelia burgdorferi B31
SHQNAKQDLPAVTE

SEQ ID NO: 162697 - protein, 14 aa, Borrelia burgdorferi B31
HQNAKQDLPAVTED

SEQ ID NO: 162698 - protein, 14 aa, Borrelia burgdorferi B31
QNAKQDLPAVTEDS

SEQ ID NO: 162699 - protein, 14 aa, Borrelia burgdorferi B31
NAKQDLPAVTEDSV

SEQ ID NO: 162700 - protein, 14 aa, Borrelia burgdorferi B31
AKQDLPAVTEDSVS

SEQ ID NO: 162701 - protein, 14 aa, Borrelia burgdorferi B31
KQDLPAVTEDSVSL

SEQ ID NO: 162702 - protein, 14 aa, Borrelia burgdorferi B31
QDLPAVTEDSVSLF

SEQ ID NO: 162703 - protein, 14 aa, Borrelia burgdorferi B31
DLPAVTEDSVSLFN

SEQ ID NO: 162704 - protein, 14 aa, Borrelia burgdorferi B31
LPAVTEDSVSLFNG

SEQ ID NO: 162705 - protein, 14 aa, Borrelia burgdorferi B31
PAVTEDSVSLFNGN

SEQ ID NO: 162706 - protein, 14 aa, Borrelia burgdorferi B31
AVTEDSVSLFNGNK

SEQ ID NO: 162707 - protein, 14 aa, Borrelia burgdorferi B31
VTEDSVSLFNGNKI

SEQ ID NO: 162708 - protein, 14 aa, Borrelia burgdorferi B31
TEDSVSLFNGNKIF

SEQ ID NO: 162709 - protein, 14 aa, Borrelia burgdorferi B31
EDSVSLFNGNKIFV

SEQ ID NO: 162710 - protein, 14 aa, Borrelia burgdorferi B31
DSVSLFNGNKIFVS

SEQ ID NO: 162711 - protein, 14 aa, Borrelia burgdorferi B31
SVSLFNGNKIFVSK

SEQ ID NO: 162712 - protein, 14 aa, Borrelia burgdorferi B31
VSLFNGNKIFVSKE

SEQ ID NO: 162713 - protein, 14 aa, Borrelia burgdorferi B31
SLFNGNKIFVSKEK

SEQ ID NO: 162714 - protein, 14 aa, Borrelia burgdorferi B31
LFNGNKIFVSKEKN

SEQ ID NO: 162715 - protein, 14 aa, Borrelia burgdorferi B31
FNGNKIFVSKEKNS

SEQ ID NO: 162716 - protein, 14 aa, Borrelia burgdorferi B31
NGNKIFVSKEKNSS

SEQ ID NO: 162717 - protein, 14 aa, Borrelia burgdorferi B31
GNKIFVSKEKNSSG

SEQ ID NO: 162718 - protein, 14 aa, Borrelia burgdorferi B31
NKIFVSKEKNSSGK

SEQ ID NO: 162719 - protein, 14 aa, Borrelia burgdorferi B31
KIFVSKEKNSSGKY

SEQ ID NO: 162720 - protein, 14 aa, Borrelia burgdorferi B31
IFVSKEKNSSGKYD

SEQ ID NO: 162721 - protein, 14 aa, Borrelia burgdorferi B31
FVSKEKNSSGKYDL

SEQ ID NO: 162722 - protein, 14 aa, Borrelia burgdorferi B31
VSKEKNSSGKYDLR

SEQ ID NO: 162723 - protein, 14 aa, Borrelia burgdorferi B31
SKEKNSSGKYDLRA

SEQ ID NO: 162724 - protein, 14 aa, Borrelia burgdorferi B31
KEKNSSGKYDLRAT

SEQ ID NO: 162725 - protein, 14 aa, Borrelia burgdorferi B31
EKNSSGKYDLRATI

SEQ ID NO: 162726 - protein, 14 aa, Borrelia burgdorferi B31
KNSSGKYDLRATID

SEQ ID NO: 162727 - protein, 14 aa, Borrelia burgdorferi B31
NSSGKYDLRATIDQ

SEQ ID NO: 162728 - protein, 14 aa, Borrelia burgdorferi B31
SSGKYDLRATIDQV

SEQ ID NO: 162729 - protein, 14 aa, Borrelia burgdorferi B31
SGKYDLRATIDQVE

SEQ ID NO: 162730 - protein, 14 aa, Borrelia burgdorferi B31
GKYDLRATIDQVEL

SEQ ID NO: 162731 - protein, 14 aa, Borrelia burgdorferi B31
KYDLRATIDQVELK

SEQ ID NO: 162732 - protein, 14 aa, Borrelia burgdorferi B31
YDLRATIDQVELKG

SEQ ID NO: 162733 - protein, 14 aa, Borrelia burgdorferi B31
DLRATIDQVELKGT

SEQ ID NO: 162734 - protein, 14 aa, Borrelia burgdorferi B31
LRATIDQVELKGTS

SEQ ID NO: 162735 - protein, 14 aa, Borrelia burgdorferi B31
RATIDQVELKGTSD

SEQ ID NO: 162736 - protein, 14 aa, Borrelia burgdorferi B31
ATIDQVELKGTSDK

SEQ ID NO: 162737 - protein, 14 aa, Borrelia burgdorferi B31
TIDQVELKGTSDKN

SEQ ID NO: 162738 - protein, 14 aa, Borrelia burgdorferi B31
IDQVELKGTSDKNN

SEQ ID NO: 162739 - protein, 14 aa, Borrelia burgdorferi B31
DQVELKGTSDKNNG

SEQ ID NO: 162740 - protein, 14 aa, Borrelia burgdorferi B31
QVELKGTSDKNNGS

SEQ ID NO: 162741 - protein, 14 aa, Borrelia burgdorferi B31
VELKGTSDKNNGSG

SEQ ID NO: 162742 - protein, 14 aa, Borrelia burgdorferi B31
ELKGTSDKNNGSGT

SEQ ID NO: 162743 - protein, 14 aa, Borrelia burgdorferi B31
LKGTSDKNNGSGTL

SEQ ID NO: 162744 - protein, 14 aa, Borrelia burgdorferi B31
KGTSDKNNGSGTLE

SEQ ID NO: 162745 - protein, 14 aa, Borrelia burgdorferi B31
GTSDKNNGSGTLEG

SEQ ID NO: 162746 - protein, 14 aa, Borrelia burgdorferi B31
TSDKNNGSGTLEGS

SEQ ID NO: 162747 - protein, 14 aa, Borrelia burgdorferi B31
SDKNNGSGTLEGSK

SEQ ID NO: 162748 - protein, 14 aa, Borrelia burgdorferi B31
DKNNGSGTLEGSKP

SEQ ID NO: 162749 - protein, 14 aa, Borrelia burgdorferi B31
KNNGSGTLEGSKPD

SEQ ID NO: 162750 - protein, 14 aa, Borrelia burgdorferi B31
NNGSGTLEGSKPDK

SEQ ID NO: 162751 - protein, 14 aa, Borrelia burgdorferi B31
NGSGTLEGSKPDKS

SEQ ID NO: 162752 - protein, 14 aa, Borrelia burgdorferi B31
GSGTLEGSKPDKSK

SEQ ID NO: 162753 - protein, 14 aa, Borrelia burgdorferi B31
SGTLEGSKPDKSKV

SEQ ID NO: 162754 - protein, 14 aa, Borrelia burgdorferi B31
GTLEGSKPDKSKVK

SEQ ID NO: 162755 - protein, 14 aa, Borrelia burgdorferi B31
TLEGSKPDKSKVKL

SEQ ID NO: 162756 - protein, 14 aa, Borrelia burgdorferi B31
LEGSKPDKSKVKLT

SEQ ID NO: 162757 - protein, 14 aa, Borrelia burgdorferi B31
EGSKPDKSKVKLTV

SEQ ID NO: 162758 - protein, 14 aa, Borrelia burgdorferi B31
GSKPDKSKVKLTVS

SEQ ID NO: 162759 - protein, 14 aa, Borrelia burgdorferi B31
SKPDKSKVKLTVSA

SEQ ID NO: 162760 - protein, 14 aa, Borrelia burgdorferi B31
KPDKSKVKLTVSAD

SEQ ID NO: 162761 - protein, 14 aa, Borrelia burgdorferi B31
PDKSKVKLTVSADL

SEQ ID NO: 162762 - protein, 14 aa, Borrelia burgdorferi B31
DKSKVKLTVSADLN

SEQ ID NO: 162763 - protein, 14 aa, Borrelia burgdorferi B31
KSKVKLTVSADLNT

SEQ ID NO: 162764 - protein, 14 aa, Borrelia burgdorferi B31
SKVKLTVSADLNTV

SEQ ID NO: 162765 - protein, 14 aa, Borrelia burgdorferi B31
KVKLTVSADLNTVT

SEQ ID NO: 162766 - protein, 14 aa, Borrelia burgdorferi B31
VKLTVSADLNTVTL

SEQ ID NO: 162767 - protein, 14 aa, Borrelia burgdorferi B31
KLTVSADLNTVTLE

SEQ ID NO: 162768 - protein, 14 aa, Borrelia burgdorferi B31
LTVSADLNTVTLEA

SEQ ID NO: 162769 - protein, 14 aa, Borrelia burgdorferi B31
TVSADLNTVTLEAF

SEQ ID NO: 162770 - protein, 14 aa, Borrelia burgdorferi B31
VSADLNTVTLEAFD

SEQ ID NO: 162771 - protein, 14 aa, Borrelia burgdorferi B31
SADLNTVTLEAFDA

SEQ ID NO: 162772 - protein, 14 aa, Borrelia burgdorferi B31
ADLNTVTLEAFDAS

SEQ ID NO: 162773 - protein, 14 aa, Borrelia burgdorferi B31
DLNTVTLEAFDASN

SEQ ID NO: 162774 - protein, 14 aa, Borrelia burgdorferi B31
LNTVTLEAFDASNQ

SEQ ID NO: 162775 - protein, 14 aa, Borrelia burgdorferi B31
NTVTLEAFDASNQK

SEQ ID NO: 162776 - protein, 14 aa, Borrelia burgdorferi B31
TVTLEAFDASNQKI

SEQ ID NO: 162777 - protein, 14 aa, Borrelia burgdorferi B31
VTLEAFDASNQKIS

SEQ ID NO: 162778 - protein, 14 aa, Borrelia burgdorferi B31
TLEAFDASNQKISS

SEQ ID NO: 162779 - protein, 14 aa, Borrelia burgdorferi B31
LEAFDASNQKISSK

SEQ ID NO: 162780 - protein, 14 aa, Borrelia burgdorferi B31
EAFDASNQKISSKV

SEQ ID NO: 162781 - protein, 14 aa, Borrelia burgdorferi B31
AFDASNQKISSKVT

SEQ ID NO: 162782 - protein, 14 aa, Borrelia burgdorferi B31
FDASNQKISSKVTK

SEQ ID NO: 162783 - protein, 14 aa, Borrelia burgdorferi B31
DASNQKISSKVTKK

SEQ ID NO: 162784 - protein, 14 aa, Borrelia burgdorferi B31
ASNQKISSKVTKKQ

SEQ ID NO: 162785 - protein, 14 aa, Borrelia burgdorferi B31
SNQKISSKVTKKQG

SEQ ID NO: 162786 - protein, 14 aa, Borrelia burgdorferi B31
NQKISSKVTKKQGS

SEQ ID NO: 162787 - protein, 14 aa, Borrelia burgdorferi B31
QKISSKVTKKQGSI

SEQ ID NO: 162788 - protein, 14 aa, Borrelia burgdorferi B31
KISSKVTKKQGSIT

SEQ ID NO: 162789 - protein, 14 aa, Borrelia burgdorferi B31
  Xaa can be any naturally occurring amino acid
  VARIANT 14: Xaa = Any Amino Acid
ISSKVTKKQGSITX

SEQ ID NO: 162790 - protein, 14 aa, Borrelia burgdorferi B31
  Xaa can be any naturally occurring amino acid
  VARIANT 13: Xaa = Any Amino Acid
SSKVTKKQGSITXE

SEQ ID NO: 162791 - protein, 14 aa, Borrelia burgdorferi B31
  Xaa can be any naturally occurring amino acid
  VARIANT 12: Xaa = Any Amino Acid
SKVTKKQGSITXET

SEQ ID NO: 162792 - protein, 14 aa, Borrelia burgdorferi B31
  Xaa can be any naturally occurring amino acid
  VARIANT 11: Xaa = Any Amino Acid
KVTKKQGSITXETL

SEQ ID NO: 162793 - protein, 14 aa, Borrelia burgdorferi B31
  Xaa can be any naturally occurring amino acid
  VARIANT 10: Xaa = Any Amino Acid
VTKKQGSITXETLK

SEQ ID NO: 162794 - protein, 14 aa, Borrelia burgdorferi B31
  Xaa can be any naturally occurring amino acid
  VARIANT 9: Xaa = Any Amino Acid
TKKQGSITXETLKA

SEQ ID NO: 162795 - protein, 14 aa, Borrelia burgdorferi B31
  Xaa can be any naturally occurring amino acid
  VARIANT 8: Xaa = Any Amino Acid
KKQGSITXETLKAN

SEQ ID NO: 162796 - protein, 14 aa, Borrelia burgdorferi B31
  Xaa can be any naturally occurring amino acid
  VARIANT 7: Xaa = Any Amino Acid
KQGSITXETLKANK

SEQ ID NO: 162797 - protein, 14 aa, Borrelia burgdorferi B31
  Xaa can be any naturally occurring amino acid
  VARIANT 6: Xaa = Any Amino Acid
QGSITXETLKANKL

SEQ ID NO: 162798 - protein, 14 aa, Borrelia burgdorferi B31
  Xaa can be any naturally occurring amino acid
  VARIANT 5: Xaa = Any Amino Acid
GSITXETLKANKLD

SEQ ID NO: 162799 - protein, 14 aa, Borrelia burgdorferi B31
  Xaa can be any naturally occurring amino acid
  VARIANT 4: Xaa = Any Amino Acid
SITXETLKANKLDS

SEQ ID NO: 162800 - protein, 14 aa, Borrelia burgdorferi B31
  Xaa can be any naturally occurring amino acid
  VARIANT 3: Xaa = Any Amino Acid
ITXETLKANKLDSK

SEQ ID NO: 162801 - protein, 14 aa, Borrelia burgdorferi B31
  Xaa can be any naturally occurring amino acid
  VARIANT 2: Xaa = Any Amino Acid
TXETLKANKLDSKK

SEQ ID NO: 162802 - protein, 14 aa, Borrelia burgdorferi B31
  Xaa can be any naturally occurring amino acid
  VARIANT 1: Xaa = Any Amino Acid
XETLKANKLDSKKL

SEQ ID NO: 162803 - protein, 14 aa, Borrelia burgdorferi B31
ETLKANKLDSKKLT

SEQ ID NO: 162804 - protein, 14 aa, Borrelia burgdorferi B31
TLKANKLDSKKLTR

SEQ ID NO: 162805 - protein, 14 aa, Borrelia burgdorferi B31
LKANKLDSKKLTRS

SEQ ID NO: 162806 - protein, 14 aa, Borrelia burgdorferi B31
KANKLDSKKLTRSN

SEQ ID NO: 162807 - protein, 14 aa, Borrelia burgdorferi B31
ANKLDSKKLTRSNG

SEQ ID NO: 162808 - protein, 14 aa, Borrelia burgdorferi B31
NKLDSKKLTRSNGT

SEQ ID NO: 162809 - protein, 14 aa, Borrelia burgdorferi B31
KLDSKKLTRSNGTT

SEQ ID NO: 162810 - protein, 14 aa, Borrelia burgdorferi B31
LDSKKLTRSNGTTL

SEQ ID NO: 162811 - protein, 14 aa, Borrelia burgdorferi B31
DSKKLTRSNGTTLE

SEQ ID NO: 162812 - protein, 14 aa, Borrelia burgdorferi B31
SKKLTRSNGTTLEY

SEQ ID NO: 162813 - protein, 14 aa, Borrelia burgdorferi B31
KKLTRSNGTTLEYS

SEQ ID NO: 162814 - protein, 14 aa, Borrelia burgdorferi B31
KLTRSNGTTLEYSQ

SEQ ID NO: 162815 - protein, 14 aa, Borrelia burgdorferi B31
LTRSNGTTLEYSQI

SEQ ID NO: 162816 - protein, 14 aa, Borrelia burgdorferi B31
TRSNGTTLEYSQIT

SEQ ID NO: 162817 - protein, 14 aa, Borrelia burgdorferi B31
RSNGTTLEYSQITD

SEQ ID NO: 162818 - protein, 14 aa, Borrelia burgdorferi B31
SNGTTLEYSQITDA

SEQ ID NO: 162819 - protein, 14 aa, Borrelia burgdorferi B31
NGTTLEYSQITDAD

SEQ ID NO: 162820 - protein, 14 aa, Borrelia burgdorferi B31
GTTLEYSQITDADN

SEQ ID NO: 162821 - protein, 14 aa, Borrelia burgdorferi B31
TTLEYSQITDADNA

SEQ ID NO: 162822 - protein, 14 aa, Borrelia burgdorferi B31
TLEYSQITDADNAT

SEQ ID NO: 162823 - protein, 14 aa, Borrelia burgdorferi B31
LEYSQITDADNATK

SEQ ID NO: 162824 - protein, 14 aa, Borrelia burgdorferi B31
EYSQITDADNATKA

SEQ ID NO: 162825 - protein, 14 aa, Borrelia burgdorferi B31
YSQITDADNATKAV

SEQ ID NO: 162826 - protein, 14 aa, Borrelia burgdorferi B31
SQITDADNATKAVE

SEQ ID NO: 162827 - protein, 14 aa, Borrelia burgdorferi B31
QITDADNATKAVET

SEQ ID NO: 162828 - protein, 14 aa, Borrelia burgdorferi B31
ITDADNATKAVETL

SEQ ID NO: 162829 - protein, 14 aa, Borrelia burgdorferi B31
TDADNATKAVETLK

SEQ ID NO: 162830 - protein, 14 aa, Borrelia burgdorferi B31
DADNATKAVETLKN

SEQ ID NO: 162831 - protein, 14 aa, Borrelia burgdorferi B31
ADNATKAVETLKNS

SEQ ID NO: 162832 - protein, 14 aa, Borrelia burgdorferi B31
DNATKAVETLKNSI

SEQ ID NO: 162833 - protein, 14 aa, Borrelia burgdorferi B31
NATKAVETLKNSIK

SEQ ID NO: 162834 - protein, 14 aa, Borrelia burgdorferi B31
ATKAVETLKNSIKL

SEQ ID NO: 162835 - protein, 14 aa, Borrelia burgdorferi B31
TKAVETLKNSIKLE

SEQ ID NO: 162836 - protein, 14 aa, Borrelia burgdorferi B31
KAVETLKNSIKLEG

SEQ ID NO: 162837 - protein, 14 aa, Borrelia burgdorferi B31
AVETLKNSIKLEGS

SEQ ID NO: 162838 - protein, 14 aa, Borrelia burgdorferi B31
VETLKNSIKLEGSL

SEQ ID NO: 162839 - protein, 14 aa, Borrelia burgdorferi B31
ETLKNSIKLEGSLV

SEQ ID NO: 162840 - protein, 14 aa, Borrelia burgdorferi B31
TLKNSIKLEGSLVG

SEQ ID NO: 162841 - protein, 14 aa, Borrelia burgdorferi B31
LKNSIKLEGSLVGG

SEQ ID NO: 162842 - protein, 14 aa, Borrelia burgdorferi B31
KNSIKLEGSLVGGK

SEQ ID NO: 162843 - protein, 14 aa, Borrelia burgdorferi B31
NSIKLEGSLVGGKT

SEQ ID NO: 162844 - protein, 14 aa, Borrelia burgdorferi B31
SIKLEGSLVGGKTT

SEQ ID NO: 162845 - protein, 14 aa, Borrelia burgdorferi B31
IKLEGSLVGGKTTV

SEQ ID NO: 162846 - protein, 14 aa, Borrelia burgdorferi B31
KLEGSLVGGKTTVE

SEQ ID NO: 162847 - protein, 14 aa, Borrelia burgdorferi B31
LEGSLVGGKTTVEI

SEQ ID NO: 162848 - protein, 14 aa, Borrelia burgdorferi B31
EGSLVGGKTTVEIK

SEQ ID NO: 162849 - protein, 14 aa, Borrelia burgdorferi B31
GSLVGGKTTVEIKE

SEQ ID NO: 162850 - protein, 14 aa, Borrelia burgdorferi B31
SLVGGKTTVEIKEG

SEQ ID NO: 162851 - protein, 14 aa, Borrelia burgdorferi B31
LVGGKTTVEIKEGT

SEQ ID NO: 162852 - protein, 14 aa, Borrelia burgdorferi B31
VGGKTTVEIKEGTV

SEQ ID NO: 162853 - protein, 14 aa, Borrelia burgdorferi B31
GGKTTVEIKEGTVT

SEQ ID NO: 162854 - protein, 14 aa, Borrelia burgdorferi B31
GKTTVEIKEGTVTL

SEQ ID NO: 162855 - protein, 14 aa, Borrelia burgdorferi B31
KTTVEIKEGTVTLK

SEQ ID NO: 162856 - protein, 14 aa, Borrelia burgdorferi B31
TTVEIKEGTVTLKR

SEQ ID NO: 162857 - protein, 14 aa, Borrelia burgdorferi B31
TVEIKEGTVTLKRE

SEQ ID NO: 162858 - protein, 14 aa, Borrelia burgdorferi B31
VEIKEGTVTLKREI

SEQ ID NO: 162859 - protein, 14 aa, Borrelia burgdorferi B31
EIKEGTVTLKREIE

SEQ ID NO: 162860 - protein, 14 aa, Borrelia burgdorferi B31
IKEGTVTLKREIEK

SEQ ID NO: 162861 - protein, 14 aa, Borrelia burgdorferi B31
KEGTVTLKREIEKD

SEQ ID NO: 162862 - protein, 14 aa, Borrelia burgdorferi B31
EGTVTLKREIEKDG

SEQ ID NO: 162863 - protein, 14 aa, Borrelia burgdorferi B31
GTVTLKREIEKDGK

SEQ ID NO: 162864 - protein, 14 aa, Borrelia burgdorferi B31
TVTLKREIEKDGKV

SEQ ID NO: 162865 - protein, 14 aa, Borrelia burgdorferi B31
VTLKREIEKDGKVK

SEQ ID NO: 162866 - protein, 14 aa, Borrelia burgdorferi B31
TLKREIEKDGKVKV

SEQ ID NO: 162867 - protein, 14 aa, Borrelia burgdorferi B31
LKREIEKDGKVKVF

SEQ ID NO: 162868 - protein, 14 aa, Borrelia burgdorferi B31
KREIEKDGKVKVFL

SEQ ID NO: 162869 - protein, 14 aa, Borrelia burgdorferi B31
REIEKDGKVKVFLN

SEQ ID NO: 162870 - protein, 14 aa, Borrelia burgdorferi B31
EIEKDGKVKVFLND

SEQ ID NO: 162871 - protein, 14 aa, Borrelia burgdorferi B31
IEKDGKVKVFLNDT

SEQ ID NO: 162872 - protein, 14 aa, Borrelia burgdorferi B31
EKDGKVKVFLNDTA

SEQ ID NO: 162873 - protein, 14 aa, Borrelia burgdorferi B31
KDGKVKVFLNDTAG

SEQ ID NO: 162874 - protein, 14 aa, Borrelia burgdorferi B31
DGKVKVFLNDTAGS

SEQ ID NO: 162875 - protein, 14 aa, Borrelia burgdorferi B31
GKVKVFLNDTAGSN

SEQ ID NO: 162876 - protein, 14 aa, Borrelia burgdorferi B31
KVKVFLNDTAGSNK

SEQ ID NO: 162877 - protein, 14 aa, Borrelia burgdorferi B31
VKVFLNDTAGSNKK

SEQ ID NO: 162878 - protein, 14 aa, Borrelia burgdorferi B31
KVFLNDTAGSNKKT

SEQ ID NO: 162879 - protein, 14 aa, Borrelia burgdorferi B31
VFLNDTAGSNKKTG

SEQ ID NO: 162880 - protein, 14 aa, Borrelia burgdorferi B31
FLNDTAGSNKKTGK

SEQ ID NO: 162881 - protein, 14 aa, Borrelia burgdorferi B31
LNDTAGSNKKTGKW

SEQ ID NO: 162882 - protein, 14 aa, Borrelia burgdorferi B31
NDTAGSNKKTGKWE

SEQ ID NO: 162883 - protein, 14 aa, Borrelia burgdorferi B31
DTAGSNKKTGKWED

SEQ ID NO: 162884 - protein, 14 aa, Borrelia burgdorferi B31
TAGSNKKTGKWEDS

SEQ ID NO: 162885 - protein, 14 aa, Borrelia burgdorferi B31
AGSNKKTGKWEDST

SEQ ID NO: 162886 - protein, 14 aa, Borrelia burgdorferi B31
GSNKKTGKWEDSTS

SEQ ID NO: 162887 - protein, 14 aa, Borrelia burgdorferi B31
SNKKTGKWEDSTST

SEQ ID NO: 162888 - protein, 14 aa, Borrelia burgdorferi B31
NKKTGKWEDSTSTL

SEQ ID NO: 162889 - protein, 14 aa, Borrelia burgdorferi B31
KKTGKWEDSTSTLT

SEQ ID NO: 162890 - protein, 14 aa, Borrelia burgdorferi B31
KTGKWEDSTSTLTI

SEQ ID NO: 162891 - protein, 14 aa, Borrelia burgdorferi B31
TGKWEDSTSTLTIS

SEQ ID NO: 162892 - protein, 14 aa, Borrelia burgdorferi B31
GKWEDSTSTLTISA

SEQ ID NO: 162893 - protein, 14 aa, Borrelia burgdorferi B31
KWEDSTSTLTISAD

SEQ ID NO: 162894 - protein, 14 aa, Borrelia burgdorferi B31
WEDSTSTLTISADS

SEQ ID NO: 162895 - protein, 14 aa, Borrelia burgdorferi B31
EDSTSTLTISADSK

SEQ ID NO: 162896 - protein, 14 aa, Borrelia burgdorferi B31
DSTSTLTISADSKK

SEQ ID NO: 162897 - protein, 14 aa, Borrelia burgdorferi B31
STSTLTISADSKKT

SEQ ID NO: 162898 - protein, 14 aa, Borrelia burgdorferi B31
TSTLTISADSKKTK

SEQ ID NO: 162899 - protein, 14 aa, Borrelia burgdorferi B31
STLTISADSKKTKD

SEQ ID NO: 162900 - protein, 14 aa, Borrelia burgdorferi B31
TLTISADSKKTKDL

SEQ ID NO: 162901 - protein, 14 aa, Borrelia burgdorferi B31
LTISADSKKTKDLV

SEQ ID NO: 162902 - protein, 14 aa, Borrelia burgdorferi B31
TISADSKKTKDLVF

SEQ ID NO: 162903 - protein, 14 aa, Borrelia burgdorferi B31
ISADSKKTKDLVFL

SEQ ID NO: 162904 - protein, 14 aa, Borrelia burgdorferi B31
SADSKKTKDLVFLT

SEQ ID NO: 162905 - protein, 14 aa, Borrelia burgdorferi B31
ADSKKTKDLVFLTD

SEQ ID NO: 162906 - protein, 14 aa, Borrelia burgdorferi B31
DSKKTKDLVFLTDG

SEQ ID NO: 162907 - protein, 14 aa, Borrelia burgdorferi B31
SKKTKDLVFLTDGT

SEQ ID NO: 162908 - protein, 14 aa, Borrelia burgdorferi B31
KKTKDLVFLTDGTI

SEQ ID NO: 162909 - protein, 14 aa, Borrelia burgdorferi B31
KTKDLVFLTDGTIT

SEQ ID NO: 162910 - protein, 14 aa, Borrelia burgdorferi B31
TKDLVFLTDGTITV

SEQ ID NO: 162911 - protein, 14 aa, Borrelia burgdorferi B31
KDLVFLTDGTITVQ

SEQ ID NO: 162912 - protein, 14 aa, Borrelia burgdorferi B31
DLVFLTDGTITVQQ

SEQ ID NO: 162913 - protein, 14 aa, Borrelia burgdorferi B31
LVFLTDGTITVQQY

SEQ ID NO: 162914 - protein, 14 aa, Borrelia burgdorferi B31
VFLTDGTITVQQYN

SEQ ID NO: 162915 - protein, 14 aa, Borrelia burgdorferi B31
FLTDGTITVQQYNT

SEQ ID NO: 162916 - protein, 14 aa, Borrelia burgdorferi B31
LTDGTITVQQYNTA

SEQ ID NO: 162917 - protein, 14 aa, Borrelia burgdorferi B31
TDGTITVQQYNTAG

SEQ ID NO: 162918 - protein, 14 aa, Borrelia burgdorferi B31
DGTITVQQYNTAGT

SEQ ID NO: 162919 - protein, 14 aa, Borrelia burgdorferi B31
GTITVQQYNTAGTS

SEQ ID NO: 162920 - protein, 14 aa, Borrelia burgdorferi B31
TITVQQYNTAGTSL

SEQ ID NO: 162921 - protein, 14 aa, Borrelia burgdorferi B31
ITVQQYNTAGTSLE

SEQ ID NO: 162922 - protein, 14 aa, Borrelia burgdorferi B31
TVQQYNTAGTSLEG

SEQ ID NO: 162923 - protein, 14 aa, Borrelia burgdorferi B31
VQQYNTAGTSLEGS

SEQ ID NO: 162924 - protein, 14 aa, Borrelia burgdorferi B31
QQYNTAGTSLEGSA

SEQ ID NO: 162925 - protein, 14 aa, Borrelia burgdorferi B31
QYNTAGTSLEGSAS

SEQ ID NO: 162926 - protein, 14 aa, Borrelia burgdorferi B31
YNTAGTSLEGSASE

SEQ ID NO: 162927 - protein, 14 aa, Borrelia burgdorferi B31
NTAGTSLEGSASEI

SEQ ID NO: 162928 - protein, 14 aa, Borrelia burgdorferi B31
TAGTSLEGSASEIK

SEQ ID NO: 162929 - protein, 14 aa, Borrelia burgdorferi B31
AGTSLEGSASEIKN

SEQ ID NO: 162930 - protein, 14 aa, Borrelia burgdorferi B31
GTSLEGSASEIKNL

SEQ ID NO: 162931 - protein, 14 aa, Borrelia burgdorferi B31
TSLEGSASEIKNLS

SEQ ID NO: 162932 - protein, 14 aa, Borrelia burgdorferi B31
SLEGSASEIKNLSE

SEQ ID NO: 162933 - protein, 14 aa, Borrelia burgdorferi B31
LEGSASEIKNLSEL

SEQ ID NO: 162934 - protein, 14 aa, Borrelia burgdorferi B31
EGSASEIKNLSELK

SEQ ID NO: 162935 - protein, 14 aa, Borrelia burgdorferi B31
GSASEIKNLSELKN

SEQ ID NO: 162936 - protein, 14 aa, Borrelia burgdorferi B31
SASEIKNLSELKNA

SEQ ID NO: 162937 - protein, 14 aa, Borrelia burgdorferi B31
ASEIKNLSELKNAL

SEQ ID NO: 162938 - protein, 14 aa, Borrelia burgdorferi B31
SEIKNLSELKNALK

SEQ ID NO: 162939 - protein, 15 aa, Borrelia burgdorferi B31
MRLLIGFALALALIG

SEQ ID NO: 162940 - protein, 15 aa, Borrelia burgdorferi B31
RLLIGFALALALIGC

SEQ ID NO: 162941 - protein, 15 aa, Borrelia burgdorferi B31
LLIGFALALALIGCA

SEQ ID NO: 162942 - protein, 15 aa, Borrelia burgdorferi B31
LIGFALALALIGCAQ

SEQ ID NO: 162943 - protein, 15 aa, Borrelia burgdorferi B31
IGFALALALIGCAQK

SEQ ID NO: 162944 - protein, 15 aa, Borrelia burgdorferi B31
GFALALALIGCAQKG

SEQ ID NO: 162945 - protein, 15 aa, Borrelia burgdorferi B31
FALALALIGCAQKGA

SEQ ID NO: 162946 - protein, 15 aa, Borrelia burgdorferi B31
ALALALIGCAQKGAE

SEQ ID NO: 162947 - protein, 15 aa, Borrelia burgdorferi B31
LALALIGCAQKGAES

SEQ ID NO: 162948 - protein, 15 aa, Borrelia burgdorferi B31
ALALIGCAQKGAESI

SEQ ID NO: 162949 - protein, 15 aa, Borrelia burgdorferi B31
LALIGCAQKGAESIG

SEQ ID NO: 162950 - protein, 15 aa, Borrelia burgdorferi B31
ALIGCAQKGAESIGS

SEQ ID NO: 162951 - protein, 15 aa, Borrelia burgdorferi B31
LIGCAQKGAESIGSQ

SEQ ID NO: 162952 - protein, 15 aa, Borrelia burgdorferi B31
IGCAQKGAESIGSQK

SEQ ID NO: 162953 - protein, 15 aa, Borrelia burgdorferi B31
GCAQKGAESIGSQKE

SEQ ID NO: 162954 - protein, 15 aa, Borrelia burgdorferi B31
CAQKGAESIGSQKEN

SEQ ID NO: 162955 - protein, 15 aa, Borrelia burgdorferi B31
AQKGAESIGSQKEND

SEQ ID NO: 162956 - protein, 15 aa, Borrelia burgdorferi B31
QKGAESIGSQKENDL

SEQ ID NO: 162957 - protein, 15 aa, Borrelia burgdorferi B31
KGAESIGSQKENDLN

SEQ ID NO: 162958 - protein, 15 aa, Borrelia burgdorferi B31
GAESIGSQKENDLNL

SEQ ID NO: 162959 - protein, 15 aa, Borrelia burgdorferi B31
AESIGSQKENDLNLE

SEQ ID NO: 162960 - protein, 15 aa, Borrelia burgdorferi B31
ESIGSQKENDLNLED

SEQ ID NO: 162961 - protein, 15 aa, Borrelia burgdorferi B31
SIGSQKENDLNLEDS

SEQ ID NO: 162962 - protein, 15 aa, Borrelia burgdorferi B31
IGSQKENDLNLEDSS

SEQ ID NO: 162963 - protein, 15 aa, Borrelia burgdorferi B31
GSQKENDLNLEDSSK

SEQ ID NO: 162964 - protein, 15 aa, Borrelia burgdorferi B31
SQKENDLNLEDSSKK

SEQ ID NO: 162965 - protein, 15 aa, Borrelia burgdorferi B31
QKENDLNLEDSSKKS

SEQ ID NO: 162966 - protein, 15 aa, Borrelia burgdorferi B31
KENDLNLEDSSKKSH

SEQ ID NO: 162967 - protein, 15 aa, Borrelia burgdorferi B31
ENDLNLEDSSKKSHQ

SEQ ID NO: 162968 - protein, 15 aa, Borrelia burgdorferi B31
NDLNLEDSSKKSHQN

SEQ ID NO: 162969 - protein, 15 aa, Borrelia burgdorferi B31
DLNLEDSSKKSHQNA

SEQ ID NO: 162970 - protein, 15 aa, Borrelia burgdorferi B31
LNLEDSSKKSHQNAK

SEQ ID NO: 162971 - protein, 15 aa, Borrelia burgdorferi B31
NLEDSSKKSHQNAKQ

SEQ ID NO: 162972 - protein, 15 aa, Borrelia burgdorferi B31
LEDSSKKSHQNAKQD

SEQ ID NO: 162973 - protein, 15 aa, Borrelia burgdorferi B31
EDSSKKSHQNAKQDL

SEQ ID NO: 162974 - protein, 15 aa, Borrelia burgdorferi B31
DSSKKSHQNAKQDLP

SEQ ID NO: 162975 - protein, 15 aa, Borrelia burgdorferi B31
SSKKSHQNAKQDLPA

SEQ ID NO: 162976 - protein, 15 aa, Borrelia burgdorferi B31
SKKSHQNAKQDLPAV

SEQ ID NO: 162977 - protein, 15 aa, Borrelia burgdorferi B31
KKSHQNAKQDLPAVT

SEQ ID NO: 162978 - protein, 15 aa, Borrelia burgdorferi B31
KSHQNAKQDLPAVTE

SEQ ID NO: 162979 - protein, 15 aa, Borrelia burgdorferi B31
SHQNAKQDLPAVTED

SEQ ID NO: 162980 - protein, 15 aa, Borrelia burgdorferi B31
HQNAKQDLPAVTEDS

SEQ ID NO: 162981 - protein, 15 aa, Borrelia burgdorferi B31
QNAKQDLPAVTEDSV

SEQ ID NO: 162982 - protein, 15 aa, Borrelia burgdorferi B31
NAKQDLPAVTEDSVS

SEQ ID NO: 162983 - protein, 15 aa, Borrelia burgdorferi B31
AKQDLPAVTEDSVSL

SEQ ID NO: 162984 - protein, 15 aa, Borrelia burgdorferi B31
KQDLPAVTEDSVSLF

SEQ ID NO: 162985 - protein, 15 aa, Borrelia burgdorferi B31
QDLPAVTEDSVSLFN

SEQ ID NO: 162986 - protein, 15 aa, Borrelia burgdorferi B31
DLPAVTEDSVSLFNG

SEQ ID NO: 162987 - protein, 15 aa, Borrelia burgdorferi B31
LPAVTEDSVSLFNGN

SEQ ID NO: 162988 - protein, 15 aa, Borrelia burgdorferi B31
PAVTEDSVSLFNGNK

SEQ ID NO: 162989 - protein, 15 aa, Borrelia burgdorferi B31
AVTEDSVSLFNGNKI

SEQ ID NO: 162990 - protein, 15 aa, Borrelia burgdorferi B31
VTEDSVSLFNGNKIF

SEQ ID NO: 162991 - protein, 15 aa, Borrelia burgdorferi B31
TEDSVSLFNGNKIFV

SEQ ID NO: 162992 - protein, 15 aa, Borrelia burgdorferi B31
EDSVSLFNGNKIFVS

SEQ ID NO: 162993 - protein, 15 aa, Borrelia burgdorferi B31
DSVSLFNGNKIFVSK

SEQ ID NO: 162994 - protein, 15 aa, Borrelia burgdorferi B31
SVSLFNGNKIFVSKE

SEQ ID NO: 162995 - protein, 15 aa, Borrelia burgdorferi B31
VSLFNGNKIFVSKEK

SEQ ID NO: 162996 - protein, 15 aa, Borrelia burgdorferi B31
SLFNGNKIFVSKEKN

SEQ ID NO: 162997 - protein, 15 aa, Borrelia burgdorferi B31
LFNGNKIFVSKEKNS

SEQ ID NO: 162998 - protein, 15 aa, Borrelia burgdorferi B31
FNGNKIFVSKEKNSS

SEQ ID NO: 162999 - protein, 15 aa, Borrelia burgdorferi B31
NGNKIFVSKEKNSSG

SEQ ID NO: 163000 - protein, 15 aa, Borrelia burgdorferi B31
GNKIFVSKEKNSSGK

SEQ ID NO: 163001 - protein, 15 aa, Borrelia burgdorferi B31
NKIFVSKEKNSSGKY

SEQ ID NO: 163002 - protein, 15 aa, Borrelia burgdorferi B31
KIFVSKEKNSSGKYD

SEQ ID NO: 163003 - protein, 15 aa, Borrelia burgdorferi B31
IFVSKEKNSSGKYDL

SEQ ID NO: 163004 - protein, 15 aa, Borrelia burgdorferi B31
FVSKEKNSSGKYDLR

SEQ ID NO: 163005 - protein, 15 aa, Borrelia burgdorferi B31
VSKEKNSSGKYDLRA

SEQ ID NO: 163006 - protein, 15 aa, Borrelia burgdorferi B31
SKEKNSSGKYDLRAT

SEQ ID NO: 163007 - protein, 15 aa, Borrelia burgdorferi B31
KEKNSSGKYDLRATI

SEQ ID NO: 163008 - protein, 15 aa, Borrelia burgdorferi B31
EKNSSGKYDLRATID

SEQ ID NO: 163009 - protein, 15 aa, Borrelia burgdorferi B31
KNSSGKYDLRATIDQ

SEQ ID NO: 163010 - protein, 15 aa, Borrelia burgdorferi B31
NSSGKYDLRATIDQV

SEQ ID NO: 163011 - protein, 15 aa, Borrelia burgdorferi B31
SSGKYDLRATIDQVE

SEQ ID NO: 163012 - protein, 15 aa, Borrelia burgdorferi B31
SGKYDLRATIDQVEL

SEQ ID NO: 163013 - protein, 15 aa, Borrelia burgdorferi B31
GKYDLRATIDQVELK

SEQ ID NO: 163014 - protein, 15 aa, Borrelia burgdorferi B31
KYDLRATIDQVELKG

SEQ ID NO: 163015 - protein, 15 aa, Borrelia burgdorferi B31
YDLRATIDQVELKGT

SEQ ID NO: 163016 - protein, 15 aa, Borrelia burgdorferi B31
DLRATIDQVELKGTS

SEQ ID NO: 163017 - protein, 15 aa, Borrelia burgdorferi B31
LRATIDQVELKGTSD

SEQ ID NO: 163018 - protein, 15 aa, Borrelia burgdorferi B31
RATIDQVELKGTSDK

SEQ ID NO: 163019 - protein, 15 aa, Borrelia burgdorferi B31
ATIDQVELKGTSDKN

SEQ ID NO: 163020 - protein, 15 aa, Borrelia burgdorferi B31
TIDQVELKGTSDKNN

SEQ ID NO: 163021 - protein, 15 aa, Borrelia burgdorferi B31
IDQVELKGTSDKNNG

SEQ ID NO: 163022 - protein, 15 aa, Borrelia burgdorferi B31
DQVELKGTSDKNNGS

SEQ ID NO: 163023 - protein, 15 aa, Borrelia burgdorferi B31
QVELKGTSDKNNGSG

SEQ ID NO: 163024 - protein, 15 aa, Borrelia burgdorferi B31
VELKGTSDKNNGSGT

SEQ ID NO: 163025 - protein, 15 aa, Borrelia burgdorferi B31
ELKGTSDKNNGSGTL

SEQ ID NO: 163026 - protein, 15 aa, Borrelia burgdorferi B31
LKGTSDKNNGSGTLE

SEQ ID NO: 163027 - protein, 15 aa, Borrelia burgdorferi B31
KGTSDKNNGSGTLEG

SEQ ID NO: 163028 - protein, 15 aa, Borrelia burgdorferi B31
GTSDKNNGSGTLEGS

SEQ ID NO: 163029 - protein, 15 aa, Borrelia burgdorferi B31
TSDKNNGSGTLEGSK

SEQ ID NO: 163030 - protein, 15 aa, Borrelia burgdorferi B31
SDKNNGSGTLEGSKP

SEQ ID NO: 163031 - protein, 15 aa, Borrelia burgdorferi B31
DKNNGSGTLEGSKPD

SEQ ID NO: 163032 - protein, 15 aa, Borrelia burgdorferi B31
KNNGSGTLEGSKPDK

SEQ ID NO: 163033 - protein, 15 aa, Borrelia burgdorferi B31
NNGSGTLEGSKPDKS

SEQ ID NO: 163034 - protein, 15 aa, Borrelia burgdorferi B31
NGSGTLEGSKPDKSK

SEQ ID NO: 163035 - protein, 15 aa, Borrelia burgdorferi B31
GSGTLEGSKPDKSKV

SEQ ID NO: 163036 - protein, 15 aa, Borrelia burgdorferi B31
SGTLEGSKPDKSKVK

SEQ ID NO: 163037 - protein, 15 aa, Borrelia burgdorferi B31
GTLEGSKPDKSKVKL

SEQ ID NO: 163038 - protein, 15 aa, Borrelia burgdorferi B31
TLEGSKPDKSKVKLT

SEQ ID NO: 163039 - protein, 15 aa, Borrelia burgdorferi B31
LEGSKPDKSKVKLTV

SEQ ID NO: 163040 - protein, 15 aa, Borrelia burgdorferi B31
EGSKPDKSKVKLTVS

SEQ ID NO: 163041 - protein, 15 aa, Borrelia burgdorferi B31
GSKPDKSKVKLTVSA

SEQ ID NO: 163042 - protein, 15 aa, Borrelia burgdorferi B31
SKPDKSKVKLTVSAD

SEQ ID NO: 163043 - protein, 15 aa, Borrelia burgdorferi B31
KPDKSKVKLTVSADL

SEQ ID NO: 163044 - protein, 15 aa, Borrelia burgdorferi B31
PDKSKVKLTVSADLN

SEQ ID NO: 163045 - protein, 15 aa, Borrelia burgdorferi B31
DKSKVKLTVSADLNT

SEQ ID NO: 163046 - protein, 15 aa, Borrelia burgdorferi B31
KSKVKLTVSADLNTV

SEQ ID NO: 163047 - protein, 15 aa, Borrelia burgdorferi B31
SKVKLTVSADLNTVT

SEQ ID NO: 163048 - protein, 15 aa, Borrelia burgdorferi B31
KVKLTVSADLNTVTL

SEQ ID NO: 163049 - protein, 15 aa, Borrelia burgdorferi B31
VKLTVSADLNTVTLE

SEQ ID NO: 163050 - protein, 15 aa, Borrelia burgdorferi B31
KLTVSADLNTVTLEA

SEQ ID NO: 163051 - protein, 15 aa, Borrelia burgdorferi B31
LTVSADLNTVTLEAF

SEQ ID NO: 163052 - protein, 15 aa, Borrelia burgdorferi B31
TVSADLNTVTLEAFD

SEQ ID NO: 163053 - protein, 15 aa, Borrelia burgdorferi B31
VSADLNTVTLEAFDA

SEQ ID NO: 163054 - protein, 15 aa, Borrelia burgdorferi B31
SADLNTVTLEAFDAS

SEQ ID NO: 163055 - protein, 15 aa, Borrelia burgdorferi B31
ADLNTVTLEAFDASN

SEQ ID NO: 163056 - protein, 15 aa, Borrelia burgdorferi B31
DLNTVTLEAFDASNQ

SEQ ID NO: 163057 - protein, 15 aa, Borrelia burgdorferi B31
LNTVTLEAFDASNQK

SEQ ID NO: 163058 - protein, 15 aa, Borrelia burgdorferi B31
NTVTLEAFDASNQKI

SEQ ID NO: 163059 - protein, 15 aa, Borrelia burgdorferi B31
TVTLEAFDASNQKIS

SEQ ID NO: 163060 - protein, 15 aa, Borrelia burgdorferi B31
VTLEAFDASNQKISS

SEQ ID NO: 163061 - protein, 15 aa, Borrelia burgdorferi B31
TLEAFDASNQKISSK

SEQ ID NO: 163062 - protein, 15 aa, Borrelia burgdorferi B31
LEAFDASNQKISSKV

SEQ ID NO: 163063 - protein, 15 aa, Borrelia burgdorferi B31
EAFDASNQKISSKVT

SEQ ID NO: 163064 - protein, 15 aa, Borrelia burgdorferi B31
AFDASNQKISSKVTK

SEQ ID NO: 163065 - protein, 15 aa, Borrelia burgdorferi B31
FDASNQKISSKVTKK

SEQ ID NO: 163066 - protein, 15 aa, Borrelia burgdorferi B31
DASNQKISSKVTKKQ

SEQ ID NO: 163067 - protein, 15 aa, Borrelia burgdorferi B31
ASNQKISSKVTKKQG

SEQ ID NO: 163068 - protein, 15 aa, Borrelia burgdorferi B31
SNQKISSKVTKKQGS

SEQ ID NO: 163069 - protein, 15 aa, Borrelia burgdorferi B31
NQKISSKVTKKQGSI

SEQ ID NO: 163070 - protein, 15 aa, Borrelia burgdorferi B31
QKISSKVTKKQGSIT

SEQ ID NO: 163071 - protein, 15 aa, Borrelia burgdorferi B31
  Xaa can be any naturally occurring amino acid
  VARIANT 15: Xaa = Any Amino Acid
KISSKVTKKQGSITX

SEQ ID NO: 163072 - protein, 15 aa, Borrelia burgdorferi B31
  Xaa can be any naturally occurring amino acid
  VARIANT 14: Xaa = Any Amino Acid
ISSKVTKKQGSITXE

SEQ ID NO: 163073 - protein, 15 aa, Borrelia burgdorferi B31
  Xaa can be any naturally occurring amino acid
  VARIANT 13: Xaa = Any Amino Acid
SSKVTKKQGSITXET

SEQ ID NO: 163074 - protein, 15 aa, Borrelia burgdorferi B31
  Xaa can be any naturally occurring amino acid
  VARIANT 12: Xaa = Any Amino Acid
SKVTKKQGSITXETL

SEQ ID NO: 163075 - protein, 15 aa, Borrelia burgdorferi B31
  Xaa can be any naturally occurring amino acid
  VARIANT 11: Xaa = Any Amino Acid
KVTKKQGSITXETLK

SEQ ID NO: 163076 - protein, 15 aa, Borrelia burgdorferi B31
  Xaa can be any naturally occurring amino acid
  VARIANT 10: Xaa = Any Amino Acid
VTKKQGSITXETLKA

SEQ ID NO: 163077 - protein, 15 aa, Borrelia burgdorferi B31
  Xaa can be any naturally occurring amino acid
  VARIANT 9: Xaa = Any Amino Acid
TKKQGSITXETLKAN

SEQ ID NO: 163078 - protein, 15 aa, Borrelia burgdorferi B31
  Xaa can be any naturally occurring amino acid
  VARIANT 8: Xaa = Any Amino Acid
KKQGSITXETLKANK

SEQ ID NO: 163079 - protein, 15 aa, Borrelia burgdorferi B31
  Xaa can be any naturally occurring amino acid
  VARIANT 7: Xaa = Any Amino Acid
KQGSITXETLKANKL

SEQ ID NO: 163080 - protein, 15 aa, Borrelia burgdorferi B31
  Xaa can be any naturally occurring amino acid
  VARIANT 6: Xaa = Any Amino Acid
QGSITXETLKANKLD

SEQ ID NO: 163081 - protein, 15 aa, Borrelia burgdorferi B31
  Xaa can be any naturally occurring amino acid
  VARIANT 5: Xaa = Any Amino Acid
GSITXETLKANKLDS

SEQ ID NO: 163082 - protein, 15 aa, Borrelia burgdorferi B31
  Xaa can be any naturally occurring amino acid
  VARIANT 4: Xaa = Any Amino Acid
SITXETLKANKLDSK

SEQ ID NO: 163083 - protein, 15 aa, Borrelia burgdorferi B31
  Xaa can be any naturally occurring amino acid
  VARIANT 3: Xaa = Any Amino Acid
ITXETLKANKLDSKK

SEQ ID NO: 163084 - protein, 15 aa, Borrelia burgdorferi B31
  Xaa can be any naturally occurring amino acid
  VARIANT 2: Xaa = Any Amino Acid
TXETLKANKLDSKKL

SEQ ID NO: 163085 - protein, 15 aa, Borrelia burgdorferi B31
  Xaa can be any naturally occurring amino acid
  VARIANT 1: Xaa = Any Amino Acid
XETLKANKLDSKKLT

SEQ ID NO: 163086 - protein, 15 aa, Borrelia burgdorferi B31
ETLKANKLDSKKLTR

SEQ ID NO: 163087 - protein, 15 aa, Borrelia burgdorferi B31
TLKANKLDSKKLTRS

SEQ ID NO: 163088 - protein, 15 aa, Borrelia burgdorferi B31
LKANKLDSKKLTRSN

SEQ ID NO: 163089 - protein, 15 aa, Borrelia burgdorferi B31
KANKLDSKKLTRSNG

SEQ ID NO: 163090 - protein, 15 aa, Borrelia burgdorferi B31
ANKLDSKKLTRSNGT

SEQ ID NO: 163091 - protein, 15 aa, Borrelia burgdorferi B31
NKLDSKKLTRSNGTT

SEQ ID NO: 163092 - protein, 15 aa, Borrelia burgdorferi B31
KLDSKKLTRSNGTTL

SEQ ID NO: 163093 - protein, 15 aa, Borrelia burgdorferi B31
LDSKKLTRSNGTTLE

SEQ ID NO: 163094 - protein, 15 aa, Borrelia burgdorferi B31
DSKKLTRSNGTTLEY

SEQ ID NO: 163095 - protein, 15 aa, Borrelia burgdorferi B31
SKKLTRSNGTTLEYS

SEQ ID NO: 163096 - protein, 15 aa, Borrelia burgdorferi B31
KKLTRSNGTTLEYSQ

SEQ ID NO: 163097 - protein, 15 aa, Borrelia burgdorferi B31
KLTRSNGTTLEYSQI

SEQ ID NO: 163098 - protein, 15 aa, Borrelia burgdorferi B31
LTRSNGTTLEYSQIT

SEQ ID NO: 163099 - protein, 15 aa, Borrelia burgdorferi B31
TRSNGTTLEYSQITD

SEQ ID NO: 163100 - protein, 15 aa, Borrelia burgdorferi B31
RSNGTTLEYSQITDA

SEQ ID NO: 163101 - protein, 15 aa, Borrelia burgdorferi B31
SNGTTLEYSQITDAD

SEQ ID NO: 163102 - protein, 15 aa, Borrelia burgdorferi B31
NGTTLEYSQITDADN

SEQ ID NO: 163103 - protein, 15 aa, Borrelia burgdorferi B31
GTTLEYSQITDADNA

SEQ ID NO: 163104 - protein, 15 aa, Borrelia burgdorferi B31
TTLEYSQITDADNAT

SEQ ID NO: 163105 - protein, 15 aa, Borrelia burgdorferi B31
TLEYSQITDADNATK

SEQ ID NO: 163106 - protein, 15 aa, Borrelia burgdorferi B31
LEYSQITDADNATKA

SEQ ID NO: 163107 - protein, 15 aa, Borrelia burgdorferi B31
EYSQITDADNATKAV

SEQ ID NO: 163108 - protein, 15 aa, Borrelia burgdorferi B31
YSQITDADNATKAVE

SEQ ID NO: 163109 - protein, 15 aa, Borrelia burgdorferi B31
SQITDADNATKAVET

SEQ ID NO: 163110 - protein, 15 aa, Borrelia burgdorferi B31
QITDADNATKAVETL

SEQ ID NO: 163111 - protein, 15 aa, Borrelia burgdorferi B31
ITDADNATKAVETLK

SEQ ID NO: 163112 - protein, 15 aa, Borrelia burgdorferi B31
TDADNATKAVETLKN

SEQ ID NO: 163113 - protein, 15 aa, Borrelia burgdorferi B31
DADNATKAVETLKNS

SEQ ID NO: 163114 - protein, 15 aa, Borrelia burgdorferi B31
ADNATKAVETLKNSI

SEQ ID NO: 163115 - protein, 15 aa, Borrelia burgdorferi B31
DNATKAVETLKNSIK

SEQ ID NO: 163116 - protein, 15 aa, Borrelia burgdorferi B31
NATKAVETLKNSIKL

SEQ ID NO: 163117 - protein, 15 aa, Borrelia burgdorferi B31
ATKAVETLKNSIKLE

SEQ ID NO: 163118 - protein, 15 aa, Borrelia burgdorferi B31
TKAVETLKNSIKLEG

SEQ ID NO: 163119 - protein, 15 aa, Borrelia burgdorferi B31
KAVETLKNSIKLEGS

SEQ ID NO: 163120 - protein, 15 aa, Borrelia burgdorferi B31
AVETLKNSIKLEGSL

SEQ ID NO: 163121 - protein, 15 aa, Borrelia burgdorferi B31
VETLKNSIKLEGSLV

SEQ ID NO: 163122 - protein, 15 aa, Borrelia burgdorferi B31
ETLKNSIKLEGSLVG

SEQ ID NO: 163123 - protein, 15 aa, Borrelia burgdorferi B31
TLKNSIKLEGSLVGG

SEQ ID NO: 163124 - protein, 15 aa, Borrelia burgdorferi B31
LKNSIKLEGSLVGGK

SEQ ID NO: 163125 - protein, 15 aa, Borrelia burgdorferi B31
KNSIKLEGSLVGGKT

SEQ ID NO: 163126 - protein, 15 aa, Borrelia burgdorferi B31
NSIKLEGSLVGGKTT

SEQ ID NO: 163127 - protein, 15 aa, Borrelia burgdorferi B31
SIKLEGSLVGGKTTV

SEQ ID NO: 163128 - protein, 15 aa, Borrelia burgdorferi B31
IKLEGSLVGGKTTVE

SEQ ID NO: 163129 - protein, 15 aa, Borrelia burgdorferi B31
KLEGSLVGGKTTVEI

SEQ ID NO: 163130 - protein, 15 aa, Borrelia burgdorferi B31
LEGSLVGGKTTVEIK

SEQ ID NO: 163131 - protein, 15 aa, Borrelia burgdorferi B31
EGSLVGGKTTVEIKE

SEQ ID NO: 163132 - protein, 15 aa, Borrelia burgdorferi B31
GSLVGGKTTVEIKEG

SEQ ID NO: 163133 - protein, 15 aa, Borrelia burgdorferi B31
SLVGGKTTVEIKEGT

SEQ ID NO: 163134 - protein, 15 aa, Borrelia burgdorferi B31
LVGGKTTVEIKEGTV

SEQ ID NO: 163135 - protein, 15 aa, Borrelia burgdorferi B31
VGGKTTVEIKEGTVT

SEQ ID NO: 163136 - protein, 15 aa, Borrelia burgdorferi B31
GGKTTVEIKEGTVTL

SEQ ID NO: 163137 - protein, 15 aa, Borrelia burgdorferi B31
GKTTVEIKEGTVTLK

SEQ ID NO: 163138 - protein, 15 aa, Borrelia burgdorferi B31
KTTVEIKEGTVTLKR

SEQ ID NO: 163139 - protein, 15 aa, Borrelia burgdorferi B31
TTVEIKEGTVTLKRE

SEQ ID NO: 163140 - protein, 15 aa, Borrelia burgdorferi B31
TVEIKEGTVTLKREI

SEQ ID NO: 163141 - protein, 15 aa, Borrelia burgdorferi B31
VEIKEGTVTLKREIE

SEQ ID NO: 163142 - protein, 15 aa, Borrelia burgdorferi B31
EIKEGTVTLKREIEK

SEQ ID NO: 163143 - protein, 15 aa, Borrelia burgdorferi B31
IKEGTVTLKREIEKD

SEQ ID NO: 163144 - protein, 15 aa, Borrelia burgdorferi B31
KEGTVTLKREIEKDG

SEQ ID NO: 163145 - protein, 15 aa, Borrelia burgdorferi B31
EGTVTLKREIEKDGK

SEQ ID NO: 163146 - protein, 15 aa, Borrelia burgdorferi B31
GTVTLKREIEKDGKV

SEQ ID NO: 163147 - protein, 15 aa, Borrelia burgdorferi B31
TVTLKREIEKDGKVK

SEQ ID NO: 163148 - protein, 15 aa, Borrelia burgdorferi B31
VTLKREIEKDGKVKV

SEQ ID NO: 163149 - protein, 15 aa, Borrelia burgdorferi B31
TLKREIEKDGKVKVF

SEQ ID NO: 163150 - protein, 15 aa, Borrelia burgdorferi B31
LKREIEKDGKVKVFL

SEQ ID NO: 163151 - protein, 15 aa, Borrelia burgdorferi B31
KREIEKDGKVKVFLN

SEQ ID NO: 163152 - protein, 15 aa, Borrelia burgdorferi B31
REIEKDGKVKVFLND

SEQ ID NO: 163153 - protein, 15 aa, Borrelia burgdorferi B31
EIEKDGKVKVFLNDT

SEQ ID NO: 163154 - protein, 15 aa, Borrelia burgdorferi B31
IEKDGKVKVFLNDTA

SEQ ID NO: 163155 - protein, 15 aa, Borrelia burgdorferi B31
EKDGKVKVFLNDTAG

SEQ ID NO: 163156 - protein, 15 aa, Borrelia burgdorferi B31
KDGKVKVFLNDTAGS

SEQ ID NO: 163157 - protein, 15 aa, Borrelia burgdorferi B31
DGKVKVFLNDTAGSN

SEQ ID NO: 163158 - protein, 15 aa, Borrelia burgdorferi B31
GKVKVFLNDTAGSNK

SEQ ID NO: 163159 - protein, 15 aa, Borrelia burgdorferi B31
KVKVFLNDTAGSNKK

SEQ ID NO: 163160 - protein, 15 aa, Borrelia burgdorferi B31
VKVFLNDTAGSNKKT

SEQ ID NO: 163161 - protein, 15 aa, Borrelia burgdorferi B31
KVFLNDTAGSNKKTG

SEQ ID NO: 163162 - protein, 15 aa, Borrelia burgdorferi B31
VFLNDTAGSNKKTGK

SEQ ID NO: 163163 - protein, 15 aa, Borrelia burgdorferi B31
FLNDTAGSNKKTGKW

SEQ ID NO: 163164 - protein, 15 aa, Borrelia burgdorferi B31
LNDTAGSNKKTGKWE

SEQ ID NO: 163165 - protein, 15 aa, Borrelia burgdorferi B31
NDTAGSNKKTGKWED

SEQ ID NO: 163166 - protein, 15 aa, Borrelia burgdorferi B31
DTAGSNKKTGKWEDS

SEQ ID NO: 163167 - protein, 15 aa, Borrelia burgdorferi B31
TAGSNKKTGKWEDST

SEQ ID NO: 163168 - protein, 15 aa, Borrelia burgdorferi B31
AGSNKKTGKWEDSTS

SEQ ID NO: 163169 - protein, 15 aa, Borrelia burgdorferi B31
GSNKKTGKWEDSTST

SEQ ID NO: 163170 - protein, 15 aa, Borrelia burgdorferi B31
SNKKTGKWEDSTSTL

SEQ ID NO: 163171 - protein, 15 aa, Borrelia burgdorferi B31
NKKTGKWEDSTSTLT

SEQ ID NO: 163172 - protein, 15 aa, Borrelia burgdorferi B31
KKTGKWEDSTSTLTI

SEQ ID NO: 163173 - protein, 15 aa, Borrelia burgdorferi B31
KTGKWEDSTSTLTIS

SEQ ID NO: 163174 - protein, 15 aa, Borrelia burgdorferi B31
TGKWEDSTSTLTISA

SEQ ID NO: 163175 - protein, 15 aa, Borrelia burgdorferi B31
GKWEDSTSTLTISAD

SEQ ID NO: 163176 - protein, 15 aa, Borrelia burgdorferi B31
KWEDSTSTLTISADS

SEQ ID NO: 163177 - protein, 15 aa, Borrelia burgdorferi B31
WEDSTSTLTISADSK

SEQ ID NO: 163178 - protein, 15 aa, Borrelia burgdorferi B31
EDSTSTLTISADSKK

SEQ ID NO: 163179 - protein, 15 aa, Borrelia burgdorferi B31
DSTSTLTISADSKKT

SEQ ID NO: 163180 - protein, 15 aa, Borrelia burgdorferi B31
STSTLTISADSKKTK

SEQ ID NO: 163181 - protein, 15 aa, Borrelia burgdorferi B31
TSTLTISADSKKTKD

SEQ ID NO: 163182 - protein, 15 aa, Borrelia burgdorferi B31
STLTISADSKKTKDL

SEQ ID NO: 163183 - protein, 15 aa, Borrelia burgdorferi B31
TLTISADSKKTKDLV

SEQ ID NO: 163184 - protein, 15 aa, Borrelia burgdorferi B31
LTISADSKKTKDLVF

SEQ ID NO: 163185 - protein, 15 aa, Borrelia burgdorferi B31
TISADSKKTKDLVFL

SEQ ID NO: 163186 - protein, 15 aa, Borrelia burgdorferi B31
ISADSKKTKDLVFLT

SEQ ID NO: 163187 - protein, 15 aa, Borrelia burgdorferi B31
SADSKKTKDLVFLTD

SEQ ID NO: 163188 - protein, 15 aa, Borrelia burgdorferi B31
ADSKKTKDLVFLTDG

SEQ ID NO: 163189 - protein, 15 aa, Borrelia burgdorferi B31
DSKKTKDLVFLTDGT

SEQ ID NO: 163190 - protein, 15 aa, Borrelia burgdorferi B31
SKKTKDLVFLTDGTI

SEQ ID NO: 163191 - protein, 15 aa, Borrelia burgdorferi B31
KKTKDLVFLTDGTIT

SEQ ID NO: 163192 - protein, 15 aa, Borrelia burgdorferi B31
KTKDLVFLTDGTITV

SEQ ID NO: 163193 - protein, 15 aa, Borrelia burgdorferi B31
TKDLVFLTDGTITVQ

SEQ ID NO: 163194 - protein, 15 aa, Borrelia burgdorferi B31
KDLVFLTDGTITVQQ

SEQ ID NO: 163195 - protein, 15 aa, Borrelia burgdorferi B31
DLVFLTDGTITVQQY

SEQ ID NO: 163196 - protein, 15 aa, Borrelia burgdorferi B31
LVFLTDGTITVQQYN

SEQ ID NO: 163197 - protein, 15 aa, Borrelia burgdorferi B31
VFLTDGTITVQQYNT

SEQ ID NO: 163198 - protein, 15 aa, Borrelia burgdorferi B31
FLTDGTITVQQYNTA

SEQ ID NO: 163199 - protein, 15 aa, Borrelia burgdorferi B31
LTDGTITVQQYNTAG

SEQ ID NO: 163200 - protein, 15 aa, Borrelia burgdorferi B31
TDGTITVQQYNTAGT

SEQ ID NO: 163201 - protein, 15 aa, Borrelia burgdorferi B31
DGTITVQQYNTAGTS

SEQ ID NO: 163202 - protein, 15 aa, Borrelia burgdorferi B31
GTITVQQYNTAGTSL

SEQ ID NO: 163203 - protein, 15 aa, Borrelia burgdorferi B31
TITVQQYNTAGTSLE

SEQ ID NO: 163204 - protein, 15 aa, Borrelia burgdorferi B31
ITVQQYNTAGTSLEG

SEQ ID NO: 163205 - protein, 15 aa, Borrelia burgdorferi B31
TVQQYNTAGTSLEGS

SEQ ID NO: 163206 - protein, 15 aa, Borrelia burgdorferi B31
VQQYNTAGTSLEGSA

SEQ ID NO: 163207 - protein, 15 aa, Borrelia burgdorferi B31
QQYNTAGTSLEGSAS

SEQ ID NO: 163208 - protein, 15 aa, Borrelia burgdorferi B31
QYNTAGTSLEGSASE

SEQ ID NO: 163209 - protein, 15 aa, Borrelia burgdorferi B31
YNTAGTSLEGSASEI

SEQ ID NO: 163210 - protein, 15 aa, Borrelia burgdorferi B31
NTAGTSLEGSASEIK

SEQ ID NO: 163211 - protein, 15 aa, Borrelia burgdorferi B31
TAGTSLEGSASEIKN

SEQ ID NO: 163212 - protein, 15 aa, Borrelia burgdorferi B31
AGTSLEGSASEIKNL

SEQ ID NO: 163213 - protein, 15 aa, Borrelia burgdorferi B31
GTSLEGSASEIKNLS

SEQ ID NO: 163214 - protein, 15 aa, Borrelia burgdorferi B31
TSLEGSASEIKNLSE

SEQ ID NO: 163215 - protein, 15 aa, Borrelia burgdorferi B31
SLEGSASEIKNLSEL

SEQ ID NO: 163216 - protein, 15 aa, Borrelia burgdorferi B31
LEGSASEIKNLSELK

SEQ ID NO: 163217 - protein, 15 aa, Borrelia burgdorferi B31
EGSASEIKNLSELKN

SEQ ID NO: 163218 - protein, 15 aa, Borrelia burgdorferi B31
GSASEIKNLSELKNA

SEQ ID NO: 163219 - protein, 15 aa, Borrelia burgdorferi B31
SASEIKNLSELKNAL

SEQ ID NO: 163220 - protein, 15 aa, Borrelia burgdorferi B31
ASEIKNLSELKNALK

SEQ ID NO: 163221 - protein, 16 aa, Borrelia burgdorferi B31
MRLLIGFALALALIGC

SEQ ID NO: 163222 - protein, 16 aa, Borrelia burgdorferi B31
RLLIGFALALALIGCA

SEQ ID NO: 163223 - protein, 16 aa, Borrelia burgdorferi B31
LLIGFALALALIGCAQ

SEQ ID NO: 163224 - protein, 16 aa, Borrelia burgdorferi B31
LIGFALALALIGCAQK

SEQ ID NO: 163225 - protein, 16 aa, Borrelia burgdorferi B31
IGFALALALIGCAQKG

SEQ ID NO: 163226 - protein, 16 aa, Borrelia burgdorferi B31
GFALALALIGCAQKGA

SEQ ID NO: 163227 - protein, 16 aa, Borrelia burgdorferi B31
FALALALIGCAQKGAE

SEQ ID NO: 163228 - protein, 16 aa, Borrelia burgdorferi B31
ALALALIGCAQKGAES

SEQ ID NO: 163229 - protein, 16 aa, Borrelia burgdorferi B31
LALALIGCAQKGAESI

SEQ ID NO: 163230 - protein, 16 aa, Borrelia burgdorferi B31
ALALIGCAQKGAESIG

SEQ ID NO: 163231 - protein, 16 aa, Borrelia burgdorferi B31
LALIGCAQKGAESIGS

SEQ ID NO: 163232 - protein, 16 aa, Borrelia burgdorferi B31
ALIGCAQKGAESIGSQ

SEQ ID NO: 163233 - protein, 16 aa, Borrelia burgdorferi B31
LIGCAQKGAESIGSQK

SEQ ID NO: 163234 - protein, 16 aa, Borrelia burgdorferi B31
IGCAQKGAESIGSQKE

SEQ ID NO: 163235 - protein, 16 aa, Borrelia burgdorferi B31
GCAQKGAESIGSQKEN

SEQ ID NO: 163236 - protein, 16 aa, Borrelia burgdorferi B31
CAQKGAESIGSQKEND

SEQ ID NO: 163237 - protein, 16 aa, Borrelia burgdorferi B31
AQKGAESIGSQKENDL

SEQ ID NO: 163238 - protein, 16 aa, Borrelia burgdorferi B31
QKGAESIGSQKENDLN

SEQ ID NO: 163239 - protein, 16 aa, Borrelia burgdorferi B31
KGAESIGSQKENDLNL

SEQ ID NO: 163240 - protein, 16 aa, Borrelia burgdorferi B31
GAESIGSQKENDLNLE

SEQ ID NO: 163241 - protein, 16 aa, Borrelia burgdorferi B31
AESIGSQKENDLNLED

SEQ ID NO: 163242 - protein, 16 aa, Borrelia burgdorferi B31
ESIGSQKENDLNLEDS

SEQ ID NO: 163243 - protein, 16 aa, Borrelia burgdorferi B31
SIGSQKENDLNLEDSS

SEQ ID NO: 163244 - protein, 16 aa, Borrelia burgdorferi B31
IGSQKENDLNLEDSSK

SEQ ID NO: 163245 - protein, 16 aa, Borrelia burgdorferi B31
GSQKENDLNLEDSSKK

SEQ ID NO: 163246 - protein, 16 aa, Borrelia burgdorferi B31
SQKENDLNLEDSSKKS

SEQ ID NO: 163247 - protein, 16 aa, Borrelia burgdorferi B31
QKENDLNLEDSSKKSH

SEQ ID NO: 163248 - protein, 16 aa, Borrelia burgdorferi B31
KENDLNLEDSSKKSHQ

SEQ ID NO: 163249 - protein, 16 aa, Borrelia burgdorferi B31
ENDLNLEDSSKKSHQN

SEQ ID NO: 163250 - protein, 16 aa, Borrelia burgdorferi B31
NDLNLEDSSKKSHQNA

SEQ ID NO: 163251 - protein, 16 aa, Borrelia burgdorferi B31
DLNLEDSSKKSHQNAK

SEQ ID NO: 163252 - protein, 16 aa, Borrelia burgdorferi B31
LNLEDSSKKSHQNAKQ

SEQ ID NO: 163253 - protein, 16 aa, Borrelia burgdorferi B31
NLEDSSKKSHQNAKQD

SEQ ID NO: 163254 - protein, 16 aa, Borrelia burgdorferi B31
LEDSSKKSHQNAKQDL

SEQ ID NO: 163255 - protein, 16 aa, Borrelia burgdorferi B31
EDSSKKSHQNAKQDLP

SEQ ID NO: 163256 - protein, 16 aa, Borrelia burgdorferi B31
DSSKKSHQNAKQDLPA

SEQ ID NO: 163257 - protein, 16 aa, Borrelia burgdorferi B31
SSKKSHQNAKQDLPAV

SEQ ID NO: 163258 - protein, 16 aa, Borrelia burgdorferi B31
SKKSHQNAKQDLPAVT

SEQ ID NO: 163259 - protein, 16 aa, Borrelia burgdorferi B31
KKSHQNAKQDLPAVTE

SEQ ID NO: 163260 - protein, 16 aa, Borrelia burgdorferi B31
KSHQNAKQDLPAVTED

SEQ ID NO: 163261 - protein, 16 aa, Borrelia burgdorferi B31
SHQNAKQDLPAVTEDS

SEQ ID NO: 163262 - protein, 16 aa, Borrelia burgdorferi B31
HQNAKQDLPAVTEDSV

SEQ ID NO: 163263 - protein, 16 aa, Borrelia burgdorferi B31
QNAKQDLPAVTEDSVS

SEQ ID NO: 163264 - protein, 16 aa, Borrelia burgdorferi B31
NAKQDLPAVTEDSVSL

SEQ ID NO: 163265 - protein, 16 aa, Borrelia burgdorferi B31
AKQDLPAVTEDSVSLF

SEQ ID NO: 163266 - protein, 16 aa, Borrelia burgdorferi B31
KQDLPAVTEDSVSLFN

SEQ ID NO: 163267 - protein, 16 aa, Borrelia burgdorferi B31
QDLPAVTEDSVSLFNG

SEQ ID NO: 163268 - protein, 16 aa, Borrelia burgdorferi B31
DLPAVTEDSVSLFNGN

SEQ ID NO: 163269 - protein, 16 aa, Borrelia burgdorferi B31
LPAVTEDSVSLFNGNK

SEQ ID NO: 163270 - protein, 16 aa, Borrelia burgdorferi B31
PAVTEDSVSLFNGNKI

SEQ ID NO: 163271 - protein, 16 aa, Borrelia burgdorferi B31
AVTEDSVSLFNGNKIF

SEQ ID NO: 163272 - protein, 16 aa, Borrelia burgdorferi B31
VTEDSVSLFNGNKIFV

SEQ ID NO: 163273 - protein, 16 aa, Borrelia burgdorferi B31
TEDSVSLFNGNKIFVS

SEQ ID NO: 163274 - protein, 16 aa, Borrelia burgdorferi B31
EDSVSLFNGNKIFVSK

SEQ ID NO: 163275 - protein, 16 aa, Borrelia burgdorferi B31
DSVSLFNGNKIFVSKE

SEQ ID NO: 163276 - protein, 16 aa, Borrelia burgdorferi B31
SVSLFNGNKIFVSKEK

SEQ ID NO: 163277 - protein, 16 aa, Borrelia burgdorferi B31
VSLFNGNKIFVSKEKN

SEQ ID NO: 163278 - protein, 16 aa, Borrelia burgdorferi B31
SLFNGNKIFVSKEKNS

SEQ ID NO: 163279 - protein, 16 aa, Borrelia burgdorferi B31
LFNGNKIFVSKEKNSS

SEQ ID NO: 163280 - protein, 16 aa, Borrelia burgdorferi B31
FNGNKIFVSKEKNSSG

SEQ ID NO: 163281 - protein, 16 aa, Borrelia burgdorferi B31
NGNKIFVSKEKNSSGK

SEQ ID NO: 163282 - protein, 16 aa, Borrelia burgdorferi B31
GNKIFVSKEKNSSGKY

SEQ ID NO: 163283 - protein, 16 aa, Borrelia burgdorferi B31
NKIFVSKEKNSSGKYD

SEQ ID NO: 163284 - protein, 16 aa, Borrelia burgdorferi B31
KIFVSKEKNSSGKYDL

SEQ ID NO: 163285 - protein, 16 aa, Borrelia burgdorferi B31
IFVSKEKNSSGKYDLR

SEQ ID NO: 163286 - protein, 16 aa, Borrelia burgdorferi B31
FVSKEKNSSGKYDLRA

SEQ ID NO: 163287 - protein, 16 aa, Borrelia burgdorferi B31
VSKEKNSSGKYDLRAT

SEQ ID NO: 163288 - protein, 16 aa, Borrelia burgdorferi B31
SKEKNSSGKYDLRATI

SEQ ID NO: 163289 - protein, 16 aa, Borrelia burgdorferi B31
KEKNSSGKYDLRATID

SEQ ID NO: 163290 - protein, 16 aa, Borrelia burgdorferi B31
EKNSSGKYDLRATIDQ

SEQ ID NO: 163291 - protein, 16 aa, Borrelia burgdorferi B31
KNSSGKYDLRATIDQV

SEQ ID NO: 163292 - protein, 16 aa, Borrelia burgdorferi B31
NSSGKYDLRATIDQVE

SEQ ID NO: 163293 - protein, 16 aa, Borrelia burgdorferi B31
SSGKYDLRATIDQVEL

SEQ ID NO: 163294 - protein, 16 aa, Borrelia burgdorferi B31
SGKYDLRATIDQVELK

SEQ ID NO: 163295 - protein, 16 aa, Borrelia burgdorferi B31
GKYDLRATIDQVELKG

SEQ ID NO: 163296 - protein, 16 aa, Borrelia burgdorferi B31
KYDLRATIDQVELKGT

SEQ ID NO: 163297 - protein, 16 aa, Borrelia burgdorferi B31
YDLRATIDQVELKGTS

SEQ ID NO: 163298 - protein, 16 aa, Borrelia burgdorferi B31
DLRATIDQVELKGTSD

SEQ ID NO: 163299 - protein, 16 aa, Borrelia burgdorferi B31
LRATIDQVELKGTSDK

SEQ ID NO: 163300 - protein, 16 aa, Borrelia burgdorferi B31
RATIDQVELKGTSDKN

SEQ ID NO: 163301 - protein, 16 aa, Borrelia burgdorferi B31
ATIDQVELKGTSDKNN

SEQ ID NO: 163302 - protein, 16 aa, Borrelia burgdorferi B31
TIDQVELKGTSDKNNG

SEQ ID NO: 163303 - protein, 16 aa, Borrelia burgdorferi B31
IDQVELKGTSDKNNGS

SEQ ID NO: 163304 - protein, 16 aa, Borrelia burgdorferi B31
DQVELKGTSDKNNGSG

SEQ ID NO: 163305 - protein, 16 aa, Borrelia burgdorferi B31
QVELKGTSDKNNGSGT

SEQ ID NO: 163306 - protein, 16 aa, Borrelia burgdorferi B31
VELKGTSDKNNGSGTL

SEQ ID NO: 163307 - protein, 16 aa, Borrelia burgdorferi B31
ELKGTSDKNNGSGTLE

SEQ ID NO: 163308 - protein, 16 aa, Borrelia burgdorferi B31
LKGTSDKNNGSGTLEG

SEQ ID NO: 163309 - protein, 16 aa, Borrelia burgdorferi B31
KGTSDKNNGSGTLEGS

SEQ ID NO: 163310 - protein, 16 aa, Borrelia burgdorferi B31
GTSDKNNGSGTLEGSK

SEQ ID NO: 163311 - protein, 16 aa, Borrelia burgdorferi B31
TSDKNNGSGTLEGSKP

SEQ ID NO: 163312 - protein, 16 aa, Borrelia burgdorferi B31
SDKNNGSGTLEGSKPD

SEQ ID NO: 163313 - protein, 16 aa, Borrelia burgdorferi B31
DKNNGSGTLEGSKPDK

SEQ ID NO: 163314 - protein, 16 aa, Borrelia burgdorferi B31
KNNGSGTLEGSKPDKS

SEQ ID NO: 163315 - protein, 16 aa, Borrelia burgdorferi B31
NNGSGTLEGSKPDKSK

SEQ ID NO: 163316 - protein, 16 aa, Borrelia burgdorferi B31
NGSGTLEGSKPDKSKV

SEQ ID NO: 163317 - protein, 16 aa, Borrelia burgdorferi B31
GSGTLEGSKPDKSKVK

SEQ ID NO: 163318 - protein, 16 aa, Borrelia burgdorferi B31
SGTLEGSKPDKSKVKL

SEQ ID NO: 163319 - protein, 16 aa, Borrelia burgdorferi B31
GTLEGSKPDKSKVKLT

SEQ ID NO: 163320 - protein, 16 aa, Borrelia burgdorferi B31
TLEGSKPDKSKVKLTV

SEQ ID NO: 163321 - protein, 16 aa, Borrelia burgdorferi B31
LEGSKPDKSKVKLTVS

SEQ ID NO: 163322 - protein, 16 aa, Borrelia burgdorferi B31
EGSKPDKSKVKLTVSA

SEQ ID NO: 163323 - protein, 16 aa, Borrelia burgdorferi B31
GSKPDKSKVKLTVSAD

SEQ ID NO: 163324 - protein, 16 aa, Borrelia burgdorferi B31
SKPDKSKVKLTVSADL

SEQ ID NO: 163325 - protein, 16 aa, Borrelia burgdorferi B31
KPDKSKVKLTVSADLN

SEQ ID NO: 163326 - protein, 16 aa, Borrelia burgdorferi B31
PDKSKVKLTVSADLNT

SEQ ID NO: 163327 - protein, 16 aa, Borrelia burgdorferi B31
DKSKVKLTVSADLNTV

SEQ ID NO: 163328 - protein, 16 aa, Borrelia burgdorferi B31
KSKVKLTVSADLNTVT

SEQ ID NO: 163329 - protein, 16 aa, Borrelia burgdorferi B31
SKVKLTVSADLNTVTL

SEQ ID NO: 163330 - protein, 16 aa, Borrelia burgdorferi B31
KVKLTVSADLNTVTLE

SEQ ID NO: 163331 - protein, 16 aa, Borrelia burgdorferi B31
VKLTVSADLNTVTLEA

SEQ ID NO: 163332 - protein, 16 aa, Borrelia burgdorferi B31
KLTVSADLNTVTLEAF

SEQ ID NO: 163333 - protein, 16 aa, Borrelia burgdorferi B31
LTVSADLNTVTLEAFD

SEQ ID NO: 163334 - protein, 16 aa, Borrelia burgdorferi B31
TVSADLNTVTLEAFDA

SEQ ID NO: 163335 - protein, 16 aa, Borrelia burgdorferi B31
VSADLNTVTLEAFDAS

SEQ ID NO: 163336 - protein, 16 aa, Borrelia burgdorferi B31
SADLNTVTLEAFDASN

SEQ ID NO: 163337 - protein, 16 aa, Borrelia burgdorferi B31
ADLNTVTLEAFDASNQ

SEQ ID NO: 163338 - protein, 16 aa, Borrelia burgdorferi B31
DLNTVTLEAFDASNQK

SEQ ID NO: 163339 - protein, 16 aa, Borrelia burgdorferi B31
LNTVTLEAFDASNQKI

SEQ ID NO: 163340 - protein, 16 aa, Borrelia burgdorferi B31
NTVTLEAFDASNQKIS

SEQ ID NO: 163341 - protein, 16 aa, Borrelia burgdorferi B31
TVTLEAFDASNQKISS

SEQ ID NO: 163342 - protein, 16 aa, Borrelia burgdorferi B31
VTLEAFDASNQKISSK

SEQ ID NO: 163343 - protein, 16 aa, Borrelia burgdorferi B31
TLEAFDASNQKISSKV

SEQ ID NO: 163344 - protein, 16 aa, Borrelia burgdorferi B31
LEAFDASNQKISSKVT

SEQ ID NO: 163345 - protein, 16 aa, Borrelia burgdorferi B31
EAFDASNQKISSKVTK

SEQ ID NO: 163346 - protein, 16 aa, Borrelia burgdorferi B31
AFDASNQKISSKVTKK

SEQ ID NO: 163347 - protein, 16 aa, Borrelia burgdorferi B31
FDASNQKISSKVTKKQ

SEQ ID NO: 163348 - protein, 16 aa, Borrelia burgdorferi B31
DASNQKISSKVTKKQG

SEQ ID NO: 163349 - protein, 16 aa, Borrelia burgdorferi B31
ASNQKISSKVTKKQGS

SEQ ID NO: 163350 - protein, 16 aa, Borrelia burgdorferi B31
SNQKISSKVTKKQGSI

SEQ ID NO: 163351 - protein, 16 aa, Borrelia burgdorferi B31
NQKISSKVTKKQGSIT

SEQ ID NO: 163352 - protein, 16 aa, Borrelia burgdorferi B31
  Xaa can be any naturally occurring amino acid
  VARIANT 16: Xaa = Any Amino Acid
QKISSKVTKKQGSITX

SEQ ID NO: 163353 - protein, 16 aa, Borrelia burgdorferi B31
  Xaa can be any naturally occurring amino acid
  VARIANT 15: Xaa = Any Amino Acid
KISSKVTKKQGSITXE

SEQ ID NO: 163354 - protein, 16 aa, Borrelia burgdorferi B31
  Xaa can be any naturally occurring amino acid
  VARIANT 14: Xaa = Any Amino Acid
ISSKVTKKQGSITXET

SEQ ID NO: 163355 - protein, 16 aa, Borrelia burgdorferi B31
  Xaa can be any naturally occurring amino acid
  VARIANT 13: Xaa = Any Amino Acid
SSKVTKKQGSITXETL

SEQ ID NO: 163356 - protein, 16 aa, Borrelia burgdorferi B31
  Xaa can be any naturally occurring amino acid
  VARIANT 12: Xaa = Any Amino Acid
SKVTKKQGSITXETLK

SEQ ID NO: 163357 - protein, 16 aa, Borrelia burgdorferi B31
  Xaa can be any naturally occurring amino acid
  VARIANT 11: Xaa = Any Amino Acid
KVTKKQGSITXETLKA

SEQ ID NO: 163358 - protein, 16 aa, Borrelia burgdorferi B31
  Xaa can be any naturally occurring amino acid
  VARIANT 10: Xaa = Any Amino Acid
VTKKQGSITXETLKAN

SEQ ID NO: 163359 - protein, 16 aa, Borrelia burgdorferi B31
  Xaa can be any naturally occurring amino acid
  VARIANT 9: Xaa = Any Amino Acid
TKKQGSITXETLKANK

SEQ ID NO: 163360 - protein, 16 aa, Borrelia burgdorferi B31
  Xaa can be any naturally occurring amino acid
  VARIANT 8: Xaa = Any Amino Acid
KKQGSITXETLKANKL

SEQ ID NO: 163361 - protein, 16 aa, Borrelia burgdorferi B31
  Xaa can be any naturally occurring amino acid
  VARIANT 7: Xaa = Any Amino Acid
KQGSITXETLKANKLD

SEQ ID NO: 163362 - protein, 16 aa, Borrelia burgdorferi B31
  Xaa can be any naturally occurring amino acid
  VARIANT 6: Xaa = Any Amino Acid
QGSITXETLKANKLDS

SEQ ID NO: 163363 - protein, 16 aa, Borrelia burgdorferi B31
  Xaa can be any naturally occurring amino acid
  VARIANT 5: Xaa = Any Amino Acid
GSITXETLKANKLDSK

SEQ ID NO: 163364 - protein, 16 aa, Borrelia burgdorferi B31
  Xaa can be any naturally occurring amino acid
  VARIANT 4: Xaa = Any Amino Acid
SITXETLKANKLDSKK

SEQ ID NO: 163365 - protein, 16 aa, Borrelia burgdorferi B31
  Xaa can be any naturally occurring amino acid
  VARIANT 3: Xaa = Any Amino Acid
ITXETLKANKLDSKKL

SEQ ID NO: 163366 - protein, 16 aa, Borrelia burgdorferi B31
  Xaa can be any naturally occurring amino acid
  VARIANT 2: Xaa = Any Amino Acid
TXETLKANKLDSKKLT

SEQ ID NO: 163367 - protein, 16 aa, Borrelia burgdorferi B31
  Xaa can be any naturally occurring amino acid
  VARIANT 1: Xaa = Any Amino Acid
XETLKANKLDSKKLTR

SEQ ID NO: 163368 - protein, 16 aa, Borrelia burgdorferi B31
ETLKANKLDSKKLTRS

SEQ ID NO: 163369 - protein, 16 aa, Borrelia burgdorferi B31
TLKANKLDSKKLTRSN

SEQ ID NO: 163370 - protein, 16 aa, Borrelia burgdorferi B31
LKANKLDSKKLTRSNG

SEQ ID NO: 163371 - protein, 16 aa, Borrelia burgdorferi B31
KANKLDSKKLTRSNGT

SEQ ID NO: 163372 - protein, 16 aa, Borrelia burgdorferi B31
ANKLDSKKLTRSNGTT

SEQ ID NO: 163373 - protein, 16 aa, Borrelia burgdorferi B31
NKLDSKKLTRSNGTTL

SEQ ID NO: 163374 - protein, 16 aa, Borrelia burgdorferi B31
KLDSKKLTRSNGTTLE

SEQ ID NO: 163375 - protein, 16 aa, Borrelia burgdorferi B31
LDSKKLTRSNGTTLEY

SEQ ID NO: 163376 - protein, 16 aa, Borrelia burgdorferi B31
DSKKLTRSNGTTLEYS

SEQ ID NO: 163377 - protein, 16 aa, Borrelia burgdorferi B31
SKKLTRSNGTTLEYSQ

SEQ ID NO: 163378 - protein, 16 aa, Borrelia burgdorferi B31
KKLTRSNGTTLEYSQI

SEQ ID NO: 163379 - protein, 16 aa, Borrelia burgdorferi B31
KLTRSNGTTLEYSQIT

SEQ ID NO: 163380 - protein, 16 aa, Borrelia burgdorferi B31
LTRSNGTTLEYSQITD

SEQ ID NO: 163381 - protein, 16 aa, Borrelia burgdorferi B31
TRSNGTTLEYSQITDA

SEQ ID NO: 163382 - protein, 16 aa, Borrelia burgdorferi B31
RSNGTTLEYSQITDAD

SEQ ID NO: 163383 - protein, 16 aa, Borrelia burgdorferi B31
SNGTTLEYSQITDADN

SEQ ID NO: 163384 - protein, 16 aa, Borrelia burgdorferi B31
NGTTLEYSQITDADNA

SEQ ID NO: 163385 - protein, 16 aa, Borrelia burgdorferi B31
GTTLEYSQITDADNAT

SEQ ID NO: 163386 - protein, 16 aa, Borrelia burgdorferi B31
TTLEYSQITDADNATK

SEQ ID NO: 163387 - protein, 16 aa, Borrelia burgdorferi B31
TLEYSQITDADNATKA

SEQ ID NO: 163388 - protein, 16 aa, Borrelia burgdorferi B31
LEYSQITDADNATKAV

SEQ ID NO: 163389 - protein, 16 aa, Borrelia burgdorferi B31
EYSQITDADNATKAVE

SEQ ID NO: 163390 - protein, 16 aa, Borrelia burgdorferi B31
YSQITDADNATKAVET

SEQ ID NO: 163391 - protein, 16 aa, Borrelia burgdorferi B31
SQITDADNATKAVETL

SEQ ID NO: 163392 - protein, 16 aa, Borrelia burgdorferi B31
QITDADNATKAVETLK

SEQ ID NO: 163393 - protein, 16 aa, Borrelia burgdorferi B31
ITDADNATKAVETLKN

SEQ ID NO: 163394 - protein, 16 aa, Borrelia burgdorferi B31
TDADNATKAVETLKNS

SEQ ID NO: 163395 - protein, 16 aa, Borrelia burgdorferi B31
DADNATKAVETLKNSI

SEQ ID NO: 163396 - protein, 16 aa, Borrelia burgdorferi B31
ADNATKAVETLKNSIK

SEQ ID NO: 163397 - protein, 16 aa, Borrelia burgdorferi B31
DNATKAVETLKNSIKL

SEQ ID NO: 163398 - protein, 16 aa, Borrelia burgdorferi B31
NATKAVETLKNSIKLE

SEQ ID NO: 163399 - protein, 16 aa, Borrelia burgdorferi B31
ATKAVETLKNSIKLEG

SEQ ID NO: 163400 - protein, 16 aa, Borrelia burgdorferi B31
TKAVETLKNSIKLEGS

SEQ ID NO: 163401 - protein, 16 aa, Borrelia burgdorferi B31
KAVETLKNSIKLEGSL

SEQ ID NO: 163402 - protein, 16 aa, Borrelia burgdorferi B31
AVETLKNSIKLEGSLV

SEQ ID NO: 163403 - protein, 16 aa, Borrelia burgdorferi B31
VETLKNSIKLEGSLVG

SEQ ID NO: 163404 - protein, 16 aa, Borrelia burgdorferi B31
ETLKNSIKLEGSLVGG

SEQ ID NO: 163405 - protein, 16 aa, Borrelia burgdorferi B31
TLKNSIKLEGSLVGGK

SEQ ID NO: 163406 - protein, 16 aa, Borrelia burgdorferi B31
LKNSIKLEGSLVGGKT

SEQ ID NO: 163407 - protein, 16 aa, Borrelia burgdorferi B31
KNSIKLEGSLVGGKTT

SEQ ID NO: 163408 - protein, 16 aa, Borrelia burgdorferi B31
NSIKLEGSLVGGKTTV

SEQ ID NO: 163409 - protein, 16 aa, Borrelia burgdorferi B31
SIKLEGSLVGGKTTVE

SEQ ID NO: 163410 - protein, 16 aa, Borrelia burgdorferi B31
IKLEGSLVGGKTTVEI

SEQ ID NO: 163411 - protein, 16 aa, Borrelia burgdorferi B31
KLEGSLVGGKTTVEIK

SEQ ID NO: 163412 - protein, 16 aa, Borrelia burgdorferi B31
LEGSLVGGKTTVEIKE

SEQ ID NO: 163413 - protein, 16 aa, Borrelia burgdorferi B31
EGSLVGGKTTVEIKEG

SEQ ID NO: 163414 - protein, 16 aa, Borrelia burgdorferi B31
GSLVGGKTTVEIKEGT

SEQ ID NO: 163415 - protein, 16 aa, Borrelia burgdorferi B31
SLVGGKTTVEIKEGTV

SEQ ID NO: 163416 - protein, 16 aa, Borrelia burgdorferi B31
LVGGKTTVEIKEGTVT

SEQ ID NO: 163417 - protein, 16 aa, Borrelia burgdorferi B31
VGGKTTVEIKEGTVTL

SEQ ID NO: 163418 - protein, 16 aa, Borrelia burgdorferi B31
GGKTTVEIKEGTVTLK

SEQ ID NO: 163419 - protein, 16 aa, Borrelia burgdorferi B31
GKTTVEIKEGTVTLKR

SEQ ID NO: 163420 - protein, 16 aa, Borrelia burgdorferi B31
KTTVEIKEGTVTLKRE

SEQ ID NO: 163421 - protein, 16 aa, Borrelia burgdorferi B31
TTVEIKEGTVTLKREI

SEQ ID NO: 163422 - protein, 16 aa, Borrelia burgdorferi B31
TVEIKEGTVTLKREIE

SEQ ID NO: 163423 - protein, 16 aa, Borrelia burgdorferi B31
VEIKEGTVTLKREIEK

SEQ ID NO: 163424 - protein, 16 aa, Borrelia burgdorferi B31
EIKEGTVTLKREIEKD

SEQ ID NO: 163425 - protein, 16 aa, Borrelia burgdorferi B31
IKEGTVTLKREIEKDG

SEQ ID NO: 163426 - protein, 16 aa, Borrelia burgdorferi B31
KEGTVTLKREIEKDGK

SEQ ID NO: 163427 - protein, 16 aa, Borrelia burgdorferi B31
EGTVTLKREIEKDGKV

SEQ ID NO: 163428 - protein, 16 aa, Borrelia burgdorferi B31
GTVTLKREIEKDGKVK

SEQ ID NO: 163429 - protein, 16 aa, Borrelia burgdorferi B31
TVTLKREIEKDGKVKV

SEQ ID NO: 163430 - protein, 16 aa, Borrelia burgdorferi B31
VTLKREIEKDGKVKVF

SEQ ID NO: 163431 - protein, 16 aa, Borrelia burgdorferi B31
TLKREIEKDGKVKVFL

SEQ ID NO: 163432 - protein, 16 aa, Borrelia burgdorferi B31
LKREIEKDGKVKVFLN

SEQ ID NO: 163433 - protein, 16 aa, Borrelia burgdorferi B31
KREIEKDGKVKVFLND

SEQ ID NO: 163434 - protein, 16 aa, Borrelia burgdorferi B31
REIEKDGKVKVFLNDT

SEQ ID NO: 163435 - protein, 16 aa, Borrelia burgdorferi B31
EIEKDGKVKVFLNDTA

SEQ ID NO: 163436 - protein, 16 aa, Borrelia burgdorferi B31
IEKDGKVKVFLNDTAG

SEQ ID NO: 163437 - protein, 16 aa, Borrelia burgdorferi B31
EKDGKVKVFLNDTAGS

SEQ ID NO: 163438 - protein, 16 aa, Borrelia burgdorferi B31
KDGKVKVFLNDTAGSN

SEQ ID NO: 163439 - protein, 16 aa, Borrelia burgdorferi B31
DGKVKVFLNDTAGSNK

SEQ ID NO: 163440 - protein, 16 aa, Borrelia burgdorferi B31
GKVKVFLNDTAGSNKK

SEQ ID NO: 163441 - protein, 16 aa, Borrelia burgdorferi B31
KVKVFLNDTAGSNKKT

SEQ ID NO: 163442 - protein, 16 aa, Borrelia burgdorferi B31
VKVFLNDTAGSNKKTG

SEQ ID NO: 163443 - protein, 16 aa, Borrelia burgdorferi B31
KVFLNDTAGSNKKTGK

SEQ ID NO: 163444 - protein, 16 aa, Borrelia burgdorferi B31
VFLNDTAGSNKKTGKW

SEQ ID NO: 163445 - protein, 16 aa, Borrelia burgdorferi B31
FLNDTAGSNKKTGKWE

SEQ ID NO: 163446 - protein, 16 aa, Borrelia burgdorferi B31
LNDTAGSNKKTGKWED

SEQ ID NO: 163447 - protein, 16 aa, Borrelia burgdorferi B31
NDTAGSNKKTGKWEDS

SEQ ID NO: 163448 - protein, 16 aa, Borrelia burgdorferi B31
DTAGSNKKTGKWEDST

SEQ ID NO: 163449 - protein, 16 aa, Borrelia burgdorferi B31
TAGSNKKTGKWEDSTS

SEQ ID NO: 163450 - protein, 16 aa, Borrelia burgdorferi B31
AGSNKKTGKWEDSTST

SEQ ID NO: 163451 - protein, 16 aa, Borrelia burgdorferi B31
GSNKKTGKWEDSTSTL

SEQ ID NO: 163452 - protein, 16 aa, Borrelia burgdorferi B31
SNKKTGKWEDSTSTLT

SEQ ID NO: 163453 - protein, 16 aa, Borrelia burgdorferi B31
NKKTGKWEDSTSTLTI

SEQ ID NO: 163454 - protein, 16 aa, Borrelia burgdorferi B31
KKTGKWEDSTSTLTIS

SEQ ID NO: 163455 - protein, 16 aa, Borrelia burgdorferi B31
KTGKWEDSTSTLTISA

SEQ ID NO: 163456 - protein, 16 aa, Borrelia burgdorferi B31
TGKWEDSTSTLTISAD

SEQ ID NO: 163457 - protein, 16 aa, Borrelia burgdorferi B31
GKWEDSTSTLTISADS

SEQ ID NO: 163458 - protein, 16 aa, Borrelia burgdorferi B31
KWEDSTSTLTISADSK

SEQ ID NO: 163459 - protein, 16 aa, Borrelia burgdorferi B31
WEDSTSTLTISADSKK

SEQ ID NO: 163460 - protein, 16 aa, Borrelia burgdorferi B31
EDSTSTLTISADSKKT

SEQ ID NO: 163461 - protein, 16 aa, Borrelia burgdorferi B31
DSTSTLTISADSKKTK

SEQ ID NO: 163462 - protein, 16 aa, Borrelia burgdorferi B31
STSTLTISADSKKTKD

SEQ ID NO: 163463 - protein, 16 aa, Borrelia burgdorferi B31
TSTLTISADSKKTKDL

SEQ ID NO: 163464 - protein, 16 aa, Borrelia burgdorferi B31
STLTISADSKKTKDLV

SEQ ID NO: 163465 - protein, 16 aa, Borrelia burgdorferi B31
TLTISADSKKTKDLVF

SEQ ID NO: 163466 - protein, 16 aa, Borrelia burgdorferi B31
LTISADSKKTKDLVFL

SEQ ID NO: 163467 - protein, 16 aa, Borrelia burgdorferi B31
TISADSKKTKDLVFLT

SEQ ID NO: 163468 - protein, 16 aa, Borrelia burgdorferi B31
ISADSKKTKDLVFLTD

SEQ ID NO: 163469 - protein, 16 aa, Borrelia burgdorferi B31
SADSKKTKDLVFLTDG

SEQ ID NO: 163470 - protein, 16 aa, Borrelia burgdorferi B31
ADSKKTKDLVFLTDGT

SEQ ID NO: 163471 - protein, 16 aa, Borrelia burgdorferi B31
DSKKTKDLVFLTDGTI

SEQ ID NO: 163472 - protein, 16 aa, Borrelia burgdorferi B31
SKKTKDLVFLTDGTIT

SEQ ID NO: 163473 - protein, 16 aa, Borrelia burgdorferi B31
KKTKDLVFLTDGTITV

SEQ ID NO: 163474 - protein, 16 aa, Borrelia burgdorferi B31
KTKDLVFLTDGTITVQ

SEQ ID NO: 163475 - protein, 16 aa, Borrelia burgdorferi B31
TKDLVFLTDGTITVQQ

SEQ ID NO: 163476 - protein, 16 aa, Borrelia burgdorferi B31
KDLVFLTDGTITVQQY

SEQ ID NO: 163477 - protein, 16 aa, Borrelia burgdorferi B31
DLVFLTDGTITVQQYN

SEQ ID NO: 163478 - protein, 16 aa, Borrelia burgdorferi B31
LVFLTDGTITVQQYNT

SEQ ID NO: 163479 - protein, 16 aa, Borrelia burgdorferi B31
VFLTDGTITVQQYNTA

SEQ ID NO: 163480 - protein, 16 aa, Borrelia burgdorferi B31
FLTDGTITVQQYNTAG

SEQ ID NO: 163481 - protein, 16 aa, Borrelia burgdorferi B31
LTDGTITVQQYNTAGT

SEQ ID NO: 163482 - protein, 16 aa, Borrelia burgdorferi B31
TDGTITVQQYNTAGTS

SEQ ID NO: 163483 - protein, 16 aa, Borrelia burgdorferi B31
DGTITVQQYNTAGTSL

SEQ ID NO: 163484 - protein, 16 aa, Borrelia burgdorferi B31
GTITVQQYNTAGTSLE

SEQ ID NO: 163485 - protein, 16 aa, Borrelia burgdorferi B31
TITVQQYNTAGTSLEG

SEQ ID NO: 163486 - protein, 16 aa, Borrelia burgdorferi B31
ITVQQYNTAGTSLEGS

SEQ ID NO: 163487 - protein, 16 aa, Borrelia burgdorferi B31
TVQQYNTAGTSLEGSA

SEQ ID NO: 163488 - protein, 16 aa, Borrelia burgdorferi B31
VQQYNTAGTSLEGSAS

SEQ ID NO: 163489 - protein, 16 aa, Borrelia burgdorferi B31
QQYNTAGTSLEGSASE

SEQ ID NO: 163490 - protein, 16 aa, Borrelia burgdorferi B31
QYNTAGTSLEGSASEI

SEQ ID NO: 163491 - protein, 16 aa, Borrelia burgdorferi B31
YNTAGTSLEGSASEIK

SEQ ID NO: 163492 - protein, 16 aa, Borrelia burgdorferi B31
NTAGTSLEGSASEIKN

SEQ ID NO: 163493 - protein, 16 aa, Borrelia burgdorferi B31
TAGTSLEGSASEIKNL

SEQ ID NO: 163494 - protein, 16 aa, Borrelia burgdorferi B31
AGTSLEGSASEIKNLS

SEQ ID NO: 163495 - protein, 16 aa, Borrelia burgdorferi B31
GTSLEGSASEIKNLSE

SEQ ID NO: 163496 - protein, 16 aa, Borrelia burgdorferi B31
TSLEGSASEIKNLSEL

SEQ ID NO: 163497 - protein, 16 aa, Borrelia burgdorferi B31
SLEGSASEIKNLSELK

SEQ ID NO: 163498 - protein, 16 aa, Borrelia burgdorferi B31
LEGSASEIKNLSELKN

SEQ ID NO: 163499 - protein, 16 aa, Borrelia burgdorferi B31
EGSASEIKNLSELKNA

SEQ ID NO: 163500 - protein, 16 aa, Borrelia burgdorferi B31
GSASEIKNLSELKNAL

SEQ ID NO: 163501 - protein, 16 aa, Borrelia burgdorferi B31
SASEIKNLSELKNALK

SEQ ID NO: 163502 - protein, 8 aa, Borrelia garinii
ILMTLFLF

SEQ ID NO: 163503 - protein, 8 aa, Borrelia garinii
LMTLFLFI

SEQ ID NO: 163504 - protein, 8 aa, Borrelia garinii
MTLFLFIS

SEQ ID NO: 163505 - protein, 8 aa, Borrelia garinii
TLFLFISC

SEQ ID NO: 163506 - protein, 8 aa, Borrelia garinii
LFLFISCN

SEQ ID NO: 163507 - protein, 8 aa, Borrelia garinii
FLFISCNN

SEQ ID NO: 163508 - protein, 8 aa, Borrelia garinii
LFISCNNS

SEQ ID NO: 163509 - protein, 8 aa, Borrelia garinii
FISCNNSG

SEQ ID NO: 163510 - protein, 8 aa, Borrelia garinii
ISCNNSGG

SEQ ID NO: 163511 - protein, 8 aa, Borrelia garinii
SCNNSGGD

SEQ ID NO: 163512 - protein, 8 aa, Borrelia garinii
CNNSGGDT

SEQ ID NO: 163513 - protein, 8 aa, Borrelia garinii
NNSGGDTA

SEQ ID NO: 163514 - protein, 8 aa, Borrelia garinii
NSGGDTAS

SEQ ID NO: 163515 - protein, 8 aa, Borrelia garinii
SGGDTAST

SEQ ID NO: 163516 - protein, 8 aa, Borrelia garinii
GGDTASTN

SEQ ID NO: 163517 - protein, 8 aa, Borrelia garinii
GDTASTNP

SEQ ID NO: 163518 - protein, 8 aa, Borrelia garinii
DTASTNPD

SEQ ID NO: 163519 - protein, 8 aa, Borrelia garinii
TASTNPDE

SEQ ID NO: 163520 - protein, 8 aa, Borrelia garinii
ASTNPDES

SEQ ID NO: 163521 - protein, 8 aa, Borrelia garinii
STNPDESA

SEQ ID NO: 163522 - protein, 8 aa, Borrelia garinii
TNPDESAK

SEQ ID NO: 163523 - protein, 8 aa, Borrelia garinii
NPDESAKG

SEQ ID NO: 163524 - protein, 8 aa, Borrelia garinii
PDESAKGP

SEQ ID NO: 163525 - protein, 8 aa, Borrelia garinii
DESAKGPN

SEQ ID NO: 163526 - protein, 8 aa, Borrelia garinii
ESAKGPNL

SEQ ID NO: 163527 - protein, 8 aa, Borrelia garinii
SAKGPNLT

SEQ ID NO: 163528 - protein, 8 aa, Borrelia garinii
AKGPNLTV

SEQ ID NO: 163529 - protein, 8 aa, Borrelia garinii
KGPNLTVI

SEQ ID NO: 163530 - protein, 8 aa, Borrelia garinii
GPNLTVIS

SEQ ID NO: 163531 - protein, 8 aa, Borrelia garinii
PNLTVISK

SEQ ID NO: 163532 - protein, 8 aa, Borrelia garinii
NLTVISKK

SEQ ID NO: 163533 - protein, 8 aa, Borrelia garinii
LTVISKKI

SEQ ID NO: 163534 - protein, 8 aa, Borrelia garinii
TVISKKIT

SEQ ID NO: 163535 - protein, 8 aa, Borrelia garinii
VISKKITD

SEQ ID NO: 163536 - protein, 8 aa, Borrelia garinii
ISKKITDS

SEQ ID NO: 163537 - protein, 8 aa, Borrelia garinii
SKKITDSN

SEQ ID NO: 163538 - protein, 8 aa, Borrelia garinii
KKITDSNA

SEQ ID NO: 163539 - protein, 8 aa, Borrelia garinii
KITDSNAF

SEQ ID NO: 163540 - protein, 8 aa, Borrelia garinii
ITDSNAFV

SEQ ID NO: 163541 - protein, 8 aa, Borrelia garinii
TDSNAFVL

SEQ ID NO: 163542 - protein, 8 aa, Borrelia garinii
DSNAFVLA

SEQ ID NO: 163543 - protein, 8 aa, Borrelia garinii
SNAFVLAV

SEQ ID NO: 163544 - protein, 8 aa, Borrelia garinii
NAFVLAVK

SEQ ID NO: 163545 - protein, 8 aa, Borrelia garinii
AFVLAVKE

SEQ ID NO: 163546 - protein, 8 aa, Borrelia garinii
FVLAVKEV

SEQ ID NO: 163547 - protein, 8 aa, Borrelia garinii
VLAVKEVE

SEQ ID NO: 163548 - protein, 8 aa, Borrelia garinii
LAVKEVEA

SEQ ID NO: 163549 - protein, 8 aa, Borrelia garinii
AVKEVEAL

SEQ ID NO: 163550 - protein, 8 aa, Borrelia garinii
VKEVEALI

SEQ ID NO: 163551 - protein, 8 aa, Borrelia garinii
KEVEALIS

SEQ ID NO: 163552 - protein, 8 aa, Borrelia garinii
EVEALISS

SEQ ID NO: 163553 - protein, 8 aa, Borrelia garinii
VEALISSI

SEQ ID NO: 163554 - protein, 8 aa, Borrelia garinii
EALISSID

SEQ ID NO: 163555 - protein, 8 aa, Borrelia garinii
ALISSIDE

SEQ ID NO: 163556 - protein, 8 aa, Borrelia garinii
LISSIDEL

SEQ ID NO: 163557 - protein, 8 aa, Borrelia garinii
ISSIDELA

SEQ ID NO: 163558 - protein, 8 aa, Borrelia garinii
SSIDELAN

SEQ ID NO: 163559 - protein, 8 aa, Borrelia garinii
SIDELANK

SEQ ID NO: 163560 - protein, 8 aa, Borrelia garinii
IDELANKA

SEQ ID NO: 163561 - protein, 8 aa, Borrelia garinii
DELANKAI

SEQ ID NO: 163562 - protein, 8 aa, Borrelia garinii
ELANKAIG

SEQ ID NO: 163563 - protein, 8 aa, Borrelia garinii
LANKAIGK

SEQ ID NO: 163564 - protein, 8 aa, Borrelia garinii
ANKAIGKV

SEQ ID NO: 163565 - protein, 8 aa, Borrelia garinii
NKAIGKVI

SEQ ID NO: 163566 - protein, 8 aa, Borrelia garinii
KAIGKVIH

SEQ ID NO: 163567 - protein, 8 aa, Borrelia garinii
AIGKVIHQ

SEQ ID NO: 163568 - protein, 8 aa, Borrelia garinii
IGKVIHQN

SEQ ID NO: 163569 - protein, 8 aa, Borrelia garinii
GKVIHQNN

SEQ ID NO: 163570 - protein, 8 aa, Borrelia garinii
KVIHQNNG

SEQ ID NO: 163571 - protein, 8 aa, Borrelia garinii
VIHQNNGL

SEQ ID NO: 163572 - protein, 8 aa, Borrelia garinii
IHQNNGLN

SEQ ID NO: 163573 - protein, 8 aa, Borrelia garinii
HQNNGLNA

SEQ ID NO: 163574 - protein, 8 aa, Borrelia garinii
QNNGLNAN

SEQ ID NO: 163575 - protein, 8 aa, Borrelia garinii
NNGLNANA

SEQ ID NO: 163576 - protein, 8 aa, Borrelia garinii
NGLNANAG

SEQ ID NO: 163577 - protein, 8 aa, Borrelia garinii
GLNANAGQ

SEQ ID NO: 163578 - protein, 8 aa, Borrelia garinii
LNANAGQN

SEQ ID NO: 163579 - protein, 8 aa, Borrelia garinii
NANAGQNG

SEQ ID NO: 163580 - protein, 8 aa, Borrelia garinii
ANAGQNGS

SEQ ID NO: 163581 - protein, 8 aa, Borrelia garinii
NAGQNGSL

SEQ ID NO: 163582 - protein, 8 aa, Borrelia garinii
AGQNGSLL

SEQ ID NO: 163583 - protein, 8 aa, Borrelia garinii
GQNGSLLA

SEQ ID NO: 163584 - protein, 8 aa, Borrelia garinii
QNGSLLAG

SEQ ID NO: 163585 - protein, 8 aa, Borrelia garinii
NGSLLAGA

SEQ ID NO: 163586 - protein, 8 aa, Borrelia garinii
GSLLAGAY

SEQ ID NO: 163587 - protein, 8 aa, Borrelia garinii
SLLAGAYA

SEQ ID NO: 163588 - protein, 8 aa, Borrelia garinii
LLAGAYAI

SEQ ID NO: 163589 - protein, 8 aa, Borrelia garinii
LAGAYAIS

SEQ ID NO: 163590 - protein, 8 aa, Borrelia garinii
AGAYAIST

SEQ ID NO: 163591 - protein, 8 aa, Borrelia garinii
GAYAISTL

SEQ ID NO: 163592 - protein, 8 aa, Borrelia garinii
AYAISTLI

SEQ ID NO: 163593 - protein, 8 aa, Borrelia garinii
YAISTLIT

SEQ ID NO: 163594 - protein, 8 aa, Borrelia garinii
AISTLITE

SEQ ID NO: 163595 - protein, 8 aa, Borrelia garinii
ISTLITEK

SEQ ID NO: 163596 - protein, 8 aa, Borrelia garinii
STLITEKL

SEQ ID NO: 163597 - protein, 8 aa, Borrelia garinii
TLITEKLS

SEQ ID NO: 163598 - protein, 8 aa, Borrelia garinii
LITEKLSK

SEQ ID NO: 163599 - protein, 8 aa, Borrelia garinii
ITEKLSKL

SEQ ID NO: 163600 - protein, 8 aa, Borrelia garinii
TEKLSKLK

SEQ ID NO: 163601 - protein, 8 aa, Borrelia garinii
EKLSKLKN

SEQ ID NO: 163602 - protein, 8 aa, Borrelia garinii
KLSKLKNS

SEQ ID NO: 163603 - protein, 8 aa, Borrelia garinii
LSKLKNSE

SEQ ID NO: 163604 - protein, 8 aa, Borrelia garinii
SKLKNSEE

SEQ ID NO: 163605 - protein, 8 aa, Borrelia garinii
KLKNSEEL

SEQ ID NO: 163606 - protein, 8 aa, Borrelia garinii
LKNSEELN

SEQ ID NO: 163607 - protein, 8 aa, Borrelia garinii
KNSEELNK

SEQ ID NO: 163608 - protein, 8 aa, Borrelia garinii
NSEELNKK

SEQ ID NO: 163609 - protein, 8 aa, Borrelia garinii
SEELNKKI

SEQ ID NO: 163610 - protein, 8 aa, Borrelia garinii
EELNKKIE

SEQ ID NO: 163611 - protein, 8 aa, Borrelia garinii
ELNKKIEE

SEQ ID NO: 163612 - protein, 8 aa, Borrelia garinii
LNKKIEEA

SEQ ID NO: 163613 - protein, 8 aa, Borrelia garinii
NKKIEEAK

SEQ ID NO: 163614 - protein, 8 aa, Borrelia garinii
KKIEEAKN

SEQ ID NO: 163615 - protein, 8 aa, Borrelia garinii
KIEEAKNH

SEQ ID NO: 163616 - protein, 8 aa, Borrelia garinii
IEEAKNHS

SEQ ID NO: 163617 - protein, 8 aa, Borrelia garinii
EEAKNHSE

SEQ ID NO: 163618 - protein, 8 aa, Borrelia garinii
EAKNHSEA

SEQ ID NO: 163619 - protein, 8 aa, Borrelia garinii
AKNHSEAF

SEQ ID NO: 163620 - protein, 8 aa, Borrelia garinii
KNHSEAFT

SEQ ID NO: 163621 - protein, 8 aa, Borrelia garinii
NHSEAFTN

SEQ ID NO: 163622 - protein, 8 aa, Borrelia garinii
HSEAFTNR

SEQ ID NO: 163623 - protein, 8 aa, Borrelia garinii
SEAFTNRL

SEQ ID NO: 163624 - protein, 8 aa, Borrelia garinii
EAFTNRLK

SEQ ID NO: 163625 - protein, 8 aa, Borrelia garinii
AFTNRLKG

SEQ ID NO: 163626 - protein, 8 aa, Borrelia garinii
FTNRLKGS

SEQ ID NO: 163627 - protein, 8 aa, Borrelia garinii
TNRLKGSH

SEQ ID NO: 163628 - protein, 8 aa, Borrelia garinii
NRLKGSHA

SEQ ID NO: 163629 - protein, 8 aa, Borrelia garinii
RLKGSHAQ

SEQ ID NO: 163630 - protein, 8 aa, Borrelia garinii
LKGSHAQL

SEQ ID NO: 163631 - protein, 8 aa, Borrelia garinii
KGSHAQLG

SEQ ID NO: 163632 - protein, 8 aa, Borrelia garinii
GSHAQLGV

SEQ ID NO: 163633 - protein, 8 aa, Borrelia garinii
SHAQLGVA

SEQ ID NO: 163634 - protein, 8 aa, Borrelia garinii
HAQLGVAA

SEQ ID NO: 163635 - protein, 8 aa, Borrelia garinii
AQLGVAAA

SEQ ID NO: 163636 - protein, 8 aa, Borrelia garinii
QLGVAAAT

SEQ ID NO: 163637 - protein, 8 aa, Borrelia garinii
LGVAAATD

SEQ ID NO: 163638 - protein, 8 aa, Borrelia garinii
GVAAATDD

SEQ ID NO: 163639 - protein, 8 aa, Borrelia garinii
VAAATDDH

SEQ ID NO: 163640 - protein, 8 aa, Borrelia garinii
AAATDDHA

SEQ ID NO: 163641 - protein, 8 aa, Borrelia garinii
AATDDHAK

SEQ ID NO: 163642 - protein, 8 aa, Borrelia garinii
ATDDHAKE

SEQ ID NO: 163643 - protein, 8 aa, Borrelia garinii
TDDHAKEA

SEQ ID NO: 163644 - protein, 8 aa, Borrelia garinii
DDHAKEAI

SEQ ID NO: 163645 - protein, 8 aa, Borrelia garinii
DHAKEAIL

SEQ ID NO: 163646 - protein, 8 aa, Borrelia garinii
HAKEAILK

SEQ ID NO: 163647 - protein, 8 aa, Borrelia garinii
AKEAILKS

SEQ ID NO: 163648 - protein, 8 aa, Borrelia garinii
KEAILKSN

SEQ ID NO: 163649 - protein, 8 aa, Borrelia garinii
EAILKSNP

SEQ ID NO: 163650 - protein, 8 aa, Borrelia garinii
AILKSNPT

SEQ ID NO: 163651 - protein, 8 aa, Borrelia garinii
ILKSNPTK

SEQ ID NO: 163652 - protein, 8 aa, Borrelia garinii
LKSNPTKD

SEQ ID NO: 163653 - protein, 8 aa, Borrelia garinii
KSNPTKDK

SEQ ID NO: 163654 - protein, 8 aa, Borrelia garinii
SNPTKDKG

SEQ ID NO: 163655 - protein, 8 aa, Borrelia garinii
NPTKDKGA

SEQ ID NO: 163656 - protein, 8 aa, Borrelia garinii
PTKDKGAK

SEQ ID NO: 163657 - protein, 8 aa, Borrelia garinii
TKDKGAKE

SEQ ID NO: 163658 - protein, 8 aa, Borrelia garinii
KDKGAKEL

SEQ ID NO: 163659 - protein, 8 aa, Borrelia garinii
DKGAKELK

SEQ ID NO: 163660 - protein, 8 aa, Borrelia garinii
KGAKELKD

SEQ ID NO: 163661 - protein, 8 aa, Borrelia garinii
GAKELKDL

SEQ ID NO: 163662 - protein, 8 aa, Borrelia garinii
AKELKDLS

SEQ ID NO: 163663 - protein, 8 aa, Borrelia garinii
KELKDLSE

SEQ ID NO: 163664 - protein, 8 aa, Borrelia garinii
ELKDLSES

SEQ ID NO: 163665 - protein, 8 aa, Borrelia garinii
LKDLSESV

SEQ ID NO: 163666 - protein, 8 aa, Borrelia garinii
KDLSESVE

SEQ ID NO: 163667 - protein, 8 aa, Borrelia garinii
DLSESVES

SEQ ID NO: 163668 - protein, 8 aa, Borrelia garinii
LSESVESL

SEQ ID NO: 163669 - protein, 8 aa, Borrelia garinii
SESVESLA

SEQ ID NO: 163670 - protein, 8 aa, Borrelia garinii
ESVESLAK

SEQ ID NO: 163671 - protein, 8 aa, Borrelia garinii
SVESLAKA

SEQ ID NO: 163672 - protein, 8 aa, Borrelia garinii
VESLAKAA

SEQ ID NO: 163673 - protein, 8 aa, Borrelia garinii
ESLAKAAQ

SEQ ID NO: 163674 - protein, 8 aa, Borrelia garinii
SLAKAAQE

SEQ ID NO: 163675 - protein, 8 aa, Borrelia garinii
LAKAAQEA

SEQ ID NO: 163676 - protein, 8 aa, Borrelia garinii
AKAAQEAL

SEQ ID NO: 163677 - protein, 8 aa, Borrelia garinii
KAAQEALA

SEQ ID NO: 163678 - protein, 8 aa, Borrelia garinii
AAQEALAN

SEQ ID NO: 163679 - protein, 8 aa, Borrelia garinii
AQEALANS

SEQ ID NO: 163680 - protein, 8 aa, Borrelia garinii
QEALANSV

SEQ ID NO: 163681 - protein, 8 aa, Borrelia garinii
EALANSVK

SEQ ID NO: 163682 - protein, 8 aa, Borrelia garinii
ALANSVKE

SEQ ID NO: 163683 - protein, 8 aa, Borrelia garinii
LANSVKEL

SEQ ID NO: 163684 - protein, 8 aa, Borrelia garinii
ANSVKELT

SEQ ID NO: 163685 - protein, 8 aa, Borrelia garinii
NSVKELTN

SEQ ID NO: 163686 - protein, 8 aa, Borrelia garinii
SVKELTNP

SEQ ID NO: 163687 - protein, 8 aa, Borrelia garinii
VKELTNPV

SEQ ID NO: 163688 - protein, 8 aa, Borrelia garinii
KELTNPVV

SEQ ID NO: 163689 - protein, 8 aa, Borrelia garinii
ELTNPVVA

SEQ ID NO: 163690 - protein, 8 aa, Borrelia garinii
LTNPVVAE

SEQ ID NO: 163691 - protein, 8 aa, Borrelia garinii
TNPVVAES

SEQ ID NO: 163692 - protein, 8 aa, Borrelia garinii
NPVVAESP

SEQ ID NO: 163693 - protein, 8 aa, Borrelia garinii
PVVAESPK

SEQ ID NO: 163694 - protein, 9 aa, Borrelia garinii
ILMTLFLFI

SEQ ID NO: 163695 - protein, 9 aa, Borrelia garinii
LMTLFLFIS

SEQ ID NO: 163696 - protein, 9 aa, Borrelia garinii
MTLFLFISC

SEQ ID NO: 163697 - protein, 9 aa, Borrelia garinii
TLFLFISCN

SEQ ID NO: 163698 - protein, 9 aa, Borrelia garinii
LFLFISCNN

SEQ ID NO: 163699 - protein, 9 aa, Borrelia garinii
FLFISCNNS

SEQ ID NO: 163700 - protein, 9 aa, Borrelia garinii
LFISCNNSG

SEQ ID NO: 163701 - protein, 9 aa, Borrelia garinii
FISCNNSGG

SEQ ID NO: 163702 - protein, 9 aa, Borrelia garinii
ISCNNSGGD

SEQ ID NO: 163703 - protein, 9 aa, Borrelia garinii
SCNNSGGDT

SEQ ID NO: 163704 - protein, 9 aa, Borrelia garinii
CNNSGGDTA

SEQ ID NO: 163705 - protein, 9 aa, Borrelia garinii
NNSGGDTAS

SEQ ID NO: 163706 - protein, 9 aa, Borrelia garinii
NSGGDTAST

SEQ ID NO: 163707 - protein, 9 aa, Borrelia garinii
SGGDTASTN

SEQ ID NO: 163708 - protein, 9 aa, Borrelia garinii
GGDTASTNP

SEQ ID NO: 163709 - protein, 9 aa, Borrelia garinii
GDTASTNPD

SEQ ID NO: 163710 - protein, 9 aa, Borrelia garinii
DTASTNPDE

SEQ ID NO: 163711 - protein, 9 aa, Borrelia garinii
TASTNPDES

SEQ ID NO: 163712 - protein, 9 aa, Borrelia garinii
ASTNPDESA

SEQ ID NO: 163713 - protein, 9 aa, Borrelia garinii
STNPDESAK

SEQ ID NO: 163714 - protein, 9 aa, Borrelia garinii
TNPDESAKG

SEQ ID NO: 163715 - protein, 9 aa, Borrelia garinii
NPDESAKGP

SEQ ID NO: 163716 - protein, 9 aa, Borrelia garinii
PDESAKGPN

SEQ ID NO: 163717 - protein, 9 aa, Borrelia garinii
DESAKGPNL

SEQ ID NO: 163718 - protein, 9 aa, Borrelia garinii
ESAKGPNLT

SEQ ID NO: 163719 - protein, 9 aa, Borrelia garinii
SAKGPNLTV

SEQ ID NO: 163720 - protein, 9 aa, Borrelia garinii
AKGPNLTVI

SEQ ID NO: 163721 - protein, 9 aa, Borrelia garinii
KGPNLTVIS

SEQ ID NO: 163722 - protein, 9 aa, Borrelia garinii
GPNLTVISK

SEQ ID NO: 163723 - protein, 9 aa, Borrelia garinii
PNLTVISKK

SEQ ID NO: 163724 - protein, 9 aa, Borrelia garinii
NLTVISKKI

SEQ ID NO: 163725 - protein, 9 aa, Borrelia garinii
LTVISKKIT

SEQ ID NO: 163726 - protein, 9 aa, Borrelia garinii
TVISKKITD

SEQ ID NO: 163727 - protein, 9 aa, Borrelia garinii
VISKKITDS

SEQ ID NO: 163728 - protein, 9 aa, Borrelia garinii
ISKKITDSN

SEQ ID NO: 163729 - protein, 9 aa, Borrelia garinii
SKKITDSNA

SEQ ID NO: 163730 - protein, 9 aa, Borrelia garinii
KKITDSNAF

SEQ ID NO: 163731 - protein, 9 aa, Borrelia garinii
KITDSNAFV

SEQ ID NO: 163732 - protein, 9 aa, Borrelia garinii
ITDSNAFVL

SEQ ID NO: 163733 - protein, 9 aa, Borrelia garinii
TDSNAFVLA

SEQ ID NO: 163734 - protein, 9 aa, Borrelia garinii
DSNAFVLAV

SEQ ID NO: 163735 - protein, 9 aa, Borrelia garinii
SNAFVLAVK

SEQ ID NO: 163736 - protein, 9 aa, Borrelia garinii
NAFVLAVKE

SEQ ID NO: 163737 - protein, 9 aa, Borrelia garinii
AFVLAVKEV

SEQ ID NO: 163738 - protein, 9 aa, Borrelia garinii
FVLAVKEVE

SEQ ID NO: 163739 - protein, 9 aa, Borrelia garinii
VLAVKEVEA

SEQ ID NO: 163740 - protein, 9 aa, Borrelia garinii
LAVKEVEAL

SEQ ID NO: 163741 - protein, 9 aa, Borrelia garinii
AVKEVEALI

SEQ ID NO: 163742 - protein, 9 aa, Borrelia garinii
VKEVEALIS

SEQ ID NO: 163743 - protein, 9 aa, Borrelia garinii
KEVEALISS

SEQ ID NO: 163744 - protein, 9 aa, Borrelia garinii
EVEALISSI

SEQ ID NO: 163745 - protein, 9 aa, Borrelia garinii
VEALISSID

SEQ ID NO: 163746 - protein, 9 aa, Borrelia garinii
EALISSIDE

SEQ ID NO: 163747 - protein, 9 aa, Borrelia garinii
ALISSIDEL

SEQ ID NO: 163748 - protein, 9 aa, Borrelia garinii
LISSIDELA

SEQ ID NO: 163749 - protein, 9 aa, Borrelia garinii
ISSIDELAN

SEQ ID NO: 163750 - protein, 9 aa, Borrelia garinii
SSIDELANK

SEQ ID NO: 163751 - protein, 9 aa, Borrelia garinii
SIDELANKA

SEQ ID NO: 163752 - protein, 9 aa, Borrelia garinii
IDELANKAI

SEQ ID NO: 163753 - protein, 9 aa, Borrelia garinii
DELANKAIG

SEQ ID NO: 163754 - protein, 9 aa, Borrelia garinii
ELANKAIGK

SEQ ID NO: 163755 - protein, 9 aa, Borrelia garinii
LANKAIGKV

SEQ ID NO: 163756 - protein, 9 aa, Borrelia garinii
ANKAIGKVI

SEQ ID NO: 163757 - protein, 9 aa, Borrelia garinii
NKAIGKVIH

SEQ ID NO: 163758 - protein, 9 aa, Borrelia garinii
KAIGKVIHQ

SEQ ID NO: 163759 - protein, 9 aa, Borrelia garinii
AIGKVIHQN

SEQ ID NO: 163760 - protein, 9 aa, Borrelia garinii
IGKVIHQNN

SEQ ID NO: 163761 - protein, 9 aa, Borrelia garinii
GKVIHQNNG

SEQ ID NO: 163762 - protein, 9 aa, Borrelia garinii
KVIHQNNGL

SEQ ID NO: 163763 - protein, 9 aa, Borrelia garinii
VIHQNNGLN

SEQ ID NO: 163764 - protein, 9 aa, Borrelia garinii
IHQNNGLNA

SEQ ID NO: 163765 - protein, 9 aa, Borrelia garinii
HQNNGLNAN

SEQ ID NO: 163766 - protein, 9 aa, Borrelia garinii
QNNGLNANA

SEQ ID NO: 163767 - protein, 9 aa, Borrelia garinii
NNGLNANAG

SEQ ID NO: 163768 - protein, 9 aa, Borrelia garinii
NGLNANAGQ

SEQ ID NO: 163769 - protein, 9 aa, Borrelia garinii
GLNANAGQN

SEQ ID NO: 163770 - protein, 9 aa, Borrelia garinii
LNANAGQNG

SEQ ID NO: 163771 - protein, 9 aa, Borrelia garinii
NANAGQNGS

SEQ ID NO: 163772 - protein, 9 aa, Borrelia garinii
ANAGQNGSL

SEQ ID NO: 163773 - protein, 9 aa, Borrelia garinii
NAGQNGSLL

SEQ ID NO: 163774 - protein, 9 aa, Borrelia garinii
AGQNGSLLA

SEQ ID NO: 163775 - protein, 9 aa, Borrelia garinii
GQNGSLLAG

SEQ ID NO: 163776 - protein, 9 aa, Borrelia garinii
QNGSLLAGA

SEQ ID NO: 163777 - protein, 9 aa, Borrelia garinii
NGSLLAGAY

SEQ ID NO: 163778 - protein, 9 aa, Borrelia garinii
GSLLAGAYA

SEQ ID NO: 163779 - protein, 9 aa, Borrelia garinii
SLLAGAYAI

SEQ ID NO: 163780 - protein, 9 aa, Borrelia garinii
LLAGAYAIS

SEQ ID NO: 163781 - protein, 9 aa, Borrelia garinii
LAGAYAIST

SEQ ID NO: 163782 - protein, 9 aa, Borrelia garinii
AGAYAISTL

SEQ ID NO: 163783 - protein, 9 aa, Borrelia garinii
GAYAISTLI

SEQ ID NO: 163784 - protein, 9 aa, Borrelia garinii
AYAISTLIT

SEQ ID NO: 163785 - protein, 9 aa, Borrelia garinii
YAISTLITE

SEQ ID NO: 163786 - protein, 9 aa, Borrelia garinii
AISTLITEK

SEQ ID NO: 163787 - protein, 9 aa, Borrelia garinii
ISTLITEKL

SEQ ID NO: 163788 - protein, 9 aa, Borrelia garinii
STLITEKLS

SEQ ID NO: 163789 - protein, 9 aa, Borrelia garinii
TLITEKLSK

SEQ ID NO: 163790 - protein, 9 aa, Borrelia garinii
LITEKLSKL

SEQ ID NO: 163791 - protein, 9 aa, Borrelia garinii
ITEKLSKLK

SEQ ID NO: 163792 - protein, 9 aa, Borrelia garinii
TEKLSKLKN

SEQ ID NO: 163793 - protein, 9 aa, Borrelia garinii
EKLSKLKNS

SEQ ID NO: 163794 - protein, 9 aa, Borrelia garinii
KLSKLKNSE

SEQ ID NO: 163795 - protein, 9 aa, Borrelia garinii
LSKLKNSEE

SEQ ID NO: 163796 - protein, 9 aa, Borrelia garinii
SKLKNSEEL

SEQ ID NO: 163797 - protein, 9 aa, Borrelia garinii
KLKNSEELN

SEQ ID NO: 163798 - protein, 9 aa, Borrelia garinii
LKNSEELNK

SEQ ID NO: 163799 - protein, 9 aa, Borrelia garinii
KNSEELNKK

SEQ ID NO: 163800 - protein, 9 aa, Borrelia garinii
NSEELNKKI

SEQ ID NO: 163801 - protein, 9 aa, Borrelia garinii
SEELNKKIE

SEQ ID NO: 163802 - protein, 9 aa, Borrelia garinii
EELNKKIEE

SEQ ID NO: 163803 - protein, 9 aa, Borrelia garinii
ELNKKIEEA

SEQ ID NO: 163804 - protein, 9 aa, Borrelia garinii
LNKKIEEAK

SEQ ID NO: 163805 - protein, 9 aa, Borrelia garinii
NKKIEEAKN

SEQ ID NO: 163806 - protein, 9 aa, Borrelia garinii
KKIEEAKNH

SEQ ID NO: 163807 - protein, 9 aa, Borrelia garinii
KIEEAKNHS

SEQ ID NO: 163808 - protein, 9 aa, Borrelia garinii
IEEAKNHSE

SEQ ID NO: 163809 - protein, 9 aa, Borrelia garinii
EEAKNHSEA

SEQ ID NO: 163810 - protein, 9 aa, Borrelia garinii
EAKNHSEAF

SEQ ID NO: 163811 - protein, 9 aa, Borrelia garinii
AKNHSEAFT

SEQ ID NO: 163812 - protein, 9 aa, Borrelia garinii
KNHSEAFTN

SEQ ID NO: 163813 - protein, 9 aa, Borrelia garinii
NHSEAFTNR

SEQ ID NO: 163814 - protein, 9 aa, Borrelia garinii
HSEAFTNRL

SEQ ID NO: 163815 - protein, 9 aa, Borrelia garinii
SEAFTNRLK

SEQ ID NO: 163816 - protein, 9 aa, Borrelia garinii
EAFTNRLKG

SEQ ID NO: 163817 - protein, 9 aa, Borrelia garinii
AFTNRLKGS

SEQ ID NO: 163818 - protein, 9 aa, Borrelia garinii
FTNRLKGSH

SEQ ID NO: 163819 - protein, 9 aa, Borrelia garinii
TNRLKGSHA

SEQ ID NO: 163820 - protein, 9 aa, Borrelia garinii
NRLKGSHAQ

SEQ ID NO: 163821 - protein, 9 aa, Borrelia garinii
RLKGSHAQL

SEQ ID NO: 163822 - protein, 9 aa, Borrelia garinii
LKGSHAQLG

SEQ ID NO: 163823 - protein, 9 aa, Borrelia garinii
KGSHAQLGV

SEQ ID NO: 163824 - protein, 9 aa, Borrelia garinii
GSHAQLGVA

SEQ ID NO: 163825 - protein, 9 aa, Borrelia garinii
SHAQLGVAA

SEQ ID NO: 163826 - protein, 9 aa, Borrelia garinii
HAQLGVAAA

SEQ ID NO: 163827 - protein, 9 aa, Borrelia garinii
AQLGVAAAT

SEQ ID NO: 163828 - protein, 9 aa, Borrelia garinii
QLGVAAATD

SEQ ID NO: 163829 - protein, 9 aa, Borrelia garinii
LGVAAATDD

SEQ ID NO: 163830 - protein, 9 aa, Borrelia garinii
GVAAATDDH

SEQ ID NO: 163831 - protein, 9 aa, Borrelia garinii
VAAATDDHA

SEQ ID NO: 163832 - protein, 9 aa, Borrelia garinii
AAATDDHAK

SEQ ID NO: 163833 - protein, 9 aa, Borrelia garinii
AATDDHAKE

SEQ ID NO: 163834 - protein, 9 aa, Borrelia garinii
ATDDHAKEA

SEQ ID NO: 163835 - protein, 9 aa, Borrelia garinii
TDDHAKEAI

SEQ ID NO: 163836 - protein, 9 aa, Borrelia garinii
DDHAKEAIL

SEQ ID NO: 163837 - protein, 9 aa, Borrelia garinii
DHAKEAILK

SEQ ID NO: 163838 - protein, 9 aa, Borrelia garinii
HAKEAILKS

SEQ ID NO: 163839 - protein, 9 aa, Borrelia garinii
AKEAILKSN

SEQ ID NO: 163840 - protein, 9 aa, Borrelia garinii
KEAILKSNP

SEQ ID NO: 163841 - protein, 9 aa, Borrelia garinii
EAILKSNPT

SEQ ID NO: 163842 - protein, 9 aa, Borrelia garinii
AILKSNPTK

SEQ ID NO: 163843 - protein, 9 aa, Borrelia garinii
ILKSNPTKD

SEQ ID NO: 163844 - protein, 9 aa, Borrelia garinii
LKSNPTKDK

SEQ ID NO: 163845 - protein, 9 aa, Borrelia garinii
KSNPTKDKG

SEQ ID NO: 163846 - protein, 9 aa, Borrelia garinii
SNPTKDKGA

SEQ ID NO: 163847 - protein, 9 aa, Borrelia garinii
NPTKDKGAK

SEQ ID NO: 163848 - protein, 9 aa, Borrelia garinii
PTKDKGAKE

SEQ ID NO: 163849 - protein, 9 aa, Borrelia garinii
TKDKGAKEL

SEQ ID NO: 163850 - protein, 9 aa, Borrelia garinii
KDKGAKELK

SEQ ID NO: 163851 - protein, 9 aa, Borrelia garinii
DKGAKELKD

SEQ ID NO: 163852 - protein, 9 aa, Borrelia garinii
KGAKELKDL

SEQ ID NO: 163853 - protein, 9 aa, Borrelia garinii
GAKELKDLS

SEQ ID NO: 163854 - protein, 9 aa, Borrelia garinii
AKELKDLSE

SEQ ID NO: 163855 - protein, 9 aa, Borrelia garinii
KELKDLSES

SEQ ID NO: 163856 - protein, 9 aa, Borrelia garinii
ELKDLSESV

SEQ ID NO: 163857 - protein, 9 aa, Borrelia garinii
LKDLSESVE

SEQ ID NO: 163858 - protein, 9 aa, Borrelia garinii
KDLSESVES

SEQ ID NO: 163859 - protein, 9 aa, Borrelia garinii
DLSESVESL

SEQ ID NO: 163860 - protein, 9 aa, Borrelia garinii
LSESVESLA

SEQ ID NO: 163861 - protein, 9 aa, Borrelia garinii
SESVESLAK

SEQ ID NO: 163862 - protein, 9 aa, Borrelia garinii
ESVESLAKA

SEQ ID NO: 163863 - protein, 9 aa, Borrelia garinii
SVESLAKAA

SEQ ID NO: 163864 - protein, 9 aa, Borrelia garinii
VESLAKAAQ

SEQ ID NO: 163865 - protein, 9 aa, Borrelia garinii
ESLAKAAQE

SEQ ID NO: 163866 - protein, 9 aa, Borrelia garinii
SLAKAAQEA

SEQ ID NO: 163867 - protein, 9 aa, Borrelia garinii
LAKAAQEAL

SEQ ID NO: 163868 - protein, 9 aa, Borrelia garinii
AKAAQEALA

SEQ ID NO: 163869 - protein, 9 aa, Borrelia garinii
KAAQEALAN

SEQ ID NO: 163870 - protein, 9 aa, Borrelia garinii
AAQEALANS

SEQ ID NO: 163871 - protein, 9 aa, Borrelia garinii
AQEALANSV

SEQ ID NO: 163872 - protein, 9 aa, Borrelia garinii
QEALANSVK

SEQ ID NO: 163873 - protein, 9 aa, Borrelia garinii
EALANSVKE

SEQ ID NO: 163874 - protein, 9 aa, Borrelia garinii
ALANSVKEL

SEQ ID NO: 163875 - protein, 9 aa, Borrelia garinii
LANSVKELT

SEQ ID NO: 163876 - protein, 9 aa, Borrelia garinii
ANSVKELTN

SEQ ID NO: 163877 - protein, 9 aa, Borrelia garinii
NSVKELTNP

SEQ ID NO: 163878 - protein, 9 aa, Borrelia garinii
SVKELTNPV

SEQ ID NO: 163879 - protein, 9 aa, Borrelia garinii
VKELTNPVV

SEQ ID NO: 163880 - protein, 9 aa, Borrelia garinii
KELTNPVVA

SEQ ID NO: 163881 - protein, 9 aa, Borrelia garinii
ELTNPVVAE

SEQ ID NO: 163882 - protein, 9 aa, Borrelia garinii
LTNPVVAES

SEQ ID NO: 163883 - protein, 9 aa, Borrelia garinii
TNPVVAESP

SEQ ID NO: 163884 - protein, 9 aa, Borrelia garinii
NPVVAESPK

SEQ ID NO: 163885 - protein, 10 aa, Borrelia garinii
ILMTLFLFIS

SEQ ID NO: 163886 - protein, 10 aa, Borrelia garinii
LMTLFLFISC

SEQ ID NO: 163887 - protein, 10 aa, Borrelia garinii
MTLFLFISCN

SEQ ID NO: 163888 - protein, 10 aa, Borrelia garinii
TLFLFISCNN

SEQ ID NO: 163889 - protein, 10 aa, Borrelia garinii
LFLFISCNNS

SEQ ID NO: 163890 - protein, 10 aa, Borrelia garinii
FLFISCNNSG

SEQ ID NO: 163891 - protein, 10 aa, Borrelia garinii
LFISCNNSGG

SEQ ID NO: 163892 - protein, 10 aa, Borrelia garinii
FISCNNSGGD

SEQ ID NO: 163893 - protein, 10 aa, Borrelia garinii
ISCNNSGGDT

SEQ ID NO: 163894 - protein, 10 aa, Borrelia garinii
SCNNSGGDTA

SEQ ID NO: 163895 - protein, 10 aa, Borrelia garinii
CNNSGGDTAS

SEQ ID NO: 163896 - protein, 10 aa, Borrelia garinii
NNSGGDTAST

SEQ ID NO: 163897 - protein, 10 aa, Borrelia garinii
NSGGDTASTN

SEQ ID NO: 163898 - protein, 10 aa, Borrelia garinii
SGGDTASTNP

SEQ ID NO: 163899 - protein, 10 aa, Borrelia garinii
GGDTASTNPD

SEQ ID NO: 163900 - protein, 10 aa, Borrelia garinii
GDTASTNPDE

SEQ ID NO: 163901 - protein, 10 aa, Borrelia garinii
DTASTNPDES

SEQ ID NO: 163902 - protein, 10 aa, Borrelia garinii
TASTNPDESA

SEQ ID NO: 163903 - protein, 10 aa, Borrelia garinii
ASTNPDESAK

SEQ ID NO: 163904 - protein, 10 aa, Borrelia garinii
STNPDESAKG

SEQ ID NO: 163905 - protein, 10 aa, Borrelia garinii
TNPDESAKGP

SEQ ID NO: 163906 - protein, 10 aa, Borrelia garinii
NPDESAKGPN

SEQ ID NO: 163907 - protein, 10 aa, Borrelia garinii
PDESAKGPNL

SEQ ID NO: 163908 - protein, 10 aa, Borrelia garinii
DESAKGPNLT

SEQ ID NO: 163909 - protein, 10 aa, Borrelia garinii
ESAKGPNLTV

SEQ ID NO: 163910 - protein, 10 aa, Borrelia garinii
SAKGPNLTVI

SEQ ID NO: 163911 - protein, 10 aa, Borrelia garinii
AKGPNLTVIS

SEQ ID NO: 163912 - protein, 10 aa, Borrelia garinii
KGPNLTVISK

SEQ ID NO: 163913 - protein, 10 aa, Borrelia garinii
GPNLTVISKK

SEQ ID NO: 163914 - protein, 10 aa, Borrelia garinii
PNLTVISKKI

SEQ ID NO: 163915 - protein, 10 aa, Borrelia garinii
NLTVISKKIT

SEQ ID NO: 163916 - protein, 10 aa, Borrelia garinii
LTVISKKITD

SEQ ID NO: 163917 - protein, 10 aa, Borrelia garinii
TVISKKITDS

SEQ ID NO: 163918 - protein, 10 aa, Borrelia garinii
VISKKITDSN

SEQ ID NO: 163919 - protein, 10 aa, Borrelia garinii
ISKKITDSNA

SEQ ID NO: 163920 - protein, 10 aa, Borrelia garinii
SKKITDSNAF

SEQ ID NO: 163921 - protein, 10 aa, Borrelia garinii
KKITDSNAFV

SEQ ID NO: 163922 - protein, 10 aa, Borrelia garinii
KITDSNAFVL

SEQ ID NO: 163923 - protein, 10 aa, Borrelia garinii
ITDSNAFVLA

SEQ ID NO: 163924 - protein, 10 aa, Borrelia garinii
TDSNAFVLAV

SEQ ID NO: 163925 - protein, 10 aa, Borrelia garinii
DSNAFVLAVK

SEQ ID NO: 163926 - protein, 10 aa, Borrelia garinii
SNAFVLAVKE

SEQ ID NO: 163927 - protein, 10 aa, Borrelia garinii
NAFVLAVKEV

SEQ ID NO: 163928 - protein, 10 aa, Borrelia garinii
AFVLAVKEVE

SEQ ID NO: 163929 - protein, 10 aa, Borrelia garinii
FVLAVKEVEA

SEQ ID NO: 163930 - protein, 10 aa, Borrelia garinii
VLAVKEVEAL

SEQ ID NO: 163931 - protein, 10 aa, Borrelia garinii
LAVKEVEALI

SEQ ID NO: 163932 - protein, 10 aa, Borrelia garinii
AVKEVEALIS

SEQ ID NO: 163933 - protein, 10 aa, Borrelia garinii
VKEVEALISS

SEQ ID NO: 163934 - protein, 10 aa, Borrelia garinii
KEVEALISSI

SEQ ID NO: 163935 - protein, 10 aa, Borrelia garinii
EVEALISSID

SEQ ID NO: 163936 - protein, 10 aa, Borrelia garinii
VEALISSIDE

SEQ ID NO: 163937 - protein, 10 aa, Borrelia garinii
EALISSIDEL

SEQ ID NO: 163938 - protein, 10 aa, Borrelia garinii
ALISSIDELA

SEQ ID NO: 163939 - protein, 10 aa, Borrelia garinii
LISSIDELAN

SEQ ID NO: 163940 - protein, 10 aa, Borrelia garinii
ISSIDELANK

SEQ ID NO: 163941 - protein, 10 aa, Borrelia garinii
SSIDELANKA

SEQ ID NO: 163942 - protein, 10 aa, Borrelia garinii
SIDELANKAI

SEQ ID NO: 163943 - protein, 10 aa, Borrelia garinii
IDELANKAIG

SEQ ID NO: 163944 - protein, 10 aa, Borrelia garinii
DELANKAIGK

SEQ ID NO: 163945 - protein, 10 aa, Borrelia garinii
ELANKAIGKV

SEQ ID NO: 163946 - protein, 10 aa, Borrelia garinii
LANKAIGKVI

SEQ ID NO: 163947 - protein, 10 aa, Borrelia garinii
ANKAIGKVIH

SEQ ID NO: 163948 - protein, 10 aa, Borrelia garinii
NKAIGKVIHQ

SEQ ID NO: 163949 - protein, 10 aa, Borrelia garinii
KAIGKVIHQN

SEQ ID NO: 163950 - protein, 10 aa, Borrelia garinii
AIGKVIHQNN

SEQ ID NO: 163951 - protein, 10 aa, Borrelia garinii
IGKVIHQNNG

SEQ ID NO: 163952 - protein, 10 aa, Borrelia garinii
GKVIHQNNGL

SEQ ID NO: 163953 - protein, 10 aa, Borrelia garinii
KVIHQNNGLN

SEQ ID NO: 163954 - protein, 10 aa, Borrelia garinii
VIHQNNGLNA

SEQ ID NO: 163955 - protein, 10 aa, Borrelia garinii
IHQNNGLNAN

SEQ ID NO: 163956 - protein, 10 aa, Borrelia garinii
HQNNGLNANA

SEQ ID NO: 163957 - protein, 10 aa, Borrelia garinii
QNNGLNANAG

SEQ ID NO: 163958 - protein, 10 aa, Borrelia garinii
NNGLNANAGQ

SEQ ID NO: 163959 - protein, 10 aa, Borrelia garinii
NGLNANAGQN

SEQ ID NO: 163960 - protein, 10 aa, Borrelia garinii
GLNANAGQNG

SEQ ID NO: 163961 - protein, 10 aa, Borrelia garinii
LNANAGQNGS

SEQ ID NO: 163962 - protein, 10 aa, Borrelia garinii
NANAGQNGSL

SEQ ID NO: 163963 - protein, 10 aa, Borrelia garinii
ANAGQNGSLL

SEQ ID NO: 163964 - protein, 10 aa, Borrelia garinii
NAGQNGSLLA

SEQ ID NO: 163965 - protein, 10 aa, Borrelia garinii
AGQNGSLLAG

SEQ ID NO: 163966 - protein, 10 aa, Borrelia garinii
GQNGSLLAGA

SEQ ID NO: 163967 - protein, 10 aa, Borrelia garinii
QNGSLLAGAY

SEQ ID NO: 163968 - protein, 10 aa, Borrelia garinii
NGSLLAGAYA

SEQ ID NO: 163969 - protein, 10 aa, Borrelia garinii
GSLLAGAYAI

SEQ ID NO: 163970 - protein, 10 aa, Borrelia garinii
SLLAGAYAIS

SEQ ID NO: 163971 - protein, 10 aa, Borrelia garinii
LLAGAYAIST

SEQ ID NO: 163972 - protein, 10 aa, Borrelia garinii
LAGAYAISTL

SEQ ID NO: 163973 - protein, 10 aa, Borrelia garinii
AGAYAISTLI

SEQ ID NO: 163974 - protein, 10 aa, Borrelia garinii
GAYAISTLIT

SEQ ID NO: 163975 - protein, 10 aa, Borrelia garinii
AYAISTLITE

SEQ ID NO: 163976 - protein, 10 aa, Borrelia garinii
YAISTLITEK

SEQ ID NO: 163977 - protein, 10 aa, Borrelia garinii
AISTLITEKL

SEQ ID NO: 163978 - protein, 10 aa, Borrelia garinii
ISTLITEKLS

SEQ ID NO: 163979 - protein, 10 aa, Borrelia garinii
STLITEKLSK

SEQ ID NO: 163980 - protein, 10 aa, Borrelia garinii
TLITEKLSKL

SEQ ID NO: 163981 - protein, 10 aa, Borrelia garinii
LITEKLSKLK

SEQ ID NO: 163982 - protein, 10 aa, Borrelia garinii
ITEKLSKLKN

SEQ ID NO: 163983 - protein, 10 aa, Borrelia garinii
TEKLSKLKNS

SEQ ID NO: 163984 - protein, 10 aa, Borrelia garinii
EKLSKLKNSE

SEQ ID NO: 163985 - protein, 10 aa, Borrelia garinii
KLSKLKNSEE

SEQ ID NO: 163986 - protein, 10 aa, Borrelia garinii
LSKLKNSEEL

SEQ ID NO: 163987 - protein, 10 aa, Borrelia garinii
SKLKNSEELN

SEQ ID NO: 163988 - protein, 10 aa, Borrelia garinii
KLKNSEELNK

SEQ ID NO: 163989 - protein, 10 aa, Borrelia garinii
LKNSEELNKK

SEQ ID NO: 163990 - protein, 10 aa, Borrelia garinii
KNSEELNKKI

SEQ ID NO: 163991 - protein, 10 aa, Borrelia garinii
NSEELNKKIE

SEQ ID NO: 163992 - protein, 10 aa, Borrelia garinii
SEELNKKIEE

SEQ ID NO: 163993 - protein, 10 aa, Borrelia garinii
EELNKKIEEA

SEQ ID NO: 163994 - protein, 10 aa, Borrelia garinii
ELNKKIEEAK

SEQ ID NO: 163995 - protein, 10 aa, Borrelia garinii
LNKKIEEAKN

SEQ ID NO: 163996 - protein, 10 aa, Borrelia garinii
NKKIEEAKNH

SEQ ID NO: 163997 - protein, 10 aa, Borrelia garinii
KKIEEAKNHS

SEQ ID NO: 163998 - protein, 10 aa, Borrelia garinii
KIEEAKNHSE

SEQ ID NO: 163999 - protein, 10 aa, Borrelia garinii
IEEAKNHSEA

SEQ ID NO: 164000 - protein, 10 aa, Borrelia garinii
EEAKNHSEAF

SEQ ID NO: 164001 - protein, 10 aa, Borrelia garinii
EAKNHSEAFT

SEQ ID NO: 164002 - protein, 10 aa, Borrelia garinii
AKNHSEAFTN

SEQ ID NO: 164003 - protein, 10 aa, Borrelia garinii
KNHSEAFTNR

SEQ ID NO: 164004 - protein, 10 aa, Borrelia garinii
NHSEAFTNRL

SEQ ID NO: 164005 - protein, 10 aa, Borrelia garinii
HSEAFTNRLK

SEQ ID NO: 164006 - protein, 10 aa, Borrelia garinii
SEAFTNRLKG

SEQ ID NO: 164007 - protein, 10 aa, Borrelia garinii
EAFTNRLKGS

SEQ ID NO: 164008 - protein, 10 aa, Borrelia garinii
AFTNRLKGSH

SEQ ID NO: 164009 - protein, 10 aa, Borrelia garinii
FTNRLKGSHA

SEQ ID NO: 164010 - protein, 10 aa, Borrelia garinii
TNRLKGSHAQ

SEQ ID NO: 164011 - protein, 10 aa, Borrelia garinii
NRLKGSHAQL

SEQ ID NO: 164012 - protein, 10 aa, Borrelia garinii
RLKGSHAQLG

SEQ ID NO: 164013 - protein, 10 aa, Borrelia garinii
LKGSHAQLGV

SEQ ID NO: 164014 - protein, 10 aa, Borrelia garinii
KGSHAQLGVA

SEQ ID NO: 164015 - protein, 10 aa, Borrelia garinii
GSHAQLGVAA

SEQ ID NO: 164016 - protein, 10 aa, Borrelia garinii
SHAQLGVAAA

SEQ ID NO: 164017 - protein, 10 aa, Borrelia garinii
HAQLGVAAAT

SEQ ID NO: 164018 - protein, 10 aa, Borrelia garinii
AQLGVAAATD

SEQ ID NO: 164019 - protein, 10 aa, Borrelia garinii
QLGVAAATDD

SEQ ID NO: 164020 - protein, 10 aa, Borrelia garinii
LGVAAATDDH

SEQ ID NO: 164021 - protein, 10 aa, Borrelia garinii
GVAAATDDHA

SEQ ID NO: 164022 - protein, 10 aa, Borrelia garinii
VAAATDDHAK

SEQ ID NO: 164023 - protein, 10 aa, Borrelia garinii
AAATDDHAKE

SEQ ID NO: 164024 - protein, 10 aa, Borrelia garinii
AATDDHAKEA

SEQ ID NO: 164025 - protein, 10 aa, Borrelia garinii
ATDDHAKEAI

SEQ ID NO: 164026 - protein, 10 aa, Borrelia garinii
TDDHAKEAIL

SEQ ID NO: 164027 - protein, 10 aa, Borrelia garinii
DDHAKEAILK

SEQ ID NO: 164028 - protein, 10 aa, Borrelia garinii
DHAKEAILKS

SEQ ID NO: 164029 - protein, 10 aa, Borrelia garinii
HAKEAILKSN

SEQ ID NO: 164030 - protein, 10 aa, Borrelia garinii
AKEAILKSNP

SEQ ID NO: 164031 - protein, 10 aa, Borrelia garinii
KEAILKSNPT

SEQ ID NO: 164032 - protein, 10 aa, Borrelia garinii
EAILKSNPTK

SEQ ID NO: 164033 - protein, 10 aa, Borrelia garinii
AILKSNPTKD

SEQ ID NO: 164034 - protein, 10 aa, Borrelia garinii
ILKSNPTKDK

SEQ ID NO: 164035 - protein, 10 aa, Borrelia garinii
LKSNPTKDKG

SEQ ID NO: 164036 - protein, 10 aa, Borrelia garinii
KSNPTKDKGA

SEQ ID NO: 164037 - protein, 10 aa, Borrelia garinii
SNPTKDKGAK

SEQ ID NO: 164038 - protein, 10 aa, Borrelia garinii
NPTKDKGAKE

SEQ ID NO: 164039 - protein, 10 aa, Borrelia garinii
PTKDKGAKEL

SEQ ID NO: 164040 - protein, 10 aa, Borrelia garinii
TKDKGAKELK

SEQ ID NO: 164041 - protein, 10 aa, Borrelia garinii
KDKGAKELKD

SEQ ID NO: 164042 - protein, 10 aa, Borrelia garinii
DKGAKELKDL

SEQ ID NO: 164043 - protein, 10 aa, Borrelia garinii
KGAKELKDLS

SEQ ID NO: 164044 - protein, 10 aa, Borrelia garinii
GAKELKDLSE

SEQ ID NO: 164045 - protein, 10 aa, Borrelia garinii
AKELKDLSES

SEQ ID NO: 164046 - protein, 10 aa, Borrelia garinii
KELKDLSESV

SEQ ID NO: 164047 - protein, 10 aa, Borrelia garinii
ELKDLSESVE

SEQ ID NO: 164048 - protein, 10 aa, Borrelia garinii
LKDLSESVES

SEQ ID NO: 164049 - protein, 10 aa, Borrelia garinii
KDLSESVESL

SEQ ID NO: 164050 - protein, 10 aa, Borrelia garinii
DLSESVESLA

SEQ ID NO: 164051 - protein, 10 aa, Borrelia garinii
LSESVESLAK

SEQ ID NO: 164052 - protein, 10 aa, Borrelia garinii
SESVESLAKA

SEQ ID NO: 164053 - protein, 10 aa, Borrelia garinii
ESVESLAKAA

SEQ ID NO: 164054 - protein, 10 aa, Borrelia garinii
SVESLAKAAQ

SEQ ID NO: 164055 - protein, 10 aa, Borrelia garinii
VESLAKAAQE

SEQ ID NO: 164056 - protein, 10 aa, Borrelia garinii
ESLAKAAQEA

SEQ ID NO: 164057 - protein, 10 aa, Borrelia garinii
SLAKAAQEAL

SEQ ID NO: 164058 - protein, 10 aa, Borrelia garinii
LAKAAQEALA

SEQ ID NO: 164059 - protein, 10 aa, Borrelia garinii
AKAAQEALAN

SEQ ID NO: 164060 - protein, 10 aa, Borrelia garinii
KAAQEALANS

SEQ ID NO: 164061 - protein, 10 aa, Borrelia garinii
AAQEALANSV

SEQ ID NO: 164062 - protein, 10 aa, Borrelia garinii
AQEALANSVK

SEQ ID NO: 164063 - protein, 10 aa, Borrelia garinii
QEALANSVKE

SEQ ID NO: 164064 - protein, 10 aa, Borrelia garinii
EALANSVKEL

SEQ ID NO: 164065 - protein, 10 aa, Borrelia garinii
ALANSVKELT

SEQ ID NO: 164066 - protein, 10 aa, Borrelia garinii
LANSVKELTN

SEQ ID NO: 164067 - protein, 10 aa, Borrelia garinii
ANSVKELTNP

SEQ ID NO: 164068 - protein, 10 aa, Borrelia garinii
NSVKELTNPV

SEQ ID NO: 164069 - protein, 10 aa, Borrelia garinii
SVKELTNPVV

SEQ ID NO: 164070 - protein, 10 aa, Borrelia garinii
VKELTNPVVA

SEQ ID NO: 164071 - protein, 10 aa, Borrelia garinii
KELTNPVVAE

SEQ ID NO: 164072 - protein, 10 aa, Borrelia garinii
ELTNPVVAES

SEQ ID NO: 164073 - protein, 10 aa, Borrelia garinii
LTNPVVAESP

SEQ ID NO: 164074 - protein, 10 aa, Borrelia garinii
TNPVVAESPK

SEQ ID NO: 164075 - protein, 11 aa, Borrelia garinii
ILMTLFLFISC

SEQ ID NO: 164076 - protein, 11 aa, Borrelia garinii
LMTLFLFISCN

SEQ ID NO: 164077 - protein, 11 aa, Borrelia garinii
MTLFLFISCNN

SEQ ID NO: 164078 - protein, 11 aa, Borrelia garinii
TLFLFISCNNS

SEQ ID NO: 164079 - protein, 11 aa, Borrelia garinii
LFLFISCNNSG

SEQ ID NO: 164080 - protein, 11 aa, Borrelia garinii
FLFISCNNSGG

SEQ ID NO: 164081 - protein, 11 aa, Borrelia garinii
LFISCNNSGGD

SEQ ID NO: 164082 - protein, 11 aa, Borrelia garinii
FISCNNSGGDT

SEQ ID NO: 164083 - protein, 11 aa, Borrelia garinii
ISCNNSGGDTA

SEQ ID NO: 164084 - protein, 11 aa, Borrelia garinii
SCNNSGGDTAS

SEQ ID NO: 164085 - protein, 11 aa, Borrelia garinii
CNNSGGDTAST

SEQ ID NO: 164086 - protein, 11 aa, Borrelia garinii
NNSGGDTASTN

SEQ ID NO: 164087 - protein, 11 aa, Borrelia garinii
NSGGDTASTNP

SEQ ID NO: 164088 - protein, 11 aa, Borrelia garinii
SGGDTASTNPD

SEQ ID NO: 164089 - protein, 11 aa, Borrelia garinii
GGDTASTNPDE

SEQ ID NO: 164090 - protein, 11 aa, Borrelia garinii
GDTASTNPDES

SEQ ID NO: 164091 - protein, 11 aa, Borrelia garinii
DTASTNPDESA

SEQ ID NO: 164092 - protein, 11 aa, Borrelia garinii
TASTNPDESAK

SEQ ID NO: 164093 - protein, 11 aa, Borrelia garinii
ASTNPDESAKG

SEQ ID NO: 164094 - protein, 11 aa, Borrelia garinii
STNPDESAKGP

SEQ ID NO: 164095 - protein, 11 aa, Borrelia garinii
TNPDESAKGPN

SEQ ID NO: 164096 - protein, 11 aa, Borrelia garinii
NPDESAKGPNL

SEQ ID NO: 164097 - protein, 11 aa, Borrelia garinii
PDESAKGPNLT

SEQ ID NO: 164098 - protein, 11 aa, Borrelia garinii
DESAKGPNLTV

SEQ ID NO: 164099 - protein, 11 aa, Borrelia garinii
ESAKGPNLTVI

SEQ ID NO: 164100 - protein, 11 aa, Borrelia garinii
SAKGPNLTVIS

SEQ ID NO: 164101 - protein, 11 aa, Borrelia garinii
AKGPNLTVISK

SEQ ID NO: 164102 - protein, 11 aa, Borrelia garinii
KGPNLTVISKK

SEQ ID NO: 164103 - protein, 11 aa, Borrelia garinii
GPNLTVISKKI

SEQ ID NO: 164104 - protein, 11 aa, Borrelia garinii
PNLTVISKKIT

SEQ ID NO: 164105 - protein, 11 aa, Borrelia garinii
NLTVISKKITD

SEQ ID NO: 164106 - protein, 11 aa, Borrelia garinii
LTVISKKITDS

SEQ ID NO: 164107 - protein, 11 aa, Borrelia garinii
TVISKKITDSN

SEQ ID NO: 164108 - protein, 11 aa, Borrelia garinii
VISKKITDSNA

SEQ ID NO: 164109 - protein, 11 aa, Borrelia garinii
ISKKITDSNAF

SEQ ID NO: 164110 - protein, 11 aa, Borrelia garinii
SKKITDSNAFV

SEQ ID NO: 164111 - protein, 11 aa, Borrelia garinii
KKITDSNAFVL

SEQ ID NO: 164112 - protein, 11 aa, Borrelia garinii
KITDSNAFVLA

SEQ ID NO: 164113 - protein, 11 aa, Borrelia garinii
ITDSNAFVLAV

SEQ ID NO: 164114 - protein, 11 aa, Borrelia garinii
TDSNAFVLAVK

SEQ ID NO: 164115 - protein, 11 aa, Borrelia garinii
DSNAFVLAVKE

SEQ ID NO: 164116 - protein, 11 aa, Borrelia garinii
SNAFVLAVKEV

SEQ ID NO: 164117 - protein, 11 aa, Borrelia garinii
NAFVLAVKEVE

SEQ ID NO: 164118 - protein, 11 aa, Borrelia garinii
AFVLAVKEVEA

SEQ ID NO: 164119 - protein, 11 aa, Borrelia garinii
FVLAVKEVEAL

SEQ ID NO: 164120 - protein, 11 aa, Borrelia garinii
VLAVKEVEALI

SEQ ID NO: 164121 - protein, 11 aa, Borrelia garinii
LAVKEVEALIS

SEQ ID NO: 164122 - protein, 11 aa, Borrelia garinii
AVKEVEALISS

SEQ ID NO: 164123 - protein, 11 aa, Borrelia garinii
VKEVEALISSI

SEQ ID NO: 164124 - protein, 11 aa, Borrelia garinii
KEVEALISSID

SEQ ID NO: 164125 - protein, 11 aa, Borrelia garinii
EVEALISSIDE

SEQ ID NO: 164126 - protein, 11 aa, Borrelia garinii
VEALISSIDEL

SEQ ID NO: 164127 - protein, 11 aa, Borrelia garinii
EALISSIDELA

SEQ ID NO: 164128 - protein, 11 aa, Borrelia garinii
ALISSIDELAN

SEQ ID NO: 164129 - protein, 11 aa, Borrelia garinii
LISSIDELANK

SEQ ID NO: 164130 - protein, 11 aa, Borrelia garinii
ISSIDELANKA

SEQ ID NO: 164131 - protein, 11 aa, Borrelia garinii
SSIDELANKAI

SEQ ID NO: 164132 - protein, 11 aa, Borrelia garinii
SIDELANKAIG

SEQ ID NO: 164133 - protein, 11 aa, Borrelia garinii
IDELANKAIGK

SEQ ID NO: 164134 - protein, 11 aa, Borrelia garinii
DELANKAIGKV

SEQ ID NO: 164135 - protein, 11 aa, Borrelia garinii
ELANKAIGKVI

SEQ ID NO: 164136 - protein, 11 aa, Borrelia garinii
LANKAIGKVIH

SEQ ID NO: 164137 - protein, 11 aa, Borrelia garinii
ANKAIGKVIHQ

SEQ ID NO: 164138 - protein, 11 aa, Borrelia garinii
NKAIGKVIHQN

SEQ ID NO: 164139 - protein, 11 aa, Borrelia garinii
KAIGKVIHQNN

SEQ ID NO: 164140 - protein, 11 aa, Borrelia garinii
AIGKVIHQNNG

SEQ ID NO: 164141 - protein, 11 aa, Borrelia garinii
IGKVIHQNNGL

SEQ ID NO: 164142 - protein, 11 aa, Borrelia garinii
GKVIHQNNGLN

SEQ ID NO: 164143 - protein, 11 aa, Borrelia garinii
KVIHQNNGLNA

SEQ ID NO: 164144 - protein, 11 aa, Borrelia garinii
VIHQNNGLNAN

SEQ ID NO: 164145 - protein, 11 aa, Borrelia garinii
IHQNNGLNANA

SEQ ID NO: 164146 - protein, 11 aa, Borrelia garinii
HQNNGLNANAG

SEQ ID NO: 164147 - protein, 11 aa, Borrelia garinii
QNNGLNANAGQ

SEQ ID NO: 164148 - protein, 11 aa, Borrelia garinii
NNGLNANAGQN

SEQ ID NO: 164149 - protein, 11 aa, Borrelia garinii
NGLNANAGQNG

SEQ ID NO: 164150 - protein, 11 aa, Borrelia garinii
GLNANAGQNGS

SEQ ID NO: 164151 - protein, 11 aa, Borrelia garinii
LNANAGQNGSL

SEQ ID NO: 164152 - protein, 11 aa, Borrelia garinii
NANAGQNGSLL

SEQ ID NO: 164153 - protein, 11 aa, Borrelia garinii
ANAGQNGSLLA

SEQ ID NO: 164154 - protein, 11 aa, Borrelia garinii
NAGQNGSLLAG

SEQ ID NO: 164155 - protein, 11 aa, Borrelia garinii
AGQNGSLLAGA

SEQ ID NO: 164156 - protein, 11 aa, Borrelia garinii
GQNGSLLAGAY

SEQ ID NO: 164157 - protein, 11 aa, Borrelia garinii
QNGSLLAGAYA

SEQ ID NO: 164158 - protein, 11 aa, Borrelia garinii
NGSLLAGAYAI

SEQ ID NO: 164159 - protein, 11 aa, Borrelia garinii
GSLLAGAYAIS

SEQ ID NO: 164160 - protein, 11 aa, Borrelia garinii
SLLAGAYAIST

SEQ ID NO: 164161 - protein, 11 aa, Borrelia garinii
LLAGAYAISTL

SEQ ID NO: 164162 - protein, 11 aa, Borrelia garinii
LAGAYAISTLI

SEQ ID NO: 164163 - protein, 11 aa, Borrelia garinii
AGAYAISTLIT

SEQ ID NO: 164164 - protein, 11 aa, Borrelia garinii
GAYAISTLITE

SEQ ID NO: 164165 - protein, 11 aa, Borrelia garinii
AYAISTLITEK

SEQ ID NO: 164166 - protein, 11 aa, Borrelia garinii
YAISTLITEKL

SEQ ID NO: 164167 - protein, 11 aa, Borrelia garinii
AISTLITEKLS

SEQ ID NO: 164168 - protein, 11 aa, Borrelia garinii
ISTLITEKLSK

SEQ ID NO: 164169 - protein, 11 aa, Borrelia garinii
STLITEKLSKL

SEQ ID NO: 164170 - protein, 11 aa, Borrelia garinii
TLITEKLSKLK

SEQ ID NO: 164171 - protein, 11 aa, Borrelia garinii
LITEKLSKLKN

SEQ ID NO: 164172 - protein, 11 aa, Borrelia garinii
ITEKLSKLKNS

SEQ ID NO: 164173 - protein, 11 aa, Borrelia garinii
TEKLSKLKNSE

SEQ ID NO: 164174 - protein, 11 aa, Borrelia garinii
EKLSKLKNSEE

SEQ ID NO: 164175 - protein, 11 aa, Borrelia garinii
KLSKLKNSEEL

SEQ ID NO: 164176 - protein, 11 aa, Borrelia garinii
LSKLKNSEELN

SEQ ID NO: 164177 - protein, 11 aa, Borrelia garinii
SKLKNSEELNK

SEQ ID NO: 164178 - protein, 11 aa, Borrelia garinii
KLKNSEELNKK

SEQ ID NO: 164179 - protein, 11 aa, Borrelia garinii
LKNSEELNKKI

SEQ ID NO: 164180 - protein, 11 aa, Borrelia garinii
KNSEELNKKIE

SEQ ID NO: 164181 - protein, 11 aa, Borrelia garinii
NSEELNKKIEE

SEQ ID NO: 164182 - protein, 11 aa, Borrelia garinii
SEELNKKIEEA

SEQ ID NO: 164183 - protein, 11 aa, Borrelia garinii
EELNKKIEEAK

SEQ ID NO: 164184 - protein, 11 aa, Borrelia garinii
ELNKKIEEAKN

SEQ ID NO: 164185 - protein, 11 aa, Borrelia garinii
LNKKIEEAKNH

SEQ ID NO: 164186 - protein, 11 aa, Borrelia garinii
NKKIEEAKNHS

SEQ ID NO: 164187 - protein, 11 aa, Borrelia garinii
KKIEEAKNHSE

SEQ ID NO: 164188 - protein, 11 aa, Borrelia garinii
KIEEAKNHSEA

SEQ ID NO: 164189 - protein, 11 aa, Borrelia garinii
IEEAKNHSEAF

SEQ ID NO: 164190 - protein, 11 aa, Borrelia garinii
EEAKNHSEAFT

SEQ ID NO: 164191 - protein, 11 aa, Borrelia garinii
EAKNHSEAFTN

SEQ ID NO: 164192 - protein, 11 aa, Borrelia garinii
AKNHSEAFTNR

SEQ ID NO: 164193 - protein, 11 aa, Borrelia garinii
KNHSEAFTNRL

SEQ ID NO: 164194 - protein, 11 aa, Borrelia garinii
NHSEAFTNRLK

SEQ ID NO: 164195 - protein, 11 aa, Borrelia garinii
HSEAFTNRLKG

SEQ ID NO: 164196 - protein, 11 aa, Borrelia garinii
SEAFTNRLKGS

SEQ ID NO: 164197 - protein, 11 aa, Borrelia garinii
EAFTNRLKGSH

SEQ ID NO: 164198 - protein, 11 aa, Borrelia garinii
AFTNRLKGSHA

SEQ ID NO: 164199 - protein, 11 aa, Borrelia garinii
FTNRLKGSHAQ

SEQ ID NO: 164200 - protein, 11 aa, Borrelia garinii
TNRLKGSHAQL

SEQ ID NO: 164201 - protein, 11 aa, Borrelia garinii
NRLKGSHAQLG

SEQ ID NO: 164202 - protein, 11 aa, Borrelia garinii
RLKGSHAQLGV

SEQ ID NO: 164203 - protein, 11 aa, Borrelia garinii
LKGSHAQLGVA

SEQ ID NO: 164204 - protein, 11 aa, Borrelia garinii
KGSHAQLGVAA

SEQ ID NO: 164205 - protein, 11 aa, Borrelia garinii
GSHAQLGVAAA

SEQ ID NO: 164206 - protein, 11 aa, Borrelia garinii
SHAQLGVAAAT

SEQ ID NO: 164207 - protein, 11 aa, Borrelia garinii
HAQLGVAAATD

SEQ ID NO: 164208 - protein, 11 aa, Borrelia garinii
AQLGVAAATDD

SEQ ID NO: 164209 - protein, 11 aa, Borrelia garinii
QLGVAAATDDH

SEQ ID NO: 164210 - protein, 11 aa, Borrelia garinii
LGVAAATDDHA

SEQ ID NO: 164211 - protein, 11 aa, Borrelia garinii
GVAAATDDHAK

SEQ ID NO: 164212 - protein, 11 aa, Borrelia garinii
VAAATDDHAKE

SEQ ID NO: 164213 - protein, 11 aa, Borrelia garinii
AAATDDHAKEA

SEQ ID NO: 164214 - protein, 11 aa, Borrelia garinii
AATDDHAKEAI

SEQ ID NO: 164215 - protein, 11 aa, Borrelia garinii
ATDDHAKEAIL

SEQ ID NO: 164216 - protein, 11 aa, Borrelia garinii
TDDHAKEAILK

SEQ ID NO: 164217 - protein, 11 aa, Borrelia garinii
DDHAKEAILKS

SEQ ID NO: 164218 - protein, 11 aa, Borrelia garinii
DHAKEAILKSN

SEQ ID NO: 164219 - protein, 11 aa, Borrelia garinii
HAKEAILKSNP

SEQ ID NO: 164220 - protein, 11 aa, Borrelia garinii
AKEAILKSNPT

SEQ ID NO: 164221 - protein, 11 aa, Borrelia garinii
KEAILKSNPTK

SEQ ID NO: 164222 - protein, 11 aa, Borrelia garinii
EAILKSNPTKD

SEQ ID NO: 164223 - protein, 11 aa, Borrelia garinii
AILKSNPTKDK

SEQ ID NO: 164224 - protein, 11 aa, Borrelia garinii
ILKSNPTKDKG

SEQ ID NO: 164225 - protein, 11 aa, Borrelia garinii
LKSNPTKDKGA

SEQ ID NO: 164226 - protein, 11 aa, Borrelia garinii
KSNPTKDKGAK

SEQ ID NO: 164227 - protein, 11 aa, Borrelia garinii
SNPTKDKGAKE

SEQ ID NO: 164228 - protein, 11 aa, Borrelia garinii
NPTKDKGAKEL

SEQ ID NO: 164229 - protein, 11 aa, Borrelia garinii
PTKDKGAKELK

SEQ ID NO: 164230 - protein, 11 aa, Borrelia garinii
TKDKGAKELKD

SEQ ID NO: 164231 - protein, 11 aa, Borrelia garinii
KDKGAKELKDL

SEQ ID NO: 164232 - protein, 11 aa, Borrelia garinii
DKGAKELKDLS

SEQ ID NO: 164233 - protein, 11 aa, Borrelia garinii
KGAKELKDLSE

SEQ ID NO: 164234 - protein, 11 aa, Borrelia garinii
GAKELKDLSES

SEQ ID NO: 164235 - protein, 11 aa, Borrelia garinii
AKELKDLSESV

SEQ ID NO: 164236 - protein, 11 aa, Borrelia garinii
KELKDLSESVE

SEQ ID NO: 164237 - protein, 11 aa, Borrelia garinii
ELKDLSESVES

SEQ ID NO: 164238 - protein, 11 aa, Borrelia garinii
LKDLSESVESL

SEQ ID NO: 164239 - protein, 11 aa, Borrelia garinii
KDLSESVESLA

SEQ ID NO: 164240 - protein, 11 aa, Borrelia garinii
DLSESVESLAK

SEQ ID NO: 164241 - protein, 11 aa, Borrelia garinii
LSESVESLAKA

SEQ ID NO: 164242 - protein, 11 aa, Borrelia garinii
SESVESLAKAA

SEQ ID NO: 164243 - protein, 11 aa, Borrelia garinii
ESVESLAKAAQ

SEQ ID NO: 164244 - protein, 11 aa, Borrelia garinii
SVESLAKAAQE

SEQ ID NO: 164245 - protein, 11 aa, Borrelia garinii
VESLAKAAQEA

SEQ ID NO: 164246 - protein, 11 aa, Borrelia garinii
ESLAKAAQEAL

SEQ ID NO: 164247 - protein, 11 aa, Borrelia garinii
SLAKAAQEALA

SEQ ID NO: 164248 - protein, 11 aa, Borrelia garinii
LAKAAQEALAN

SEQ ID NO: 164249 - protein, 11 aa, Borrelia garinii
AKAAQEALANS

SEQ ID NO: 164250 - protein, 11 aa, Borrelia garinii
KAAQEALANSV

SEQ ID NO: 164251 - protein, 11 aa, Borrelia garinii
AAQEALANSVK

SEQ ID NO: 164252 - protein, 11 aa, Borrelia garinii
AQEALANSVKE

SEQ ID NO: 164253 - protein, 11 aa, Borrelia garinii
QEALANSVKEL

SEQ ID NO: 164254 - protein, 11 aa, Borrelia garinii
EALANSVKELT

SEQ ID NO: 164255 - protein, 11 aa, Borrelia garinii
ALANSVKELTN

SEQ ID NO: 164256 - protein, 11 aa, Borrelia garinii
LANSVKELTNP

SEQ ID NO: 164257 - protein, 11 aa, Borrelia garinii
ANSVKELTNPV

SEQ ID NO: 164258 - protein, 11 aa, Borrelia garinii
NSVKELTNPVV

SEQ ID NO: 164259 - protein, 11 aa, Borrelia garinii
SVKELTNPVVA

SEQ ID NO: 164260 - protein, 11 aa, Borrelia garinii
VKELTNPVVAE

SEQ ID NO: 164261 - protein, 11 aa, Borrelia garinii
KELTNPVVAES

SEQ ID NO: 164262 - protein, 11 aa, Borrelia garinii
ELTNPVVAESP

SEQ ID NO: 164263 - protein, 11 aa, Borrelia garinii
LTNPVVAESPK

SEQ ID NO: 164264 - protein, 13 aa, Borrelia garinii
ILMTLFLFISCNN

SEQ ID NO: 164265 - protein, 13 aa, Borrelia garinii
LMTLFLFISCNNS

SEQ ID NO: 164266 - protein, 13 aa, Borrelia garinii
MTLFLFISCNNSG

SEQ ID NO: 164267 - protein, 13 aa, Borrelia garinii
TLFLFISCNNSGG

SEQ ID NO: 164268 - protein, 13 aa, Borrelia garinii
LFLFISCNNSGGD

SEQ ID NO: 164269 - protein, 13 aa, Borrelia garinii
FLFISCNNSGGDT

SEQ ID NO: 164270 - protein, 13 aa, Borrelia garinii
LFISCNNSGGDTA

SEQ ID NO: 164271 - protein, 13 aa, Borrelia garinii
FISCNNSGGDTAS

SEQ ID NO: 164272 - protein, 13 aa, Borrelia garinii
ISCNNSGGDTAST

SEQ ID NO: 164273 - protein, 13 aa, Borrelia garinii
SCNNSGGDTASTN

SEQ ID NO: 164274 - protein, 13 aa, Borrelia garinii
CNNSGGDTASTNP

SEQ ID NO: 164275 - protein, 13 aa, Borrelia garinii
NNSGGDTASTNPD

SEQ ID NO: 164276 - protein, 13 aa, Borrelia garinii
NSGGDTASTNPDE

SEQ ID NO: 164277 - protein, 13 aa, Borrelia garinii
SGGDTASTNPDES

SEQ ID NO: 164278 - protein, 13 aa, Borrelia garinii
GGDTASTNPDESA

SEQ ID NO: 164279 - protein, 13 aa, Borrelia garinii
GDTASTNPDESAK

SEQ ID NO: 164280 - protein, 13 aa, Borrelia garinii
DTASTNPDESAKG

SEQ ID NO: 164281 - protein, 13 aa, Borrelia garinii
TASTNPDESAKGP

SEQ ID NO: 164282 - protein, 13 aa, Borrelia garinii
ASTNPDESAKGPN

SEQ ID NO: 164283 - protein, 13 aa, Borrelia garinii
STNPDESAKGPNL

SEQ ID NO: 164284 - protein, 13 aa, Borrelia garinii
TNPDESAKGPNLT

SEQ ID NO: 164285 - protein, 13 aa, Borrelia garinii
NPDESAKGPNLTV

SEQ ID NO: 164286 - protein, 13 aa, Borrelia garinii
PDESAKGPNLTVI

SEQ ID NO: 164287 - protein, 13 aa, Borrelia garinii
DESAKGPNLTVIS

SEQ ID NO: 164288 - protein, 13 aa, Borrelia garinii
ESAKGPNLTVISK

SEQ ID NO: 164289 - protein, 13 aa, Borrelia garinii
SAKGPNLTVISKK

SEQ ID NO: 164290 - protein, 13 aa, Borrelia garinii
AKGPNLTVISKKI

SEQ ID NO: 164291 - protein, 13 aa, Borrelia garinii
KGPNLTVISKKIT

SEQ ID NO: 164292 - protein, 13 aa, Borrelia garinii
GPNLTVISKKITD

SEQ ID NO: 164293 - protein, 13 aa, Borrelia garinii
PNLTVISKKITDS

SEQ ID NO: 164294 - protein, 13 aa, Borrelia garinii
NLTVISKKITDSN

SEQ ID NO: 164295 - protein, 13 aa, Borrelia garinii
LTVISKKITDSNA

SEQ ID NO: 164296 - protein, 13 aa, Borrelia garinii
TVISKKITDSNAF

SEQ ID NO: 164297 - protein, 13 aa, Borrelia garinii
VISKKITDSNAFV

SEQ ID NO: 164298 - protein, 13 aa, Borrelia garinii
ISKKITDSNAFVL

SEQ ID NO: 164299 - protein, 13 aa, Borrelia garinii
SKKITDSNAFVLA

SEQ ID NO: 164300 - protein, 13 aa, Borrelia garinii
KKITDSNAFVLAV

SEQ ID NO: 164301 - protein, 13 aa, Borrelia garinii
KITDSNAFVLAVK

SEQ ID NO: 164302 - protein, 13 aa, Borrelia garinii
ITDSNAFVLAVKE

SEQ ID NO: 164303 - protein, 13 aa, Borrelia garinii
TDSNAFVLAVKEV

SEQ ID NO: 164304 - protein, 13 aa, Borrelia garinii
DSNAFVLAVKEVE

SEQ ID NO: 164305 - protein, 13 aa, Borrelia garinii
SNAFVLAVKEVEA

SEQ ID NO: 164306 - protein, 13 aa, Borrelia garinii
NAFVLAVKEVEAL

SEQ ID NO: 164307 - protein, 13 aa, Borrelia garinii
AFVLAVKEVEALI

SEQ ID NO: 164308 - protein, 13 aa, Borrelia garinii
FVLAVKEVEALIS

SEQ ID NO: 164309 - protein, 13 aa, Borrelia garinii
VLAVKEVEALISS

SEQ ID NO: 164310 - protein, 13 aa, Borrelia garinii
LAVKEVEALISSI

SEQ ID NO: 164311 - protein, 13 aa, Borrelia garinii
AVKEVEALISSID

SEQ ID NO: 164312 - protein, 13 aa, Borrelia garinii
VKEVEALISSIDE

SEQ ID NO: 164313 - protein, 13 aa, Borrelia garinii
KEVEALISSIDEL

SEQ ID NO: 164314 - protein, 13 aa, Borrelia garinii
EVEALISSIDELA

SEQ ID NO: 164315 - protein, 13 aa, Borrelia garinii
VEALISSIDELAN

SEQ ID NO: 164316 - protein, 13 aa, Borrelia garinii
EALISSIDELANK

SEQ ID NO: 164317 - protein, 13 aa, Borrelia garinii
ALISSIDELANKA

SEQ ID NO: 164318 - protein, 13 aa, Borrelia garinii
LISSIDELANKAI

SEQ ID NO: 164319 - protein, 13 aa, Borrelia garinii
ISSIDELANKAIG

SEQ ID NO: 164320 - protein, 13 aa, Borrelia garinii
SSIDELANKAIGK

SEQ ID NO: 164321 - protein, 13 aa, Borrelia garinii
SIDELANKAIGKV

SEQ ID NO: 164322 - protein, 13 aa, Borrelia garinii
IDELANKAIGKVI

SEQ ID NO: 164323 - protein, 13 aa, Borrelia garinii
DELANKAIGKVIH

SEQ ID NO: 164324 - protein, 13 aa, Borrelia garinii
ELANKAIGKVIHQ

SEQ ID NO: 164325 - protein, 13 aa, Borrelia garinii
LANKAIGKVIHQN

SEQ ID NO: 164326 - protein, 13 aa, Borrelia garinii
ANKAIGKVIHQNN

SEQ ID NO: 164327 - protein, 13 aa, Borrelia garinii
NKAIGKVIHQNNG

SEQ ID NO: 164328 - protein, 13 aa, Borrelia garinii
KAIGKVIHQNNGL

SEQ ID NO: 164329 - protein, 13 aa, Borrelia garinii
AIGKVIHQNNGLN

SEQ ID NO: 164330 - protein, 13 aa, Borrelia garinii
IGKVIHQNNGLNA

SEQ ID NO: 164331 - protein, 13 aa, Borrelia garinii
GKVIHQNNGLNAN

SEQ ID NO: 164332 - protein, 13 aa, Borrelia garinii
KVIHQNNGLNANA

SEQ ID NO: 164333 - protein, 13 aa, Borrelia garinii
VIHQNNGLNANAG

SEQ ID NO: 164334 - protein, 13 aa, Borrelia garinii
IHQNNGLNANAGQ

SEQ ID NO: 164335 - protein, 13 aa, Borrelia garinii
HQNNGLNANAGQN

SEQ ID NO: 164336 - protein, 13 aa, Borrelia garinii
QNNGLNANAGQNG

SEQ ID NO: 164337 - protein, 13 aa, Borrelia garinii
NNGLNANAGQNGS

SEQ ID NO: 164338 - protein, 13 aa, Borrelia garinii
NGLNANAGQNGSL

SEQ ID NO: 164339 - protein, 13 aa, Borrelia garinii
GLNANAGQNGSLL

SEQ ID NO: 164340 - protein, 13 aa, Borrelia garinii
LNANAGQNGSLLA

SEQ ID NO: 164341 - protein, 13 aa, Borrelia garinii
NANAGQNGSLLAG

SEQ ID NO: 164342 - protein, 13 aa, Borrelia garinii
ANAGQNGSLLAGA

SEQ ID NO: 164343 - protein, 13 aa, Borrelia garinii
NAGQNGSLLAGAY

SEQ ID NO: 164344 - protein, 13 aa, Borrelia garinii
AGQNGSLLAGAYA

SEQ ID NO: 164345 - protein, 13 aa, Borrelia garinii
GQNGSLLAGAYAI

SEQ ID NO: 164346 - protein, 13 aa, Borrelia garinii
QNGSLLAGAYAIS

SEQ ID NO: 164347 - protein, 13 aa, Borrelia garinii
NGSLLAGAYAIST

SEQ ID NO: 164348 - protein, 13 aa, Borrelia garinii
GSLLAGAYAISTL

SEQ ID NO: 164349 - protein, 13 aa, Borrelia garinii
SLLAGAYAISTLI

SEQ ID NO: 164350 - protein, 13 aa, Borrelia garinii
LLAGAYAISTLIT

SEQ ID NO: 164351 - protein, 13 aa, Borrelia garinii
LAGAYAISTLITE

SEQ ID NO: 164352 - protein, 13 aa, Borrelia garinii
AGAYAISTLITEK

SEQ ID NO: 164353 - protein, 13 aa, Borrelia garinii
GAYAISTLITEKL

SEQ ID NO: 164354 - protein, 13 aa, Borrelia garinii
AYAISTLITEKLS

SEQ ID NO: 164355 - protein, 13 aa, Borrelia garinii
YAISTLITEKLSK

SEQ ID NO: 164356 - protein, 13 aa, Borrelia garinii
AISTLITEKLSKL

SEQ ID NO: 164357 - protein, 13 aa, Borrelia garinii
ISTLITEKLSKLK

SEQ ID NO: 164358 - protein, 13 aa, Borrelia garinii
STLITEKLSKLKN

SEQ ID NO: 164359 - protein, 13 aa, Borrelia garinii
TLITEKLSKLKNS

SEQ ID NO: 164360 - protein, 13 aa, Borrelia garinii
LITEKLSKLKNSE

SEQ ID NO: 164361 - protein, 13 aa, Borrelia garinii
ITEKLSKLKNSEE

SEQ ID NO: 164362 - protein, 13 aa, Borrelia garinii
TEKLSKLKNSEEL

SEQ ID NO: 164363 - protein, 13 aa, Borrelia garinii
EKLSKLKNSEELN

SEQ ID NO: 164364 - protein, 13 aa, Borrelia garinii
KLSKLKNSEELNK

SEQ ID NO: 164365 - protein, 13 aa, Borrelia garinii
LSKLKNSEELNKK

SEQ ID NO: 164366 - protein, 13 aa, Borrelia garinii
SKLKNSEELNKKI

SEQ ID NO: 164367 - protein, 13 aa, Borrelia garinii
KLKNSEELNKKIE

SEQ ID NO: 164368 - protein, 13 aa, Borrelia garinii
LKNSEELNKKIEE

SEQ ID NO: 164369 - protein, 13 aa, Borrelia garinii
KNSEELNKKIEEA

SEQ ID NO: 164370 - protein, 13 aa, Borrelia garinii
NSEELNKKIEEAK

SEQ ID NO: 164371 - protein, 13 aa, Borrelia garinii
SEELNKKIEEAKN

SEQ ID NO: 164372 - protein, 13 aa, Borrelia garinii
EELNKKIEEAKNH

SEQ ID NO: 164373 - protein, 13 aa, Borrelia garinii
ELNKKIEEAKNHS

SEQ ID NO: 164374 - protein, 13 aa, Borrelia garinii
LNKKIEEAKNHSE

SEQ ID NO: 164375 - protein, 13 aa, Borrelia garinii
NKKIEEAKNHSEA

SEQ ID NO: 164376 - protein, 13 aa, Borrelia garinii
KKIEEAKNHSEAF

SEQ ID NO: 164377 - protein, 13 aa, Borrelia garinii
KIEEAKNHSEAFT

SEQ ID NO: 164378 - protein, 13 aa, Borrelia garinii
IEEAKNHSEAFTN

SEQ ID NO: 164379 - protein, 13 aa, Borrelia garinii
EEAKNHSEAFTNR

SEQ ID NO: 164380 - protein, 13 aa, Borrelia garinii
EAKNHSEAFTNRL

SEQ ID NO: 164381 - protein, 13 aa, Borrelia garinii
AKNHSEAFTNRLK

SEQ ID NO: 164382 - protein, 13 aa, Borrelia garinii
KNHSEAFTNRLKG

SEQ ID NO: 164383 - protein, 13 aa, Borrelia garinii
NHSEAFTNRLKGS

SEQ ID NO: 164384 - protein, 13 aa, Borrelia garinii
HSEAFTNRLKGSH

SEQ ID NO: 164385 - protein, 13 aa, Borrelia garinii
SEAFTNRLKGSHA

SEQ ID NO: 164386 - protein, 13 aa, Borrelia garinii
EAFTNRLKGSHAQ

SEQ ID NO: 164387 - protein, 13 aa, Borrelia garinii
AFTNRLKGSHAQL

SEQ ID NO: 164388 - protein, 13 aa, Borrelia garinii
FTNRLKGSHAQLG

SEQ ID NO: 164389 - protein, 13 aa, Borrelia garinii
TNRLKGSHAQLGV

SEQ ID NO: 164390 - protein, 13 aa, Borrelia garinii
NRLKGSHAQLGVA

SEQ ID NO: 164391 - protein, 13 aa, Borrelia garinii
RLKGSHAQLGVAA

SEQ ID NO: 164392 - protein, 13 aa, Borrelia garinii
LKGSHAQLGVAAA

SEQ ID NO: 164393 - protein, 13 aa, Borrelia garinii
KGSHAQLGVAAAT

SEQ ID NO: 164394 - protein, 13 aa, Borrelia garinii
GSHAQLGVAAATD

SEQ ID NO: 164395 - protein, 13 aa, Borrelia garinii
SHAQLGVAAATDD

SEQ ID NO: 164396 - protein, 13 aa, Borrelia garinii
HAQLGVAAATDDH

SEQ ID NO: 164397 - protein, 13 aa, Borrelia garinii
AQLGVAAATDDHA

SEQ ID NO: 164398 - protein, 13 aa, Borrelia garinii
QLGVAAATDDHAK

SEQ ID NO: 164399 - protein, 13 aa, Borrelia garinii
LGVAAATDDHAKE

SEQ ID NO: 164400 - protein, 13 aa, Borrelia garinii
GVAAATDDHAKEA

SEQ ID NO: 164401 - protein, 13 aa, Borrelia garinii
VAAATDDHAKEAI

SEQ ID NO: 164402 - protein, 13 aa, Borrelia garinii
AAATDDHAKEAIL

SEQ ID NO: 164403 - protein, 13 aa, Borrelia garinii
AATDDHAKEAILK

SEQ ID NO: 164404 - protein, 13 aa, Borrelia garinii
ATDDHAKEAILKS

SEQ ID NO: 164405 - protein, 13 aa, Borrelia garinii
TDDHAKEAILKSN

SEQ ID NO: 164406 - protein, 13 aa, Borrelia garinii
DDHAKEAILKSNP

SEQ ID NO: 164407 - protein, 13 aa, Borrelia garinii
DHAKEAILKSNPT

SEQ ID NO: 164408 - protein, 13 aa, Borrelia garinii
HAKEAILKSNPTK

SEQ ID NO: 164409 - protein, 13 aa, Borrelia garinii
AKEAILKSNPTKD

SEQ ID NO: 164410 - protein, 13 aa, Borrelia garinii
KEAILKSNPTKDK

SEQ ID NO: 164411 - protein, 13 aa, Borrelia garinii
EAILKSNPTKDKG

SEQ ID NO: 164412 - protein, 13 aa, Borrelia garinii
AILKSNPTKDKGA

SEQ ID NO: 164413 - protein, 13 aa, Borrelia garinii
ILKSNPTKDKGAK

SEQ ID NO: 164414 - protein, 13 aa, Borrelia garinii
LKSNPTKDKGAKE

SEQ ID NO: 164415 - protein, 13 aa, Borrelia garinii
KSNPTKDKGAKEL

SEQ ID NO: 164416 - protein, 13 aa, Borrelia garinii
SNPTKDKGAKELK

SEQ ID NO: 164417 - protein, 13 aa, Borrelia garinii
NPTKDKGAKELKD

SEQ ID NO: 164418 - protein, 13 aa, Borrelia garinii
PTKDKGAKELKDL

SEQ ID NO: 164419 - protein, 13 aa, Borrelia garinii
TKDKGAKELKDLS

SEQ ID NO: 164420 - protein, 13 aa, Borrelia garinii
KDKGAKELKDLSE

SEQ ID NO: 164421 - protein, 13 aa, Borrelia garinii
DKGAKELKDLSES

SEQ ID NO: 164422 - protein, 13 aa, Borrelia garinii
KGAKELKDLSESV

SEQ ID NO: 164423 - protein, 13 aa, Borrelia garinii
GAKELKDLSESVE

SEQ ID NO: 164424 - protein, 13 aa, Borrelia garinii
AKELKDLSESVES

SEQ ID NO: 164425 - protein, 13 aa, Borrelia garinii
KELKDLSESVESL

SEQ ID NO: 164426 - protein, 13 aa, Borrelia garinii
ELKDLSESVESLA

SEQ ID NO: 164427 - protein, 13 aa, Borrelia garinii
LKDLSESVESLAK

SEQ ID NO: 164428 - protein, 13 aa, Borrelia garinii
KDLSESVESLAKA

SEQ ID NO: 164429 - protein, 13 aa, Borrelia garinii
DLSESVESLAKAA

SEQ ID NO: 164430 - protein, 13 aa, Borrelia garinii
LSESVESLAKAAQ

SEQ ID NO: 164431 - protein, 13 aa, Borrelia garinii
SESVESLAKAAQE

SEQ ID NO: 164432 - protein, 13 aa, Borrelia garinii
ESVESLAKAAQEA

SEQ ID NO: 164433 - protein, 13 aa, Borrelia garinii
SVESLAKAAQEAL

SEQ ID NO: 164434 - protein, 13 aa, Borrelia garinii
VESLAKAAQEALA

SEQ ID NO: 164435 - protein, 13 aa, Borrelia garinii
ESLAKAAQEALAN

SEQ ID NO: 164436 - protein, 13 aa, Borrelia garinii
SLAKAAQEALANS

SEQ ID NO: 164437 - protein, 13 aa, Borrelia garinii
LAKAAQEALANSV

SEQ ID NO: 164438 - protein, 13 aa, Borrelia garinii
AKAAQEALANSVK

SEQ ID NO: 164439 - protein, 13 aa, Borrelia garinii
KAAQEALANSVKE

SEQ ID NO: 164440 - protein, 13 aa, Borrelia garinii
AAQEALANSVKEL

SEQ ID NO: 164441 - protein, 13 aa, Borrelia garinii
AQEALANSVKELT

SEQ ID NO: 164442 - protein, 13 aa, Borrelia garinii
QEALANSVKELTN

SEQ ID NO: 164443 - protein, 13 aa, Borrelia garinii
EALANSVKELTNP

SEQ ID NO: 164444 - protein, 13 aa, Borrelia garinii
ALANSVKELTNPV

SEQ ID NO: 164445 - protein, 13 aa, Borrelia garinii
LANSVKELTNPVV

SEQ ID NO: 164446 - protein, 13 aa, Borrelia garinii
ANSVKELTNPVVA

SEQ ID NO: 164447 - protein, 13 aa, Borrelia garinii
NSVKELTNPVVAE

SEQ ID NO: 164448 - protein, 13 aa, Borrelia garinii
SVKELTNPVVAES

SEQ ID NO: 164449 - protein, 13 aa, Borrelia garinii
VKELTNPVVAESP

SEQ ID NO: 164450 - protein, 13 aa, Borrelia garinii
KELTNPVVAESPK

SEQ ID NO: 164451 - protein, 14 aa, Borrelia garinii
ILMTLFLFISCNNS

SEQ ID NO: 164452 - protein, 14 aa, Borrelia garinii
LMTLFLFISCNNSG

SEQ ID NO: 164453 - protein, 14 aa, Borrelia garinii
MTLFLFISCNNSGG

SEQ ID NO: 164454 - protein, 14 aa, Borrelia garinii
TLFLFISCNNSGGD

SEQ ID NO: 164455 - protein, 14 aa, Borrelia garinii
LFLFISCNNSGGDT

SEQ ID NO: 164456 - protein, 14 aa, Borrelia garinii
FLFISCNNSGGDTA

SEQ ID NO: 164457 - protein, 14 aa, Borrelia garinii
LFISCNNSGGDTAS

SEQ ID NO: 164458 - protein, 14 aa, Borrelia garinii
FISCNNSGGDTAST

SEQ ID NO: 164459 - protein, 14 aa, Borrelia garinii
ISCNNSGGDTASTN

SEQ ID NO: 164460 - protein, 14 aa, Borrelia garinii
SCNNSGGDTASTNP

SEQ ID NO: 164461 - protein, 14 aa, Borrelia garinii
CNNSGGDTASTNPD

SEQ ID NO: 164462 - protein, 14 aa, Borrelia garinii
NNSGGDTASTNPDE

SEQ ID NO: 164463 - protein, 14 aa, Borrelia garinii
NSGGDTASTNPDES

SEQ ID NO: 164464 - protein, 14 aa, Borrelia garinii
SGGDTASTNPDESA

SEQ ID NO: 164465 - protein, 14 aa, Borrelia garinii
GGDTASTNPDESAK

SEQ ID NO: 164466 - protein, 14 aa, Borrelia garinii
GDTASTNPDESAKG

SEQ ID NO: 164467 - protein, 14 aa, Borrelia garinii
DTASTNPDESAKGP

SEQ ID NO: 164468 - protein, 14 aa, Borrelia garinii
TASTNPDESAKGPN

SEQ ID NO: 164469 - protein, 14 aa, Borrelia garinii
ASTNPDESAKGPNL

SEQ ID NO: 164470 - protein, 14 aa, Borrelia garinii
STNPDESAKGPNLT

SEQ ID NO: 164471 - protein, 14 aa, Borrelia garinii
TNPDESAKGPNLTV

SEQ ID NO: 164472 - protein, 14 aa, Borrelia garinii
NPDESAKGPNLTVI

SEQ ID NO: 164473 - protein, 14 aa, Borrelia garinii
PDESAKGPNLTVIS

SEQ ID NO: 164474 - protein, 14 aa, Borrelia garinii
DESAKGPNLTVISK

SEQ ID NO: 164475 - protein, 14 aa, Borrelia garinii
ESAKGPNLTVISKK

SEQ ID NO: 164476 - protein, 14 aa, Borrelia garinii
SAKGPNLTVISKKI

SEQ ID NO: 164477 - protein, 14 aa, Borrelia garinii
AKGPNLTVISKKIT

SEQ ID NO: 164478 - protein, 14 aa, Borrelia garinii
KGPNLTVISKKITD

SEQ ID NO: 164479 - protein, 14 aa, Borrelia garinii
GPNLTVISKKITDS

SEQ ID NO: 164480 - protein, 14 aa, Borrelia garinii
PNLTVISKKITDSN

SEQ ID NO: 164481 - protein, 14 aa, Borrelia garinii
NLTVISKKITDSNA

SEQ ID NO: 164482 - protein, 14 aa, Borrelia garinii
LTVISKKITDSNAF

SEQ ID NO: 164483 - protein, 14 aa, Borrelia garinii
TVISKKITDSNAFV

SEQ ID NO: 164484 - protein, 14 aa, Borrelia garinii
VISKKITDSNAFVL

SEQ ID NO: 164485 - protein, 14 aa, Borrelia garinii
ISKKITDSNAFVLA

SEQ ID NO: 164486 - protein, 14 aa, Borrelia garinii
SKKITDSNAFVLAV

SEQ ID NO: 164487 - protein, 14 aa, Borrelia garinii
KKITDSNAFVLAVK

SEQ ID NO: 164488 - protein, 14 aa, Borrelia garinii
KITDSNAFVLAVKE

SEQ ID NO: 164489 - protein, 14 aa, Borrelia garinii
ITDSNAFVLAVKEV

SEQ ID NO: 164490 - protein, 14 aa, Borrelia garinii
TDSNAFVLAVKEVE

SEQ ID NO: 164491 - protein, 14 aa, Borrelia garinii
DSNAFVLAVKEVEA

SEQ ID NO: 164492 - protein, 14 aa, Borrelia garinii
SNAFVLAVKEVEAL

SEQ ID NO: 164493 - protein, 14 aa, Borrelia garinii
NAFVLAVKEVEALI

SEQ ID NO: 164494 - protein, 14 aa, Borrelia garinii
AFVLAVKEVEALIS

SEQ ID NO: 164495 - protein, 14 aa, Borrelia garinii
FVLAVKEVEALISS

SEQ ID NO: 164496 - protein, 14 aa, Borrelia garinii
VLAVKEVEALISSI

SEQ ID NO: 164497 - protein, 14 aa, Borrelia garinii
LAVKEVEALISSID

SEQ ID NO: 164498 - protein, 14 aa, Borrelia garinii
AVKEVEALISSIDE

SEQ ID NO: 164499 - protein, 14 aa, Borrelia garinii
VKEVEALISSIDEL

SEQ ID NO: 164500 - protein, 14 aa, Borrelia garinii
KEVEALISSIDELA

SEQ ID NO: 164501 - protein, 14 aa, Borrelia garinii
EVEALISSIDELAN

SEQ ID NO: 164502 - protein, 14 aa, Borrelia garinii
VEALISSIDELANK

SEQ ID NO: 164503 - protein, 14 aa, Borrelia garinii
EALISSIDELANKA

SEQ ID NO: 164504 - protein, 14 aa, Borrelia garinii
ALISSIDELANKAI

SEQ ID NO: 164505 - protein, 14 aa, Borrelia garinii
LISSIDELANKAIG

SEQ ID NO: 164506 - protein, 14 aa, Borrelia garinii
ISSIDELANKAIGK

SEQ ID NO: 164507 - protein, 14 aa, Borrelia garinii
SSIDELANKAIGKV

SEQ ID NO: 164508 - protein, 14 aa, Borrelia garinii
SIDELANKAIGKVI

SEQ ID NO: 164509 - protein, 14 aa, Borrelia garinii
IDELANKAIGKVIH

SEQ ID NO: 164510 - protein, 14 aa, Borrelia garinii
DELANKAIGKVIHQ

SEQ ID NO: 164511 - protein, 14 aa, Borrelia garinii
ELANKAIGKVIHQN

SEQ ID NO: 164512 - protein, 14 aa, Borrelia garinii
LANKAIGKVIHQNN

SEQ ID NO: 164513 - protein, 14 aa, Borrelia garinii
ANKAIGKVIHQNNG

SEQ ID NO: 164514 - protein, 14 aa, Borrelia garinii
NKAIGKVIHQNNGL

SEQ ID NO: 164515 - protein, 14 aa, Borrelia garinii
KAIGKVIHQNNGLN

SEQ ID NO: 164516 - protein, 14 aa, Borrelia garinii
AIGKVIHQNNGLNA

SEQ ID NO: 164517 - protein, 14 aa, Borrelia garinii
IGKVIHQNNGLNAN

SEQ ID NO: 164518 - protein, 14 aa, Borrelia garinii
GKVIHQNNGLNANA

SEQ ID NO: 164519 - protein, 14 aa, Borrelia garinii
KVIHQNNGLNANAG

SEQ ID NO: 164520 - protein, 14 aa, Borrelia garinii
VIHQNNGLNANAGQ

SEQ ID NO: 164521 - protein, 14 aa, Borrelia garinii
IHQNNGLNANAGQN

SEQ ID NO: 164522 - protein, 14 aa, Borrelia garinii
HQNNGLNANAGQNG

SEQ ID NO: 164523 - protein, 14 aa, Borrelia garinii
QNNGLNANAGQNGS

SEQ ID NO: 164524 - protein, 14 aa, Borrelia garinii
NNGLNANAGQNGSL

SEQ ID NO: 164525 - protein, 14 aa, Borrelia garinii
NGLNANAGQNGSLL

SEQ ID NO: 164526 - protein, 14 aa, Borrelia garinii
GLNANAGQNGSLLA

SEQ ID NO: 164527 - protein, 14 aa, Borrelia garinii
LNANAGQNGSLLAG

SEQ ID NO: 164528 - protein, 14 aa, Borrelia garinii
NANAGQNGSLLAGA

SEQ ID NO: 164529 - protein, 14 aa, Borrelia garinii
ANAGQNGSLLAGAY

SEQ ID NO: 164530 - protein, 14 aa, Borrelia garinii
NAGQNGSLLAGAYA

SEQ ID NO: 164531 - protein, 14 aa, Borrelia garinii
AGQNGSLLAGAYAI

SEQ ID NO: 164532 - protein, 14 aa, Borrelia garinii
GQNGSLLAGAYAIS

SEQ ID NO: 164533 - protein, 14 aa, Borrelia garinii
QNGSLLAGAYAIST

SEQ ID NO: 164534 - protein, 14 aa, Borrelia garinii
NGSLLAGAYAISTL

SEQ ID NO: 164535 - protein, 14 aa, Borrelia garinii
GSLLAGAYAISTLI

SEQ ID NO: 164536 - protein, 14 aa, Borrelia garinii
SLLAGAYAISTLIT

SEQ ID NO: 164537 - protein, 14 aa, Borrelia garinii
LLAGAYAISTLITE

SEQ ID NO: 164538 - protein, 14 aa, Borrelia garinii
LAGAYAISTLITEK

SEQ ID NO: 164539 - protein, 14 aa, Borrelia garinii
AGAYAISTLITEKL

SEQ ID NO: 164540 - protein, 14 aa, Borrelia garinii
GAYAISTLITEKLS

SEQ ID NO: 164541 - protein, 14 aa, Borrelia garinii
AYAISTLITEKLSK

SEQ ID NO: 164542 - protein, 14 aa, Borrelia garinii
YAISTLITEKLSKL

SEQ ID NO: 164543 - protein, 14 aa, Borrelia garinii
AISTLITEKLSKLK

SEQ ID NO: 164544 - protein, 14 aa, Borrelia garinii
ISTLITEKLSKLKN

SEQ ID NO: 164545 - protein, 14 aa, Borrelia garinii
STLITEKLSKLKNS

SEQ ID NO: 164546 - protein, 14 aa, Borrelia garinii
TLITEKLSKLKNSE

SEQ ID NO: 164547 - protein, 14 aa, Borrelia garinii
LITEKLSKLKNSEE

SEQ ID NO: 164548 - protein, 14 aa, Borrelia garinii
ITEKLSKLKNSEEL

SEQ ID NO: 164549 - protein, 14 aa, Borrelia garinii
TEKLSKLKNSEELN

SEQ ID NO: 164550 - protein, 14 aa, Borrelia garinii
EKLSKLKNSEELNK

SEQ ID NO: 164551 - protein, 14 aa, Borrelia garinii
KLSKLKNSEELNKK

SEQ ID NO: 164552 - protein, 14 aa, Borrelia garinii
LSKLKNSEELNKKI

SEQ ID NO: 164553 - protein, 14 aa, Borrelia garinii
SKLKNSEELNKKIE

SEQ ID NO: 164554 - protein, 14 aa, Borrelia garinii
KLKNSEELNKKIEE

SEQ ID NO: 164555 - protein, 14 aa, Borrelia garinii
LKNSEELNKKIEEA

SEQ ID NO: 164556 - protein, 14 aa, Borrelia garinii
KNSEELNKKIEEAK

SEQ ID NO: 164557 - protein, 14 aa, Borrelia garinii
NSEELNKKIEEAKN

SEQ ID NO: 164558 - protein, 14 aa, Borrelia garinii
SEELNKKIEEAKNH

SEQ ID NO: 164559 - protein, 14 aa, Borrelia garinii
EELNKKIEEAKNHS

SEQ ID NO: 164560 - protein, 14 aa, Borrelia garinii
ELNKKIEEAKNHSE

SEQ ID NO: 164561 - protein, 14 aa, Borrelia garinii
LNKKIEEAKNHSEA

SEQ ID NO: 164562 - protein, 14 aa, Borrelia garinii
NKKIEEAKNHSEAF

SEQ ID NO: 164563 - protein, 14 aa, Borrelia garinii
KKIEEAKNHSEAFT

SEQ ID NO: 164564 - protein, 14 aa, Borrelia garinii
KIEEAKNHSEAFTN

SEQ ID NO: 164565 - protein, 14 aa, Borrelia garinii
IEEAKNHSEAFTNR

SEQ ID NO: 164566 - protein, 14 aa, Borrelia garinii
EEAKNHSEAFTNRL

SEQ ID NO: 164567 - protein, 14 aa, Borrelia garinii
EAKNHSEAFTNRLK

SEQ ID NO: 164568 - protein, 14 aa, Borrelia garinii
AKNHSEAFTNRLKG

SEQ ID NO: 164569 - protein, 14 aa, Borrelia garinii
KNHSEAFTNRLKGS

SEQ ID NO: 164570 - protein, 14 aa, Borrelia garinii
NHSEAFTNRLKGSH

SEQ ID NO: 164571 - protein, 14 aa, Borrelia garinii
HSEAFTNRLKGSHA

SEQ ID NO: 164572 - protein, 14 aa, Borrelia garinii
SEAFTNRLKGSHAQ

SEQ ID NO: 164573 - protein, 14 aa, Borrelia garinii
EAFTNRLKGSHAQL

SEQ ID NO: 164574 - protein, 14 aa, Borrelia garinii
AFTNRLKGSHAQLG

SEQ ID NO: 164575 - protein, 14 aa, Borrelia garinii
FTNRLKGSHAQLGV

SEQ ID NO: 164576 - protein, 14 aa, Borrelia garinii
TNRLKGSHAQLGVA

SEQ ID NO: 164577 - protein, 14 aa, Borrelia garinii
NRLKGSHAQLGVAA

SEQ ID NO: 164578 - protein, 14 aa, Borrelia garinii
RLKGSHAQLGVAAA

SEQ ID NO: 164579 - protein, 14 aa, Borrelia garinii
LKGSHAQLGVAAAT

SEQ ID NO: 164580 - protein, 14 aa, Borrelia garinii
KGSHAQLGVAAATD

SEQ ID NO: 164581 - protein, 14 aa, Borrelia garinii
GSHAQLGVAAATDD

SEQ ID NO: 164582 - protein, 14 aa, Borrelia garinii
SHAQLGVAAATDDH

SEQ ID NO: 164583 - protein, 14 aa, Borrelia garinii
HAQLGVAAATDDHA

SEQ ID NO: 164584 - protein, 14 aa, Borrelia garinii
AQLGVAAATDDHAK

SEQ ID NO: 164585 - protein, 14 aa, Borrelia garinii
QLGVAAATDDHAKE

SEQ ID NO: 164586 - protein, 14 aa, Borrelia garinii
LGVAAATDDHAKEA

SEQ ID NO: 164587 - protein, 14 aa, Borrelia garinii
GVAAATDDHAKEAI

SEQ ID NO: 164588 - protein, 14 aa, Borrelia garinii
VAAATDDHAKEAIL

SEQ ID NO: 164589 - protein, 14 aa, Borrelia garinii
AAATDDHAKEAILK

SEQ ID NO: 164590 - protein, 14 aa, Borrelia garinii
AATDDHAKEAILKS

SEQ ID NO: 164591 - protein, 14 aa, Borrelia garinii
ATDDHAKEAILKSN

SEQ ID NO: 164592 - protein, 14 aa, Borrelia garinii
TDDHAKEAILKSNP

SEQ ID NO: 164593 - protein, 14 aa, Borrelia garinii
DDHAKEAILKSNPT

SEQ ID NO: 164594 - protein, 14 aa, Borrelia garinii
DHAKEAILKSNPTK

SEQ ID NO: 164595 - protein, 14 aa, Borrelia garinii
HAKEAILKSNPTKD

SEQ ID NO: 164596 - protein, 14 aa, Borrelia garinii
AKEAILKSNPTKDK

SEQ ID NO: 164597 - protein, 14 aa, Borrelia garinii
KEAILKSNPTKDKG

SEQ ID NO: 164598 - protein, 14 aa, Borrelia garinii
EAILKSNPTKDKGA

SEQ ID NO: 164599 - protein, 14 aa, Borrelia garinii
AILKSNPTKDKGAK

SEQ ID NO: 164600 - protein, 14 aa, Borrelia garinii
ILKSNPTKDKGAKE

SEQ ID NO: 164601 - protein, 14 aa, Borrelia garinii
LKSNPTKDKGAKEL

SEQ ID NO: 164602 - protein, 14 aa, Borrelia garinii
KSNPTKDKGAKELK

SEQ ID NO: 164603 - protein, 14 aa, Borrelia garinii
SNPTKDKGAKELKD

SEQ ID NO: 164604 - protein, 14 aa, Borrelia garinii
NPTKDKGAKELKDL

SEQ ID NO: 164605 - protein, 14 aa, Borrelia garinii
PTKDKGAKELKDLS

SEQ ID NO: 164606 - protein, 14 aa, Borrelia garinii
TKDKGAKELKDLSE

SEQ ID NO: 164607 - protein, 14 aa, Borrelia garinii
KDKGAKELKDLSES

SEQ ID NO: 164608 - protein, 14 aa, Borrelia garinii
DKGAKELKDLSESV

SEQ ID NO: 164609 - protein, 14 aa, Borrelia garinii
KGAKELKDLSESVE

SEQ ID NO: 164610 - protein, 14 aa, Borrelia garinii
GAKELKDLSESVES

SEQ ID NO: 164611 - protein, 14 aa, Borrelia garinii
AKELKDLSESVESL

SEQ ID NO: 164612 - protein, 14 aa, Borrelia garinii
KELKDLSESVESLA

SEQ ID NO: 164613 - protein, 14 aa, Borrelia garinii
ELKDLSESVESLAK

SEQ ID NO: 164614 - protein, 14 aa, Borrelia garinii
LKDLSESVESLAKA

SEQ ID NO: 164615 - protein, 14 aa, Borrelia garinii
KDLSESVESLAKAA

SEQ ID NO: 164616 - protein, 14 aa, Borrelia garinii
DLSESVESLAKAAQ

SEQ ID NO: 164617 - protein, 14 aa, Borrelia garinii
LSESVESLAKAAQE

SEQ ID NO: 164618 - protein, 14 aa, Borrelia garinii
SESVESLAKAAQEA

SEQ ID NO: 164619 - protein, 14 aa, Borrelia garinii
ESVESLAKAAQEAL

SEQ ID NO: 164620 - protein, 14 aa, Borrelia garinii
SVESLAKAAQEALA

SEQ ID NO: 164621 - protein, 14 aa, Borrelia garinii
VESLAKAAQEALAN

SEQ ID NO: 164622 - protein, 14 aa, Borrelia garinii
ESLAKAAQEALANS

SEQ ID NO: 164623 - protein, 14 aa, Borrelia garinii
SLAKAAQEALANSV

SEQ ID NO: 164624 - protein, 14 aa, Borrelia garinii
LAKAAQEALANSVK

SEQ ID NO: 164625 - protein, 14 aa, Borrelia garinii
AKAAQEALANSVKE

SEQ ID NO: 164626 - protein, 14 aa, Borrelia garinii
KAAQEALANSVKEL

SEQ ID NO: 164627 - protein, 14 aa, Borrelia garinii
AAQEALANSVKELT

SEQ ID NO: 164628 - protein, 14 aa, Borrelia garinii
AQEALANSVKELTN

SEQ ID NO: 164629 - protein, 14 aa, Borrelia garinii
QEALANSVKELTNP

SEQ ID NO: 164630 - protein, 14 aa, Borrelia garinii
EALANSVKELTNPV

SEQ ID NO: 164631 - protein, 14 aa, Borrelia garinii
ALANSVKELTNPVV

SEQ ID NO: 164632 - protein, 14 aa, Borrelia garinii
LANSVKELTNPVVA

SEQ ID NO: 164633 - protein, 14 aa, Borrelia garinii
ANSVKELTNPVVAE

SEQ ID NO: 164634 - protein, 14 aa, Borrelia garinii
NSVKELTNPVVAES

SEQ ID NO: 164635 - protein, 14 aa, Borrelia garinii
SVKELTNPVVAESP

SEQ ID NO: 164636 - protein, 14 aa, Borrelia garinii
VKELTNPVVAESPK

SEQ ID NO: 164637 - protein, 15 aa, Borrelia garinii
ILMTLFLFISCNNSG

SEQ ID NO: 164638 - protein, 15 aa, Borrelia garinii
LMTLFLFISCNNSGG

SEQ ID NO: 164639 - protein, 15 aa, Borrelia garinii
MTLFLFISCNNSGGD

SEQ ID NO: 164640 - protein, 15 aa, Borrelia garinii
TLFLFISCNNSGGDT

SEQ ID NO: 164641 - protein, 15 aa, Borrelia garinii
LFLFISCNNSGGDTA

SEQ ID NO: 164642 - protein, 15 aa, Borrelia garinii
FLFISCNNSGGDTAS

SEQ ID NO: 164643 - protein, 15 aa, Borrelia garinii
LFISCNNSGGDTAST

SEQ ID NO: 164644 - protein, 15 aa, Borrelia garinii
FISCNNSGGDTASTN

SEQ ID NO: 164645 - protein, 15 aa, Borrelia garinii
ISCNNSGGDTASTNP

SEQ ID NO: 164646 - protein, 15 aa, Borrelia garinii
SCNNSGGDTASTNPD

SEQ ID NO: 164647 - protein, 15 aa, Borrelia garinii
CNNSGGDTASTNPDE

SEQ ID NO: 164648 - protein, 15 aa, Borrelia garinii
NNSGGDTASTNPDES

SEQ ID NO: 164649 - protein, 15 aa, Borrelia garinii
NSGGDTASTNPDESA

SEQ ID NO: 164650 - protein, 15 aa, Borrelia garinii
SGGDTASTNPDESAK

SEQ ID NO: 164651 - protein, 15 aa, Borrelia garinii
GGDTASTNPDESAKG

SEQ ID NO: 164652 - protein, 15 aa, Borrelia garinii
GDTASTNPDESAKGP

SEQ ID NO: 164653 - protein, 15 aa, Borrelia garinii
DTASTNPDESAKGPN

SEQ ID NO: 164654 - protein, 15 aa, Borrelia garinii
TASTNPDESAKGPNL

SEQ ID NO: 164655 - protein, 15 aa, Borrelia garinii
ASTNPDESAKGPNLT

SEQ ID NO: 164656 - protein, 15 aa, Borrelia garinii
STNPDESAKGPNLTV

SEQ ID NO: 164657 - protein, 15 aa, Borrelia garinii
TNPDESAKGPNLTVI

SEQ ID NO: 164658 - protein, 15 aa, Borrelia garinii
NPDESAKGPNLTVIS

SEQ ID NO: 164659 - protein, 15 aa, Borrelia garinii
PDESAKGPNLTVISK

SEQ ID NO: 164660 - protein, 15 aa, Borrelia garinii
DESAKGPNLTVISKK

SEQ ID NO: 164661 - protein, 15 aa, Borrelia garinii
ESAKGPNLTVISKKI

SEQ ID NO: 164662 - protein, 15 aa, Borrelia garinii
SAKGPNLTVISKKIT

SEQ ID NO: 164663 - protein, 15 aa, Borrelia garinii
AKGPNLTVISKKITD

SEQ ID NO: 164664 - protein, 15 aa, Borrelia garinii
KGPNLTVISKKITDS

SEQ ID NO: 164665 - protein, 15 aa, Borrelia garinii
GPNLTVISKKITDSN

SEQ ID NO: 164666 - protein, 15 aa, Borrelia garinii
PNLTVISKKITDSNA

SEQ ID NO: 164667 - protein, 15 aa, Borrelia garinii
NLTVISKKITDSNAF

SEQ ID NO: 164668 - protein, 15 aa, Borrelia garinii
LTVISKKITDSNAFV

SEQ ID NO: 164669 - protein, 15 aa, Borrelia garinii
TVISKKITDSNAFVL

SEQ ID NO: 164670 - protein, 15 aa, Borrelia garinii
VISKKITDSNAFVLA

SEQ ID NO: 164671 - protein, 15 aa, Borrelia garinii
ISKKITDSNAFVLAV

SEQ ID NO: 164672 - protein, 15 aa, Borrelia garinii
SKKITDSNAFVLAVK

SEQ ID NO: 164673 - protein, 15 aa, Borrelia garinii
KKITDSNAFVLAVKE

SEQ ID NO: 164674 - protein, 15 aa, Borrelia garinii
KITDSNAFVLAVKEV

SEQ ID NO: 164675 - protein, 15 aa, Borrelia garinii
ITDSNAFVLAVKEVE

SEQ ID NO: 164676 - protein, 15 aa, Borrelia garinii
TDSNAFVLAVKEVEA

SEQ ID NO: 164677 - protein, 15 aa, Borrelia garinii
DSNAFVLAVKEVEAL

SEQ ID NO: 164678 - protein, 15 aa, Borrelia garinii
SNAFVLAVKEVEALI

SEQ ID NO: 164679 - protein, 15 aa, Borrelia garinii
NAFVLAVKEVEALIS

SEQ ID NO: 164680 - protein, 15 aa, Borrelia garinii
AFVLAVKEVEALISS

SEQ ID NO: 164681 - protein, 15 aa, Borrelia garinii
FVLAVKEVEALISSI

SEQ ID NO: 164682 - protein, 15 aa, Borrelia garinii
VLAVKEVEALISSID

SEQ ID NO: 164683 - protein, 15 aa, Borrelia garinii
LAVKEVEALISSIDE

SEQ ID NO: 164684 - protein, 15 aa, Borrelia garinii
AVKEVEALISSIDEL

SEQ ID NO: 164685 - protein, 15 aa, Borrelia garinii
VKEVEALISSIDELA

SEQ ID NO: 164686 - protein, 15 aa, Borrelia garinii
KEVEALISSIDELAN

SEQ ID NO: 164687 - protein, 15 aa, Borrelia garinii
EVEALISSIDELANK

SEQ ID NO: 164688 - protein, 15 aa, Borrelia garinii
VEALISSIDELANKA

SEQ ID NO: 164689 - protein, 15 aa, Borrelia garinii
EALISSIDELANKAI

SEQ ID NO: 164690 - protein, 15 aa, Borrelia garinii
ALISSIDELANKAIG

SEQ ID NO: 164691 - protein, 15 aa, Borrelia garinii
LISSIDELANKAIGK

SEQ ID NO: 164692 - protein, 15 aa, Borrelia garinii
ISSIDELANKAIGKV

SEQ ID NO: 164693 - protein, 15 aa, Borrelia garinii
SSIDELANKAIGKVI

SEQ ID NO: 164694 - protein, 15 aa, Borrelia garinii
SIDELANKAIGKVIH

SEQ ID NO: 164695 - protein, 15 aa, Borrelia garinii
IDELANKAIGKVIHQ

SEQ ID NO: 164696 - protein, 15 aa, Borrelia garinii
DELANKAIGKVIHQN

SEQ ID NO: 164697 - protein, 15 aa, Borrelia garinii
ELANKAIGKVIHQNN

SEQ ID NO: 164698 - protein, 15 aa, Borrelia garinii
LANKAIGKVIHQNNG

SEQ ID NO: 164699 - protein, 15 aa, Borrelia garinii
ANKAIGKVIHQNNGL

SEQ ID NO: 164700 - protein, 15 aa, Borrelia garinii
NKAIGKVIHQNNGLN

SEQ ID NO: 164701 - protein, 15 aa, Borrelia garinii
KAIGKVIHQNNGLNA

SEQ ID NO: 164702 - protein, 15 aa, Borrelia garinii
AIGKVIHQNNGLNAN

SEQ ID NO: 164703 - protein, 15 aa, Borrelia garinii
IGKVIHQNNGLNANA

SEQ ID NO: 164704 - protein, 15 aa, Borrelia garinii
GKVIHQNNGLNANAG

SEQ ID NO: 164705 - protein, 15 aa, Borrelia garinii
KVIHQNNGLNANAGQ

SEQ ID NO: 164706 - protein, 15 aa, Borrelia garinii
VIHQNNGLNANAGQN

SEQ ID NO: 164707 - protein, 15 aa, Borrelia garinii
IHQNNGLNANAGQNG

SEQ ID NO: 164708 - protein, 15 aa, Borrelia garinii
HQNNGLNANAGQNGS

SEQ ID NO: 164709 - protein, 15 aa, Borrelia garinii
QNNGLNANAGQNGSL

SEQ ID NO: 164710 - protein, 15 aa, Borrelia garinii
NNGLNANAGQNGSLL

SEQ ID NO: 164711 - protein, 15 aa, Borrelia garinii
NGLNANAGQNGSLLA

SEQ ID NO: 164712 - protein, 15 aa, Borrelia garinii
GLNANAGQNGSLLAG

SEQ ID NO: 164713 - protein, 15 aa, Borrelia garinii
LNANAGQNGSLLAGA

SEQ ID NO: 164714 - protein, 15 aa, Borrelia garinii
NANAGQNGSLLAGAY

SEQ ID NO: 164715 - protein, 15 aa, Borrelia garinii
ANAGQNGSLLAGAYA

SEQ ID NO: 164716 - protein, 15 aa, Borrelia garinii
NAGQNGSLLAGAYAI

SEQ ID NO: 164717 - protein, 15 aa, Borrelia garinii
AGQNGSLLAGAYAIS

SEQ ID NO: 164718 - protein, 15 aa, Borrelia garinii
GQNGSLLAGAYAIST

SEQ ID NO: 164719 - protein, 15 aa, Borrelia garinii
QNGSLLAGAYAISTL

SEQ ID NO: 164720 - protein, 15 aa, Borrelia garinii
NGSLLAGAYAISTLI

SEQ ID NO: 164721 - protein, 15 aa, Borrelia garinii
GSLLAGAYAISTLIT

SEQ ID NO: 164722 - protein, 15 aa, Borrelia garinii
SLLAGAYAISTLITE

SEQ ID NO: 164723 - protein, 15 aa, Borrelia garinii
LLAGAYAISTLITEK

SEQ ID NO: 164724 - protein, 15 aa, Borrelia garinii
LAGAYAISTLITEKL

SEQ ID NO: 164725 - protein, 15 aa, Borrelia garinii
AGAYAISTLITEKLS

SEQ ID NO: 164726 - protein, 15 aa, Borrelia garinii
GAYAISTLITEKLSK

SEQ ID NO: 164727 - protein, 15 aa, Borrelia garinii
AYAISTLITEKLSKL

SEQ ID NO: 164728 - protein, 15 aa, Borrelia garinii
YAISTLITEKLSKLK

SEQ ID NO: 164729 - protein, 15 aa, Borrelia garinii
AISTLITEKLSKLKN

SEQ ID NO: 164730 - protein, 15 aa, Borrelia garinii
ISTLITEKLSKLKNS

SEQ ID NO: 164731 - protein, 15 aa, Borrelia garinii
STLITEKLSKLKNSE

SEQ ID NO: 164732 - protein, 15 aa, Borrelia garinii
TLITEKLSKLKNSEE

SEQ ID NO: 164733 - protein, 15 aa, Borrelia garinii
LITEKLSKLKNSEEL

SEQ ID NO: 164734 - protein, 15 aa, Borrelia garinii
ITEKLSKLKNSEELN

SEQ ID NO: 164735 - protein, 15 aa, Borrelia garinii
TEKLSKLKNSEELNK

SEQ ID NO: 164736 - protein, 15 aa, Borrelia garinii
EKLSKLKNSEELNKK

SEQ ID NO: 164737 - protein, 15 aa, Borrelia garinii
KLSKLKNSEELNKKI

SEQ ID NO: 164738 - protein, 15 aa, Borrelia garinii
LSKLKNSEELNKKIE

SEQ ID NO: 164739 - protein, 15 aa, Borrelia garinii
SKLKNSEELNKKIEE

SEQ ID NO: 164740 - protein, 15 aa, Borrelia garinii
KLKNSEELNKKIEEA

SEQ ID NO: 164741 - protein, 15 aa, Borrelia garinii
LKNSEELNKKIEEAK

SEQ ID NO: 164742 - protein, 15 aa, Borrelia garinii
KNSEELNKKIEEAKN

SEQ ID NO: 164743 - protein, 15 aa, Borrelia garinii
NSEELNKKIEEAKNH

SEQ ID NO: 164744 - protein, 15 aa, Borrelia garinii
SEELNKKIEEAKNHS

SEQ ID NO: 164745 - protein, 15 aa, Borrelia garinii
EELNKKIEEAKNHSE

SEQ ID NO: 164746 - protein, 15 aa, Borrelia garinii
ELNKKIEEAKNHSEA

SEQ ID NO: 164747 - protein, 15 aa, Borrelia garinii
LNKKIEEAKNHSEAF

SEQ ID NO: 164748 - protein, 15 aa, Borrelia garinii
NKKIEEAKNHSEAFT

SEQ ID NO: 164749 - protein, 15 aa, Borrelia garinii
KKIEEAKNHSEAFTN

SEQ ID NO: 164750 - protein, 15 aa, Borrelia garinii
KIEEAKNHSEAFTNR

SEQ ID NO: 164751 - protein, 15 aa, Borrelia garinii
IEEAKNHSEAFTNRL

SEQ ID NO: 164752 - protein, 15 aa, Borrelia garinii
EEAKNHSEAFTNRLK

SEQ ID NO: 164753 - protein, 15 aa, Borrelia garinii
EAKNHSEAFTNRLKG

SEQ ID NO: 164754 - protein, 15 aa, Borrelia garinii
AKNHSEAFTNRLKGS

SEQ ID NO: 164755 - protein, 15 aa, Borrelia garinii
KNHSEAFTNRLKGSH

SEQ ID NO: 164756 - protein, 15 aa, Borrelia garinii
NHSEAFTNRLKGSHA

SEQ ID NO: 164757 - protein, 15 aa, Borrelia garinii
HSEAFTNRLKGSHAQ

SEQ ID NO: 164758 - protein, 15 aa, Borrelia garinii
SEAFTNRLKGSHAQL

SEQ ID NO: 164759 - protein, 15 aa, Borrelia garinii
EAFTNRLKGSHAQLG

SEQ ID NO: 164760 - protein, 15 aa, Borrelia garinii
AFTNRLKGSHAQLGV

SEQ ID NO: 164761 - protein, 15 aa, Borrelia garinii
FTNRLKGSHAQLGVA

SEQ ID NO: 164762 - protein, 15 aa, Borrelia garinii
TNRLKGSHAQLGVAA

SEQ ID NO: 164763 - protein, 15 aa, Borrelia garinii
NRLKGSHAQLGVAAA

SEQ ID NO: 164764 - protein, 15 aa, Borrelia garinii
RLKGSHAQLGVAAAT

SEQ ID NO: 164765 - protein, 15 aa, Borrelia garinii
LKGSHAQLGVAAATD

SEQ ID NO: 164766 - protein, 15 aa, Borrelia garinii
KGSHAQLGVAAATDD

SEQ ID NO: 164767 - protein, 15 aa, Borrelia garinii
GSHAQLGVAAATDDH

SEQ ID NO: 164768 - protein, 15 aa, Borrelia garinii
SHAQLGVAAATDDHA

SEQ ID NO: 164769 - protein, 15 aa, Borrelia garinii
HAQLGVAAATDDHAK

SEQ ID NO: 164770 - protein, 15 aa, Borrelia garinii
AQLGVAAATDDHAKE

SEQ ID NO: 164771 - protein, 15 aa, Borrelia garinii
QLGVAAATDDHAKEA

SEQ ID NO: 164772 - protein, 15 aa, Borrelia garinii
LGVAAATDDHAKEAI

SEQ ID NO: 164773 - protein, 15 aa, Borrelia garinii
GVAAATDDHAKEAIL

SEQ ID NO: 164774 - protein, 15 aa, Borrelia garinii
VAAATDDHAKEAILK

SEQ ID NO: 164775 - protein, 15 aa, Borrelia garinii
AAATDDHAKEAILKS

SEQ ID NO: 164776 - protein, 15 aa, Borrelia garinii
AATDDHAKEAILKSN

SEQ ID NO: 164777 - protein, 15 aa, Borrelia garinii
ATDDHAKEAILKSNP

SEQ ID NO: 164778 - protein, 15 aa, Borrelia garinii
TDDHAKEAILKSNPT

SEQ ID NO: 164779 - protein, 15 aa, Borrelia garinii
DDHAKEAILKSNPTK

SEQ ID NO: 164780 - protein, 15 aa, Borrelia garinii
DHAKEAILKSNPTKD

SEQ ID NO: 164781 - protein, 15 aa, Borrelia garinii
HAKEAILKSNPTKDK

SEQ ID NO: 164782 - protein, 15 aa, Borrelia garinii
AKEAILKSNPTKDKG

SEQ ID NO: 164783 - protein, 15 aa, Borrelia garinii
KEAILKSNPTKDKGA

SEQ ID NO: 164784 - protein, 15 aa, Borrelia garinii
EAILKSNPTKDKGAK

SEQ ID NO: 164785 - protein, 15 aa, Borrelia garinii
AILKSNPTKDKGAKE

SEQ ID NO: 164786 - protein, 15 aa, Borrelia garinii
ILKSNPTKDKGAKEL

SEQ ID NO: 164787 - protein, 15 aa, Borrelia garinii
LKSNPTKDKGAKELK

SEQ ID NO: 164788 - protein, 15 aa, Borrelia garinii
KSNPTKDKGAKELKD

SEQ ID NO: 164789 - protein, 15 aa, Borrelia garinii
SNPTKDKGAKELKDL

SEQ ID NO: 164790 - protein, 15 aa, Borrelia garinii
NPTKDKGAKELKDLS

SEQ ID NO: 164791 - protein, 15 aa, Borrelia garinii
PTKDKGAKELKDLSE

SEQ ID NO: 164792 - protein, 15 aa, Borrelia garinii
TKDKGAKELKDLSES

SEQ ID NO: 164793 - protein, 15 aa, Borrelia garinii
KDKGAKELKDLSESV

SEQ ID NO: 164794 - protein, 15 aa, Borrelia garinii
DKGAKELKDLSESVE

SEQ ID NO: 164795 - protein, 15 aa, Borrelia garinii
KGAKELKDLSESVES

SEQ ID NO: 164796 - protein, 15 aa, Borrelia garinii
GAKELKDLSESVESL

SEQ ID NO: 164797 - protein, 15 aa, Borrelia garinii
AKELKDLSESVESLA

SEQ ID NO: 164798 - protein, 15 aa, Borrelia garinii
KELKDLSESVESLAK

SEQ ID NO: 164799 - protein, 15 aa, Borrelia garinii
ELKDLSESVESLAKA

SEQ ID NO: 164800 - protein, 15 aa, Borrelia garinii
LKDLSESVESLAKAA

SEQ ID NO: 164801 - protein, 15 aa, Borrelia garinii
KDLSESVESLAKAAQ

SEQ ID NO: 164802 - protein, 15 aa, Borrelia garinii
DLSESVESLAKAAQE

SEQ ID NO: 164803 - protein, 15 aa, Borrelia garinii
LSESVESLAKAAQEA

SEQ ID NO: 164804 - protein, 15 aa, Borrelia garinii
SESVESLAKAAQEAL

SEQ ID NO: 164805 - protein, 15 aa, Borrelia garinii
ESVESLAKAAQEALA

SEQ ID NO: 164806 - protein, 15 aa, Borrelia garinii
SVESLAKAAQEALAN

SEQ ID NO: 164807 - protein, 15 aa, Borrelia garinii
VESLAKAAQEALANS

SEQ ID NO: 164808 - protein, 15 aa, Borrelia garinii
ESLAKAAQEALANSV

SEQ ID NO: 164809 - protein, 15 aa, Borrelia garinii
SLAKAAQEALANSVK

SEQ ID NO: 164810 - protein, 15 aa, Borrelia garinii
LAKAAQEALANSVKE

SEQ ID NO: 164811 - protein, 15 aa, Borrelia garinii
AKAAQEALANSVKEL

SEQ ID NO: 164812 - protein, 15 aa, Borrelia garinii
KAAQEALANSVKELT

SEQ ID NO: 164813 - protein, 15 aa, Borrelia garinii
AAQEALANSVKELTN

SEQ ID NO: 164814 - protein, 15 aa, Borrelia garinii
AQEALANSVKELTNP

SEQ ID NO: 164815 - protein, 15 aa, Borrelia garinii
QEALANSVKELTNPV

SEQ ID NO: 164816 - protein, 15 aa, Borrelia garinii
EALANSVKELTNPVV

SEQ ID NO: 164817 - protein, 15 aa, Borrelia garinii
ALANSVKELTNPVVA

SEQ ID NO: 164818 - protein, 15 aa, Borrelia garinii
LANSVKELTNPVVAE

SEQ ID NO: 164819 - protein, 15 aa, Borrelia garinii
ANSVKELTNPVVAES

SEQ ID NO: 164820 - protein, 15 aa, Borrelia garinii
NSVKELTNPVVAESP

SEQ ID NO: 164821 - protein, 15 aa, Borrelia garinii
SVKELTNPVVAESPK

SEQ ID NO: 164822 - protein, 16 aa, Borrelia garinii
ILMTLFLFISCNNSGG

SEQ ID NO: 164823 - protein, 16 aa, Borrelia garinii
LMTLFLFISCNNSGGD

SEQ ID NO: 164824 - protein, 16 aa, Borrelia garinii
MTLFLFISCNNSGGDT

SEQ ID NO: 164825 - protein, 16 aa, Borrelia garinii
TLFLFISCNNSGGDTA

SEQ ID NO: 164826 - protein, 16 aa, Borrelia garinii
LFLFISCNNSGGDTAS

SEQ ID NO: 164827 - protein, 16 aa, Borrelia garinii
FLFISCNNSGGDTAST

SEQ ID NO: 164828 - protein, 16 aa, Borrelia garinii
LFISCNNSGGDTASTN

SEQ ID NO: 164829 - protein, 16 aa, Borrelia garinii
FISCNNSGGDTASTNP

SEQ ID NO: 164830 - protein, 16 aa, Borrelia garinii
ISCNNSGGDTASTNPD

SEQ ID NO: 164831 - protein, 16 aa, Borrelia garinii
SCNNSGGDTASTNPDE

SEQ ID NO: 164832 - protein, 16 aa, Borrelia garinii
CNNSGGDTASTNPDES

SEQ ID NO: 164833 - protein, 16 aa, Borrelia garinii
NNSGGDTASTNPDESA

SEQ ID NO: 164834 - protein, 16 aa, Borrelia garinii
NSGGDTASTNPDESAK

SEQ ID NO: 164835 - protein, 16 aa, Borrelia garinii
SGGDTASTNPDESAKG

SEQ ID NO: 164836 - protein, 16 aa, Borrelia garinii
GGDTASTNPDESAKGP

SEQ ID NO: 164837 - protein, 16 aa, Borrelia garinii
GDTASTNPDESAKGPN

SEQ ID NO: 164838 - protein, 16 aa, Borrelia garinii
DTASTNPDESAKGPNL

SEQ ID NO: 164839 - protein, 16 aa, Borrelia garinii
TASTNPDESAKGPNLT

SEQ ID NO: 164840 - protein, 16 aa, Borrelia garinii
ASTNPDESAKGPNLTV

SEQ ID NO: 164841 - protein, 16 aa, Borrelia garinii
STNPDESAKGPNLTVI

SEQ ID NO: 164842 - protein, 16 aa, Borrelia garinii
TNPDESAKGPNLTVIS

SEQ ID NO: 164843 - protein, 16 aa, Borrelia garinii
NPDESAKGPNLTVISK

SEQ ID NO: 164844 - protein, 16 aa, Borrelia garinii
PDESAKGPNLTVISKK

SEQ ID NO: 164845 - protein, 16 aa, Borrelia garinii
DESAKGPNLTVISKKI

SEQ ID NO: 164846 - protein, 16 aa, Borrelia garinii
ESAKGPNLTVISKKIT

SEQ ID NO: 164847 - protein, 16 aa, Borrelia garinii
SAKGPNLTVISKKITD

SEQ ID NO: 164848 - protein, 16 aa, Borrelia garinii
AKGPNLTVISKKITDS

SEQ ID NO: 164849 - protein, 16 aa, Borrelia garinii
KGPNLTVISKKITDSN

SEQ ID NO: 164850 - protein, 16 aa, Borrelia garinii
GPNLTVISKKITDSNA

SEQ ID NO: 164851 - protein, 16 aa, Borrelia garinii
PNLTVISKKITDSNAF

SEQ ID NO: 164852 - protein, 16 aa, Borrelia garinii
NLTVISKKITDSNAFV

SEQ ID NO: 164853 - protein, 16 aa, Borrelia garinii
LTVISKKITDSNAFVL

SEQ ID NO: 164854 - protein, 16 aa, Borrelia garinii
TVISKKITDSNAFVLA

SEQ ID NO: 164855 - protein, 16 aa, Borrelia garinii
VISKKITDSNAFVLAV

SEQ ID NO: 164856 - protein, 16 aa, Borrelia garinii
ISKKITDSNAFVLAVK

SEQ ID NO: 164857 - protein, 16 aa, Borrelia garinii
SKKITDSNAFVLAVKE

SEQ ID NO: 164858 - protein, 16 aa, Borrelia garinii
KKITDSNAFVLAVKEV

SEQ ID NO: 164859 - protein, 16 aa, Borrelia garinii
KITDSNAFVLAVKEVE

SEQ ID NO: 164860 - protein, 16 aa, Borrelia garinii
ITDSNAFVLAVKEVEA

SEQ ID NO: 164861 - protein, 16 aa, Borrelia garinii
TDSNAFVLAVKEVEAL

SEQ ID NO: 164862 - protein, 16 aa, Borrelia garinii
DSNAFVLAVKEVEALI

SEQ ID NO: 164863 - protein, 16 aa, Borrelia garinii
SNAFVLAVKEVEALIS

SEQ ID NO: 164864 - protein, 16 aa, Borrelia garinii
NAFVLAVKEVEALISS

SEQ ID NO: 164865 - protein, 16 aa, Borrelia garinii
AFVLAVKEVEALISSI

SEQ ID NO: 164866 - protein, 16 aa, Borrelia garinii
FVLAVKEVEALISSID

SEQ ID NO: 164867 - protein, 16 aa, Borrelia garinii
VLAVKEVEALISSIDE

SEQ ID NO: 164868 - protein, 16 aa, Borrelia garinii
LAVKEVEALISSIDEL

SEQ ID NO: 164869 - protein, 16 aa, Borrelia garinii
AVKEVEALISSIDELA

SEQ ID NO: 164870 - protein, 16 aa, Borrelia garinii
VKEVEALISSIDELAN

SEQ ID NO: 164871 - protein, 16 aa, Borrelia garinii
KEVEALISSIDELANK

SEQ ID NO: 164872 - protein, 16 aa, Borrelia garinii
EVEALISSIDELANKA

SEQ ID NO: 164873 - protein, 16 aa, Borrelia garinii
VEALISSIDELANKAI

SEQ ID NO: 164874 - protein, 16 aa, Borrelia garinii
EALISSIDELANKAIG

SEQ ID NO: 164875 - protein, 16 aa, Borrelia garinii
ALISSIDELANKAIGK

SEQ ID NO: 164876 - protein, 16 aa, Borrelia garinii
LISSIDELANKAIGKV

SEQ ID NO: 164877 - protein, 16 aa, Borrelia garinii
ISSIDELANKAIGKVI

SEQ ID NO: 164878 - protein, 16 aa, Borrelia garinii
SSIDELANKAIGKVIH

SEQ ID NO: 164879 - protein, 16 aa, Borrelia garinii
SIDELANKAIGKVIHQ

SEQ ID NO: 164880 - protein, 16 aa, Borrelia garinii
IDELANKAIGKVIHQN

SEQ ID NO: 164881 - protein, 16 aa, Borrelia garinii
DELANKAIGKVIHQNN

SEQ ID NO: 164882 - protein, 16 aa, Borrelia garinii
ELANKAIGKVIHQNNG

SEQ ID NO: 164883 - protein, 16 aa, Borrelia garinii
LANKAIGKVIHQNNGL

SEQ ID NO: 164884 - protein, 16 aa, Borrelia garinii
ANKAIGKVIHQNNGLN

SEQ ID NO: 164885 - protein, 16 aa, Borrelia garinii
NKAIGKVIHQNNGLNA

SEQ ID NO: 164886 - protein, 16 aa, Borrelia garinii
KAIGKVIHQNNGLNAN

SEQ ID NO: 164887 - protein, 16 aa, Borrelia garinii
AIGKVIHQNNGLNANA

SEQ ID NO: 164888 - protein, 16 aa, Borrelia garinii
IGKVIHQNNGLNANAG

SEQ ID NO: 164889 - protein, 16 aa, Borrelia garinii
GKVIHQNNGLNANAGQ

SEQ ID NO: 164890 - protein, 16 aa, Borrelia garinii
KVIHQNNGLNANAGQN

SEQ ID NO: 164891 - protein, 16 aa, Borrelia garinii
VIHQNNGLNANAGQNG

SEQ ID NO: 164892 - protein, 16 aa, Borrelia garinii
IHQNNGLNANAGQNGS

SEQ ID NO: 164893 - protein, 16 aa, Borrelia garinii
HQNNGLNANAGQNGSL

SEQ ID NO: 164894 - protein, 16 aa, Borrelia garinii
QNNGLNANAGQNGSLL

SEQ ID NO: 164895 - protein, 16 aa, Borrelia garinii
NNGLNANAGQNGSLLA

SEQ ID NO: 164896 - protein, 16 aa, Borrelia garinii
NGLNANAGQNGSLLAG

SEQ ID NO: 164897 - protein, 16 aa, Borrelia garinii
GLNANAGQNGSLLAGA

SEQ ID NO: 164898 - protein, 16 aa, Borrelia garinii
LNANAGQNGSLLAGAY

SEQ ID NO: 164899 - protein, 16 aa, Borrelia garinii
NANAGQNGSLLAGAYA

SEQ ID NO: 164900 - protein, 16 aa, Borrelia garinii
ANAGQNGSLLAGAYAI

SEQ ID NO: 164901 - protein, 16 aa, Borrelia garinii
NAGQNGSLLAGAYAIS

SEQ ID NO: 164902 - protein, 16 aa, Borrelia garinii
AGQNGSLLAGAYAIST

SEQ ID NO: 164903 - protein, 16 aa, Borrelia garinii
GQNGSLLAGAYAISTL

SEQ ID NO: 164904 - protein, 16 aa, Borrelia garinii
QNGSLLAGAYAISTLI

SEQ ID NO: 164905 - protein, 16 aa, Borrelia garinii
NGSLLAGAYAISTLIT

SEQ ID NO: 164906 - protein, 16 aa, Borrelia garinii
GSLLAGAYAISTLITE

SEQ ID NO: 164907 - protein, 16 aa, Borrelia garinii
SLLAGAYAISTLITEK

SEQ ID NO: 164908 - protein, 16 aa, Borrelia garinii
LLAGAYAISTLITEKL

SEQ ID NO: 164909 - protein, 16 aa, Borrelia garinii
LAGAYAISTLITEKLS

SEQ ID NO: 164910 - protein, 16 aa, Borrelia garinii
AGAYAISTLITEKLSK

SEQ ID NO: 164911 - protein, 16 aa, Borrelia garinii
GAYAISTLITEKLSKL

SEQ ID NO: 164912 - protein, 16 aa, Borrelia garinii
AYAISTLITEKLSKLK

SEQ ID NO: 164913 - protein, 16 aa, Borrelia garinii
YAISTLITEKLSKLKN

SEQ ID NO: 164914 - protein, 16 aa, Borrelia garinii
AISTLITEKLSKLKNS

SEQ ID NO: 164915 - protein, 16 aa, Borrelia garinii
ISTLITEKLSKLKNSE

SEQ ID NO: 164916 - protein, 16 aa, Borrelia garinii
STLITEKLSKLKNSEE

SEQ ID NO: 164917 - protein, 16 aa, Borrelia garinii
TLITEKLSKLKNSEEL

SEQ ID NO: 164918 - protein, 16 aa, Borrelia garinii
LITEKLSKLKNSEELN

SEQ ID NO: 164919 - protein, 16 aa, Borrelia garinii
ITEKLSKLKNSEELNK

SEQ ID NO: 164920 - protein, 16 aa, Borrelia garinii
TEKLSKLKNSEELNKK

SEQ ID NO: 164921 - protein, 16 aa, Borrelia garinii
EKLSKLKNSEELNKKI

SEQ ID NO: 164922 - protein, 16 aa, Borrelia garinii
KLSKLKNSEELNKKIE

SEQ ID NO: 164923 - protein, 16 aa, Borrelia garinii
LSKLKNSEELNKKIEE

SEQ ID NO: 164924 - protein, 16 aa, Borrelia garinii
SKLKNSEELNKKIEEA

SEQ ID NO: 164925 - protein, 16 aa, Borrelia garinii
KLKNSEELNKKIEEAK

SEQ ID NO: 164926 - protein, 16 aa, Borrelia garinii
LKNSEELNKKIEEAKN

SEQ ID NO: 164927 - protein, 16 aa, Borrelia garinii
KNSEELNKKIEEAKNH

SEQ ID NO: 164928 - protein, 16 aa, Borrelia garinii
NSEELNKKIEEAKNHS

SEQ ID NO: 164929 - protein, 16 aa, Borrelia garinii
SEELNKKIEEAKNHSE

SEQ ID NO: 164930 - protein, 16 aa, Borrelia garinii
EELNKKIEEAKNHSEA

SEQ ID NO: 164931 - protein, 16 aa, Borrelia garinii
ELNKKIEEAKNHSEAF

SEQ ID NO: 164932 - protein, 16 aa, Borrelia garinii
LNKKIEEAKNHSEAFT

SEQ ID NO: 164933 - protein, 16 aa, Borrelia garinii
NKKIEEAKNHSEAFTN

SEQ ID NO: 164934 - protein, 16 aa, Borrelia garinii
KKIEEAKNHSEAFTNR

SEQ ID NO: 164935 - protein, 16 aa, Borrelia garinii
KIEEAKNHSEAFTNRL

SEQ ID NO: 164936 - protein, 16 aa, Borrelia garinii
IEEAKNHSEAFTNRLK

SEQ ID NO: 164937 - protein, 16 aa, Borrelia garinii
EEAKNHSEAFTNRLKG

SEQ ID NO: 164938 - protein, 16 aa, Borrelia garinii
EAKNHSEAFTNRLKGS

SEQ ID NO: 164939 - protein, 16 aa, Borrelia garinii
AKNHSEAFTNRLKGSH

SEQ ID NO: 164940 - protein, 16 aa, Borrelia garinii
KNHSEAFTNRLKGSHA

SEQ ID NO: 164941 - protein, 16 aa, Borrelia garinii
NHSEAFTNRLKGSHAQ

SEQ ID NO: 164942 - protein, 16 aa, Borrelia garinii
HSEAFTNRLKGSHAQL

SEQ ID NO: 164943 - protein, 16 aa, Borrelia garinii
SEAFTNRLKGSHAQLG

SEQ ID NO: 164944 - protein, 16 aa, Borrelia garinii
EAFTNRLKGSHAQLGV

SEQ ID NO: 164945 - protein, 16 aa, Borrelia garinii
AFTNRLKGSHAQLGVA

SEQ ID NO: 164946 - protein, 16 aa, Borrelia garinii
FTNRLKGSHAQLGVAA

SEQ ID NO: 164947 - protein, 16 aa, Borrelia garinii
TNRLKGSHAQLGVAAA

SEQ ID NO: 164948 - protein, 16 aa, Borrelia garinii
NRLKGSHAQLGVAAAT

SEQ ID NO: 164949 - protein, 16 aa, Borrelia garinii
RLKGSHAQLGVAAATD

SEQ ID NO: 164950 - protein, 16 aa, Borrelia garinii
LKGSHAQLGVAAATDD

SEQ ID NO: 164951 - protein, 16 aa, Borrelia garinii
KGSHAQLGVAAATDDH

SEQ ID NO: 164952 - protein, 16 aa, Borrelia garinii
GSHAQLGVAAATDDHA

SEQ ID NO: 164953 - protein, 16 aa, Borrelia garinii
SHAQLGVAAATDDHAK

SEQ ID NO: 164954 - protein, 16 aa, Borrelia garinii
HAQLGVAAATDDHAKE

SEQ ID NO: 164955 - protein, 16 aa, Borrelia garinii
AQLGVAAATDDHAKEA

SEQ ID NO: 164956 - protein, 16 aa, Borrelia garinii
QLGVAAATDDHAKEAI

SEQ ID NO: 164957 - protein, 16 aa, Borrelia garinii
LGVAAATDDHAKEAIL

SEQ ID NO: 164958 - protein, 16 aa, Borrelia garinii
GVAAATDDHAKEAILK

SEQ ID NO: 164959 - protein, 16 aa, Borrelia garinii
VAAATDDHAKEAILKS

SEQ ID NO: 164960 - protein, 16 aa, Borrelia garinii
AAATDDHAKEAILKSN

SEQ ID NO: 164961 - protein, 16 aa, Borrelia garinii
AATDDHAKEAILKSNP

SEQ ID NO: 164962 - protein, 16 aa, Borrelia garinii
ATDDHAKEAILKSNPT

SEQ ID NO: 164963 - protein, 16 aa, Borrelia garinii
TDDHAKEAILKSNPTK

SEQ ID NO: 164964 - protein, 16 aa, Borrelia garinii
DDHAKEAILKSNPTKD

SEQ ID NO: 164965 - protein, 16 aa, Borrelia garinii
DHAKEAILKSNPTKDK

SEQ ID NO: 164966 - protein, 16 aa, Borrelia garinii
HAKEAILKSNPTKDKG

SEQ ID NO: 164967 - protein, 16 aa, Borrelia garinii
AKEAILKSNPTKDKGA

SEQ ID NO: 164968 - protein, 16 aa, Borrelia garinii
KEAILKSNPTKDKGAK

SEQ ID NO: 164969 - protein, 16 aa, Borrelia garinii
EAILKSNPTKDKGAKE

SEQ ID NO: 164970 - protein, 16 aa, Borrelia garinii
AILKSNPTKDKGAKEL

SEQ ID NO: 164971 - protein, 16 aa, Borrelia garinii
ILKSNPTKDKGAKELK

SEQ ID NO: 164972 - protein, 16 aa, Borrelia garinii
LKSNPTKDKGAKELKD

SEQ ID NO: 164973 - protein, 16 aa, Borrelia garinii
KSNPTKDKGAKELKDL

SEQ ID NO: 164974 - protein, 16 aa, Borrelia garinii
SNPTKDKGAKELKDLS

SEQ ID NO: 164975 - protein, 16 aa, Borrelia garinii
NPTKDKGAKELKDLSE

SEQ ID NO: 164976 - protein, 16 aa, Borrelia garinii
PTKDKGAKELKDLSES

SEQ ID NO: 164977 - protein, 16 aa, Borrelia garinii
TKDKGAKELKDLSESV

SEQ ID NO: 164978 - protein, 16 aa, Borrelia garinii
KDKGAKELKDLSESVE

SEQ ID NO: 164979 - protein, 16 aa, Borrelia garinii
DKGAKELKDLSESVES

SEQ ID NO: 164980 - protein, 16 aa, Borrelia garinii
KGAKELKDLSESVESL

SEQ ID NO: 164981 - protein, 16 aa, Borrelia garinii
GAKELKDLSESVESLA

SEQ ID NO: 164982 - protein, 16 aa, Borrelia garinii
AKELKDLSESVESLAK

SEQ ID NO: 164983 - protein, 16 aa, Borrelia garinii
KELKDLSESVESLAKA

SEQ ID NO: 164984 - protein, 16 aa, Borrelia garinii
ELKDLSESVESLAKAA

SEQ ID NO: 164985 - protein, 16 aa, Borrelia garinii
LKDLSESVESLAKAAQ

SEQ ID NO: 164986 - protein, 16 aa, Borrelia garinii
KDLSESVESLAKAAQE

SEQ ID NO: 164987 - protein, 16 aa, Borrelia garinii
DLSESVESLAKAAQEA

SEQ ID NO: 164988 - protein, 16 aa, Borrelia garinii
LSESVESLAKAAQEAL

SEQ ID NO: 164989 - protein, 16 aa, Borrelia garinii
SESVESLAKAAQEALA

SEQ ID NO: 164990 - protein, 16 aa, Borrelia garinii
ESVESLAKAAQEALAN

SEQ ID NO: 164991 - protein, 16 aa, Borrelia garinii
SVESLAKAAQEALANS

SEQ ID NO: 164992 - protein, 16 aa, Borrelia garinii
VESLAKAAQEALANSV

SEQ ID NO: 164993 - protein, 16 aa, Borrelia garinii
ESLAKAAQEALANSVK

SEQ ID NO: 164994 - protein, 16 aa, Borrelia garinii
SLAKAAQEALANSVKE

SEQ ID NO: 164995 - protein, 16 aa, Borrelia garinii
LAKAAQEALANSVKEL

SEQ ID NO: 164996 - protein, 16 aa, Borrelia garinii
AKAAQEALANSVKELT

SEQ ID NO: 164997 - protein, 16 aa, Borrelia garinii
KAAQEALANSVKELTN

SEQ ID NO: 164998 - protein, 16 aa, Borrelia garinii
AAQEALANSVKELTNP

SEQ ID NO: 164999 - protein, 16 aa, Borrelia garinii
AQEALANSVKELTNPV

SEQ ID NO: 165000 - protein, 16 aa, Borrelia garinii
QEALANSVKELTNPVV

SEQ ID NO: 165001 - protein, 16 aa, Borrelia garinii
EALANSVKELTNPVVA

SEQ ID NO: 165002 - protein, 16 aa, Borrelia garinii
ALANSVKELTNPVVAE

SEQ ID NO: 165003 - protein, 16 aa, Borrelia garinii
LANSVKELTNPVVAES

SEQ ID NO: 165004 - protein, 16 aa, Borrelia garinii
ANSVKELTNPVVAESP

SEQ ID NO: 165005 - protein, 16 aa, Borrelia garinii
NSVKELTNPVVAESPK

SEQ ID NO: 165006 - protein, 8 aa, Borrelia burgdorferi B31
MKKNTLSA

SEQ ID NO: 165007 - protein, 8 aa, Borrelia burgdorferi B31
KKNTLSAI

SEQ ID NO: 165008 - protein, 8 aa, Borrelia burgdorferi B31
KNTLSAIL

SEQ ID NO: 165009 - protein, 8 aa, Borrelia burgdorferi B31
NTLSAILM

SEQ ID NO: 165010 - protein, 8 aa, Borrelia burgdorferi B31
TLSAILMT

SEQ ID NO: 165011 - protein, 8 aa, Borrelia burgdorferi B31
LSAILMTL

SEQ ID NO: 165012 - protein, 8 aa, Borrelia burgdorferi B31
SAILMTLF

SEQ ID NO: 165013 - protein, 8 aa, Borrelia burgdorferi B31
AILMTLFL

SEQ ID NO: 165014 - protein, 8 aa, Borrelia burgdorferi B31
ILMTLFLF

SEQ ID NO: 165015 - protein, 8 aa, Borrelia burgdorferi B31
LMTLFLFI

SEQ ID NO: 165016 - protein, 8 aa, Borrelia burgdorferi B31
MTLFLFIS

SEQ ID NO: 165017 - protein, 8 aa, Borrelia burgdorferi B31
TLFLFISC

SEQ ID NO: 165018 - protein, 8 aa, Borrelia burgdorferi B31
LFLFISCN

SEQ ID NO: 165019 - protein, 8 aa, Borrelia burgdorferi B31
FLFISCNN

SEQ ID NO: 165020 - protein, 8 aa, Borrelia burgdorferi B31
LFISCNNS

SEQ ID NO: 165021 - protein, 8 aa, Borrelia burgdorferi B31
FISCNNSG

SEQ ID NO: 165022 - protein, 8 aa, Borrelia burgdorferi B31
ISCNNSGK

SEQ ID NO: 165023 - protein, 8 aa, Borrelia burgdorferi B31
SCNNSGKD

SEQ ID NO: 165024 - protein, 8 aa, Borrelia burgdorferi B31
CNNSGKDG

SEQ ID NO: 165025 - protein, 8 aa, Borrelia burgdorferi B31
NNSGKDGN

SEQ ID NO: 165026 - protein, 8 aa, Borrelia burgdorferi B31
NSGKDGNT

SEQ ID NO: 165027 - protein, 8 aa, Borrelia burgdorferi B31
SGKDGNTS

SEQ ID NO: 165028 - protein, 8 aa, Borrelia burgdorferi B31
GKDGNTSA

SEQ ID NO: 165029 - protein, 8 aa, Borrelia burgdorferi B31
KDGNTSAN

SEQ ID NO: 165030 - protein, 8 aa, Borrelia burgdorferi B31
DGNTSANS

SEQ ID NO: 165031 - protein, 8 aa, Borrelia burgdorferi B31
GNTSANSA

SEQ ID NO: 165032 - protein, 8 aa, Borrelia burgdorferi B31
NTSANSAD

SEQ ID NO: 165033 - protein, 8 aa, Borrelia burgdorferi B31
TSANSADE

SEQ ID NO: 165034 - protein, 8 aa, Borrelia burgdorferi B31
SANSADES

SEQ ID NO: 165035 - protein, 8 aa, Borrelia burgdorferi B31
ANSADESV

SEQ ID NO: 165036 - protein, 8 aa, Borrelia burgdorferi B31
NSADESVK

SEQ ID NO: 165037 - protein, 8 aa, Borrelia burgdorferi B31
SADESVKG

SEQ ID NO: 165038 - protein, 8 aa, Borrelia burgdorferi B31
ADESVKGP

SEQ ID NO: 165039 - protein, 8 aa, Borrelia burgdorferi B31
DESVKGPN

SEQ ID NO: 165040 - protein, 8 aa, Borrelia burgdorferi B31
ESVKGPNL

SEQ ID NO: 165041 - protein, 8 aa, Borrelia burgdorferi B31
SVKGPNLT

SEQ ID NO: 165042 - protein, 8 aa, Borrelia burgdorferi B31
VKGPNLTE

SEQ ID NO: 165043 - protein, 8 aa, Borrelia burgdorferi B31
KGPNLTEI

SEQ ID NO: 165044 - protein, 8 aa, Borrelia burgdorferi B31
GPNLTEIS

SEQ ID NO: 165045 - protein, 8 aa, Borrelia burgdorferi B31
PNLTEISK

SEQ ID NO: 165046 - protein, 8 aa, Borrelia burgdorferi B31
NLTEISKK

SEQ ID NO: 165047 - protein, 8 aa, Borrelia burgdorferi B31
LTEISKKI

SEQ ID NO: 165048 - protein, 8 aa, Borrelia burgdorferi B31
TEISKKIT

SEQ ID NO: 165049 - protein, 8 aa, Borrelia burgdorferi B31
EISKKITD

SEQ ID NO: 165050 - protein, 8 aa, Borrelia burgdorferi B31
ISKKITDS

SEQ ID NO: 165051 - protein, 8 aa, Borrelia burgdorferi B31
SKKITDSN

SEQ ID NO: 165052 - protein, 8 aa, Borrelia burgdorferi B31
KKITDSNA

SEQ ID NO: 165053 - protein, 8 aa, Borrelia burgdorferi B31
KITDSNAV

SEQ ID NO: 165054 - protein, 8 aa, Borrelia burgdorferi B31
ITDSNAVL

SEQ ID NO: 165055 - protein, 8 aa, Borrelia burgdorferi B31
TDSNAVLL

SEQ ID NO: 165056 - protein, 8 aa, Borrelia burgdorferi B31
DSNAVLLA

SEQ ID NO: 165057 - protein, 8 aa, Borrelia burgdorferi B31
SNAVLLAV

SEQ ID NO: 165058 - protein, 8 aa, Borrelia burgdorferi B31
NAVLLAVK

SEQ ID NO: 165059 - protein, 8 aa, Borrelia burgdorferi B31
AVLLAVKE

SEQ ID NO: 165060 - protein, 8 aa, Borrelia burgdorferi B31
VLLAVKEV

SEQ ID NO: 165061 - protein, 8 aa, Borrelia burgdorferi B31
LLAVKEVE

SEQ ID NO: 165062 - protein, 8 aa, Borrelia burgdorferi B31
LAVKEVEA

SEQ ID NO: 165063 - protein, 8 aa, Borrelia burgdorferi B31
AVKEVEAL

SEQ ID NO: 165064 - protein, 8 aa, Borrelia burgdorferi B31
VKEVEALL

SEQ ID NO: 165065 - protein, 8 aa, Borrelia burgdorferi B31
KEVEALLS

SEQ ID NO: 165066 - protein, 8 aa, Borrelia burgdorferi B31
EVEALLSS

SEQ ID NO: 165067 - protein, 8 aa, Borrelia burgdorferi B31
VEALLSSI

SEQ ID NO: 165068 - protein, 8 aa, Borrelia burgdorferi B31
EALLSSID

SEQ ID NO: 165069 - protein, 8 aa, Borrelia burgdorferi B31
ALLSSIDE

SEQ ID NO: 165070 - protein, 8 aa, Borrelia burgdorferi B31
LLSSIDEI

SEQ ID NO: 165071 - protein, 8 aa, Borrelia burgdorferi B31
LSSIDEIA

SEQ ID NO: 165072 - protein, 8 aa, Borrelia burgdorferi B31
SSIDEIAA

SEQ ID NO: 165073 - protein, 8 aa, Borrelia burgdorferi B31
SIDEIAAK

SEQ ID NO: 165074 - protein, 8 aa, Borrelia burgdorferi B31
IDEIAAKA

SEQ ID NO: 165075 - protein, 8 aa, Borrelia burgdorferi B31
DEIAAKAI

SEQ ID NO: 165076 - protein, 8 aa, Borrelia burgdorferi B31
EIAAKAIG

SEQ ID NO: 165077 - protein, 8 aa, Borrelia burgdorferi B31
IAAKAIGK

SEQ ID NO: 165078 - protein, 8 aa, Borrelia burgdorferi B31
AAKAIGKK

SEQ ID NO: 165079 - protein, 8 aa, Borrelia burgdorferi B31
AKAIGKKI

SEQ ID NO: 165080 - protein, 8 aa, Borrelia burgdorferi B31
KAIGKKIH

SEQ ID NO: 165081 - protein, 8 aa, Borrelia burgdorferi B31
AIGKKIHQ

SEQ ID NO: 165082 - protein, 8 aa, Borrelia burgdorferi B31
IGKKIHQN

SEQ ID NO: 165083 - protein, 8 aa, Borrelia burgdorferi B31
GKKIHQNN

SEQ ID NO: 165084 - protein, 8 aa, Borrelia burgdorferi B31
KKIHQNNG

SEQ ID NO: 165085 - protein, 8 aa, Borrelia burgdorferi B31
KIHQNNGL

SEQ ID NO: 165086 - protein, 8 aa, Borrelia burgdorferi B31
IHQNNGLD

SEQ ID NO: 165087 - protein, 8 aa, Borrelia burgdorferi B31
HQNNGLDT

SEQ ID NO: 165088 - protein, 8 aa, Borrelia burgdorferi B31
QNNGLDTE

SEQ ID NO: 165089 - protein, 8 aa, Borrelia burgdorferi B31
NNGLDTEN

SEQ ID NO: 165090 - protein, 8 aa, Borrelia burgdorferi B31
NGLDTENN

SEQ ID NO: 165091 - protein, 8 aa, Borrelia burgdorferi B31
GLDTENNH

SEQ ID NO: 165092 - protein, 8 aa, Borrelia burgdorferi B31
LDTENNHN

SEQ ID NO: 165093 - protein, 8 aa, Borrelia burgdorferi B31
DTENNHNG

SEQ ID NO: 165094 - protein, 8 aa, Borrelia burgdorferi B31
TENNHNGS

SEQ ID NO: 165095 - protein, 8 aa, Borrelia burgdorferi B31
ENNHNGSL

SEQ ID NO: 165096 - protein, 8 aa, Borrelia burgdorferi B31
NNHNGSLL

SEQ ID NO: 165097 - protein, 8 aa, Borrelia burgdorferi B31
NHNGSLLA

SEQ ID NO: 165098 - protein, 8 aa, Borrelia burgdorferi B31
HNGSLLAG

SEQ ID NO: 165099 - protein, 8 aa, Borrelia burgdorferi B31
NGSLLAGA

SEQ ID NO: 165100 - protein, 8 aa, Borrelia burgdorferi B31
GSLLAGAY

SEQ ID NO: 165101 - protein, 8 aa, Borrelia burgdorferi B31
SLLAGAYA

SEQ ID NO: 165102 - protein, 8 aa, Borrelia burgdorferi B31
LLAGAYAI

SEQ ID NO: 165103 - protein, 8 aa, Borrelia burgdorferi B31
LAGAYAIS

SEQ ID NO: 165104 - protein, 8 aa, Borrelia burgdorferi B31
AGAYAIST

SEQ ID NO: 165105 - protein, 8 aa, Borrelia burgdorferi B31
GAYAISTL

SEQ ID NO: 165106 - protein, 8 aa, Borrelia burgdorferi B31
AYAISTLI

SEQ ID NO: 165107 - protein, 8 aa, Borrelia burgdorferi B31
YAISTLIK

SEQ ID NO: 165108 - protein, 8 aa, Borrelia burgdorferi B31
AISTLIKQ

SEQ ID NO: 165109 - protein, 8 aa, Borrelia burgdorferi B31
ISTLIKQK

SEQ ID NO: 165110 - protein, 8 aa, Borrelia burgdorferi B31
STLIKQKL

SEQ ID NO: 165111 - protein, 8 aa, Borrelia burgdorferi B31
TLIKQKLD

SEQ ID NO: 165112 - protein, 8 aa, Borrelia burgdorferi B31
LIKQKLDG

SEQ ID NO: 165113 - protein, 8 aa, Borrelia burgdorferi B31
IKQKLDGL

SEQ ID NO: 165114 - protein, 8 aa, Borrelia burgdorferi B31
KQKLDGLK

SEQ ID NO: 165115 - protein, 8 aa, Borrelia burgdorferi B31
QKLDGLKN

SEQ ID NO: 165116 - protein, 8 aa, Borrelia burgdorferi B31
KLDGLKNE

SEQ ID NO: 165117 - protein, 8 aa, Borrelia burgdorferi B31
LDGLKNEG

SEQ ID NO: 165118 - protein, 8 aa, Borrelia burgdorferi B31
DGLKNEGL

SEQ ID NO: 165119 - protein, 8 aa, Borrelia burgdorferi B31
GLKNEGLK

SEQ ID NO: 165120 - protein, 8 aa, Borrelia burgdorferi B31
LKNEGLKE

SEQ ID NO: 165121 - protein, 8 aa, Borrelia burgdorferi B31
KNEGLKEK

SEQ ID NO: 165122 - protein, 8 aa, Borrelia burgdorferi B31
NEGLKEKI

SEQ ID NO: 165123 - protein, 8 aa, Borrelia burgdorferi B31
EGLKEKID

SEQ ID NO: 165124 - protein, 8 aa, Borrelia burgdorferi B31
GLKEKIDA

SEQ ID NO: 165125 - protein, 8 aa, Borrelia burgdorferi B31
LKEKIDAA

SEQ ID NO: 165126 - protein, 8 aa, Borrelia burgdorferi B31
KEKIDAAK

SEQ ID NO: 165127 - protein, 8 aa, Borrelia burgdorferi B31
EKIDAAKK

SEQ ID NO: 165128 - protein, 8 aa, Borrelia burgdorferi B31
KIDAAKKC

SEQ ID NO: 165129 - protein, 8 aa, Borrelia burgdorferi B31
IDAAKKCS

SEQ ID NO: 165130 - protein, 8 aa, Borrelia burgdorferi B31
DAAKKCSE

SEQ ID NO: 165131 - protein, 8 aa, Borrelia burgdorferi B31
AAKKCSET

SEQ ID NO: 165132 - protein, 8 aa, Borrelia burgdorferi B31
AKKCSETF

SEQ ID NO: 165133 - protein, 8 aa, Borrelia burgdorferi B31
KKCSETFT

SEQ ID NO: 165134 - protein, 8 aa, Borrelia burgdorferi B31
KCSETFTN

SEQ ID NO: 165135 - protein, 8 aa, Borrelia burgdorferi B31
CSETFTNK

SEQ ID NO: 165136 - protein, 8 aa, Borrelia burgdorferi B31
SETFTNKL

SEQ ID NO: 165137 - protein, 8 aa, Borrelia burgdorferi B31
ETFTNKLK

SEQ ID NO: 165138 - protein, 8 aa, Borrelia burgdorferi B31
TFTNKLKE

SEQ ID NO: 165139 - protein, 8 aa, Borrelia burgdorferi B31
FTNKLKEK

SEQ ID NO: 165140 - protein, 8 aa, Borrelia burgdorferi B31
TNKLKEKH

SEQ ID NO: 165141 - protein, 8 aa, Borrelia burgdorferi B31
NKLKEKHT

SEQ ID NO: 165142 - protein, 8 aa, Borrelia burgdorferi B31
KLKEKHTD

SEQ ID NO: 165143 - protein, 8 aa, Borrelia burgdorferi B31
LKEKHTDL

SEQ ID NO: 165144 - protein, 8 aa, Borrelia burgdorferi B31
KEKHTDLG

SEQ ID NO: 165145 - protein, 8 aa, Borrelia burgdorferi B31
EKHTDLGK

SEQ ID NO: 165146 - protein, 8 aa, Borrelia burgdorferi B31
KHTDLGKE

SEQ ID NO: 165147 - protein, 8 aa, Borrelia burgdorferi B31
HTDLGKEG

SEQ ID NO: 165148 - protein, 8 aa, Borrelia burgdorferi B31
TDLGKEGV

SEQ ID NO: 165149 - protein, 8 aa, Borrelia burgdorferi B31
DLGKEGVT

SEQ ID NO: 165150 - protein, 8 aa, Borrelia burgdorferi B31
LGKEGVTD

SEQ ID NO: 165151 - protein, 8 aa, Borrelia burgdorferi B31
GKEGVTDA

SEQ ID NO: 165152 - protein, 8 aa, Borrelia burgdorferi B31
KEGVTDAD

SEQ ID NO: 165153 - protein, 8 aa, Borrelia burgdorferi B31
EGVTDADA

SEQ ID NO: 165154 - protein, 8 aa, Borrelia burgdorferi B31
GVTDADAK

SEQ ID NO: 165155 - protein, 8 aa, Borrelia burgdorferi B31
VTDADAKE

SEQ ID NO: 165156 - protein, 8 aa, Borrelia burgdorferi B31
TDADAKEA

SEQ ID NO: 165157 - protein, 8 aa, Borrelia burgdorferi B31
DADAKEAI

SEQ ID NO: 165158 - protein, 8 aa, Borrelia burgdorferi B31
ADAKEAIL

SEQ ID NO: 165159 - protein, 8 aa, Borrelia burgdorferi B31
DAKEAILK

SEQ ID NO: 165160 - protein, 8 aa, Borrelia burgdorferi B31
AKEAILKT

SEQ ID NO: 165161 - protein, 8 aa, Borrelia burgdorferi B31
KEAILKTN

SEQ ID NO: 165162 - protein, 8 aa, Borrelia burgdorferi B31
EAILKTNG

SEQ ID NO: 165163 - protein, 8 aa, Borrelia burgdorferi B31
AILKTNGT

SEQ ID NO: 165164 - protein, 8 aa, Borrelia burgdorferi B31
ILKTNGTK

SEQ ID NO: 165165 - protein, 8 aa, Borrelia burgdorferi B31
LKTNGTKT

SEQ ID NO: 165166 - protein, 8 aa, Borrelia burgdorferi B31
KTNGTKTK

SEQ ID NO: 165167 - protein, 8 aa, Borrelia burgdorferi B31
TNGTKTKG

SEQ ID NO: 165168 - protein, 8 aa, Borrelia burgdorferi B31
NGTKTKGA

SEQ ID NO: 165169 - protein, 8 aa, Borrelia burgdorferi B31
GTKTKGAE

SEQ ID NO: 165170 - protein, 8 aa, Borrelia burgdorferi B31
TKTKGAEE

SEQ ID NO: 165171 - protein, 8 aa, Borrelia burgdorferi B31
KTKGAEEL

SEQ ID NO: 165172 - protein, 8 aa, Borrelia burgdorferi B31
TKGAEELG

SEQ ID NO: 165173 - protein, 8 aa, Borrelia burgdorferi B31
KGAEELGK

SEQ ID NO: 165174 - protein, 8 aa, Borrelia burgdorferi B31
GAEELGKL

SEQ ID NO: 165175 - protein, 8 aa, Borrelia burgdorferi B31
AEELGKLF

SEQ ID NO: 165176 - protein, 8 aa, Borrelia burgdorferi B31
EELGKLFE

SEQ ID NO: 165177 - protein, 8 aa, Borrelia burgdorferi B31
ELGKLFES

SEQ ID NO: 165178 - protein, 8 aa, Borrelia burgdorferi B31
LGKLFESV

SEQ ID NO: 165179 - protein, 8 aa, Borrelia burgdorferi B31
GKLFESVE

SEQ ID NO: 165180 - protein, 8 aa, Borrelia burgdorferi B31
KLFESVEV

SEQ ID NO: 165181 - protein, 8 aa, Borrelia burgdorferi B31
LFESVEVL

SEQ ID NO: 165182 - protein, 8 aa, Borrelia burgdorferi B31
FESVEVLS

SEQ ID NO: 165183 - protein, 8 aa, Borrelia burgdorferi B31
ESVEVLSK

SEQ ID NO: 165184 - protein, 8 aa, Borrelia burgdorferi B31
SVEVLSKA

SEQ ID NO: 165185 - protein, 8 aa, Borrelia burgdorferi B31
VEVLSKAA

SEQ ID NO: 165186 - protein, 8 aa, Borrelia burgdorferi B31
EVLSKAAK

SEQ ID NO: 165187 - protein, 8 aa, Borrelia burgdorferi B31
VLSKAAKE

SEQ ID NO: 165188 - protein, 8 aa, Borrelia burgdorferi B31
LSKAAKEM

SEQ ID NO: 165189 - protein, 8 aa, Borrelia burgdorferi B31
SKAAKEML

SEQ ID NO: 165190 - protein, 8 aa, Borrelia burgdorferi B31
KAAKEMLA

SEQ ID NO: 165191 - protein, 8 aa, Borrelia burgdorferi B31
AAKEMLAN

SEQ ID NO: 165192 - protein, 8 aa, Borrelia burgdorferi B31
AKEMLANS

SEQ ID NO: 165193 - protein, 8 aa, Borrelia burgdorferi B31
KEMLANSV

SEQ ID NO: 165194 - protein, 8 aa, Borrelia burgdorferi B31
EMLANSVK

SEQ ID NO: 165195 - protein, 8 aa, Borrelia burgdorferi B31
MLANSVKE

SEQ ID NO: 165196 - protein, 8 aa, Borrelia burgdorferi B31
LANSVKEL

SEQ ID NO: 165197 - protein, 8 aa, Borrelia burgdorferi B31
ANSVKELT

SEQ ID NO: 165198 - protein, 8 aa, Borrelia burgdorferi B31
NSVKELTS

SEQ ID NO: 165199 - protein, 8 aa, Borrelia burgdorferi B31
SVKELTSP

SEQ ID NO: 165200 - protein, 8 aa, Borrelia burgdorferi B31
VKELTSPV

SEQ ID NO: 165201 - protein, 8 aa, Borrelia burgdorferi B31
KELTSPVV

SEQ ID NO: 165202 - protein, 8 aa, Borrelia burgdorferi B31
ELTSPVVA

SEQ ID NO: 165203 - protein, 8 aa, Borrelia burgdorferi B31
LTSPVVAE

SEQ ID NO: 165204 - protein, 8 aa, Borrelia burgdorferi B31
TSPVVAES

SEQ ID NO: 165205 - protein, 8 aa, Borrelia burgdorferi B31
SPVVAESP

SEQ ID NO: 165206 - protein, 8 aa, Borrelia burgdorferi B31
PVVAESPK

SEQ ID NO: 165207 - protein, 8 aa, Borrelia burgdorferi B31
VVAESPKK

SEQ ID NO: 165208 - protein, 8 aa, Borrelia burgdorferi B31
VAESPKKP

SEQ ID NO: 165209 - protein, 9 aa, Borrelia burgdorferi B31
MKKNTLSAI

SEQ ID NO: 165210 - protein, 9 aa, Borrelia burgdorferi B31
KKNTLSAIL

SEQ ID NO: 165211 - protein, 9 aa, Borrelia burgdorferi B31
KNTLSAILM

SEQ ID NO: 165212 - protein, 9 aa, Borrelia burgdorferi B31
NTLSAILMT

SEQ ID NO: 165213 - protein, 9 aa, Borrelia burgdorferi B31
TLSAILMTL

SEQ ID NO: 165214 - protein, 9 aa, Borrelia burgdorferi B31
LSAILMTLF

SEQ ID NO: 165215 - protein, 9 aa, Borrelia burgdorferi B31
SAILMTLFL

SEQ ID NO: 165216 - protein, 9 aa, Borrelia burgdorferi B31
AILMTLFLF

SEQ ID NO: 165217 - protein, 9 aa, Borrelia burgdorferi B31
ILMTLFLFI

SEQ ID NO: 165218 - protein, 9 aa, Borrelia burgdorferi B31
LMTLFLFIS

SEQ ID NO: 165219 - protein, 9 aa, Borrelia burgdorferi B31
MTLFLFISC

SEQ ID NO: 165220 - protein, 9 aa, Borrelia burgdorferi B31
TLFLFISCN

SEQ ID NO: 165221 - protein, 9 aa, Borrelia burgdorferi B31
LFLFISCNN

SEQ ID NO: 165222 - protein, 9 aa, Borrelia burgdorferi B31
FLFISCNNS

SEQ ID NO: 165223 - protein, 9 aa, Borrelia burgdorferi B31
LFISCNNSG

SEQ ID NO: 165224 - protein, 9 aa, Borrelia burgdorferi B31
FISCNNSGK

SEQ ID NO: 165225 - protein, 9 aa, Borrelia burgdorferi B31
ISCNNSGKD

SEQ ID NO: 165226 - protein, 9 aa, Borrelia burgdorferi B31
SCNNSGKDG

SEQ ID NO: 165227 - protein, 9 aa, Borrelia burgdorferi B31
CNNSGKDGN

SEQ ID NO: 165228 - protein, 9 aa, Borrelia burgdorferi B31
NNSGKDGNT

SEQ ID NO: 165229 - protein, 9 aa, Borrelia burgdorferi B31
NSGKDGNTS

SEQ ID NO: 165230 - protein, 9 aa, Borrelia burgdorferi B31
SGKDGNTSA

SEQ ID NO: 165231 - protein, 9 aa, Borrelia burgdorferi B31
GKDGNTSAN

SEQ ID NO: 165232 - protein, 9 aa, Borrelia burgdorferi B31
KDGNTSANS

SEQ ID NO: 165233 - protein, 9 aa, Borrelia burgdorferi B31
DGNTSANSA

SEQ ID NO: 165234 - protein, 9 aa, Borrelia burgdorferi B31
GNTSANSAD

SEQ ID NO: 165235 - protein, 9 aa, Borrelia burgdorferi B31
NTSANSADE

SEQ ID NO: 165236 - protein, 9 aa, Borrelia burgdorferi B31
TSANSADES

SEQ ID NO: 165237 - protein, 9 aa, Borrelia burgdorferi B31
SANSADESV

SEQ ID NO: 165238 - protein, 9 aa, Borrelia burgdorferi B31
ANSADESVK

SEQ ID NO: 165239 - protein, 9 aa, Borrelia burgdorferi B31
NSADESVKG

SEQ ID NO: 165240 - protein, 9 aa, Borrelia burgdorferi B31
SADESVKGP

SEQ ID NO: 165241 - protein, 9 aa, Borrelia burgdorferi B31
ADESVKGPN

SEQ ID NO: 165242 - protein, 9 aa, Borrelia burgdorferi B31
DESVKGPNL

SEQ ID NO: 165243 - protein, 9 aa, Borrelia burgdorferi B31
ESVKGPNLT

SEQ ID NO: 165244 - protein, 9 aa, Borrelia burgdorferi B31
SVKGPNLTE

SEQ ID NO: 165245 - protein, 9 aa, Borrelia burgdorferi B31
VKGPNLTEI

SEQ ID NO: 165246 - protein, 9 aa, Borrelia burgdorferi B31
KGPNLTEIS

SEQ ID NO: 165247 - protein, 9 aa, Borrelia burgdorferi B31
GPNLTEISK

SEQ ID NO: 165248 - protein, 9 aa, Borrelia burgdorferi B31
PNLTEISKK

SEQ ID NO: 165249 - protein, 9 aa, Borrelia burgdorferi B31
NLTEISKKI

SEQ ID NO: 165250 - protein, 9 aa, Borrelia burgdorferi B31
LTEISKKIT

SEQ ID NO: 165251 - protein, 9 aa, Borrelia burgdorferi B31
TEISKKITD

SEQ ID NO: 165252 - protein, 9 aa, Borrelia burgdorferi B31
EISKKITDS

SEQ ID NO: 165253 - protein, 9 aa, Borrelia burgdorferi B31
ISKKITDSN

SEQ ID NO: 165254 - protein, 9 aa, Borrelia burgdorferi B31
SKKITDSNA

SEQ ID NO: 165255 - protein, 9 aa, Borrelia burgdorferi B31
KKITDSNAV

SEQ ID NO: 165256 - protein, 9 aa, Borrelia burgdorferi B31
KITDSNAVL

SEQ ID NO: 165257 - protein, 9 aa, Borrelia burgdorferi B31
ITDSNAVLL

SEQ ID NO: 165258 - protein, 9 aa, Borrelia burgdorferi B31
TDSNAVLLA

SEQ ID NO: 165259 - protein, 9 aa, Borrelia burgdorferi B31
DSNAVLLAV

SEQ ID NO: 165260 - protein, 9 aa, Borrelia burgdorferi B31
SNAVLLAVK

SEQ ID NO: 165261 - protein, 9 aa, Borrelia burgdorferi B31
NAVLLAVKE

SEQ ID NO: 165262 - protein, 9 aa, Borrelia burgdorferi B31
AVLLAVKEV

SEQ ID NO: 165263 - protein, 9 aa, Borrelia burgdorferi B31
VLLAVKEVE

SEQ ID NO: 165264 - protein, 9 aa, Borrelia burgdorferi B31
LLAVKEVEA

SEQ ID NO: 165265 - protein, 9 aa, Borrelia burgdorferi B31
LAVKEVEAL

SEQ ID NO: 165266 - protein, 9 aa, Borrelia burgdorferi B31
AVKEVEALL

SEQ ID NO: 165267 - protein, 9 aa, Borrelia burgdorferi B31
VKEVEALLS

SEQ ID NO: 165268 - protein, 9 aa, Borrelia burgdorferi B31
KEVEALLSS

SEQ ID NO: 165269 - protein, 9 aa, Borrelia burgdorferi B31
EVEALLSSI

SEQ ID NO: 165270 - protein, 9 aa, Borrelia burgdorferi B31
VEALLSSID

SEQ ID NO: 165271 - protein, 9 aa, Borrelia burgdorferi B31
EALLSSIDE

SEQ ID NO: 165272 - protein, 9 aa, Borrelia burgdorferi B31
ALLSSIDEI

SEQ ID NO: 165273 - protein, 9 aa, Borrelia burgdorferi B31
LLSSIDEIA

SEQ ID NO: 165274 - protein, 9 aa, Borrelia burgdorferi B31
LSSIDEIAA

SEQ ID NO: 165275 - protein, 9 aa, Borrelia burgdorferi B31
SSIDEIAAK

SEQ ID NO: 165276 - protein, 9 aa, Borrelia burgdorferi B31
SIDEIAAKA

SEQ ID NO: 165277 - protein, 9 aa, Borrelia burgdorferi B31
IDEIAAKAI

SEQ ID NO: 165278 - protein, 9 aa, Borrelia burgdorferi B31
DEIAAKAIG

SEQ ID NO: 165279 - protein, 9 aa, Borrelia burgdorferi B31
EIAAKAIGK

SEQ ID NO: 165280 - protein, 9 aa, Borrelia burgdorferi B31
IAAKAIGKK

SEQ ID NO: 165281 - protein, 9 aa, Borrelia burgdorferi B31
AAKAIGKKI

SEQ ID NO: 165282 - protein, 9 aa, Borrelia burgdorferi B31
AKAIGKKIH

SEQ ID NO: 165283 - protein, 9 aa, Borrelia burgdorferi B31
KAIGKKIHQ

SEQ ID NO: 165284 - protein, 9 aa, Borrelia burgdorferi B31
AIGKKIHQN

SEQ ID NO: 165285 - protein, 9 aa, Borrelia burgdorferi B31
IGKKIHQNN

SEQ ID NO: 165286 - protein, 9 aa, Borrelia burgdorferi B31
GKKIHQNNG

SEQ ID NO: 165287 - protein, 9 aa, Borrelia burgdorferi B31
KKIHQNNGL

SEQ ID NO: 165288 - protein, 9 aa, Borrelia burgdorferi B31
KIHQNNGLD

SEQ ID NO: 165289 - protein, 9 aa, Borrelia burgdorferi B31
IHQNNGLDT

SEQ ID NO: 165290 - protein, 9 aa, Borrelia burgdorferi B31
HQNNGLDTE

SEQ ID NO: 165291 - protein, 9 aa, Borrelia burgdorferi B31
QNNGLDTEN

SEQ ID NO: 165292 - protein, 9 aa, Borrelia burgdorferi B31
NNGLDTENN

SEQ ID NO: 165293 - protein, 9 aa, Borrelia burgdorferi B31
NGLDTENNH

SEQ ID NO: 165294 - protein, 9 aa, Borrelia burgdorferi B31
GLDTENNHN

SEQ ID NO: 165295 - protein, 9 aa, Borrelia burgdorferi B31
LDTENNHNG

SEQ ID NO: 165296 - protein, 9 aa, Borrelia burgdorferi B31
DTENNHNGS

SEQ ID NO: 165297 - protein, 9 aa, Borrelia burgdorferi B31
TENNHNGSL

SEQ ID NO: 165298 - protein, 9 aa, Borrelia burgdorferi B31
ENNHNGSLL

SEQ ID NO: 165299 - protein, 9 aa, Borrelia burgdorferi B31
NNHNGSLLA

SEQ ID NO: 165300 - protein, 9 aa, Borrelia burgdorferi B31
NHNGSLLAG

SEQ ID NO: 165301 - protein, 9 aa, Borrelia burgdorferi B31
HNGSLLAGA

SEQ ID NO: 165302 - protein, 9 aa, Borrelia burgdorferi B31
NGSLLAGAY

SEQ ID NO: 165303 - protein, 9 aa, Borrelia burgdorferi B31
GSLLAGAYA

SEQ ID NO: 165304 - protein, 9 aa, Borrelia burgdorferi B31
SLLAGAYAI

SEQ ID NO: 165305 - protein, 9 aa, Borrelia burgdorferi B31
LLAGAYAIS

SEQ ID NO: 165306 - protein, 9 aa, Borrelia burgdorferi B31
LAGAYAIST

SEQ ID NO: 165307 - protein, 9 aa, Borrelia burgdorferi B31
AGAYAISTL

SEQ ID NO: 165308 - protein, 9 aa, Borrelia burgdorferi B31
GAYAISTLI

SEQ ID NO: 165309 - protein, 9 aa, Borrelia burgdorferi B31
AYAISTLIK

SEQ ID NO: 165310 - protein, 9 aa, Borrelia burgdorferi B31
YAISTLIKQ

SEQ ID NO: 165311 - protein, 9 aa, Borrelia burgdorferi B31
AISTLIKQK

SEQ ID NO: 165312 - protein, 9 aa, Borrelia burgdorferi B31
ISTLIKQKL

SEQ ID NO: 165313 - protein, 9 aa, Borrelia burgdorferi B31
STLIKQKLD

SEQ ID NO: 165314 - protein, 9 aa, Borrelia burgdorferi B31
TLIKQKLDG

SEQ ID NO: 165315 - protein, 9 aa, Borrelia burgdorferi B31
LIKQKLDGL

SEQ ID NO: 165316 - protein, 9 aa, Borrelia burgdorferi B31
IKQKLDGLK

SEQ ID NO: 165317 - protein, 9 aa, Borrelia burgdorferi B31
KQKLDGLKN

SEQ ID NO: 165318 - protein, 9 aa, Borrelia burgdorferi B31
QKLDGLKNE

SEQ ID NO: 165319 - protein, 9 aa, Borrelia burgdorferi B31
KLDGLKNEG

SEQ ID NO: 165320 - protein, 9 aa, Borrelia burgdorferi B31
LDGLKNEGL

SEQ ID NO: 165321 - protein, 9 aa, Borrelia burgdorferi B31
DGLKNEGLK

SEQ ID NO: 165322 - protein, 9 aa, Borrelia burgdorferi B31
GLKNEGLKE

SEQ ID NO: 165323 - protein, 9 aa, Borrelia burgdorferi B31
LKNEGLKEK

SEQ ID NO: 165324 - protein, 9 aa, Borrelia burgdorferi B31
KNEGLKEKI

SEQ ID NO: 165325 - protein, 9 aa, Borrelia burgdorferi B31
NEGLKEKID

SEQ ID NO: 165326 - protein, 9 aa, Borrelia burgdorferi B31
EGLKEKIDA

SEQ ID NO: 165327 - protein, 9 aa, Borrelia burgdorferi B31
GLKEKIDAA

SEQ ID NO: 165328 - protein, 9 aa, Borrelia burgdorferi B31
LKEKIDAAK

SEQ ID NO: 165329 - protein, 9 aa, Borrelia burgdorferi B31
KEKIDAAKK

SEQ ID NO: 165330 - protein, 9 aa, Borrelia burgdorferi B31
EKIDAAKKC

SEQ ID NO: 165331 - protein, 9 aa, Borrelia burgdorferi B31
KIDAAKKCS

SEQ ID NO: 165332 - protein, 9 aa, Borrelia burgdorferi B31
IDAAKKCSE

SEQ ID NO: 165333 - protein, 9 aa, Borrelia burgdorferi B31
DAAKKCSET

SEQ ID NO: 165334 - protein, 9 aa, Borrelia burgdorferi B31
AAKKCSETF

SEQ ID NO: 165335 - protein, 9 aa, Borrelia burgdorferi B31
AKKCSETFT

SEQ ID NO: 165336 - protein, 9 aa, Borrelia burgdorferi B31
KKCSETFTN

SEQ ID NO: 165337 - protein, 9 aa, Borrelia burgdorferi B31
KCSETFTNK

SEQ ID NO: 165338 - protein, 9 aa, Borrelia burgdorferi B31
CSETFTNKL

SEQ ID NO: 165339 - protein, 9 aa, Borrelia burgdorferi B31
SETFTNKLK

SEQ ID NO: 165340 - protein, 9 aa, Borrelia burgdorferi B31
ETFTNKLKE

SEQ ID NO: 165341 - protein, 9 aa, Borrelia burgdorferi B31
TFTNKLKEK

SEQ ID NO: 165342 - protein, 9 aa, Borrelia burgdorferi B31
FTNKLKEKH

SEQ ID NO: 165343 - protein, 9 aa, Borrelia burgdorferi B31
TNKLKEKHT

SEQ ID NO: 165344 - protein, 9 aa, Borrelia burgdorferi B31
NKLKEKHTD

SEQ ID NO: 165345 - protein, 9 aa, Borrelia burgdorferi B31
KLKEKHTDL

SEQ ID NO: 165346 - protein, 9 aa, Borrelia burgdorferi B31
LKEKHTDLG

SEQ ID NO: 165347 - protein, 9 aa, Borrelia burgdorferi B31
KEKHTDLGK

SEQ ID NO: 165348 - protein, 9 aa, Borrelia burgdorferi B31
EKHTDLGKE

SEQ ID NO: 165349 - protein, 9 aa, Borrelia burgdorferi B31
KHTDLGKEG

SEQ ID NO: 165350 - protein, 9 aa, Borrelia burgdorferi B31
HTDLGKEGV

SEQ ID NO: 165351 - protein, 9 aa, Borrelia burgdorferi B31
TDLGKEGVT

SEQ ID NO: 165352 - protein, 9 aa, Borrelia burgdorferi B31
DLGKEGVTD

SEQ ID NO: 165353 - protein, 9 aa, Borrelia burgdorferi B31
LGKEGVTDA

SEQ ID NO: 165354 - protein, 9 aa, Borrelia burgdorferi B31
GKEGVTDAD

SEQ ID NO: 165355 - protein, 9 aa, Borrelia burgdorferi B31
KEGVTDADA

SEQ ID NO: 165356 - protein, 9 aa, Borrelia burgdorferi B31
EGVTDADAK

SEQ ID NO: 165357 - protein, 9 aa, Borrelia burgdorferi B31
GVTDADAKE

SEQ ID NO: 165358 - protein, 9 aa, Borrelia burgdorferi B31
VTDADAKEA

SEQ ID NO: 165359 - protein, 9 aa, Borrelia burgdorferi B31
TDADAKEAI

SEQ ID NO: 165360 - protein, 9 aa, Borrelia burgdorferi B31
DADAKEAIL

SEQ ID NO: 165361 - protein, 9 aa, Borrelia burgdorferi B31
ADAKEAILK

SEQ ID NO: 165362 - protein, 9 aa, Borrelia burgdorferi B31
DAKEAILKT

SEQ ID NO: 165363 - protein, 9 aa, Borrelia burgdorferi B31
AKEAILKTN

SEQ ID NO: 165364 - protein, 9 aa, Borrelia burgdorferi B31
KEAILKTNG

SEQ ID NO: 165365 - protein, 9 aa, Borrelia burgdorferi B31
EAILKTNGT

SEQ ID NO: 165366 - protein, 9 aa, Borrelia burgdorferi B31
AILKTNGTK

SEQ ID NO: 165367 - protein, 9 aa, Borrelia burgdorferi B31
ILKTNGTKT

SEQ ID NO: 165368 - protein, 9 aa, Borrelia burgdorferi B31
LKTNGTKTK

SEQ ID NO: 165369 - protein, 9 aa, Borrelia burgdorferi B31
KTNGTKTKG

SEQ ID NO: 165370 - protein, 9 aa, Borrelia burgdorferi B31
TNGTKTKGA

SEQ ID NO: 165371 - protein, 9 aa, Borrelia burgdorferi B31
NGTKTKGAE

SEQ ID NO: 165372 - protein, 9 aa, Borrelia burgdorferi B31
GTKTKGAEE

SEQ ID NO: 165373 - protein, 9 aa, Borrelia burgdorferi B31
TKTKGAEEL

SEQ ID NO: 165374 - protein, 9 aa, Borrelia burgdorferi B31
KTKGAEELG

SEQ ID NO: 165375 - protein, 9 aa, Borrelia burgdorferi B31
TKGAEELGK

SEQ ID NO: 165376 - protein, 9 aa, Borrelia burgdorferi B31
KGAEELGKL

SEQ ID NO: 165377 - protein, 9 aa, Borrelia burgdorferi B31
GAEELGKLF

SEQ ID NO: 165378 - protein, 9 aa, Borrelia burgdorferi B31
AEELGKLFE

SEQ ID NO: 165379 - protein, 9 aa, Borrelia burgdorferi B31
EELGKLFES

SEQ ID NO: 165380 - protein, 9 aa, Borrelia burgdorferi B31
ELGKLFESV

SEQ ID NO: 165381 - protein, 9 aa, Borrelia burgdorferi B31
LGKLFESVE

SEQ ID NO: 165382 - protein, 9 aa, Borrelia burgdorferi B31
GKLFESVEV

SEQ ID NO: 165383 - protein, 9 aa, Borrelia burgdorferi B31
KLFESVEVL

SEQ ID NO: 165384 - protein, 9 aa, Borrelia burgdorferi B31
LFESVEVLS

SEQ ID NO: 165385 - protein, 9 aa, Borrelia burgdorferi B31
FESVEVLSK

SEQ ID NO: 165386 - protein, 9 aa, Borrelia burgdorferi B31
ESVEVLSKA

SEQ ID NO: 165387 - protein, 9 aa, Borrelia burgdorferi B31
SVEVLSKAA

SEQ ID NO: 165388 - protein, 9 aa, Borrelia burgdorferi B31
VEVLSKAAK

SEQ ID NO: 165389 - protein, 9 aa, Borrelia burgdorferi B31
EVLSKAAKE

SEQ ID NO: 165390 - protein, 9 aa, Borrelia burgdorferi B31
VLSKAAKEM

SEQ ID NO: 165391 - protein, 9 aa, Borrelia burgdorferi B31
LSKAAKEML

SEQ ID NO: 165392 - protein, 9 aa, Borrelia burgdorferi B31
SKAAKEMLA

SEQ ID NO: 165393 - protein, 9 aa, Borrelia burgdorferi B31
KAAKEMLAN

SEQ ID NO: 165394 - protein, 9 aa, Borrelia burgdorferi B31
AAKEMLANS

SEQ ID NO: 165395 - protein, 9 aa, Borrelia burgdorferi B31
AKEMLANSV

SEQ ID NO: 165396 - protein, 9 aa, Borrelia burgdorferi B31
KEMLANSVK

SEQ ID NO: 165397 - protein, 9 aa, Borrelia burgdorferi B31
EMLANSVKE

SEQ ID NO: 165398 - protein, 9 aa, Borrelia burgdorferi B31
MLANSVKEL

SEQ ID NO: 165399 - protein, 9 aa, Borrelia burgdorferi B31
LANSVKELT

SEQ ID NO: 165400 - protein, 9 aa, Borrelia burgdorferi B31
ANSVKELTS

SEQ ID NO: 165401 - protein, 9 aa, Borrelia burgdorferi B31
NSVKELTSP

SEQ ID NO: 165402 - protein, 9 aa, Borrelia burgdorferi B31
SVKELTSPV

SEQ ID NO: 165403 - protein, 9 aa, Borrelia burgdorferi B31
VKELTSPVV

SEQ ID NO: 165404 - protein, 9 aa, Borrelia burgdorferi B31
KELTSPVVA

SEQ ID NO: 165405 - protein, 9 aa, Borrelia burgdorferi B31
ELTSPVVAE

SEQ ID NO: 165406 - protein, 9 aa, Borrelia burgdorferi B31
LTSPVVAES

SEQ ID NO: 165407 - protein, 9 aa, Borrelia burgdorferi B31
TSPVVAESP

SEQ ID NO: 165408 - protein, 9 aa, Borrelia burgdorferi B31
SPVVAESPK

SEQ ID NO: 165409 - protein, 9 aa, Borrelia burgdorferi B31
PVVAESPKK

SEQ ID NO: 165410 - protein, 9 aa, Borrelia burgdorferi B31
VVAESPKKP

SEQ ID NO: 165411 - protein, 10 aa, Borrelia burgdorferi B31
MKKNTLSAIL

SEQ ID NO: 165412 - protein, 10 aa, Borrelia burgdorferi B31
KKNTLSAILM

SEQ ID NO: 165413 - protein, 10 aa, Borrelia burgdorferi B31
KNTLSAILMT

SEQ ID NO: 165414 - protein, 10 aa, Borrelia burgdorferi B31
NTLSAILMTL

SEQ ID NO: 165415 - protein, 10 aa, Borrelia burgdorferi B31
TLSAILMTLF

SEQ ID NO: 165416 - protein, 10 aa, Borrelia burgdorferi B31
LSAILMTLFL

SEQ ID NO: 165417 - protein, 10 aa, Borrelia burgdorferi B31
SAILMTLFLF

SEQ ID NO: 165418 - protein, 10 aa, Borrelia burgdorferi B31
AILMTLFLFI

SEQ ID NO: 165419 - protein, 10 aa, Borrelia burgdorferi B31
ILMTLFLFIS

SEQ ID NO: 165420 - protein, 10 aa, Borrelia burgdorferi B31
LMTLFLFISC

SEQ ID NO: 165421 - protein, 10 aa, Borrelia burgdorferi B31
MTLFLFISCN

SEQ ID NO: 165422 - protein, 10 aa, Borrelia burgdorferi B31
TLFLFISCNN

SEQ ID NO: 165423 - protein, 10 aa, Borrelia burgdorferi B31
LFLFISCNNS

SEQ ID NO: 165424 - protein, 10 aa, Borrelia burgdorferi B31
FLFISCNNSG

SEQ ID NO: 165425 - protein, 10 aa, Borrelia burgdorferi B31
LFISCNNSGK

SEQ ID NO: 165426 - protein, 10 aa, Borrelia burgdorferi B31
FISCNNSGKD

SEQ ID NO: 165427 - protein, 10 aa, Borrelia burgdorferi B31
ISCNNSGKDG

SEQ ID NO: 165428 - protein, 10 aa, Borrelia burgdorferi B31
SCNNSGKDGN

SEQ ID NO: 165429 - protein, 10 aa, Borrelia burgdorferi B31
CNNSGKDGNT

SEQ ID NO: 165430 - protein, 10 aa, Borrelia burgdorferi B31
NNSGKDGNTS

SEQ ID NO: 165431 - protein, 10 aa, Borrelia burgdorferi B31
NSGKDGNTSA

SEQ ID NO: 165432 - protein, 10 aa, Borrelia burgdorferi B31
SGKDGNTSAN

SEQ ID NO: 165433 - protein, 10 aa, Borrelia burgdorferi B31
GKDGNTSANS

SEQ ID NO: 165434 - protein, 10 aa, Borrelia burgdorferi B31
KDGNTSANSA

SEQ ID NO: 165435 - protein, 10 aa, Borrelia burgdorferi B31
DGNTSANSAD

SEQ ID NO: 165436 - protein, 10 aa, Borrelia burgdorferi B31
GNTSANSADE

SEQ ID NO: 165437 - protein, 10 aa, Borrelia burgdorferi B31
NTSANSADES

SEQ ID NO: 165438 - protein, 10 aa, Borrelia burgdorferi B31
TSANSADESV

SEQ ID NO: 165439 - protein, 10 aa, Borrelia burgdorferi B31
SANSADESVK

SEQ ID NO: 165440 - protein, 10 aa, Borrelia burgdorferi B31
ANSADESVKG

SEQ ID NO: 165441 - protein, 10 aa, Borrelia burgdorferi B31
NSADESVKGP

SEQ ID NO: 165442 - protein, 10 aa, Borrelia burgdorferi B31
SADESVKGPN

SEQ ID NO: 165443 - protein, 10 aa, Borrelia burgdorferi B31
ADESVKGPNL

SEQ ID NO: 165444 - protein, 10 aa, Borrelia burgdorferi B31
DESVKGPNLT

SEQ ID NO: 165445 - protein, 10 aa, Borrelia burgdorferi B31
ESVKGPNLTE

SEQ ID NO: 165446 - protein, 10 aa, Borrelia burgdorferi B31
SVKGPNLTEI

SEQ ID NO: 165447 - protein, 10 aa, Borrelia burgdorferi B31
VKGPNLTEIS

SEQ ID NO: 165448 - protein, 10 aa, Borrelia burgdorferi B31
KGPNLTEISK

SEQ ID NO: 165449 - protein, 10 aa, Borrelia burgdorferi B31
GPNLTEISKK

SEQ ID NO: 165450 - protein, 10 aa, Borrelia burgdorferi B31
PNLTEISKKI

SEQ ID NO: 165451 - protein, 10 aa, Borrelia burgdorferi B31
NLTEISKKIT

SEQ ID NO: 165452 - protein, 10 aa, Borrelia burgdorferi B31
LTEISKKITD

SEQ ID NO: 165453 - protein, 10 aa, Borrelia burgdorferi B31
TEISKKITDS

SEQ ID NO: 165454 - protein, 10 aa, Borrelia burgdorferi B31
EISKKITDSN

SEQ ID NO: 165455 - protein, 10 aa, Borrelia burgdorferi B31
ISKKITDSNA

SEQ ID NO: 165456 - protein, 10 aa, Borrelia burgdorferi B31
SKKITDSNAV

SEQ ID NO: 165457 - protein, 10 aa, Borrelia burgdorferi B31
KKITDSNAVL

SEQ ID NO: 165458 - protein, 10 aa, Borrelia burgdorferi B31
KITDSNAVLL

SEQ ID NO: 165459 - protein, 10 aa, Borrelia burgdorferi B31
ITDSNAVLLA

SEQ ID NO: 165460 - protein, 10 aa, Borrelia burgdorferi B31
TDSNAVLLAV

SEQ ID NO: 165461 - protein, 10 aa, Borrelia burgdorferi B31
DSNAVLLAVK

SEQ ID NO: 165462 - protein, 10 aa, Borrelia burgdorferi B31
SNAVLLAVKE

SEQ ID NO: 165463 - protein, 10 aa, Borrelia burgdorferi B31
NAVLLAVKEV

SEQ ID NO: 165464 - protein, 10 aa, Borrelia burgdorferi B31
AVLLAVKEVE

SEQ ID NO: 165465 - protein, 10 aa, Borrelia burgdorferi B31
VLLAVKEVEA

SEQ ID NO: 165466 - protein, 10 aa, Borrelia burgdorferi B31
LLAVKEVEAL

SEQ ID NO: 165467 - protein, 10 aa, Borrelia burgdorferi B31
LAVKEVEALL

SEQ ID NO: 165468 - protein, 10 aa, Borrelia burgdorferi B31
AVKEVEALLS

SEQ ID NO: 165469 - protein, 10 aa, Borrelia burgdorferi B31
VKEVEALLSS

SEQ ID NO: 165470 - protein, 10 aa, Borrelia burgdorferi B31
KEVEALLSSI

SEQ ID NO: 165471 - protein, 10 aa, Borrelia burgdorferi B31
EVEALLSSID

SEQ ID NO: 165472 - protein, 10 aa, Borrelia burgdorferi B31
VEALLSSIDE

SEQ ID NO: 165473 - protein, 10 aa, Borrelia burgdorferi B31
EALLSSIDEI

SEQ ID NO: 165474 - protein, 10 aa, Borrelia burgdorferi B31
ALLSSIDEIA

SEQ ID NO: 165475 - protein, 10 aa, Borrelia burgdorferi B31
LLSSIDEIAA

SEQ ID NO: 165476 - protein, 10 aa, Borrelia burgdorferi B31
LSSIDEIAAK

SEQ ID NO: 165477 - protein, 10 aa, Borrelia burgdorferi B31
SSIDEIAAKA

SEQ ID NO: 165478 - protein, 10 aa, Borrelia burgdorferi B31
SIDEIAAKAI

SEQ ID NO: 165479 - protein, 10 aa, Borrelia burgdorferi B31
IDEIAAKAIG

SEQ ID NO: 165480 - protein, 10 aa, Borrelia burgdorferi B31
DEIAAKAIGK

SEQ ID NO: 165481 - protein, 10 aa, Borrelia burgdorferi B31
EIAAKAIGKK

SEQ ID NO: 165482 - protein, 10 aa, Borrelia burgdorferi B31
IAAKAIGKKI

SEQ ID NO: 165483 - protein, 10 aa, Borrelia burgdorferi B31
AAKAIGKKIH

SEQ ID NO: 165484 - protein, 10 aa, Borrelia burgdorferi B31
AKAIGKKIHQ

SEQ ID NO: 165485 - protein, 10 aa, Borrelia burgdorferi B31
KAIGKKIHQN

SEQ ID NO: 165486 - protein, 10 aa, Borrelia burgdorferi B31
AIGKKIHQNN

SEQ ID NO: 165487 - protein, 10 aa, Borrelia burgdorferi B31
IGKKIHQNNG

SEQ ID NO: 165488 - protein, 10 aa, Borrelia burgdorferi B31
GKKIHQNNGL

SEQ ID NO: 165489 - protein, 10 aa, Borrelia burgdorferi B31
KKIHQNNGLD

SEQ ID NO: 165490 - protein, 10 aa, Borrelia burgdorferi B31
KIHQNNGLDT

SEQ ID NO: 165491 - protein, 10 aa, Borrelia burgdorferi B31
IHQNNGLDTE

SEQ ID NO: 165492 - protein, 10 aa, Borrelia burgdorferi B31
HQNNGLDTEN

SEQ ID NO: 165493 - protein, 10 aa, Borrelia burgdorferi B31
QNNGLDTENN

SEQ ID NO: 165494 - protein, 10 aa, Borrelia burgdorferi B31
NNGLDTENNH

SEQ ID NO: 165495 - protein, 10 aa, Borrelia burgdorferi B31
NGLDTENNHN

SEQ ID NO: 165496 - protein, 10 aa, Borrelia burgdorferi B31
GLDTENNHNG

SEQ ID NO: 165497 - protein, 10 aa, Borrelia burgdorferi B31
LDTENNHNGS

SEQ ID NO: 165498 - protein, 10 aa, Borrelia burgdorferi B31
DTENNHNGSL

SEQ ID NO: 165499 - protein, 10 aa, Borrelia burgdorferi B31
TENNHNGSLL

SEQ ID NO: 165500 - protein, 10 aa, Borrelia burgdorferi B31
ENNHNGSLLA

SEQ ID NO: 165501 - protein, 10 aa, Borrelia burgdorferi B31
NNHNGSLLAG

SEQ ID NO: 165502 - protein, 10 aa, Borrelia burgdorferi B31
NHNGSLLAGA

SEQ ID NO: 165503 - protein, 10 aa, Borrelia burgdorferi B31
HNGSLLAGAY

SEQ ID NO: 165504 - protein, 10 aa, Borrelia burgdorferi B31
NGSLLAGAYA

SEQ ID NO: 165505 - protein, 10 aa, Borrelia burgdorferi B31
GSLLAGAYAI

SEQ ID NO: 165506 - protein, 10 aa, Borrelia burgdorferi B31
SLLAGAYAIS

SEQ ID NO: 165507 - protein, 10 aa, Borrelia burgdorferi B31
LLAGAYAIST

SEQ ID NO: 165508 - protein, 10 aa, Borrelia burgdorferi B31
LAGAYAISTL

SEQ ID NO: 165509 - protein, 10 aa, Borrelia burgdorferi B31
AGAYAISTLI

SEQ ID NO: 165510 - protein, 10 aa, Borrelia burgdorferi B31
GAYAISTLIK

SEQ ID NO: 165511 - protein, 10 aa, Borrelia burgdorferi B31
AYAISTLIKQ

SEQ ID NO: 165512 - protein, 10 aa, Borrelia burgdorferi B31
YAISTLIKQK

SEQ ID NO: 165513 - protein, 10 aa, Borrelia burgdorferi B31
AISTLIKQKL

SEQ ID NO: 165514 - protein, 10 aa, Borrelia burgdorferi B31
ISTLIKQKLD

SEQ ID NO: 165515 - protein, 10 aa, Borrelia burgdorferi B31
STLIKQKLDG

SEQ ID NO: 165516 - protein, 10 aa, Borrelia burgdorferi B31
TLIKQKLDGL

SEQ ID NO: 165517 - protein, 10 aa, Borrelia burgdorferi B31
LIKQKLDGLK

SEQ ID NO: 165518 - protein, 10 aa, Borrelia burgdorferi B31
IKQKLDGLKN

SEQ ID NO: 165519 - protein, 10 aa, Borrelia burgdorferi B31
KQKLDGLKNE

SEQ ID NO: 165520 - protein, 10 aa, Borrelia burgdorferi B31
QKLDGLKNEG

SEQ ID NO: 165521 - protein, 10 aa, Borrelia burgdorferi B31
KLDGLKNEGL

SEQ ID NO: 165522 - protein, 10 aa, Borrelia burgdorferi B31
LDGLKNEGLK

SEQ ID NO: 165523 - protein, 10 aa, Borrelia burgdorferi B31
DGLKNEGLKE

SEQ ID NO: 165524 - protein, 10 aa, Borrelia burgdorferi B31
GLKNEGLKEK

SEQ ID NO: 165525 - protein, 10 aa, Borrelia burgdorferi B31
LKNEGLKEKI

SEQ ID NO: 165526 - protein, 10 aa, Borrelia burgdorferi B31
KNEGLKEKID

SEQ ID NO: 165527 - protein, 10 aa, Borrelia burgdorferi B31
NEGLKEKIDA

SEQ ID NO: 165528 - protein, 10 aa, Borrelia burgdorferi B31
EGLKEKIDAA

SEQ ID NO: 165529 - protein, 10 aa, Borrelia burgdorferi B31
GLKEKIDAAK

SEQ ID NO: 165530 - protein, 10 aa, Borrelia burgdorferi B31
LKEKIDAAKK

SEQ ID NO: 165531 - protein, 10 aa, Borrelia burgdorferi B31
KEKIDAAKKC

SEQ ID NO: 165532 - protein, 10 aa, Borrelia burgdorferi B31
EKIDAAKKCS

SEQ ID NO: 165533 - protein, 10 aa, Borrelia burgdorferi B31
KIDAAKKCSE

SEQ ID NO: 165534 - protein, 10 aa, Borrelia burgdorferi B31
IDAAKKCSET

SEQ ID NO: 165535 - protein, 10 aa, Borrelia burgdorferi B31
DAAKKCSETF

SEQ ID NO: 165536 - protein, 10 aa, Borrelia burgdorferi B31
AAKKCSETFT

SEQ ID NO: 165537 - protein, 10 aa, Borrelia burgdorferi B31
AKKCSETFTN

SEQ ID NO: 165538 - protein, 10 aa, Borrelia burgdorferi B31
KKCSETFTNK

SEQ ID NO: 165539 - protein, 10 aa, Borrelia burgdorferi B31
KCSETFTNKL

SEQ ID NO: 165540 - protein, 10 aa, Borrelia burgdorferi B31
CSETFTNKLK

SEQ ID NO: 165541 - protein, 10 aa, Borrelia burgdorferi B31
SETFTNKLKE

SEQ ID NO: 165542 - protein, 10 aa, Borrelia burgdorferi B31
ETFTNKLKEK

SEQ ID NO: 165543 - protein, 10 aa, Borrelia burgdorferi B31
TFTNKLKEKH

SEQ ID NO: 165544 - protein, 10 aa, Borrelia burgdorferi B31
FTNKLKEKHT

SEQ ID NO: 165545 - protein, 10 aa, Borrelia burgdorferi B31
TNKLKEKHTD

SEQ ID NO: 165546 - protein, 10 aa, Borrelia burgdorferi B31
NKLKEKHTDL

SEQ ID NO: 165547 - protein, 10 aa, Borrelia burgdorferi B31
KLKEKHTDLG

SEQ ID NO: 165548 - protein, 10 aa, Borrelia burgdorferi B31
LKEKHTDLGK

SEQ ID NO: 165549 - protein, 10 aa, Borrelia burgdorferi B31
KEKHTDLGKE

SEQ ID NO: 165550 - protein, 10 aa, Borrelia burgdorferi B31
EKHTDLGKEG

SEQ ID NO: 165551 - protein, 10 aa, Borrelia burgdorferi B31
KHTDLGKEGV

SEQ ID NO: 165552 - protein, 10 aa, Borrelia burgdorferi B31
HTDLGKEGVT

SEQ ID NO: 165553 - protein, 10 aa, Borrelia burgdorferi B31
TDLGKEGVTD

SEQ ID NO: 165554 - protein, 10 aa, Borrelia burgdorferi B31
DLGKEGVTDA

SEQ ID NO: 165555 - protein, 10 aa, Borrelia burgdorferi B31
LGKEGVTDAD

SEQ ID NO: 165556 - protein, 10 aa, Borrelia burgdorferi B31
GKEGVTDADA

SEQ ID NO: 165557 - protein, 10 aa, Borrelia burgdorferi B31
KEGVTDADAK

SEQ ID NO: 165558 - protein, 10 aa, Borrelia burgdorferi B31
EGVTDADAKE

SEQ ID NO: 165559 - protein, 10 aa, Borrelia burgdorferi B31
GVTDADAKEA

SEQ ID NO: 165560 - protein, 10 aa, Borrelia burgdorferi B31
VTDADAKEAI

SEQ ID NO: 165561 - protein, 10 aa, Borrelia burgdorferi B31
TDADAKEAIL

SEQ ID NO: 165562 - protein, 10 aa, Borrelia burgdorferi B31
DADAKEAILK

SEQ ID NO: 165563 - protein, 10 aa, Borrelia burgdorferi B31
ADAKEAILKT

SEQ ID NO: 165564 - protein, 10 aa, Borrelia burgdorferi B31
DAKEAILKTN

SEQ ID NO: 165565 - protein, 10 aa, Borrelia burgdorferi B31
AKEAILKTNG

SEQ ID NO: 165566 - protein, 10 aa, Borrelia burgdorferi B31
KEAILKTNGT

SEQ ID NO: 165567 - protein, 10 aa, Borrelia burgdorferi B31
EAILKTNGTK

SEQ ID NO: 165568 - protein, 10 aa, Borrelia burgdorferi B31
AILKTNGTKT

SEQ ID NO: 165569 - protein, 10 aa, Borrelia burgdorferi B31
ILKTNGTKTK

SEQ ID NO: 165570 - protein, 10 aa, Borrelia burgdorferi B31
LKTNGTKTKG

SEQ ID NO: 165571 - protein, 10 aa, Borrelia burgdorferi B31
KTNGTKTKGA

SEQ ID NO: 165572 - protein, 10 aa, Borrelia burgdorferi B31
TNGTKTKGAE

SEQ ID NO: 165573 - protein, 10 aa, Borrelia burgdorferi B31
NGTKTKGAEE

SEQ ID NO: 165574 - protein, 10 aa, Borrelia burgdorferi B31
GTKTKGAEEL

SEQ ID NO: 165575 - protein, 10 aa, Borrelia burgdorferi B31
TKTKGAEELG

SEQ ID NO: 165576 - protein, 10 aa, Borrelia burgdorferi B31
KTKGAEELGK

SEQ ID NO: 165577 - protein, 10 aa, Borrelia burgdorferi B31
TKGAEELGKL

SEQ ID NO: 165578 - protein, 10 aa, Borrelia burgdorferi B31
KGAEELGKLF

SEQ ID NO: 165579 - protein, 10 aa, Borrelia burgdorferi B31
GAEELGKLFE

SEQ ID NO: 165580 - protein, 10 aa, Borrelia burgdorferi B31
AEELGKLFES

SEQ ID NO: 165581 - protein, 10 aa, Borrelia burgdorferi B31
EELGKLFESV

SEQ ID NO: 165582 - protein, 10 aa, Borrelia burgdorferi B31
ELGKLFESVE

SEQ ID NO: 165583 - protein, 10 aa, Borrelia burgdorferi B31
LGKLFESVEV

SEQ ID NO: 165584 - protein, 10 aa, Borrelia burgdorferi B31
GKLFESVEVL

SEQ ID NO: 165585 - protein, 10 aa, Borrelia burgdorferi B31
KLFESVEVLS

SEQ ID NO: 165586 - protein, 10 aa, Borrelia burgdorferi B31
LFESVEVLSK

SEQ ID NO: 165587 - protein, 10 aa, Borrelia burgdorferi B31
FESVEVLSKA

SEQ ID NO: 165588 - protein, 10 aa, Borrelia burgdorferi B31
ESVEVLSKAA

SEQ ID NO: 165589 - protein, 10 aa, Borrelia burgdorferi B31
SVEVLSKAAK

SEQ ID NO: 165590 - protein, 10 aa, Borrelia burgdorferi B31
VEVLSKAAKE

SEQ ID NO: 165591 - protein, 10 aa, Borrelia burgdorferi B31
EVLSKAAKEM

SEQ ID NO: 165592 - protein, 10 aa, Borrelia burgdorferi B31
VLSKAAKEML

SEQ ID NO: 165593 - protein, 10 aa, Borrelia burgdorferi B31
LSKAAKEMLA

SEQ ID NO: 165594 - protein, 10 aa, Borrelia burgdorferi B31
SKAAKEMLAN

SEQ ID NO: 165595 - protein, 10 aa, Borrelia burgdorferi B31
KAAKEMLANS

SEQ ID NO: 165596 - protein, 10 aa, Borrelia burgdorferi B31
AAKEMLANSV

SEQ ID NO: 165597 - protein, 10 aa, Borrelia burgdorferi B31
AKEMLANSVK

SEQ ID NO: 165598 - protein, 10 aa, Borrelia burgdorferi B31
KEMLANSVKE

SEQ ID NO: 165599 - protein, 10 aa, Borrelia burgdorferi B31
EMLANSVKEL

SEQ ID NO: 165600 - protein, 10 aa, Borrelia burgdorferi B31
MLANSVKELT

SEQ ID NO: 165601 - protein, 10 aa, Borrelia burgdorferi B31
LANSVKELTS

SEQ ID NO: 165602 - protein, 10 aa, Borrelia burgdorferi B31
ANSVKELTSP

SEQ ID NO: 165603 - protein, 10 aa, Borrelia burgdorferi B31
NSVKELTSPV

SEQ ID NO: 165604 - protein, 10 aa, Borrelia burgdorferi B31
SVKELTSPVV

SEQ ID NO: 165605 - protein, 10 aa, Borrelia burgdorferi B31
VKELTSPVVA

SEQ ID NO: 165606 - protein, 10 aa, Borrelia burgdorferi B31
KELTSPVVAE

SEQ ID NO: 165607 - protein, 10 aa, Borrelia burgdorferi B31
ELTSPVVAES

SEQ ID NO: 165608 - protein, 10 aa, Borrelia burgdorferi B31
LTSPVVAESP

SEQ ID NO: 165609 - protein, 10 aa, Borrelia burgdorferi B31
TSPVVAESPK

SEQ ID NO: 165610 - protein, 10 aa, Borrelia burgdorferi B31
SPVVAESPKK

SEQ ID NO: 165611 - protein, 10 aa, Borrelia burgdorferi B31
PVVAESPKKP

SEQ ID NO: 165612 - protein, 11 aa, Borrelia burgdorferi B31
MKKNTLSAILM

SEQ ID NO: 165613 - protein, 11 aa, Borrelia burgdorferi B31
KKNTLSAILMT

SEQ ID NO: 165614 - protein, 11 aa, Borrelia burgdorferi B31
KNTLSAILMTL

SEQ ID NO: 165615 - protein, 11 aa, Borrelia burgdorferi B31
NTLSAILMTLF

SEQ ID NO: 165616 - protein, 11 aa, Borrelia burgdorferi B31
TLSAILMTLFL

SEQ ID NO: 165617 - protein, 11 aa, Borrelia burgdorferi B31
LSAILMTLFLF

SEQ ID NO: 165618 - protein, 11 aa, Borrelia burgdorferi B31
SAILMTLFLFI

SEQ ID NO: 165619 - protein, 11 aa, Borrelia burgdorferi B31
AILMTLFLFIS

SEQ ID NO: 165620 - protein, 11 aa, Borrelia burgdorferi B31
ILMTLFLFISC

SEQ ID NO: 165621 - protein, 11 aa, Borrelia burgdorferi B31
LMTLFLFISCN

SEQ ID NO: 165622 - protein, 11 aa, Borrelia burgdorferi B31
MTLFLFISCNN

SEQ ID NO: 165623 - protein, 11 aa, Borrelia burgdorferi B31
TLFLFISCNNS

SEQ ID NO: 165624 - protein, 11 aa, Borrelia burgdorferi B31
LFLFISCNNSG

SEQ ID NO: 165625 - protein, 11 aa, Borrelia burgdorferi B31
FLFISCNNSGK

SEQ ID NO: 165626 - protein, 11 aa, Borrelia burgdorferi B31
LFISCNNSGKD

SEQ ID NO: 165627 - protein, 11 aa, Borrelia burgdorferi B31
FISCNNSGKDG

SEQ ID NO: 165628 - protein, 11 aa, Borrelia burgdorferi B31
ISCNNSGKDGN

SEQ ID NO: 165629 - protein, 11 aa, Borrelia burgdorferi B31
SCNNSGKDGNT

SEQ ID NO: 165630 - protein, 11 aa, Borrelia burgdorferi B31
CNNSGKDGNTS

SEQ ID NO: 165631 - protein, 11 aa, Borrelia burgdorferi B31
NNSGKDGNTSA

SEQ ID NO: 165632 - protein, 11 aa, Borrelia burgdorferi B31
NSGKDGNTSAN

SEQ ID NO: 165633 - protein, 11 aa, Borrelia burgdorferi B31
SGKDGNTSANS

SEQ ID NO: 165634 - protein, 11 aa, Borrelia burgdorferi B31
GKDGNTSANSA

SEQ ID NO: 165635 - protein, 11 aa, Borrelia burgdorferi B31
KDGNTSANSAD

SEQ ID NO: 165636 - protein, 11 aa, Borrelia burgdorferi B31
DGNTSANSADE

SEQ ID NO: 165637 - protein, 11 aa, Borrelia burgdorferi B31
GNTSANSADES

SEQ ID NO: 165638 - protein, 11 aa, Borrelia burgdorferi B31
NTSANSADESV

SEQ ID NO: 165639 - protein, 11 aa, Borrelia burgdorferi B31
TSANSADESVK

SEQ ID NO: 165640 - protein, 11 aa, Borrelia burgdorferi B31
SANSADESVKG

SEQ ID NO: 165641 - protein, 11 aa, Borrelia burgdorferi B31
ANSADESVKGP

SEQ ID NO: 165642 - protein, 11 aa, Borrelia burgdorferi B31
NSADESVKGPN

SEQ ID NO: 165643 - protein, 11 aa, Borrelia burgdorferi B31
SADESVKGPNL

SEQ ID NO: 165644 - protein, 11 aa, Borrelia burgdorferi B31
ADESVKGPNLT

SEQ ID NO: 165645 - protein, 11 aa, Borrelia burgdorferi B31
DESVKGPNLTE

SEQ ID NO: 165646 - protein, 11 aa, Borrelia burgdorferi B31
ESVKGPNLTEI

SEQ ID NO: 165647 - protein, 11 aa, Borrelia burgdorferi B31
SVKGPNLTEIS

SEQ ID NO: 165648 - protein, 11 aa, Borrelia burgdorferi B31
VKGPNLTEISK

SEQ ID NO: 165649 - protein, 11 aa, Borrelia burgdorferi B31
KGPNLTEISKK

SEQ ID NO: 165650 - protein, 11 aa, Borrelia burgdorferi B31
GPNLTEISKKI

SEQ ID NO: 165651 - protein, 11 aa, Borrelia burgdorferi B31
PNLTEISKKIT

SEQ ID NO: 165652 - protein, 11 aa, Borrelia burgdorferi B31
NLTEISKKITD

SEQ ID NO: 165653 - protein, 11 aa, Borrelia burgdorferi B31
LTEISKKITDS

SEQ ID NO: 165654 - protein, 11 aa, Borrelia burgdorferi B31
TEISKKITDSN

SEQ ID NO: 165655 - protein, 11 aa, Borrelia burgdorferi B31
EISKKITDSNA

SEQ ID NO: 165656 - protein, 11 aa, Borrelia burgdorferi B31
ISKKITDSNAV

SEQ ID NO: 165657 - protein, 11 aa, Borrelia burgdorferi B31
SKKITDSNAVL

SEQ ID NO: 165658 - protein, 11 aa, Borrelia burgdorferi B31
KKITDSNAVLL

SEQ ID NO: 165659 - protein, 11 aa, Borrelia burgdorferi B31
KITDSNAVLLA

SEQ ID NO: 165660 - protein, 11 aa, Borrelia burgdorferi B31
ITDSNAVLLAV

SEQ ID NO: 165661 - protein, 11 aa, Borrelia burgdorferi B31
TDSNAVLLAVK

SEQ ID NO: 165662 - protein, 11 aa, Borrelia burgdorferi B31
DSNAVLLAVKE

SEQ ID NO: 165663 - protein, 11 aa, Borrelia burgdorferi B31
SNAVLLAVKEV

SEQ ID NO: 165664 - protein, 11 aa, Borrelia burgdorferi B31
NAVLLAVKEVE

SEQ ID NO: 165665 - protein, 11 aa, Borrelia burgdorferi B31
AVLLAVKEVEA

SEQ ID NO: 165666 - protein, 11 aa, Borrelia burgdorferi B31
VLLAVKEVEAL

SEQ ID NO: 165667 - protein, 11 aa, Borrelia burgdorferi B31
LLAVKEVEALL

SEQ ID NO: 165668 - protein, 11 aa, Borrelia burgdorferi B31
LAVKEVEALLS

SEQ ID NO: 165669 - protein, 11 aa, Borrelia burgdorferi B31
AVKEVEALLSS

SEQ ID NO: 165670 - protein, 11 aa, Borrelia burgdorferi B31
VKEVEALLSSI

SEQ ID NO: 165671 - protein, 11 aa, Borrelia burgdorferi B31
KEVEALLSSID

SEQ ID NO: 165672 - protein, 11 aa, Borrelia burgdorferi B31
EVEALLSSIDE

SEQ ID NO: 165673 - protein, 11 aa, Borrelia burgdorferi B31
VEALLSSIDEI

SEQ ID NO: 165674 - protein, 11 aa, Borrelia burgdorferi B31
EALLSSIDEIA

SEQ ID NO: 165675 - protein, 11 aa, Borrelia burgdorferi B31
ALLSSIDEIAA

SEQ ID NO: 165676 - protein, 11 aa, Borrelia burgdorferi B31
LLSSIDEIAAK

SEQ ID NO: 165677 - protein, 11 aa, Borrelia burgdorferi B31
LSSIDEIAAKA

SEQ ID NO: 165678 - protein, 11 aa, Borrelia burgdorferi B31
SSIDEIAAKAI

SEQ ID NO: 165679 - protein, 11 aa, Borrelia burgdorferi B31
SIDEIAAKAIG

SEQ ID NO: 165680 - protein, 11 aa, Borrelia burgdorferi B31
IDEIAAKAIGK

SEQ ID NO: 165681 - protein, 11 aa, Borrelia burgdorferi B31
DEIAAKAIGKK

SEQ ID NO: 165682 - protein, 11 aa, Borrelia burgdorferi B31
EIAAKAIGKKI

SEQ ID NO: 165683 - protein, 11 aa, Borrelia burgdorferi B31
IAAKAIGKKIH

SEQ ID NO: 165684 - protein, 11 aa, Borrelia burgdorferi B31
AAKAIGKKIHQ

SEQ ID NO: 165685 - protein, 11 aa, Borrelia burgdorferi B31
AKAIGKKIHQN

SEQ ID NO: 165686 - protein, 11 aa, Borrelia burgdorferi B31
KAIGKKIHQNN

SEQ ID NO: 165687 - protein, 11 aa, Borrelia burgdorferi B31
AIGKKIHQNNG

SEQ ID NO: 165688 - protein, 11 aa, Borrelia burgdorferi B31
IGKKIHQNNGL

SEQ ID NO: 165689 - protein, 11 aa, Borrelia burgdorferi B31
GKKIHQNNGLD

SEQ ID NO: 165690 - protein, 11 aa, Borrelia burgdorferi B31
KKIHQNNGLDT

SEQ ID NO: 165691 - protein, 11 aa, Borrelia burgdorferi B31
KIHQNNGLDTE

SEQ ID NO: 165692 - protein, 11 aa, Borrelia burgdorferi B31
IHQNNGLDTEN

SEQ ID NO: 165693 - protein, 11 aa, Borrelia burgdorferi B31
HQNNGLDTENN

SEQ ID NO: 165694 - protein, 11 aa, Borrelia burgdorferi B31
QNNGLDTENNH

SEQ ID NO: 165695 - protein, 11 aa, Borrelia burgdorferi B31
NNGLDTENNHN

SEQ ID NO: 165696 - protein, 11 aa, Borrelia burgdorferi B31
NGLDTENNHNG

SEQ ID NO: 165697 - protein, 11 aa, Borrelia burgdorferi B31
GLDTENNHNGS

SEQ ID NO: 165698 - protein, 11 aa, Borrelia burgdorferi B31
LDTENNHNGSL

SEQ ID NO: 165699 - protein, 11 aa, Borrelia burgdorferi B31
DTENNHNGSLL

SEQ ID NO: 165700 - protein, 11 aa, Borrelia burgdorferi B31
TENNHNGSLLA

SEQ ID NO: 165701 - protein, 11 aa, Borrelia burgdorferi B31
ENNHNGSLLAG

SEQ ID NO: 165702 - protein, 11 aa, Borrelia burgdorferi B31
NNHNGSLLAGA

SEQ ID NO: 165703 - protein, 11 aa, Borrelia burgdorferi B31
NHNGSLLAGAY

SEQ ID NO: 165704 - protein, 11 aa, Borrelia burgdorferi B31
HNGSLLAGAYA

SEQ ID NO: 165705 - protein, 11 aa, Borrelia burgdorferi B31
NGSLLAGAYAI

SEQ ID NO: 165706 - protein, 11 aa, Borrelia burgdorferi B31
GSLLAGAYAIS

SEQ ID NO: 165707 - protein, 11 aa, Borrelia burgdorferi B31
SLLAGAYAIST

SEQ ID NO: 165708 - protein, 11 aa, Borrelia burgdorferi B31
LLAGAYAISTL

SEQ ID NO: 165709 - protein, 11 aa, Borrelia burgdorferi B31
LAGAYAISTLI

SEQ ID NO: 165710 - protein, 11 aa, Borrelia burgdorferi B31
AGAYAISTLIK

SEQ ID NO: 165711 - protein, 11 aa, Borrelia burgdorferi B31
GAYAISTLIKQ

SEQ ID NO: 165712 - protein, 11 aa, Borrelia burgdorferi B31
AYAISTLIKQK

SEQ ID NO: 165713 - protein, 11 aa, Borrelia burgdorferi B31
YAISTLIKQKL

SEQ ID NO: 165714 - protein, 11 aa, Borrelia burgdorferi B31
AISTLIKQKLD

SEQ ID NO: 165715 - protein, 11 aa, Borrelia burgdorferi B31
ISTLIKQKLDG

SEQ ID NO: 165716 - protein, 11 aa, Borrelia burgdorferi B31
STLIKQKLDGL

SEQ ID NO: 165717 - protein, 11 aa, Borrelia burgdorferi B31
TLIKQKLDGLK

SEQ ID NO: 165718 - protein, 11 aa, Borrelia burgdorferi B31
LIKQKLDGLKN

SEQ ID NO: 165719 - protein, 11 aa, Borrelia burgdorferi B31
IKQKLDGLKNE

SEQ ID NO: 165720 - protein, 11 aa, Borrelia burgdorferi B31
KQKLDGLKNEG

SEQ ID NO: 165721 - protein, 11 aa, Borrelia burgdorferi B31
QKLDGLKNEGL

SEQ ID NO: 165722 - protein, 11 aa, Borrelia burgdorferi B31
KLDGLKNEGLK

SEQ ID NO: 165723 - protein, 11 aa, Borrelia burgdorferi B31
LDGLKNEGLKE

SEQ ID NO: 165724 - protein, 11 aa, Borrelia burgdorferi B31
DGLKNEGLKEK

SEQ ID NO: 165725 - protein, 11 aa, Borrelia burgdorferi B31
GLKNEGLKEKI

SEQ ID NO: 165726 - protein, 11 aa, Borrelia burgdorferi B31
LKNEGLKEKID

SEQ ID NO: 165727 - protein, 11 aa, Borrelia burgdorferi B31
KNEGLKEKIDA

SEQ ID NO: 165728 - protein, 11 aa, Borrelia burgdorferi B31
NEGLKEKIDAA

SEQ ID NO: 165729 - protein, 11 aa, Borrelia burgdorferi B31
EGLKEKIDAAK

SEQ ID NO: 165730 - protein, 11 aa, Borrelia burgdorferi B31
GLKEKIDAAKK

SEQ ID NO: 165731 - protein, 11 aa, Borrelia burgdorferi B31
LKEKIDAAKKC

SEQ ID NO: 165732 - protein, 11 aa, Borrelia burgdorferi B31
KEKIDAAKKCS

SEQ ID NO: 165733 - protein, 11 aa, Borrelia burgdorferi B31
EKIDAAKKCSE

SEQ ID NO: 165734 - protein, 11 aa, Borrelia burgdorferi B31
KIDAAKKCSET

SEQ ID NO: 165735 - protein, 11 aa, Borrelia burgdorferi B31
IDAAKKCSETF

SEQ ID NO: 165736 - protein, 11 aa, Borrelia burgdorferi B31
DAAKKCSETFT

SEQ ID NO: 165737 - protein, 11 aa, Borrelia burgdorferi B31
AAKKCSETFTN

SEQ ID NO: 165738 - protein, 11 aa, Borrelia burgdorferi B31
AKKCSETFTNK

SEQ ID NO: 165739 - protein, 11 aa, Borrelia burgdorferi B31
KKCSETFTNKL

SEQ ID NO: 165740 - protein, 11 aa, Borrelia burgdorferi B31
KCSETFTNKLK

SEQ ID NO: 165741 - protein, 11 aa, Borrelia burgdorferi B31
CSETFTNKLKE

SEQ ID NO: 165742 - protein, 11 aa, Borrelia burgdorferi B31
SETFTNKLKEK

SEQ ID NO: 165743 - protein, 11 aa, Borrelia burgdorferi B31
ETFTNKLKEKH

SEQ ID NO: 165744 - protein, 11 aa, Borrelia burgdorferi B31
TFTNKLKEKHT

SEQ ID NO: 165745 - protein, 11 aa, Borrelia burgdorferi B31
FTNKLKEKHTD

SEQ ID NO: 165746 - protein, 11 aa, Borrelia burgdorferi B31
TNKLKEKHTDL

SEQ ID NO: 165747 - protein, 11 aa, Borrelia burgdorferi B31
NKLKEKHTDLG

SEQ ID NO: 165748 - protein, 11 aa, Borrelia burgdorferi B31
KLKEKHTDLGK

SEQ ID NO: 165749 - protein, 11 aa, Borrelia burgdorferi B31
LKEKHTDLGKE

SEQ ID NO: 165750 - protein, 11 aa, Borrelia burgdorferi B31
KEKHTDLGKEG

SEQ ID NO: 165751 - protein, 11 aa, Borrelia burgdorferi B31
EKHTDLGKEGV

SEQ ID NO: 165752 - protein, 11 aa, Borrelia burgdorferi B31
KHTDLGKEGVT

SEQ ID NO: 165753 - protein, 11 aa, Borrelia burgdorferi B31
HTDLGKEGVTD

SEQ ID NO: 165754 - protein, 11 aa, Borrelia burgdorferi B31
TDLGKEGVTDA

SEQ ID NO: 165755 - protein, 11 aa, Borrelia burgdorferi B31
DLGKEGVTDAD

SEQ ID NO: 165756 - protein, 11 aa, Borrelia burgdorferi B31
LGKEGVTDADA

SEQ ID NO: 165757 - protein, 11 aa, Borrelia burgdorferi B31
GKEGVTDADAK

SEQ ID NO: 165758 - protein, 11 aa, Borrelia burgdorferi B31
KEGVTDADAKE

SEQ ID NO: 165759 - protein, 11 aa, Borrelia burgdorferi B31
EGVTDADAKEA

SEQ ID NO: 165760 - protein, 11 aa, Borrelia burgdorferi B31
GVTDADAKEAI

SEQ ID NO: 165761 - protein, 11 aa, Borrelia burgdorferi B31
VTDADAKEAIL

SEQ ID NO: 165762 - protein, 11 aa, Borrelia burgdorferi B31
TDADAKEAILK

SEQ ID NO: 165763 - protein, 11 aa, Borrelia burgdorferi B31
DADAKEAILKT

SEQ ID NO: 165764 - protein, 11 aa, Borrelia burgdorferi B31
ADAKEAILKTN

SEQ ID NO: 165765 - protein, 11 aa, Borrelia burgdorferi B31
DAKEAILKTNG

SEQ ID NO: 165766 - protein, 11 aa, Borrelia burgdorferi B31
AKEAILKTNGT

SEQ ID NO: 165767 - protein, 11 aa, Borrelia burgdorferi B31
KEAILKTNGTK

SEQ ID NO: 165768 - protein, 11 aa, Borrelia burgdorferi B31
EAILKTNGTKT

SEQ ID NO: 165769 - protein, 11 aa, Borrelia burgdorferi B31
AILKTNGTKTK

SEQ ID NO: 165770 - protein, 11 aa, Borrelia burgdorferi B31
ILKTNGTKTKG

SEQ ID NO: 165771 - protein, 11 aa, Borrelia burgdorferi B31
LKTNGTKTKGA

SEQ ID NO: 165772 - protein, 11 aa, Borrelia burgdorferi B31
KTNGTKTKGAE

SEQ ID NO: 165773 - protein, 11 aa, Borrelia burgdorferi B31
TNGTKTKGAEE

SEQ ID NO: 165774 - protein, 11 aa, Borrelia burgdorferi B31
NGTKTKGAEEL

SEQ ID NO: 165775 - protein, 11 aa, Borrelia burgdorferi B31
GTKTKGAEELG

SEQ ID NO: 165776 - protein, 11 aa, Borrelia burgdorferi B31
TKTKGAEELGK

SEQ ID NO: 165777 - protein, 11 aa, Borrelia burgdorferi B31
KTKGAEELGKL

SEQ ID NO: 165778 - protein, 11 aa, Borrelia burgdorferi B31
TKGAEELGKLF

SEQ ID NO: 165779 - protein, 11 aa, Borrelia burgdorferi B31
KGAEELGKLFE

SEQ ID NO: 165780 - protein, 11 aa, Borrelia burgdorferi B31
GAEELGKLFES

SEQ ID NO: 165781 - protein, 11 aa, Borrelia burgdorferi B31
AEELGKLFESV

SEQ ID NO: 165782 - protein, 11 aa, Borrelia burgdorferi B31
EELGKLFESVE

SEQ ID NO: 165783 - protein, 11 aa, Borrelia burgdorferi B31
ELGKLFESVEV

SEQ ID NO: 165784 - protein, 11 aa, Borrelia burgdorferi B31
LGKLFESVEVL

SEQ ID NO: 165785 - protein, 11 aa, Borrelia burgdorferi B31
GKLFESVEVLS

SEQ ID NO: 165786 - protein, 11 aa, Borrelia burgdorferi B31
KLFESVEVLSK

SEQ ID NO: 165787 - protein, 11 aa, Borrelia burgdorferi B31
LFESVEVLSKA

SEQ ID NO: 165788 - protein, 11 aa, Borrelia burgdorferi B31
FESVEVLSKAA

SEQ ID NO: 165789 - protein, 11 aa, Borrelia burgdorferi B31
ESVEVLSKAAK

SEQ ID NO: 165790 - protein, 11 aa, Borrelia burgdorferi B31
SVEVLSKAAKE

SEQ ID NO: 165791 - protein, 11 aa, Borrelia burgdorferi B31
VEVLSKAAKEM

SEQ ID NO: 165792 - protein, 11 aa, Borrelia burgdorferi B31
EVLSKAAKEML

SEQ ID NO: 165793 - protein, 11 aa, Borrelia burgdorferi B31
VLSKAAKEMLA

SEQ ID NO: 165794 - protein, 11 aa, Borrelia burgdorferi B31
LSKAAKEMLAN

SEQ ID NO: 165795 - protein, 11 aa, Borrelia burgdorferi B31
SKAAKEMLANS

SEQ ID NO: 165796 - protein, 11 aa, Borrelia burgdorferi B31
KAAKEMLANSV

SEQ ID NO: 165797 - protein, 11 aa, Borrelia burgdorferi B31
AAKEMLANSVK

SEQ ID NO: 165798 - protein, 11 aa, Borrelia burgdorferi B31
AKEMLANSVKE

SEQ ID NO: 165799 - protein, 11 aa, Borrelia burgdorferi B31
KEMLANSVKEL

SEQ ID NO: 165800 - protein, 11 aa, Borrelia burgdorferi B31
EMLANSVKELT

SEQ ID NO: 165801 - protein, 11 aa, Borrelia burgdorferi B31
MLANSVKELTS

SEQ ID NO: 165802 - protein, 11 aa, Borrelia burgdorferi B31
LANSVKELTSP

SEQ ID NO: 165803 - protein, 11 aa, Borrelia burgdorferi B31
ANSVKELTSPV

SEQ ID NO: 165804 - protein, 11 aa, Borrelia burgdorferi B31
NSVKELTSPVV

SEQ ID NO: 165805 - protein, 11 aa, Borrelia burgdorferi B31
SVKELTSPVVA

SEQ ID NO: 165806 - protein, 11 aa, Borrelia burgdorferi B31
VKELTSPVVAE

SEQ ID NO: 165807 - protein, 11 aa, Borrelia burgdorferi B31
KELTSPVVAES

SEQ ID NO: 165808 - protein, 11 aa, Borrelia burgdorferi B31
ELTSPVVAESP

SEQ ID NO: 165809 - protein, 11 aa, Borrelia burgdorferi B31
LTSPVVAESPK

SEQ ID NO: 165810 - protein, 11 aa, Borrelia burgdorferi B31
TSPVVAESPKK

SEQ ID NO: 165811 - protein, 11 aa, Borrelia burgdorferi B31
SPVVAESPKKP

SEQ ID NO: 165812 - protein, 13 aa, Borrelia burgdorferi B31
MKKNTLSAILMTL

SEQ ID NO: 165813 - protein, 13 aa, Borrelia burgdorferi B31
KKNTLSAILMTLF

SEQ ID NO: 165814 - protein, 13 aa, Borrelia burgdorferi B31
KNTLSAILMTLFL

SEQ ID NO: 165815 - protein, 13 aa, Borrelia burgdorferi B31
NTLSAILMTLFLF

SEQ ID NO: 165816 - protein, 13 aa, Borrelia burgdorferi B31
TLSAILMTLFLFI

SEQ ID NO: 165817 - protein, 13 aa, Borrelia burgdorferi B31
LSAILMTLFLFIS

SEQ ID NO: 165818 - protein, 13 aa, Borrelia burgdorferi B31
SAILMTLFLFISC

SEQ ID NO: 165819 - protein, 13 aa, Borrelia burgdorferi B31
AILMTLFLFISCN

SEQ ID NO: 165820 - protein, 13 aa, Borrelia burgdorferi B31
ILMTLFLFISCNN

SEQ ID NO: 165821 - protein, 13 aa, Borrelia burgdorferi B31
LMTLFLFISCNNS

SEQ ID NO: 165822 - protein, 13 aa, Borrelia burgdorferi B31
MTLFLFISCNNSG

SEQ ID NO: 165823 - protein, 13 aa, Borrelia burgdorferi B31
TLFLFISCNNSGK

SEQ ID NO: 165824 - protein, 13 aa, Borrelia burgdorferi B31
LFLFISCNNSGKD

SEQ ID NO: 165825 - protein, 13 aa, Borrelia burgdorferi B31
FLFISCNNSGKDG

SEQ ID NO: 165826 - protein, 13 aa, Borrelia burgdorferi B31
LFISCNNSGKDGN

SEQ ID NO: 165827 - protein, 13 aa, Borrelia burgdorferi B31
FISCNNSGKDGNT

SEQ ID NO: 165828 - protein, 13 aa, Borrelia burgdorferi B31
ISCNNSGKDGNTS

SEQ ID NO: 165829 - protein, 13 aa, Borrelia burgdorferi B31
SCNNSGKDGNTSA

SEQ ID NO: 165830 - protein, 13 aa, Borrelia burgdorferi B31
CNNSGKDGNTSAN

SEQ ID NO: 165831 - protein, 13 aa, Borrelia burgdorferi B31
NNSGKDGNTSANS

SEQ ID NO: 165832 - protein, 13 aa, Borrelia burgdorferi B31
NSGKDGNTSANSA

SEQ ID NO: 165833 - protein, 13 aa, Borrelia burgdorferi B31
SGKDGNTSANSAD

SEQ ID NO: 165834 - protein, 13 aa, Borrelia burgdorferi B31
GKDGNTSANSADE

SEQ ID NO: 165835 - protein, 13 aa, Borrelia burgdorferi B31
KDGNTSANSADES

SEQ ID NO: 165836 - protein, 13 aa, Borrelia burgdorferi B31
DGNTSANSADESV

SEQ ID NO: 165837 - protein, 13 aa, Borrelia burgdorferi B31
GNTSANSADESVK

SEQ ID NO: 165838 - protein, 13 aa, Borrelia burgdorferi B31
NTSANSADESVKG

SEQ ID NO: 165839 - protein, 13 aa, Borrelia burgdorferi B31
TSANSADESVKGP

SEQ ID NO: 165840 - protein, 13 aa, Borrelia burgdorferi B31
SANSADESVKGPN

SEQ ID NO: 165841 - protein, 13 aa, Borrelia burgdorferi B31
ANSADESVKGPNL

SEQ ID NO: 165842 - protein, 13 aa, Borrelia burgdorferi B31
NSADESVKGPNLT

SEQ ID NO: 165843 - protein, 13 aa, Borrelia burgdorferi B31
SADESVKGPNLTE

SEQ ID NO: 165844 - protein, 13 aa, Borrelia burgdorferi B31
ADESVKGPNLTEI

SEQ ID NO: 165845 - protein, 13 aa, Borrelia burgdorferi B31
DESVKGPNLTEIS

SEQ ID NO: 165846 - protein, 13 aa, Borrelia burgdorferi B31
ESVKGPNLTEISK

SEQ ID NO: 165847 - protein, 13 aa, Borrelia burgdorferi B31
SVKGPNLTEISKK

SEQ ID NO: 165848 - protein, 13 aa, Borrelia burgdorferi B31
VKGPNLTEISKKI

SEQ ID NO: 165849 - protein, 13 aa, Borrelia burgdorferi B31
KGPNLTEISKKIT

SEQ ID NO: 165850 - protein, 13 aa, Borrelia burgdorferi B31
GPNLTEISKKITD

SEQ ID NO: 165851 - protein, 13 aa, Borrelia burgdorferi B31
PNLTEISKKITDS

SEQ ID NO: 165852 - protein, 13 aa, Borrelia burgdorferi B31
NLTEISKKITDSN

SEQ ID NO: 165853 - protein, 13 aa, Borrelia burgdorferi B31
LTEISKKITDSNA

SEQ ID NO: 165854 - protein, 13 aa, Borrelia burgdorferi B31
TEISKKITDSNAV

SEQ ID NO: 165855 - protein, 13 aa, Borrelia burgdorferi B31
EISKKITDSNAVL

SEQ ID NO: 165856 - protein, 13 aa, Borrelia burgdorferi B31
ISKKITDSNAVLL

SEQ ID NO: 165857 - protein, 13 aa, Borrelia burgdorferi B31
SKKITDSNAVLLA

SEQ ID NO: 165858 - protein, 13 aa, Borrelia burgdorferi B31
KKITDSNAVLLAV

SEQ ID NO: 165859 - protein, 13 aa, Borrelia burgdorferi B31
KITDSNAVLLAVK

SEQ ID NO: 165860 - protein, 13 aa, Borrelia burgdorferi B31
ITDSNAVLLAVKE

SEQ ID NO: 165861 - protein, 13 aa, Borrelia burgdorferi B31
TDSNAVLLAVKEV

SEQ ID NO: 165862 - protein, 13 aa, Borrelia burgdorferi B31
DSNAVLLAVKEVE

SEQ ID NO: 165863 - protein, 13 aa, Borrelia burgdorferi B31
SNAVLLAVKEVEA

SEQ ID NO: 165864 - protein, 13 aa, Borrelia burgdorferi B31
NAVLLAVKEVEAL

SEQ ID NO: 165865 - protein, 13 aa, Borrelia burgdorferi B31
AVLLAVKEVEALL

SEQ ID NO: 165866 - protein, 13 aa, Borrelia burgdorferi B31
VLLAVKEVEALLS

SEQ ID NO: 165867 - protein, 13 aa, Borrelia burgdorferi B31
LLAVKEVEALLSS

SEQ ID NO: 165868 - protein, 13 aa, Borrelia burgdorferi B31
LAVKEVEALLSSI

SEQ ID NO: 165869 - protein, 13 aa, Borrelia burgdorferi B31
AVKEVEALLSSID

SEQ ID NO: 165870 - protein, 13 aa, Borrelia burgdorferi B31
VKEVEALLSSIDE

SEQ ID NO: 165871 - protein, 13 aa, Borrelia burgdorferi B31
KEVEALLSSIDEI

SEQ ID NO: 165872 - protein, 13 aa, Borrelia burgdorferi B31
EVEALLSSIDEIA

SEQ ID NO: 165873 - protein, 13 aa, Borrelia burgdorferi B31
VEALLSSIDEIAA

SEQ ID NO: 165874 - protein, 13 aa, Borrelia burgdorferi B31
EALLSSIDEIAAK

SEQ ID NO: 165875 - protein, 13 aa, Borrelia burgdorferi B31
ALLSSIDEIAAKA

SEQ ID NO: 165876 - protein, 13 aa, Borrelia burgdorferi B31
LLSSIDEIAAKAI

SEQ ID NO: 165877 - protein, 13 aa, Borrelia burgdorferi B31
LSSIDEIAAKAIG

SEQ ID NO: 165878 - protein, 13 aa, Borrelia burgdorferi B31
SSIDEIAAKAIGK

SEQ ID NO: 165879 - protein, 13 aa, Borrelia burgdorferi B31
SIDEIAAKAIGKK

SEQ ID NO: 165880 - protein, 13 aa, Borrelia burgdorferi B31
IDEIAAKAIGKKI

SEQ ID NO: 165881 - protein, 13 aa, Borrelia burgdorferi B31
DEIAAKAIGKKIH

SEQ ID NO: 165882 - protein, 13 aa, Borrelia burgdorferi B31
EIAAKAIGKKIHQ

SEQ ID NO: 165883 - protein, 13 aa, Borrelia burgdorferi B31
IAAKAIGKKIHQN

SEQ ID NO: 165884 - protein, 13 aa, Borrelia burgdorferi B31
AAKAIGKKIHQNN

SEQ ID NO: 165885 - protein, 13 aa, Borrelia burgdorferi B31
AKAIGKKIHQNNG

SEQ ID NO: 165886 - protein, 13 aa, Borrelia burgdorferi B31
KAIGKKIHQNNGL

SEQ ID NO: 165887 - protein, 13 aa, Borrelia burgdorferi B31
AIGKKIHQNNGLD

SEQ ID NO: 165888 - protein, 13 aa, Borrelia burgdorferi B31
IGKKIHQNNGLDT

SEQ ID NO: 165889 - protein, 13 aa, Borrelia burgdorferi B31
GKKIHQNNGLDTE

SEQ ID NO: 165890 - protein, 13 aa, Borrelia burgdorferi B31
KKIHQNNGLDTEN

SEQ ID NO: 165891 - protein, 13 aa, Borrelia burgdorferi B31
KIHQNNGLDTENN

SEQ ID NO: 165892 - protein, 13 aa, Borrelia burgdorferi B31
IHQNNGLDTENNH

SEQ ID NO: 165893 - protein, 13 aa, Borrelia burgdorferi B31
HQNNGLDTENNHN

SEQ ID NO: 165894 - protein, 13 aa, Borrelia burgdorferi B31
QNNGLDTENNHNG

SEQ ID NO: 165895 - protein, 13 aa, Borrelia burgdorferi B31
NNGLDTENNHNGS

SEQ ID NO: 165896 - protein, 13 aa, Borrelia burgdorferi B31
NGLDTENNHNGSL

SEQ ID NO: 165897 - protein, 13 aa, Borrelia burgdorferi B31
GLDTENNHNGSLL

SEQ ID NO: 165898 - protein, 13 aa, Borrelia burgdorferi B31
LDTENNHNGSLLA

SEQ ID NO: 165899 - protein, 13 aa, Borrelia burgdorferi B31
DTENNHNGSLLAG

SEQ ID NO: 165900 - protein, 13 aa, Borrelia burgdorferi B31
TENNHNGSLLAGA

SEQ ID NO: 165901 - protein, 13 aa, Borrelia burgdorferi B31
ENNHNGSLLAGAY

SEQ ID NO: 165902 - protein, 13 aa, Borrelia burgdorferi B31
NNHNGSLLAGAYA

SEQ ID NO: 165903 - protein, 13 aa, Borrelia burgdorferi B31
NHNGSLLAGAYAI

SEQ ID NO: 165904 - protein, 13 aa, Borrelia burgdorferi B31
HNGSLLAGAYAIS

SEQ ID NO: 165905 - protein, 13 aa, Borrelia burgdorferi B31
NGSLLAGAYAIST

SEQ ID NO: 165906 - protein, 13 aa, Borrelia burgdorferi B31
GSLLAGAYAISTL

SEQ ID NO: 165907 - protein, 13 aa, Borrelia burgdorferi B31
SLLAGAYAISTLI

SEQ ID NO: 165908 - protein, 13 aa, Borrelia burgdorferi B31
LLAGAYAISTLIK

SEQ ID NO: 165909 - protein, 13 aa, Borrelia burgdorferi B31
LAGAYAISTLIKQ

SEQ ID NO: 165910 - protein, 13 aa, Borrelia burgdorferi B31
AGAYAISTLIKQK

SEQ ID NO: 165911 - protein, 13 aa, Borrelia burgdorferi B31
GAYAISTLIKQKL

SEQ ID NO: 165912 - protein, 13 aa, Borrelia burgdorferi B31
AYAISTLIKQKLD

SEQ ID NO: 165913 - protein, 13 aa, Borrelia burgdorferi B31
YAISTLIKQKLDG

SEQ ID NO: 165914 - protein, 13 aa, Borrelia burgdorferi B31
AISTLIKQKLDGL

SEQ ID NO: 165915 - protein, 13 aa, Borrelia burgdorferi B31
ISTLIKQKLDGLK

SEQ ID NO: 165916 - protein, 13 aa, Borrelia burgdorferi B31
STLIKQKLDGLKN

SEQ ID NO: 165917 - protein, 13 aa, Borrelia burgdorferi B31
TLIKQKLDGLKNE

SEQ ID NO: 165918 - protein, 13 aa, Borrelia burgdorferi B31
LIKQKLDGLKNEG

SEQ ID NO: 165919 - protein, 13 aa, Borrelia burgdorferi B31
IKQKLDGLKNEGL

SEQ ID NO: 165920 - protein, 13 aa, Borrelia burgdorferi B31
KQKLDGLKNEGLK

SEQ ID NO: 165921 - protein, 13 aa, Borrelia burgdorferi B31
QKLDGLKNEGLKE

SEQ ID NO: 165922 - protein, 13 aa, Borrelia burgdorferi B31
KLDGLKNEGLKEK

SEQ ID NO: 165923 - protein, 13 aa, Borrelia burgdorferi B31
LDGLKNEGLKEKI

SEQ ID NO: 165924 - protein, 13 aa, Borrelia burgdorferi B31
DGLKNEGLKEKID

SEQ ID NO: 165925 - protein, 13 aa, Borrelia burgdorferi B31
GLKNEGLKEKIDA

SEQ ID NO: 165926 - protein, 13 aa, Borrelia burgdorferi B31
LKNEGLKEKIDAA

SEQ ID NO: 165927 - protein, 13 aa, Borrelia burgdorferi B31
KNEGLKEKIDAAK

SEQ ID NO: 165928 - protein, 13 aa, Borrelia burgdorferi B31
NEGLKEKIDAAKK

SEQ ID NO: 165929 - protein, 13 aa, Borrelia burgdorferi B31
EGLKEKIDAAKKC

SEQ ID NO: 165930 - protein, 13 aa, Borrelia burgdorferi B31
GLKEKIDAAKKCS

SEQ ID NO: 165931 - protein, 13 aa, Borrelia burgdorferi B31
LKEKIDAAKKCSE

SEQ ID NO: 165932 - protein, 13 aa, Borrelia burgdorferi B31
KEKIDAAKKCSET

SEQ ID NO: 165933 - protein, 13 aa, Borrelia burgdorferi B31
EKIDAAKKCSETF

SEQ ID NO: 165934 - protein, 13 aa, Borrelia burgdorferi B31
KIDAAKKCSETFT

SEQ ID NO: 165935 - protein, 13 aa, Borrelia burgdorferi B31
IDAAKKCSETFTN

SEQ ID NO: 165936 - protein, 13 aa, Borrelia burgdorferi B31
DAAKKCSETFTNK

SEQ ID NO: 165937 - protein, 13 aa, Borrelia burgdorferi B31
AAKKCSETFTNKL

SEQ ID NO: 165938 - protein, 13 aa, Borrelia burgdorferi B31
AKKCSETFTNKLK

SEQ ID NO: 165939 - protein, 13 aa, Borrelia burgdorferi B31
KKCSETFTNKLKE

SEQ ID NO: 165940 - protein, 13 aa, Borrelia burgdorferi B31
KCSETFTNKLKEK

SEQ ID NO: 165941 - protein, 13 aa, Borrelia burgdorferi B31
CSETFTNKLKEKH

SEQ ID NO: 165942 - protein, 13 aa, Borrelia burgdorferi B31
SETFTNKLKEKHT

SEQ ID NO: 165943 - protein, 13 aa, Borrelia burgdorferi B31
ETFTNKLKEKHTD

SEQ ID NO: 165944 - protein, 13 aa, Borrelia burgdorferi B31
TFTNKLKEKHTDL

SEQ ID NO: 165945 - protein, 13 aa, Borrelia burgdorferi B31
FTNKLKEKHTDLG

SEQ ID NO: 165946 - protein, 13 aa, Borrelia burgdorferi B31
TNKLKEKHTDLGK

SEQ ID NO: 165947 - protein, 13 aa, Borrelia burgdorferi B31
NKLKEKHTDLGKE

SEQ ID NO: 165948 - protein, 13 aa, Borrelia burgdorferi B31
KLKEKHTDLGKEG

SEQ ID NO: 165949 - protein, 13 aa, Borrelia burgdorferi B31
LKEKHTDLGKEGV

SEQ ID NO: 165950 - protein, 13 aa, Borrelia burgdorferi B31
KEKHTDLGKEGVT

SEQ ID NO: 165951 - protein, 13 aa, Borrelia burgdorferi B31
EKHTDLGKEGVTD

SEQ ID NO: 165952 - protein, 13 aa, Borrelia burgdorferi B31
KHTDLGKEGVTDA

SEQ ID NO: 165953 - protein, 13 aa, Borrelia burgdorferi B31
HTDLGKEGVTDAD

SEQ ID NO: 165954 - protein, 13 aa, Borrelia burgdorferi B31
TDLGKEGVTDADA

SEQ ID NO: 165955 - protein, 13 aa, Borrelia burgdorferi B31
DLGKEGVTDADAK

SEQ ID NO: 165956 - protein, 13 aa, Borrelia burgdorferi B31
LGKEGVTDADAKE

SEQ ID NO: 165957 - protein, 13 aa, Borrelia burgdorferi B31
GKEGVTDADAKEA

SEQ ID NO: 165958 - protein, 13 aa, Borrelia burgdorferi B31
KEGVTDADAKEAI

SEQ ID NO: 165959 - protein, 13 aa, Borrelia burgdorferi B31
EGVTDADAKEAIL

SEQ ID NO: 165960 - protein, 13 aa, Borrelia burgdorferi B31
GVTDADAKEAILK

SEQ ID NO: 165961 - protein, 13 aa, Borrelia burgdorferi B31
VTDADAKEAILKT

SEQ ID NO: 165962 - protein, 13 aa, Borrelia burgdorferi B31
TDADAKEAILKTN

SEQ ID NO: 165963 - protein, 13 aa, Borrelia burgdorferi B31
DADAKEAILKTNG

SEQ ID NO: 165964 - protein, 13 aa, Borrelia burgdorferi B31
ADAKEAILKTNGT

SEQ ID NO: 165965 - protein, 13 aa, Borrelia burgdorferi B31
DAKEAILKTNGTK

SEQ ID NO: 165966 - protein, 13 aa, Borrelia burgdorferi B31
AKEAILKTNGTKT

SEQ ID NO: 165967 - protein, 13 aa, Borrelia burgdorferi B31
KEAILKTNGTKTK

SEQ ID NO: 165968 - protein, 13 aa, Borrelia burgdorferi B31
EAILKTNGTKTKG

SEQ ID NO: 165969 - protein, 13 aa, Borrelia burgdorferi B31
AILKTNGTKTKGA

SEQ ID NO: 165970 - protein, 13 aa, Borrelia burgdorferi B31
ILKTNGTKTKGAE

SEQ ID NO: 165971 - protein, 13 aa, Borrelia burgdorferi B31
LKTNGTKTKGAEE

SEQ ID NO: 165972 - protein, 13 aa, Borrelia burgdorferi B31
KTNGTKTKGAEEL

SEQ ID NO: 165973 - protein, 13 aa, Borrelia burgdorferi B31
TNGTKTKGAEELG

SEQ ID NO: 165974 - protein, 13 aa, Borrelia burgdorferi B31
NGTKTKGAEELGK

SEQ ID NO: 165975 - protein, 13 aa, Borrelia burgdorferi B31
GTKTKGAEELGKL

SEQ ID NO: 165976 - protein, 13 aa, Borrelia burgdorferi B31
TKTKGAEELGKLF

SEQ ID NO: 165977 - protein, 13 aa, Borrelia burgdorferi B31
KTKGAEELGKLFE

SEQ ID NO: 165978 - protein, 13 aa, Borrelia burgdorferi B31
TKGAEELGKLFES

SEQ ID NO: 165979 - protein, 13 aa, Borrelia burgdorferi B31
KGAEELGKLFESV

SEQ ID NO: 165980 - protein, 13 aa, Borrelia burgdorferi B31
GAEELGKLFESVE

SEQ ID NO: 165981 - protein, 13 aa, Borrelia burgdorferi B31
AEELGKLFESVEV

SEQ ID NO: 165982 - protein, 13 aa, Borrelia burgdorferi B31
EELGKLFESVEVL

SEQ ID NO: 165983 - protein, 13 aa, Borrelia burgdorferi B31
ELGKLFESVEVLS

SEQ ID NO: 165984 - protein, 13 aa, Borrelia burgdorferi B31
LGKLFESVEVLSK

SEQ ID NO: 165985 - protein, 13 aa, Borrelia burgdorferi B31
GKLFESVEVLSKA

SEQ ID NO: 165986 - protein, 13 aa, Borrelia burgdorferi B31
KLFESVEVLSKAA

SEQ ID NO: 165987 - protein, 13 aa, Borrelia burgdorferi B31
LFESVEVLSKAAK

SEQ ID NO: 165988 - protein, 13 aa, Borrelia burgdorferi B31
FESVEVLSKAAKE

SEQ ID NO: 165989 - protein, 13 aa, Borrelia burgdorferi B31
ESVEVLSKAAKEM

SEQ ID NO: 165990 - protein, 13 aa, Borrelia burgdorferi B31
SVEVLSKAAKEML

SEQ ID NO: 165991 - protein, 13 aa, Borrelia burgdorferi B31
VEVLSKAAKEMLA

SEQ ID NO: 165992 - protein, 13 aa, Borrelia burgdorferi B31
EVLSKAAKEMLAN

SEQ ID NO: 165993 - protein, 13 aa, Borrelia burgdorferi B31
VLSKAAKEMLANS

SEQ ID NO: 165994 - protein, 13 aa, Borrelia burgdorferi B31
LSKAAKEMLANSV

SEQ ID NO: 165995 - protein, 13 aa, Borrelia burgdorferi B31
SKAAKEMLANSVK

SEQ ID NO: 165996 - protein, 13 aa, Borrelia burgdorferi B31
KAAKEMLANSVKE

SEQ ID NO: 165997 - protein, 13 aa, Borrelia burgdorferi B31
AAKEMLANSVKEL

SEQ ID NO: 165998 - protein, 13 aa, Borrelia burgdorferi B31
AKEMLANSVKELT

SEQ ID NO: 165999 - protein, 13 aa, Borrelia burgdorferi B31
KEMLANSVKELTS

SEQ ID NO: 166000 - protein, 13 aa, Borrelia burgdorferi B31
EMLANSVKELTSP

SEQ ID NO: 166001 - protein, 13 aa, Borrelia burgdorferi B31
MLANSVKELTSPV

SEQ ID NO: 166002 - protein, 13 aa, Borrelia burgdorferi B31
LANSVKELTSPVV

SEQ ID NO: 166003 - protein, 13 aa, Borrelia burgdorferi B31
ANSVKELTSPVVA

SEQ ID NO: 166004 - protein, 13 aa, Borrelia burgdorferi B31
NSVKELTSPVVAE

SEQ ID NO: 166005 - protein, 13 aa, Borrelia burgdorferi B31
SVKELTSPVVAES

SEQ ID NO: 166006 - protein, 13 aa, Borrelia burgdorferi B31
VKELTSPVVAESP

SEQ ID NO: 166007 - protein, 13 aa, Borrelia burgdorferi B31
KELTSPVVAESPK

SEQ ID NO: 166008 - protein, 13 aa, Borrelia burgdorferi B31
ELTSPVVAESPKK

SEQ ID NO: 166009 - protein, 13 aa, Borrelia burgdorferi B31
LTSPVVAESPKKP

SEQ ID NO: 166010 - protein, 14 aa, Borrelia burgdorferi B31
MKKNTLSAILMTLF

SEQ ID NO: 166011 - protein, 14 aa, Borrelia burgdorferi B31
KKNTLSAILMTLFL

SEQ ID NO: 166012 - protein, 14 aa, Borrelia burgdorferi B31
KNTLSAILMTLFLF

SEQ ID NO: 166013 - protein, 14 aa, Borrelia burgdorferi B31
NTLSAILMTLFLFI

SEQ ID NO: 166014 - protein, 14 aa, Borrelia burgdorferi B31
TLSAILMTLFLFIS

SEQ ID NO: 166015 - protein, 14 aa, Borrelia burgdorferi B31
LSAILMTLFLFISC

SEQ ID NO: 166016 - protein, 14 aa, Borrelia burgdorferi B31
SAILMTLFLFISCN

SEQ ID NO: 166017 - protein, 14 aa, Borrelia burgdorferi B31
AILMTLFLFISCNN

SEQ ID NO: 166018 - protein, 14 aa, Borrelia burgdorferi B31
ILMTLFLFISCNNS

SEQ ID NO: 166019 - protein, 14 aa, Borrelia burgdorferi B31
LMTLFLFISCNNSG

SEQ ID NO: 166020 - protein, 14 aa, Borrelia burgdorferi B31
MTLFLFISCNNSGK

SEQ ID NO: 166021 - protein, 14 aa, Borrelia burgdorferi B31
TLFLFISCNNSGKD

SEQ ID NO: 166022 - protein, 14 aa, Borrelia burgdorferi B31
LFLFISCNNSGKDG

SEQ ID NO: 166023 - protein, 14 aa, Borrelia burgdorferi B31
FLFISCNNSGKDGN

SEQ ID NO: 166024 - protein, 14 aa, Borrelia burgdorferi B31
LFISCNNSGKDGNT

SEQ ID NO: 166025 - protein, 14 aa, Borrelia burgdorferi B31
FISCNNSGKDGNTS

SEQ ID NO: 166026 - protein, 14 aa, Borrelia burgdorferi B31
ISCNNSGKDGNTSA

SEQ ID NO: 166027 - protein, 14 aa, Borrelia burgdorferi B31
SCNNSGKDGNTSAN

SEQ ID NO: 166028 - protein, 14 aa, Borrelia burgdorferi B31
CNNSGKDGNTSANS

SEQ ID NO: 166029 - protein, 14 aa, Borrelia burgdorferi B31
NNSGKDGNTSANSA

SEQ ID NO: 166030 - protein, 14 aa, Borrelia burgdorferi B31
NSGKDGNTSANSAD

SEQ ID NO: 166031 - protein, 14 aa, Borrelia burgdorferi B31
SGKDGNTSANSADE

SEQ ID NO: 166032 - protein, 14 aa, Borrelia burgdorferi B31
GKDGNTSANSADES

SEQ ID NO: 166033 - protein, 14 aa, Borrelia burgdorferi B31
KDGNTSANSADESV

SEQ ID NO: 166034 - protein, 14 aa, Borrelia burgdorferi B31
DGNTSANSADESVK

SEQ ID NO: 166035 - protein, 14 aa, Borrelia burgdorferi B31
GNTSANSADESVKG

SEQ ID NO: 166036 - protein, 14 aa, Borrelia burgdorferi B31
NTSANSADESVKGP

SEQ ID NO: 166037 - protein, 14 aa, Borrelia burgdorferi B31
TSANSADESVKGPN

SEQ ID NO: 166038 - protein, 14 aa, Borrelia burgdorferi B31
SANSADESVKGPNL

SEQ ID NO: 166039 - protein, 14 aa, Borrelia burgdorferi B31
ANSADESVKGPNLT

SEQ ID NO: 166040 - protein, 14 aa, Borrelia burgdorferi B31
NSADESVKGPNLTE

SEQ ID NO: 166041 - protein, 14 aa, Borrelia burgdorferi B31
SADESVKGPNLTEI

SEQ ID NO: 166042 - protein, 14 aa, Borrelia burgdorferi B31
ADESVKGPNLTEIS

SEQ ID NO: 166043 - protein, 14 aa, Borrelia burgdorferi B31
DESVKGPNLTEISK

SEQ ID NO: 166044 - protein, 14 aa, Borrelia burgdorferi B31
ESVKGPNLTEISKK

SEQ ID NO: 166045 - protein, 14 aa, Borrelia burgdorferi B31
SVKGPNLTEISKKI

SEQ ID NO: 166046 - protein, 14 aa, Borrelia burgdorferi B31
VKGPNLTEISKKIT

SEQ ID NO: 166047 - protein, 14 aa, Borrelia burgdorferi B31
KGPNLTEISKKITD

SEQ ID NO: 166048 - protein, 14 aa, Borrelia burgdorferi B31
GPNLTEISKKITDS

SEQ ID NO: 166049 - protein, 14 aa, Borrelia burgdorferi B31
PNLTEISKKITDSN

SEQ ID NO: 166050 - protein, 14 aa, Borrelia burgdorferi B31
NLTEISKKITDSNA

SEQ ID NO: 166051 - protein, 14 aa, Borrelia burgdorferi B31
LTEISKKITDSNAV

SEQ ID NO: 166052 - protein, 14 aa, Borrelia burgdorferi B31
TEISKKITDSNAVL

SEQ ID NO: 166053 - protein, 14 aa, Borrelia burgdorferi B31
EISKKITDSNAVLL

SEQ ID NO: 166054 - protein, 14 aa, Borrelia burgdorferi B31
ISKKITDSNAVLLA

SEQ ID NO: 166055 - protein, 14 aa, Borrelia burgdorferi B31
SKKITDSNAVLLAV

SEQ ID NO: 166056 - protein, 14 aa, Borrelia burgdorferi B31
KKITDSNAVLLAVK

SEQ ID NO: 166057 - protein, 14 aa, Borrelia burgdorferi B31
KITDSNAVLLAVKE

SEQ ID NO: 166058 - protein, 14 aa, Borrelia burgdorferi B31
ITDSNAVLLAVKEV

SEQ ID NO: 166059 - protein, 14 aa, Borrelia burgdorferi B31
TDSNAVLLAVKEVE

SEQ ID NO: 166060 - protein, 14 aa, Borrelia burgdorferi B31
DSNAVLLAVKEVEA

SEQ ID NO: 166061 - protein, 14 aa, Borrelia burgdorferi B31
SNAVLLAVKEVEAL

SEQ ID NO: 166062 - protein, 14 aa, Borrelia burgdorferi B31
NAVLLAVKEVEALL

SEQ ID NO: 166063 - protein, 14 aa, Borrelia burgdorferi B31
AVLLAVKEVEALLS

SEQ ID NO: 166064 - protein, 14 aa, Borrelia burgdorferi B31
VLLAVKEVEALLSS

SEQ ID NO: 166065 - protein, 14 aa, Borrelia burgdorferi B31
LLAVKEVEALLSSI

SEQ ID NO: 166066 - protein, 14 aa, Borrelia burgdorferi B31
LAVKEVEALLSSID

SEQ ID NO: 166067 - protein, 14 aa, Borrelia burgdorferi B31
AVKEVEALLSSIDE

SEQ ID NO: 166068 - protein, 14 aa, Borrelia burgdorferi B31
VKEVEALLSSIDEI

SEQ ID NO: 166069 - protein, 14 aa, Borrelia burgdorferi B31
KEVEALLSSIDEIA

SEQ ID NO: 166070 - protein, 14 aa, Borrelia burgdorferi B31
EVEALLSSIDEIAA

SEQ ID NO: 166071 - protein, 14 aa, Borrelia burgdorferi B31
VEALLSSIDEIAAK

SEQ ID NO: 166072 - protein, 14 aa, Borrelia burgdorferi B31
EALLSSIDEIAAKA

SEQ ID NO: 166073 - protein, 14 aa, Borrelia burgdorferi B31
ALLSSIDEIAAKAI

SEQ ID NO: 166074 - protein, 14 aa, Borrelia burgdorferi B31
LLSSIDEIAAKAIG

SEQ ID NO: 166075 - protein, 14 aa, Borrelia burgdorferi B31
LSSIDEIAAKAIGK

SEQ ID NO: 166076 - protein, 14 aa, Borrelia burgdorferi B31
SSIDEIAAKAIGKK

SEQ ID NO: 166077 - protein, 14 aa, Borrelia burgdorferi B31
SIDEIAAKAIGKKI

SEQ ID NO: 166078 - protein, 14 aa, Borrelia burgdorferi B31
IDEIAAKAIGKKIH

SEQ ID NO: 166079 - protein, 14 aa, Borrelia burgdorferi B31
DEIAAKAIGKKIHQ

SEQ ID NO: 166080 - protein, 14 aa, Borrelia burgdorferi B31
EIAAKAIGKKIHQN

SEQ ID NO: 166081 - protein, 14 aa, Borrelia burgdorferi B31
IAAKAIGKKIHQNN

SEQ ID NO: 166082 - protein, 14 aa, Borrelia burgdorferi B31
AAKAIGKKIHQNNG

SEQ ID NO: 166083 - protein, 14 aa, Borrelia burgdorferi B31
AKAIGKKIHQNNGL

SEQ ID NO: 166084 - protein, 14 aa, Borrelia burgdorferi B31
KAIGKKIHQNNGLD

SEQ ID NO: 166085 - protein, 14 aa, Borrelia burgdorferi B31
AIGKKIHQNNGLDT

SEQ ID NO: 166086 - protein, 14 aa, Borrelia burgdorferi B31
IGKKIHQNNGLDTE

SEQ ID NO: 166087 - protein, 14 aa, Borrelia burgdorferi B31
GKKIHQNNGLDTEN

SEQ ID NO: 166088 - protein, 14 aa, Borrelia burgdorferi B31
KKIHQNNGLDTENN

SEQ ID NO: 166089 - protein, 14 aa, Borrelia burgdorferi B31
KIHQNNGLDTENNH

SEQ ID NO: 166090 - protein, 14 aa, Borrelia burgdorferi B31
IHQNNGLDTENNHN

SEQ ID NO: 166091 - protein, 14 aa, Borrelia burgdorferi B31
HQNNGLDTENNHNG

SEQ ID NO: 166092 - protein, 14 aa, Borrelia burgdorferi B31
QNNGLDTENNHNGS

SEQ ID NO: 166093 - protein, 14 aa, Borrelia burgdorferi B31
NNGLDTENNHNGSL

SEQ ID NO: 166094 - protein, 14 aa, Borrelia burgdorferi B31
NGLDTENNHNGSLL

SEQ ID NO: 166095 - protein, 14 aa, Borrelia burgdorferi B31
GLDTENNHNGSLLA

SEQ ID NO: 166096 - protein, 14 aa, Borrelia burgdorferi B31
LDTENNHNGSLLAG

SEQ ID NO: 166097 - protein, 14 aa, Borrelia burgdorferi B31
DTENNHNGSLLAGA

SEQ ID NO: 166098 - protein, 14 aa, Borrelia burgdorferi B31
TENNHNGSLLAGAY

SEQ ID NO: 166099 - protein, 14 aa, Borrelia burgdorferi B31
ENNHNGSLLAGAYA

SEQ ID NO: 166100 - protein, 14 aa, Borrelia burgdorferi B31
NNHNGSLLAGAYAI

SEQ ID NO: 166101 - protein, 14 aa, Borrelia burgdorferi B31
NHNGSLLAGAYAIS

SEQ ID NO: 166102 - protein, 14 aa, Borrelia burgdorferi B31
HNGSLLAGAYAIST

SEQ ID NO: 166103 - protein, 14 aa, Borrelia burgdorferi B31
NGSLLAGAYAISTL

SEQ ID NO: 166104 - protein, 14 aa, Borrelia burgdorferi B31
GSLLAGAYAISTLI

SEQ ID NO: 166105 - protein, 14 aa, Borrelia burgdorferi B31
SLLAGAYAISTLIK

SEQ ID NO: 166106 - protein, 14 aa, Borrelia burgdorferi B31
LLAGAYAISTLIKQ

SEQ ID NO: 166107 - protein, 14 aa, Borrelia burgdorferi B31
LAGAYAISTLIKQK

SEQ ID NO: 166108 - protein, 14 aa, Borrelia burgdorferi B31
AGAYAISTLIKQKL

SEQ ID NO: 166109 - protein, 14 aa, Borrelia burgdorferi B31
GAYAISTLIKQKLD

SEQ ID NO: 166110 - protein, 14 aa, Borrelia burgdorferi B31
AYAISTLIKQKLDG

SEQ ID NO: 166111 - protein, 14 aa, Borrelia burgdorferi B31
YAISTLIKQKLDGL

SEQ ID NO: 166112 - protein, 14 aa, Borrelia burgdorferi B31
AISTLIKQKLDGLK

SEQ ID NO: 166113 - protein, 14 aa, Borrelia burgdorferi B31
ISTLIKQKLDGLKN

SEQ ID NO: 166114 - protein, 14 aa, Borrelia burgdorferi B31
STLIKQKLDGLKNE

SEQ ID NO: 166115 - protein, 14 aa, Borrelia burgdorferi B31
TLIKQKLDGLKNEG

SEQ ID NO: 166116 - protein, 14 aa, Borrelia burgdorferi B31
LIKQKLDGLKNEGL

SEQ ID NO: 166117 - protein, 14 aa, Borrelia burgdorferi B31
IKQKLDGLKNEGLK

SEQ ID NO: 166118 - protein, 14 aa, Borrelia burgdorferi B31
KQKLDGLKNEGLKE

SEQ ID NO: 166119 - protein, 14 aa, Borrelia burgdorferi B31
QKLDGLKNEGLKEK

SEQ ID NO: 166120 - protein, 14 aa, Borrelia burgdorferi B31
KLDGLKNEGLKEKI

SEQ ID NO: 166121 - protein, 14 aa, Borrelia burgdorferi B31
LDGLKNEGLKEKID

SEQ ID NO: 166122 - protein, 14 aa, Borrelia burgdorferi B31
DGLKNEGLKEKIDA

SEQ ID NO: 166123 - protein, 14 aa, Borrelia burgdorferi B31
GLKNEGLKEKIDAA

SEQ ID NO: 166124 - protein, 14 aa, Borrelia burgdorferi B31
LKNEGLKEKIDAAK

SEQ ID NO: 166125 - protein, 14 aa, Borrelia burgdorferi B31
KNEGLKEKIDAAKK

SEQ ID NO: 166126 - protein, 14 aa, Borrelia burgdorferi B31
NEGLKEKIDAAKKC

SEQ ID NO: 166127 - protein, 14 aa, Borrelia burgdorferi B31
EGLKEKIDAAKKCS

SEQ ID NO: 166128 - protein, 14 aa, Borrelia burgdorferi B31
GLKEKIDAAKKCSE

SEQ ID NO: 166129 - protein, 14 aa, Borrelia burgdorferi B31
LKEKIDAAKKCSET

SEQ ID NO: 166130 - protein, 14 aa, Borrelia burgdorferi B31
KEKIDAAKKCSETF

SEQ ID NO: 166131 - protein, 14 aa, Borrelia burgdorferi B31
EKIDAAKKCSETFT

SEQ ID NO: 166132 - protein, 14 aa, Borrelia burgdorferi B31
KIDAAKKCSETFTN

SEQ ID NO: 166133 - protein, 14 aa, Borrelia burgdorferi B31
IDAAKKCSETFTNK

SEQ ID NO: 166134 - protein, 14 aa, Borrelia burgdorferi B31
DAAKKCSETFTNKL

SEQ ID NO: 166135 - protein, 14 aa, Borrelia burgdorferi B31
AAKKCSETFTNKLK

SEQ ID NO: 166136 - protein, 14 aa, Borrelia burgdorferi B31
AKKCSETFTNKLKE

SEQ ID NO: 166137 - protein, 14 aa, Borrelia burgdorferi B31
KKCSETFTNKLKEK

SEQ ID NO: 166138 - protein, 14 aa, Borrelia burgdorferi B31
KCSETFTNKLKEKH

SEQ ID NO: 166139 - protein, 14 aa, Borrelia burgdorferi B31
CSETFTNKLKEKHT

SEQ ID NO: 166140 - protein, 14 aa, Borrelia burgdorferi B31
SETFTNKLKEKHTD

SEQ ID NO: 166141 - protein, 14 aa, Borrelia burgdorferi B31
ETFTNKLKEKHTDL

SEQ ID NO: 166142 - protein, 14 aa, Borrelia burgdorferi B31
TFTNKLKEKHTDLG

SEQ ID NO: 166143 - protein, 14 aa, Borrelia burgdorferi B31
FTNKLKEKHTDLGK

SEQ ID NO: 166144 - protein, 14 aa, Borrelia burgdorferi B31
TNKLKEKHTDLGKE

SEQ ID NO: 166145 - protein, 14 aa, Borrelia burgdorferi B31
NKLKEKHTDLGKEG

SEQ ID NO: 166146 - protein, 14 aa, Borrelia burgdorferi B31
KLKEKHTDLGKEGV

SEQ ID NO: 166147 - protein, 14 aa, Borrelia burgdorferi B31
LKEKHTDLGKEGVT

SEQ ID NO: 166148 - protein, 14 aa, Borrelia burgdorferi B31
KEKHTDLGKEGVTD

SEQ ID NO: 166149 - protein, 14 aa, Borrelia burgdorferi B31
EKHTDLGKEGVTDA

SEQ ID NO: 166150 - protein, 14 aa, Borrelia burgdorferi B31
KHTDLGKEGVTDAD

SEQ ID NO: 166151 - protein, 14 aa, Borrelia burgdorferi B31
HTDLGKEGVTDADA

SEQ ID NO: 166152 - protein, 14 aa, Borrelia burgdorferi B31
TDLGKEGVTDADAK

SEQ ID NO: 166153 - protein, 14 aa, Borrelia burgdorferi B31
DLGKEGVTDADAKE

SEQ ID NO: 166154 - protein, 14 aa, Borrelia burgdorferi B31
LGKEGVTDADAKEA

SEQ ID NO: 166155 - protein, 14 aa, Borrelia burgdorferi B31
GKEGVTDADAKEAI

SEQ ID NO: 166156 - protein, 14 aa, Borrelia burgdorferi B31
KEGVTDADAKEAIL

SEQ ID NO: 166157 - protein, 14 aa, Borrelia burgdorferi B31
EGVTDADAKEAILK

SEQ ID NO: 166158 - protein, 14 aa, Borrelia burgdorferi B31
GVTDADAKEAILKT

SEQ ID NO: 166159 - protein, 14 aa, Borrelia burgdorferi B31
VTDADAKEAILKTN

SEQ ID NO: 166160 - protein, 14 aa, Borrelia burgdorferi B31
TDADAKEAILKTNG

SEQ ID NO: 166161 - protein, 14 aa, Borrelia burgdorferi B31
DADAKEAILKTNGT

SEQ ID NO: 166162 - protein, 14 aa, Borrelia burgdorferi B31
ADAKEAILKTNGTK

SEQ ID NO: 166163 - protein, 14 aa, Borrelia burgdorferi B31
DAKEAILKTNGTKT

SEQ ID NO: 166164 - protein, 14 aa, Borrelia burgdorferi B31
AKEAILKTNGTKTK

SEQ ID NO: 166165 - protein, 14 aa, Borrelia burgdorferi B31
KEAILKTNGTKTKG

SEQ ID NO: 166166 - protein, 14 aa, Borrelia burgdorferi B31
EAILKTNGTKTKGA

SEQ ID NO: 166167 - protein, 14 aa, Borrelia burgdorferi B31
AILKTNGTKTKGAE

SEQ ID NO: 166168 - protein, 14 aa, Borrelia burgdorferi B31
ILKTNGTKTKGAEE

SEQ ID NO: 166169 - protein, 14 aa, Borrelia burgdorferi B31
LKTNGTKTKGAEEL

SEQ ID NO: 166170 - protein, 14 aa, Borrelia burgdorferi B31
KTNGTKTKGAEELG

SEQ ID NO: 166171 - protein, 14 aa, Borrelia burgdorferi B31
TNGTKTKGAEELGK

SEQ ID NO: 166172 - protein, 14 aa, Borrelia burgdorferi B31
NGTKTKGAEELGKL

SEQ ID NO: 166173 - protein, 14 aa, Borrelia burgdorferi B31
GTKTKGAEELGKLF

SEQ ID NO: 166174 - protein, 14 aa, Borrelia burgdorferi B31
TKTKGAEELGKLFE

SEQ ID NO: 166175 - protein, 14 aa, Borrelia burgdorferi B31
KTKGAEELGKLFES

SEQ ID NO: 166176 - protein, 14 aa, Borrelia burgdorferi B31
TKGAEELGKLFESV

SEQ ID NO: 166177 - protein, 14 aa, Borrelia burgdorferi B31
KGAEELGKLFESVE

SEQ ID NO: 166178 - protein, 14 aa, Borrelia burgdorferi B31
GAEELGKLFESVEV

SEQ ID NO: 166179 - protein, 14 aa, Borrelia burgdorferi B31
AEELGKLFESVEVL

SEQ ID NO: 166180 - protein, 14 aa, Borrelia burgdorferi B31
EELGKLFESVEVLS

SEQ ID NO: 166181 - protein, 14 aa, Borrelia burgdorferi B31
ELGKLFESVEVLSK

SEQ ID NO: 166182 - protein, 14 aa, Borrelia burgdorferi B31
LGKLFESVEVLSKA

SEQ ID NO: 166183 - protein, 14 aa, Borrelia burgdorferi B31
GKLFESVEVLSKAA

SEQ ID NO: 166184 - protein, 14 aa, Borrelia burgdorferi B31
KLFESVEVLSKAAK

SEQ ID NO: 166185 - protein, 14 aa, Borrelia burgdorferi B31
LFESVEVLSKAAKE

SEQ ID NO: 166186 - protein, 14 aa, Borrelia burgdorferi B31
FESVEVLSKAAKEM

SEQ ID NO: 166187 - protein, 14 aa, Borrelia burgdorferi B31
ESVEVLSKAAKEML

SEQ ID NO: 166188 - protein, 14 aa, Borrelia burgdorferi B31
SVEVLSKAAKEMLA

SEQ ID NO: 166189 - protein, 14 aa, Borrelia burgdorferi B31
VEVLSKAAKEMLAN

SEQ ID NO: 166190 - protein, 14 aa, Borrelia burgdorferi B31
EVLSKAAKEMLANS

SEQ ID NO: 166191 - protein, 14 aa, Borrelia burgdorferi B31
VLSKAAKEMLANSV

SEQ ID NO: 166192 - protein, 14 aa, Borrelia burgdorferi B31
LSKAAKEMLANSVK

SEQ ID NO: 166193 - protein, 14 aa, Borrelia burgdorferi B31
SKAAKEMLANSVKE

SEQ ID NO: 166194 - protein, 14 aa, Borrelia burgdorferi B31
KAAKEMLANSVKEL

SEQ ID NO: 166195 - protein, 14 aa, Borrelia burgdorferi B31
AAKEMLANSVKELT

SEQ ID NO: 166196 - protein, 14 aa, Borrelia burgdorferi B31
AKEMLANSVKELTS

SEQ ID NO: 166197 - protein, 14 aa, Borrelia burgdorferi B31
KEMLANSVKELTSP

SEQ ID NO: 166198 - protein, 14 aa, Borrelia burgdorferi B31
EMLANSVKELTSPV

SEQ ID NO: 166199 - protein, 14 aa, Borrelia burgdorferi B31
MLANSVKELTSPVV

SEQ ID NO: 166200 - protein, 14 aa, Borrelia burgdorferi B31
LANSVKELTSPVVA

SEQ ID NO: 166201 - protein, 14 aa, Borrelia burgdorferi B31
ANSVKELTSPVVAE

SEQ ID NO: 166202 - protein, 14 aa, Borrelia burgdorferi B31
NSVKELTSPVVAES

SEQ ID NO: 166203 - protein, 14 aa, Borrelia burgdorferi B31
SVKELTSPVVAESP

SEQ ID NO: 166204 - protein, 14 aa, Borrelia burgdorferi B31
VKELTSPVVAESPK

SEQ ID NO: 166205 - protein, 14 aa, Borrelia burgdorferi B31
KELTSPVVAESPKK

SEQ ID NO: 166206 - protein, 14 aa, Borrelia burgdorferi B31
ELTSPVVAESPKKP

SEQ ID NO: 166207 - protein, 15 aa, Borrelia burgdorferi B31
MKKNTLSAILMTLFL

SEQ ID NO: 166208 - protein, 15 aa, Borrelia burgdorferi B31
KKNTLSAILMTLFLF

SEQ ID NO: 166209 - protein, 15 aa, Borrelia burgdorferi B31
KNTLSAILMTLFLFI

SEQ ID NO: 166210 - protein, 15 aa, Borrelia burgdorferi B31
NTLSAILMTLFLFIS

SEQ ID NO: 166211 - protein, 15 aa, Borrelia burgdorferi B31
TLSAILMTLFLFISC

SEQ ID NO: 166212 - protein, 15 aa, Borrelia burgdorferi B31
LSAILMTLFLFISCN

SEQ ID NO: 166213 - protein, 15 aa, Borrelia burgdorferi B31
SAILMTLFLFISCNN

SEQ ID NO: 166214 - protein, 15 aa, Borrelia burgdorferi B31
AILMTLFLFISCNNS

SEQ ID NO: 166215 - protein, 15 aa, Borrelia burgdorferi B31
ILMTLFLFISCNNSG

SEQ ID NO: 166216 - protein, 15 aa, Borrelia burgdorferi B31
LMTLFLFISCNNSGK

SEQ ID NO: 166217 - protein, 15 aa, Borrelia burgdorferi B31
MTLFLFISCNNSGKD

SEQ ID NO: 166218 - protein, 15 aa, Borrelia burgdorferi B31
TLFLFISCNNSGKDG

SEQ ID NO: 166219 - protein, 15 aa, Borrelia burgdorferi B31
LFLFISCNNSGKDGN

SEQ ID NO: 166220 - protein, 15 aa, Borrelia burgdorferi B31
FLFISCNNSGKDGNT

SEQ ID NO: 166221 - protein, 15 aa, Borrelia burgdorferi B31
LFISCNNSGKDGNTS

SEQ ID NO: 166222 - protein, 15 aa, Borrelia burgdorferi B31
FISCNNSGKDGNTSA

SEQ ID NO: 166223 - protein, 15 aa, Borrelia burgdorferi B31
ISCNNSGKDGNTSAN

SEQ ID NO: 166224 - protein, 15 aa, Borrelia burgdorferi B31
SCNNSGKDGNTSANS

SEQ ID NO: 166225 - protein, 15 aa, Borrelia burgdorferi B31
CNNSGKDGNTSANSA

SEQ ID NO: 166226 - protein, 15 aa, Borrelia burgdorferi B31
NNSGKDGNTSANSAD

SEQ ID NO: 166227 - protein, 15 aa, Borrelia burgdorferi B31
NSGKDGNTSANSADE

SEQ ID NO: 166228 - protein, 15 aa, Borrelia burgdorferi B31
SGKDGNTSANSADES

SEQ ID NO: 166229 - protein, 15 aa, Borrelia burgdorferi B31
GKDGNTSANSADESV

SEQ ID NO: 166230 - protein, 15 aa, Borrelia burgdorferi B31
KDGNTSANSADESVK

SEQ ID NO: 166231 - protein, 15 aa, Borrelia burgdorferi B31
DGNTSANSADESVKG

SEQ ID NO: 166232 - protein, 15 aa, Borrelia burgdorferi B31
GNTSANSADESVKGP

SEQ ID NO: 166233 - protein, 15 aa, Borrelia burgdorferi B31
NTSANSADESVKGPN

SEQ ID NO: 166234 - protein, 15 aa, Borrelia burgdorferi B31
TSANSADESVKGPNL

SEQ ID NO: 166235 - protein, 15 aa, Borrelia burgdorferi B31
SANSADESVKGPNLT

SEQ ID NO: 166236 - protein, 15 aa, Borrelia burgdorferi B31
ANSADESVKGPNLTE

SEQ ID NO: 166237 - protein, 15 aa, Borrelia burgdorferi B31
NSADESVKGPNLTEI

SEQ ID NO: 166238 - protein, 15 aa, Borrelia burgdorferi B31
SADESVKGPNLTEIS

SEQ ID NO: 166239 - protein, 15 aa, Borrelia burgdorferi B31
ADESVKGPNLTEISK

SEQ ID NO: 166240 - protein, 15 aa, Borrelia burgdorferi B31
DESVKGPNLTEISKK

SEQ ID NO: 166241 - protein, 15 aa, Borrelia burgdorferi B31
ESVKGPNLTEISKKI

SEQ ID NO: 166242 - protein, 15 aa, Borrelia burgdorferi B31
SVKGPNLTEISKKIT

SEQ ID NO: 166243 - protein, 15 aa, Borrelia burgdorferi B31
VKGPNLTEISKKITD

SEQ ID NO: 166244 - protein, 15 aa, Borrelia burgdorferi B31
KGPNLTEISKKITDS

SEQ ID NO: 166245 - protein, 15 aa, Borrelia burgdorferi B31
GPNLTEISKKITDSN

SEQ ID NO: 166246 - protein, 15 aa, Borrelia burgdorferi B31
PNLTEISKKITDSNA

SEQ ID NO: 166247 - protein, 15 aa, Borrelia burgdorferi B31
NLTEISKKITDSNAV

SEQ ID NO: 166248 - protein, 15 aa, Borrelia burgdorferi B31
LTEISKKITDSNAVL

SEQ ID NO: 166249 - protein, 15 aa, Borrelia burgdorferi B31
TEISKKITDSNAVLL

SEQ ID NO: 166250 - protein, 15 aa, Borrelia burgdorferi B31
EISKKITDSNAVLLA

SEQ ID NO: 166251 - protein, 15 aa, Borrelia burgdorferi B31
ISKKITDSNAVLLAV

SEQ ID NO: 166252 - protein, 15 aa, Borrelia burgdorferi B31
SKKITDSNAVLLAVK

SEQ ID NO: 166253 - protein, 15 aa, Borrelia burgdorferi B31
KKITDSNAVLLAVKE

SEQ ID NO: 166254 - protein, 15 aa, Borrelia burgdorferi B31
KITDSNAVLLAVKEV

SEQ ID NO: 166255 - protein, 15 aa, Borrelia burgdorferi B31
ITDSNAVLLAVKEVE

SEQ ID NO: 166256 - protein, 15 aa, Borrelia burgdorferi B31
TDSNAVLLAVKEVEA

SEQ ID NO: 166257 - protein, 15 aa, Borrelia burgdorferi B31
DSNAVLLAVKEVEAL

SEQ ID NO: 166258 - protein, 15 aa, Borrelia burgdorferi B31
SNAVLLAVKEVEALL

SEQ ID NO: 166259 - protein, 15 aa, Borrelia burgdorferi B31
NAVLLAVKEVEALLS

SEQ ID NO: 166260 - protein, 15 aa, Borrelia burgdorferi B31
AVLLAVKEVEALLSS

SEQ ID NO: 166261 - protein, 15 aa, Borrelia burgdorferi B31
VLLAVKEVEALLSSI

SEQ ID NO: 166262 - protein, 15 aa, Borrelia burgdorferi B31
LLAVKEVEALLSSID

SEQ ID NO: 166263 - protein, 15 aa, Borrelia burgdorferi B31
LAVKEVEALLSSIDE

SEQ ID NO: 166264 - protein, 15 aa, Borrelia burgdorferi B31
AVKEVEALLSSIDEI

SEQ ID NO: 166265 - protein, 15 aa, Borrelia burgdorferi B31
VKEVEALLSSIDEIA

SEQ ID NO: 166266 - protein, 15 aa, Borrelia burgdorferi B31
KEVEALLSSIDEIAA

SEQ ID NO: 166267 - protein, 15 aa, Borrelia burgdorferi B31
EVEALLSSIDEIAAK

SEQ ID NO: 166268 - protein, 15 aa, Borrelia burgdorferi B31
VEALLSSIDEIAAKA

SEQ ID NO: 166269 - protein, 15 aa, Borrelia burgdorferi B31
EALLSSIDEIAAKAI

SEQ ID NO: 166270 - protein, 15 aa, Borrelia burgdorferi B31
ALLSSIDEIAAKAIG

SEQ ID NO: 166271 - protein, 15 aa, Borrelia burgdorferi B31
LLSSIDEIAAKAIGK

SEQ ID NO: 166272 - protein, 15 aa, Borrelia burgdorferi B31
LSSIDEIAAKAIGKK

SEQ ID NO: 166273 - protein, 15 aa, Borrelia burgdorferi B31
SSIDEIAAKAIGKKI

SEQ ID NO: 166274 - protein, 15 aa, Borrelia burgdorferi B31
SIDEIAAKAIGKKIH

SEQ ID NO: 166275 - protein, 15 aa, Borrelia burgdorferi B31
IDEIAAKAIGKKIHQ

SEQ ID NO: 166276 - protein, 15 aa, Borrelia burgdorferi B31
DEIAAKAIGKKIHQN

SEQ ID NO: 166277 - protein, 15 aa, Borrelia burgdorferi B31
EIAAKAIGKKIHQNN

SEQ ID NO: 166278 - protein, 15 aa, Borrelia burgdorferi B31
IAAKAIGKKIHQNNG

SEQ ID NO: 166279 - protein, 15 aa, Borrelia burgdorferi B31
AAKAIGKKIHQNNGL

SEQ ID NO: 166280 - protein, 15 aa, Borrelia burgdorferi B31
AKAIGKKIHQNNGLD

SEQ ID NO: 166281 - protein, 15 aa, Borrelia burgdorferi B31
KAIGKKIHQNNGLDT

SEQ ID NO: 166282 - protein, 15 aa, Borrelia burgdorferi B31
AIGKKIHQNNGLDTE

SEQ ID NO: 166283 - protein, 15 aa, Borrelia burgdorferi B31
IGKKIHQNNGLDTEN

SEQ ID NO: 166284 - protein, 15 aa, Borrelia burgdorferi B31
GKKIHQNNGLDTENN

SEQ ID NO: 166285 - protein, 15 aa, Borrelia burgdorferi B31
KKIHQNNGLDTENNH

SEQ ID NO: 166286 - protein, 15 aa, Borrelia burgdorferi B31
KIHQNNGLDTENNHN

SEQ ID NO: 166287 - protein, 15 aa, Borrelia burgdorferi B31
IHQNNGLDTENNHNG

SEQ ID NO: 166288 - protein, 15 aa, Borrelia burgdorferi B31
HQNNGLDTENNHNGS

SEQ ID NO: 166289 - protein, 15 aa, Borrelia burgdorferi B31
QNNGLDTENNHNGSL

SEQ ID NO: 166290 - protein, 15 aa, Borrelia burgdorferi B31
NNGLDTENNHNGSLL

SEQ ID NO: 166291 - protein, 15 aa, Borrelia burgdorferi B31
NGLDTENNHNGSLLA

SEQ ID NO: 166292 - protein, 15 aa, Borrelia burgdorferi B31
GLDTENNHNGSLLAG

SEQ ID NO: 166293 - protein, 15 aa, Borrelia burgdorferi B31
LDTENNHNGSLLAGA

SEQ ID NO: 166294 - protein, 15 aa, Borrelia burgdorferi B31
DTENNHNGSLLAGAY

SEQ ID NO: 166295 - protein, 15 aa, Borrelia burgdorferi B31
TENNHNGSLLAGAYA

SEQ ID NO: 166296 - protein, 15 aa, Borrelia burgdorferi B31
ENNHNGSLLAGAYAI

SEQ ID NO: 166297 - protein, 15 aa, Borrelia burgdorferi B31
NNHNGSLLAGAYAIS

SEQ ID NO: 166298 - protein, 15 aa, Borrelia burgdorferi B31
NHNGSLLAGAYAIST

SEQ ID NO: 166299 - protein, 15 aa, Borrelia burgdorferi B31
HNGSLLAGAYAISTL

SEQ ID NO: 166300 - protein, 15 aa, Borrelia burgdorferi B31
NGSLLAGAYAISTLI

SEQ ID NO: 166301 - protein, 15 aa, Borrelia burgdorferi B31
GSLLAGAYAISTLIK

SEQ ID NO: 166302 - protein, 15 aa, Borrelia burgdorferi B31
SLLAGAYAISTLIKQ

SEQ ID NO: 166303 - protein, 15 aa, Borrelia burgdorferi B31
LLAGAYAISTLIKQK

SEQ ID NO: 166304 - protein, 15 aa, Borrelia burgdorferi B31
LAGAYAISTLIKQKL

SEQ ID NO: 166305 - protein, 15 aa, Borrelia burgdorferi B31
AGAYAISTLIKQKLD

SEQ ID NO: 166306 - protein, 15 aa, Borrelia burgdorferi B31
GAYAISTLIKQKLDG

SEQ ID NO: 166307 - protein, 15 aa, Borrelia burgdorferi B31
AYAISTLIKQKLDGL

SEQ ID NO: 166308 - protein, 15 aa, Borrelia burgdorferi B31
YAISTLIKQKLDGLK

SEQ ID NO: 166309 - protein, 15 aa, Borrelia burgdorferi B31
AISTLIKQKLDGLKN

SEQ ID NO: 166310 - protein, 15 aa, Borrelia burgdorferi B31
ISTLIKQKLDGLKNE

SEQ ID NO: 166311 - protein, 15 aa, Borrelia burgdorferi B31
STLIKQKLDGLKNEG

SEQ ID NO: 166312 - protein, 15 aa, Borrelia burgdorferi B31
TLIKQKLDGLKNEGL

SEQ ID NO: 166313 - protein, 15 aa, Borrelia burgdorferi B31
LIKQKLDGLKNEGLK

SEQ ID NO: 166314 - protein, 15 aa, Borrelia burgdorferi B31
IKQKLDGLKNEGLKE

SEQ ID NO: 166315 - protein, 15 aa, Borrelia burgdorferi B31
KQKLDGLKNEGLKEK

SEQ ID NO: 166316 - protein, 15 aa, Borrelia burgdorferi B31
QKLDGLKNEGLKEKI

SEQ ID NO: 166317 - protein, 15 aa, Borrelia burgdorferi B31
KLDGLKNEGLKEKID

SEQ ID NO: 166318 - protein, 15 aa, Borrelia burgdorferi B31
LDGLKNEGLKEKIDA

SEQ ID NO: 166319 - protein, 15 aa, Borrelia burgdorferi B31
DGLKNEGLKEKIDAA

SEQ ID NO: 166320 - protein, 15 aa, Borrelia burgdorferi B31
GLKNEGLKEKIDAAK

SEQ ID NO: 166321 - protein, 15 aa, Borrelia burgdorferi B31
LKNEGLKEKIDAAKK

SEQ ID NO: 166322 - protein, 15 aa, Borrelia burgdorferi B31
KNEGLKEKIDAAKKC

SEQ ID NO: 166323 - protein, 15 aa, Borrelia burgdorferi B31
NEGLKEKIDAAKKCS

SEQ ID NO: 166324 - protein, 15 aa, Borrelia burgdorferi B31
EGLKEKIDAAKKCSE

SEQ ID NO: 166325 - protein, 15 aa, Borrelia burgdorferi B31
GLKEKIDAAKKCSET

SEQ ID NO: 166326 - protein, 15 aa, Borrelia burgdorferi B31
LKEKIDAAKKCSETF

SEQ ID NO: 166327 - protein, 15 aa, Borrelia burgdorferi B31
KEKIDAAKKCSETFT

SEQ ID NO: 166328 - protein, 15 aa, Borrelia burgdorferi B31
EKIDAAKKCSETFTN

SEQ ID NO: 166329 - protein, 15 aa, Borrelia burgdorferi B31
KIDAAKKCSETFTNK

SEQ ID NO: 166330 - protein, 15 aa, Borrelia burgdorferi B31
IDAAKKCSETFTNKL

SEQ ID NO: 166331 - protein, 15 aa, Borrelia burgdorferi B31
DAAKKCSETFTNKLK

SEQ ID NO: 166332 - protein, 15 aa, Borrelia burgdorferi B31
AAKKCSETFTNKLKE

SEQ ID NO: 166333 - protein, 15 aa, Borrelia burgdorferi B31
AKKCSETFTNKLKEK

SEQ ID NO: 166334 - protein, 15 aa, Borrelia burgdorferi B31
KKCSETFTNKLKEKH

SEQ ID NO: 166335 - protein, 15 aa, Borrelia burgdorferi B31
KCSETFTNKLKEKHT

SEQ ID NO: 166336 - protein, 15 aa, Borrelia burgdorferi B31
CSETFTNKLKEKHTD

SEQ ID NO: 166337 - protein, 15 aa, Borrelia burgdorferi B31
SETFTNKLKEKHTDL

SEQ ID NO: 166338 - protein, 15 aa, Borrelia burgdorferi B31
ETFTNKLKEKHTDLG

SEQ ID NO: 166339 - protein, 15 aa, Borrelia burgdorferi B31
TFTNKLKEKHTDLGK

SEQ ID NO: 166340 - protein, 15 aa, Borrelia burgdorferi B31
FTNKLKEKHTDLGKE

SEQ ID NO: 166341 - protein, 15 aa, Borrelia burgdorferi B31
TNKLKEKHTDLGKEG

SEQ ID NO: 166342 - protein, 15 aa, Borrelia burgdorferi B31
NKLKEKHTDLGKEGV

SEQ ID NO: 166343 - protein, 15 aa, Borrelia burgdorferi B31
KLKEKHTDLGKEGVT

SEQ ID NO: 166344 - protein, 15 aa, Borrelia burgdorferi B31
LKEKHTDLGKEGVTD

SEQ ID NO: 166345 - protein, 15 aa, Borrelia burgdorferi B31
KEKHTDLGKEGVTDA

SEQ ID NO: 166346 - protein, 15 aa, Borrelia burgdorferi B31
EKHTDLGKEGVTDAD

SEQ ID NO: 166347 - protein, 15 aa, Borrelia burgdorferi B31
KHTDLGKEGVTDADA

SEQ ID NO: 166348 - protein, 15 aa, Borrelia burgdorferi B31
HTDLGKEGVTDADAK

SEQ ID NO: 166349 - protein, 15 aa, Borrelia burgdorferi B31
TDLGKEGVTDADAKE

SEQ ID NO: 166350 - protein, 15 aa, Borrelia burgdorferi B31
DLGKEGVTDADAKEA

SEQ ID NO: 166351 - protein, 15 aa, Borrelia burgdorferi B31
LGKEGVTDADAKEAI

SEQ ID NO: 166352 - protein, 15 aa, Borrelia burgdorferi B31
GKEGVTDADAKEAIL

SEQ ID NO: 166353 - protein, 15 aa, Borrelia burgdorferi B31
KEGVTDADAKEAILK

SEQ ID NO: 166354 - protein, 15 aa, Borrelia burgdorferi B31
EGVTDADAKEAILKT

SEQ ID NO: 166355 - protein, 15 aa, Borrelia burgdorferi B31
GVTDADAKEAILKTN

SEQ ID NO: 166356 - protein, 15 aa, Borrelia burgdorferi B31
VTDADAKEAILKTNG

SEQ ID NO: 166357 - protein, 15 aa, Borrelia burgdorferi B31
TDADAKEAILKTNGT

SEQ ID NO: 166358 - protein, 15 aa, Borrelia burgdorferi B31
DADAKEAILKTNGTK

SEQ ID NO: 166359 - protein, 15 aa, Borrelia burgdorferi B31
ADAKEAILKTNGTKT

SEQ ID NO: 166360 - protein, 15 aa, Borrelia burgdorferi B31
DAKEAILKTNGTKTK

SEQ ID NO: 166361 - protein, 15 aa, Borrelia burgdorferi B31
AKEAILKTNGTKTKG

SEQ ID NO: 166362 - protein, 15 aa, Borrelia burgdorferi B31
KEAILKTNGTKTKGA

SEQ ID NO: 166363 - protein, 15 aa, Borrelia burgdorferi B31
EAILKTNGTKTKGAE

SEQ ID NO: 166364 - protein, 15 aa, Borrelia burgdorferi B31
AILKTNGTKTKGAEE

SEQ ID NO: 166365 - protein, 15 aa, Borrelia burgdorferi B31
ILKTNGTKTKGAEEL

SEQ ID NO: 166366 - protein, 15 aa, Borrelia burgdorferi B31
LKTNGTKTKGAEELG

SEQ ID NO: 166367 - protein, 15 aa, Borrelia burgdorferi B31
KTNGTKTKGAEELGK

SEQ ID NO: 166368 - protein, 15 aa, Borrelia burgdorferi B31
TNGTKTKGAEELGKL

SEQ ID NO: 166369 - protein, 15 aa, Borrelia burgdorferi B31
NGTKTKGAEELGKLF

SEQ ID NO: 166370 - protein, 15 aa, Borrelia burgdorferi B31
GTKTKGAEELGKLFE

SEQ ID NO: 166371 - protein, 15 aa, Borrelia burgdorferi B31
TKTKGAEELGKLFES

SEQ ID NO: 166372 - protein, 15 aa, Borrelia burgdorferi B31
KTKGAEELGKLFESV

SEQ ID NO: 166373 - protein, 15 aa, Borrelia burgdorferi B31
TKGAEELGKLFESVE

SEQ ID NO: 166374 - protein, 15 aa, Borrelia burgdorferi B31
KGAEELGKLFESVEV

SEQ ID NO: 166375 - protein, 15 aa, Borrelia burgdorferi B31
GAEELGKLFESVEVL

SEQ ID NO: 166376 - protein, 15 aa, Borrelia burgdorferi B31
AEELGKLFESVEVLS

SEQ ID NO: 166377 - protein, 15 aa, Borrelia burgdorferi B31
EELGKLFESVEVLSK

SEQ ID NO: 166378 - protein, 15 aa, Borrelia burgdorferi B31
ELGKLFESVEVLSKA

SEQ ID NO: 166379 - protein, 15 aa, Borrelia burgdorferi B31
LGKLFESVEVLSKAA

SEQ ID NO: 166380 - protein, 15 aa, Borrelia burgdorferi B31
GKLFESVEVLSKAAK

SEQ ID NO: 166381 - protein, 15 aa, Borrelia burgdorferi B31
KLFESVEVLSKAAKE

SEQ ID NO: 166382 - protein, 15 aa, Borrelia burgdorferi B31
LFESVEVLSKAAKEM

SEQ ID NO: 166383 - protein, 15 aa, Borrelia burgdorferi B31
FESVEVLSKAAKEML

SEQ ID NO: 166384 - protein, 15 aa, Borrelia burgdorferi B31
ESVEVLSKAAKEMLA

SEQ ID NO: 166385 - protein, 15 aa, Borrelia burgdorferi B31
SVEVLSKAAKEMLAN

SEQ ID NO: 166386 - protein, 15 aa, Borrelia burgdorferi B31
VEVLSKAAKEMLANS

SEQ ID NO: 166387 - protein, 15 aa, Borrelia burgdorferi B31
EVLSKAAKEMLANSV

SEQ ID NO: 166388 - protein, 15 aa, Borrelia burgdorferi B31
VLSKAAKEMLANSVK

SEQ ID NO: 166389 - protein, 15 aa, Borrelia burgdorferi B31
LSKAAKEMLANSVKE

SEQ ID NO: 166390 - protein, 15 aa, Borrelia burgdorferi B31
SKAAKEMLANSVKEL

SEQ ID NO: 166391 - protein, 15 aa, Borrelia burgdorferi B31
KAAKEMLANSVKELT

SEQ ID NO: 166392 - protein, 15 aa, Borrelia burgdorferi B31
AAKEMLANSVKELTS

SEQ ID NO: 166393 - protein, 15 aa, Borrelia burgdorferi B31
AKEMLANSVKELTSP

SEQ ID NO: 166394 - protein, 15 aa, Borrelia burgdorferi B31
KEMLANSVKELTSPV

SEQ ID NO: 166395 - protein, 15 aa, Borrelia burgdorferi B31
EMLANSVKELTSPVV

SEQ ID NO: 166396 - protein, 15 aa, Borrelia burgdorferi B31
MLANSVKELTSPVVA

SEQ ID NO: 166397 - protein, 15 aa, Borrelia burgdorferi B31
LANSVKELTSPVVAE

SEQ ID NO: 166398 - protein, 15 aa, Borrelia burgdorferi B31
ANSVKELTSPVVAES

SEQ ID NO: 166399 - protein, 15 aa, Borrelia burgdorferi B31
NSVKELTSPVVAESP

SEQ ID NO: 166400 - protein, 15 aa, Borrelia burgdorferi B31
SVKELTSPVVAESPK

SEQ ID NO: 166401 - protein, 15 aa, Borrelia burgdorferi B31
VKELTSPVVAESPKK

SEQ ID NO: 166402 - protein, 15 aa, Borrelia burgdorferi B31
KELTSPVVAESPKKP

SEQ ID NO: 166403 - protein, 16 aa, Borrelia burgdorferi B31
MKKNTLSAILMTLFLF

SEQ ID NO: 166404 - protein, 16 aa, Borrelia burgdorferi B31
KKNTLSAILMTLFLFI

SEQ ID NO: 166405 - protein, 16 aa, Borrelia burgdorferi B31
KNTLSAILMTLFLFIS

SEQ ID NO: 166406 - protein, 16 aa, Borrelia burgdorferi B31
NTLSAILMTLFLFISC

SEQ ID NO: 166407 - protein, 16 aa, Borrelia burgdorferi B31
TLSAILMTLFLFISCN

SEQ ID NO: 166408 - protein, 16 aa, Borrelia burgdorferi B31
LSAILMTLFLFISCNN

SEQ ID NO: 166409 - protein, 16 aa, Borrelia burgdorferi B31
SAILMTLFLFISCNNS

SEQ ID NO: 166410 - protein, 16 aa, Borrelia burgdorferi B31
AILMTLFLFISCNNSG

SEQ ID NO: 166411 - protein, 16 aa, Borrelia burgdorferi B31
ILMTLFLFISCNNSGK

SEQ ID NO: 166412 - protein, 16 aa, Borrelia burgdorferi B31
LMTLFLFISCNNSGKD

SEQ ID NO: 166413 - protein, 16 aa, Borrelia burgdorferi B31
MTLFLFISCNNSGKDG

SEQ ID NO: 166414 - protein, 16 aa, Borrelia burgdorferi B31
TLFLFISCNNSGKDGN

SEQ ID NO: 166415 - protein, 16 aa, Borrelia burgdorferi B31
LFLFISCNNSGKDGNT

SEQ ID NO: 166416 - protein, 16 aa, Borrelia burgdorferi B31
FLFISCNNSGKDGNTS

SEQ ID NO: 166417 - protein, 16 aa, Borrelia burgdorferi B31
LFISCNNSGKDGNTSA

SEQ ID NO: 166418 - protein, 16 aa, Borrelia burgdorferi B31
FISCNNSGKDGNTSAN

SEQ ID NO: 166419 - protein, 16 aa, Borrelia burgdorferi B31
ISCNNSGKDGNTSANS

SEQ ID NO: 166420 - protein, 16 aa, Borrelia burgdorferi B31
SCNNSGKDGNTSANSA

SEQ ID NO: 166421 - protein, 16 aa, Borrelia burgdorferi B31
CNNSGKDGNTSANSAD

SEQ ID NO: 166422 - protein, 16 aa, Borrelia burgdorferi B31
NNSGKDGNTSANSADE

SEQ ID NO: 166423 - protein, 16 aa, Borrelia burgdorferi B31
NSGKDGNTSANSADES

SEQ ID NO: 166424 - protein, 16 aa, Borrelia burgdorferi B31
SGKDGNTSANSADESV

SEQ ID NO: 166425 - protein, 16 aa, Borrelia burgdorferi B31
GKDGNTSANSADESVK

SEQ ID NO: 166426 - protein, 16 aa, Borrelia burgdorferi B31
KDGNTSANSADESVKG

SEQ ID NO: 166427 - protein, 16 aa, Borrelia burgdorferi B31
DGNTSANSADESVKGP

SEQ ID NO: 166428 - protein, 16 aa, Borrelia burgdorferi B31
GNTSANSADESVKGPN

SEQ ID NO: 166429 - protein, 16 aa, Borrelia burgdorferi B31
NTSANSADESVKGPNL

SEQ ID NO: 166430 - protein, 16 aa, Borrelia burgdorferi B31
TSANSADESVKGPNLT

SEQ ID NO: 166431 - protein, 16 aa, Borrelia burgdorferi B31
SANSADESVKGPNLTE

SEQ ID NO: 166432 - protein, 16 aa, Borrelia burgdorferi B31
ANSADESVKGPNLTEI

SEQ ID NO: 166433 - protein, 16 aa, Borrelia burgdorferi B31
NSADESVKGPNLTEIS

SEQ ID NO: 166434 - protein, 16 aa, Borrelia burgdorferi B31
SADESVKGPNLTEISK

SEQ ID NO: 166435 - protein, 16 aa, Borrelia burgdorferi B31
ADESVKGPNLTEISKK

SEQ ID NO: 166436 - protein, 16 aa, Borrelia burgdorferi B31
DESVKGPNLTEISKKI

SEQ ID NO: 166437 - protein, 16 aa, Borrelia burgdorferi B31
ESVKGPNLTEISKKIT

SEQ ID NO: 166438 - protein, 16 aa, Borrelia burgdorferi B31
SVKGPNLTEISKKITD

SEQ ID NO: 166439 - protein, 16 aa, Borrelia burgdorferi B31
VKGPNLTEISKKITDS

SEQ ID NO: 166440 - protein, 16 aa, Borrelia burgdorferi B31
KGPNLTEISKKITDSN

SEQ ID NO: 166441 - protein, 16 aa, Borrelia burgdorferi B31
GPNLTEISKKITDSNA

SEQ ID NO: 166442 - protein, 16 aa, Borrelia burgdorferi B31
PNLTEISKKITDSNAV

SEQ ID NO: 166443 - protein, 16 aa, Borrelia burgdorferi B31
NLTEISKKITDSNAVL

SEQ ID NO: 166444 - protein, 16 aa, Borrelia burgdorferi B31
LTEISKKITDSNAVLL

SEQ ID NO: 166445 - protein, 16 aa, Borrelia burgdorferi B31
TEISKKITDSNAVLLA

SEQ ID NO: 166446 - protein, 16 aa, Borrelia burgdorferi B31
EISKKITDSNAVLLAV

SEQ ID NO: 166447 - protein, 16 aa, Borrelia burgdorferi B31
ISKKITDSNAVLLAVK

SEQ ID NO: 166448 - protein, 16 aa, Borrelia burgdorferi B31
SKKITDSNAVLLAVKE

SEQ ID NO: 166449 - protein, 16 aa, Borrelia burgdorferi B31
KKITDSNAVLLAVKEV

SEQ ID NO: 166450 - protein, 16 aa, Borrelia burgdorferi B31
KITDSNAVLLAVKEVE

SEQ ID NO: 166451 - protein, 16 aa, Borrelia burgdorferi B31
ITDSNAVLLAVKEVEA

SEQ ID NO: 166452 - protein, 16 aa, Borrelia burgdorferi B31
TDSNAVLLAVKEVEAL

SEQ ID NO: 166453 - protein, 16 aa, Borrelia burgdorferi B31
DSNAVLLAVKEVEALL
